United States Patent 7,314,750 (ADDRESSABLE OLIGONUCLEOTIDE ARRAY OF THE RAT GENOME) - sequence listing, part 2

SEQ ID NO: 37149 - DNA, 25 bp, Rattus norvegicus
aagatattccatcgtcccttctcaa

SEQ ID NO: 37150 - DNA, 25 bp, Rattus norvegicus
aagatattccatggtcccttctcaa

SEQ ID NO: 37151 - DNA, 25 bp, Rattus norvegicus
aagatattcttgcttcctaccaatg

SEQ ID NO: 37152 - DNA, 25 bp, Rattus norvegicus
aagatattcttggttcctaccaatg

SEQ ID NO: 37153 - DNA, 25 bp, Rattus norvegicus
aagatcaaaataccctgcagggagc

SEQ ID NO: 37154 - DNA, 25 bp, Rattus norvegicus
aagatcaaaatagcctgcagggagc

SEQ ID NO: 37155 - DNA, 25 bp, Rattus norvegicus
aagatcaaacctaccagcctgtgta

SEQ ID NO: 37156 - DNA, 25 bp, Rattus norvegicus
aagatcaaaccttccagcctgtgta

SEQ ID NO: 37157 - DNA, 25 bp, Rattus norvegicus
aagatcaaacgtccttcctttcggg

SEQ ID NO: 37158 - DNA, 25 bp, Rattus norvegicus
aagatcaaacgtgcttcctttcggg

SEQ ID NO: 37159 - DNA, 25 bp, Rattus norvegicus
aagatcaaatcaccctacatcccag

SEQ ID NO: 37160 - DNA, 25 bp, Rattus norvegicus
aagatcaaatcagcctacatcccag

SEQ ID NO: 37161 - DNA, 25 bp, Rattus norvegicus
aagatcaacactaccgcgccttagc

SEQ ID NO: 37162 - DNA, 25 bp, Rattus norvegicus
aagatcaacacttccgcgccttagc

SEQ ID NO: 37163 - DNA, 25 bp, Rattus norvegicus
aagatcaagaacaacctggcctcgg

SEQ ID NO: 37164 - DNA, 25 bp, Rattus norvegicus
aagatcaagaactacctggcctcgg

SEQ ID NO: 37165 - DNA, 25 bp, Rattus norvegicus
aagatcaagctaccccaacttcagg

SEQ ID NO: 37166 - DNA, 25 bp, Rattus norvegicus
aagatcaagctagcccaacttcagg

SEQ ID NO: 37167 - DNA, 25 bp, Rattus norvegicus
aagatcaatgctcctgactacgccc

SEQ ID NO: 37168 - DNA, 25 bp, Rattus norvegicus
aagatcaatgctgctgactacgccc

SEQ ID NO: 37169 - DNA, 25 bp, Rattus norvegicus
aagatcaatgttacggggattcccg

SEQ ID NO: 37170 - DNA, 25 bp, Rattus norvegicus
aagatcaatgtttcggggattcccg

SEQ ID NO: 37171 - DNA, 25 bp, Rattus norvegicus
aagatcacatcccaagagcttctag

SEQ ID NO: 37172 - DNA, 25 bp, Rattus norvegicus
aagatcacatccgaagagcttctag

SEQ ID NO: 37173 - DNA, 25 bp, Rattus norvegicus
aagatcacatctcgcaggttctgct

SEQ ID NO: 37174 - DNA, 25 bp, Rattus norvegicus
aagatcacatctggcaggttctgct

SEQ ID NO: 37175 - DNA, 25 bp, Rattus norvegicus
aagatcaccatcagagctttcacta

SEQ ID NO: 37176 - DNA, 25 bp, Rattus norvegicus
aagatcaccatctgagctttcacta

SEQ ID NO: 37177 - DNA, 25 bp, Rattus norvegicus
aagatcactgacaggcaggtgcctt

SEQ ID NO: 37178 - DNA, 25 bp, Rattus norvegicus
aagatcactgactggcaggtgcctt

SEQ ID NO: 37179 - DNA, 25 bp, Rattus norvegicus
aagatcactgttcactggttggcct

SEQ ID NO: 37180 - DNA, 25 bp, Rattus norvegicus
aagatcactgttgactggttggcct

SEQ ID NO: 37181 - DNA, 25 bp, Rattus norvegicus
aagatcacttacactagtcacataa

SEQ ID NO: 37182 - DNA, 25 bp, Rattus norvegicus
aagatcacttactctagtcacataa

SEQ ID NO: 37183 - DNA, 25 bp, Rattus norvegicus
aagatcacttcacatgcttgtacag

SEQ ID NO: 37184 - DNA, 25 bp, Rattus norvegicus
aagatcacttcagatgcttgtacag

SEQ ID NO: 37185 - DNA, 25 bp, Rattus norvegicus
aagatcagaactacaaggctatcct

SEQ ID NO: 37186 - DNA, 25 bp, Rattus norvegicus
aagatcagaacttcaaggctatcct

SEQ ID NO: 37187 - DNA, 25 bp, Rattus norvegicus
aagatcaggagccttctgctctgcc

SEQ ID NO: 37188 - DNA, 25 bp, Rattus norvegicus
aagatcaggagcgttctgctctgcc

SEQ ID NO: 37189 - DNA, 25 bp, Rattus norvegicus
aagatcagggaccagtacctcgtgt

SEQ ID NO: 37190 - DNA, 25 bp, Rattus norvegicus
aagatcagggacgagtacctcgtgt

SEQ ID NO: 37191 - DNA, 25 bp, Rattus norvegicus
aagatcaggtctaccagttctctca

SEQ ID NO: 37192 - DNA, 25 bp, Rattus norvegicus
aagatcaggtcttccagttctctca

SEQ ID NO: 37193 - DNA, 25 bp, Rattus norvegicus
aagatcaggtgcactcaccctcaga

SEQ ID NO: 37194 - DNA, 25 bp, Rattus norvegicus
aagatcaggtgctctcaccctcaga

SEQ ID NO: 37195 - DNA, 25 bp, Rattus norvegicus
aagatcaggtttccccatggacttc

SEQ ID NO: 37196 - DNA, 25 bp, Rattus norvegicus
aagatcaggtttgcccatggacttc

SEQ ID NO: 37197 - DNA, 25 bp, Rattus norvegicus
aagatcagtaacattccatgcggaa

SEQ ID NO: 37198 - DNA, 25 bp, Rattus norvegicus
aagatcagtaactttccatgcggaa

SEQ ID NO: 37199 - DNA, 25 bp, Rattus norvegicus
aagatcagtcttcagagcagcctaa

SEQ ID NO: 37200 - DNA, 25 bp, Rattus norvegicus
aagatcagtcttcgctacctaggaa

SEQ ID NO: 37201 - DNA, 25 bp, Rattus norvegicus
aagatcagtcttgagagcagcctaa

SEQ ID NO: 37202 - DNA, 25 bp, Rattus norvegicus
aagatcagtcttggctacctaggaa

SEQ ID NO: 37203 - DNA, 25 bp, Rattus norvegicus
aagatcatatacaccttttctccgg

SEQ ID NO: 37204 - DNA, 25 bp, Rattus norvegicus
aagatcatatactccttttctccgg

SEQ ID NO: 37205 - DNA, 25 bp, Rattus norvegicus
aagatcatcacacaggtccagcagg

SEQ ID NO: 37206 - DNA, 25 bp, Rattus norvegicus
aagatcatcacagaggtccagcagg

SEQ ID NO: 37207 - DNA, 25 bp, Rattus norvegicus
aagatcatcatactgggttgtggaa

SEQ ID NO: 37208 - DNA, 25 bp, Rattus norvegicus
aagatcatcatagtgggttgtggaa

SEQ ID NO: 37209 - DNA, 25 bp, Rattus norvegicus
aagatcatcattcgtgtgcagacca

SEQ ID NO: 37210 - DNA, 25 bp, Rattus norvegicus
aagatcatcattggtgtgcagacca

SEQ ID NO: 37211 - DNA, 25 bp, Rattus norvegicus
aagatcatcttaattttggtgtaga

SEQ ID NO: 37212 - DNA, 25 bp, Rattus norvegicus
aagatcatcttatttttggtgtaga

SEQ ID NO: 37213 - DNA, 25 bp, Rattus norvegicus
aagatcatgaatcagcaccagcagc

SEQ ID NO: 37214 - DNA, 25 bp, Rattus norvegicus
aagatcatgaatgagcaccagcagc

SEQ ID NO: 37215 - DNA, 25 bp, Rattus norvegicus
aagatcatgagtcaatcctgggtgt

SEQ ID NO: 37216 - DNA, 25 bp, Rattus norvegicus
aagatcatgagtgaatcctgggtgt

SEQ ID NO: 37217 - DNA, 25 bp, Rattus norvegicus
aagatcatggttcagtttccccgta

SEQ ID NO: 37218 - DNA, 25 bp, Rattus norvegicus
aagatcatggttgagtttccccgta

SEQ ID NO: 37219 - DNA, 25 bp, Rattus norvegicus
aagatcattattatacctccatggg

SEQ ID NO: 37220 - DNA, 25 bp, Rattus norvegicus
aagatcattattttacctccatggg

SEQ ID NO: 37221 - DNA, 25 bp, Rattus norvegicus
aagatccaagaaagggtgccaccct

SEQ ID NO: 37222 - DNA, 25 bp, Rattus norvegicus
aagatccaagaatgggtgccaccct

SEQ ID NO: 37223 - DNA, 25 bp, Rattus norvegicus
aagatccaccttcaatctgggccat

SEQ ID NO: 37224 - DNA, 25 bp, Rattus norvegicus
aagatccaccttgaatctgggccat

SEQ ID NO: 37225 - DNA, 25 bp, Rattus norvegicus
aagatccacttcacaagcagggctc

SEQ ID NO: 37226 - DNA, 25 bp, Rattus norvegicus
aagatccacttctcaagcagggctc

SEQ ID NO: 37227 - DNA, 25 bp, Rattus norvegicus
aagatccagcctcttgttactccat

SEQ ID NO: 37228 - DNA, 25 bp, Rattus norvegicus
aagatccagcctgttgttactccat

SEQ ID NO: 37229 - DNA, 25 bp, Rattus norvegicus
aagatccaggcacagctctttatct

SEQ ID NO: 37230 - DNA, 25 bp, Rattus norvegicus
aagatccaggcagagctctttatct

SEQ ID NO: 37231 - DNA, 25 bp, Rattus norvegicus
aagatccagggcacccgtggcaagg

SEQ ID NO: 37232 - DNA, 25 bp, Rattus norvegicus
aagatccagggctcccgtggcaagg

SEQ ID NO: 37233 - DNA, 25 bp, Rattus norvegicus
aagatccagtgtatcaggtgctaga

SEQ ID NO: 37234 - DNA, 25 bp, Rattus norvegicus
aagatccagtgtttcaggtgctaga

SEQ ID NO: 37235 - DNA, 25 bp, Rattus norvegicus
aagatccatgtgctgcagaacgcag

SEQ ID NO: 37236 - DNA, 25 bp, Rattus norvegicus
aagatccatgtggtgcagaacgcag

SEQ ID NO: 37237 - DNA, 25 bp, Rattus norvegicus
aagatccattctactacccatgaat

SEQ ID NO: 37238 - DNA, 25 bp, Rattus norvegicus
aagatccattcttctacccatgaat

SEQ ID NO: 37239 - DNA, 25 bp, Rattus norvegicus
aagatcccaaatacctcataaccaa

SEQ ID NO: 37240 - DNA, 25 bp, Rattus norvegicus
aagatcccaaattcctcataaccaa

SEQ ID NO: 37241 - DNA, 25 bp, Rattus norvegicus
aagatcccagccatgagtcacaggt

SEQ ID NO: 37242 - DNA, 25 bp, Rattus norvegicus
aagatcccagccttgagtcacaggt

SEQ ID NO: 37243 - DNA, 25 bp, Rattus norvegicus
aagatcccagtgattatagagcgat

SEQ ID NO: 37244 - DNA, 25 bp, Rattus norvegicus
aagatcccagtgtttatagagcgat

SEQ ID NO: 37245 - DNA, 25 bp, Rattus norvegicus
aagatccccagcaggagattgccca

SEQ ID NO: 37246 - DNA, 25 bp, Rattus norvegicus
aagatccccagctggagattgccca

SEQ ID NO: 37247 - DNA, 25 bp, Rattus norvegicus
aagatccccataagaaagttctcgg

SEQ ID NO: 37248 - DNA, 25 bp, Rattus norvegicus
aagatccccatatgaaagttctcgg

SEQ ID NO: 37249 - DNA, 25 bp, Rattus norvegicus
aagatcccctatctgcgactggaga

SEQ ID NO: 37250 - DNA, 25 bp, Rattus norvegicus
aagatcccctatgtgcgactggaga

SEQ ID NO: 37251 - DNA, 25 bp, Rattus norvegicus
aagatccccttcaacatactgttga

SEQ ID NO: 37252 - DNA, 25 bp, Rattus norvegicus
aagatccccttctacatactgttga

SEQ ID NO: 37253 - DNA, 25 bp, Rattus norvegicus
aagatcccgctgctactgagccgac

SEQ ID NO: 37254 - DNA, 25 bp, Rattus norvegicus
aagatcccgctggtactgagccgac

SEQ ID NO: 37255 - DNA, 25 bp, Rattus norvegicus
aagatcccggtgcaagctgactttc

SEQ ID NO: 37256 - DNA, 25 bp, Rattus norvegicus
aagatcccggtggaagctgactttc

SEQ ID NO: 37257 - DNA, 25 bp, Rattus norvegicus
aagatcccgtacaaggtggtggcac

SEQ ID NO: 37258 - DNA, 25 bp, Rattus norvegicus
aagatcccgtactaggtggtggcac

SEQ ID NO: 37259 - DNA, 25 bp, Rattus norvegicus
aagatccctctgcaaaccaaagtac

SEQ ID NO: 37260 - DNA, 25 bp, Rattus norvegicus
aagatccctctggaaaccaaagtac

SEQ ID NO: 37261 - DNA, 25 bp, Rattus norvegicus
aagatccctgacagcttctcaagat

SEQ ID NO: 37262 - DNA, 25 bp, Rattus norvegicus
aagatccctgactgcttctcaagat

SEQ ID NO: 37263 - DNA, 25 bp, Rattus norvegicus
aagatccctggaactctggagacca

SEQ ID NO: 37264 - DNA, 25 bp, Rattus norvegicus
aagatccctggatctctggagacca

SEQ ID NO: 37265 - DNA, 25 bp, Rattus norvegicus
aagatccctgtgcagtttccagttt

SEQ ID NO: 37266 - DNA, 25 bp, Rattus norvegicus
aagatccctgtggagtttccagttt

SEQ ID NO: 37267 - DNA, 25 bp, Rattus norvegicus
aagatccgaacacagcggtcgacat

SEQ ID NO: 37268 - DNA, 25 bp, Rattus norvegicus
aagatccgaacagagcggtcgacat

SEQ ID NO: 37269 - DNA, 25 bp, Rattus norvegicus
aagatccgtggtcatggctcattac

SEQ ID NO: 37270 - DNA, 25 bp, Rattus norvegicus
aagatccgtggtgatggctcattac

SEQ ID NO: 37271 - DNA, 25 bp, Rattus norvegicus
aagatcctagttccctttgtgtata

SEQ ID NO: 37272 - DNA, 25 bp, Rattus norvegicus
aagatcctagttgcctttgtgtata

SEQ ID NO: 37273 - DNA, 25 bp, Rattus norvegicus
aagatcctcatgacggctgctgtta

SEQ ID NO: 37274 - DNA, 25 bp, Rattus norvegicus
aagatcctcatgtcggctgctgtta

SEQ ID NO: 37275 - DNA, 25 bp, Rattus norvegicus
aagatcctccagatccctaagactc

SEQ ID NO: 37276 - DNA, 25 bp, Rattus norvegicus
aagatcctccagttccctaagactc

SEQ ID NO: 37277 - DNA, 25 bp, Rattus norvegicus
aagatcctccgactgtctgggtgga

SEQ ID NO: 37278 - DNA, 25 bp, Rattus norvegicus
aagatcctccgagtgtctgggtgga

SEQ ID NO: 37279 - DNA, 25 bp, Rattus norvegicus
aagatcctcctcagtcagacaaatt

SEQ ID NO: 37280 - DNA, 25 bp, Rattus norvegicus
aagatcctcctctgtcagacaaatt

SEQ ID NO: 37281 - DNA, 25 bp, Rattus norvegicus
aagatcctctcgctaaatggccaag

SEQ ID NO: 37282 - DNA, 25 bp, Rattus norvegicus
aagatcctctcggtaaatggccaag

SEQ ID NO: 37283 - DNA, 25 bp, Rattus norvegicus
aagatcctgacccagattcctttga

SEQ ID NO: 37284 - DNA, 25 bp, Rattus norvegicus
aagatcctgacccagcgtggctaca

SEQ ID NO: 37285 - DNA, 25 bp, Rattus norvegicus
aagatcctgaccgagattcctttga

SEQ ID NO: 37286 - DNA, 25 bp, Rattus norvegicus
aagatcctgaccgagcgtggctaca

SEQ ID NO: 37287 - DNA, 25 bp, Rattus norvegicus
aagatcctgaggatcacgggtctct

SEQ ID NO: 37288 - DNA, 25 bp, Rattus norvegicus
aagatcctgaggttcacgggtctct

SEQ ID NO: 37289 - DNA, 25 bp, Rattus norvegicus
aagatcctgattctaggtgacacaa

SEQ ID NO: 37290 - DNA, 25 bp, Rattus norvegicus
aagatcctgattgtaggtgacacaa

SEQ ID NO: 37291 - DNA, 25 bp, Rattus norvegicus
aagatcctgcccagttaccaggaac

SEQ ID NO: 37292 - DNA, 25 bp, Rattus norvegicus
aagatcctgccctgttaccaggaac

SEQ ID NO: 37293 - DNA, 25 bp, Rattus norvegicus
aagatcctggacagctgcagacagc

SEQ ID NO: 37294 - DNA, 25 bp, Rattus norvegicus
aagatcctggactgctgcagacagc

SEQ ID NO: 37295 - DNA, 25 bp, Rattus norvegicus
aagatcctgggcaccgtggtctgac

SEQ ID NO: 37296 - DNA, 25 bp, Rattus norvegicus
aagatcctgggctccgtggtctgac

SEQ ID NO: 37297 - DNA, 25 bp, Rattus norvegicus
aagatcctgggtctgtgtgccagaa

SEQ ID NO: 37298 - DNA, 25 bp, Rattus norvegicus
aagatcctgggtgtgtgtgccagaa

SEQ ID NO: 37299 - DNA, 25 bp, Rattus norvegicus
aagatcctggtgctgttagccttgc

SEQ ID NO: 37300 - DNA, 25 bp, Rattus norvegicus
aagatcctggtggtgttagccttgc

SEQ ID NO: 37301 - DNA, 25 bp, Rattus norvegicus
aagatcctgtggcagcatccagagc

SEQ ID NO: 37302 - DNA, 25 bp, Rattus norvegicus
aagatcctgtgggagcatccagagc

SEQ ID NO: 37303 - DNA, 25 bp, Rattus norvegicus
aagatccttcacaactctgtaacac

SEQ ID NO: 37304 - DNA, 25 bp, Rattus norvegicus
aagatccttcactactctgtaacac

SEQ ID NO: 37305 - DNA, 25 bp, Rattus norvegicus
aagatccttgatcccagaatccatt

SEQ ID NO: 37306 - DNA, 25 bp, Rattus norvegicus
aagatccttgatgccagaatccatt

SEQ ID NO: 37307 - DNA, 25 bp, Rattus norvegicus
aagatccttgctaacctggttcaca

SEQ ID NO: 37308 - DNA, 25 bp, Rattus norvegicus
aagatccttgcttacctggttcaca

SEQ ID NO: 37309 - DNA, 25 bp, Rattus norvegicus
aagatccttggcacttgggttctct

SEQ ID NO: 37310 - DNA, 25 bp, Rattus norvegicus
aagatccttggctcttgggttctct

SEQ ID NO: 37311 - DNA, 25 bp, Rattus norvegicus
aagatccttgttagccactggaaga

SEQ ID NO: 37312 - DNA, 25 bp, Rattus norvegicus
aagatccttgtttgccactggaaga

SEQ ID NO: 37313 - DNA, 25 bp, Rattus norvegicus
aagatcctttgtatgtctggcagca

SEQ ID NO: 37314 - DNA, 25 bp, Rattus norvegicus
aagatcctttgtttgtctggcagca

SEQ ID NO: 37315 - DNA, 25 bp, Rattus norvegicus
aagatcgactttcacagtgtgtcca

SEQ ID NO: 37316 - DNA, 25 bp, Rattus norvegicus
aagatcgactttgacagtgtgtcca

SEQ ID NO: 37317 - DNA, 25 bp, Rattus norvegicus
aagatcgagcctcgtgtcaacttcc

SEQ ID NO: 37318 - DNA, 25 bp, Rattus norvegicus
aagatcgagcctggtgtcaacttcc

SEQ ID NO: 37319 - DNA, 25 bp, Rattus norvegicus
aagatcgcaaggcagtgaccgtcct

SEQ ID NO: 37320 - DNA, 25 bp, Rattus norvegicus
aagatcgcaagggagtgaccgtcct

SEQ ID NO: 37321 - DNA, 25 bp, Rattus norvegicus
aagatcgcagtcagctaaggaggaa

SEQ ID NO: 37322 - DNA, 25 bp, Rattus norvegicus
aagatcgcagtctgctaaggaggaa

SEQ ID NO: 37323 - DNA, 25 bp, Rattus norvegicus
aagatcgcgccgcattattgctgca

SEQ ID NO: 37324 - DNA, 25 bp, Rattus norvegicus
aagatcgcgccggattattgctgca

SEQ ID NO: 37325 - DNA, 25 bp, Rattus norvegicus
aagatcggagctcaccgtcctgcac

SEQ ID NO: 37326 - DNA, 25 bp, Rattus norvegicus
aagatcggagctgaccgtcctgcac

SEQ ID NO: 37327 - DNA, 25 bp, Rattus norvegicus
aagatcggctgtcgcatccagctga

SEQ ID NO: 37328 - DNA, 25 bp, Rattus norvegicus
aagatcggctgtggcatccagctga

SEQ ID NO: 37329 - DNA, 25 bp, Rattus norvegicus
aagatcggtaccaacgtgaaatgag

SEQ ID NO: 37330 - DNA, 25 bp, Rattus norvegicus
aagatcggtacctacgtgaaatgag

SEQ ID NO: 37331 - DNA, 25 bp, Rattus norvegicus
aagatcggtgtcatcagtttgcaga

SEQ ID NO: 37332 - DNA, 25 bp, Rattus norvegicus
aagatcggtgtcatcatgtcttcag

SEQ ID NO: 37333 - DNA, 25 bp, Rattus norvegicus
aagatcggtgtcttcagtttgcaga

SEQ ID NO: 37334 - DNA, 25 bp, Rattus norvegicus
aagatcggtgtcttcatgtcttcag

SEQ ID NO: 37335 - DNA, 25 bp, Rattus norvegicus
aagatcgtagaccaccttcggtctc

SEQ ID NO: 37336 - DNA, 25 bp, Rattus norvegicus
aagatcgtagacgaccttcggtctc

SEQ ID NO: 37337 - DNA, 25 bp, Rattus norvegicus
aagatcgtgacgcactacaccctgg

SEQ ID NO: 37338 - DNA, 25 bp, Rattus norvegicus
aagatcgtgacggactacaccctgg

SEQ ID NO: 37339 - DNA, 25 bp, Rattus norvegicus
aagatcgtgagtatattgccaaggc

SEQ ID NO: 37340 - DNA, 25 bp, Rattus norvegicus
aagatcgtgagtttattgccaaggc

SEQ ID NO: 37341 - DNA, 25 bp, Rattus norvegicus
aagatcgtgggcaccttgtgtgcca

SEQ ID NO: 37342 - DNA, 25 bp, Rattus norvegicus
aagatcgtgggctccttgtgtgcca

SEQ ID NO: 37343 - DNA, 25 bp, Rattus norvegicus
aagatcgtgtgcccgctcacgggct

SEQ ID NO: 37344 - DNA, 25 bp, Rattus norvegicus
aagatcgtgtgcgcgctcacgggct

SEQ ID NO: 37345 - DNA, 25 bp, Rattus norvegicus
aagatcgtgttgcttagcctgcagg

SEQ ID NO: 37346 - DNA, 25 bp, Rattus norvegicus
aagatcgtgttggttagcctgcagg

SEQ ID NO: 37347 - DNA, 25 bp, Rattus norvegicus
aagatctaacctagctggcactttg

SEQ ID NO: 37348 - DNA, 25 bp, Rattus norvegicus
aagatctaaccttgctggcactttg

SEQ ID NO: 37349 - DNA, 25 bp, Rattus norvegicus
aagatctacaacatcaggctgagag

SEQ ID NO: 37350 - DNA, 25 bp, Rattus norvegicus
aagatctacaacttcaggctgagag

SEQ ID NO: 37351 - DNA, 25 bp, Rattus norvegicus
aagatctacacacggctgcagccta

SEQ ID NO: 37352 - DNA, 25 bp, Rattus norvegicus
aagatctacacagggctgcagccta

SEQ ID NO: 37353 - DNA, 25 bp, Rattus norvegicus
aagatctacagaagccgaggacggg

SEQ ID NO: 37354 - DNA, 25 bp, Rattus norvegicus
aagatctacagatgccgaggacggg

SEQ ID NO: 37355 - DNA, 25 bp, Rattus norvegicus
aagatctaccttatactcacatgca

SEQ ID NO: 37356 - DNA, 25 bp, Rattus norvegicus
aagatctaccttttactcacatgca

SEQ ID NO: 37357 - DNA, 25 bp, Rattus norvegicus
aagatctacttcaactggctgtgca

SEQ ID NO: 37358 - DNA, 25 bp, Rattus norvegicus
aagatctacttctactggctgtgca

SEQ ID NO: 37359 - DNA, 25 bp, Rattus norvegicus
aagatctcacttccagtcatcgggc

SEQ ID NO: 37360 - DNA, 25 bp, Rattus norvegicus
aagatctcacttgcagtcatcgggc

SEQ ID NO: 37361 - DNA, 25 bp, Rattus norvegicus
aagatctcccctccacacatttatg

SEQ ID NO: 37362 - DNA, 25 bp, Rattus norvegicus
aagatctcccctgcacacatttatg

SEQ ID NO: 37363 - DNA, 25 bp, Rattus norvegicus
aagatctcccgccatgagctgttac

SEQ ID NO: 37364 - DNA, 25 bp, Rattus norvegicus
aagatctcccgcgatgagctgttac

SEQ ID NO: 37365 - DNA, 25 bp, Rattus norvegicus
aagatctccgagactcccgtgaagt

SEQ ID NO: 37366 - DNA, 25 bp, Rattus norvegicus
aagatctccgagtctcccgtgaagt

SEQ ID NO: 37367 - DNA, 25 bp, Rattus norvegicus
aagatctcctggctcttccgtgttt

SEQ ID NO: 37368 - DNA, 25 bp, Rattus norvegicus
aagatctcctgggtcttccgtgttt

SEQ ID NO: 37369 - DNA, 25 bp, Rattus norvegicus
aagatctcggaacttgaccaggcct

SEQ ID NO: 37370 - DNA, 25 bp, Rattus norvegicus
aagatctcggaagttgaccaggcct

SEQ ID NO: 37371 - DNA, 25 bp, Rattus norvegicus
aagatctcgtgtctttaatctctgg

SEQ ID NO: 37372 - DNA, 25 bp, Rattus norvegicus
aagatctcgtgtgtttaatctctgg

SEQ ID NO: 37373 - DNA, 25 bp, Rattus norvegicus
aagatctctcccatagtatgctacc

SEQ ID NO: 37374 - DNA, 25 bp, Rattus norvegicus
aagatctctcccttagtatgctacc

SEQ ID NO: 37375 - DNA, 25 bp, Rattus norvegicus
aagatctctgatctccttttcttac

SEQ ID NO: 37376 - DNA, 25 bp, Rattus norvegicus
aagatctctgatgtccttttcttac

SEQ ID NO: 37377 - DNA, 25 bp, Rattus norvegicus
aagatctctgtgatttccagctact

SEQ ID NO: 37378 - DNA, 25 bp, Rattus norvegicus
aagatctctgtgttttccagctact

SEQ ID NO: 37379 - DNA, 25 bp, Rattus norvegicus
aagatctctttgcaacgtaagtgaa

SEQ ID NO: 37380 - DNA, 25 bp, Rattus norvegicus
aagatctctttggaacgtaagtgaa

SEQ ID NO: 37381 - DNA, 25 bp, Rattus norvegicus
aagatctcttttccgcagaaacagc

SEQ ID NO: 37382 - DNA, 25 bp, Rattus norvegicus
aagatctcttttgcgcagaaacagc

SEQ ID NO: 37383 - DNA, 25 bp, Rattus norvegicus
aagatctgacttatggtagcagaag

SEQ ID NO: 37384 - DNA, 25 bp, Rattus norvegicus
aagatctgacttttggtagcagaag

SEQ ID NO: 37385 - DNA, 25 bp, Rattus norvegicus
aagatctgagttaggcctccagcag

SEQ ID NO: 37386 - DNA, 25 bp, Rattus norvegicus
aagatctgagtttggcctccagcag

SEQ ID NO: 37387 - DNA, 25 bp, Rattus norvegicus
aagatctgctaaatgctaagctatt

SEQ ID NO: 37388 - DNA, 25 bp, Rattus norvegicus
aagatctgctaattgctaagctatt

SEQ ID NO: 37389 - DNA, 25 bp, Rattus norvegicus
aagatctgctttaccttgttttgat

SEQ ID NO: 37390 - DNA, 25 bp, Rattus norvegicus
aagatctgcttttccttgttttgat

SEQ ID NO: 37391 - DNA, 25 bp, Rattus norvegicus
aagatctggattccggttgcacttc

SEQ ID NO: 37392 - DNA, 25 bp, Rattus norvegicus
aagatctggattgcggttgcacttc

SEQ ID NO: 37393 - DNA, 25 bp, Rattus norvegicus
aagatctggccactttgtgttttta

SEQ ID NO: 37394 - DNA, 25 bp, Rattus norvegicus
aagatctggccagtttgtgttttta

SEQ ID NO: 37395 - DNA, 25 bp, Rattus norvegicus
aagatctgggccaggattcacctgc

SEQ ID NO: 37396 - DNA, 25 bp, Rattus norvegicus
aagatctgggcctggattcacctgc

SEQ ID NO: 37397 - DNA, 25 bp, Rattus norvegicus
aagatctggtaccaaccccgaggtg

SEQ ID NO: 37398 - DNA, 25 bp, Rattus norvegicus
aagatctggtacgaaccccgaggtg

SEQ ID NO: 37399 - DNA, 25 bp, Rattus norvegicus
aagatctggtcgcagtaggccatca

SEQ ID NO: 37400 - DNA, 25 bp, Rattus norvegicus
aagatctggtcggagtaggccatca

SEQ ID NO: 37401 - DNA, 25 bp, Rattus norvegicus
aagatctgtgaacagagcattggac

SEQ ID NO: 37402 - DNA, 25 bp, Rattus norvegicus
aagatctgtgaagagagcattggac

SEQ ID NO: 37403 - DNA, 25 bp, Rattus norvegicus
aagatctgtgcaagtgagccgaaca

SEQ ID NO: 37404 - DNA, 25 bp, Rattus norvegicus
aagatctgtgcatgtgagccgaaca

SEQ ID NO: 37405 - DNA, 25 bp, Rattus norvegicus
aagatcttatcaatcactgtgcccc

SEQ ID NO: 37406 - DNA, 25 bp, Rattus norvegicus
aagatcttatcattcactgtgcccc

SEQ ID NO: 37407 - DNA, 25 bp, Rattus norvegicus
aagatcttcaccaacgagtgtcgct

SEQ ID NO: 37408 - DNA, 25 bp, Rattus norvegicus
aagatcttcacctacgagtgtcgct

SEQ ID NO: 37409 - DNA, 25 bp, Rattus norvegicus
aagatcttcatgaaccaaacccagg

SEQ ID NO: 37410 - DNA, 25 bp, Rattus norvegicus
aagatcttcatgtaccaaacccagg

SEQ ID NO: 37411 - DNA, 25 bp, Rattus norvegicus
aagatcttcattacagccttggcca

SEQ ID NO: 37412 - DNA, 25 bp, Rattus norvegicus
aagatcttcatttcagccttggcca

SEQ ID NO: 37413 - DNA, 25 bp, Rattus norvegicus
aagatcttccaccaggcactgagaa

SEQ ID NO: 37414 - DNA, 25 bp, Rattus norvegicus
aagatcttccacgaggcactgagaa

SEQ ID NO: 37415 - DNA, 25 bp, Rattus norvegicus
aagatcttcccacagtcagttcagt

SEQ ID NO: 37416 - DNA, 25 bp, Rattus norvegicus
aagatcttcccagagtcagttcagt

SEQ ID NO: 37417 - DNA, 25 bp, Rattus norvegicus
aagatcttcctgagcagtgtttccc

SEQ ID NO: 37418 - DNA, 25 bp, Rattus norvegicus
aagatcttcctgtgcagtgtttccc

SEQ ID NO: 37419 - DNA, 25 bp, Rattus norvegicus
aagatcttcttcaccgggtgttggc

SEQ ID NO: 37420 - DNA, 25 bp, Rattus norvegicus
aagatcttcttctccgggtgttggc

SEQ ID NO: 37421 - DNA, 25 bp, Rattus norvegicus
aagatcttgaccaaccagtatggga

SEQ ID NO: 37422 - DNA, 25 bp, Rattus norvegicus
aagatcttgaccagggatgttcccg

SEQ ID NO: 37423 - DNA, 25 bp, Rattus norvegicus
aagatcttgacctaccagtatggga

SEQ ID NO: 37424 - DNA, 25 bp, Rattus norvegicus
aagatcttgacctgggatgttcccg

SEQ ID NO: 37425 - DNA, 25 bp, Rattus norvegicus
aagatcttgcacctcgggtgaacct

SEQ ID NO: 37426 - DNA, 25 bp, Rattus norvegicus
aagatcttgcacgtcgggtgaacct

SEQ ID NO: 37427 - DNA, 25 bp, Rattus norvegicus
aagatcttggtgaacgtcgtgtcct

SEQ ID NO: 37428 - DNA, 25 bp, Rattus norvegicus
aagatcttggtgaagcgtctgagct

SEQ ID NO: 37429 - DNA, 25 bp, Rattus norvegicus
aagatcttggtgtacgtcgtgtcct

SEQ ID NO: 37430 - DNA, 25 bp, Rattus norvegicus
aagatcttggtgtagcgtctgagct

SEQ ID NO: 37431 - DNA, 25 bp, Rattus norvegicus
aagatcttgttcagtatcctaggat

SEQ ID NO: 37432 - DNA, 25 bp, Rattus norvegicus
aagatcttgttctgtatcctaggat

SEQ ID NO: 37433 - DNA, 25 bp, Rattus norvegicus
aagatctttgctaaccagcctggaa

SEQ ID NO: 37434 - DNA, 25 bp, Rattus norvegicus
aagatctttgcttaccagcctggaa

SEQ ID NO: 37435 - DNA, 25 bp, Rattus norvegicus
aagatctttttgctatccctgctta

SEQ ID NO: 37436 - DNA, 25 bp, Rattus norvegicus
aagatctttttggtatccctgctta

SEQ ID NO: 37437 - DNA, 25 bp, Rattus norvegicus
aagatgaaactcctgtcggacaccc

SEQ ID NO: 37438 - DNA, 25 bp, Rattus norvegicus
aagatgaaactcgtgtcggacaccc

SEQ ID NO: 37439 - DNA, 25 bp, Rattus norvegicus
aagatgaacacacctggtctcaggt

SEQ ID NO: 37440 - DNA, 25 bp, Rattus norvegicus
aagatgaacacagctggtctcaggt

SEQ ID NO: 37441 - DNA, 25 bp, Rattus norvegicus
aagatgaacccgcaggccctgaagg

SEQ ID NO: 37442 - DNA, 25 bp, Rattus norvegicus
aagatgaacccggaggccctgaagg

SEQ ID NO: 37443 - DNA, 25 bp, Rattus norvegicus
aagatgaaccctctgtggaacacca

SEQ ID NO: 37444 - DNA, 25 bp, Rattus norvegicus
aagatgaaccctgtgtggaacacca

SEQ ID NO: 37445 - DNA, 25 bp, Rattus norvegicus
aagatgaactctatgtttacccaag

SEQ ID NO: 37446 - DNA, 25 bp, Rattus norvegicus
aagatgaactctttgtttacccaag

SEQ ID NO: 37447 - DNA, 25 bp, Rattus norvegicus
aagatgaactttaccaccctgagga

SEQ ID NO: 37448 - DNA, 25 bp, Rattus norvegicus
aagatgaacttttccaccctgagga

SEQ ID NO: 37449 - DNA, 25 bp, Rattus norvegicus
aagatgaatctccaaccagcaaatg

SEQ ID NO: 37450 - DNA, 25 bp, Rattus norvegicus
aagatgaatctcgaaccagcaaatg

SEQ ID NO: 37451 - DNA, 25 bp, Rattus norvegicus
aagatgacagccatcacaggcaggg

SEQ ID NO: 37452 - DNA, 25 bp, Rattus norvegicus
aagatgacagccttcacaggcaggg

SEQ ID NO: 37453 - DNA, 25 bp, Rattus norvegicus
aagatgacaggcatgtcgctccagc

SEQ ID NO: 37454 - DNA, 25 bp, Rattus norvegicus
aagatgacaggcttgtcgctccagc

SEQ ID NO: 37455 - DNA, 25 bp, Rattus norvegicus
aagatgacagtgaccattttggcat

SEQ ID NO: 37456 - DNA, 25 bp, Rattus norvegicus
aagatgacagtgtccattttggcat

SEQ ID NO: 37457 - DNA, 25 bp, Rattus norvegicus
aagatgacatacagccaccagaggt

SEQ ID NO: 37458 - DNA, 25 bp, Rattus norvegicus
aagatgacatactgccaccagaggt

SEQ ID NO: 37459 - DNA, 25 bp, Rattus norvegicus
aagatgaccaaacatacaagctact

SEQ ID NO: 37460 - DNA, 25 bp, Rattus norvegicus
aagatgaccaaagatacaagctact

SEQ ID NO: 37461 - DNA, 25 bp, Rattus norvegicus
aagatgaccctgaccggtccatgaa

SEQ ID NO: 37462 - DNA, 25 bp, Rattus norvegicus
aagatgaccctgctgaacccatgca

SEQ ID NO: 37463 - DNA, 25 bp, Rattus norvegicus
aagatgaccctggtgaacccatgca

SEQ ID NO: 37464 - DNA, 25 bp, Rattus norvegicus
aagatgaccctgtccggtccatgaa

SEQ ID NO: 37465 - DNA, 25 bp, Rattus norvegicus
aagatgacctggaggccatagccca

SEQ ID NO: 37466 - DNA, 25 bp, Rattus norvegicus
aagatgacctggtggccatagccca

SEQ ID NO: 37467 - DNA, 25 bp, Rattus norvegicus
aagatgacgcgaacgtggccgacgc

SEQ ID NO: 37468 - DNA, 25 bp, Rattus norvegicus
aagatgacgcgatcgtggccgacgc

SEQ ID NO: 37469 - DNA, 25 bp, Rattus norvegicus
aagatgacggctacttccgggaact

SEQ ID NO: 37470 - DNA, 25 bp, Rattus norvegicus
aagatgacggcttcttccgggaact

SEQ ID NO: 37471 - DNA, 25 bp, Rattus norvegicus
aagatgactaacagttctcacccct

SEQ ID NO: 37472 - DNA, 25 bp, Rattus norvegicus
aagatgactaactgttctcacccct

SEQ ID NO: 37473 - DNA, 25 bp, Rattus norvegicus
aagatgactaccagcttgttcgaaa

SEQ ID NO: 37474 - DNA, 25 bp, Rattus norvegicus
aagatgactacctgcttgttcgaaa

SEQ ID NO: 37475 - DNA, 25 bp, Rattus norvegicus
aagatgactcccagcagagacagga

SEQ ID NO: 37476 - DNA, 25 bp, Rattus norvegicus
aagatgactccctgcagagacagga

SEQ ID NO: 37477 - DNA, 25 bp, Rattus norvegicus
aagatgactcggagctggctcgcga

SEQ ID NO: 37478 - DNA, 25 bp, Rattus norvegicus
aagatgactcggtgctggctcgcga

SEQ ID NO: 37479 - DNA, 25 bp, Rattus norvegicus
aagatgactgtacgtctccccaggt

SEQ ID NO: 37480 - DNA, 25 bp, Rattus norvegicus
aagatgactgtaggtctccccaggt

SEQ ID NO: 37481 - DNA, 25 bp, Rattus norvegicus
aagatgacttcccttgccttttact

SEQ ID NO: 37482 - DNA, 25 bp, Rattus norvegicus
aagatgacttccgttgccttttact

SEQ ID NO: 37483 - DNA, 25 bp, Rattus norvegicus
aagatgagacttccagttcctctga

SEQ ID NO: 37484 - DNA, 25 bp, Rattus norvegicus
aagatgagacttgcagttcctctga

SEQ ID NO: 37485 - DNA, 25 bp, Rattus norvegicus
aagatgagagccagggtcacagtct

SEQ ID NO: 37486 - DNA, 25 bp, Rattus norvegicus
aagatgagagcctgggtcacagtct

SEQ ID NO: 37487 - DNA, 25 bp, Rattus norvegicus
aagatgagatcgcttcccagccatt

SEQ ID NO: 37488 - DNA, 25 bp, Rattus norvegicus
aagatgagatcggttcccagccatt

SEQ ID NO: 37489 - DNA, 25 bp, Rattus norvegicus
aagatgagcaagagggccctgccat

SEQ ID NO: 37490 - DNA, 25 bp, Rattus norvegicus
aagatgagcaagtgggccctgccat

SEQ ID NO: 37491 - DNA, 25 bp, Rattus norvegicus
aagatgagcagcatccggcaattct

SEQ ID NO: 37492 - DNA, 25 bp, Rattus norvegicus
aagatgagcagcttccggcaattct

SEQ ID NO: 37493 - DNA, 25 bp, Rattus norvegicus
aagatgagctcccagatgccgttct

SEQ ID NO: 37494 - DNA, 25 bp, Rattus norvegicus
aagatgagctccgagatgccgttct

SEQ ID NO: 37495 - DNA, 25 bp, Rattus norvegicus
aagatgagggagacgggccctgcga

SEQ ID NO: 37496 - DNA, 25 bp, Rattus norvegicus
aagatgagggagtcgggccctgcga

SEQ ID NO: 37497 - DNA, 25 bp, Rattus norvegicus
aagatgaggtttcgtgagccgttcc

SEQ ID NO: 37498 - DNA, 25 bp, Rattus norvegicus
aagatgaggtttggtgagccgttcc

SEQ ID NO: 37499 - DNA, 25 bp, Rattus norvegicus
aagatgagttgccaagcctggtccc

SEQ ID NO: 37500 - DNA, 25 bp, Rattus norvegicus
aagatgagttgcgaagcctggtccc

SEQ ID NO: 37501 - DNA, 25 bp, Rattus norvegicus
aagatgatacctagaaaccacctgg

SEQ ID NO: 37502 - DNA, 25 bp, Rattus norvegicus
aagatgataccttgaaaccacctgg

SEQ ID NO: 37503 - DNA, 25 bp, Rattus norvegicus
aagatgatcattcccagattttccc

SEQ ID NO: 37504 - DNA, 25 bp, Rattus norvegicus
aagatgatcattgccagattttccc

SEQ ID NO: 37505 - DNA, 25 bp, Rattus norvegicus
aagatgatccaaattcaatccaaat

SEQ ID NO: 37506 - DNA, 25 bp, Rattus norvegicus
aagatgatccaatttcaatccaaat

SEQ ID NO: 37507 - DNA, 25 bp, Rattus norvegicus
aagatgatccccatggtgcttgtat

SEQ ID NO: 37508 - DNA, 25 bp, Rattus norvegicus
aagatgatccccttggtgcttgtat

SEQ ID NO: 37509 - DNA, 25 bp, Rattus norvegicus
aagatgatgaaccgcttcatgccac

SEQ ID NO: 37510 - DNA, 25 bp, Rattus norvegicus
aagatgatgaacggcttcatgccac

SEQ ID NO: 37511 - DNA, 25 bp, Rattus norvegicus
aagatgatggaactcccggcagcat

SEQ ID NO: 37512 - DNA, 25 bp, Rattus norvegicus
aagatgatggaagtcccggcagcat

SEQ ID NO: 37513 - DNA, 25 bp, Rattus norvegicus
aagatgatgtgaccccatcacagca

SEQ ID NO: 37514 - DNA, 25 bp, Rattus norvegicus
aagatgatgtgagcccatcacagca

SEQ ID NO: 37515 - DNA, 25 bp, Rattus norvegicus
aagatgattcagagagtcccacgca

SEQ ID NO: 37516 - DNA, 25 bp, Rattus norvegicus
aagatgattcagtgagtcccacgca

SEQ ID NO: 37517 - DNA, 25 bp, Rattus norvegicus
aagatgatttaaactctgccacccc

SEQ ID NO: 37518 - DNA, 25 bp, Rattus norvegicus
aagatgatttaatctctgccacccc

SEQ ID NO: 37519 - DNA, 25 bp, Rattus norvegicus
aagatgatttctctgtcaagcccca

SEQ ID NO: 37520 - DNA, 25 bp, Rattus norvegicus
aagatgatttctgtgtcaagcccca

SEQ ID NO: 37521 - DNA, 25 bp, Rattus norvegicus
aagatgattttccagtttatgacta

SEQ ID NO: 37522 - DNA, 25 bp, Rattus norvegicus
aagatgattttcgagtttatgacta

SEQ ID NO: 37523 - DNA, 25 bp, Rattus norvegicus
aagatgcaaaccacctgggccagag

SEQ ID NO: 37524 - DNA, 25 bp, Rattus norvegicus
aagatgcaaacctcctgggccagag

SEQ ID NO: 37525 - DNA, 25 bp, Rattus norvegicus
aagatgcaatgacgctttccgtgcc

SEQ ID NO: 37526 - DNA, 25 bp, Rattus norvegicus
aagatgcaatgaggctttccgtgcc

SEQ ID NO: 37527 - DNA, 25 bp, Rattus norvegicus
aagatgcacctaactctcgagactg

SEQ ID NO: 37528 - DNA, 25 bp, Rattus norvegicus
aagatgcacctatctctcgagactg

SEQ ID NO: 37529 - DNA, 25 bp, Rattus norvegicus
aagatgcacgcaaggagttccccac

SEQ ID NO: 37530 - DNA, 25 bp, Rattus norvegicus
aagatgcacgcatggagttccccac

SEQ ID NO: 37531 - DNA, 25 bp, Rattus norvegicus
aagatgcaggacacgcctagaatct

SEQ ID NO: 37532 - DNA, 25 bp, Rattus norvegicus
aagatgcaggactcgcctagaatct

SEQ ID NO: 37533 - DNA, 25 bp, Rattus norvegicus
aagatgcaggcgatccaggcatgct

SEQ ID NO: 37534 - DNA, 25 bp, Rattus norvegicus
aagatgcaggcgttccaggcatgct

SEQ ID NO: 37535 - DNA, 25 bp, Rattus norvegicus
aagatgcagggcctcatgttccggt

SEQ ID NO: 37536 - DNA, 25 bp, Rattus norvegicus
aagatgcagggcgtcatgttccggt

SEQ ID NO: 37537 - DNA, 25 bp, Rattus norvegicus
aagatgcagtggacttccagctaat

SEQ ID NO: 37538 - DNA, 25 bp, Rattus norvegicus
aagatgcagtggtcttccagctaat

SEQ ID NO: 37539 - DNA, 25 bp, Rattus norvegicus
aagatgcagttcaatgtcccgcaac

SEQ ID NO: 37540 - DNA, 25 bp, Rattus norvegicus
aagatgcagttctatgtcccgcaac

SEQ ID NO: 37541 - DNA, 25 bp, Rattus norvegicus
aagatgcatgcacctatcacacctg

SEQ ID NO: 37542 - DNA, 25 bp, Rattus norvegicus
aagatgcatgcactgcgggacttgc

SEQ ID NO: 37543 - DNA, 25 bp, Rattus norvegicus
aagatgcatgcagctatcacacctg

SEQ ID NO: 37544 - DNA, 25 bp, Rattus norvegicus
aagatgcatgcagtgcgggacttgc

SEQ ID NO: 37545 - DNA, 25 bp, Rattus norvegicus
aagatgcatgccaaacgtgttccac

SEQ ID NO: 37546 - DNA, 25 bp, Rattus norvegicus
aagatgcatgcctaacgtgttccac

SEQ ID NO: 37547 - DNA, 25 bp, Rattus norvegicus
aagatgccaaataccttacctgtgc

SEQ ID NO: 37548 - DNA, 25 bp, Rattus norvegicus
aagatgccaaattccttacctgtgc

SEQ ID NO: 37549 - DNA, 25 bp, Rattus norvegicus
aagatgccaagtccccttgtttctc

SEQ ID NO: 37550 - DNA, 25 bp, Rattus norvegicus
aagatgccaagtgcccttgtttctc

SEQ ID NO: 37551 - DNA, 25 bp, Rattus norvegicus
aagatgccaattccagagtcgctga

SEQ ID NO: 37552 - DNA, 25 bp, Rattus norvegicus
aagatgccaattgcagagtcgctga

SEQ ID NO: 37553 - DNA, 25 bp, Rattus norvegicus
aagatgccacagacctgggacagct

SEQ ID NO: 37554 - DNA, 25 bp, Rattus norvegicus
aagatgccacagtcctgggacagct

SEQ ID NO: 37555 - DNA, 25 bp, Rattus norvegicus
aagatgccaccaccttactgggcac

SEQ ID NO: 37556 - DNA, 25 bp, Rattus norvegicus
aagatgccaccagcttactgggcac

SEQ ID NO: 37557 - DNA, 25 bp, Rattus norvegicus
aagatgccatccctgtgaccacagc

SEQ ID NO: 37558 - DNA, 25 bp, Rattus norvegicus
aagatgccatccgtgtgaccacagc

SEQ ID NO: 37559 - DNA, 25 bp, Rattus norvegicus
aagatgccatgcaccgtcccagaaa

SEQ ID NO: 37560 - DNA, 25 bp, Rattus norvegicus
aagatgccatgctccgtcccagaaa

SEQ ID NO: 37561 - DNA, 25 bp, Rattus norvegicus
aagatgccatgtcttccctaaagca

SEQ ID NO: 37562 - DNA, 25 bp, Rattus norvegicus
aagatgccatgtgttccctaaagca

SEQ ID NO: 37563 - DNA, 25 bp, Rattus norvegicus
aagatgcccagcatcagatctacac

SEQ ID NO: 37564 - DNA, 25 bp, Rattus norvegicus
aagatgcccagcttcagatctacac

SEQ ID NO: 37565 - DNA, 25 bp, Rattus norvegicus
aagatgcccaggatttaattccaag

SEQ ID NO: 37566 - DNA, 25 bp, Rattus norvegicus
aagatgcccaggttttaattccaag

SEQ ID NO: 37567 - DNA, 25 bp, Rattus norvegicus
aagatgcccattcaggtgtccccga

SEQ ID NO: 37568 - DNA, 25 bp, Rattus norvegicus
aagatgcccattgaggtgtccccga

SEQ ID NO: 37569 - DNA, 25 bp, Rattus norvegicus
aagatgccccgtatgattgctaagg

SEQ ID NO: 37570 - DNA, 25 bp, Rattus norvegicus
aagatgccccgtttgattgctaagg

SEQ ID NO: 37571 - DNA, 25 bp, Rattus norvegicus
aagatgcccctgaaagctgaccttt

SEQ ID NO: 37572 - DNA, 25 bp, Rattus norvegicus
aagatgcccctgtaagctgaccttt

SEQ ID NO: 37573 - DNA, 25 bp, Rattus norvegicus
aagatgccctgtaggatgtagcctc

SEQ ID NO: 37574 - DNA, 25 bp, Rattus norvegicus
aagatgccctgttggatgtagcctc

SEQ ID NO: 37575 - DNA, 25 bp, Rattus norvegicus
aagatgccgatgcaaggagccttcc

SEQ ID NO: 37576 - DNA, 25 bp, Rattus norvegicus
aagatgccgatggaaggagccttcc

SEQ ID NO: 37577 - DNA, 25 bp, Rattus norvegicus
aagatgcctcctaggcttgcctgga

SEQ ID NO: 37578 - DNA, 25 bp, Rattus norvegicus
aagatgcctccttggcttgcctgga

SEQ ID NO: 37579 - DNA, 25 bp, Rattus norvegicus
aagatgcctctcagtgttacgacgc

SEQ ID NO: 37580 - DNA, 25 bp, Rattus norvegicus
aagatgcctctctgtgttacgacgc

SEQ ID NO: 37581 - DNA, 25 bp, Rattus norvegicus
aagatgcctgagacagccacgtgca

SEQ ID NO: 37582 - DNA, 25 bp, Rattus norvegicus
aagatgcctgagtcagccacgtgca

SEQ ID NO: 37583 - DNA, 25 bp, Rattus norvegicus
aagatgccttagagttgcttcgccc

SEQ ID NO: 37584 - DNA, 25 bp, Rattus norvegicus
aagatgccttagtgttgcttcgccc

SEQ ID NO: 37585 - DNA, 25 bp, Rattus norvegicus
aagatgccttggacggaagtgcttt

SEQ ID NO: 37586 - DNA, 25 bp, Rattus norvegicus
aagatgccttggtcggaagtgcttt

SEQ ID NO: 37587 - DNA, 25 bp, Rattus norvegicus
aagatgcctttgacgatgcgcttct

SEQ ID NO: 37588 - DNA, 25 bp, Rattus norvegicus
aagatgcctttgtcgatgcgcttct

SEQ ID NO: 37589 - DNA, 25 bp, Rattus norvegicus
aagatgcgacagaacccagggtctt

SEQ ID NO: 37590 - DNA, 25 bp, Rattus norvegicus
aagatgcgacagtacccagggtctt

SEQ ID NO: 37591 - DNA, 25 bp, Rattus norvegicus
aagatgcgcaggctgatcacccgag

SEQ ID NO: 37592 - DNA, 25 bp, Rattus norvegicus
aagatgcgcagggtgatcacccgag

SEQ ID NO: 37593 - DNA, 25 bp, Rattus norvegicus
aagatgcgcccaccgatgtatttta

SEQ ID NO: 37594 - DNA, 25 bp, Rattus norvegicus
aagatgcgcccagcgatgtatttta

SEQ ID NO: 37595 - DNA, 25 bp, Rattus norvegicus
aagatgcgcgccatcctggtattta

SEQ ID NO: 37596 - DNA, 25 bp, Rattus norvegicus
aagatgcgcgccttcctggtattta

SEQ ID NO: 37597 - DNA, 25 bp, Rattus norvegicus
aagatgcggcccacggcttctgtta

SEQ ID NO: 37598 - DNA, 25 bp, Rattus norvegicus
aagatgcggccctcggcttctgtta

SEQ ID NO: 37599 - DNA, 25 bp, Rattus norvegicus
aagatgcggtagcaattggagccct

SEQ ID NO: 37600 - DNA, 25 bp, Rattus norvegicus
aagatgcggtaggaattggagccct

SEQ ID NO: 37601 - DNA, 25 bp, Rattus norvegicus
aagatgcgtatactcgtgactgcgt

SEQ ID NO: 37602 - DNA, 25 bp, Rattus norvegicus
aagatgcgtatagtcgtgactgcgt

SEQ ID NO: 37603 - DNA, 25 bp, Rattus norvegicus
aagatgcgtgtaagtttcccgtgtc

SEQ ID NO: 37604 - DNA, 25 bp, Rattus norvegicus
aagatgcgtgtatgtttcccgtgtc

SEQ ID NO: 37605 - DNA, 25 bp, Rattus norvegicus
aagatgctacagctcttttaaaagc

SEQ ID NO: 37606 - DNA, 25 bp, Rattus norvegicus
aagatgctacaggtcttttaaaagc

SEQ ID NO: 37607 - DNA, 25 bp, Rattus norvegicus
aagatgctaggactggccctaccca

SEQ ID NO: 37608 - DNA, 25 bp, Rattus norvegicus
aagatgctaggagtggccctaccca

SEQ ID NO: 37609 - DNA, 25 bp, Rattus norvegicus
aagatgctaggcactccaggctggg

SEQ ID NO: 37610 - DNA, 25 bp, Rattus norvegicus
aagatgctaggctctccaggctggg

SEQ ID NO: 37611 - DNA, 25 bp, Rattus norvegicus
aagatgctattcctgtccttgtgat

SEQ ID NO: 37612 - DNA, 25 bp, Rattus norvegicus
aagatgctattcgtgtccttgtgat

SEQ ID NO: 37613 - DNA, 25 bp, Rattus norvegicus
aagatgctcagcatcagagactcag

SEQ ID NO: 37614 - DNA, 25 bp, Rattus norvegicus
aagatgctcagcttcagagactcag

SEQ ID NO: 37615 - DNA, 25 bp, Rattus norvegicus
aagatgctcatcctgtaaactggaa

SEQ ID NO: 37616 - DNA, 25 bp, Rattus norvegicus
aagatgctcatcgtgtaaactggaa

SEQ ID NO: 37617 - DNA, 25 bp, Rattus norvegicus
aagatgctcctgattgctttcgcaa

SEQ ID NO: 37618 - DNA, 25 bp, Rattus norvegicus
aagatgctcctgtttgctttcgcaa

SEQ ID NO: 37619 - DNA, 25 bp, Rattus norvegicus
aagatgctcttgcttggtgtgcaga

SEQ ID NO: 37620 - DNA, 25 bp, Rattus norvegicus
aagatgctcttggttggtgtgcaga

SEQ ID NO: 37621 - DNA, 25 bp, Rattus norvegicus
aagatgctgacccaaagtatgaaga

SEQ ID NO: 37622 - DNA, 25 bp, Rattus norvegicus
aagatgctgaccgaaagtatgaaga

SEQ ID NO: 37623 - DNA, 25 bp, Rattus norvegicus
aagatgctgattatgacactcactg

SEQ ID NO: 37624 - DNA, 25 bp, Rattus norvegicus
aagatgctgattttgacactcactg

SEQ ID NO: 37625 - DNA, 25 bp, Rattus norvegicus
aagatgctgcaaatcgtgctgcctg

SEQ ID NO: 37626 - DNA, 25 bp, Rattus norvegicus
aagatgctgcaattcgtgctgcctg

SEQ ID NO: 37627 - DNA, 25 bp, Rattus norvegicus
aagatgctgcatactcaactgacta

SEQ ID NO: 37628 - DNA, 25 bp, Rattus norvegicus
aagatgctgcattctcaactgacta

SEQ ID NO: 37629 - DNA, 25 bp, Rattus norvegicus
aagatgctgccgattcaaggaattt

SEQ ID NO: 37630 - DNA, 25 bp, Rattus norvegicus
aagatgctgccgtttcaaggaattt

SEQ ID NO: 37631 - DNA, 25 bp, Rattus norvegicus
aagatgctgcggaatgtgctggccc

SEQ ID NO: 37632 - DNA, 25 bp, Rattus norvegicus
aagatgctgcggtatgtgctggccc

SEQ ID NO: 37633 - DNA, 25 bp, Rattus norvegicus
aagatgctgctgatgccaacaatgg

SEQ ID NO: 37634 - DNA, 25 bp, Rattus norvegicus
aagatgctgctgttgccaacaatgg

SEQ ID NO: 37635 - DNA, 25 bp, Rattus norvegicus
aagatgctgcttagctgaccgaagc

SEQ ID NO: 37636 - DNA, 25 bp, Rattus norvegicus
aagatgctgctttgctgaccgaagc

SEQ ID NO: 37637 - DNA, 25 bp, Rattus norvegicus
aagatgctggctccctggaacggct

SEQ ID NO: 37638 - DNA, 25 bp, Rattus norvegicus
aagatgctggctgcctggaacggct

SEQ ID NO: 37639 - DNA, 25 bp, Rattus norvegicus
aagatgctggtgaccatggctccta

SEQ ID NO: 37640 - DNA, 25 bp, Rattus norvegicus
aagatgctggtgcacttttcctagt

SEQ ID NO: 37641 - DNA, 25 bp, Rattus norvegicus
aagatgctggtggacttttcctagt

SEQ ID NO: 37642 - DNA, 25 bp, Rattus norvegicus
aagatgctggtgtccatggctccta

SEQ ID NO: 37643 - DNA, 25 bp, Rattus norvegicus
aagatgctgtacaccatcactggtg

SEQ ID NO: 37644 - DNA, 25 bp, Rattus norvegicus
aagatgctgtactccatcactggtg

SEQ ID NO: 37645 - DNA, 25 bp, Rattus norvegicus
aagatgcttcatatgtcgtctctga

SEQ ID NO: 37646 - DNA, 25 bp, Rattus norvegicus
aagatgcttcatttgtcgtctctga

SEQ ID NO: 37647 - DNA, 25 bp, Rattus norvegicus
aagatgcttgacctgatgctggacg

SEQ ID NO: 37648 - DNA, 25 bp, Rattus norvegicus
aagatgcttgacgtgatgctggacg

SEQ ID NO: 37649 - DNA, 25 bp, Rattus norvegicus
aagatgcttgttataacccactcgc

SEQ ID NO: 37650 - DNA, 25 bp, Rattus norvegicus
aagatgcttgttttaacccactcgc

SEQ ID NO: 37651 - DNA, 25 bp, Rattus norvegicus
aagatgcttttcatgaggctgccaa

SEQ ID NO: 37652 - DNA, 25 bp, Rattus norvegicus
aagatgcttttcttgaggctgccaa

SEQ ID NO: 37653 - DNA, 25 bp, Rattus norvegicus
aagatggaccttcacgatcctaccc

SEQ ID NO: 37654 - DNA, 25 bp, Rattus norvegicus
aagatggaccttgacgatcctaccc

SEQ ID NO: 37655 - DNA, 25 bp, Rattus norvegicus
aagatggacggcagctggcttctaa

SEQ ID NO: 37656 - DNA, 25 bp, Rattus norvegicus
aagatggacggctgctggcttctaa

SEQ ID NO: 37657 - DNA, 25 bp, Rattus norvegicus
aagatggactgacttctgcgtgaca

SEQ ID NO: 37658 - DNA, 25 bp, Rattus norvegicus
aagatggactgagttctgcgtgaca

SEQ ID NO: 37659 - DNA, 25 bp, Rattus norvegicus
aagatggagcagaaccacgtggcct

SEQ ID NO: 37660 - DNA, 25 bp, Rattus norvegicus
aagatggagcagacggccctgagtc

SEQ ID NO: 37661 - DNA, 25 bp, Rattus norvegicus
aagatggagcagcaccactgacgcc

SEQ ID NO: 37662 - DNA, 25 bp, Rattus norvegicus
aagatggagcaggaccactgacgcc

SEQ ID NO: 37663 - DNA, 25 bp, Rattus norvegicus
aagatggagcagtaccacgtggcct

SEQ ID NO: 37664 - DNA, 25 bp, Rattus norvegicus
aagatggagcagtcggccctgagtc

SEQ ID NO: 37665 - DNA, 25 bp, Rattus norvegicus
aagatggagccccatccagcagagc

SEQ ID NO: 37666 - DNA, 25 bp, Rattus norvegicus
aagatggagcccgatccagcagagc

SEQ ID NO: 37667 - DNA, 25 bp, Rattus norvegicus
aagatggagccgaagggatgccctc

SEQ ID NO: 37668 - DNA, 25 bp, Rattus norvegicus
aagatggagccgtagggatgccctc

SEQ ID NO: 37669 - DNA, 25 bp, Rattus norvegicus
aagatggaggagctctcagctcccc

SEQ ID NO: 37670 - DNA, 25 bp, Rattus norvegicus
aagatggaggaggtctcagctcccc

SEQ ID NO: 37671 - DNA, 25 bp, Rattus norvegicus
aagatggaggctcatgcccgttcca

SEQ ID NO: 37672 - DNA, 25 bp, Rattus norvegicus
aagatggaggctgatgcccgttcca

SEQ ID NO: 37673 - DNA, 25 bp, Rattus norvegicus
aagatggatgcacagcctggctcct

SEQ ID NO: 37674 - DNA, 25 bp, Rattus norvegicus
aagatggatgcagagcctggctcct

SEQ ID NO: 37675 - DNA, 25 bp, Rattus norvegicus
aagatggcagccactgtcttgtaca

SEQ ID NO: 37676 - DNA, 25 bp, Rattus norvegicus
aagatggcagcctctgtcttgtaca

SEQ ID NO: 37677 - DNA, 25 bp, Rattus norvegicus
aagatggcatcgagcggctgaagct

SEQ ID NO: 37678 - DNA, 25 bp, Rattus norvegicus
aagatggcatcgtgcggctgaagct

SEQ ID NO: 37679 - DNA, 25 bp, Rattus norvegicus
aagatggcatctcttgccgctccgt

SEQ ID NO: 37680 - DNA, 25 bp, Rattus norvegicus
aagatggcatctgttgccgctccgt

SEQ ID NO: 37681 - DNA, 25 bp, Rattus norvegicus
aagatggcattcctcacagcatttg

SEQ ID NO: 37682 - DNA, 25 bp, Rattus norvegicus
aagatggcattcgtcacagcatttg

SEQ ID NO: 37683 - DNA, 25 bp, Rattus norvegicus
aagatggcccatcagttgacttcgt

SEQ ID NO: 37684 - DNA, 25 bp, Rattus norvegicus
aagatggcccatgagttgacttcgt

SEQ ID NO: 37685 - DNA, 25 bp, Rattus norvegicus
aagatggccgccaacagaaactaga

SEQ ID NO: 37686 - DNA, 25 bp, Rattus norvegicus
aagatggccgcctacagaaactaga

SEQ ID NO: 37687 - DNA, 25 bp, Rattus norvegicus
aagatggcctgacaacctggccttc

SEQ ID NO: 37688 - DNA, 25 bp, Rattus norvegicus
aagatggcctgagaacctggccttc

SEQ ID NO: 37689 - DNA, 25 bp, Rattus norvegicus
aagatggcgcccattgcttgtcctc

SEQ ID NO: 37690 - DNA, 25 bp, Rattus norvegicus
aagatggcgccctttgcttgtcctc

SEQ ID NO: 37691 - DNA, 25 bp, Rattus norvegicus
aagatggcgtcaacctcaggcgagg

SEQ ID NO: 37692 - DNA, 25 bp, Rattus norvegicus
aagatggcgtcatcctcaggcgagg

SEQ ID NO: 37693 - DNA, 25 bp, Rattus norvegicus
aagatggctaccaccttaccttact

SEQ ID NO: 37694 - DNA, 25 bp, Rattus norvegicus
aagatggctacctccttaccttact

SEQ ID NO: 37695 - DNA, 25 bp, Rattus norvegicus
aagatggctccaagaggacaggcaa

SEQ ID NO: 37696 - DNA, 25 bp, Rattus norvegicus
aagatggctccatgaggacaggcaa

SEQ ID NO: 37697 - DNA, 25 bp, Rattus norvegicus
aagatggctcccagttggttattca

SEQ ID NO: 37698 - DNA, 25 bp, Rattus norvegicus
aagatggctccctgttggttattca

SEQ ID NO: 37699 - DNA, 25 bp, Rattus norvegicus
aagatggctgctcagttcgacacct

SEQ ID NO: 37700 - DNA, 25 bp, Rattus norvegicus
aagatggctgctgagttcgacacct

SEQ ID NO: 37701 - DNA, 25 bp, Rattus norvegicus
aagatggctgggagagccttcgtaa

SEQ ID NO: 37702 - DNA, 25 bp, Rattus norvegicus
aagatggctgggtgagccttcgtaa

SEQ ID NO: 37703 - DNA, 25 bp, Rattus norvegicus
aagatggctgtcctctctaaggaat

SEQ ID NO: 37704 - DNA, 25 bp, Rattus norvegicus
aagatggctgtcgtctctaaggaat

SEQ ID NO: 37705 - DNA, 25 bp, Rattus norvegicus
aagatggcttagcacatgcctgcca

SEQ ID NO: 37706 - DNA, 25 bp, Rattus norvegicus
aagatggcttaggacatgcctgcca

SEQ ID NO: 37707 - DNA, 25 bp, Rattus norvegicus
aagatggcttcaccaccatcctgca

SEQ ID NO: 37708 - DNA, 25 bp, Rattus norvegicus
aagatggcttcagcaccatcctgca

SEQ ID NO: 37709 - DNA, 25 bp, Rattus norvegicus
aagatggcttccagatacccgtgtt

SEQ ID NO: 37710 - DNA, 25 bp, Rattus norvegicus
aagatggcttccatgcaatgttggc

SEQ ID NO: 37711 - DNA, 25 bp, Rattus norvegicus
aagatggcttcctgatacccgtgtt

SEQ ID NO: 37712 - DNA, 25 bp, Rattus norvegicus
aagatggcttccttgcaatgttggc

SEQ ID NO: 37713 - DNA, 25 bp, Rattus norvegicus
aagatggcttctattacctgtacgc

SEQ ID NO: 37714 - DNA, 25 bp, Rattus norvegicus
aagatggcttcttttacctgtacgc

SEQ ID NO: 37715 - DNA, 25 bp, Rattus norvegicus
aagatgggaagcagccccaaggaat

SEQ ID NO: 37716 - DNA, 25 bp, Rattus norvegicus
aagatgggaagctgccccaaggaat

SEQ ID NO: 37717 - DNA, 25 bp, Rattus norvegicus
aagatgggagtcatgagttgtctca

SEQ ID NO: 37718 - DNA, 25 bp, Rattus norvegicus
aagatgggagtcttgagttgtctca

SEQ ID NO: 37719 - DNA, 25 bp, Rattus norvegicus
aagatgggatgcacccttcctagtc

SEQ ID NO: 37720 - DNA, 25 bp, Rattus norvegicus
aagatgggatgctcccttcctagtc

SEQ ID NO: 37721 - DNA, 25 bp, Rattus norvegicus
aagatgggcagcacgcagtttcatt

SEQ ID NO: 37722 - DNA, 25 bp, Rattus norvegicus
aagatgggcagctcgcagtttcatt

SEQ ID NO: 37723 - DNA, 25 bp, Rattus norvegicus
aagatgggccgcatcggcgcagacc

SEQ ID NO: 37724 - DNA, 25 bp, Rattus norvegicus
aagatgggccgcttcggcgcagacc

SEQ ID NO: 37725 - DNA, 25 bp, Rattus norvegicus
aagatgggcgacactttgggaccaa

SEQ ID NO: 37726 - DNA, 25 bp, Rattus norvegicus
aagatgggcgactctttgggaccaa

SEQ ID NO: 37727 - DNA, 25 bp, Rattus norvegicus
aagatgggctcactacgagttcaag

SEQ ID NO: 37728 - DNA, 25 bp, Rattus norvegicus
aagatgggctcagtacgagttcaag

SEQ ID NO: 37729 - DNA, 25 bp, Rattus norvegicus
aagatgggctccagtcacctaatga

SEQ ID NO: 37730 - DNA, 25 bp, Rattus norvegicus
aagatgggctcctgtcacctaatga

SEQ ID NO: 37731 - DNA, 25 bp, Rattus norvegicus
aagatgggctgacgcttcctgctgc

SEQ ID NO: 37732 - DNA, 25 bp, Rattus norvegicus
aagatgggctgaggcttcctgctgc

SEQ ID NO: 37733 - DNA, 25 bp, Rattus norvegicus
aagatgggtaacacgcacctggcgt

SEQ ID NO: 37734 - DNA, 25 bp, Rattus norvegicus
aagatgggtaactcgcacctggcgt

SEQ ID NO: 37735 - DNA, 25 bp, Rattus norvegicus
aagatgggtgacactggtctttccc

SEQ ID NO: 37736 - DNA, 25 bp, Rattus norvegicus
aagatgggtgactctggtctttccc

SEQ ID NO: 37737 - DNA, 25 bp, Rattus norvegicus
aagatgggtgcccatcacgtgacct

SEQ ID NO: 37738 - DNA, 25 bp, Rattus norvegicus
aagatgggtgccgatcacgtgacct

SEQ ID NO: 37739 - DNA, 25 bp, Rattus norvegicus
aagatgggttagagcctccatgtgg

SEQ ID NO: 37740 - DNA, 25 bp, Rattus norvegicus
aagatgggttagtgcctccatgtgg

SEQ ID NO: 37741 - DNA, 25 bp, Rattus norvegicus
aagatggtaaccagcacgtgaccca

SEQ ID NO: 37742 - DNA, 25 bp, Rattus norvegicus
aagatggtaacctgcacgtgaccca

SEQ ID NO: 37743 - DNA, 25 bp, Rattus norvegicus
aagatggtcatgaccgtgtttgcct

SEQ ID NO: 37744 - DNA, 25 bp, Rattus norvegicus
aagatggtcatgcttctggcggcca

SEQ ID NO: 37745 - DNA, 25 bp, Rattus norvegicus
aagatggtcatggttctggcggcca

SEQ ID NO: 37746 - DNA, 25 bp, Rattus norvegicus
aagatggtcatgtccgtgtttgcct

SEQ ID NO: 37747 - DNA, 25 bp, Rattus norvegicus
aagatggtcattatgccctgtagat

SEQ ID NO: 37748 - DNA, 25 bp, Rattus norvegicus
aagatggtcattttgccctgtagat

SEQ ID NO: 37749 - DNA, 25 bp, Rattus norvegicus
aagatggtctttccgctcatcatga

SEQ ID NO: 37750 - DNA, 25 bp, Rattus norvegicus
aagatggtctttgcgctcatcatga

SEQ ID NO: 37751 - DNA, 25 bp, Rattus norvegicus
aagatggtgaaaagggcccctgccg

SEQ ID NO: 37752 - DNA, 25 bp, Rattus norvegicus
aagatggtgaaatgggcccctgccg

SEQ ID NO: 37753 - DNA, 25 bp, Rattus norvegicus
aagatggtgaagatcgtgtgccctt

SEQ ID NO: 37754 - DNA, 25 bp, Rattus norvegicus
aagatggtgaagttcgtgtgccctt

SEQ ID NO: 37755 - DNA, 25 bp, Rattus norvegicus
aagatggtgacaagcttacaaagct

SEQ ID NO: 37756 - DNA, 25 bp, Rattus norvegicus
aagatggtgacatgcttacaaagct

SEQ ID NO: 37757 - DNA, 25 bp, Rattus norvegicus
aagatggtgaccagacctgcttctt

SEQ ID NO: 37758 - DNA, 25 bp, Rattus norvegicus
aagatggtgacctgacctgcttctt

SEQ ID NO: 37759 - DNA, 25 bp, Rattus norvegicus
aagatggtgcaacctccatcctagc

SEQ ID NO: 37760 - DNA, 25 bp, Rattus norvegicus
aagatggtgcaagctccatcctagc

SEQ ID NO: 37761 - DNA, 25 bp, Rattus norvegicus
aagatggtgcgcagatctctacggt

SEQ ID NO: 37762 - DNA, 25 bp, Rattus norvegicus
aagatggtgcgctgatctctacggt

SEQ ID NO: 37763 - DNA, 25 bp, Rattus norvegicus
aagatggtgcttcgtactttctctg

SEQ ID NO: 37764 - DNA, 25 bp, Rattus norvegicus
aagatggtgcttggtactttctctg

SEQ ID NO: 37765 - DNA, 25 bp, Rattus norvegicus
aagatggtggctctcagactgaccc

SEQ ID NO: 37766 - DNA, 25 bp, Rattus norvegicus
aagatggtggctgtcagactgaccc

SEQ ID NO: 37767 - DNA, 25 bp, Rattus norvegicus
aagatggtgtcccagagcatcaccc

SEQ ID NO: 37768 - DNA, 25 bp, Rattus norvegicus
aagatggtgtccgagagcatcaccc

SEQ ID NO: 37769 - DNA, 25 bp, Rattus norvegicus
aagatggtgtgtactccctggggcc

SEQ ID NO: 37770 - DNA, 25 bp, Rattus norvegicus
aagatggtgtgttctccctggggcc

SEQ ID NO: 37771 - DNA, 25 bp, Rattus norvegicus
aagatggttacaccttagtttgctg

SEQ ID NO: 37772 - DNA, 25 bp, Rattus norvegicus
aagatggttacagcttagtttgctg

SEQ ID NO: 37773 - DNA, 25 bp, Rattus norvegicus
aagatggtttcaatctcgtgcctct

SEQ ID NO: 37774 - DNA, 25 bp, Rattus norvegicus
aagatggtttcattctcgtgcctct

SEQ ID NO: 37775 - DNA, 25 bp, Rattus norvegicus
aagatggttttgagcttctttcaat

SEQ ID NO: 37776 - DNA, 25 bp, Rattus norvegicus
aagatggttttgtgcttctttcaat

SEQ ID NO: 37777 - DNA, 25 bp, Rattus norvegicus
aagatgtaacccactggaagtcccg

SEQ ID NO: 37778 - DNA, 25 bp, Rattus norvegicus
aagatgtaaccctctggaagtcccg

SEQ ID NO: 37779 - DNA, 25 bp, Rattus norvegicus
aagatgtaccatactttttgacaga

SEQ ID NO: 37780 - DNA, 25 bp, Rattus norvegicus
aagatgtaccattctttttgacaga

SEQ ID NO: 37781 - DNA, 25 bp, Rattus norvegicus
aagatgtagctgctggtgaaccagt

SEQ ID NO: 37782 - DNA, 25 bp, Rattus norvegicus
aagatgtagctggtggtgaaccagt

SEQ ID NO: 37783 - DNA, 25 bp, Rattus norvegicus
aagatgtatggcatcactacctctg

SEQ ID NO: 37784 - DNA, 25 bp, Rattus norvegicus
aagatgtatggcttcactacctctg

SEQ ID NO: 37785 - DNA, 25 bp, Rattus norvegicus
aagatgtattacatgggtgcccagg

SEQ ID NO: 37786 - DNA, 25 bp, Rattus norvegicus
aagatgtattacttgggtgcccagg

SEQ ID NO: 37787 - DNA, 25 bp, Rattus norvegicus
aagatgtattgcccgatgcaatgag

SEQ ID NO: 37788 - DNA, 25 bp, Rattus norvegicus
aagatgtattgcgcgatgcaatgag

SEQ ID NO: 37789 - DNA, 25 bp, Rattus norvegicus
aagatgtattgtagaccctatgcac

SEQ ID NO: 37790 - DNA, 25 bp, Rattus norvegicus
aagatgtattgttgaccctatgcac

SEQ ID NO: 37791 - DNA, 25 bp, Rattus norvegicus
aagatgtcacctctgtgcctatgca

SEQ ID NO: 37792 - DNA, 25 bp, Rattus norvegicus
aagatgtcacctgtgtgcctatgca

SEQ ID NO: 37793 - DNA, 25 bp, Rattus norvegicus
aagatgtcacgtcgtacaggcccgc

SEQ ID NO: 37794 - DNA, 25 bp, Rattus norvegicus
aagatgtcacgtggtacaggcccgc

SEQ ID NO: 37795 - DNA, 25 bp, Rattus norvegicus
aagatgtcagccatgttctggcctc

SEQ ID NO: 37796 - DNA, 25 bp, Rattus norvegicus
aagatgtcagccttgttctggcctc

SEQ ID NO: 37797 - DNA, 25 bp, Rattus norvegicus
aagatgtcaggcacaaaccacttct

SEQ ID NO: 37798 - DNA, 25 bp, Rattus norvegicus
aagatgtcaggctcaaaccacttct

SEQ ID NO: 37799 - DNA, 25 bp, Rattus norvegicus
aagatgtcagtcctggccttgcaga

SEQ ID NO: 37800 - DNA, 25 bp, Rattus norvegicus
aagatgtcagtcgtggccttgcaga

SEQ ID NO: 37801 - DNA, 25 bp, Rattus norvegicus
aagatgtcatctaacctcaggagaa

SEQ ID NO: 37802 - DNA, 25 bp, Rattus norvegicus
aagatgtcatcttacctcaggagaa

SEQ ID NO: 37803 - DNA, 25 bp, Rattus norvegicus
aagatgtcattgctcccttctgttt

SEQ ID NO: 37804 - DNA, 25 bp, Rattus norvegicus
aagatgtcattggtcccttctgttt

SEQ ID NO: 37805 - DNA, 25 bp, Rattus norvegicus
aagatgtcatttacgatatcacaag

SEQ ID NO: 37806 - DNA, 25 bp, Rattus norvegicus
aagatgtcattttcgatatcacaag

SEQ ID NO: 37807 - DNA, 25 bp, Rattus norvegicus
aagatgtccacaagcatgatccccg

SEQ ID NO: 37808 - DNA, 25 bp, Rattus norvegicus
aagatgtccacaattctgtcggttc

SEQ ID NO: 37809 - DNA, 25 bp, Rattus norvegicus
aagatgtccacatgcatgatccccg

SEQ ID NO: 37810 - DNA, 25 bp, Rattus norvegicus
aagatgtccacatttctgtcggttc

SEQ ID NO: 37811 - DNA, 25 bp, Rattus norvegicus
aagatgtccatccacgatctctact

SEQ ID NO: 37812 - DNA, 25 bp, Rattus norvegicus
aagatgtccatcgacgatctctact

SEQ ID NO: 37813 - DNA, 25 bp, Rattus norvegicus
aagatgtccccgacagagacaggag

SEQ ID NO: 37814 - DNA, 25 bp, Rattus norvegicus
aagatgtccccgtcagagacaggag

SEQ ID NO: 37815 - DNA, 25 bp, Rattus norvegicus
aagatgtcctctaggattctaagat

SEQ ID NO: 37816 - DNA, 25 bp, Rattus norvegicus
aagatgtcctctcagcctagggatg

SEQ ID NO: 37817 - DNA, 25 bp, Rattus norvegicus
aagatgtcctctgagcctagggatg

SEQ ID NO: 37818 - DNA, 25 bp, Rattus norvegicus
aagatgtcctcttggattctaagat

SEQ ID NO: 37819 - DNA, 25 bp, Rattus norvegicus
aagatgtcctttagcaacaccgaga

SEQ ID NO: 37820 - DNA, 25 bp, Rattus norvegicus
aagatgtccttttgcaacaccgaga

SEQ ID NO: 37821 - DNA, 25 bp, Rattus norvegicus
aagatgtcgtcaagttttccctttt

SEQ ID NO: 37822 - DNA, 25 bp, Rattus norvegicus
aagatgtcgtcatgttttccctttt

SEQ ID NO: 37823 - DNA, 25 bp, Rattus norvegicus
aagatgtcgtctaacagggctttgg

SEQ ID NO: 37824 - DNA, 25 bp, Rattus norvegicus
aagatgtcgtcttacagggctttgg

SEQ ID NO: 37825 - DNA, 25 bp, Rattus norvegicus
aagatgtctagtcctgccattcagt

SEQ ID NO: 37826 - DNA, 25 bp, Rattus norvegicus
aagatgtctagtgctgccattcagt

SEQ ID NO: 37827 - DNA, 25 bp, Rattus norvegicus
aagatgtctattaccataacccagg

SEQ ID NO: 37828 - DNA, 25 bp, Rattus norvegicus
aagatgtctatttccataacccagg

SEQ ID NO: 37829 - DNA, 25 bp, Rattus norvegicus
aagatgtctctccttcttgagtacc

SEQ ID NO: 37830 - DNA, 25 bp, Rattus norvegicus
aagatgtctctcgttcttgagtacc

SEQ ID NO: 37831 - DNA, 25 bp, Rattus norvegicus
aagatgtctctgcaggacctgcact

SEQ ID NO: 37832 - DNA, 25 bp, Rattus norvegicus
aagatgtctctggaggacctgcact

SEQ ID NO: 37833 - DNA, 25 bp, Rattus norvegicus
aagatgtctgatatgtgtctatgct

SEQ ID NO: 37834 - DNA, 25 bp, Rattus norvegicus
aagatgtctgatttgtgtctatgct

SEQ ID NO: 37835 - DNA, 25 bp, Rattus norvegicus
aagatgtcttgcacccacaaatatg

SEQ ID NO: 37836 - DNA, 25 bp, Rattus norvegicus
aagatgtcttgctcccacaaatatg

SEQ ID NO: 37837 - DNA, 25 bp, Rattus norvegicus
aagatgtctttaattttcagtgcac

SEQ ID NO: 37838 - DNA, 25 bp, Rattus norvegicus
aagatgtctttatttttcagtgcac

SEQ ID NO: 37839 - DNA, 25 bp, Rattus norvegicus
aagatgtgaccactgcaggaccctc

SEQ ID NO: 37840 - DNA, 25 bp, Rattus norvegicus
aagatgtgaccagtgcaggaccctc

SEQ ID NO: 37841 - DNA, 25 bp, Rattus norvegicus
aagatgtgagttcccaccttctgtt

SEQ ID NO: 37842 - DNA, 25 bp, Rattus norvegicus
aagatgtgagttgccaccttctgtt

SEQ ID NO: 37843 - DNA, 25 bp, Rattus norvegicus
aagatgtgccggaccctggaggacc

SEQ ID NO: 37844 - DNA, 25 bp, Rattus norvegicus
aagatgtgccggtccctggaggacc

SEQ ID NO: 37845 - DNA, 25 bp, Rattus norvegicus
aagatgtgcctgaacccagctagtc

SEQ ID NO: 37846 - DNA, 25 bp, Rattus norvegicus
aagatgtgcctgtacccagctagtc

SEQ ID NO: 37847 - DNA, 25 bp, Rattus norvegicus
aagatgtgccttatgtttctttgtt

SEQ ID NO: 37848 - DNA, 25 bp, Rattus norvegicus
aagatgtgccttttgtttctttgtt

SEQ ID NO: 37849 - DNA, 25 bp, Rattus norvegicus
aagatgtgcgggattctgtgtcttt

SEQ ID NO: 37850 - DNA, 25 bp, Rattus norvegicus
aagatgtgcgggtttctgtgtcttt

SEQ ID NO: 37851 - DNA, 25 bp, Rattus norvegicus
aagatgtggagcactgcccgtccga

SEQ ID NO: 37852 - DNA, 25 bp, Rattus norvegicus
aagatgtggagctctgcccgtccga

SEQ ID NO: 37853 - DNA, 25 bp, Rattus norvegicus
aagatgtgggccctgcatcagctgc

SEQ ID NO: 37854 - DNA, 25 bp, Rattus norvegicus
aagatgtgggccgtgcatcagctgc

SEQ ID NO: 37855 - DNA, 25 bp, Rattus norvegicus
aagatgtgtaccacatgcccagcaa

SEQ ID NO: 37856 - DNA, 25 bp, Rattus norvegicus
aagatgtgtacctcatgcccagcaa

SEQ ID NO: 37857 - DNA, 25 bp, Rattus norvegicus
aagatgtgtataatgaccccaggtc

SEQ ID NO: 37858 - DNA, 25 bp, Rattus norvegicus
aagatgtgtatattgaccccaggtc

SEQ ID NO: 37859 - DNA, 25 bp, Rattus norvegicus
aagatgtgtcctctgttgtctacaa

SEQ ID NO: 37860 - DNA, 25 bp, Rattus norvegicus
aagatgtgtcctgtgttgtctacaa

SEQ ID NO: 37861 - DNA, 25 bp, Rattus norvegicus
aagatgtgtttcagctttggattac

SEQ ID NO: 37862 - DNA, 25 bp, Rattus norvegicus
aagatgtgtttctgctttggattac

SEQ ID NO: 37863 - DNA, 25 bp, Rattus norvegicus
aagatgttaattagcctgtttgtta

SEQ ID NO: 37864 - DNA, 25 bp, Rattus norvegicus
aagatgttaatttgcctgtttgtta

SEQ ID NO: 37865 - DNA, 25 bp, Rattus norvegicus
aagatgttagacacttctccgtgag

SEQ ID NO: 37866 - DNA, 25 bp, Rattus norvegicus
aagatgttagactcttctccgtgag

SEQ ID NO: 37867 - DNA, 25 bp, Rattus norvegicus
aagatgttcctgagttatggctgaa

SEQ ID NO: 37868 - DNA, 25 bp, Rattus norvegicus
aagatgttcctgtgttatggctgaa

SEQ ID NO: 37869 - DNA, 25 bp, Rattus norvegicus
aagatgttctccctcaagaagtgga

SEQ ID NO: 37870 - DNA, 25 bp, Rattus norvegicus
aagatgttctccgtcaagaagtgga

SEQ ID NO: 37871 - DNA, 25 bp, Rattus norvegicus
aagatgttgcttctactctacgaga

SEQ ID NO: 37872 - DNA, 25 bp, Rattus norvegicus
aagatgttgcttgtactctacgaga

SEQ ID NO: 37873 - DNA, 25 bp, Rattus norvegicus
aagatgttgggaatgtgcccaccct

SEQ ID NO: 37874 - DNA, 25 bp, Rattus norvegicus
aagatgttgggattgtgcccaccct

SEQ ID NO: 37875 - DNA, 25 bp, Rattus norvegicus
aagatgtttagtatcctgagcttga

SEQ ID NO: 37876 - DNA, 25 bp, Rattus norvegicus
aagatgtttagtttcctgagcttga

SEQ ID NO: 37877 - DNA, 25 bp, Rattus norvegicus
aagatgtttctaatgcctgggagag

SEQ ID NO: 37878 - DNA, 25 bp, Rattus norvegicus
aagatgtttctattgcctgggagag

SEQ ID NO: 37879 - DNA, 25 bp, Rattus norvegicus
aagatgtttgagctcttctgtttgc

SEQ ID NO: 37880 - DNA, 25 bp, Rattus norvegicus
aagatgtttgaggtcttctgtttgc

SEQ ID NO: 37881 - DNA, 25 bp, Rattus norvegicus
aagatgttttccagcttagccattc

SEQ ID NO: 37882 - DNA, 25 bp, Rattus norvegicus
aagatgttttcctgcttagccattc

SEQ ID NO: 37883 - DNA, 25 bp, Rattus norvegicus
aagatgttttgtaaatttgtcgtga

SEQ ID NO: 37884 - DNA, 25 bp, Rattus norvegicus
aagatgttttgttaatttgtcgtga

SEQ ID NO: 37885 - DNA, 25 bp, Rattus norvegicus
aagattaacaggctgcccgaggcct

SEQ ID NO: 37886 - DNA, 25 bp, Rattus norvegicus
aagattaacagggtgcccgaggcct

SEQ ID NO: 37887 - DNA, 25 bp, Rattus norvegicus
aagattaacctgactgtccgaagcc

SEQ ID NO: 37888 - DNA, 25 bp, Rattus norvegicus
aagattaacctgtctgtccgaagcc

SEQ ID NO: 37889 - DNA, 25 bp, Rattus norvegicus
aagattaagcgcagggcactagccc

SEQ ID NO: 37890 - DNA, 25 bp, Rattus norvegicus
aagattaagcgctgggcactagccc

SEQ ID NO: 37891 - DNA, 25 bp, Rattus norvegicus
aagattaagtctatgggccggtaag

SEQ ID NO: 37892 - DNA, 25 bp, Rattus norvegicus
aagattaagtctcgcctcagtggct

SEQ ID NO: 37893 - DNA, 25 bp, Rattus norvegicus
aagattaagtctggcctcagtggct

SEQ ID NO: 37894 - DNA, 25 bp, Rattus norvegicus
aagattaagtctttgggccggtaag

SEQ ID NO: 37895 - DNA, 25 bp, Rattus norvegicus
aagattacacgcagttcatccgact

SEQ ID NO: 37896 - DNA, 25 bp, Rattus norvegicus
aagattacacgctgttcatccgact

SEQ ID NO: 37897 - DNA, 25 bp, Rattus norvegicus
aagattactatcattggacctacaa

SEQ ID NO: 37898 - DNA, 25 bp, Rattus norvegicus
aagattactatctttggacctacaa

SEQ ID NO: 37899 - DNA, 25 bp, Rattus norvegicus
aagattagatttcgcactgtgtaag

SEQ ID NO: 37900 - DNA, 25 bp, Rattus norvegicus
aagattagatttggcactgtgtaag

SEQ ID NO: 37901 - DNA, 25 bp, Rattus norvegicus
aagattagcccacaactattttcag

SEQ ID NO: 37902 - DNA, 25 bp, Rattus norvegicus
aagattagcccagaactattttcag

SEQ ID NO: 37903 - DNA, 25 bp, Rattus norvegicus
aagattaggcgtcctgtgtttctgt

SEQ ID NO: 37904 - DNA, 25 bp, Rattus norvegicus
aagattaggcgtgctgtgtttctgt

SEQ ID NO: 37905 - DNA, 25 bp, Rattus norvegicus
aagattatacaacgctctgcagaag

SEQ ID NO: 37906 - DNA, 25 bp, Rattus norvegicus
aagattatacaaggctctgcagaag

SEQ ID NO: 37907 - DNA, 25 bp, Rattus norvegicus
aagattatatggactgtccacagaa

SEQ ID NO: 37908 - DNA, 25 bp, Rattus norvegicus
aagattatatggtctgtccacagaa

SEQ ID NO: 37909 - DNA, 25 bp, Rattus norvegicus
aagattatcccgagctactgtgcaa

SEQ ID NO: 37910 - DNA, 25 bp, Rattus norvegicus
aagattatcccgctcacaacactgc

SEQ ID NO: 37911 - DNA, 25 bp, Rattus norvegicus
aagattatcccggtcacaacactgc

SEQ ID NO: 37912 - DNA, 25 bp, Rattus norvegicus
aagattatcccgtgctactgtgcaa

SEQ ID NO: 37913 - DNA, 25 bp, Rattus norvegicus
aagattatcctgaattccttcctcc

SEQ ID NO: 37914 - DNA, 25 bp, Rattus norvegicus
aagattatcctgtattccttcctcc

SEQ ID NO: 37915 - DNA, 25 bp, Rattus norvegicus
aagattatcttgatgcctacctccc

SEQ ID NO: 37916 - DNA, 25 bp, Rattus norvegicus
aagattatcttgttgcctacctccc

SEQ ID NO: 37917 - DNA, 25 bp, Rattus norvegicus
aagattatgaccactttccatcctt

SEQ ID NO: 37918 - DNA, 25 bp, Rattus norvegicus
aagattatgacctctttccatcctt

SEQ ID NO: 37919 - DNA, 25 bp, Rattus norvegicus
aagattatgagtaggtgaccacctt

SEQ ID NO: 37920 - DNA, 25 bp, Rattus norvegicus
aagattatgagttggtgaccacctt

SEQ ID NO: 37921 - DNA, 25 bp, Rattus norvegicus
aagattatgccaattctgtggaata

SEQ ID NO: 37922 - DNA, 25 bp, Rattus norvegicus
aagattatgccatttctgtggaata

SEQ ID NO: 37923 - DNA, 25 bp, Rattus norvegicus
aagattatttgcaacagacctgaga

SEQ ID NO: 37924 - DNA, 25 bp, Rattus norvegicus
aagattatttgctacagacctgaga

SEQ ID NO: 37925 - DNA, 25 bp, Rattus norvegicus
aagattcaacccagttgtggtctca

SEQ ID NO: 37926 - DNA, 25 bp, Rattus norvegicus
aagattcaaccctgttgtggtctca

SEQ ID NO: 37927 - DNA, 25 bp, Rattus norvegicus
aagattcaagataccattctttgga

SEQ ID NO: 37928 - DNA, 25 bp, Rattus norvegicus
aagattcaagattccattctttgga

SEQ ID NO: 37929 - DNA, 25 bp, Rattus norvegicus
aagattcacagcatccagcattttg

SEQ ID NO: 37930 - DNA, 25 bp, Rattus norvegicus
aagattcacagcttccagcattttg

SEQ ID NO: 37931 - DNA, 25 bp, Rattus norvegicus
aagattcagaccctcaaactggcgg

SEQ ID NO: 37932 - DNA, 25 bp, Rattus norvegicus
aagattcagaccgtcaaactggcgg

SEQ ID NO: 37933 - DNA, 25 bp, Rattus norvegicus
aagattcagcgtcttgttactcccc

SEQ ID NO: 37934 - DNA, 25 bp, Rattus norvegicus
aagattcagcgtgttgttactcccc

SEQ ID NO: 37935 - DNA, 25 bp, Rattus norvegicus
aagattcaggcaagttgccctcacg

SEQ ID NO: 37936 - DNA, 25 bp, Rattus norvegicus
aagattcaggcatgttgccctcacg

SEQ ID NO: 37937 - DNA, 25 bp, Rattus norvegicus
aagattcatcagaatactccagaga

SEQ ID NO: 37938 - DNA, 25 bp, Rattus norvegicus
aagattcatcagtatactccagaga

SEQ ID NO: 37939 - DNA, 25 bp, Rattus norvegicus
aagattcatccaaagagcgatagca

SEQ ID NO: 37940 - DNA, 25 bp, Rattus norvegicus
aagattcatccatagagcgatagca

SEQ ID NO: 37941 - DNA, 25 bp, Rattus norvegicus
aagattcatttaaaccaccagggag

SEQ ID NO: 37942 - DNA, 25 bp, Rattus norvegicus
aagattcatttataccaccagggag

SEQ ID NO: 37943 - DNA, 25 bp, Rattus norvegicus
aagattccacagaagctgctgtcct

SEQ ID NO: 37944 - DNA, 25 bp, Rattus norvegicus
aagattccacagtagctgctgtcct

SEQ ID NO: 37945 - DNA, 25 bp, Rattus norvegicus
aagattccagatcagctctctgcat

SEQ ID NO: 37946 - DNA, 25 bp, Rattus norvegicus
aagattccagatgagctctctgcat

SEQ ID NO: 37947 - DNA, 25 bp, Rattus norvegicus
aagattccaggtactgcgtgtgcaa

SEQ ID NO: 37948 - DNA, 25 bp, Rattus norvegicus
aagattccaggttctgcgtgtgcaa

SEQ ID NO: 37949 - DNA, 25 bp, Rattus norvegicus
aagattccagtgatcgagcatttga

SEQ ID NO: 37950 - DNA, 25 bp, Rattus norvegicus
aagattccagtgttcgagcatttga

SEQ ID NO: 37951 - DNA, 25 bp, Rattus norvegicus
aagattcccacactcaactgcaggt

SEQ ID NO: 37952 - DNA, 25 bp, Rattus norvegicus
aagattcccacagtcaactgcaggt

SEQ ID NO: 37953 - DNA, 25 bp, Rattus norvegicus
aagattcccctaaagctggagctag

SEQ ID NO: 37954 - DNA, 25 bp, Rattus norvegicus
aagattcccctatagctggagctag

SEQ ID NO: 37955 - DNA, 25 bp, Rattus norvegicus
aagattccctcaatcaattactcac

SEQ ID NO: 37956 - DNA, 25 bp, Rattus norvegicus
aagattccctcattcaattactcac

SEQ ID NO: 37957 - DNA, 25 bp, Rattus norvegicus
aagattccctcccagaagtgtgcac

SEQ ID NO: 37958 - DNA, 25 bp, Rattus norvegicus
aagattccctccgagaagtgtgcac

SEQ ID NO: 37959 - DNA, 25 bp, Rattus norvegicus
aagattccctgcactgctttatgta

SEQ ID NO: 37960 - DNA, 25 bp, Rattus norvegicus
aagattccctgctctgctttatgta

SEQ ID NO: 37961 - DNA, 25 bp, Rattus norvegicus
aagattcccttgactgtctatccta

SEQ ID NO: 37962 - DNA, 25 bp, Rattus norvegicus
aagattcccttgtctgtctatccta

SEQ ID NO: 37963 - DNA, 25 bp, Rattus norvegicus
aagattccggttccttatccgtgga

SEQ ID NO: 37964 - DNA, 25 bp, Rattus norvegicus
aagattccggttgcttatccgtgga

SEQ ID NO: 37965 - DNA, 25 bp, Rattus norvegicus
aagattccttccactaggatgttac

SEQ ID NO: 37966 - DNA, 25 bp, Rattus norvegicus
aagattccttcctctaggatgttac

SEQ ID NO: 37967 - DNA, 25 bp, Rattus norvegicus
aagattccttggagttgctgagcag

SEQ ID NO: 37968 - DNA, 25 bp, Rattus norvegicus
aagattccttggtgttgctgagcag

SEQ ID NO: 37969 - DNA, 25 bp, Rattus norvegicus
aagattcgagatctcaccaagtgtc

SEQ ID NO: 37970 - DNA, 25 bp, Rattus norvegicus
aagattcgagatgtcaccaagtgtc

SEQ ID NO: 37971 - DNA, 25 bp, Rattus norvegicus
aagattcgtctcaactatgaacaac

SEQ ID NO: 37972 - DNA, 25 bp, Rattus norvegicus
aagattcgtctctactatgaacaac

SEQ ID NO: 37973 - DNA, 25 bp, Rattus norvegicus
aagattctcagacctccatgtgttt

SEQ ID NO: 37974 - DNA, 25 bp, Rattus norvegicus
aagattctcagagctccatgtgttt

SEQ ID NO: 37975 - DNA, 25 bp, Rattus norvegicus
aagattctcatcatgcaagcctgca

SEQ ID NO: 37976 - DNA, 25 bp, Rattus norvegicus
aagattctcatcttgcaagcctgca

SEQ ID NO: 37977 - DNA, 25 bp, Rattus norvegicus
aagattctccaaacgtttctaaaga

SEQ ID NO: 37978 - DNA, 25 bp, Rattus norvegicus
aagattctccaatcgtttctaaaga

SEQ ID NO: 37979 - DNA, 25 bp, Rattus norvegicus
aagattctccatcactgggtaccag

SEQ ID NO: 37980 - DNA, 25 bp, Rattus norvegicus
aagattctccatgactgggtaccag

SEQ ID NO: 37981 - DNA, 25 bp, Rattus norvegicus
aagattctcgctaatggactataaa

SEQ ID NO: 37982 - DNA, 25 bp, Rattus norvegicus
aagattctcgcttatggactataaa

SEQ ID NO: 37983 - DNA, 25 bp, Rattus norvegicus
aagattctcttgacctcacagttac

SEQ ID NO: 37984 - DNA, 25 bp, Rattus norvegicus
aagattctcttgtcctcacagttac

SEQ ID NO: 37985 - DNA, 25 bp, Rattus norvegicus
aagattctgcacagagctttgctca

SEQ ID NO: 37986 - DNA, 25 bp, Rattus norvegicus
aagattctgcactgagctttgctca

SEQ ID NO: 37987 - DNA, 25 bp, Rattus norvegicus
aagattctgcccatcatgtttccat

SEQ ID NO: 37988 - DNA, 25 bp, Rattus norvegicus
aagattctgcccatgtttagcctgc

SEQ ID NO: 37989 - DNA, 25 bp, Rattus norvegicus
aagattctgcccttcatgtttccat

SEQ ID NO: 37990 - DNA, 25 bp, Rattus norvegicus
aagattctgcccttgtttagcctgc

SEQ ID NO: 37991 - DNA, 25 bp, Rattus norvegicus
aagattctgcttctagttgctgctg

SEQ ID NO: 37992 - DNA, 25 bp, Rattus norvegicus
aagattctgcttgtagttgctgctg

SEQ ID NO: 37993 - DNA, 25 bp, Rattus norvegicus
aagattctggccagctttcgcgaga

SEQ ID NO: 37994 - DNA, 25 bp, Rattus norvegicus
aagattctggcctgctttcgcgaga

SEQ ID NO: 37995 - DNA, 25 bp, Rattus norvegicus
aagattctggctaggtttccctctc

SEQ ID NO: 37996 - DNA, 25 bp, Rattus norvegicus
aagattctggcttggtttccctctc

SEQ ID NO: 37997 - DNA, 25 bp, Rattus norvegicus
aagattctggtcattgatgccttct

SEQ ID NO: 37998 - DNA, 25 bp, Rattus norvegicus
aagattctggtctttgatgccttct

SEQ ID NO: 37999 - DNA, 25 bp, Rattus norvegicus
aagattcttcatctcttgctcagcc

SEQ ID NO: 38000 - DNA, 25 bp, Rattus norvegicus
aagattcttcatcttctagtatgta

SEQ ID NO: 38001 - DNA, 25 bp, Rattus norvegicus
aagattcttcatgtcttgctcagcc

SEQ ID NO: 38002 - DNA, 25 bp, Rattus norvegicus
aagattcttcatgttctagtatgta

SEQ ID NO: 38003 - DNA, 25 bp, Rattus norvegicus
aagattcttgaactgtcccctgatc

SEQ ID NO: 38004 - DNA, 25 bp, Rattus norvegicus
aagattcttgaagtgtcccctgatc

SEQ ID NO: 38005 - DNA, 25 bp, Rattus norvegicus
aagattcttgccagtgtaaaacaca

SEQ ID NO: 38006 - DNA, 25 bp, Rattus norvegicus
aagattcttgcctgtgtaaaacaca

SEQ ID NO: 38007 - DNA, 25 bp, Rattus norvegicus
aagattgaaattagcccctcgccgt

SEQ ID NO: 38008 - DNA, 25 bp, Rattus norvegicus
aagattgaaatttgcccctcgccgt

SEQ ID NO: 38009 - DNA, 25 bp, Rattus norvegicus
aagattgacaggatctgagctccat

SEQ ID NO: 38010 - DNA, 25 bp, Rattus norvegicus
aagattgacaggttctgagctccat

SEQ ID NO: 38011 - DNA, 25 bp, Rattus norvegicus
aagattgacgcaccccgcagagaga

SEQ ID NO: 38012 - DNA, 25 bp, Rattus norvegicus
aagattgacgcagcccgcagagaga

SEQ ID NO: 38013 - DNA, 25 bp, Rattus norvegicus
aagattgaggtcagttatgtaccaa

SEQ ID NO: 38014 - DNA, 25 bp, Rattus norvegicus
aagattgaggtctgttatgtaccaa

SEQ ID NO: 38015 - DNA, 25 bp, Rattus norvegicus
aagattgagttccacattgtagcga

SEQ ID NO: 38016 - DNA, 25 bp, Rattus norvegicus
aagattgagttcgacattgtagcga

SEQ ID NO: 38017 - DNA, 25 bp, Rattus norvegicus
aagattgcaattctcacgtgtccat

SEQ ID NO: 38018 - DNA, 25 bp, Rattus norvegicus
aagattgcaattgtcacgtgtccat

SEQ ID NO: 38019 - DNA, 25 bp, Rattus norvegicus
aagattgccaaactgtaacatgtca

SEQ ID NO: 38020 - DNA, 25 bp, Rattus norvegicus
aagattgccaaagtgtaacatgtca

SEQ ID NO: 38021 - DNA, 25 bp, Rattus norvegicus
aagattgccaagaaccagaggtttc

SEQ ID NO: 38022 - DNA, 25 bp, Rattus norvegicus
aagattgccaagtaccagaggtttc

SEQ ID NO: 38023 - DNA, 25 bp, Rattus norvegicus
aagattgccagtaagctacattgaa

SEQ ID NO: 38024 - DNA, 25 bp, Rattus norvegicus
aagattgccagttagctacattgaa

SEQ ID NO: 38025 - DNA, 25 bp, Rattus norvegicus
aagattgccatcatcttggatcagg

SEQ ID NO: 38026 - DNA, 25 bp, Rattus norvegicus
aagattgccatcttcttggatcagg

SEQ ID NO: 38027 - DNA, 25 bp, Rattus norvegicus
aagattggccccactcattaccagg

SEQ ID NO: 38028 - DNA, 25 bp, Rattus norvegicus
aagattggcccctctcattaccagg

SEQ ID NO: 38029 - DNA, 25 bp, Rattus norvegicus
aagattgggacaaccgtggctgcaa

SEQ ID NO: 38030 - DNA, 25 bp, Rattus norvegicus
aagattgggacatccgtggctgcaa

SEQ ID NO: 38031 - DNA, 25 bp, Rattus norvegicus
aagattgggctaattttcatagctt

SEQ ID NO: 38032 - DNA, 25 bp, Rattus norvegicus
aagattgggctatttttcatagctt

SEQ ID NO: 38033 - DNA, 25 bp, Rattus norvegicus
aagattgggctcagcattccctgca

SEQ ID NO: 38034 - DNA, 25 bp, Rattus norvegicus
aagattgggctctgcattccctgca

SEQ ID NO: 38035 - DNA, 25 bp, Rattus norvegicus
aagattggtcccacagatcggaaca

SEQ ID NO: 38036 - DNA, 25 bp, Rattus norvegicus
aagattggtccctcagatcggaaca

SEQ ID NO: 38037 - DNA, 25 bp, Rattus norvegicus
aagattggtcctccctatgagtcta

SEQ ID NO: 38038 - DNA, 25 bp, Rattus norvegicus
aagattggtcctgcctatgagtcta

SEQ ID NO: 38039 - DNA, 25 bp, Rattus norvegicus
aagattggtgcacgatctcttccct

SEQ ID NO: 38040 - DNA, 25 bp, Rattus norvegicus
aagattggtgcaggatctcttccct

SEQ ID NO: 38041 - DNA, 25 bp, Rattus norvegicus
aagattgtacttagccagttcaaag

SEQ ID NO: 38042 - DNA, 25 bp, Rattus norvegicus
aagattgtactttgccagttcaaag

SEQ ID NO: 38043 - DNA, 25 bp, Rattus norvegicus
aagattgtaggtacgactcctgcct

SEQ ID NO: 38044 - DNA, 25 bp, Rattus norvegicus
aagattgtaggttcgactcctgcct

SEQ ID NO: 38045 - DNA, 25 bp, Rattus norvegicus
aagattgtccaaaccatctcagcac

SEQ ID NO: 38046 - DNA, 25 bp, Rattus norvegicus
aagattgtccaatccatctcagcac

SEQ ID NO: 38047 - DNA, 25 bp, Rattus norvegicus
aagattgtcctgagatggctttcaa

SEQ ID NO: 38048 - DNA, 25 bp, Rattus norvegicus
aagattgtcctgtgatggctttcaa

SEQ ID NO: 38049 - DNA, 25 bp, Rattus norvegicus
aagattgtcttacgagtccttctgg

SEQ ID NO: 38050 - DNA, 25 bp, Rattus norvegicus
aagattgtcttaggagtccttctgg

SEQ ID NO: 38051 - DNA, 25 bp, Rattus norvegicus
aagattgtgccgctgaatacttaca

SEQ ID NO: 38052 - DNA, 25 bp, Rattus norvegicus
aagattgtgccggtgaatacttaca

SEQ ID NO: 38053 - DNA, 25 bp, Rattus norvegicus
aagattgtgctcatctccattgctg

SEQ ID NO: 38054 - DNA, 25 bp, Rattus norvegicus
aagattgtgctcttctccattgctg

SEQ ID NO: 38055 - DNA, 25 bp, Rattus norvegicus
aagattgtgggcactctttgtgcca

SEQ ID NO: 38056 - DNA, 25 bp, Rattus norvegicus
aagattgtgggctctctttgtgcca

SEQ ID NO: 38057 - DNA, 25 bp, Rattus norvegicus
aagattgtggtccagccagcagcat

SEQ ID NO: 38058 - DNA, 25 bp, Rattus norvegicus
aagattgtggtcgagccagcagcat

SEQ ID NO: 38059 - DNA, 25 bp, Rattus norvegicus
aagattgttcataacctaaggcaca

SEQ ID NO: 38060 - DNA, 25 bp, Rattus norvegicus
aagattgttcattacctaaggcaca

SEQ ID NO: 38061 - DNA, 25 bp, Rattus norvegicus
aagattgttccgcaggtccagtctt

SEQ ID NO: 38062 - DNA, 25 bp, Rattus norvegicus
aagattgttccggaggtccagtctt

SEQ ID NO: 38063 - DNA, 25 bp, Rattus norvegicus
aagattgttctgcagctactccatt

SEQ ID NO: 38064 - DNA, 25 bp, Rattus norvegicus
aagattgttctggagctactccatt

SEQ ID NO: 38065 - DNA, 25 bp, Rattus norvegicus
aagattgttggccactcgaatttct

SEQ ID NO: 38066 - DNA, 25 bp, Rattus norvegicus
aagattgttggcgactcgaatttct

SEQ ID NO: 38067 - DNA, 25 bp, Rattus norvegicus
aagattgttgtgactgtggcttccc

SEQ ID NO: 38068 - DNA, 25 bp, Rattus norvegicus
aagattgttgtgtctgtggcttccc

SEQ ID NO: 38069 - DNA, 25 bp, Rattus norvegicus
aagatttacatcaagattaccaggg

SEQ ID NO: 38070 - DNA, 25 bp, Rattus norvegicus
aagatttacatctagattaccaggg

SEQ ID NO: 38071 - DNA, 25 bp, Rattus norvegicus
aagatttatcccattgctgccgtac

SEQ ID NO: 38072 - DNA, 25 bp, Rattus norvegicus
aagatttatccctttgctgccgtac

SEQ ID NO: 38073 - DNA, 25 bp, Rattus norvegicus
aagatttatctactctgcctcccaa

SEQ ID NO: 38074 - DNA, 25 bp, Rattus norvegicus
aagatttatctagtctgcctcccaa

SEQ ID NO: 38075 - DNA, 25 bp, Rattus norvegicus
aagatttatctgagagcttgacctc

SEQ ID NO: 38076 - DNA, 25 bp, Rattus norvegicus
aagatttatctgtgagcttgacctc

SEQ ID NO: 38077 - DNA, 25 bp, Rattus norvegicus
aagatttatgttctctcagggccgt

SEQ ID NO: 38078 - DNA, 25 bp, Rattus norvegicus
aagatttatgttgtctcagggccgt

SEQ ID NO: 38079 - DNA, 25 bp, Rattus norvegicus
aagatttatttccagagttctcaaa

SEQ ID NO: 38080 - DNA, 25 bp, Rattus norvegicus
aagatttatttcgagagttctcaaa

SEQ ID NO: 38081 - DNA, 25 bp, Rattus norvegicus
aagatttcagatcggctctgtagcc

SEQ ID NO: 38082 - DNA, 25 bp, Rattus norvegicus
aagatttcagatgggctctgtagcc

SEQ ID NO: 38083 - DNA, 25 bp, Rattus norvegicus
aagatttcatggcttgcacagacat

SEQ ID NO: 38084 - DNA, 25 bp, Rattus norvegicus
aagatttcatgggttgcacagacat

SEQ ID NO: 38085 - DNA, 25 bp, Rattus norvegicus
aagatttcattaaccgtctcacaga

SEQ ID NO: 38086 - DNA, 25 bp, Rattus norvegicus
aagatttcattatccgtctcacaga

SEQ ID NO: 38087 - DNA, 25 bp, Rattus norvegicus
aagatttccctactctagcgggctt

SEQ ID NO: 38088 - DNA, 25 bp, Rattus norvegicus
aagatttccctagtctagcgggctt

SEQ ID NO: 38089 - DNA, 25 bp, Rattus norvegicus
aagatttcctgtatctacacaaccg

SEQ ID NO: 38090 - DNA, 25 bp, Rattus norvegicus
aagatttcctgtttctacacaaccg

SEQ ID NO: 38091 - DNA, 25 bp, Rattus norvegicus
aagatttctagtatgcctgcatccc

SEQ ID NO: 38092 - DNA, 25 bp, Rattus norvegicus
aagatttctagtttgcctgcatccc

SEQ ID NO: 38093 - DNA, 25 bp, Rattus norvegicus
aagatttctcgtctgtatgtgtgtt

SEQ ID NO: 38094 - DNA, 25 bp, Rattus norvegicus
aagatttctcgtgtgtatgtgtgtt

SEQ ID NO: 38095 - DNA, 25 bp, Rattus norvegicus
aagatttctcttatgtgcacttctg

SEQ ID NO: 38096 - DNA, 25 bp, Rattus norvegicus
aagatttctcttttgtgcacttctg

SEQ ID NO: 38097 - DNA, 25 bp, Rattus norvegicus
aagatttctgccagcaaccacaggt

SEQ ID NO: 38098 - DNA, 25 bp, Rattus norvegicus
aagatttctgcctgcaaccacaggt

SEQ ID NO: 38099 - DNA, 25 bp, Rattus norvegicus
aagatttcttcaacttctctattgg

SEQ ID NO: 38100 - DNA, 25 bp, Rattus norvegicus
aagatttcttcatcttctctattgg

SEQ ID NO: 38101 - DNA, 25 bp, Rattus norvegicus
aagatttgacttcacagcacagtga

SEQ ID NO: 38102 - DNA, 25 bp, Rattus norvegicus
aagatttgacttgacagcacagtga

SEQ ID NO: 38103 - DNA, 25 bp, Rattus norvegicus
aagatttgagacatcttcccagcca

SEQ ID NO: 38104 - DNA, 25 bp, Rattus norvegicus
aagatttgagacttcttcccagcca

SEQ ID NO: 38105 - DNA, 25 bp, Rattus norvegicus
aagatttgccttactgagcctgtct

SEQ ID NO: 38106 - DNA, 25 bp, Rattus norvegicus
aagatttgcctttctgagcctgtct

SEQ ID NO: 38107 - DNA, 25 bp, Rattus norvegicus
aagatttgctacagatttgcaccca

SEQ ID NO: 38108 - DNA, 25 bp, Rattus norvegicus
aagatttgctactgatttgcaccca

SEQ ID NO: 38109 - DNA, 25 bp, Rattus norvegicus
aagatttggagccttcgtggtgctt

SEQ ID NO: 38110 - DNA, 25 bp, Rattus norvegicus
aagatttggagcgttcgtggtgctt

SEQ ID NO: 38111 - DNA, 25 bp, Rattus norvegicus
aagatttgggacatctctgtggcat

SEQ ID NO: 38112 - DNA, 25 bp, Rattus norvegicus
aagatttgggacttctctgtggcat

SEQ ID NO: 38113 - DNA, 25 bp, Rattus norvegicus
aagatttggtgaatggtgcagcctc

SEQ ID NO: 38114 - DNA, 25 bp, Rattus norvegicus
aagatttggtgattggtgcagcctc

SEQ ID NO: 38115 - DNA, 25 bp, Rattus norvegicus
aagatttgtagtctgggtctctcct

SEQ ID NO: 38116 - DNA, 25 bp, Rattus norvegicus
aagatttgtagtgtgggtctctcct

SEQ ID NO: 38117 - DNA, 25 bp, Rattus norvegicus
aagatttgttccagataccttcaat

SEQ ID NO: 38118 - DNA, 25 bp, Rattus norvegicus
aagatttgttcctgataccttcaat

SEQ ID NO: 38119 - DNA, 25 bp, Rattus norvegicus
aagattttcagcagtgaaactcaac

SEQ ID NO: 38120 - DNA, 25 bp, Rattus norvegicus
aagattttcagctgtgaaactcaac

SEQ ID NO: 38121 - DNA, 25 bp, Rattus norvegicus
aagattttcataatgcttgggcgga

SEQ ID NO: 38122 - DNA, 25 bp, Rattus norvegicus
aagattttcatattgcttgggcgga

SEQ ID NO: 38123 - DNA, 25 bp, Rattus norvegicus
aagattttcatcatctgcagcgccg

SEQ ID NO: 38124 - DNA, 25 bp, Rattus norvegicus
aagattttcatcttctgcagcgccg

SEQ ID NO: 38125 - DNA, 25 bp, Rattus norvegicus
aagattttctaacttggctcccttg

SEQ ID NO: 38126 - DNA, 25 bp, Rattus norvegicus
aagattttctaagttggctcccttg

SEQ ID NO: 38127 - DNA, 25 bp, Rattus norvegicus
aagattttgaatacttcaccagtaa

SEQ ID NO: 38128 - DNA, 25 bp, Rattus norvegicus
aagattttgaattcttcaccagtaa

SEQ ID NO: 38129 - DNA, 25 bp, Rattus norvegicus
aagattttgccaacaccattcctgg

SEQ ID NO: 38130 - DNA, 25 bp, Rattus norvegicus
aagattttgccatcaccattcctgg

SEQ ID NO: 38131 - DNA, 25 bp, Rattus norvegicus
aagattttggagcagcacttgagtg

SEQ ID NO: 38132 - DNA, 25 bp, Rattus norvegicus
aagattttggaggagcacttgagtg

SEQ ID NO: 38133 - DNA, 25 bp, Rattus norvegicus
aagattttgtttcaggtattgccac

SEQ ID NO: 38134 - DNA, 25 bp, Rattus norvegicus
aagattttgtttgaggtattgccac

SEQ ID NO: 38135 - DNA, 25 bp, Rattus norvegicus
aagcaaaaccttaggctagggctgc

SEQ ID NO: 38136 - DNA, 25 bp, Rattus norvegicus
aagcaaaacctttggctagggctgc

SEQ ID NO: 38137 - DNA, 25 bp, Rattus norvegicus
aagcaaaatcctcttgggcctgctg

SEQ ID NO: 38138 - DNA, 25 bp, Rattus norvegicus
aagcaaaatcctgttgggcctgctg

SEQ ID NO: 38139 - DNA, 25 bp, Rattus norvegicus
aagcaaaatcgaaaccacctcgctg

SEQ ID NO: 38140 - DNA, 25 bp, Rattus norvegicus
aagcaaaatcgataccacctcgctg

SEQ ID NO: 38141 - DNA, 25 bp, Rattus norvegicus
aagcaaacaatacccttcactttct

SEQ ID NO: 38142 - DNA, 25 bp, Rattus norvegicus
aagcaaacaatagccttcactttct

SEQ ID NO: 38143 - DNA, 25 bp, Rattus norvegicus
aagcaaacatctaatccctagccat

SEQ ID NO: 38144 - DNA, 25 bp, Rattus norvegicus
aagcaaacatcttatccctagccat

SEQ ID NO: 38145 - DNA, 25 bp, Rattus norvegicus
aagcaaacattacccagctgacctg

SEQ ID NO: 38146 - DNA, 25 bp, Rattus norvegicus
aagcaaacattagccagctgacctg

SEQ ID NO: 38147 - DNA, 25 bp, Rattus norvegicus
aagcaaaccgcgactcggctccgtt

SEQ ID NO: 38148 - DNA, 25 bp, Rattus norvegicus
aagcaaaccgcgtctcggctccgtt

SEQ ID NO: 38149 - DNA, 25 bp, Rattus norvegicus
aagcaaacctgacgctgcactcttt

SEQ ID NO: 38150 - DNA, 25 bp, Rattus norvegicus
aagcaaacctgaggctgcactcttt

SEQ ID NO: 38151 - DNA, 25 bp, Rattus norvegicus
aagcaaacgcttatctccatcaggg

SEQ ID NO: 38152 - DNA, 25 bp, Rattus norvegicus
aagcaaacgcttttctccatcaggg

SEQ ID NO: 38153 - DNA, 25 bp, Rattus norvegicus
aagcaaacggttcgctgaagcagca

SEQ ID NO: 38154 - DNA, 25 bp, Rattus norvegicus
aagcaaacggttggctgaagcagca

SEQ ID NO: 38155 - DNA, 25 bp, Rattus norvegicus
aagcaaacgttcatttacttgagaa

SEQ ID NO: 38156 - DNA, 25 bp, Rattus norvegicus
aagcaaacgttcttttacttgagaa

SEQ ID NO: 38157 - DNA, 25 bp, Rattus norvegicus
aagcaaactgccaatttcccagtgt

SEQ ID NO: 38158 - DNA, 25 bp, Rattus norvegicus
aagcaaactgcctatttcccagtgt

SEQ ID NO: 38159 - DNA, 25 bp, Rattus norvegicus
aagcaaacttcaacagagtcctgtc

SEQ ID NO: 38160 - DNA, 25 bp, Rattus norvegicus
aagcaaacttcatcagagtcctgtc

SEQ ID NO: 38161 - DNA, 25 bp, Rattus norvegicus
aagcaaagacgtccctcaccgtgag

SEQ ID NO: 38162 - DNA, 25 bp, Rattus norvegicus
aagcaaagacgtgcctcaccgtgag

SEQ ID NO: 38163 - DNA, 25 bp, Rattus norvegicus
aagcaaagcaacatggccgtttcca

SEQ ID NO: 38164 - DNA, 25 bp, Rattus norvegicus
aagcaaagcaacttggccgtttcca

SEQ ID NO: 38165 - DNA, 25 bp, Rattus norvegicus
aagcaaagcctcctgcaaatgcagt

SEQ ID NO: 38166 - DNA, 25 bp, Rattus norvegicus
aagcaaagcctcgtgcaaatgcagt

SEQ ID NO: 38167 - DNA, 25 bp, Rattus norvegicus
aagcaaagccttcggaagtagcttc

SEQ ID NO: 38168 - DNA, 25 bp, Rattus norvegicus
aagcaaagccttgggaagtagcttc

SEQ ID NO: 38169 - DNA, 25 bp, Rattus norvegicus
aagcaaagcttgaaccaactccttg

SEQ ID NO: 38170 - DNA, 25 bp, Rattus norvegicus
aagcaaagcttgtaccaactccttg

SEQ ID NO: 38171 - DNA, 25 bp, Rattus norvegicus
aagcaaaggcttacttccggcatat

SEQ ID NO: 38172 - DNA, 25 bp, Rattus norvegicus
aagcaaaggctttcttccggcatat

SEQ ID NO: 38173 - DNA, 25 bp, Rattus norvegicus
aagcaaagggaaagccccgtggctt

SEQ ID NO: 38174 - DNA, 25 bp, Rattus norvegicus
aagcaaagggaatgccccgtggctt

SEQ ID NO: 38175 - DNA, 25 bp, Rattus norvegicus
aagcaaagtgccagcatagaggaaa

SEQ ID NO: 38176 - DNA, 25 bp, Rattus norvegicus
aagcaaagtgcctgcatagaggaaa

SEQ ID NO: 38177 - DNA, 25 bp, Rattus norvegicus
aagcaaagtgctctgctgagccttt

SEQ ID NO: 38178 - DNA, 25 bp, Rattus norvegicus
aagcaaagtgctgtgctgagccttt

SEQ ID NO: 38179 - DNA, 25 bp, Rattus norvegicus
aagcaaagtggcctgcccagtgctg

SEQ ID NO: 38180 - DNA, 25 bp, Rattus norvegicus
aagcaaagtggcgtgcccagtgctg

SEQ ID NO: 38181 - DNA, 25 bp, Rattus norvegicus
aagcaaagttgccattctttcccca

SEQ ID NO: 38182 - DNA, 25 bp, Rattus norvegicus
aagcaaagttgcgattctttcccca

SEQ ID NO: 38183 - DNA, 25 bp, Rattus norvegicus
aagcaaatcgaacagaacacacccc

SEQ ID NO: 38184 - DNA, 25 bp, Rattus norvegicus
aagcaaatcgaagagaacacacccc

SEQ ID NO: 38185 - DNA, 25 bp, Rattus norvegicus
aagcaaatcggacaaccccacgtca

SEQ ID NO: 38186 - DNA, 25 bp, Rattus norvegicus
aagcaaatcggagaaccccacgtca

SEQ ID NO: 38187 - DNA, 25 bp, Rattus norvegicus
aagcaaatgcatactatcgttatta

SEQ ID NO: 38188 - DNA, 25 bp, Rattus norvegicus
aagcaaatgcattctatcgttatta

SEQ ID NO: 38189 - DNA, 25 bp, Rattus norvegicus
aagcaaatgctaccagccacttttc

SEQ ID NO: 38190 - DNA, 25 bp, Rattus norvegicus
aagcaaatgctagcagccacttttc

SEQ ID NO: 38191 - DNA, 25 bp, Rattus norvegicus
aagcaaatgtataccaggtctggtg

SEQ ID NO: 38192 - DNA, 25 bp, Rattus norvegicus
aagcaaatgtattccaggtctggtg

SEQ ID NO: 38193 - DNA, 25 bp, Rattus norvegicus
aagcaacaagagagggtgaatcaac

SEQ ID NO: 38194 - DNA, 25 bp, Rattus norvegicus
aagcaacaagagtgggtgaatcaac

SEQ ID NO: 38195 - DNA, 25 bp, Rattus norvegicus
aagcaacaaggcacattcccacaaa

SEQ ID NO: 38196 - DNA, 25 bp, Rattus norvegicus
aagcaacaaggcattgtggttaata

SEQ ID NO: 38197 - DNA, 25 bp, Rattus norvegicus
aagcaacaaggctcattcccacaaa

SEQ ID NO: 38198 - DNA, 25 bp, Rattus norvegicus
aagcaacaaggctttgtggttaata

SEQ ID NO: 38199 - DNA, 25 bp, Rattus norvegicus
aagcaacacacacctgtctgtacgt

SEQ ID NO: 38200 - DNA, 25 bp, Rattus norvegicus
aagcaacacacagctgtctgtacgt

SEQ ID NO: 38201 - DNA, 25 bp, Rattus norvegicus
aagcaacacagccatgtctgaagcc

SEQ ID NO: 38202 - DNA, 25 bp, Rattus norvegicus
aagcaacacagcgatgtctgaagcc

SEQ ID NO: 38203 - DNA, 25 bp, Rattus norvegicus
aagcaacaccacctttcacaatgat

SEQ ID NO: 38204 - DNA, 25 bp, Rattus norvegicus
aagcaacaccacgtttcacaatgat

SEQ ID NO: 38205 - DNA, 25 bp, Rattus norvegicus
aagcaacaggacatggtaatcaact

SEQ ID NO: 38206 - DNA, 25 bp, Rattus norvegicus
aagcaacaggacttggtaatcaact

SEQ ID NO: 38207 - DNA, 25 bp, Rattus norvegicus
aagcaacaggtgatgttgggccttt

SEQ ID NO: 38208 - DNA, 25 bp, Rattus norvegicus
aagcaacaggtgttgttgggccttt

SEQ ID NO: 38209 - DNA, 25 bp, Rattus norvegicus
aagcaacagtgtatggtggtcccca

SEQ ID NO: 38210 - DNA, 25 bp, Rattus norvegicus
aagcaacagtgtttggtggtcccca

SEQ ID NO: 38211 - DNA, 25 bp, Rattus norvegicus
aagcaacatctaaggtctccaatga

SEQ ID NO: 38212 - DNA, 25 bp, Rattus norvegicus
aagcaacatctatggtctccaatga

SEQ ID NO: 38213 - DNA, 25 bp, Rattus norvegicus
aagcaacatttgagacctgtctttg

SEQ ID NO: 38214 - DNA, 25 bp, Rattus norvegicus
aagcaacatttgtgacctgtctttg

SEQ ID NO: 38215 - DNA, 25 bp, Rattus norvegicus
aagcaaccaaaaagagcactgtttt

SEQ ID NO: 38216 - DNA, 25 bp, Rattus norvegicus
aagcaaccaaaatgagcactgtttt

SEQ ID NO: 38217 - DNA, 25 bp, Rattus norvegicus
aagcaaccaacaactttaattagaa

SEQ ID NO: 38218 - DNA, 25 bp, Rattus norvegicus
aagcaaccaacatctttaattagaa

SEQ ID NO: 38219 - DNA, 25 bp, Rattus norvegicus
aagcaaccacctaccaattggaggg

SEQ ID NO: 38220 - DNA, 25 bp, Rattus norvegicus
aagcaaccaccttccaattggaggg

SEQ ID NO: 38221 - DNA, 25 bp, Rattus norvegicus
aagcaaccatttcttccaagtagat

SEQ ID NO: 38222 - DNA, 25 bp, Rattus norvegicus
aagcaaccatttgttccaagtagat

SEQ ID NO: 38223 - DNA, 25 bp, Rattus norvegicus
aagcaaccgtggagaatggatgcca

SEQ ID NO: 38224 - DNA, 25 bp, Rattus norvegicus
aagcaaccgtggtgaatggatgcca

SEQ ID NO: 38225 - DNA, 25 bp, Rattus norvegicus
aagcaaccgtgtagtgcgtcagccg

SEQ ID NO: 38226 - DNA, 25 bp, Rattus norvegicus
aagcaaccgtgttgtgcgtcagccg

SEQ ID NO: 38227 - DNA, 25 bp, Rattus norvegicus
aagcaacctacacctagccagggta

SEQ ID NO: 38228 - DNA, 25 bp, Rattus norvegicus
aagcaacctacagctagccagggta

SEQ ID NO: 38229 - DNA, 25 bp, Rattus norvegicus
aagcaacctcggagggcacactgtg

SEQ ID NO: 38230 - DNA, 25 bp, Rattus norvegicus
aagcaacctcggtgggcacactgtg

SEQ ID NO: 38231 - DNA, 25 bp, Rattus norvegicus
aagcaacctgagagtggtcccagca

SEQ ID NO: 38232 - DNA, 25 bp, Rattus norvegicus
aagcaacctgagtgtggtcccagca

SEQ ID NO: 38233 - DNA, 25 bp, Rattus norvegicus
aagcaacctgtgatggaccaaagtc

SEQ ID NO: 38234 - DNA, 25 bp, Rattus norvegicus
aagcaacctgtgttggaccaaagtc

SEQ ID NO: 38235 - DNA, 25 bp, Rattus norvegicus
aagcaacctttcaatagtcactcaa

SEQ ID NO: 38236 - DNA, 25 bp, Rattus norvegicus
aagcaacctttctatagtcactcaa

SEQ ID NO: 38237 - DNA, 25 bp, Rattus norvegicus
aagcaacctttgcagcagcagcagc

SEQ ID NO: 38238 - DNA, 25 bp, Rattus norvegicus
aagcaacctttggagcagcagcagc

SEQ ID NO: 38239 - DNA, 25 bp, Rattus norvegicus
aagcaacgcccgaggaggaagcgtt

SEQ ID NO: 38240 - DNA, 25 bp, Rattus norvegicus
aagcaacgcccgtggaggaagcgtt

SEQ ID NO: 38241 - DNA, 25 bp, Rattus norvegicus
aagcaacgctctcagctttagtggg

SEQ ID NO: 38242 - DNA, 25 bp, Rattus norvegicus
aagcaacgctctgagctttagtggg

SEQ ID NO: 38243 - DNA, 25 bp, Rattus norvegicus
aagcaactagttactaattcccagt

SEQ ID NO: 38244 - DNA, 25 bp, Rattus norvegicus
aagcaactagtttctaattcccagt

SEQ ID NO: 38245 - DNA, 25 bp, Rattus norvegicus
aagcaactcaggctgcgatcgaccc

SEQ ID NO: 38246 - DNA, 25 bp, Rattus norvegicus
aagcaactcagggtgcgatcgaccc

SEQ ID NO: 38247 - DNA, 25 bp, Rattus norvegicus
aagcaactcgcgatctggagagcca

SEQ ID NO: 38248 - DNA, 25 bp, Rattus norvegicus
aagcaactcgcgttctggagagcca

SEQ ID NO: 38249 - DNA, 25 bp, Rattus norvegicus
aagcaactctagcatcccagacatc

SEQ ID NO: 38250 - DNA, 25 bp, Rattus norvegicus
aagcaactctaggatcccagacatc

SEQ ID NO: 38251 - DNA, 25 bp, Rattus norvegicus
aagcaactctgcaggaacaaacgag

SEQ ID NO: 38252 - DNA, 25 bp, Rattus norvegicus
aagcaactctgctggaacaaacgag

SEQ ID NO: 38253 - DNA, 25 bp, Rattus norvegicus
aagcaactcttcacggaagccgtgg

SEQ ID NO: 38254 - DNA, 25 bp, Rattus norvegicus
aagcaactcttctcggaagccgtgg

SEQ ID NO: 38255 - DNA, 25 bp, Rattus norvegicus
aagcaactgcagcttctactgggca

SEQ ID NO: 38256 - DNA, 25 bp, Rattus norvegicus
aagcaactgcaggttctactgggca

SEQ ID NO: 38257 - DNA, 25 bp, Rattus norvegicus
aagcaactgctgatctcaagaaagt

SEQ ID NO: 38258 - DNA, 25 bp, Rattus norvegicus
aagcaactgctgttctcaagaaagt

SEQ ID NO: 38259 - DNA, 25 bp, Rattus norvegicus
aagcaactgcttaggatggcacata

SEQ ID NO: 38260 - DNA, 25 bp, Rattus norvegicus
aagcaactgctttggatggcacata

SEQ ID NO: 38261 - DNA, 25 bp, Rattus norvegicus
aagcaactggtcaacacttccatca

SEQ ID NO: 38262 - DNA, 25 bp, Rattus norvegicus
aagcaactggtctacacttccatca

SEQ ID NO: 38263 - DNA, 25 bp, Rattus norvegicus
aagcaactgtccaagcactgagctg

SEQ ID NO: 38264 - DNA, 25 bp, Rattus norvegicus
aagcaactgtcctagcactgagctg

SEQ ID NO: 38265 - DNA, 25 bp, Rattus norvegicus
aagcaacttcatacacagtgtctga

SEQ ID NO: 38266 - DNA, 25 bp, Rattus norvegicus
aagcaacttcattcacagtgtctga

SEQ ID NO: 38267 - DNA, 25 bp, Rattus norvegicus
aagcaacttcgaccgcttaggaaat

SEQ ID NO: 38268 - DNA, 25 bp, Rattus norvegicus
aagcaacttcgagcgcttaggaaat

SEQ ID NO: 38269 - DNA, 25 bp, Rattus norvegicus
aagcaacttgagagcgccatgcgca

SEQ ID NO: 38270 - DNA, 25 bp, Rattus norvegicus
aagcaacttgagtgcgccatgcgca

SEQ ID NO: 38271 - DNA, 25 bp, Rattus norvegicus
aagcaagaactcacagcaactggcc

SEQ ID NO: 38272 - DNA, 25 bp, Rattus norvegicus
aagcaagaactctcagcaactggcc

SEQ ID NO: 38273 - DNA, 25 bp, Rattus norvegicus
aagcaagaatgcaatttacacaatc

SEQ ID NO: 38274 - DNA, 25 bp, Rattus norvegicus
aagcaagaatgctatttacacaatc

SEQ ID NO: 38275 - DNA, 25 bp, Rattus norvegicus
aagcaagacaccctatctcagattc

SEQ ID NO: 38276 - DNA, 25 bp, Rattus norvegicus
aagcaagacaccgtatctcagattc

SEQ ID NO: 38277 - DNA, 25 bp, Rattus norvegicus
aagcaagactggctggctagcaacc

SEQ ID NO: 38278 - DNA, 25 bp, Rattus norvegicus
aagcaagactgggtggctagcaacc

SEQ ID NO: 38279 - DNA, 25 bp, Rattus norvegicus
aagcaagagtcaccctctccatgtt

SEQ ID NO: 38280 - DNA, 25 bp, Rattus norvegicus
aagcaagagtcagcctctccatgtt

SEQ ID NO: 38281 - DNA, 25 bp, Rattus norvegicus
aagcaagagtctaggctctcaggcc

SEQ ID NO: 38282 - DNA, 25 bp, Rattus norvegicus
aagcaagagtcttggctctcaggcc

SEQ ID NO: 38283 - DNA, 25 bp, Rattus norvegicus
aagcaagcactgctttttgcgcctc

SEQ ID NO: 38284 - DNA, 25 bp, Rattus norvegicus
aagcaagcactggtttttgcgcctc

SEQ ID NO: 38285 - DNA, 25 bp, Rattus norvegicus
aagcaagcacttaacacacattcca

SEQ ID NO: 38286 - DNA, 25 bp, Rattus norvegicus
aagcaagcactttacacacattcca

SEQ ID NO: 38287 - DNA, 25 bp, Rattus norvegicus
aagcaagcagagcaaccctcggtta

SEQ ID NO: 38288 - DNA, 25 bp, Rattus norvegicus
aagcaagcagaggaaccctcggtta

SEQ ID NO: 38289 - DNA, 25 bp, Rattus norvegicus
aagcaagcaggactcggctctccat

SEQ ID NO: 38290 - DNA, 25 bp, Rattus norvegicus
aagcaagcaggagtcggctctccat

SEQ ID NO: 38291 - DNA, 25 bp, Rattus norvegicus
aagcaagcatgactggtggccaacc

SEQ ID NO: 38292 - DNA, 25 bp, Rattus norvegicus
aagcaagcatgagtggtggccaacc

SEQ ID NO: 38293 - DNA, 25 bp, Rattus norvegicus
aagcaagccgttcctgtcgtctctg

SEQ ID NO: 38294 - DNA, 25 bp, Rattus norvegicus
aagcaagccgttgctgtcgtctctg

SEQ ID NO: 38295 - DNA, 25 bp, Rattus norvegicus
aagcaagcctatactgtgatgtaac

SEQ ID NO: 38296 - DNA, 25 bp, Rattus norvegicus
aagcaagcctattctgtgatgtaac

SEQ ID NO: 38297 - DNA, 25 bp, Rattus norvegicus
aagcaagcctgtaaagacttacgga

SEQ ID NO: 38298 - DNA, 25 bp, Rattus norvegicus
aagcaagcctgttaagacttacgga

SEQ ID NO: 38299 - DNA, 25 bp, Rattus norvegicus
aagcaagccttaaaagtgatcttag

SEQ ID NO: 38300 - DNA, 25 bp, Rattus norvegicus
aagcaagccttataagtgatcttag

SEQ ID NO: 38301 - DNA, 25 bp, Rattus norvegicus
aagcaagctactattcctaccctga

SEQ ID NO: 38302 - DNA, 25 bp, Rattus norvegicus
aagcaagctacttttcctaccctga

SEQ ID NO: 38303 - DNA, 25 bp, Rattus norvegicus
aagcaagctattaccctgttgggta

SEQ ID NO: 38304 - DNA, 25 bp, Rattus norvegicus
aagcaagctatttccctgttgggta

SEQ ID NO: 38305 - DNA, 25 bp, Rattus norvegicus
aagcaagctcccatcaggaggctaa

SEQ ID NO: 38306 - DNA, 25 bp, Rattus norvegicus
aagcaagctcccttcaggaggctaa

SEQ ID NO: 38307 - DNA, 25 bp, Rattus norvegicus
aagcaagctctaattgccctgatgc

SEQ ID NO: 38308 - DNA, 25 bp, Rattus norvegicus
aagcaagctctatttgccctgatgc

SEQ ID NO: 38309 - DNA, 25 bp, Rattus norvegicus
aagcaagctgaaaggcaacacggaa

SEQ ID NO: 38310 - DNA, 25 bp, Rattus norvegicus
aagcaagctgaatggcaacacggaa

SEQ ID NO: 38311 - DNA, 25 bp, Rattus norvegicus
aagcaagctgctccgtctgttacca

SEQ ID NO: 38312 - DNA, 25 bp, Rattus norvegicus
aagcaagctgctgcgtctgttacca

SEQ ID NO: 38313 - DNA, 25 bp, Rattus norvegicus
aagcaagctgtgaacttcctcagtg

SEQ ID NO: 38314 - DNA, 25 bp, Rattus norvegicus
aagcaagctgtgtacttcctcagtg

SEQ ID NO: 38315 - DNA, 25 bp, Rattus norvegicus
aagcaagctgttctgaggccattca

SEQ ID NO: 38316 - DNA, 25 bp, Rattus norvegicus
aagcaagctgttgtgaggccattca

SEQ ID NO: 38317 - DNA, 25 bp, Rattus norvegicus
aagcaagctttccttatcttaagat

SEQ ID NO: 38318 - DNA, 25 bp, Rattus norvegicus
aagcaagctttcgttatcttaagat

SEQ ID NO: 38319 - DNA, 25 bp, Rattus norvegicus
aagcaagcttttactcacagttcac

SEQ ID NO: 38320 - DNA, 25 bp, Rattus norvegicus
aagcaagctttttctcacagttcac

SEQ ID NO: 38321 - DNA, 25 bp, Rattus norvegicus
aagcaaggacctatggaccagacaa

SEQ ID NO: 38322 - DNA, 25 bp, Rattus norvegicus
aagcaaggacctttggaccagacaa

SEQ ID NO: 38323 - DNA, 25 bp, Rattus norvegicus
aagcaaggactgacctgcagaggtt

SEQ ID NO: 38324 - DNA, 25 bp, Rattus norvegicus
aagcaaggactgtcctgcagaggtt

SEQ ID NO: 38325 - DNA, 25 bp, Rattus norvegicus
aagcaaggattgcaggcccatcacc

SEQ ID NO: 38326 - DNA, 25 bp, Rattus norvegicus
aagcaaggattggaggcccatcacc

SEQ ID NO: 38327 - DNA, 25 bp, Rattus norvegicus
aagcaaggcatgaggaacaggagtt

SEQ ID NO: 38328 - DNA, 25 bp, Rattus norvegicus
aagcaaggcatgtggaacaggagtt

SEQ ID NO: 38329 - DNA, 25 bp, Rattus norvegicus
aagcaaggcgtgcactgagcaccac

SEQ ID NO: 38330 - DNA, 25 bp, Rattus norvegicus
aagcaaggcgtggactgagcaccac

SEQ ID NO: 38331 - DNA, 25 bp, Rattus norvegicus
aagcaaggtacacacccgtgaatga

SEQ ID NO: 38332 - DNA, 25 bp, Rattus norvegicus
aagcaaggtacagacccgtgaatga

SEQ ID NO: 38333 - DNA, 25 bp, Rattus norvegicus
aagcaagtaaccatgcagctgactg

SEQ ID NO: 38334 - DNA, 25 bp, Rattus norvegicus
aagcaagtaaccttgcagctgactg

SEQ ID NO: 38335 - DNA, 25 bp, Rattus norvegicus
aagcaagtaccacctcaagtttgga

SEQ ID NO: 38336 - DNA, 25 bp, Rattus norvegicus
aagcaagtaccagctcaagtttgga

SEQ ID NO: 38337 - DNA, 25 bp, Rattus norvegicus
aagcaagtacgcagctctgtctgtg

SEQ ID NO: 38338 - DNA, 25 bp, Rattus norvegicus
aagcaagtacgctgctctgtctgtg

SEQ ID NO: 38339 - DNA, 25 bp, Rattus norvegicus
aagcaagtactgaagcactcggaga

SEQ ID NO: 38340 - DNA, 25 bp, Rattus norvegicus
aagcaagtactgtagcactcggaga

SEQ ID NO: 38341 - DNA, 25 bp, Rattus norvegicus
aagcaagtccgtatgcaaggctaaa

SEQ ID NO: 38342 - DNA, 25 bp, Rattus norvegicus
aagcaagtccgtttgcaaggctaaa

SEQ ID NO: 38343 - DNA, 25 bp, Rattus norvegicus
aagcaagtcctgatgagaatcccag

SEQ ID NO: 38344 - DNA, 25 bp, Rattus norvegicus
aagcaagtcctgttgagaatcccag

SEQ ID NO: 38345 - DNA, 25 bp, Rattus norvegicus
aagcaagtccttcgtctcagcaaac

SEQ ID NO: 38346 - DNA, 25 bp, Rattus norvegicus
aagcaagtccttggtctcagcaaac

SEQ ID NO: 38347 - DNA, 25 bp, Rattus norvegicus
aagcaagtctccaaacgtgccaatc

SEQ ID NO: 38348 - DNA, 25 bp, Rattus norvegicus
aagcaagtctcctaacgtgccaatc

SEQ ID NO: 38349 - DNA, 25 bp, Rattus norvegicus
aagcaagtgcccatttatacagtga

SEQ ID NO: 38350 - DNA, 25 bp, Rattus norvegicus
aagcaagtgcccttttatacagtga

SEQ ID NO: 38351 - DNA, 25 bp, Rattus norvegicus
aagcaagtgcttatccaggcagcag

SEQ ID NO: 38352 - DNA, 25 bp, Rattus norvegicus
aagcaagtgcttttccaggcagcag

SEQ ID NO: 38353 - DNA, 25 bp, Rattus norvegicus
aagcaagtgtagctgtcaccgccct

SEQ ID NO: 38354 - DNA, 25 bp, Rattus norvegicus
aagcaagtgtaggtgtcaccgccct

SEQ ID NO: 38355 - DNA, 25 bp, Rattus norvegicus
aagcaagtgtgcaccatttcactcg

SEQ ID NO: 38356 - DNA, 25 bp, Rattus norvegicus
aagcaagtgtgctccatttcactcg

SEQ ID NO: 38357 - DNA, 25 bp, Rattus norvegicus
aagcaagttcaacagccatactccg

SEQ ID NO: 38358 - DNA, 25 bp, Rattus norvegicus
aagcaagttcaagagccatactccg

SEQ ID NO: 38359 - DNA, 25 bp, Rattus norvegicus
aagcaataacgtccatgatgtcagt

SEQ ID NO: 38360 - DNA, 25 bp, Rattus norvegicus
aagcaataacgtgcatgatgtcagt

SEQ ID NO: 38361 - DNA, 25 bp, Rattus norvegicus
aagcaataccttcaggtctgcagcg

SEQ ID NO: 38362 - DNA, 25 bp, Rattus norvegicus
aagcaataccttgaggtctgcagcg

SEQ ID NO: 38363 - DNA, 25 bp, Rattus norvegicus
aagcaatacgatccactgagcacca

SEQ ID NO: 38364 - DNA, 25 bp, Rattus norvegicus
aagcaatacgatgcactgagcacca

SEQ ID NO: 38365 - DNA, 25 bp, Rattus norvegicus
aagcaatagcaccttaggctccctg

SEQ ID NO: 38366 - DNA, 25 bp, Rattus norvegicus
aagcaatagcacgttaggctccctg

SEQ ID NO: 38367 - DNA, 25 bp, Rattus norvegicus
aagcaatatggcatcggtggccgcg

SEQ ID NO: 38368 - DNA, 25 bp, Rattus norvegicus
aagcaatatggcttcggtggccgcg

SEQ ID NO: 38369 - DNA, 25 bp, Rattus norvegicus
aagcaatcagacatccctttcaatc

SEQ ID NO: 38370 - DNA, 25 bp, Rattus norvegicus
aagcaatcagacttccctttcaatc

SEQ ID NO: 38371 - DNA, 25 bp, Rattus norvegicus
aagcaatccagacggcaggccgtct

SEQ ID NO: 38372 - DNA, 25 bp, Rattus norvegicus
aagcaatccagagggcaggccgtct

SEQ ID NO: 38373 - DNA, 25 bp, Rattus norvegicus
aagcaatccagtattttatcgtcca

SEQ ID NO: 38374 - DNA, 25 bp, Rattus norvegicus
aagcaatccagttttttatcgtcca

SEQ ID NO: 38375 - DNA, 25 bp, Rattus norvegicus
aagcaatcccgcactgttttgctga

SEQ ID NO: 38376 - DNA, 25 bp, Rattus norvegicus
aagcaatcccgctctgttttgctga

SEQ ID NO: 38377 - DNA, 25 bp, Rattus norvegicus
aagcaatctcctctgttaaaatgtg

SEQ ID NO: 38378 - DNA, 25 bp, Rattus norvegicus
aagcaatctcctgtgttaaaatgtg

SEQ ID NO: 38379 - DNA, 25 bp, Rattus norvegicus
aagcaatctgttctaattctcactg

SEQ ID NO: 38380 - DNA, 25 bp, Rattus norvegicus
aagcaatctgttgtaattctcactg

SEQ ID NO: 38381 - DNA, 25 bp, Rattus norvegicus
aagcaatgagtcctctgtcaccttg

SEQ ID NO: 38382 - DNA, 25 bp, Rattus norvegicus
aagcaatgagtcgtctgtcaccttg

SEQ ID NO: 38383 - DNA, 25 bp, Rattus norvegicus
aagcaatgcgttctgtcttcaccaa

SEQ ID NO: 38384 - DNA, 25 bp, Rattus norvegicus
aagcaatgcgttgtgtcttcaccaa

SEQ ID NO: 38385 - DNA, 25 bp, Rattus norvegicus
aagcaatgctccatcaacctaataa

SEQ ID NO: 38386 - DNA, 25 bp, Rattus norvegicus
aagcaatgctccttcaacctaataa

SEQ ID NO: 38387 - DNA, 25 bp, Rattus norvegicus
aagcaatgcttgaggtttcgtatga

SEQ ID NO: 38388 - DNA, 25 bp, Rattus norvegicus
aagcaatgcttgtggtttcgtatga

SEQ ID NO: 38389 - DNA, 25 bp, Rattus norvegicus
aagcaatggcaaatcactgcaagag

SEQ ID NO: 38390 - DNA, 25 bp, Rattus norvegicus
aagcaatggcaattcactgcaagag

SEQ ID NO: 38391 - DNA, 25 bp, Rattus norvegicus
aagcaatggccccagatgtggccgt

SEQ ID NO: 38392 - DNA, 25 bp, Rattus norvegicus
aagcaatggcccgagatgtggccgt

SEQ ID NO: 38393 - DNA, 25 bp, Rattus norvegicus
aagcaatggcggctatggcacgccc

SEQ ID NO: 38394 - DNA, 25 bp, Rattus norvegicus
aagcaatggcgggtatggcacgccc

SEQ ID NO: 38395 - DNA, 25 bp, Rattus norvegicus
aagcaatgtattcccctgctgtcat

SEQ ID NO: 38396 - DNA, 25 bp, Rattus norvegicus
aagcaatgtattgccctgctgtcat

SEQ ID NO: 38397 - DNA, 25 bp, Rattus norvegicus
aagcaatgtgtccacagcaagttga

SEQ ID NO: 38398 - DNA, 25 bp, Rattus norvegicus
aagcaatgtgtcgacagcaagttga

SEQ ID NO: 38399 - DNA, 25 bp, Rattus norvegicus
aagcaatgtgttaaagcctttgtag

SEQ ID NO: 38400 - DNA, 25 bp, Rattus norvegicus
aagcaatgtgtttaagcctttgtag

SEQ ID NO: 38401 - DNA, 25 bp, Rattus norvegicus
aagcaatgttgacgtctactgttac

SEQ ID NO: 38402 - DNA, 25 bp, Rattus norvegicus
aagcaatgttgaggtctactgttac

SEQ ID NO: 38403 - DNA, 25 bp, Rattus norvegicus
aagcaattactcaagttatcctcaa

SEQ ID NO: 38404 - DNA, 25 bp, Rattus norvegicus
aagcaattactctagttatcctcaa

SEQ ID NO: 38405 - DNA, 25 bp, Rattus norvegicus
aagcaattaggtcagggctttccgt

SEQ ID NO: 38406 - DNA, 25 bp, Rattus norvegicus
aagcaattaggtgagggctttccgt

SEQ ID NO: 38407 - DNA, 25 bp, Rattus norvegicus
aagcaattgaagagcgccgtgtgat

SEQ ID NO: 38408 - DNA, 25 bp, Rattus norvegicus
aagcaattgaagtgcgccgtgtgat

SEQ ID NO: 38409 - DNA, 25 bp, Rattus norvegicus
aagcaattgaatactctacatcaga

SEQ ID NO: 38410 - DNA, 25 bp, Rattus norvegicus
aagcaattgaattctctacatcaga

SEQ ID NO: 38411 - DNA, 25 bp, Rattus norvegicus
aagcaattgctcacggaggactccc

SEQ ID NO: 38412 - DNA, 25 bp, Rattus norvegicus
aagcaattgctctcggaggactccc

SEQ ID NO: 38413 - DNA, 25 bp, Rattus norvegicus
aagcaattgcttctcctagaccaga

SEQ ID NO: 38414 - DNA, 25 bp, Rattus norvegicus
aagcaattgcttgtcctagaccaga

SEQ ID NO: 38415 - DNA, 25 bp, Rattus norvegicus
aagcaattgggtacagtgctgctct

SEQ ID NO: 38416 - DNA, 25 bp, Rattus norvegicus
aagcaattgggttcagtgctgctct

SEQ ID NO: 38417 - DNA, 25 bp, Rattus norvegicus
aagcaattgttcacccagacactga

SEQ ID NO: 38418 - DNA, 25 bp, Rattus norvegicus
aagcaattgttccaatgagcccctg

SEQ ID NO: 38419 - DNA, 25 bp, Rattus norvegicus
aagcaattgttcgaatgagcccctg

SEQ ID NO: 38420 - DNA, 25 bp, Rattus norvegicus
aagcaattgttctcccagacactga

SEQ ID NO: 38421 - DNA, 25 bp, Rattus norvegicus
aagcaatttcaaaactaggcctcag

SEQ ID NO: 38422 - DNA, 25 bp, Rattus norvegicus
aagcaatttcaatactaggcctcag

SEQ ID NO: 38423 - DNA, 25 bp, Rattus norvegicus
aagcaatttgtaactgtgggccatt

SEQ ID NO: 38424 - DNA, 25 bp, Rattus norvegicus
aagcaatttgtatctgtgggccatt

SEQ ID NO: 38425 - DNA, 25 bp, Rattus norvegicus
aagcaattttctctcattcacctca

SEQ ID NO: 38426 - DNA, 25 bp, Rattus norvegicus
aagcaattttctgtcattcacctca

SEQ ID NO: 38427 - DNA, 25 bp, Rattus norvegicus
aagcacaaaccaccagaagggcaag

SEQ ID NO: 38428 - DNA, 25 bp, Rattus norvegicus
aagcacaaaccagcagaagggcaag

SEQ ID NO: 38429 - DNA, 25 bp, Rattus norvegicus
aagcacaaacgtatagttctatgta

SEQ ID NO: 38430 - DNA, 25 bp, Rattus norvegicus
aagcacaaacgtttagttctatgta

SEQ ID NO: 38431 - DNA, 25 bp, Rattus norvegicus
aagcacaaacttatctttagatatt

SEQ ID NO: 38432 - DNA, 25 bp, Rattus norvegicus
aagcacaaacttttctttagatatt

SEQ ID NO: 38433 - DNA, 25 bp, Rattus norvegicus
aagcacaacctcacccatagaaatt

SEQ ID NO: 38434 - DNA, 25 bp, Rattus norvegicus
aagcacaacctctcccatagaaatt

SEQ ID NO: 38435 - DNA, 25 bp, Rattus norvegicus
aagcacaagacacggccaaatctct

SEQ ID NO: 38436 - DNA, 25 bp, Rattus norvegicus
aagcacaagacagggccaaatctct

SEQ ID NO: 38437 - DNA, 25 bp, Rattus norvegicus
aagcacaagcacacgtggcttttca

SEQ ID NO: 38438 - DNA, 25 bp, Rattus norvegicus
aagcacaagcactcgtggcttttca

SEQ ID NO: 38439 - DNA, 25 bp, Rattus norvegicus
aagcacaaggaacttcatctcagga

SEQ ID NO: 38440 - DNA, 25 bp, Rattus norvegicus
aagcacaaggaagttcatctcagga

SEQ ID NO: 38441 - DNA, 25 bp, Rattus norvegicus
aagcacaatcagactttcctttgaa

SEQ ID NO: 38442 - DNA, 25 bp, Rattus norvegicus
aagcacaatcagtctttcctttgaa

SEQ ID NO: 38443 - DNA, 25 bp, Rattus norvegicus
aagcacaatgacatccatttcttga

SEQ ID NO: 38444 - DNA, 25 bp, Rattus norvegicus
aagcacaatgacttccatttcttga

SEQ ID NO: 38445 - DNA, 25 bp, Rattus norvegicus
aagcacaatgcaacgagtctcttga

SEQ ID NO: 38446 - DNA, 25 bp, Rattus norvegicus
aagcacaatgcatcgagtctcttga

SEQ ID NO: 38447 - DNA, 25 bp, Rattus norvegicus
aagcacaatgccacacatgggacaa

SEQ ID NO: 38448 - DNA, 25 bp, Rattus norvegicus
aagcacaatgcctcacatgggacaa

SEQ ID NO: 38449 - DNA, 25 bp, Rattus norvegicus
aagcacaatggcagtttcttcctcc

SEQ ID NO: 38450 - DNA, 25 bp, Rattus norvegicus
aagcacaatggctgtttcttcctcc

SEQ ID NO: 38451 - DNA, 25 bp, Rattus norvegicus
aagcacaattctcccttgatgttta

SEQ ID NO: 38452 - DNA, 25 bp, Rattus norvegicus
aagcacaattctgccttgatgttta

SEQ ID NO: 38453 - DNA, 25 bp, Rattus norvegicus
aagcacaattgcaggagcgtctcag

SEQ ID NO: 38454 - DNA, 25 bp, Rattus norvegicus
aagcacaattgctggagcgtctcag

SEQ ID NO: 38455 - DNA, 25 bp, Rattus norvegicus
aagcacacaaagagttccttcccat

SEQ ID NO: 38456 - DNA, 25 bp, Rattus norvegicus
aagcacacaaagtgttccttcccat

SEQ ID NO: 38457 - DNA, 25 bp, Rattus norvegicus
aagcacacaaggacagggtaggaga

SEQ ID NO: 38458 - DNA, 25 bp, Rattus norvegicus
aagcacacaaggtcagggtaggaga

SEQ ID NO: 38459 - DNA, 25 bp, Rattus norvegicus
aagcacacaatgatgccagagctag

SEQ ID NO: 38460 - DNA, 25 bp, Rattus norvegicus
aagcacacaatgttgccagagctag

SEQ ID NO: 38461 - DNA, 25 bp, Rattus norvegicus
aagcacacacacagccttaaggttc

SEQ ID NO: 38462 - DNA, 25 bp, Rattus norvegicus
aagcacacacactgccttaaggttc

SEQ ID NO: 38463 - DNA, 25 bp, Rattus norvegicus
aagcacacacagaacctgttgggct

SEQ ID NO: 38464 - DNA, 25 bp, Rattus norvegicus
aagcacacacagtacctgttgggct

SEQ ID NO: 38465 - DNA, 25 bp, Rattus norvegicus
aagcacacacgaagactggcctgaa

SEQ ID NO: 38466 - DNA, 25 bp, Rattus norvegicus
aagcacacacgatgactggcctgaa

SEQ ID NO: 38467 - DNA, 25 bp, Rattus norvegicus
aagcacacaggccagctgtggcagt

SEQ ID NO: 38468 - DNA, 25 bp, Rattus norvegicus
aagcacacaggcgagctgtggcagt

SEQ ID NO: 38469 - DNA, 25 bp, Rattus norvegicus
aagcacacagggatcttgaccatat

SEQ ID NO: 38470 - DNA, 25 bp, Rattus norvegicus
aagcacacagggttcttgaccatat

SEQ ID NO: 38471 - DNA, 25 bp, Rattus norvegicus
aagcacacagtacgtctcagtgacc

SEQ ID NO: 38472 - DNA, 25 bp, Rattus norvegicus
aagcacacagtaggtctcagtgacc

SEQ ID NO: 38473 - DNA, 25 bp, Rattus norvegicus
aagcacacagttccaagtcaaccag

SEQ ID NO: 38474 - DNA, 25 bp, Rattus norvegicus
aagcacacagttgcaagtcaaccag

SEQ ID NO: 38475 - DNA, 25 bp, Rattus norvegicus
aagcacaccactaccatttttgatg

SEQ ID NO: 38476 - DNA, 25 bp, Rattus norvegicus
aagcacaccacttccatttttgatg

SEQ ID NO: 38477 - DNA, 25 bp, Rattus norvegicus
aagcacacccagatacagcacgagc

SEQ ID NO: 38478 - DNA, 25 bp, Rattus norvegicus
aagcacacccagttacagcacgagc

SEQ ID NO: 38479 - DNA, 25 bp, Rattus norvegicus
aagcacacctatcacacgtttaaag

SEQ ID NO: 38480 - DNA, 25 bp, Rattus norvegicus
aagcacacctatgacacgtttaaag

SEQ ID NO: 38481 - DNA, 25 bp, Rattus norvegicus
aagcacacgaggatagcagctgaca

SEQ ID NO: 38482 - DNA, 25 bp, Rattus norvegicus
aagcacacgaggttagcagctgaca

SEQ ID NO: 38483 - DNA, 25 bp, Rattus norvegicus
aagcacacggctacggaacacttcg

SEQ ID NO: 38484 - DNA, 25 bp, Rattus norvegicus
aagcacacggcttcggaacacttcg

SEQ ID NO: 38485 - DNA, 25 bp, Rattus norvegicus
aagcacacggtcactttcatgccgc

SEQ ID NO: 38486 - DNA, 25 bp, Rattus norvegicus
aagcacacggtctctttcatgccgc

SEQ ID NO: 38487 - DNA, 25 bp, Rattus norvegicus
aagcacactgggactctacatggaa

SEQ ID NO: 38488 - DNA, 25 bp, Rattus norvegicus
aagcacactgggtctctacatggaa

SEQ ID NO: 38489 - DNA, 25 bp, Rattus norvegicus
aagcacactgtccatcaagtctcat

SEQ ID NO: 38490 - DNA, 25 bp, Rattus norvegicus
aagcacactgtcgatcaagtctcat

SEQ ID NO: 38491 - DNA, 25 bp, Rattus norvegicus
aagcacactgtgatcactcttacag

SEQ ID NO: 38492 - DNA, 25 bp, Rattus norvegicus
aagcacactgtgattggccgagtga

SEQ ID NO: 38493 - DNA, 25 bp, Rattus norvegicus
aagcacactgtgttcactcttacag

SEQ ID NO: 38494 - DNA, 25 bp, Rattus norvegicus
aagcacactgtgtttggccgagtga

SEQ ID NO: 38495 - DNA, 25 bp, Rattus norvegicus
aagcacacttaaacattctgctgag

SEQ ID NO: 38496 - DNA, 25 bp, Rattus norvegicus
aagcacacttaatcattctgctgag

SEQ ID NO: 38497 - DNA, 25 bp, Rattus norvegicus
aagcacactttccacatgttgggtg

SEQ ID NO: 38498 - DNA, 25 bp, Rattus norvegicus
aagcacactttcgacatgttgggtg

SEQ ID NO: 38499 - DNA, 25 bp, Rattus norvegicus
aagcacagaaagaaacctctcctcc

SEQ ID NO: 38500 - DNA, 25 bp, Rattus norvegicus
aagcacagaaagtaacctctcctcc

SEQ ID NO: 38501 - DNA, 25 bp, Rattus norvegicus
aagcacagactccagttctgccaaa

SEQ ID NO: 38502 - DNA, 25 bp, Rattus norvegicus
aagcacagactcgagttctgccaaa

SEQ ID NO: 38503 - DNA, 25 bp, Rattus norvegicus
aagcacagatgacggcagcctgagt

SEQ ID NO: 38504 - DNA, 25 bp, Rattus norvegicus
aagcacagatgagggcagcctgagt

SEQ ID NO: 38505 - DNA, 25 bp, Rattus norvegicus
aagcacagatgccagctcctttagt

SEQ ID NO: 38506 - DNA, 25 bp, Rattus norvegicus
aagcacagatgcgagctcctttagt

SEQ ID NO: 38507 - DNA, 25 bp, Rattus norvegicus
aagcacagatttacctctacacaca

SEQ ID NO: 38508 - DNA, 25 bp, Rattus norvegicus
aagcacagattttcctctacacaca

SEQ ID NO: 38509 - DNA, 25 bp, Rattus norvegicus
aagcacagcatgcagggcagttccc

SEQ ID NO: 38510 - DNA, 25 bp, Rattus norvegicus
aagcacagcatggagggcagttccc

SEQ ID NO: 38511 - DNA, 25 bp, Rattus norvegicus
aagcacagccatatggctacctttt

SEQ ID NO: 38512 - DNA, 25 bp, Rattus norvegicus
aagcacagccatttggctacctttt

SEQ ID NO: 38513 - DNA, 25 bp, Rattus norvegicus
aagcacagcccactggccttaggtc

SEQ ID NO: 38514 - DNA, 25 bp, Rattus norvegicus
aagcacagcccagtggccttaggtc

SEQ ID NO: 38515 - DNA, 25 bp, Rattus norvegicus
aagcacagctatccatgtccttctg

SEQ ID NO: 38516 - DNA, 25 bp, Rattus norvegicus
aagcacagctatgcatgtccttctg

SEQ ID NO: 38517 - DNA, 25 bp, Rattus norvegicus
aagcacaggaagagatcccacgcgt

SEQ ID NO: 38518 - DNA, 25 bp, Rattus norvegicus
aagcacaggaagtgatcccacgcgt

SEQ ID NO: 38519 - DNA, 25 bp, Rattus norvegicus
aagcacaggagtcgtgtcctccatg

SEQ ID NO: 38520 - DNA, 25 bp, Rattus norvegicus
aagcacaggagtggtgtcctccatg

SEQ ID NO: 38521 - DNA, 25 bp, Rattus norvegicus
aagcacaggcccatagccgctgtgg

SEQ ID NO: 38522 - DNA, 25 bp, Rattus norvegicus
aagcacaggcccttagccgctgtgg

SEQ ID NO: 38523 - DNA, 25 bp, Rattus norvegicus
aagcacaggtggcagctcatgctcc

SEQ ID NO: 38524 - DNA, 25 bp, Rattus norvegicus
aagcacaggtgggagctcatgctcc

SEQ ID NO: 38525 - DNA, 25 bp, Rattus norvegicus
aagcacaggtgtaccggacgagtct

SEQ ID NO: 38526 - DNA, 25 bp, Rattus norvegicus
aagcacaggtgttccggacgagtct

SEQ ID NO: 38527 - DNA, 25 bp, Rattus norvegicus
aagcacagtcacatggcgatgtccc

SEQ ID NO: 38528 - DNA, 25 bp, Rattus norvegicus
aagcacagtcacttggcgatgtccc

SEQ ID NO: 38529 - DNA, 25 bp, Rattus norvegicus
aagcacagtgacattttccctacaa

SEQ ID NO: 38530 - DNA, 25 bp, Rattus norvegicus
aagcacagtgactttttccctacaa

SEQ ID NO: 38531 - DNA, 25 bp, Rattus norvegicus
aagcacagtgcacacacttccagca

SEQ ID NO: 38532 - DNA, 25 bp, Rattus norvegicus
aagcacagtgcaccatgcagcgaga

SEQ ID NO: 38533 - DNA, 25 bp, Rattus norvegicus
aagcacagtgcagacacttccagca

SEQ ID NO: 38534 - DNA, 25 bp, Rattus norvegicus
aagcacagtgcagcatgcagcgaga

SEQ ID NO: 38535 - DNA, 25 bp, Rattus norvegicus
aagcacagtgccaggtagactcaca

SEQ ID NO: 38536 - DNA, 25 bp, Rattus norvegicus
aagcacagtgcctggtagactcaca

SEQ ID NO: 38537 - DNA, 25 bp, Rattus norvegicus
aagcacagtgctagacctactcaag

SEQ ID NO: 38538 - DNA, 25 bp, Rattus norvegicus
aagcacagtgcttgacctactcaag

SEQ ID NO: 38539 - DNA, 25 bp, Rattus norvegicus
aagcacagttaactgcagctcctcg

SEQ ID NO: 38540 - DNA, 25 bp, Rattus norvegicus
aagcacagttaagtgcagctcctcg

SEQ ID NO: 38541 - DNA, 25 bp, Rattus norvegicus
aagcacagttccacatgcgtttgtc

SEQ ID NO: 38542 - DNA, 25 bp, Rattus norvegicus
aagcacagttcctcatgcgtttgtc

SEQ ID NO: 38543 - DNA, 25 bp, Rattus norvegicus
aagcacagttctcggcattgccgtg

SEQ ID NO: 38544 - DNA, 25 bp, Rattus norvegicus
aagcacagttctgggcattgccgtg

SEQ ID NO: 38545 - DNA, 25 bp, Rattus norvegicus
aagcacagttgcaacctgggcgtac

SEQ ID NO: 38546 - DNA, 25 bp, Rattus norvegicus
aagcacagttgctacctgggcgtac

SEQ ID NO: 38547 - DNA, 25 bp, Rattus norvegicus
aagcacagttggcagctgctgagaa

SEQ ID NO: 38548 - DNA, 25 bp, Rattus norvegicus
aagcacagttgggagctgctgagaa

SEQ ID NO: 38549 - DNA, 25 bp, Rattus norvegicus
aagcacatcaatcgatccaccgttc

SEQ ID NO: 38550 - DNA, 25 bp, Rattus norvegicus
aagcacatcaatggatccaccgttc

SEQ ID NO: 38551 - DNA, 25 bp, Rattus norvegicus
aagcacatcattattctgtcacgta

SEQ ID NO: 38552 - DNA, 25 bp, Rattus norvegicus
aagcacatcatttttctgtcacgta

SEQ ID NO: 38553 - DNA, 25 bp, Rattus norvegicus
aagcacatccttaatggacttccca

SEQ ID NO: 38554 - DNA, 25 bp, Rattus norvegicus
aagcacatcctttatggacttccca

SEQ ID NO: 38555 - DNA, 25 bp, Rattus norvegicus
aagcacatctgtatggcaagcacca

SEQ ID NO: 38556 - DNA, 25 bp, Rattus norvegicus
aagcacatctgtttggcaagcacca

SEQ ID NO: 38557 - DNA, 25 bp, Rattus norvegicus
aagcacatggcaccgtctgcttgca

SEQ ID NO: 38558 - DNA, 25 bp, Rattus norvegicus
aagcacatggcagcgtctgcttgca

SEQ ID NO: 38559 - DNA, 25 bp, Rattus norvegicus
aagcacattaaacatcattctccaa

SEQ ID NO: 38560 - DNA, 25 bp, Rattus norvegicus
aagcacattaaagatcattctccaa

SEQ ID NO: 38561 - DNA, 25 bp, Rattus norvegicus
aagcacattattactgtcagcctgg

SEQ ID NO: 38562 - DNA, 25 bp, Rattus norvegicus
aagcacattatttctgtcagcctgg

SEQ ID NO: 38563 - DNA, 25 bp, Rattus norvegicus
aagcacattgctcattcctgagctc

SEQ ID NO: 38564 - DNA, 25 bp, Rattus norvegicus
aagcacattgctgattcctgagctc

SEQ ID NO: 38565 - DNA, 25 bp, Rattus norvegicus
aagcacattgttcccttctgtgaat

SEQ ID NO: 38566 - DNA, 25 bp, Rattus norvegicus
aagcacattgttgccttctgtgaat

SEQ ID NO: 38567 - DNA, 25 bp, Rattus norvegicus
aagcacatttttactgacgtaaact

SEQ ID NO: 38568 - DNA, 25 bp, Rattus norvegicus
aagcacattttttctgacgtaaact

SEQ ID NO: 38569 - DNA, 25 bp, Rattus norvegicus
aagcaccaacccattgtgccttgtg

SEQ ID NO: 38570 - DNA, 25 bp, Rattus norvegicus
aagcaccaaccctttgtgccttgtg

SEQ ID NO: 38571 - DNA, 25 bp, Rattus norvegicus
aagcaccaagcgctagactggacca

SEQ ID NO: 38572 - DNA, 25 bp, Rattus norvegicus
aagcaccaagcggtagactggacca

SEQ ID NO: 38573 - DNA, 25 bp, Rattus norvegicus
aagcaccaagctacagttctctgac

SEQ ID NO: 38574 - DNA, 25 bp, Rattus norvegicus
aagcaccaagcttcagttctctgac

SEQ ID NO: 38575 - DNA, 25 bp, Rattus norvegicus
aagcaccaagtcataatggagcaga

SEQ ID NO: 38576 - DNA, 25 bp, Rattus norvegicus
aagcaccaagtcttaatggagcaga

SEQ ID NO: 38577 - DNA, 25 bp, Rattus norvegicus
aagcaccacagtaatgtagtcacaa

SEQ ID NO: 38578 - DNA, 25 bp, Rattus norvegicus
aagcaccacagttatgtagtcacaa

SEQ ID NO: 38579 - DNA, 25 bp, Rattus norvegicus
aagcaccactatcactgagccatct

SEQ ID NO: 38580 - DNA, 25 bp, Rattus norvegicus
aagcaccactatgactgagccatct

SEQ ID NO: 38581 - DNA, 25 bp, Rattus norvegicus
aagcaccagagtacaacccacaagg

SEQ ID NO: 38582 - DNA, 25 bp, Rattus norvegicus
aagcaccagagttcaacccacaagg

SEQ ID NO: 38583 - DNA, 25 bp, Rattus norvegicus
aagcaccagatcaaacaggccgtga

SEQ ID NO: 38584 - DNA, 25 bp, Rattus norvegicus
aagcaccagatctaacaggccgtga

SEQ ID NO: 38585 - DNA, 25 bp, Rattus norvegicus
aagcaccagccaagtatgaacatgt

SEQ ID NO: 38586 - DNA, 25 bp, Rattus norvegicus
aagcaccagccatgtatgaacatgt

SEQ ID NO: 38587 - DNA, 25 bp, Rattus norvegicus
aagcaccaggtgaggcaccgttcat

SEQ ID NO: 38588 - DNA, 25 bp, Rattus norvegicus
aagcaccaggtgtggcaccgttcat

SEQ ID NO: 38589 - DNA, 25 bp, Rattus norvegicus
aagcaccagtttccattaccttaag

SEQ ID NO: 38590 - DNA, 25 bp, Rattus norvegicus
aagcaccagtttgcattaccttaag

SEQ ID NO: 38591 - DNA, 25 bp, Rattus norvegicus
aagcaccatgctaatggacctcatc

SEQ ID NO: 38592 - DNA, 25 bp, Rattus norvegicus
aagcaccatgcttatggacctcatc

SEQ ID NO: 38593 - DNA, 25 bp, Rattus norvegicus
aagcaccatttccagtatatcgttt

SEQ ID NO: 38594 - DNA, 25 bp, Rattus norvegicus
aagcaccatttcgagtatatcgttt

SEQ ID NO: 38595 - DNA, 25 bp, Rattus norvegicus
aagcaccattttccttgtaaagaag

SEQ ID NO: 38596 - DNA, 25 bp, Rattus norvegicus
aagcaccattttgcttgtaaagaag

SEQ ID NO: 38597 - DNA, 25 bp, Rattus norvegicus
aagcaccccacgacgggaattatcg

SEQ ID NO: 38598 - DNA, 25 bp, Rattus norvegicus
aagcaccccacgtcgggaattatcg

SEQ ID NO: 38599 - DNA, 25 bp, Rattus norvegicus
aagcaccccgaaactctgaagtgtg

SEQ ID NO: 38600 - DNA, 25 bp, Rattus norvegicus
aagcaccccgaatctctgaagtgtg

SEQ ID NO: 38601 - DNA, 25 bp, Rattus norvegicus
aagcaccccggtcgctctcggagtt

SEQ ID NO: 38602 - DNA, 25 bp, Rattus norvegicus
aagcaccccggtggctctcggagtt

SEQ ID NO: 38603 - DNA, 25 bp, Rattus norvegicus
aagcacccgtggaggatgttcctgg

SEQ ID NO: 38604 - DNA, 25 bp, Rattus norvegicus
aagcacccgtggtggatgttcctgg

SEQ ID NO: 38605 - DNA, 25 bp, Rattus norvegicus
aagcaccctatacctgcaaatggac

SEQ ID NO: 38606 - DNA, 25 bp, Rattus norvegicus
aagcaccctatagctgcaaatggac

SEQ ID NO: 38607 - DNA, 25 bp, Rattus norvegicus
aagcaccgagctacctgttaattcc

SEQ ID NO: 38608 - DNA, 25 bp, Rattus norvegicus
aagcaccgagcttcctgttaattcc

SEQ ID NO: 38609 - DNA, 25 bp, Rattus norvegicus
aagcaccgcgaacaagtgacaccgt

SEQ ID NO: 38610 - DNA, 25 bp, Rattus norvegicus
aagcaccgcgaagaagtgacaccgt

SEQ ID NO: 38611 - DNA, 25 bp, Rattus norvegicus
aagcaccgggacaatggttgccttt

SEQ ID NO: 38612 - DNA, 25 bp, Rattus norvegicus
aagcaccgggactatggttgccttt

SEQ ID NO: 38613 - DNA, 25 bp, Rattus norvegicus
aagcaccgtgcgctctgcagatcag

SEQ ID NO: 38614 - DNA, 25 bp, Rattus norvegicus
aagcaccgtgcggtctgcagatcag

SEQ ID NO: 38615 - DNA, 25 bp, Rattus norvegicus
aagcaccgtggactcaggccagtac

SEQ ID NO: 38616 - DNA, 25 bp, Rattus norvegicus
aagcaccgtggagtcaggccagtac

SEQ ID NO: 38617 - DNA, 25 bp, Rattus norvegicus
aagcaccgttgccattacagacagg

SEQ ID NO: 38618 - DNA, 25 bp, Rattus norvegicus
aagcaccgttgcgattacagacagg

SEQ ID NO: 38619 - DNA, 25 bp, Rattus norvegicus
aagcacctaaatccgcatgtggcgt

SEQ ID NO: 38620 - DNA, 25 bp, Rattus norvegicus
aagcacctaaatgcgcatgtggcgt

SEQ ID NO: 38621 - DNA, 25 bp, Rattus norvegicus
aagcacctagccaggagctcctaga

SEQ ID NO: 38622 - DNA, 25 bp, Rattus norvegicus
aagcacctagcccttccagaaaatc

SEQ ID NO: 38623 - DNA, 25 bp, Rattus norvegicus
aagcacctagccgttccagaaaatc

SEQ ID NO: 38624 - DNA, 25 bp, Rattus norvegicus
aagcacctagcctggagctcctaga

SEQ ID NO: 38625 - DNA, 25 bp, Rattus norvegicus
aagcacctgaacctgtctatgtaca

SEQ ID NO: 38626 - DNA, 25 bp, Rattus norvegicus
aagcacctgaacgtgtctatgtaca

SEQ ID NO: 38627 - DNA, 25 bp, Rattus norvegicus
aagcacctgctgcaggtggcttgct

SEQ ID NO: 38628 - DNA, 25 bp, Rattus norvegicus
aagcacctgctggaggtggcttgct

SEQ ID NO: 38629 - DNA, 25 bp, Rattus norvegicus
aagcacctgggtagtctggtggaaa

SEQ ID NO: 38630 - DNA, 25 bp, Rattus norvegicus
aagcacctgggttgtctggtggaaa

SEQ ID NO: 38631 - DNA, 25 bp, Rattus norvegicus
aagcacctggtcacggataagctga

SEQ ID NO: 38632 - DNA, 25 bp, Rattus norvegicus
aagcacctggtctcggataagctga

SEQ ID NO: 38633 - DNA, 25 bp, Rattus norvegicus
aagcacctgtaaaagagtccttcat

SEQ ID NO: 38634 - DNA, 25 bp, Rattus norvegicus
aagcacctgtaatagagtccttcat

SEQ ID NO: 38635 - DNA, 25 bp, Rattus norvegicus
aagcacctgtctcttatttcaaaaa

SEQ ID NO: 38636 - DNA, 25 bp, Rattus norvegicus
aagcacctgtctgttatttcaaaaa

SEQ ID NO: 38637 - DNA, 25 bp, Rattus norvegicus
aagcacctgttgaagccagaccgga

SEQ ID NO: 38638 - DNA, 25 bp, Rattus norvegicus
aagcacctgttgtagccagaccgga

SEQ ID NO: 38639 - DNA, 25 bp, Rattus norvegicus
aagcacctgtttaggtgtgtccacc

SEQ ID NO: 38640 - DNA, 25 bp, Rattus norvegicus
aagcacctgttttggtgtgtccacc

SEQ ID NO: 38641 - DNA, 25 bp, Rattus norvegicus
aagcaccttaatcgcttagctcctg

SEQ ID NO: 38642 - DNA, 25 bp, Rattus norvegicus
aagcaccttaatggcttagctcctg

SEQ ID NO: 38643 - DNA, 25 bp, Rattus norvegicus
aagcaccttgacacataatgaactc

SEQ ID NO: 38644 - DNA, 25 bp, Rattus norvegicus
aagcaccttgactcataatgaactc

SEQ ID NO: 38645 - DNA, 25 bp, Rattus norvegicus
aagcaccttgtaagtagtaatgtat

SEQ ID NO: 38646 - DNA, 25 bp, Rattus norvegicus
aagcaccttgtatgtagtaatgtat

SEQ ID NO: 38647 - DNA, 25 bp, Rattus norvegicus
aagcaccttgtgagctggcagctac

SEQ ID NO: 38648 - DNA, 25 bp, Rattus norvegicus
aagcaccttgtgtgctggcagctac

SEQ ID NO: 38649 - DNA, 25 bp, Rattus norvegicus
aagcaccttgttctgtcattcaaca

SEQ ID NO: 38650 - DNA, 25 bp, Rattus norvegicus
aagcaccttgttgtgtcattcaaca

SEQ ID NO: 38651 - DNA, 25 bp, Rattus norvegicus
aagcacctttatcaagacccacggc

SEQ ID NO: 38652 - DNA, 25 bp, Rattus norvegicus
aagcacctttatgaagacccacggc

SEQ ID NO: 38653 - DNA, 25 bp, Rattus norvegicus
aagcacctttctcctgatggccagt

SEQ ID NO: 38654 - DNA, 25 bp, Rattus norvegicus
aagcacctttctgctgatggccagt

SEQ ID NO: 38655 - DNA, 25 bp, Rattus norvegicus
aagcacctttgcaaatcccaagtac

SEQ ID NO: 38656 - DNA, 25 bp, Rattus norvegicus
aagcacctttgctaatcccaagtac

SEQ ID NO: 38657 - DNA, 25 bp, Rattus norvegicus
aagcacgacggcaccaagacggagc

SEQ ID NO: 38658 - DNA, 25 bp, Rattus norvegicus
aagcacgacggctccaagacggagc

SEQ ID NO: 38659 - DNA, 25 bp, Rattus norvegicus
aagcacgcaccgcagagtcagtcag

SEQ ID NO: 38660 - DNA, 25 bp, Rattus norvegicus
aagcacgcaccggagagtcagtcag

SEQ ID NO: 38661 - DNA, 25 bp, Rattus norvegicus
aagcacgcactgctcttggagagga

SEQ ID NO: 38662 - DNA, 25 bp, Rattus norvegicus
aagcacgcactggtcttggagagga

SEQ ID NO: 38663 - DNA, 25 bp, Rattus norvegicus
aagcacgcagaaatctttagaggga

SEQ ID NO: 38664 - DNA, 25 bp, Rattus norvegicus
aagcacgcagaattctttagaggga

SEQ ID NO: 38665 - DNA, 25 bp, Rattus norvegicus
aagcacgcagatcccatggacattt

SEQ ID NO: 38666 - DNA, 25 bp, Rattus norvegicus
aagcacgcagatgccatggacattt

SEQ ID NO: 38667 - DNA, 25 bp, Rattus norvegicus
aagcacgcattcctagactgatggc

SEQ ID NO: 38668 - DNA, 25 bp, Rattus norvegicus
aagcacgcattcgtagactgatggc

SEQ ID NO: 38669 - DNA, 25 bp, Rattus norvegicus
aagcacgcctatctgtgtatgcctg

SEQ ID NO: 38670 - DNA, 25 bp, Rattus norvegicus
aagcacgcctatgtgtgtatgcctg

SEQ ID NO: 38671 - DNA, 25 bp, Rattus norvegicus
aagcacgcgcctcacttacagatca

SEQ ID NO: 38672 - DNA, 25 bp, Rattus norvegicus
aagcacgcgcctgacttacagatca

SEQ ID NO: 38673 - DNA, 25 bp, Rattus norvegicus
aagcacgcgctcacaggtcaggaga

SEQ ID NO: 38674 - DNA, 25 bp, Rattus norvegicus
aagcacgcgctctcaggtcaggaga

SEQ ID NO: 38675 - DNA, 25 bp, Rattus norvegicus
aagcacgctgaaaactttgacgttg

SEQ ID NO: 38676 - DNA, 25 bp, Rattus norvegicus
aagcacgctgaatactttgacgttg

SEQ ID NO: 38677 - DNA, 25 bp, Rattus norvegicus
aagcacgctgagctgatgccggcta

SEQ ID NO: 38678 - DNA, 25 bp, Rattus norvegicus
aagcacgctgaggtgatgccggcta

SEQ ID NO: 38679 - DNA, 25 bp, Rattus norvegicus
aagcacggagacatctgagtagatc

SEQ ID NO: 38680 - DNA, 25 bp, Rattus norvegicus
aagcacggagacttctgagtagatc

SEQ ID NO: 38681 - DNA, 25 bp, Rattus norvegicus
aagcacggagcaccgcacgacctgg

SEQ ID NO: 38682 - DNA, 25 bp, Rattus norvegicus
aagcacggagcagcgcacgacctgg

SEQ ID NO: 38683 - DNA, 25 bp, Rattus norvegicus
aagcacggagctatgtttacacttt

SEQ ID NO: 38684 - DNA, 25 bp, Rattus norvegicus
aagcacggagctttgtttacacttt

SEQ ID NO: 38685 - DNA, 25 bp, Rattus norvegicus
aagcacgggagaatcagcaccatct

SEQ ID NO: 38686 - DNA, 25 bp, Rattus norvegicus
aagcacgggagattcagcaccatct

SEQ ID NO: 38687 - DNA, 25 bp, Rattus norvegicus
aagcacgggcacctgagttcagatt

SEQ ID NO: 38688 - DNA, 25 bp, Rattus norvegicus
aagcacgggcacgtgagttcagatt

SEQ ID NO: 38689 - DNA, 25 bp, Rattus norvegicus
aagcacggtcacaggaggcgctgct

SEQ ID NO: 38690 - DNA, 25 bp, Rattus norvegicus
aagcacggtcactggaggcgctgct

SEQ ID NO: 38691 - DNA, 25 bp, Rattus norvegicus
aagcacggtgctcgtaacagtccaa

SEQ ID NO: 38692 - DNA, 25 bp, Rattus norvegicus
aagcacggtgctggtaacagtccaa

SEQ ID NO: 38693 - DNA, 25 bp, Rattus norvegicus
aagcacgtcagcagggcctatggtg

SEQ ID NO: 38694 - DNA, 25 bp, Rattus norvegicus
aagcacgtcagctgggcctatggtg

SEQ ID NO: 38695 - DNA, 25 bp, Rattus norvegicus
aagcacgtcggtatttgagaactca

SEQ ID NO: 38696 - DNA, 25 bp, Rattus norvegicus
aagcacgtcggtttttgagaactca

SEQ ID NO: 38697 - DNA, 25 bp, Rattus norvegicus
aagcacgtctcccttgtgtttaatt

SEQ ID NO: 38698 - DNA, 25 bp, Rattus norvegicus
aagcacgtctccgttgtgtttaatt

SEQ ID NO: 38699 - DNA, 25 bp, Rattus norvegicus
aagcacgtcttgcaacagagcaccc

SEQ ID NO: 38700 - DNA, 25 bp, Rattus norvegicus
aagcacgtcttggaacagagcaccc

SEQ ID NO: 38701 - DNA, 25 bp, Rattus norvegicus
aagcacgtgagtccggaagatccag

SEQ ID NO: 38702 - DNA, 25 bp, Rattus norvegicus
aagcacgtgagtgcggaagatccag

SEQ ID NO: 38703 - DNA, 25 bp, Rattus norvegicus
aagcacgtgcttctggatcattgat

SEQ ID NO: 38704 - DNA, 25 bp, Rattus norvegicus
aagcacgtgcttgtggatcattgat

SEQ ID NO: 38705 - DNA, 25 bp, Rattus norvegicus
aagcacgtggcgacccgagttggct

SEQ ID NO: 38706 - DNA, 25 bp, Rattus norvegicus
aagcacgtggcgtcccgagttggct

SEQ ID NO: 38707 - DNA, 25 bp, Rattus norvegicus
aagcacgtgtgtatttgagtggcta

SEQ ID NO: 38708 - DNA, 25 bp, Rattus norvegicus
aagcacgtgtgtttttgagtggcta

SEQ ID NO: 38709 - DNA, 25 bp, Rattus norvegicus
aagcacgtgtttactgctcggtggg

SEQ ID NO: 38710 - DNA, 25 bp, Rattus norvegicus
aagcacgtgttttctgctcggtggg

SEQ ID NO: 38711 - DNA, 25 bp, Rattus norvegicus
aagcacgttcctaactgagctgtct

SEQ ID NO: 38712 - DNA, 25 bp, Rattus norvegicus
aagcacgttccttactgagctgtct

SEQ ID NO: 38713 - DNA, 25 bp, Rattus norvegicus
aagcacgttgctaatgaaggccagg

SEQ ID NO: 38714 - DNA, 25 bp, Rattus norvegicus
aagcacgttgcttatgaaggccagg

SEQ ID NO: 38715 - DNA, 25 bp, Rattus norvegicus
aagcacgttggtacatttgtctatg

SEQ ID NO: 38716 - DNA, 25 bp, Rattus norvegicus
aagcacgttggttcatttgtctatg

SEQ ID NO: 38717 - DNA, 25 bp, Rattus norvegicus
aagcactaaattccattctctatta

SEQ ID NO: 38718 - DNA, 25 bp, Rattus norvegicus
aagcactaaattgcattctctatta

SEQ ID NO: 38719 - DNA, 25 bp, Rattus norvegicus
aagcactaagcccaggaccatatga

SEQ ID NO: 38720 - DNA, 25 bp, Rattus norvegicus
aagcactaagccgaggaccatatga

SEQ ID NO: 38721 - DNA, 25 bp, Rattus norvegicus
aagcactacattccctgcattgcaa

SEQ ID NO: 38722 - DNA, 25 bp, Rattus norvegicus
aagcactacattctggctgtcccct

SEQ ID NO: 38723 - DNA, 25 bp, Rattus norvegicus
aagcactacattgcctgcattgcaa

SEQ ID NO: 38724 - DNA, 25 bp, Rattus norvegicus
aagcactacattgtggctgtcccct

SEQ ID NO: 38725 - DNA, 25 bp, Rattus norvegicus
aagcactagactatggagccctgaa

SEQ ID NO: 38726 - DNA, 25 bp, Rattus norvegicus
aagcactagactttggagccctgaa

SEQ ID NO: 38727 - DNA, 25 bp, Rattus norvegicus
aagcactagaggctggtagccactc

SEQ ID NO: 38728 - DNA, 25 bp, Rattus norvegicus
aagcactagagggtggtagccactc

SEQ ID NO: 38729 - DNA, 25 bp, Rattus norvegicus
aagcactagcatacggacatgtcag

SEQ ID NO: 38730 - DNA, 25 bp, Rattus norvegicus
aagcactagcattcggacatgtcag

SEQ ID NO: 38731 - DNA, 25 bp, Rattus norvegicus
aagcactagcgtccgagttcgtcca

SEQ ID NO: 38732 - DNA, 25 bp, Rattus norvegicus
aagcactagcgtgcgagttcgtcca

SEQ ID NO: 38733 - DNA, 25 bp, Rattus norvegicus
aagcactaggcacagagagaccctg

SEQ ID NO: 38734 - DNA, 25 bp, Rattus norvegicus
aagcactaggcagagagagaccctg

SEQ ID NO: 38735 - DNA, 25 bp, Rattus norvegicus
aagcactatgagaggcagatggacc

SEQ ID NO: 38736 - DNA, 25 bp, Rattus norvegicus
aagcactatgagtggcagatggacc

SEQ ID NO: 38737 - DNA, 25 bp, Rattus norvegicus
aagcactatgtgctctgcgtggtca

SEQ ID NO: 38738 - DNA, 25 bp, Rattus norvegicus
aagcactatgtggtctgcgtggtca

SEQ ID NO: 38739 - DNA, 25 bp, Rattus norvegicus
aagcactattttaggagagcgggat

SEQ ID NO: 38740 - DNA, 25 bp, Rattus norvegicus
aagcactatttttggagagcgggat

SEQ ID NO: 38741 - DNA, 25 bp, Rattus norvegicus
aagcactcaaaacttcatggacagt

SEQ ID NO: 38742 - DNA, 25 bp, Rattus norvegicus
aagcactcaaaagttcatggacagt

SEQ ID NO: 38743 - DNA, 25 bp, Rattus norvegicus
aagcactcaaagagcagagacagct

SEQ ID NO: 38744 - DNA, 25 bp, Rattus norvegicus
aagcactcaaagctgagcctctgag

SEQ ID NO: 38745 - DNA, 25 bp, Rattus norvegicus
aagcactcaaaggtgagcctctgag

SEQ ID NO: 38746 - DNA, 25 bp, Rattus norvegicus
aagcactcaaagtgcagagacagct

SEQ ID NO: 38747 - DNA, 25 bp, Rattus norvegicus
aagcactcagttagccctcagagat

SEQ ID NO: 38748 - DNA, 25 bp, Rattus norvegicus
aagcactcagtttgccctcagagat

SEQ ID NO: 38749 - DNA, 25 bp, Rattus norvegicus
aagcactcattaaatcctgccttcc

SEQ ID NO: 38750 - DNA, 25 bp, Rattus norvegicus
aagcactcattatatcctgccttcc

SEQ ID NO: 38751 - DNA, 25 bp, Rattus norvegicus
aagcactcatttacatagtactcat

SEQ ID NO: 38752 - DNA, 25 bp, Rattus norvegicus
aagcactcattttcatagtactcat

SEQ ID NO: 38753 - DNA, 25 bp, Rattus norvegicus
aagcactccatactccgtttgggaa

SEQ ID NO: 38754 - DNA, 25 bp, Rattus norvegicus
aagcactccatagtccgtttgggaa

SEQ ID NO: 38755 - DNA, 25 bp, Rattus norvegicus
aagcactcggccagatttgggttct

SEQ ID NO: 38756 - DNA, 25 bp, Rattus norvegicus
aagcactcggcctgatttgggttct

SEQ ID NO: 38757 - DNA, 25 bp, Rattus norvegicus
aagcactctggaaggacgtttcgca

SEQ ID NO: 38758 - DNA, 25 bp, Rattus norvegicus
aagcactctggatggacgtttcgca

SEQ ID NO: 38759 - DNA, 25 bp, Rattus norvegicus
aagcactctgtgaatgtaaggcaat

SEQ ID NO: 38760 - DNA, 25 bp, Rattus norvegicus
aagcactctgtgcactgagcaatat

SEQ ID NO: 38761 - DNA, 25 bp, Rattus norvegicus
aagcactctgtgcattccaatctct

SEQ ID NO: 38762 - DNA, 25 bp, Rattus norvegicus
aagcactctgtggactgagcaatat

SEQ ID NO: 38763 - DNA, 25 bp, Rattus norvegicus
aagcactctgtggattccaatctct

SEQ ID NO: 38764 - DNA, 25 bp, Rattus norvegicus
aagcactctgtgtatgtaaggcaat

SEQ ID NO: 38765 - DNA, 25 bp, Rattus norvegicus
aagcactcttatcccttcaatgcac

SEQ ID NO: 38766 - DNA, 25 bp, Rattus norvegicus
aagcactcttatgccttcaatgcac

SEQ ID NO: 38767 - DNA, 25 bp, Rattus norvegicus
aagcactcttgaaacttgcccggaa

SEQ ID NO: 38768 - DNA, 25 bp, Rattus norvegicus
aagcactcttgatacttgcccggaa

SEQ ID NO: 38769 - DNA, 25 bp, Rattus norvegicus
aagcactctttgacttaccgttatg

SEQ ID NO: 38770 - DNA, 25 bp, Rattus norvegicus
aagcactctttgtcttaccgttatg

SEQ ID NO: 38771 - DNA, 25 bp, Rattus norvegicus
aagcactgacctacctgattttgga

SEQ ID NO: 38772 - DNA, 25 bp, Rattus norvegicus
aagcactgaccttcctgattttgga

SEQ ID NO: 38773 - DNA, 25 bp, Rattus norvegicus
aagcactgagaacactgaagcggaa

SEQ ID NO: 38774 - DNA, 25 bp, Rattus norvegicus
aagcactgagaagactgaagcggaa

SEQ ID NO: 38775 - DNA, 25 bp, Rattus norvegicus
aagcactgagccctggacactgagg

SEQ ID NO: 38776 - DNA, 25 bp, Rattus norvegicus
aagcactgagccgtggacactgagg

SEQ ID NO: 38777 - DNA, 25 bp, Rattus norvegicus
aagcactgagttactcttccaagac

SEQ ID NO: 38778 - DNA, 25 bp, Rattus norvegicus
aagcactgagtttctcttccaagac

SEQ ID NO: 38779 - DNA, 25 bp, Rattus norvegicus
aagcactgcacaatgtccctttttt

SEQ ID NO: 38780 - DNA, 25 bp, Rattus norvegicus
aagcactgcacattgtccctttttt

SEQ ID NO: 38781 - DNA, 25 bp, Rattus norvegicus
aagcactgcagaagccgcttctctg

SEQ ID NO: 38782 - DNA, 25 bp, Rattus norvegicus
aagcactgcagatgccgcttctctg

SEQ ID NO: 38783 - DNA, 25 bp, Rattus norvegicus
aagcactgccccacttatttgaagc

SEQ ID NO: 38784 - DNA, 25 bp, Rattus norvegicus
aagcactgcccctcttatttgaagc

SEQ ID NO: 38785 - DNA, 25 bp, Rattus norvegicus
aagcactgctagactttgagattct

SEQ ID NO: 38786 - DNA, 25 bp, Rattus norvegicus
aagcactgctagtctttgagattct

SEQ ID NO: 38787 - DNA, 25 bp, Rattus norvegicus
aagcactgctgcactagttacctgg

SEQ ID NO: 38788 - DNA, 25 bp, Rattus norvegicus
aagcactgctgctctagttacctgg

SEQ ID NO: 38789 - DNA, 25 bp, Rattus norvegicus
aagcactggaacacatactgcacca

SEQ ID NO: 38790 - DNA, 25 bp, Rattus norvegicus
aagcactggaactcatactgcacca

SEQ ID NO: 38791 - DNA, 25 bp, Rattus norvegicus
aagcactggacacacagcattactg

SEQ ID NO: 38792 - DNA, 25 bp, Rattus norvegicus
aagcactggacagacagcattactg

SEQ ID NO: 38793 - DNA, 25 bp, Rattus norvegicus
aagcactgggccagcagtcagaact

SEQ ID NO: 38794 - DNA, 25 bp, Rattus norvegicus
aagcactgggcctgcagtcagaact

SEQ ID NO: 38795 - DNA, 25 bp, Rattus norvegicus
aagcactggtggcactaagcggcct

SEQ ID NO: 38796 - DNA, 25 bp, Rattus norvegicus
aagcactggtgggactaagcggcct

SEQ ID NO: 38797 - DNA, 25 bp, Rattus norvegicus
aagcactgtcatattcatctggaac

SEQ ID NO: 38798 - DNA, 25 bp, Rattus norvegicus
aagcactgtcattttcatctggaac

SEQ ID NO: 38799 - DNA, 25 bp, Rattus norvegicus
aagcactgtgtacgctttctctgca

SEQ ID NO: 38800 - DNA, 25 bp, Rattus norvegicus
aagcactgtgtaggctttctctgca

SEQ ID NO: 38801 - DNA, 25 bp, Rattus norvegicus
aagcactgttacatgagagtagcag

SEQ ID NO: 38802 - DNA, 25 bp, Rattus norvegicus
aagcactgttacttgagagtagcag

SEQ ID NO: 38803 - DNA, 25 bp, Rattus norvegicus
aagcactgttgaccgaaggctggac

SEQ ID NO: 38804 - DNA, 25 bp, Rattus norvegicus
aagcactgttgagcgaaggctggac

SEQ ID NO: 38805 - DNA, 25 bp, Rattus norvegicus
aagcacttacagaggtctgcccaaa

SEQ ID NO: 38806 - DNA, 25 bp, Rattus norvegicus
aagcacttacagtggtctgcccaaa

SEQ ID NO: 38807 - DNA, 25 bp, Rattus norvegicus
aagcacttactcagaagttttctga

SEQ ID NO: 38808 - DNA, 25 bp, Rattus norvegicus
aagcacttactctgaagttttctga

SEQ ID NO: 38809 - DNA, 25 bp, Rattus norvegicus
aagcacttcatccacagttgtttgt

SEQ ID NO: 38810 - DNA, 25 bp, Rattus norvegicus
aagcacttcatcgacagttgtttgt

SEQ ID NO: 38811 - DNA, 25 bp, Rattus norvegicus
aagcacttccacctactgaggaatc

SEQ ID NO: 38812 - DNA, 25 bp, Rattus norvegicus
aagcacttccacgtactgaggaatc

SEQ ID NO: 38813 - DNA, 25 bp, Rattus norvegicus
aagcacttccttactctttgacttt

SEQ ID NO: 38814 - DNA, 25 bp, Rattus norvegicus
aagcacttcctttctctttgacttt

SEQ ID NO: 38815 - DNA, 25 bp, Rattus norvegicus
aagcacttcgacaggctgtatgcgc

SEQ ID NO: 38816 - DNA, 25 bp, Rattus norvegicus
aagcacttcgactggctgtatgcgc

SEQ ID NO: 38817 - DNA, 25 bp, Rattus norvegicus
aagcacttcttcctgtacggcgagt

SEQ ID NO: 38818 - DNA, 25 bp, Rattus norvegicus
aagcacttcttcgtgtacggcgagt

SEQ ID NO: 38819 - DNA, 25 bp, Rattus norvegicus
aagcacttctttcgatttactagga

SEQ ID NO: 38820 - DNA, 25 bp, Rattus norvegicus
aagcacttctttggatttactagga

SEQ ID NO: 38821 - DNA, 25 bp, Rattus norvegicus
aagcacttgccccactgtatatata

SEQ ID NO: 38822 - DNA, 25 bp, Rattus norvegicus
aagcacttgcccgactgtatatata

SEQ ID NO: 38823 - DNA, 25 bp, Rattus norvegicus
aagcacttgcgaaggacttttgttc

SEQ ID NO: 38824 - DNA, 25 bp, Rattus norvegicus
aagcacttgcgatggacttttgttc

SEQ ID NO: 38825 - DNA, 25 bp, Rattus norvegicus
aagcacttgctacacaagcctggtg

SEQ ID NO: 38826 - DNA, 25 bp, Rattus norvegicus
aagcacttgctagacaagcctggtg

SEQ ID NO: 38827 - DNA, 25 bp, Rattus norvegicus
aagcacttgtatatttacacgcatc

SEQ ID NO: 38828 - DNA, 25 bp, Rattus norvegicus
aagcacttgtatttttacacgcatc

SEQ ID NO: 38829 - DNA, 25 bp, Rattus norvegicus
aagcacttgtcccaggtgcgagtct

SEQ ID NO: 38830 - DNA, 25 bp, Rattus norvegicus
aagcacttgtccgaggtgcgagtct

SEQ ID NO: 38831 - DNA, 25 bp, Rattus norvegicus
aagcacttgtggcagcagggctcac

SEQ ID NO: 38832 - DNA, 25 bp, Rattus norvegicus
aagcacttgtgggagcagggctcac

SEQ ID NO: 38833 - DNA, 25 bp, Rattus norvegicus
aagcactttacaattgccatccaag

SEQ ID NO: 38834 - DNA, 25 bp, Rattus norvegicus
aagcactttacatttgccatccaag

SEQ ID NO: 38835 - DNA, 25 bp, Rattus norvegicus
aagcactttcctctcagtacttgag

SEQ ID NO: 38836 - DNA, 25 bp, Rattus norvegicus
aagcactttcctgtcagtacttgag

SEQ ID NO: 38837 - DNA, 25 bp, Rattus norvegicus
aagcactttctcagtcttagttgtg

SEQ ID NO: 38838 - DNA, 25 bp, Rattus norvegicus
aagcactttctctgtcttagttgtg

SEQ ID NO: 38839 - DNA, 25 bp, Rattus norvegicus
aagcacttttgtcgtacctttcact

SEQ ID NO: 38840 - DNA, 25 bp, Rattus norvegicus
aagcacttttgtggtacctttcact

SEQ ID NO: 38841 - DNA, 25 bp, Rattus norvegicus
aagcagaaaccgcatgctctgccca

SEQ ID NO: 38842 - DNA, 25 bp, Rattus norvegicus
aagcagaaaccggatgctctgccca

SEQ ID NO: 38843 - DNA, 25 bp, Rattus norvegicus
aagcagaaactgaccttaaccacca

SEQ ID NO: 38844 - DNA, 25 bp, Rattus norvegicus
aagcagaaactgtccttaaccacca

SEQ ID NO: 38845 - DNA, 25 bp, Rattus norvegicus
aagcagaaagcccatgccagtgcta

SEQ ID NO: 38846 - DNA, 25 bp, Rattus norvegicus
aagcagaaagccgatgccagtgcta

SEQ ID NO: 38847 - DNA, 25 bp, Rattus norvegicus
aagcagaaaggccatcttcccactg

SEQ ID NO: 38848 - DNA, 25 bp, Rattus norvegicus
aagcagaaaggcgatcttcccactg

SEQ ID NO: 38849 - DNA, 25 bp, Rattus norvegicus
aagcagaaatcgagtgccacctctg

SEQ ID NO: 38850 - DNA, 25 bp, Rattus norvegicus
aagcagaaatcgtgtgccacctctg

SEQ ID NO: 38851 - DNA, 25 bp, Rattus norvegicus
aagcagaactatacttcacactccc

SEQ ID NO: 38852 - DNA, 25 bp, Rattus norvegicus
aagcagaactattcttcacactccc

SEQ ID NO: 38853 - DNA, 25 bp, Rattus norvegicus
aagcagaactcccagcgtggcctga

SEQ ID NO: 38854 - DNA, 25 bp, Rattus norvegicus
aagcagaactccgagcgtggcctga

SEQ ID NO: 38855 - DNA, 25 bp, Rattus norvegicus
aagcagaacttgctgcagttgccga

SEQ ID NO: 38856 - DNA, 25 bp, Rattus norvegicus
aagcagaacttggtgcagttgccga

SEQ ID NO: 38857 - DNA, 25 bp, Rattus norvegicus
aagcagaagcccacaggcgtcggag

SEQ ID NO: 38858 - DNA, 25 bp, Rattus norvegicus
aagcagaagccctcaggcgtcggag

SEQ ID NO: 38859 - DNA, 25 bp, Rattus norvegicus
aagcagaagcgacttctcttctcca

SEQ ID NO: 38860 - DNA, 25 bp, Rattus norvegicus
aagcagaagcgagttctcttctcca

SEQ ID NO: 38861 - DNA, 25 bp, Rattus norvegicus
aagcagacacagagggtcctagcat

SEQ ID NO: 38862 - DNA, 25 bp, Rattus norvegicus
aagcagacacagtgggtcctagcat

SEQ ID NO: 38863 - DNA, 25 bp, Rattus norvegicus
aagcagacacttagcaggcatccaa

SEQ ID NO: 38864 - DNA, 25 bp, Rattus norvegicus
aagcagacactttgcaggcatccaa

SEQ ID NO: 38865 - DNA, 25 bp, Rattus norvegicus
aagcagacagcaccacagtaacaga

SEQ ID NO: 38866 - DNA, 25 bp, Rattus norvegicus
aagcagacagcagcacagtaacaga

SEQ ID NO: 38867 - DNA, 25 bp, Rattus norvegicus
aagcagacagctcgactttgggcac

SEQ ID NO: 38868 - DNA, 25 bp, Rattus norvegicus
aagcagacagctggactttgggcac

SEQ ID NO: 38869 - DNA, 25 bp, Rattus norvegicus
aagcagaccctgactggagagcaga

SEQ ID NO: 38870 - DNA, 25 bp, Rattus norvegicus
aagcagaccctgtctggagagcaga

SEQ ID NO: 38871 - DNA, 25 bp, Rattus norvegicus
aagcagacccttaagcacgttgatg

SEQ ID NO: 38872 - DNA, 25 bp, Rattus norvegicus
aagcagaccctttagcacgttgatg

SEQ ID NO: 38873 - DNA, 25 bp, Rattus norvegicus
aagcagaccttgatcttttgagaaa

SEQ ID NO: 38874 - DNA, 25 bp, Rattus norvegicus
aagcagaccttgttcttttgagaaa

SEQ ID NO: 38875 - DNA, 25 bp, Rattus norvegicus
aagcagacgtttagactccaatcgc

SEQ ID NO: 38876 - DNA, 25 bp, Rattus norvegicus
aagcagacgttttgactccaatcgc

SEQ ID NO: 38877 - DNA, 25 bp, Rattus norvegicus
aagcagactcctaaacaggcattta

SEQ ID NO: 38878 - DNA, 25 bp, Rattus norvegicus
aagcagactccttaacaggcattta

SEQ ID NO: 38879 - DNA, 25 bp, Rattus norvegicus
aagcagactgaaccatgtcaccttc

SEQ ID NO: 38880 - DNA, 25 bp, Rattus norvegicus
aagcagactgaagcatgtcaccttc

SEQ ID NO: 38881 - DNA, 25 bp, Rattus norvegicus
aagcagactggcaagctgctgagga

SEQ ID NO: 38882 - DNA, 25 bp, Rattus norvegicus
aagcagactggctagctgctgagga

SEQ ID NO: 38883 - DNA, 25 bp, Rattus norvegicus
aagcagacttccatccatctcttgg

SEQ ID NO: 38884 - DNA, 25 bp, Rattus norvegicus
aagcagacttccttccatctcttgg

SEQ ID NO: 38885 - DNA, 25 bp, Rattus norvegicus
aagcagagacatccactttcccaat

SEQ ID NO: 38886 - DNA, 25 bp, Rattus norvegicus
aagcagagacatgcactttcccaat

SEQ ID NO: 38887 - DNA, 25 bp, Rattus norvegicus
aagcagagaccccagtatccagagg

SEQ ID NO: 38888 - DNA, 25 bp, Rattus norvegicus
aagcagagacccgagtatccagagg

SEQ ID NO: 38889 - DNA, 25 bp, Rattus norvegicus
aagcagagaccgagccaagccaggc

SEQ ID NO: 38890 - DNA, 25 bp, Rattus norvegicus
aagcagagaccgtgccaagccaggc

SEQ ID NO: 38891 - DNA, 25 bp, Rattus norvegicus
aagcagagagtgagaccgtagtatt

SEQ ID NO: 38892 - DNA, 25 bp, Rattus norvegicus
aagcagagagtgtgaccgtagtatt

SEQ ID NO: 38893 - DNA, 25 bp, Rattus norvegicus
aagcagagcagccatccatccaatg

SEQ ID NO: 38894 - DNA, 25 bp, Rattus norvegicus
aagcagagcagcgatccatccaatg

SEQ ID NO: 38895 - DNA, 25 bp, Rattus norvegicus
aagcagagccgcaggtgatcagaaa

SEQ ID NO: 38896 - DNA, 25 bp, Rattus norvegicus
aagcagagccgctggtgatcagaaa

SEQ ID NO: 38897 - DNA, 25 bp, Rattus norvegicus
aagcagagcctgacactttatatgg

SEQ ID NO: 38898 - DNA, 25 bp, Rattus norvegicus
aagcagagcctgacttgggcttcct

SEQ ID NO: 38899 - DNA, 25 bp, Rattus norvegicus
aagcagagcctgctgtttttgttct

SEQ ID NO: 38900 - DNA, 25 bp, Rattus norvegicus
aagcagagcctggtgtttttgttct

SEQ ID NO: 38901 - DNA, 25 bp, Rattus norvegicus
aagcagagcctgtcactttatatgg

SEQ ID NO: 38902 - DNA, 25 bp, Rattus norvegicus
aagcagagcctgtcttgggcttcct

SEQ ID NO: 38903 - DNA, 25 bp, Rattus norvegicus
aagcagagctaccttagcatgggta

SEQ ID NO: 38904 - DNA, 25 bp, Rattus norvegicus
aagcagagctacgttagcatgggta

SEQ ID NO: 38905 - DNA, 25 bp, Rattus norvegicus
aagcagagctgacctcagtgacctt

SEQ ID NO: 38906 - DNA, 25 bp, Rattus norvegicus
aagcagagctgacgctaggcagaca

SEQ ID NO: 38907 - DNA, 25 bp, Rattus norvegicus
aagcagagctgagctcagtgacctt

SEQ ID NO: 38908 - DNA, 25 bp, Rattus norvegicus
aagcagagctgaggctaggcagaca

SEQ ID NO: 38909 - DNA, 25 bp, Rattus norvegicus
aagcagagctgcctcagggtgcacc

SEQ ID NO: 38910 - DNA, 25 bp, Rattus norvegicus
aagcagagctgcgtcagggtgcacc

SEQ ID NO: 38911 - DNA, 25 bp, Rattus norvegicus
aagcagagctggctgttaacgtgta

SEQ ID NO: 38912 - DNA, 25 bp, Rattus norvegicus
aagcagagctgggtgttaacgtgta

SEQ ID NO: 38913 - DNA, 25 bp, Rattus norvegicus
aagcagagctgtcatcccagccagc

SEQ ID NO: 38914 - DNA, 25 bp, Rattus norvegicus
aagcagagctgtgatcccagccagc

SEQ ID NO: 38915 - DNA, 25 bp, Rattus norvegicus
aagcagaggactagctgcttctgcg

SEQ ID NO: 38916 - DNA, 25 bp, Rattus norvegicus
aagcagaggacttgctgcttctgcg

SEQ ID NO: 38917 - DNA, 25 bp, Rattus norvegicus
aagcagaggccaaatctcagggaaa

SEQ ID NO: 38918 - DNA, 25 bp, Rattus norvegicus
aagcagaggccacgacaggtattct

SEQ ID NO: 38919 - DNA, 25 bp, Rattus norvegicus
aagcagaggccaggacaggtattct

SEQ ID NO: 38920 - DNA, 25 bp, Rattus norvegicus
aagcagaggccatatctcagggaaa

SEQ ID NO: 38921 - DNA, 25 bp, Rattus norvegicus
aagcagaggcccagacagtctacta

SEQ ID NO: 38922 - DNA, 25 bp, Rattus norvegicus
aagcagaggccctgacagtctacta

SEQ ID NO: 38923 - DNA, 25 bp, Rattus norvegicus
aagcagaggctgagtcccgtgcaga

SEQ ID NO: 38924 - DNA, 25 bp, Rattus norvegicus
aagcagaggctgtgtcccgtgcaga

SEQ ID NO: 38925 - DNA, 25 bp, Rattus norvegicus
aagcagaggtcaccaaactttttct

SEQ ID NO: 38926 - DNA, 25 bp, Rattus norvegicus
aagcagaggtcagcaaactttttct

SEQ ID NO: 38927 - DNA, 25 bp, Rattus norvegicus
aagcagagtatgctgccatcaactc

SEQ ID NO: 38928 - DNA, 25 bp, Rattus norvegicus
aagcagagtatggtgccatcaactc

SEQ ID NO: 38929 - DNA, 25 bp, Rattus norvegicus
aagcagagtcatatccaaacggagg

SEQ ID NO: 38930 - DNA, 25 bp, Rattus norvegicus
aagcagagtcatttccaaacggagg

SEQ ID NO: 38931 - DNA, 25 bp, Rattus norvegicus
aagcagagtccgagtccgcggagca

SEQ ID NO: 38932 - DNA, 25 bp, Rattus norvegicus
aagcagagtccgtgtccgcggagca

SEQ ID NO: 38933 - DNA, 25 bp, Rattus norvegicus
aagcagagtggtagccccagggtcc

SEQ ID NO: 38934 - DNA, 25 bp, Rattus norvegicus
aagcagagtggttgccccagggtcc

SEQ ID NO: 38935 - DNA, 25 bp, Rattus norvegicus
aagcagatactcagtctccattctc

SEQ ID NO: 38936 - DNA, 25 bp, Rattus norvegicus
aagcagatactctgtctccattctc

SEQ ID NO: 38937 - DNA, 25 bp, Rattus norvegicus
aagcagatcatcagaagcccaattg

SEQ ID NO: 38938 - DNA, 25 bp, Rattus norvegicus
aagcagatcatctgaagcccaattg

SEQ ID NO: 38939 - DNA, 25 bp, Rattus norvegicus
aagcagatcgatattgtctccagca

SEQ ID NO: 38940 - DNA, 25 bp, Rattus norvegicus
aagcagatcgattttgtctccagca

SEQ ID NO: 38941 - DNA, 25 bp, Rattus norvegicus
aagcagatctgcacctgtgatgggc

SEQ ID NO: 38942 - DNA, 25 bp, Rattus norvegicus
aagcagatctgctcctgtgatgggc

SEQ ID NO: 38943 - DNA, 25 bp, Rattus norvegicus
aagcagatgcacattagggcccaag

SEQ ID NO: 38944 - DNA, 25 bp, Rattus norvegicus
aagcagatgcactttagggcccaag

SEQ ID NO: 38945 - DNA, 25 bp, Rattus norvegicus
aagcagatgccccaaggtcacatta

SEQ ID NO: 38946 - DNA, 25 bp, Rattus norvegicus
aagcagatgcccgaaggtcacatta

SEQ ID NO: 38947 - DNA, 25 bp, Rattus norvegicus
aagcagatgcgtagctgctcgtgtc

SEQ ID NO: 38948 - DNA, 25 bp, Rattus norvegicus
aagcagatgcgttgctgctcgtgtc

SEQ ID NO: 38949 - DNA, 25 bp, Rattus norvegicus
aagcagatgctgctgcggtcactga

SEQ ID NO: 38950 - DNA, 25 bp, Rattus norvegicus
aagcagatgctggtgcggtcactga

SEQ ID NO: 38951 - DNA, 25 bp, Rattus norvegicus
aagcagatgtgcacctgtctgcaga

SEQ ID NO: 38952 - DNA, 25 bp, Rattus norvegicus
aagcagatgtgctcctgtctgcaga

SEQ ID NO: 38953 - DNA, 25 bp, Rattus norvegicus
aagcagattgatcgcgtgatctctg

SEQ ID NO: 38954 - DNA, 25 bp, Rattus norvegicus
aagcagattgatggcgtgatctctg

SEQ ID NO: 38955 - DNA, 25 bp, Rattus norvegicus
aagcagattggcagcctggaatcca

SEQ ID NO: 38956 - DNA, 25 bp, Rattus norvegicus
aagcagattggctgcctggaatcca

SEQ ID NO: 38957 - DNA, 25 bp, Rattus norvegicus
aagcagatttatcaggtctacccct

SEQ ID NO: 38958 - DNA, 25 bp, Rattus norvegicus
aagcagatttatgaggtctacccct

SEQ ID NO: 38959 - DNA, 25 bp, Rattus norvegicus
aagcagcaaacaccgttccttcatt

SEQ ID NO: 38960 - DNA, 25 bp, Rattus norvegicus
aagcagcaaacagcgttccttcatt

SEQ ID NO: 38961 - DNA, 25 bp, Rattus norvegicus
aagcagcaacacctgggcgttcatt

SEQ ID NO: 38962 - DNA, 25 bp, Rattus norvegicus
aagcagcaacacgtgggcgttcatt

SEQ ID NO: 38963 - DNA, 25 bp, Rattus norvegicus
aagcagcaacctacacaagcagcgg

SEQ ID NO: 38964 - DNA, 25 bp, Rattus norvegicus
aagcagcaaccttcacaagcagcgg

SEQ ID NO: 38965 - DNA, 25 bp, Rattus norvegicus
aagcagcaacggagacaccgtagtt

SEQ ID NO: 38966 - DNA, 25 bp, Rattus norvegicus
aagcagcaacggtgacaccgtagtt

SEQ ID NO: 38967 - DNA, 25 bp, Rattus norvegicus
aagcagcaacttatcttcatgtcct

SEQ ID NO: 38968 - DNA, 25 bp, Rattus norvegicus
aagcagcaacttttcttcatgtcct

SEQ ID NO: 38969 - DNA, 25 bp, Rattus norvegicus
aagcagcaatagcaggcctacctct

SEQ ID NO: 38970 - DNA, 25 bp, Rattus norvegicus
aagcagcaataggaggcctacctct

SEQ ID NO: 38971 - DNA, 25 bp, Rattus norvegicus
aagcagcaatggaacctggaccatg

SEQ ID NO: 38972 - DNA, 25 bp, Rattus norvegicus
aagcagcaatggtacctggaccatg

SEQ ID NO: 38973 - DNA, 25 bp, Rattus norvegicus
aagcagcacagaatcttgaccttcc

SEQ ID NO: 38974 - DNA, 25 bp, Rattus norvegicus
aagcagcacagacccgagagtgttt

SEQ ID NO: 38975 - DNA, 25 bp, Rattus norvegicus
aagcagcacagagccgagagtgttt

SEQ ID NO: 38976 - DNA, 25 bp, Rattus norvegicus
aagcagcacagattcttgaccttcc

SEQ ID NO: 38977 - DNA, 25 bp, Rattus norvegicus
aagcagcacatgaagtccacagtat

SEQ ID NO: 38978 - DNA, 25 bp, Rattus norvegicus
aagcagcacatgtagtccacagtat

SEQ ID NO: 38979 - DNA, 25 bp, Rattus norvegicus
aagcagcacgccatcaagcaggcat

SEQ ID NO: 38980 - DNA, 25 bp, Rattus norvegicus
aagcagcacgccttcaagcaggcat

SEQ ID NO: 38981 - DNA, 25 bp, Rattus norvegicus
aagcagcactcaacctaattctaac

SEQ ID NO: 38982 - DNA, 25 bp, Rattus norvegicus
aagcagcactcatcctaattctaac

SEQ ID NO: 38983 - DNA, 25 bp, Rattus norvegicus
aagcagcactcgacggatggagact

SEQ ID NO: 38984 - DNA, 25 bp, Rattus norvegicus
aagcagcactcgtcggatggagact

SEQ ID NO: 38985 - DNA, 25 bp, Rattus norvegicus
aagcagcactttcttttgccatagc

SEQ ID NO: 38986 - DNA, 25 bp, Rattus norvegicus
aagcagcactttgttttgccatagc

SEQ ID NO: 38987 - DNA, 25 bp, Rattus norvegicus
aagcagcagaagagatctctactca

SEQ ID NO: 38988 - DNA, 25 bp, Rattus norvegicus
aagcagcagaagtgatctctactca

SEQ ID NO: 38989 - DNA, 25 bp, Rattus norvegicus
aagcagcagaccacgatagcctgaa

SEQ ID NO: 38990 - DNA, 25 bp, Rattus norvegicus
aagcagcagacctcgatagcctgaa

SEQ ID NO: 38991 - DNA, 25 bp, Rattus norvegicus
aagcagcagcacagggtgccatgtg

SEQ ID NO: 38992 - DNA, 25 bp, Rattus norvegicus
aagcagcagcacatggtttcatcca

SEQ ID NO: 38993 - DNA, 25 bp, Rattus norvegicus
aagcagcagcactgggtgccatgtg

SEQ ID NO: 38994 - DNA, 25 bp, Rattus norvegicus
aagcagcagcacttggtttcatcca

SEQ ID NO: 38995 - DNA, 25 bp, Rattus norvegicus
aagcagcagcagaagaggtgttgtc

SEQ ID NO: 38996 - DNA, 25 bp, Rattus norvegicus
aagcagcagcagtagaggtgttgtc

SEQ ID NO: 38997 - DNA, 25 bp, Rattus norvegicus
aagcagcagcatagtgagatcgatc

SEQ ID NO: 38998 - DNA, 25 bp, Rattus norvegicus
aagcagcagcatcctgcagtagcta

SEQ ID NO: 38999 - DNA, 25 bp, Rattus norvegicus
aagcagcagcatgctgcagtagcta

SEQ ID NO: 39000 - DNA, 25 bp, Rattus norvegicus
aagcagcagcattgtgagatcgatc

SEQ ID NO: 39001 - DNA, 25 bp, Rattus norvegicus
aagcagcagcgactacttctgtcgt

SEQ ID NO: 39002 - DNA, 25 bp, Rattus norvegicus
aagcagcagcgagtacttctgtcgt

SEQ ID NO: 39003 - DNA, 25 bp, Rattus norvegicus
aagcagcagcgcctgttagcagtgc

SEQ ID NO: 39004 - DNA, 25 bp, Rattus norvegicus
aagcagcagcgcgtgttagcagtgc

SEQ ID NO: 39005 - DNA, 25 bp, Rattus norvegicus
aagcagcagctgctgttgtcgcagc

SEQ ID NO: 39006 - DNA, 25 bp, Rattus norvegicus
aagcagcagctggtgttgtcgcagc

SEQ ID NO: 39007 - DNA, 25 bp, Rattus norvegicus
aagcagcaggcacggttctaggaaa

SEQ ID NO: 39008 - DNA, 25 bp, Rattus norvegicus
aagcagcaggcagggttctaggaaa

SEQ ID NO: 39009 - DNA, 25 bp, Rattus norvegicus
aagcagcaggcgcaaggctatccca

SEQ ID NO: 39010 - DNA, 25 bp, Rattus norvegicus
aagcagcaggcggaaggctatccca

SEQ ID NO: 39011 - DNA, 25 bp, Rattus norvegicus
aagcagcatcttaatccaggtttca

SEQ ID NO: 39012 - DNA, 25 bp, Rattus norvegicus
aagcagcatctttatccaggtttca

SEQ ID NO: 39013 - DNA, 25 bp, Rattus norvegicus
aagcagcatgacaatattggccaga

SEQ ID NO: 39014 - DNA, 25 bp, Rattus norvegicus
aagcagcatgactatattggccaga

SEQ ID NO: 39015 - DNA, 25 bp, Rattus norvegicus
aagcagcatgttcaccccagggaaa

SEQ ID NO: 39016 - DNA, 25 bp, Rattus norvegicus
aagcagcatgttgaccccagggaaa

SEQ ID NO: 39017 - DNA, 25 bp, Rattus norvegicus
aagcagcattcgcttacctttgcag

SEQ ID NO: 39018 - DNA, 25 bp, Rattus norvegicus
aagcagcattcggttacctttgcag

SEQ ID NO: 39019 - DNA, 25 bp, Rattus norvegicus
aagcagcattctcagccggcgccaa

SEQ ID NO: 39020 - DNA, 25 bp, Rattus norvegicus
aagcagcattctgagccggcgccaa

SEQ ID NO: 39021 - DNA, 25 bp, Rattus norvegicus
aagcagccaacccacgtgagagaag

SEQ ID NO: 39022 - DNA, 25 bp, Rattus norvegicus
aagcagccaaccgacgtgagagaag

SEQ ID NO: 39023 - DNA, 25 bp, Rattus norvegicus
aagcagccacatcggtcagcaccat

SEQ ID NO: 39024 - DNA, 25 bp, Rattus norvegicus
aagcagccacatgggtcagcaccat

SEQ ID NO: 39025 - DNA, 25 bp, Rattus norvegicus
aagcagccacggatggtgaagacca

SEQ ID NO: 39026 - DNA, 25 bp, Rattus norvegicus
aagcagccacggttggtgaagacca

SEQ ID NO: 39027 - DNA, 25 bp, Rattus norvegicus
aagcagccagaaacccatgtgcgga

SEQ ID NO: 39028 - DNA, 25 bp, Rattus norvegicus
aagcagccagaaccacaaatcattg

SEQ ID NO: 39029 - DNA, 25 bp, Rattus norvegicus
aagcagccagaagcacaaatcattg

SEQ ID NO: 39030 - DNA, 25 bp, Rattus norvegicus
aagcagccagaatcccatgtgcgga

SEQ ID NO: 39031 - DNA, 25 bp, Rattus norvegicus
aagcagccagcaacatcattttctc

SEQ ID NO: 39032 - DNA, 25 bp, Rattus norvegicus
aagcagccagcatcatcattttctc

SEQ ID NO: 39033 - DNA, 25 bp, Rattus norvegicus
aagcagccagctactagcttatcac

SEQ ID NO: 39034 - DNA, 25 bp, Rattus norvegicus
aagcagccagcttctagcttatcac

SEQ ID NO: 39035 - DNA, 25 bp, Rattus norvegicus
aagcagccatcccaacgaagactta

SEQ ID NO: 39036 - DNA, 25 bp, Rattus norvegicus
aagcagccatccgaacgaagactta

SEQ ID NO: 39037 - DNA, 25 bp, Rattus norvegicus
aagcagccatcgaccttgtctcaac

SEQ ID NO: 39038 - DNA, 25 bp, Rattus norvegicus
aagcagccatcgtccttgtctcaac

SEQ ID NO: 39039 - DNA, 25 bp, Rattus norvegicus
aagcagcccaaacctgaggctcagt

SEQ ID NO: 39040 - DNA, 25 bp, Rattus norvegicus
aagcagcccaaagctgaggctcagt

SEQ ID NO: 39041 - DNA, 25 bp, Rattus norvegicus
aagcagcccttgcacctgatttggg

SEQ ID NO: 39042 - DNA, 25 bp, Rattus norvegicus
aagcagcccttggacctgatttggg

SEQ ID NO: 39043 - DNA, 25 bp, Rattus norvegicus
aagcagccgaagaactggcctgtca

SEQ ID NO: 39044 - DNA, 25 bp, Rattus norvegicus
aagcagccgaagtactggcctgtca

SEQ ID NO: 39045 - DNA, 25 bp, Rattus norvegicus
aagcagccgatcatggcggatggcc

SEQ ID NO: 39046 - DNA, 25 bp, Rattus norvegicus
aagcagccgatcttggcggatggcc

SEQ ID NO: 39047 - DNA, 25 bp, Rattus norvegicus
aagcagcctaggcatgagcaccgcg

SEQ ID NO: 39048 - DNA, 25 bp, Rattus norvegicus
aagcagcctagggatgagcaccgcg

SEQ ID NO: 39049 - DNA, 25 bp, Rattus norvegicus
aagcagcctgctacatgaaaggcta

SEQ ID NO: 39050 - DNA, 25 bp, Rattus norvegicus
aagcagcctgcttcatgaaaggcta

SEQ ID NO: 39051 - DNA, 25 bp, Rattus norvegicus
aagcagcctggcatcgtatgttacc

SEQ ID NO: 39052 - DNA, 25 bp, Rattus norvegicus
aagcagcctggcttcgtatgttacc

SEQ ID NO: 39053 - DNA, 25 bp, Rattus norvegicus
aagcagccttgtcaattagcagaaa

SEQ ID NO: 39054 - DNA, 25 bp, Rattus norvegicus
aagcagccttgtgaattagcagaaa

SEQ ID NO: 39055 - DNA, 25 bp, Rattus norvegicus
aagcagcgaatccagactccagtgg

SEQ ID NO: 39056 - DNA, 25 bp, Rattus norvegicus
aagcagcgaatcgagactccagtgg

SEQ ID NO: 39057 - DNA, 25 bp, Rattus norvegicus
aagcagcgcctaaggtgaccccgga

SEQ ID NO: 39058 - DNA, 25 bp, Rattus norvegicus
aagcagcgcctatggtgaccccgga

SEQ ID NO: 39059 - DNA, 25 bp, Rattus norvegicus
aagcagcgctaacttaggcctcagc

SEQ ID NO: 39060 - DNA, 25 bp, Rattus norvegicus
aagcagcgctaagttaggcctcagc

SEQ ID NO: 39061 - DNA, 25 bp, Rattus norvegicus
aagcagcgctgactgtcttgagcct

SEQ ID NO: 39062 - DNA, 25 bp, Rattus norvegicus
aagcagcgctgagtgtcttgagcct

SEQ ID NO: 39063 - DNA, 25 bp, Rattus norvegicus
aagcagcggcaactggaccacgagt

SEQ ID NO: 39064 - DNA, 25 bp, Rattus norvegicus
aagcagcggcaagtggaccacgagt

SEQ ID NO: 39065 - DNA, 25 bp, Rattus norvegicus
aagcagcgtctcagtgttttgatcc

SEQ ID NO: 39066 - DNA, 25 bp, Rattus norvegicus
aagcagcgtctctgtgttttgatcc

SEQ ID NO: 39067 - DNA, 25 bp, Rattus norvegicus
aagcagcgttaaccggctgctagtc

SEQ ID NO: 39068 - DNA, 25 bp, Rattus norvegicus
aagcagcgttaagcggctgctagtc

SEQ ID NO: 39069 - DNA, 25 bp, Rattus norvegicus
aagcagcgttacacacagagcaatg

SEQ ID NO: 39070 - DNA, 25 bp, Rattus norvegicus
aagcagcgttactcacagagcaatg

SEQ ID NO: 39071 - DNA, 25 bp, Rattus norvegicus
aagcagctactgatactcagccatg

SEQ ID NO: 39072 - DNA, 25 bp, Rattus norvegicus
aagcagctactgttactcagccatg

SEQ ID NO: 39073 - DNA, 25 bp, Rattus norvegicus
aagcagctagcacttctcacgtgac

SEQ ID NO: 39074 - DNA, 25 bp, Rattus norvegicus
aagcagctagcagttctcacgtgac

SEQ ID NO: 39075 - DNA, 25 bp, Rattus norvegicus
aagcagctaggcagtatttccctat

SEQ ID NO: 39076 - DNA, 25 bp, Rattus norvegicus
aagcagctaggctgtatttccctat

SEQ ID NO: 39077 - DNA, 25 bp, Rattus norvegicus
aagcagctatctcggcaacgcttca

SEQ ID NO: 39078 - DNA, 25 bp, Rattus norvegicus
aagcagctatctgggcaacgcttca

SEQ ID NO: 39079 - DNA, 25 bp, Rattus norvegicus
aagcagctatgtctcatgatcttag

SEQ ID NO: 39080 - DNA, 25 bp, Rattus norvegicus
aagcagctatgtgtcatgatcttag

SEQ ID NO: 39081 - DNA, 25 bp, Rattus norvegicus
aagcagctcatcaccaacatcagga

SEQ ID NO: 39082 - DNA, 25 bp, Rattus norvegicus
aagcagctcatctccaacatcagga

SEQ ID NO: 39083 - DNA, 25 bp, Rattus norvegicus
aagcagctcattcgcatcctttcaa

SEQ ID NO: 39084 - DNA, 25 bp, Rattus norvegicus
aagcagctcattggcatcctttcaa

SEQ ID NO: 39085 - DNA, 25 bp, Rattus norvegicus
aagcagctcggtactgtgcagagat

SEQ ID NO: 39086 - DNA, 25 bp, Rattus norvegicus
aagcagctcggttctgtgcagagat

SEQ ID NO: 39087 - DNA, 25 bp, Rattus norvegicus
aagcagctctgacatgcctgttgtc

SEQ ID NO: 39088 - DNA, 25 bp, Rattus norvegicus
aagcagctctgagatgcctgttgtc

SEQ ID NO: 39089 - DNA, 25 bp, Rattus norvegicus
aagcagctcttgactgtttctttaa

SEQ ID NO: 39090 - DNA, 25 bp, Rattus norvegicus
aagcagctcttgtctgtttctttaa

SEQ ID NO: 39091 - DNA, 25 bp, Rattus norvegicus
aagcagctgacaatcaactccctct

SEQ ID NO: 39092 - DNA, 25 bp, Rattus norvegicus
aagcagctgacattcaactccctct

SEQ ID NO: 39093 - DNA, 25 bp, Rattus norvegicus
aagcagctgaggatggcctggacct

SEQ ID NO: 39094 - DNA, 25 bp, Rattus norvegicus
aagcagctgaggctcatgccaaaga

SEQ ID NO: 39095 - DNA, 25 bp, Rattus norvegicus
aagcagctgagggtcatgccaaaga

SEQ ID NO: 39096 - DNA, 25 bp, Rattus norvegicus
aagcagctgaggttggcctggacct

SEQ ID NO: 39097 - DNA, 25 bp, Rattus norvegicus
aagcagctgatgatagttccctact

SEQ ID NO: 39098 - DNA, 25 bp, Rattus norvegicus
aagcagctgatgttagttccctact

SEQ ID NO: 39099 - DNA, 25 bp, Rattus norvegicus
aagcagctgcagcaccttcggaatg

SEQ ID NO: 39100 - DNA, 25 bp, Rattus norvegicus
aagcagctgcaggaccttcggaatg

SEQ ID NO: 39101 - DNA, 25 bp, Rattus norvegicus
aagcagctgcccctcctggacaaga

SEQ ID NO: 39102 - DNA, 25 bp, Rattus norvegicus
aagcagctgcccgtcctggacaaga

SEQ ID NO: 39103 - DNA, 25 bp, Rattus norvegicus
aagcagctgctgaagggtacctttt

SEQ ID NO: 39104 - DNA, 25 bp, Rattus norvegicus
aagcagctgctgtagggtacctttt

SEQ ID NO: 39105 - DNA, 25 bp, Rattus norvegicus
aagcagctggctcagttccgggctc

SEQ ID NO: 39106 - DNA, 25 bp, Rattus norvegicus
aagcagctggctgagttccgggctc

SEQ ID NO: 39107 - DNA, 25 bp, Rattus norvegicus
aagcagctgggaactgtccagtttt

SEQ ID NO: 39108 - DNA, 25 bp, Rattus norvegicus
aagcagctgggatctgtccagtttt

SEQ ID NO: 39109 - DNA, 25 bp, Rattus norvegicus
aagcagctgtccctgctgcctaact

SEQ ID NO: 39110 - DNA, 25 bp, Rattus norvegicus
aagcagctgtccgtgctgcctaact

SEQ ID NO: 39111 - DNA, 25 bp, Rattus norvegicus
aagcagctgtgtatgccaagtacct

SEQ ID NO: 39112 - DNA, 25 bp, Rattus norvegicus
aagcagctgtgtttgccaagtacct

SEQ ID NO: 39113 - DNA, 25 bp, Rattus norvegicus
aagcagctgttcattggccagggct

SEQ ID NO: 39114 - DNA, 25 bp, Rattus norvegicus
aagcagctgttctttggccagggct

SEQ ID NO: 39115 - DNA, 25 bp, Rattus norvegicus
aagcagctgtttactcacgggagca

SEQ ID NO: 39116 - DNA, 25 bp, Rattus norvegicus
aagcagctgttttctcacgggagca

SEQ ID NO: 39117 - DNA, 25 bp, Rattus norvegicus
aagcagcttaatatggtcccctact

SEQ ID NO: 39118 - DNA, 25 bp, Rattus norvegicus
aagcagcttaatttggtcccctact

SEQ ID NO: 39119 - DNA, 25 bp, Rattus norvegicus
aagcagcttcgtaatgttcccagag

SEQ ID NO: 39120 - DNA, 25 bp, Rattus norvegicus
aagcagcttcgttatgttcccagag

SEQ ID NO: 39121 - DNA, 25 bp, Rattus norvegicus
aagcagcttctgaagtgagccaggt

SEQ ID NO: 39122 - DNA, 25 bp, Rattus norvegicus
aagcagcttctgaatcagggtctaa

SEQ ID NO: 39123 - DNA, 25 bp, Rattus norvegicus
aagcagcttctgtagtgagccaggt

SEQ ID NO: 39124 - DNA, 25 bp, Rattus norvegicus
aagcagcttctgtatcagggtctaa

SEQ ID NO: 39125 - DNA, 25 bp, Rattus norvegicus
aagcagcttgacattggcattaaca

SEQ ID NO: 39126 - DNA, 25 bp, Rattus norvegicus
aagcagcttgactttggcattaaca

SEQ ID NO: 39127 - DNA, 25 bp, Rattus norvegicus
aagcagcttgctacatggaaatcct

SEQ ID NO: 39128 - DNA, 25 bp, Rattus norvegicus
aagcagcttgctatgccgggaggct

SEQ ID NO: 39129 - DNA, 25 bp, Rattus norvegicus
aagcagcttgcttcatggaaatcct

SEQ ID NO: 39130 - DNA, 25 bp, Rattus norvegicus
aagcagcttgctttgccgggaggct

SEQ ID NO: 39131 - DNA, 25 bp, Rattus norvegicus
aagcagcttgtcacttacaaggcca

SEQ ID NO: 39132 - DNA, 25 bp, Rattus norvegicus
aagcagcttgtctcttacaaggcca

SEQ ID NO: 39133 - DNA, 25 bp, Rattus norvegicus
aagcagctttgacagtgttcggtga

SEQ ID NO: 39134 - DNA, 25 bp, Rattus norvegicus
aagcagctttgagagtgttcggtga

SEQ ID NO: 39135 - DNA, 25 bp, Rattus norvegicus
aagcagctttggagactctgtggaa

SEQ ID NO: 39136 - DNA, 25 bp, Rattus norvegicus
aagcagctttggtgactctgtggaa

SEQ ID NO: 39137 - DNA, 25 bp, Rattus norvegicus
aagcaggaactactcgaggctctca

SEQ ID NO: 39138 - DNA, 25 bp, Rattus norvegicus
aagcaggaactagtcgaggctctca

SEQ ID NO: 39139 - DNA, 25 bp, Rattus norvegicus
aagcaggaatccacttggtgtccat

SEQ ID NO: 39140 - DNA, 25 bp, Rattus norvegicus
aagcaggaatcctcttggtgtccat

SEQ ID NO: 39141 - DNA, 25 bp, Rattus norvegicus
aagcaggaatgtaacctcttccctt

SEQ ID NO: 39142 - DNA, 25 bp, Rattus norvegicus
aagcaggaatgtcagcgtcccgaaa

SEQ ID NO: 39143 - DNA, 25 bp, Rattus norvegicus
aagcaggaatgtgagcgtcccgaaa

SEQ ID NO: 39144 - DNA, 25 bp, Rattus norvegicus
aagcaggaatgttacctcttccctt

SEQ ID NO: 39145 - DNA, 25 bp, Rattus norvegicus
aagcaggacatcacaagtctccgtt

SEQ ID NO: 39146 - DNA, 25 bp, Rattus norvegicus
aagcaggacatctcaagtctccgtt

SEQ ID NO: 39147 - DNA, 25 bp, Rattus norvegicus
aagcaggacccacagttagtagcaa

SEQ ID NO: 39148 - DNA, 25 bp, Rattus norvegicus
aagcaggacccagagttagtagcaa

SEQ ID NO: 39149 - DNA, 25 bp, Rattus norvegicus
aagcaggaccgaacccagtgaaatt

SEQ ID NO: 39150 - DNA, 25 bp, Rattus norvegicus
aagcaggaccgatcccagtgaaatt

SEQ ID NO: 39151 - DNA, 25 bp, Rattus norvegicus
aagcaggacgtgatcagcgccgctg

SEQ ID NO: 39152 - DNA, 25 bp, Rattus norvegicus
aagcaggacgtgttcagcgccgctg

SEQ ID NO: 39153 - DNA, 25 bp, Rattus norvegicus
aagcaggactttacttcgcagctca

SEQ ID NO: 39154 - DNA, 25 bp, Rattus norvegicus
aagcaggacttttcttcgcagctca

SEQ ID NO: 39155 - DNA, 25 bp, Rattus norvegicus
aagcaggagctaacgtttctatcac

SEQ ID NO: 39156 - DNA, 25 bp, Rattus norvegicus
aagcaggagctatcgtttctatcac

SEQ ID NO: 39157 - DNA, 25 bp, Rattus norvegicus
aagcaggaggagaccagtccggctt

SEQ ID NO: 39158 - DNA, 25 bp, Rattus norvegicus
aagcaggaggagtccagtccggctt

SEQ ID NO: 39159 - DNA, 25 bp, Rattus norvegicus
aagcaggaggatcgccttgcattct

SEQ ID NO: 39160 - DNA, 25 bp, Rattus norvegicus
aagcaggaggatggccttgcattct

SEQ ID NO: 39161 - DNA, 25 bp, Rattus norvegicus
aagcaggagtcccatgctttttctt

SEQ ID NO: 39162 - DNA, 25 bp, Rattus norvegicus
aagcaggagtccgatgctttttctt

SEQ ID NO: 39163 - DNA, 25 bp, Rattus norvegicus
aagcaggagttcaccggcaggactt

SEQ ID NO: 39164 - DNA, 25 bp, Rattus norvegicus
aagcaggagttctccggcaggactt

SEQ ID NO: 39165 - DNA, 25 bp, Rattus norvegicus
aagcaggatctaaatgtcctcccag

SEQ ID NO: 39166 - DNA, 25 bp, Rattus norvegicus
aagcaggatctatatgtcctcccag

SEQ ID NO: 39167 - DNA, 25 bp, Rattus norvegicus
aagcaggatggtcgccttcaggtta

SEQ ID NO: 39168 - DNA, 25 bp, Rattus norvegicus
aagcaggatggtggccttcaggtta

SEQ ID NO: 39169 - DNA, 25 bp, Rattus norvegicus
aagcaggattgcatacaggcctctc

SEQ ID NO: 39170 - DNA, 25 bp, Rattus norvegicus
aagcaggattgcttacaggcctctc

SEQ ID NO: 39171 - DNA, 25 bp, Rattus norvegicus
aagcaggatttacagcgccctgtac

SEQ ID NO: 39172 - DNA, 25 bp, Rattus norvegicus
aagcaggatttagagcgccctgtac

SEQ ID NO: 39173 - DNA, 25 bp, Rattus norvegicus
aagcaggcaacacagtgactctccg

SEQ ID NO: 39174 - DNA, 25 bp, Rattus norvegicus
aagcaggcaacagagtgactctccg

SEQ ID NO: 39175 - DNA, 25 bp, Rattus norvegicus
aagcaggcactcaaccaagtgactt

SEQ ID NO: 39176 - DNA, 25 bp, Rattus norvegicus
aagcaggcactctaccaagtgactt

SEQ ID NO: 39177 - DNA, 25 bp, Rattus norvegicus
aagcaggcactgaatgaatatgcaa

SEQ ID NO: 39178 - DNA, 25 bp, Rattus norvegicus
aagcaggcactgtatgaatatgcaa

SEQ ID NO: 39179 - DNA, 25 bp, Rattus norvegicus
aagcaggcagatcggaaggtaattc

SEQ ID NO: 39180 - DNA, 25 bp, Rattus norvegicus
aagcaggcagatgggaaggtaattc

SEQ ID NO: 39181 - DNA, 25 bp, Rattus norvegicus
aagcaggcaggtcgccacatgcaca

SEQ ID NO: 39182 - DNA, 25 bp, Rattus norvegicus
aagcaggcaggtctctgcgttccag

SEQ ID NO: 39183 - DNA, 25 bp, Rattus norvegicus
aagcaggcaggtggccacatgcaca

SEQ ID NO: 39184 - DNA, 25 bp, Rattus norvegicus
aagcaggcaggtgtctgcgttccag

SEQ ID NO: 39185 - DNA, 25 bp, Rattus norvegicus
aagcaggcagtgcagcatctcttgc

SEQ ID NO: 39186 - DNA, 25 bp, Rattus norvegicus
aagcaggcagtggagcatctcttgc

SEQ ID NO: 39187 - DNA, 25 bp, Rattus norvegicus
aagcaggcattcacttggtgtcccc

SEQ ID NO: 39188 - DNA, 25 bp, Rattus norvegicus
aagcaggcattctcttggtgtcccc

SEQ ID NO: 39189 - DNA, 25 bp, Rattus norvegicus
aagcaggccaagaaaccctgtcagt

SEQ ID NO: 39190 - DNA, 25 bp, Rattus norvegicus
aagcaggccaagtaaccctgtcagt

SEQ ID NO: 39191 - DNA, 25 bp, Rattus norvegicus
aagcaggccccaaaaaccgggagat

SEQ ID NO: 39192 - DNA, 25 bp, Rattus norvegicus
aagcaggccccataaaccgggagat

SEQ ID NO: 39193 - DNA, 25 bp, Rattus norvegicus
aagcaggccctcagtgagatcgaga

SEQ ID NO: 39194 - DNA, 25 bp, Rattus norvegicus
aagcaggccctctgtgagatcgaga

SEQ ID NO: 39195 - DNA, 25 bp, Rattus norvegicus
aagcaggcgtgaacaccgacacaca

SEQ ID NO: 39196 - DNA, 25 bp, Rattus norvegicus
aagcaggcgtgatcaccgacacaca

SEQ ID NO: 39197 - DNA, 25 bp, Rattus norvegicus
aagcaggctccgaagggttggctca

SEQ ID NO: 39198 - DNA, 25 bp, Rattus norvegicus
aagcaggctccgtagggttggctca

SEQ ID NO: 39199 - DNA, 25 bp, Rattus norvegicus
aagcaggctgggaaccctgtatctt

SEQ ID NO: 39200 - DNA, 25 bp, Rattus norvegicus
aagcaggctgggtaccctgtatctt

SEQ ID NO: 39201 - DNA, 25 bp, Rattus norvegicus
aagcaggctgtgctgccaacaccgc

SEQ ID NO: 39202 - DNA, 25 bp, Rattus norvegicus
aagcaggctgtggtgccaacaccgc

SEQ ID NO: 39203 - DNA, 25 bp, Rattus norvegicus
aagcaggcttctcaggtatggtctc

SEQ ID NO: 39204 - DNA, 25 bp, Rattus norvegicus
aagcaggcttctgaggtatggtctc

SEQ ID NO: 39205 - DNA, 25 bp, Rattus norvegicus
aagcaggctttaacttactgtgcaa

SEQ ID NO: 39206 - DNA, 25 bp, Rattus norvegicus
aagcaggctttatcttactgtgcaa

SEQ ID NO: 39207 - DNA, 25 bp, Rattus norvegicus
aagcagggaaatcgacactgactgg

SEQ ID NO: 39208 - DNA, 25 bp, Rattus norvegicus
aagcagggaaatggacactgactgg

SEQ ID NO: 39209 - DNA, 25 bp, Rattus norvegicus
aagcagggacttcttgattcctttc

SEQ ID NO: 39210 - DNA, 25 bp, Rattus norvegicus
aagcagggacttgttgattcctttc

SEQ ID NO: 39211 - DNA, 25 bp, Rattus norvegicus
aagcagggagcacaagccagttcca

SEQ ID NO: 39212 - DNA, 25 bp, Rattus norvegicus
aagcagggagcagaagccagttcca

SEQ ID NO: 39213 - DNA, 25 bp, Rattus norvegicus
aagcagggatggagactggcctcca

SEQ ID NO: 39214 - DNA, 25 bp, Rattus norvegicus
aagcagggatggtgactggcctcca

SEQ ID NO: 39215 - DNA, 25 bp, Rattus norvegicus
aagcagggcaaacaccagcatttcc

SEQ ID NO: 39216 - DNA, 25 bp, Rattus norvegicus
aagcagggcaaagaccagcatttcc

SEQ ID NO: 39217 - DNA, 25 bp, Rattus norvegicus
aagcagggcagaagacggctattga

SEQ ID NO: 39218 - DNA, 25 bp, Rattus norvegicus
aagcagggcagatgacggctattga

SEQ ID NO: 39219 - DNA, 25 bp, Rattus norvegicus
aagcagggccagctactcggaatta

SEQ ID NO: 39220 - DNA, 25 bp, Rattus norvegicus
aagcagggccaggtactcggaatta

SEQ ID NO: 39221 - DNA, 25 bp, Rattus norvegicus
aagcagggcctcctggacaaacatg

SEQ ID NO: 39222 - DNA, 25 bp, Rattus norvegicus
aagcagggcctcgtggacaaacatg

SEQ ID NO: 39223 - DNA, 25 bp, Rattus norvegicus
aagcagggctgcatcaaagagcaat

SEQ ID NO: 39224 - DNA, 25 bp, Rattus norvegicus
aagcagggctgcttcaaagagcaat

SEQ ID NO: 39225 - DNA, 25 bp, Rattus norvegicus
aagcagggctgtcatttcccgggtc

SEQ ID NO: 39226 - DNA, 25 bp, Rattus norvegicus
aagcagggctgtgatttcccgggtc

SEQ ID NO: 39227 - DNA, 25 bp, Rattus norvegicus
aagcagggcttgagaatccttctca

SEQ ID NO: 39228 - DNA, 25 bp, Rattus norvegicus
aagcagggcttgtgaatccttctca

SEQ ID NO: 39229 - DNA, 25 bp, Rattus norvegicus
aagcagggtcagctgtttgctgtcc

SEQ ID NO: 39230 - DNA, 25 bp, Rattus norvegicus
aagcagggtcaggtgtttgctgtcc

SEQ ID NO: 39231 - DNA, 25 bp, Rattus norvegicus
aagcagggtcttacaagccttggca

SEQ ID NO: 39232 - DNA, 25 bp, Rattus norvegicus
aagcagggtcttctggttgtctctc

SEQ ID NO: 39233 - DNA, 25 bp, Rattus norvegicus
aagcagggtcttgtggttgtctctc

SEQ ID NO: 39234 - DNA, 25 bp, Rattus norvegicus
aagcagggtctttcaagccttggca

SEQ ID NO: 39235 - DNA, 25 bp, Rattus norvegicus
aagcagggtgttcagtcctagcttt

SEQ ID NO: 39236 - DNA, 25 bp, Rattus norvegicus
aagcagggtgttgagtcctagcttt

SEQ ID NO: 39237 - DNA, 25 bp, Rattus norvegicus
aagcaggtacgtctccttgccgagt

SEQ ID NO: 39238 - DNA, 25 bp, Rattus norvegicus
aagcaggtacgtgtccttgccgagt

SEQ ID NO: 39239 - DNA, 25 bp, Rattus norvegicus
aagcaggtagaaccaagcccaaatt

SEQ ID NO: 39240 - DNA, 25 bp, Rattus norvegicus
aagcaggtagaactgcacccacctc

SEQ ID NO: 39241 - DNA, 25 bp, Rattus norvegicus
aagcaggtagaagcaagcccaaatt

SEQ ID NO: 39242 - DNA, 25 bp, Rattus norvegicus
aagcaggtagaagtgcacccacctc

SEQ ID NO: 39243 - DNA, 25 bp, Rattus norvegicus
aagcaggtagttatctccgtccctt

SEQ ID NO: 39244 - DNA, 25 bp, Rattus norvegicus
aagcaggtagttttctccgtccctt

SEQ ID NO: 39245 - DNA, 25 bp, Rattus norvegicus
aagcaggtatatctttcactccact

SEQ ID NO: 39246 - DNA, 25 bp, Rattus norvegicus
aagcaggtatatgtttcactccact

SEQ ID NO: 39247 - DNA, 25 bp, Rattus norvegicus
aagcaggtatgtatgcaattcgtgc

SEQ ID NO: 39248 - DNA, 25 bp, Rattus norvegicus
aagcaggtatgtttgcaattcgtgc

SEQ ID NO: 39249 - DNA, 25 bp, Rattus norvegicus
aagcaggtcaaacgctctgggccat

SEQ ID NO: 39250 - DNA, 25 bp, Rattus norvegicus
aagcaggtcaaaggctctgggccat

SEQ ID NO: 39251 - DNA, 25 bp, Rattus norvegicus
aagcaggtcaccatagtggcagcct

SEQ ID NO: 39252 - DNA, 25 bp, Rattus norvegicus
aagcaggtcaccatcgttgtgaact

SEQ ID NO: 39253 - DNA, 25 bp, Rattus norvegicus
aagcaggtcaccttagtggcagcct

SEQ ID NO: 39254 - DNA, 25 bp, Rattus norvegicus
aagcaggtcaccttcgttgtgaact

SEQ ID NO: 39255 - DNA, 25 bp, Rattus norvegicus
aagcaggtcgttatacagtcaacat

SEQ ID NO: 39256 - DNA, 25 bp, Rattus norvegicus
aagcaggtcgttttacagtcaacat

SEQ ID NO: 39257 - DNA, 25 bp, Rattus norvegicus
aagcaggtctaacagcggcctggac

SEQ ID NO: 39258 - DNA, 25 bp, Rattus norvegicus
aagcaggtctaagagcggcctggac

SEQ ID NO: 39259 - DNA, 25 bp, Rattus norvegicus
aagcaggtgactactctgtggaggt

SEQ ID NO: 39260 - DNA, 25 bp, Rattus norvegicus
aagcaggtgacttctctgtggaggt

SEQ ID NO: 39261 - DNA, 25 bp, Rattus norvegicus
aagcaggtgctccaagcttccatgg

SEQ ID NO: 39262 - DNA, 25 bp, Rattus norvegicus
aagcaggtgctcgaagcttccatgg

SEQ ID NO: 39263 - DNA, 25 bp, Rattus norvegicus
aagcaggtgcttcctctagcaggtc

SEQ ID NO: 39264 - DNA, 25 bp, Rattus norvegicus
aagcaggtgcttgctctagcaggtc

SEQ ID NO: 39265 - DNA, 25 bp, Rattus norvegicus
aagcaggtggctaacatctacaagt

SEQ ID NO: 39266 - DNA, 25 bp, Rattus norvegicus
aagcaggtggcttacatctacaagt

SEQ ID NO: 39267 - DNA, 25 bp, Rattus norvegicus
aagcaggtgttactcttggccttcg

SEQ ID NO: 39268 - DNA, 25 bp, Rattus norvegicus
aagcaggtgttagtcttggccttcg

SEQ ID NO: 39269 - DNA, 25 bp, Rattus norvegicus
aagcaggttagcaacaagcccggac

SEQ ID NO: 39270 - DNA, 25 bp, Rattus norvegicus
aagcaggttagctacaagcccggac

SEQ ID NO: 39271 - DNA, 25 bp, Rattus norvegicus
aagcaggttcagcaccgtgggactt

SEQ ID NO: 39272 - DNA, 25 bp, Rattus norvegicus
aagcaggttcaggaccgtgggactt

SEQ ID NO: 39273 - DNA, 25 bp, Rattus norvegicus
aagcaggttcttcttggtgcacagc

SEQ ID NO: 39274 - DNA, 25 bp, Rattus norvegicus
aagcaggttcttgttggtgcacagc

SEQ ID NO: 39275 - DNA, 25 bp, Rattus norvegicus
aagcagtaaactctctttagaggta

SEQ ID NO: 39276 - DNA, 25 bp, Rattus norvegicus
aagcagtaaactgtctttagaggta

SEQ ID NO: 39277 - DNA, 25 bp, Rattus norvegicus
aagcagtaacagcaccttaggaagt

SEQ ID NO: 39278 - DNA, 25 bp, Rattus norvegicus
aagcagtaacaggaccttaggaagt

SEQ ID NO: 39279 - DNA, 25 bp, Rattus norvegicus
aagcagtaagcaaccaggccaggtt

SEQ ID NO: 39280 - DNA, 25 bp, Rattus norvegicus
aagcagtaagcaactttaggtttaa

SEQ ID NO: 39281 - DNA, 25 bp, Rattus norvegicus
aagcagtaagcatccaggccaggtt

SEQ ID NO: 39282 - DNA, 25 bp, Rattus norvegicus
aagcagtaagcatctttaggtttaa

SEQ ID NO: 39283 - DNA, 25 bp, Rattus norvegicus
aagcagtaagttcctctccgttcct

SEQ ID NO: 39284 - DNA, 25 bp, Rattus norvegicus
aagcagtaagttgctctccgttcct

SEQ ID NO: 39285 - DNA, 25 bp, Rattus norvegicus
aagcagtacatcacgtgcatgcaaa

SEQ ID NO: 39286 - DNA, 25 bp, Rattus norvegicus
aagcagtacatccagtttgtggccg

SEQ ID NO: 39287 - DNA, 25 bp, Rattus norvegicus
aagcagtacatcgagtttgtggccg

SEQ ID NO: 39288 - DNA, 25 bp, Rattus norvegicus
aagcagtacatctcgtgcatgcaaa

SEQ ID NO: 39289 - DNA, 25 bp, Rattus norvegicus
aagcagtacttgcacggcatctcgg

SEQ ID NO: 39290 - DNA, 25 bp, Rattus norvegicus
aagcagtacttggacggcatctcgg

SEQ ID NO: 39291 - DNA, 25 bp, Rattus norvegicus
aagcagtagcggatcgtgtgctctg

SEQ ID NO: 39292 - DNA, 25 bp, Rattus norvegicus
aagcagtagcggttcgtgtgctctg

SEQ ID NO: 39293 - DNA, 25 bp, Rattus norvegicus
aagcagtaggtgcacacttcctaaa

SEQ ID NO: 39294 - DNA, 25 bp, Rattus norvegicus
aagcagtaggtggacacttcctaaa

SEQ ID NO: 39295 - DNA, 25 bp, Rattus norvegicus
aagcagtcaaccactgtcagtaagg

SEQ ID NO: 39296 - DNA, 25 bp, Rattus norvegicus
aagcagtcaacctctgtcagtaagg

SEQ ID NO: 39297 - DNA, 25 bp, Rattus norvegicus
aagcagtcaagaaaccaaagcagga

SEQ ID NO: 39298 - DNA, 25 bp, Rattus norvegicus
aagcagtcaagataccaaagcagga

SEQ ID NO: 39299 - DNA, 25 bp, Rattus norvegicus
aagcagtcacacaatcagcggagat

SEQ ID NO: 39300 - DNA, 25 bp, Rattus norvegicus
aagcagtcacactatcagcggagat

SEQ ID NO: 39301 - DNA, 25 bp, Rattus norvegicus
aagcagtcacagatcttgcatccag

SEQ ID NO: 39302 - DNA, 25 bp, Rattus norvegicus
aagcagtcacagttcttgcatccag

SEQ ID NO: 39303 - DNA, 25 bp, Rattus norvegicus
aagcagtcactaactttccgagttg

SEQ ID NO: 39304 - DNA, 25 bp, Rattus norvegicus
aagcagtcactatctttccgagttg

SEQ ID NO: 39305 - DNA, 25 bp, Rattus norvegicus
aagcagtcaggaacgtgccgacctc

SEQ ID NO: 39306 - DNA, 25 bp, Rattus norvegicus
aagcagtcaggatcgtgccgacctc

SEQ ID NO: 39307 - DNA, 25 bp, Rattus norvegicus
aagcagtcagttaatgtctagcaga

SEQ ID NO: 39308 - DNA, 25 bp, Rattus norvegicus
aagcagtcagtttatgtctagcaga

SEQ ID NO: 39309 - DNA, 25 bp, Rattus norvegicus
aagcagtccaaaaatcatcccaagg

SEQ ID NO: 39310 - DNA, 25 bp, Rattus norvegicus
aagcagtccaaatatcatcccaagg

SEQ ID NO: 39311 - DNA, 25 bp, Rattus norvegicus
aagcagtccagccttcggatgtctc

SEQ ID NO: 39312 - DNA, 25 bp, Rattus norvegicus
aagcagtccagcgttcggatgtctc

SEQ ID NO: 39313 - DNA, 25 bp, Rattus norvegicus
aagcagtccctcctttgggattatt

SEQ ID NO: 39314 - DNA, 25 bp, Rattus norvegicus
aagcagtccctcgtttgggattatt

SEQ ID NO: 39315 - DNA, 25 bp, Rattus norvegicus
aagcagtccggaatgtctgaggccc

SEQ ID NO: 39316 - DNA, 25 bp, Rattus norvegicus
aagcagtccggattgtctgaggccc

SEQ ID NO: 39317 - DNA, 25 bp, Rattus norvegicus
aagcagtcctgcacagaagtattgt

SEQ ID NO: 39318 - DNA, 25 bp, Rattus norvegicus
aagcagtcctgctcagaagtattgt

SEQ ID NO: 39319 - DNA, 25 bp, Rattus norvegicus
aagcagtcctggcttcaaagcctct

SEQ ID NO: 39320 - DNA, 25 bp, Rattus norvegicus
aagcagtcctgggttcaaagcctct

SEQ ID NO: 39321 - DNA, 25 bp, Rattus norvegicus
aagcagtcgctgcacgagctgagcc

SEQ ID NO: 39322 - DNA, 25 bp, Rattus norvegicus
aagcagtcgctggacgagctgagcc

SEQ ID NO: 39323 - DNA, 25 bp, Rattus norvegicus
aagcagtctctgaagggaatgggcc

SEQ ID NO: 39324 - DNA, 25 bp, Rattus norvegicus
aagcagtctctgcagctacacttac

SEQ ID NO: 39325 - DNA, 25 bp, Rattus norvegicus
aagcagtctctggagctacacttac

SEQ ID NO: 39326 - DNA, 25 bp, Rattus norvegicus
aagcagtctctgtagggaatgggcc

SEQ ID NO: 39327 - DNA, 25 bp, Rattus norvegicus
aagcagtgagcactcccagcctgaa

SEQ ID NO: 39328 - DNA, 25 bp, Rattus norvegicus
aagcagtgagcagtcccagcctgaa

SEQ ID NO: 39329 - DNA, 25 bp, Rattus norvegicus
aagcagtgagtcatcattttacgat

SEQ ID NO: 39330 - DNA, 25 bp, Rattus norvegicus
aagcagtgagtcttcattttacgat

SEQ ID NO: 39331 - DNA, 25 bp, Rattus norvegicus
aagcagtgatgactttgggttacca

SEQ ID NO: 39332 - DNA, 25 bp, Rattus norvegicus
aagcagtgatgagtttgggttacca

SEQ ID NO: 39333 - DNA, 25 bp, Rattus norvegicus
aagcagtgattgacaccctgcacga

SEQ ID NO: 39334 - DNA, 25 bp, Rattus norvegicus
aagcagtgattgtcaccctgcacga

SEQ ID NO: 39335 - DNA, 25 bp, Rattus norvegicus
aagcagtgcatgacccgaatttcct

SEQ ID NO: 39336 - DNA, 25 bp, Rattus norvegicus
aagcagtgcatgtcccgaatttcct

SEQ ID NO: 39337 - DNA, 25 bp, Rattus norvegicus
aagcagtgctgtacagtgctgacct

SEQ ID NO: 39338 - DNA, 25 bp, Rattus norvegicus
aagcagtgctgttcagtgctgacct

SEQ ID NO: 39339 - DNA, 25 bp, Rattus norvegicus
aagcagtgcttcagtaaacagaccc

SEQ ID NO: 39340 - DNA, 25 bp, Rattus norvegicus
aagcagtgcttctgtaaacagaccc

SEQ ID NO: 39341 - DNA, 25 bp, Rattus norvegicus
aagcagtggcctataccttggtacc

SEQ ID NO: 39342 - DNA, 25 bp, Rattus norvegicus
aagcagtggcctttaccttggtacc

SEQ ID NO: 39343 - DNA, 25 bp, Rattus norvegicus
aagcagtggcttacacatcgttttc

SEQ ID NO: 39344 - DNA, 25 bp, Rattus norvegicus
aagcagtggcttccttactgtcaaa

SEQ ID NO: 39345 - DNA, 25 bp, Rattus norvegicus
aagcagtggcttgcttactgtcaaa

SEQ ID NO: 39346 - DNA, 25 bp, Rattus norvegicus
aagcagtggctttcacatcgttttc

SEQ ID NO: 39347 - DNA, 25 bp, Rattus norvegicus
aagcagtgtgaactggtgctcccca

SEQ ID NO: 39348 - DNA, 25 bp, Rattus norvegicus
aagcagtgtgaagtggtgctcccca

SEQ ID NO: 39349 - DNA, 25 bp, Rattus norvegicus
aagcagttatggaatctccctctgt

SEQ ID NO: 39350 - DNA, 25 bp, Rattus norvegicus
aagcagttatggtatctccctctgt

SEQ ID NO: 39351 - DNA, 25 bp, Rattus norvegicus
aagcagttccttcctacagttaggg

SEQ ID NO: 39352 - DNA, 25 bp, Rattus norvegicus
aagcagttccttgctacagttaggg

SEQ ID NO: 39353 - DNA, 25 bp, Rattus norvegicus
aagcagttcgaaatcgtgggctccg

SEQ ID NO: 39354 - DNA, 25 bp, Rattus norvegicus
aagcagttcgaattcgtgggctccg

SEQ ID NO: 39355 - DNA, 25 bp, Rattus norvegicus
aagcagttcgagatttatagaggta

SEQ ID NO: 39356 - DNA, 25 bp, Rattus norvegicus
aagcagttcgagttttatagaggta

SEQ ID NO: 39357 - DNA, 25 bp, Rattus norvegicus
aagcagttctccagactggtaccct

SEQ ID NO: 39358 - DNA, 25 bp, Rattus norvegicus
aagcagttctcctgactggtaccct

SEQ ID NO: 39359 - DNA, 25 bp, Rattus norvegicus
aagcagttctgcctgaggatctcta

SEQ ID NO: 39360 - DNA, 25 bp, Rattus norvegicus
aagcagttctgcgtgaggatctcta

SEQ ID NO: 39361 - DNA, 25 bp, Rattus norvegicus
aagcagttctttacaacatgggaag

SEQ ID NO: 39362 - DNA, 25 bp, Rattus norvegicus
aagcagttcttttcaacatgggaag

SEQ ID NO: 39363 - DNA, 25 bp, Rattus norvegicus
aagcagttgatcacccaccataggg

SEQ ID NO: 39364 - DNA, 25 bp, Rattus norvegicus
aagcagttgatctcccaccataggg

SEQ ID NO: 39365 - DNA, 25 bp, Rattus norvegicus
aagcagttgcccctttttatactgg

SEQ ID NO: 39366 - DNA, 25 bp, Rattus norvegicus
aagcagttgcccgtttttatactgg

SEQ ID NO: 39367 - DNA, 25 bp, Rattus norvegicus
aagcagttgccgcaggcctcttata

SEQ ID NO: 39368 - DNA, 25 bp, Rattus norvegicus
aagcagttgccggaggcctcttata

SEQ ID NO: 39369 - DNA, 25 bp, Rattus norvegicus
aagcagttgcgcaccattcaaaaga

SEQ ID NO: 39370 - DNA, 25 bp, Rattus norvegicus
aagcagttgcgctccattcaaaaga

SEQ ID NO: 39371 - DNA, 25 bp, Rattus norvegicus
aagcagttggcaagttcttcctgga

SEQ ID NO: 39372 - DNA, 25 bp, Rattus norvegicus
aagcagttggcatgttcttcctgga

SEQ ID NO: 39373 - DNA, 25 bp, Rattus norvegicus
aagcagttgtgtcttgatcctaatt

SEQ ID NO: 39374 - DNA, 25 bp, Rattus norvegicus
aagcagttgtgtgttgatcctaatt

SEQ ID NO: 39375 - DNA, 25 bp, Rattus norvegicus
aagcagtttagtccacattttacac

SEQ ID NO: 39376 - DNA, 25 bp, Rattus norvegicus
aagcagtttagtgcacattttacac

SEQ ID NO: 39377 - DNA, 25 bp, Rattus norvegicus
aagcagtttccacgcctagatggga

SEQ ID NO: 39378 - DNA, 25 bp, Rattus norvegicus
aagcagtttccaggcctagatggga

SEQ ID NO: 39379 - DNA, 25 bp, Rattus norvegicus
aagcagtttcccctttcagtgttct

SEQ ID NO: 39380 - DNA, 25 bp, Rattus norvegicus
aagcagtttcccgtttcagtgttct

SEQ ID NO: 39381 - DNA, 25 bp, Rattus norvegicus
aagcagtttccgacagtgttcagga

SEQ ID NO: 39382 - DNA, 25 bp, Rattus norvegicus
aagcagtttccgtcagtgttcagga

SEQ ID NO: 39383 - DNA, 25 bp, Rattus norvegicus
aagcagtttctgcagtgtgctcaga

SEQ ID NO: 39384 - DNA, 25 bp, Rattus norvegicus
aagcagtttctggagtgtgctcaga

SEQ ID NO: 39385 - DNA, 25 bp, Rattus norvegicus
aagcagtttgacatctaggtcagca

SEQ ID NO: 39386 - DNA, 25 bp, Rattus norvegicus
aagcagtttgacttctaggtcagca

SEQ ID NO: 39387 - DNA, 25 bp, Rattus norvegicus
aagcagtttgctatttaggctaaca

SEQ ID NO: 39388 - DNA, 25 bp, Rattus norvegicus
aagcagtttgctttttaggctaaca

SEQ ID NO: 39389 - DNA, 25 bp, Rattus norvegicus
aagcataaatctccatcgcacgcca

SEQ ID NO: 39390 - DNA, 25 bp, Rattus norvegicus
aagcataaatctgcatcgcacgcca

SEQ ID NO: 39391 - DNA, 25 bp, Rattus norvegicus
aagcataatcgaaccatcccagagg

SEQ ID NO: 39392 - DNA, 25 bp, Rattus norvegicus
aagcataatcgatccatcccagagg

SEQ ID NO: 39393 - DNA, 25 bp, Rattus norvegicus
aagcatacagaaaggctgcactaca

SEQ ID NO: 39394 - DNA, 25 bp, Rattus norvegicus
aagcatacagaatggctgcactaca

SEQ ID NO: 39395 - DNA, 25 bp, Rattus norvegicus
aagcatacaggtagcagccatccgt

SEQ ID NO: 39396 - DNA, 25 bp, Rattus norvegicus
aagcatacaggttgcagccatccgt

SEQ ID NO: 39397 - DNA, 25 bp, Rattus norvegicus
aagcatacatgaccttctccatcgt

SEQ ID NO: 39398 - DNA, 25 bp, Rattus norvegicus
aagcatacatgagcttctccatcgt

SEQ ID NO: 39399 - DNA, 25 bp, Rattus norvegicus
aagcatacattcactgggcttccct

SEQ ID NO: 39400 - DNA, 25 bp, Rattus norvegicus
aagcatacattctctgggcttccct

SEQ ID NO: 39401 - DNA, 25 bp, Rattus norvegicus
aagcataccctgaaaaatccctgtg

SEQ ID NO: 39402 - DNA, 25 bp, Rattus norvegicus
aagcataccctgtaaaatccctgtg

SEQ ID NO: 39403 - DNA, 25 bp, Rattus norvegicus
aagcatacctaactctctttgagga

SEQ ID NO: 39404 - DNA, 25 bp, Rattus norvegicus
aagcatacctaagtctctttgagga

SEQ ID NO: 39405 - DNA, 25 bp, Rattus norvegicus
aagcatactgtacgtttctcccatg

SEQ ID NO: 39406 - DNA, 25 bp, Rattus norvegicus
aagcatactgtaggtttctcccatg

SEQ ID NO: 39407 - DNA, 25 bp, Rattus norvegicus
aagcatacttacatcgtaccacggg

SEQ ID NO: 39408 - DNA, 25 bp, Rattus norvegicus
aagcatacttacttcgtaccacggg

SEQ ID NO: 39409 - DNA, 25 bp, Rattus norvegicus
aagcatacttccagatgggtcaata

SEQ ID NO: 39410 - DNA, 25 bp, Rattus norvegicus
aagcatacttcctgatgggtcaata

SEQ ID NO: 39411 - DNA, 25 bp, Rattus norvegicus
aagcatagacggacagcctggtgcc

SEQ ID NO: 39412 - DNA, 25 bp, Rattus norvegicus
aagcatagacggtcagcctggtgcc

SEQ ID NO: 39413 - DNA, 25 bp, Rattus norvegicus
aagcatagcaccctgacagttctta

SEQ ID NO: 39414 - DNA, 25 bp, Rattus norvegicus
aagcatagcaccgtgacagttctta

SEQ ID NO: 39415 - DNA, 25 bp, Rattus norvegicus
aagcatagtattacggggcatgtcc

SEQ ID NO: 39416 - DNA, 25 bp, Rattus norvegicus
aagcatagtatttcggggcatgtcc

SEQ ID NO: 39417 - DNA, 25 bp, Rattus norvegicus
aagcatatattactcttacagagga

SEQ ID NO: 39418 - DNA, 25 bp, Rattus norvegicus
aagcatatattagtcttacagagga

SEQ ID NO: 39419 - DNA, 25 bp, Rattus norvegicus
aagcatatcagtatgtggacattcc

SEQ ID NO: 39420 - DNA, 25 bp, Rattus norvegicus
aagcatatcagtttgtggacattcc

SEQ ID NO: 39421 - DNA, 25 bp, Rattus norvegicus
aagcatatcataattccgcagagga

SEQ ID NO: 39422 - DNA, 25 bp, Rattus norvegicus
aagcatatcatatttccgcagagga

SEQ ID NO: 39423 - DNA, 25 bp, Rattus norvegicus
aagcatatcctaactctgactcatt

SEQ ID NO: 39424 - DNA, 25 bp, Rattus norvegicus
aagcatatcctatctctgactcatt

SEQ ID NO: 39425 - DNA, 25 bp, Rattus norvegicus
aagcatatggtgaacagacaaacat

SEQ ID NO: 39426 - DNA, 25 bp, Rattus norvegicus
aagcatatggtgtacagacaaacat

SEQ ID NO: 39427 - DNA, 25 bp, Rattus norvegicus
aagcatattacgataggcagcagat

SEQ ID NO: 39428 - DNA, 25 bp, Rattus norvegicus
aagcatattacgttaggcagcagat

SEQ ID NO: 39429 - DNA, 25 bp, Rattus norvegicus
aagcatattaggattcactctacaa

SEQ ID NO: 39430 - DNA, 25 bp, Rattus norvegicus
aagcatattaggtttcactctacaa

SEQ ID NO: 39431 - DNA, 25 bp, Rattus norvegicus
aagcatattttcaccaaaggttggt

SEQ ID NO: 39432 - DNA, 25 bp, Rattus norvegicus
aagcatattttctccaaaggttggt

SEQ ID NO: 39433 - DNA, 25 bp, Rattus norvegicus
aagcatcaagagacaggattaccct

SEQ ID NO: 39434 - DNA, 25 bp, Rattus norvegicus
aagcatcaagagtcaggattaccct

SEQ ID NO: 39435 - DNA, 25 bp, Rattus norvegicus
aagcatcaatcactgttccttcctg

SEQ ID NO: 39436 - DNA, 25 bp, Rattus norvegicus
aagcatcaatcagtgttccttcctg

SEQ ID NO: 39437 - DNA, 25 bp, Rattus norvegicus
aagcatcacaagaatcacacccact

SEQ ID NO: 39438 - DNA, 25 bp, Rattus norvegicus
aagcatcacaagtatcacacccact

SEQ ID NO: 39439 - DNA, 25 bp, Rattus norvegicus
aagcatcacagcatgagcatgccaa

SEQ ID NO: 39440 - DNA, 25 bp, Rattus norvegicus
aagcatcacagcttgagcatgccaa

SEQ ID NO: 39441 - DNA, 25 bp, Rattus norvegicus
aagcatcacaggagacggtctggca

SEQ ID NO: 39442 - DNA, 25 bp, Rattus norvegicus
aagcatcacaggtgacggtctggca

SEQ ID NO: 39443 - DNA, 25 bp, Rattus norvegicus
aagcatcacctcaagtgatcctggg

SEQ ID NO: 39444 - DNA, 25 bp, Rattus norvegicus
aagcatcacctctagtgatcctggg

SEQ ID NO: 39445 - DNA, 25 bp, Rattus norvegicus
aagcatcagataccagccctgtatt

SEQ ID NO: 39446 - DNA, 25 bp, Rattus norvegicus
aagcatcagatagcagccctgtatt

SEQ ID NO: 39447 - DNA, 25 bp, Rattus norvegicus
aagcatcagatcaccgtcttttttg

SEQ ID NO: 39448 - DNA, 25 bp, Rattus norvegicus
aagcatcagatctccgtcttttttg

SEQ ID NO: 39449 - DNA, 25 bp, Rattus norvegicus
aagcatcagcaactggtccacacga

SEQ ID NO: 39450 - DNA, 25 bp, Rattus norvegicus
aagcatcagcaagtggtccacacga

SEQ ID NO: 39451 - DNA, 25 bp, Rattus norvegicus
aagcatcagctaaggagccagccga

SEQ ID NO: 39452 - DNA, 25 bp, Rattus norvegicus
aagcatcagctatggagccagccga

SEQ ID NO: 39453 - DNA, 25 bp, Rattus norvegicus
aagcatcagcttcaacaacaaacag

SEQ ID NO: 39454 - DNA, 25 bp, Rattus norvegicus
aagcatcagcttgaacaacaaacag

SEQ ID NO: 39455 - DNA, 25 bp, Rattus norvegicus
aagcatcaggacaacctgtcactgc

SEQ ID NO: 39456 - DNA, 25 bp, Rattus norvegicus
aagcatcaggactacctgtcactgc

SEQ ID NO: 39457 - DNA, 25 bp, Rattus norvegicus
aagcatcagggcaggttgggcactc

SEQ ID NO: 39458 - DNA, 25 bp, Rattus norvegicus
aagcatcagggctggttgggcactc

SEQ ID NO: 39459 - DNA, 25 bp, Rattus norvegicus
aagcatcagtgcacctgcttatgtt

SEQ ID NO: 39460 - DNA, 25 bp, Rattus norvegicus
aagcatcagtgctcctgcttatgtt

SEQ ID NO: 39461 - DNA, 25 bp, Rattus norvegicus
aagcatcatcaccagtctactttaa

SEQ ID NO: 39462 - DNA, 25 bp, Rattus norvegicus
aagcatcatcacgagtctactttaa

SEQ ID NO: 39463 - DNA, 25 bp, Rattus norvegicus
aagcatcatgtgatcttggtccgaa

SEQ ID NO: 39464 - DNA, 25 bp, Rattus norvegicus
aagcatcatgtgttcttggtccgaa

SEQ ID NO: 39465 - DNA, 25 bp, Rattus norvegicus
aagcatcattatcaggcagccagtg

SEQ ID NO: 39466 - DNA, 25 bp, Rattus norvegicus
aagcatcattatgaggcagccagtg

SEQ ID NO: 39467 - DNA, 25 bp, Rattus norvegicus
aagcatccagaaaccttgtaatttc

SEQ ID NO: 39468 - DNA, 25 bp, Rattus norvegicus
aagcatccagaatccttgtaatttc

SEQ ID NO: 39469 - DNA, 25 bp, Rattus norvegicus
aagcatccatctagagttccaggac

SEQ ID NO: 39470 - DNA, 25 bp, Rattus norvegicus
aagcatccatcttgagttccaggac

SEQ ID NO: 39471 - DNA, 25 bp, Rattus norvegicus
aagcatccattgcatgagacagaca

SEQ ID NO: 39472 - DNA, 25 bp, Rattus norvegicus
aagcatccattggatgagacagaca

SEQ ID NO: 39473 - DNA, 25 bp, Rattus norvegicus
aagcatccggaactacgctgagccc

SEQ ID NO: 39474 - DNA, 25 bp, Rattus norvegicus
aagcatccggaagtacgctgagccc

SEQ ID NO: 39475 - DNA, 25 bp, Rattus norvegicus
aagcatccgtgcagttgacccagag

SEQ ID NO: 39476 - DNA, 25 bp, Rattus norvegicus
aagcatccgtgctgttgacccagag

SEQ ID NO: 39477 - DNA, 25 bp, Rattus norvegicus
aagcatcctactcgagtatctgtcc

SEQ ID NO: 39478 - DNA, 25 bp, Rattus norvegicus
aagcatcctactggagtatctgtcc

SEQ ID NO: 39479 - DNA, 25 bp, Rattus norvegicus
aagcatcctcacattcttagacaat

SEQ ID NO: 39480 - DNA, 25 bp, Rattus norvegicus
aagcatcctcactttcttagacaat

SEQ ID NO: 39481 - DNA, 25 bp, Rattus norvegicus
aagcatcctccgcagctccgtattt

SEQ ID NO: 39482 - DNA, 25 bp, Rattus norvegicus
aagcatcctccggagctccgtattt

SEQ ID NO: 39483 - DNA, 25 bp, Rattus norvegicus
aagcatcctctaaccgcatgaagaa

SEQ ID NO: 39484 - DNA, 25 bp, Rattus norvegicus
aagcatcctctatccgcatgaagaa

SEQ ID NO: 39485 - DNA, 25 bp, Rattus norvegicus
aagcatcctctgatcttcatacatt

SEQ ID NO: 39486 - DNA, 25 bp, Rattus norvegicus
aagcatcctctgttcttcatacatt

SEQ ID NO: 39487 - DNA, 25 bp, Rattus norvegicus
aagcatcctcttctgtagtcagaca

SEQ ID NO: 39488 - DNA, 25 bp, Rattus norvegicus
aagcatcctcttgtgtagtcagaca

SEQ ID NO: 39489 - DNA, 25 bp, Rattus norvegicus
aagcatcctgacaacagcaactgat

SEQ ID NO: 39490 - DNA, 25 bp, Rattus norvegicus
aagcatcctgactacagcaactgat

SEQ ID NO: 39491 - DNA, 25 bp, Rattus norvegicus
aagcatcctggaacgtttgtctttg

SEQ ID NO: 39492 - DNA, 25 bp, Rattus norvegicus
aagcatcctggatcgtttgtctttg

SEQ ID NO: 39493 - DNA, 25 bp, Rattus norvegicus
aagcatcctgtgatctgcacggttg

SEQ ID NO: 39494 - DNA, 25 bp, Rattus norvegicus
aagcatcctgtgttctgcacggttg

SEQ ID NO: 39495 - DNA, 25 bp, Rattus norvegicus
aagcatccttcaatctgcattccat

SEQ ID NO: 39496 - DNA, 25 bp, Rattus norvegicus
aagcatccttcattctgcattccat

SEQ ID NO: 39497 - DNA, 25 bp, Rattus norvegicus
aagcatccttgactcgtgaagccag

SEQ ID NO: 39498 - DNA, 25 bp, Rattus norvegicus
aagcatccttgagtcgtgaagccag

SEQ ID NO: 39499 - DNA, 25 bp, Rattus norvegicus
aagcatcgagaaccggaaggagacc

SEQ ID NO: 39500 - DNA, 25 bp, Rattus norvegicus
aagcatcgagaagcggaaggagacc

SEQ ID NO: 39501 - DNA, 25 bp, Rattus norvegicus
aagcatcgcgccatcaatagctgtt

SEQ ID NO: 39502 - DNA, 25 bp, Rattus norvegicus
aagcatcgcgccttcaatagctgtt

SEQ ID NO: 39503 - DNA, 25 bp, Rattus norvegicus
aagcatcgctgcactaaatgatgaa

SEQ ID NO: 39504 - DNA, 25 bp, Rattus norvegicus
aagcatcgctgctctaaatgatgaa

SEQ ID NO: 39505 - DNA, 25 bp, Rattus norvegicus
aagcatcgcttacaagcccttacag

SEQ ID NO: 39506 - DNA, 25 bp, Rattus norvegicus
aagcatcgcttagaagcccttacag

SEQ ID NO: 39507 - DNA, 25 bp, Rattus norvegicus
aagcatcgtcagagagtgtttgtat

SEQ ID NO: 39508 - DNA, 25 bp, Rattus norvegicus
aagcatcgtcagtgagtgtttgtat

SEQ ID NO: 39509 - DNA, 25 bp, Rattus norvegicus
aagcatcgtgacactacggacctgc

SEQ ID NO: 39510 - DNA, 25 bp, Rattus norvegicus
aagcatcgtgactctacggacctgc

SEQ ID NO: 39511 - DNA, 25 bp, Rattus norvegicus
aagcatctaaatacacatctgtctg

SEQ ID NO: 39512 - DNA, 25 bp, Rattus norvegicus
aagcatctaaattcacatctgtctg

SEQ ID NO: 39513 - DNA, 25 bp, Rattus norvegicus
aagcatctaaccagctagcaaaatt

SEQ ID NO: 39514 - DNA, 25 bp, Rattus norvegicus
aagcatctaacctgctagcaaaatt

SEQ ID NO: 39515 - DNA, 25 bp, Rattus norvegicus
aagcatctaggtactatggctcaga

SEQ ID NO: 39516 - DNA, 25 bp, Rattus norvegicus
aagcatctaggttctatggctcaga

SEQ ID NO: 39517 - DNA, 25 bp, Rattus norvegicus
aagcatctatctcgtttgcagtttt

SEQ ID NO: 39518 - DNA, 25 bp, Rattus norvegicus
aagcatctatctggtttgcagtttt

SEQ ID NO: 39519 - DNA, 25 bp, Rattus norvegicus
aagcatctattcctggcgtctgtaa

SEQ ID NO: 39520 - DNA, 25 bp, Rattus norvegicus
aagcatctattcgtggcgtctgtaa

SEQ ID NO: 39521 - DNA, 25 bp, Rattus norvegicus
aagcatctatttatcggttcctgga

SEQ ID NO: 39522 - DNA, 25 bp, Rattus norvegicus
aagcatctatttttcggttcctgga

SEQ ID NO: 39523 - DNA, 25 bp, Rattus norvegicus
aagcatctcaaccacgacgtggtca

SEQ ID NO: 39524 - DNA, 25 bp, Rattus norvegicus
aagcatctcaacgacgacgtggtca

SEQ ID NO: 39525 - DNA, 25 bp, Rattus norvegicus
aagcatctcaagactatggatcaca

SEQ ID NO: 39526 - DNA, 25 bp, Rattus norvegicus
aagcatctcaagtctatggatcaca

SEQ ID NO: 39527 - DNA, 25 bp, Rattus norvegicus
aagcatctcagacagaacctttcat

SEQ ID NO: 39528 - DNA, 25 bp, Rattus norvegicus
aagcatctcagagagaacctttcat

SEQ ID NO: 39529 - DNA, 25 bp, Rattus norvegicus
aagcatctcgaacccatgggcacta

SEQ ID NO: 39530 - DNA, 25 bp, Rattus norvegicus
aagcatctcgaagccatgggcacta

SEQ ID NO: 39531 - DNA, 25 bp, Rattus norvegicus
aagcatctctgaactgtcagtgcta

SEQ ID NO: 39532 - DNA, 25 bp, Rattus norvegicus
aagcatctctgatctgtcagtgcta

SEQ ID NO: 39533 - DNA, 25 bp, Rattus norvegicus
aagcatctctgccaagaagacgaat

SEQ ID NO: 39534 - DNA, 25 bp, Rattus norvegicus
aagcatctctgcgaagaagacgaat

SEQ ID NO: 39535 - DNA, 25 bp, Rattus norvegicus
aagcatctgaacctagtcctggcat

SEQ ID NO: 39536 - DNA, 25 bp, Rattus norvegicus
aagcatctgaacgtagtcctggcat

SEQ ID NO: 39537 - DNA, 25 bp, Rattus norvegicus
aagcatctgacacctggtagtccta

SEQ ID NO: 39538 - DNA, 25 bp, Rattus norvegicus
aagcatctgacagctggtagtccta

SEQ ID NO: 39539 - DNA, 25 bp, Rattus norvegicus
aagcatctgcgcactcatactggag

SEQ ID NO: 39540 - DNA, 25 bp, Rattus norvegicus
aagcatctgcgctctcatactggag

SEQ ID NO: 39541 - DNA, 25 bp, Rattus norvegicus
aagcatctgctacccgaggttcaca

SEQ ID NO: 39542 - DNA, 25 bp, Rattus norvegicus
aagcatctgctagccgaggttcaca

SEQ ID NO: 39543 - DNA, 25 bp, Rattus norvegicus
aagcatctgctcctctggagtcaga

SEQ ID NO: 39544 - DNA, 25 bp, Rattus norvegicus
aagcatctgctcgtctggagtcaga

SEQ ID NO: 39545 - DNA, 25 bp, Rattus norvegicus
aagcatctgggcatgctcaagtgag

SEQ ID NO: 39546 - DNA, 25 bp, Rattus norvegicus
aagcatctgggcttgctcaagtgag

SEQ ID NO: 39547 - DNA, 25 bp, Rattus norvegicus
aagcatctgtaaacactcgtgacgt

SEQ ID NO: 39548 - DNA, 25 bp, Rattus norvegicus
aagcatctgtaatcactcgtgacgt

SEQ ID NO: 39549 - DNA, 25 bp, Rattus norvegicus
aagcatctgtctatgatttcactgt

SEQ ID NO: 39550 - DNA, 25 bp, Rattus norvegicus
aagcatctgtctttgatttcactgt

SEQ ID NO: 39551 - DNA, 25 bp, Rattus norvegicus
aagcatctgtttactgcaactttta

SEQ ID NO: 39552 - DNA, 25 bp, Rattus norvegicus
aagcatctgtttatggtgtttgtac

SEQ ID NO: 39553 - DNA, 25 bp, Rattus norvegicus
aagcatctgttttctgcaactttta

SEQ ID NO: 39554 - DNA, 25 bp, Rattus norvegicus
aagcatctgtttttggtgtttgtac

SEQ ID NO: 39555 - DNA, 25 bp, Rattus norvegicus
aagcatcttcctctaatctattata

SEQ ID NO: 39556 - DNA, 25 bp, Rattus norvegicus
aagcatcttcctgtaatctattata

SEQ ID NO: 39557 - DNA, 25 bp, Rattus norvegicus
aagcatcttctcatattctgtgcaa

SEQ ID NO: 39558 - DNA, 25 bp, Rattus norvegicus
aagcatcttctcttattctgtgcaa

SEQ ID NO: 39559 - DNA, 25 bp, Rattus norvegicus
aagcatcttggcagggtgtggtttc

SEQ ID NO: 39560 - DNA, 25 bp, Rattus norvegicus
aagcatcttggctgggtgtggtttc

SEQ ID NO: 39561 - DNA, 25 bp, Rattus norvegicus
aagcatcttgttaccatattttagt

SEQ ID NO: 39562 - DNA, 25 bp, Rattus norvegicus
aagcatcttgtttccatattttagt

SEQ ID NO: 39563 - DNA, 25 bp, Rattus norvegicus
aagcatgactttaggaatctctgaa

SEQ ID NO: 39564 - DNA, 25 bp, Rattus norvegicus
aagcatgacttttggaatctctgaa

SEQ ID NO: 39565 - DNA, 25 bp, Rattus norvegicus
aagcatgagaggactgagtccggct

SEQ ID NO: 39566 - DNA, 25 bp, Rattus norvegicus
aagcatgagaggtctgagtccggct

SEQ ID NO: 39567 - DNA, 25 bp, Rattus norvegicus
aagcatgagcataacccctgaggat

SEQ ID NO: 39568 - DNA, 25 bp, Rattus norvegicus
aagcatgagcattacccctgaggat

SEQ ID NO: 39569 - DNA, 25 bp, Rattus norvegicus
aagcatgagtcaacacgcccggttt

SEQ ID NO: 39570 - DNA, 25 bp, Rattus norvegicus
aagcatgagtcatcacgcccggttt

SEQ ID NO: 39571 - DNA, 25 bp, Rattus norvegicus
aagcatgatggtctggtgagaacct

SEQ ID NO: 39572 - DNA, 25 bp, Rattus norvegicus
aagcatgatggtgtggtgagaacct

SEQ ID NO: 39573 - DNA, 25 bp, Rattus norvegicus
aagcatgcaactctactggtgtatt

SEQ ID NO: 39574 - DNA, 25 bp, Rattus norvegicus
aagcatgcaactgtactggtgtatt

SEQ ID NO: 39575 - DNA, 25 bp, Rattus norvegicus
aagcatgcaaggaggaagccagcct

SEQ ID NO: 39576 - DNA, 25 bp, Rattus norvegicus
aagcatgcaaggtggaagccagcct

SEQ ID NO: 39577 - DNA, 25 bp, Rattus norvegicus
aagcatgcaataccttgctcaactc

SEQ ID NO: 39578 - DNA, 25 bp, Rattus norvegicus
aagcatgcaatagcttgctcaactc

SEQ ID NO: 39579 - DNA, 25 bp, Rattus norvegicus
aagcatgcactcaactgctgagaca

SEQ ID NO: 39580 - DNA, 25 bp, Rattus norvegicus
aagcatgcactctactgctgagaca

SEQ ID NO: 39581 - DNA, 25 bp, Rattus norvegicus
aagcatgcagatcttgaaaccgaaa

SEQ ID NO: 39582 - DNA, 25 bp, Rattus norvegicus
aagcatgcagatgttgaaaccgaaa

SEQ ID NO: 39583 - DNA, 25 bp, Rattus norvegicus
aagcatgcatcaaggctccttctta

SEQ ID NO: 39584 - DNA, 25 bp, Rattus norvegicus
aagcatgcatcatggctccttctta

SEQ ID NO: 39585 - DNA, 25 bp, Rattus norvegicus
aagcatgccgcgaaacacgagctac

SEQ ID NO: 39586 - DNA, 25 bp, Rattus norvegicus
aagcatgccgcgtaacacgagctac

SEQ ID NO: 39587 - DNA, 25 bp, Rattus norvegicus
aagcatgccgtgcagcttgtttcgt

SEQ ID NO: 39588 - DNA, 25 bp, Rattus norvegicus
aagcatgccgtggagcttgtttcgt

SEQ ID NO: 39589 - DNA, 25 bp, Rattus norvegicus
aagcatgcctataacttttatgaca

SEQ ID NO: 39590 - DNA, 25 bp, Rattus norvegicus
aagcatgcctattacttttatgaca

SEQ ID NO: 39591 - DNA, 25 bp, Rattus norvegicus
aagcatgcctctaaataagcggtgt

SEQ ID NO: 39592 - DNA, 25 bp, Rattus norvegicus
aagcatgcctcttaataagcggtgt

SEQ ID NO: 39593 - DNA, 25 bp, Rattus norvegicus
aagcatgcctgcactgggcatttat

SEQ ID NO: 39594 - DNA, 25 bp, Rattus norvegicus
aagcatgcctgctctgggcatttat

SEQ ID NO: 39595 - DNA, 25 bp, Rattus norvegicus
aagcatgcgacccaggcattctttg

SEQ ID NO: 39596 - DNA, 25 bp, Rattus norvegicus
aagcatgcgaccgaggcattctttg

SEQ ID NO: 39597 - DNA, 25 bp, Rattus norvegicus
aagcatgctcacagggtctggctga

SEQ ID NO: 39598 - DNA, 25 bp, Rattus norvegicus
aagcatgctcactgggtctggctga

SEQ ID NO: 39599 - DNA, 25 bp, Rattus norvegicus
aagcatgctcagagccttttggttt

SEQ ID NO: 39600 - DNA, 25 bp, Rattus norvegicus
aagcatgctcagtgccttttggttt

SEQ ID NO: 39601 - DNA, 25 bp, Rattus norvegicus
aagcatgctccccactaaattacac

SEQ ID NO: 39602 - DNA, 25 bp, Rattus norvegicus
aagcatgctcccgactaaattacac

SEQ ID NO: 39603 - DNA, 25 bp, Rattus norvegicus
aagcatgcttagattctggtcatga

SEQ ID NO: 39604 - DNA, 25 bp, Rattus norvegicus
aagcatgcttagtttctggtcatga

SEQ ID NO: 39605 - DNA, 25 bp, Rattus norvegicus
aagcatgcttctaccatgtatctga

SEQ ID NO: 39606 - DNA, 25 bp, Rattus norvegicus
aagcatgcttcttccatgtatctga

SEQ ID NO: 39607 - DNA, 25 bp, Rattus norvegicus
aagcatgcttgcacttgctgtgttg

SEQ ID NO: 39608 - DNA, 25 bp, Rattus norvegicus
aagcatgcttgcatttctcaacaca

SEQ ID NO: 39609 - DNA, 25 bp, Rattus norvegicus
aagcatgcttgctcttgctgtgttg

SEQ ID NO: 39610 - DNA, 25 bp, Rattus norvegicus
aagcatgcttgcttttctcaacaca

SEQ ID NO: 39611 - DNA, 25 bp, Rattus norvegicus
aagcatgcttttacactggtccctt

SEQ ID NO: 39612 - DNA, 25 bp, Rattus norvegicus
aagcatgctttttcactggtccctt

SEQ ID NO: 39613 - DNA, 25 bp, Rattus norvegicus
aagcatggacgacagatgtcacaca

SEQ ID NO: 39614 - DNA, 25 bp, Rattus norvegicus
aagcatggacgagagatgtcacaca

SEQ ID NO: 39615 - DNA, 25 bp, Rattus norvegicus
aagcatggactgctgagagcgctca

SEQ ID NO: 39616 - DNA, 25 bp, Rattus norvegicus
aagcatggactggtgagagcgctca

SEQ ID NO: 39617 - DNA, 25 bp, Rattus norvegicus
aagcatggacttcgcgcgcacactt

SEQ ID NO: 39618 - DNA, 25 bp, Rattus norvegicus
aagcatggacttggcgcgcacactt

SEQ ID NO: 39619 - DNA, 25 bp, Rattus norvegicus
aagcatggcaggactcaggcagccg

SEQ ID NO: 39620 - DNA, 25 bp, Rattus norvegicus
aagcatggcaggtctcaggcagccg

SEQ ID NO: 39621 - DNA, 25 bp, Rattus norvegicus
aagcatggcctgaacaacctcaaac

SEQ ID NO: 39622 - DNA, 25 bp, Rattus norvegicus
aagcatggcctgtacaacctcaaac

SEQ ID NO: 39623 - DNA, 25 bp, Rattus norvegicus
aagcatggcgttagtctgccgtgcc

SEQ ID NO: 39624 - DNA, 25 bp, Rattus norvegicus
aagcatggcgtttgtctgccgtgcc

SEQ ID NO: 39625 - DNA, 25 bp, Rattus norvegicus
aagcatggctgaccttcaattaaaa

SEQ ID NO: 39626 - DNA, 25 bp, Rattus norvegicus
aagcatggctgagcttcaattaaaa

SEQ ID NO: 39627 - DNA, 25 bp, Rattus norvegicus
aagcatggctgtcgccttccaggga

SEQ ID NO: 39628 - DNA, 25 bp, Rattus norvegicus
aagcatggctgtggccttccaggga

SEQ ID NO: 39629 - DNA, 25 bp, Rattus norvegicus
aagcatggcttacacagaccaccta

SEQ ID NO: 39630 - DNA, 25 bp, Rattus norvegicus
aagcatggcttagacagaccaccta

SEQ ID NO: 39631 - DNA, 25 bp, Rattus norvegicus
aagcatgggaaactcacactccacc

SEQ ID NO: 39632 - DNA, 25 bp, Rattus norvegicus
aagcatgggaaagtcacactccacc

SEQ ID NO: 39633 - DNA, 25 bp, Rattus norvegicus
aagcatgggccaactgaaagggttt

SEQ ID NO: 39634 - DNA, 25 bp, Rattus norvegicus
aagcatgggccatctgaaagggttt

SEQ ID NO: 39635 - DNA, 25 bp, Rattus norvegicus
aagcatgggtgtctaccattccctg

SEQ ID NO: 39636 - DNA, 25 bp, Rattus norvegicus
aagcatgggtgtgtaccattccctg

SEQ ID NO: 39637 - DNA, 25 bp, Rattus norvegicus
aagcatggttacaaagcctcctctg

SEQ ID NO: 39638 - DNA, 25 bp, Rattus norvegicus
aagcatggttactaagcctcctctg

SEQ ID NO: 39639 - DNA, 25 bp, Rattus norvegicus
aagcatgtacaccataccctgttta

SEQ ID NO: 39640 - DNA, 25 bp, Rattus norvegicus
aagcatgtacacgataccctgttta

SEQ ID NO: 39641 - DNA, 25 bp, Rattus norvegicus
aagcatgtatgcaccttgtttttaa

SEQ ID NO: 39642 - DNA, 25 bp, Rattus norvegicus
aagcatgtatgctccttgtttttaa

SEQ ID NO: 39643 - DNA, 25 bp, Rattus norvegicus
aagcatgtcaaacactctgaatcag

SEQ ID NO: 39644 - DNA, 25 bp, Rattus norvegicus
aagcatgtcaaagactctgaatcag

SEQ ID NO: 39645 - DNA, 25 bp, Rattus norvegicus
aagcatgtccttatttatagccctg

SEQ ID NO: 39646 - DNA, 25 bp, Rattus norvegicus
aagcatgtccttttttatagccctg

SEQ ID NO: 39647 - DNA, 25 bp, Rattus norvegicus
aagcatgtgcaaactgtccacagcc

SEQ ID NO: 39648 - DNA, 25 bp, Rattus norvegicus
aagcatgtgcaatctgtccacagcc

SEQ ID NO: 39649 - DNA, 25 bp, Rattus norvegicus
aagcatgtgcacaaccactgtacaa

SEQ ID NO: 39650 - DNA, 25 bp, Rattus norvegicus
aagcatgtgcactaccactgtacaa

SEQ ID NO: 39651 - DNA, 25 bp, Rattus norvegicus
aagcatgtgctgcaccggaggactc

SEQ ID NO: 39652 - DNA, 25 bp, Rattus norvegicus
aagcatgtgctggaccggaggactc

SEQ ID NO: 39653 - DNA, 25 bp, Rattus norvegicus
aagcatgtgggcacctgttccggca

SEQ ID NO: 39654 - DNA, 25 bp, Rattus norvegicus
aagcatgtgggctcctgttccggca

SEQ ID NO: 39655 - DNA, 25 bp, Rattus norvegicus
aagcatgttacgcaggccagagtca

SEQ ID NO: 39656 - DNA, 25 bp, Rattus norvegicus
aagcatgttacggaggccagagtca

SEQ ID NO: 39657 - DNA, 25 bp, Rattus norvegicus
aagcatgttatccagaatcagttag

SEQ ID NO: 39658 - DNA, 25 bp, Rattus norvegicus
aagcatgttatcgagaatcagttag

SEQ ID NO: 39659 - DNA, 25 bp, Rattus norvegicus
aagcatgttgagagctgccactgat

SEQ ID NO: 39660 - DNA, 25 bp, Rattus norvegicus
aagcatgttgagtgctgccactgat

SEQ ID NO: 39661 - DNA, 25 bp, Rattus norvegicus
aagcatgttgatcggttttccttac

SEQ ID NO: 39662 - DNA, 25 bp, Rattus norvegicus
aagcatgttgatgggttttccttac

SEQ ID NO: 39663 - DNA, 25 bp, Rattus norvegicus
aagcatgtttgacgtcttgtgtatc

SEQ ID NO: 39664 - DNA, 25 bp, Rattus norvegicus
aagcatgtttgaggtcttgtgtatc

SEQ ID NO: 39665 - DNA, 25 bp, Rattus norvegicus
aagcattaaattcaccttcttccca

SEQ ID NO: 39666 - DNA, 25 bp, Rattus norvegicus
aagcattaaattgaccttcttccca

SEQ ID NO: 39667 - DNA, 25 bp, Rattus norvegicus
aagcattacgggattggcctgccag

SEQ ID NO: 39668 - DNA, 25 bp, Rattus norvegicus
aagcattacgggtttggcctgccag

SEQ ID NO: 39669 - DNA, 25 bp, Rattus norvegicus
aagcattacgtaagctaagcctcaa

SEQ ID NO: 39670 - DNA, 25 bp, Rattus norvegicus
aagcattacgtatgctaagcctcaa

SEQ ID NO: 39671 - DNA, 25 bp, Rattus norvegicus
aagcattactgcagcagactgtgca

SEQ ID NO: 39672 - DNA, 25 bp, Rattus norvegicus
aagcattactgctgcagactgtgca

SEQ ID NO: 39673 - DNA, 25 bp, Rattus norvegicus
aagcattacttgaacactgtgtctg

SEQ ID NO: 39674 - DNA, 25 bp, Rattus norvegicus
aagcattacttgtacactgtgtctg

SEQ ID NO: 39675 - DNA, 25 bp, Rattus norvegicus
aagcattagcttcgagcctgcaggt

SEQ ID NO: 39676 - DNA, 25 bp, Rattus norvegicus
aagcattagcttggagcctgcaggt

SEQ ID NO: 39677 - DNA, 25 bp, Rattus norvegicus
aagcattatccacagtgcatccgac

SEQ ID NO: 39678 - DNA, 25 bp, Rattus norvegicus
aagcattatccagagtgcatccgac

SEQ ID NO: 39679 - DNA, 25 bp, Rattus norvegicus
aagcattattttcacggcagtccaa

SEQ ID NO: 39680 - DNA, 25 bp, Rattus norvegicus
aagcattattttgacggcagtccaa

SEQ ID NO: 39681 - DNA, 25 bp, Rattus norvegicus
aagcattcacaacgtcctgggctct

SEQ ID NO: 39682 - DNA, 25 bp, Rattus norvegicus
aagcattcacaaggtcctgggctct

SEQ ID NO: 39683 - DNA, 25 bp, Rattus norvegicus
aagcattcacacacatgacctacgg

SEQ ID NO: 39684 - DNA, 25 bp, Rattus norvegicus
aagcattcacactcatgacctacgg

SEQ ID NO: 39685 - DNA, 25 bp, Rattus norvegicus
aagcattcacctatttgcattttgt

SEQ ID NO: 39686 - DNA, 25 bp, Rattus norvegicus
aagcattcacctttttgcattttgt

SEQ ID NO: 39687 - DNA, 25 bp, Rattus norvegicus
aagcattcagaacaattcctgtcag

SEQ ID NO: 39688 - DNA, 25 bp, Rattus norvegicus
aagcattcagaagaattcctgtcag

SEQ ID NO: 39689 - DNA, 25 bp, Rattus norvegicus
aagcattcagagctgtcactctgct

SEQ ID NO: 39690 - DNA, 25 bp, Rattus norvegicus
aagcattcagaggtgtcactctgct

SEQ ID NO: 39691 - DNA, 25 bp, Rattus norvegicus
aagcattcagctcacttgcctcata

SEQ ID NO: 39692 - DNA, 25 bp, Rattus norvegicus
aagcattcagctgacttgcctcata

SEQ ID NO: 39693 - DNA, 25 bp, Rattus norvegicus
aagcattcagtcaatgggtctacga

SEQ ID NO: 39694 - DNA, 25 bp, Rattus norvegicus
aagcattcagtctatgggtctacga

SEQ ID NO: 39695 - DNA, 25 bp, Rattus norvegicus
aagcattcagtgagctgccaatttt

SEQ ID NO: 39696 - DNA, 25 bp, Rattus norvegicus
aagcattcagtgtgctgccaatttt

SEQ ID NO: 39697 - DNA, 25 bp, Rattus norvegicus
aagcattcatggcaccgctcaagaa

SEQ ID NO: 39698 - DNA, 25 bp, Rattus norvegicus
aagcattcatgggaccgctcaagaa

SEQ ID NO: 39699 - DNA, 25 bp, Rattus norvegicus
aagcattcctgtaaactcagtgttg

SEQ ID NO: 39700 - DNA, 25 bp, Rattus norvegicus
aagcattcctgttaactcagtgttg

SEQ ID NO: 39701 - DNA, 25 bp, Rattus norvegicus
aagcattcctttctaggctgacttc

SEQ ID NO: 39702 - DNA, 25 bp, Rattus norvegicus
aagcattcctttgtaggctgacttc

SEQ ID NO: 39703 - DNA, 25 bp, Rattus norvegicus
aagcattcgaagatcattctggtat

SEQ ID NO: 39704 - DNA, 25 bp, Rattus norvegicus
aagcattcgaagttcattctggtat

SEQ ID NO: 39705 - DNA, 25 bp, Rattus norvegicus
aagcattctaaaagagacttctccg

SEQ ID NO: 39706 - DNA, 25 bp, Rattus norvegicus
aagcattctaaatgagacttctccg

SEQ ID NO: 39707 - DNA, 25 bp, Rattus norvegicus
aagcattctaaccagccagctgaga

SEQ ID NO: 39708 - DNA, 25 bp, Rattus norvegicus
aagcattctaacgagccagctgaga

SEQ ID NO: 39709 - DNA, 25 bp, Rattus norvegicus
aagcattctctcattaacatggtta

SEQ ID NO: 39710 - DNA, 25 bp, Rattus norvegicus
aagcattctctctttaacatggtta

SEQ ID NO: 39711 - DNA, 25 bp, Rattus norvegicus
aagcattctgcacttggcttctctt

SEQ ID NO: 39712 - DNA, 25 bp, Rattus norvegicus
aagcattctgcagttggcttctctt

SEQ ID NO: 39713 - DNA, 25 bp, Rattus norvegicus
aagcattctgccactatttatatat

SEQ ID NO: 39714 - DNA, 25 bp, Rattus norvegicus
aagcattctgcctctatttatatat

SEQ ID NO: 39715 - DNA, 25 bp, Rattus norvegicus
aagcattctgctcagggcaactgga

SEQ ID NO: 39716 - DNA, 25 bp, Rattus norvegicus
aagcattctgctgagggcaactgga

SEQ ID NO: 39717 - DNA, 25 bp, Rattus norvegicus
aagcattctggactagctgaagtta

SEQ ID NO: 39718 - DNA, 25 bp, Rattus norvegicus
aagcattctggagtagctgaagtta

SEQ ID NO: 39719 - DNA, 25 bp, Rattus norvegicus
aagcattcttggaagtggccagtaa

SEQ ID NO: 39720 - DNA, 25 bp, Rattus norvegicus
aagcattcttggtagtggccagtaa

SEQ ID NO: 39721 - DNA, 25 bp, Rattus norvegicus
aagcattcttttatgtcaacaccat

SEQ ID NO: 39722 - DNA, 25 bp, Rattus norvegicus
aagcattcttttccagagcctcaac

SEQ ID NO: 39723 - DNA, 25 bp, Rattus norvegicus
aagcattcttttcggccctcctggc

SEQ ID NO: 39724 - DNA, 25 bp, Rattus norvegicus
aagcattcttttgcagagcctcaac

SEQ ID NO: 39725 - DNA, 25 bp, Rattus norvegicus
aagcattcttttgggccctcctggc

SEQ ID NO: 39726 - DNA, 25 bp, Rattus norvegicus
aagcattcttttttgtcaacaccat

SEQ ID NO: 39727 - DNA, 25 bp, Rattus norvegicus
aagcattgagtgagctgctggccta

SEQ ID NO: 39728 - DNA, 25 bp, Rattus norvegicus
aagcattgagtgtgctgctggccta

SEQ ID NO: 39729 - DNA, 25 bp, Rattus norvegicus
aagcattgcagtatccaggcaggca

SEQ ID NO: 39730 - DNA, 25 bp, Rattus norvegicus
aagcattgcagtttccaggcaggca

SEQ ID NO: 39731 - DNA, 25 bp, Rattus norvegicus
aagcattgcattatctgaggctgaa

SEQ ID NO: 39732 - DNA, 25 bp, Rattus norvegicus
aagcattgcattttctgaggctgaa

SEQ ID NO: 39733 - DNA, 25 bp, Rattus norvegicus
aagcattgcctgacttgtttgagat

SEQ ID NO: 39734 - DNA, 25 bp, Rattus norvegicus
aagcattgcctgtcttgtttgagat

SEQ ID NO: 39735 - DNA, 25 bp, Rattus norvegicus
aagcattgccttcgaaccgggtgca

SEQ ID NO: 39736 - DNA, 25 bp, Rattus norvegicus
aagcattgccttggaaccgggtgca

SEQ ID NO: 39737 - DNA, 25 bp, Rattus norvegicus
aagcattggagtagtctctccccac

SEQ ID NO: 39738 - DNA, 25 bp, Rattus norvegicus
aagcattggagttgtctctccccac

SEQ ID NO: 39739 - DNA, 25 bp, Rattus norvegicus
aagcattggattacttggcctttat

SEQ ID NO: 39740 - DNA, 25 bp, Rattus norvegicus
aagcattggatttcttggcctttat

SEQ ID NO: 39741 - DNA, 25 bp, Rattus norvegicus
aagcattgtgcaagccctgtgctaa

SEQ ID NO: 39742 - DNA, 25 bp, Rattus norvegicus
aagcattgtgcatgccctgtgctaa

SEQ ID NO: 39743 - DNA, 25 bp, Rattus norvegicus
aagcattgtgctcatgcaagaattc

SEQ ID NO: 39744 - DNA, 25 bp, Rattus norvegicus
aagcattgtgctgatgcaagaattc

SEQ ID NO: 39745 - DNA, 25 bp, Rattus norvegicus
aagcattgttagatctcccggaaga

SEQ ID NO: 39746 - DNA, 25 bp, Rattus norvegicus
aagcattgttagttctcccggaaga

SEQ ID NO: 39747 - DNA, 25 bp, Rattus norvegicus
aagcattgttgtctaccttgttcct

SEQ ID NO: 39748 - DNA, 25 bp, Rattus norvegicus
aagcattgttgtgtaccttgttcct

SEQ ID NO: 39749 - DNA, 25 bp, Rattus norvegicus
aagcatttaaatccccaacagcctt

SEQ ID NO: 39750 - DNA, 25 bp, Rattus norvegicus
aagcatttaaatgcccaacagcctt

SEQ ID NO: 39751 - DNA, 25 bp, Rattus norvegicus
aagcatttaacaatctggagcctcc

SEQ ID NO: 39752 - DNA, 25 bp, Rattus norvegicus
aagcatttaacattctggagcctcc

SEQ ID NO: 39753 - DNA, 25 bp, Rattus norvegicus
aagcatttagatcgcctctttccaa

SEQ ID NO: 39754 - DNA, 25 bp, Rattus norvegicus
aagcatttagatggcctctttccaa

SEQ ID NO: 39755 - DNA, 25 bp, Rattus norvegicus
aagcatttatcaatctccttgctgt

SEQ ID NO: 39756 - DNA, 25 bp, Rattus norvegicus
aagcatttatcattctccttgctgt

SEQ ID NO: 39757 - DNA, 25 bp, Rattus norvegicus
aagcatttcaatacacttgagtgag

SEQ ID NO: 39758 - DNA, 25 bp, Rattus norvegicus
aagcatttcaattcacttgagtgag

SEQ ID NO: 39759 - DNA, 25 bp, Rattus norvegicus
aagcatttccaccactgtctacttt

SEQ ID NO: 39760 - DNA, 25 bp, Rattus norvegicus
aagcatttccacgactgtctacttt

SEQ ID NO: 39761 - DNA, 25 bp, Rattus norvegicus
aagcatttcctgcagtttgaacgtg

SEQ ID NO: 39762 - DNA, 25 bp, Rattus norvegicus
aagcatttcctggagtttgaacgtg

SEQ ID NO: 39763 - DNA, 25 bp, Rattus norvegicus
aagcatttcgggatcgctgcaatca

SEQ ID NO: 39764 - DNA, 25 bp, Rattus norvegicus
aagcatttcgggttcgctgcaatca

SEQ ID NO: 39765 - DNA, 25 bp, Rattus norvegicus
aagcatttctatatgacgtggtcag

SEQ ID NO: 39766 - DNA, 25 bp, Rattus norvegicus
aagcatttctatttgacgtggtcag

SEQ ID NO: 39767 - DNA, 25 bp, Rattus norvegicus
aagcatttgaccatcgctacaagtt

SEQ ID NO: 39768 - DNA, 25 bp, Rattus norvegicus
aagcatttgaccttcgctacaagtt

SEQ ID NO: 39769 - DNA, 25 bp, Rattus norvegicus
aagcatttgacgatggtgcctgtct

SEQ ID NO: 39770 - DNA, 25 bp, Rattus norvegicus
aagcatttgacgttggtgcctgtct

SEQ ID NO: 39771 - DNA, 25 bp, Rattus norvegicus
aagcatttgctacacacccaatatc

SEQ ID NO: 39772 - DNA, 25 bp, Rattus norvegicus
aagcatttgctagacacccaatatc

SEQ ID NO: 39773 - DNA, 25 bp, Rattus norvegicus
aagcatttgcttcggtctgttactg

SEQ ID NO: 39774 - DNA, 25 bp, Rattus norvegicus
aagcatttgcttctttatcatgagt

SEQ ID NO: 39775 - DNA, 25 bp, Rattus norvegicus
aagcatttgcttgggtctgttactg

SEQ ID NO: 39776 - DNA, 25 bp, Rattus norvegicus
aagcatttgcttgtttatcatgagt

SEQ ID NO: 39777 - DNA, 25 bp, Rattus norvegicus
aagcatttggaacctgcagctctca

SEQ ID NO: 39778 - DNA, 25 bp, Rattus norvegicus
aagcatttggaagctgcagctctca

SEQ ID NO: 39779 - DNA, 25 bp, Rattus norvegicus
aagcatttggtgacttcccaaggga

SEQ ID NO: 39780 - DNA, 25 bp, Rattus norvegicus
aagcatttggtgtcttcccaaggga

SEQ ID NO: 39781 - DNA, 25 bp, Rattus norvegicus
aagcatttgtctagtcgtccactgg

SEQ ID NO: 39782 - DNA, 25 bp, Rattus norvegicus
aagcatttgtcttgtcgtccactgg

SEQ ID NO: 39783 - DNA, 25 bp, Rattus norvegicus
aagcatttgttaatctttactgtaa

SEQ ID NO: 39784 - DNA, 25 bp, Rattus norvegicus
aagcatttgttattctttactgtaa

SEQ ID NO: 39785 - DNA, 25 bp, Rattus norvegicus
aagcatttgtttcggttgcgaattc

SEQ ID NO: 39786 - DNA, 25 bp, Rattus norvegicus
aagcatttgtttgggttgcgaattc

SEQ ID NO: 39787 - DNA, 25 bp, Rattus norvegicus
aagcattttaacacagggcgaagcc

SEQ ID NO: 39788 - DNA, 25 bp, Rattus norvegicus
aagcattttaactcagggcgaagcc

SEQ ID NO: 39789 - DNA, 25 bp, Rattus norvegicus
aagcattttacgagcctggtaccac

SEQ ID NO: 39790 - DNA, 25 bp, Rattus norvegicus
aagcattttacgtgcctggtaccac

SEQ ID NO: 39791 - DNA, 25 bp, Rattus norvegicus
aagcattttccaatctgtttgcagg

SEQ ID NO: 39792 - DNA, 25 bp, Rattus norvegicus
aagcattttccaccaaagccaggca

SEQ ID NO: 39793 - DNA, 25 bp, Rattus norvegicus
aagcattttccagcaaagccaggca

SEQ ID NO: 39794 - DNA, 25 bp, Rattus norvegicus
aagcattttccattctgtttgcagg

SEQ ID NO: 39795 - DNA, 25 bp, Rattus norvegicus
aagcattttcttattgtgggcagat

SEQ ID NO: 39796 - DNA, 25 bp, Rattus norvegicus
aagcattttctttttgtgggcagat

SEQ ID NO: 39797 - DNA, 25 bp, Rattus norvegicus
aagccaaaacccaggtcagagccta

SEQ ID NO: 39798 - DNA, 25 bp, Rattus norvegicus
aagccaaaaccctggtcagagccta

SEQ ID NO: 39799 - DNA, 25 bp, Rattus norvegicus
aagccaaaactgcttcttcaacctc

SEQ ID NO: 39800 - DNA, 25 bp, Rattus norvegicus
aagccaaaactggttcttcaacctc

SEQ ID NO: 39801 - DNA, 25 bp, Rattus norvegicus
aagccaaaagacaccccagagaaga

SEQ ID NO: 39802 - DNA, 25 bp, Rattus norvegicus
aagccaaaagactccccagagaaga

SEQ ID NO: 39803 - DNA, 25 bp, Rattus norvegicus
aagccaaacagaagcaggtcctaag

SEQ ID NO: 39804 - DNA, 25 bp, Rattus norvegicus
aagccaaacagatgcaggtcctaag

SEQ ID NO: 39805 - DNA, 25 bp, Rattus norvegicus
aagccaaacgatcttcctaaccaat

SEQ ID NO: 39806 - DNA, 25 bp, Rattus norvegicus
aagccaaacgatgttcctaaccaat

SEQ ID NO: 39807 - DNA, 25 bp, Rattus norvegicus
aagccaaagagaagcctgcctctaa

SEQ ID NO: 39808 - DNA, 25 bp, Rattus norvegicus
aagccaaagagactgcagacgccat

SEQ ID NO: 39809 - DNA, 25 bp, Rattus norvegicus
aagccaaagagagtgcagacgccat

SEQ ID NO: 39810 - DNA, 25 bp, Rattus norvegicus
aagccaaagagatgcctgcctctaa

SEQ ID NO: 39811 - DNA, 25 bp, Rattus norvegicus
aagccaaagaggagctccccaacct

SEQ ID NO: 39812 - DNA, 25 bp, Rattus norvegicus
aagccaaagaggtgctccccaacct

SEQ ID NO: 39813 - DNA, 25 bp, Rattus norvegicus
aagccaaagcaactcatgcattaag

SEQ ID NO: 39814 - DNA, 25 bp, Rattus norvegicus
aagccaaagcaagtcatgcattaag

SEQ ID NO: 39815 - DNA, 25 bp, Rattus norvegicus
aagccaaagcctcacgagctgtgga

SEQ ID NO: 39816 - DNA, 25 bp, Rattus norvegicus
aagccaaagcctgacgagctgtgga

SEQ ID NO: 39817 - DNA, 25 bp, Rattus norvegicus
aagccaaaggctctacaagaattag

SEQ ID NO: 39818 - DNA, 25 bp, Rattus norvegicus
aagccaaaggctgtacaagaattag

SEQ ID NO: 39819 - DNA, 25 bp, Rattus norvegicus
aagccaaatcccatatgtatctgaa

SEQ ID NO: 39820 - DNA, 25 bp, Rattus norvegicus
aagccaaatcccttatgtatctgaa

SEQ ID NO: 39821 - DNA, 25 bp, Rattus norvegicus
aagccaaatggaaggaacttgccta

SEQ ID NO: 39822 - DNA, 25 bp, Rattus norvegicus
aagccaaatggatggaacttgccta

SEQ ID NO: 39823 - DNA, 25 bp, Rattus norvegicus
aagccaaattctactatcctctttc

SEQ ID NO: 39824 - DNA, 25 bp, Rattus norvegicus
aagccaaattcttctatcctctttc

SEQ ID NO: 39825 - DNA, 25 bp, Rattus norvegicus
aagccaacaacaaagtgctctggaa

SEQ ID NO: 39826 - DNA, 25 bp, Rattus norvegicus
aagccaacaacatagtgctctggaa

SEQ ID NO: 39827 - DNA, 25 bp, Rattus norvegicus
aagccaacaattctgcactagggta

SEQ ID NO: 39828 - DNA, 25 bp, Rattus norvegicus
aagccaacaattgtgcactagggta

SEQ ID NO: 39829 - DNA, 25 bp, Rattus norvegicus
aagccaacacttagtcatttttaat

SEQ ID NO: 39830 - DNA, 25 bp, Rattus norvegicus
aagccaacactttgtcatttttaat

SEQ ID NO: 39831 - DNA, 25 bp, Rattus norvegicus
aagccaacaggacagctcttggtca

SEQ ID NO: 39832 - DNA, 25 bp, Rattus norvegicus
aagccaacaggagagctcttggtca

SEQ ID NO: 39833 - DNA, 25 bp, Rattus norvegicus
aagccaaccaatcacctcggagagt

SEQ ID NO: 39834 - DNA, 25 bp, Rattus norvegicus
aagccaaccaatgacctcggagagt

SEQ ID NO: 39835 - DNA, 25 bp, Rattus norvegicus
aagccaacccttacaccagaatagt

SEQ ID NO: 39836 - DNA, 25 bp, Rattus norvegicus
aagccaaccctttcaccagaatagt

SEQ ID NO: 39837 - DNA, 25 bp, Rattus norvegicus
aagccaaccgcacctgttttatatt

SEQ ID NO: 39838 - DNA, 25 bp, Rattus norvegicus
aagccaaccgcagctgttttatatt

SEQ ID NO: 39839 - DNA, 25 bp, Rattus norvegicus
aagccaacctcaagcaaagcaggga

SEQ ID NO: 39840 - DNA, 25 bp, Rattus norvegicus
aagccaacctcatgcaaagcaggga

SEQ ID NO: 39841 - DNA, 25 bp, Rattus norvegicus
aagccaacctgtactatcttgttct

SEQ ID NO: 39842 - DNA, 25 bp, Rattus norvegicus
aagccaacctgttctatcttgttct

SEQ ID NO: 39843 - DNA, 25 bp, Rattus norvegicus
aagccaaccttgatcagtcttccag

SEQ ID NO: 39844 - DNA, 25 bp, Rattus norvegicus
aagccaaccttgttcagtcttccag

SEQ ID NO: 39845 - DNA, 25 bp, Rattus norvegicus
aagccaacgagcctgcggaatctgt

SEQ ID NO: 39846 - DNA, 25 bp, Rattus norvegicus
aagccaacgagcgtgcggaatctgt

SEQ ID NO: 39847 - DNA, 25 bp, Rattus norvegicus
aagccaacgtctactttttgatctc

SEQ ID NO: 39848 - DNA, 25 bp, Rattus norvegicus
aagccaacgtcttctttttgatctc

SEQ ID NO: 39849 - DNA, 25 bp, Rattus norvegicus
aagccaacttagacgtttgtctatg

SEQ ID NO: 39850 - DNA, 25 bp, Rattus norvegicus
aagccaacttagtcgtttgtctatg

SEQ ID NO: 39851 - DNA, 25 bp, Rattus norvegicus
aagccaagaaagctgctcaggagca

SEQ ID NO: 39852 - DNA, 25 bp, Rattus norvegicus
aagccaagaaaggtgctcaggagca

SEQ ID NO: 39853 - DNA, 25 bp, Rattus norvegicus
aagccaagaagtatccctagccgag

SEQ ID NO: 39854 - DNA, 25 bp, Rattus norvegicus
aagccaagaagtttccctagccgag

SEQ ID NO: 39855 - DNA, 25 bp, Rattus norvegicus
aagccaagaattacgctctcttcat

SEQ ID NO: 39856 - DNA, 25 bp, Rattus norvegicus
aagccaagaatttcgctctcttcat

SEQ ID NO: 39857 - DNA, 25 bp, Rattus norvegicus
aagccaagacacaggaaactttcag

SEQ ID NO: 39858 - DNA, 25 bp, Rattus norvegicus
aagccaagacactggaaactttcag

SEQ ID NO: 39859 - DNA, 25 bp, Rattus norvegicus
aagccaagaccgcagctggtgtcct

SEQ ID NO: 39860 - DNA, 25 bp, Rattus norvegicus
aagccaagaccggagctggtgtcct

SEQ ID NO: 39861 - DNA, 25 bp, Rattus norvegicus
aagccaagactgacattactcattg

SEQ ID NO: 39862 - DNA, 25 bp, Rattus norvegicus
aagccaagactgtcattactcattg

SEQ ID NO: 39863 - DNA, 25 bp, Rattus norvegicus
aagccaagagaacagccagtgctca

SEQ ID NO: 39864 - DNA, 25 bp, Rattus norvegicus
aagccaagagaagagccagtgctca

SEQ ID NO: 39865 - DNA, 25 bp, Rattus norvegicus
aagccaagaggtccccacagagtat

SEQ ID NO: 39866 - DNA, 25 bp, Rattus norvegicus
aagccaagaggtgcccacagagtat

SEQ ID NO: 39867 - DNA, 25 bp, Rattus norvegicus
aagccaagcttgagttctgcaaaac

SEQ ID NO: 39868 - DNA, 25 bp, Rattus norvegicus
aagccaagcttgtgttctgcaaaac

SEQ ID NO: 39869 - DNA, 25 bp, Rattus norvegicus
aagccaaggagaccattcaggccct

SEQ ID NO: 39870 - DNA, 25 bp, Rattus norvegicus
aagccaaggagaccattcgagcaaa

SEQ ID NO: 39871 - DNA, 25 bp, Rattus norvegicus
aagccaaggagagcattcaggccct

SEQ ID NO: 39872 - DNA, 25 bp, Rattus norvegicus
aagccaaggagagcattcgagcaaa

SEQ ID NO: 39873 - DNA, 25 bp, Rattus norvegicus
aagccaaggattcccatccaaggat

SEQ ID NO: 39874 - DNA, 25 bp, Rattus norvegicus
aagccaaggattgccatccaaggat

SEQ ID NO: 39875 - DNA, 25 bp, Rattus norvegicus
aagccaaggctcagagggaccaagt

SEQ ID NO: 39876 - DNA, 25 bp, Rattus norvegicus
aagccaaggctctgagggaccaagt

SEQ ID NO: 39877 - DNA, 25 bp, Rattus norvegicus
aagccaagtataaccagctcctgac

SEQ ID NO: 39878 - DNA, 25 bp, Rattus norvegicus
aagccaagtatatccagctcctgac

SEQ ID NO: 39879 - DNA, 25 bp, Rattus norvegicus
aagccaagtcttcttttctctgcct

SEQ ID NO: 39880 - DNA, 25 bp, Rattus norvegicus
aagccaagtcttgttttctctgcct

SEQ ID NO: 39881 - DNA, 25 bp, Rattus norvegicus
aagccaatacccaaaaatccacact

SEQ ID NO: 39882 - DNA, 25 bp, Rattus norvegicus
aagccaataccctaaaatccacact

SEQ ID NO: 39883 - DNA, 25 bp, Rattus norvegicus
aagccaataggcaacattctgctca

SEQ ID NO: 39884 - DNA, 25 bp, Rattus norvegicus
aagccaataggctacattctgctca

SEQ ID NO: 39885 - DNA, 25 bp, Rattus norvegicus
aagccaatgctgcacttgacgccat

SEQ ID NO: 39886 - DNA, 25 bp, Rattus norvegicus
aagccaatgctggacttgacgccat

SEQ ID NO: 39887 - DNA, 25 bp, Rattus norvegicus
aagccaatgtggagcctgctctggt

SEQ ID NO: 39888 - DNA, 25 bp, Rattus norvegicus
aagccaatgtggtgcctgctctggt

SEQ ID NO: 39889 - DNA, 25 bp, Rattus norvegicus
aagccaatgttcatctcaccaagtt

SEQ ID NO: 39890 - DNA, 25 bp, Rattus norvegicus
aagccaatgttcttctcaccaagtt

SEQ ID NO: 39891 - DNA, 25 bp, Rattus norvegicus
aagccaatttcaatttgttcaattc

SEQ ID NO: 39892 - DNA, 25 bp, Rattus norvegicus
aagccaatttcattttgttcaattc

SEQ ID NO: 39893 - DNA, 25 bp, Rattus norvegicus
aagccacaagatccctttctttagg

SEQ ID NO: 39894 - DNA, 25 bp, Rattus norvegicus
aagccacaagatgcctttctttagg

SEQ ID NO: 39895 - DNA, 25 bp, Rattus norvegicus
aagccacaatgcacagctgctggga

SEQ ID NO: 39896 - DNA, 25 bp, Rattus norvegicus
aagccacaatgcactagaatccttg

SEQ ID NO: 39897 - DNA, 25 bp, Rattus norvegicus
aagccacaatgctcagctgctggga

SEQ ID NO: 39898 - DNA, 25 bp, Rattus norvegicus
aagccacaatgctctagaatccttg

SEQ ID NO: 39899 - DNA, 25 bp, Rattus norvegicus
aagccacacagactttttccttctt

SEQ ID NO: 39900 - DNA, 25 bp, Rattus norvegicus
aagccacacagagtttttccttctt

SEQ ID NO: 39901 - DNA, 25 bp, Rattus norvegicus
aagccacacaggaaggtccttcatg

SEQ ID NO: 39902 - DNA, 25 bp, Rattus norvegicus
aagccacacaggtaggtccttcatg

SEQ ID NO: 39903 - DNA, 25 bp, Rattus norvegicus
aagccacacctgagttacacggcaa

SEQ ID NO: 39904 - DNA, 25 bp, Rattus norvegicus
aagccacacctgtgttacacggcaa

SEQ ID NO: 39905 - DNA, 25 bp, Rattus norvegicus
aagccacactacatgtgtttgcctt

SEQ ID NO: 39906 - DNA, 25 bp, Rattus norvegicus
aagccacactacttgtgtttgcctt

SEQ ID NO: 39907 - DNA, 25 bp, Rattus norvegicus
aagccacagaccattgtagttgtca

SEQ ID NO: 39908 - DNA, 25 bp, Rattus norvegicus
aagccacagacctttgtagttgtca

SEQ ID NO: 39909 - DNA, 25 bp, Rattus norvegicus
aagccacagagcaatttcttaagta

SEQ ID NO: 39910 - DNA, 25 bp, Rattus norvegicus
aagccacagagctatttcttaagta

SEQ ID NO: 39911 - DNA, 25 bp, Rattus norvegicus
aagccacagcacaggaagactcaga

SEQ ID NO: 39912 - DNA, 25 bp, Rattus norvegicus
aagccacagcactggaagactcaga

SEQ ID NO: 39913 - DNA, 25 bp, Rattus norvegicus
aagccacagcataagctaggttcta

SEQ ID NO: 39914 - DNA, 25 bp, Rattus norvegicus
aagccacagcattagctaggttcta

SEQ ID NO: 39915 - DNA, 25 bp, Rattus norvegicus
aagccacagccaaagccaaactagg

SEQ ID NO: 39916 - DNA, 25 bp, Rattus norvegicus
aagccacagccatagccaaactagg

SEQ ID NO: 39917 - DNA, 25 bp, Rattus norvegicus
aagccacaggtgacactctgagtga

SEQ ID NO: 39918 - DNA, 25 bp, Rattus norvegicus
aagccacaggtgtcactctgagtga

SEQ ID NO: 39919 - DNA, 25 bp, Rattus norvegicus
aagccacagtacctctgtctataca

SEQ ID NO: 39920 - DNA, 25 bp, Rattus norvegicus
aagccacagtacgtctgtctataca

SEQ ID NO: 39921 - DNA, 25 bp, Rattus norvegicus
aagccacagtccacagtacatcagt

SEQ ID NO: 39922 - DNA, 25 bp, Rattus norvegicus
aagccacagtcctcagtacatcagt

SEQ ID NO: 39923 - DNA, 25 bp, Rattus norvegicus
aagccacagttgctgacatgctgca

SEQ ID NO: 39924 - DNA, 25 bp, Rattus norvegicus
aagccacagttggtgacatgctgca

SEQ ID NO: 39925 - DNA, 25 bp, Rattus norvegicus
aagccacatcacacattagctctgt

SEQ ID NO: 39926 - DNA, 25 bp, Rattus norvegicus
aagccacatcactcattagctctgt

SEQ ID NO: 39927 - DNA, 25 bp, Rattus norvegicus
aagccaccacatcgttttgtgtgct

SEQ ID NO: 39928 - DNA, 25 bp, Rattus norvegicus
aagccaccacatggttttgtgtgct

SEQ ID NO: 39929 - DNA, 25 bp, Rattus norvegicus
aagccaccactgacatttattgttg

SEQ ID NO: 39930 - DNA, 25 bp, Rattus norvegicus
aagccaccactgtcatttattgttg

SEQ ID NO: 39931 - DNA, 25 bp, Rattus norvegicus
aagccaccattgaatctgtagagga

SEQ ID NO: 39932 - DNA, 25 bp, Rattus norvegicus
aagccaccattgtatctgtagagga

SEQ ID NO: 39933 - DNA, 25 bp, Rattus norvegicus
aagccacccaaccagtatgtgactt

SEQ ID NO: 39934 - DNA, 25 bp, Rattus norvegicus
aagccacccaacgagtatgtgactt

SEQ ID NO: 39935 - DNA, 25 bp, Rattus norvegicus
aagccacccagcaatggcagggctg

SEQ ID NO: 39936 - DNA, 25 bp, Rattus norvegicus
aagccacccagctatggcagggctg

SEQ ID NO: 39937 - DNA, 25 bp, Rattus norvegicus
aagccaccccagcagaagggttgga

SEQ ID NO: 39938 - DNA, 25 bp, Rattus norvegicus
aagccaccccaggagaagggttgga

SEQ ID NO: 39939 - DNA, 25 bp, Rattus norvegicus
aagccaccgaggagtttctggcaga

SEQ ID NO: 39940 - DNA, 25 bp, Rattus norvegicus
aagccaccgaggtgtttctggcaga

SEQ ID NO: 39941 - DNA, 25 bp, Rattus norvegicus
aagccaccgctcagggtcaagcatt

SEQ ID NO: 39942 - DNA, 25 bp, Rattus norvegicus
aagccaccgctctgggtcaagcatt

SEQ ID NO: 39943 - DNA, 25 bp, Rattus norvegicus
aagccaccggtgacactgtgtctca

SEQ ID NO: 39944 - DNA, 25 bp, Rattus norvegicus
aagccaccggtgtcactgtgtctca

SEQ ID NO: 39945 - DNA, 25 bp, Rattus norvegicus
aagccacctcatatacaatctctgg

SEQ ID NO: 39946 - DNA, 25 bp, Rattus norvegicus
aagccacctcatttacaatctctgg

SEQ ID NO: 39947 - DNA, 25 bp, Rattus norvegicus
aagccacctcgaagacctgcctggt

SEQ ID NO: 39948 - DNA, 25 bp, Rattus norvegicus
aagccacctcgatgacctgcctggt

SEQ ID NO: 39949 - DNA, 25 bp, Rattus norvegicus
aagccacctgatcacattaatgaat

SEQ ID NO: 39950 - DNA, 25 bp, Rattus norvegicus
aagccacctgatgacattaatgaat

SEQ ID NO: 39951 - DNA, 25 bp, Rattus norvegicus
aagccacctggactggaaatctcag

SEQ ID NO: 39952 - DNA, 25 bp, Rattus norvegicus
aagccacctggagtggaaatctcag

SEQ ID NO: 39953 - DNA, 25 bp, Rattus norvegicus
aagccaccttaacactagcctgatg

SEQ ID NO: 39954 - DNA, 25 bp, Rattus norvegicus
aagccaccttaagactagcctgatg

SEQ ID NO: 39955 - DNA, 25 bp, Rattus norvegicus
aagccaccttccaaggagaactgat

SEQ ID NO: 39956 - DNA, 25 bp, Rattus norvegicus
aagccaccttccactcaaagctgga

SEQ ID NO: 39957 - DNA, 25 bp, Rattus norvegicus
aagccaccttcctaggagaactgat

SEQ ID NO: 39958 - DNA, 25 bp, Rattus norvegicus
aagccaccttcctctcaaagctgga

SEQ ID NO: 39959 - DNA, 25 bp, Rattus norvegicus
aagccacgagctccagctgcctatg

SEQ ID NO: 39960 - DNA, 25 bp, Rattus norvegicus
aagccacgagctgcagctgcctatg

SEQ ID NO: 39961 - DNA, 25 bp, Rattus norvegicus
aagccacgcaggagctgaccgctcg

SEQ ID NO: 39962 - DNA, 25 bp, Rattus norvegicus
aagccacgcaggtgctgaccgctcg

SEQ ID NO: 39963 - DNA, 25 bp, Rattus norvegicus
aagccacgccccaacaggaagttgc

SEQ ID NO: 39964 - DNA, 25 bp, Rattus norvegicus
aagccacgccccctggtagaatact

SEQ ID NO: 39965 - DNA, 25 bp, Rattus norvegicus
aagccacgccccgtggtagaatact

SEQ ID NO: 39966 - DNA, 25 bp, Rattus norvegicus
aagccacgcccctacaggaagttgc

SEQ ID NO: 39967 - DNA, 25 bp, Rattus norvegicus
aagccacgcctcaggaaatgcgtcg

SEQ ID NO: 39968 - DNA, 25 bp, Rattus norvegicus
aagccacgcctctggaaatgcgtcg

SEQ ID NO: 39969 - DNA, 25 bp, Rattus norvegicus
aagccacggccaagcgcatctaaat

SEQ ID NO: 39970 - DNA, 25 bp, Rattus norvegicus
aagccacggccatgcgcatctaaat

SEQ ID NO: 39971 - DNA, 25 bp, Rattus norvegicus
aagccacgggttagaggactacatg

SEQ ID NO: 39972 - DNA, 25 bp, Rattus norvegicus
aagccacgggtttgaggactacatg

SEQ ID NO: 39973 - DNA, 25 bp, Rattus norvegicus
aagccacggtcgaacacaacaccat

SEQ ID NO: 39974 - DNA, 25 bp, Rattus norvegicus
aagccacggtcgtacacaacaccat

SEQ ID NO: 39975 - DNA, 25 bp, Rattus norvegicus
aagccacggtgaacagtgccttcat

SEQ ID NO: 39976 - DNA, 25 bp, Rattus norvegicus
aagccacggtgatcagtgccttcat

SEQ ID NO: 39977 - DNA, 25 bp, Rattus norvegicus
aagccacgtctgctgtgatgtgcta

SEQ ID NO: 39978 - DNA, 25 bp, Rattus norvegicus
aagccacgtctggtgtgatgtgcta

SEQ ID NO: 39979 - DNA, 25 bp, Rattus norvegicus
aagccactatctagttttggacatg

SEQ ID NO: 39980 - DNA, 25 bp, Rattus norvegicus
aagccactatcttgttttggacatg

SEQ ID NO: 39981 - DNA, 25 bp, Rattus norvegicus
aagccactcattaatcttgattttg

SEQ ID NO: 39982 - DNA, 25 bp, Rattus norvegicus
aagccactcatttatcttgattttg

SEQ ID NO: 39983 - DNA, 25 bp, Rattus norvegicus
aagccactccctcgttgaaggttca

SEQ ID NO: 39984 - DNA, 25 bp, Rattus norvegicus
aagccactccctggttgaaggttca

SEQ ID NO: 39985 - DNA, 25 bp, Rattus norvegicus
aagccactgaccactgtccaaagag

SEQ ID NO: 39986 - DNA, 25 bp, Rattus norvegicus
aagccactgacctctgtccaaagag

SEQ ID NO: 39987 - DNA, 25 bp, Rattus norvegicus
aagccactgaggaaggtttgccaaa

SEQ ID NO: 39988 - DNA, 25 bp, Rattus norvegicus
aagccactgaggtaggtttgccaaa

SEQ ID NO: 39989 - DNA, 25 bp, Rattus norvegicus
aagccactgcacaatcccagctgag

SEQ ID NO: 39990 - DNA, 25 bp, Rattus norvegicus
aagccactgcactatcccagctgag

SEQ ID NO: 39991 - DNA, 25 bp, Rattus norvegicus
aagccactgcttatacacttgaaaa

SEQ ID NO: 39992 - DNA, 25 bp, Rattus norvegicus
aagccactgcttcaaaagaaaacca

SEQ ID NO: 39993 - DNA, 25 bp, Rattus norvegicus
aagccactgcttgaaaagaaaacca

SEQ ID NO: 39994 - DNA, 25 bp, Rattus norvegicus
aagccactgcttttacacttgaaaa

SEQ ID NO: 39995 - DNA, 25 bp, Rattus norvegicus
aagccactgggtcttgatggagcat

SEQ ID NO: 39996 - DNA, 25 bp, Rattus norvegicus
aagccactgggtgttgatggagcat

SEQ ID NO: 39997 - DNA, 25 bp, Rattus norvegicus
aagccactgtccaagtttgttttct

SEQ ID NO: 39998 - DNA, 25 bp, Rattus norvegicus
aagccactgtcctagtttgttttct

SEQ ID NO: 39999 - DNA, 25 bp, Rattus norvegicus
aagccactgtttcgagttctcttct

SEQ ID NO: 40000 - DNA, 25 bp, Rattus norvegicus
aagccactgtttggagttctcttct

SEQ ID NO: 40001 - DNA, 25 bp, Rattus norvegicus
aagccacttcctaagctgagcagaa

SEQ ID NO: 40002 - DNA, 25 bp, Rattus norvegicus
aagccacttccttagctgagcagaa

SEQ ID NO: 40003 - DNA, 25 bp, Rattus norvegicus
aagccacttgggagagatcctgcct

SEQ ID NO: 40004 - DNA, 25 bp, Rattus norvegicus
aagccacttgggtgagatcctgcct

SEQ ID NO: 40005 - DNA, 25 bp, Rattus norvegicus
aagccactttgactcattggtcgct

SEQ ID NO: 40006 - DNA, 25 bp, Rattus norvegicus
aagccactttgagtcattggtcgct

SEQ ID NO: 40007 - DNA, 25 bp, Rattus norvegicus
aagccactttgcagataagacaata

SEQ ID NO: 40008 - DNA, 25 bp, Rattus norvegicus
aagccactttgctgataagacaata

SEQ ID NO: 40009 - DNA, 25 bp, Rattus norvegicus
aagccagaaagccataggacccagg

SEQ ID NO: 40010 - DNA, 25 bp, Rattus norvegicus
aagccagaaagcgataggacccagg

SEQ ID NO: 40011 - DNA, 25 bp, Rattus norvegicus
aagccagaaatgctcacttcccgtt

SEQ ID NO: 40012 - DNA, 25 bp, Rattus norvegicus
aagccagaaatggtcacttcccgtt

SEQ ID NO: 40013 - DNA, 25 bp, Rattus norvegicus
aagccagaacacaagtctttcagaa

SEQ ID NO: 40014 - DNA, 25 bp, Rattus norvegicus
aagccagaacactagtctttcagaa

SEQ ID NO: 40015 - DNA, 25 bp, Rattus norvegicus
aagccagaaccccaaagtgacaagt

SEQ ID NO: 40016 - DNA, 25 bp, Rattus norvegicus
aagccagaacccgaaagtgacaagt

SEQ ID NO: 40017 - DNA, 25 bp, Rattus norvegicus
aagccagaagcaagcttagcccctg

SEQ ID NO: 40018 - DNA, 25 bp, Rattus norvegicus
aagccagaagcatgcttagcccctg

SEQ ID NO: 40019 - DNA, 25 bp, Rattus norvegicus
aagccagaagttaaggctcctcctt

SEQ ID NO: 40020 - DNA, 25 bp, Rattus norvegicus
aagccagaagtttaggctcctcctt

SEQ ID NO: 40021 - DNA, 25 bp, Rattus norvegicus
aagccagaatatcctgggcaccagc

SEQ ID NO: 40022 - DNA, 25 bp, Rattus norvegicus
aagccagaatatgctgggcaccagc

SEQ ID NO: 40023 - DNA, 25 bp, Rattus norvegicus
aagccagaatctaaatgccctcctt

SEQ ID NO: 40024 - DNA, 25 bp, Rattus norvegicus
aagccagaatctagccgtgaagcca

SEQ ID NO: 40025 - DNA, 25 bp, Rattus norvegicus
aagccagaatctctcttcatgagga

SEQ ID NO: 40026 - DNA, 25 bp, Rattus norvegicus
aagccagaatctgtcttcatgagga

SEQ ID NO: 40027 - DNA, 25 bp, Rattus norvegicus
aagccagaatcttaatgccctcctt

SEQ ID NO: 40028 - DNA, 25 bp, Rattus norvegicus
aagccagaatcttgccgtgaagcca

SEQ ID NO: 40029 - DNA, 25 bp, Rattus norvegicus
aagccagacatcaagcaccattttc

SEQ ID NO: 40030 - DNA, 25 bp, Rattus norvegicus
aagccagacatctagcaccattttc

SEQ ID NO: 40031 - DNA, 25 bp, Rattus norvegicus
aagccagacatgctgacgcacagtt

SEQ ID NO: 40032 - DNA, 25 bp, Rattus norvegicus
aagccagacatggtgacgcacagtt

SEQ ID NO: 40033 - DNA, 25 bp, Rattus norvegicus
aagccagaccacatgcagagactaa

SEQ ID NO: 40034 - DNA, 25 bp, Rattus norvegicus
aagccagaccacttgcagagactaa

SEQ ID NO: 40035 - DNA, 25 bp, Rattus norvegicus
aagccagaccggaatttggcccgtg

SEQ ID NO: 40036 - DNA, 25 bp, Rattus norvegicus
aagccagaccggtatttggcccgtg

SEQ ID NO: 40037 - DNA, 25 bp, Rattus norvegicus
aagccagacctacaccatttcatga

SEQ ID NO: 40038 - DNA, 25 bp, Rattus norvegicus
aagccagacctagaccatttcatga

SEQ ID NO: 40039 - DNA, 25 bp, Rattus norvegicus
aagccagacgccagaggacgtgctg

SEQ ID NO: 40040 - DNA, 25 bp, Rattus norvegicus
aagccagacgcctgaggacgtgctg

SEQ ID NO: 40041 - DNA, 25 bp, Rattus norvegicus
aagccagactcaccctttaagttat

SEQ ID NO: 40042 - DNA, 25 bp, Rattus norvegicus
aagccagactcagcctttaagttat

SEQ ID NO: 40043 - DNA, 25 bp, Rattus norvegicus
aagccagagaagcagatacccagca

SEQ ID NO: 40044 - DNA, 25 bp, Rattus norvegicus
aagccagagaaggagatacccagca

SEQ ID NO: 40045 - DNA, 25 bp, Rattus norvegicus
aagccagagagtcctcaacctcaca

SEQ ID NO: 40046 - DNA, 25 bp, Rattus norvegicus
aagccagagagtgctcaacctcaca

SEQ ID NO: 40047 - DNA, 25 bp, Rattus norvegicus
aagccagagcaacaccaagggtgcg

SEQ ID NO: 40048 - DNA, 25 bp, Rattus norvegicus
aagccagagcaagaccaagggtgcg

SEQ ID NO: 40049 - DNA, 25 bp, Rattus norvegicus
aagccagagcatataggagtgtcca

SEQ ID NO: 40050 - DNA, 25 bp, Rattus norvegicus
aagccagagcatttaggagtgtcca

SEQ ID NO: 40051 - DNA, 25 bp, Rattus norvegicus
aagccagagctcatgaaacctacag

SEQ ID NO: 40052 - DNA, 25 bp, Rattus norvegicus
aagccagagctcttgaaacctacag

SEQ ID NO: 40053 - DNA, 25 bp, Rattus norvegicus
aagccagaggaaccatccagaggtc

SEQ ID NO: 40054 - DNA, 25 bp, Rattus norvegicus
aagccagaggaagcatccagaggtc

SEQ ID NO: 40055 - DNA, 25 bp, Rattus norvegicus
aagccagagggtagccacggtccgt

SEQ ID NO: 40056 - DNA, 25 bp, Rattus norvegicus
aagccagagggttgccacggtccgt

SEQ ID NO: 40057 - DNA, 25 bp, Rattus norvegicus
aagccagagtcaatcagagcaatac

SEQ ID NO: 40058 - DNA, 25 bp, Rattus norvegicus
aagccagagtcattcagagcaatac

SEQ ID NO: 40059 - DNA, 25 bp, Rattus norvegicus
aagccagagttcctccagatcgtca

SEQ ID NO: 40060 - DNA, 25 bp, Rattus norvegicus
aagccagagttcgtccagatcgtca

SEQ ID NO: 40061 - DNA, 25 bp, Rattus norvegicus
aagccagataccacacatagttttc

SEQ ID NO: 40062 - DNA, 25 bp, Rattus norvegicus
aagccagatacctcacatagttttc

SEQ ID NO: 40063 - DNA, 25 bp, Rattus norvegicus
aagccagatctcaagccccaggtat

SEQ ID NO: 40064 - DNA, 25 bp, Rattus norvegicus
aagccagatctctagccccaggtat

SEQ ID NO: 40065 - DNA, 25 bp, Rattus norvegicus
aagccagatgtactcagggcccacc

SEQ ID NO: 40066 - DNA, 25 bp, Rattus norvegicus
aagccagatgtagtcagggcccacc

SEQ ID NO: 40067 - DNA, 25 bp, Rattus norvegicus
aagccagatttgatccagtgtgagc

SEQ ID NO: 40068 - DNA, 25 bp, Rattus norvegicus
aagccagatttgttccagtgtgagc

SEQ ID NO: 40069 - DNA, 25 bp, Rattus norvegicus
aagccagcaaccaaggagagtctct

SEQ ID NO: 40070 - DNA, 25 bp, Rattus norvegicus
aagccagcaacctaggagagtctct

SEQ ID NO: 40071 - DNA, 25 bp, Rattus norvegicus
aagccagcacatctaaaagtagcct

SEQ ID NO: 40072 - DNA, 25 bp, Rattus norvegicus
aagccagcacatgtaaaagtagcct

SEQ ID NO: 40073 - DNA, 25 bp, Rattus norvegicus
aagccagcactgactactaattatg

SEQ ID NO: 40074 - DNA, 25 bp, Rattus norvegicus
aagccagcactgtctactaattatg

SEQ ID NO: 40075 - DNA, 25 bp, Rattus norvegicus
aagccagcacttaatttccttgttc

SEQ ID NO: 40076 - DNA, 25 bp, Rattus norvegicus
aagccagcactttatttccttgttc

SEQ ID NO: 40077 - DNA, 25 bp, Rattus norvegicus
aagccagcagaaactcagctttgta

SEQ ID NO: 40078 - DNA, 25 bp, Rattus norvegicus
aagccagcagaatctcagctttgta

SEQ ID NO: 40079 - DNA, 25 bp, Rattus norvegicus
aagccagcagccctgatgggagatc

SEQ ID NO: 40080 - DNA, 25 bp, Rattus norvegicus
aagccagcagccgtgatgggagatc

SEQ ID NO: 40081 - DNA, 25 bp, Rattus norvegicus
aagccagcagctacagctcattgat

SEQ ID NO: 40082 - DNA, 25 bp, Rattus norvegicus
aagccagcagcttcagctcattgat

SEQ ID NO: 40083 - DNA, 25 bp, Rattus norvegicus
aagccagcagttctttttacagtca

SEQ ID NO: 40084 - DNA, 25 bp, Rattus norvegicus
aagccagcagttgtttttacagtca

SEQ ID NO: 40085 - DNA, 25 bp, Rattus norvegicus
aagccagcatcacgtgccaagtgct

SEQ ID NO: 40086 - DNA, 25 bp, Rattus norvegicus
aagccagcatcaggtgccaagtgct

SEQ ID NO: 40087 - DNA, 25 bp, Rattus norvegicus
aagccagccaagaggaggcctttct

SEQ ID NO: 40088 - DNA, 25 bp, Rattus norvegicus
aagccagccaagtggaggcctttct

SEQ ID NO: 40089 - DNA, 25 bp, Rattus norvegicus
aagccagccaataccaacagtcaga

SEQ ID NO: 40090 - DNA, 25 bp, Rattus norvegicus
aagccagccaattccaacagtcaga

SEQ ID NO: 40091 - DNA, 25 bp, Rattus norvegicus
aagccagccgagctgagctgagact

SEQ ID NO: 40092 - DNA, 25 bp, Rattus norvegicus
aagccagccgaggtgagctgagact

SEQ ID NO: 40093 - DNA, 25 bp, Rattus norvegicus
aagccagccgccaatgaagagtaac

SEQ ID NO: 40094 - DNA, 25 bp, Rattus norvegicus
aagccagccgcctatgaagagtaac

SEQ ID NO: 40095 - DNA, 25 bp, Rattus norvegicus
aagccagcctcaatggacgtgaaga

SEQ ID NO: 40096 - DNA, 25 bp, Rattus norvegicus
aagccagcctcattggacgtgaaga

SEQ ID NO: 40097 - DNA, 25 bp, Rattus norvegicus
aagccagcctggaacatcagagcca

SEQ ID NO: 40098 - DNA, 25 bp, Rattus norvegicus
aagccagcctggaggttttaagatc

SEQ ID NO: 40099 - DNA, 25 bp, Rattus norvegicus
aagccagcctggtacatcagagcca

SEQ ID NO: 40100 - DNA, 25 bp, Rattus norvegicus
aagccagcctggtggttttaagatc

SEQ ID NO: 40101 - DNA, 25 bp, Rattus norvegicus
aagccagcctgtaatcccagtattg

SEQ ID NO: 40102 - DNA, 25 bp, Rattus norvegicus
aagccagcctgttatcccagtattg

SEQ ID NO: 40103 - DNA, 25 bp, Rattus norvegicus
aagccagcgacgagtctagttctga

SEQ ID NO: 40104 - DNA, 25 bp, Rattus norvegicus
aagccagcgacgtgtctagttctga

SEQ ID NO: 40105 - DNA, 25 bp, Rattus norvegicus
aagccagcgaggcagatgtttctgt

SEQ ID NO: 40106 - DNA, 25 bp, Rattus norvegicus
aagccagcgagggagatgtttctgt

SEQ ID NO: 40107 - DNA, 25 bp, Rattus norvegicus
aagccagcgtttagttcagcactga

SEQ ID NO: 40108 - DNA, 25 bp, Rattus norvegicus
aagccagcgtttcttgagttcctca

SEQ ID NO: 40109 - DNA, 25 bp, Rattus norvegicus
aagccagcgtttgttgagttcctca

SEQ ID NO: 40110 - DNA, 25 bp, Rattus norvegicus
aagccagcgttttgttcagcactga

SEQ ID NO: 40111 - DNA, 25 bp, Rattus norvegicus
aagccagctcagaggccagcagagt

SEQ ID NO: 40112 - DNA, 25 bp, Rattus norvegicus
aagccagctcagtggccagcagagt

SEQ ID NO: 40113 - DNA, 25 bp, Rattus norvegicus
aagccagctcatactctgatagatc

SEQ ID NO: 40114 - DNA, 25 bp, Rattus norvegicus
aagccagctcattctctgatagatc

SEQ ID NO: 40115 - DNA, 25 bp, Rattus norvegicus
aagccagctctaattctatttaact

SEQ ID NO: 40116 - DNA, 25 bp, Rattus norvegicus
aagccagctctatttctatttaact

SEQ ID NO: 40117 - DNA, 25 bp, Rattus norvegicus
aagccagctctcagtgtaaccagca

SEQ ID NO: 40118 - DNA, 25 bp, Rattus norvegicus
aagccagctctcatctttgaagtct

SEQ ID NO: 40119 - DNA, 25 bp, Rattus norvegicus
aagccagctctctgtgtaaccagca

SEQ ID NO: 40120 - DNA, 25 bp, Rattus norvegicus
aagccagctctcttctttgaagtct

SEQ ID NO: 40121 - DNA, 25 bp, Rattus norvegicus
aagccagctctgctgctgcacagag

SEQ ID NO: 40122 - DNA, 25 bp, Rattus norvegicus
aagccagctctggtgctgcacagag

SEQ ID NO: 40123 - DNA, 25 bp, Rattus norvegicus
aagccagctgagactttaatgtgaa

SEQ ID NO: 40124 - DNA, 25 bp, Rattus norvegicus
aagccagctgagtctttaatgtgaa

SEQ ID NO: 40125 - DNA, 25 bp, Rattus norvegicus
aagccagctgcaaaatgggtccttt

SEQ ID NO: 40126 - DNA, 25 bp, Rattus norvegicus
aagccagctgcaacttgtatttcgc

SEQ ID NO: 40127 - DNA, 25 bp, Rattus norvegicus
aagccagctgcataatgggtccttt

SEQ ID NO: 40128 - DNA, 25 bp, Rattus norvegicus
aagccagctgcatcttgtatttcgc

SEQ ID NO: 40129 - DNA, 25 bp, Rattus norvegicus
aagccagctggtcggatcccatcac

SEQ ID NO: 40130 - DNA, 25 bp, Rattus norvegicus
aagccagctggtgggatcccatcac

SEQ ID NO: 40131 - DNA, 25 bp, Rattus norvegicus
aagccagctgtaccctcagtggagg

SEQ ID NO: 40132 - DNA, 25 bp, Rattus norvegicus
aagccagctgtagcctcagtggagg

SEQ ID NO: 40133 - DNA, 25 bp, Rattus norvegicus
aagccagcttccatcccctgtttag

SEQ ID NO: 40134 - DNA, 25 bp, Rattus norvegicus
aagccagcttccttcccctgtttag

SEQ ID NO: 40135 - DNA, 25 bp, Rattus norvegicus
aagccaggaaaaccgcgagtccggc

SEQ ID NO: 40136 - DNA, 25 bp, Rattus norvegicus
aagccaggaaaagcgcgagtccggc

SEQ ID NO: 40137 - DNA, 25 bp, Rattus norvegicus
aagccaggactcaatgcttccattc

SEQ ID NO: 40138 - DNA, 25 bp, Rattus norvegicus
aagccaggactctatgcttccattc

SEQ ID NO: 40139 - DNA, 25 bp, Rattus norvegicus
aagccaggaggaatgtcaccctctc

SEQ ID NO: 40140 - DNA, 25 bp, Rattus norvegicus
aagccaggaggattgtcaccctctc

SEQ ID NO: 40141 - DNA, 25 bp, Rattus norvegicus
aagccaggagtcaacacccgtgtgt

SEQ ID NO: 40142 - DNA, 25 bp, Rattus norvegicus
aagccaggagtctacacccgtgtgt

SEQ ID NO: 40143 - DNA, 25 bp, Rattus norvegicus
aagccaggagttaatggtctctgca

SEQ ID NO: 40144 - DNA, 25 bp, Rattus norvegicus
aagccaggagtttatggtctctgca

SEQ ID NO: 40145 - DNA, 25 bp, Rattus norvegicus
aagccaggcacccatctctggatgc

SEQ ID NO: 40146 - DNA, 25 bp, Rattus norvegicus
aagccaggcaccgatctctggatgc

SEQ ID NO: 40147 - DNA, 25 bp, Rattus norvegicus
aagccaggcatcatctttgtcacca

SEQ ID NO: 40148 - DNA, 25 bp, Rattus norvegicus
aagccaggcatcttctttgtcacca

SEQ ID NO: 40149 - DNA, 25 bp, Rattus norvegicus
aagccaggccaaattgtgtgacgca

SEQ ID NO: 40150 - DNA, 25 bp, Rattus norvegicus
aagccaggccaatttgtgtgacgca

SEQ ID NO: 40151 - DNA, 25 bp, Rattus norvegicus
aagccaggccacaacgactttttga

SEQ ID NO: 40152 - DNA, 25 bp, Rattus norvegicus
aagccaggccactacgactttttga

SEQ ID NO: 40153 - DNA, 25 bp, Rattus norvegicus
aagccaggcccactggcatgaacca

SEQ ID NO: 40154 - DNA, 25 bp, Rattus norvegicus
aagccaggcccagtggcatgaacca

SEQ ID NO: 40155 - DNA, 25 bp, Rattus norvegicus
aagccaggccgtagatggcttcact

SEQ ID NO: 40156 - DNA, 25 bp, Rattus norvegicus
aagccaggccgttgatggcttcact

SEQ ID NO: 40157 - DNA, 25 bp, Rattus norvegicus
aagccaggcgctaacaccgagatag

SEQ ID NO: 40158 - DNA, 25 bp, Rattus norvegicus
aagccaggcgcttacaccgagatag

SEQ ID NO: 40159 - DNA, 25 bp, Rattus norvegicus
aagccaggctcaacctccaggaaga

SEQ ID NO: 40160 - DNA, 25 bp, Rattus norvegicus
aagccaggctcacgtcagaaaccga

SEQ ID NO: 40161 - DNA, 25 bp, Rattus norvegicus
aagccaggctcaggtcagaaaccga

SEQ ID NO: 40162 - DNA, 25 bp, Rattus norvegicus
aagccaggctcatcctccaggaaga

SEQ ID NO: 40163 - DNA, 25 bp, Rattus norvegicus
aagccaggctttaatgtgacttcat

SEQ ID NO: 40164 - DNA, 25 bp, Rattus norvegicus
aagccaggctttattgggctctggt

SEQ ID NO: 40165 - DNA, 25 bp, Rattus norvegicus
aagccaggcttttatgtgacttcat

SEQ ID NO: 40166 - DNA, 25 bp, Rattus norvegicus
aagccaggcttttttgggctctggt

SEQ ID NO: 40167 - DNA, 25 bp, Rattus norvegicus
aagccagggaccatggcagctgcca

SEQ ID NO: 40168 - DNA, 25 bp, Rattus norvegicus
aagccagggaccttggcagctgcca

SEQ ID NO: 40169 - DNA, 25 bp, Rattus norvegicus
aagccagggcacctcactgatagaa

SEQ ID NO: 40170 - DNA, 25 bp, Rattus norvegicus
aagccagggcacgtcactgatagaa

SEQ ID NO: 40171 - DNA, 25 bp, Rattus norvegicus
aagccagggcccagagcccttggct

SEQ ID NO: 40172 - DNA, 25 bp, Rattus norvegicus
aagccagggccctgagcccttggct

SEQ ID NO: 40173 - DNA, 25 bp, Rattus norvegicus
aagccagggctaatctaaaaggaga

SEQ ID NO: 40174 - DNA, 25 bp, Rattus norvegicus
aagccagggctattctaaaaggaga

SEQ ID NO: 40175 - DNA, 25 bp, Rattus norvegicus
aagccagggctgctctgtccaatgg

SEQ ID NO: 40176 - DNA, 25 bp, Rattus norvegicus
aagccagggctggtctgtccaatgg

SEQ ID NO: 40177 - DNA, 25 bp, Rattus norvegicus
aagccagggcttattggcaatgcca

SEQ ID NO: 40178 - DNA, 25 bp, Rattus norvegicus
aagccagggctttttggcaatgcca

SEQ ID NO: 40179 - DNA, 25 bp, Rattus norvegicus
aagccaggtaagatccatcgagtga

SEQ ID NO: 40180 - DNA, 25 bp, Rattus norvegicus
aagccaggtaagttccatcgagtga

SEQ ID NO: 40181 - DNA, 25 bp, Rattus norvegicus
aagccaggtccaattggccactgga

SEQ ID NO: 40182 - DNA, 25 bp, Rattus norvegicus
aagccaggtccatttggccactgga

SEQ ID NO: 40183 - DNA, 25 bp, Rattus norvegicus
aagccagtaaagcagcacgcgcgga

SEQ ID NO: 40184 - DNA, 25 bp, Rattus norvegicus
aagccagtaaaggagcacgcgcgga

SEQ ID NO: 40185 - DNA, 25 bp, Rattus norvegicus
aagccagtactaagacttcagcact

SEQ ID NO: 40186 - DNA, 25 bp, Rattus norvegicus
aagccagtactatgacttcagcact

SEQ ID NO: 40187 - DNA, 25 bp, Rattus norvegicus
aagccagtaggcagttctcaaccgt

SEQ ID NO: 40188 - DNA, 25 bp, Rattus norvegicus
aagccagtaggctgttctcaaccgt

SEQ ID NO: 40189 - DNA, 25 bp, Rattus norvegicus
aagccagtagggagagctcgccctt

SEQ ID NO: 40190 - DNA, 25 bp, Rattus norvegicus
aagccagtagggtgagctcgccctt

SEQ ID NO: 40191 - DNA, 25 bp, Rattus norvegicus
aagccagtatagcaagccttgaaga

SEQ ID NO: 40192 - DNA, 25 bp, Rattus norvegicus
aagccagtataggaagccttgaaga

SEQ ID NO: 40193 - DNA, 25 bp, Rattus norvegicus
aagccagtcaaacatcccaagtcaa

SEQ ID NO: 40194 - DNA, 25 bp, Rattus norvegicus
aagccagtcaaagatcccaagtcaa

SEQ ID NO: 40195 - DNA, 25 bp, Rattus norvegicus
aagccagtcaggagatcggtattgc

SEQ ID NO: 40196 - DNA, 25 bp, Rattus norvegicus
aagccagtcaggtgatcggtattgc

SEQ ID NO: 40197 - DNA, 25 bp, Rattus norvegicus
aagccagtcatccaacagtcattta

SEQ ID NO: 40198 - DNA, 25 bp, Rattus norvegicus
aagccagtcatcgaacagtcattta

SEQ ID NO: 40199 - DNA, 25 bp, Rattus norvegicus
aagccagtcgtaacaccagaagtct

SEQ ID NO: 40200 - DNA, 25 bp, Rattus norvegicus
aagccagtcgtatcaccagaagtct

SEQ ID NO: 40201 - DNA, 25 bp, Rattus norvegicus
aagccagtctaccttccatttatga

SEQ ID NO: 40202 - DNA, 25 bp, Rattus norvegicus
aagccagtctacgttccatttatga

SEQ ID NO: 40203 - DNA, 25 bp, Rattus norvegicus
aagccagtctccactatgtagtatt

SEQ ID NO: 40204 - DNA, 25 bp, Rattus norvegicus
aagccagtctcctctatgtagtatt

SEQ ID NO: 40205 - DNA, 25 bp, Rattus norvegicus
aagccagtctgcaaatactgttatg

SEQ ID NO: 40206 - DNA, 25 bp, Rattus norvegicus
aagccagtctgctaatactgttatg

SEQ ID NO: 40207 - DNA, 25 bp, Rattus norvegicus
aagccagtcttgaattactgtattt

SEQ ID NO: 40208 - DNA, 25 bp, Rattus norvegicus
aagccagtcttgtattactgtattt

SEQ ID NO: 40209 - DNA, 25 bp, Rattus norvegicus
aagccagtgagcctattaaccgtgc

SEQ ID NO: 40210 - DNA, 25 bp, Rattus norvegicus
aagccagtgagcgtattaaccgtgc

SEQ ID NO: 40211 - DNA, 25 bp, Rattus norvegicus
aagccagtgatgaggattagtaaca

SEQ ID NO: 40212 - DNA, 25 bp, Rattus norvegicus
aagccagtgatgctgaaacttaagt

SEQ ID NO: 40213 - DNA, 25 bp, Rattus norvegicus
aagccagtgatggtgaaacttaagt

SEQ ID NO: 40214 - DNA, 25 bp, Rattus norvegicus
aagccagtgatgtggattagtaaca

SEQ ID NO: 40215 - DNA, 25 bp, Rattus norvegicus
aagccagtgctaaaggaatcctcca

SEQ ID NO: 40216 - DNA, 25 bp, Rattus norvegicus
aagccagtgctataggaatcctcca

SEQ ID NO: 40217 - DNA, 25 bp, Rattus norvegicus
aagccagtgctcagggagtggaaaa

SEQ ID NO: 40218 - DNA, 25 bp, Rattus norvegicus
aagccagtgctcagtctgtgccggg

SEQ ID NO: 40219 - DNA, 25 bp, Rattus norvegicus
aagccagtgctctgggagtggaaaa

SEQ ID NO: 40220 - DNA, 25 bp, Rattus norvegicus
aagccagtgctctgtctgtgccggg

SEQ ID NO: 40221 - DNA, 25 bp, Rattus norvegicus
aagccagtgctgaaacatgtccaca

SEQ ID NO: 40222 - DNA, 25 bp, Rattus norvegicus
aagccagtgctgtaacatgtccaca

SEQ ID NO: 40223 - DNA, 25 bp, Rattus norvegicus
aagccagtgtagatgactaccccga

SEQ ID NO: 40224 - DNA, 25 bp, Rattus norvegicus
aagccagtgtagttgactaccccga

SEQ ID NO: 40225 - DNA, 25 bp, Rattus norvegicus
aagccagtgtttacacctctgagtc

SEQ ID NO: 40226 - DNA, 25 bp, Rattus norvegicus
aagccagtgttttcacctctgagtc

SEQ ID NO: 40227 - DNA, 25 bp, Rattus norvegicus
aagccagttatcactgctgcttctg

SEQ ID NO: 40228 - DNA, 25 bp, Rattus norvegicus
aagccagttatctctgctgcttctg

SEQ ID NO: 40229 - DNA, 25 bp, Rattus norvegicus
aagccagttcaccagggaccagatg

SEQ ID NO: 40230 - DNA, 25 bp, Rattus norvegicus
aagccagttcaccagttggaagatt

SEQ ID NO: 40231 - DNA, 25 bp, Rattus norvegicus
aagccagttcacgagggaccagatg

SEQ ID NO: 40232 - DNA, 25 bp, Rattus norvegicus
aagccagttcacgagttggaagatt

SEQ ID NO: 40233 - DNA, 25 bp, Rattus norvegicus
aagccagttctcagtggtactctga

SEQ ID NO: 40234 - DNA, 25 bp, Rattus norvegicus
aagccagttctctgtggtactctga

SEQ ID NO: 40235 - DNA, 25 bp, Rattus norvegicus
aagccagttgcactaatcgaggaag

SEQ ID NO: 40236 - DNA, 25 bp, Rattus norvegicus
aagccagttgcagtaatcgaggaag

SEQ ID NO: 40237 - DNA, 25 bp, Rattus norvegicus
aagccagttggcaatcagtaaccat

SEQ ID NO: 40238 - DNA, 25 bp, Rattus norvegicus
aagccagttggctatcagtaaccat

SEQ ID NO: 40239 - DNA, 25 bp, Rattus norvegicus
aagccagtttatacagtgacttcag

SEQ ID NO: 40240 - DNA, 25 bp, Rattus norvegicus
aagccagtttattcagtgacttcag

SEQ ID NO: 40241 - DNA, 25 bp, Rattus norvegicus
aagccagttttaacaagcctctacc

SEQ ID NO: 40242 - DNA, 25 bp, Rattus norvegicus
aagccagttttatcaagcctctacc

SEQ ID NO: 40243 - DNA, 25 bp, Rattus norvegicus
aagccatacaatatcccctatatag

SEQ ID NO: 40244 - DNA, 25 bp, Rattus norvegicus
aagccatacaatttcccctatatag

SEQ ID NO: 40245 - DNA, 25 bp, Rattus norvegicus
aagccatacagtattgttacctcag

SEQ ID NO: 40246 - DNA, 25 bp, Rattus norvegicus
aagccatacagttttgttacctcag

SEQ ID NO: 40247 - DNA, 25 bp, Rattus norvegicus
aagccatagactagctcatagccaa

SEQ ID NO: 40248 - DNA, 25 bp, Rattus norvegicus
aagccatagacttgctcatagccaa

SEQ ID NO: 40249 - DNA, 25 bp, Rattus norvegicus
aagccatagaggctccggtgcccag

SEQ ID NO: 40250 - DNA, 25 bp, Rattus norvegicus
aagccatagagggtccggtgcccag

SEQ ID NO: 40251 - DNA, 25 bp, Rattus norvegicus
aagccataggaaatccgggcccgca

SEQ ID NO: 40252 - DNA, 25 bp, Rattus norvegicus
aagccataggaattccgggcccgca

SEQ ID NO: 40253 - DNA, 25 bp, Rattus norvegicus
aagccataggctaataggtcacaat

SEQ ID NO: 40254 - DNA, 25 bp, Rattus norvegicus
aagccataggcttataggtcacaat

SEQ ID NO: 40255 - DNA, 25 bp, Rattus norvegicus
aagccatatgggatgctccagtcat

SEQ ID NO: 40256 - DNA, 25 bp, Rattus norvegicus
aagccatatgggttgctccagtcat

SEQ ID NO: 40257 - DNA, 25 bp, Rattus norvegicus
aagccatatgtgacggagctgacat

SEQ ID NO: 40258 - DNA, 25 bp, Rattus norvegicus
aagccatatgtgtcggagctgacat

SEQ ID NO: 40259 - DNA, 25 bp, Rattus norvegicus
aagccatattctctaaattcactgt

SEQ ID NO: 40260 - DNA, 25 bp, Rattus norvegicus
aagccatattctgtaaattcactgt

SEQ ID NO: 40261 - DNA, 25 bp, Rattus norvegicus
aagccatcaacgacctagacagaga

SEQ ID NO: 40262 - DNA, 25 bp, Rattus norvegicus
aagccatcaacgtcctagacagaga

SEQ ID NO: 40263 - DNA, 25 bp, Rattus norvegicus
aagccatcaagacaattccctaacc

SEQ ID NO: 40264 - DNA, 25 bp, Rattus norvegicus
aagccatcaagagaattccctaacc

SEQ ID NO: 40265 - DNA, 25 bp, Rattus norvegicus
aagccatcagggagcgcagcccaac

SEQ ID NO: 40266 - DNA, 25 bp, Rattus norvegicus
aagccatcagggtgcgcagcccaac

SEQ ID NO: 40267 - DNA, 25 bp, Rattus norvegicus
aagccatcagtgcaacttctgtggg

SEQ ID NO: 40268 - DNA, 25 bp, Rattus norvegicus
aagccatcagtggaacttctgtggg

SEQ ID NO: 40269 - DNA, 25 bp, Rattus norvegicus
aagccatcatctactttgacccaga

SEQ ID NO: 40270 - DNA, 25 bp, Rattus norvegicus
aagccatcatctattggcatcagcc

SEQ ID NO: 40271 - DNA, 25 bp, Rattus norvegicus
aagccatcatcttctttgacccaga

SEQ ID NO: 40272 - DNA, 25 bp, Rattus norvegicus
aagccatcatcttttggcatcagcc

SEQ ID NO: 40273 - DNA, 25 bp, Rattus norvegicus
aagccatccggaatcaggctgggca

SEQ ID NO: 40274 - DNA, 25 bp, Rattus norvegicus
aagccatccggattcaggctgggca

SEQ ID NO: 40275 - DNA, 25 bp, Rattus norvegicus
aagccatccggtcatgttcgcagcg

SEQ ID NO: 40276 - DNA, 25 bp, Rattus norvegicus
aagccatccggtgatgttcgcagcg

SEQ ID NO: 40277 - DNA, 25 bp, Rattus norvegicus
aagccatcctgtattgattgtttta

SEQ ID NO: 40278 - DNA, 25 bp, Rattus norvegicus
aagccatcctgttttgattgtttta

SEQ ID NO: 40279 - DNA, 25 bp, Rattus norvegicus
aagccatccttacccctatttaatg

SEQ ID NO: 40280 - DNA, 25 bp, Rattus norvegicus
aagccatccttagccctatttaatg

SEQ ID NO: 40281 - DNA, 25 bp, Rattus norvegicus
aagccatcctttatcctctgaaagg

SEQ ID NO: 40282 - DNA, 25 bp, Rattus norvegicus
aagccatcctttatctgcaaacaaa

SEQ ID NO: 40283 - DNA, 25 bp, Rattus norvegicus
aagccatcctttttcctctgaaagg

SEQ ID NO: 40284 - DNA, 25 bp, Rattus norvegicus
aagccatcctttttctgcaaacaaa

SEQ ID NO: 40285 - DNA, 25 bp, Rattus norvegicus
aagccatcggcactcttggtggaga

SEQ ID NO: 40286 - DNA, 25 bp, Rattus norvegicus
aagccatcggcagtcttggtggaga

SEQ ID NO: 40287 - DNA, 25 bp, Rattus norvegicus
aagccatcgtagaaagagcagcaca

SEQ ID NO: 40288 - DNA, 25 bp, Rattus norvegicus
aagccatcgtagtaagagcagcaca

SEQ ID NO: 40289 - DNA, 25 bp, Rattus norvegicus
aagccatctcaaatccatagcaaat

SEQ ID NO: 40290 - DNA, 25 bp, Rattus norvegicus
aagccatctcaattccatagcaaat

SEQ ID NO: 40291 - DNA, 25 bp, Rattus norvegicus
aagccatctctacaactttcttttg

SEQ ID NO: 40292 - DNA, 25 bp, Rattus norvegicus
aagccatctctagaactttcttttg

SEQ ID NO: 40293 - DNA, 25 bp, Rattus norvegicus
aagccatctgaaatctgtttccaag

SEQ ID NO: 40294 - DNA, 25 bp, Rattus norvegicus
aagccatctgaattctgtttccaag

SEQ ID NO: 40295 - DNA, 25 bp, Rattus norvegicus
aagccatctgcaaagctagtcacaa

SEQ ID NO: 40296 - DNA, 25 bp, Rattus norvegicus
aagccatctgcatagctagtcacaa

SEQ ID NO: 40297 - DNA, 25 bp, Rattus norvegicus
aagccatctgcgaggtcatgggcca

SEQ ID NO: 40298 - DNA, 25 bp, Rattus norvegicus
aagccatctgcgtggtcatgggcca

SEQ ID NO: 40299 - DNA, 25 bp, Rattus norvegicus
aagccatctgttcatcagaagcgat

SEQ ID NO: 40300 - DNA, 25 bp, Rattus norvegicus
aagccatctgttgatcagaagcgat

SEQ ID NO: 40301 - DNA, 25 bp, Rattus norvegicus
aagccatctttcaggcgctgtagtt

SEQ ID NO: 40302 - DNA, 25 bp, Rattus norvegicus
aagccatctttctggcgctgtagtt

SEQ ID NO: 40303 - DNA, 25 bp, Rattus norvegicus
aagccatctttgactacatagacgg

SEQ ID NO: 40304 - DNA, 25 bp, Rattus norvegicus
aagccatctttgtctacatagacgg

SEQ ID NO: 40305 - DNA, 25 bp, Rattus norvegicus
aagccatgaatgaggctgcctcagc

SEQ ID NO: 40306 - DNA, 25 bp, Rattus norvegicus
aagccatgaatgtggctgcctcagc

SEQ ID NO: 40307 - DNA, 25 bp, Rattus norvegicus
aagccatgacataaattgcactctg

SEQ ID NO: 40308 - DNA, 25 bp, Rattus norvegicus
aagccatgacataccttgccaatgc

SEQ ID NO: 40309 - DNA, 25 bp, Rattus norvegicus
aagccatgacattaattgcactctg

SEQ ID NO: 40310 - DNA, 25 bp, Rattus norvegicus
aagccatgacattccttgccaatgc

SEQ ID NO: 40311 - DNA, 25 bp, Rattus norvegicus
aagccatgagagatgctccacttct

SEQ ID NO: 40312 - DNA, 25 bp, Rattus norvegicus
aagccatgagagttgctccacttct

SEQ ID NO: 40313 - DNA, 25 bp, Rattus norvegicus
aagccatgagatatcctgccctgct

SEQ ID NO: 40314 - DNA, 25 bp, Rattus norvegicus
aagccatgagatttcctgccctgct

SEQ ID NO: 40315 - DNA, 25 bp, Rattus norvegicus
aagccatgagcgactactgggttgt

SEQ ID NO: 40316 - DNA, 25 bp, Rattus norvegicus
aagccatgagcgtctactgggttgt

SEQ ID NO: 40317 - DNA, 25 bp, Rattus norvegicus
aagccatgaggccaaagcaacccaa

SEQ ID NO: 40318 - DNA, 25 bp, Rattus norvegicus
aagccatgaggcgaaagcaacccaa

SEQ ID NO: 40319 - DNA, 25 bp, Rattus norvegicus
aagccatgatggacgcaactgaaga

SEQ ID NO: 40320 - DNA, 25 bp, Rattus norvegicus
aagccatgatggtcgcaactgaaga

SEQ ID NO: 40321 - DNA, 25 bp, Rattus norvegicus
aagccatgattgcacagatgttggt

SEQ ID NO: 40322 - DNA, 25 bp, Rattus norvegicus
aagccatgattggacagatgttggt

SEQ ID NO: 40323 - DNA, 25 bp, Rattus norvegicus
aagccatgcagtcgtgatgcacaac

SEQ ID NO: 40324 - DNA, 25 bp, Rattus norvegicus
aagccatgcagtggtgatgcacaac

SEQ ID NO: 40325 - DNA, 25 bp, Rattus norvegicus
aagccatgcattcttttctcattcc

SEQ ID NO: 40326 - DNA, 25 bp, Rattus norvegicus
aagccatgcattgttttctcattcc

SEQ ID NO: 40327 - DNA, 25 bp, Rattus norvegicus
aagccatgcgtgctgtggtaactcc

SEQ ID NO: 40328 - DNA, 25 bp, Rattus norvegicus
aagccatgcgtggtgtggtaactcc

SEQ ID NO: 40329 - DNA, 25 bp, Rattus norvegicus
aagccatgcttaccaaatcacgtag

SEQ ID NO: 40330 - DNA, 25 bp, Rattus norvegicus
aagccatgcttagcaaatcacgtag

SEQ ID NO: 40331 - DNA, 25 bp, Rattus norvegicus
aagccatggaacaaccaggttgatt

SEQ ID NO: 40332 - DNA, 25 bp, Rattus norvegicus
aagccatggaactaccaggttgatt

SEQ ID NO: 40333 - DNA, 25 bp, Rattus norvegicus
aagccatggagccttttgggtccag

SEQ ID NO: 40334 - DNA, 25 bp, Rattus norvegicus
aagccatggagcgttttgggtccag

SEQ ID NO: 40335 - DNA, 25 bp, Rattus norvegicus
aagccatggatcactgtggacgcag

SEQ ID NO: 40336 - DNA, 25 bp, Rattus norvegicus
aagccatggatcaggattctgacta

SEQ ID NO: 40337 - DNA, 25 bp, Rattus norvegicus
aagccatggatctctgtggacgcag

SEQ ID NO: 40338 - DNA, 25 bp, Rattus norvegicus
aagccatggatctggattctgacta

SEQ ID NO: 40339 - DNA, 25 bp, Rattus norvegicus
aagccatgggttagtagctgtcata

SEQ ID NO: 40340 - DNA, 25 bp, Rattus norvegicus
aagccatgggtttgtagctgtcata

SEQ ID NO: 40341 - DNA, 25 bp, Rattus norvegicus
aagccatgtaagctggagctgccaa

SEQ ID NO: 40342 - DNA, 25 bp, Rattus norvegicus
aagccatgtaaggtggagctgccaa

SEQ ID NO: 40343 - DNA, 25 bp, Rattus norvegicus
aagccatgtctgatcattccttaat

SEQ ID NO: 40344 - DNA, 25 bp, Rattus norvegicus
aagccatgtctgttcattccttaat

SEQ ID NO: 40345 - DNA, 25 bp, Rattus norvegicus
aagccatgtgaaattgctccagctc

SEQ ID NO: 40346 - DNA, 25 bp, Rattus norvegicus
aagccatgtgaatttgctccagctc

SEQ ID NO: 40347 - DNA, 25 bp, Rattus norvegicus
aagccatgtggcaacaattcatcaa

SEQ ID NO: 40348 - DNA, 25 bp, Rattus norvegicus
aagccatgtggctacaattcatcaa

SEQ ID NO: 40349 - DNA, 25 bp, Rattus norvegicus
aagccatgtgtgctcttactcatta

SEQ ID NO: 40350 - DNA, 25 bp, Rattus norvegicus
aagccatgtgtggtcttactcatta

SEQ ID NO: 40351 - DNA, 25 bp, Rattus norvegicus
aagccatgttagaggtctcattctg

SEQ ID NO: 40352 - DNA, 25 bp, Rattus norvegicus
aagccatgttagtggtctcattctg

SEQ ID NO: 40353 - DNA, 25 bp, Rattus norvegicus
aagccatgttgtacagactcagcct

SEQ ID NO: 40354 - DNA, 25 bp, Rattus norvegicus
aagccatgttgttcagactcagcct

SEQ ID NO: 40355 - DNA, 25 bp, Rattus norvegicus
aagccatgtttgagttttctgtggg

SEQ ID NO: 40356 - DNA, 25 bp, Rattus norvegicus
aagccatgtttgtgttttctgtggg

SEQ ID NO: 40357 - DNA, 25 bp, Rattus norvegicus
aagccatgttttaaagcagagccag

SEQ ID NO: 40358 - DNA, 25 bp, Rattus norvegicus
aagccatgttttctgggatcctaaa

SEQ ID NO: 40359 - DNA, 25 bp, Rattus norvegicus
aagccatgttttgtgggatcctaaa

SEQ ID NO: 40360 - DNA, 25 bp, Rattus norvegicus
aagccatgtttttaagcagagccag

SEQ ID NO: 40361 - DNA, 25 bp, Rattus norvegicus
aagccattacccatgagtgttagta

SEQ ID NO: 40362 - DNA, 25 bp, Rattus norvegicus
aagccattacccttgagtgttagta

SEQ ID NO: 40363 - DNA, 25 bp, Rattus norvegicus
aagccattactaagtctgatgacca

SEQ ID NO: 40364 - DNA, 25 bp, Rattus norvegicus
aagccattactatgtctgatgacca

SEQ ID NO: 40365 - DNA, 25 bp, Rattus norvegicus
aagccattactgacttgttttcatg

SEQ ID NO: 40366 - DNA, 25 bp, Rattus norvegicus
aagccattactgtcttgttttcatg

SEQ ID NO: 40367 - DNA, 25 bp, Rattus norvegicus
aagccattagctctatttttaggag

SEQ ID NO: 40368 - DNA, 25 bp, Rattus norvegicus
aagccattagctgtatttttaggag

SEQ ID NO: 40369 - DNA, 25 bp, Rattus norvegicus
aagccattatggacacttgattttg

SEQ ID NO: 40370 - DNA, 25 bp, Rattus norvegicus
aagccattatggtcacttgattttg

SEQ ID NO: 40371 - DNA, 25 bp, Rattus norvegicus
aagccattattgacttgagatcaga

SEQ ID NO: 40372 - DNA, 25 bp, Rattus norvegicus
aagccattattgtcttgagatcaga

SEQ ID NO: 40373 - DNA, 25 bp, Rattus norvegicus
aagccattatttacgatatccctcc

SEQ ID NO: 40374 - DNA, 25 bp, Rattus norvegicus
aagccattattttcgatatccctcc

SEQ ID NO: 40375 - DNA, 25 bp, Rattus norvegicus
aagccattccaaacctttctgtgat

SEQ ID NO: 40376 - DNA, 25 bp, Rattus norvegicus
aagccattccaatcctttctgtgat

SEQ ID NO: 40377 - DNA, 25 bp, Rattus norvegicus
aagccattccagagccctgagtgtg

SEQ ID NO: 40378 - DNA, 25 bp, Rattus norvegicus
aagccattccagtgccctgagtgtg

SEQ ID NO: 40379 - DNA, 25 bp, Rattus norvegicus
aagccattcctcagcatttgtattc

SEQ ID NO: 40380 - DNA, 25 bp, Rattus norvegicus
aagccattcctctgcatttgtattc

SEQ ID NO: 40381 - DNA, 25 bp, Rattus norvegicus
aagccattccttcccataattgctg

SEQ ID NO: 40382 - DNA, 25 bp, Rattus norvegicus
aagccattccttgccataattgctg

SEQ ID NO: 40383 - DNA, 25 bp, Rattus norvegicus
aagccattctgcattcattcaaact

SEQ ID NO: 40384 - DNA, 25 bp, Rattus norvegicus
aagccattctgctttcattcaaact

SEQ ID NO: 40385 - DNA, 25 bp, Rattus norvegicus
aagccattctggcatatgtttggtc

SEQ ID NO: 40386 - DNA, 25 bp, Rattus norvegicus
aagccattctgggatatgtttggtc

SEQ ID NO: 40387 - DNA, 25 bp, Rattus norvegicus
aagccattgaaaccgttctctaaga

SEQ ID NO: 40388 - DNA, 25 bp, Rattus norvegicus
aagccattgaaagcgttctctaaga

SEQ ID NO: 40389 - DNA, 25 bp, Rattus norvegicus
aagccattgccacgatcatcacgta

SEQ ID NO: 40390 - DNA, 25 bp, Rattus norvegicus
aagccattgccaggatcatcacgta

SEQ ID NO: 40391 - DNA, 25 bp, Rattus norvegicus
aagccattgcttcgtccatctacac

SEQ ID NO: 40392 - DNA, 25 bp, Rattus norvegicus
aagccattgcttggtccatctacac

SEQ ID NO: 40393 - DNA, 25 bp, Rattus norvegicus
aagccattggctaccatcaggttcg

SEQ ID NO: 40394 - DNA, 25 bp, Rattus norvegicus
aagccattggcttccatcaggttcg

SEQ ID NO: 40395 - DNA, 25 bp, Rattus norvegicus
aagccattgtcactgtgtccggaga

SEQ ID NO: 40396 - DNA, 25 bp, Rattus norvegicus
aagccattgtcagtgtgtccggaga

SEQ ID NO: 40397 - DNA, 25 bp, Rattus norvegicus
aagccatttacaaccattgtgacat

SEQ ID NO: 40398 - DNA, 25 bp, Rattus norvegicus
aagccatttacaagtttagttgtgc

SEQ ID NO: 40399 - DNA, 25 bp, Rattus norvegicus
aagccatttacatccattgtgacat

SEQ ID NO: 40400 - DNA, 25 bp, Rattus norvegicus
aagccatttacatgtttagttgtgc

SEQ ID NO: 40401 - DNA, 25 bp, Rattus norvegicus
aagccatttattacttcctggtgga

SEQ ID NO: 40402 - DNA, 25 bp, Rattus norvegicus
aagccatttatttcttcctggtgga

SEQ ID NO: 40403 - DNA, 25 bp, Rattus norvegicus
aagccatttcatcccgaagcactaa

SEQ ID NO: 40404 - DNA, 25 bp, Rattus norvegicus
aagccatttcatgccgaagcactaa

SEQ ID NO: 40405 - DNA, 25 bp, Rattus norvegicus
aagccatttgagattctgcccttac

SEQ ID NO: 40406 - DNA, 25 bp, Rattus norvegicus
aagccatttgagtttctgcccttac

SEQ ID NO: 40407 - DNA, 25 bp, Rattus norvegicus
aagccatttgatagccatgagttta

SEQ ID NO: 40408 - DNA, 25 bp, Rattus norvegicus
aagccatttgattgccatgagttta

SEQ ID NO: 40409 - DNA, 25 bp, Rattus norvegicus
aagccatttgcgataccagttcaag

SEQ ID NO: 40410 - DNA, 25 bp, Rattus norvegicus
aagccatttgcgttaccagttcaag

SEQ ID NO: 40411 - DNA, 25 bp, Rattus norvegicus
aagccattttacagtctctcttctt

SEQ ID NO: 40412 - DNA, 25 bp, Rattus norvegicus
aagccattttacctgtggcacgcca

SEQ ID NO: 40413 - DNA, 25 bp, Rattus norvegicus
aagccattttacgtgtggcacgcca

SEQ ID NO: 40414 - DNA, 25 bp, Rattus norvegicus
aagccattttactgtctctcttctt

SEQ ID NO: 40415 - DNA, 25 bp, Rattus norvegicus
aagccattttagaggtgtttgcaaa

SEQ ID NO: 40416 - DNA, 25 bp, Rattus norvegicus
aagccattttagtggtgtttgcaaa

SEQ ID NO: 40417 - DNA, 25 bp, Rattus norvegicus
aagccattttctccctccacatgtg

SEQ ID NO: 40418 - DNA, 25 bp, Rattus norvegicus
aagccattttctgcctccacatgtg

SEQ ID NO: 40419 - DNA, 25 bp, Rattus norvegicus
aagccattttgcattacagttgaac

SEQ ID NO: 40420 - DNA, 25 bp, Rattus norvegicus
aagccattttgctttacagttgaac

SEQ ID NO: 40421 - DNA, 25 bp, Rattus norvegicus
aagccattttgtattgtgataatga

SEQ ID NO: 40422 - DNA, 25 bp, Rattus norvegicus
aagccattttgttttgtgataatga

SEQ ID NO: 40423 - DNA, 25 bp, Rattus norvegicus
aagcccaaagctcactgactgtgaa

SEQ ID NO: 40424 - DNA, 25 bp, Rattus norvegicus
aagcccaaagctgactgactgtgaa

SEQ ID NO: 40425 - DNA, 25 bp, Rattus norvegicus
aagcccaaatctattgtcctcattc

SEQ ID NO: 40426 - DNA, 25 bp, Rattus norvegicus
aagcccaaatcttttgtcctcattc

SEQ ID NO: 40427 - DNA, 25 bp, Rattus norvegicus
aagcccaaattgaatctgtgcagac

SEQ ID NO: 40428 - DNA, 25 bp, Rattus norvegicus
aagcccaaattgtatctgtgcagac

SEQ ID NO: 40429 - DNA, 25 bp, Rattus norvegicus
aagcccaacgcaaacagtatcactc

SEQ ID NO: 40430 - DNA, 25 bp, Rattus norvegicus
aagcccaacgcatacagtatcactc

SEQ ID NO: 40431 - DNA, 25 bp, Rattus norvegicus
aagcccaactcgctccagagagatg

SEQ ID NO: 40432 - DNA, 25 bp, Rattus norvegicus
aagcccaactcggtccagagagatg

SEQ ID NO: 40433 - DNA, 25 bp, Rattus norvegicus
aagcccaagcctacctggatgagtg

SEQ ID NO: 40434 - DNA, 25 bp, Rattus norvegicus
aagcccaagccttcctggatgagtg

SEQ ID NO: 40435 - DNA, 25 bp, Rattus norvegicus
aagcccaaggcaacggagctgacag

SEQ ID NO: 40436 - DNA, 25 bp, Rattus norvegicus
aagcccaaggcatcggagctgacag

SEQ ID NO: 40437 - DNA, 25 bp, Rattus norvegicus
aagcccaagggcacatccatgaatg

SEQ ID NO: 40438 - DNA, 25 bp, Rattus norvegicus
aagcccaagggctcatccatgaatg

SEQ ID NO: 40439 - DNA, 25 bp, Rattus norvegicus
aagcccaaggtaccgtctatatcta

SEQ ID NO: 40440 - DNA, 25 bp, Rattus norvegicus
aagcccaaggtagcgtctatatcta

SEQ ID NO: 40441 - DNA, 25 bp, Rattus norvegicus
aagcccaaggtgactttgtccaggt

SEQ ID NO: 40442 - DNA, 25 bp, Rattus norvegicus
aagcccaaggtgtctttgtccaggt

SEQ ID NO: 40443 - DNA, 25 bp, Rattus norvegicus
aagcccaagtcaccaagccgtggca

SEQ ID NO: 40444 - DNA, 25 bp, Rattus norvegicus
aagcccaagtcagcaagccgtggca

SEQ ID NO: 40445 - DNA, 25 bp, Rattus norvegicus
aagcccaagtccatcgaagcactta

SEQ ID NO: 40446 - DNA, 25 bp, Rattus norvegicus
aagcccaagtccttcgaagcactta

SEQ ID NO: 40447 - DNA, 25 bp, Rattus norvegicus
aagcccaatactaagagtcccaatt

SEQ ID NO: 40448 - DNA, 25 bp, Rattus norvegicus
aagcccaatacttagagtcccaatt

SEQ ID NO: 40449 - DNA, 25 bp, Rattus norvegicus
aagcccaatatcatggagacccaac

SEQ ID NO: 40450 - DNA, 25 bp, Rattus norvegicus
aagcccaatatcttggagacccaac

SEQ ID NO: 40451 - DNA, 25 bp, Rattus norvegicus
aagcccaatgagattgccagccaaa

SEQ ID NO: 40452 - DNA, 25 bp, Rattus norvegicus
aagcccaatgagtttgccagccaaa

SEQ ID NO: 40453 - DNA, 25 bp, Rattus norvegicus
aagcccaatggccacattgccaata

SEQ ID NO: 40454 - DNA, 25 bp, Rattus norvegicus
aagcccaatggcgacattgccaata

SEQ ID NO: 40455 - DNA, 25 bp, Rattus norvegicus
aagcccaatttgatttccacagtat

SEQ ID NO: 40456 - DNA, 25 bp, Rattus norvegicus
aagcccaatttgttttccacagtat

SEQ ID NO: 40457 - DNA, 25 bp, Rattus norvegicus
aagcccacaaagatgctgcagtagc

SEQ ID NO: 40458 - DNA, 25 bp, Rattus norvegicus
aagcccacaaagttgctgcagtagc

SEQ ID NO: 40459 - DNA, 25 bp, Rattus norvegicus
aagcccacaacaatccaaggtcact

SEQ ID NO: 40460 - DNA, 25 bp, Rattus norvegicus
aagcccacaacattccaaggtcact

SEQ ID NO: 40461 - DNA, 25 bp, Rattus norvegicus
aagcccacaatgatttctgtatggt

SEQ ID NO: 40462 - DNA, 25 bp, Rattus norvegicus
aagcccacaatgttttctgtatggt

SEQ ID NO: 40463 - DNA, 25 bp, Rattus norvegicus
aagcccacacaaaacagcctgaatg

SEQ ID NO: 40464 - DNA, 25 bp, Rattus norvegicus
aagcccacacaatacagcctgaatg

SEQ ID NO: 40465 - DNA, 25 bp, Rattus norvegicus
aagcccacagtgacaaagccaagga

SEQ ID NO: 40466 - DNA, 25 bp, Rattus norvegicus
aagcccacagtgtcaaagccaagga

SEQ ID NO: 40467 - DNA, 25 bp, Rattus norvegicus
aagcccaccatgcaggatgatccaa

SEQ ID NO: 40468 - DNA, 25 bp, Rattus norvegicus
aagcccaccatggaggatgatccaa

SEQ ID NO: 40469 - DNA, 25 bp, Rattus norvegicus
aagcccactcttcttggaggtcacg

SEQ ID NO: 40470 - DNA, 25 bp, Rattus norvegicus
aagcccactcttgttggaggtcacg

SEQ ID NO: 40471 - DNA, 25 bp, Rattus norvegicus
aagcccacttccatagccagtgtgg

SEQ ID NO: 40472 - DNA, 25 bp, Rattus norvegicus
aagcccacttccttagccagtgtgg

SEQ ID NO: 40473 - DNA, 25 bp, Rattus norvegicus
aagcccagaacgaggtgccttggaa

SEQ ID NO: 40474 - DNA, 25 bp, Rattus norvegicus
aagcccagaacgtggtgccttggaa

SEQ ID NO: 40475 - DNA, 25 bp, Rattus norvegicus
aagcccagaattacctgatcttcgg

SEQ ID NO: 40476 - DNA, 25 bp, Rattus norvegicus
aagcccagaatttcctgatcttcgg

SEQ ID NO: 40477 - DNA, 25 bp, Rattus norvegicus
aagcccagacggatgcaggaacatt

SEQ ID NO: 40478 - DNA, 25 bp, Rattus norvegicus
aagcccagacggttgcaggaacatt

SEQ ID NO: 40479 - DNA, 25 bp, Rattus norvegicus
aagcccagaggcagatacccagcaa

SEQ ID NO: 40480 - DNA, 25 bp, Rattus norvegicus
aagcccagaggctgatacccagcaa

SEQ ID NO: 40481 - DNA, 25 bp, Rattus norvegicus
aagcccagaggtccttctcgtggat

SEQ ID NO: 40482 - DNA, 25 bp, Rattus norvegicus
aagcccagaggtgcttctcgtggat

SEQ ID NO: 40483 - DNA, 25 bp, Rattus norvegicus
aagcccagatggatccttcagagac

SEQ ID NO: 40484 - DNA, 25 bp, Rattus norvegicus
aagcccagatggttccttcagagac

SEQ ID NO: 40485 - DNA, 25 bp, Rattus norvegicus
aagcccagattcatgtatatagttg

SEQ ID NO: 40486 - DNA, 25 bp, Rattus norvegicus
aagcccagattcttgtatatagttg

SEQ ID NO: 40487 - DNA, 25 bp, Rattus norvegicus
aagcccagcatcaagtggttcaagg

SEQ ID NO: 40488 - DNA, 25 bp, Rattus norvegicus
aagcccagcatctagtggttcaagg

SEQ ID NO: 40489 - DNA, 25 bp, Rattus norvegicus
aagcccagcattcacggagatctac

SEQ ID NO: 40490 - DNA, 25 bp, Rattus norvegicus
aagcccagcattgacggagatctac

SEQ ID NO: 40491 - DNA, 25 bp, Rattus norvegicus
aagcccagcccaagagaaggccatc

SEQ ID NO: 40492 - DNA, 25 bp, Rattus norvegicus
aagcccagcccacgaacgttgaaag

SEQ ID NO: 40493 - DNA, 25 bp, Rattus norvegicus
aagcccagcccaggaacgttgaaag

SEQ ID NO: 40494 - DNA, 25 bp, Rattus norvegicus
aagcccagcccatgagaaggccatc

SEQ ID NO: 40495 - DNA, 25 bp, Rattus norvegicus
aagcccagcctacattagctgactt

SEQ ID NO: 40496 - DNA, 25 bp, Rattus norvegicus
aagcccagcctagattagctgactt

SEQ ID NO: 40497 - DNA, 25 bp, Rattus norvegicus
aagcccagcgtcaatgcagttgcca

SEQ ID NO: 40498 - DNA, 25 bp, Rattus norvegicus
aagcccagcgtctatgcagttgcca

SEQ ID NO: 40499 - DNA, 25 bp, Rattus norvegicus
aagcccagctctatgaaacatccag

SEQ ID NO: 40500 - DNA, 25 bp, Rattus norvegicus
aagcccagctctttgaaacatccag

SEQ ID NO: 40501 - DNA, 25 bp, Rattus norvegicus
aagcccaggagcacatgcttgtact

SEQ ID NO: 40502 - DNA, 25 bp, Rattus norvegicus
aagcccaggagctcatgcttgtact

SEQ ID NO: 40503 - DNA, 25 bp, Rattus norvegicus
aagcccaggcagacaggcttcatga

SEQ ID NO: 40504 - DNA, 25 bp, Rattus norvegicus
aagcccaggcagtcaggcttcatga

SEQ ID NO: 40505 - DNA, 25 bp, Rattus norvegicus
aagcccagggagagatttataaaag

SEQ ID NO: 40506 - DNA, 25 bp, Rattus norvegicus
aagcccagggagtgatttataaaag

SEQ ID NO: 40507 - DNA, 25 bp, Rattus norvegicus
aagcccagggccaccagaataagca

SEQ ID NO: 40508 - DNA, 25 bp, Rattus norvegicus
aagcccagggcctccagaataagca

SEQ ID NO: 40509 - DNA, 25 bp, Rattus norvegicus
aagcccagggtcatgctactcacgg

SEQ ID NO: 40510 - DNA, 25 bp, Rattus norvegicus
aagcccagggtcttgctactcacgg

SEQ ID NO: 40511 - DNA, 25 bp, Rattus norvegicus
aagcccagggtgatgacgcagactc

SEQ ID NO: 40512 - DNA, 25 bp, Rattus norvegicus
aagcccagggtgttgacgcagactc

SEQ ID NO: 40513 - DNA, 25 bp, Rattus norvegicus
aagcccagtatcatgtctgtttgtg

SEQ ID NO: 40514 - DNA, 25 bp, Rattus norvegicus
aagcccagtatcttgtctgtttgtg

SEQ ID NO: 40515 - DNA, 25 bp, Rattus norvegicus
aagcccagtcaaatagggtgtgcca

SEQ ID NO: 40516 - DNA, 25 bp, Rattus norvegicus
aagcccagtcaattagggtgtgcca

SEQ ID NO: 40517 - DNA, 25 bp, Rattus norvegicus
aagcccagtctccaaatgaggtcca

SEQ ID NO: 40518 - DNA, 25 bp, Rattus norvegicus
aagcccagtctcgaaatgaggtcca

SEQ ID NO: 40519 - DNA, 25 bp, Rattus norvegicus
aagcccagtcttatacatatcaatg

SEQ ID NO: 40520 - DNA, 25 bp, Rattus norvegicus
aagcccagtcttttacatatcaatg

SEQ ID NO: 40521 - DNA, 25 bp, Rattus norvegicus
aagcccagtggaagagcctgctgtc

SEQ ID NO: 40522 - DNA, 25 bp, Rattus norvegicus
aagcccagtggatgagcctgctgtc

SEQ ID NO: 40523 - DNA, 25 bp, Rattus norvegicus
aagcccagtggcagccttagagtcc

SEQ ID NO: 40524 - DNA, 25 bp, Rattus norvegicus
aagcccagtggctgccttagagtcc

SEQ ID NO: 40525 - DNA, 25 bp, Rattus norvegicus
aagcccagttcaagatgcttgccct

SEQ ID NO: 40526 - DNA, 25 bp, Rattus norvegicus
aagcccagttcatgatgcttgccct

SEQ ID NO: 40527 - DNA, 25 bp, Rattus norvegicus
aagcccatagacagtggtcccagct

SEQ ID NO: 40528 - DNA, 25 bp, Rattus norvegicus
aagcccatagactgtggtcccagct

SEQ ID NO: 40529 - DNA, 25 bp, Rattus norvegicus
aagcccatatccatgttccagggtg

SEQ ID NO: 40530 - DNA, 25 bp, Rattus norvegicus
aagcccatatccttgttccagggtg

SEQ ID NO: 40531 - DNA, 25 bp, Rattus norvegicus
aagcccatccctcggaaggccttgg

SEQ ID NO: 40532 - DNA, 25 bp, Rattus norvegicus
aagcccatccctgggaaggccttgg

SEQ ID NO: 40533 - DNA, 25 bp, Rattus norvegicus
aagcccatcctactagcgggccttg

SEQ ID NO: 40534 - DNA, 25 bp, Rattus norvegicus
aagcccatcctagtagcgggccttg

SEQ ID NO: 40535 - DNA, 25 bp, Rattus norvegicus
aagcccatctaaaactaggtgtgtg

SEQ ID NO: 40536 - DNA, 25 bp, Rattus norvegicus
aagcccatctaatactaggtgtgtg

SEQ ID NO: 40537 - DNA, 25 bp, Rattus norvegicus
aagcccatctcgacgttgaaaacat

SEQ ID NO: 40538 - DNA, 25 bp, Rattus norvegicus
aagcccatctcgtcgttgaaaacat

SEQ ID NO: 40539 - DNA, 25 bp, Rattus norvegicus
aagcccatgacacttccagaagtga

SEQ ID NO: 40540 - DNA, 25 bp, Rattus norvegicus
aagcccatgacagttccagaagtga

SEQ ID NO: 40541 - DNA, 25 bp, Rattus norvegicus
aagcccatgagtccacagtgactgt

SEQ ID NO: 40542 - DNA, 25 bp, Rattus norvegicus
aagcccatgagtgcacagtgactgt

SEQ ID NO: 40543 - DNA, 25 bp, Rattus norvegicus
aagcccatgcatcaacttgtgagga

SEQ ID NO: 40544 - DNA, 25 bp, Rattus norvegicus
aagcccatgcatgaacttgtgagga

SEQ ID NO: 40545 - DNA, 25 bp, Rattus norvegicus
aagcccatgcgtagttctggagcca

SEQ ID NO: 40546 - DNA, 25 bp, Rattus norvegicus
aagcccatgcgttgttctggagcca

SEQ ID NO: 40547 - DNA, 25 bp, Rattus norvegicus
aagcccatgggtccaacccagttac

SEQ ID NO: 40548 - DNA, 25 bp, Rattus norvegicus
aagcccatgggtgcaacccagttac

SEQ ID NO: 40549 - DNA, 25 bp, Rattus norvegicus
aagcccatgtgaatgccctgagaat

SEQ ID NO: 40550 - DNA, 25 bp, Rattus norvegicus
aagcccatgtgattgccctgagaat

SEQ ID NO: 40551 - DNA, 25 bp, Rattus norvegicus
aagcccatgtttctgctatctgctg

SEQ ID NO: 40552 - DNA, 25 bp, Rattus norvegicus
aagcccatgtttgtgctatctgctg

SEQ ID NO: 40553 - DNA, 25 bp, Rattus norvegicus
aagcccattagtccatatttcctcg

SEQ ID NO: 40554 - DNA, 25 bp, Rattus norvegicus
aagcccattagtgcatatttcctcg

SEQ ID NO: 40555 - DNA, 25 bp, Rattus norvegicus
aagcccattctaaatcctgctggcc

SEQ ID NO: 40556 - DNA, 25 bp, Rattus norvegicus
aagcccattctatatcctgctggcc

SEQ ID NO: 40557 - DNA, 25 bp, Rattus norvegicus
aagcccattggaaaggacctctcag

SEQ ID NO: 40558 - DNA, 25 bp, Rattus norvegicus
aagcccattggataggacctctcag

SEQ ID NO: 40559 - DNA, 25 bp, Rattus norvegicus
aagccccaaagccagccagtgaagc

SEQ ID NO: 40560 - DNA, 25 bp, Rattus norvegicus
aagccccaaagcgagccagtgaagc

SEQ ID NO: 40561 - DNA, 25 bp, Rattus norvegicus
aagccccaacatcgaaggtactcct

SEQ ID NO: 40562 - DNA, 25 bp, Rattus norvegicus
aagccccaacatggaaggtactcct

SEQ ID NO: 40563 - DNA, 25 bp, Rattus norvegicus
aagccccaagacataatttcctgat

SEQ ID NO: 40564 - DNA, 25 bp, Rattus norvegicus
aagccccaagacttaatttcctgat

SEQ ID NO: 40565 - DNA, 25 bp, Rattus norvegicus
aagccccaagcactattctttcttt

SEQ ID NO: 40566 - DNA, 25 bp, Rattus norvegicus
aagccccaagcagtattctttcttt

SEQ ID NO: 40567 - DNA, 25 bp, Rattus norvegicus
aagccccaaggacaattatggaaat

SEQ ID NO: 40568 - DNA, 25 bp, Rattus norvegicus
aagccccaaggagaattatggaaat

SEQ ID NO: 40569 - DNA, 25 bp, Rattus norvegicus
aagccccaaggccaattgtggacct

SEQ ID NO: 40570 - DNA, 25 bp, Rattus norvegicus
aagccccaaggcgaattgtggacct

SEQ ID NO: 40571 - DNA, 25 bp, Rattus norvegicus
aagccccaagtgcacaggcaactct

SEQ ID NO: 40572 - DNA, 25 bp, Rattus norvegicus
aagccccaagtggacaggcaactct

SEQ ID NO: 40573 - DNA, 25 bp, Rattus norvegicus
aagccccagatgctgatcatggtat

SEQ ID NO: 40574 - DNA, 25 bp, Rattus norvegicus
aagccccagatggtgatcatggtat

SEQ ID NO: 40575 - DNA, 25 bp, Rattus norvegicus
aagccccagctaccctgaaacttgt

SEQ ID NO: 40576 - DNA, 25 bp, Rattus norvegicus
aagccccagctagcctgaaacttgt

SEQ ID NO: 40577 - DNA, 25 bp, Rattus norvegicus
aagccccagctcaggtggcatggtg

SEQ ID NO: 40578 - DNA, 25 bp, Rattus norvegicus
aagccccagctctggtggcatggtg

SEQ ID NO: 40579 - DNA, 25 bp, Rattus norvegicus
aagccccaggaaccctctaaagatg

SEQ ID NO: 40580 - DNA, 25 bp, Rattus norvegicus
aagccccaggaagcctctaaagatg

SEQ ID NO: 40581 - DNA, 25 bp, Rattus norvegicus
aagccccaggaccaactcttggtga

SEQ ID NO: 40582 - DNA, 25 bp, Rattus norvegicus
aagccccaggacgaactcttggtga

SEQ ID NO: 40583 - DNA, 25 bp, Rattus norvegicus
aagccccaggagcagtccagaagat

SEQ ID NO: 40584 - DNA, 25 bp, Rattus norvegicus
aagccccaggagcatagctcttgtc

SEQ ID NO: 40585 - DNA, 25 bp, Rattus norvegicus
aagccccaggaggagtccagaagat

SEQ ID NO: 40586 - DNA, 25 bp, Rattus norvegicus
aagccccaggaggatagctcttgtc

SEQ ID NO: 40587 - DNA, 25 bp, Rattus norvegicus
aagccccaggcaatattttcattcc

SEQ ID NO: 40588 - DNA, 25 bp, Rattus norvegicus
aagccccaggcattattttcattcc

SEQ ID NO: 40589 - DNA, 25 bp, Rattus norvegicus
aagccccaggtaatcgtgcagtaaa

SEQ ID NO: 40590 - DNA, 25 bp, Rattus norvegicus
aagccccaggtattcgtgcagtaaa

SEQ ID NO: 40591 - DNA, 25 bp, Rattus norvegicus
aagccccaggttcacattagcctta

SEQ ID NO: 40592 - DNA, 25 bp, Rattus norvegicus
aagccccaggttgacattagcctta

SEQ ID NO: 40593 - DNA, 25 bp, Rattus norvegicus
aagccccatagaccgttgtcatctt

SEQ ID NO: 40594 - DNA, 25 bp, Rattus norvegicus
aagccccatagagcgttgtcatctt

SEQ ID NO: 40595 - DNA, 25 bp, Rattus norvegicus
aagccccatttgatctatattcctg

SEQ ID NO: 40596 - DNA, 25 bp, Rattus norvegicus
aagccccatttgttctatattcctg

SEQ ID NO: 40597 - DNA, 25 bp, Rattus norvegicus
aagccccgggtaagtagtgctcctt

SEQ ID NO: 40598 - DNA, 25 bp, Rattus norvegicus
aagccccgggtatgtagtgctcctt

SEQ ID NO: 40599 - DNA, 25 bp, Rattus norvegicus
aagccccgggtcaactgagccatcg

SEQ ID NO: 40600 - DNA, 25 bp, Rattus norvegicus
aagccccgggtctactgagccatcg

SEQ ID NO: 40601 - DNA, 25 bp, Rattus norvegicus
aagccccggtgcagtccagagtctt

SEQ ID NO: 40602 - DNA, 25 bp, Rattus norvegicus
aagccccggtgctgtccagagtctt

SEQ ID NO: 40603 - DNA, 25 bp, Rattus norvegicus
aagcccctcagtccagaatcgattc

SEQ ID NO: 40604 - DNA, 25 bp, Rattus norvegicus
aagcccctcagtgcagaatcgattc

SEQ ID NO: 40605 - DNA, 25 bp, Rattus norvegicus
aagcccctccatatcagcaaggaaa

SEQ ID NO: 40606 - DNA, 25 bp, Rattus norvegicus
aagcccctccatttcagcaaggaaa

SEQ ID NO: 40607 - DNA, 25 bp, Rattus norvegicus
aagcccctcgggaactctgtgagta

SEQ ID NO: 40608 - DNA, 25 bp, Rattus norvegicus
aagcccctcgggtactctgtgagta

SEQ ID NO: 40609 - DNA, 25 bp, Rattus norvegicus
aagcccctctctcaataagggtctt

SEQ ID NO: 40610 - DNA, 25 bp, Rattus norvegicus
aagcccctctctgaataagggtctt

SEQ ID NO: 40611 - DNA, 25 bp, Rattus norvegicus
aagcccctcttgatcatcaaaatct

SEQ ID NO: 40612 - DNA, 25 bp, Rattus norvegicus
aagcccctcttgttcatcaaaatct

SEQ ID NO: 40613 - DNA, 25 bp, Rattus norvegicus
aagcccctgaagctttcattccctg

SEQ ID NO: 40614 - DNA, 25 bp, Rattus norvegicus
aagcccctgaaggtttcattccctg

SEQ ID NO: 40615 - DNA, 25 bp, Rattus norvegicus
aagcccctgcggatgactgaaaaga

SEQ ID NO: 40616 - DNA, 25 bp, Rattus norvegicus
aagcccctgcggttgactgaaaaga

SEQ ID NO: 40617 - DNA, 25 bp, Rattus norvegicus
aagcccctggacagttgcacggcaa

SEQ ID NO: 40618 - DNA, 25 bp, Rattus norvegicus
aagcccctggactgttgcacggcaa

SEQ ID NO: 40619 - DNA, 25 bp, Rattus norvegicus
aagcccctggagacagcagtgattg

SEQ ID NO: 40620 - DNA, 25 bp, Rattus norvegicus
aagcccctggagtcagcagtgattg

SEQ ID NO: 40621 - DNA, 25 bp, Rattus norvegicus
aagccccttcaaagacgggtttctg

SEQ ID NO: 40622 - DNA, 25 bp, Rattus norvegicus
aagccccttcaatgacgggtttctg

SEQ ID NO: 40623 - DNA, 25 bp, Rattus norvegicus
aagcccgaactcattcattaatcat

SEQ ID NO: 40624 - DNA, 25 bp, Rattus norvegicus
aagcccgaactctttcattaatcat

SEQ ID NO: 40625 - DNA, 25 bp, Rattus norvegicus
aagcccgaagcacagtagagttttg

SEQ ID NO: 40626 - DNA, 25 bp, Rattus norvegicus
aagcccgaagcagagtagagttttg

SEQ ID NO: 40627 - DNA, 25 bp, Rattus norvegicus
aagcccgacctcaccaggagcagca

SEQ ID NO: 40628 - DNA, 25 bp, Rattus norvegicus
aagcccgacctctccaggagcagca

SEQ ID NO: 40629 - DNA, 25 bp, Rattus norvegicus
aagcccgagcgacaaggacaaaggt

SEQ ID NO: 40630 - DNA, 25 bp, Rattus norvegicus
aagcccgagcgagaaggacaaaggt

SEQ ID NO: 40631 - DNA, 25 bp, Rattus norvegicus
aagcccgagggaacagtggcatctc

SEQ ID NO: 40632 - DNA, 25 bp, Rattus norvegicus
aagcccgagggatcagtggcatctc

SEQ ID NO: 40633 - DNA, 25 bp, Rattus norvegicus
aagcccgaggtcacctctgatgaag

SEQ ID NO: 40634 - DNA, 25 bp, Rattus norvegicus
aagcccgaggtctcctctgatgaag

SEQ ID NO: 40635 - DNA, 25 bp, Rattus norvegicus
aagcccgagtgtccacgtgctcaga

SEQ ID NO: 40636 - DNA, 25 bp, Rattus norvegicus
aagcccgagtgtgcacgtgctcaga

SEQ ID NO: 40637 - DNA, 25 bp, Rattus norvegicus
aagcccgcatagagctggattctgt

SEQ ID NO: 40638 - DNA, 25 bp, Rattus norvegicus
aagcccgcatagtgctggattctgt

SEQ ID NO: 40639 - DNA, 25 bp, Rattus norvegicus
aagcccgccccaaactgtaaataca

SEQ ID NO: 40640 - DNA, 25 bp, Rattus norvegicus
aagcccgccccatactgtaaataca

SEQ ID NO: 40641 - DNA, 25 bp, Rattus norvegicus
aagcccgcctggagcagagcgagaa

SEQ ID NO: 40642 - DNA, 25 bp, Rattus norvegicus
aagcccgcctggtgcagagcgagaa

SEQ ID NO: 40643 - DNA, 25 bp, Rattus norvegicus
aagcccgcttagctatagagcccag

SEQ ID NO: 40644 - DNA, 25 bp, Rattus norvegicus
aagcccgcttaggtatagagcccag

SEQ ID NO: 40645 - DNA, 25 bp, Rattus norvegicus
aagcccgctttgcttcacctaatat

SEQ ID NO: 40646 - DNA, 25 bp, Rattus norvegicus
aagcccgctttggttcacctaatat

SEQ ID NO: 40647 - DNA, 25 bp, Rattus norvegicus
aagcccggacttctcattaaatcac

SEQ ID NO: 40648 - DNA, 25 bp, Rattus norvegicus
aagcccggacttgtcattaaatcac

SEQ ID NO: 40649 - DNA, 25 bp, Rattus norvegicus
aagcccgggctcctaactttgtatg

SEQ ID NO: 40650 - DNA, 25 bp, Rattus norvegicus
aagcccgggctcgtaactttgtatg

SEQ ID NO: 40651 - DNA, 25 bp, Rattus norvegicus
aagcccgggtcactgatttttatca

SEQ ID NO: 40652 - DNA, 25 bp, Rattus norvegicus
aagcccgggtcagtgatttttatca

SEQ ID NO: 40653 - DNA, 25 bp, Rattus norvegicus
aagcccgggttgacgcggctccatg

SEQ ID NO: 40654 - DNA, 25 bp, Rattus norvegicus
aagcccgggttgtcgcggctccatg

SEQ ID NO: 40655 - DNA, 25 bp, Rattus norvegicus
aagcccggtccccacttgagatgtc

SEQ ID NO: 40656 - DNA, 25 bp, Rattus norvegicus
aagcccggtcccgacttgagatgtc

SEQ ID NO: 40657 - DNA, 25 bp, Rattus norvegicus
aagcccggtggcatagcgcgactca

SEQ ID NO: 40658 - DNA, 25 bp, Rattus norvegicus
aagcccggtggcttagcgcgactca

SEQ ID NO: 40659 - DNA, 25 bp, Rattus norvegicus
aagcccgtaacgatatcctgtcata

SEQ ID NO: 40660 - DNA, 25 bp, Rattus norvegicus
aagcccgtaacgttatcctgtcata

SEQ ID NO: 40661 - DNA, 25 bp, Rattus norvegicus
aagcccgtcggaaataagattgtca

SEQ ID NO: 40662 - DNA, 25 bp, Rattus norvegicus
aagcccgtcggatataagattgtca

SEQ ID NO: 40663 - DNA, 25 bp, Rattus norvegicus
aagcccgtctccactaactttgaga

SEQ ID NO: 40664 - DNA, 25 bp, Rattus norvegicus
aagcccgtctcctctaactttgaga

SEQ ID NO: 40665 - DNA, 25 bp, Rattus norvegicus
aagcccgtctgactctttttgtata

SEQ ID NO: 40666 - DNA, 25 bp, Rattus norvegicus
aagcccgtctgagtctttttgtata

SEQ ID NO: 40667 - DNA, 25 bp, Rattus norvegicus
aagcccgtggcccaactttgaggca

SEQ ID NO: 40668 - DNA, 25 bp, Rattus norvegicus
aagcccgtggccgaactttgaggca

SEQ ID NO: 40669 - DNA, 25 bp, Rattus norvegicus
aagcccgttaaaccgtgcacagctg

SEQ ID NO: 40670 - DNA, 25 bp, Rattus norvegicus
aagcccgttaaagcgtgcacagctg

SEQ ID NO: 40671 - DNA, 25 bp, Rattus norvegicus
aagcccgttgttcgaccagaagaga

SEQ ID NO: 40672 - DNA, 25 bp, Rattus norvegicus
aagcccgttgttggaccagaagaga

SEQ ID NO: 40673 - DNA, 25 bp, Rattus norvegicus
aagccctaacagatctactatcttc

SEQ ID NO: 40674 - DNA, 25 bp, Rattus norvegicus
aagccctaacagttctactatcttc

SEQ ID NO: 40675 - DNA, 25 bp, Rattus norvegicus
aagccctaagagaacattcttctaa

SEQ ID NO: 40676 - DNA, 25 bp, Rattus norvegicus
aagccctaagagtacattcttctaa

SEQ ID NO: 40677 - DNA, 25 bp, Rattus norvegicus
aagccctaagccattcatttcataa

SEQ ID NO: 40678 - DNA, 25 bp, Rattus norvegicus
aagccctaagcctttcatttcataa

SEQ ID NO: 40679 - DNA, 25 bp, Rattus norvegicus
aagccctaatggaagtttagctcat

SEQ ID NO: 40680 - DNA, 25 bp, Rattus norvegicus
aagccctaatggtagtttagctcat

SEQ ID NO: 40681 - DNA, 25 bp, Rattus norvegicus
aagccctacaccagcgagtgtggca

SEQ ID NO: 40682 - DNA, 25 bp, Rattus norvegicus
aagccctacacctgcgagtgtggca

SEQ ID NO: 40683 - DNA, 25 bp, Rattus norvegicus
aagccctacatgacaccatggatgc

SEQ ID NO: 40684 - DNA, 25 bp, Rattus norvegicus
aagccctacatgtcaccatggatgc

SEQ ID NO: 40685 - DNA, 25 bp, Rattus norvegicus
aagccctacttcatactaacatttt

SEQ ID NO: 40686 - DNA, 25 bp, Rattus norvegicus
aagccctacttcttactaacatttt

SEQ ID NO: 40687 - DNA, 25 bp, Rattus norvegicus
aagccctagaaacctacgagatcat

SEQ ID NO: 40688 - DNA, 25 bp, Rattus norvegicus
aagccctagaaagctacgagatcat

SEQ ID NO: 40689 - DNA, 25 bp, Rattus norvegicus
aagccctagcttccgtgagagaatc

SEQ ID NO: 40690 - DNA, 25 bp, Rattus norvegicus
aagccctagcttgcgtgagagaatc

SEQ ID NO: 40691 - DNA, 25 bp, Rattus norvegicus
aagccctaggatcgcagcatgctac

SEQ ID NO: 40692 - DNA, 25 bp, Rattus norvegicus
aagccctaggatggcagcatgctac

SEQ ID NO: 40693 - DNA, 25 bp, Rattus norvegicus
aagccctagggcagctactgtgaat

SEQ ID NO: 40694 - DNA, 25 bp, Rattus norvegicus
aagccctagggctgctactgtgaat

SEQ ID NO: 40695 - DNA, 25 bp, Rattus norvegicus
aagccctataaaagcgatgtgtgtg

SEQ ID NO: 40696 - DNA, 25 bp, Rattus norvegicus
aagccctataaatgcgatgtgtgtg

SEQ ID NO: 40697 - DNA, 25 bp, Rattus norvegicus
aagccctatgggaactctctctgaa

SEQ ID NO: 40698 - DNA, 25 bp, Rattus norvegicus
aagccctatgggtactctctctgaa

SEQ ID NO: 40699 - DNA, 25 bp, Rattus norvegicus
aagccctatgtcaggcacagtgccc

SEQ ID NO: 40700 - DNA, 25 bp, Rattus norvegicus
aagccctatgtctggcacagtgccc

SEQ ID NO: 40701 - DNA, 25 bp, Rattus norvegicus
aagccctcaagacaactgcgtagtt

SEQ ID NO: 40702 - DNA, 25 bp, Rattus norvegicus
aagccctcaagagaactgcgtagtt

SEQ ID NO: 40703 - DNA, 25 bp, Rattus norvegicus
aagccctcaattattccagccatac

SEQ ID NO: 40704 - DNA, 25 bp, Rattus norvegicus
aagccctcaatttttccagccatac

SEQ ID NO: 40705 - DNA, 25 bp, Rattus norvegicus
aagccctcacctaaagatccatatg

SEQ ID NO: 40706 - DNA, 25 bp, Rattus norvegicus
aagccctcaccttaagatccatatg

SEQ ID NO: 40707 - DNA, 25 bp, Rattus norvegicus
aagccctcagaacggcagcgtctga

SEQ ID NO: 40708 - DNA, 25 bp, Rattus norvegicus
aagccctcagaagggcagcgtctga

SEQ ID NO: 40709 - DNA, 25 bp, Rattus norvegicus
aagccctcagacacccttggattga

SEQ ID NO: 40710 - DNA, 25 bp, Rattus norvegicus
aagccctcagactcccttggattga

SEQ ID NO: 40711 - DNA, 25 bp, Rattus norvegicus
aagccctcagatcagctgcatcttt

SEQ ID NO: 40712 - DNA, 25 bp, Rattus norvegicus
aagccctcagatgagctgcatcttt

SEQ ID NO: 40713 - DNA, 25 bp, Rattus norvegicus
aagccctcattcaggcgggagctaa

SEQ ID NO: 40714 - DNA, 25 bp, Rattus norvegicus
aagccctcattctggcgggagctaa

SEQ ID NO: 40715 - DNA, 25 bp, Rattus norvegicus
aagccctccaacatgcatgcagaag

SEQ ID NO: 40716 - DNA, 25 bp, Rattus norvegicus
aagccctccaacttgcatgcagaag

SEQ ID NO: 40717 - DNA, 25 bp, Rattus norvegicus
aagccctccagtactaggactcaaa

SEQ ID NO: 40718 - DNA, 25 bp, Rattus norvegicus
aagccctccagttctaggactcaaa

SEQ ID NO: 40719 - DNA, 25 bp, Rattus norvegicus
aagccctccatgcaaaggagctcaa

SEQ ID NO: 40720 - DNA, 25 bp, Rattus norvegicus
aagccctccatggaaaggagctcaa

SEQ ID NO: 40721 - DNA, 25 bp, Rattus norvegicus
aagccctcctccctggtgaggagga

SEQ ID NO: 40722 - DNA, 25 bp, Rattus norvegicus
aagccctcctccgtggtgaggagga

SEQ ID NO: 40723 - DNA, 25 bp, Rattus norvegicus
aagccctcgcttcatgatgcagata

SEQ ID NO: 40724 - DNA, 25 bp, Rattus norvegicus
aagccctcgcttgatgatgcagata

SEQ ID NO: 40725 - DNA, 25 bp, Rattus norvegicus
aagccctctattacctttgaattct

SEQ ID NO: 40726 - DNA, 25 bp, Rattus norvegicus
aagccctctatttcctttgaattct

SEQ ID NO: 40727 - DNA, 25 bp, Rattus norvegicus
aagccctcttccagctagtggcaaa

SEQ ID NO: 40728 - DNA, 25 bp, Rattus norvegicus
aagccctcttcctgctagtggcaaa

SEQ ID NO: 40729 - DNA, 25 bp, Rattus norvegicus
aagccctcttgtcttgtgttgcaac

SEQ ID NO: 40730 - DNA, 25 bp, Rattus norvegicus
aagccctcttgtgttgtgttgcaac

SEQ ID NO: 40731 - DNA, 25 bp, Rattus norvegicus
aagccctctttgatcaggagatagg

SEQ ID NO: 40732 - DNA, 25 bp, Rattus norvegicus
aagccctctttgttcaggagatagg

SEQ ID NO: 40733 - DNA, 25 bp, Rattus norvegicus
aagccctgaagcatgatttcctggg

SEQ ID NO: 40734 - DNA, 25 bp, Rattus norvegicus
aagccctgaagcttgatttcctggg

SEQ ID NO: 40735 - DNA, 25 bp, Rattus norvegicus
aagccctgacctcggcactagggaa

SEQ ID NO: 40736 - DNA, 25 bp, Rattus norvegicus
aagccctgacctgggcactagggaa

SEQ ID NO: 40737 - DNA, 25 bp, Rattus norvegicus
aagccctgactacattccatcactt

SEQ ID NO: 40738 - DNA, 25 bp, Rattus norvegicus
aagccctgactagattccatcactt

SEQ ID NO: 40739 - DNA, 25 bp, Rattus norvegicus
aagccctgactcaggctgggaatgt

SEQ ID NO: 40740 - DNA, 25 bp, Rattus norvegicus
aagccctgactctggctgggaatgt

SEQ ID NO: 40741 - DNA, 25 bp, Rattus norvegicus
aagccctgagacaggtgccctagag

SEQ ID NO: 40742 - DNA, 25 bp, Rattus norvegicus
aagccctgagactggtgccctagag

SEQ ID NO: 40743 - DNA, 25 bp, Rattus norvegicus
aagccctgatccatacggaaacatc

SEQ ID NO: 40744 - DNA, 25 bp, Rattus norvegicus
aagccctgatccttacggaaacatc

SEQ ID NO: 40745 - DNA, 25 bp, Rattus norvegicus
aagccctgatgaccagagttcaaca

SEQ ID NO: 40746 - DNA, 25 bp, Rattus norvegicus
aagccctgatgagcagagttcaaca

SEQ ID NO: 40747 - DNA, 25 bp, Rattus norvegicus
aagccctgcatgagaatccttcaga

SEQ ID NO: 40748 - DNA, 25 bp, Rattus norvegicus
aagccctgcatgtgaatccttcaga

SEQ ID NO: 40749 - DNA, 25 bp, Rattus norvegicus
aagccctgccctcccaaatgtgaaa

SEQ ID NO: 40750 - DNA, 25 bp, Rattus norvegicus
aagccctgccctgccaaatgtgaaa

SEQ ID NO: 40751 - DNA, 25 bp, Rattus norvegicus
aagccctgccttctgggaattaccg

SEQ ID NO: 40752 - DNA, 25 bp, Rattus norvegicus
aagccctgccttgtgggaattaccg

SEQ ID NO: 40753 - DNA, 25 bp, Rattus norvegicus
aagccctgcgctctcattgtcagat

SEQ ID NO: 40754 - DNA, 25 bp, Rattus norvegicus
aagccctgcgctgtcattgtcagat

SEQ ID NO: 40755 - DNA, 25 bp, Rattus norvegicus
aagccctgctctcacagaagatcgt

SEQ ID NO: 40756 - DNA, 25 bp, Rattus norvegicus
aagccctgctctgacagaagatcgt

SEQ ID NO: 40757 - DNA, 25 bp, Rattus norvegicus
aagccctgctggaacagctccagca

SEQ ID NO: 40758 - DNA, 25 bp, Rattus norvegicus
aagccctgctggtacagctccagca

SEQ ID NO: 40759 - DNA, 25 bp, Rattus norvegicus
aagccctgcttcagtgacctaactt

SEQ ID NO: 40760 - DNA, 25 bp, Rattus norvegicus
aagccctgcttctgtgacctaactt

SEQ ID NO: 40761 - DNA, 25 bp, Rattus norvegicus
aagccctggaagactgcggaagcac

SEQ ID NO: 40762 - DNA, 25 bp, Rattus norvegicus
aagccctggaagtctgcggaagcac

SEQ ID NO: 40763 - DNA, 25 bp, Rattus norvegicus
aagccctggaccaattgtaccttat

SEQ ID NO: 40764 - DNA, 25 bp, Rattus norvegicus
aagccctggacctattgtaccttat

SEQ ID NO: 40765 - DNA, 25 bp, Rattus norvegicus
aagccctggagtagtttcctctaga

SEQ ID NO: 40766 - DNA, 25 bp, Rattus norvegicus
aagccctggagttgtttcctctaga

SEQ ID NO: 40767 - DNA, 25 bp, Rattus norvegicus
aagccctgggacagttgatctccaa

SEQ ID NO: 40768 - DNA, 25 bp, Rattus norvegicus
aagccctgggactgttgatctccaa

SEQ ID NO: 40769 - DNA, 25 bp, Rattus norvegicus
aagccctgggcaaagcaaccgtgaa

SEQ ID NO: 40770 - DNA, 25 bp, Rattus norvegicus
aagccctgggcaccgggtcatctgt

SEQ ID NO: 40771 - DNA, 25 bp, Rattus norvegicus
aagccctgggcagcgggtcatctgt

SEQ ID NO: 40772 - DNA, 25 bp, Rattus norvegicus
aagccctgggcatagcaaccgtgaa

SEQ ID NO: 40773 - DNA, 25 bp, Rattus norvegicus
aagccctgggtgctccttcaatgaa

SEQ ID NO: 40774 - DNA, 25 bp, Rattus norvegicus
aagccctgggtggtccttcaatgaa

SEQ ID NO: 40775 - DNA, 25 bp, Rattus norvegicus
aagccctgtgggactaagcgtctac

SEQ ID NO: 40776 - DNA, 25 bp, Rattus norvegicus
aagccctgtgggtctaagcgtctac

SEQ ID NO: 40777 - DNA, 25 bp, Rattus norvegicus
aagccctgtgtcaatgtgcactgtt

SEQ ID NO: 40778 - DNA, 25 bp, Rattus norvegicus
aagccctgtgtctatgtgcactgtt

SEQ ID NO: 40779 - DNA, 25 bp, Rattus norvegicus
aagccctgtttgattgcacatcata

SEQ ID NO: 40780 - DNA, 25 bp, Rattus norvegicus
aagccctgtttgtttgcacatcata

SEQ ID NO: 40781 - DNA, 25 bp, Rattus norvegicus
aagccctgttttctcctgtctggag

SEQ ID NO: 40782 - DNA, 25 bp, Rattus norvegicus
aagccctgttttgtcctgtctggag

SEQ ID NO: 40783 - DNA, 25 bp, Rattus norvegicus
aagcccttaagaattgctcctataa

SEQ ID NO: 40784 - DNA, 25 bp, Rattus norvegicus
aagcccttaagatttgctcctataa

SEQ ID NO: 40785 - DNA, 25 bp, Rattus norvegicus
aagcccttagctagtgttgtcaaat

SEQ ID NO: 40786 - DNA, 25 bp, Rattus norvegicus
aagcccttagctcctttgatgacag

SEQ ID NO: 40787 - DNA, 25 bp, Rattus norvegicus
aagcccttagctgctttgatgacag

SEQ ID NO: 40788 - DNA, 25 bp, Rattus norvegicus
aagcccttagcttgtgttgtcaaat

SEQ ID NO: 40789 - DNA, 25 bp, Rattus norvegicus
aagcccttcaagaacaccacagtta

SEQ ID NO: 40790 - DNA, 25 bp, Rattus norvegicus
aagcccttcaagatctgcacagatt

SEQ ID NO: 40791 - DNA, 25 bp, Rattus norvegicus
aagcccttcaagtacaccacagtta

SEQ ID NO: 40792 - DNA, 25 bp, Rattus norvegicus
aagcccttcaagttctgcacagatt

SEQ ID NO: 40793 - DNA, 25 bp, Rattus norvegicus
aagcccttcaccaagctttagtgac

SEQ ID NO: 40794 - DNA, 25 bp, Rattus norvegicus
aagcccttcacctagctttagtgac

SEQ ID NO: 40795 - DNA, 25 bp, Rattus norvegicus
aagcccttccgaccagaatgaatgc

SEQ ID NO: 40796 - DNA, 25 bp, Rattus norvegicus
aagcccttccgagcagaatgaatgc

SEQ ID NO: 40797 - DNA, 25 bp, Rattus norvegicus
aagcccttctaacctcggcctgaga

SEQ ID NO: 40798 - DNA, 25 bp, Rattus norvegicus
aagcccttctaagctcggcctgaga

SEQ ID NO: 40799 - DNA, 25 bp, Rattus norvegicus
aagcccttctccatactgaacttat

SEQ ID NO: 40800 - DNA, 25 bp, Rattus norvegicus
aagcccttctccttactgaacttat

SEQ ID NO: 40801 - DNA, 25 bp, Rattus norvegicus
aagcccttctgtaaatgtccctaag

SEQ ID NO: 40802 - DNA, 25 bp, Rattus norvegicus
aagcccttctgttaatgtccctaag

SEQ ID NO: 40803 - DNA, 25 bp, Rattus norvegicus
aagcccttctttacatggtggtagc

SEQ ID NO: 40804 - DNA, 25 bp, Rattus norvegicus
aagcccttctttctatctgattttg

SEQ ID NO: 40805 - DNA, 25 bp, Rattus norvegicus
aagcccttctttgtatctgattttg

SEQ ID NO: 40806 - DNA, 25 bp, Rattus norvegicus
aagcccttcttttcatggtggtagc

SEQ ID NO: 40807 - DNA, 25 bp, Rattus norvegicus
aagcccttgcttctataggcctaaa

SEQ ID NO: 40808 - DNA, 25 bp, Rattus norvegicus
aagcccttgcttgtataggcctaaa

SEQ ID NO: 40809 - DNA, 25 bp, Rattus norvegicus
aagcccttggcgctgtaagttacaa

SEQ ID NO: 40810 - DNA, 25 bp, Rattus norvegicus
aagcccttggcggtgtaagttacaa

SEQ ID NO: 40811 - DNA, 25 bp, Rattus norvegicus
aagcccttgtgtcttgagaggtcca

SEQ ID NO: 40812 - DNA, 25 bp, Rattus norvegicus
aagcccttgtgtgttgagaggtcca

SEQ ID NO: 40813 - DNA, 25 bp, Rattus norvegicus
aagcccttgttccagcctttgaaat

SEQ ID NO: 40814 - DNA, 25 bp, Rattus norvegicus
aagcccttgttcgagcctttgaaat

SEQ ID NO: 40815 - DNA, 25 bp, Rattus norvegicus
aagcccttgtttaatagattccctg

SEQ ID NO: 40816 - DNA, 25 bp, Rattus norvegicus
aagcccttgttttatagattccctg

SEQ ID NO: 40817 - DNA, 25 bp, Rattus norvegicus
aagccctttactacagagcattgcc

SEQ ID NO: 40818 - DNA, 25 bp, Rattus norvegicus
aagccctttacttcagagcattgcc

SEQ ID NO: 40819 - DNA, 25 bp, Rattus norvegicus
aagccctttgaaagtgacaggtgtg

SEQ ID NO: 40820 - DNA, 25 bp, Rattus norvegicus
aagccctttgaatgtgacaggtgtg

SEQ ID NO: 40821 - DNA, 25 bp, Rattus norvegicus
aagccctttgagaaacagaccgcac

SEQ ID NO: 40822 - DNA, 25 bp, Rattus norvegicus
aagccctttgagtaacagaccgcac

SEQ ID NO: 40823 - DNA, 25 bp, Rattus norvegicus
aagccctttgatctgtgtttctaaa

SEQ ID NO: 40824 - DNA, 25 bp, Rattus norvegicus
aagccctttgatgtgtgtttctaaa

SEQ ID NO: 40825 - DNA, 25 bp, Rattus norvegicus
aagccctttggaacattaaatgctc

SEQ ID NO: 40826 - DNA, 25 bp, Rattus norvegicus
aagccctttggatcattaaatgctc

SEQ ID NO: 40827 - DNA, 25 bp, Rattus norvegicus
aagcccttttagctccagatacctt

SEQ ID NO: 40828 - DNA, 25 bp, Rattus norvegicus
aagcccttttaggtccagatacctt

SEQ ID NO: 40829 - DNA, 25 bp, Rattus norvegicus
aagcccttttgcagactctcaatga

SEQ ID NO: 40830 - DNA, 25 bp, Rattus norvegicus
aagcccttttgctgactctcaatga

SEQ ID NO: 40831 - DNA, 25 bp, Rattus norvegicus
aagccgaaactgagcggaaaccgct

SEQ ID NO: 40832 - DNA, 25 bp, Rattus norvegicus
aagccgaaactgtgcggaaaccgct

SEQ ID NO: 40833 - DNA, 25 bp, Rattus norvegicus
aagccgaactgaacatatccgaact

SEQ ID NO: 40834 - DNA, 25 bp, Rattus norvegicus
aagccgaactgatcatatccgaact

SEQ ID NO: 40835 - DNA, 25 bp, Rattus norvegicus
aagccgaatgttagctattgtttgg

SEQ ID NO: 40836 - DNA, 25 bp, Rattus norvegicus
aagccgaatgtttgctattgtttgg

SEQ ID NO: 40837 - DNA, 25 bp, Rattus norvegicus
aagccgaccactacaaggttgcggt

SEQ ID NO: 40838 - DNA, 25 bp, Rattus norvegicus
aagccgaccacttcaaggttgcggt

SEQ ID NO: 40839 - DNA, 25 bp, Rattus norvegicus
aagccgacctcgagaaggcgctgct

SEQ ID NO: 40840 - DNA, 25 bp, Rattus norvegicus
aagccgacctcgtgaaggcgctgct

SEQ ID NO: 40841 - DNA, 25 bp, Rattus norvegicus
aagccgacctttccttcttgaagat

SEQ ID NO: 40842 - DNA, 25 bp, Rattus norvegicus
aagccgacctttgcttcttgaagat

SEQ ID NO: 40843 - DNA, 25 bp, Rattus norvegicus
aagccgacgaggagcatccagacca

SEQ ID NO: 40844 - DNA, 25 bp, Rattus norvegicus
aagccgacgaggtgcatccagacca

SEQ ID NO: 40845 - DNA, 25 bp, Rattus norvegicus
aagccgacggtgcagctgcaccaag

SEQ ID NO: 40846 - DNA, 25 bp, Rattus norvegicus
aagccgacggtggagctgcaccaag

SEQ ID NO: 40847 - DNA, 25 bp, Rattus norvegicus
aagccgactccgagagaagctgacc

SEQ ID NO: 40848 - DNA, 25 bp, Rattus norvegicus
aagccgactccgtgagaagctgacc

SEQ ID NO: 40849 - DNA, 25 bp, Rattus norvegicus
aagccgactgcgctgagttccagcc

SEQ ID NO: 40850 - DNA, 25 bp, Rattus norvegicus
aagccgactgcggtgagttccagcc

SEQ ID NO: 40851 - DNA, 25 bp, Rattus norvegicus
aagccgactgtccattgggcagatg

SEQ ID NO: 40852 - DNA, 25 bp, Rattus norvegicus
aagccgactgtcgattgggcagatg

SEQ ID NO: 40853 - DNA, 25 bp, Rattus norvegicus
aagccgagaggtacttaagttccag

SEQ ID NO: 40854 - DNA, 25 bp, Rattus norvegicus
aagccgagaggttcttaagttccag

SEQ ID NO: 40855 - DNA, 25 bp, Rattus norvegicus
aagccgagatctccagctaactgct

SEQ ID NO: 40856 - DNA, 25 bp, Rattus norvegicus
aagccgagatctgcagctaactgct

SEQ ID NO: 40857 - DNA, 25 bp, Rattus norvegicus
aagccgagccgcagcgcttggtagc

SEQ ID NO: 40858 - DNA, 25 bp, Rattus norvegicus
aagccgagccgctgcgcttggtagc

SEQ ID NO: 40859 - DNA, 25 bp, Rattus norvegicus
aagccgagcggtagatggaagttga

SEQ ID NO: 40860 - DNA, 25 bp, Rattus norvegicus
aagccgagcggttgatggaagttga

SEQ ID NO: 40861 - DNA, 25 bp, Rattus norvegicus
aagccgagctagattgaggtactgt

SEQ ID NO: 40862 - DNA, 25 bp, Rattus norvegicus
aagccgagctagtttgaggtactgt

SEQ ID NO: 40863 - DNA, 25 bp, Rattus norvegicus
aagccgaggatcctttggcatgcaa

SEQ ID NO: 40864 - DNA, 25 bp, Rattus norvegicus
aagccgaggatcgtttggcatgcaa

SEQ ID NO: 40865 - DNA, 25 bp, Rattus norvegicus
aagccgaggcagattaccggcgctt

SEQ ID NO: 40866 - DNA, 25 bp, Rattus norvegicus
aagccgaggcagtttaccggcgctt

SEQ ID NO: 40867 - DNA, 25 bp, Rattus norvegicus
aagccgaggccaaccaggaggagat

SEQ ID NO: 40868 - DNA, 25 bp, Rattus norvegicus
aagccgaggccacatctcttactta

SEQ ID NO: 40869 - DNA, 25 bp, Rattus norvegicus
aagccgaggccagatctcttactta

SEQ ID NO: 40870 - DNA, 25 bp, Rattus norvegicus
aagccgaggccatccaggaggagat

SEQ ID NO: 40871 - DNA, 25 bp, Rattus norvegicus
aagccgaggcctataatccgacagt

SEQ ID NO: 40872 - DNA, 25 bp, Rattus norvegicus
aagccgaggcctttaatccgacagt

SEQ ID NO: 40873 - DNA, 25 bp, Rattus norvegicus
aagccgaggcttatagtcatttatc

SEQ ID NO: 40874 - DNA, 25 bp, Rattus norvegicus
aagccgaggcttccagcagcaatgg

SEQ ID NO: 40875 - DNA, 25 bp, Rattus norvegicus
aagccgaggcttgcagcagcaatgg

SEQ ID NO: 40876 - DNA, 25 bp, Rattus norvegicus
aagccgaggcttttagtcatttatc

SEQ ID NO: 40877 - DNA, 25 bp, Rattus norvegicus
aagccgagggacacctagatgtgtt

SEQ ID NO: 40878 - DNA, 25 bp, Rattus norvegicus
aagccgagggactcctagatgtgtt

SEQ ID NO: 40879 - DNA, 25 bp, Rattus norvegicus
aagccgaggtctaagtgctctggat

SEQ ID NO: 40880 - DNA, 25 bp, Rattus norvegicus
aagccgaggtcttagtgctctggat

SEQ ID NO: 40881 - DNA, 25 bp, Rattus norvegicus
aagccgagtactccatcgcgagaat

SEQ ID NO: 40882 - DNA, 25 bp, Rattus norvegicus
aagccgagtactgcatcgcgagaat

SEQ ID NO: 40883 - DNA, 25 bp, Rattus norvegicus
aagccgagtctgagttggcgcagca

SEQ ID NO: 40884 - DNA, 25 bp, Rattus norvegicus
aagccgagtctgtgttggcgcagca

SEQ ID NO: 40885 - DNA, 25 bp, Rattus norvegicus
aagccgagtgacctaccgagggatt

SEQ ID NO: 40886 - DNA, 25 bp, Rattus norvegicus
aagccgagtgacgtaccgagggatt

SEQ ID NO: 40887 - DNA, 25 bp, Rattus norvegicus
aagccgagtgtcaggtggaatccta

SEQ ID NO: 40888 - DNA, 25 bp, Rattus norvegicus
aagccgagtgtctggtggaatccta

SEQ ID NO: 40889 - DNA, 25 bp, Rattus norvegicus
aagccgatagcaccagcctggcaga

SEQ ID NO: 40890 - DNA, 25 bp, Rattus norvegicus
aagccgatagcagcagcctggcaga

SEQ ID NO: 40891 - DNA, 25 bp, Rattus norvegicus
aagccgatcaggacctgctttttga

SEQ ID NO: 40892 - DNA, 25 bp, Rattus norvegicus
aagccgatcaggtcctgctttttga

SEQ ID NO: 40893 - DNA, 25 bp, Rattus norvegicus
aagccgatgcttagtccagatgaca

SEQ ID NO: 40894 - DNA, 25 bp, Rattus norvegicus
aagccgatgctttgtccagatgaca

SEQ ID NO: 40895 - DNA, 25 bp, Rattus norvegicus
aagccgcataataccgagttaactg

SEQ ID NO: 40896 - DNA, 25 bp, Rattus norvegicus
aagccgcataattccgagttaactg

SEQ ID NO: 40897 - DNA, 25 bp, Rattus norvegicus
aagccgcatctcatagtgacactga

SEQ ID NO: 40898 - DNA, 25 bp, Rattus norvegicus
aagccgcatctcttagtgacactga

SEQ ID NO: 40899 - DNA, 25 bp, Rattus norvegicus
aagccgccaagcagggcaacgtgaa

SEQ ID NO: 40900 - DNA, 25 bp, Rattus norvegicus
aagccgccaagctgggcaacgtgaa

SEQ ID NO: 40901 - DNA, 25 bp, Rattus norvegicus
aagccgccacggatacaacttgaag

SEQ ID NO: 40902 - DNA, 25 bp, Rattus norvegicus
aagccgccacggttacaacttgaag

SEQ ID NO: 40903 - DNA, 25 bp, Rattus norvegicus
aagccgccatcacctgattttcaaa

SEQ ID NO: 40904 - DNA, 25 bp, Rattus norvegicus
aagccgccatcagctgattttcaaa

SEQ ID NO: 40905 - DNA, 25 bp, Rattus norvegicus
aagccgccgatgaacgtcagtccaa

SEQ ID NO: 40906 - DNA, 25 bp, Rattus norvegicus
aagccgccgatgtacgtcagtccaa

SEQ ID NO: 40907 - DNA, 25 bp, Rattus norvegicus
aagccgccggttcgaagcaccaagt

SEQ ID NO: 40908 - DNA, 25 bp, Rattus norvegicus
aagccgccggttggaagcaccaagt

SEQ ID NO: 40909 - DNA, 25 bp, Rattus norvegicus
aagccgccttctcagtttatttaag

SEQ ID NO: 40910 - DNA, 25 bp, Rattus norvegicus
aagccgccttctgagtttatttaag

SEQ ID NO: 40911 - DNA, 25 bp, Rattus norvegicus
aagccgcgccttaaagattccacat

SEQ ID NO: 40912 - DNA, 25 bp, Rattus norvegicus
aagccgcgcctttaagattccacat

SEQ ID NO: 40913 - DNA, 25 bp, Rattus norvegicus
aagccgctgtccagccagtggataa

SEQ ID NO: 40914 - DNA, 25 bp, Rattus norvegicus
aagccgctgtcctgccagtggataa

SEQ ID NO: 40915 - DNA, 25 bp, Rattus norvegicus
aagccgctgtcgaataggtcgtgct

SEQ ID NO: 40916 - DNA, 25 bp, Rattus norvegicus
aagccgctgtcgtataggtcgtgct

SEQ ID NO: 40917 - DNA, 25 bp, Rattus norvegicus
aagccgctgtctctttggactttaa

SEQ ID NO: 40918 - DNA, 25 bp, Rattus norvegicus
aagccgctgtctgtttggactttaa

SEQ ID NO: 40919 - DNA, 25 bp, Rattus norvegicus
aagccggaacgtcgagtcacctcag

SEQ ID NO: 40920 - DNA, 25 bp, Rattus norvegicus
aagccggaacgtggagtcacctcag

SEQ ID NO: 40921 - DNA, 25 bp, Rattus norvegicus
aagccggaactgatctgcacactgt

SEQ ID NO: 40922 - DNA, 25 bp, Rattus norvegicus
aagccggaactgttctgcacactgt

SEQ ID NO: 40923 - DNA, 25 bp, Rattus norvegicus
aagccggaatccatttttgtcacag

SEQ ID NO: 40924 - DNA, 25 bp, Rattus norvegicus
aagccggaatccttttttgtcacag

SEQ ID NO: 40925 - DNA, 25 bp, Rattus norvegicus
aagccggacctcattcagctgagaa

SEQ ID NO: 40926 - DNA, 25 bp, Rattus norvegicus
aagccggacctctttcagctgagaa

SEQ ID NO: 40927 - DNA, 25 bp, Rattus norvegicus
aagccggatattaaacattgtgggt

SEQ ID NO: 40928 - DNA, 25 bp, Rattus norvegicus
aagccggatatttaacattgtgggt

SEQ ID NO: 40929 - DNA, 25 bp, Rattus norvegicus
aagccggatgtcccacctctctgag

SEQ ID NO: 40930 - DNA, 25 bp, Rattus norvegicus
aagccggatgtcgcacctctctgag

SEQ ID NO: 40931 - DNA, 25 bp, Rattus norvegicus
aagccggcaggacaaaacacacagt

SEQ ID NO: 40932 - DNA, 25 bp, Rattus norvegicus
aagccggcaggagaaaacacacagt

SEQ ID NO: 40933 - DNA, 25 bp, Rattus norvegicus
aagccggcattaattgtcaggacaa

SEQ ID NO: 40934 - DNA, 25 bp, Rattus norvegicus
aagccggcattatttgtcaggacaa

SEQ ID NO: 40935 - DNA, 25 bp, Rattus norvegicus
aagccggccaacacatcaagacttt

SEQ ID NO: 40936 - DNA, 25 bp, Rattus norvegicus
aagccggccaactcatcaagacttt

SEQ ID NO: 40937 - DNA, 25 bp, Rattus norvegicus
aagccggcctcaagctcatagcgag

SEQ ID NO: 40938 - DNA, 25 bp, Rattus norvegicus
aagccggcctcatgctcatagcgag

SEQ ID NO: 40939 - DNA, 25 bp, Rattus norvegicus
aagccggcgcaaagaagcggcagaa

SEQ ID NO: 40940 - DNA, 25 bp, Rattus norvegicus
aagccggcgcaatgaagcggcagaa

SEQ ID NO: 40941 - DNA, 25 bp, Rattus norvegicus
aagccggctacgaccatcaggtggt

SEQ ID NO: 40942 - DNA, 25 bp, Rattus norvegicus
aagccggctacgtccatcaggtggt

SEQ ID NO: 40943 - DNA, 25 bp, Rattus norvegicus
aagccggcttacaagagacggacat

SEQ ID NO: 40944 - DNA, 25 bp, Rattus norvegicus
aagccggcttactagagacggacat

SEQ ID NO: 40945 - DNA, 25 bp, Rattus norvegicus
aagccggcttcgagagtcgtatcta

SEQ ID NO: 40946 - DNA, 25 bp, Rattus norvegicus
aagccggcttcgtgagtcgtatcta

SEQ ID NO: 40947 - DNA, 25 bp, Rattus norvegicus
aagccgggaaaacacttcagccgca

SEQ ID NO: 40948 - DNA, 25 bp, Rattus norvegicus
aagccgggaaaagacttcagccgca

SEQ ID NO: 40949 - DNA, 25 bp, Rattus norvegicus
aagccgggccatctcaggaagccaa

SEQ ID NO: 40950 - DNA, 25 bp, Rattus norvegicus
aagccgggccatgtcaggaagccaa

SEQ ID NO: 40951 - DNA, 25 bp, Rattus norvegicus
aagccgggcttgcacctctggaaaa

SEQ ID NO: 40952 - DNA, 25 bp, Rattus norvegicus
aagccgggcttggacctctggaaaa

SEQ ID NO: 40953 - DNA, 25 bp, Rattus norvegicus
aagccgggggctagtactctcctgc

SEQ ID NO: 40954 - DNA, 25 bp, Rattus norvegicus
aagccgggggcttgtactctcctgc

SEQ ID NO: 40955 - DNA, 25 bp, Rattus norvegicus
aagccgggtattcctgtaattctag

SEQ ID NO: 40956 - DNA, 25 bp, Rattus norvegicus
aagccgggtattgctgtaattctag

SEQ ID NO: 40957 - DNA, 25 bp, Rattus norvegicus
aagccgggtcgaaaatgctggcact

SEQ ID NO: 40958 - DNA, 25 bp, Rattus norvegicus
aagccgggtcgataatgctggcact

SEQ ID NO: 40959 - DNA, 25 bp, Rattus norvegicus
aagccgggtgatcttggcacacgcc

SEQ ID NO: 40960 - DNA, 25 bp, Rattus norvegicus
aagccgggtgatgttggcacacgcc

SEQ ID NO: 40961 - DNA, 25 bp, Rattus norvegicus
aagccggtaaggacggagagctccg

SEQ ID NO: 40962 - DNA, 25 bp, Rattus norvegicus
aagccggtaaggtcggagagctccg

SEQ ID NO: 40963 - DNA, 25 bp, Rattus norvegicus
aagccggtcaagcaggcggtcacac

SEQ ID NO: 40964 - DNA, 25 bp, Rattus norvegicus
aagccggtcaaggaggcggtcacac

SEQ ID NO: 40965 - DNA, 25 bp, Rattus norvegicus
aagccggtcacccagttggtgtgct

SEQ ID NO: 40966 - DNA, 25 bp, Rattus norvegicus
aagccggtcaccgagttggtgtgct

SEQ ID NO: 40967 - DNA, 25 bp, Rattus norvegicus
aagccggtcggcaaaggcgcgacgg

SEQ ID NO: 40968 - DNA, 25 bp, Rattus norvegicus
aagccggtcggctaaggcgcgacgg

SEQ ID NO: 40969 - DNA, 25 bp, Rattus norvegicus
aagccggtctagacttgtgttgttc

SEQ ID NO: 40970 - DNA, 25 bp, Rattus norvegicus
aagccggtctagtcttgtgttgttc

SEQ ID NO: 40971 - DNA, 25 bp, Rattus norvegicus
aagccggtcttgcatggttgcctgt

SEQ ID NO: 40972 - DNA, 25 bp, Rattus norvegicus
aagccggtcttggatggttgcctgt

SEQ ID NO: 40973 - DNA, 25 bp, Rattus norvegicus
aagccggtgcgcagctgaaaacgat

SEQ ID NO: 40974 - DNA, 25 bp, Rattus norvegicus
aagccggtgcgctgctgaaaacgat

SEQ ID NO: 40975 - DNA, 25 bp, Rattus norvegicus
aagccggtgcttagggaagatctcc

SEQ ID NO: 40976 - DNA, 25 bp, Rattus norvegicus
aagccggtgctttgggaagatctcc

SEQ ID NO: 40977 - DNA, 25 bp, Rattus norvegicus
aagccggtgggaactgaatgacgtc

SEQ ID NO: 40978 - DNA, 25 bp, Rattus norvegicus
aagccggtgggatctgaatgacgtc

SEQ ID NO: 40979 - DNA, 25 bp, Rattus norvegicus
aagccgtaaccaagctgagggatta

SEQ ID NO: 40980 - DNA, 25 bp, Rattus norvegicus
aagccgtaaccatgctgagggatta

SEQ ID NO: 40981 - DNA, 25 bp, Rattus norvegicus
aagccgtaagttcttttctctgtga

SEQ ID NO: 40982 - DNA, 25 bp, Rattus norvegicus
aagccgtaagttgttttctctgtga

SEQ ID NO: 40983 - DNA, 25 bp, Rattus norvegicus
aagccgtacagtagcgatgcgtgcg

SEQ ID NO: 40984 - DNA, 25 bp, Rattus norvegicus
aagccgtacagttgcgatgcgtgcg

SEQ ID NO: 40985 - DNA, 25 bp, Rattus norvegicus
aagccgtcaaagcaggtgcacctgt

SEQ ID NO: 40986 - DNA, 25 bp, Rattus norvegicus
aagccgtcaaaggaggtgcacctgt

SEQ ID NO: 40987 - DNA, 25 bp, Rattus norvegicus
aagccgtcagtgctggtgtttttgc

SEQ ID NO: 40988 - DNA, 25 bp, Rattus norvegicus
aagccgtcagtggtggtgtttttgc

SEQ ID NO: 40989 - DNA, 25 bp, Rattus norvegicus
aagccgtctgcacctgatgatgaga

SEQ ID NO: 40990 - DNA, 25 bp, Rattus norvegicus
aagccgtctgcagctgatgatgaga

SEQ ID NO: 40991 - DNA, 25 bp, Rattus norvegicus
aagccgtgaacgctagcagccaagt

SEQ ID NO: 40992 - DNA, 25 bp, Rattus norvegicus
aagccgtgaacggtagcagccaagt

SEQ ID NO: 40993 - DNA, 25 bp, Rattus norvegicus
aagccgtgacggctcctcaggctgc

SEQ ID NO: 40994 - DNA, 25 bp, Rattus norvegicus
aagccgtgacgggtcctcaggctgc

SEQ ID NO: 40995 - DNA, 25 bp, Rattus norvegicus
aagccgtgactcatcctgggatgtt

SEQ ID NO: 40996 - DNA, 25 bp, Rattus norvegicus
aagccgtgactcttcctgggatgtt

SEQ ID NO: 40997 - DNA, 25 bp, Rattus norvegicus
aagccgtgcagaactttttgaagtg

SEQ ID NO: 40998 - DNA, 25 bp, Rattus norvegicus
aagccgtgcagatctttttgaagtg

SEQ ID NO: 40999 - DNA, 25 bp, Rattus norvegicus
aagccgtgccagagagcatgtcaca

SEQ ID NO: 41000 - DNA, 25 bp, Rattus norvegicus
aagccgtgccagtgagcatgtcaca

SEQ ID NO: 41001 - DNA, 25 bp, Rattus norvegicus
aagccgtgctttctatgcaacgaca

SEQ ID NO: 41002 - DNA, 25 bp, Rattus norvegicus
aagccgtgctttgtatgcaacgaca

SEQ ID NO: 41003 - DNA, 25 bp, Rattus norvegicus
aagccgtggacaacgtcataactgt

SEQ ID NO: 41004 - DNA, 25 bp, Rattus norvegicus
aagccgtggacatcgtcataactgt

SEQ ID NO: 41005 - DNA, 25 bp, Rattus norvegicus
aagccgtggagccttcgagcttcac

SEQ ID NO: 41006 - DNA, 25 bp, Rattus norvegicus
aagccgtggagcgttcgagcttcac

SEQ ID NO: 41007 - DNA, 25 bp, Rattus norvegicus
aagccgtggattcggaagcgtccta

SEQ ID NO: 41008 - DNA, 25 bp, Rattus norvegicus
aagccgtggattgggaagcgtccta

SEQ ID NO: 41009 - DNA, 25 bp, Rattus norvegicus
aagccgtgggccaggatgttagcac

SEQ ID NO: 41010 - DNA, 25 bp, Rattus norvegicus
aagccgtgggcctggatgttagcac

SEQ ID NO: 41011 - DNA, 25 bp, Rattus norvegicus
aagccgtgtgagcagtgtgctctct

SEQ ID NO: 41012 - DNA, 25 bp, Rattus norvegicus
aagccgtgtgaggagtgtgctctct

SEQ ID NO: 41013 - DNA, 25 bp, Rattus norvegicus
aagccgtgtggcaagagcaaccaat

SEQ ID NO: 41014 - DNA, 25 bp, Rattus norvegicus
aagccgtgtggctagagcaaccaat

SEQ ID NO: 41015 - DNA, 25 bp, Rattus norvegicus
aagccgttggcaattccttatcttt

SEQ ID NO: 41016 - DNA, 25 bp, Rattus norvegicus
aagccgttggcatttccttatcttt

SEQ ID NO: 41017 - DNA, 25 bp, Rattus norvegicus
aagccgtttatgctttggctcaaac

SEQ ID NO: 41018 - DNA, 25 bp, Rattus norvegicus
aagccgtttatggtttggctcaaac

SEQ ID NO: 41019 - DNA, 25 bp, Rattus norvegicus
aagccgtttattactctggtgtaag

SEQ ID NO: 41020 - DNA, 25 bp, Rattus norvegicus
aagccgtttatttctctggtgtaag

SEQ ID NO: 41021 - DNA, 25 bp, Rattus norvegicus
aagcctaaccagaggtgtcttccag

SEQ ID NO: 41022 - DNA, 25 bp, Rattus norvegicus
aagcctaaccagtggtgtcttccag

SEQ ID NO: 41023 - DNA, 25 bp, Rattus norvegicus
aagcctaacttgcagctcattctag

SEQ ID NO: 41024 - DNA, 25 bp, Rattus norvegicus
aagcctaacttggagctcattctag

SEQ ID NO: 41025 - DNA, 25 bp, Rattus norvegicus
aagcctaagagcagttgccttttct

SEQ ID NO: 41026 - DNA, 25 bp, Rattus norvegicus
aagcctaagagctgttgccttttct

SEQ ID NO: 41027 - DNA, 25 bp, Rattus norvegicus
aagcctaagccgagcagacccggct

SEQ ID NO: 41028 - DNA, 25 bp, Rattus norvegicus
aagcctaagccgtgcagacccggct

SEQ ID NO: 41029 - DNA, 25 bp, Rattus norvegicus
aagcctaaggtgacctggatccacg

SEQ ID NO: 41030 - DNA, 25 bp, Rattus norvegicus
aagcctaaggtgtcctggatccacg

SEQ ID NO: 41031 - DNA, 25 bp, Rattus norvegicus
aagcctaaggttactccgtcagcac

SEQ ID NO: 41032 - DNA, 25 bp, Rattus norvegicus
aagcctaaggtttctccgtcagcac

SEQ ID NO: 41033 - DNA, 25 bp, Rattus norvegicus
aagcctacaaagacagctcgttcca

SEQ ID NO: 41034 - DNA, 25 bp, Rattus norvegicus
aagcctacaaagtcagctcgttcca

SEQ ID NO: 41035 - DNA, 25 bp, Rattus norvegicus
aagcctacagccagaatgccaggta

SEQ ID NO: 41036 - DNA, 25 bp, Rattus norvegicus
aagcctacagcctgaatgccaggta

SEQ ID NO: 41037 - DNA, 25 bp, Rattus norvegicus
aagcctacagttattctaccttcat

SEQ ID NO: 41038 - DNA, 25 bp, Rattus norvegicus
aagcctacagtttttctaccttcat

SEQ ID NO: 41039 - DNA, 25 bp, Rattus norvegicus
aagcctaccatgaccagagttgttt

SEQ ID NO: 41040 - DNA, 25 bp, Rattus norvegicus
aagcctaccatgtccagagttgttt

SEQ ID NO: 41041 - DNA, 25 bp, Rattus norvegicus
aagcctacccagcaacagtttagct

SEQ ID NO: 41042 - DNA, 25 bp, Rattus norvegicus
aagcctacccaggaacagtttagct

SEQ ID NO: 41043 - DNA, 25 bp, Rattus norvegicus
aagcctaccctcaaacttagtgcat

SEQ ID NO: 41044 - DNA, 25 bp, Rattus norvegicus
aagcctaccctctaacttagtgcat

SEQ ID NO: 41045 - DNA, 25 bp, Rattus norvegicus
aagcctacggtgactagggtcttat

SEQ ID NO: 41046 - DNA, 25 bp, Rattus norvegicus
aagcctacggtgtctagggtcttat

SEQ ID NO: 41047 - DNA, 25 bp, Rattus norvegicus
aagcctacgtggatgctcgagttca

SEQ ID NO: 41048 - DNA, 25 bp, Rattus norvegicus
aagcctacgtggttgctcgagttca

SEQ ID NO: 41049 - DNA, 25 bp, Rattus norvegicus
aagcctactacccatccagtaggta

SEQ ID NO: 41050 - DNA, 25 bp, Rattus norvegicus
aagcctactaccgatccagtaggta

SEQ ID NO: 41051 - DNA, 25 bp, Rattus norvegicus
aagcctactcagaagtcacctattc

SEQ ID NO: 41052 - DNA, 25 bp, Rattus norvegicus
aagcctactcagtagtcacctattc

SEQ ID NO: 41053 - DNA, 25 bp, Rattus norvegicus
aagcctactcccaagtcaaagtcaa

SEQ ID NO: 41054 - DNA, 25 bp, Rattus norvegicus
aagcctactccctagtcaaagtcaa

SEQ ID NO: 41055 - DNA, 25 bp, Rattus norvegicus
aagcctacttctccctacaggtgat

SEQ ID NO: 41056 - DNA, 25 bp, Rattus norvegicus
aagcctacttctgcctacaggtgat

SEQ ID NO: 41057 - DNA, 25 bp, Rattus norvegicus
aagcctagaaaaccagctgctgcca

SEQ ID NO: 41058 - DNA, 25 bp, Rattus norvegicus
aagcctagaaaagcagctgctgcca

SEQ ID NO: 41059 - DNA, 25 bp, Rattus norvegicus
aagcctagagctcactgttttgaaa

SEQ ID NO: 41060 - DNA, 25 bp, Rattus norvegicus
aagcctagagctgactgttttgaaa

SEQ ID NO: 41061 - DNA, 25 bp, Rattus norvegicus
aagcctagaggtcccatttcacggt

SEQ ID NO: 41062 - DNA, 25 bp, Rattus norvegicus
aagcctagaggtgccatttcacggt

SEQ ID NO: 41063 - DNA, 25 bp, Rattus norvegicus
aagcctagccccatcgatggaggca

SEQ ID NO: 41064 - DNA, 25 bp, Rattus norvegicus
aagcctagccccttcgatggaggca

SEQ ID NO: 41065 - DNA, 25 bp, Rattus norvegicus
aagcctagcttcacctgaaatgcag

SEQ ID NO: 41066 - DNA, 25 bp, Rattus norvegicus
aagcctagcttctcctgaaatgcag

SEQ ID NO: 41067 - DNA, 25 bp, Rattus norvegicus
aagcctagggcccagtaacagtaca

SEQ ID NO: 41068 - DNA, 25 bp, Rattus norvegicus
aagcctagggccgagtaacagtaca

SEQ ID NO: 41069 - DNA, 25 bp, Rattus norvegicus
aagcctaggtaaccgtggtctacat

SEQ ID NO: 41070 - DNA, 25 bp, Rattus norvegicus
aagcctaggtaagcgtggtctacat

SEQ ID NO: 41071 - DNA, 25 bp, Rattus norvegicus
aagcctagtctacatgttacagcat

SEQ ID NO: 41072 - DNA, 25 bp, Rattus norvegicus
aagcctagtctagatgttacagcat

SEQ ID NO: 41073 - DNA, 25 bp, Rattus norvegicus
aagcctagttgacctctggactgaa

SEQ ID NO: 41074 - DNA, 25 bp, Rattus norvegicus
aagcctagttgagctctggactgaa

SEQ ID NO: 41075 - DNA, 25 bp, Rattus norvegicus
aagcctatagctcaggtctctctgg

SEQ ID NO: 41076 - DNA, 25 bp, Rattus norvegicus
aagcctatagctgaggtctctctgg

SEQ ID NO: 41077 - DNA, 25 bp, Rattus norvegicus
aagcctatcctcaatagcactttgc

SEQ ID NO: 41078 - DNA, 25 bp, Rattus norvegicus
aagcctatcctctatagcactttgc

SEQ ID NO: 41079 - DNA, 25 bp, Rattus norvegicus
aagcctatcctgacgctgatgtttg

SEQ ID NO: 41080 - DNA, 25 bp, Rattus norvegicus
aagcctatcctgtcgctgatgtttg

SEQ ID NO: 41081 - DNA, 25 bp, Rattus norvegicus
aagcctatctctacagcgtgacaca

SEQ ID NO: 41082 - DNA, 25 bp, Rattus norvegicus
aagcctatctcttcagcgtgacaca

SEQ ID NO: 41083 - DNA, 25 bp, Rattus norvegicus
aagcctatgaccatgtatatgctga

SEQ ID NO: 41084 - DNA, 25 bp, Rattus norvegicus
aagcctatgaccttgtatatgctga

SEQ ID NO: 41085 - DNA, 25 bp, Rattus norvegicus
aagcctatgctcagactgggcagca

SEQ ID NO: 41086 - DNA, 25 bp, Rattus norvegicus
aagcctatgctctgactgggcagca

SEQ ID NO: 41087 - DNA, 25 bp, Rattus norvegicus
aagcctatgtataccacaattgtaa

SEQ ID NO: 41088 - DNA, 25 bp, Rattus norvegicus
aagcctatgtatcgaaccctggtac

SEQ ID NO: 41089 - DNA, 25 bp, Rattus norvegicus
aagcctatgtatggaaccctggtac

SEQ ID NO: 41090 - DNA, 25 bp, Rattus norvegicus
aagcctatgtattccacaattgtaa

SEQ ID NO: 41091 - DNA, 25 bp, Rattus norvegicus
aagcctatgtgacgacttctctgca

SEQ ID NO: 41092 - DNA, 25 bp, Rattus norvegicus
aagcctatgtgaggacttctctgca

SEQ ID NO: 41093 - DNA, 25 bp, Rattus norvegicus
aagcctattcttctatacacgacta

SEQ ID NO: 41094 - DNA, 25 bp, Rattus norvegicus
aagcctattcttgtatacacgacta

SEQ ID NO: 41095 - DNA, 25 bp, Rattus norvegicus
aagcctattgggattctctggttct

SEQ ID NO: 41096 - DNA, 25 bp, Rattus norvegicus
aagcctattgggtttctctggttct

SEQ ID NO: 41097 - DNA, 25 bp, Rattus norvegicus
aagcctcaacatcccagacagtggt

SEQ ID NO: 41098 - DNA, 25 bp, Rattus norvegicus
aagcctcaacatgccagacagtggt

SEQ ID NO: 41099 - DNA, 25 bp, Rattus norvegicus
aagcctcaactgaaacctgcagcaa

SEQ ID NO: 41100 - DNA, 25 bp, Rattus norvegicus
aagcctcaactgcaatgctaacgtg

SEQ ID NO: 41101 - DNA, 25 bp, Rattus norvegicus
aagcctcaactggaatgctaacgtg

SEQ ID NO: 41102 - DNA, 25 bp, Rattus norvegicus
aagcctcaactgtaacctgcagcaa

SEQ ID NO: 41103 - DNA, 25 bp, Rattus norvegicus
aagcctcacctgagtgcctttatga

SEQ ID NO: 41104 - DNA, 25 bp, Rattus norvegicus
aagcctcacctgtgtgcctttatga

SEQ ID NO: 41105 - DNA, 25 bp, Rattus norvegicus
aagcctcacgaaattcacgttctcg

SEQ ID NO: 41106 - DNA, 25 bp, Rattus norvegicus
aagcctcacgaatttcacgttctcg

SEQ ID NO: 41107 - DNA, 25 bp, Rattus norvegicus
aagcctcacgacctcagggacagga

SEQ ID NO: 41108 - DNA, 25 bp, Rattus norvegicus
aagcctcacgacgtcagggacagga

SEQ ID NO: 41109 - DNA, 25 bp, Rattus norvegicus
aagcctcactatcgattgattttgt

SEQ ID NO: 41110 - DNA, 25 bp, Rattus norvegicus
aagcctcactatggattgattttgt

SEQ ID NO: 41111 - DNA, 25 bp, Rattus norvegicus
aagcctcactggatgtgaccactaa

SEQ ID NO: 41112 - DNA, 25 bp, Rattus norvegicus
aagcctcactggttgtgaccactaa

SEQ ID NO: 41113 - DNA, 25 bp, Rattus norvegicus
aagcctcacttcaacctgtatttag

SEQ ID NO: 41114 - DNA, 25 bp, Rattus norvegicus
aagcctcacttctacctgtatttag

SEQ ID NO: 41115 - DNA, 25 bp, Rattus norvegicus
aagcctcacttgcattctggaacag

SEQ ID NO: 41116 - DNA, 25 bp, Rattus norvegicus
aagcctcacttggattctggaacag

SEQ ID NO: 41117 - DNA, 25 bp, Rattus norvegicus
aagcctcagcctctgggtaggttgc

SEQ ID NO: 41118 - DNA, 25 bp, Rattus norvegicus
aagcctcagcctgtgggtaggttgc

SEQ ID NO: 41119 - DNA, 25 bp, Rattus norvegicus
aagcctcaggccatgccggaagaga

SEQ ID NO: 41120 - DNA, 25 bp, Rattus norvegicus
aagcctcaggccttgccggaagaga

SEQ ID NO: 41121 - DNA, 25 bp, Rattus norvegicus
aagcctcaggtcagggtcagcagca

SEQ ID NO: 41122 - DNA, 25 bp, Rattus norvegicus
aagcctcaggtctgggtcagcagca

SEQ ID NO: 41123 - DNA, 25 bp, Rattus norvegicus
aagcctcaggtgaagctgcgtcgcg

SEQ ID NO: 41124 - DNA, 25 bp, Rattus norvegicus
aagcctcaggtgtagctgcgtcgcg

SEQ ID NO: 41125 - DNA, 25 bp, Rattus norvegicus
aagcctcaggttaggctctggcaga

SEQ ID NO: 41126 - DNA, 25 bp, Rattus norvegicus
aagcctcaggtttggctctggcaga

SEQ ID NO: 41127 - DNA, 25 bp, Rattus norvegicus
aagcctcagtgtcattttgttccac

SEQ ID NO: 41128 - DNA, 25 bp, Rattus norvegicus
aagcctcagtgtgattttgttccac

SEQ ID NO: 41129 - DNA, 25 bp, Rattus norvegicus
aagcctccaaatacactcctggtga

SEQ ID NO: 41130 - DNA, 25 bp, Rattus norvegicus
aagcctccaaattcactcctggtga

SEQ ID NO: 41131 - DNA, 25 bp, Rattus norvegicus
aagcctccagagagacttgactgtc

SEQ ID NO: 41132 - DNA, 25 bp, Rattus norvegicus
aagcctccagagctgaagtccccaa

SEQ ID NO: 41133 - DNA, 25 bp, Rattus norvegicus
aagcctccagaggtgaagtccccaa

SEQ ID NO: 41134 - DNA, 25 bp, Rattus norvegicus
aagcctccagagtgacttgactgtc

SEQ ID NO: 41135 - DNA, 25 bp, Rattus norvegicus
aagcctccagctcttgtattacttt

SEQ ID NO: 41136 - DNA, 25 bp, Rattus norvegicus
aagcctccagctgttgtattacttt

SEQ ID NO: 41137 - DNA, 25 bp, Rattus norvegicus
aagcctccaggaatgtgcggcgccg

SEQ ID NO: 41138 - DNA, 25 bp, Rattus norvegicus
aagcctccaggattgtgcggcgccg

SEQ ID NO: 41139 - DNA, 25 bp, Rattus norvegicus
aagcctccaggcaatgctcttgggt

SEQ ID NO: 41140 - DNA, 25 bp, Rattus norvegicus
aagcctccaggcacttcaggtggat

SEQ ID NO: 41141 - DNA, 25 bp, Rattus norvegicus
aagcctccaggctatgctcttgggt

SEQ ID NO: 41142 - DNA, 25 bp, Rattus norvegicus
aagcctccaggctcttcaggtggat

SEQ ID NO: 41143 - DNA, 25 bp, Rattus norvegicus
aagcctccatggagtctgcatagag

SEQ ID NO: 41144 - DNA, 25 bp, Rattus norvegicus
aagcctccatggtgtctgcatagag

SEQ ID NO: 41145 - DNA, 25 bp, Rattus norvegicus
aagcctccctgcagtatcgacgagt

SEQ ID NO: 41146 - DNA, 25 bp, Rattus norvegicus
aagcctccctgctgtatcgacgagt

SEQ ID NO: 41147 - DNA, 25 bp, Rattus norvegicus
aagcctcccttaacttttgccatgt

SEQ ID NO: 41148 - DNA, 25 bp, Rattus norvegicus
aagcctcccttatcttttgccatgt

SEQ ID NO: 41149 - DNA, 25 bp, Rattus norvegicus
aagcctccgcatcgcgttgtgccta

SEQ ID NO: 41150 - DNA, 25 bp, Rattus norvegicus
aagcctccgcatggcgttgtgccta

SEQ ID NO: 41151 - DNA, 25 bp, Rattus norvegicus
aagcctccgcggattccaagcagcg

SEQ ID NO: 41152 - DNA, 25 bp, Rattus norvegicus
aagcctccgcggtttccaagcagcg

SEQ ID NO: 41153 - DNA, 25 bp, Rattus norvegicus
aagcctccggagagcaagcactgct

SEQ ID NO: 41154 - DNA, 25 bp, Rattus norvegicus
aagcctccggagtgcaagcactgct

SEQ ID NO: 41155 - DNA, 25 bp, Rattus norvegicus
aagcctccgggaagcgtgtacttat

SEQ ID NO: 41156 - DNA, 25 bp, Rattus norvegicus
aagcctccgggatgcgtgtacttat

SEQ ID NO: 41157 - DNA, 25 bp, Rattus norvegicus
aagcctccgtccagccaagaaagca

SEQ ID NO: 41158 - DNA, 25 bp, Rattus norvegicus
aagcctccgtcctgccaagaaagca

SEQ ID NO: 41159 - DNA, 25 bp, Rattus norvegicus
aagcctcctcatctggacgacgtgt

SEQ ID NO: 41160 - DNA, 25 bp, Rattus norvegicus
aagcctcctcatgtggacgacgtgt

SEQ ID NO: 41161 - DNA, 25 bp, Rattus norvegicus
aagcctcctgaaccataatcttatc

SEQ ID NO: 41162 - DNA, 25 bp, Rattus norvegicus
aagcctcctgaagcataatcttatc

SEQ ID NO: 41163 - DNA, 25 bp, Rattus norvegicus
aagcctcctgtaactcagtggatct

SEQ ID NO: 41164 - DNA, 25 bp, Rattus norvegicus
aagcctcctgtaagagttcctttcg

SEQ ID NO: 41165 - DNA, 25 bp, Rattus norvegicus
aagcctcctgtatctcagtggatct

SEQ ID NO: 41166 - DNA, 25 bp, Rattus norvegicus
aagcctcctgtatgagttcctttcg

SEQ ID NO: 41167 - DNA, 25 bp, Rattus norvegicus
aagcctccttacaccatgcaggttg

SEQ ID NO: 41168 - DNA, 25 bp, Rattus norvegicus
aagcctccttactccatgcaggttg

SEQ ID NO: 41169 - DNA, 25 bp, Rattus norvegicus
aagcctccttttaactggtatgtgg

SEQ ID NO: 41170 - DNA, 25 bp, Rattus norvegicus
aagcctccttttactgctggtacag

SEQ ID NO: 41171 - DNA, 25 bp, Rattus norvegicus
aagcctcctttttactggtatgtgg

SEQ ID NO: 41172 - DNA, 25 bp, Rattus norvegicus
aagcctcctttttctgctggtacag

SEQ ID NO: 41173 - DNA, 25 bp, Rattus norvegicus
aagcctcgacggatgctgatgccag

SEQ ID NO: 41174 - DNA, 25 bp, Rattus norvegicus
aagcctcgacggttgctgatgccag

SEQ ID NO: 41175 - DNA, 25 bp, Rattus norvegicus
aagcctcgagggacatggcgactca

SEQ ID NO: 41176 - DNA, 25 bp, Rattus norvegicus
aagcctcgagggtcatggcgactca

SEQ ID NO: 41177 - DNA, 25 bp, Rattus norvegicus
aagcctcgcccgctggtgttggatt

SEQ ID NO: 41178 - DNA, 25 bp, Rattus norvegicus
aagcctcgcccggtggtgttggatt

SEQ ID NO: 41179 - DNA, 25 bp, Rattus norvegicus
aagcctcgctggatctaaactgaac

SEQ ID NO: 41180 - DNA, 25 bp, Rattus norvegicus
aagcctcgctggttctaaactgaac

SEQ ID NO: 41181 - DNA, 25 bp, Rattus norvegicus
aagcctcggaagacaactgtcggaa

SEQ ID NO: 41182 - DNA, 25 bp, Rattus norvegicus
aagcctcggaagtcaactgtcggaa

SEQ ID NO: 41183 - DNA, 25 bp, Rattus norvegicus
aagcctcgttgcagcagctggtgtc

SEQ ID NO: 41184 - DNA, 25 bp, Rattus norvegicus
aagcctcgttgctgcagctggtgtc

SEQ ID NO: 41185 - DNA, 25 bp, Rattus norvegicus
aagcctctaaatactgcagggattt

SEQ ID NO: 41186 - DNA, 25 bp, Rattus norvegicus
aagcctctaaattctgcagggattt

SEQ ID NO: 41187 - DNA, 25 bp, Rattus norvegicus
aagcctctacttaatattttttgat

SEQ ID NO: 41188 - DNA, 25 bp, Rattus norvegicus
aagcctctactttatattttttgat

SEQ ID NO: 41189 - DNA, 25 bp, Rattus norvegicus
aagcctctaggtatctttgccaaca

SEQ ID NO: 41190 - DNA, 25 bp, Rattus norvegicus
aagcctctaggtttctttgccaaca

SEQ ID NO: 41191 - DNA, 25 bp, Rattus norvegicus
aagcctctcaacagaagctgtgcag

SEQ ID NO: 41192 - DNA, 25 bp, Rattus norvegicus
aagcctctcaactgaagctgtgcag

SEQ ID NO: 41193 - DNA, 25 bp, Rattus norvegicus
aagcctctcaagacagacactagtg

SEQ ID NO: 41194 - DNA, 25 bp, Rattus norvegicus
aagcctctcaagtcagacactagtg

SEQ ID NO: 41195 - DNA, 25 bp, Rattus norvegicus
aagcctctccagatttctaaagcaa

SEQ ID NO: 41196 - DNA, 25 bp, Rattus norvegicus
aagcctctccagttttctaaagcaa

SEQ ID NO: 41197 - DNA, 25 bp, Rattus norvegicus
aagcctctccctagagcactgagga

SEQ ID NO: 41198 - DNA, 25 bp, Rattus norvegicus
aagcctctccctcatattttcggca

SEQ ID NO: 41199 - DNA, 25 bp, Rattus norvegicus
aagcctctccctgatattttcggca

SEQ ID NO: 41200 - DNA, 25 bp, Rattus norvegicus
aagcctctcccttgagcactgagga

SEQ ID NO: 41201 - DNA, 25 bp, Rattus norvegicus
aagcctctctgtctcatgagctgtg

SEQ ID NO: 41202 - DNA, 25 bp, Rattus norvegicus
aagcctctctgtgtcatgagctgtg

SEQ ID NO: 41203 - DNA, 25 bp, Rattus norvegicus
aagcctctcttcagtgggaactctg

SEQ ID NO: 41204 - DNA, 25 bp, Rattus norvegicus
aagcctctcttctgtgggaactctg

SEQ ID NO: 41205 - DNA, 25 bp, Rattus norvegicus
aagcctctgaacagcatcatcaagc

SEQ ID NO: 41206 - DNA, 25 bp, Rattus norvegicus
aagcctctgaactgcatcatcaagc

SEQ ID NO: 41207 - DNA, 25 bp, Rattus norvegicus
aagcctctgactaaggttttcctag

SEQ ID NO: 41208 - DNA, 25 bp, Rattus norvegicus
aagcctctgactcaatgcatccggg

SEQ ID NO: 41209 - DNA, 25 bp, Rattus norvegicus
aagcctctgactgaatgcatccggg

SEQ ID NO: 41210 - DNA, 25 bp, Rattus norvegicus
aagcctctgacttaggttttcctag

SEQ ID NO: 41211 - DNA, 25 bp, Rattus norvegicus
aagcctctgaggaacaagcgtgtgg

SEQ ID NO: 41212 - DNA, 25 bp, Rattus norvegicus
aagcctctgaggacttccttgaata

SEQ ID NO: 41213 - DNA, 25 bp, Rattus norvegicus
aagcctctgaggtacaagcgtgtgg

SEQ ID NO: 41214 - DNA, 25 bp, Rattus norvegicus
aagcctctgaggtcttccttgaata

SEQ ID NO: 41215 - DNA, 25 bp, Rattus norvegicus
aagcctctgccaaaaagcgactggg

SEQ ID NO: 41216 - DNA, 25 bp, Rattus norvegicus
aagcctctgccataaagcgactggg

SEQ ID NO: 41217 - DNA, 25 bp, Rattus norvegicus
aagcctctgcgtacctgtggagtaa

SEQ ID NO: 41218 - DNA, 25 bp, Rattus norvegicus
aagcctctgcgttcctgtggagtaa

SEQ ID NO: 41219 - DNA, 25 bp, Rattus norvegicus
aagcctctggacaccttgatttgtt

SEQ ID NO: 41220 - DNA, 25 bp, Rattus norvegicus
aagcctctggactccttgatttgtt

SEQ ID NO: 41221 - DNA, 25 bp, Rattus norvegicus
aagcctctgggcatgttccaaaaat

SEQ ID NO: 41222 - DNA, 25 bp, Rattus norvegicus
aagcctctgggcttgttccaaaaat

SEQ ID NO: 41223 - DNA, 25 bp, Rattus norvegicus
aagcctcttcaaagcactgtatgca

SEQ ID NO: 41224 - DNA, 25 bp, Rattus norvegicus
aagcctcttcaatgcactgtatgca

SEQ ID NO: 41225 - DNA, 25 bp, Rattus norvegicus
aagcctcttctaacagtggtttcta

SEQ ID NO: 41226 - DNA, 25 bp, Rattus norvegicus
aagcctcttctatcagtggtttcta

SEQ ID NO: 41227 - DNA, 25 bp, Rattus norvegicus
aagcctcttggtccacaataaccct

SEQ ID NO: 41228 - DNA, 25 bp, Rattus norvegicus
aagcctcttggtgcacaataaccct

SEQ ID NO: 41229 - DNA, 25 bp, Rattus norvegicus
aagcctctttacatgcttgagccat

SEQ ID NO: 41230 - DNA, 25 bp, Rattus norvegicus
aagcctctttacttgcttgagccat

SEQ ID NO: 41231 - DNA, 25 bp, Rattus norvegicus
aagcctctttccacttgtcatgtgg

SEQ ID NO: 41232 - DNA, 25 bp, Rattus norvegicus
aagcctctttccagctaacagtcag

SEQ ID NO: 41233 - DNA, 25 bp, Rattus norvegicus
aagcctctttcctcttgtcatgtgg

SEQ ID NO: 41234 - DNA, 25 bp, Rattus norvegicus
aagcctctttcctgctaacagtcag

SEQ ID NO: 41235 - DNA, 25 bp, Rattus norvegicus
aagcctctttgcaagtcctggtgaa

SEQ ID NO: 41236 - DNA, 25 bp, Rattus norvegicus
aagcctctttgctagtcctggtgaa

SEQ ID NO: 41237 - DNA, 25 bp, Rattus norvegicus
aagcctcttttaccagtctctaggt

SEQ ID NO: 41238 - DNA, 25 bp, Rattus norvegicus
aagcctcttttagcagtctctaggt

SEQ ID NO: 41239 - DNA, 25 bp, Rattus norvegicus
aagcctgaaaatatgttgttgtgca

SEQ ID NO: 41240 - DNA, 25 bp, Rattus norvegicus
aagcctgaaaatttgttgttgtgca

SEQ ID NO: 41241 - DNA, 25 bp, Rattus norvegicus
aagcctgaagagcttgccgctgctg

SEQ ID NO: 41242 - DNA, 25 bp, Rattus norvegicus
aagcctgaagaggttgccgctgctg

SEQ ID NO: 41243 - DNA, 25 bp, Rattus norvegicus
aagcctgaagcaactgaggcctcct

SEQ ID NO: 41244 - DNA, 25 bp, Rattus norvegicus
aagcctgaagcatctgaggcctcct

SEQ ID NO: 41245 - DNA, 25 bp, Rattus norvegicus
aagcctgaagtgctgtcaatggtca

SEQ ID NO: 41246 - DNA, 25 bp, Rattus norvegicus
aagcctgaagtggtgtcaatggtca

SEQ ID NO: 41247 - DNA, 25 bp, Rattus norvegicus
aagcctgaccgcctgaaggcgagat

SEQ ID NO: 41248 - DNA, 25 bp, Rattus norvegicus
aagcctgaccgcgtgaaggcgagat

SEQ ID NO: 41249 - DNA, 25 bp, Rattus norvegicus
aagcctgactccagctgtcaatctt

SEQ ID NO: 41250 - DNA, 25 bp, Rattus norvegicus
aagcctgactcctgctgtcaatctt

SEQ ID NO: 41251 - DNA, 25 bp, Rattus norvegicus
aagcctgactgacagcgtggactgt

SEQ ID NO: 41252 - DNA, 25 bp, Rattus norvegicus
aagcctgactgacgagtatgatgaa

SEQ ID NO: 41253 - DNA, 25 bp, Rattus norvegicus
aagcctgactgacgtccccaggtgg

SEQ ID NO: 41254 - DNA, 25 bp, Rattus norvegicus
aagcctgactgagagcgtggactgt

SEQ ID NO: 41255 - DNA, 25 bp, Rattus norvegicus
aagcctgactgaggagtatgatgaa

SEQ ID NO: 41256 - DNA, 25 bp, Rattus norvegicus
aagcctgactgaggtccccaggtgg

SEQ ID NO: 41257 - DNA, 25 bp, Rattus norvegicus
aagcctgagacactgaaattaactg

SEQ ID NO: 41258 - DNA, 25 bp, Rattus norvegicus
aagcctgagacagtgaaattaactg

SEQ ID NO: 41259 - DNA, 25 bp, Rattus norvegicus
aagcctgagaccatgttgcagaccc

SEQ ID NO: 41260 - DNA, 25 bp, Rattus norvegicus
aagcctgagaccttgttgcagaccc

SEQ ID NO: 41261 - DNA, 25 bp, Rattus norvegicus
aagcctgagagcattcaccagcgag

SEQ ID NO: 41262 - DNA, 25 bp, Rattus norvegicus
aagcctgagagctttcaccagcgag

SEQ ID NO: 41263 - DNA, 25 bp, Rattus norvegicus
aagcctgagagtatctgataaccca

SEQ ID NO: 41264 - DNA, 25 bp, Rattus norvegicus
aagcctgagagtttctgataaccca

SEQ ID NO: 41265 - DNA, 25 bp, Rattus norvegicus
aagcctgagcgtacagatggccagc

SEQ ID NO: 41266 - DNA, 25 bp, Rattus norvegicus
aagcctgagcgttcagatggccagc

SEQ ID NO: 41267 - DNA, 25 bp, Rattus norvegicus
aagcctgaggctacacccatggtta

SEQ ID NO: 41268 - DNA, 25 bp, Rattus norvegicus
aagcctgaggcttcacccatggtta

SEQ ID NO: 41269 - DNA, 25 bp, Rattus norvegicus
aagcctgaggtcatcagagttctaa

SEQ ID NO: 41270 - DNA, 25 bp, Rattus norvegicus
aagcctgaggtcttcagagttctaa

SEQ ID NO: 41271 - DNA, 25 bp, Rattus norvegicus
aagcctgagtgtaaccaacggtgga

SEQ ID NO: 41272 - DNA, 25 bp, Rattus norvegicus
aagcctgagtgttaccaacggtgga

SEQ ID NO: 41273 - DNA, 25 bp, Rattus norvegicus
aagcctgatctcatgcagctgcgca

SEQ ID NO: 41274 - DNA, 25 bp, Rattus norvegicus
aagcctgatctcttgcagctgcgca

SEQ ID NO: 41275 - DNA, 25 bp, Rattus norvegicus
aagcctgatctgatcctgttcctgc

SEQ ID NO: 41276 - DNA, 25 bp, Rattus norvegicus
aagcctgatctgttcctgttcctgc

SEQ ID NO: 41277 - DNA, 25 bp, Rattus norvegicus
aagcctgatgaccaaagagagccaa

SEQ ID NO: 41278 - DNA, 25 bp, Rattus norvegicus
aagcctgatgacctggttttgatac

SEQ ID NO: 41279 - DNA, 25 bp, Rattus norvegicus
aagcctgatgacgaaagagagccaa

SEQ ID NO: 41280 - DNA, 25 bp, Rattus norvegicus
aagcctgatgacgtggttttgatac

SEQ ID NO: 41281 - DNA, 25 bp, Rattus norvegicus
aagcctgatgctagtttcccagagg

SEQ ID NO: 41282 - DNA, 25 bp, Rattus norvegicus
aagcctgatgcttgtttcccagagg

SEQ ID NO: 41283 - DNA, 25 bp, Rattus norvegicus
aagcctgatgtgctgaattgatcct

SEQ ID NO: 41284 - DNA, 25 bp, Rattus norvegicus
aagcctgatgtggtgaattgatcct

SEQ ID NO: 41285 - DNA, 25 bp, Rattus norvegicus
aagcctgattcaatctgacgactga

SEQ ID NO: 41286 - DNA, 25 bp, Rattus norvegicus
aagcctgattcattctgacgactga

SEQ ID NO: 41287 - DNA, 25 bp, Rattus norvegicus
aagcctgatttgcttggtctttcaa

SEQ ID NO: 41288 - DNA, 25 bp, Rattus norvegicus
aagcctgatttggttggtctttcaa

SEQ ID NO: 41289 - DNA, 25 bp, Rattus norvegicus
aagcctgcaactagttccagcctgg

SEQ ID NO: 41290 - DNA, 25 bp, Rattus norvegicus
aagcctgcaacttgttccagcctgg

SEQ ID NO: 41291 - DNA, 25 bp, Rattus norvegicus
aagcctgcaagactgagctggctgc

SEQ ID NO: 41292 - DNA, 25 bp, Rattus norvegicus
aagcctgcaagagtgagctggctgc

SEQ ID NO: 41293 - DNA, 25 bp, Rattus norvegicus
aagcctgcagaaaccaaacccaaga

SEQ ID NO: 41294 - DNA, 25 bp, Rattus norvegicus
aagcctgcagaactgcacgtgtgct

SEQ ID NO: 41295 - DNA, 25 bp, Rattus norvegicus
aagcctgcagaagtgcacgtgtgct

SEQ ID NO: 41296 - DNA, 25 bp, Rattus norvegicus
aagcctgcagaatccaaacccaaga

SEQ ID NO: 41297 - DNA, 25 bp, Rattus norvegicus
aagcctgcagagactgcgagcagcc

SEQ ID NO: 41298 - DNA, 25 bp, Rattus norvegicus
aagcctgcagagtctgcgagcagcc

SEQ ID NO: 41299 - DNA, 25 bp, Rattus norvegicus
aagcctgcagcaagagatctgccac

SEQ ID NO: 41300 - DNA, 25 bp, Rattus norvegicus
aagcctgcagcatgagatctgccac

SEQ ID NO: 41301 - DNA, 25 bp, Rattus norvegicus
aagcctgcaggtagctgacgggaca

SEQ ID NO: 41302 - DNA, 25 bp, Rattus norvegicus
aagcctgcaggttgctgacgggaca

SEQ ID NO: 41303 - DNA, 25 bp, Rattus norvegicus
aagcctgcatccaggataccattaa

SEQ ID NO: 41304 - DNA, 25 bp, Rattus norvegicus
aagcctgcatcctggataccattaa

SEQ ID NO: 41305 - DNA, 25 bp, Rattus norvegicus
aagcctgcccggaatggaaataaat

SEQ ID NO: 41306 - DNA, 25 bp, Rattus norvegicus
aagcctgcccggtatggaaataaat

SEQ ID NO: 41307 - DNA, 25 bp, Rattus norvegicus
aagcctgccgcccatgtcaatgtgc

SEQ ID NO: 41308 - DNA, 25 bp, Rattus norvegicus
aagcctgccgccgatgtcaatgtgc

SEQ ID NO: 41309 - DNA, 25 bp, Rattus norvegicus
aagcctgcctcaacagcttgggtta

SEQ ID NO: 41310 - DNA, 25 bp, Rattus norvegicus
aagcctgcctcatcagcttgggtta

SEQ ID NO: 41311 - DNA, 25 bp, Rattus norvegicus
aagcctgcctctaagaaggaacgga

SEQ ID NO: 41312 - DNA, 25 bp, Rattus norvegicus
aagcctgcctcttagaaggaacgga

SEQ ID NO: 41313 - DNA, 25 bp, Rattus norvegicus
aagcctgccttaatctgctacagag

SEQ ID NO: 41314 - DNA, 25 bp, Rattus norvegicus
aagcctgccttattctgctacagag

SEQ ID NO: 41315 - DNA, 25 bp, Rattus norvegicus
aagcctgccttcatcctggagagtg

SEQ ID NO: 41316 - DNA, 25 bp, Rattus norvegicus
aagcctgccttcttcctggagagtg

SEQ ID NO: 41317 - DNA, 25 bp, Rattus norvegicus
aagcctgcctttctccatctgttat

SEQ ID NO: 41318 - DNA, 25 bp, Rattus norvegicus
aagcctgcctttgtccatctgttat

SEQ ID NO: 41319 - DNA, 25 bp, Rattus norvegicus
aagcctgcgtctagttttgaggtgg

SEQ ID NO: 41320 - DNA, 25 bp, Rattus norvegicus
aagcctgcgtcttgttttgaggtgg

SEQ ID NO: 41321 - DNA, 25 bp, Rattus norvegicus
aagcctgctagaccctaaggccggc

SEQ ID NO: 41322 - DNA, 25 bp, Rattus norvegicus
aagcctgctagagcctaaggccggc

SEQ ID NO: 41323 - DNA, 25 bp, Rattus norvegicus
aagcctgctcaaactagggatccag

SEQ ID NO: 41324 - DNA, 25 bp, Rattus norvegicus
aagcctgctcaatctagggatccag

SEQ ID NO: 41325 - DNA, 25 bp, Rattus norvegicus
aagcctgctcacatcagtcagtagt

SEQ ID NO: 41326 - DNA, 25 bp, Rattus norvegicus
aagcctgctcacttcagtcagtagt

SEQ ID NO: 41327 - DNA, 25 bp, Rattus norvegicus
aagcctgctcatattctgcaagaga

SEQ ID NO: 41328 - DNA, 25 bp, Rattus norvegicus
aagcctgctcattttctgcaagaga

SEQ ID NO: 41329 - DNA, 25 bp, Rattus norvegicus
aagcctgctctgaagtggcagcatg

SEQ ID NO: 41330 - DNA, 25 bp, Rattus norvegicus
aagcctgctctgtagtggcagcatg

SEQ ID NO: 41331 - DNA, 25 bp, Rattus norvegicus
aagcctgctgagctaaggccagcct

SEQ ID NO: 41332 - DNA, 25 bp, Rattus norvegicus
aagcctgctgaggtaaggccagcct

SEQ ID NO: 41333 - DNA, 25 bp, Rattus norvegicus
aagcctgctgtcattaaaagtatct

SEQ ID NO: 41334 - DNA, 25 bp, Rattus norvegicus
aagcctgctgtctttaaaagtatct

SEQ ID NO: 41335 - DNA, 25 bp, Rattus norvegicus
aagcctgcttaacgccatgaggaac

SEQ ID NO: 41336 - DNA, 25 bp, Rattus norvegicus
aagcctgcttaaggccatgaggaac

SEQ ID NO: 41337 - DNA, 25 bp, Rattus norvegicus
aagcctgcttcccagtgatgtactc

SEQ ID NO: 41338 - DNA, 25 bp, Rattus norvegicus
aagcctgcttccgagtgatgtactc

SEQ ID NO: 41339 - DNA, 25 bp, Rattus norvegicus
aagcctgcttctcgcctagatggta

SEQ ID NO: 41340 - DNA, 25 bp, Rattus norvegicus
aagcctgcttctggcctagatggta

SEQ ID NO: 41341 - DNA, 25 bp, Rattus norvegicus
aagcctggaaatctattagtattta

SEQ ID NO: 41342 - DNA, 25 bp, Rattus norvegicus
aagcctggaaatgtattagtattta

SEQ ID NO: 41343 - DNA, 25 bp, Rattus norvegicus
aagcctggaagccaggcactcagtt

SEQ ID NO: 41344 - DNA, 25 bp, Rattus norvegicus
aagcctggaagcgaggcactcagtt

SEQ ID NO: 41345 - DNA, 25 bp, Rattus norvegicus
aagcctggactaaagaactccttgt

SEQ ID NO: 41346 - DNA, 25 bp, Rattus norvegicus
aagcctggactatagaactccttgt

SEQ ID NO: 41347 - DNA, 25 bp, Rattus norvegicus
aagcctggacttcacccgcattgtg

SEQ ID NO: 41348 - DNA, 25 bp, Rattus norvegicus
aagcctggacttgacccgcattgtg

SEQ ID NO: 41349 - DNA, 25 bp, Rattus norvegicus
aagcctggagccaagagctttctag

SEQ ID NO: 41350 - DNA, 25 bp, Rattus norvegicus
aagcctggagccaatttaccctgtt

SEQ ID NO: 41351 - DNA, 25 bp, Rattus norvegicus
aagcctggagcctagagctttctag

SEQ ID NO: 41352 - DNA, 25 bp, Rattus norvegicus
aagcctggagcctatttaccctgtt

SEQ ID NO: 41353 - DNA, 25 bp, Rattus norvegicus
aagcctggagctaatgcacgtgaga

SEQ ID NO: 41354 - DNA, 25 bp, Rattus norvegicus
aagcctggagcttatgcacgtgaga

SEQ ID NO: 41355 - DNA, 25 bp, Rattus norvegicus
aagcctggatcaagatgctgttgat

SEQ ID NO: 41356 - DNA, 25 bp, Rattus norvegicus
aagcctggatcatgatgctgttgat

SEQ ID NO: 41357 - DNA, 25 bp, Rattus norvegicus
aagcctggcagaatggtgtttccta

SEQ ID NO: 41358 - DNA, 25 bp, Rattus norvegicus
aagcctggcagattggtgtttccta

SEQ ID NO: 41359 - DNA, 25 bp, Rattus norvegicus
aagcctggcagcactgactttgtag

SEQ ID NO: 41360 - DNA, 25 bp, Rattus norvegicus
aagcctggcagctctgactttgtag

SEQ ID NO: 41361 - DNA, 25 bp, Rattus norvegicus
aagcctggcatccatgagttaggtc

SEQ ID NO: 41362 - DNA, 25 bp, Rattus norvegicus
aagcctggcatcgatgagttaggtc

SEQ ID NO: 41363 - DNA, 25 bp, Rattus norvegicus
aagcctggccgtagagttagaagat

SEQ ID NO: 41364 - DNA, 25 bp, Rattus norvegicus
aagcctggccgttgagttagaagat

SEQ ID NO: 41365 - DNA, 25 bp, Rattus norvegicus
aagcctggcgtcagtctcaaaataa

SEQ ID NO: 41366 - DNA, 25 bp, Rattus norvegicus
aagcctggcgtctgtctcaaaataa

SEQ ID NO: 41367 - DNA, 25 bp, Rattus norvegicus
aagcctggctaaactctgcatttgg

SEQ ID NO: 41368 - DNA, 25 bp, Rattus norvegicus
aagcctggctaatctctgcatttgg

SEQ ID NO: 41369 - DNA, 25 bp, Rattus norvegicus
aagcctggctccctgtttacagaag

SEQ ID NO: 41370 - DNA, 25 bp, Rattus norvegicus
aagcctggctccgtgtttacagaag

SEQ ID NO: 41371 - DNA, 25 bp, Rattus norvegicus
aagcctggctggacagtgcttagtg

SEQ ID NO: 41372 - DNA, 25 bp, Rattus norvegicus
aagcctggctggtcagtgcttagtg

SEQ ID NO: 41373 - DNA, 25 bp, Rattus norvegicus
aagcctggcttaaatgacattctgt

SEQ ID NO: 41374 - DNA, 25 bp, Rattus norvegicus
aagcctggcttatatgacattctgt

SEQ ID NO: 41375 - DNA, 25 bp, Rattus norvegicus
aagcctgggaatcccagtgtgtgtc

SEQ ID NO: 41376 - DNA, 25 bp, Rattus norvegicus
aagcctgggaatgccagtgtgtgtc

SEQ ID NO: 41377 - DNA, 25 bp, Rattus norvegicus
aagcctgggaccaatggagttcaag

SEQ ID NO: 41378 - DNA, 25 bp, Rattus norvegicus
aagcctgggacctatggagttcaag

SEQ ID NO: 41379 - DNA, 25 bp, Rattus norvegicus
aagcctgggactagagccatcctaa

SEQ ID NO: 41380 - DNA, 25 bp, Rattus norvegicus
aagcctgggacttgagccatcctaa

SEQ ID NO: 41381 - DNA, 25 bp, Rattus norvegicus
aagcctgggaggaaaccagcaaatt

SEQ ID NO: 41382 - DNA, 25 bp, Rattus norvegicus
aagcctgggaggtaaccagcaaatt

SEQ ID NO: 41383 - DNA, 25 bp, Rattus norvegicus
aagcctgggctgatgcttttacaaa

SEQ ID NO: 41384 - DNA, 25 bp, Rattus norvegicus
aagcctgggctgttgcttttacaaa

SEQ ID NO: 41385 - DNA, 25 bp, Rattus norvegicus
aagcctgggcttatgggacatagga

SEQ ID NO: 41386 - DNA, 25 bp, Rattus norvegicus
aagcctgggcttcagaatctttaaa

SEQ ID NO: 41387 - DNA, 25 bp, Rattus norvegicus
aagcctgggcttctttaggtgatat

SEQ ID NO: 41388 - DNA, 25 bp, Rattus norvegicus
aagcctgggcttgagaatctttaaa

SEQ ID NO: 41389 - DNA, 25 bp, Rattus norvegicus
aagcctgggcttgtttaggtgatat

SEQ ID NO: 41390 - DNA, 25 bp, Rattus norvegicus
aagcctgggcttttgggacatagga

SEQ ID NO: 41391 - DNA, 25 bp, Rattus norvegicus
aagcctgggtcgcaatcgtaactga

SEQ ID NO: 41392 - DNA, 25 bp, Rattus norvegicus
aagcctgggtcggaatcgtaactga

SEQ ID NO: 41393 - DNA, 25 bp, Rattus norvegicus
aagcctggtaatcctcctgcagaag

SEQ ID NO: 41394 - DNA, 25 bp, Rattus norvegicus
aagcctggtaatgctcctgcagaag

SEQ ID NO: 41395 - DNA, 25 bp, Rattus norvegicus
aagcctggtagcacatgctcgtcat

SEQ ID NO: 41396 - DNA, 25 bp, Rattus norvegicus
aagcctggtagctcatgctcgtcat

SEQ ID NO: 41397 - DNA, 25 bp, Rattus norvegicus
aagcctggtctcagtgctgtggact

SEQ ID NO: 41398 - DNA, 25 bp, Rattus norvegicus
aagcctggtctcatgacagtcttat

SEQ ID NO: 41399 - DNA, 25 bp, Rattus norvegicus
aagcctggtctctgtgctgtggact

SEQ ID NO: 41400 - DNA, 25 bp, Rattus norvegicus
aagcctggtctcttgacagtcttat

SEQ ID NO: 41401 - DNA, 25 bp, Rattus norvegicus
aagcctggtcttctaattctggttc

SEQ ID NO: 41402 - DNA, 25 bp, Rattus norvegicus
aagcctggtcttgtaattctggttc

SEQ ID NO: 41403 - DNA, 25 bp, Rattus norvegicus
aagcctggtgcacaacggtcctgga

SEQ ID NO: 41404 - DNA, 25 bp, Rattus norvegicus
aagcctggtgcagaacggtcctgga

SEQ ID NO: 41405 - DNA, 25 bp, Rattus norvegicus
aagcctggtggtagtggttattctt

SEQ ID NO: 41406 - DNA, 25 bp, Rattus norvegicus
aagcctggtggttgtggttattctt

SEQ ID NO: 41407 - DNA, 25 bp, Rattus norvegicus
aagcctggtgtcaatactcgggtgc

SEQ ID NO: 41408 - DNA, 25 bp, Rattus norvegicus
aagcctggtgtctatactcgggtgc

SEQ ID NO: 41409 - DNA, 25 bp, Rattus norvegicus
aagcctggtgtgcaagacgttactg

SEQ ID NO: 41410 - DNA, 25 bp, Rattus norvegicus
aagcctggtgtggaagacgttactg

SEQ ID NO: 41411 - DNA, 25 bp, Rattus norvegicus
aagcctgtaaatagaccgttcctca

SEQ ID NO: 41412 - DNA, 25 bp, Rattus norvegicus
aagcctgtaaattgaccgttcctca

SEQ ID NO: 41413 - DNA, 25 bp, Rattus norvegicus
aagcctgtaatcaaacactcgggat

SEQ ID NO: 41414 - DNA, 25 bp, Rattus norvegicus
aagcctgtaatctaacactcgggat

SEQ ID NO: 41415 - DNA, 25 bp, Rattus norvegicus
aagcctgtacagatgtcataagtga

SEQ ID NO: 41416 - DNA, 25 bp, Rattus norvegicus
aagcctgtacagttgtcataagtga

SEQ ID NO: 41417 - DNA, 25 bp, Rattus norvegicus
aagcctgtacttcctttcttagcac

SEQ ID NO: 41418 - DNA, 25 bp, Rattus norvegicus
aagcctgtacttgctttcttagcac

SEQ ID NO: 41419 - DNA, 25 bp, Rattus norvegicus
aagcctgtagtgaccttcattgctg

SEQ ID NO: 41420 - DNA, 25 bp, Rattus norvegicus
aagcctgtagtgtccttcattgctg

SEQ ID NO: 41421 - DNA, 25 bp, Rattus norvegicus
aagcctgtatcaaccttgaaggtca

SEQ ID NO: 41422 - DNA, 25 bp, Rattus norvegicus
aagcctgtatcatccttgaaggtca

SEQ ID NO: 41423 - DNA, 25 bp, Rattus norvegicus
aagcctgtcattctcttggctgtgc

SEQ ID NO: 41424 - DNA, 25 bp, Rattus norvegicus
aagcctgtcattgtcttggctgtgc

SEQ ID NO: 41425 - DNA, 25 bp, Rattus norvegicus
aagcctgtccctaggatgatctcaa

SEQ ID NO: 41426 - DNA, 25 bp, Rattus norvegicus
aagcctgtccctataagactgtgat

SEQ ID NO: 41427 - DNA, 25 bp, Rattus norvegicus
aagcctgtcccttggatgatctcaa

SEQ ID NO: 41428 - DNA, 25 bp, Rattus norvegicus
aagcctgtccctttaagactgtgat

SEQ ID NO: 41429 - DNA, 25 bp, Rattus norvegicus
aagcctgtctgaaagcgtgcacata

SEQ ID NO: 41430 - DNA, 25 bp, Rattus norvegicus
aagcctgtctgatagcgtgcacata

SEQ ID NO: 41431 - DNA, 25 bp, Rattus norvegicus
aagcctgtctgccacttacaaggaa

SEQ ID NO: 41432 - DNA, 25 bp, Rattus norvegicus
aagcctgtctgcgacttacaaggaa

SEQ ID NO: 41433 - DNA, 25 bp, Rattus norvegicus
aagcctgtctgtatctggtagctct

SEQ ID NO: 41434 - DNA, 25 bp, Rattus norvegicus
aagcctgtctgtttctggtagctct

SEQ ID NO: 41435 - DNA, 25 bp, Rattus norvegicus
aagcctgtcttaagtggatttttac

SEQ ID NO: 41436 - DNA, 25 bp, Rattus norvegicus
aagcctgtcttatgtggatttttac

SEQ ID NO: 41437 - DNA, 25 bp, Rattus norvegicus
aagcctgtcttcacacttgtcagag

SEQ ID NO: 41438 - DNA, 25 bp, Rattus norvegicus
aagcctgtcttctcacttgtcagag

SEQ ID NO: 41439 - DNA, 25 bp, Rattus norvegicus
aagcctgtctttcacctctgtggat

SEQ ID NO: 41440 - DNA, 25 bp, Rattus norvegicus
aagcctgtctttgacctctgtggat

SEQ ID NO: 41441 - DNA, 25 bp, Rattus norvegicus
aagcctgtgagcatccacattgtat

SEQ ID NO: 41442 - DNA, 25 bp, Rattus norvegicus
aagcctgtgagcttccacattgtat

SEQ ID NO: 41443 - DNA, 25 bp, Rattus norvegicus
aagcctgtgaggatttgtactatga

SEQ ID NO: 41444 - DNA, 25 bp, Rattus norvegicus
aagcctgtgaggttttgtactatga

SEQ ID NO: 41445 - DNA, 25 bp, Rattus norvegicus
aagcctgtgcatcaggactgccttc

SEQ ID NO: 41446 - DNA, 25 bp, Rattus norvegicus
aagcctgtgcatctttctttaactt

SEQ ID NO: 41447 - DNA, 25 bp, Rattus norvegicus
aagcctgtgcatgaggactgccttc

SEQ ID NO: 41448 - DNA, 25 bp, Rattus norvegicus
aagcctgtgcatgtttctttaactt

SEQ ID NO: 41449 - DNA, 25 bp, Rattus norvegicus
aagcctgtgcctaaattctcttcat

SEQ ID NO: 41450 - DNA, 25 bp, Rattus norvegicus
aagcctgtgccttaattctcttcat

SEQ ID NO: 41451 - DNA, 25 bp, Rattus norvegicus
aagcctgtgctgacagtcactgcat

SEQ ID NO: 41452 - DNA, 25 bp, Rattus norvegicus
aagcctgtgctgtcagtcactgcat

SEQ ID NO: 41453 - DNA, 25 bp, Rattus norvegicus
aagcctgtggacagggctcaggcaa

SEQ ID NO: 41454 - DNA, 25 bp, Rattus norvegicus
aagcctgtggactgggctcaggcaa

SEQ ID NO: 41455 - DNA, 25 bp, Rattus norvegicus
aagcctgtggagcactggcaccagc

SEQ ID NO: 41456 - DNA, 25 bp, Rattus norvegicus
aagcctgtggaggactggcaccagc

SEQ ID NO: 41457 - DNA, 25 bp, Rattus norvegicus
aagcctgtggttaggcagcctccta

SEQ ID NO: 41458 - DNA, 25 bp, Rattus norvegicus
aagcctgtggtttggcagcctccta

SEQ ID NO: 41459 - DNA, 25 bp, Rattus norvegicus
aagcctgtgtaaaactcacactgtg

SEQ ID NO: 41460 - DNA, 25 bp, Rattus norvegicus
aagcctgtgtaatactcacactgtg

SEQ ID NO: 41461 - DNA, 25 bp, Rattus norvegicus
aagcctgtgtatattactccacggt

SEQ ID NO: 41462 - DNA, 25 bp, Rattus norvegicus
aagcctgtgtattttactccacggt

SEQ ID NO: 41463 - DNA, 25 bp, Rattus norvegicus
aagcctgtgtcgctgctggtacgcc

SEQ ID NO: 41464 - DNA, 25 bp, Rattus norvegicus
aagcctgtgtcggtgctggtacgcc

SEQ ID NO: 41465 - DNA, 25 bp, Rattus norvegicus
aagcctgtgtctcccaggacagctg

SEQ ID NO: 41466 - DNA, 25 bp, Rattus norvegicus
aagcctgtgtctgccaggacagctg

SEQ ID NO: 41467 - DNA, 25 bp, Rattus norvegicus
aagcctgtgtgtaggttcacgtggc

SEQ ID NO: 41468 - DNA, 25 bp, Rattus norvegicus
aagcctgtgtgtctcatgttttcaa

SEQ ID NO: 41469 - DNA, 25 bp, Rattus norvegicus
aagcctgtgtgtgtcatgttttcaa

SEQ ID NO: 41470 - DNA, 25 bp, Rattus norvegicus
aagcctgtgtgttggttcacgtggc

SEQ ID NO: 41471 - DNA, 25 bp, Rattus norvegicus
aagcctgtgttgcacagtctgtgca

SEQ ID NO: 41472 - DNA, 25 bp, Rattus norvegicus
aagcctgtgttggacagtctgtgca

SEQ ID NO: 41473 - DNA, 25 bp, Rattus norvegicus
aagcctgttcctacaacaagacttc

SEQ ID NO: 41474 - DNA, 25 bp, Rattus norvegicus
aagcctgttcctactactcctacag

SEQ ID NO: 41475 - DNA, 25 bp, Rattus norvegicus
aagcctgttccttcaacaagacttc

SEQ ID NO: 41476 - DNA, 25 bp, Rattus norvegicus
aagcctgttccttctactcctacag

SEQ ID NO: 41477 - DNA, 25 bp, Rattus norvegicus
aagcctgttctccagtggctaagcc

SEQ ID NO: 41478 - DNA, 25 bp, Rattus norvegicus
aagcctgttctcgagtggctaagcc

SEQ ID NO: 41479 - DNA, 25 bp, Rattus norvegicus
aagcctgttggaacagagacaccgg

SEQ ID NO: 41480 - DNA, 25 bp, Rattus norvegicus
aagcctgttggatcagagacaccgg

SEQ ID NO: 41481 - DNA, 25 bp, Rattus norvegicus
aagcctgtttccatatctgctacaa

SEQ ID NO: 41482 - DNA, 25 bp, Rattus norvegicus
aagcctgtttccttatctgctacaa

SEQ ID NO: 41483 - DNA, 25 bp, Rattus norvegicus
aagcctgtttgtacttgacagcctc

SEQ ID NO: 41484 - DNA, 25 bp, Rattus norvegicus
aagcctgtttgttcttgacagcctc

SEQ ID NO: 41485 - DNA, 25 bp, Rattus norvegicus
aagccttaaagaccacctcatcgtc

SEQ ID NO: 41486 - DNA, 25 bp, Rattus norvegicus
aagccttaaagagcacctcatcgtc

SEQ ID NO: 41487 - DNA, 25 bp, Rattus norvegicus
aagccttaaccaaaacactgtaatg

SEQ ID NO: 41488 - DNA, 25 bp, Rattus norvegicus
aagccttaaccataacactgtaatg

SEQ ID NO: 41489 - DNA, 25 bp, Rattus norvegicus
aagccttacaccctgatgagcatgg

SEQ ID NO: 41490 - DNA, 25 bp, Rattus norvegicus
aagccttacaccgtgatgagcatgg

SEQ ID NO: 41491 - DNA, 25 bp, Rattus norvegicus
aagccttaccagactctctaggatt

SEQ ID NO: 41492 - DNA, 25 bp, Rattus norvegicus
aagccttaccagctctcattttttg

SEQ ID NO: 41493 - DNA, 25 bp, Rattus norvegicus
aagccttaccaggtctcattttttg

SEQ ID NO: 41494 - DNA, 25 bp, Rattus norvegicus
aagccttaccagtctctctaggatt

SEQ ID NO: 41495 - DNA, 25 bp, Rattus norvegicus
aagccttacgagcatgtcagcatca

SEQ ID NO: 41496 - DNA, 25 bp, Rattus norvegicus
aagccttacgaggatgtcagcatca

SEQ ID NO: 41497 - DNA, 25 bp, Rattus norvegicus
aagccttactagctttccagtgtat

SEQ ID NO: 41498 - DNA, 25 bp, Rattus norvegicus
aagccttactaggtttccagtgtat

SEQ ID NO: 41499 - DNA, 25 bp, Rattus norvegicus
aagccttagaagagctgctgccttg

SEQ ID NO: 41500 - DNA, 25 bp, Rattus norvegicus
aagccttagaagtgctgctgccttg

SEQ ID NO: 41501 - DNA, 25 bp, Rattus norvegicus
aagccttagacaagcgccaagccca

SEQ ID NO: 41502 - DNA, 25 bp, Rattus norvegicus
aagccttagacatgcgccaagccca

SEQ ID NO: 41503 - DNA, 25 bp, Rattus norvegicus
aagccttagaccattggtgatccct

SEQ ID NO: 41504 - DNA, 25 bp, Rattus norvegicus
aagccttagacctttggtgatccct

SEQ ID NO: 41505 - DNA, 25 bp, Rattus norvegicus
aagccttataatcacttatgttgac

SEQ ID NO: 41506 - DNA, 25 bp, Rattus norvegicus
aagccttataatgacttatgttgac

SEQ ID NO: 41507 - DNA, 25 bp, Rattus norvegicus
aagccttatgccagctcctgggatg

SEQ ID NO: 41508 - DNA, 25 bp, Rattus norvegicus
aagccttatgcctgctcctgggatg

SEQ ID NO: 41509 - DNA, 25 bp, Rattus norvegicus
aagccttcaaacatactgattgggt

SEQ ID NO: 41510 - DNA, 25 bp, Rattus norvegicus
aagccttcaaacttactgattgggt

SEQ ID NO: 41511 - DNA, 25 bp, Rattus norvegicus
aagccttcaaccaggatttcatcat

SEQ ID NO: 41512 - DNA, 25 bp, Rattus norvegicus
aagccttcaacctggatttcatcat

SEQ ID NO: 41513 - DNA, 25 bp, Rattus norvegicus
aagccttcaagaatgcgcctttctc

SEQ ID NO: 41514 - DNA, 25 bp, Rattus norvegicus
aagccttcaagattgcgcctttctc

SEQ ID NO: 41515 - DNA, 25 bp, Rattus norvegicus
aagccttcaaggaacagctgaccca

SEQ ID NO: 41516 - DNA, 25 bp, Rattus norvegicus
aagccttcaaggtacagctgaccca

SEQ ID NO: 41517 - DNA, 25 bp, Rattus norvegicus
aagccttcacccaacaagtatgatg

SEQ ID NO: 41518 - DNA, 25 bp, Rattus norvegicus
aagccttcaccctacaagtatgatg

SEQ ID NO: 41519 - DNA, 25 bp, Rattus norvegicus
aagccttcagtacctgataccgatg

SEQ ID NO: 41520 - DNA, 25 bp, Rattus norvegicus
aagccttcagtagctgataccgatg

SEQ ID NO: 41521 - DNA, 25 bp, Rattus norvegicus
aagccttcattcacgtagttgttag

SEQ ID NO: 41522 - DNA, 25 bp, Rattus norvegicus
aagccttcattctcgtagttgttag

SEQ ID NO: 41523 - DNA, 25 bp, Rattus norvegicus
aagccttccaaaaacttgtacgatg

SEQ ID NO: 41524 - DNA, 25 bp, Rattus norvegicus
aagccttccaaatacttgtacgatg

SEQ ID NO: 41525 - DNA, 25 bp, Rattus norvegicus
aagccttccaggactaacatcttca

SEQ ID NO: 41526 - DNA, 25 bp, Rattus norvegicus
aagccttccaggcaagagctctcag

SEQ ID NO: 41527 - DNA, 25 bp, Rattus norvegicus
aagccttccagggaagagctctcag

SEQ ID NO: 41528 - DNA, 25 bp, Rattus norvegicus
aagccttccaggtctaacatcttca

SEQ ID NO: 41529 - DNA, 25 bp, Rattus norvegicus
aagccttccagtagtgctgctttga

SEQ ID NO: 41530 - DNA, 25 bp, Rattus norvegicus
aagccttccagttgtgctgctttga

SEQ ID NO: 41531 - DNA, 25 bp, Rattus norvegicus
aagccttccatccaacttacgaaga

SEQ ID NO: 41532 - DNA, 25 bp, Rattus norvegicus
aagccttccatcgaacttacgaaga

SEQ ID NO: 41533 - DNA, 25 bp, Rattus norvegicus
aagccttcccaccagaaggttacag

SEQ ID NO: 41534 - DNA, 25 bp, Rattus norvegicus
aagccttcccacgagaaggttacag

SEQ ID NO: 41535 - DNA, 25 bp, Rattus norvegicus
aagccttccggcagctgcgggaact

SEQ ID NO: 41536 - DNA, 25 bp, Rattus norvegicus
aagccttccggctgctgcgggaact

SEQ ID NO: 41537 - DNA, 25 bp, Rattus norvegicus
aagccttcctttccttgacagaact

SEQ ID NO: 41538 - DNA, 25 bp, Rattus norvegicus
aagccttcctttgcttgacagaact

SEQ ID NO: 41539 - DNA, 25 bp, Rattus norvegicus
aagccttctgaaattgcctcagttt

SEQ ID NO: 41540 - DNA, 25 bp, Rattus norvegicus
aagccttctgaatttgcctcagttt

SEQ ID NO: 41541 - DNA, 25 bp, Rattus norvegicus
aagccttctgatacattttctgcgg

SEQ ID NO: 41542 - DNA, 25 bp, Rattus norvegicus
aagccttctgattcattttctgcgg

SEQ ID NO: 41543 - DNA, 25 bp, Rattus norvegicus
aagccttctgtcacggaactaacaa

SEQ ID NO: 41544 - DNA, 25 bp, Rattus norvegicus
aagccttctgtctcggaactaacaa

SEQ ID NO: 41545 - DNA, 25 bp, Rattus norvegicus
aagccttcttctaaacattcagtga

SEQ ID NO: 41546 - DNA, 25 bp, Rattus norvegicus
aagccttcttcttaacattcagtga

SEQ ID NO: 41547 - DNA, 25 bp, Rattus norvegicus
aagccttcttgcacttgagtctgaa

SEQ ID NO: 41548 - DNA, 25 bp, Rattus norvegicus
aagccttcttgctcttgagtctgaa

SEQ ID NO: 41549 - DNA, 25 bp, Rattus norvegicus
aagccttgaaatctctctagcatga

SEQ ID NO: 41550 - DNA, 25 bp, Rattus norvegicus
aagccttgaaatgtctctagcatga

SEQ ID NO: 41551 - DNA, 25 bp, Rattus norvegicus
aagccttgaactcaattccaacctg

SEQ ID NO: 41552 - DNA, 25 bp, Rattus norvegicus
aagccttgaactgaattccaacctg

SEQ ID NO: 41553 - DNA, 25 bp, Rattus norvegicus
aagccttgactcagtgaaaatgcca

SEQ ID NO: 41554 - DNA, 25 bp, Rattus norvegicus
aagccttgactctgtgaaaatgcca

SEQ ID NO: 41555 - DNA, 25 bp, Rattus norvegicus
aagccttgagcaatgtgacacccag

SEQ ID NO: 41556 - DNA, 25 bp, Rattus norvegicus
aagccttgagcattgtgacacccag

SEQ ID NO: 41557 - DNA, 25 bp, Rattus norvegicus
aagccttgaggaccaggtgaacgac

SEQ ID NO: 41558 - DNA, 25 bp, Rattus norvegicus
aagccttgaggagcaggtgaacgac

SEQ ID NO: 41559 - DNA, 25 bp, Rattus norvegicus
aagccttgatccagtgactgtactg

SEQ ID NO: 41560 - DNA, 25 bp, Rattus norvegicus
aagccttgatcctgtgactgtactg

SEQ ID NO: 41561 - DNA, 25 bp, Rattus norvegicus
aagccttgatggcttctgtctactt

SEQ ID NO: 41562 - DNA, 25 bp, Rattus norvegicus
aagccttgatgggttctgtctactt

SEQ ID NO: 41563 - DNA, 25 bp, Rattus norvegicus
aagccttgatgtagtatgtccattc

SEQ ID NO: 41564 - DNA, 25 bp, Rattus norvegicus
aagccttgatgttgtatgtccattc

SEQ ID NO: 41565 - DNA, 25 bp, Rattus norvegicus
aagccttgattcacttagccacaaa

SEQ ID NO: 41566 - DNA, 25 bp, Rattus norvegicus
aagccttgattctcttagccacaaa

SEQ ID NO: 41567 - DNA, 25 bp, Rattus norvegicus
aagccttgatttaccttcactttag

SEQ ID NO: 41568 - DNA, 25 bp, Rattus norvegicus
aagccttgattttccttcactttag

SEQ ID NO: 41569 - DNA, 25 bp, Rattus norvegicus
aagccttgcaaaatgggttctcctt

SEQ ID NO: 41570 - DNA, 25 bp, Rattus norvegicus
aagccttgcaaattgggttctcctt

SEQ ID NO: 41571 - DNA, 25 bp, Rattus norvegicus
aagccttgcaagacatagtttggga

SEQ ID NO: 41572 - DNA, 25 bp, Rattus norvegicus
aagccttgcaagtcatagtttggga

SEQ ID NO: 41573 - DNA, 25 bp, Rattus norvegicus
aagccttgcacacaaccagtggcag

SEQ ID NO: 41574 - DNA, 25 bp, Rattus norvegicus
aagccttgcacagaaccagtggcag

SEQ ID NO: 41575 - DNA, 25 bp, Rattus norvegicus
aagccttgcaggaatgaagcatcta

SEQ ID NO: 41576 - DNA, 25 bp, Rattus norvegicus
aagccttgcaggcagcagtggtact

SEQ ID NO: 41577 - DNA, 25 bp, Rattus norvegicus
aagccttgcagggagcagtggtact

SEQ ID NO: 41578 - DNA, 25 bp, Rattus norvegicus
aagccttgcaggtatgaagcatcta

SEQ ID NO: 41579 - DNA, 25 bp, Rattus norvegicus
aagccttgctctcctagcttcagaa

SEQ ID NO: 41580 - DNA, 25 bp, Rattus norvegicus
aagccttgctctgctagcttcagaa

SEQ ID NO: 41581 - DNA, 25 bp, Rattus norvegicus
aagccttgctgactgagtttgaccc

SEQ ID NO: 41582 - DNA, 25 bp, Rattus norvegicus
aagccttgctgagtgagtttgaccc

SEQ ID NO: 41583 - DNA, 25 bp, Rattus norvegicus
aagccttgctttattactgaactat

SEQ ID NO: 41584 - DNA, 25 bp, Rattus norvegicus
aagccttgcttttttactgaactat

SEQ ID NO: 41585 - DNA, 25 bp, Rattus norvegicus
aagccttggaccaagttgatcgaga

SEQ ID NO: 41586 - DNA, 25 bp, Rattus norvegicus
aagccttggacctagttgatcgaga

SEQ ID NO: 41587 - DNA, 25 bp, Rattus norvegicus
aagccttggagcctgagttgcctgc

SEQ ID NO: 41588 - DNA, 25 bp, Rattus norvegicus
aagccttggagcgtgagttgcctgc

SEQ ID NO: 41589 - DNA, 25 bp, Rattus norvegicus
aagccttggcacagcatgattgggt

SEQ ID NO: 41590 - DNA, 25 bp, Rattus norvegicus
aagccttggcactgcatgattgggt

SEQ ID NO: 41591 - DNA, 25 bp, Rattus norvegicus
aagccttgggccagcagatgctatg

SEQ ID NO: 41592 - DNA, 25 bp, Rattus norvegicus
aagccttgggcctgcagatgctatg

SEQ ID NO: 41593 - DNA, 25 bp, Rattus norvegicus
aagccttgtggcatgtatagttctg

SEQ ID NO: 41594 - DNA, 25 bp, Rattus norvegicus
aagccttgtggcttgtatagttctg

SEQ ID NO: 41595 - DNA, 25 bp, Rattus norvegicus
aagccttgtggtagtgcatcttcaa

SEQ ID NO: 41596 - DNA, 25 bp, Rattus norvegicus
aagccttgtggttgtgcatcttcaa

SEQ ID NO: 41597 - DNA, 25 bp, Rattus norvegicus
aagcctttagaaatgtgagccccaa

SEQ ID NO: 41598 - DNA, 25 bp, Rattus norvegicus
aagcctttagaattgtgagccccaa

SEQ ID NO: 41599 - DNA, 25 bp, Rattus norvegicus
aagcctttagctacctcattataat

SEQ ID NO: 41600 - DNA, 25 bp, Rattus norvegicus
aagcctttagctcatgtggttaagt

SEQ ID NO: 41601 - DNA, 25 bp, Rattus norvegicus
aagcctttagctgatgtggttaagt

SEQ ID NO: 41602 - DNA, 25 bp, Rattus norvegicus
aagcctttagcttcctcattataat

SEQ ID NO: 41603 - DNA, 25 bp, Rattus norvegicus
aagcctttattaacacttggaaatg

SEQ ID NO: 41604 - DNA, 25 bp, Rattus norvegicus
aagcctttattatcacttggaaatg

SEQ ID NO: 41605 - DNA, 25 bp, Rattus norvegicus
aagcctttccaactgtttctaccat

SEQ ID NO: 41606 - DNA, 25 bp, Rattus norvegicus
aagcctttccaagtgtttctaccat

SEQ ID NO: 41607 - DNA, 25 bp, Rattus norvegicus
aagcctttccccagtgtggtcagag

SEQ ID NO: 41608 - DNA, 25 bp, Rattus norvegicus
aagcctttcccctgtgtggtcagag

SEQ ID NO: 41609 - DNA, 25 bp, Rattus norvegicus
aagcctttcctaagcttgttttgtg

SEQ ID NO: 41610 - DNA, 25 bp, Rattus norvegicus
aagcctttcctatgcttgttttgtg

SEQ ID NO: 41611 - DNA, 25 bp, Rattus norvegicus
aagcctttcctcaagtctcaagtct

SEQ ID NO: 41612 - DNA, 25 bp, Rattus norvegicus
aagcctttcctctagtctcaagtct

SEQ ID NO: 41613 - DNA, 25 bp, Rattus norvegicus
aagcctttctcgcacctgtactgag

SEQ ID NO: 41614 - DNA, 25 bp, Rattus norvegicus
aagcctttctcggacctgtactgag

SEQ ID NO: 41615 - DNA, 25 bp, Rattus norvegicus
aagcctttctctccatctgagatat

SEQ ID NO: 41616 - DNA, 25 bp, Rattus norvegicus
aagcctttctctgcatctgagatat

SEQ ID NO: 41617 - DNA, 25 bp, Rattus norvegicus
aagcctttctgaatcttattcagca

SEQ ID NO: 41618 - DNA, 25 bp, Rattus norvegicus
aagcctttctgattcttattcagca

SEQ ID NO: 41619 - DNA, 25 bp, Rattus norvegicus
aagcctttcttcactacagagctat

SEQ ID NO: 41620 - DNA, 25 bp, Rattus norvegicus
aagcctttcttctctacagagctat

SEQ ID NO: 41621 - DNA, 25 bp, Rattus norvegicus
aagcctttgatcagatgcactcggg

SEQ ID NO: 41622 - DNA, 25 bp, Rattus norvegicus
aagcctttgatctgatgcactcggg

SEQ ID NO: 41623 - DNA, 25 bp, Rattus norvegicus
aagcctttgcagctccttgtttgga

SEQ ID NO: 41624 - DNA, 25 bp, Rattus norvegicus
aagcctttgcagcttcagaagtgga

SEQ ID NO: 41625 - DNA, 25 bp, Rattus norvegicus
aagcctttgcaggtccttgtttgga

SEQ ID NO: 41626 - DNA, 25 bp, Rattus norvegicus
aagcctttgcaggttcagaagtgga

SEQ ID NO: 41627 - DNA, 25 bp, Rattus norvegicus
aagcctttgcatcttacactcttct

SEQ ID NO: 41628 - DNA, 25 bp, Rattus norvegicus
aagcctttgcatgttacactcttct

SEQ ID NO: 41629 - DNA, 25 bp, Rattus norvegicus
aagcctttgccacgtgtctgtgctg

SEQ ID NO: 41630 - DNA, 25 bp, Rattus norvegicus
aagcctttgccaggtgtctgtgctg

SEQ ID NO: 41631 - DNA, 25 bp, Rattus norvegicus
aagcctttgcctacgtgataactgg

SEQ ID NO: 41632 - DNA, 25 bp, Rattus norvegicus
aagcctttgccttcgtgataactgg

SEQ ID NO: 41633 - DNA, 25 bp, Rattus norvegicus
aagcctttgcttcaggtcatcaaga

SEQ ID NO: 41634 - DNA, 25 bp, Rattus norvegicus
aagcctttgcttctaatgtatacat

SEQ ID NO: 41635 - DNA, 25 bp, Rattus norvegicus
aagcctttgcttgaggtcatcaaga

SEQ ID NO: 41636 - DNA, 25 bp, Rattus norvegicus
aagcctttgcttgtaatgtatacat

SEQ ID NO: 41637 - DNA, 25 bp, Rattus norvegicus
aagcctttggagctcagaaactcaa

SEQ ID NO: 41638 - DNA, 25 bp, Rattus norvegicus
aagcctttggaggtcagaaactcaa

SEQ ID NO: 41639 - DNA, 25 bp, Rattus norvegicus
aagcctttggctcagtttgccttgt

SEQ ID NO: 41640 - DNA, 25 bp, Rattus norvegicus
aagcctttggctgagtttgccttgt

SEQ ID NO: 41641 - DNA, 25 bp, Rattus norvegicus
aagcctttgggtctccttggaactg

SEQ ID NO: 41642 - DNA, 25 bp, Rattus norvegicus
aagcctttgggtgtccttggaactg

SEQ ID NO: 41643 - DNA, 25 bp, Rattus norvegicus
aagcctttggtgaattccttctacg

SEQ ID NO: 41644 - DNA, 25 bp, Rattus norvegicus
aagcctttggtgtattccttctacg

SEQ ID NO: 41645 - DNA, 25 bp, Rattus norvegicus
aagcctttggttctcctggttgaca

SEQ ID NO: 41646 - DNA, 25 bp, Rattus norvegicus
aagcctttggttgtcctggttgaca

SEQ ID NO: 41647 - DNA, 25 bp, Rattus norvegicus
aagcctttgtttaacgtactcacag

SEQ ID NO: 41648 - DNA, 25 bp, Rattus norvegicus
aagcctttgttttacgtactcacag

SEQ ID NO: 41649 - DNA, 25 bp, Rattus norvegicus
aagccttttatgactggagctgcag

SEQ ID NO: 41650 - DNA, 25 bp, Rattus norvegicus
aagccttttatgtctggagctgcag

SEQ ID NO: 41651 - DNA, 25 bp, Rattus norvegicus
aagccttttcaacttatgcccacct

SEQ ID NO: 41652 - DNA, 25 bp, Rattus norvegicus
aagccttttcaagttatgcccacct

SEQ ID NO: 41653 - DNA, 25 bp, Rattus norvegicus
aagccttttcatctattacttcaag

SEQ ID NO: 41654 - DNA, 25 bp, Rattus norvegicus
aagccttttcatgtattacttcaag

SEQ ID NO: 41655 - DNA, 25 bp, Rattus norvegicus
aagccttttcccacaagtcttgccg

SEQ ID NO: 41656 - DNA, 25 bp, Rattus norvegicus
aagccttttccctcaagtcttgccg

SEQ ID NO: 41657 - DNA, 25 bp, Rattus norvegicus
aagccttttctcaacggtggagcta

SEQ ID NO: 41658 - DNA, 25 bp, Rattus norvegicus
aagccttttctcaatggactgacag

SEQ ID NO: 41659 - DNA, 25 bp, Rattus norvegicus
aagccttttctctacggtggagcta

SEQ ID NO: 41660 - DNA, 25 bp, Rattus norvegicus
aagccttttctctatggactgacag

SEQ ID NO: 41661 - DNA, 25 bp, Rattus norvegicus
aagccttttgtgacttcgaagcaga

SEQ ID NO: 41662 - DNA, 25 bp, Rattus norvegicus
aagccttttgtgtcttcgaagcaga

SEQ ID NO: 41663 - DNA, 25 bp, Rattus norvegicus
aagcctttttgcaggtttgggtgat

SEQ ID NO: 41664 - DNA, 25 bp, Rattus norvegicus
aagcctttttgctggtttgggtgat

SEQ ID NO: 41665 - DNA, 25 bp, Rattus norvegicus
aagcgaaacaataccgtccggcact

SEQ ID NO: 41666 - DNA, 25 bp, Rattus norvegicus
aagcgaaacaattccgtccggcact

SEQ ID NO: 41667 - DNA, 25 bp, Rattus norvegicus
aagcgaaaccctaagacatcaccat

SEQ ID NO: 41668 - DNA, 25 bp, Rattus norvegicus
aagcgaaacccttagacatcaccat

SEQ ID NO: 41669 - DNA, 25 bp, Rattus norvegicus
aagcgaaagcaacccacatgtgatg

SEQ ID NO: 41670 - DNA, 25 bp, Rattus norvegicus
aagcgaaagcaagccacatgtgatg

SEQ ID NO: 41671 - DNA, 25 bp, Rattus norvegicus
aagcgaaattttacagatgccgaag

SEQ ID NO: 41672 - DNA, 25 bp, Rattus norvegicus
aagcgaaatttttcagatgccgaag

SEQ ID NO: 41673 - DNA, 25 bp, Rattus norvegicus
aagcgaaccattcttgcctagagca

SEQ ID NO: 41674 - DNA, 25 bp, Rattus norvegicus
aagcgaaccattgttgcctagagca

SEQ ID NO: 41675 - DNA, 25 bp, Rattus norvegicus
aagcgaacccaaacaatctacagag

SEQ ID NO: 41676 - DNA, 25 bp, Rattus norvegicus
aagcgaacccaatcaatctacagag

SEQ ID NO: 41677 - DNA, 25 bp, Rattus norvegicus
aagcgaacccagctgcaactgtgtt

SEQ ID NO: 41678 - DNA, 25 bp, Rattus norvegicus
aagcgaacccaggtgcaactgtgtt

SEQ ID NO: 41679 - DNA, 25 bp, Rattus norvegicus
aagcgaactaaacaccaactgcggt

SEQ ID NO: 41680 - DNA, 25 bp, Rattus norvegicus
aagcgaactaaacgctcgggcagct

SEQ ID NO: 41681 - DNA, 25 bp, Rattus norvegicus
aagcgaactaaagaccaactgcggt

SEQ ID NO: 41682 - DNA, 25 bp, Rattus norvegicus
aagcgaactaaaggctcgggcagct

SEQ ID NO: 41683 - DNA, 25 bp, Rattus norvegicus
aagcgaagcccacgattattacaac

SEQ ID NO: 41684 - DNA, 25 bp, Rattus norvegicus
aagcgaagcccaggattattacaac

SEQ ID NO: 41685 - DNA, 25 bp, Rattus norvegicus
aagcgaagcgacagggctcacagaa

SEQ ID NO: 41686 - DNA, 25 bp, Rattus norvegicus
aagcgaagcgactgggctcacagaa

SEQ ID NO: 41687 - DNA, 25 bp, Rattus norvegicus
aagcgaaggaggacaggcagtccct

SEQ ID NO: 41688 - DNA, 25 bp, Rattus norvegicus
aagcgaaggaggtcaggcagtccct

SEQ ID NO: 41689 - DNA, 25 bp, Rattus norvegicus
aagcgaaggcagctggaactccagt

SEQ ID NO: 41690 - DNA, 25 bp, Rattus norvegicus
aagcgaaggcaggtggaactccagt

SEQ ID NO: 41691 - DNA, 25 bp, Rattus norvegicus
aagcgaagtgacacgcacactgact

SEQ ID NO: 41692 - DNA, 25 bp, Rattus norvegicus
aagcgaagtgactcgcacactgact

SEQ ID NO: 41693 - DNA, 25 bp, Rattus norvegicus
aagcgaagttcaattgtaagcaatc

SEQ ID NO: 41694 - DNA, 25 bp, Rattus norvegicus
aagcgaagttcatttgtaagcaatc

SEQ ID NO: 41695 - DNA, 25 bp, Rattus norvegicus
aagcgaataggtccctgtcactgta

SEQ ID NO: 41696 - DNA, 25 bp, Rattus norvegicus
aagcgaataggtgcctgtcactgta

SEQ ID NO: 41697 - DNA, 25 bp, Rattus norvegicus
aagcgaatctgtccacggtatgacc

SEQ ID NO: 41698 - DNA, 25 bp, Rattus norvegicus
aagcgaatctgtgcacggtatgacc

SEQ ID NO: 41699 - DNA, 25 bp, Rattus norvegicus
aagcgaatgtctatgatcactagag

SEQ ID NO: 41700 - DNA, 25 bp, Rattus norvegicus
aagcgaatgtctttgatcactagag

SEQ ID NO: 41701 - DNA, 25 bp, Rattus norvegicus
aagcgaattaggaccacttcaatgt

SEQ ID NO: 41702 - DNA, 25 bp, Rattus norvegicus
aagcgaattaggtccacttcaatgt

SEQ ID NO: 41703 - DNA, 25 bp, Rattus norvegicus
aagcgacactatatcatggcgtacg

SEQ ID NO: 41704 - DNA, 25 bp, Rattus norvegicus
aagcgacactatttcatggcgtacg

SEQ ID NO: 41705 - DNA, 25 bp, Rattus norvegicus
aagcgacagggcacacagaaggcgt

SEQ ID NO: 41706 - DNA, 25 bp, Rattus norvegicus
aagcgacagggctcacagaaggcgt

SEQ ID NO: 41707 - DNA, 25 bp, Rattus norvegicus
aagcgacagtgtatgctctccagtc

SEQ ID NO: 41708 - DNA, 25 bp, Rattus norvegicus
aagcgacagtgtttgctctccagtc

SEQ ID NO: 41709 - DNA, 25 bp, Rattus norvegicus
aagcgaccattgactctaggagcct

SEQ ID NO: 41710 - DNA, 25 bp, Rattus norvegicus
aagcgaccattgtctctaggagcct

SEQ ID NO: 41711 - DNA, 25 bp, Rattus norvegicus
aagcgacctaccactgttgcggtgc

SEQ ID NO: 41712 - DNA, 25 bp, Rattus norvegicus
aagcgacctacctctgttgcggtgc

SEQ ID NO: 41713 - DNA, 25 bp, Rattus norvegicus
aagcgacgcatccatttctgtgatt

SEQ ID NO: 41714 - DNA, 25 bp, Rattus norvegicus
aagcgacgcatcgatttctgtgatt

SEQ ID NO: 41715 - DNA, 25 bp, Rattus norvegicus
aagcgactgccaagaactcccaggt

SEQ ID NO: 41716 - DNA, 25 bp, Rattus norvegicus
aagcgactgccatgaactcccaggt

SEQ ID NO: 41717 - DNA, 25 bp, Rattus norvegicus
aagcgactgcttaactgccagcgtt

SEQ ID NO: 41718 - DNA, 25 bp, Rattus norvegicus
aagcgactgctttactgccagcgtt

SEQ ID NO: 41719 - DNA, 25 bp, Rattus norvegicus
aagcgactgtccaggtgctaagtga

SEQ ID NO: 41720 - DNA, 25 bp, Rattus norvegicus
aagcgactgtcctggtgctaagtga

SEQ ID NO: 41721 - DNA, 25 bp, Rattus norvegicus
aagcgacttggaaccttctccgctg

SEQ ID NO: 41722 - DNA, 25 bp, Rattus norvegicus
aagcgacttggatccttctccgctg

SEQ ID NO: 41723 - DNA, 25 bp, Rattus norvegicus
aagcgagacagcctgtctgtccaca

SEQ ID NO: 41724 - DNA, 25 bp, Rattus norvegicus
aagcgagacagcgtgtctgtccaca

SEQ ID NO: 41725 - DNA, 25 bp, Rattus norvegicus
aagcgagagcgaatgctgtcctagc

SEQ ID NO: 41726 - DNA, 25 bp, Rattus norvegicus
aagcgagagcgattgctgtcctagc

SEQ ID NO: 41727 - DNA, 25 bp, Rattus norvegicus
aagcgagatgtccttacagccatat

SEQ ID NO: 41728 - DNA, 25 bp, Rattus norvegicus
aagcgagatgtcgttacagccatat

SEQ ID NO: 41729 - DNA, 25 bp, Rattus norvegicus
aagcgagatttcagagactctttct

SEQ ID NO: 41730 - DNA, 25 bp, Rattus norvegicus
aagcgagatttctgagactctttct

SEQ ID NO: 41731 - DNA, 25 bp, Rattus norvegicus
aagcgagccattacctaccagatcg

SEQ ID NO: 41732 - DNA, 25 bp, Rattus norvegicus
aagcgagccatttcctaccagatcg

SEQ ID NO: 41733 - DNA, 25 bp, Rattus norvegicus
aagcgagccccaactatgtgcccat

SEQ ID NO: 41734 - DNA, 25 bp, Rattus norvegicus
aagcgagccccatctatgtgcccat

SEQ ID NO: 41735 - DNA, 25 bp, Rattus norvegicus
aagcgagccctccagaaggcagtct

SEQ ID NO: 41736 - DNA, 25 bp, Rattus norvegicus
aagcgagccctcgagaaggcagtct

SEQ ID NO: 41737 - DNA, 25 bp, Rattus norvegicus
aagcgagccgaaacctcttagaagt

SEQ ID NO: 41738 - DNA, 25 bp, Rattus norvegicus
aagcgagccgaatcctcttagaagt

SEQ ID NO: 41739 - DNA, 25 bp, Rattus norvegicus
aagcgagcctttctagtttcactaa

SEQ ID NO: 41740 - DNA, 25 bp, Rattus norvegicus
aagcgagcctttgtagtttcactaa

SEQ ID NO: 41741 - DNA, 25 bp, Rattus norvegicus
aagcgagcgaagaacctccccgagc

SEQ ID NO: 41742 - DNA, 25 bp, Rattus norvegicus
aagcgagcgaagtacctccccgagc

SEQ ID NO: 41743 - DNA, 25 bp, Rattus norvegicus
aagcgagcgaatctgttctggcaat

SEQ ID NO: 41744 - DNA, 25 bp, Rattus norvegicus
aagcgagcgaatgtgttctggcaat

SEQ ID NO: 41745 - DNA, 25 bp, Rattus norvegicus
aagcgagcgaggcttaccttgtggg

SEQ ID NO: 41746 - DNA, 25 bp, Rattus norvegicus
aagcgagcgagggttaccttgtggg

SEQ ID NO: 41747 - DNA, 25 bp, Rattus norvegicus
aagcgagcggagattcagttcgccg

SEQ ID NO: 41748 - DNA, 25 bp, Rattus norvegicus
aagcgagcggagtttcagttcgccg

SEQ ID NO: 41749 - DNA, 25 bp, Rattus norvegicus
aagcgagctaggagacatttcgaga

SEQ ID NO: 41750 - DNA, 25 bp, Rattus norvegicus
aagcgagctaggtgacatttcgaga

SEQ ID NO: 41751 - DNA, 25 bp, Rattus norvegicus
aagcgagctctcacagaagcttcaa

SEQ ID NO: 41752 - DNA, 25 bp, Rattus norvegicus
aagcgagctctctcagaagcttcaa

SEQ ID NO: 41753 - DNA, 25 bp, Rattus norvegicus
aagcgagctgaaatagccgtgcgga

SEQ ID NO: 41754 - DNA, 25 bp, Rattus norvegicus
aagcgagctgaattagccgtgcgga

SEQ ID NO: 41755 - DNA, 25 bp, Rattus norvegicus
aagcgagctgacatctattcggtgg

SEQ ID NO: 41756 - DNA, 25 bp, Rattus norvegicus
aagcgagctgacttctattcggtgg

SEQ ID NO: 41757 - DNA, 25 bp, Rattus norvegicus
aagcgagctggacgctcccatgcct

SEQ ID NO: 41758 - DNA, 25 bp, Rattus norvegicus
aagcgagctggaggctcccatgcct

SEQ ID NO: 41759 - DNA, 25 bp, Rattus norvegicus
aagcgagctgtgattcctgacgaca

SEQ ID NO: 41760 - DNA, 25 bp, Rattus norvegicus
aagcgagctgtgtttcctgacgaca

SEQ ID NO: 41761 - DNA, 25 bp, Rattus norvegicus
aagcgagcttcgagagcaccgggca

SEQ ID NO: 41762 - DNA, 25 bp, Rattus norvegicus
aagcgagcttcgtgagcaccgggca

SEQ ID NO: 41763 - DNA, 25 bp, Rattus norvegicus
aagcgagctttcaacatcctgatgt

SEQ ID NO: 41764 - DNA, 25 bp, Rattus norvegicus
aagcgagctttctacatcctgatgt

SEQ ID NO: 41765 - DNA, 25 bp, Rattus norvegicus
aagcgaggacgccagatacctcaaa

SEQ ID NO: 41766 - DNA, 25 bp, Rattus norvegicus
aagcgaggacgcgagatacctcaaa

SEQ ID NO: 41767 - DNA, 25 bp, Rattus norvegicus
aagcgaggcctgataccttttcctg

SEQ ID NO: 41768 - DNA, 25 bp, Rattus norvegicus
aagcgaggcctgttaccttttcctg

SEQ ID NO: 41769 - DNA, 25 bp, Rattus norvegicus
aagcgaggctttcctaagagacgtg

SEQ ID NO: 41770 - DNA, 25 bp, Rattus norvegicus
aagcgaggctttgctaagagacgtg

SEQ ID NO: 41771 - DNA, 25 bp, Rattus norvegicus
aagcgagggaatctgttctgtttat

SEQ ID NO: 41772 - DNA, 25 bp, Rattus norvegicus
aagcgagggaatgtgttctgtttat

SEQ ID NO: 41773 - DNA, 25 bp, Rattus norvegicus
aagcgaggttgaccgggctggtcat

SEQ ID NO: 41774 - DNA, 25 bp, Rattus norvegicus
aagcgaggttgagcgggctggtcat

SEQ ID NO: 41775 - DNA, 25 bp, Rattus norvegicus
aagcgagtacaacaagggcagcaac

SEQ ID NO: 41776 - DNA, 25 bp, Rattus norvegicus
aagcgagtacaagaagggcagcaac

SEQ ID NO: 41777 - DNA, 25 bp, Rattus norvegicus
aagcgagtagataacgcccgcctca

SEQ ID NO: 41778 - DNA, 25 bp, Rattus norvegicus
aagcgagtagattacgcccgcctca

SEQ ID NO: 41779 - DNA, 25 bp, Rattus norvegicus
aagcgagtatgacctcattctgaac

SEQ ID NO: 41780 - DNA, 25 bp, Rattus norvegicus
aagcgagtatgagctcattctgaac

SEQ ID NO: 41781 - DNA, 25 bp, Rattus norvegicus
aagcgagtcgttactcaacagccga

SEQ ID NO: 41782 - DNA, 25 bp, Rattus norvegicus
aagcgagtcgtttctcaacagccga

SEQ ID NO: 41783 - DNA, 25 bp, Rattus norvegicus
aagcgagtctccagctaatgagtca

SEQ ID NO: 41784 - DNA, 25 bp, Rattus norvegicus
aagcgagtctcctgctaatgagtca

SEQ ID NO: 41785 - DNA, 25 bp, Rattus norvegicus
aagcgagtgactccctggactgtgt

SEQ ID NO: 41786 - DNA, 25 bp, Rattus norvegicus
aagcgagtgactgcctggactgtgt

SEQ ID NO: 41787 - DNA, 25 bp, Rattus norvegicus
aagcgagtgcccatgggccccatca

SEQ ID NO: 41788 - DNA, 25 bp, Rattus norvegicus
aagcgagtgcccttgggccccatca

SEQ ID NO: 41789 - DNA, 25 bp, Rattus norvegicus
aagcgagtgctgaccgatgctgacg

SEQ ID NO: 41790 - DNA, 25 bp, Rattus norvegicus
aagcgagtgctgtccgatgctgacg

SEQ ID NO: 41791 - DNA, 25 bp, Rattus norvegicus
aagcgagtggaacgtggcttcctct

SEQ ID NO: 41792 - DNA, 25 bp, Rattus norvegicus
aagcgagtggaaggtggcttcctct

SEQ ID NO: 41793 - DNA, 25 bp, Rattus norvegicus
aagcgagtggcaatccagttcctaa

SEQ ID NO: 41794 - DNA, 25 bp, Rattus norvegicus
aagcgagtggcattccagttcctaa

SEQ ID NO: 41795 - DNA, 25 bp, Rattus norvegicus
aagcgagttataccttctccccagg

SEQ ID NO: 41796 - DNA, 25 bp, Rattus norvegicus
aagcgagttatagcttctccccagg

SEQ ID NO: 41797 - DNA, 25 bp, Rattus norvegicus
aagcgagttctaaagctgctgggag

SEQ ID NO: 41798 - DNA, 25 bp, Rattus norvegicus
aagcgagttctatagctgctgggag

SEQ ID NO: 41799 - DNA, 25 bp, Rattus norvegicus
aagcgagttttcatgctgacccact

SEQ ID NO: 41800 - DNA, 25 bp, Rattus norvegicus
aagcgagttttcttgctgacccact

SEQ ID NO: 41801 - DNA, 25 bp, Rattus norvegicus
aagcgataccttcttctttgaactg

SEQ ID NO: 41802 - DNA, 25 bp, Rattus norvegicus
aagcgataccttgttctttgaactg

SEQ ID NO: 41803 - DNA, 25 bp, Rattus norvegicus
aagcgataggagctcagtgctactt

SEQ ID NO: 41804 - DNA, 25 bp, Rattus norvegicus
aagcgataggaggtcagtgctactt

SEQ ID NO: 41805 - DNA, 25 bp, Rattus norvegicus
aagcgatattcgacagcctcaagga

SEQ ID NO: 41806 - DNA, 25 bp, Rattus norvegicus
aagcgatattcgtcagcctcaagga

SEQ ID NO: 41807 - DNA, 25 bp, Rattus norvegicus
aagcgatcagtacaaggcccagatt

SEQ ID NO: 41808 - DNA, 25 bp, Rattus norvegicus
aagcgatcagtagaaggcccagatt

SEQ ID NO: 41809 - DNA, 25 bp, Rattus norvegicus
aagcgatcatccactttttcctgaa

SEQ ID NO: 41810 - DNA, 25 bp, Rattus norvegicus
aagcgatcatcctctttttcctgaa

SEQ ID NO: 41811 - DNA, 25 bp, Rattus norvegicus
aagcgatcttctaggattcaacatc

SEQ ID NO: 41812 - DNA, 25 bp, Rattus norvegicus
aagcgatcttcttggattcaacatc

SEQ ID NO: 41813 - DNA, 25 bp, Rattus norvegicus
aagcgatgacgcctcctagtggttg

SEQ ID NO: 41814 - DNA, 25 bp, Rattus norvegicus
aagcgatgacgcgtcctagtggttg

SEQ ID NO: 41815 - DNA, 25 bp, Rattus norvegicus
aagcgatgctgcactgcatgtgtgg

SEQ ID NO: 41816 - DNA, 25 bp, Rattus norvegicus
aagcgatgctgctctgcatgtgtgg

SEQ ID NO: 41817 - DNA, 25 bp, Rattus norvegicus
aagcgatgtcgccatcagttgccct

SEQ ID NO: 41818 - DNA, 25 bp, Rattus norvegicus
aagcgatgtcgcgatcagttgccct

SEQ ID NO: 41819 - DNA, 25 bp, Rattus norvegicus
aagcgattatatagtcaccttcccc

SEQ ID NO: 41820 - DNA, 25 bp, Rattus norvegicus
aagcgattatattgtcaccttcccc

SEQ ID NO: 41821 - DNA, 25 bp, Rattus norvegicus
aagcgattgtaaaactgtctccggt

SEQ ID NO: 41822 - DNA, 25 bp, Rattus norvegicus
aagcgattgtaatactgtctccggt

SEQ ID NO: 41823 - DNA, 25 bp, Rattus norvegicus
aagcgattttatcttgcgctaaatt

SEQ ID NO: 41824 - DNA, 25 bp, Rattus norvegicus
aagcgattttatgttgcgctaaatt

SEQ ID NO: 41825 - DNA, 25 bp, Rattus norvegicus
aagcgcaaagaactttccctcgcac

SEQ ID NO: 41826 - DNA, 25 bp, Rattus norvegicus
aagcgcaaagaagtttccctcgcac

SEQ ID NO: 41827 - DNA, 25 bp, Rattus norvegicus
aagcgcaacactaggcgttttttat

SEQ ID NO: 41828 - DNA, 25 bp, Rattus norvegicus
aagcgcaacacttggcgttttttat

SEQ ID NO: 41829 - DNA, 25 bp, Rattus norvegicus
aagcgcaacctaatcttggaacagg

SEQ ID NO: 41830 - DNA, 25 bp, Rattus norvegicus
aagcgcaacctattcttggaacagg

SEQ ID NO: 41831 - DNA, 25 bp, Rattus norvegicus
aagcgcacagccaggccggcgacag

SEQ ID NO: 41832 - DNA, 25 bp, Rattus norvegicus
aagcgcacagcctggccggcgacag

SEQ ID NO: 41833 - DNA, 25 bp, Rattus norvegicus
aagcgcacagttcgctggacagcct

SEQ ID NO: 41834 - DNA, 25 bp, Rattus norvegicus
aagcgcacagttggctggacagcct

SEQ ID NO: 41835 - DNA, 25 bp, Rattus norvegicus
aagcgcaccagcatctgagtcaaaa

SEQ ID NO: 41836 - DNA, 25 bp, Rattus norvegicus
aagcgcaccagcttctgagtcaaaa

SEQ ID NO: 41837 - DNA, 25 bp, Rattus norvegicus
aagcgcacccttcctgtgacggaca

SEQ ID NO: 41838 - DNA, 25 bp, Rattus norvegicus
aagcgcacccttgctgtgacggaca

SEQ ID NO: 41839 - DNA, 25 bp, Rattus norvegicus
aagcgcactgtgctcaccgagagtg

SEQ ID NO: 41840 - DNA, 25 bp, Rattus norvegicus
aagcgcactgtggtcaccgagagtg

SEQ ID NO: 41841 - DNA, 25 bp, Rattus norvegicus
aagcgcacttttcttttcaagccag

SEQ ID NO: 41842 - DNA, 25 bp, Rattus norvegicus
aagcgcacttttgttttcaagccag

SEQ ID NO: 41843 - DNA, 25 bp, Rattus norvegicus
aagcgcagactgaacatctcaccat

SEQ ID NO: 41844 - DNA, 25 bp, Rattus norvegicus
aagcgcagactgtacatctcaccat

SEQ ID NO: 41845 - DNA, 25 bp, Rattus norvegicus
aagcgcagagttatggccttaccca

SEQ ID NO: 41846 - DNA, 25 bp, Rattus norvegicus
aagcgcagagttttggccttaccca

SEQ ID NO: 41847 - DNA, 25 bp, Rattus norvegicus
aagcgcagcaagataggcccgtaca

SEQ ID NO: 41848 - DNA, 25 bp, Rattus norvegicus
aagcgcagcaagttaggcccgtaca

SEQ ID NO: 41849 - DNA, 25 bp, Rattus norvegicus
aagcgcagcacgcaagcccttgaag

SEQ ID NO: 41850 - DNA, 25 bp, Rattus norvegicus
aagcgcagcacggaagcccttgaag

SEQ ID NO: 41851 - DNA, 25 bp, Rattus norvegicus
aagcgcagcaggagccaagaccgtt

SEQ ID NO: 41852 - DNA, 25 bp, Rattus norvegicus
aagcgcagcaggtgccaagaccgtt

SEQ ID NO: 41853 - DNA, 25 bp, Rattus norvegicus
aagcgcagccggaagcacgggatta

SEQ ID NO: 41854 - DNA, 25 bp, Rattus norvegicus
aagcgcagccggtagcacgggatta

SEQ ID NO: 41855 - DNA, 25 bp, Rattus norvegicus
aagcgcagcgagcaggacacagaaa

SEQ ID NO: 41856 - DNA, 25 bp, Rattus norvegicus
aagcgcagcgaggaggacacagaaa

SEQ ID NO: 41857 - DNA, 25 bp, Rattus norvegicus
aagcgcagcgcactggcagacacta

SEQ ID NO: 41858 - DNA, 25 bp, Rattus norvegicus
aagcgcagcgcagtggcagacacta

SEQ ID NO: 41859 - DNA, 25 bp, Rattus norvegicus
aagcgcaggcagagcgtttccccat

SEQ ID NO: 41860 - DNA, 25 bp, Rattus norvegicus
aagcgcaggcagtgcgtttccccat

SEQ ID NO: 41861 - DNA, 25 bp, Rattus norvegicus
aagcgcaggccaaattcgggagtga

SEQ ID NO: 41862 - DNA, 25 bp, Rattus norvegicus
aagcgcaggccatattcgggagtga

SEQ ID NO: 41863 - DNA, 25 bp, Rattus norvegicus
aagcgcagggctagtttgtcaaaca

SEQ ID NO: 41864 - DNA, 25 bp, Rattus norvegicus
aagcgcagggcttgtttgtcaaaca

SEQ ID NO: 41865 - DNA, 25 bp, Rattus norvegicus
aagcgcagtgtgatgggctgtaata

SEQ ID NO: 41866 - DNA, 25 bp, Rattus norvegicus
aagcgcagtgtgttgggctgtaata

SEQ ID NO: 41867 - DNA, 25 bp, Rattus norvegicus
aagcgcagttccagattcccagtga

SEQ ID NO: 41868 - DNA, 25 bp, Rattus norvegicus
aagcgcagttcctgattcccagtga

SEQ ID NO: 41869 - DNA, 25 bp, Rattus norvegicus
aagcgcatcatcaccgacaagcact

SEQ ID NO: 41870 - DNA, 25 bp, Rattus norvegicus
aagcgcatcatctccgacaagcact

SEQ ID NO: 41871 - DNA, 25 bp, Rattus norvegicus
aagcgcatcgttaagctgattctag

SEQ ID NO: 41872 - DNA, 25 bp, Rattus norvegicus
aagcgcatcgtttagctgattctag

SEQ ID NO: 41873 - DNA, 25 bp, Rattus norvegicus
aagcgcatctcgcagctgtttcggg

SEQ ID NO: 41874 - DNA, 25 bp, Rattus norvegicus
aagcgcatctcggagctgtttcggg

SEQ ID NO: 41875 - DNA, 25 bp, Rattus norvegicus
aagcgcatgtatctgtgagtgtcct

SEQ ID NO: 41876 - DNA, 25 bp, Rattus norvegicus
aagcgcatgtatgtgtgagtgtcct

SEQ ID NO: 41877 - DNA, 25 bp, Rattus norvegicus
aagcgcatgtgcctaacttcatttt

SEQ ID NO: 41878 - DNA, 25 bp, Rattus norvegicus
aagcgcatgtgcgtaacttcatttt

SEQ ID NO: 41879 - DNA, 25 bp, Rattus norvegicus
aagcgcattctcatgagccttacaa

SEQ ID NO: 41880 - DNA, 25 bp, Rattus norvegicus
aagcgcattctcttgagccttacaa

SEQ ID NO: 41881 - DNA, 25 bp, Rattus norvegicus
aagcgccactcccagtaggagccag

SEQ ID NO: 41882 - DNA, 25 bp, Rattus norvegicus
aagcgccactccgagtaggagccag

SEQ ID NO: 41883 - DNA, 25 bp, Rattus norvegicus
aagcgccagtaaagccagacgcatg

SEQ ID NO: 41884 - DNA, 25 bp, Rattus norvegicus
aagcgccagtaatgccagacgcatg

SEQ ID NO: 41885 - DNA, 25 bp, Rattus norvegicus
aagcgccatttaataggacatgtcc

SEQ ID NO: 41886 - DNA, 25 bp, Rattus norvegicus
aagcgccatttattaggacatgtcc

SEQ ID NO: 41887 - DNA, 25 bp, Rattus norvegicus
aagcgccattttcactgagggcaga

SEQ ID NO: 41888 - DNA, 25 bp, Rattus norvegicus
aagcgccattttgactgagggcaga

SEQ ID NO: 41889 - DNA, 25 bp, Rattus norvegicus
aagcgcccagttcctaagggtgcaa

SEQ ID NO: 41890 - DNA, 25 bp, Rattus norvegicus
aagcgcccagttgctaagggtgcaa

SEQ ID NO: 41891 - DNA, 25 bp, Rattus norvegicus
aagcgccccccacaagaagagcgga

SEQ ID NO: 41892 - DNA, 25 bp, Rattus norvegicus
aagcgccccccagaagaagagcgga

SEQ ID NO: 41893 - DNA, 25 bp, Rattus norvegicus
aagcgccccgctcaagattatgtgc

SEQ ID NO: 41894 - DNA, 25 bp, Rattus norvegicus
aagcgccccgctgaagattatgtgc

SEQ ID NO: 41895 - DNA, 25 bp, Rattus norvegicus
aagcgccgattgctcttctgcaaga

SEQ ID NO: 41896 - DNA, 25 bp, Rattus norvegicus
aagcgccgattggtcttctgcaaga

SEQ ID NO: 41897 - DNA, 25 bp, Rattus norvegicus
aagcgccgcaaccaggagatgcagc

SEQ ID NO: 41898 - DNA, 25 bp, Rattus norvegicus
aagcgccgcaacgaggagatgcagc

SEQ ID NO: 41899 - DNA, 25 bp, Rattus norvegicus
aagcgccggaacaagaggctgtact

SEQ ID NO: 41900 - DNA, 25 bp, Rattus norvegicus
aagcgccggaactagaggctgtact

SEQ ID NO: 41901 - DNA, 25 bp, Rattus norvegicus
aagcgccgtggtacatcatctgtca

SEQ ID NO: 41902 - DNA, 25 bp, Rattus norvegicus
aagcgccgtggttcatcatctgtca

SEQ ID NO: 41903 - DNA, 25 bp, Rattus norvegicus
aagcgcctcgatcagctttgatgaa

SEQ ID NO: 41904 - DNA, 25 bp, Rattus norvegicus
aagcgcctcgatgagctttgatgaa

SEQ ID NO: 41905 - DNA, 25 bp, Rattus norvegicus
aagcgcctgaggattgccttgactc

SEQ ID NO: 41906 - DNA, 25 bp, Rattus norvegicus
aagcgcctgaggtttgccttgactc

SEQ ID NO: 41907 - DNA, 25 bp, Rattus norvegicus
aagcgcctgggaaggcaaagcccaa

SEQ ID NO: 41908 - DNA, 25 bp, Rattus norvegicus
aagcgcctgggatggcaaagcccaa

SEQ ID NO: 41909 - DNA, 25 bp, Rattus norvegicus
aagcgccttgagactgcttgttgtc

SEQ ID NO: 41910 - DNA, 25 bp, Rattus norvegicus
aagcgccttgagtctgcttgttgtc

SEQ ID NO: 41911 - DNA, 25 bp, Rattus norvegicus
aagcgcgagcggacatcatctctaa

SEQ ID NO: 41912 - DNA, 25 bp, Rattus norvegicus
aagcgcgagcggtcatcatctctaa

SEQ ID NO: 41913 - DNA, 25 bp, Rattus norvegicus
aagcgcgcagcaacagtccgccaga

SEQ ID NO: 41914 - DNA, 25 bp, Rattus norvegicus
aagcgcgcagcatcagtccgccaga

SEQ ID NO: 41915 - DNA, 25 bp, Rattus norvegicus
aagcgcgcagctcaccatttggaag

SEQ ID NO: 41916 - DNA, 25 bp, Rattus norvegicus
aagcgcgcagctgaccatttggaag

SEQ ID NO: 41917 - DNA, 25 bp, Rattus norvegicus
aagcgcgccgcgcaggtagtccggg

SEQ ID NO: 41918 - DNA, 25 bp, Rattus norvegicus
aagcgcgccgcggaggtagtccggg

SEQ ID NO: 41919 - DNA, 25 bp, Rattus norvegicus
aagcgcggccagacctgcgtggtac

SEQ ID NO: 41920 - DNA, 25 bp, Rattus norvegicus
aagcgcggccagtcctgcgtggtac

SEQ ID NO: 41921 - DNA, 25 bp, Rattus norvegicus
aagcgcggcgtaagaagatctgttt

SEQ ID NO: 41922 - DNA, 25 bp, Rattus norvegicus
aagcgcggcgtatgaagatctgttt

SEQ ID NO: 41923 - DNA, 25 bp, Rattus norvegicus
aagcgcgtacatatcgggcggacac

SEQ ID NO: 41924 - DNA, 25 bp, Rattus norvegicus
aagcgcgtacatttcgggcggacac

SEQ ID NO: 41925 - DNA, 25 bp, Rattus norvegicus
aagcgcgtgctgagcaagctgcagt

SEQ ID NO: 41926 - DNA, 25 bp, Rattus norvegicus
aagcgcgtgctgagctgacgtaatc

SEQ ID NO: 41927 - DNA, 25 bp, Rattus norvegicus
aagcgcgtgctgtgcaagctgcagt

SEQ ID NO: 41928 - DNA, 25 bp, Rattus norvegicus
aagcgcgtgctgtgctgacgtaatc

SEQ ID NO: 41929 - DNA, 25 bp, Rattus norvegicus
aagcgctatgacaggaccgggaaga

SEQ ID NO: 41930 - DNA, 25 bp, Rattus norvegicus
aagcgctatgactggaccgggaaga

SEQ ID NO: 41931 - DNA, 25 bp, Rattus norvegicus
aagcgctccaggactcagagccaaa

SEQ ID NO: 41932 - DNA, 25 bp, Rattus norvegicus
aagcgctccaggtctcagagccaaa

SEQ ID NO: 41933 - DNA, 25 bp, Rattus norvegicus
aagcgctccctcctggaaagtggct

SEQ ID NO: 41934 - DNA, 25 bp, Rattus norvegicus
aagcgctccctcgtggaaagtggct

SEQ ID NO: 41935 - DNA, 25 bp, Rattus norvegicus
aagcgctcctgaaggacaggcctct

SEQ ID NO: 41936 - DNA, 25 bp, Rattus norvegicus
aagcgctcctgatggacaggcctct

SEQ ID NO: 41937 - DNA, 25 bp, Rattus norvegicus
aagcgctctcttctttcttttctac

SEQ ID NO: 41938 - DNA, 25 bp, Rattus norvegicus
aagcgctctcttgtttcttttctac

SEQ ID NO: 41939 - DNA, 25 bp, Rattus norvegicus
aagcgctctgaacattaccctagaa

SEQ ID NO: 41940 - DNA, 25 bp, Rattus norvegicus
aagcgctctgaagattaccctagaa

SEQ ID NO: 41941 - DNA, 25 bp, Rattus norvegicus
aagcgctctgctaggtatggcacca

SEQ ID NO: 41942 - DNA, 25 bp, Rattus norvegicus
aagcgctctgcttggtatggcacca

SEQ ID NO: 41943 - DNA, 25 bp, Rattus norvegicus
aagcgctcttagaagcaggacagaa

SEQ ID NO: 41944 - DNA, 25 bp, Rattus norvegicus
aagcgctcttagtagcaggacagaa

SEQ ID NO: 41945 - DNA, 25 bp, Rattus norvegicus
aagcgctgcagtcttgctgtatggc

SEQ ID NO: 41946 - DNA, 25 bp, Rattus norvegicus
aagcgctgcagtgttgctgtatggc

SEQ ID NO: 41947 - DNA, 25 bp, Rattus norvegicus
aagcgctgcctgcagctgcaagaaa

SEQ ID NO: 41948 - DNA, 25 bp, Rattus norvegicus
aagcgctgcctggagctgcaagaaa

SEQ ID NO: 41949 - DNA, 25 bp, Rattus norvegicus
aagcgctgcgggagaatgacacctt

SEQ ID NO: 41950 - DNA, 25 bp, Rattus norvegicus
aagcgctgcgggtgaatgacacctt

SEQ ID NO: 41951 - DNA, 25 bp, Rattus norvegicus
aagcgctggcccatacagaggcggc

SEQ ID NO: 41952 - DNA, 25 bp, Rattus norvegicus
aagcgctggcccttacagaggcggc

SEQ ID NO: 41953 - DNA, 25 bp, Rattus norvegicus
aagcgctggtttcttctcgtctcaa

SEQ ID NO: 41954 - DNA, 25 bp, Rattus norvegicus
aagcgctggtttgttctcgtctcaa

SEQ ID NO: 41955 - DNA, 25 bp, Rattus norvegicus
aagcgctgttcaagaactgactcta

SEQ ID NO: 41956 - DNA, 25 bp, Rattus norvegicus
aagcgctgttcatgaactgactcta

SEQ ID NO: 41957 - DNA, 25 bp, Rattus norvegicus
aagcgcttaattaggccaacagtca

SEQ ID NO: 41958 - DNA, 25 bp, Rattus norvegicus
aagcgcttaatttggccaacagtca

SEQ ID NO: 41959 - DNA, 25 bp, Rattus norvegicus
aagcgcttagttattcagctcgcaa

SEQ ID NO: 41960 - DNA, 25 bp, Rattus norvegicus
aagcgcttagtttttcagctcgcaa

SEQ ID NO: 41961 - DNA, 25 bp, Rattus norvegicus
aagcgcttccttatgcacctttaat

SEQ ID NO: 41962 - DNA, 25 bp, Rattus norvegicus
aagcgcttccttttgcacctttaat

SEQ ID NO: 41963 - DNA, 25 bp, Rattus norvegicus
aagcgcttgctcaatctctgtacag

SEQ ID NO: 41964 - DNA, 25 bp, Rattus norvegicus
aagcgcttgctctatctctgtacag

SEQ ID NO: 41965 - DNA, 25 bp, Rattus norvegicus
aagcgcttgtcacatggaggagccc

SEQ ID NO: 41966 - DNA, 25 bp, Rattus norvegicus
aagcgcttgtcagatggaggagccc

SEQ ID NO: 41967 - DNA, 25 bp, Rattus norvegicus
aagcgcttgtgcaaacagagccaga

SEQ ID NO: 41968 - DNA, 25 bp, Rattus norvegicus
aagcgcttgtgctaacagagccaga

SEQ ID NO: 41969 - DNA, 25 bp, Rattus norvegicus
aagcgctttacacacccagctgtct

SEQ ID NO: 41970 - DNA, 25 bp, Rattus norvegicus
aagcgctttacagacccagctgtct

SEQ ID NO: 41971 - DNA, 25 bp, Rattus norvegicus
aagcgctttggaacacagactgcct

SEQ ID NO: 41972 - DNA, 25 bp, Rattus norvegicus
aagcgctttggatcacagactgcct

SEQ ID NO: 41973 - DNA, 25 bp, Rattus norvegicus
aagcgctttgttatcctgacagtat

SEQ ID NO: 41974 - DNA, 25 bp, Rattus norvegicus
aagcgctttgttttcctgacagtat

SEQ ID NO: 41975 - DNA, 25 bp, Rattus norvegicus
aagcggaaccataggagccttctgc

SEQ ID NO: 41976 - DNA, 25 bp, Rattus norvegicus
aagcggaaccatattctgaatacca

SEQ ID NO: 41977 - DNA, 25 bp, Rattus norvegicus
aagcggaaccattggagccttctgc

SEQ ID NO: 41978 - DNA, 25 bp, Rattus norvegicus
aagcggaaccattttctgaatacca

SEQ ID NO: 41979 - DNA, 25 bp, Rattus norvegicus
aagcggaagctactgatcccgtctg

SEQ ID NO: 41980 - DNA, 25 bp, Rattus norvegicus
aagcggaagctagtgatcccgtctg

SEQ ID NO: 41981 - DNA, 25 bp, Rattus norvegicus
aagcggaagtcccagttgttctgaa

SEQ ID NO: 41982 - DNA, 25 bp, Rattus norvegicus
aagcggaagtccgagttgttctgaa

SEQ ID NO: 41983 - DNA, 25 bp, Rattus norvegicus
aagcggaataacaagttgtccctag

SEQ ID NO: 41984 - DNA, 25 bp, Rattus norvegicus
aagcggaataactagttgtccctag

SEQ ID NO: 41985 - DNA, 25 bp, Rattus norvegicus
aagcggacagacagttcctgagcct

SEQ ID NO: 41986 - DNA, 25 bp, Rattus norvegicus
aagcggacagactgttcctgagcct

SEQ ID NO: 41987 - DNA, 25 bp, Rattus norvegicus
aagcggacccagagagccattgcag

SEQ ID NO: 41988 - DNA, 25 bp, Rattus norvegicus
aagcggacccagtgagccattgcag

SEQ ID NO: 41989 - DNA, 25 bp, Rattus norvegicus
aagcggaccgttatgagatgtttct

SEQ ID NO: 41990 - DNA, 25 bp, Rattus norvegicus
aagcggaccgttttgagatgtttct

SEQ ID NO: 41991 - DNA, 25 bp, Rattus norvegicus
aagcggactgcacttgtgactttgt

SEQ ID NO: 41992 - DNA, 25 bp, Rattus norvegicus
aagcggactgcagttgtgactttgt

SEQ ID NO: 41993 - DNA, 25 bp, Rattus norvegicus
aagcggagtctgactctgggtacta

SEQ ID NO: 41994 - DNA, 25 bp, Rattus norvegicus
aagcggagtctgataggcatccccg

SEQ ID NO: 41995 - DNA, 25 bp, Rattus norvegicus
aagcggagtctgtctctgggtacta

SEQ ID NO: 41996 - DNA, 25 bp, Rattus norvegicus
aagcggagtctgttaggcatccccg

SEQ ID NO: 41997 - DNA, 25 bp, Rattus norvegicus
aagcggagtgcacctcacaggtgcc

SEQ ID NO: 41998 - DNA, 25 bp, Rattus norvegicus
aagcggagtgcagctcacaggtgcc

SEQ ID NO: 41999 - DNA, 25 bp, Rattus norvegicus
aagcggatatatatcctatgcaaaa

SEQ ID NO: 42000 - DNA, 25 bp, Rattus norvegicus
aagcggatatatttcctatgcaaaa

SEQ ID NO: 42001 - DNA, 25 bp, Rattus norvegicus
aagcggatctataagaatgtctcac

SEQ ID NO: 42002 - DNA, 25 bp, Rattus norvegicus
aagcggatctattagaatgtctcac

SEQ ID NO: 42003 - DNA, 25 bp, Rattus norvegicus
aagcggatctccaccattaggatga

SEQ ID NO: 42004 - DNA, 25 bp, Rattus norvegicus
aagcggatctcctccattaggatga

SEQ ID NO: 42005 - DNA, 25 bp, Rattus norvegicus
aagcggattaccatctttattttgt

SEQ ID NO: 42006 - DNA, 25 bp, Rattus norvegicus
aagcggattaccttctttattttgt

SEQ ID NO: 42007 - DNA, 25 bp, Rattus norvegicus
aagcggcagaatcctcttctggagc

SEQ ID NO: 42008 - DNA, 25 bp, Rattus norvegicus
aagcggcagaatgctcttctggagc

SEQ ID NO: 42009 - DNA, 25 bp, Rattus norvegicus
aagcggcagaggctgcctcgtctcc

SEQ ID NO: 42010 - DNA, 25 bp, Rattus norvegicus
aagcggcagagggtgcctcgtctcc

SEQ ID NO: 42011 - DNA, 25 bp, Rattus norvegicus
aagcggcagatccagctgaggacca

SEQ ID NO: 42012 - DNA, 25 bp, Rattus norvegicus
aagcggcagatcgagctgaggacca

SEQ ID NO: 42013 - DNA, 25 bp, Rattus norvegicus
aagcggcagccaagcattcttcaat

SEQ ID NO: 42014 - DNA, 25 bp, Rattus norvegicus
aagcggcagccatgcattcttcaat

SEQ ID NO: 42015 - DNA, 25 bp, Rattus norvegicus
aagcggcagcgcaagggcctctgaa

SEQ ID NO: 42016 - DNA, 25 bp, Rattus norvegicus
aagcggcagcgctagggcctctgaa

SEQ ID NO: 42017 - DNA, 25 bp, Rattus norvegicus
aagcggcattatatcatttgacgag

SEQ ID NO: 42018 - DNA, 25 bp, Rattus norvegicus
aagcggcattatttcatttgacgag

SEQ ID NO: 42019 - DNA, 25 bp, Rattus norvegicus
aagcggccaaccactgtgaaagtat

SEQ ID NO: 42020 - DNA, 25 bp, Rattus norvegicus
aagcggccaacctctgtgaaagtat

SEQ ID NO: 42021 - DNA, 25 bp, Rattus norvegicus
aagcggcctctaacagccaagtaga

SEQ ID NO: 42022 - DNA, 25 bp, Rattus norvegicus
aagcggcctctatcagccaagtaga

SEQ ID NO: 42023 - DNA, 25 bp, Rattus norvegicus
aagcggcctgcgctgcgcctggtgg

SEQ ID NO: 42024 - DNA, 25 bp, Rattus norvegicus
aagcggcctgcggtgcgcctggtgg

SEQ ID NO: 42025 - DNA, 25 bp, Rattus norvegicus
aagcggcggaccagcctttttgcga

SEQ ID NO: 42026 - DNA, 25 bp, Rattus norvegicus
aagcggcggacctgcctttttgcga

SEQ ID NO: 42027 - DNA, 25 bp, Rattus norvegicus
aagcggcggcacatcctcgaagaga

SEQ ID NO: 42028 - DNA, 25 bp, Rattus norvegicus
aagcggcggcacttcctcgaagaga

SEQ ID NO: 42029 - DNA, 25 bp, Rattus norvegicus
aagcggcgtggaatctcattttgta

SEQ ID NO: 42030 - DNA, 25 bp, Rattus norvegicus
aagcggcgtggattctcattttgta

SEQ ID NO: 42031 - DNA, 25 bp, Rattus norvegicus
aagcggctcacaagggcctgtaact

SEQ ID NO: 42032 - DNA, 25 bp, Rattus norvegicus
aagcggctcacatgggcctgtaact

SEQ ID NO: 42033 - DNA, 25 bp, Rattus norvegicus
aagcggctccctagctgacatggaa

SEQ ID NO: 42034 - DNA, 25 bp, Rattus norvegicus
aagcggctcccttgctgacatggaa

SEQ ID NO: 42035 - DNA, 25 bp, Rattus norvegicus
aagcggctccttcgaattgactcca

SEQ ID NO: 42036 - DNA, 25 bp, Rattus norvegicus
aagcggctccttggaattgactcca

SEQ ID NO: 42037 - DNA, 25 bp, Rattus norvegicus
aagcggctgcttatggttaattatg

SEQ ID NO: 42038 - DNA, 25 bp, Rattus norvegicus
aagcggctgcttttggttaattatg

SEQ ID NO: 42039 - DNA, 25 bp, Rattus norvegicus
aagcggctgttcatggcatacttta

SEQ ID NO: 42040 - DNA, 25 bp, Rattus norvegicus
aagcggctgttcttggcatacttta

SEQ ID NO: 42041 - DNA, 25 bp, Rattus norvegicus
aagcgggacacgatggtggtcctcc

SEQ ID NO: 42042 - DNA, 25 bp, Rattus norvegicus
aagcgggacacgttggtggtcctcc

SEQ ID NO: 42043 - DNA, 25 bp, Rattus norvegicus
aagcgggactacaccgcgaggagaa

SEQ ID NO: 42044 - DNA, 25 bp, Rattus norvegicus
aagcgggactactccgcgaggagaa

SEQ ID NO: 42045 - DNA, 25 bp, Rattus norvegicus
aagcgggatgcacttctcttagcag

SEQ ID NO: 42046 - DNA, 25 bp, Rattus norvegicus
aagcgggatgcagttctcttagcag

SEQ ID NO: 42047 - DNA, 25 bp, Rattus norvegicus
aagcgggcctttagatatattaaat

SEQ ID NO: 42048 - DNA, 25 bp, Rattus norvegicus
aagcgggccttttgatatattaaat

SEQ ID NO: 42049 - DNA, 25 bp, Rattus norvegicus
aagcgggcgcagacacccgaaacgg

SEQ ID NO: 42050 - DNA, 25 bp, Rattus norvegicus
aagcgggcgcagtcacccgaaacgg

SEQ ID NO: 42051 - DNA, 25 bp, Rattus norvegicus
aagcgggcgccaagtcagtgcatgt

SEQ ID NO: 42052 - DNA, 25 bp, Rattus norvegicus
aagcgggcgccatgtcagtgcatgt

SEQ ID NO: 42053 - DNA, 25 bp, Rattus norvegicus
aagcgggctttccttatcgaggagc

SEQ ID NO: 42054 - DNA, 25 bp, Rattus norvegicus
aagcgggctttcgttatcgaggagc

SEQ ID NO: 42055 - DNA, 25 bp, Rattus norvegicus
aagcgggtgcttaagggtagatctc

SEQ ID NO: 42056 - DNA, 25 bp, Rattus norvegicus
aagcgggtgctttagggtagatctc

SEQ ID NO: 42057 - DNA, 25 bp, Rattus norvegicus
aagcggtatgtgaacttgcgcccac

SEQ ID NO: 42058 - DNA, 25 bp, Rattus norvegicus
aagcggtatgtgtacttgcgcccac

SEQ ID NO: 42059 - DNA, 25 bp, Rattus norvegicus
aagcggtattgtccatcttcaggtt

SEQ ID NO: 42060 - DNA, 25 bp, Rattus norvegicus
aagcggtattgtgcatcttcaggtt

SEQ ID NO: 42061 - DNA, 25 bp, Rattus norvegicus
aagcggtcaagaatgcagcctctac

SEQ ID NO: 42062 - DNA, 25 bp, Rattus norvegicus
aagcggtcaagattgcagcctctac

SEQ ID NO: 42063 - DNA, 25 bp, Rattus norvegicus
aagcggtcacctacacaagactgaa

SEQ ID NO: 42064 - DNA, 25 bp, Rattus norvegicus
aagcggtcaccttcacaagactgaa

SEQ ID NO: 42065 - DNA, 25 bp, Rattus norvegicus
aagcggtccaaacacagtagcccag

SEQ ID NO: 42066 - DNA, 25 bp, Rattus norvegicus
aagcggtccaaagacagtagcccag

SEQ ID NO: 42067 - DNA, 25 bp, Rattus norvegicus
aagcggtccccaagactagaacctg

SEQ ID NO: 42068 - DNA, 25 bp, Rattus norvegicus
aagcggtccccatgactagaacctg

SEQ ID NO: 42069 - DNA, 25 bp, Rattus norvegicus
aagcggtccctcacttgggagactc

SEQ ID NO: 42070 - DNA, 25 bp, Rattus norvegicus
aagcggtccctctcttgggagactc

SEQ ID NO: 42071 - DNA, 25 bp, Rattus norvegicus
aagcggtcttgaattcagaaggact

SEQ ID NO: 42072 - DNA, 25 bp, Rattus norvegicus
aagcggtcttgatttcagaaggact

SEQ ID NO: 42073 - DNA, 25 bp, Rattus norvegicus
aagcggtcttggcacctcttctgac

SEQ ID NO: 42074 - DNA, 25 bp, Rattus norvegicus
aagcggtcttgggacctcttctgac

SEQ ID NO: 42075 - DNA, 25 bp, Rattus norvegicus
aagcggtgaatcagaaccttctcaa

SEQ ID NO: 42076 - DNA, 25 bp, Rattus norvegicus
aagcggtgaatctgaaccttctcaa

SEQ ID NO: 42077 - DNA, 25 bp, Rattus norvegicus
aagcggtgcagcctgctcaggaact

SEQ ID NO: 42078 - DNA, 25 bp, Rattus norvegicus
aagcggtgcagcgtgctcaggaact

SEQ ID NO: 42079 - DNA, 25 bp, Rattus norvegicus
aagcggtgccttagagtctatacta

SEQ ID NO: 42080 - DNA, 25 bp, Rattus norvegicus
aagcggtgcctttgagtctatacta

SEQ ID NO: 42081 - DNA, 25 bp, Rattus norvegicus
aagcggtggacaacagcaaggccaa

SEQ ID NO: 42082 - DNA, 25 bp, Rattus norvegicus
aagcggtggacatcagcaaggccaa

SEQ ID NO: 42083 - DNA, 25 bp, Rattus norvegicus
aagcggttacaacttgcccagctct

SEQ ID NO: 42084 - DNA, 25 bp, Rattus norvegicus
aagcggttacaagttgcccagctct

SEQ ID NO: 42085 - DNA, 25 bp, Rattus norvegicus
aagcggttcattcagaaggaaattc

SEQ ID NO: 42086 - DNA, 25 bp, Rattus norvegicus
aagcggttcattgagaaggaaattc

SEQ ID NO: 42087 - DNA, 25 bp, Rattus norvegicus
aagcggttccttcattcagatggtt

SEQ ID NO: 42088 - DNA, 25 bp, Rattus norvegicus
aagcggttccttgattcagatggtt

SEQ ID NO: 42089 - DNA, 25 bp, Rattus norvegicus
aagcggttgtctcaagcggctgtcc

SEQ ID NO: 42090 - DNA, 25 bp, Rattus norvegicus
aagcggttgtctgaagcggctgtcc

SEQ ID NO: 42091 - DNA, 25 bp, Rattus norvegicus
aagcggtttacccatctgcatcgat

SEQ ID NO: 42092 - DNA, 25 bp, Rattus norvegicus
aagcggtttaccgatctgcatcgat

SEQ ID NO: 42093 - DNA, 25 bp, Rattus norvegicus
aagcgtaaagctccccagaactctg

SEQ ID NO: 42094 - DNA, 25 bp, Rattus norvegicus
aagcgtaaagctgcccagaactctg

SEQ ID NO: 42095 - DNA, 25 bp, Rattus norvegicus
aagcgtaactcacatattaatgggc

SEQ ID NO: 42096 - DNA, 25 bp, Rattus norvegicus
aagcgtaactcagatattaatgggc

SEQ ID NO: 42097 - DNA, 25 bp, Rattus norvegicus
aagcgtaattgcctactagtcattg

SEQ ID NO: 42098 - DNA, 25 bp, Rattus norvegicus
aagcgtaattgcgtactagtcattg

SEQ ID NO: 42099 - DNA, 25 bp, Rattus norvegicus
aagcgtagcttaatcaccagagtgg

SEQ ID NO: 42100 - DNA, 25 bp, Rattus norvegicus
aagcgtagcttattcaccagagtgg

SEQ ID NO: 42101 - DNA, 25 bp, Rattus norvegicus
aagcgtatacatcccatcagagccc

SEQ ID NO: 42102 - DNA, 25 bp, Rattus norvegicus
aagcgtatacatgccatcagagccc

SEQ ID NO: 42103 - DNA, 25 bp, Rattus norvegicus
aagcgtcaaagaccctctctgatta

SEQ ID NO: 42104 - DNA, 25 bp, Rattus norvegicus
aagcgtcaaagagcctctctgatta

SEQ ID NO: 42105 - DNA, 25 bp, Rattus norvegicus
aagcgtcaagcaagccacggtggct

SEQ ID NO: 42106 - DNA, 25 bp, Rattus norvegicus
aagcgtcaagcatgccacggtggct

SEQ ID NO: 42107 - DNA, 25 bp, Rattus norvegicus
aagcgtcacctcagggcctggagaa

SEQ ID NO: 42108 - DNA, 25 bp, Rattus norvegicus
aagcgtcacctctgggcctggagaa

SEQ ID NO: 42109 - DNA, 25 bp, Rattus norvegicus
aagcgtcacctgatgagtttgccat

SEQ ID NO: 42110 - DNA, 25 bp, Rattus norvegicus
aagcgtcacctgttgagtttgccat

SEQ ID NO: 42111 - DNA, 25 bp, Rattus norvegicus
aagcgtcagctgacgaggcagcaga

SEQ ID NO: 42112 - DNA, 25 bp, Rattus norvegicus
aagcgtcagctgtcgaggcagcaga

SEQ ID NO: 42113 - DNA, 25 bp, Rattus norvegicus
aagcgtcatcgtccccatgcgacaa

SEQ ID NO: 42114 - DNA, 25 bp, Rattus norvegicus
aagcgtcatcgtgcccatgcgacaa

SEQ ID NO: 42115 - DNA, 25 bp, Rattus norvegicus
aagcgtcatgttccacacttgtaat

SEQ ID NO: 42116 - DNA, 25 bp, Rattus norvegicus
aagcgtcatgttgcacacttgtaat

SEQ ID NO: 42117 - DNA, 25 bp, Rattus norvegicus
aagcgtccaaggagatcccaggcga

SEQ ID NO: 42118 - DNA, 25 bp, Rattus norvegicus
aagcgtccaaggtgatcccaggcga

SEQ ID NO: 42119 - DNA, 25 bp, Rattus norvegicus
aagcgtccatatccatcgactttta

SEQ ID NO: 42120 - DNA, 25 bp, Rattus norvegicus
aagcgtccatatgcatcgactttta

SEQ ID NO: 42121 - DNA, 25 bp, Rattus norvegicus
aagcgtccatgtcaaggtccacatg

SEQ ID NO: 42122 - DNA, 25 bp, Rattus norvegicus
aagcgtccatgtgaaggtccacatg

SEQ ID NO: 42123 - DNA, 25 bp, Rattus norvegicus
aagcgtcccgcaccgttaagagaca

SEQ ID NO: 42124 - DNA, 25 bp, Rattus norvegicus
aagcgtcccgcagcgttaagagaca

SEQ ID NO: 42125 - DNA, 25 bp, Rattus norvegicus
aagcgtccgactaccataaaagtat

SEQ ID NO: 42126 - DNA, 25 bp, Rattus norvegicus
aagcgtccgacttccataaaagtat

SEQ ID NO: 42127 - DNA, 25 bp, Rattus norvegicus
aagcgtcctgctaatgcatctagtt

SEQ ID NO: 42128 - DNA, 25 bp, Rattus norvegicus
aagcgtcctgcttatgcatctagtt

SEQ ID NO: 42129 - DNA, 25 bp, Rattus norvegicus
aagcgtccttgacagaatttcctga

SEQ ID NO: 42130 - DNA, 25 bp, Rattus norvegicus
aagcgtccttgagagaatttcctga

SEQ ID NO: 42131 - DNA, 25 bp, Rattus norvegicus
aagcgtccttgtcaaattcctgctc

SEQ ID NO: 42132 - DNA, 25 bp, Rattus norvegicus
aagcgtccttgtgaaattcctgctc

SEQ ID NO: 42133 - DNA, 25 bp, Rattus norvegicus
aagcgtctagttatttgaaacgcag

SEQ ID NO: 42134 - DNA, 25 bp, Rattus norvegicus
aagcgtctagttttttgaaacgcag

SEQ ID NO: 42135 - DNA, 25 bp, Rattus norvegicus
aagcgtctcttcaacacgtatacag

SEQ ID NO: 42136 - DNA, 25 bp, Rattus norvegicus
aagcgtctcttctacacgtatacag

SEQ ID NO: 42137 - DNA, 25 bp, Rattus norvegicus
aagcgtctgactagtatcctcattg

SEQ ID NO: 42138 - DNA, 25 bp, Rattus norvegicus
aagcgtctgacttgtatcctcattg

SEQ ID NO: 42139 - DNA, 25 bp, Rattus norvegicus
aagcgtctgcagaagtcagtgatgc

SEQ ID NO: 42140 - DNA, 25 bp, Rattus norvegicus
aagcgtctgcagtagtcagtgatgc

SEQ ID NO: 42141 - DNA, 25 bp, Rattus norvegicus
aagcgtcttgttctcagcatgtgcc

SEQ ID NO: 42142 - DNA, 25 bp, Rattus norvegicus
aagcgtcttgttgtcagcatgtgcc

SEQ ID NO: 42143 - DNA, 25 bp, Rattus norvegicus
aagcgtctttaacaggctcgttgat

SEQ ID NO: 42144 - DNA, 25 bp, Rattus norvegicus
aagcgtctttaagaggctcgttgat

SEQ ID NO: 42145 - DNA, 25 bp, Rattus norvegicus
aagcgtgaagtgattgcctagaata

SEQ ID NO: 42146 - DNA, 25 bp, Rattus norvegicus
aagcgtgaagtgtttgcctagaata

SEQ ID NO: 42147 - DNA, 25 bp, Rattus norvegicus
aagcgtgagcaaccctgatctctgt

SEQ ID NO: 42148 - DNA, 25 bp, Rattus norvegicus
aagcgtgagcaagcctgatctctgt

SEQ ID NO: 42149 - DNA, 25 bp, Rattus norvegicus
aagcgtgaggctcgtctgacttaac

SEQ ID NO: 42150 - DNA, 25 bp, Rattus norvegicus
aagcgtgaggctggtctgacttaac

SEQ ID NO: 42151 - DNA, 25 bp, Rattus norvegicus
aagcgtgatgcacagcaccgtgcgc

SEQ ID NO: 42152 - DNA, 25 bp, Rattus norvegicus
aagcgtgatgcagagcaccgtgcgc

SEQ ID NO: 42153 - DNA, 25 bp, Rattus norvegicus
aagcgtgattacctgctaaggccgg

SEQ ID NO: 42154 - DNA, 25 bp, Rattus norvegicus
aagcgtgattacgtgctaaggccgg

SEQ ID NO: 42155 - DNA, 25 bp, Rattus norvegicus
aagcgtgcaataactaccaatcaag

SEQ ID NO: 42156 - DNA, 25 bp, Rattus norvegicus
aagcgtgcaatatctaccaatcaag

SEQ ID NO: 42157 - DNA, 25 bp, Rattus norvegicus
aagcgtgccaatcaacatgctggtg

SEQ ID NO: 42158 - DNA, 25 bp, Rattus norvegicus
aagcgtgccaatgaacatgctggtg

SEQ ID NO: 42159 - DNA, 25 bp, Rattus norvegicus
aagcgtgccctcaaagattccagga

SEQ ID NO: 42160 - DNA, 25 bp, Rattus norvegicus
aagcgtgccctctaagattccagga

SEQ ID NO: 42161 - DNA, 25 bp, Rattus norvegicus
aagcgtgccgctcaaaagcaggcaa

SEQ ID NO: 42162 - DNA, 25 bp, Rattus norvegicus
aagcgtgccgctgaaaagcaggcaa

SEQ ID NO: 42163 - DNA, 25 bp, Rattus norvegicus
aagcgtgccttactttcttcgaagg

SEQ ID NO: 42164 - DNA, 25 bp, Rattus norvegicus
aagcgtgccttagtttcttcgaagg

SEQ ID NO: 42165 - DNA, 25 bp, Rattus norvegicus
aagcgtgcgcacatcaagtggagaa

SEQ ID NO: 42166 - DNA, 25 bp, Rattus norvegicus
aagcgtgcgcacttcaagtggagaa

SEQ ID NO: 42167 - DNA, 25 bp, Rattus norvegicus
aagcgtgcggacatcttcacacttg

SEQ ID NO: 42168 - DNA, 25 bp, Rattus norvegicus
aagcgtgcggacttcttcacacttg

SEQ ID NO: 42169 - DNA, 25 bp, Rattus norvegicus
aagcgtgcggccaggcggaaacttc

SEQ ID NO: 42170 - DNA, 25 bp, Rattus norvegicus
aagcgtgcggcctggcggaaacttc

SEQ ID NO: 42171 - DNA, 25 bp, Rattus norvegicus
aagcgtgctctcctgcttttgtgaa

SEQ ID NO: 42172 - DNA, 25 bp, Rattus norvegicus
aagcgtgctctcgtgcttttgtgaa

SEQ ID NO: 42173 - DNA, 25 bp, Rattus norvegicus
aagcgtgctgaaaaggattcttctc

SEQ ID NO: 42174 - DNA, 25 bp, Rattus norvegicus
aagcgtgctgaataggattcttctc

SEQ ID NO: 42175 - DNA, 25 bp, Rattus norvegicus
aagcgtgctgcgagtgtcagctgaa

SEQ ID NO: 42176 - DNA, 25 bp, Rattus norvegicus
aagcgtgctgcgtgtgtcagctgaa

SEQ ID NO: 42177 - DNA, 25 bp, Rattus norvegicus
aagcgtgctgtacacctagcccttt

SEQ ID NO: 42178 - DNA, 25 bp, Rattus norvegicus
aagcgtgctgtagacctagcccttt

SEQ ID NO: 42179 - DNA, 25 bp, Rattus norvegicus
aagcgtggacacatgtgctactctc

SEQ ID NO: 42180 - DNA, 25 bp, Rattus norvegicus
aagcgtggacacttgtgctactctc

SEQ ID NO: 42181 - DNA, 25 bp, Rattus norvegicus
aagcgtggcattctggatcagtgct

SEQ ID NO: 42182 - DNA, 25 bp, Rattus norvegicus
aagcgtggcattgtggatcagtgct

SEQ ID NO: 42183 - DNA, 25 bp, Rattus norvegicus
aagcgtggccctatttcagaagaca

SEQ ID NO: 42184 - DNA, 25 bp, Rattus norvegicus
aagcgtggccctttttcagaagaca

SEQ ID NO: 42185 - DNA, 25 bp, Rattus norvegicus
aagcgtggccgtcaaagagtaaccg

SEQ ID NO: 42186 - DNA, 25 bp, Rattus norvegicus
aagcgtggccgtgaaagagtaaccg

SEQ ID NO: 42187 - DNA, 25 bp, Rattus norvegicus
aagcgtggtacaacctgagtccttg

SEQ ID NO: 42188 - DNA, 25 bp, Rattus norvegicus
aagcgtggtacatcctgagtccttg

SEQ ID NO: 42189 - DNA, 25 bp, Rattus norvegicus
aagcgtgtacacacatgaaatggga

SEQ ID NO: 42190 - DNA, 25 bp, Rattus norvegicus
aagcgtgtacactcatgaaatggga

SEQ ID NO: 42191 - DNA, 25 bp, Rattus norvegicus
aagcgtgtcagaaagttacttccaa

SEQ ID NO: 42192 - DNA, 25 bp, Rattus norvegicus
aagcgtgtcagatagttacttccaa

SEQ ID NO: 42193 - DNA, 25 bp, Rattus norvegicus
aagcgtgtccagctaaggctctgaa

SEQ ID NO: 42194 - DNA, 25 bp, Rattus norvegicus
aagcgtgtccaggtaaggctctgaa

SEQ ID NO: 42195 - DNA, 25 bp, Rattus norvegicus
aagcgtgtgctccagaatctagtca

SEQ ID NO: 42196 - DNA, 25 bp, Rattus norvegicus
aagcgtgtgctcgagaatctagtca

SEQ ID NO: 42197 - DNA, 25 bp, Rattus norvegicus
aagcgtgtggcaagcactcgactac

SEQ ID NO: 42198 - DNA, 25 bp, Rattus norvegicus
aagcgtgtggcatgcactcgactac

SEQ ID NO: 42199 - DNA, 25 bp, Rattus norvegicus
aagcgtgtgtcaaggatagcccctt

SEQ ID NO: 42200 - DNA, 25 bp, Rattus norvegicus
aagcgtgtgtcatggatagcccctt

SEQ ID NO: 42201 - DNA, 25 bp, Rattus norvegicus
aagcgtgtgtcgctcatctgtcgcc

SEQ ID NO: 42202 - DNA, 25 bp, Rattus norvegicus
aagcgtgtgtcggtcatctgtcgcc

SEQ ID NO: 42203 - DNA, 25 bp, Rattus norvegicus
aagcgtgtgtgcaaggagcctccct

SEQ ID NO: 42204 - DNA, 25 bp, Rattus norvegicus
aagcgtgtgtgctaggagcctccct

SEQ ID NO: 42205 - DNA, 25 bp, Rattus norvegicus
aagcgtgtgtttctcttcatcactg

SEQ ID NO: 42206 - DNA, 25 bp, Rattus norvegicus
aagcgtgtgtttgtcttcatcactg

SEQ ID NO: 42207 - DNA, 25 bp, Rattus norvegicus
aagcgtgttggactgtctctcatct

SEQ ID NO: 42208 - DNA, 25 bp, Rattus norvegicus
aagcgtgttggagtgtctctcatct

SEQ ID NO: 42209 - DNA, 25 bp, Rattus norvegicus
aagcgtgttttcaccagtctgtagc

SEQ ID NO: 42210 - DNA, 25 bp, Rattus norvegicus
aagcgtgttttctccagtctgtagc

SEQ ID NO: 42211 - DNA, 25 bp, Rattus norvegicus
aagcgttacagtagcactcccagga

SEQ ID NO: 42212 - DNA, 25 bp, Rattus norvegicus
aagcgttacagttgcactcccagga

SEQ ID NO: 42213 - DNA, 25 bp, Rattus norvegicus
aagcgttatcctccatccaagactt

SEQ ID NO: 42214 - DNA, 25 bp, Rattus norvegicus
aagcgttatcctgcatccaagactt

SEQ ID NO: 42215 - DNA, 25 bp, Rattus norvegicus
aagcgttcaagcagcatgtgactgg

SEQ ID NO: 42216 - DNA, 25 bp, Rattus norvegicus
aagcgttcaagctgcatgtgactgg

SEQ ID NO: 42217 - DNA, 25 bp, Rattus norvegicus
aagcgttcatgaagctctacatgga

SEQ ID NO: 42218 - DNA, 25 bp, Rattus norvegicus
aagcgttcatgatgctctacatgga

SEQ ID NO: 42219 - DNA, 25 bp, Rattus norvegicus
aagcgttcatttcctgagactgtta

SEQ ID NO: 42220 - DNA, 25 bp, Rattus norvegicus
aagcgttcatttgctgagactgtta

SEQ ID NO: 42221 - DNA, 25 bp, Rattus norvegicus
aagcgttccgcaatcctagtttgag

SEQ ID NO: 42222 - DNA, 25 bp, Rattus norvegicus
aagcgttccgcattcctagtttgag

SEQ ID NO: 42223 - DNA, 25 bp, Rattus norvegicus
aagcgttccttccattagtgaggca

SEQ ID NO: 42224 - DNA, 25 bp, Rattus norvegicus
aagcgttccttcgattagtgaggca

SEQ ID NO: 42225 - DNA, 25 bp, Rattus norvegicus
aagcgttctcagacctcagcagcag

SEQ ID NO: 42226 - DNA, 25 bp, Rattus norvegicus
aagcgttctcagtcctcagcagcag

SEQ ID NO: 42227 - DNA, 25 bp, Rattus norvegicus
aagcgttctgaaacctagtgttcac

SEQ ID NO: 42228 - DNA, 25 bp, Rattus norvegicus
aagcgttctgaatcctagtgttcac

SEQ ID NO: 42229 - DNA, 25 bp, Rattus norvegicus
aagcgttgcttcagatttctcttct

SEQ ID NO: 42230 - DNA, 25 bp, Rattus norvegicus
aagcgttgcttctgatttctcttct

SEQ ID NO: 42231 - DNA, 25 bp, Rattus norvegicus
aagcgtttattaagccaagtgtggc

SEQ ID NO: 42232 - DNA, 25 bp, Rattus norvegicus
aagcgtttattatgccaagtgtggc

SEQ ID NO: 42233 - DNA, 25 bp, Rattus norvegicus
aagcgtttccgcaaagcacagtgtc

SEQ ID NO: 42234 - DNA, 25 bp, Rattus norvegicus
aagcgtttccgctaagcacagtgtc

SEQ ID NO: 42235 - DNA, 25 bp, Rattus norvegicus
aagcgtttctacctggacgtgaagc

SEQ ID NO: 42236 - DNA, 25 bp, Rattus norvegicus
aagcgtttctacgtggacgtgaagc

SEQ ID NO: 42237 - DNA, 25 bp, Rattus norvegicus
aagcgtttgttgcacctcctggtat

SEQ ID NO: 42238 - DNA, 25 bp, Rattus norvegicus
aagcgtttgttggacctcctggtat

SEQ ID NO: 42239 - DNA, 25 bp, Rattus norvegicus
aagctaaaaagtactctgccatcag

SEQ ID NO: 42240 - DNA, 25 bp, Rattus norvegicus
aagctaaaaagttctctgccatcag

SEQ ID NO: 42241 - DNA, 25 bp, Rattus norvegicus
aagctaaaagccaacctctgactca

SEQ ID NO: 42242 - DNA, 25 bp, Rattus norvegicus
aagctaaaagcctacctctgactca

SEQ ID NO: 42243 - DNA, 25 bp, Rattus norvegicus
aagctaaaagctcaatctcctggaa

SEQ ID NO: 42244 - DNA, 25 bp, Rattus norvegicus
aagctaaaagctgaatctcctggaa

SEQ ID NO: 42245 - DNA, 25 bp, Rattus norvegicus
aagctaaaggccatgttcctgccac

SEQ ID NO: 42246 - DNA, 25 bp, Rattus norvegicus
aagctaaaggccttgttcctgccac

SEQ ID NO: 42247 - DNA, 25 bp, Rattus norvegicus
aagctaaagtgtccctattgtccca

SEQ ID NO: 42248 - DNA, 25 bp, Rattus norvegicus
aagctaaagtgtgcctattgtccca

SEQ ID NO: 42249 - DNA, 25 bp, Rattus norvegicus
aagctaaattacaagtgtccctcga

SEQ ID NO: 42250 - DNA, 25 bp, Rattus norvegicus
aagctaaattactagtgtccctcga

SEQ ID NO: 42251 - DNA, 25 bp, Rattus norvegicus
aagctaacacccatcattctgggag

SEQ ID NO: 42252 - DNA, 25 bp, Rattus norvegicus
aagctaacacccttcattctgggag

SEQ ID NO: 42253 - DNA, 25 bp, Rattus norvegicus
aagctaacatcaaccccgtgagcag

SEQ ID NO: 42254 - DNA, 25 bp, Rattus norvegicus
aagctaacatcatccccgtgagcag

SEQ ID NO: 42255 - DNA, 25 bp, Rattus norvegicus
aagctaaccctactatacttgttat

SEQ ID NO: 42256 - DNA, 25 bp, Rattus norvegicus
aagctaaccctagtatacttgttat

SEQ ID NO: 42257 - DNA, 25 bp, Rattus norvegicus
aagctaactgctacgaggaggtcaa

SEQ ID NO: 42258 - DNA, 25 bp, Rattus norvegicus
aagctaactgcttcgaggaggtcaa

SEQ ID NO: 42259 - DNA, 25 bp, Rattus norvegicus
aagctaactggtaggcacctccttt

SEQ ID NO: 42260 - DNA, 25 bp, Rattus norvegicus
aagctaactggttggcacctccttt

SEQ ID NO: 42261 - DNA, 25 bp, Rattus norvegicus
aagctaagaatactgcacctatgca

SEQ ID NO: 42262 - DNA, 25 bp, Rattus norvegicus
aagctaagaatagtgcacctatgca

SEQ ID NO: 42263 - DNA, 25 bp, Rattus norvegicus
aagctaagaggtacctgcctgtggc

SEQ ID NO: 42264 - DNA, 25 bp, Rattus norvegicus
aagctaagaggtccaggttcccatc

SEQ ID NO: 42265 - DNA, 25 bp, Rattus norvegicus
aagctaagaggtgcaggttcccatc

SEQ ID NO: 42266 - DNA, 25 bp, Rattus norvegicus
aagctaagaggttcctgcctgtggc

SEQ ID NO: 42267 - DNA, 25 bp, Rattus norvegicus
aagctaagagtgatctttctacttt

SEQ ID NO: 42268 - DNA, 25 bp, Rattus norvegicus
aagctaagagtgttctttctacttt

SEQ ID NO: 42269 - DNA, 25 bp, Rattus norvegicus
aagctaagccagagcaccgctggaa

SEQ ID NO: 42270 - DNA, 25 bp, Rattus norvegicus
aagctaagccagtgcaccgctggaa

SEQ ID NO: 42271 - DNA, 25 bp, Rattus norvegicus
aagctaaggcagattggcgttctcc

SEQ ID NO: 42272 - DNA, 25 bp, Rattus norvegicus
aagctaaggcagtttggcgttctcc

SEQ ID NO: 42273 - DNA, 25 bp, Rattus norvegicus
aagctaagggctctatctctcaacc

SEQ ID NO: 42274 - DNA, 25 bp, Rattus norvegicus
aagctaagggctgtatctctcaacc

SEQ ID NO: 42275 - DNA, 25 bp, Rattus norvegicus
aagctaagtaacatcctgcctgacc

SEQ ID NO: 42276 - DNA, 25 bp, Rattus norvegicus
aagctaagtaacttcctgcctgacc

SEQ ID NO: 42277 - DNA, 25 bp, Rattus norvegicus
aagctaatacttctgcagttctctt

SEQ ID NO: 42278 - DNA, 25 bp, Rattus norvegicus
aagctaatacttgtgcagttctctt

SEQ ID NO: 42279 - DNA, 25 bp, Rattus norvegicus
aagctaatatataaagatctcccac

SEQ ID NO: 42280 - DNA, 25 bp, Rattus norvegicus
aagctaatatattaagatctcccac

SEQ ID NO: 42281 - DNA, 25 bp, Rattus norvegicus
aagctaatctagatgccaagtggga

SEQ ID NO: 42282 - DNA, 25 bp, Rattus norvegicus
aagctaatctagttgccaagtggga

SEQ ID NO: 42283 - DNA, 25 bp, Rattus norvegicus
aagctaatgaccctgagcctggcat

SEQ ID NO: 42284 - DNA, 25 bp, Rattus norvegicus
aagctaatgaccgtgagcctggcat

SEQ ID NO: 42285 - DNA, 25 bp, Rattus norvegicus
aagctaatgctgaaggcctgggaaa

SEQ ID NO: 42286 - DNA, 25 bp, Rattus norvegicus
aagctaatgctgtaggcctgggaaa

SEQ ID NO: 42287 - DNA, 25 bp, Rattus norvegicus
aagctaatgtgtcttcctgggagga

SEQ ID NO: 42288 - DNA, 25 bp, Rattus norvegicus
aagctaatgtgtgttcctgggagga

SEQ ID NO: 42289 - DNA, 25 bp, Rattus norvegicus
aagctacaaggtcaggccccttcaa

SEQ ID NO: 42290 - DNA, 25 bp, Rattus norvegicus
aagctacaaggtgaggccccttcaa

SEQ ID NO: 42291 - DNA, 25 bp, Rattus norvegicus
aagctacacaacaggtggccttgtc

SEQ ID NO: 42292 - DNA, 25 bp, Rattus norvegicus
aagctacacaactggtggccttgtc

SEQ ID NO: 42293 - DNA, 25 bp, Rattus norvegicus
aagctacacagcaagtcccacagta

SEQ ID NO: 42294 - DNA, 25 bp, Rattus norvegicus
aagctacacagctagtcccacagta

SEQ ID NO: 42295 - DNA, 25 bp, Rattus norvegicus
aagctacactgtaacggccctggaa

SEQ ID NO: 42296 - DNA, 25 bp, Rattus norvegicus
aagctacactgttacggccctggaa

SEQ ID NO: 42297 - DNA, 25 bp, Rattus norvegicus
aagctacagaagaaaccaaggcact

SEQ ID NO: 42298 - DNA, 25 bp, Rattus norvegicus
aagctacagaagtaaccaaggcact

SEQ ID NO: 42299 - DNA, 25 bp, Rattus norvegicus
aagctacagctgcaaggccttcaat

SEQ ID NO: 42300 - DNA, 25 bp, Rattus norvegicus
aagctacagctggaaggccttcaat

SEQ ID NO: 42301 - DNA, 25 bp, Rattus norvegicus
aagctacagtccatgtttgagtccc

SEQ ID NO: 42302 - DNA, 25 bp, Rattus norvegicus
aagctacagtccttgtttgagtccc

SEQ ID NO: 42303 - DNA, 25 bp, Rattus norvegicus
aagctacagtttagtctccgtgggc

SEQ ID NO: 42304 - DNA, 25 bp, Rattus norvegicus
aagctacagttttgtctccgtgggc

SEQ ID NO: 42305 - DNA, 25 bp, Rattus norvegicus
aagctacatcccagattagtcctgc

SEQ ID NO: 42306 - DNA, 25 bp, Rattus norvegicus
aagctacatccctgattagtcctgc

SEQ ID NO: 42307 - DNA, 25 bp, Rattus norvegicus
aagctacatcgaatacagtgggttt

SEQ ID NO: 42308 - DNA, 25 bp, Rattus norvegicus
aagctacatcgattacagtgggttt

SEQ ID NO: 42309 - DNA, 25 bp, Rattus norvegicus
aagctacatgggatgctcttcctgc

SEQ ID NO: 42310 - DNA, 25 bp, Rattus norvegicus
aagctacatgggttgctcttcctgc

SEQ ID NO: 42311 - DNA, 25 bp, Rattus norvegicus
aagctaccatgtcaggtgactcttt

SEQ ID NO: 42312 - DNA, 25 bp, Rattus norvegicus
aagctaccatgtgaggtgactcttt

SEQ ID NO: 42313 - DNA, 25 bp, Rattus norvegicus
aagctaccccggcactgtcaaacag

SEQ ID NO: 42314 - DNA, 25 bp, Rattus norvegicus
aagctaccccgggactgtcaaacag

SEQ ID NO: 42315 - DNA, 25 bp, Rattus norvegicus
aagctaccctgacgatggtccctgg

SEQ ID NO: 42316 - DNA, 25 bp, Rattus norvegicus
aagctaccctgaggatggtccctgg

SEQ ID NO: 42317 - DNA, 25 bp, Rattus norvegicus
aagctaccggcaaggtaactcagcc

SEQ ID NO: 42318 - DNA, 25 bp, Rattus norvegicus
aagctaccggcatggtaactcagcc

SEQ ID NO: 42319 - DNA, 25 bp, Rattus norvegicus
aagctacctcagaaacccttatgtc

SEQ ID NO: 42320 - DNA, 25 bp, Rattus norvegicus
aagctacctcagtaacccttatgtc

SEQ ID NO: 42321 - DNA, 25 bp, Rattus norvegicus
aagctacctggactagctctaccct

SEQ ID NO: 42322 - DNA, 25 bp, Rattus norvegicus
aagctacctggagtagctctaccct

SEQ ID NO: 42323 - DNA, 25 bp, Rattus norvegicus
aagctacctggtcggacttggttct

SEQ ID NO: 42324 - DNA, 25 bp, Rattus norvegicus
aagctacctggtgggacttggttct

SEQ ID NO: 42325 - DNA, 25 bp, Rattus norvegicus
aagctacggactctgagctgcggtc

SEQ ID NO: 42326 - DNA, 25 bp, Rattus norvegicus
aagctacggactgtgagctgcggtc

SEQ ID NO: 42327 - DNA, 25 bp, Rattus norvegicus
aagctacgtcagcaacttgtataag

SEQ ID NO: 42328 - DNA, 25 bp, Rattus norvegicus
aagctacgtcaggaacttgtataag

SEQ ID NO: 42329 - DNA, 25 bp, Rattus norvegicus
aagctacgtgacactgggactccta

SEQ ID NO: 42330 - DNA, 25 bp, Rattus norvegicus
aagctacgtgactctgggactccta

SEQ ID NO: 42331 - DNA, 25 bp, Rattus norvegicus
aagctacgttgcaccactgtataag

SEQ ID NO: 42332 - DNA, 25 bp, Rattus norvegicus
aagctacgttgctccactgtataag

SEQ ID NO: 42333 - DNA, 25 bp, Rattus norvegicus
aagctactaaccattgttcctggtg

SEQ ID NO: 42334 - DNA, 25 bp, Rattus norvegicus
aagctactaacctttgttcctggtg

SEQ ID NO: 42335 - DNA, 25 bp, Rattus norvegicus
aagctactacacaaactgcactgtc

SEQ ID NO: 42336 - DNA, 25 bp, Rattus norvegicus
aagctactacactaactgcactgtc

SEQ ID NO: 42337 - DNA, 25 bp, Rattus norvegicus
aagctactcctacactggcttctgt

SEQ ID NO: 42338 - DNA, 25 bp, Rattus norvegicus
aagctactcctagactggcttctgt

SEQ ID NO: 42339 - DNA, 25 bp, Rattus norvegicus
aagctactctgcctgctgacagtgg

SEQ ID NO: 42340 - DNA, 25 bp, Rattus norvegicus
aagctactctgcgtgctgacagtgg

SEQ ID NO: 42341 - DNA, 25 bp, Rattus norvegicus
aagctactgatgagctcaagttcga

SEQ ID NO: 42342 - DNA, 25 bp, Rattus norvegicus
aagctactgatgtgctcaagttcga

SEQ ID NO: 42343 - DNA, 25 bp, Rattus norvegicus
aagctactgcagagcttaacaacta

SEQ ID NO: 42344 - DNA, 25 bp, Rattus norvegicus
aagctactgcagtgcttaacaacta

SEQ ID NO: 42345 - DNA, 25 bp, Rattus norvegicus
aagctactgcctatatattctcctg

SEQ ID NO: 42346 - DNA, 25 bp, Rattus norvegicus
aagctactgcctttatattctcctg

SEQ ID NO: 42347 - DNA, 25 bp, Rattus norvegicus
aagctactgctaaggttgttaggaa

SEQ ID NO: 42348 - DNA, 25 bp, Rattus norvegicus
aagctactgctatggttgttaggaa

SEQ ID NO: 42349 - DNA, 25 bp, Rattus norvegicus
aagctactgctcctatattctaaga

SEQ ID NO: 42350 - DNA, 25 bp, Rattus norvegicus
aagctactgctcgtatattctaaga

SEQ ID NO: 42351 - DNA, 25 bp, Rattus norvegicus
aagctactggttatggctgcccaaa

SEQ ID NO: 42352 - DNA, 25 bp, Rattus norvegicus
aagctactggttttggctgcccaaa

SEQ ID NO: 42353 - DNA, 25 bp, Rattus norvegicus
aagctactgtacagcaggtctccag

SEQ ID NO: 42354 - DNA, 25 bp, Rattus norvegicus
aagctactgtactgcaggtctccag

SEQ ID NO: 42355 - DNA, 25 bp, Rattus norvegicus
aagctactgtagaccctggccatgg

SEQ ID NO: 42356 - DNA, 25 bp, Rattus norvegicus
aagctactgtagtccctggccatgg

SEQ ID NO: 42357 - DNA, 25 bp, Rattus norvegicus
aagctactgtgtcctttctccatga

SEQ ID NO: 42358 - DNA, 25 bp, Rattus norvegicus
aagctactgtgtgctttctccatga

SEQ ID NO: 42359 - DNA, 25 bp, Rattus norvegicus
aagctacttgacatgtgtgttgggt

SEQ ID NO: 42360 - DNA, 25 bp, Rattus norvegicus
aagctacttgacttgtgtgttgggt

SEQ ID NO: 42361 - DNA, 25 bp, Rattus norvegicus
aagctacttggcactgaggcttaaa

SEQ ID NO: 42362 - DNA, 25 bp, Rattus norvegicus
aagctacttggctctgaggcttaaa

SEQ ID NO: 42363 - DNA, 25 bp, Rattus norvegicus
aagctagacccgaagatgctgatga

SEQ ID NO: 42364 - DNA, 25 bp, Rattus norvegicus
aagctagacccgtagatgctgatga

SEQ ID NO: 42365 - DNA, 25 bp, Rattus norvegicus
aagctagagaccaggaagcacccca

SEQ ID NO: 42366 - DNA, 25 bp, Rattus norvegicus
aagctagagacctggaagcacccca

SEQ ID NO: 42367 - DNA, 25 bp, Rattus norvegicus
aagctagaggttcccggccatggct

SEQ ID NO: 42368 - DNA, 25 bp, Rattus norvegicus
aagctagaggttgccggccatggct

SEQ ID NO: 42369 - DNA, 25 bp, Rattus norvegicus
aagctagagtcgagtccccgaggtg

SEQ ID NO: 42370 - DNA, 25 bp, Rattus norvegicus
aagctagagtcgtgtccccgaggtg

SEQ ID NO: 42371 - DNA, 25 bp, Rattus norvegicus
aagctagagtgaactctccagccct

SEQ ID NO: 42372 - DNA, 25 bp, Rattus norvegicus
aagctagagtgatctctccagccct

SEQ ID NO: 42373 - DNA, 25 bp, Rattus norvegicus
aagctagagttgctcttcagagaaa

SEQ ID NO: 42374 - DNA, 25 bp, Rattus norvegicus
aagctagagttggtcttcagagaaa

SEQ ID NO: 42375 - DNA, 25 bp, Rattus norvegicus
aagctagatacaccgtcaggtcctt

SEQ ID NO: 42376 - DNA, 25 bp, Rattus norvegicus
aagctagatacagcgtcaggtcctt

SEQ ID NO: 42377 - DNA, 25 bp, Rattus norvegicus
aagctagatctactcaggtcccatc

SEQ ID NO: 42378 - DNA, 25 bp, Rattus norvegicus
aagctagatctagtcaggtcccatc

SEQ ID NO: 42379 - DNA, 25 bp, Rattus norvegicus
aagctagatcttacctccagtaaaa

SEQ ID NO: 42380 - DNA, 25 bp, Rattus norvegicus
aagctagatctttcctccagtaaaa

SEQ ID NO: 42381 - DNA, 25 bp, Rattus norvegicus
aagctagcaactccagcttcttcct

SEQ ID NO: 42382 - DNA, 25 bp, Rattus norvegicus
aagctagcaactgcagcttcttcct

SEQ ID NO: 42383 - DNA, 25 bp, Rattus norvegicus
aagctagcaaggactgctgtgctgc

SEQ ID NO: 42384 - DNA, 25 bp, Rattus norvegicus
aagctagcaaggtctgctgtgctgc

SEQ ID NO: 42385 - DNA, 25 bp, Rattus norvegicus
aagctagccatgcatcatctccatc

SEQ ID NO: 42386 - DNA, 25 bp, Rattus norvegicus
aagctagccatggatcatctccatc

SEQ ID NO: 42387 - DNA, 25 bp, Rattus norvegicus
aagctagcctggaattggatcccca

SEQ ID NO: 42388 - DNA, 25 bp, Rattus norvegicus
aagctagcctggtattggatcccca

SEQ ID NO: 42389 - DNA, 25 bp, Rattus norvegicus
aagctagctcataggcccttcatat

SEQ ID NO: 42390 - DNA, 25 bp, Rattus norvegicus
aagctagctcattggcccttcatat

SEQ ID NO: 42391 - DNA, 25 bp, Rattus norvegicus
aagctagctctgaagccctaggatt

SEQ ID NO: 42392 - DNA, 25 bp, Rattus norvegicus
aagctagctctgtagccctaggatt

SEQ ID NO: 42393 - DNA, 25 bp, Rattus norvegicus
aagctagctgatcggtggcctcaca

SEQ ID NO: 42394 - DNA, 25 bp, Rattus norvegicus
aagctagctgatgggtggcctcaca

SEQ ID NO: 42395 - DNA, 25 bp, Rattus norvegicus
aagctagctggcaccggctgcaatt

SEQ ID NO: 42396 - DNA, 25 bp, Rattus norvegicus
aagctagctggctccggctgcaatt

SEQ ID NO: 42397 - DNA, 25 bp, Rattus norvegicus
aagctaggatacagcctttggagca

SEQ ID NO: 42398 - DNA, 25 bp, Rattus norvegicus
aagctaggatactgcctttggagca

SEQ ID NO: 42399 - DNA, 25 bp, Rattus norvegicus
aagctaggccaaaccattctgggct

SEQ ID NO: 42400 - DNA, 25 bp, Rattus norvegicus
aagctaggccaatccattctgggct

SEQ ID NO: 42401 - DNA, 25 bp, Rattus norvegicus
aagctaggccctcaatgcatctatc

SEQ ID NO: 42402 - DNA, 25 bp, Rattus norvegicus
aagctaggccctgaatgcatctatc

SEQ ID NO: 42403 - DNA, 25 bp, Rattus norvegicus
aagctaggccttagtgtcacttgga

SEQ ID NO: 42404 - DNA, 25 bp, Rattus norvegicus
aagctaggcctttgtgtcacttgga

SEQ ID NO: 42405 - DNA, 25 bp, Rattus norvegicus
aagctagggttaactcagttccgcc

SEQ ID NO: 42406 - DNA, 25 bp, Rattus norvegicus
aagctagggttatctcagttccgcc

SEQ ID NO: 42407 - DNA, 25 bp, Rattus norvegicus
aagctaggtcaactgacccctcatt

SEQ ID NO: 42408 - DNA, 25 bp, Rattus norvegicus
aagctaggtcaagtgacccctcatt

SEQ ID NO: 42409 - DNA, 25 bp, Rattus norvegicus
aagctagtaaccatgacagtttcta

SEQ ID NO: 42410 - DNA, 25 bp, Rattus norvegicus
aagctagtaaccttgacagtttcta

SEQ ID NO: 42411 - DNA, 25 bp, Rattus norvegicus
aagctagtcaccaccttgttttaag

SEQ ID NO: 42412 - DNA, 25 bp, Rattus norvegicus
aagctagtcacctccttgttttaag

SEQ ID NO: 42413 - DNA, 25 bp, Rattus norvegicus
aagctagtcatgaccttggtgtgta

SEQ ID NO: 42414 - DNA, 25 bp, Rattus norvegicus
aagctagtcatgtccttggtgtgta

SEQ ID NO: 42415 - DNA, 25 bp, Rattus norvegicus
aagctagtcctacaccctaagagta

SEQ ID NO: 42416 - DNA, 25 bp, Rattus norvegicus
aagctagtcctagaccctaagagta

SEQ ID NO: 42417 - DNA, 25 bp, Rattus norvegicus
aagctagtcctgaggtgacttaatc

SEQ ID NO: 42418 - DNA, 25 bp, Rattus norvegicus
aagctagtcctgtggtgacttaatc

SEQ ID NO: 42419 - DNA, 25 bp, Rattus norvegicus
aagctagtctcaagagtggtccaca

SEQ ID NO: 42420 - DNA, 25 bp, Rattus norvegicus
aagctagtctcatgagtggtccaca

SEQ ID NO: 42421 - DNA, 25 bp, Rattus norvegicus
aagctagtctgcagcggattgcgtt

SEQ ID NO: 42422 - DNA, 25 bp, Rattus norvegicus
aagctagtctgctgcggattgcgtt

SEQ ID NO: 42423 - DNA, 25 bp, Rattus norvegicus
aagctagtgctgactccttgcttaa

SEQ ID NO: 42424 - DNA, 25 bp, Rattus norvegicus
aagctagtgctgtctccttgcttaa

SEQ ID NO: 42425 - DNA, 25 bp, Rattus norvegicus
aagctagtgttcatcctcggttctg

SEQ ID NO: 42426 - DNA, 25 bp, Rattus norvegicus
aagctagtgttcttcctcggttctg

SEQ ID NO: 42427 - DNA, 25 bp, Rattus norvegicus
aagctataatgacccttctctttcc

SEQ ID NO: 42428 - DNA, 25 bp, Rattus norvegicus
aagctataatgagccttctctttcc

SEQ ID NO: 42429 - DNA, 25 bp, Rattus norvegicus
aagctataccgaaacccgtggaagt

SEQ ID NO: 42430 - DNA, 25 bp, Rattus norvegicus
aagctataccgatacccgtggaagt

SEQ ID NO: 42431 - DNA, 25 bp, Rattus norvegicus
aagctatataacaccattccttttt

SEQ ID NO: 42432 - DNA, 25 bp, Rattus norvegicus
aagctatataactccattccttttt

SEQ ID NO: 42433 - DNA, 25 bp, Rattus norvegicus
aagctatatttcagccctctataag

SEQ ID NO: 42434 - DNA, 25 bp, Rattus norvegicus
aagctatatttctgccctctataag

SEQ ID NO: 42435 - DNA, 25 bp, Rattus norvegicus
aagctatcacctaggatttcaggat

SEQ ID NO: 42436 - DNA, 25 bp, Rattus norvegicus
aagctatcaccttggatttcaggat

SEQ ID NO: 42437 - DNA, 25 bp, Rattus norvegicus
aagctatcagtgattgtcctgtatg

SEQ ID NO: 42438 - DNA, 25 bp, Rattus norvegicus
aagctatcagtgtttgtcctgtatg

SEQ ID NO: 42439 - DNA, 25 bp, Rattus norvegicus
aagctatccagcatctttgggcagc

SEQ ID NO: 42440 - DNA, 25 bp, Rattus norvegicus
aagctatccagcttctttgggcagc

SEQ ID NO: 42441 - DNA, 25 bp, Rattus norvegicus
aagctatcctggacgatatcccctt

SEQ ID NO: 42442 - DNA, 25 bp, Rattus norvegicus
aagctatcctggtcgatatcccctt

SEQ ID NO: 42443 - DNA, 25 bp, Rattus norvegicus
aagctatccttcctcttaaagcgag

SEQ ID NO: 42444 - DNA, 25 bp, Rattus norvegicus
aagctatccttcgtcttaaagcgag

SEQ ID NO: 42445 - DNA, 25 bp, Rattus norvegicus
aagctatcgccaaaatccggtcaca

SEQ ID NO: 42446 - DNA, 25 bp, Rattus norvegicus
aagctatcgccataatccggtcaca

SEQ ID NO: 42447 - DNA, 25 bp, Rattus norvegicus
aagctatctgaaatcgtgtgtacgc

SEQ ID NO: 42448 - DNA, 25 bp, Rattus norvegicus
aagctatctgaattcgtgtgtacgc

SEQ ID NO: 42449 - DNA, 25 bp, Rattus norvegicus
aagctatctgtgctcttccagtttg

SEQ ID NO: 42450 - DNA, 25 bp, Rattus norvegicus
aagctatctgtggtcttccagtttg

SEQ ID NO: 42451 - DNA, 25 bp, Rattus norvegicus
aagctatgaagacacccgtggaggt

SEQ ID NO: 42452 - DNA, 25 bp, Rattus norvegicus
aagctatgaagagacccgtggaggt

SEQ ID NO: 42453 - DNA, 25 bp, Rattus norvegicus
aagctatgacgtaatgacaaatcta

SEQ ID NO: 42454 - DNA, 25 bp, Rattus norvegicus
aagctatgacgttatgacaaatcta

SEQ ID NO: 42455 - DNA, 25 bp, Rattus norvegicus
aagctatgacttcgtagcctctcat

SEQ ID NO: 42456 - DNA, 25 bp, Rattus norvegicus
aagctatgacttggtagcctctcat

SEQ ID NO: 42457 - DNA, 25 bp, Rattus norvegicus
aagctatgagccaggcataccctaa

SEQ ID NO: 42458 - DNA, 25 bp, Rattus norvegicus
aagctatgagcctggcataccctaa

SEQ ID NO: 42459 - DNA, 25 bp, Rattus norvegicus
aagctatgataactcccagatggca

SEQ ID NO: 42460 - DNA, 25 bp, Rattus norvegicus
aagctatgataagtcccagatggca

SEQ ID NO: 42461 - DNA, 25 bp, Rattus norvegicus
aagctatggcccaggactctcattt

SEQ ID NO: 42462 - DNA, 25 bp, Rattus norvegicus
aagctatggccctggactctcattt

SEQ ID NO: 42463 - DNA, 25 bp, Rattus norvegicus
aagctatgtcacatctgtctttgaa

SEQ ID NO: 42464 - DNA, 25 bp, Rattus norvegicus
aagctatgtcacttctgtctttgaa

SEQ ID NO: 42465 - DNA, 25 bp, Rattus norvegicus
aagctatgtcttacgaatactgagc

SEQ ID NO: 42466 - DNA, 25 bp, Rattus norvegicus
aagctatgtctttcgaatactgagc

SEQ ID NO: 42467 - DNA, 25 bp, Rattus norvegicus
aagctatgtgcactccttcttcggc

SEQ ID NO: 42468 - DNA, 25 bp, Rattus norvegicus
aagctatgtgcagtccttcttcggc

SEQ ID NO: 42469 - DNA, 25 bp, Rattus norvegicus
aagctatgttctcctggaatcccca

SEQ ID NO: 42470 - DNA, 25 bp, Rattus norvegicus
aagctatgttctgctggaatcccca

SEQ ID NO: 42471 - DNA, 25 bp, Rattus norvegicus
aagctatgtttaattcctgatgaga

SEQ ID NO: 42472 - DNA, 25 bp, Rattus norvegicus
aagctatgtttatttcctgatgaga

SEQ ID NO: 42473 - DNA, 25 bp, Rattus norvegicus
aagctattcaaaatccggagcctga

SEQ ID NO: 42474 - DNA, 25 bp, Rattus norvegicus
aagctattcaaattccggagcctga

SEQ ID NO: 42475 - DNA, 25 bp, Rattus norvegicus
aagctattcacaccagcatcatctg

SEQ ID NO: 42476 - DNA, 25 bp, Rattus norvegicus
aagctattcacagcagcatcatctg

SEQ ID NO: 42477 - DNA, 25 bp, Rattus norvegicus
aagctattcctgctatttctgcctg

SEQ ID NO: 42478 - DNA, 25 bp, Rattus norvegicus
aagctattcctggtatttctgcctg

SEQ ID NO: 42479 - DNA, 25 bp, Rattus norvegicus
aagctattgcacagtcttggtgaac

SEQ ID NO: 42480 - DNA, 25 bp, Rattus norvegicus
aagctattgcactgtcttggtgaac

SEQ ID NO: 42481 - DNA, 25 bp, Rattus norvegicus
aagctattggtcatctggctccttt

SEQ ID NO: 42482 - DNA, 25 bp, Rattus norvegicus
aagctattggtcttctggctccttt

SEQ ID NO: 42483 - DNA, 25 bp, Rattus norvegicus
aagctattgtccagcaaaggcaccc

SEQ ID NO: 42484 - DNA, 25 bp, Rattus norvegicus
aagctattgtcctgcaaaggcaccc

SEQ ID NO: 42485 - DNA, 25 bp, Rattus norvegicus
aagctatttataaacctgcacatga

SEQ ID NO: 42486 - DNA, 25 bp, Rattus norvegicus
aagctatttatatacctgcacatga

SEQ ID NO: 42487 - DNA, 25 bp, Rattus norvegicus
aagctattttacatgccaatctatt

SEQ ID NO: 42488 - DNA, 25 bp, Rattus norvegicus
aagctattttacttgccaatctatt

SEQ ID NO: 42489 - DNA, 25 bp, Rattus norvegicus
aagctattttataggctttagaaat

SEQ ID NO: 42490 - DNA, 25 bp, Rattus norvegicus
aagctattttattggctttagaaat

SEQ ID NO: 42491 - DNA, 25 bp, Rattus norvegicus
aagctattttgacatgcggtccaga

SEQ ID NO: 42492 - DNA, 25 bp, Rattus norvegicus
aagctattttgagatgcggtccaga

SEQ ID NO: 42493 - DNA, 25 bp, Rattus norvegicus
aagctattttgcatcccattgacca

SEQ ID NO: 42494 - DNA, 25 bp, Rattus norvegicus
aagctattttgcttcccattgacca

SEQ ID NO: 42495 - DNA, 25 bp, Rattus norvegicus
aagctcaaaactctcatggcacgga

SEQ ID NO: 42496 - DNA, 25 bp, Rattus norvegicus
aagctcaaaactgtcatggcacgga

SEQ ID NO: 42497 - DNA, 25 bp, Rattus norvegicus
aagctcaaccccatcagtgatgaat

SEQ ID NO: 42498 - DNA, 25 bp, Rattus norvegicus
aagctcaaccccttcagtgatgaat

SEQ ID NO: 42499 - DNA, 25 bp, Rattus norvegicus
aagctcaactctcgatccacactgg

SEQ ID NO: 42500 - DNA, 25 bp, Rattus norvegicus
aagctcaactctggatccacactgg

SEQ ID NO: 42501 - DNA, 25 bp, Rattus norvegicus
aagctcaacttgaatatttccccag

SEQ ID NO: 42502 - DNA, 25 bp, Rattus norvegicus
aagctcaacttgtatatttccccag

SEQ ID NO: 42503 - DNA, 25 bp, Rattus norvegicus
aagctcaagaacaggtgcgactgga

SEQ ID NO: 42504 - DNA, 25 bp, Rattus norvegicus
aagctcaagaactggtgcgactgga

SEQ ID NO: 42505 - DNA, 25 bp, Rattus norvegicus
aagctcaagatgaccttggccagca

SEQ ID NO: 42506 - DNA, 25 bp, Rattus norvegicus
aagctcaagatgcaggttgaccaaa

SEQ ID NO: 42507 - DNA, 25 bp, Rattus norvegicus
aagctcaagatggaggttgaccaaa

SEQ ID NO: 42508 - DNA, 25 bp, Rattus norvegicus
aagctcaagatgtccttggccagca

SEQ ID NO: 42509 - DNA, 25 bp, Rattus norvegicus
aagctcaaggaaacctgacccgagg

SEQ ID NO: 42510 - DNA, 25 bp, Rattus norvegicus
aagctcaaggaatcctgacccgagg

SEQ ID NO: 42511 - DNA, 25 bp, Rattus norvegicus
aagctcaaggccagtattgctgcat

SEQ ID NO: 42512 - DNA, 25 bp, Rattus norvegicus
aagctcaaggcctgtattgctgcat

SEQ ID NO: 42513 - DNA, 25 bp, Rattus norvegicus
aagctcaaggtgagtttcctttaga

SEQ ID NO: 42514 - DNA, 25 bp, Rattus norvegicus
aagctcaaggtgtgtttcctttaga

SEQ ID NO: 42515 - DNA, 25 bp, Rattus norvegicus
aagctcaagtccaagtagatcaaga

SEQ ID NO: 42516 - DNA, 25 bp, Rattus norvegicus
aagctcaagtcctagtagatcaaga

SEQ ID NO: 42517 - DNA, 25 bp, Rattus norvegicus
aagctcacagccctaggcttagctt

SEQ ID NO: 42518 - DNA, 25 bp, Rattus norvegicus
aagctcacagccgtaggcttagctt

SEQ ID NO: 42519 - DNA, 25 bp, Rattus norvegicus
aagctcaccctgagtagttcttgct

SEQ ID NO: 42520 - DNA, 25 bp, Rattus norvegicus
aagctcaccctgtgtagttcttgct

SEQ ID NO: 42521 - DNA, 25 bp, Rattus norvegicus
aagctcacctacattttgcaagaca

SEQ ID NO: 42522 - DNA, 25 bp, Rattus norvegicus
aagctcacctactttttgcaagaca

SEQ ID NO: 42523 - DNA, 25 bp, Rattus norvegicus
aagctcacggagcaaacaacaacaa

SEQ ID NO: 42524 - DNA, 25 bp, Rattus norvegicus
aagctcacggaggaaacaacaacaa

SEQ ID NO: 42525 - DNA, 25 bp, Rattus norvegicus
aagctcactctgcattgtgctatgg

SEQ ID NO: 42526 - DNA, 25 bp, Rattus norvegicus
aagctcactctggattgtgctatgg

SEQ ID NO: 42527 - DNA, 25 bp, Rattus norvegicus
aagctcactcttacattggttctga

SEQ ID NO: 42528 - DNA, 25 bp, Rattus norvegicus
aagctcactctttcattggttctga

SEQ ID NO: 42529 - DNA, 25 bp, Rattus norvegicus
aagctcactggtaggagacctctac

SEQ ID NO: 42530 - DNA, 25 bp, Rattus norvegicus
aagctcactggttggagacctctac

SEQ ID NO: 42531 - DNA, 25 bp, Rattus norvegicus
aagctcacttatatcagccttggga

SEQ ID NO: 42532 - DNA, 25 bp, Rattus norvegicus
aagctcacttatttcagccttggga

SEQ ID NO: 42533 - DNA, 25 bp, Rattus norvegicus
aagctcactttgactcttgatccag

SEQ ID NO: 42534 - DNA, 25 bp, Rattus norvegicus
aagctcactttgtctcttgatccag

SEQ ID NO: 42535 - DNA, 25 bp, Rattus norvegicus
aagctcagaagcacacagctgccag

SEQ ID NO: 42536 - DNA, 25 bp, Rattus norvegicus
aagctcagaagctcacagctgccag

SEQ ID NO: 42537 - DNA, 25 bp, Rattus norvegicus
aagctcagagagaccatccggcgtg

SEQ ID NO: 42538 - DNA, 25 bp, Rattus norvegicus
aagctcagagagtccatccggcgtg

SEQ ID NO: 42539 - DNA, 25 bp, Rattus norvegicus
aagctcagagctagtgcagaatttt

SEQ ID NO: 42540 - DNA, 25 bp, Rattus norvegicus
aagctcagagcttgtgcagaatttt

SEQ ID NO: 42541 - DNA, 25 bp, Rattus norvegicus
aagctcagcagcaagggtcctggta

SEQ ID NO: 42542 - DNA, 25 bp, Rattus norvegicus
aagctcagcagctagggtcctggta

SEQ ID NO: 42543 - DNA, 25 bp, Rattus norvegicus
aagctcagccaaagacccacggtgg

SEQ ID NO: 42544 - DNA, 25 bp, Rattus norvegicus
aagctcagccaatgacccacggtgg

SEQ ID NO: 42545 - DNA, 25 bp, Rattus norvegicus
aagctcagccgcaatgacgtcattg

SEQ ID NO: 42546 - DNA, 25 bp, Rattus norvegicus
aagctcagccgctatgacgtcattg

SEQ ID NO: 42547 - DNA, 25 bp, Rattus norvegicus
aagctcagcctcattgccagccgga

SEQ ID NO: 42548 - DNA, 25 bp, Rattus norvegicus
aagctcagcctctttgccagccgga

SEQ ID NO: 42549 - DNA, 25 bp, Rattus norvegicus
aagctcagcgtgcatatttctcctt

SEQ ID NO: 42550 - DNA, 25 bp, Rattus norvegicus
aagctcagcgtggatatttctcctt

SEQ ID NO: 42551 - DNA, 25 bp, Rattus norvegicus
aagctcaggaacaatgcctctcgta

SEQ ID NO: 42552 - DNA, 25 bp, Rattus norvegicus
aagctcaggaactatgcctctcgta

SEQ ID NO: 42553 - DNA, 25 bp, Rattus norvegicus
aagctcaggctacgaccaggtaagg

SEQ ID NO: 42554 - DNA, 25 bp, Rattus norvegicus
aagctcaggctaggaccaggtaagg

SEQ ID NO: 42555 - DNA, 25 bp, Rattus norvegicus
aagctcaggctgaatgtggcgcaga

SEQ ID NO: 42556 - DNA, 25 bp, Rattus norvegicus
aagctcaggctgtatgtggcgcaga

SEQ ID NO: 42557 - DNA, 25 bp, Rattus norvegicus
aagctcagtgcaactctttttgttc

SEQ ID NO: 42558 - DNA, 25 bp, Rattus norvegicus
aagctcagtgcatctctttttgttc

SEQ ID NO: 42559 - DNA, 25 bp, Rattus norvegicus
aagctcagttcccatcaactctgta

SEQ ID NO: 42560 - DNA, 25 bp, Rattus norvegicus
aagctcagttccgatcaactctgta

SEQ ID NO: 42561 - DNA, 25 bp, Rattus norvegicus
aagctcagttctcaccttgttcaac

SEQ ID NO: 42562 - DNA, 25 bp, Rattus norvegicus
aagctcagttctgaccttgttcaac

SEQ ID NO: 42563 - DNA, 25 bp, Rattus norvegicus
aagctcataagtcaaggctgttgtg

SEQ ID NO: 42564 - DNA, 25 bp, Rattus norvegicus
aagctcataagtgaaggctgttgtg

SEQ ID NO: 42565 - DNA, 25 bp, Rattus norvegicus
aagctcatagttactgtggcatttg

SEQ ID NO: 42566 - DNA, 25 bp, Rattus norvegicus
aagctcatagtttctgtggcatttg

SEQ ID NO: 42567 - DNA, 25 bp, Rattus norvegicus
aagctcatatccatggctgggtttg

SEQ ID NO: 42568 - DNA, 25 bp, Rattus norvegicus
aagctcatatccttggctgggtttg

SEQ ID NO: 42569 - DNA, 25 bp, Rattus norvegicus
aagctcatattcacaacctctaggt

SEQ ID NO: 42570 - DNA, 25 bp, Rattus norvegicus
aagctcatattctcaacctctaggt

SEQ ID NO: 42571 - DNA, 25 bp, Rattus norvegicus
aagctcatgatgacccagagggagt

SEQ ID NO: 42572 - DNA, 25 bp, Rattus norvegicus
aagctcatgatgtcccagagggagt

SEQ ID NO: 42573 - DNA, 25 bp, Rattus norvegicus
aagctcatggcgaccccaggcctgg

SEQ ID NO: 42574 - DNA, 25 bp, Rattus norvegicus
aagctcatggcgtccccaggcctgg

SEQ ID NO: 42575 - DNA, 25 bp, Rattus norvegicus
aagctcatggtgctccctgtttcag

SEQ ID NO: 42576 - DNA, 25 bp, Rattus norvegicus
aagctcatggtggtccctgtttcag

SEQ ID NO: 42577 - DNA, 25 bp, Rattus norvegicus
aagctcatgtggaggctttgccatc

SEQ ID NO: 42578 - DNA, 25 bp, Rattus norvegicus
aagctcatgtggtggctttgccatc

SEQ ID NO: 42579 - DNA, 25 bp, Rattus norvegicus
aagctcattactatgcaggacgaat

SEQ ID NO: 42580 - DNA, 25 bp, Rattus norvegicus
aagctcattactttgcaggacgaat

SEQ ID NO: 42581 - DNA, 25 bp, Rattus norvegicus
aagctcattctcaagctggaggtgt

SEQ ID NO: 42582 - DNA, 25 bp, Rattus norvegicus
aagctcattctctagctggaggtgt

SEQ ID NO: 42583 - DNA, 25 bp, Rattus norvegicus
aagctcatttccaggtatgacaatg

SEQ ID NO: 42584 - DNA, 25 bp, Rattus norvegicus
aagctcatttcctggtatgacaatg

SEQ ID NO: 42585 - DNA, 25 bp, Rattus norvegicus
aagctccaacaaaaggcaggccctg

SEQ ID NO: 42586 - DNA, 25 bp, Rattus norvegicus
aagctccaacaataggcaggccctg

SEQ ID NO: 42587 - DNA, 25 bp, Rattus norvegicus
aagctccaattacccagtgttttgt

SEQ ID NO: 42588 - DNA, 25 bp, Rattus norvegicus
aagctccaattagccagtgttttgt

SEQ ID NO: 42589 - DNA, 25 bp, Rattus norvegicus
aagctccacacaaggtccttcattt

SEQ ID NO: 42590 - DNA, 25 bp, Rattus norvegicus
aagctccacacatggtccttcattt

SEQ ID NO: 42591 - DNA, 25 bp, Rattus norvegicus
aagctccacactccagaagcatcag

SEQ ID NO: 42592 - DNA, 25 bp, Rattus norvegicus
aagctccacactgcagaagcatcag

SEQ ID NO: 42593 - DNA, 25 bp, Rattus norvegicus
aagctccaccctcctagaggagagt

SEQ ID NO: 42594 - DNA, 25 bp, Rattus norvegicus
aagctccaccctgctagaggagagt

SEQ ID NO: 42595 - DNA, 25 bp, Rattus norvegicus
aagctccaccgacatggtggccagt

SEQ ID NO: 42596 - DNA, 25 bp, Rattus norvegicus
aagctccaccgagatggtggccagt

SEQ ID NO: 42597 - DNA, 25 bp, Rattus norvegicus
aagctccaggtacggagacagacgt

SEQ ID NO: 42598 - DNA, 25 bp, Rattus norvegicus
aagctccaggtagggagacagacgt

SEQ ID NO: 42599 - DNA, 25 bp, Rattus norvegicus
aagctccagtcccaggcctgaggtg

SEQ ID NO: 42600 - DNA, 25 bp, Rattus norvegicus
aagctccagtccgaggcctgaggtg

SEQ ID NO: 42601 - DNA, 25 bp, Rattus norvegicus
aagctccatctcctaggagactagg

SEQ ID NO: 42602 - DNA, 25 bp, Rattus norvegicus
aagctccatctcgtaggagactagg

SEQ ID NO: 42603 - DNA, 25 bp, Rattus norvegicus
aagctccattccactgttcttctga

SEQ ID NO: 42604 - DNA, 25 bp, Rattus norvegicus
aagctccattcctctgttcttctga

SEQ ID NO: 42605 - DNA, 25 bp, Rattus norvegicus
aagctcccaatgctcctgaatctga

SEQ ID NO: 42606 - DNA, 25 bp, Rattus norvegicus
aagctcccaatggtcctgaatctga

SEQ ID NO: 42607 - DNA, 25 bp, Rattus norvegicus
aagctcccacagactggtcagtttt

SEQ ID NO: 42608 - DNA, 25 bp, Rattus norvegicus
aagctcccacagtctggtcagtttt

SEQ ID NO: 42609 - DNA, 25 bp, Rattus norvegicus
aagctcccaggcatcagaaaatcat

SEQ ID NO: 42610 - DNA, 25 bp, Rattus norvegicus
aagctcccaggcttcagaaaatcat

SEQ ID NO: 42611 - DNA, 25 bp, Rattus norvegicus
aagctcccggagcagcagtttgatg

SEQ ID NO: 42612 - DNA, 25 bp, Rattus norvegicus
aagctcccggaggagcagtttgatg

SEQ ID NO: 42613 - DNA, 25 bp, Rattus norvegicus
aagctccctaccctgacaggaaagg

SEQ ID NO: 42614 - DNA, 25 bp, Rattus norvegicus
aagctccctaccgtgacaggaaagg

SEQ ID NO: 42615 - DNA, 25 bp, Rattus norvegicus
aagctccctagcacagaggccaaaa

SEQ ID NO: 42616 - DNA, 25 bp, Rattus norvegicus
aagctccctagctcagaggccaaaa

SEQ ID NO: 42617 - DNA, 25 bp, Rattus norvegicus
aagctccctcgcagttgaaaggcta

SEQ ID NO: 42618 - DNA, 25 bp, Rattus norvegicus
aagctccctcgctgttgaaaggcta

SEQ ID NO: 42619 - DNA, 25 bp, Rattus norvegicus
aagctccgcttcaatgacgactggg

SEQ ID NO: 42620 - DNA, 25 bp, Rattus norvegicus
aagctccgcttctatgacgactggg

SEQ ID NO: 42621 - DNA, 25 bp, Rattus norvegicus
aagctccggagcagtatcgtttctg

SEQ ID NO: 42622 - DNA, 25 bp, Rattus norvegicus
aagctccggagctgtatcgtttctg

SEQ ID NO: 42623 - DNA, 25 bp, Rattus norvegicus
aagctccgggacatcatcacgttgc

SEQ ID NO: 42624 - DNA, 25 bp, Rattus norvegicus
aagctccgggacttcatcacgttgc

SEQ ID NO: 42625 - DNA, 25 bp, Rattus norvegicus
aagctccggtgtatgcggcttcgtg

SEQ ID NO: 42626 - DNA, 25 bp, Rattus norvegicus
aagctccggtgtttgcggcttcgtg

SEQ ID NO: 42627 - DNA, 25 bp, Rattus norvegicus
aagctccgtggaatcagtgcgaacg

SEQ ID NO: 42628 - DNA, 25 bp, Rattus norvegicus
aagctccgtggattcagtgcgaacg

SEQ ID NO: 42629 - DNA, 25 bp, Rattus norvegicus
aagctcctacagacacagtgtgaat

SEQ ID NO: 42630 - DNA, 25 bp, Rattus norvegicus
aagctcctacagtcacagtgtgaat

SEQ ID NO: 42631 - DNA, 25 bp, Rattus norvegicus
aagctcctaggacgaaggcgtttga

SEQ ID NO: 42632 - DNA, 25 bp, Rattus norvegicus
aagctcctaggaggaaggcgtttga

SEQ ID NO: 42633 - DNA, 25 bp, Rattus norvegicus
aagctcctatatctttcatttatgg

SEQ ID NO: 42634 - DNA, 25 bp, Rattus norvegicus
aagctcctatatgtttcatttatgg

SEQ ID NO: 42635 - DNA, 25 bp, Rattus norvegicus
aagctcctccatatgtgaggccatg

SEQ ID NO: 42636 - DNA, 25 bp, Rattus norvegicus
aagctcctccatttgtgaggccatg

SEQ ID NO: 42637 - DNA, 25 bp, Rattus norvegicus
aagctcctctctcgtgagacacagg

SEQ ID NO: 42638 - DNA, 25 bp, Rattus norvegicus
aagctcctctctggtgagacacagg

SEQ ID NO: 42639 - DNA, 25 bp, Rattus norvegicus
aagctcctgagtatcatggcgccta

SEQ ID NO: 42640 - DNA, 25 bp, Rattus norvegicus
aagctcctgagtttcatggcgccta

SEQ ID NO: 42641 - DNA, 25 bp, Rattus norvegicus
aagctcctgcggaagactctgtaca

SEQ ID NO: 42642 - DNA, 25 bp, Rattus norvegicus
aagctcctgcggtagactctgtaca

SEQ ID NO: 42643 - DNA, 25 bp, Rattus norvegicus
aagctcctggaaaaggcactctgga

SEQ ID NO: 42644 - DNA, 25 bp, Rattus norvegicus
aagctcctggaataggcactctgga

SEQ ID NO: 42645 - DNA, 25 bp, Rattus norvegicus
aagctcctggagctggccgtgtacc

SEQ ID NO: 42646 - DNA, 25 bp, Rattus norvegicus
aagctcctggaggtggccgtgtacc

SEQ ID NO: 42647 - DNA, 25 bp, Rattus norvegicus
aagctcctgggtaacgtgctggtga

SEQ ID NO: 42648 - DNA, 25 bp, Rattus norvegicus
aagctcctgggttacgtgctggtga

SEQ ID NO: 42649 - DNA, 25 bp, Rattus norvegicus
aagctcctggtgctaaaccaaacaa

SEQ ID NO: 42650 - DNA, 25 bp, Rattus norvegicus
aagctcctggtgctcacccgaggaa

SEQ ID NO: 42651 - DNA, 25 bp, Rattus norvegicus
aagctcctggtggtaaaccaaacaa

SEQ ID NO: 42652 - DNA, 25 bp, Rattus norvegicus
aagctcctggtggtcacccgaggaa

SEQ ID NO: 42653 - DNA, 25 bp, Rattus norvegicus
aagctccttctaaacatatgtccta

SEQ ID NO: 42654 - DNA, 25 bp, Rattus norvegicus
aagctccttctatacatatgtccta

SEQ ID NO: 42655 - DNA, 25 bp, Rattus norvegicus
aagctccttgctagacatccagtat

SEQ ID NO: 42656 - DNA, 25 bp, Rattus norvegicus
aagctccttgcttgacatccagtat

SEQ ID NO: 42657 - DNA, 25 bp, Rattus norvegicus
aagctcctttaaaatgacctatcaa

SEQ ID NO: 42658 - DNA, 25 bp, Rattus norvegicus
aagctcctttaatatgacctatcaa

SEQ ID NO: 42659 - DNA, 25 bp, Rattus norvegicus
aagctcgaaactacacattccaaag

SEQ ID NO: 42660 - DNA, 25 bp, Rattus norvegicus
aagctcgaaacttcacattccaaag

SEQ ID NO: 42661 - DNA, 25 bp, Rattus norvegicus
aagctcgacttcagtgcatgttcgt

SEQ ID NO: 42662 - DNA, 25 bp, Rattus norvegicus
aagctcgacttctgtgcatgttcgt

SEQ ID NO: 42663 - DNA, 25 bp, Rattus norvegicus
aagctcgcaaccacaaagccatgga

SEQ ID NO: 42664 - DNA, 25 bp, Rattus norvegicus
aagctcgcaacctcaaagccatgga

SEQ ID NO: 42665 - DNA, 25 bp, Rattus norvegicus
aagctcgcacttcgtcggtggactt

SEQ ID NO: 42666 - DNA, 25 bp, Rattus norvegicus
aagctcgcacttggtcggtggactt

SEQ ID NO: 42667 - DNA, 25 bp, Rattus norvegicus
aagctcgcctgcaacggcgatcgag

SEQ ID NO: 42668 - DNA, 25 bp, Rattus norvegicus
aagctcgcctgctacggcgatcgag

SEQ ID NO: 42669 - DNA, 25 bp, Rattus norvegicus
aagctcgccttgaatgtgggtgaca

SEQ ID NO: 42670 - DNA, 25 bp, Rattus norvegicus
aagctcgccttgtatgtgggtgaca

SEQ ID NO: 42671 - DNA, 25 bp, Rattus norvegicus
aagctcgctgtgactacctgaaggg

SEQ ID NO: 42672 - DNA, 25 bp, Rattus norvegicus
aagctcgctgtgtctacctgaaggg

SEQ ID NO: 42673 - DNA, 25 bp, Rattus norvegicus
aagctcggaagtagcaacatggcca

SEQ ID NO: 42674 - DNA, 25 bp, Rattus norvegicus
aagctcggaagttgcaacatggcca

SEQ ID NO: 42675 - DNA, 25 bp, Rattus norvegicus
aagctcggagttcttgtacacgtac

SEQ ID NO: 42676 - DNA, 25 bp, Rattus norvegicus
aagctcggagttgttgtacacgtac

SEQ ID NO: 42677 - DNA, 25 bp, Rattus norvegicus
aagctcggcaagaccgtggtagcca

SEQ ID NO: 42678 - DNA, 25 bp, Rattus norvegicus
aagctcggcaagtccgtggtagcca

SEQ ID NO: 42679 - DNA, 25 bp, Rattus norvegicus
aagctcggcggccatgaccacgtac

SEQ ID NO: 42680 - DNA, 25 bp, Rattus norvegicus
aagctcggcggcgatgaccacgtac

SEQ ID NO: 42681 - DNA, 25 bp, Rattus norvegicus
aagctcggctagacaggttttctca

SEQ ID NO: 42682 - DNA, 25 bp, Rattus norvegicus
aagctcggctagtcaggttttctca

SEQ ID NO: 42683 - DNA, 25 bp, Rattus norvegicus
aagctcggcttcctcagggctgaga

SEQ ID NO: 42684 - DNA, 25 bp, Rattus norvegicus
aagctcggcttcgtcagggctgaga

SEQ ID NO: 42685 - DNA, 25 bp, Rattus norvegicus
aagctcgggcggacacatttcataa

SEQ ID NO: 42686 - DNA, 25 bp, Rattus norvegicus
aagctcgggcggtcacatttcataa

SEQ ID NO: 42687 - DNA, 25 bp, Rattus norvegicus
aagctcgggcttcgtatcaggattc

SEQ ID NO: 42688 - DNA, 25 bp, Rattus norvegicus
aagctcgggcttggtatcaggattc

SEQ ID NO: 42689 - DNA, 25 bp, Rattus norvegicus
aagctcggtactcccatctaggaaa

SEQ ID NO: 42690 - DNA, 25 bp, Rattus norvegicus
aagctcggtactgccatctaggaaa

SEQ ID NO: 42691 - DNA, 25 bp, Rattus norvegicus
aagctcggtataatcacacccatcc

SEQ ID NO: 42692 - DNA, 25 bp, Rattus norvegicus
aagctcggtatattcacacccatcc

SEQ ID NO: 42693 - DNA, 25 bp, Rattus norvegicus
aagctcgtctggaaaatgcagcctc

SEQ ID NO: 42694 - DNA, 25 bp, Rattus norvegicus
aagctcgtctggtaaatgcagcctc

SEQ ID NO: 42695 - DNA, 25 bp, Rattus norvegicus
aagctcgtggttcgatcggttatca

SEQ ID NO: 42696 - DNA, 25 bp, Rattus norvegicus
aagctcgtggttggatcggttatca

SEQ ID NO: 42697 - DNA, 25 bp, Rattus norvegicus
aagctctaaagaaccatgtctcctc

SEQ ID NO: 42698 - DNA, 25 bp, Rattus norvegicus
aagctctaaagatccatgtctcctc

SEQ ID NO: 42699 - DNA, 25 bp, Rattus norvegicus
aagctctaagcaaacgcatcctgtg

SEQ ID NO: 42700 - DNA, 25 bp, Rattus norvegicus
aagctctaagcatacgcatcctgtg

SEQ ID NO: 42701 - DNA, 25 bp, Rattus norvegicus
aagctctaagccacaggagttaagt

SEQ ID NO: 42702 - DNA, 25 bp, Rattus norvegicus
aagctctaagcctcaggagttaagt

SEQ ID NO: 42703 - DNA, 25 bp, Rattus norvegicus
aagctctaatggacctttttgaaga

SEQ ID NO: 42704 - DNA, 25 bp, Rattus norvegicus
aagctctaatggtcctttttgaaga

SEQ ID NO: 42705 - DNA, 25 bp, Rattus norvegicus
aagctctacagactcacttgtctct

SEQ ID NO: 42706 - DNA, 25 bp, Rattus norvegicus
aagctctacagagtcacttgtctct

SEQ ID NO: 42707 - DNA, 25 bp, Rattus norvegicus
aagctctaccccagtgtggaatttt

SEQ ID NO: 42708 - DNA, 25 bp, Rattus norvegicus
aagctctacccctgtgtggaatttt

SEQ ID NO: 42709 - DNA, 25 bp, Rattus norvegicus
aagctctaccctcagtgtcatcgaa

SEQ ID NO: 42710 - DNA, 25 bp, Rattus norvegicus
aagctctaccctgagtgtcatcgaa

SEQ ID NO: 42711 - DNA, 25 bp, Rattus norvegicus
aagctctacgaaagctttcccacat

SEQ ID NO: 42712 - DNA, 25 bp, Rattus norvegicus
aagctctacgaatgctttcccacat

SEQ ID NO: 42713 - DNA, 25 bp, Rattus norvegicus
aagctctacgatatctacctcttca

SEQ ID NO: 42714 - DNA, 25 bp, Rattus norvegicus
aagctctacgatttctacctcttca

SEQ ID NO: 42715 - DNA, 25 bp, Rattus norvegicus
aagctctacgctactgtcatgataa

SEQ ID NO: 42716 - DNA, 25 bp, Rattus norvegicus
aagctctacgcttctgtcatgataa

SEQ ID NO: 42717 - DNA, 25 bp, Rattus norvegicus
aagctctactatccagtcggttctg

SEQ ID NO: 42718 - DNA, 25 bp, Rattus norvegicus
aagctctactatgcagtcggttctg

SEQ ID NO: 42719 - DNA, 25 bp, Rattus norvegicus
aagctctagggcactcttgtcgcta

SEQ ID NO: 42720 - DNA, 25 bp, Rattus norvegicus
aagctctagggctctcttgtcgcta

SEQ ID NO: 42721 - DNA, 25 bp, Rattus norvegicus
aagctctatgccaacatgtttgaga

SEQ ID NO: 42722 - DNA, 25 bp, Rattus norvegicus
aagctctatgcctacatgtttgaga

SEQ ID NO: 42723 - DNA, 25 bp, Rattus norvegicus
aagctctatggccttcactgtccat

SEQ ID NO: 42724 - DNA, 25 bp, Rattus norvegicus
aagctctatggcgttcactgtccat

SEQ ID NO: 42725 - DNA, 25 bp, Rattus norvegicus
aagctctcagcgagaccttcgaggg

SEQ ID NO: 42726 - DNA, 25 bp, Rattus norvegicus
aagctctcagcgtgaccttcgaggg

SEQ ID NO: 42727 - DNA, 25 bp, Rattus norvegicus
aagctctcagctaaatctgcatcca

SEQ ID NO: 42728 - DNA, 25 bp, Rattus norvegicus
aagctctcagcttaatctgcatcca

SEQ ID NO: 42729 - DNA, 25 bp, Rattus norvegicus
aagctctcatatctttcactttaga

SEQ ID NO: 42730 - DNA, 25 bp, Rattus norvegicus
aagctctcatatgtttcactttaga

SEQ ID NO: 42731 - DNA, 25 bp, Rattus norvegicus
aagctctcatgccaaggctgcggga

SEQ ID NO: 42732 - DNA, 25 bp, Rattus norvegicus
aagctctcatgcgaaggctgcggga

SEQ ID NO: 42733 - DNA, 25 bp, Rattus norvegicus
aagctctcatttcatccccaagtaa

SEQ ID NO: 42734 - DNA, 25 bp, Rattus norvegicus
aagctctcatttgatccccaagtaa

SEQ ID NO: 42735 - DNA, 25 bp, Rattus norvegicus
aagctctccaggctttgaagcacat

SEQ ID NO: 42736 - DNA, 25 bp, Rattus norvegicus
aagctctccagggtttgaagcacat

SEQ ID NO: 42737 - DNA, 25 bp, Rattus norvegicus
aagctctccattatcaaactctgac

SEQ ID NO: 42738 - DNA, 25 bp, Rattus norvegicus
aagctctccattttcaaactctgac

SEQ ID NO: 42739 - DNA, 25 bp, Rattus norvegicus
aagctctcccctctctataaaatag

SEQ ID NO: 42740 - DNA, 25 bp, Rattus norvegicus
aagctctcccctgtctataaaatag

SEQ ID NO: 42741 - DNA, 25 bp, Rattus norvegicus
aagctctcccttaggtctcatcacg

SEQ ID NO: 42742 - DNA, 25 bp, Rattus norvegicus
aagctctccctttggtctcatcacg

SEQ ID NO: 42743 - DNA, 25 bp, Rattus norvegicus
aagctctccgagagtttgcctgatg

SEQ ID NO: 42744 - DNA, 25 bp, Rattus norvegicus
aagctctccgagtgtttgcctgatg

SEQ ID NO: 42745 - DNA, 25 bp, Rattus norvegicus
aagctctcctaactcatactgtata

SEQ ID NO: 42746 - DNA, 25 bp, Rattus norvegicus
aagctctcctaagtcatactgtata

SEQ ID NO: 42747 - DNA, 25 bp, Rattus norvegicus
aagctctcctatacccagcagatgg

SEQ ID NO: 42748 - DNA, 25 bp, Rattus norvegicus
aagctctcctattcccagcagatgg

SEQ ID NO: 42749 - DNA, 25 bp, Rattus norvegicus
aagctctcgaaacccactggagtaa

SEQ ID NO: 42750 - DNA, 25 bp, Rattus norvegicus
aagctctcgaaagccactggagtaa

SEQ ID NO: 42751 - DNA, 25 bp, Rattus norvegicus
aagctctcgagcataaattacatag

SEQ ID NO: 42752 - DNA, 25 bp, Rattus norvegicus
aagctctcgagcttaaattacatag

SEQ ID NO: 42753 - DNA, 25 bp, Rattus norvegicus
aagctctctatgaagcacttacgga

SEQ ID NO: 42754 - DNA, 25 bp, Rattus norvegicus
aagctctctatgtagcacttacgga

SEQ ID NO: 42755 - DNA, 25 bp, Rattus norvegicus
aagctctctcctcacttgtattgtg

SEQ ID NO: 42756 - DNA, 25 bp, Rattus norvegicus
aagctctctcctgacttgtattgtg

SEQ ID NO: 42757 - DNA, 25 bp, Rattus norvegicus
aagctctctgacatctggcagcagt

SEQ ID NO: 42758 - DNA, 25 bp, Rattus norvegicus
aagctctctgacttctggcagcagt

SEQ ID NO: 42759 - DNA, 25 bp, Rattus norvegicus
aagctctctggtaagatcttttaca

SEQ ID NO: 42760 - DNA, 25 bp, Rattus norvegicus
aagctctctggttagatcttttaca

SEQ ID NO: 42761 - DNA, 25 bp, Rattus norvegicus
aagctctctgtgacatggtctatag

SEQ ID NO: 42762 - DNA, 25 bp, Rattus norvegicus
aagctctctgtgtcatggtctatag

SEQ ID NO: 42763 - DNA, 25 bp, Rattus norvegicus
aagctctcttaaactcggctcaagt

SEQ ID NO: 42764 - DNA, 25 bp, Rattus norvegicus
aagctctcttaatctcggctcaagt

SEQ ID NO: 42765 - DNA, 25 bp, Rattus norvegicus
aagctctgagctaatatctcctgct

SEQ ID NO: 42766 - DNA, 25 bp, Rattus norvegicus
aagctctgagctagcacatgacaaa

SEQ ID NO: 42767 - DNA, 25 bp, Rattus norvegicus
aagctctgagcttatatctcctgct

SEQ ID NO: 42768 - DNA, 25 bp, Rattus norvegicus
aagctctgagcttgcacatgacaaa

SEQ ID NO: 42769 - DNA, 25 bp, Rattus norvegicus
aagctctgatggatctttccttgac

SEQ ID NO: 42770 - DNA, 25 bp, Rattus norvegicus
aagctctgatggttctttccttgac

SEQ ID NO: 42771 - DNA, 25 bp, Rattus norvegicus
aagctctgcaggaacttaccatctc

SEQ ID NO: 42772 - DNA, 25 bp, Rattus norvegicus
aagctctgcaggtacttaccatctc

SEQ ID NO: 42773 - DNA, 25 bp, Rattus norvegicus
aagctctgccaacatggagagcggc

SEQ ID NO: 42774 - DNA, 25 bp, Rattus norvegicus
aagctctgccaagatggagagcggc

SEQ ID NO: 42775 - DNA, 25 bp, Rattus norvegicus
aagctctgcctcaatatctgcgtgg

SEQ ID NO: 42776 - DNA, 25 bp, Rattus norvegicus
aagctctgcctctatatctgcgtgg

SEQ ID NO: 42777 - DNA, 25 bp, Rattus norvegicus
aagctctgcctgagggaatcgggtt

SEQ ID NO: 42778 - DNA, 25 bp, Rattus norvegicus
aagctctgcctgtgggaatcgggtt

SEQ ID NO: 42779 - DNA, 25 bp, Rattus norvegicus
aagctctgcgatccaagaagtttag

SEQ ID NO: 42780 - DNA, 25 bp, Rattus norvegicus
aagctctgcgatgcaagaagtttag

SEQ ID NO: 42781 - DNA, 25 bp, Rattus norvegicus
aagctctgctctcttctcaagttgg

SEQ ID NO: 42782 - DNA, 25 bp, Rattus norvegicus
aagctctgctctgttctcaagttgg

SEQ ID NO: 42783 - DNA, 25 bp, Rattus norvegicus
aagctctggaataacctccacatca

SEQ ID NO: 42784 - DNA, 25 bp, Rattus norvegicus
aagctctggaattacctccacatca

SEQ ID NO: 42785 - DNA, 25 bp, Rattus norvegicus
aagctctggatcagggtactttcac

SEQ ID NO: 42786 - DNA, 25 bp, Rattus norvegicus
aagctctggatctgggtactttcac

SEQ ID NO: 42787 - DNA, 25 bp, Rattus norvegicus
aagctctggcccatgggtactaggt

SEQ ID NO: 42788 - DNA, 25 bp, Rattus norvegicus
aagctctggcccttgggtactaggt

SEQ ID NO: 42789 - DNA, 25 bp, Rattus norvegicus
aagctctggccgatcatcaagaaaa

SEQ ID NO: 42790 - DNA, 25 bp, Rattus norvegicus
aagctctggccgttcatcaagaaaa

SEQ ID NO: 42791 - DNA, 25 bp, Rattus norvegicus
aagctctggtctatgaagcctcgca

SEQ ID NO: 42792 - DNA, 25 bp, Rattus norvegicus
aagctctggtctttgaagcctcgca

SEQ ID NO: 42793 - DNA, 25 bp, Rattus norvegicus
aagctctggtgcactggtggtgacc

SEQ ID NO: 42794 - DNA, 25 bp, Rattus norvegicus
aagctctggtgctctggtggtgacc

SEQ ID NO: 42795 - DNA, 25 bp, Rattus norvegicus
aagctctgtaagcagaagtctgtga

SEQ ID NO: 42796 - DNA, 25 bp, Rattus norvegicus
aagctctgtaaggagaagtctgtga

SEQ ID NO: 42797 - DNA, 25 bp, Rattus norvegicus
aagctctgtgacaaggttttgttat

SEQ ID NO: 42798 - DNA, 25 bp, Rattus norvegicus
aagctctgtgactaggttttgttat

SEQ ID NO: 42799 - DNA, 25 bp, Rattus norvegicus
aagctctgtgagcaccgccttttct

SEQ ID NO: 42800 - DNA, 25 bp, Rattus norvegicus
aagctctgtgaggaccgccttttct

SEQ ID NO: 42801 - DNA, 25 bp, Rattus norvegicus
aagctctgtgggacatggaatccgt

SEQ ID NO: 42802 - DNA, 25 bp, Rattus norvegicus
aagctctgtgggtcatggaatccgt

SEQ ID NO: 42803 - DNA, 25 bp, Rattus norvegicus
aagctctgtgttcttcatattccta

SEQ ID NO: 42804 - DNA, 25 bp, Rattus norvegicus
aagctctgtgttgttcatattccta

SEQ ID NO: 42805 - DNA, 25 bp, Rattus norvegicus
aagctctgttagaggcctggttaaa

SEQ ID NO: 42806 - DNA, 25 bp, Rattus norvegicus
aagctctgttagtggcctggttaaa

SEQ ID NO: 42807 - DNA, 25 bp, Rattus norvegicus
aagctctgttgcctgcggtccgcac

SEQ ID NO: 42808 - DNA, 25 bp, Rattus norvegicus
aagctctgttgcgtgcggtccgcac

SEQ ID NO: 42809 - DNA, 25 bp, Rattus norvegicus
aagctctgttggcagtcctttccag

SEQ ID NO: 42810 - DNA, 25 bp, Rattus norvegicus
aagctctgttgggagtcctttccag

SEQ ID NO: 42811 - DNA, 25 bp, Rattus norvegicus
aagctcttaagaagtgttcagtcac

SEQ ID NO: 42812 - DNA, 25 bp, Rattus norvegicus
aagctcttaagatgtgttcagtcac

SEQ ID NO: 42813 - DNA, 25 bp, Rattus norvegicus
aagctcttaagcatcgtggcgctgg

SEQ ID NO: 42814 - DNA, 25 bp, Rattus norvegicus
aagctcttaagcttcgtggcgctgg

SEQ ID NO: 42815 - DNA, 25 bp, Rattus norvegicus
aagctcttaagtatcttgtcttctt

SEQ ID NO: 42816 - DNA, 25 bp, Rattus norvegicus
aagctcttaagtttcttgtcttctt

SEQ ID NO: 42817 - DNA, 25 bp, Rattus norvegicus
aagctcttacagctggttcatcgat

SEQ ID NO: 42818 - DNA, 25 bp, Rattus norvegicus
aagctcttacaggtggttcatcgat

SEQ ID NO: 42819 - DNA, 25 bp, Rattus norvegicus
aagctcttactcagtgcacaaatat

SEQ ID NO: 42820 - DNA, 25 bp, Rattus norvegicus
aagctcttactctgtgcacaaatat

SEQ ID NO: 42821 - DNA, 25 bp, Rattus norvegicus
aagctcttagtcattctattctgtg

SEQ ID NO: 42822 - DNA, 25 bp, Rattus norvegicus
aagctcttagtctttctattctgtg

SEQ ID NO: 42823 - DNA, 25 bp, Rattus norvegicus
aagctcttattaaaacacgttctaa

SEQ ID NO: 42824 - DNA, 25 bp, Rattus norvegicus
aagctcttattaccagctctaaaga

SEQ ID NO: 42825 - DNA, 25 bp, Rattus norvegicus
aagctcttattagcagctctaaaga

SEQ ID NO: 42826 - DNA, 25 bp, Rattus norvegicus
aagctcttattataacacgttctaa

SEQ ID NO: 42827 - DNA, 25 bp, Rattus norvegicus
aagctcttcagacttcgagacccat

SEQ ID NO: 42828 - DNA, 25 bp, Rattus norvegicus
aagctcttcagagttcgagacccat

SEQ ID NO: 42829 - DNA, 25 bp, Rattus norvegicus
aagctcttcagcattggtggtctgg

SEQ ID NO: 42830 - DNA, 25 bp, Rattus norvegicus
aagctcttcagctttggtggtctgg

SEQ ID NO: 42831 - DNA, 25 bp, Rattus norvegicus
aagctcttcagtatctcagagcagt

SEQ ID NO: 42832 - DNA, 25 bp, Rattus norvegicus
aagctcttcagtttctcagagcagt

SEQ ID NO: 42833 - DNA, 25 bp, Rattus norvegicus
aagctcttcatactgcaagtcgtag

SEQ ID NO: 42834 - DNA, 25 bp, Rattus norvegicus
aagctcttcatagtgcaagtcgtag

SEQ ID NO: 42835 - DNA, 25 bp, Rattus norvegicus
aagctcttcattagcactttgacaa

SEQ ID NO: 42836 - DNA, 25 bp, Rattus norvegicus
aagctcttcatttgcactttgacaa

SEQ ID NO: 42837 - DNA, 25 bp, Rattus norvegicus
aagctcttccaccatccttgtcgtg

SEQ ID NO: 42838 - DNA, 25 bp, Rattus norvegicus
aagctcttccacgatccttgtcgtg

SEQ ID NO: 42839 - DNA, 25 bp, Rattus norvegicus
aagctcttccccattgtcgaggaga

SEQ ID NO: 42840 - DNA, 25 bp, Rattus norvegicus
aagctcttcccctttgtcgaggaga

SEQ ID NO: 42841 - DNA, 25 bp, Rattus norvegicus
aagctcttccggacaaccatcaaca

SEQ ID NO: 42842 - DNA, 25 bp, Rattus norvegicus
aagctcttccggtcaaccatcaaca

SEQ ID NO: 42843 - DNA, 25 bp, Rattus norvegicus
aagctcttcctgagccacatgagtt

SEQ ID NO: 42844 - DNA, 25 bp, Rattus norvegicus
aagctcttcctgagtgaccaaggtc

SEQ ID NO: 42845 - DNA, 25 bp, Rattus norvegicus
aagctcttcctgtgccacatgagtt

SEQ ID NO: 42846 - DNA, 25 bp, Rattus norvegicus
aagctcttcctgtgtgaccaaggtc

SEQ ID NO: 42847 - DNA, 25 bp, Rattus norvegicus
aagctcttcggtctgcctttcttta

SEQ ID NO: 42848 - DNA, 25 bp, Rattus norvegicus
aagctcttcggtgtgcctttcttta

SEQ ID NO: 42849 - DNA, 25 bp, Rattus norvegicus
aagctcttctgcagtggctctgtgt

SEQ ID NO: 42850 - DNA, 25 bp, Rattus norvegicus
aagctcttctgctgtggctctgtgt

SEQ ID NO: 42851 - DNA, 25 bp, Rattus norvegicus
aagctcttgaacaataaggaatctc

SEQ ID NO: 42852 - DNA, 25 bp, Rattus norvegicus
aagctcttgaactataaggaatctc

SEQ ID NO: 42853 - DNA, 25 bp, Rattus norvegicus
aagctcttgaatattcctgttaaca

SEQ ID NO: 42854 - DNA, 25 bp, Rattus norvegicus
aagctcttgaattttcctgttaaca

SEQ ID NO: 42855 - DNA, 25 bp, Rattus norvegicus
aagctcttgagacactttgctgcaa

SEQ ID NO: 42856 - DNA, 25 bp, Rattus norvegicus
aagctcttgagagactttgctgcaa

SEQ ID NO: 42857 - DNA, 25 bp, Rattus norvegicus
aagctcttgaggaggcacatgccgt

SEQ ID NO: 42858 - DNA, 25 bp, Rattus norvegicus
aagctcttgaggtggcacatgccgt

SEQ ID NO: 42859 - DNA, 25 bp, Rattus norvegicus
aagctcttgctcagatttcctcctt

SEQ ID NO: 42860 - DNA, 25 bp, Rattus norvegicus
aagctcttgctctgatttcctcctt

SEQ ID NO: 42861 - DNA, 25 bp, Rattus norvegicus
aagctcttgctgaggtctttgacct

SEQ ID NO: 42862 - DNA, 25 bp, Rattus norvegicus
aagctcttgctgatcatttgatgta

SEQ ID NO: 42863 - DNA, 25 bp, Rattus norvegicus
aagctcttgctgtggtctttgacct

SEQ ID NO: 42864 - DNA, 25 bp, Rattus norvegicus
aagctcttgctgttcatttgatgta

SEQ ID NO: 42865 - DNA, 25 bp, Rattus norvegicus
aagctcttggacaggccgatgtctt

SEQ ID NO: 42866 - DNA, 25 bp, Rattus norvegicus
aagctcttggactggccgatgtctt

SEQ ID NO: 42867 - DNA, 25 bp, Rattus norvegicus
aagctcttgttcatgttgccatgac

SEQ ID NO: 42868 - DNA, 25 bp, Rattus norvegicus
aagctcttgttcttgttgccatgac

SEQ ID NO: 42869 - DNA, 25 bp, Rattus norvegicus
aagctctttggtcataacgtagttc

SEQ ID NO: 42870 - DNA, 25 bp, Rattus norvegicus
aagctctttggtgataacgtagttc

SEQ ID NO: 42871 - DNA, 25 bp, Rattus norvegicus
aagctctttgtgacaggacttttca

SEQ ID NO: 42872 - DNA, 25 bp, Rattus norvegicus
aagctctttgtgtcaggacttttca

SEQ ID NO: 42873 - DNA, 25 bp, Rattus norvegicus
aagctcttttctctcataacttgta

SEQ ID NO: 42874 - DNA, 25 bp, Rattus norvegicus
aagctcttttctgtcataacttgta

SEQ ID NO: 42875 - DNA, 25 bp, Rattus norvegicus
aagctcttttttcacctgttcttca

SEQ ID NO: 42876 - DNA, 25 bp, Rattus norvegicus
aagctcttttttgacctgttcttca

SEQ ID NO: 42877 - DNA, 25 bp, Rattus norvegicus
aagctgaaatctctacttcacccaa

SEQ ID NO: 42878 - DNA, 25 bp, Rattus norvegicus
aagctgaaatctgtacttcacccaa

SEQ ID NO: 42879 - DNA, 25 bp, Rattus norvegicus
aagctgaacattagtgcttcccgcg

SEQ ID NO: 42880 - DNA, 25 bp, Rattus norvegicus
aagctgaacatttgtgcttcccgcg

SEQ ID NO: 42881 - DNA, 25 bp, Rattus norvegicus
aagctgaacccacgacccaacattt

SEQ ID NO: 42882 - DNA, 25 bp, Rattus norvegicus
aagctgaacccaggacccaacattt

SEQ ID NO: 42883 - DNA, 25 bp, Rattus norvegicus
aagctgaacgaactggaactgacca

SEQ ID NO: 42884 - DNA, 25 bp, Rattus norvegicus
aagctgaacgaagtggaactgacca

SEQ ID NO: 42885 - DNA, 25 bp, Rattus norvegicus
aagctgaagaccagctgctctgaaa

SEQ ID NO: 42886 - DNA, 25 bp, Rattus norvegicus
aagctgaagacctgctgctctgaaa

SEQ ID NO: 42887 - DNA, 25 bp, Rattus norvegicus
aagctgaagattaaagggttgggca

SEQ ID NO: 42888 - DNA, 25 bp, Rattus norvegicus
aagctgaagatttaagggttgggca

SEQ ID NO: 42889 - DNA, 25 bp, Rattus norvegicus
aagctgaagcacaatgggcccggat

SEQ ID NO: 42890 - DNA, 25 bp, Rattus norvegicus
aagctgaagcacctggaaaggctaa

SEQ ID NO: 42891 - DNA, 25 bp, Rattus norvegicus
aagctgaagcacctgtctgttattt

SEQ ID NO: 42892 - DNA, 25 bp, Rattus norvegicus
aagctgaagcacgtggaaaggctaa

SEQ ID NO: 42893 - DNA, 25 bp, Rattus norvegicus
aagctgaagcacgtgtctgttattt

SEQ ID NO: 42894 - DNA, 25 bp, Rattus norvegicus
aagctgaagcactatgggcccggat

SEQ ID NO: 42895 - DNA, 25 bp, Rattus norvegicus
aagctgaagctgattgtggtcctag

SEQ ID NO: 42896 - DNA, 25 bp, Rattus norvegicus
aagctgaagctgtttgtggtcctag

SEQ ID NO: 42897 - DNA, 25 bp, Rattus norvegicus
aagctgaaggataggctggccaccc

SEQ ID NO: 42898 - DNA, 25 bp, Rattus norvegicus
aagctgaaggattggctggccaccc

SEQ ID NO: 42899 - DNA, 25 bp, Rattus norvegicus
aagctgaaggccagggctcctcggc

SEQ ID NO: 42900 - DNA, 25 bp, Rattus norvegicus
aagctgaaggcctgggctcctcggc

SEQ ID NO: 42901 - DNA, 25 bp, Rattus norvegicus
aagctgaatgctactggctctcctt

SEQ ID NO: 42902 - DNA, 25 bp, Rattus norvegicus
aagctgaatgcttctggctctcctt

SEQ ID NO: 42903 - DNA, 25 bp, Rattus norvegicus
aagctgacaacaataactggcccct

SEQ ID NO: 42904 - DNA, 25 bp, Rattus norvegicus
aagctgacaacattaactggcccct

SEQ ID NO: 42905 - DNA, 25 bp, Rattus norvegicus
aagctgacactgaagattgttgtga

SEQ ID NO: 42906 - DNA, 25 bp, Rattus norvegicus
aagctgacactgtagattgttgtga

SEQ ID NO: 42907 - DNA, 25 bp, Rattus norvegicus
aagctgacagctaagtgccttgccc

SEQ ID NO: 42908 - DNA, 25 bp, Rattus norvegicus
aagctgacagcttagtgccttgccc

SEQ ID NO: 42909 - DNA, 25 bp, Rattus norvegicus
aagctgacagtcattgctgagcaaa

SEQ ID NO: 42910 - DNA, 25 bp, Rattus norvegicus
aagctgacagtctttgctgagcaaa

SEQ ID NO: 42911 - DNA, 25 bp, Rattus norvegicus
aagctgacagttaccctatctagga

SEQ ID NO: 42912 - DNA, 25 bp, Rattus norvegicus
aagctgacagtttccctatctagga

SEQ ID NO: 42913 - DNA, 25 bp, Rattus norvegicus
aagctgaccagtaagttgtatccac

SEQ ID NO: 42914 - DNA, 25 bp, Rattus norvegicus
aagctgaccagttagttgtatccac

SEQ ID NO: 42915 - DNA, 25 bp, Rattus norvegicus
aagctgaccggtactgccattgaca

SEQ ID NO: 42916 - DNA, 25 bp, Rattus norvegicus
aagctgaccggttctgccattgaca

SEQ ID NO: 42917 - DNA, 25 bp, Rattus norvegicus
aagctgacctcacttgacttctttg

SEQ ID NO: 42918 - DNA, 25 bp, Rattus norvegicus
aagctgacctcagttgacttctttg

SEQ ID NO: 42919 - DNA, 25 bp, Rattus norvegicus
aagctgacctttatctgcgaagttc

SEQ ID NO: 42920 - DNA, 25 bp, Rattus norvegicus
aagctgacctttttctgcgaagttc

SEQ ID NO: 42921 - DNA, 25 bp, Rattus norvegicus
aagctgactaacagcctctgtgttt

SEQ ID NO: 42922 - DNA, 25 bp, Rattus norvegicus
aagctgactaactgcctctgtgttt

SEQ ID NO: 42923 - DNA, 25 bp, Rattus norvegicus
aagctgactagcatgttctgtgaat

SEQ ID NO: 42924 - DNA, 25 bp, Rattus norvegicus
aagctgactagcttgttctgtgaat

SEQ ID NO: 42925 - DNA, 25 bp, Rattus norvegicus
aagctgactggtacaatctgtcctc

SEQ ID NO: 42926 - DNA, 25 bp, Rattus norvegicus
aagctgactggttcaatctgtcctc

SEQ ID NO: 42927 - DNA, 25 bp, Rattus norvegicus
aagctgactttcataatgaagggaa

SEQ ID NO: 42928 - DNA, 25 bp, Rattus norvegicus
aagctgactttcttaatgaagggaa

SEQ ID NO: 42929 - DNA, 25 bp, Rattus norvegicus
aagctgagaacgaggtcaaccctgt

SEQ ID NO: 42930 - DNA, 25 bp, Rattus norvegicus
aagctgagaacgtggtcaaccctgt

SEQ ID NO: 42931 - DNA, 25 bp, Rattus norvegicus
aagctgagagtcacggcaaggcccc

SEQ ID NO: 42932 - DNA, 25 bp, Rattus norvegicus
aagctgagagtccatcatttcttca

SEQ ID NO: 42933 - DNA, 25 bp, Rattus norvegicus
aagctgagagtcgatcatttcttca

SEQ ID NO: 42934 - DNA, 25 bp, Rattus norvegicus
aagctgagagtctcggcaaggcccc

SEQ ID NO: 42935 - DNA, 25 bp, Rattus norvegicus
aagctgagagttagtttcccctcct

SEQ ID NO: 42936 - DNA, 25 bp, Rattus norvegicus
aagctgagagtttgtttcccctcct

SEQ ID NO: 42937 - DNA, 25 bp, Rattus norvegicus
aagctgagcaccaggactgcggtct

SEQ ID NO: 42938 - DNA, 25 bp, Rattus norvegicus
aagctgagcacctggactgcggtct

SEQ ID NO: 42939 - DNA, 25 bp, Rattus norvegicus
aagctgagcactctcactcctgagc

SEQ ID NO: 42940 - DNA, 25 bp, Rattus norvegicus
aagctgagcactgtcactcctgagc

SEQ ID NO: 42941 - DNA, 25 bp, Rattus norvegicus
aagctgagcagaccatccttcacgg

SEQ ID NO: 42942 - DNA, 25 bp, Rattus norvegicus
aagctgagcagagcatccttcacgg

SEQ ID NO: 42943 - DNA, 25 bp, Rattus norvegicus
aagctgagcatcaccaagctgcggg

SEQ ID NO: 42944 - DNA, 25 bp, Rattus norvegicus
aagctgagcatctccaagctgcggg

SEQ ID NO: 42945 - DNA, 25 bp, Rattus norvegicus
aagctgagccacattgagctccaaa

SEQ ID NO: 42946 - DNA, 25 bp, Rattus norvegicus
aagctgagccactttgagctccaaa

SEQ ID NO: 42947 - DNA, 25 bp, Rattus norvegicus
aagctgagccagatccggaagagac

SEQ ID NO: 42948 - DNA, 25 bp, Rattus norvegicus
aagctgagccagttccggaagagac

SEQ ID NO: 42949 - DNA, 25 bp, Rattus norvegicus
aagctgagccatacaaagcctttta

SEQ ID NO: 42950 - DNA, 25 bp, Rattus norvegicus
aagctgagccattcaaagcctttta

SEQ ID NO: 42951 - DNA, 25 bp, Rattus norvegicus
aagctgagccccaacggcgacggcg

SEQ ID NO: 42952 - DNA, 25 bp, Rattus norvegicus
aagctgagcccctacggcgacggcg

SEQ ID NO: 42953 - DNA, 25 bp, Rattus norvegicus
aagctgagccgacggaaacaaacaa

SEQ ID NO: 42954 - DNA, 25 bp, Rattus norvegicus
aagctgagccgagggaaacaaacaa

SEQ ID NO: 42955 - DNA, 25 bp, Rattus norvegicus
aagctgagcggcatctccttcaaga

SEQ ID NO: 42956 - DNA, 25 bp, Rattus norvegicus
aagctgagcggcttctccttcaaga

SEQ ID NO: 42957 - DNA, 25 bp, Rattus norvegicus
aagctgagcgtgctcctcgtcctat

SEQ ID NO: 42958 - DNA, 25 bp, Rattus norvegicus
aagctgagcgtggtcctcgtcctat

SEQ ID NO: 42959 - DNA, 25 bp, Rattus norvegicus
aagctgagctcaagcggctgtgctg

SEQ ID NO: 42960 - DNA, 25 bp, Rattus norvegicus
aagctgagctcatgcggctgtgctg

SEQ ID NO: 42961 - DNA, 25 bp, Rattus norvegicus
aagctgagctttctcggtttttcat

SEQ ID NO: 42962 - DNA, 25 bp, Rattus norvegicus
aagctgagctttgtcggtttttcat

SEQ ID NO: 42963 - DNA, 25 bp, Rattus norvegicus
aagctgaggaatactcttgcccctt

SEQ ID NO: 42964 - DNA, 25 bp, Rattus norvegicus
aagctgaggaattctcttgcccctt

SEQ ID NO: 42965 - DNA, 25 bp, Rattus norvegicus
aagctgaggactagactctgccttg

SEQ ID NO: 42966 - DNA, 25 bp, Rattus norvegicus
aagctgaggacttgactctgccttg

SEQ ID NO: 42967 - DNA, 25 bp, Rattus norvegicus
aagctgaggagcacgttcgaggcca

SEQ ID NO: 42968 - DNA, 25 bp, Rattus norvegicus
aagctgaggagctcgttcgaggcca

SEQ ID NO: 42969 - DNA, 25 bp, Rattus norvegicus
aagctgaggcgcattctgaacctga

SEQ ID NO: 42970 - DNA, 25 bp, Rattus norvegicus
aagctgaggcgctttctgaacctga

SEQ ID NO: 42971 - DNA, 25 bp, Rattus norvegicus
aagctgagtctaagtttgggtttat

SEQ ID NO: 42972 - DNA, 25 bp, Rattus norvegicus
aagctgagtctacttttccccttat

SEQ ID NO: 42973 - DNA, 25 bp, Rattus norvegicus
aagctgagtctagttttccccttat

SEQ ID NO: 42974 - DNA, 25 bp, Rattus norvegicus
aagctgagtctatgtttgggtttat

SEQ ID NO: 42975 - DNA, 25 bp, Rattus norvegicus
aagctgagtgatccgctgtgaatcc

SEQ ID NO: 42976 - DNA, 25 bp, Rattus norvegicus
aagctgagtgatgcgctgtgaatcc

SEQ ID NO: 42977 - DNA, 25 bp, Rattus norvegicus
aagctgagtgcaaccaggtggtact

SEQ ID NO: 42978 - DNA, 25 bp, Rattus norvegicus
aagctgagtgcatccaggtggtact

SEQ ID NO: 42979 - DNA, 25 bp, Rattus norvegicus
aagctgagtgcgacgcctccgctgg

SEQ ID NO: 42980 - DNA, 25 bp, Rattus norvegicus
aagctgagtgcgtcgcctccgctgg

SEQ ID NO: 42981 - DNA, 25 bp, Rattus norvegicus
aagctgagtgttcaccagccagcta

SEQ ID NO: 42982 - DNA, 25 bp, Rattus norvegicus
aagctgagtgttgaccagccagcta

SEQ ID NO: 42983 - DNA, 25 bp, Rattus norvegicus
aagctgatatctacactatggctat

SEQ ID NO: 42984 - DNA, 25 bp, Rattus norvegicus
aagctgatatcttcactatggctat

SEQ ID NO: 42985 - DNA, 25 bp, Rattus norvegicus
aagctgatcaaaacttctctacgaa

SEQ ID NO: 42986 - DNA, 25 bp, Rattus norvegicus
aagctgatcaaatcttctctacgaa

SEQ ID NO: 42987 - DNA, 25 bp, Rattus norvegicus
aagctgatcacaattgcaggaaata

SEQ ID NO: 42988 - DNA, 25 bp, Rattus norvegicus
aagctgatcacatttgcaggaaata

SEQ ID NO: 42989 - DNA, 25 bp, Rattus norvegicus
aagctgatccaccagggcggtgccc

SEQ ID NO: 42990 - DNA, 25 bp, Rattus norvegicus
aagctgatccacgagggcggtgccc

SEQ ID NO: 42991 - DNA, 25 bp, Rattus norvegicus
aagctgatctacaggcttcattcct

SEQ ID NO: 42992 - DNA, 25 bp, Rattus norvegicus
aagctgatctactggcttcattcct

SEQ ID NO: 42993 - DNA, 25 bp, Rattus norvegicus
aagctgatgcccagagtgctgacca

SEQ ID NO: 42994 - DNA, 25 bp, Rattus norvegicus
aagctgatgccctgagtgctgacca

SEQ ID NO: 42995 - DNA, 25 bp, Rattus norvegicus
aagctgatgctgacggtgatgacca

SEQ ID NO: 42996 - DNA, 25 bp, Rattus norvegicus
aagctgatgctgtcggtgatgacca

SEQ ID NO: 42997 - DNA, 25 bp, Rattus norvegicus
aagctgatggacaatgcccgcaatg

SEQ ID NO: 42998 - DNA, 25 bp, Rattus norvegicus
aagctgatggactatgcccgcaatg

SEQ ID NO: 42999 - DNA, 25 bp, Rattus norvegicus
aagctgatggtacccttccctaggg

SEQ ID NO: 43000 - DNA, 25 bp, Rattus norvegicus
aagctgatggtagccttccctaggg

SEQ ID NO: 43001 - DNA, 25 bp, Rattus norvegicus
aagctgatgtccatccaggaaatgc

SEQ ID NO: 43002 - DNA, 25 bp, Rattus norvegicus
aagctgatgtccttccaggaaatgc

SEQ ID NO: 43003 - DNA, 25 bp, Rattus norvegicus
aagctgatgtcgctggtcagacgct

SEQ ID NO: 43004 - DNA, 25 bp, Rattus norvegicus
aagctgatgtcggtggtcagacgct

SEQ ID NO: 43005 - DNA, 25 bp, Rattus norvegicus
aagctgatgtttattccctggtcta

SEQ ID NO: 43006 - DNA, 25 bp, Rattus norvegicus
aagctgatgttttttccctggtcta

SEQ ID NO: 43007 - DNA, 25 bp, Rattus norvegicus
aagctgattgttactccttttgcaa

SEQ ID NO: 43008 - DNA, 25 bp, Rattus norvegicus
aagctgattgtttctccttttgcaa

SEQ ID NO: 43009 - DNA, 25 bp, Rattus norvegicus
aagctgatttgccattttactgaaa

SEQ ID NO: 43010 - DNA, 25 bp, Rattus norvegicus
aagctgatttgcgattttactgaaa

SEQ ID NO: 43011 - DNA, 25 bp, Rattus norvegicus
aagctgcaaactataggaggtgtct

SEQ ID NO: 43012 - DNA, 25 bp, Rattus norvegicus
aagctgcaaactttaggaggtgtct

SEQ ID NO: 43013 - DNA, 25 bp, Rattus norvegicus
aagctgcaacttccctgtcagaatt

SEQ ID NO: 43014 - DNA, 25 bp, Rattus norvegicus
aagctgcaacttgcctgtcagaatt

SEQ ID NO: 43015 - DNA, 25 bp, Rattus norvegicus
aagctgcaagctatctgttgtggga

SEQ ID NO: 43016 - DNA, 25 bp, Rattus norvegicus
aagctgcaagctttctgttgtggga

SEQ ID NO: 43017 - DNA, 25 bp, Rattus norvegicus
aagctgcaagtgcacgtggtagata

SEQ ID NO: 43018 - DNA, 25 bp, Rattus norvegicus
aagctgcaagtggacgtggtagata

SEQ ID NO: 43019 - DNA, 25 bp, Rattus norvegicus
aagctgcacacaaagttcttcctgt

SEQ ID NO: 43020 - DNA, 25 bp, Rattus norvegicus
aagctgcacacacatttggagggta

SEQ ID NO: 43021 - DNA, 25 bp, Rattus norvegicus
aagctgcacacagatttggagggta

SEQ ID NO: 43022 - DNA, 25 bp, Rattus norvegicus
aagctgcacacatagttcttcctgt

SEQ ID NO: 43023 - DNA, 25 bp, Rattus norvegicus
aagctgcaccaccagactctggtag

SEQ ID NO: 43024 - DNA, 25 bp, Rattus norvegicus
aagctgcaccacgagactctggtag

SEQ ID NO: 43025 - DNA, 25 bp, Rattus norvegicus
aagctgcaccatatgctgtaagagc

SEQ ID NO: 43026 - DNA, 25 bp, Rattus norvegicus
aagctgcaccatttgctgtaagagc

SEQ ID NO: 43027 - DNA, 25 bp, Rattus norvegicus
aagctgcacctcattgagaacccag

SEQ ID NO: 43028 - DNA, 25 bp, Rattus norvegicus
aagctgcacctctttgagaacccag

SEQ ID NO: 43029 - DNA, 25 bp, Rattus norvegicus
aagctgcactacaagcccaatcgat

SEQ ID NO: 43030 - DNA, 25 bp, Rattus norvegicus
aagctgcactactagcccaatcgat

SEQ ID NO: 43031 - DNA, 25 bp, Rattus norvegicus
aagctgcactccattgtggtttcca

SEQ ID NO: 43032 - DNA, 25 bp, Rattus norvegicus
aagctgcactcctttgtggtttcca

SEQ ID NO: 43033 - DNA, 25 bp, Rattus norvegicus
aagctgcactgcaacagccgtgtgt

SEQ ID NO: 43034 - DNA, 25 bp, Rattus norvegicus
aagctgcactgctacagccgtgtgt

SEQ ID NO: 43035 - DNA, 25 bp, Rattus norvegicus
aagctgcactttacaccttatgttt

SEQ ID NO: 43036 - DNA, 25 bp, Rattus norvegicus
aagctgcacttttcaccttatgttt

SEQ ID NO: 43037 - DNA, 25 bp, Rattus norvegicus
aagctgcagaacagggccttgtgct

SEQ ID NO: 43038 - DNA, 25 bp, Rattus norvegicus
aagctgcagaactgggccttgtgct

SEQ ID NO: 43039 - DNA, 25 bp, Rattus norvegicus
aagctgcagacactcgggcacccag

SEQ ID NO: 43040 - DNA, 25 bp, Rattus norvegicus
aagctgcagacagtcgggcacccag

SEQ ID NO: 43041 - DNA, 25 bp, Rattus norvegicus
aagctgcagaggactcattgccttc

SEQ ID NO: 43042 - DNA, 25 bp, Rattus norvegicus
aagctgcagaggtctcattgccttc

SEQ ID NO: 43043 - DNA, 25 bp, Rattus norvegicus
aagctgcagcagaggcctcggctcc

SEQ ID NO: 43044 - DNA, 25 bp, Rattus norvegicus
aagctgcagcagtggcctcggctcc

SEQ ID NO: 43045 - DNA, 25 bp, Rattus norvegicus
aagctgcagcatatggccttggcgt

SEQ ID NO: 43046 - DNA, 25 bp, Rattus norvegicus
aagctgcagcatttggccttggcgt

SEQ ID NO: 43047 - DNA, 25 bp, Rattus norvegicus
aagctgcagcgccacaccaaaatag

SEQ ID NO: 43048 - DNA, 25 bp, Rattus norvegicus
aagctgcagcgcgacaccaaaatag

SEQ ID NO: 43049 - DNA, 25 bp, Rattus norvegicus
aagctgcagctaagtggcccacgag

SEQ ID NO: 43050 - DNA, 25 bp, Rattus norvegicus
aagctgcagctatgtggcccacgag

SEQ ID NO: 43051 - DNA, 25 bp, Rattus norvegicus
aagctgcagctgacgtcagtgtttt

SEQ ID NO: 43052 - DNA, 25 bp, Rattus norvegicus
aagctgcagctgtcgtcagtgtttt

SEQ ID NO: 43053 - DNA, 25 bp, Rattus norvegicus
aagctgcagcttctgattccagtga

SEQ ID NO: 43054 - DNA, 25 bp, Rattus norvegicus
aagctgcagcttgtgattccagtga

SEQ ID NO: 43055 - DNA, 25 bp, Rattus norvegicus
aagctgcaggccaagcgtgcaatat

SEQ ID NO: 43056 - DNA, 25 bp, Rattus norvegicus
aagctgcaggcctagcgtgcaatat

SEQ ID NO: 43057 - DNA, 25 bp, Rattus norvegicus
aagctgcagggaatcgcagtgctgt

SEQ ID NO: 43058 - DNA, 25 bp, Rattus norvegicus
aagctgcagggattcgcagtgctgt

SEQ ID NO: 43059 - DNA, 25 bp, Rattus norvegicus
aagctgcaggtgacaggagaagcac

SEQ ID NO: 43060 - DNA, 25 bp, Rattus norvegicus
aagctgcaggtgtcaggagaagcac

SEQ ID NO: 43061 - DNA, 25 bp, Rattus norvegicus
aagctgcagtcactcattgtcctga

SEQ ID NO: 43062 - DNA, 25 bp, Rattus norvegicus
aagctgcagtcagtcattgtcctga

SEQ ID NO: 43063 - DNA, 25 bp, Rattus norvegicus
aagctgcagtgaccactgtgcgccg

SEQ ID NO: 43064 - DNA, 25 bp, Rattus norvegicus
aagctgcagtgagcactgtgcgccg

SEQ ID NO: 43065 - DNA, 25 bp, Rattus norvegicus
aagctgcatccaacttccgctggta

SEQ ID NO: 43066 - DNA, 25 bp, Rattus norvegicus
aagctgcatccatcttccgctggta

SEQ ID NO: 43067 - DNA, 25 bp, Rattus norvegicus
aagctgcatgaacccaacaatgaat

SEQ ID NO: 43068 - DNA, 25 bp, Rattus norvegicus
aagctgcatgaagccaacaatgaat

SEQ ID NO: 43069 - DNA, 25 bp, Rattus norvegicus
aagctgcatgtcaaggatttcctgt

SEQ ID NO: 43070 - DNA, 25 bp, Rattus norvegicus
aagctgcatgtccttggttctggaa

SEQ ID NO: 43071 - DNA, 25 bp, Rattus norvegicus
aagctgcatgtcgttggttctggaa

SEQ ID NO: 43072 - DNA, 25 bp, Rattus norvegicus
aagctgcatgtctaggatttcctgt

SEQ ID NO: 43073 - DNA, 25 bp, Rattus norvegicus
aagctgcatgttagacacgtgtctt

SEQ ID NO: 43074 - DNA, 25 bp, Rattus norvegicus
aagctgcatgtttgacacgtgtctt

SEQ ID NO: 43075 - DNA, 25 bp, Rattus norvegicus
aagctgccaataaacaaactgtcta

SEQ ID NO: 43076 - DNA, 25 bp, Rattus norvegicus
aagctgccaatatacaaactgtcta

SEQ ID NO: 43077 - DNA, 25 bp, Rattus norvegicus
aagctgccaccaaaattgccaaacg

SEQ ID NO: 43078 - DNA, 25 bp, Rattus norvegicus
aagctgccaccataattgccaaacg

SEQ ID NO: 43079 - DNA, 25 bp, Rattus norvegicus
aagctgccactgaatagggcccagt

SEQ ID NO: 43080 - DNA, 25 bp, Rattus norvegicus
aagctgccactgtatagggcccagt

SEQ ID NO: 43081 - DNA, 25 bp, Rattus norvegicus
aagctgccattgaagatggccgtac

SEQ ID NO: 43082 - DNA, 25 bp, Rattus norvegicus
aagctgccattgacattcagaacac

SEQ ID NO: 43083 - DNA, 25 bp, Rattus norvegicus
aagctgccattgtagatggccgtac

SEQ ID NO: 43084 - DNA, 25 bp, Rattus norvegicus
aagctgccattgtcattcagaacac

SEQ ID NO: 43085 - DNA, 25 bp, Rattus norvegicus
aagctgcccacaaaacactcagagg

SEQ ID NO: 43086 - DNA, 25 bp, Rattus norvegicus
aagctgcccacataacactcagagg

SEQ ID NO: 43087 - DNA, 25 bp, Rattus norvegicus
aagctgcccagcagagctcctgaga

SEQ ID NO: 43088 - DNA, 25 bp, Rattus norvegicus
aagctgcccagctgagctcctgaga

SEQ ID NO: 43089 - DNA, 25 bp, Rattus norvegicus
aagctgcccataagggactttatat

SEQ ID NO: 43090 - DNA, 25 bp, Rattus norvegicus
aagctgcccatatgggactttatat

SEQ ID NO: 43091 - DNA, 25 bp, Rattus norvegicus
aagctgccccttcgcaaatgttgaa

SEQ ID NO: 43092 - DNA, 25 bp, Rattus norvegicus
aagctgccccttggcaaatgttgaa

SEQ ID NO: 43093 - DNA, 25 bp, Rattus norvegicus
aagctgccctccagagaggcaaggg

SEQ ID NO: 43094 - DNA, 25 bp, Rattus norvegicus
aagctgccctcctgagaggcaaggg

SEQ ID NO: 43095 - DNA, 25 bp, Rattus norvegicus
aagctgccgagtccctggtgtgctc

SEQ ID NO: 43096 - DNA, 25 bp, Rattus norvegicus
aagctgccgagtgcctggtgtgctc

SEQ ID NO: 43097 - DNA, 25 bp, Rattus norvegicus
aagctgccgcaccagagacttggct

SEQ ID NO: 43098 - DNA, 25 bp, Rattus norvegicus
aagctgccgcacgagagacttggct

SEQ ID NO: 43099 - DNA, 25 bp, Rattus norvegicus
aagctgccgctacctcactaaatga

SEQ ID NO: 43100 - DNA, 25 bp, Rattus norvegicus
aagctgccgctagctcactaaatga

SEQ ID NO: 43101 - DNA, 25 bp, Rattus norvegicus
aagctgcctaacacactatggatgg

SEQ ID NO: 43102 - DNA, 25 bp, Rattus norvegicus
aagctgcctaactcactatggatgg

SEQ ID NO: 43103 - DNA, 25 bp, Rattus norvegicus
aagctgcctcaacccttgttgttta

SEQ ID NO: 43104 - DNA, 25 bp, Rattus norvegicus
aagctgcctcaagccttgttgttta

SEQ ID NO: 43105 - DNA, 25 bp, Rattus norvegicus
aagctgcctccactcgttggaatcg

SEQ ID NO: 43106 - DNA, 25 bp, Rattus norvegicus
aagctgcctccagtcgttggaatcg

SEQ ID NO: 43107 - DNA, 25 bp, Rattus norvegicus
aagctgcctctaagagccctgtgga

SEQ ID NO: 43108 - DNA, 25 bp, Rattus norvegicus
aagctgcctctatgagccctgtgga

SEQ ID NO: 43109 - DNA, 25 bp, Rattus norvegicus
aagctgcctgcaaggttcagtacca

SEQ ID NO: 43110 - DNA, 25 bp, Rattus norvegicus
aagctgcctgcatggttcagtacca

SEQ ID NO: 43111 - DNA, 25 bp, Rattus norvegicus
aagctgcctgtcacttgtgagactt

SEQ ID NO: 43112 - DNA, 25 bp, Rattus norvegicus
aagctgcctgtcatccttgaagata

SEQ ID NO: 43113 - DNA, 25 bp, Rattus norvegicus
aagctgcctgtctcttgtgagactt

SEQ ID NO: 43114 - DNA, 25 bp, Rattus norvegicus
aagctgcctgtcttccttgaagata

SEQ ID NO: 43115 - DNA, 25 bp, Rattus norvegicus
aagctgcctgtgatatgtccgctgg

SEQ ID NO: 43116 - DNA, 25 bp, Rattus norvegicus
aagctgcctgtgttatgtccgctgg

SEQ ID NO: 43117 - DNA, 25 bp, Rattus norvegicus
aagctgcctgttctatgtgttgccc

SEQ ID NO: 43118 - DNA, 25 bp, Rattus norvegicus
aagctgcctgttgtatgtgttgccc

SEQ ID NO: 43119 - DNA, 25 bp, Rattus norvegicus
aagctgccttatcaggtgggaccct

SEQ ID NO: 43120 - DNA, 25 bp, Rattus norvegicus
aagctgccttatgaggtgggaccct

SEQ ID NO: 43121 - DNA, 25 bp, Rattus norvegicus
aagctgccttctctctctgcactgg

SEQ ID NO: 43122 - DNA, 25 bp, Rattus norvegicus
aagctgccttctgtctctgcactgg

SEQ ID NO: 43123 - DNA, 25 bp, Rattus norvegicus
aagctgccttggcatttaagcacca

SEQ ID NO: 43124 - DNA, 25 bp, Rattus norvegicus
aagctgccttgggatttaagcacca

SEQ ID NO: 43125 - DNA, 25 bp, Rattus norvegicus
aagctgcgaggtctgcaccacagaa

SEQ ID NO: 43126 - DNA, 25 bp, Rattus norvegicus
aagctgcgaggtgtgcaccacagaa

SEQ ID NO: 43127 - DNA, 25 bp, Rattus norvegicus
aagctgcgatcacagagctgatggt

SEQ ID NO: 43128 - DNA, 25 bp, Rattus norvegicus
aagctgcgatcagagagctgatggt

SEQ ID NO: 43129 - DNA, 25 bp, Rattus norvegicus
aagctgcgcactaggccatggcgag

SEQ ID NO: 43130 - DNA, 25 bp, Rattus norvegicus
aagctgcgcacttggccatggcgag

SEQ ID NO: 43131 - DNA, 25 bp, Rattus norvegicus
aagctgcgcggtagctgacgtacaa

SEQ ID NO: 43132 - DNA, 25 bp, Rattus norvegicus
aagctgcgcggttgctgacgtacaa

SEQ ID NO: 43133 - DNA, 25 bp, Rattus norvegicus
aagctgcggaagctgtagcgctcat

SEQ ID NO: 43134 - DNA, 25 bp, Rattus norvegicus
aagctgcggaaggtgtagcgctcat

SEQ ID NO: 43135 - DNA, 25 bp, Rattus norvegicus
aagctgctaaggcatccagcctcac

SEQ ID NO: 43136 - DNA, 25 bp, Rattus norvegicus
aagctgctaagggatccagcctcac

SEQ ID NO: 43137 - DNA, 25 bp, Rattus norvegicus
aagctgctacatccagttcaactaa

SEQ ID NO: 43138 - DNA, 25 bp, Rattus norvegicus
aagctgctacatgcagttcaactaa

SEQ ID NO: 43139 - DNA, 25 bp, Rattus norvegicus
aagctgctacgaatggatgtgccga

SEQ ID NO: 43140 - DNA, 25 bp, Rattus norvegicus
aagctgctacgattggatgtgccga

SEQ ID NO: 43141 - DNA, 25 bp, Rattus norvegicus
aagctgctactgaagaagcccctgc

SEQ ID NO: 43142 - DNA, 25 bp, Rattus norvegicus
aagctgctactgcttttctcgggat

SEQ ID NO: 43143 - DNA, 25 bp, Rattus norvegicus
aagctgctactggttttctcgggat

SEQ ID NO: 43144 - DNA, 25 bp, Rattus norvegicus
aagctgctactgtagaagcccctgc

SEQ ID NO: 43145 - DNA, 25 bp, Rattus norvegicus
aagctgctagaacctgtctgggtct

SEQ ID NO: 43146 - DNA, 25 bp, Rattus norvegicus
aagctgctagaagctgtctgggtct

SEQ ID NO: 43147 - DNA, 25 bp, Rattus norvegicus
aagctgctatttcggtaacttactt

SEQ ID NO: 43148 - DNA, 25 bp, Rattus norvegicus
aagctgctatttgggtaacttactt

SEQ ID NO: 43149 - DNA, 25 bp, Rattus norvegicus
aagctgctcaggaaggccccaataa

SEQ ID NO: 43150 - DNA, 25 bp, Rattus norvegicus
aagctgctcaggctcttttcaggac

SEQ ID NO: 43151 - DNA, 25 bp, Rattus norvegicus
aagctgctcagggtcttttcaggac

SEQ ID NO: 43152 - DNA, 25 bp, Rattus norvegicus
aagctgctcaggtaggccccaataa

SEQ ID NO: 43153 - DNA, 25 bp, Rattus norvegicus
aagctgctcatgatgtagtgtttag

SEQ ID NO: 43154 - DNA, 25 bp, Rattus norvegicus
aagctgctcatgttgtagtgtttag

SEQ ID NO: 43155 - DNA, 25 bp, Rattus norvegicus
aagctgctcgctaactgcaagatga

SEQ ID NO: 43156 - DNA, 25 bp, Rattus norvegicus
aagctgctcgcttactgcaagatga

SEQ ID NO: 43157 - DNA, 25 bp, Rattus norvegicus
aagctgctcttgaggctgccatcaa

SEQ ID NO: 43158 - DNA, 25 bp, Rattus norvegicus
aagctgctcttgtggctgccatcaa

SEQ ID NO: 43159 - DNA, 25 bp, Rattus norvegicus
aagctgctgaccaagttccagaact

SEQ ID NO: 43160 - DNA, 25 bp, Rattus norvegicus
aagctgctgacctagttccagaact

SEQ ID NO: 43161 - DNA, 25 bp, Rattus norvegicus
aagctgctgactcatgattacccca

SEQ ID NO: 43162 - DNA, 25 bp, Rattus norvegicus
aagctgctgactctgctagacacat

SEQ ID NO: 43163 - DNA, 25 bp, Rattus norvegicus
aagctgctgactgatgattacccca

SEQ ID NO: 43164 - DNA, 25 bp, Rattus norvegicus
aagctgctgactgtgctagacacat

SEQ ID NO: 43165 - DNA, 25 bp, Rattus norvegicus
aagctgctgatactcattccttatt

SEQ ID NO: 43166 - DNA, 25 bp, Rattus norvegicus
aagctgctgatagtcattccttatt

SEQ ID NO: 43167 - DNA, 25 bp, Rattus norvegicus
aagctgctgcagatatcggtgctgg

SEQ ID NO: 43168 - DNA, 25 bp, Rattus norvegicus
aagctgctgcagttatcggtgctgg

SEQ ID NO: 43169 - DNA, 25 bp, Rattus norvegicus
aagctgctgcatcccttaagtcaat

SEQ ID NO: 43170 - DNA, 25 bp, Rattus norvegicus
aagctgctgcatgccttaagtcaat

SEQ ID NO: 43171 - DNA, 25 bp, Rattus norvegicus
aagctgctgcccatgccagtgtgga

SEQ ID NO: 43172 - DNA, 25 bp, Rattus norvegicus
aagctgctgcccttgccagtgtgga

SEQ ID NO: 43173 - DNA, 25 bp, Rattus norvegicus
aagctgctgcctacagggatgggac

SEQ ID NO: 43174 - DNA, 25 bp, Rattus norvegicus
aagctgctgccttcagggatgggac

SEQ ID NO: 43175 - DNA, 25 bp, Rattus norvegicus
aagctgctgctgcacacctttgagt

SEQ ID NO: 43176 - DNA, 25 bp, Rattus norvegicus
aagctgctgctggacacctttgagt

SEQ ID NO: 43177 - DNA, 25 bp, Rattus norvegicus
aagctgctgcttcctgaacattctg

SEQ ID NO: 43178 - DNA, 25 bp, Rattus norvegicus
aagctgctgcttcgtagtctctgtg

SEQ ID NO: 43179 - DNA, 25 bp, Rattus norvegicus
aagctgctgcttgctgaacattctg

SEQ ID NO: 43180 - DNA, 25 bp, Rattus norvegicus
aagctgctgcttggtagtctctgtg

SEQ ID NO: 43181 - DNA, 25 bp, Rattus norvegicus
aagctgctgggcattctctttaggg

SEQ ID NO: 43182 - DNA, 25 bp, Rattus norvegicus
aagctgctgggctttctctttaggg

SEQ ID NO: 43183 - DNA, 25 bp, Rattus norvegicus
aagctgctggttcaactggtccaaa

SEQ ID NO: 43184 - DNA, 25 bp, Rattus norvegicus
aagctgctggttgaactggtccaaa

SEQ ID NO: 43185 - DNA, 25 bp, Rattus norvegicus
aagctgctgtatctctgctcacggc

SEQ ID NO: 43186 - DNA, 25 bp, Rattus norvegicus
aagctgctgtatgtctgctcacggc

SEQ ID NO: 43187 - DNA, 25 bp, Rattus norvegicus
aagctgctgtccatccgggtggacg

SEQ ID NO: 43188 - DNA, 25 bp, Rattus norvegicus
aagctgctgtccttccgggtggacg

SEQ ID NO: 43189 - DNA, 25 bp, Rattus norvegicus
aagctgctgtctagagatctttgcc

SEQ ID NO: 43190 - DNA, 25 bp, Rattus norvegicus
aagctgctgtcttgagatctttgcc

SEQ ID NO: 43191 - DNA, 25 bp, Rattus norvegicus
aagctgctgttaccactgcttgaca

SEQ ID NO: 43192 - DNA, 25 bp, Rattus norvegicus
aagctgctgttagcactgcttgaca

SEQ ID NO: 43193 - DNA, 25 bp, Rattus norvegicus
aagctgctgttgctaaggctgccat

SEQ ID NO: 43194 - DNA, 25 bp, Rattus norvegicus
aagctgctgttggtaaggctgccat

SEQ ID NO: 43195 - DNA, 25 bp, Rattus norvegicus
aagctgcttcccatcctcactaagt

SEQ ID NO: 43196 - DNA, 25 bp, Rattus norvegicus
aagctgcttcccatctgatgtcact

SEQ ID NO: 43197 - DNA, 25 bp, Rattus norvegicus
aagctgcttcccttcctcactaagt

SEQ ID NO: 43198 - DNA, 25 bp, Rattus norvegicus
aagctgcttcccttctgatgtcact

SEQ ID NO: 43199 - DNA, 25 bp, Rattus norvegicus
aagctgcttcgacaagagaaccgga

SEQ ID NO: 43200 - DNA, 25 bp, Rattus norvegicus
aagctgcttcgagaagagaaccgga

SEQ ID NO: 43201 - DNA, 25 bp, Rattus norvegicus
aagctgcttcggctgttgtttcttt

SEQ ID NO: 43202 - DNA, 25 bp, Rattus norvegicus
aagctgcttcgggtgttgtttcttt

SEQ ID NO: 43203 - DNA, 25 bp, Rattus norvegicus
aagctgcttctcattggctttggct

SEQ ID NO: 43204 - DNA, 25 bp, Rattus norvegicus
aagctgcttctctttggctttggct

SEQ ID NO: 43205 - DNA, 25 bp, Rattus norvegicus
aagctgcttgaaagtctgccgaaat

SEQ ID NO: 43206 - DNA, 25 bp, Rattus norvegicus
aagctgcttgaatgtctgccgaaat

SEQ ID NO: 43207 - DNA, 25 bp, Rattus norvegicus
aagctgcttgtgagttcagttcatc

SEQ ID NO: 43208 - DNA, 25 bp, Rattus norvegicus
aagctgcttgtgtgttcagttcatc

SEQ ID NO: 43209 - DNA, 25 bp, Rattus norvegicus
aagctgctttaccacctagctgaca

SEQ ID NO: 43210 - DNA, 25 bp, Rattus norvegicus
aagctgctttacgacctagctgaca

SEQ ID NO: 43211 - DNA, 25 bp, Rattus norvegicus
aagctgctttccagctcacagtggt

SEQ ID NO: 43212 - DNA, 25 bp, Rattus norvegicus
aagctgctttcctgctcacagtggt

SEQ ID NO: 43213 - DNA, 25 bp, Rattus norvegicus
aagctgctttctcatgtgtgctggt

SEQ ID NO: 43214 - DNA, 25 bp, Rattus norvegicus
aagctgctttctgatgtgtgctggt

SEQ ID NO: 43215 - DNA, 25 bp, Rattus norvegicus
aagctgctttgacaaccttttgtca

SEQ ID NO: 43216 - DNA, 25 bp, Rattus norvegicus
aagctgctttgagaaccttttgtca

SEQ ID NO: 43217 - DNA, 25 bp, Rattus norvegicus
aagctgctttgcaaagggtcatgac

SEQ ID NO: 43218 - DNA, 25 bp, Rattus norvegicus
aagctgctttgcaacttctataagt

SEQ ID NO: 43219 - DNA, 25 bp, Rattus norvegicus
aagctgctttgctaagggtcatgac

SEQ ID NO: 43220 - DNA, 25 bp, Rattus norvegicus
aagctgctttgctacttctataagt

SEQ ID NO: 43221 - DNA, 25 bp, Rattus norvegicus
aagctggaaacacggccacggagcc

SEQ ID NO: 43222 - DNA, 25 bp, Rattus norvegicus
aagctggaaacagggccacggagcc

SEQ ID NO: 43223 - DNA, 25 bp, Rattus norvegicus
aagctggaacggcacccttcaagag

SEQ ID NO: 43224 - DNA, 25 bp, Rattus norvegicus
aagctggaacgggacccttcaagag

SEQ ID NO: 43225 - DNA, 25 bp, Rattus norvegicus
aagctggaagagaaggcacgcctag

SEQ ID NO: 43226 - DNA, 25 bp, Rattus norvegicus
aagctggaagagtaggcacgcctag

SEQ ID NO: 43227 - DNA, 25 bp, Rattus norvegicus
aagctggaatggagagctctgccaa

SEQ ID NO: 43228 - DNA, 25 bp, Rattus norvegicus
aagctggaatggtgagctctgccaa

SEQ ID NO: 43229 - DNA, 25 bp, Rattus norvegicus
aagctggacattagctggtccgcta

SEQ ID NO: 43230 - DNA, 25 bp, Rattus norvegicus
aagctggacatttgctggtccgcta

SEQ ID NO: 43231 - DNA, 25 bp, Rattus norvegicus
aagctggaccctccaggcggtcagt

SEQ ID NO: 43232 - DNA, 25 bp, Rattus norvegicus
aagctggaccctgcaggcggtcagt

SEQ ID NO: 43233 - DNA, 25 bp, Rattus norvegicus
aagctggacctcaggagcttcaggc

SEQ ID NO: 43234 - DNA, 25 bp, Rattus norvegicus
aagctggacctctggagcttcaggc

SEQ ID NO: 43235 - DNA, 25 bp, Rattus norvegicus
aagctggactacactggactgactg

SEQ ID NO: 43236 - DNA, 25 bp, Rattus norvegicus
aagctggactactctggactgactg

SEQ ID NO: 43237 - DNA, 25 bp, Rattus norvegicus
aagctggactgcctgcaaatgcctc

SEQ ID NO: 43238 - DNA, 25 bp, Rattus norvegicus
aagctggactgcgtgcaaatgcctc

SEQ ID NO: 43239 - DNA, 25 bp, Rattus norvegicus
aagctggacttacttctgtgaaact

SEQ ID NO: 43240 - DNA, 25 bp, Rattus norvegicus
aagctggacttagttctgtgaaact

SEQ ID NO: 43241 - DNA, 25 bp, Rattus norvegicus
aagctggactttcttgccatccttg

SEQ ID NO: 43242 - DNA, 25 bp, Rattus norvegicus
aagctggactttgttgccatccttg

SEQ ID NO: 43243 - DNA, 25 bp, Rattus norvegicus
aagctggagaatactacgtgcctat

SEQ ID NO: 43244 - DNA, 25 bp, Rattus norvegicus
aagctggagaattctacgtgcctat

SEQ ID NO: 43245 - DNA, 25 bp, Rattus norvegicus
aagctggagtctctgctcaattaaa

SEQ ID NO: 43246 - DNA, 25 bp, Rattus norvegicus
aagctggagtctgtgctcaattaaa

SEQ ID NO: 43247 - DNA, 25 bp, Rattus norvegicus
aagctggagtgtacttgtccctttc

SEQ ID NO: 43248 - DNA, 25 bp, Rattus norvegicus
aagctggagtgttcttgtccctttc

SEQ ID NO: 43249 - DNA, 25 bp, Rattus norvegicus
aagctggatagcactgttgtcatca

SEQ ID NO: 43250 - DNA, 25 bp, Rattus norvegicus
aagctggatagctctgttgtcatca

SEQ ID NO: 43251 - DNA, 25 bp, Rattus norvegicus
aagctggatcataacgtttatctga

SEQ ID NO: 43252 - DNA, 25 bp, Rattus norvegicus
aagctggatcattacgtttatctga

SEQ ID NO: 43253 - DNA, 25 bp, Rattus norvegicus
aagctggatgcccatggtttcgctc

SEQ ID NO: 43254 - DNA, 25 bp, Rattus norvegicus
aagctggatgccgatggtttcgctc

SEQ ID NO: 43255 - DNA, 25 bp, Rattus norvegicus
aagctggatggcacctgcaggacat

SEQ ID NO: 43256 - DNA, 25 bp, Rattus norvegicus
aagctggatggctcctgcaggacat

SEQ ID NO: 43257 - DNA, 25 bp, Rattus norvegicus
aagctggatgtgctggtactgacct

SEQ ID NO: 43258 - DNA, 25 bp, Rattus norvegicus
aagctggatgtggtggtactgacct

SEQ ID NO: 43259 - DNA, 25 bp, Rattus norvegicus
aagctggattacattctgggcctga

SEQ ID NO: 43260 - DNA, 25 bp, Rattus norvegicus
aagctggattactttctgggcctga

SEQ ID NO: 43261 - DNA, 25 bp, Rattus norvegicus
aagctggcagtgctcacatgaacta

SEQ ID NO: 43262 - DNA, 25 bp, Rattus norvegicus
aagctggcagtgctctccaactttg

SEQ ID NO: 43263 - DNA, 25 bp, Rattus norvegicus
aagctggcagtggtcacatgaacta

SEQ ID NO: 43264 - DNA, 25 bp, Rattus norvegicus
aagctggcagtggtctccaactttg

SEQ ID NO: 43265 - DNA, 25 bp, Rattus norvegicus
aagctggcatcgagcgacccgtccg

SEQ ID NO: 43266 - DNA, 25 bp, Rattus norvegicus
aagctggcatcgtgcgacccgtccg

SEQ ID NO: 43267 - DNA, 25 bp, Rattus norvegicus
aagctggccaaacagcctttccaaa

SEQ ID NO: 43268 - DNA, 25 bp, Rattus norvegicus
aagctggccaaagagcctttccaaa

SEQ ID NO: 43269 - DNA, 25 bp, Rattus norvegicus
aagctggccagcaccagggagagac

SEQ ID NO: 43270 - DNA, 25 bp, Rattus norvegicus
aagctggccagctccagggagagac

SEQ ID NO: 43271 - DNA, 25 bp, Rattus norvegicus
aagctggcccagatcattgaaaaag

SEQ ID NO: 43272 - DNA, 25 bp, Rattus norvegicus
aagctggcccagttcattgaaaaag

SEQ ID NO: 43273 - DNA, 25 bp, Rattus norvegicus
aagctggccgacagtgactgcgatg

SEQ ID NO: 43274 - DNA, 25 bp, Rattus norvegicus
aagctggccgactgtgactgcgatg

SEQ ID NO: 43275 - DNA, 25 bp, Rattus norvegicus
aagctggccgccaaaatggagtctg

SEQ ID NO: 43276 - DNA, 25 bp, Rattus norvegicus
aagctggccgcctaaatggagtctg

SEQ ID NO: 43277 - DNA, 25 bp, Rattus norvegicus
aagctggcctacaatgcctatcaga

SEQ ID NO: 43278 - DNA, 25 bp, Rattus norvegicus
aagctggcctactatgcctatcaga

SEQ ID NO: 43279 - DNA, 25 bp, Rattus norvegicus
aagctggcctccagtaacatgctgt

SEQ ID NO: 43280 - DNA, 25 bp, Rattus norvegicus
aagctggcctcctgtaacatgctgt

SEQ ID NO: 43281 - DNA, 25 bp, Rattus norvegicus
aagctggccttcatgactcagtgag

SEQ ID NO: 43282 - DNA, 25 bp, Rattus norvegicus
aagctggccttcttgactcagtgag

SEQ ID NO: 43283 - DNA, 25 bp, Rattus norvegicus
aagctggcctttccatgaatagcca

SEQ ID NO: 43284 - DNA, 25 bp, Rattus norvegicus
aagctggcctttgcatgaatagcca

SEQ ID NO: 43285 - DNA, 25 bp, Rattus norvegicus
aagctggcgctgcactggtcttcag

SEQ ID NO: 43286 - DNA, 25 bp, Rattus norvegicus
aagctggcgctggactggtcttcag

SEQ ID NO: 43287 - DNA, 25 bp, Rattus norvegicus
aagctggcggccatgcttgaggaaa

SEQ ID NO: 43288 - DNA, 25 bp, Rattus norvegicus
aagctggcggccttgcttgaggaaa

SEQ ID NO: 43289 - DNA, 25 bp, Rattus norvegicus
aagctggcgttcagaacttccggga

SEQ ID NO: 43290 - DNA, 25 bp, Rattus norvegicus
aagctggcgttctgaacttccggga

SEQ ID NO: 43291 - DNA, 25 bp, Rattus norvegicus
aagctggctattatctagttgtcaa

SEQ ID NO: 43292 - DNA, 25 bp, Rattus norvegicus
aagctggctattttctagttgtcaa

SEQ ID NO: 43293 - DNA, 25 bp, Rattus norvegicus
aagctggctctgcagagtgccttaa

SEQ ID NO: 43294 - DNA, 25 bp, Rattus norvegicus
aagctggctctggagagtgccttaa

SEQ ID NO: 43295 - DNA, 25 bp, Rattus norvegicus
aagctggctgatcgccgactgcgct

SEQ ID NO: 43296 - DNA, 25 bp, Rattus norvegicus
aagctggctgatggccgactgcgct

SEQ ID NO: 43297 - DNA, 25 bp, Rattus norvegicus
aagctggctgctactcttcgtggct

SEQ ID NO: 43298 - DNA, 25 bp, Rattus norvegicus
aagctggctgcttctcttcgtggct

SEQ ID NO: 43299 - DNA, 25 bp, Rattus norvegicus
aagctggctgggaagttttcgacgt

SEQ ID NO: 43300 - DNA, 25 bp, Rattus norvegicus
aagctggctgggtagttttcgacgt

SEQ ID NO: 43301 - DNA, 25 bp, Rattus norvegicus
aagctggcttcactgcctactgtac

SEQ ID NO: 43302 - DNA, 25 bp, Rattus norvegicus
aagctggcttcagtgcctactgtac

SEQ ID NO: 43303 - DNA, 25 bp, Rattus norvegicus
aagctggcttcgaggtccgaggaaa

SEQ ID NO: 43304 - DNA, 25 bp, Rattus norvegicus
aagctggcttcgtggtccgaggaaa

SEQ ID NO: 43305 - DNA, 25 bp, Rattus norvegicus
aagctgggacgcagtattcttccgt

SEQ ID NO: 43306 - DNA, 25 bp, Rattus norvegicus
aagctgggacgctgtattcttccgt

SEQ ID NO: 43307 - DNA, 25 bp, Rattus norvegicus
aagctgggagctacctttgaatgag

SEQ ID NO: 43308 - DNA, 25 bp, Rattus norvegicus
aagctgggagcttcctttgaatgag

SEQ ID NO: 43309 - DNA, 25 bp, Rattus norvegicus
aagctgggcactctttctgattttt

SEQ ID NO: 43310 - DNA, 25 bp, Rattus norvegicus
aagctgggcactgtttctgattttt

SEQ ID NO: 43311 - DNA, 25 bp, Rattus norvegicus
aagctgggcatgctttgtcaagctc

SEQ ID NO: 43312 - DNA, 25 bp, Rattus norvegicus
aagctgggcatggtttgtcaagctc

SEQ ID NO: 43313 - DNA, 25 bp, Rattus norvegicus
aagctgggccagaggctatgccaaa

SEQ ID NO: 43314 - DNA, 25 bp, Rattus norvegicus
aagctgggccagtggctatgccaaa

SEQ ID NO: 43315 - DNA, 25 bp, Rattus norvegicus
aagctgggcgtgacagtccttacga

SEQ ID NO: 43316 - DNA, 25 bp, Rattus norvegicus
aagctgggcgtgtcagtccttacga

SEQ ID NO: 43317 - DNA, 25 bp, Rattus norvegicus
aagctgggctggacctattctggca

SEQ ID NO: 43318 - DNA, 25 bp, Rattus norvegicus
aagctgggctggattgcttcagcat

SEQ ID NO: 43319 - DNA, 25 bp, Rattus norvegicus
aagctgggctggtcctattctggca

SEQ ID NO: 43320 - DNA, 25 bp, Rattus norvegicus
aagctgggctggtttgcttcagcat

SEQ ID NO: 43321 - DNA, 25 bp, Rattus norvegicus
aagctgggcttaactgctttagcct

SEQ ID NO: 43322 - DNA, 25 bp, Rattus norvegicus
aagctgggcttatctgctttagcct

SEQ ID NO: 43323 - DNA, 25 bp, Rattus norvegicus
aagctgggcttgcagccgattccag

SEQ ID NO: 43324 - DNA, 25 bp, Rattus norvegicus
aagctgggcttggagccgattccag

SEQ ID NO: 43325 - DNA, 25 bp, Rattus norvegicus
aagctgggtacacagagcactgctg

SEQ ID NO: 43326 - DNA, 25 bp, Rattus norvegicus
aagctgggtacagagagcactgctg

SEQ ID NO: 43327 - DNA, 25 bp, Rattus norvegicus
aagctgggtgggattccttgactca

SEQ ID NO: 43328 - DNA, 25 bp, Rattus norvegicus
aagctgggtgggtttccttgactca

SEQ ID NO: 43329 - DNA, 25 bp, Rattus norvegicus
aagctgggtgtcatctctgagatgg

SEQ ID NO: 43330 - DNA, 25 bp, Rattus norvegicus
aagctgggtgtcttctctgagatgg

SEQ ID NO: 43331 - DNA, 25 bp, Rattus norvegicus
aagctggtagtcatgccaggtgcaa

SEQ ID NO: 43332 - DNA, 25 bp, Rattus norvegicus
aagctggtagtcttgccaggtgcaa

SEQ ID NO: 43333 - DNA, 25 bp, Rattus norvegicus
aagctggtagtgcacgactgtcccg

SEQ ID NO: 43334 - DNA, 25 bp, Rattus norvegicus
aagctggtagtggacgactgtcccg

SEQ ID NO: 43335 - DNA, 25 bp, Rattus norvegicus
aagctggtatacagcatctgtcact

SEQ ID NO: 43336 - DNA, 25 bp, Rattus norvegicus
aagctggtatactgcatctgtcact

SEQ ID NO: 43337 - DNA, 25 bp, Rattus norvegicus
aagctggtatgtactagctcttctg

SEQ ID NO: 43338 - DNA, 25 bp, Rattus norvegicus
aagctggtatgttctagctcttctg

SEQ ID NO: 43339 - DNA, 25 bp, Rattus norvegicus
aagctggtccagaccgccgagctaa

SEQ ID NO: 43340 - DNA, 25 bp, Rattus norvegicus
aagctggtccagtccgccgagctaa

SEQ ID NO: 43341 - DNA, 25 bp, Rattus norvegicus
aagctggtctcactaaaatcctggg

SEQ ID NO: 43342 - DNA, 25 bp, Rattus norvegicus
aagctggtctcagtaaaatcctggg

SEQ ID NO: 43343 - DNA, 25 bp, Rattus norvegicus
aagctggtctccactgctaccactg

SEQ ID NO: 43344 - DNA, 25 bp, Rattus norvegicus
aagctggtctcctctgctaccactg

SEQ ID NO: 43345 - DNA, 25 bp, Rattus norvegicus
aagctggtcttgagttgttggttcc

SEQ ID NO: 43346 - DNA, 25 bp, Rattus norvegicus
aagctggtcttgtgttgttggttcc

SEQ ID NO: 43347 - DNA, 25 bp, Rattus norvegicus
aagctggtctttctcatgggtgcct

SEQ ID NO: 43348 - DNA, 25 bp, Rattus norvegicus
aagctggtctttgtcatgggtgcct

SEQ ID NO: 43349 - DNA, 25 bp, Rattus norvegicus
aagctggtgatgacctgttcattcc

SEQ ID NO: 43350 - DNA, 25 bp, Rattus norvegicus
aagctggtgatgtcctgttcattcc

SEQ ID NO: 43351 - DNA, 25 bp, Rattus norvegicus
aagctggtgccactagagcctgtta

SEQ ID NO: 43352 - DNA, 25 bp, Rattus norvegicus
aagctggtgccagtagagcctgtta

SEQ ID NO: 43353 - DNA, 25 bp, Rattus norvegicus
aagctggtgcccatctttaaggcta

SEQ ID NO: 43354 - DNA, 25 bp, Rattus norvegicus
aagctggtgcccctgaaggagacca

SEQ ID NO: 43355 - DNA, 25 bp, Rattus norvegicus
aagctggtgcccgtgaaggagacca

SEQ ID NO: 43356 - DNA, 25 bp, Rattus norvegicus
aagctggtgcccttctttaaggcta

SEQ ID NO: 43357 - DNA, 25 bp, Rattus norvegicus
aagctggtgcctctgaatcaggaaa

SEQ ID NO: 43358 - DNA, 25 bp, Rattus norvegicus
aagctggtgcctgtgaatcaggaaa

SEQ ID NO: 43359 - DNA, 25 bp, Rattus norvegicus
aagctggtgctgaccccaatggcag

SEQ ID NO: 43360 - DNA, 25 bp, Rattus norvegicus
aagctggtgctgtccccaatggcag

SEQ ID NO: 43361 - DNA, 25 bp, Rattus norvegicus
aagctggtgtccatccatgatgaca

SEQ ID NO: 43362 - DNA, 25 bp, Rattus norvegicus
aagctggtgtccttccatgatgaca

SEQ ID NO: 43363 - DNA, 25 bp, Rattus norvegicus
aagctggtgtgcagttagtccttcc

SEQ ID NO: 43364 - DNA, 25 bp, Rattus norvegicus
aagctggtgtgctgttagtccttcc

SEQ ID NO: 43365 - DNA, 25 bp, Rattus norvegicus
aagctggtgttaaccaggctgccta

SEQ ID NO: 43366 - DNA, 25 bp, Rattus norvegicus
aagctggtgttatccaggctgccta

SEQ ID NO: 43367 - DNA, 25 bp, Rattus norvegicus
aagctggttcatctcctcatggaca

SEQ ID NO: 43368 - DNA, 25 bp, Rattus norvegicus
aagctggttcatgtcctcatggaca

SEQ ID NO: 43369 - DNA, 25 bp, Rattus norvegicus
aagctggttgagaaaccccgtcagt

SEQ ID NO: 43370 - DNA, 25 bp, Rattus norvegicus
aagctggttgagtaaccccgtcagt

SEQ ID NO: 43371 - DNA, 25 bp, Rattus norvegicus
aagctgtaacagaggcacatcctac

SEQ ID NO: 43372 - DNA, 25 bp, Rattus norvegicus
aagctgtaacagtggcacatcctac

SEQ ID NO: 43373 - DNA, 25 bp, Rattus norvegicus
aagctgtaacatatcatctctccaa

SEQ ID NO: 43374 - DNA, 25 bp, Rattus norvegicus
aagctgtaacatttcatctctccaa

SEQ ID NO: 43375 - DNA, 25 bp, Rattus norvegicus
aagctgtaacttcaacgtctaatag

SEQ ID NO: 43376 - DNA, 25 bp, Rattus norvegicus
aagctgtaacttgaacgtctaatag

SEQ ID NO: 43377 - DNA, 25 bp, Rattus norvegicus
aagctgtaagatagctccagatgcc

SEQ ID NO: 43378 - DNA, 25 bp, Rattus norvegicus
aagctgtaagattgctccagatgcc

SEQ ID NO: 43379 - DNA, 25 bp, Rattus norvegicus
aagctgtaagtcagccaggcctaca

SEQ ID NO: 43380 - DNA, 25 bp, Rattus norvegicus
aagctgtaagtctgccaggcctaca

SEQ ID NO: 43381 - DNA, 25 bp, Rattus norvegicus
aagctgtacaggattctggccagac

SEQ ID NO: 43382 - DNA, 25 bp, Rattus norvegicus
aagctgtacaggtttctggccagac

SEQ ID NO: 43383 - DNA, 25 bp, Rattus norvegicus
aagctgtacttgagttggatggaga

SEQ ID NO: 43384 - DNA, 25 bp, Rattus norvegicus
aagctgtacttgtgttggatggaga

SEQ ID NO: 43385 - DNA, 25 bp, Rattus norvegicus
aagctgtagccacatgggctttcat

SEQ ID NO: 43386 - DNA, 25 bp, Rattus norvegicus
aagctgtagccagatgggctttcat

SEQ ID NO: 43387 - DNA, 25 bp, Rattus norvegicus
aagctgtagtgtaccttattttcaa

SEQ ID NO: 43388 - DNA, 25 bp, Rattus norvegicus
aagctgtagtgttccttattttcaa

SEQ ID NO: 43389 - DNA, 25 bp, Rattus norvegicus
aagctgtatcatatcactcactgga

SEQ ID NO: 43390 - DNA, 25 bp, Rattus norvegicus
aagctgtatcatttcactcactgga

SEQ ID NO: 43391 - DNA, 25 bp, Rattus norvegicus
aagctgtatccacaaagcttccgct

SEQ ID NO: 43392 - DNA, 25 bp, Rattus norvegicus
aagctgtatccagaaagcttccgct

SEQ ID NO: 43393 - DNA, 25 bp, Rattus norvegicus
aagctgtatgctatcaagatgtttt

SEQ ID NO: 43394 - DNA, 25 bp, Rattus norvegicus
aagctgtatgctttcaagatgtttt

SEQ ID NO: 43395 - DNA, 25 bp, Rattus norvegicus
aagctgtatttaagcgccgcggatc

SEQ ID NO: 43396 - DNA, 25 bp, Rattus norvegicus
aagctgtatttatgcgccgcggatc

SEQ ID NO: 43397 - DNA, 25 bp, Rattus norvegicus
aagctgtcaaggacttccatgttat

SEQ ID NO: 43398 - DNA, 25 bp, Rattus norvegicus
aagctgtcaaggtcttccatgttat

SEQ ID NO: 43399 - DNA, 25 bp, Rattus norvegicus
aagctgtcacagcattctttgccag

SEQ ID NO: 43400 - DNA, 25 bp, Rattus norvegicus
aagctgtcacaggattctttgccag

SEQ ID NO: 43401 - DNA, 25 bp, Rattus norvegicus
aagctgtcagccacaaggaaaacgg

SEQ ID NO: 43402 - DNA, 25 bp, Rattus norvegicus
aagctgtcagcctcaaggaaaacgg

SEQ ID NO: 43403 - DNA, 25 bp, Rattus norvegicus
aagctgtcagcgctgggtgtcctct

SEQ ID NO: 43404 - DNA, 25 bp, Rattus norvegicus
aagctgtcagcggtgggtgtcctct

SEQ ID NO: 43405 - DNA, 25 bp, Rattus norvegicus
aagctgtcaggtctctctaagtagg

SEQ ID NO: 43406 - DNA, 25 bp, Rattus norvegicus
aagctgtcaggtgtctctaagtagg

SEQ ID NO: 43407 - DNA, 25 bp, Rattus norvegicus
aagctgtcatacatgatcttggaag

SEQ ID NO: 43408 - DNA, 25 bp, Rattus norvegicus
aagctgtcatacttgatcttggaag

SEQ ID NO: 43409 - DNA, 25 bp, Rattus norvegicus
aagctgtcatcactagggtcttgcc

SEQ ID NO: 43410 - DNA, 25 bp, Rattus norvegicus
aagctgtcatcagtagggtcttgcc

SEQ ID NO: 43411 - DNA, 25 bp, Rattus norvegicus
aagctgtcattccttggacgtctga

SEQ ID NO: 43412 - DNA, 25 bp, Rattus norvegicus
aagctgtcattcgttggacgtctga

SEQ ID NO: 43413 - DNA, 25 bp, Rattus norvegicus
aagctgtccaacacaggaggccaca

SEQ ID NO: 43414 - DNA, 25 bp, Rattus norvegicus
aagctgtccaactcaggaggccaca

SEQ ID NO: 43415 - DNA, 25 bp, Rattus norvegicus
aagctgtccatccatctgattcata

SEQ ID NO: 43416 - DNA, 25 bp, Rattus norvegicus
aagctgtccatcgatctgattcata

SEQ ID NO: 43417 - DNA, 25 bp, Rattus norvegicus
aagctgtccgagctctggtgcttta

SEQ ID NO: 43418 - DNA, 25 bp, Rattus norvegicus
aagctgtccgaggtctggtgcttta

SEQ ID NO: 43419 - DNA, 25 bp, Rattus norvegicus
aagctgtcgatcagttgggttcaac

SEQ ID NO: 43420 - DNA, 25 bp, Rattus norvegicus
aagctgtcgatctgttgggttcaac

SEQ ID NO: 43421 - DNA, 25 bp, Rattus norvegicus
aagctgtctaccagagagtggagaa

SEQ ID NO: 43422 - DNA, 25 bp, Rattus norvegicus
aagctgtctacctgagagtggagaa

SEQ ID NO: 43423 - DNA, 25 bp, Rattus norvegicus
aagctgtctatcagactctggcttc

SEQ ID NO: 43424 - DNA, 25 bp, Rattus norvegicus
aagctgtctatctgactctggcttc

SEQ ID NO: 43425 - DNA, 25 bp, Rattus norvegicus
aagctgtctccaaggagccaaacaa

SEQ ID NO: 43426 - DNA, 25 bp, Rattus norvegicus
aagctgtctccaagggttggtcaca

SEQ ID NO: 43427 - DNA, 25 bp, Rattus norvegicus
aagctgtctccatggagccaaacaa

SEQ ID NO: 43428 - DNA, 25 bp, Rattus norvegicus
aagctgtctccatgggttggtcaca

SEQ ID NO: 43429 - DNA, 25 bp, Rattus norvegicus
aagctgtctgaaagccttcggaggc

SEQ ID NO: 43430 - DNA, 25 bp, Rattus norvegicus
aagctgtctgaatgccttcggaggc

SEQ ID NO: 43431 - DNA, 25 bp, Rattus norvegicus
aagctgtcttagaagccagtggtat

SEQ ID NO: 43432 - DNA, 25 bp, Rattus norvegicus
aagctgtcttagtagccagtggtat

SEQ ID NO: 43433 - DNA, 25 bp, Rattus norvegicus
aagctgtcttttcaccccaaacagt

SEQ ID NO: 43434 - DNA, 25 bp, Rattus norvegicus
aagctgtcttttgaccccaaacagt

SEQ ID NO: 43435 - DNA, 25 bp, Rattus norvegicus
aagctgtgaactacatcttgtcctg

SEQ ID NO: 43436 - DNA, 25 bp, Rattus norvegicus
aagctgtgaacttcatcttgtcctg

SEQ ID NO: 43437 - DNA, 25 bp, Rattus norvegicus
aagctgtgacttacagagaatctcc

SEQ ID NO: 43438 - DNA, 25 bp, Rattus norvegicus
aagctgtgactttcagagaatctcc

SEQ ID NO: 43439 - DNA, 25 bp, Rattus norvegicus
aagctgtgagcaaaccttcctttcg

SEQ ID NO: 43440 - DNA, 25 bp, Rattus norvegicus
aagctgtgagcataccttcctttcg

SEQ ID NO: 43441 - DNA, 25 bp, Rattus norvegicus
aagctgtgcttcactggctaggaca

SEQ ID NO: 43442 - DNA, 25 bp, Rattus norvegicus
aagctgtgcttctctggctaggaca

SEQ ID NO: 43443 - DNA, 25 bp, Rattus norvegicus
aagctgtggatgacgacctgaacct

SEQ ID NO: 43444 - DNA, 25 bp, Rattus norvegicus
aagctgtggatgtcgacctgaacct

SEQ ID NO: 43445 - DNA, 25 bp, Rattus norvegicus
aagctgtggcatatttgttatctca

SEQ ID NO: 43446 - DNA, 25 bp, Rattus norvegicus
aagctgtggcatttttgttatctca

SEQ ID NO: 43447 - DNA, 25 bp, Rattus norvegicus
aagctgtgggacaagcctgggccat

SEQ ID NO: 43448 - DNA, 25 bp, Rattus norvegicus
aagctgtgggactagcctgggccat

SEQ ID NO: 43449 - DNA, 25 bp, Rattus norvegicus
aagctgtggtggacgaatcctgctc

SEQ ID NO: 43450 - DNA, 25 bp, Rattus norvegicus
aagctgtggtggtcgaatcctgctc

SEQ ID NO: 43451 - DNA, 25 bp, Rattus norvegicus
aagctgtggttcagacttgcctgga

SEQ ID NO: 43452 - DNA, 25 bp, Rattus norvegicus
aagctgtggttctgacttgcctgga

SEQ ID NO: 43453 - DNA, 25 bp, Rattus norvegicus
aagctgtgtactccattgacatcga

SEQ ID NO: 43454 - DNA, 25 bp, Rattus norvegicus
aagctgtgtactgcattgacatcga

SEQ ID NO: 43455 - DNA, 25 bp, Rattus norvegicus
aagctgtgtcatctgcatttttata

SEQ ID NO: 43456 - DNA, 25 bp, Rattus norvegicus
aagctgtgtcatgtgcatttttata

SEQ ID NO: 43457 - DNA, 25 bp, Rattus norvegicus
aagctgtgtccactatacttcctgt

SEQ ID NO: 43458 - DNA, 25 bp, Rattus norvegicus
aagctgtgtccagtatacttcctgt

SEQ ID NO: 43459 - DNA, 25 bp, Rattus norvegicus
aagctgtgtctccacaagcgggact

SEQ ID NO: 43460 - DNA, 25 bp, Rattus norvegicus
aagctgtgtctcgacaagcgggact

SEQ ID NO: 43461 - DNA, 25 bp, Rattus norvegicus
aagctgtgtctgcttcttccagaag

SEQ ID NO: 43462 - DNA, 25 bp, Rattus norvegicus
aagctgtgtctggttcttccagaag

SEQ ID NO: 43463 - DNA, 25 bp, Rattus norvegicus
aagctgtgtcttaatgtatgtgatg

SEQ ID NO: 43464 - DNA, 25 bp, Rattus norvegicus
aagctgtgtctttatgtatgtgatg

SEQ ID NO: 43465 - DNA, 25 bp, Rattus norvegicus
aagctgtgtgacagtccccgaggaa

SEQ ID NO: 43466 - DNA, 25 bp, Rattus norvegicus
aagctgtgtgactgtccccgaggaa

SEQ ID NO: 43467 - DNA, 25 bp, Rattus norvegicus
aagctgtgtgcaccagcacctgtga

SEQ ID NO: 43468 - DNA, 25 bp, Rattus norvegicus
aagctgtgtgcagcagcacctgtga

SEQ ID NO: 43469 - DNA, 25 bp, Rattus norvegicus
aagctgtgtgccagggtgtatgaca

SEQ ID NO: 43470 - DNA, 25 bp, Rattus norvegicus
aagctgtgtgcctgggtgtatgaca

SEQ ID NO: 43471 - DNA, 25 bp, Rattus norvegicus
aagctgtgtgcgctgacatactttc

SEQ ID NO: 43472 - DNA, 25 bp, Rattus norvegicus
aagctgtgtgcggtgacatactttc

SEQ ID NO: 43473 - DNA, 25 bp, Rattus norvegicus
aagctgtgtggcattcagttttaaa

SEQ ID NO: 43474 - DNA, 25 bp, Rattus norvegicus
aagctgtgtggctttcagttttaaa

SEQ ID NO: 43475 - DNA, 25 bp, Rattus norvegicus
aagctgtgtgtgagttagatgtaac

SEQ ID NO: 43476 - DNA, 25 bp, Rattus norvegicus
aagctgtgtgtgtgttagatgtaac

SEQ ID NO: 43477 - DNA, 25 bp, Rattus norvegicus
aagctgtgtgttaggctgcacctgc

SEQ ID NO: 43478 - DNA, 25 bp, Rattus norvegicus
aagctgtgtgttcatctggtcccgg

SEQ ID NO: 43479 - DNA, 25 bp, Rattus norvegicus
aagctgtgtgttgatctggtcccgg

SEQ ID NO: 43480 - DNA, 25 bp, Rattus norvegicus
aagctgtgtgtttggctgcacctgc

SEQ ID NO: 43481 - DNA, 25 bp, Rattus norvegicus
aagctgttagctattccaggctttg

SEQ ID NO: 43482 - DNA, 25 bp, Rattus norvegicus
aagctgttagcttttccaggctttg

SEQ ID NO: 43483 - DNA, 25 bp, Rattus norvegicus
aagctgttccagctcacagtagagc

SEQ ID NO: 43484 - DNA, 25 bp, Rattus norvegicus
aagctgttccaggtcacagtagagc

SEQ ID NO: 43485 - DNA, 25 bp, Rattus norvegicus
aagctgttcttgctctgaaccctga

SEQ ID NO: 43486 - DNA, 25 bp, Rattus norvegicus
aagctgttcttggtctgaaccctga

SEQ ID NO: 43487 - DNA, 25 bp, Rattus norvegicus
aagctgttgaggctttttgagcccc

SEQ ID NO: 43488 - DNA, 25 bp, Rattus norvegicus
aagctgttgagggtttttgagcccc

SEQ ID NO: 43489 - DNA, 25 bp, Rattus norvegicus
aagctgttgcttattctggttacaa

SEQ ID NO: 43490 - DNA, 25 bp, Rattus norvegicus
aagctgttgctttttctggttacaa

SEQ ID NO: 43491 - DNA, 25 bp, Rattus norvegicus
aagctgttggaacctcttctgcaga

SEQ ID NO: 43492 - DNA, 25 bp, Rattus norvegicus
aagctgttggaagctcttctgcaga

SEQ ID NO: 43493 - DNA, 25 bp, Rattus norvegicus
aagctgttgtacacctcgggtaaag

SEQ ID NO: 43494 - DNA, 25 bp, Rattus norvegicus
aagctgttgtactcctcgggtaaag

SEQ ID NO: 43495 - DNA, 25 bp, Rattus norvegicus
aagctgtttcctatttgactcttcc

SEQ ID NO: 43496 - DNA, 25 bp, Rattus norvegicus
aagctgtttcctttttgactcttcc

SEQ ID NO: 43497 - DNA, 25 bp, Rattus norvegicus
aagctgtttcggatgcattgcattt

SEQ ID NO: 43498 - DNA, 25 bp, Rattus norvegicus
aagctgtttcggttgcattgcattt

SEQ ID NO: 43499 - DNA, 25 bp, Rattus norvegicus
aagctgtttctaactgcagtgcttc

SEQ ID NO: 43500 - DNA, 25 bp, Rattus norvegicus
aagctgtttctatctgcagtgcttc

SEQ ID NO: 43501 - DNA, 25 bp, Rattus norvegicus
aagctgtttgacacctcctgcagaa

SEQ ID NO: 43502 - DNA, 25 bp, Rattus norvegicus
aagctgtttgacactcagtgttcgc

SEQ ID NO: 43503 - DNA, 25 bp, Rattus norvegicus
aagctgtttgactcctcctgcagaa

SEQ ID NO: 43504 - DNA, 25 bp, Rattus norvegicus
aagctgtttgactctcagtgttcgc

SEQ ID NO: 43505 - DNA, 25 bp, Rattus norvegicus
aagctgtttgatcctgggccaggca

SEQ ID NO: 43506 - DNA, 25 bp, Rattus norvegicus
aagctgtttgatgctgggccaggca

SEQ ID NO: 43507 - DNA, 25 bp, Rattus norvegicus
aagctgtttgctcccaagtagccac

SEQ ID NO: 43508 - DNA, 25 bp, Rattus norvegicus
aagctgtttgctgccaagtagccac

SEQ ID NO: 43509 - DNA, 25 bp, Rattus norvegicus
aagctgtttgtcacaggctgtccat

SEQ ID NO: 43510 - DNA, 25 bp, Rattus norvegicus
aagctgtttgtctcaggctgtccat

SEQ ID NO: 43511 - DNA, 25 bp, Rattus norvegicus
aagctgtttgtgaggtcgtgcatat

SEQ ID NO: 43512 - DNA, 25 bp, Rattus norvegicus
aagctgtttgtgtggtcgtgcatat

SEQ ID NO: 43513 - DNA, 25 bp, Rattus norvegicus
aagctgttttcacagcgtttgcctg

SEQ ID NO: 43514 - DNA, 25 bp, Rattus norvegicus
aagctgttttcagagcgtttgcctg

SEQ ID NO: 43515 - DNA, 25 bp, Rattus norvegicus
aagcttaaaaatccagtctgttcga

SEQ ID NO: 43516 - DNA, 25 bp, Rattus norvegicus
aagcttaaaaatgcagtctgttcga

SEQ ID NO: 43517 - DNA, 25 bp, Rattus norvegicus
aagcttaaacctcggcggatgtgcc

SEQ ID NO: 43518 - DNA, 25 bp, Rattus norvegicus
aagcttaaacctgggcggatgtgcc

SEQ ID NO: 43519 - DNA, 25 bp, Rattus norvegicus
aagcttaaactgcagcgggatttca

SEQ ID NO: 43520 - DNA, 25 bp, Rattus norvegicus
aagcttaaactggagcgggatttca

SEQ ID NO: 43521 - DNA, 25 bp, Rattus norvegicus
aagcttaaccatatgctcctcgaaa

SEQ ID NO: 43522 - DNA, 25 bp, Rattus norvegicus
aagcttaaccatttgctcctcgaaa

SEQ ID NO: 43523 - DNA, 25 bp, Rattus norvegicus
aagcttaacccacagaatgccttct

SEQ ID NO: 43524 - DNA, 25 bp, Rattus norvegicus
aagcttaacccagagaatgccttct

SEQ ID NO: 43525 - DNA, 25 bp, Rattus norvegicus
aagcttaacctcagatcacacgtag

SEQ ID NO: 43526 - DNA, 25 bp, Rattus norvegicus
aagcttaacctctgatcacacgtag

SEQ ID NO: 43527 - DNA, 25 bp, Rattus norvegicus
aagcttaacggaccacactggtttg

SEQ ID NO: 43528 - DNA, 25 bp, Rattus norvegicus
aagcttaacggagcacactggtttg

SEQ ID NO: 43529 - DNA, 25 bp, Rattus norvegicus
aagcttaactacatggccatctctc

SEQ ID NO: 43530 - DNA, 25 bp, Rattus norvegicus
aagcttaactacttggccatctctc

SEQ ID NO: 43531 - DNA, 25 bp, Rattus norvegicus
aagcttaagctcagggcctcccaat

SEQ ID NO: 43532 - DNA, 25 bp, Rattus norvegicus
aagcttaagctctgggcctcccaat

SEQ ID NO: 43533 - DNA, 25 bp, Rattus norvegicus
aagcttaagttcatttgcggatcag

SEQ ID NO: 43534 - DNA, 25 bp, Rattus norvegicus
aagcttaagttcttttgcggatcag

SEQ ID NO: 43535 - DNA, 25 bp, Rattus norvegicus
aagcttaatgctagttactgttaca

SEQ ID NO: 43536 - DNA, 25 bp, Rattus norvegicus
aagcttaatgcttgttactgttaca

SEQ ID NO: 43537 - DNA, 25 bp, Rattus norvegicus
aagcttacactgactgctctggtag

SEQ ID NO: 43538 - DNA, 25 bp, Rattus norvegicus
aagcttacactgtctgctctggtag

SEQ ID NO: 43539 - DNA, 25 bp, Rattus norvegicus
aagcttacagctaggaccgcagaag

SEQ ID NO: 43540 - DNA, 25 bp, Rattus norvegicus
aagcttacagcttggaccgcagaag

SEQ ID NO: 43541 - DNA, 25 bp, Rattus norvegicus
aagcttacagggatcgggatggtca

SEQ ID NO: 43542 - DNA, 25 bp, Rattus norvegicus
aagcttacagggttcgggatggtca

SEQ ID NO: 43543 - DNA, 25 bp, Rattus norvegicus
aagcttacagtgcttagctgctcca

SEQ ID NO: 43544 - DNA, 25 bp, Rattus norvegicus
aagcttacagtggttagctgctcca

SEQ ID NO: 43545 - DNA, 25 bp, Rattus norvegicus
aagcttacctctcctgggagattgt

SEQ ID NO: 43546 - DNA, 25 bp, Rattus norvegicus
aagcttacctctgctgggagattgt

SEQ ID NO: 43547 - DNA, 25 bp, Rattus norvegicus
aagcttacggtcctttgtcggctca

SEQ ID NO: 43548 - DNA, 25 bp, Rattus norvegicus
aagcttacggtcgtttgtcggctca

SEQ ID NO: 43549 - DNA, 25 bp, Rattus norvegicus
aagcttactcagagttgtaggttct

SEQ ID NO: 43550 - DNA, 25 bp, Rattus norvegicus
aagcttactcagtgttgtaggttct

SEQ ID NO: 43551 - DNA, 25 bp, Rattus norvegicus
aagcttactctgacacagatgcagg

SEQ ID NO: 43552 - DNA, 25 bp, Rattus norvegicus
aagcttactctgtcacagatgcagg

SEQ ID NO: 43553 - DNA, 25 bp, Rattus norvegicus
aagcttactgagcaactgtgtacca

SEQ ID NO: 43554 - DNA, 25 bp, Rattus norvegicus
aagcttactgaggaactgtgtacca

SEQ ID NO: 43555 - DNA, 25 bp, Rattus norvegicus
aagcttactgatcgagccttccggc

SEQ ID NO: 43556 - DNA, 25 bp, Rattus norvegicus
aagcttactgatggagccttccggc

SEQ ID NO: 43557 - DNA, 25 bp, Rattus norvegicus
aagcttactgtcaagtggcctccaa

SEQ ID NO: 43558 - DNA, 25 bp, Rattus norvegicus
aagcttactgtctagtggcctccaa

SEQ ID NO: 43559 - DNA, 25 bp, Rattus norvegicus
aagcttactgtgatcatgtgccctc

SEQ ID NO: 43560 - DNA, 25 bp, Rattus norvegicus
aagcttactgtgcaagtctgcagcc

SEQ ID NO: 43561 - DNA, 25 bp, Rattus norvegicus
aagcttactgtggaagtctgcagcc

SEQ ID NO: 43562 - DNA, 25 bp, Rattus norvegicus
aagcttactgtgttcatgtgccctc

SEQ ID NO: 43563 - DNA, 25 bp, Rattus norvegicus
aagcttacttccctggaggaaacag

SEQ ID NO: 43564 - DNA, 25 bp, Rattus norvegicus
aagcttacttccgtggaggaaacag

SEQ ID NO: 43565 - DNA, 25 bp, Rattus norvegicus
aagcttagaactcggagctctccgc

SEQ ID NO: 43566 - DNA, 25 bp, Rattus norvegicus
aagcttagaactgggagctctccgc

SEQ ID NO: 43567 - DNA, 25 bp, Rattus norvegicus
aagcttagcacccatcgttaattta

SEQ ID NO: 43568 - DNA, 25 bp, Rattus norvegicus
aagcttagcaccgatcgttaattta

SEQ ID NO: 43569 - DNA, 25 bp, Rattus norvegicus
aagcttagcctaactgcctgaatgg

SEQ ID NO: 43570 - DNA, 25 bp, Rattus norvegicus
aagcttagcctatctgcctgaatgg

SEQ ID NO: 43571 - DNA, 25 bp, Rattus norvegicus
aagcttagtgccaagtatgtgtata

SEQ ID NO: 43572 - DNA, 25 bp, Rattus norvegicus
aagcttagtgcctagtatgtgtata

SEQ ID NO: 43573 - DNA, 25 bp, Rattus norvegicus
aagcttagtttcatcttctatgtga

SEQ ID NO: 43574 - DNA, 25 bp, Rattus norvegicus
aagcttagtttcttcttctatgtga

SEQ ID NO: 43575 - DNA, 25 bp, Rattus norvegicus
aagcttatcttgatggcattatttt

SEQ ID NO: 43576 - DNA, 25 bp, Rattus norvegicus
aagcttatcttgttggcattatttt

SEQ ID NO: 43577 - DNA, 25 bp, Rattus norvegicus
aagcttatgctgcagtggcagttcc

SEQ ID NO: 43578 - DNA, 25 bp, Rattus norvegicus
aagcttatgctggagtggcagttcc

SEQ ID NO: 43579 - DNA, 25 bp, Rattus norvegicus
aagcttatgcttcctggctgactag

SEQ ID NO: 43580 - DNA, 25 bp, Rattus norvegicus
aagcttatgcttgctggctgactag

SEQ ID NO: 43581 - DNA, 25 bp, Rattus norvegicus
aagcttattactccagctgtggtct

SEQ ID NO: 43582 - DNA, 25 bp, Rattus norvegicus
aagcttattactgcagctgtggtct

SEQ ID NO: 43583 - DNA, 25 bp, Rattus norvegicus
aagcttcaaagcaaggtcacggtgg

SEQ ID NO: 43584 - DNA, 25 bp, Rattus norvegicus
aagcttcaaagctaggtcacggtgg

SEQ ID NO: 43585 - DNA, 25 bp, Rattus norvegicus
aagcttcaagtacaactacgttcag

SEQ ID NO: 43586 - DNA, 25 bp, Rattus norvegicus
aagcttcaagtagaactacgttcag

SEQ ID NO: 43587 - DNA, 25 bp, Rattus norvegicus
aagcttcacctgacatcttgtactg

SEQ ID NO: 43588 - DNA, 25 bp, Rattus norvegicus
aagcttcacctgtcatcttgtactg

SEQ ID NO: 43589 - DNA, 25 bp, Rattus norvegicus
aagcttcactccatgggctgggcct

SEQ ID NO: 43590 - DNA, 25 bp, Rattus norvegicus
aagcttcactccttgggctgggcct

SEQ ID NO: 43591 - DNA, 25 bp, Rattus norvegicus
aagcttcagaccacagcagaatccg

SEQ ID NO: 43592 - DNA, 25 bp, Rattus norvegicus
aagcttcagacctcagcagaatccg

SEQ ID NO: 43593 - DNA, 25 bp, Rattus norvegicus
aagcttcagagtacttcattttgac

SEQ ID NO: 43594 - DNA, 25 bp, Rattus norvegicus
aagcttcagagttcttcattttgac

SEQ ID NO: 43595 - DNA, 25 bp, Rattus norvegicus
aagcttcagcacaagagactcttga

SEQ ID NO: 43596 - DNA, 25 bp, Rattus norvegicus
aagcttcagcactagagactcttga

SEQ ID NO: 43597 - DNA, 25 bp, Rattus norvegicus
aagcttcaggccataggtcttcgct

SEQ ID NO: 43598 - DNA, 25 bp, Rattus norvegicus
aagcttcaggccttaggtcttcgct

SEQ ID NO: 43599 - DNA, 25 bp, Rattus norvegicus
aagcttcagggccacattcaggact

SEQ ID NO: 43600 - DNA, 25 bp, Rattus norvegicus
aagcttcagggcgacattcaggact

SEQ ID NO: 43601 - DNA, 25 bp, Rattus norvegicus
aagcttcaggttacatgaattcact

SEQ ID NO: 43602 - DNA, 25 bp, Rattus norvegicus
aagcttcaggtttcatgaattcact

SEQ ID NO: 43603 - DNA, 25 bp, Rattus norvegicus
aagcttcagtcacctcccgagtctt

SEQ ID NO: 43604 - DNA, 25 bp, Rattus norvegicus
aagcttcagtcagctcccgagtctt

SEQ ID NO: 43605 - DNA, 25 bp, Rattus norvegicus
aagcttcatactcttgtttttctac

SEQ ID NO: 43606 - DNA, 25 bp, Rattus norvegicus
aagcttcatactgttgtttttctac

SEQ ID NO: 43607 - DNA, 25 bp, Rattus norvegicus
aagcttcatattcccagtgctgtga

SEQ ID NO: 43608 - DNA, 25 bp, Rattus norvegicus
aagcttcatattgccagtgctgtga

SEQ ID NO: 43609 - DNA, 25 bp, Rattus norvegicus
aagcttcatcttcacaatggcatgc

SEQ ID NO: 43610 - DNA, 25 bp, Rattus norvegicus
aagcttcatcttgacaatggcatgc

SEQ ID NO: 43611 - DNA, 25 bp, Rattus norvegicus
aagcttcatgtgctgacggtgaatt

SEQ ID NO: 43612 - DNA, 25 bp, Rattus norvegicus
aagcttcatgtggtgacggtgaatt

SEQ ID NO: 43613 - DNA, 25 bp, Rattus norvegicus
aagcttcattgcacatgtccagtgt

SEQ ID NO: 43614 - DNA, 25 bp, Rattus norvegicus
aagcttcattgctcatgtccagtgt

SEQ ID NO: 43615 - DNA, 25 bp, Rattus norvegicus
aagcttccagaacatagagtaccaa

SEQ ID NO: 43616 - DNA, 25 bp, Rattus norvegicus
aagcttccagaagatagagtaccaa

SEQ ID NO: 43617 - DNA, 25 bp, Rattus norvegicus
aagcttccagatctgcgtgaggcag

SEQ ID NO: 43618 - DNA, 25 bp, Rattus norvegicus
aagcttccagatgtgcgtgaggcag

SEQ ID NO: 43619 - DNA, 25 bp, Rattus norvegicus
aagcttccaggaccaagtagaacac

SEQ ID NO: 43620 - DNA, 25 bp, Rattus norvegicus
aagcttccaggagcaagtagaacac

SEQ ID NO: 43621 - DNA, 25 bp, Rattus norvegicus
aagcttccaggtatgctgtgtcagt

SEQ ID NO: 43622 - DNA, 25 bp, Rattus norvegicus
aagcttccaggtttgctgtgtcagt

SEQ ID NO: 43623 - DNA, 25 bp, Rattus norvegicus
aagcttccatagcacaggtgtgcaa

SEQ ID NO: 43624 - DNA, 25 bp, Rattus norvegicus
aagcttccataggacaggtgtgcaa

SEQ ID NO: 43625 - DNA, 25 bp, Rattus norvegicus
aagcttccatttactctggcttatc

SEQ ID NO: 43626 - DNA, 25 bp, Rattus norvegicus
aagcttccattttctctggcttatc

SEQ ID NO: 43627 - DNA, 25 bp, Rattus norvegicus
aagcttcccaccatggaagttccat

SEQ ID NO: 43628 - DNA, 25 bp, Rattus norvegicus
aagcttcccaccttggaagttccat

SEQ ID NO: 43629 - DNA, 25 bp, Rattus norvegicus
aagcttcctactcttaacatcctga

SEQ ID NO: 43630 - DNA, 25 bp, Rattus norvegicus
aagcttcctactgttaacatcctga

SEQ ID NO: 43631 - DNA, 25 bp, Rattus norvegicus
aagcttcctgcaattccttagtggg

SEQ ID NO: 43632 - DNA, 25 bp, Rattus norvegicus
aagcttcctgcatttccttagtggg

SEQ ID NO: 43633 - DNA, 25 bp, Rattus norvegicus
aagcttcctggactggacttatcac

SEQ ID NO: 43634 - DNA, 25 bp, Rattus norvegicus
aagcttcctggagtggacttatcac

SEQ ID NO: 43635 - DNA, 25 bp, Rattus norvegicus
aagcttcctttcagagttctaggtc

SEQ ID NO: 43636 - DNA, 25 bp, Rattus norvegicus
aagcttcctttctgagttctaggtc

SEQ ID NO: 43637 - DNA, 25 bp, Rattus norvegicus
aagcttccttttcagagtaatttct

SEQ ID NO: 43638 - DNA, 25 bp, Rattus norvegicus
aagcttccttttgagagtaatttct

SEQ ID NO: 43639 - DNA, 25 bp, Rattus norvegicus
aagcttcgatctcttttcctttcaa

SEQ ID NO: 43640 - DNA, 25 bp, Rattus norvegicus
aagcttcgatctgttttcctttcaa

SEQ ID NO: 43641 - DNA, 25 bp, Rattus norvegicus
aagcttcgattcagaactgcctgtc

SEQ ID NO: 43642 - DNA, 25 bp, Rattus norvegicus
aagcttcgattcagtgtgcggtggt

SEQ ID NO: 43643 - DNA, 25 bp, Rattus norvegicus
aagcttcgattctgaactgcctgtc

SEQ ID NO: 43644 - DNA, 25 bp, Rattus norvegicus
aagcttcgattctgtgtgcggtggt

SEQ ID NO: 43645 - DNA, 25 bp, Rattus norvegicus
aagcttcgcaggatcctttggcgga

SEQ ID NO: 43646 - DNA, 25 bp, Rattus norvegicus
aagcttcgcaggttcctttggcgga

SEQ ID NO: 43647 - DNA, 25 bp, Rattus norvegicus
aagcttcgccaactcagagccacgt

SEQ ID NO: 43648 - DNA, 25 bp, Rattus norvegicus
aagcttcgccaagtcagagccacgt

SEQ ID NO: 43649 - DNA, 25 bp, Rattus norvegicus
aagcttcgcttcctgcaaactgagg

SEQ ID NO: 43650 - DNA, 25 bp, Rattus norvegicus
aagcttcgcttcgtgcaaactgagg

SEQ ID NO: 43651 - DNA, 25 bp, Rattus norvegicus
aagcttcgtcccaagggctcatttt

SEQ ID NO: 43652 - DNA, 25 bp, Rattus norvegicus
aagcttcgtccctagggctcatttt

SEQ ID NO: 43653 - DNA, 25 bp, Rattus norvegicus
aagcttcgtgaactttattccatga

SEQ ID NO: 43654 - DNA, 25 bp, Rattus norvegicus
aagcttcgtgaagtttattccatga

SEQ ID NO: 43655 - DNA, 25 bp, Rattus norvegicus
aagcttctagatagtttgtattgtg

SEQ ID NO: 43656 - DNA, 25 bp, Rattus norvegicus
aagcttctagattgtttgtattgtg

SEQ ID NO: 43657 - DNA, 25 bp, Rattus norvegicus
aagcttctcaagagtttacagcgga

SEQ ID NO: 43658 - DNA, 25 bp, Rattus norvegicus
aagcttctcaagtgtttacagcgga

SEQ ID NO: 43659 - DNA, 25 bp, Rattus norvegicus
aagcttctcagcagaataatctcag

SEQ ID NO: 43660 - DNA, 25 bp, Rattus norvegicus
aagcttctcagctgaataatctcag

SEQ ID NO: 43661 - DNA, 25 bp, Rattus norvegicus
aagcttctccaaagtgtcatcttaa

SEQ ID NO: 43662 - DNA, 25 bp, Rattus norvegicus
aagcttctccaatgtgtcatcttaa

SEQ ID NO: 43663 - DNA, 25 bp, Rattus norvegicus
aagcttctccttcacgtaaacacaa

SEQ ID NO: 43664 - DNA, 25 bp, Rattus norvegicus
aagcttctccttcggtacttgaaat

SEQ ID NO: 43665 - DNA, 25 bp, Rattus norvegicus
aagcttctccttgacgtaaacacaa

SEQ ID NO: 43666 - DNA, 25 bp, Rattus norvegicus
aagcttctccttgggtacttgaaat

SEQ ID NO: 43667 - DNA, 25 bp, Rattus norvegicus
aagcttctcgtgagtagctcagcta

SEQ ID NO: 43668 - DNA, 25 bp, Rattus norvegicus
aagcttctcgtgtgtagctcagcta

SEQ ID NO: 43669 - DNA, 25 bp, Rattus norvegicus
aagcttctctacagaggcattctga

SEQ ID NO: 43670 - DNA, 25 bp, Rattus norvegicus
aagcttctctactgaggcattctga

SEQ ID NO: 43671 - DNA, 25 bp, Rattus norvegicus
aagcttctctccaacaccagacatt

SEQ ID NO: 43672 - DNA, 25 bp, Rattus norvegicus
aagcttctctcctacaccagacatt

SEQ ID NO: 43673 - DNA, 25 bp, Rattus norvegicus
aagcttctcttcatcccctgcagat

SEQ ID NO: 43674 - DNA, 25 bp, Rattus norvegicus
aagcttctcttcttcccctgcagat

SEQ ID NO: 43675 - DNA, 25 bp, Rattus norvegicus
aagcttctgaaaacacaatccctcc

SEQ ID NO: 43676 - DNA, 25 bp, Rattus norvegicus
aagcttctgaaatcacaatccctcc

SEQ ID NO: 43677 - DNA, 25 bp, Rattus norvegicus
aagcttctgacaagacttctcaaga

SEQ ID NO: 43678 - DNA, 25 bp, Rattus norvegicus
aagcttctgacatgacttctcaaga

SEQ ID NO: 43679 - DNA, 25 bp, Rattus norvegicus
aagcttctgagcagggctgtgccgt

SEQ ID NO: 43680 - DNA, 25 bp, Rattus norvegicus
aagcttctgagccttgcgacacagt

SEQ ID NO: 43681 - DNA, 25 bp, Rattus norvegicus
aagcttctgagcgttgcgacacagt

SEQ ID NO: 43682 - DNA, 25 bp, Rattus norvegicus
aagcttctgagctgggctgtgccgt

SEQ ID NO: 43683 - DNA, 25 bp, Rattus norvegicus
aagcttctgctaaggctgccttgga

SEQ ID NO: 43684 - DNA, 25 bp, Rattus norvegicus
aagcttctgctacccaaggaagtca

SEQ ID NO: 43685 - DNA, 25 bp, Rattus norvegicus
aagcttctgctagccaaggaagtca

SEQ ID NO: 43686 - DNA, 25 bp, Rattus norvegicus
aagcttctgctatggctgccttgga

SEQ ID NO: 43687 - DNA, 25 bp, Rattus norvegicus
aagcttctggacctgagggagccca

SEQ ID NO: 43688 - DNA, 25 bp, Rattus norvegicus
aagcttctggacgtgagggagccca

SEQ ID NO: 43689 - DNA, 25 bp, Rattus norvegicus
aagcttctggatacccaaaataggg

SEQ ID NO: 43690 - DNA, 25 bp, Rattus norvegicus
aagcttctggattcccaaaataggg

SEQ ID NO: 43691 - DNA, 25 bp, Rattus norvegicus
aagcttctggctaaggtatggcacc

SEQ ID NO: 43692 - DNA, 25 bp, Rattus norvegicus
aagcttctggcttaggtatggcacc

SEQ ID NO: 43693 - DNA, 25 bp, Rattus norvegicus
aagcttctgggcaatgaccgctgcg

SEQ ID NO: 43694 - DNA, 25 bp, Rattus norvegicus
aagcttctgggcacaatgactacca

SEQ ID NO: 43695 - DNA, 25 bp, Rattus norvegicus
aagcttctgggcacgtaccaacctt

SEQ ID NO: 43696 - DNA, 25 bp, Rattus norvegicus
aagcttctgggctatgaccgctgcg

SEQ ID NO: 43697 - DNA, 25 bp, Rattus norvegicus
aagcttctgggctcaatgactacca

SEQ ID NO: 43698 - DNA, 25 bp, Rattus norvegicus
aagcttctgggctcgtaccaacctt

SEQ ID NO: 43699 - DNA, 25 bp, Rattus norvegicus
aagcttctgtaactccaggttagga

SEQ ID NO: 43700 - DNA, 25 bp, Rattus norvegicus
aagcttctgtaactggctgtctcca

SEQ ID NO: 43701 - DNA, 25 bp, Rattus norvegicus
aagcttctgtaagtccaggttagga

SEQ ID NO: 43702 - DNA, 25 bp, Rattus norvegicus
aagcttctgtaagtggctgtctcca

SEQ ID NO: 43703 - DNA, 25 bp, Rattus norvegicus
aagcttctgtccctccgagggagtg

SEQ ID NO: 43704 - DNA, 25 bp, Rattus norvegicus
aagcttctgtccgtccgagggagtg

SEQ ID NO: 43705 - DNA, 25 bp, Rattus norvegicus
aagcttctgtttcttacactctgca

SEQ ID NO: 43706 - DNA, 25 bp, Rattus norvegicus
aagcttctgtttgttacactctgca

SEQ ID NO: 43707 - DNA, 25 bp, Rattus norvegicus
aagcttcttcgacttgcttcagcta

SEQ ID NO: 43708 - DNA, 25 bp, Rattus norvegicus
aagcttcttcgagttgcttcagcta

SEQ ID NO: 43709 - DNA, 25 bp, Rattus norvegicus
aagcttcttctgagaggtttaacaa

SEQ ID NO: 43710 - DNA, 25 bp, Rattus norvegicus
aagcttcttctgagtgtaccttaga

SEQ ID NO: 43711 - DNA, 25 bp, Rattus norvegicus
aagcttcttctgtgaggtttaacaa

SEQ ID NO: 43712 - DNA, 25 bp, Rattus norvegicus
aagcttcttctgtgtgtaccttaga

SEQ ID NO: 43713 - DNA, 25 bp, Rattus norvegicus
aagcttcttgatctcttttggttcc

SEQ ID NO: 43714 - DNA, 25 bp, Rattus norvegicus
aagcttcttgatgtcttttggttcc

SEQ ID NO: 43715 - DNA, 25 bp, Rattus norvegicus
aagcttcttgcccatcaagacagga

SEQ ID NO: 43716 - DNA, 25 bp, Rattus norvegicus
aagcttcttgccgatcaagacagga

SEQ ID NO: 43717 - DNA, 25 bp, Rattus norvegicus
aagcttctttatacccaatcttggc

SEQ ID NO: 43718 - DNA, 25 bp, Rattus norvegicus
aagcttctttattcccaatcttggc

SEQ ID NO: 43719 - DNA, 25 bp, Rattus norvegicus
aagcttgaagacctttagcgtttct

SEQ ID NO: 43720 - DNA, 25 bp, Rattus norvegicus
aagcttgaagacgtttagcgtttct

SEQ ID NO: 43721 - DNA, 25 bp, Rattus norvegicus
aagcttgaagcccagctaacggaaa

SEQ ID NO: 43722 - DNA, 25 bp, Rattus norvegicus
aagcttgaagccgagctaacggaaa

SEQ ID NO: 43723 - DNA, 25 bp, Rattus norvegicus
aagcttgacaatcattagcccttca

SEQ ID NO: 43724 - DNA, 25 bp, Rattus norvegicus
aagcttgacaatgattagcccttca

SEQ ID NO: 43725 - DNA, 25 bp, Rattus norvegicus
aagcttgacccaagtggatgtctcc

SEQ ID NO: 43726 - DNA, 25 bp, Rattus norvegicus
aagcttgacccatgtggatgtctcc

SEQ ID NO: 43727 - DNA, 25 bp, Rattus norvegicus
aagcttgactgcagggaccaaaggg

SEQ ID NO: 43728 - DNA, 25 bp, Rattus norvegicus
aagcttgactgctgggaccaaaggg

SEQ ID NO: 43729 - DNA, 25 bp, Rattus norvegicus
aagcttgactggagctggctgcagc

SEQ ID NO: 43730 - DNA, 25 bp, Rattus norvegicus
aagcttgactggtgctggctgcagc

SEQ ID NO: 43731 - DNA, 25 bp, Rattus norvegicus
aagcttgaggccagtgtcctccaac

SEQ ID NO: 43732 - DNA, 25 bp, Rattus norvegicus
aagcttgaggccagtttaggttact

SEQ ID NO: 43733 - DNA, 25 bp, Rattus norvegicus
aagcttgaggcctgtgtcctccaac

SEQ ID NO: 43734 - DNA, 25 bp, Rattus norvegicus
aagcttgaggcctgtttaggttact

SEQ ID NO: 43735 - DNA, 25 bp, Rattus norvegicus
aagcttgatcttagccagtatgtac

SEQ ID NO: 43736 - DNA, 25 bp, Rattus norvegicus
aagcttgatctttgccagtatgtac

SEQ ID NO: 43737 - DNA, 25 bp, Rattus norvegicus
aagcttgatgcaccccattggtaac

SEQ ID NO: 43738 - DNA, 25 bp, Rattus norvegicus
aagcttgatgcagcccattggtaac

SEQ ID NO: 43739 - DNA, 25 bp, Rattus norvegicus
aagcttgattgcctttgatgaacca

SEQ ID NO: 43740 - DNA, 25 bp, Rattus norvegicus
aagcttgattgcgtttgatgaacca

SEQ ID NO: 43741 - DNA, 25 bp, Rattus norvegicus
aagcttgattttcttgctcctgcag

SEQ ID NO: 43742 - DNA, 25 bp, Rattus norvegicus
aagcttgattttgttgctcctgcag

SEQ ID NO: 43743 - DNA, 25 bp, Rattus norvegicus
aagcttgcaatcattgagttttact

SEQ ID NO: 43744 - DNA, 25 bp, Rattus norvegicus
aagcttgcaatctttgagttttact

SEQ ID NO: 43745 - DNA, 25 bp, Rattus norvegicus
aagcttgcagatcctcccaagtgct

SEQ ID NO: 43746 - DNA, 25 bp, Rattus norvegicus
aagcttgcagatgctcccaagtgct

SEQ ID NO: 43747 - DNA, 25 bp, Rattus norvegicus
aagcttgcagtgacctgtgggtcat

SEQ ID NO: 43748 - DNA, 25 bp, Rattus norvegicus
aagcttgcagtgtcctgtgggtcat

SEQ ID NO: 43749 - DNA, 25 bp, Rattus norvegicus
aagcttgcattaagccacctgcttt

SEQ ID NO: 43750 - DNA, 25 bp, Rattus norvegicus
aagcttgcattatgccacctgcttt

SEQ ID NO: 43751 - DNA, 25 bp, Rattus norvegicus
aagcttgcatttattcccatggtga

SEQ ID NO: 43752 - DNA, 25 bp, Rattus norvegicus
aagcttgcattttttcccatggtga

SEQ ID NO: 43753 - DNA, 25 bp, Rattus norvegicus
aagcttgcccgtagcgtgtattaca

SEQ ID NO: 43754 - DNA, 25 bp, Rattus norvegicus
aagcttgcccgttgcgtgtattaca

SEQ ID NO: 43755 - DNA, 25 bp, Rattus norvegicus
aagcttgctctcagtaatgtaaaca

SEQ ID NO: 43756 - DNA, 25 bp, Rattus norvegicus
aagcttgctctcagtgtcctccgag

SEQ ID NO: 43757 - DNA, 25 bp, Rattus norvegicus
aagcttgctctctgtaatgtaaaca

SEQ ID NO: 43758 - DNA, 25 bp, Rattus norvegicus
aagcttgctctctgtgtcctccgag

SEQ ID NO: 43759 - DNA, 25 bp, Rattus norvegicus
aagcttggagctagcaggattgcct

SEQ ID NO: 43760 - DNA, 25 bp, Rattus norvegicus
aagcttggagcttgcaggattgcct

SEQ ID NO: 43761 - DNA, 25 bp, Rattus norvegicus
aagcttggagggagcctgccattta

SEQ ID NO: 43762 - DNA, 25 bp, Rattus norvegicus
aagcttggagggtgcctgccattta

SEQ ID NO: 43763 - DNA, 25 bp, Rattus norvegicus
aagcttggagtcctgaccttagcat

SEQ ID NO: 43764 - DNA, 25 bp, Rattus norvegicus
aagcttggagtcgtgaccttagcat

SEQ ID NO: 43765 - DNA, 25 bp, Rattus norvegicus
aagcttggcctgctgtttgatgacg

SEQ ID NO: 43766 - DNA, 25 bp, Rattus norvegicus
aagcttggcctggtgtttgatgacg

SEQ ID NO: 43767 - DNA, 25 bp, Rattus norvegicus
aagcttggcgatataattatttaca

SEQ ID NO: 43768 - DNA, 25 bp, Rattus norvegicus
aagcttggcgatttaattatttaca

SEQ ID NO: 43769 - DNA, 25 bp, Rattus norvegicus
aagcttgggaatacaccagcctgtt

SEQ ID NO: 43770 - DNA, 25 bp, Rattus norvegicus
aagcttgggaattcaccagcctgtt

SEQ ID NO: 43771 - DNA, 25 bp, Rattus norvegicus
aagcttgggcctcattgttcatctt

SEQ ID NO: 43772 - DNA, 25 bp, Rattus norvegicus
aagcttgggcctgattgttcatctt

SEQ ID NO: 43773 - DNA, 25 bp, Rattus norvegicus
aagcttggggctatgctcacaccac

SEQ ID NO: 43774 - DNA, 25 bp, Rattus norvegicus
aagcttggggctttgctcacaccac

SEQ ID NO: 43775 - DNA, 25 bp, Rattus norvegicus
aagcttggtctcacaaaggagcact

SEQ ID NO: 43776 - DNA, 25 bp, Rattus norvegicus
aagcttggtctctcaaaggagcact

SEQ ID NO: 43777 - DNA, 25 bp, Rattus norvegicus
aagcttggtcttagcagctggtagc

SEQ ID NO: 43778 - DNA, 25 bp, Rattus norvegicus
aagcttggtctttgcagctggtagc

SEQ ID NO: 43779 - DNA, 25 bp, Rattus norvegicus
aagcttggtgtacttattcctagtc

SEQ ID NO: 43780 - DNA, 25 bp, Rattus norvegicus
aagcttggtgtagttattcctagtc

SEQ ID NO: 43781 - DNA, 25 bp, Rattus norvegicus
aagcttggtgttcttgcctggaatc

SEQ ID NO: 43782 - DNA, 25 bp, Rattus norvegicus
aagcttggtgttgttgcctggaatc

SEQ ID NO: 43783 - DNA, 25 bp, Rattus norvegicus
aagcttgtactaacttctcatcaga

SEQ ID NO: 43784 - DNA, 25 bp, Rattus norvegicus
aagcttgtactatcttctcatcaga

SEQ ID NO: 43785 - DNA, 25 bp, Rattus norvegicus
aagcttgtattgaatgttgtgcctg

SEQ ID NO: 43786 - DNA, 25 bp, Rattus norvegicus
aagcttgtattgtatgttgtgcctg

SEQ ID NO: 43787 - DNA, 25 bp, Rattus norvegicus
aagcttgtatttctcactcccttag

SEQ ID NO: 43788 - DNA, 25 bp, Rattus norvegicus
aagcttgtatttgtcactcccttag

SEQ ID NO: 43789 - DNA, 25 bp, Rattus norvegicus
aagcttgtcaagcattccatgttga

SEQ ID NO: 43790 - DNA, 25 bp, Rattus norvegicus
aagcttgtcaaggattccatgttga

SEQ ID NO: 43791 - DNA, 25 bp, Rattus norvegicus
aagcttgtcacaaacccttggagtc

SEQ ID NO: 43792 - DNA, 25 bp, Rattus norvegicus
aagcttgtcacatacccttggagtc

SEQ ID NO: 43793 - DNA, 25 bp, Rattus norvegicus
aagcttgtcagcagcctgtaggacc

SEQ ID NO: 43794 - DNA, 25 bp, Rattus norvegicus
aagcttgtcagctgcctgtaggacc

SEQ ID NO: 43795 - DNA, 25 bp, Rattus norvegicus
aagcttgtgaccagctgggcagcaa

SEQ ID NO: 43796 - DNA, 25 bp, Rattus norvegicus
aagcttgtgacctgctgggcagcaa

SEQ ID NO: 43797 - DNA, 25 bp, Rattus norvegicus
aagcttgtggcaacttgggcagagt

SEQ ID NO: 43798 - DNA, 25 bp, Rattus norvegicus
aagcttgtggcatcttgggcagagt

SEQ ID NO: 43799 - DNA, 25 bp, Rattus norvegicus
aagcttgtggccaattgtcacccag

SEQ ID NO: 43800 - DNA, 25 bp, Rattus norvegicus
aagcttgtggcctattgtcacccag

SEQ ID NO: 43801 - DNA, 25 bp, Rattus norvegicus
aagcttgttccaagagggccacata

SEQ ID NO: 43802 - DNA, 25 bp, Rattus norvegicus
aagcttgttccatgagggccacata

SEQ ID NO: 43803 - DNA, 25 bp, Rattus norvegicus
aagcttgttcttaagtcacgatgac

SEQ ID NO: 43804 - DNA, 25 bp, Rattus norvegicus
aagcttgttctttagtcacgatgac

SEQ ID NO: 43805 - DNA, 25 bp, Rattus norvegicus
aagcttgtttgtatcctttgtctag

SEQ ID NO: 43806 - DNA, 25 bp, Rattus norvegicus
aagcttgtttgtttcctttgtctag

SEQ ID NO: 43807 - DNA, 25 bp, Rattus norvegicus
aagcttgttttgagttgctgtctcc

SEQ ID NO: 43808 - DNA, 25 bp, Rattus norvegicus
aagcttgttttgtgttgctgtctcc

SEQ ID NO: 43809 - DNA, 25 bp, Rattus norvegicus
aagctttaagaacagccgtccgcct

SEQ ID NO: 43810 - DNA, 25 bp, Rattus norvegicus
aagctttaagaagagccgtccgcct

SEQ ID NO: 43811 - DNA, 25 bp, Rattus norvegicus
aagctttaattcactgtggactcca

SEQ ID NO: 43812 - DNA, 25 bp, Rattus norvegicus
aagctttaattcctgccttgttcca

SEQ ID NO: 43813 - DNA, 25 bp, Rattus norvegicus
aagctttaattcgtgccttgttcca

SEQ ID NO: 43814 - DNA, 25 bp, Rattus norvegicus
aagctttaattctctgtggactcca

SEQ ID NO: 43815 - DNA, 25 bp, Rattus norvegicus
aagctttaccttaaccttgaagatg

SEQ ID NO: 43816 - DNA, 25 bp, Rattus norvegicus
aagctttacctttaccttgaagatg

SEQ ID NO: 43817 - DNA, 25 bp, Rattus norvegicus
aagctttagatccaccatgctaacc

SEQ ID NO: 43818 - DNA, 25 bp, Rattus norvegicus
aagctttagatcgaccatgctaacc

SEQ ID NO: 43819 - DNA, 25 bp, Rattus norvegicus
aagctttagtcaccgaggcagtcta

SEQ ID NO: 43820 - DNA, 25 bp, Rattus norvegicus
aagctttagtcagcgaggcagtcta

SEQ ID NO: 43821 - DNA, 25 bp, Rattus norvegicus
aagctttatgttcctggttcattta

SEQ ID NO: 43822 - DNA, 25 bp, Rattus norvegicus
aagctttatgttgctggttcattta

SEQ ID NO: 43823 - DNA, 25 bp, Rattus norvegicus
aagctttattgtactatgctcatag

SEQ ID NO: 43824 - DNA, 25 bp, Rattus norvegicus
aagctttattgttctatgctcatag

SEQ ID NO: 43825 - DNA, 25 bp, Rattus norvegicus
aagctttatttcagcctcatttgat

SEQ ID NO: 43826 - DNA, 25 bp, Rattus norvegicus
aagctttatttctgcctcatttgat

SEQ ID NO: 43827 - DNA, 25 bp, Rattus norvegicus
aagctttcaagaaccaccattctga

SEQ ID NO: 43828 - DNA, 25 bp, Rattus norvegicus
aagctttcaagatccaccattctga

SEQ ID NO: 43829 - DNA, 25 bp, Rattus norvegicus
aagctttcaatcatcctggcgagga

SEQ ID NO: 43830 - DNA, 25 bp, Rattus norvegicus
aagctttcaatcttcctggcgagga

SEQ ID NO: 43831 - DNA, 25 bp, Rattus norvegicus
aagctttcagacatgttctttacaa

SEQ ID NO: 43832 - DNA, 25 bp, Rattus norvegicus
aagctttcagacttgttctttacaa

SEQ ID NO: 43833 - DNA, 25 bp, Rattus norvegicus
aagctttcagatcctttttatgatg

SEQ ID NO: 43834 - DNA, 25 bp, Rattus norvegicus
aagctttcagatcgctttaatggag

SEQ ID NO: 43835 - DNA, 25 bp, Rattus norvegicus
aagctttcagatgctttttatgatg

SEQ ID NO: 43836 - DNA, 25 bp, Rattus norvegicus
aagctttcagatggctttaatggag

SEQ ID NO: 43837 - DNA, 25 bp, Rattus norvegicus
aagctttcagccagagttcggttcc

SEQ ID NO: 43838 - DNA, 25 bp, Rattus norvegicus
aagctttcagcctgagttcggttcc

SEQ ID NO: 43839 - DNA, 25 bp, Rattus norvegicus
aagctttcagcgcaggcttgagccc

SEQ ID NO: 43840 - DNA, 25 bp, Rattus norvegicus
aagctttcagcggaggcttgagccc

SEQ ID NO: 43841 - DNA, 25 bp, Rattus norvegicus
aagctttcagttcttctacgttccg

SEQ ID NO: 43842 - DNA, 25 bp, Rattus norvegicus
aagctttcagttgttctacgttccg

SEQ ID NO: 43843 - DNA, 25 bp, Rattus norvegicus
aagctttccggacacacggagctct

SEQ ID NO: 43844 - DNA, 25 bp, Rattus norvegicus
aagctttccggagacacggagctct

SEQ ID NO: 43845 - DNA, 25 bp, Rattus norvegicus
aagctttcctctcgtgtgactcacc

SEQ ID NO: 43846 - DNA, 25 bp, Rattus norvegicus
aagctttcctctggtgtgactcacc

SEQ ID NO: 43847 - DNA, 25 bp, Rattus norvegicus
aagctttcctggacaaggtcatggc

SEQ ID NO: 43848 - DNA, 25 bp, Rattus norvegicus
aagctttcctggtcaaggtcatggc

SEQ ID NO: 43849 - DNA, 25 bp, Rattus norvegicus
aagctttctcctccacaatgagctg

SEQ ID NO: 43850 - DNA, 25 bp, Rattus norvegicus
aagctttctcctgcacaatgagctg

SEQ ID NO: 43851 - DNA, 25 bp, Rattus norvegicus
aagctttctcgtaccactatgtgca

SEQ ID NO: 43852 - DNA, 25 bp, Rattus norvegicus
aagctttctcgttccactatgtgca

SEQ ID NO: 43853 - DNA, 25 bp, Rattus norvegicus
aagctttctgccctgtagctacttg

SEQ ID NO: 43854 - DNA, 25 bp, Rattus norvegicus
aagctttctgccgtgtagctacttg

SEQ ID NO: 43855 - DNA, 25 bp, Rattus norvegicus
aagctttctttcattcactcttcaa

SEQ ID NO: 43856 - DNA, 25 bp, Rattus norvegicus
aagctttctttctttcactcttcaa

SEQ ID NO: 43857 - DNA, 25 bp, Rattus norvegicus
aagctttgaaacactgtcctcaggt

SEQ ID NO: 43858 - DNA, 25 bp, Rattus norvegicus
aagctttgaaactctgtcctcaggt

SEQ ID NO: 43859 - DNA, 25 bp, Rattus norvegicus
aagctttgaattattcctctcccag

SEQ ID NO: 43860 - DNA, 25 bp, Rattus norvegicus
aagctttgaatttttcctctcccag

SEQ ID NO: 43861 - DNA, 25 bp, Rattus norvegicus
aagctttgagcaccttaccctatcc

SEQ ID NO: 43862 - DNA, 25 bp, Rattus norvegicus
aagctttgagcagcttaccctatcc

SEQ ID NO: 43863 - DNA, 25 bp, Rattus norvegicus
aagctttgagctatcctgatcatac

SEQ ID NO: 43864 - DNA, 25 bp, Rattus norvegicus
aagctttgagctttcctgatcatac

SEQ ID NO: 43865 - DNA, 25 bp, Rattus norvegicus
aagctttgaggaccagcttcgcctg

SEQ ID NO: 43866 - DNA, 25 bp, Rattus norvegicus
aagctttgaggagcagcttcgcctg

SEQ ID NO: 43867 - DNA, 25 bp, Rattus norvegicus
aagctttgagtgagcctgagagcaa

SEQ ID NO: 43868 - DNA, 25 bp, Rattus norvegicus
aagctttgagtgtgcctgagagcaa

SEQ ID NO: 43869 - DNA, 25 bp, Rattus norvegicus
aagctttgcagcacatttggtccct

SEQ ID NO: 43870 - DNA, 25 bp, Rattus norvegicus
aagctttgcagctcatttggtccct

SEQ ID NO: 43871 - DNA, 25 bp, Rattus norvegicus
aagctttgcaggagcagattcggga

SEQ ID NO: 43872 - DNA, 25 bp, Rattus norvegicus
aagctttgcaggtgcagattcggga

SEQ ID NO: 43873 - DNA, 25 bp, Rattus norvegicus
aagctttgccgtctcctgatggaga

SEQ ID NO: 43874 - DNA, 25 bp, Rattus norvegicus
aagctttgccgtgtcctgatggaga

SEQ ID NO: 43875 - DNA, 25 bp, Rattus norvegicus
aagctttgcgccagacaatgcagca

SEQ ID NO: 43876 - DNA, 25 bp, Rattus norvegicus
aagctttgcgcctgacaatgcagca

SEQ ID NO: 43877 - DNA, 25 bp, Rattus norvegicus
aagctttgctggagcgtagttgctc

SEQ ID NO: 43878 - DNA, 25 bp, Rattus norvegicus
aagctttgctggtgcgtagttgctc

SEQ ID NO: 43879 - DNA, 25 bp, Rattus norvegicus
aagctttggcaaagtcctcggcgat

SEQ ID NO: 43880 - DNA, 25 bp, Rattus norvegicus
aagctttggcaatgtcctcggcgat

SEQ ID NO: 43881 - DNA, 25 bp, Rattus norvegicus
aagctttggccgcagtctctaaaat

SEQ ID NO: 43882 - DNA, 25 bp, Rattus norvegicus
aagctttggccggagtctctaaaat

SEQ ID NO: 43883 - DNA, 25 bp, Rattus norvegicus
aagctttggcttacaatagtcataa

SEQ ID NO: 43884 - DNA, 25 bp, Rattus norvegicus
aagctttggctttcaatagtcataa

SEQ ID NO: 43885 - DNA, 25 bp, Rattus norvegicus
aagctttgtcccatcagaggcagct

SEQ ID NO: 43886 - DNA, 25 bp, Rattus norvegicus
aagctttgtcccttcagaggcagct

SEQ ID NO: 43887 - DNA, 25 bp, Rattus norvegicus
aagctttgtcttaatctgggtcccg

SEQ ID NO: 43888 - DNA, 25 bp, Rattus norvegicus
aagctttgtctttatctgggtcccg

SEQ ID NO: 43889 - DNA, 25 bp, Rattus norvegicus
aagctttgtgctcgttggaccttcc

SEQ ID NO: 43890 - DNA, 25 bp, Rattus norvegicus
aagctttgtgctggttggaccttcc

SEQ ID NO: 43891 - DNA, 25 bp, Rattus norvegicus
aagcttttaaacaggagagacttct

SEQ ID NO: 43892 - DNA, 25 bp, Rattus norvegicus
aagcttttaaactggagagacttct

SEQ ID NO: 43893 - DNA, 25 bp, Rattus norvegicus
aagcttttaaccatcaaccaggaat

SEQ ID NO: 43894 - DNA, 25 bp, Rattus norvegicus
aagcttttaaccttcaaccaggaat

SEQ ID NO: 43895 - DNA, 25 bp, Rattus norvegicus
aagcttttacttacacacaggagac

SEQ ID NO: 43896 - DNA, 25 bp, Rattus norvegicus
aagcttttactttcacacaggagac

SEQ ID NO: 43897 - DNA, 25 bp, Rattus norvegicus
aagcttttcacaattgtttcattgc

SEQ ID NO: 43898 - DNA, 25 bp, Rattus norvegicus
aagcttttcacatttgtttcattgc

SEQ ID NO: 43899 - DNA, 25 bp, Rattus norvegicus
aagcttttcatcagtctagaaggaa

SEQ ID NO: 43900 - DNA, 25 bp, Rattus norvegicus
aagcttttcatctgtctagaaggaa

SEQ ID NO: 43901 - DNA, 25 bp, Rattus norvegicus
aagcttttccctctccaccaagaga

SEQ ID NO: 43902 - DNA, 25 bp, Rattus norvegicus
aagcttttccctgtccaccaagaga

SEQ ID NO: 43903 - DNA, 25 bp, Rattus norvegicus
aagcttttcctgactgtgacacatt

SEQ ID NO: 43904 - DNA, 25 bp, Rattus norvegicus
aagcttttcctgtctgtgacacatt

SEQ ID NO: 43905 - DNA, 25 bp, Rattus norvegicus
aagcttttccttctggactttgcaa

SEQ ID NO: 43906 - DNA, 25 bp, Rattus norvegicus
aagcttttccttgtggactttgcaa

SEQ ID NO: 43907 - DNA, 25 bp, Rattus norvegicus
aagcttttcgccctgagcatgcgca

SEQ ID NO: 43908 - DNA, 25 bp, Rattus norvegicus
aagcttttcgccgtgagcatgcgca

SEQ ID NO: 43909 - DNA, 25 bp, Rattus norvegicus
aagcttttctatatgtacctttgag

SEQ ID NO: 43910 - DNA, 25 bp, Rattus norvegicus
aagcttttctatttgtacctttgag

SEQ ID NO: 43911 - DNA, 25 bp, Rattus norvegicus
aagcttttctcaactccatacatgt

SEQ ID NO: 43912 - DNA, 25 bp, Rattus norvegicus
aagcttttctcaactggagtccttc

SEQ ID NO: 43913 - DNA, 25 bp, Rattus norvegicus
aagcttttctcatctccatacatgt

SEQ ID NO: 43914 - DNA, 25 bp, Rattus norvegicus
aagcttttctcatctggagtccttc

SEQ ID NO: 43915 - DNA, 25 bp, Rattus norvegicus
aagcttttcttgcttctccagtgct

SEQ ID NO: 43916 - DNA, 25 bp, Rattus norvegicus
aagcttttcttggttctccagtgct

SEQ ID NO: 43917 - DNA, 25 bp, Rattus norvegicus
aagcttttgcatcaaccttctatga

SEQ ID NO: 43918 - DNA, 25 bp, Rattus norvegicus
aagcttttgcatgaaccttctatga

SEQ ID NO: 43919 - DNA, 25 bp, Rattus norvegicus
aagcttttgcgtatatcttccctat

SEQ ID NO: 43920 - DNA, 25 bp, Rattus norvegicus
aagcttttgcgtttatcttccctat

SEQ ID NO: 43921 - DNA, 25 bp, Rattus norvegicus
aagcttttggacagctgaaagccca

SEQ ID NO: 43922 - DNA, 25 bp, Rattus norvegicus
aagcttttggactgctgaaagccca

SEQ ID NO: 43923 - DNA, 25 bp, Rattus norvegicus
aagcttttgtacatcttgttcatga

SEQ ID NO: 43924 - DNA, 25 bp, Rattus norvegicus
aagcttttgtacttcttgttcatga

SEQ ID NO: 43925 - DNA, 25 bp, Rattus norvegicus
aagcttttgtcaatgccctgagggc

SEQ ID NO: 43926 - DNA, 25 bp, Rattus norvegicus
aagcttttgtcattgccctgagggc

SEQ ID NO: 43927 - DNA, 25 bp, Rattus norvegicus
aagcttttgttgctgcttggctttt

SEQ ID NO: 43928 - DNA, 25 bp, Rattus norvegicus
aagcttttgttggtgcttggctttt

SEQ ID NO: 43929 - DNA, 25 bp, Rattus norvegicus
aagcttttgtttctactctgcaggc

SEQ ID NO: 43930 - DNA, 25 bp, Rattus norvegicus
aagcttttgtttgtactctgcaggc

SEQ ID NO: 43931 - DNA, 25 bp, Rattus norvegicus
aagctttttccccatagtgcctata

SEQ ID NO: 43932 - DNA, 25 bp, Rattus norvegicus
aagctttttcccgatagtgcctata

SEQ ID NO: 43933 - DNA, 25 bp, Rattus norvegicus
aaggaaaaatacacacagtcggaag

SEQ ID NO: 43934 - DNA, 25 bp, Rattus norvegicus
aaggaaaaatactcacagtcggaag

SEQ ID NO: 43935 - DNA, 25 bp, Rattus norvegicus
aaggaaaaccagctattgcccatag

SEQ ID NO: 43936 - DNA, 25 bp, Rattus norvegicus
aaggaaaaccaggtattgcccatag

SEQ ID NO: 43937 - DNA, 25 bp, Rattus norvegicus
aaggaaaacgctccaatcacagcac

SEQ ID NO: 43938 - DNA, 25 bp, Rattus norvegicus
aaggaaaacgctgcaatcacagcac

SEQ ID NO: 43939 - DNA, 25 bp, Rattus norvegicus
aaggaaaactatcgtcgcgctcctg

SEQ ID NO: 43940 - DNA, 25 bp, Rattus norvegicus
aaggaaaactatggtcgcgctcctg

SEQ ID NO: 43941 - DNA, 25 bp, Rattus norvegicus
aaggaaaagaaaccctgcaccgcat

SEQ ID NO: 43942 - DNA, 25 bp, Rattus norvegicus
aaggaaaagaaagcctgcaccgcat

SEQ ID NO: 43943 - DNA, 25 bp, Rattus norvegicus
aaggaaaaggtgatccccacagcct

SEQ ID NO: 43944 - DNA, 25 bp, Rattus norvegicus
aaggaaaaggtgttccccacagcct

SEQ ID NO: 43945 - DNA, 25 bp, Rattus norvegicus
aaggaaaatgtcactgtcacagagg

SEQ ID NO: 43946 - DNA, 25 bp, Rattus norvegicus
aaggaaaatgtctctgtcacagagg

SEQ ID NO: 43947 - DNA, 25 bp, Rattus norvegicus
aaggaaaatgtgcttcctcccttct

SEQ ID NO: 43948 - DNA, 25 bp, Rattus norvegicus
aaggaaaatgtggttcctcccttct

SEQ ID NO: 43949 - DNA, 25 bp, Rattus norvegicus
aaggaaacacatcgatcccgcccag

SEQ ID NO: 43950 - DNA, 25 bp, Rattus norvegicus
aaggaaacacatggatcccgcccag

SEQ ID NO: 43951 - DNA, 25 bp, Rattus norvegicus
aaggaaacagctcctgctgcggctc

SEQ ID NO: 43952 - DNA, 25 bp, Rattus norvegicus
aaggaaacagctgctgctgcggctc

SEQ ID NO: 43953 - DNA, 25 bp, Rattus norvegicus
aaggaaacagttaagccccagtgca

SEQ ID NO: 43954 - DNA, 25 bp, Rattus norvegicus
aaggaaacagtttagccccagtgca

SEQ ID NO: 43955 - DNA, 25 bp, Rattus norvegicus
aaggaaaccatcagccgagtaactg

SEQ ID NO: 43956 - DNA, 25 bp, Rattus norvegicus
aaggaaaccatctgccgagtaactg

SEQ ID NO: 43957 - DNA, 25 bp, Rattus norvegicus
aaggaaacccaacccctgtgtgtgg

SEQ ID NO: 43958 - DNA, 25 bp, Rattus norvegicus
aaggaaacccaagccctgtgtgtgg

SEQ ID NO: 43959 - DNA, 25 bp, Rattus norvegicus
aaggaaacccacattcatcaactgc

SEQ ID NO: 43960 - DNA, 25 bp, Rattus norvegicus
aaggaaacccactttcatcaactgc

SEQ ID NO: 43961 - DNA, 25 bp, Rattus norvegicus
aaggaaacgtgcagccctttagcct

SEQ ID NO: 43962 - DNA, 25 bp, Rattus norvegicus
aaggaaacgtgctgccctttagcct

SEQ ID NO: 43963 - DNA, 25 bp, Rattus norvegicus
aaggaaacgtggcaccagctctgtc

SEQ ID NO: 43964 - DNA, 25 bp, Rattus norvegicus
aaggaaacgtgggaccagctctgtc

SEQ ID NO: 43965 - DNA, 25 bp, Rattus norvegicus
aaggaaactcagaacctctcacttc

SEQ ID NO: 43966 - DNA, 25 bp, Rattus norvegicus
aaggaaactcagcttcggaagcagc

SEQ ID NO: 43967 - DNA, 25 bp, Rattus norvegicus
aaggaaactcaggttcggaagcagc

SEQ ID NO: 43968 - DNA, 25 bp, Rattus norvegicus
aaggaaactcagtacctctcacttc

SEQ ID NO: 43969 - DNA, 25 bp, Rattus norvegicus
aaggaaactccacctgtgaggctaa

SEQ ID NO: 43970 - DNA, 25 bp, Rattus norvegicus
aaggaaactccagctgtgaggctaa

SEQ ID NO: 43971 - DNA, 25 bp, Rattus norvegicus
aaggaaactctaccatggcttgaag

SEQ ID NO: 43972 - DNA, 25 bp, Rattus norvegicus
aaggaaactctagcatggcttgaag

SEQ ID NO: 43973 - DNA, 25 bp, Rattus norvegicus
aaggaaacttcacgccttttcatct

SEQ ID NO: 43974 - DNA, 25 bp, Rattus norvegicus
aaggaaacttcaggccttttcatct

SEQ ID NO: 43975 - DNA, 25 bp, Rattus norvegicus
aaggaaactttgatgtgggctgaca

SEQ ID NO: 43976 - DNA, 25 bp, Rattus norvegicus
aaggaaactttgttgtgggctgaca

SEQ ID NO: 43977 - DNA, 25 bp, Rattus norvegicus
aaggaaagaccaccgcccgaggagc

SEQ ID NO: 43978 - DNA, 25 bp, Rattus norvegicus
aaggaaagaccagcgcccgaggagc

SEQ ID NO: 43979 - DNA, 25 bp, Rattus norvegicus
aaggaaaggctcactcagtgttaaa

SEQ ID NO: 43980 - DNA, 25 bp, Rattus norvegicus
aaggaaaggctctctcagtgttaaa

SEQ ID NO: 43981 - DNA, 25 bp, Rattus norvegicus
aaggaaaggtcgctgcccagtgttc

SEQ ID NO: 43982 - DNA, 25 bp, Rattus norvegicus
aaggaaaggtcggtgcccagtgttc

SEQ ID NO: 43983 - DNA, 25 bp, Rattus norvegicus
aaggaaagtcatatctctaaagctc

SEQ ID NO: 43984 - DNA, 25 bp, Rattus norvegicus
aaggaaagtcatttctctaaagctc

SEQ ID NO: 43985 - DNA, 25 bp, Rattus norvegicus
aaggaaagttccactcttctctgtg

SEQ ID NO: 43986 - DNA, 25 bp, Rattus norvegicus
aaggaaagttcctctcttctctgtg

SEQ ID NO: 43987 - DNA, 25 bp, Rattus norvegicus
aaggaaatacgcaggtcacctcagc

SEQ ID NO: 43988 - DNA, 25 bp, Rattus norvegicus
aaggaaatacgctggtcacctcagc

SEQ ID NO: 43989 - DNA, 25 bp, Rattus norvegicus
aaggaaatccttaagctctggagaa

SEQ ID NO: 43990 - DNA, 25 bp, Rattus norvegicus
aaggaaatcctttagctctggagaa

SEQ ID NO: 43991 - DNA, 25 bp, Rattus norvegicus
aaggaaatctcaaccatggcttcaa

SEQ ID NO: 43992 - DNA, 25 bp, Rattus norvegicus
aaggaaatctcatccatggcttcaa

SEQ ID NO: 43993 - DNA, 25 bp, Rattus norvegicus
aaggaaatgacgatcattcccgaac

SEQ ID NO: 43994 - DNA, 25 bp, Rattus norvegicus
aaggaaatgacgttcattcccgaac

SEQ ID NO: 43995 - DNA, 25 bp, Rattus norvegicus
aaggaaatgcataggctggaaggcc

SEQ ID NO: 43996 - DNA, 25 bp, Rattus norvegicus
aaggaaatgcattggctggaaggcc

SEQ ID NO: 43997 - DNA, 25 bp, Rattus norvegicus
aaggaaatgtgacctgcctgtgttt

SEQ ID NO: 43998 - DNA, 25 bp, Rattus norvegicus
aaggaaatgtgagctgcctgtgttt

SEQ ID NO: 43999 - DNA, 25 bp, Rattus norvegicus
aaggaaattgctcgcgggagacact

SEQ ID NO: 44000 - DNA, 25 bp, Rattus norvegicus
aaggaaattgctggcgggagacact

SEQ ID NO: 44001 - DNA, 25 bp, Rattus norvegicus
aaggaacaagtcactctctttagcc

SEQ ID NO: 44002 - DNA, 25 bp, Rattus norvegicus
aaggaacaagtcagtcccgtgtcaa

SEQ ID NO: 44003 - DNA, 25 bp, Rattus norvegicus
aaggaacaagtctctctctttagcc

SEQ ID NO: 44004 - DNA, 25 bp, Rattus norvegicus
aaggaacaagtctgtcccgtgtcaa

SEQ ID NO: 44005 - DNA, 25 bp, Rattus norvegicus
aaggaacacaaccagcgggaccgca

SEQ ID NO: 44006 - DNA, 25 bp, Rattus norvegicus
aaggaacacaacgagcgggaccgca

SEQ ID NO: 44007 - DNA, 25 bp, Rattus norvegicus
aaggaacacacacaggtttatataa

SEQ ID NO: 44008 - DNA, 25 bp, Rattus norvegicus
aaggaacacacagaggtttatataa

SEQ ID NO: 44009 - DNA, 25 bp, Rattus norvegicus
aaggaacacagacatcccagctcct

SEQ ID NO: 44010 - DNA, 25 bp, Rattus norvegicus
aaggaacacagaccagccctcgctt

SEQ ID NO: 44011 - DNA, 25 bp, Rattus norvegicus
aaggaacacagagatcccagctcct

SEQ ID NO: 44012 - DNA, 25 bp, Rattus norvegicus
aaggaacacagagcagccctcgctt

SEQ ID NO: 44013 - DNA, 25 bp, Rattus norvegicus
aaggaacacaggatccgtcagctcc

SEQ ID NO: 44014 - DNA, 25 bp, Rattus norvegicus
aaggaacacaggttccgtcagctcc

SEQ ID NO: 44015 - DNA, 25 bp, Rattus norvegicus
aaggaacaccccagtcgccactatg

SEQ ID NO: 44016 - DNA, 25 bp, Rattus norvegicus
aaggaacacccctgtcgccactatg

SEQ ID NO: 44017 - DNA, 25 bp, Rattus norvegicus
aaggaacagatgaaccaggacaaac

SEQ ID NO: 44018 - DNA, 25 bp, Rattus norvegicus
aaggaacagatgtaccaggacaaac

SEQ ID NO: 44019 - DNA, 25 bp, Rattus norvegicus
aaggaacagctgacccacctggcct

SEQ ID NO: 44020 - DNA, 25 bp, Rattus norvegicus
aaggaacagctgtcccacctggcct

SEQ ID NO: 44021 - DNA, 25 bp, Rattus norvegicus
aaggaacaggccatccatggaggac

SEQ ID NO: 44022 - DNA, 25 bp, Rattus norvegicus
aaggaacaggccttccatggaggac

SEQ ID NO: 44023 - DNA, 25 bp, Rattus norvegicus
aaggaacagtctatcttcagatttc

SEQ ID NO: 44024 - DNA, 25 bp, Rattus norvegicus
aaggaacagtctttcttcagatttc

SEQ ID NO: 44025 - DNA, 25 bp, Rattus norvegicus
aaggaacatgcgcttattataggca

SEQ ID NO: 44026 - DNA, 25 bp, Rattus norvegicus
aaggaacatgcggttattataggca

SEQ ID NO: 44027 - DNA, 25 bp, Rattus norvegicus
aaggaacatgctactaactctagag

SEQ ID NO: 44028 - DNA, 25 bp, Rattus norvegicus
aaggaacatgcttctaactctagag

SEQ ID NO: 44029 - DNA, 25 bp, Rattus norvegicus
aaggaaccaaacaagggcagccaca

SEQ ID NO: 44030 - DNA, 25 bp, Rattus norvegicus
aaggaaccaaactagggcagccaca

SEQ ID NO: 44031 - DNA, 25 bp, Rattus norvegicus
aaggaaccaaggaaggctgccaact

SEQ ID NO: 44032 - DNA, 25 bp, Rattus norvegicus
aaggaaccaaggtaggctgccaact

SEQ ID NO: 44033 - DNA, 25 bp, Rattus norvegicus
aaggaaccacatatttcaggccatg

SEQ ID NO: 44034 - DNA, 25 bp, Rattus norvegicus
aaggaaccacatttttcaggccatg

SEQ ID NO: 44035 - DNA, 25 bp, Rattus norvegicus
aaggaaccacctctgactctaacca

SEQ ID NO: 44036 - DNA, 25 bp, Rattus norvegicus
aaggaaccacctgtgactctaacca

SEQ ID NO: 44037 - DNA, 25 bp, Rattus norvegicus
aaggaaccactgcagccatcctaga

SEQ ID NO: 44038 - DNA, 25 bp, Rattus norvegicus
aaggaaccactggagccatcctaga

SEQ ID NO: 44039 - DNA, 25 bp, Rattus norvegicus
aaggaaccagagacccacatgagga

SEQ ID NO: 44040 - DNA, 25 bp, Rattus norvegicus
aaggaaccagagtcccacatgagga

SEQ ID NO: 44041 - DNA, 25 bp, Rattus norvegicus
aaggaaccagtcaacagagtgggaa

SEQ ID NO: 44042 - DNA, 25 bp, Rattus norvegicus
aaggaaccagtctacagagtgggaa

SEQ ID NO: 44043 - DNA, 25 bp, Rattus norvegicus
aaggaaccatagagcccatctgtgt

SEQ ID NO: 44044 - DNA, 25 bp, Rattus norvegicus
aaggaaccatagtgcccatctgtgt

SEQ ID NO: 44045 - DNA, 25 bp, Rattus norvegicus
aaggaacccaatccgacctctgatt

SEQ ID NO: 44046 - DNA, 25 bp, Rattus norvegicus
aaggaacccaatgcgacctctgatt

SEQ ID NO: 44047 - DNA, 25 bp, Rattus norvegicus
aaggaacccaccatcaacttggaat

SEQ ID NO: 44048 - DNA, 25 bp, Rattus norvegicus
aaggaacccaccttcaacttggaat

SEQ ID NO: 44049 - DNA, 25 bp, Rattus norvegicus
aaggaacccagccttcttgtttcag

SEQ ID NO: 44050 - DNA, 25 bp, Rattus norvegicus
aaggaacccagcgttcttgtttcag

SEQ ID NO: 44051 - DNA, 25 bp, Rattus norvegicus
aaggaaccccaaatgcagaaaccag

SEQ ID NO: 44052 - DNA, 25 bp, Rattus norvegicus
aaggaaccccaattgcagaaaccag

SEQ ID NO: 44053 - DNA, 25 bp, Rattus norvegicus
aaggaacccctgcttggatggtgcc

SEQ ID NO: 44054 - DNA, 25 bp, Rattus norvegicus
aaggaacccctggttggatggtgcc

SEQ ID NO: 44055 - DNA, 25 bp, Rattus norvegicus
aaggaaccgccaagtgtgtgccaac

SEQ ID NO: 44056 - DNA, 25 bp, Rattus norvegicus
aaggaaccgccatgtgtgtgccaac

SEQ ID NO: 44057 - DNA, 25 bp, Rattus norvegicus
aaggaaccgtaaacctgtcacctga

SEQ ID NO: 44058 - DNA, 25 bp, Rattus norvegicus
aaggaaccgtaatcctgtcacctga

SEQ ID NO: 44059 - DNA, 25 bp, Rattus norvegicus
aaggaacctggcctctacactgtgt

SEQ ID NO: 44060 - DNA, 25 bp, Rattus norvegicus
aaggaacctggcgtctacactgtgt

SEQ ID NO: 44061 - DNA, 25 bp, Rattus norvegicus
aaggaacctgggagatcctctcagc

SEQ ID NO: 44062 - DNA, 25 bp, Rattus norvegicus
aaggaacctgggtgatcctctcagc

SEQ ID NO: 44063 - DNA, 25 bp, Rattus norvegicus
aaggaacctggtcgtgatccccaag

SEQ ID NO: 44064 - DNA, 25 bp, Rattus norvegicus
aaggaacctggtggtgatccccaag

SEQ ID NO: 44065 - DNA, 25 bp, Rattus norvegicus
aaggaacctgtgatcacaccggagt

SEQ ID NO: 44066 - DNA, 25 bp, Rattus norvegicus
aaggaacctgtgttcacaccggagt

SEQ ID NO: 44067 - DNA, 25 bp, Rattus norvegicus
aaggaaccttgaatccagccaggat

SEQ ID NO: 44068 - DNA, 25 bp, Rattus norvegicus
aaggaaccttgattccagccaggat

SEQ ID NO: 44069 - DNA, 25 bp, Rattus norvegicus
aaggaacgaaaacctgtgccggtga

SEQ ID NO: 44070 - DNA, 25 bp, Rattus norvegicus
aaggaacgaaaagctgtgccggtga

SEQ ID NO: 44071 - DNA, 25 bp, Rattus norvegicus
aaggaacgacagcttcacatgcagc

SEQ ID NO: 44072 - DNA, 25 bp, Rattus norvegicus
aaggaacgacaggttcacatgcagc

SEQ ID NO: 44073 - DNA, 25 bp, Rattus norvegicus
aaggaacgcaccacaattgctcagc

SEQ ID NO: 44074 - DNA, 25 bp, Rattus norvegicus
aaggaacgcacctcaattgctcagc

SEQ ID NO: 44075 - DNA, 25 bp, Rattus norvegicus
aaggaacgctggcacatattcccca

SEQ ID NO: 44076 - DNA, 25 bp, Rattus norvegicus
aaggaacgctgggacatattcccca

SEQ ID NO: 44077 - DNA, 25 bp, Rattus norvegicus
aaggaacggatacctgatgtgaaga

SEQ ID NO: 44078 - DNA, 25 bp, Rattus norvegicus
aaggaacggatagctgatgtgaaga

SEQ ID NO: 44079 - DNA, 25 bp, Rattus norvegicus
aaggaacggcctagcctgggaatgc

SEQ ID NO: 44080 - DNA, 25 bp, Rattus norvegicus
aaggaacggccttgcctgggaatgc

SEQ ID NO: 44081 - DNA, 25 bp, Rattus norvegicus
aaggaacgtggtccgtgagtcctca

SEQ ID NO: 44082 - DNA, 25 bp, Rattus norvegicus
aaggaacgtggtgcgtgagtcctca

SEQ ID NO: 44083 - DNA, 25 bp, Rattus norvegicus
aaggaactcacacttcttgctcacc

SEQ ID NO: 44084 - DNA, 25 bp, Rattus norvegicus
aaggaactcacagttcttgctcacc

SEQ ID NO: 44085 - DNA, 25 bp, Rattus norvegicus
aaggaactccacaatgcagcagtgt

SEQ ID NO: 44086 - DNA, 25 bp, Rattus norvegicus
aaggaactccactatgcagcagtgt

SEQ ID NO: 44087 - DNA, 25 bp, Rattus norvegicus
aaggaactcctcatttgtttcatat

SEQ ID NO: 44088 - DNA, 25 bp, Rattus norvegicus
aaggaactcctcttttgtttcatat

SEQ ID NO: 44089 - DNA, 25 bp, Rattus norvegicus
aaggaactcctgctactattctaca

SEQ ID NO: 44090 - DNA, 25 bp, Rattus norvegicus
aaggaactcctggtactattctaca

SEQ ID NO: 44091 - DNA, 25 bp, Rattus norvegicus
aaggaactctgcaactttcacctag

SEQ ID NO: 44092 - DNA, 25 bp, Rattus norvegicus
aaggaactctgctactttcacctag

SEQ ID NO: 44093 - DNA, 25 bp, Rattus norvegicus
aaggaactcttcatgacagtgctac

SEQ ID NO: 44094 - DNA, 25 bp, Rattus norvegicus
aaggaactcttcttgacagtgctac

SEQ ID NO: 44095 - DNA, 25 bp, Rattus norvegicus
aaggaactcttgcagcttgaggcta

SEQ ID NO: 44096 - DNA, 25 bp, Rattus norvegicus
aaggaactcttggagcttgaggcta

SEQ ID NO: 44097 - DNA, 25 bp, Rattus norvegicus
aaggaactctttccacgacaggaca

SEQ ID NO: 44098 - DNA, 25 bp, Rattus norvegicus
aaggaactctttgcacgacaggaca

SEQ ID NO: 44099 - DNA, 25 bp, Rattus norvegicus
aaggaactgaacatctgggccaaga

SEQ ID NO: 44100 - DNA, 25 bp, Rattus norvegicus
aaggaactgaacttctgggccaaga

SEQ ID NO: 44101 - DNA, 25 bp, Rattus norvegicus
aaggaactgaagacctggacagaaa

SEQ ID NO: 44102 - DNA, 25 bp, Rattus norvegicus
aaggaactgaagtcctggacagaaa

SEQ ID NO: 44103 - DNA, 25 bp, Rattus norvegicus
aaggaactgagcaaactctccagcc

SEQ ID NO: 44104 - DNA, 25 bp, Rattus norvegicus
aaggaactgagctaactctccagcc

SEQ ID NO: 44105 - DNA, 25 bp, Rattus norvegicus
aaggaactgctcatgctcttggttc

SEQ ID NO: 44106 - DNA, 25 bp, Rattus norvegicus
aaggaactgctcttgctcttggttc

SEQ ID NO: 44107 - DNA, 25 bp, Rattus norvegicus
aaggaactgtaaatgttacccagag

SEQ ID NO: 44108 - DNA, 25 bp, Rattus norvegicus
aaggaactgtaattgttacccagag

SEQ ID NO: 44109 - DNA, 25 bp, Rattus norvegicus
aaggaactgttgctcaagcctgcag

SEQ ID NO: 44110 - DNA, 25 bp, Rattus norvegicus
aaggaactgttggtcaagcctgcag

SEQ ID NO: 44111 - DNA, 25 bp, Rattus norvegicus
aaggaacttcttacgcatcaacatt

SEQ ID NO: 44112 - DNA, 25 bp, Rattus norvegicus
aaggaacttctttcgcatcaacatt

SEQ ID NO: 44113 - DNA, 25 bp, Rattus norvegicus
aaggaagaaaggcatggctccctca

SEQ ID NO: 44114 - DNA, 25 bp, Rattus norvegicus
aaggaagaaagggatggctccctca

SEQ ID NO: 44115 - DNA, 25 bp, Rattus norvegicus
aaggaagaatcgctgctaccggctg

SEQ ID NO: 44116 - DNA, 25 bp, Rattus norvegicus
aaggaagaatcggtgctaccggctg

SEQ ID NO: 44117 - DNA, 25 bp, Rattus norvegicus
aaggaagacactagaatgctgtgac

SEQ ID NO: 44118 - DNA, 25 bp, Rattus norvegicus
aaggaagacacttgaatgctgtgac

SEQ ID NO: 44119 - DNA, 25 bp, Rattus norvegicus
aaggaagaccccaatctagtcccat

SEQ ID NO: 44120 - DNA, 25 bp, Rattus norvegicus
aaggaagaccccagactcagatagg

SEQ ID NO: 44121 - DNA, 25 bp, Rattus norvegicus
aaggaagacccctatctagtcccat

SEQ ID NO: 44122 - DNA, 25 bp, Rattus norvegicus
aaggaagacccctgactcagatagg

SEQ ID NO: 44123 - DNA, 25 bp, Rattus norvegicus
aaggaagacctccaaggactcacct

SEQ ID NO: 44124 - DNA, 25 bp, Rattus norvegicus
aaggaagacctcgaaggactcacct

SEQ ID NO: 44125 - DNA, 25 bp, Rattus norvegicus
aaggaagaccttctggtgtgagact

SEQ ID NO: 44126 - DNA, 25 bp, Rattus norvegicus
aaggaagaccttgtggtgtgagact

SEQ ID NO: 44127 - DNA, 25 bp, Rattus norvegicus
aaggaagactccatccgagcaggaa

SEQ ID NO: 44128 - DNA, 25 bp, Rattus norvegicus
aaggaagactccttccgagcaggaa

SEQ ID NO: 44129 - DNA, 25 bp, Rattus norvegicus
aaggaagactttcggcactgggaca

SEQ ID NO: 44130 - DNA, 25 bp, Rattus norvegicus
aaggaagactttgggcactgggaca

SEQ ID NO: 44131 - DNA, 25 bp, Rattus norvegicus
aaggaagagatcctcctggagcgaa

SEQ ID NO: 44132 - DNA, 25 bp, Rattus norvegicus
aaggaagagatcgtcctggagcgaa

SEQ ID NO: 44133 - DNA, 25 bp, Rattus norvegicus
aaggaagaggatcctggtttccctg

SEQ ID NO: 44134 - DNA, 25 bp, Rattus norvegicus
aaggaagaggatgctggtttccctg

SEQ ID NO: 44135 - DNA, 25 bp, Rattus norvegicus
aaggaagaggctatcagtctcccaa

SEQ ID NO: 44136 - DNA, 25 bp, Rattus norvegicus
aaggaagaggctttcagtctcccaa

SEQ ID NO: 44137 - DNA, 25 bp, Rattus norvegicus
aaggaagagtgcactggccttgcgc

SEQ ID NO: 44138 - DNA, 25 bp, Rattus norvegicus
aaggaagagtgctctggccttgcgc

SEQ ID NO: 44139 - DNA, 25 bp, Rattus norvegicus
aaggaagatgctctcatggctcacc

SEQ ID NO: 44140 - DNA, 25 bp, Rattus norvegicus
aaggaagatgctgtcatggctcacc

SEQ ID NO: 44141 - DNA, 25 bp, Rattus norvegicus
aaggaagcaaatccactcacccgtc

SEQ ID NO: 44142 - DNA, 25 bp, Rattus norvegicus
aaggaagcaaatgcactcacccgtc

SEQ ID NO: 44143 - DNA, 25 bp, Rattus norvegicus
aaggaagcagacattccccacgata

SEQ ID NO: 44144 - DNA, 25 bp, Rattus norvegicus
aaggaagcagactttccccacgata

SEQ ID NO: 44145 - DNA, 25 bp, Rattus norvegicus
aaggaagcagcgaatccagactcca

SEQ ID NO: 44146 - DNA, 25 bp, Rattus norvegicus
aaggaagcagcgtatccagactcca

SEQ ID NO: 44147 - DNA, 25 bp, Rattus norvegicus
aaggaagcagtcagtgtaccctccc

SEQ ID NO: 44148 - DNA, 25 bp, Rattus norvegicus
aaggaagcagtctgtgtaccctccc

SEQ ID NO: 44149 - DNA, 25 bp, Rattus norvegicus
aaggaagcattgacttgaaggcaga

SEQ ID NO: 44150 - DNA, 25 bp, Rattus norvegicus
aaggaagcattgtcttgaaggcaga

SEQ ID NO: 44151 - DNA, 25 bp, Rattus norvegicus
aaggaagccaacagtgtcttgtgtt

SEQ ID NO: 44152 - DNA, 25 bp, Rattus norvegicus
aaggaagccaactgtgtcttgtgtt

SEQ ID NO: 44153 - DNA, 25 bp, Rattus norvegicus
aaggaagccattccactgtgaatac

SEQ ID NO: 44154 - DNA, 25 bp, Rattus norvegicus
aaggaagccattgcactgtgaatac

SEQ ID NO: 44155 - DNA, 25 bp, Rattus norvegicus
aaggaagcccttcagcagaaacagt

SEQ ID NO: 44156 - DNA, 25 bp, Rattus norvegicus
aaggaagcccttgagcagaaacagt

SEQ ID NO: 44157 - DNA, 25 bp, Rattus norvegicus
aaggaagccgccatgagggctgctt

SEQ ID NO: 44158 - DNA, 25 bp, Rattus norvegicus
aaggaagccgccttgagggctgctt

SEQ ID NO: 44159 - DNA, 25 bp, Rattus norvegicus
aaggaagccggcagtctccaagtct

SEQ ID NO: 44160 - DNA, 25 bp, Rattus norvegicus
aaggaagccggctgtctccaagtct

SEQ ID NO: 44161 - DNA, 25 bp, Rattus norvegicus
aaggaagcctgcaacactcagtggt

SEQ ID NO: 44162 - DNA, 25 bp, Rattus norvegicus
aaggaagcctgcacctgggaaatgt

SEQ ID NO: 44163 - DNA, 25 bp, Rattus norvegicus
aaggaagcctgctacactcagtggt

SEQ ID NO: 44164 - DNA, 25 bp, Rattus norvegicus
aaggaagcctgctcctgggaaatgt

SEQ ID NO: 44165 - DNA, 25 bp, Rattus norvegicus
aaggaagcgtccatctgcaagtaga

SEQ ID NO: 44166 - DNA, 25 bp, Rattus norvegicus
aaggaagcgtccttctgcaagtaga

SEQ ID NO: 44167 - DNA, 25 bp, Rattus norvegicus
aaggaagctcctacttgtaagaagt

SEQ ID NO: 44168 - DNA, 25 bp, Rattus norvegicus
aaggaagctcctcaactgaagtctc

SEQ ID NO: 44169 - DNA, 25 bp, Rattus norvegicus
aaggaagctcctgaactgaagtctc

SEQ ID NO: 44170 - DNA, 25 bp, Rattus norvegicus
aaggaagctccttcttgtaagaagt

SEQ ID NO: 44171 - DNA, 25 bp, Rattus norvegicus
aaggaagctgagcttgccgctcaca

SEQ ID NO: 44172 - DNA, 25 bp, Rattus norvegicus
aaggaagctgaggttgccgctcaca

SEQ ID NO: 44173 - DNA, 25 bp, Rattus norvegicus
aaggaagctgctacagtgatgacgt

SEQ ID NO: 44174 - DNA, 25 bp, Rattus norvegicus
aaggaagctgcttcagtgatgacgt

SEQ ID NO: 44175 - DNA, 25 bp, Rattus norvegicus
aaggaagctggactcatcacatgag

SEQ ID NO: 44176 - DNA, 25 bp, Rattus norvegicus
aaggaagctggagtcatcacatgag

SEQ ID NO: 44177 - DNA, 25 bp, Rattus norvegicus
aaggaagctgtgacacacactgcct

SEQ ID NO: 44178 - DNA, 25 bp, Rattus norvegicus
aaggaagctgtgtcacacactgcct

SEQ ID NO: 44179 - DNA, 25 bp, Rattus norvegicus
aaggaaggacttagctctcgagtaa

SEQ ID NO: 44180 - DNA, 25 bp, Rattus norvegicus
aaggaaggactttgctctcgagtaa

SEQ ID NO: 44181 - DNA, 25 bp, Rattus norvegicus
aaggaaggagagatcaaggcgctat

SEQ ID NO: 44182 - DNA, 25 bp, Rattus norvegicus
aaggaaggagagttcaaggcgctat

SEQ ID NO: 44183 - DNA, 25 bp, Rattus norvegicus
aaggaaggcagtccccgtctccgag

SEQ ID NO: 44184 - DNA, 25 bp, Rattus norvegicus
aaggaaggcagtgcccgtctccgag

SEQ ID NO: 44185 - DNA, 25 bp, Rattus norvegicus
aaggaaggccaaccctctacaatgg

SEQ ID NO: 44186 - DNA, 25 bp, Rattus norvegicus
aaggaaggccaagcctctacaatgg

SEQ ID NO: 44187 - DNA, 25 bp, Rattus norvegicus
aaggaaggccatagccacctgactt

SEQ ID NO: 44188 - DNA, 25 bp, Rattus norvegicus
aaggaaggccattgccacctgactt

SEQ ID NO: 44189 - DNA, 25 bp, Rattus norvegicus
aaggaaggctagcttcaggcaccaa

SEQ ID NO: 44190 - DNA, 25 bp, Rattus norvegicus
aaggaaggctaggttcaggcaccaa

SEQ ID NO: 44191 - DNA, 25 bp, Rattus norvegicus
aaggaaggctcaatatgctctccca

SEQ ID NO: 44192 - DNA, 25 bp, Rattus norvegicus
aaggaaggctcattatgctctccca

SEQ ID NO: 44193 - DNA, 25 bp, Rattus norvegicus
aaggaaggctttctcctggcactga

SEQ ID NO: 44194 - DNA, 25 bp, Rattus norvegicus
aaggaaggctttgtcctggcactga

SEQ ID NO: 44195 - DNA, 25 bp, Rattus norvegicus
aaggaagggcccacgatagacattc

SEQ ID NO: 44196 - DNA, 25 bp, Rattus norvegicus
aaggaagggccctcgatagacattc

SEQ ID NO: 44197 - DNA, 25 bp, Rattus norvegicus
aaggaagggcctatgctgaacagaa

SEQ ID NO: 44198 - DNA, 25 bp, Rattus norvegicus
aaggaagggcctttgctgaacagaa

SEQ ID NO: 44199 - DNA, 25 bp, Rattus norvegicus
aaggaagggctcatagctgtcccca

SEQ ID NO: 44200 - DNA, 25 bp, Rattus norvegicus
aaggaagggctcttagctgtcccca

SEQ ID NO: 44201 - DNA, 25 bp, Rattus norvegicus
aaggaaggttccactgcaactgtcc

SEQ ID NO: 44202 - DNA, 25 bp, Rattus norvegicus
aaggaaggttcctctgcaactgtcc

SEQ ID NO: 44203 - DNA, 25 bp, Rattus norvegicus
aaggaagtacttctctttcctgcca

SEQ ID NO: 44204 - DNA, 25 bp, Rattus norvegicus
aaggaagtacttgtctttcctgcca

SEQ ID NO: 44205 - DNA, 25 bp, Rattus norvegicus
aaggaagtagccatgtccgtccctg

SEQ ID NO: 44206 - DNA, 25 bp, Rattus norvegicus
aaggaagtagccttgtccgtccctg

SEQ ID NO: 44207 - DNA, 25 bp, Rattus norvegicus
aaggaagtcaatcgcctctgagcct

SEQ ID NO: 44208 - DNA, 25 bp, Rattus norvegicus
aaggaagtcaatggcctctgagcct

SEQ ID NO: 44209 - DNA, 25 bp, Rattus norvegicus
aaggaagtcaccataccagagcctg

SEQ ID NO: 44210 - DNA, 25 bp, Rattus norvegicus
aaggaagtcaccttaccagagcctg

SEQ ID NO: 44211 - DNA, 25 bp, Rattus norvegicus
aaggaagtcctgaccactctgggtg

SEQ ID NO: 44212 - DNA, 25 bp, Rattus norvegicus
aaggaagtcctgaggccagcagctg

SEQ ID NO: 44213 - DNA, 25 bp, Rattus norvegicus
aaggaagtcctgcaacctcccacag

SEQ ID NO: 44214 - DNA, 25 bp, Rattus norvegicus
aaggaagtcctgcttggtaatgaaa

SEQ ID NO: 44215 - DNA, 25 bp, Rattus norvegicus
aaggaagtcctggaacctcccacag

SEQ ID NO: 44216 - DNA, 25 bp, Rattus norvegicus
aaggaagtcctggttggtaatgaaa

SEQ ID NO: 44217 - DNA, 25 bp, Rattus norvegicus
aaggaagtcctgtccactctgggtg

SEQ ID NO: 44218 - DNA, 25 bp, Rattus norvegicus
aaggaagtcctgtggccagcagctg

SEQ ID NO: 44219 - DNA, 25 bp, Rattus norvegicus
aaggaagtcggcactgtcatgcaga

SEQ ID NO: 44220 - DNA, 25 bp, Rattus norvegicus
aaggaagtcggctctgtcatgcaga

SEQ ID NO: 44221 - DNA, 25 bp, Rattus norvegicus
aaggaagtcttgagcctgcttccac

SEQ ID NO: 44222 - DNA, 25 bp, Rattus norvegicus
aaggaagtcttgtgcctgcttccac

SEQ ID NO: 44223 - DNA, 25 bp, Rattus norvegicus
aaggaagtgataacctccccatggt

SEQ ID NO: 44224 - DNA, 25 bp, Rattus norvegicus
aaggaagtgatatcctccccatggt

SEQ ID NO: 44225 - DNA, 25 bp, Rattus norvegicus
aaggaagtgcttcctgcctgtcatc

SEQ ID NO: 44226 - DNA, 25 bp, Rattus norvegicus
aaggaagtgcttgctgcctgtcatc

SEQ ID NO: 44227 - DNA, 25 bp, Rattus norvegicus
aaggaagtggttccactcccaggca

SEQ ID NO: 44228 - DNA, 25 bp, Rattus norvegicus
aaggaagtggttgcactcccaggca

SEQ ID NO: 44229 - DNA, 25 bp, Rattus norvegicus
aaggaagtgtggaccccatcaaaca

SEQ ID NO: 44230 - DNA, 25 bp, Rattus norvegicus
aaggaagtgtggtccccatcaaaca

SEQ ID NO: 44231 - DNA, 25 bp, Rattus norvegicus
aaggaagtgttcaacctcacgactc

SEQ ID NO: 44232 - DNA, 25 bp, Rattus norvegicus
aaggaagtgttctacctcacgactc

SEQ ID NO: 44233 - DNA, 25 bp, Rattus norvegicus
aaggaagttccgagctgtgctgaat

SEQ ID NO: 44234 - DNA, 25 bp, Rattus norvegicus
aaggaagttccgtgctgtgctgaat

SEQ ID NO: 44235 - DNA, 25 bp, Rattus norvegicus
aaggaagttctcaatgcgcaccaca

SEQ ID NO: 44236 - DNA, 25 bp, Rattus norvegicus
aaggaagttctctatgcgcaccaca

SEQ ID NO: 44237 - DNA, 25 bp, Rattus norvegicus
aaggaagttctgagccctaggcagc

SEQ ID NO: 44238 - DNA, 25 bp, Rattus norvegicus
aaggaagttctgtgccctaggcagc

SEQ ID NO: 44239 - DNA, 25 bp, Rattus norvegicus
aaggaatacctgatactcttagagt

SEQ ID NO: 44240 - DNA, 25 bp, Rattus norvegicus
aaggaatacctgttactcttagagt

SEQ ID NO: 44241 - DNA, 25 bp, Rattus norvegicus
aaggaatacttccacaactgggtga

SEQ ID NO: 44242 - DNA, 25 bp, Rattus norvegicus
aaggaatacttcgacaactgggtga

SEQ ID NO: 44243 - DNA, 25 bp, Rattus norvegicus
aaggaatagaagcagtgtggcaacc

SEQ ID NO: 44244 - DNA, 25 bp, Rattus norvegicus
aaggaatagaaggagtgtggcaacc

SEQ ID NO: 44245 - DNA, 25 bp, Rattus norvegicus
aaggaataggacaagccccagctca

SEQ ID NO: 44246 - DNA, 25 bp, Rattus norvegicus
aaggaataggactagccccagctca

SEQ ID NO: 44247 - DNA, 25 bp, Rattus norvegicus
aaggaatattacacacggctcggag

SEQ ID NO: 44248 - DNA, 25 bp, Rattus norvegicus
aaggaatattactcacggctcggag

SEQ ID NO: 44249 - DNA, 25 bp, Rattus norvegicus
aaggaatattctctcttcaattaag

SEQ ID NO: 44250 - DNA, 25 bp, Rattus norvegicus
aaggaatattctgtcttcaattaag

SEQ ID NO: 44251 - DNA, 25 bp, Rattus norvegicus
aaggaatcagcacgttctctgccgc

SEQ ID NO: 44252 - DNA, 25 bp, Rattus norvegicus
aaggaatcagcaggttctctgccgc

SEQ ID NO: 44253 - DNA, 25 bp, Rattus norvegicus
aaggaatcagcccaacagaagaatt

SEQ ID NO: 44254 - DNA, 25 bp, Rattus norvegicus
aaggaatcagccgaacagaagaatt

SEQ ID NO: 44255 - DNA, 25 bp, Rattus norvegicus
aaggaatcagcgatgctcctgcatc

SEQ ID NO: 44256 - DNA, 25 bp, Rattus norvegicus
aaggaatcagcgttgctcctgcatc

SEQ ID NO: 44257 - DNA, 25 bp, Rattus norvegicus
aaggaatccattctcattagtgaca

SEQ ID NO: 44258 - DNA, 25 bp, Rattus norvegicus
aaggaatccattgtcattagtgaca

SEQ ID NO: 44259 - DNA, 25 bp, Rattus norvegicus
aaggaatccctaataagactgagaa

SEQ ID NO: 44260 - DNA, 25 bp, Rattus norvegicus
aaggaatccctattaagactgagaa

SEQ ID NO: 44261 - DNA, 25 bp, Rattus norvegicus
aaggaatccttcaatagcacatatt

SEQ ID NO: 44262 - DNA, 25 bp, Rattus norvegicus
aaggaatccttctatagcacatatt

SEQ ID NO: 44263 - DNA, 25 bp, Rattus norvegicus
aaggaatcggtgagcccaagcagat

SEQ ID NO: 44264 - DNA, 25 bp, Rattus norvegicus
aaggaatcggtgtgcccaagcagat

SEQ ID NO: 44265 - DNA, 25 bp, Rattus norvegicus
aaggaatctcaacccatcctaagat

SEQ ID NO: 44266 - DNA, 25 bp, Rattus norvegicus
aaggaatctcaacccctaagccatt

SEQ ID NO: 44267 - DNA, 25 bp, Rattus norvegicus
aaggaatctcaagccatcctaagat

SEQ ID NO: 44268 - DNA, 25 bp, Rattus norvegicus
aaggaatctcaagccctaagccatt

SEQ ID NO: 44269 - DNA, 25 bp, Rattus norvegicus
aaggaatctcaccatccagggtctt

SEQ ID NO: 44270 - DNA, 25 bp, Rattus norvegicus
aaggaatctcacgatccagggtctt

SEQ ID NO: 44271 - DNA, 25 bp, Rattus norvegicus
aaggaatctctccaacagctgggtc

SEQ ID NO: 44272 - DNA, 25 bp, Rattus norvegicus
aaggaatctctcgaacagctgggtc

SEQ ID NO: 44273 - DNA, 25 bp, Rattus norvegicus
aaggaatctgccactttttattagc

SEQ ID NO: 44274 - DNA, 25 bp, Rattus norvegicus
aaggaatctgcctctttttattagc

SEQ ID NO: 44275 - DNA, 25 bp, Rattus norvegicus
aaggaatcttcaacaagcccggagc

SEQ ID NO: 44276 - DNA, 25 bp, Rattus norvegicus
aaggaatcttcatcaagcccggagc

SEQ ID NO: 44277 - DNA, 25 bp, Rattus norvegicus
aaggaatgactcaggtctccaacca

SEQ ID NO: 44278 - DNA, 25 bp, Rattus norvegicus
aaggaatgactctggtctccaacca

SEQ ID NO: 44279 - DNA, 25 bp, Rattus norvegicus
aaggaatgctctatggaggcagcct

SEQ ID NO: 44280 - DNA, 25 bp, Rattus norvegicus
aaggaatgctctttggaggcagcct

SEQ ID NO: 44281 - DNA, 25 bp, Rattus norvegicus
aaggaatggaccctcatgctacatg

SEQ ID NO: 44282 - DNA, 25 bp, Rattus norvegicus
aaggaatggaccgtcatgctacatg

SEQ ID NO: 44283 - DNA, 25 bp, Rattus norvegicus
aaggaatggactcccttgtcctcaa

SEQ ID NO: 44284 - DNA, 25 bp, Rattus norvegicus
aaggaatggactgccttgtcctcaa

SEQ ID NO: 44285 - DNA, 25 bp, Rattus norvegicus
aaggaatggcctactgttttgaata

SEQ ID NO: 44286 - DNA, 25 bp, Rattus norvegicus
aaggaatggcctccaggtggttcca

SEQ ID NO: 44287 - DNA, 25 bp, Rattus norvegicus
aaggaatggcctgcaggtggttcca

SEQ ID NO: 44288 - DNA, 25 bp, Rattus norvegicus
aaggaatggccttctgttttgaata

SEQ ID NO: 44289 - DNA, 25 bp, Rattus norvegicus
aaggaatgggctcagctacctgcac

SEQ ID NO: 44290 - DNA, 25 bp, Rattus norvegicus
aaggaatgggctgagctacctgcac

SEQ ID NO: 44291 - DNA, 25 bp, Rattus norvegicus
aaggaatgtcctcaagaggtgatca

SEQ ID NO: 44292 - DNA, 25 bp, Rattus norvegicus
aaggaatgtcctgaagaggtgatca

SEQ ID NO: 44293 - DNA, 25 bp, Rattus norvegicus
aaggaatgtgtaaggcctcttctcc

SEQ ID NO: 44294 - DNA, 25 bp, Rattus norvegicus
aaggaatgtgtatggcctcttctcc

SEQ ID NO: 44295 - DNA, 25 bp, Rattus norvegicus
aaggaatgttccctaccgcatccga

SEQ ID NO: 44296 - DNA, 25 bp, Rattus norvegicus
aaggaatgttccgtaccgcatccga

SEQ ID NO: 44297 - DNA, 25 bp, Rattus norvegicus
aaggaattcaacagccatccagacc

SEQ ID NO: 44298 - DNA, 25 bp, Rattus norvegicus
aaggaattcaactgccatccagacc

SEQ ID NO: 44299 - DNA, 25 bp, Rattus norvegicus
aaggaattcagtaacagctcatgtt

SEQ ID NO: 44300 - DNA, 25 bp, Rattus norvegicus
aaggaattcagttacagctcatgtt

SEQ ID NO: 44301 - DNA, 25 bp, Rattus norvegicus
aaggaattcctacggccacatgcaa

SEQ ID NO: 44302 - DNA, 25 bp, Rattus norvegicus
aaggaattcctagggccacatgcaa

SEQ ID NO: 44303 - DNA, 25 bp, Rattus norvegicus
aaggaattcctcaacgcaggctctt

SEQ ID NO: 44304 - DNA, 25 bp, Rattus norvegicus
aaggaattcctctacgcaggctctt

SEQ ID NO: 44305 - DNA, 25 bp, Rattus norvegicus
aaggaattgcagactgctgcctgca

SEQ ID NO: 44306 - DNA, 25 bp, Rattus norvegicus
aaggaattgcagtctgctgcctgca

SEQ ID NO: 44307 - DNA, 25 bp, Rattus norvegicus
aaggaatttacactgctgtgccggg

SEQ ID NO: 44308 - DNA, 25 bp, Rattus norvegicus
aaggaatttacagtgctgtgccggg

SEQ ID NO: 44309 - DNA, 25 bp, Rattus norvegicus
aaggaatttatgctgtgtcacaatc

SEQ ID NO: 44310 - DNA, 25 bp, Rattus norvegicus
aaggaatttatggtgtgtcacaatc

SEQ ID NO: 44311 - DNA, 25 bp, Rattus norvegicus
aaggaatttgcaccccttttctggc

SEQ ID NO: 44312 - DNA, 25 bp, Rattus norvegicus
aaggaatttgcagcccttttctggc

SEQ ID NO: 44313 - DNA, 25 bp, Rattus norvegicus
aaggaatttgctaggcctcctcgaa

SEQ ID NO: 44314 - DNA, 25 bp, Rattus norvegicus
aaggaatttgcttggcctcctcgaa

SEQ ID NO: 44315 - DNA, 25 bp, Rattus norvegicus
aaggaattttgaaccagcagcctgg

SEQ ID NO: 44316 - DNA, 25 bp, Rattus norvegicus
aaggaattttgatccagcagcctgg

SEQ ID NO: 44317 - DNA, 25 bp, Rattus norvegicus
aaggacaaacagacccctggagcgt

SEQ ID NO: 44318 - DNA, 25 bp, Rattus norvegicus
aaggacaaacagcattccacgctct

SEQ ID NO: 44319 - DNA, 25 bp, Rattus norvegicus
aaggacaaacaggattccacgctct

SEQ ID NO: 44320 - DNA, 25 bp, Rattus norvegicus
aaggacaaacagtcccctggagcgt

SEQ ID NO: 44321 - DNA, 25 bp, Rattus norvegicus
aaggacaaacgcatctcgggcaccg

SEQ ID NO: 44322 - DNA, 25 bp, Rattus norvegicus
aaggacaaacgcttctcgggcaccg

SEQ ID NO: 44323 - DNA, 25 bp, Rattus norvegicus
aaggacaaactccaccatccaaagg

SEQ ID NO: 44324 - DNA, 25 bp, Rattus norvegicus
aaggacaaactcgaccatccaaagg

SEQ ID NO: 44325 - DNA, 25 bp, Rattus norvegicus
aaggacaaaggaaccaaacgctctg

SEQ ID NO: 44326 - DNA, 25 bp, Rattus norvegicus
aaggacaaaggatccaaacgctctg

SEQ ID NO: 44327 - DNA, 25 bp, Rattus norvegicus
aaggacaaatggctcttttctggtc

SEQ ID NO: 44328 - DNA, 25 bp, Rattus norvegicus
aaggacaaatgggtcttttctggtc

SEQ ID NO: 44329 - DNA, 25 bp, Rattus norvegicus
aaggacaacctcagttttgctggcg

SEQ ID NO: 44330 - DNA, 25 bp, Rattus norvegicus
aaggacaacctctgttttgctggcg

SEQ ID NO: 44331 - DNA, 25 bp, Rattus norvegicus
aaggacaaccttatgaatgcttgga

SEQ ID NO: 44332 - DNA, 25 bp, Rattus norvegicus
aaggacaaccttttgaatgcttgga

SEQ ID NO: 44333 - DNA, 25 bp, Rattus norvegicus
aaggacaacgtgctgcacaccttca

SEQ ID NO: 44334 - DNA, 25 bp, Rattus norvegicus
aaggacaacgtggtgcacaccttca

SEQ ID NO: 44335 - DNA, 25 bp, Rattus norvegicus
aaggacaactcactgctccctaggg

SEQ ID NO: 44336 - DNA, 25 bp, Rattus norvegicus
aaggacaactcagtgctccctaggg

SEQ ID NO: 44337 - DNA, 25 bp, Rattus norvegicus
aaggacaagatcatcatagtgggtt

SEQ ID NO: 44338 - DNA, 25 bp, Rattus norvegicus
aaggacaagatcttcatagtgggtt

SEQ ID NO: 44339 - DNA, 25 bp, Rattus norvegicus
aaggacaagcccctgtgcaagagcc

SEQ ID NO: 44340 - DNA, 25 bp, Rattus norvegicus
aaggacaagcccgtgtgcaagagcc

SEQ ID NO: 44341 - DNA, 25 bp, Rattus norvegicus
aaggacaagctcctgatagccggct

SEQ ID NO: 44342 - DNA, 25 bp, Rattus norvegicus
aaggacaagctcgtgatagccggct

SEQ ID NO: 44343 - DNA, 25 bp, Rattus norvegicus
aaggacaagcttcctgacacaggca

SEQ ID NO: 44344 - DNA, 25 bp, Rattus norvegicus
aaggacaagcttgctgacacaggca

SEQ ID NO: 44345 - DNA, 25 bp, Rattus norvegicus
aaggacaagtgaagctccccagtgc

SEQ ID NO: 44346 - DNA, 25 bp, Rattus norvegicus
aaggacaagtgatgctccccagtgc

SEQ ID NO: 44347 - DNA, 25 bp, Rattus norvegicus
aaggacaagtgtcgctgtgctcgaa

SEQ ID NO: 44348 - DNA, 25 bp, Rattus norvegicus
aaggacaagtgtggctgtgctcgaa

SEQ ID NO: 44349 - DNA, 25 bp, Rattus norvegicus
aaggacaatcctcgcacgactactg

SEQ ID NO: 44350 - DNA, 25 bp, Rattus norvegicus
aaggacaatcctggcacgactactg

SEQ ID NO: 44351 - DNA, 25 bp, Rattus norvegicus
aaggacaatctgatcttttgcaaac

SEQ ID NO: 44352 - DNA, 25 bp, Rattus norvegicus
aaggacaatctgttcttttgcaaac

SEQ ID NO: 44353 - DNA, 25 bp, Rattus norvegicus
aaggacaatgtgaggcccctgcagc

SEQ ID NO: 44354 - DNA, 25 bp, Rattus norvegicus
aaggacaatgtgtggcccctgcagc

SEQ ID NO: 44355 - DNA, 25 bp, Rattus norvegicus
aaggacacaatactactgaccccaa

SEQ ID NO: 44356 - DNA, 25 bp, Rattus norvegicus
aaggacacaatagtactgaccccaa

SEQ ID NO: 44357 - DNA, 25 bp, Rattus norvegicus
aaggacacacagcatcccatcaggg

SEQ ID NO: 44358 - DNA, 25 bp, Rattus norvegicus
aaggacacacaggatcccatcaggg

SEQ ID NO: 44359 - DNA, 25 bp, Rattus norvegicus
aaggacacagcaatcactttcgggt

SEQ ID NO: 44360 - DNA, 25 bp, Rattus norvegicus
aaggacacagcattcactttcgggt

SEQ ID NO: 44361 - DNA, 25 bp, Rattus norvegicus
aaggacaccattagagaccaagagc

SEQ ID NO: 44362 - DNA, 25 bp, Rattus norvegicus
aaggacaccatttgagaccaagagc

SEQ ID NO: 44363 - DNA, 25 bp, Rattus norvegicus
aaggacacccacacataggtggcat

SEQ ID NO: 44364 - DNA, 25 bp, Rattus norvegicus
aaggacacccactcataggtggcat

SEQ ID NO: 44365 - DNA, 25 bp, Rattus norvegicus
aaggacacccctctggtgacactgt

SEQ ID NO: 44366 - DNA, 25 bp, Rattus norvegicus
aaggacacccctgtggtgacactgt

SEQ ID NO: 44367 - DNA, 25 bp, Rattus norvegicus
aaggacaccctgaacctgcaactga

SEQ ID NO: 44368 - DNA, 25 bp, Rattus norvegicus
aaggacaccctgtacctgcaactga

SEQ ID NO: 44369 - DNA, 25 bp, Rattus norvegicus
aaggacacgggcatgcctagctgag

SEQ ID NO: 44370 - DNA, 25 bp, Rattus norvegicus
aaggacacgggcttgcctagctgag

SEQ ID NO: 44371 - DNA, 25 bp, Rattus norvegicus
aaggacacggtgagcccagttctgt

SEQ ID NO: 44372 - DNA, 25 bp, Rattus norvegicus
aaggacacggtgtgcccagttctgt

SEQ ID NO: 44373 - DNA, 25 bp, Rattus norvegicus
aaggacacgtgtcttctagttctgc

SEQ ID NO: 44374 - DNA, 25 bp, Rattus norvegicus
aaggacacgtgtgttctagttctgc

SEQ ID NO: 44375 - DNA, 25 bp, Rattus norvegicus
aaggacactagcagcactctgtgct

SEQ ID NO: 44376 - DNA, 25 bp, Rattus norvegicus
aaggacactagctgcactctgtgct

SEQ ID NO: 44377 - DNA, 25 bp, Rattus norvegicus
aaggacactgaccatccgtagctac

SEQ ID NO: 44378 - DNA, 25 bp, Rattus norvegicus
aaggacactgacgatccgtagctac

SEQ ID NO: 44379 - DNA, 25 bp, Rattus norvegicus
aaggacactggacctctgggttgtt

SEQ ID NO: 44380 - DNA, 25 bp, Rattus norvegicus
aaggacactggagctctgggttgtt

SEQ ID NO: 44381 - DNA, 25 bp, Rattus norvegicus
aaggacactggcatctttccagaat

SEQ ID NO: 44382 - DNA, 25 bp, Rattus norvegicus
aaggacactggcttctttccagaat

SEQ ID NO: 44383 - DNA, 25 bp, Rattus norvegicus
aaggacagacttaggtctccagaac

SEQ ID NO: 44384 - DNA, 25 bp, Rattus norvegicus
aaggacagactttggtctccagaac

SEQ ID NO: 44385 - DNA, 25 bp, Rattus norvegicus
aaggacagagtcacaattcattggg

SEQ ID NO: 44386 - DNA, 25 bp, Rattus norvegicus
aaggacagagtctcaattcattggg

SEQ ID NO: 44387 - DNA, 25 bp, Rattus norvegicus
aaggacaggcctacccagatctgga

SEQ ID NO: 44388 - DNA, 25 bp, Rattus norvegicus
aaggacaggccttcccagatctgga

SEQ ID NO: 44389 - DNA, 25 bp, Rattus norvegicus
aaggacagtatccatctatttgcca

SEQ ID NO: 44390 - DNA, 25 bp, Rattus norvegicus
aaggacagtatcgatctatttgcca

SEQ ID NO: 44391 - DNA, 25 bp, Rattus norvegicus
aaggacagtctccagtgttaagtgt

SEQ ID NO: 44392 - DNA, 25 bp, Rattus norvegicus
aaggacagtctcgagtgttaagtgt

SEQ ID NO: 44393 - DNA, 25 bp, Rattus norvegicus
aaggacagtcttatcctgggctggc

SEQ ID NO: 44394 - DNA, 25 bp, Rattus norvegicus
aaggacagtcttttcctgggctggc

SEQ ID NO: 44395 - DNA, 25 bp, Rattus norvegicus
aaggacataaggcacctggcaagaa

SEQ ID NO: 44396 - DNA, 25 bp, Rattus norvegicus
aaggacataagggacctggcaagaa

SEQ ID NO: 44397 - DNA, 25 bp, Rattus norvegicus
aaggacataccaacctggctgagaa

SEQ ID NO: 44398 - DNA, 25 bp, Rattus norvegicus
aaggacataccatcctggctgagaa

SEQ ID NO: 44399 - DNA, 25 bp, Rattus norvegicus
aaggacatacgtagccttggaaact

SEQ ID NO: 44400 - DNA, 25 bp, Rattus norvegicus
aaggacatacgttgccttggaaact

SEQ ID NO: 44401 - DNA, 25 bp, Rattus norvegicus
aaggacataggaacccagcgctaga

SEQ ID NO: 44402 - DNA, 25 bp, Rattus norvegicus
aaggacataggatcccagcgctaga

SEQ ID NO: 44403 - DNA, 25 bp, Rattus norvegicus
aaggacatagtgctccctcatcctc

SEQ ID NO: 44404 - DNA, 25 bp, Rattus norvegicus
aaggacatagtggtccctcatcctc

SEQ ID NO: 44405 - DNA, 25 bp, Rattus norvegicus
aaggacatcataataagcccatcaa

SEQ ID NO: 44406 - DNA, 25 bp, Rattus norvegicus
aaggacatcatattaagcccatcaa

SEQ ID NO: 44407 - DNA, 25 bp, Rattus norvegicus
aaggacatcattacatcagagcaag

SEQ ID NO: 44408 - DNA, 25 bp, Rattus norvegicus
aaggacatcatttcatcagagcaag

SEQ ID NO: 44409 - DNA, 25 bp, Rattus norvegicus
aaggacatccacatagcatcttcac

SEQ ID NO: 44410 - DNA, 25 bp, Rattus norvegicus
aaggacatccacttagcatcttcac

SEQ ID NO: 44411 - DNA, 25 bp, Rattus norvegicus
aaggacatccccactgttagccatg

SEQ ID NO: 44412 - DNA, 25 bp, Rattus norvegicus
aaggacatcccctctgttagccatg

SEQ ID NO: 44413 - DNA, 25 bp, Rattus norvegicus
aaggacatcccgctgcgtggtgcca

SEQ ID NO: 44414 - DNA, 25 bp, Rattus norvegicus
aaggacatcccggtgcgtggtgcca

SEQ ID NO: 44415 - DNA, 25 bp, Rattus norvegicus
aaggacatccgcatgaatccccact

SEQ ID NO: 44416 - DNA, 25 bp, Rattus norvegicus
aaggacatccgcttgaatccccact

SEQ ID NO: 44417 - DNA, 25 bp, Rattus norvegicus
aaggacatcgaaaatattctcaatg

SEQ ID NO: 44418 - DNA, 25 bp, Rattus norvegicus
aaggacatcgaatatattctcaatg

SEQ ID NO: 44419 - DNA, 25 bp, Rattus norvegicus
aaggacatcgagcaccccgagatcg

SEQ ID NO: 44420 - DNA, 25 bp, Rattus norvegicus
aaggacatcgaggaccccgagatcg

SEQ ID NO: 44421 - DNA, 25 bp, Rattus norvegicus
aaggacatcttcatagtctagggca

SEQ ID NO: 44422 - DNA, 25 bp, Rattus norvegicus
aaggacatcttcttagtctagggca

SEQ ID NO: 44423 - DNA, 25 bp, Rattus norvegicus
aaggacatgactcctgccagggcga

SEQ ID NO: 44424 - DNA, 25 bp, Rattus norvegicus
aaggacatgactgctgccagggcga

SEQ ID NO: 44425 - DNA, 25 bp, Rattus norvegicus
aaggacatgaggacagtttcgtttc

SEQ ID NO: 44426 - DNA, 25 bp, Rattus norvegicus
aaggacatgaggtcagtttcgtttc

SEQ ID NO: 44427 - DNA, 25 bp, Rattus norvegicus
aaggacatgatccacatcgcagaca

SEQ ID NO: 44428 - DNA, 25 bp, Rattus norvegicus
aaggacatgatcgacatcgcagaca

SEQ ID NO: 44429 - DNA, 25 bp, Rattus norvegicus
aaggacatgctgctgcttgcaggaa

SEQ ID NO: 44430 - DNA, 25 bp, Rattus norvegicus
aaggacatgctggtgcttgcaggaa

SEQ ID NO: 44431 - DNA, 25 bp, Rattus norvegicus
aaggacatgtatatcactgccaccc

SEQ ID NO: 44432 - DNA, 25 bp, Rattus norvegicus
aaggacatgtatttcactgccaccc

SEQ ID NO: 44433 - DNA, 25 bp, Rattus norvegicus
aaggacatgtcactcagccagtcat

SEQ ID NO: 44434 - DNA, 25 bp, Rattus norvegicus
aaggacatgtcagtcagccagtcat

SEQ ID NO: 44435 - DNA, 25 bp, Rattus norvegicus
aaggacatgttgacctacctcacag

SEQ ID NO: 44436 - DNA, 25 bp, Rattus norvegicus
aaggacatgttgtcctacctcacag

SEQ ID NO: 44437 - DNA, 25 bp, Rattus norvegicus
aaggacattcttcagcaatgcaaga

SEQ ID NO: 44438 - DNA, 25 bp, Rattus norvegicus
aaggacattcttccatatctctgaa

SEQ ID NO: 44439 - DNA, 25 bp, Rattus norvegicus
aaggacattcttgagcaatgcaaga

SEQ ID NO: 44440 - DNA, 25 bp, Rattus norvegicus
aaggacattcttgcatatctctgaa

SEQ ID NO: 44441 - DNA, 25 bp, Rattus norvegicus
aaggacattggcagaatgctctccc

SEQ ID NO: 44442 - DNA, 25 bp, Rattus norvegicus
aaggacattggctgaatgctctccc

SEQ ID NO: 44443 - DNA, 25 bp, Rattus norvegicus
aaggacattggtacccctggagatg

SEQ ID NO: 44444 - DNA, 25 bp, Rattus norvegicus
aaggacattggttcccctggagatg

SEQ ID NO: 44445 - DNA, 25 bp, Rattus norvegicus
aaggacattgtcagtaccccatcac

SEQ ID NO: 44446 - DNA, 25 bp, Rattus norvegicus
aaggacattgtctgtaccccatcac

SEQ ID NO: 44447 - DNA, 25 bp, Rattus norvegicus
aaggacatttacagctcttccagag

SEQ ID NO: 44448 - DNA, 25 bp, Rattus norvegicus
aaggacatttactgctcttccagag

SEQ ID NO: 44449 - DNA, 25 bp, Rattus norvegicus
aaggacatttccaacctgtaccgat

SEQ ID NO: 44450 - DNA, 25 bp, Rattus norvegicus
aaggacatttcctacctgtaccgat

SEQ ID NO: 44451 - DNA, 25 bp, Rattus norvegicus
aaggacatttgccactgtatctaat

SEQ ID NO: 44452 - DNA, 25 bp, Rattus norvegicus
aaggacatttgcgactgtatctaat

SEQ ID NO: 44453 - DNA, 25 bp, Rattus norvegicus
aaggaccaaagtactcaactgcagg

SEQ ID NO: 44454 - DNA, 25 bp, Rattus norvegicus
aaggaccaaagttctcaactgcagg

SEQ ID NO: 44455 - DNA, 25 bp, Rattus norvegicus
aaggaccaacatctgggactggcta

SEQ ID NO: 44456 - DNA, 25 bp, Rattus norvegicus
aaggaccaacatgtgggactggcta

SEQ ID NO: 44457 - DNA, 25 bp, Rattus norvegicus
aaggaccaagatctgcggcaagttt

SEQ ID NO: 44458 - DNA, 25 bp, Rattus norvegicus
aaggaccaagatgtgcggcaagttt

SEQ ID NO: 44459 - DNA, 25 bp, Rattus norvegicus
aaggaccaatagcagctgtccagaa

SEQ ID NO: 44460 - DNA, 25 bp, Rattus norvegicus
aaggaccaataggagctgtccagaa

SEQ ID NO: 44461 - DNA, 25 bp, Rattus norvegicus
aaggaccacaggatgccctggagcc

SEQ ID NO: 44462 - DNA, 25 bp, Rattus norvegicus
aaggaccacaggttgccctggagcc

SEQ ID NO: 44463 - DNA, 25 bp, Rattus norvegicus
aaggaccaccttcaaatctcatagt

SEQ ID NO: 44464 - DNA, 25 bp, Rattus norvegicus
aaggaccaccttgaaatctcatagt

SEQ ID NO: 44465 - DNA, 25 bp, Rattus norvegicus
aaggaccacgacaggagactccact

SEQ ID NO: 44466 - DNA, 25 bp, Rattus norvegicus
aaggaccacgactggagactccact

SEQ ID NO: 44467 - DNA, 25 bp, Rattus norvegicus
aaggaccaggcgctgagtctctctc

SEQ ID NO: 44468 - DNA, 25 bp, Rattus norvegicus
aaggaccaggcggtgagtctctctc

SEQ ID NO: 44469 - DNA, 25 bp, Rattus norvegicus
aaggaccagggcatgtgccacgtgc

SEQ ID NO: 44470 - DNA, 25 bp, Rattus norvegicus
aaggaccagggcttgtgccacgtgc

SEQ ID NO: 44471 - DNA, 25 bp, Rattus norvegicus
aaggaccagtgaaacgattcagcag

SEQ ID NO: 44472 - DNA, 25 bp, Rattus norvegicus
aaggaccagtgatacgattcagcag

SEQ ID NO: 44473 - DNA, 25 bp, Rattus norvegicus
aaggaccatcctactgttgaaatgt

SEQ ID NO: 44474 - DNA, 25 bp, Rattus norvegicus
aaggaccatcctagagacgaaacaa

SEQ ID NO: 44475 - DNA, 25 bp, Rattus norvegicus
aaggaccatccttctgttgaaatgt

SEQ ID NO: 44476 - DNA, 25 bp, Rattus norvegicus
aaggaccatccttgagacgaaacaa

SEQ ID NO: 44477 - DNA, 25 bp, Rattus norvegicus
aaggaccatctgagtctggctgtga

SEQ ID NO: 44478 - DNA, 25 bp, Rattus norvegicus
aaggaccatctgtgtctggctgtga

SEQ ID NO: 44479 - DNA, 25 bp, Rattus norvegicus
aaggaccatggtcagccctgctaga

SEQ ID NO: 44480 - DNA, 25 bp, Rattus norvegicus
aaggaccatggtgagccctgctaga

SEQ ID NO: 44481 - DNA, 25 bp, Rattus norvegicus
aaggaccatgtcattgcctgttacc

SEQ ID NO: 44482 - DNA, 25 bp, Rattus norvegicus
aaggaccatgtctttgcctgttacc

SEQ ID NO: 44483 - DNA, 25 bp, Rattus norvegicus
aaggacccaccaccagaagcagacg

SEQ ID NO: 44484 - DNA, 25 bp, Rattus norvegicus
aaggacccaccagcagaagcagacg

SEQ ID NO: 44485 - DNA, 25 bp, Rattus norvegicus
aaggacccactgcagctaaacagtg

SEQ ID NO: 44486 - DNA, 25 bp, Rattus norvegicus
aaggacccactggagctaaacagtg

SEQ ID NO: 44487 - DNA, 25 bp, Rattus norvegicus
aaggacccagagagtcagcagaagt

SEQ ID NO: 44488 - DNA, 25 bp, Rattus norvegicus
aaggacccagagatgccagcaccat

SEQ ID NO: 44489 - DNA, 25 bp, Rattus norvegicus
aaggacccagagtgtcagcagaagt

SEQ ID NO: 44490 - DNA, 25 bp, Rattus norvegicus
aaggacccagagttgccagcaccat

SEQ ID NO: 44491 - DNA, 25 bp, Rattus norvegicus
aaggacccagatatctcctgagagt

SEQ ID NO: 44492 - DNA, 25 bp, Rattus norvegicus
aaggacccagatttctcctgagagt

SEQ ID NO: 44493 - DNA, 25 bp, Rattus norvegicus
aaggacccaggaatgtggcacagaa

SEQ ID NO: 44494 - DNA, 25 bp, Rattus norvegicus
aaggacccaggattgtggcacagaa

SEQ ID NO: 44495 - DNA, 25 bp, Rattus norvegicus
aaggacccatcgctagttctattat

SEQ ID NO: 44496 - DNA, 25 bp, Rattus norvegicus
aaggacccatcggtagttctattat

SEQ ID NO: 44497 - DNA, 25 bp, Rattus norvegicus
aaggaccccaatctgtgaagtctga

SEQ ID NO: 44498 - DNA, 25 bp, Rattus norvegicus
aaggaccccaatgtgtgaagtctga

SEQ ID NO: 44499 - DNA, 25 bp, Rattus norvegicus
aaggacccgcaaccttagtgttgac

SEQ ID NO: 44500 - DNA, 25 bp, Rattus norvegicus
aaggacccgcaagcttagtgttgac

SEQ ID NO: 44501 - DNA, 25 bp, Rattus norvegicus
aaggacccgcagctgctgtttgccg

SEQ ID NO: 44502 - DNA, 25 bp, Rattus norvegicus
aaggacccgcaggtgctgtttgccg

SEQ ID NO: 44503 - DNA, 25 bp, Rattus norvegicus
aaggacccgtggaagtgctagcagt

SEQ ID NO: 44504 - DNA, 25 bp, Rattus norvegicus
aaggacccgtggtagtgctagcagt

SEQ ID NO: 44505 - DNA, 25 bp, Rattus norvegicus
aaggacccgttgatatgttctagaa

SEQ ID NO: 44506 - DNA, 25 bp, Rattus norvegicus
aaggacccgttgttatgttctagaa

SEQ ID NO: 44507 - DNA, 25 bp, Rattus norvegicus
aaggaccctagcaggcttagcagaa

SEQ ID NO: 44508 - DNA, 25 bp, Rattus norvegicus
aaggaccctagctggcttagcagaa

SEQ ID NO: 44509 - DNA, 25 bp, Rattus norvegicus
aaggaccctcgtctgtatatattcc

SEQ ID NO: 44510 - DNA, 25 bp, Rattus norvegicus
aaggaccctcgtgtgtatatattcc

SEQ ID NO: 44511 - DNA, 25 bp, Rattus norvegicus
aaggaccctgagagaccacatctgg

SEQ ID NO: 44512 - DNA, 25 bp, Rattus norvegicus
aaggaccctgagtgaccacatctgg

SEQ ID NO: 44513 - DNA, 25 bp, Rattus norvegicus
aaggaccctgcacattggctgctag

SEQ ID NO: 44514 - DNA, 25 bp, Rattus norvegicus
aaggaccctgcagattggctgctag

SEQ ID NO: 44515 - DNA, 25 bp, Rattus norvegicus
aaggaccctgggaatcctgaaagct

SEQ ID NO: 44516 - DNA, 25 bp, Rattus norvegicus
aaggaccctgggtatcctgaaagct

SEQ ID NO: 44517 - DNA, 25 bp, Rattus norvegicus
aaggaccctgtgacccataaagcac

SEQ ID NO: 44518 - DNA, 25 bp, Rattus norvegicus
aaggaccctgtgtcccataaagcac

SEQ ID NO: 44519 - DNA, 25 bp, Rattus norvegicus
aaggaccgaaacctgcggcgtatca

SEQ ID NO: 44520 - DNA, 25 bp, Rattus norvegicus
aaggaccgaaacgtgcggcgtatca

SEQ ID NO: 44521 - DNA, 25 bp, Rattus norvegicus
aaggaccgagacaacaccatgtcgc

SEQ ID NO: 44522 - DNA, 25 bp, Rattus norvegicus
aaggaccgagactacaccatgtcgc

SEQ ID NO: 44523 - DNA, 25 bp, Rattus norvegicus
aaggaccgatgcctgtccatcctgt

SEQ ID NO: 44524 - DNA, 25 bp, Rattus norvegicus
aaggaccgatgcgtgtccatcctgt

SEQ ID NO: 44525 - DNA, 25 bp, Rattus norvegicus
aaggaccgctacatctccaagatgt

SEQ ID NO: 44526 - DNA, 25 bp, Rattus norvegicus
aaggaccgctacttctccaagatgt

SEQ ID NO: 44527 - DNA, 25 bp, Rattus norvegicus
aaggaccggaagcatcggccacacc

SEQ ID NO: 44528 - DNA, 25 bp, Rattus norvegicus
aaggaccggaaggatcggccacacc

SEQ ID NO: 44529 - DNA, 25 bp, Rattus norvegicus
aaggaccggaataccacagtgggag

SEQ ID NO: 44530 - DNA, 25 bp, Rattus norvegicus
aaggaccggaattccacagtgggag

SEQ ID NO: 44531 - DNA, 25 bp, Rattus norvegicus
aaggacctaaggcacagcctgctta

SEQ ID NO: 44532 - DNA, 25 bp, Rattus norvegicus
aaggacctaagggacagcctgctta

SEQ ID NO: 44533 - DNA, 25 bp, Rattus norvegicus
aaggacctactgagatccctacaag

SEQ ID NO: 44534 - DNA, 25 bp, Rattus norvegicus
aaggacctactgtgatccctacaag

SEQ ID NO: 44535 - DNA, 25 bp, Rattus norvegicus
aaggacctcaatcattatttttctc

SEQ ID NO: 44536 - DNA, 25 bp, Rattus norvegicus
aaggacctcaatgattatttttctc

SEQ ID NO: 44537 - DNA, 25 bp, Rattus norvegicus
aaggacctcagactggcttagatct

SEQ ID NO: 44538 - DNA, 25 bp, Rattus norvegicus
aaggacctcagagtggcttagatct

SEQ ID NO: 44539 - DNA, 25 bp, Rattus norvegicus
aaggacctccagagtagtctgcttc

SEQ ID NO: 44540 - DNA, 25 bp, Rattus norvegicus
aaggacctccagtgtagtctgcttc

SEQ ID NO: 44541 - DNA, 25 bp, Rattus norvegicus
aaggacctcctgcttcttggctcct

SEQ ID NO: 44542 - DNA, 25 bp, Rattus norvegicus
aaggacctcctggttcttggctcct

SEQ ID NO: 44543 - DNA, 25 bp, Rattus norvegicus
aaggacctctcacatgcaagacgga

SEQ ID NO: 44544 - DNA, 25 bp, Rattus norvegicus
aaggacctctcagatgcaagacgga

SEQ ID NO: 44545 - DNA, 25 bp, Rattus norvegicus
aaggacctctgtatccaggaggcta

SEQ ID NO: 44546 - DNA, 25 bp, Rattus norvegicus
aaggacctctgtttccaggaggcta

SEQ ID NO: 44547 - DNA, 25 bp, Rattus norvegicus
aaggacctgatgcaaacacccaact

SEQ ID NO: 44548 - DNA, 25 bp, Rattus norvegicus
aaggacctgatgctgtggcttctgc

SEQ ID NO: 44549 - DNA, 25 bp, Rattus norvegicus
aaggacctgatggaaacacccaact

SEQ ID NO: 44550 - DNA, 25 bp, Rattus norvegicus
aaggacctgatggtgtggcttctgc

SEQ ID NO: 44551 - DNA, 25 bp, Rattus norvegicus
aaggacctgattcacctgacaacaa

SEQ ID NO: 44552 - DNA, 25 bp, Rattus norvegicus
aaggacctgattgacctgacaacaa

SEQ ID NO: 44553 - DNA, 25 bp, Rattus norvegicus
aaggacctgcagacagggtctcttc

SEQ ID NO: 44554 - DNA, 25 bp, Rattus norvegicus
aaggacctgcagtcagggtctcttc

SEQ ID NO: 44555 - DNA, 25 bp, Rattus norvegicus
aaggacctgcttacagggacactga

SEQ ID NO: 44556 - DNA, 25 bp, Rattus norvegicus
aaggacctgcttatcagtgatgaca

SEQ ID NO: 44557 - DNA, 25 bp, Rattus norvegicus
aaggacctgctttcagggacactga

SEQ ID NO: 44558 - DNA, 25 bp, Rattus norvegicus
aaggacctgcttttcagtgatgaca

SEQ ID NO: 44559 - DNA, 25 bp, Rattus norvegicus
aaggacctggtcaaatactctagaa

SEQ ID NO: 44560 - DNA, 25 bp, Rattus norvegicus
aaggacctggtctaatactctagaa

SEQ ID NO: 44561 - DNA, 25 bp, Rattus norvegicus
aaggacctgtatacacaccttcttt

SEQ ID NO: 44562 - DNA, 25 bp, Rattus norvegicus
aaggacctgtattcacaccttcttt

SEQ ID NO: 44563 - DNA, 25 bp, Rattus norvegicus
aaggacctgtcactgcacatgggac

SEQ ID NO: 44564 - DNA, 25 bp, Rattus norvegicus
aaggacctgtcagtgcacatgggac

SEQ ID NO: 44565 - DNA, 25 bp, Rattus norvegicus
aaggaccttacccaggctgcggcag

SEQ ID NO: 44566 - DNA, 25 bp, Rattus norvegicus
aaggaccttaccgaggctgcggcag

SEQ ID NO: 44567 - DNA, 25 bp, Rattus norvegicus
aaggaccttctacacttgcacaaga

SEQ ID NO: 44568 - DNA, 25 bp, Rattus norvegicus
aaggaccttctagacttgcacaaga

SEQ ID NO: 44569 - DNA, 25 bp, Rattus norvegicus
aaggaccttcttagctgccagttac

SEQ ID NO: 44570 - DNA, 25 bp, Rattus norvegicus
aaggaccttctttgctgccagttac

SEQ ID NO: 44571 - DNA, 25 bp, Rattus norvegicus
aaggaccttgcactgcagttgcaga

SEQ ID NO: 44572 - DNA, 25 bp, Rattus norvegicus
aaggaccttgcagtgcagttgcaga

SEQ ID NO: 44573 - DNA, 25 bp, Rattus norvegicus
aaggaccttgttctgaagcccagga

SEQ ID NO: 44574 - DNA, 25 bp, Rattus norvegicus
aaggaccttgttgtgaagcccagga

SEQ ID NO: 44575 - DNA, 25 bp, Rattus norvegicus
aaggacctttctccaggcggtgagc

SEQ ID NO: 44576 - DNA, 25 bp, Rattus norvegicus
aaggacctttctgcaggcggtgagc

SEQ ID NO: 44577 - DNA, 25 bp, Rattus norvegicus
aaggacctttgcctcagaactgaat

SEQ ID NO: 44578 - DNA, 25 bp, Rattus norvegicus
aaggacctttgcgtcagaactgaat

SEQ ID NO: 44579 - DNA, 25 bp, Rattus norvegicus
aaggacgaaagcactgccctgcagt

SEQ ID NO: 44580 - DNA, 25 bp, Rattus norvegicus
aaggacgaaagctctgccctgcagt

SEQ ID NO: 44581 - DNA, 25 bp, Rattus norvegicus
aaggacgacactcctcgtggtccag

SEQ ID NO: 44582 - DNA, 25 bp, Rattus norvegicus
aaggacgacactgctcgtggtccag

SEQ ID NO: 44583 - DNA, 25 bp, Rattus norvegicus
aaggacgacattccaggcatccaga

SEQ ID NO: 44584 - DNA, 25 bp, Rattus norvegicus
aaggacgacattgcaggcatccaga

SEQ ID NO: 44585 - DNA, 25 bp, Rattus norvegicus
aaggacgaggcacgcgatttcctgc

SEQ ID NO: 44586 - DNA, 25 bp, Rattus norvegicus
aaggacgaggcaggcgatttcctgc

SEQ ID NO: 44587 - DNA, 25 bp, Rattus norvegicus
aaggacgatcttcccttcttcacgt

SEQ ID NO: 44588 - DNA, 25 bp, Rattus norvegicus
aaggacgatcttgccttcttcacgt

SEQ ID NO: 44589 - DNA, 25 bp, Rattus norvegicus
aaggacgccgcacccacgaaggaga

SEQ ID NO: 44590 - DNA, 25 bp, Rattus norvegicus
aaggacgccgcagccacgaaggaga

SEQ ID NO: 44591 - DNA, 25 bp, Rattus norvegicus
aaggacgcctttcctccgctgtcgg

SEQ ID NO: 44592 - DNA, 25 bp, Rattus norvegicus
aaggacgcctttgctccgctgtcgg

SEQ ID NO: 44593 - DNA, 25 bp, Rattus norvegicus
aaggacgcgtcaacttcactgggta

SEQ ID NO: 44594 - DNA, 25 bp, Rattus norvegicus
aaggacgcgtcatcttcactgggta

SEQ ID NO: 44595 - DNA, 25 bp, Rattus norvegicus
aaggacgctgagcaactggccactc

SEQ ID NO: 44596 - DNA, 25 bp, Rattus norvegicus
aaggacgctgaggaactggccactc

SEQ ID NO: 44597 - DNA, 25 bp, Rattus norvegicus
aaggacgctggcctcatgtagatca

SEQ ID NO: 44598 - DNA, 25 bp, Rattus norvegicus
aaggacgctggcgtcatgtagatca

SEQ ID NO: 44599 - DNA, 25 bp, Rattus norvegicus
aaggacgctgtgaggccagtcagaa

SEQ ID NO: 44600 - DNA, 25 bp, Rattus norvegicus
aaggacgctgtgtggccagtcagaa

SEQ ID NO: 44601 - DNA, 25 bp, Rattus norvegicus
aaggacgcttgacacattctgcaac

SEQ ID NO: 44602 - DNA, 25 bp, Rattus norvegicus
aaggacgcttgagacattctgcaac

SEQ ID NO: 44603 - DNA, 25 bp, Rattus norvegicus
aaggacggcatgatccacggagatg

SEQ ID NO: 44604 - DNA, 25 bp, Rattus norvegicus
aaggacggcatgttccacggagatg

SEQ ID NO: 44605 - DNA, 25 bp, Rattus norvegicus
aaggacggcctgacgcattggatgc

SEQ ID NO: 44606 - DNA, 25 bp, Rattus norvegicus
aaggacggcctgtcgcattggatgc

SEQ ID NO: 44607 - DNA, 25 bp, Rattus norvegicus
aaggacggcgtgacaggcatcacct

SEQ ID NO: 44608 - DNA, 25 bp, Rattus norvegicus
aaggacggcgtgtcaggcatcacct

SEQ ID NO: 44609 - DNA, 25 bp, Rattus norvegicus
aaggacggctgcctagtctgtactc

SEQ ID NO: 44610 - DNA, 25 bp, Rattus norvegicus
aaggacggctgcgtagtctgtactc

SEQ ID NO: 44611 - DNA, 25 bp, Rattus norvegicus
aaggacgggcctacccaggacatga

SEQ ID NO: 44612 - DNA, 25 bp, Rattus norvegicus
aaggacgggcctcaaaagcctggct

SEQ ID NO: 44613 - DNA, 25 bp, Rattus norvegicus
aaggacgggcctgaaaagcctggct

SEQ ID NO: 44614 - DNA, 25 bp, Rattus norvegicus
aaggacgggccttcccaggacatga

SEQ ID NO: 44615 - DNA, 25 bp, Rattus norvegicus
aaggacggtctgatacctttgcaga

SEQ ID NO: 44616 - DNA, 25 bp, Rattus norvegicus
aaggacggtctgttacctttgcaga

SEQ ID NO: 44617 - DNA, 25 bp, Rattus norvegicus
aaggacggtcttctgtgagttcttg

SEQ ID NO: 44618 - DNA, 25 bp, Rattus norvegicus
aaggacggtcttgtgtgagttcttg

SEQ ID NO: 44619 - DNA, 25 bp, Rattus norvegicus
aaggacgtactcaaccagtgcaaga

SEQ ID NO: 44620 - DNA, 25 bp, Rattus norvegicus
aaggacgtactctaccagtgcaaga

SEQ ID NO: 44621 - DNA, 25 bp, Rattus norvegicus
aaggacgtcttgactttttgccatt

SEQ ID NO: 44622 - DNA, 25 bp, Rattus norvegicus
aaggacgtcttgtctttttgccatt

SEQ ID NO: 44623 - DNA, 25 bp, Rattus norvegicus
aaggacgtgttgcacgcctgtgcct

SEQ ID NO: 44624 - DNA, 25 bp, Rattus norvegicus
aaggacgtgttggacgcctgtgcct

SEQ ID NO: 44625 - DNA, 25 bp, Rattus norvegicus
aaggacgttctaattattttcgcag

SEQ ID NO: 44626 - DNA, 25 bp, Rattus norvegicus
aaggacgttctatttattttcgcag

SEQ ID NO: 44627 - DNA, 25 bp, Rattus norvegicus
aaggactaaggtccctgacccggct

SEQ ID NO: 44628 - DNA, 25 bp, Rattus norvegicus
aaggactaaggtgcctgacccggct

SEQ ID NO: 44629 - DNA, 25 bp, Rattus norvegicus
aaggactacacccaccatgaaagag

SEQ ID NO: 44630 - DNA, 25 bp, Rattus norvegicus
aaggactacaccgaccatgaaagag

SEQ ID NO: 44631 - DNA, 25 bp, Rattus norvegicus
aaggactacagcacttcaaagttca

SEQ ID NO: 44632 - DNA, 25 bp, Rattus norvegicus
aaggactacagctcttcaaagttca

SEQ ID NO: 44633 - DNA, 25 bp, Rattus norvegicus
aaggactactctctggagctccaaa

SEQ ID NO: 44634 - DNA, 25 bp, Rattus norvegicus
aaggactactctgtggagctccaaa

SEQ ID NO: 44635 - DNA, 25 bp, Rattus norvegicus
aaggactatacgcaggtggactacc

SEQ ID NO: 44636 - DNA, 25 bp, Rattus norvegicus
aaggactatacggaggtggactacc

SEQ ID NO: 44637 - DNA, 25 bp, Rattus norvegicus
aaggactattgcaacagtgcccgga

SEQ ID NO: 44638 - DNA, 25 bp, Rattus norvegicus
aaggactattgctacagtgcccgga

SEQ ID NO: 44639 - DNA, 25 bp, Rattus norvegicus
aaggactcacataaggttgccagca

SEQ ID NO: 44640 - DNA, 25 bp, Rattus norvegicus
aaggactcacattaggttgccagca

SEQ ID NO: 44641 - DNA, 25 bp, Rattus norvegicus
aaggactcagctattctctctatat

SEQ ID NO: 44642 - DNA, 25 bp, Rattus norvegicus
aaggactcagcttttctctctatat

SEQ ID NO: 44643 - DNA, 25 bp, Rattus norvegicus
aaggactcaggaagccataaaccgc

SEQ ID NO: 44644 - DNA, 25 bp, Rattus norvegicus
aaggactcaggatgccataaaccgc

SEQ ID NO: 44645 - DNA, 25 bp, Rattus norvegicus
aaggactcatggaacccggtgtgct

SEQ ID NO: 44646 - DNA, 25 bp, Rattus norvegicus
aaggactcatggagcccacggtgga

SEQ ID NO: 44647 - DNA, 25 bp, Rattus norvegicus
aaggactcatggtacccggtgtgct

SEQ ID NO: 44648 - DNA, 25 bp, Rattus norvegicus
aaggactcatggtgcccacggtgga

SEQ ID NO: 44649 - DNA, 25 bp, Rattus norvegicus
aaggactcattcctgccttggagaa

SEQ ID NO: 44650 - DNA, 25 bp, Rattus norvegicus
aaggactcattcgtgccttggagaa

SEQ ID NO: 44651 - DNA, 25 bp, Rattus norvegicus
aaggactccagacacttgtcattgt

SEQ ID NO: 44652 - DNA, 25 bp, Rattus norvegicus
aaggactccagagacttgtcattgt

SEQ ID NO: 44653 - DNA, 25 bp, Rattus norvegicus
aaggactccatcctccaataaatca

SEQ ID NO: 44654 - DNA, 25 bp, Rattus norvegicus
aaggactccatcgtccaataaatca

SEQ ID NO: 44655 - DNA, 25 bp, Rattus norvegicus
aaggactcccttacattttggtgca

SEQ ID NO: 44656 - DNA, 25 bp, Rattus norvegicus
aaggactccctttcattttggtgca

SEQ ID NO: 44657 - DNA, 25 bp, Rattus norvegicus
aaggactcctacatgaagctctgcc

SEQ ID NO: 44658 - DNA, 25 bp, Rattus norvegicus
aaggactcctacttgaagctctgcc

SEQ ID NO: 44659 - DNA, 25 bp, Rattus norvegicus
aaggactcgacccagattcggtggt

SEQ ID NO: 44660 - DNA, 25 bp, Rattus norvegicus
aaggactcgaccgagattcggtggt

SEQ ID NO: 44661 - DNA, 25 bp, Rattus norvegicus
aaggactcgattcacacacttgtga

SEQ ID NO: 44662 - DNA, 25 bp, Rattus norvegicus
aaggactcgattgacacacttgtga

SEQ ID NO: 44663 - DNA, 25 bp, Rattus norvegicus
aaggactcggcaaccacgtcgtgga

SEQ ID NO: 44664 - DNA, 25 bp, Rattus norvegicus
aaggactcggcatccacgtcgtgga

SEQ ID NO: 44665 - DNA, 25 bp, Rattus norvegicus
aaggactcgggcagactggatgcac

SEQ ID NO: 44666 - DNA, 25 bp, Rattus norvegicus
aaggactcgggctgactggatgcac

SEQ ID NO: 44667 - DNA, 25 bp, Rattus norvegicus
aaggactcgggtagtctgacatcgc

SEQ ID NO: 44668 - DNA, 25 bp, Rattus norvegicus
aaggactcgggttgtctgacatcgc

SEQ ID NO: 44669 - DNA, 25 bp, Rattus norvegicus
aaggactcgtgcctgctaagaaagc

SEQ ID NO: 44670 - DNA, 25 bp, Rattus norvegicus
aaggactcgtgcgtgctaagaaagc

SEQ ID NO: 44671 - DNA, 25 bp, Rattus norvegicus
aaggactctcctacataaatgttag

SEQ ID NO: 44672 - DNA, 25 bp, Rattus norvegicus
aaggactctcctctttaccaagaag

SEQ ID NO: 44673 - DNA, 25 bp, Rattus norvegicus
aaggactctcctgtttaccaagaag

SEQ ID NO: 44674 - DNA, 25 bp, Rattus norvegicus
aaggactctccttcataaatgttag

SEQ ID NO: 44675 - DNA, 25 bp, Rattus norvegicus
aaggactctcttcccttaggaaaga

SEQ ID NO: 44676 - DNA, 25 bp, Rattus norvegicus
aaggactctcttgccttaggaaaga

SEQ ID NO: 44677 - DNA, 25 bp, Rattus norvegicus
aaggactgaccaacacttgccttta

SEQ ID NO: 44678 - DNA, 25 bp, Rattus norvegicus
aaggactgaccatcacttgccttta

SEQ ID NO: 44679 - DNA, 25 bp, Rattus norvegicus
aaggactgacgcacggaaacgaagt

SEQ ID NO: 44680 - DNA, 25 bp, Rattus norvegicus
aaggactgacgctcggaaacgaagt

SEQ ID NO: 44681 - DNA, 25 bp, Rattus norvegicus
aaggactgacttcgaagccctcttg

SEQ ID NO: 44682 - DNA, 25 bp, Rattus norvegicus
aaggactgacttggaagccctcttg

SEQ ID NO: 44683 - DNA, 25 bp, Rattus norvegicus
aaggactgagcaccttcatcaagga

SEQ ID NO: 44684 - DNA, 25 bp, Rattus norvegicus
aaggactgagcagcttcatcaagga

SEQ ID NO: 44685 - DNA, 25 bp, Rattus norvegicus
aaggactgagcccttttgttcctgg

SEQ ID NO: 44686 - DNA, 25 bp, Rattus norvegicus
aaggactgagccgttttgttcctgg

SEQ ID NO: 44687 - DNA, 25 bp, Rattus norvegicus
aaggactgcaacagttacttcccag

SEQ ID NO: 44688 - DNA, 25 bp, Rattus norvegicus
aaggactgcaaccactttcagacga

SEQ ID NO: 44689 - DNA, 25 bp, Rattus norvegicus
aaggactgcaacgactttcagacga

SEQ ID NO: 44690 - DNA, 25 bp, Rattus norvegicus
aaggactgcaactgttacttcccag

SEQ ID NO: 44691 - DNA, 25 bp, Rattus norvegicus
aaggactgcatcagtagcagccagc

SEQ ID NO: 44692 - DNA, 25 bp, Rattus norvegicus
aaggactgcatctgtagcagccagc

SEQ ID NO: 44693 - DNA, 25 bp, Rattus norvegicus
aaggactgccctctgaaatttagag

SEQ ID NO: 44694 - DNA, 25 bp, Rattus norvegicus
aaggactgccctgtgaaatttagag

SEQ ID NO: 44695 - DNA, 25 bp, Rattus norvegicus
aaggactgcggcaaatgccatttgc

SEQ ID NO: 44696 - DNA, 25 bp, Rattus norvegicus
aaggactgcggctaatgccatttgc

SEQ ID NO: 44697 - DNA, 25 bp, Rattus norvegicus
aaggactgctctagtggttggccat

SEQ ID NO: 44698 - DNA, 25 bp, Rattus norvegicus
aaggactgctcttgtggttggccat

SEQ ID NO: 44699 - DNA, 25 bp, Rattus norvegicus
aaggactgctttctgcacggagccc

SEQ ID NO: 44700 - DNA, 25 bp, Rattus norvegicus
aaggactgctttgtgcacggagccc

SEQ ID NO: 44701 - DNA, 25 bp, Rattus norvegicus
aaggactggaacacgatcctccttc

SEQ ID NO: 44702 - DNA, 25 bp, Rattus norvegicus
aaggactggaactcgatcctccttc

SEQ ID NO: 44703 - DNA, 25 bp, Rattus norvegicus
aaggactggcctcgctggatctgca

SEQ ID NO: 44704 - DNA, 25 bp, Rattus norvegicus
aaggactggcctggctggatctgca

SEQ ID NO: 44705 - DNA, 25 bp, Rattus norvegicus
aaggactggctcacttataagactc

SEQ ID NO: 44706 - DNA, 25 bp, Rattus norvegicus
aaggactggctctcttataagactc

SEQ ID NO: 44707 - DNA, 25 bp, Rattus norvegicus
aaggactggtcaccagttttacggg

SEQ ID NO: 44708 - DNA, 25 bp, Rattus norvegicus
aaggactggtcagcagttttacggg

SEQ ID NO: 44709 - DNA, 25 bp, Rattus norvegicus
aaggactggtctatctacatcctgg

SEQ ID NO: 44710 - DNA, 25 bp, Rattus norvegicus
aaggactggtctttctacatcctgg

SEQ ID NO: 44711 - DNA, 25 bp, Rattus norvegicus
aaggactgtaaaactctgtgcgcac

SEQ ID NO: 44712 - DNA, 25 bp, Rattus norvegicus
aaggactgtaaatctctgtgcgcac

SEQ ID NO: 44713 - DNA, 25 bp, Rattus norvegicus
aaggactgtaatactatttaggaag

SEQ ID NO: 44714 - DNA, 25 bp, Rattus norvegicus
aaggactgtaattctatttaggaag

SEQ ID NO: 44715 - DNA, 25 bp, Rattus norvegicus
aaggactgtcctaggacgagcagct

SEQ ID NO: 44716 - DNA, 25 bp, Rattus norvegicus
aaggactgtcctattctccggatgt

SEQ ID NO: 44717 - DNA, 25 bp, Rattus norvegicus
aaggactgtccttggacgagcagct

SEQ ID NO: 44718 - DNA, 25 bp, Rattus norvegicus
aaggactgtccttttctccggatgt

SEQ ID NO: 44719 - DNA, 25 bp, Rattus norvegicus
aaggactgtctacaacttccccaag

SEQ ID NO: 44720 - DNA, 25 bp, Rattus norvegicus
aaggactgtctagaacttccccaag

SEQ ID NO: 44721 - DNA, 25 bp, Rattus norvegicus
aaggactgtcttccctattacatca

SEQ ID NO: 44722 - DNA, 25 bp, Rattus norvegicus
aaggactgtcttgcctattacatca

SEQ ID NO: 44723 - DNA, 25 bp, Rattus norvegicus
aaggactgtgcacagtttccaccac

SEQ ID NO: 44724 - DNA, 25 bp, Rattus norvegicus
aaggactgtgcagagtttccaccac

SEQ ID NO: 44725 - DNA, 25 bp, Rattus norvegicus
aaggactgtggcagcctctgaccaa

SEQ ID NO: 44726 - DNA, 25 bp, Rattus norvegicus
aaggactgtggctgcctctgaccaa

SEQ ID NO: 44727 - DNA, 25 bp, Rattus norvegicus
aaggactgtgggatgtatacaaact

SEQ ID NO: 44728 - DNA, 25 bp, Rattus norvegicus
aaggactgtgggttgtatacaaact

SEQ ID NO: 44729 - DNA, 25 bp, Rattus norvegicus
aaggactgttccaaacttgctaagg

SEQ ID NO: 44730 - DNA, 25 bp, Rattus norvegicus
aaggactgttcctaacttgctaagg

SEQ ID NO: 44731 - DNA, 25 bp, Rattus norvegicus
aaggactgttcgctcatctggatct

SEQ ID NO: 44732 - DNA, 25 bp, Rattus norvegicus
aaggactgttcggtcatctggatct

SEQ ID NO: 44733 - DNA, 25 bp, Rattus norvegicus
aaggacttaacacccattcttgctt

SEQ ID NO: 44734 - DNA, 25 bp, Rattus norvegicus
aaggacttaacagccattcttgctt

SEQ ID NO: 44735 - DNA, 25 bp, Rattus norvegicus
aaggacttaagtatctggcctgaca

SEQ ID NO: 44736 - DNA, 25 bp, Rattus norvegicus
aaggacttaagtttctggcctgaca

SEQ ID NO: 44737 - DNA, 25 bp, Rattus norvegicus
aaggacttaatcacacactacacgt

SEQ ID NO: 44738 - DNA, 25 bp, Rattus norvegicus
aaggacttaatctcacactacacgt

SEQ ID NO: 44739 - DNA, 25 bp, Rattus norvegicus
aaggacttactaccgatgcattcta

SEQ ID NO: 44740 - DNA, 25 bp, Rattus norvegicus
aaggacttactagcgatgcattcta

SEQ ID NO: 44741 - DNA, 25 bp, Rattus norvegicus
aaggacttaggtatgcttgtctcgg

SEQ ID NO: 44742 - DNA, 25 bp, Rattus norvegicus
aaggacttaggtttgcttgtctcgg

SEQ ID NO: 44743 - DNA, 25 bp, Rattus norvegicus
aaggacttatacaatgcggcaccac

SEQ ID NO: 44744 - DNA, 25 bp, Rattus norvegicus
aaggacttatactatgcggcaccac

SEQ ID NO: 44745 - DNA, 25 bp, Rattus norvegicus
aaggacttcacaagctgcccagtta

SEQ ID NO: 44746 - DNA, 25 bp, Rattus norvegicus
aaggacttcacatgctgcccagtta

SEQ ID NO: 44747 - DNA, 25 bp, Rattus norvegicus
aaggacttcagccaatttgatttca

SEQ ID NO: 44748 - DNA, 25 bp, Rattus norvegicus
aaggacttcagcgaatttgatttca

SEQ ID NO: 44749 - DNA, 25 bp, Rattus norvegicus
aaggacttcatgctggcatctgaca

SEQ ID NO: 44750 - DNA, 25 bp, Rattus norvegicus
aaggacttcatgcttgctttggctt

SEQ ID NO: 44751 - DNA, 25 bp, Rattus norvegicus
aaggacttcatggtggcatctgaca

SEQ ID NO: 44752 - DNA, 25 bp, Rattus norvegicus
aaggacttcatggttgctttggctt

SEQ ID NO: 44753 - DNA, 25 bp, Rattus norvegicus
aaggacttcctgaatctatttcaag

SEQ ID NO: 44754 - DNA, 25 bp, Rattus norvegicus
aaggacttcctgtatctatttcaag

SEQ ID NO: 44755 - DNA, 25 bp, Rattus norvegicus
aaggacttcggacctgagaccgcgc

SEQ ID NO: 44756 - DNA, 25 bp, Rattus norvegicus
aaggacttcggagctgagaccgcgc

SEQ ID NO: 44757 - DNA, 25 bp, Rattus norvegicus
aaggacttctgtctgccgtttgtct

SEQ ID NO: 44758 - DNA, 25 bp, Rattus norvegicus
aaggacttctgtgtgccgtttgtct

SEQ ID NO: 44759 - DNA, 25 bp, Rattus norvegicus
aaggacttgaccattgtttctccca

SEQ ID NO: 44760 - DNA, 25 bp, Rattus norvegicus
aaggacttgacctttgtttctccca

SEQ ID NO: 44761 - DNA, 25 bp, Rattus norvegicus
aaggacttgctcagcaccgtgggtg

SEQ ID NO: 44762 - DNA, 25 bp, Rattus norvegicus
aaggacttgctctgcaccgtgggtg

SEQ ID NO: 44763 - DNA, 25 bp, Rattus norvegicus
aaggacttgcttatggctgagacca

SEQ ID NO: 44764 - DNA, 25 bp, Rattus norvegicus
aaggacttgcttttggctgagacca

SEQ ID NO: 44765 - DNA, 25 bp, Rattus norvegicus
aaggacttggcaccctgcaggagca

SEQ ID NO: 44766 - DNA, 25 bp, Rattus norvegicus
aaggacttggcagcctgcaggagca

SEQ ID NO: 44767 - DNA, 25 bp, Rattus norvegicus
aaggactttagtcccctctcctgaa

SEQ ID NO: 44768 - DNA, 25 bp, Rattus norvegicus
aaggactttagtgccctctcctgaa

SEQ ID NO: 44769 - DNA, 25 bp, Rattus norvegicus
aaggactttccaaagctgatcctca

SEQ ID NO: 44770 - DNA, 25 bp, Rattus norvegicus
aaggactttccatagctgatcctca

SEQ ID NO: 44771 - DNA, 25 bp, Rattus norvegicus
aaggactttcctacagagctaccag

SEQ ID NO: 44772 - DNA, 25 bp, Rattus norvegicus
aaggactttccttcagagctaccag

SEQ ID NO: 44773 - DNA, 25 bp, Rattus norvegicus
aaggactttgaaatctgcacaggcc

SEQ ID NO: 44774 - DNA, 25 bp, Rattus norvegicus
aaggactttgaattctgcacaggcc

SEQ ID NO: 44775 - DNA, 25 bp, Rattus norvegicus
aaggactttgagctccggcacggca

SEQ ID NO: 44776 - DNA, 25 bp, Rattus norvegicus
aaggactttgaggtccggcacggca

SEQ ID NO: 44777 - DNA, 25 bp, Rattus norvegicus
aaggactttggaacactgccttcag

SEQ ID NO: 44778 - DNA, 25 bp, Rattus norvegicus
aaggactttggatcactgccttcag

SEQ ID NO: 44779 - DNA, 25 bp, Rattus norvegicus
aaggactttggcaagtacccagtgg

SEQ ID NO: 44780 - DNA, 25 bp, Rattus norvegicus
aaggactttggctagtacccagtgg

SEQ ID NO: 44781 - DNA, 25 bp, Rattus norvegicus
aaggactttgtcactatggtttagg

SEQ ID NO: 44782 - DNA, 25 bp, Rattus norvegicus
aaggactttgtctctatggtttagg

SEQ ID NO: 44783 - DNA, 25 bp, Rattus norvegicus
aaggactttttcagcatttgaggta

SEQ ID NO: 44784 - DNA, 25 bp, Rattus norvegicus
aaggactttttctgcatttgaggta

SEQ ID NO: 44785 - DNA, 25 bp, Rattus norvegicus
aaggactttttgatggactctgtgt

SEQ ID NO: 44786 - DNA, 25 bp, Rattus norvegicus
aaggactttttgttggactctgtgt

SEQ ID NO: 44787 - DNA, 25 bp, Rattus norvegicus
aaggagaaacccacaggtgctcaaa

SEQ ID NO: 44788 - DNA, 25 bp, Rattus norvegicus
aaggagaaaccctcaggtgctcaaa

SEQ ID NO: 44789 - DNA, 25 bp, Rattus norvegicus
aaggagaacacgctcatcctgctgg

SEQ ID NO: 44790 - DNA, 25 bp, Rattus norvegicus
aaggagaacacggtcatcctgctgg

SEQ ID NO: 44791 - DNA, 25 bp, Rattus norvegicus
aaggagaactgtaccgcctactacg

SEQ ID NO: 44792 - DNA, 25 bp, Rattus norvegicus
aaggagaactgttccgcctactacg

SEQ ID NO: 44793 - DNA, 25 bp, Rattus norvegicus
aaggagaagcccctcacctatgagc

SEQ ID NO: 44794 - DNA, 25 bp, Rattus norvegicus
aaggagaagcccgtcacctatgagc

SEQ ID NO: 44795 - DNA, 25 bp, Rattus norvegicus
aaggagaagctcacatttcatcccc

SEQ ID NO: 44796 - DNA, 25 bp, Rattus norvegicus
aaggagaagctctcatttcatcccc

SEQ ID NO: 44797 - DNA, 25 bp, Rattus norvegicus
aaggagaagtccaaactcgagatga

SEQ ID NO: 44798 - DNA, 25 bp, Rattus norvegicus
aaggagaagtcctaactcgagatga

SEQ ID NO: 44799 - DNA, 25 bp, Rattus norvegicus
aaggagaatgcacctgccatcatct

SEQ ID NO: 44800 - DNA, 25 bp, Rattus norvegicus
aaggagaatgcagctgccatcatct

SEQ ID NO: 44801 - DNA, 25 bp, Rattus norvegicus
aaggagacacccagagtcagcttca

SEQ ID NO: 44802 - DNA, 25 bp, Rattus norvegicus
aaggagacaccctgagtcagcttca

SEQ ID NO: 44803 - DNA, 25 bp, Rattus norvegicus
aaggagacacgcagtaccccaatgc

SEQ ID NO: 44804 - DNA, 25 bp, Rattus norvegicus
aaggagacacgctgtaccccaatgc

SEQ ID NO: 44805 - DNA, 25 bp, Rattus norvegicus
aaggagacacgtcggcagcacacgt

SEQ ID NO: 44806 - DNA, 25 bp, Rattus norvegicus
aaggagacacgtgggcagcacacgt

SEQ ID NO: 44807 - DNA, 25 bp, Rattus norvegicus
aaggagacactacttccctgaagca

SEQ ID NO: 44808 - DNA, 25 bp, Rattus norvegicus
aaggagacactagttccctgaagca

SEQ ID NO: 44809 - DNA, 25 bp, Rattus norvegicus
aaggagacactcattcaacctctca

SEQ ID NO: 44810 - DNA, 25 bp, Rattus norvegicus
aaggagacactctttcaacctctca

SEQ ID NO: 44811 - DNA, 25 bp, Rattus norvegicus
aaggagacagacctagtgtccccac

SEQ ID NO: 44812 - DNA, 25 bp, Rattus norvegicus
aaggagacagacgtagtgtccccac

SEQ ID NO: 44813 - DNA, 25 bp, Rattus norvegicus
aaggagacagcgcagccctctgctt

SEQ ID NO: 44814 - DNA, 25 bp, Rattus norvegicus
aaggagacagcggagccctctgctt

SEQ ID NO: 44815 - DNA, 25 bp, Rattus norvegicus
aaggagacaggcctcctgttcagaa

SEQ ID NO: 44816 - DNA, 25 bp, Rattus norvegicus
aaggagacaggcgtcctgttcagaa

SEQ ID NO: 44817 - DNA, 25 bp, Rattus norvegicus
aaggagacatagcttacttctctta

SEQ ID NO: 44818 - DNA, 25 bp, Rattus norvegicus
aaggagacataggttacttctctta

SEQ ID NO: 44819 - DNA, 25 bp, Rattus norvegicus
aaggagacatctccctttttctgca

SEQ ID NO: 44820 - DNA, 25 bp, Rattus norvegicus
aaggagacatctgcctttttctgca

SEQ ID NO: 44821 - DNA, 25 bp, Rattus norvegicus
aaggagaccagaccctaccttcgtg

SEQ ID NO: 44822 - DNA, 25 bp, Rattus norvegicus
aaggagaccagagcctaccttcgtg

SEQ ID NO: 44823 - DNA, 25 bp, Rattus norvegicus
aaggagacccctcgcaatgcctgag

SEQ ID NO: 44824 - DNA, 25 bp, Rattus norvegicus
aaggagacccctggcaatgcctgag

SEQ ID NO: 44825 - DNA, 25 bp, Rattus norvegicus
aaggagaccctgcttttcaagatgc

SEQ ID NO: 44826 - DNA, 25 bp, Rattus norvegicus
aaggagaccctggttttcaagatgc

SEQ ID NO: 44827 - DNA, 25 bp, Rattus norvegicus
aaggagacctaacctgtcctgcaga

SEQ ID NO: 44828 - DNA, 25 bp, Rattus norvegicus
aaggagacctaagctgtcctgcaga

SEQ ID NO: 44829 - DNA, 25 bp, Rattus norvegicus
aaggagacctcaactttgcatagcc

SEQ ID NO: 44830 - DNA, 25 bp, Rattus norvegicus
aaggagacctcatctttgcatagcc

SEQ ID NO: 44831 - DNA, 25 bp, Rattus norvegicus
aaggagacctgtccccagaaggacc

SEQ ID NO: 44832 - DNA, 25 bp, Rattus norvegicus
aaggagacctgtgcccagaaggacc

SEQ ID NO: 44833 - DNA, 25 bp, Rattus norvegicus
aaggagacgctcactgtgcttctaa

SEQ ID NO: 44834 - DNA, 25 bp, Rattus norvegicus
aaggagacgctctctgtgcttctaa

SEQ ID NO: 44835 - DNA, 25 bp, Rattus norvegicus
aaggagactccacatgcaacctaga

SEQ ID NO: 44836 - DNA, 25 bp, Rattus norvegicus
aaggagactccagatgcaacctaga

SEQ ID NO: 44837 - DNA, 25 bp, Rattus norvegicus
aaggagactgacagtctcacactct

SEQ ID NO: 44838 - DNA, 25 bp, Rattus norvegicus
aaggagactgactgtctcacactct

SEQ ID NO: 44839 - DNA, 25 bp, Rattus norvegicus
aaggagactgccctgagaatattaa

SEQ ID NO: 44840 - DNA, 25 bp, Rattus norvegicus
aaggagactgccgtgagaatattaa

SEQ ID NO: 44841 - DNA, 25 bp, Rattus norvegicus
aaggagactgctctcttcagtgtga

SEQ ID NO: 44842 - DNA, 25 bp, Rattus norvegicus
aaggagactgctgtcttcagtgtga

SEQ ID NO: 44843 - DNA, 25 bp, Rattus norvegicus
aaggagactgtcatctggatgacct

SEQ ID NO: 44844 - DNA, 25 bp, Rattus norvegicus
aaggagactgtcttctggatgacct

SEQ ID NO: 44845 - DNA, 25 bp, Rattus norvegicus
aaggagagaaccaagccctctgcat

SEQ ID NO: 44846 - DNA, 25 bp, Rattus norvegicus
aaggagagaacctagccctctgcat

SEQ ID NO: 44847 - DNA, 25 bp, Rattus norvegicus
aaggagagaggaccacacctgctcc

SEQ ID NO: 44848 - DNA, 25 bp, Rattus norvegicus
aaggagagaggagcacacctgctcc

SEQ ID NO: 44849 - DNA, 25 bp, Rattus norvegicus
aaggagagatttcccagagccaaga

SEQ ID NO: 44850 - DNA, 25 bp, Rattus norvegicus
aaggagagatttgccagagccaaga

SEQ ID NO: 44851 - DNA, 25 bp, Rattus norvegicus
aaggagagcacaaagccaacccagg

SEQ ID NO: 44852 - DNA, 25 bp, Rattus norvegicus
aaggagagcacatagccaacccagg

SEQ ID NO: 44853 - DNA, 25 bp, Rattus norvegicus
aaggagagccttcagggtcttctgc

SEQ ID NO: 44854 - DNA, 25 bp, Rattus norvegicus
aaggagagccttgagggtcttctgc

SEQ ID NO: 44855 - DNA, 25 bp, Rattus norvegicus
aaggagagcggacgccacatgtcca

SEQ ID NO: 44856 - DNA, 25 bp, Rattus norvegicus
aaggagagcggaggccacatgtcca

SEQ ID NO: 44857 - DNA, 25 bp, Rattus norvegicus
aaggagagcgtgcactcttcaactc

SEQ ID NO: 44858 - DNA, 25 bp, Rattus norvegicus
aaggagagcgtggactcttcaactc

SEQ ID NO: 44859 - DNA, 25 bp, Rattus norvegicus
aaggagagctcaaaaccattcgttc

SEQ ID NO: 44860 - DNA, 25 bp, Rattus norvegicus
aaggagagctcataaccattcgttc

SEQ ID NO: 44861 - DNA, 25 bp, Rattus norvegicus
aaggagaggctacacccagcagatt

SEQ ID NO: 44862 - DNA, 25 bp, Rattus norvegicus
aaggagaggctagacccagcagatt

SEQ ID NO: 44863 - DNA, 25 bp, Rattus norvegicus
aaggagaggctcatgcactgcactc

SEQ ID NO: 44864 - DNA, 25 bp, Rattus norvegicus
aaggagaggctcttgcactgcactc

SEQ ID NO: 44865 - DNA, 25 bp, Rattus norvegicus
aaggagaggctgagtgctcacttcc

SEQ ID NO: 44866 - DNA, 25 bp, Rattus norvegicus
aaggagaggctgtgtgctcacttcc

SEQ ID NO: 44867 - DNA, 25 bp, Rattus norvegicus
aaggagagggacacgcctctagaac

SEQ ID NO: 44868 - DNA, 25 bp, Rattus norvegicus
aaggagagggactcgcctctagaac

SEQ ID NO: 44869 - DNA, 25 bp, Rattus norvegicus
aaggagagggtcacactaacagtaa

SEQ ID NO: 44870 - DNA, 25 bp, Rattus norvegicus
aaggagagggtctcactaacagtaa

SEQ ID NO: 44871 - DNA, 25 bp, Rattus norvegicus
aaggagagtaggctctctagccacc

SEQ ID NO: 44872 - DNA, 25 bp, Rattus norvegicus
aaggagagtagggtctctagccacc

SEQ ID NO: 44873 - DNA, 25 bp, Rattus norvegicus
aaggagagtgtacctgccatggcca

SEQ ID NO: 44874 - DNA, 25 bp, Rattus norvegicus
aaggagagtgtagctgccatggcca

SEQ ID NO: 44875 - DNA, 25 bp, Rattus norvegicus
aaggagatactcataatgcatttat

SEQ ID NO: 44876 - DNA, 25 bp, Rattus norvegicus
aaggagatactcttaatgcatttat

SEQ ID NO: 44877 - DNA, 25 bp, Rattus norvegicus
aaggagatatggatctgcccacgtc

SEQ ID NO: 44878 - DNA, 25 bp, Rattus norvegicus
aaggagatatggttctgcccacgtc

SEQ ID NO: 44879 - DNA, 25 bp, Rattus norvegicus
aaggagatcatgcagcaccgcttct

SEQ ID NO: 44880 - DNA, 25 bp, Rattus norvegicus
aaggagatcatggagcaccgcttct

SEQ ID NO: 44881 - DNA, 25 bp, Rattus norvegicus
aaggagatccatcagctgcaaaaca

SEQ ID NO: 44882 - DNA, 25 bp, Rattus norvegicus
aaggagatccatgagctgcaaaaca

SEQ ID NO: 44883 - DNA, 25 bp, Rattus norvegicus
aaggagatccccaactgtactagtg

SEQ ID NO: 44884 - DNA, 25 bp, Rattus norvegicus
aaggagatcccctactgtactagtg

SEQ ID NO: 44885 - DNA, 25 bp, Rattus norvegicus
aaggagatcgagacctactgcctcc

SEQ ID NO: 44886 - DNA, 25 bp, Rattus norvegicus
aaggagatcgagtcctactgcctcc

SEQ ID NO: 44887 - DNA, 25 bp, Rattus norvegicus
aaggagatcgctactgcctatgtcc

SEQ ID NO: 44888 - DNA, 25 bp, Rattus norvegicus
aaggagatcgcttctgcctatgtcc

SEQ ID NO: 44889 - DNA, 25 bp, Rattus norvegicus
aaggagatctacacgcactttacct

SEQ ID NO: 44890 - DNA, 25 bp, Rattus norvegicus
aaggagatctactcgcactttacct

SEQ ID NO: 44891 - DNA, 25 bp, Rattus norvegicus
aaggagatctcaacccgtcggccat

SEQ ID NO: 44892 - DNA, 25 bp, Rattus norvegicus
aaggagatctcatcccgtcggccat

SEQ ID NO: 44893 - DNA, 25 bp, Rattus norvegicus
aaggagatctccaagttccaggcgt

SEQ ID NO: 44894 - DNA, 25 bp, Rattus norvegicus
aaggagatctccagtcaggctccct

SEQ ID NO: 44895 - DNA, 25 bp, Rattus norvegicus
aaggagatctcctagttccaggcgt

SEQ ID NO: 44896 - DNA, 25 bp, Rattus norvegicus
aaggagatctcctgtcaggctccct

SEQ ID NO: 44897 - DNA, 25 bp, Rattus norvegicus
aaggagatctgtaggcctccacaca

SEQ ID NO: 44898 - DNA, 25 bp, Rattus norvegicus
aaggagatctgttggcctccacaca

SEQ ID NO: 44899 - DNA, 25 bp, Rattus norvegicus
aaggagatgagtccctttgtctcac

SEQ ID NO: 44900 - DNA, 25 bp, Rattus norvegicus
aaggagatgagtgcctttgtctcac

SEQ ID NO: 44901 - DNA, 25 bp, Rattus norvegicus
aaggagatgcccacatagacccttc

SEQ ID NO: 44902 - DNA, 25 bp, Rattus norvegicus
aaggagatgccctcatagacccttc

SEQ ID NO: 44903 - DNA, 25 bp, Rattus norvegicus
aaggagatgcctagctgcgtacagg

SEQ ID NO: 44904 - DNA, 25 bp, Rattus norvegicus
aaggagatgccttgctgcgtacagg

SEQ ID NO: 44905 - DNA, 25 bp, Rattus norvegicus
aaggagatgctgctactcagcggct

SEQ ID NO: 44906 - DNA, 25 bp, Rattus norvegicus
aaggagatgctggtactcagcggct

SEQ ID NO: 44907 - DNA, 25 bp, Rattus norvegicus
aaggagatggctctgtacttctgac

SEQ ID NO: 44908 - DNA, 25 bp, Rattus norvegicus
aaggagatggctgtgtacttctgac

SEQ ID NO: 44909 - DNA, 25 bp, Rattus norvegicus
aaggagatgttgaggtccctgtcct

SEQ ID NO: 44910 - DNA, 25 bp, Rattus norvegicus
aaggagatgttgtggtccctgtcct

SEQ ID NO: 44911 - DNA, 25 bp, Rattus norvegicus
aaggagatgtttcactgaccatgac

SEQ ID NO: 44912 - DNA, 25 bp, Rattus norvegicus
aaggagatgtttgactgaccatgac

SEQ ID NO: 44913 - DNA, 25 bp, Rattus norvegicus
aaggagattaacaacgcccacgcaa

SEQ ID NO: 44914 - DNA, 25 bp, Rattus norvegicus
aaggagattaactacgcccacgcaa

SEQ ID NO: 44915 - DNA, 25 bp, Rattus norvegicus
aaggagattactcccctggctccta

SEQ ID NO: 44916 - DNA, 25 bp, Rattus norvegicus
aaggagattactgccctggctccta

SEQ ID NO: 44917 - DNA, 25 bp, Rattus norvegicus
aaggagattccaatgctcttcggtt

SEQ ID NO: 44918 - DNA, 25 bp, Rattus norvegicus
aaggagattccattgctcttcggtt

SEQ ID NO: 44919 - DNA, 25 bp, Rattus norvegicus
aaggagattcgcatcaactcggagg

SEQ ID NO: 44920 - DNA, 25 bp, Rattus norvegicus
aaggagattcgcttcaactcggagg

SEQ ID NO: 44921 - DNA, 25 bp, Rattus norvegicus
aaggagatttccctcttagagtgct

SEQ ID NO: 44922 - DNA, 25 bp, Rattus norvegicus
aaggagatttccgtcttagagtgct

SEQ ID NO: 44923 - DNA, 25 bp, Rattus norvegicus
aaggagattttaatggcagtccaat

SEQ ID NO: 44924 - DNA, 25 bp, Rattus norvegicus
aaggagattttattggcagtccaat

SEQ ID NO: 44925 - DNA, 25 bp, Rattus norvegicus
aaggagattttcagtttccaataat

SEQ ID NO: 44926 - DNA, 25 bp, Rattus norvegicus
aaggagattttctgtttccaataat

SEQ ID NO: 44927 - DNA, 25 bp, Rattus norvegicus
aaggagcaagttctgtaccctcttc

SEQ ID NO: 44928 - DNA, 25 bp, Rattus norvegicus
aaggagcaagttgtgtaccctcttc

SEQ ID NO: 44929 - DNA, 25 bp, Rattus norvegicus
aaggagcacatcctagaactggtcc

SEQ ID NO: 44930 - DNA, 25 bp, Rattus norvegicus
aaggagcacatcgtagaactggtcc

SEQ ID NO: 44931 - DNA, 25 bp, Rattus norvegicus
aaggagcacattatgtatcccattt

SEQ ID NO: 44932 - DNA, 25 bp, Rattus norvegicus
aaggagcacattttgtatcccattt

SEQ ID NO: 44933 - DNA, 25 bp, Rattus norvegicus
aaggagcacctcaagtccaagctgg

SEQ ID NO: 44934 - DNA, 25 bp, Rattus norvegicus
aaggagcacctctagtccaagctgg

SEQ ID NO: 44935 - DNA, 25 bp, Rattus norvegicus
aaggagcacctgcacatcgtgaaga

SEQ ID NO: 44936 - DNA, 25 bp, Rattus norvegicus
aaggagcacctggacatcgtgaaga

SEQ ID NO: 44937 - DNA, 25 bp, Rattus norvegicus
aaggagcacgctaatgtggagtcaa

SEQ ID NO: 44938 - DNA, 25 bp, Rattus norvegicus
aaggagcacgcttatgtggagtcaa

SEQ ID NO: 44939 - DNA, 25 bp, Rattus norvegicus
aaggagcagcaaccctgagttcagg

SEQ ID NO: 44940 - DNA, 25 bp, Rattus norvegicus
aaggagcagcaagcctgagttcagg

SEQ ID NO: 44941 - DNA, 25 bp, Rattus norvegicus
aaggagcagcagcttgtctgtgccc

SEQ ID NO: 44942 - DNA, 25 bp, Rattus norvegicus
aaggagcagcaggttgtctgtgccc

SEQ ID NO: 44943 - DNA, 25 bp, Rattus norvegicus
aaggagcagcttctttttcacaaac

SEQ ID NO: 44944 - DNA, 25 bp, Rattus norvegicus
aaggagcagcttgtttttcacaaac

SEQ ID NO: 44945 - DNA, 25 bp, Rattus norvegicus
aaggagcaggaactcctcctaccta

SEQ ID NO: 44946 - DNA, 25 bp, Rattus norvegicus
aaggagcaggaagtcctcctaccta

SEQ ID NO: 44947 - DNA, 25 bp, Rattus norvegicus
aaggagcaggtcagagtttccccac

SEQ ID NO: 44948 - DNA, 25 bp, Rattus norvegicus
aaggagcaggtctgagtttccccac

SEQ ID NO: 44949 - DNA, 25 bp, Rattus norvegicus
aaggagcagtaacccggctgccaaa

SEQ ID NO: 44950 - DNA, 25 bp, Rattus norvegicus
aaggagcagtaactgcccttcactg

SEQ ID NO: 44951 - DNA, 25 bp, Rattus norvegicus
aaggagcagtaagccggctgccaaa

SEQ ID NO: 44952 - DNA, 25 bp, Rattus norvegicus
aaggagcagtaagtgcccttcactg

SEQ ID NO: 44953 - DNA, 25 bp, Rattus norvegicus
aaggagcagtcaacttgcaacttcc

SEQ ID NO: 44954 - DNA, 25 bp, Rattus norvegicus
aaggagcagtcatcttgcaacttcc

SEQ ID NO: 44955 - DNA, 25 bp, Rattus norvegicus
aaggagcagtctaaccttgctccgt

SEQ ID NO: 44956 - DNA, 25 bp, Rattus norvegicus
aaggagcagtcttaccttgctccgt

SEQ ID NO: 44957 - DNA, 25 bp, Rattus norvegicus
aaggagcagttgaggcagctgttcc

SEQ ID NO: 44958 - DNA, 25 bp, Rattus norvegicus
aaggagcagttgtggcagctgttcc

SEQ ID NO: 44959 - DNA, 25 bp, Rattus norvegicus
aaggagcagtttcacctgtctgtgt

SEQ ID NO: 44960 - DNA, 25 bp, Rattus norvegicus
aaggagcagtttgacctgtctgtgt

SEQ ID NO: 44961 - DNA, 25 bp, Rattus norvegicus
aaggagcatgatcgcggtgtccctt

SEQ ID NO: 44962 - DNA, 25 bp, Rattus norvegicus
aaggagcatgatggcggtgtccctt

SEQ ID NO: 44963 - DNA, 25 bp, Rattus norvegicus
aaggagcatgcacagtgccggccat

SEQ ID NO: 44964 - DNA, 25 bp, Rattus norvegicus
aaggagcatgcagagtgccggccat

SEQ ID NO: 44965 - DNA, 25 bp, Rattus norvegicus
aaggagcatgctactccttctccag

SEQ ID NO: 44966 - DNA, 25 bp, Rattus norvegicus
aaggagcatgcttctccttctccag

SEQ ID NO: 44967 - DNA, 25 bp, Rattus norvegicus
aaggagcatggacacccaccttcct

SEQ ID NO: 44968 - DNA, 25 bp, Rattus norvegicus
aaggagcatggagacccaccttcct

SEQ ID NO: 44969 - DNA, 25 bp, Rattus norvegicus
aaggagccaatgcttctctgtccca

SEQ ID NO: 44970 - DNA, 25 bp, Rattus norvegicus
aaggagccaatggttctctgtccca

SEQ ID NO: 44971 - DNA, 25 bp, Rattus norvegicus
aaggagccagctaagactcagccca

SEQ ID NO: 44972 - DNA, 25 bp, Rattus norvegicus
aaggagccagctaggtctgacagaa

SEQ ID NO: 44973 - DNA, 25 bp, Rattus norvegicus
aaggagccagcttagactcagccca

SEQ ID NO: 44974 - DNA, 25 bp, Rattus norvegicus
aaggagccagcttggtctgacagaa

SEQ ID NO: 44975 - DNA, 25 bp, Rattus norvegicus
aaggagccagtcacagatgtccagt

SEQ ID NO: 44976 - DNA, 25 bp, Rattus norvegicus
aaggagccagtctcagatgtccagt

SEQ ID NO: 44977 - DNA, 25 bp, Rattus norvegicus
aaggagccagttcgtcctcattagc

SEQ ID NO: 44978 - DNA, 25 bp, Rattus norvegicus
aaggagccagttggtcctcattagc

SEQ ID NO: 44979 - DNA, 25 bp, Rattus norvegicus
aaggagccatctccccaagattgaa

SEQ ID NO: 44980 - DNA, 25 bp, Rattus norvegicus
aaggagccatctgcccaagattgaa

SEQ ID NO: 44981 - DNA, 25 bp, Rattus norvegicus
aaggagcccaagagccaggatatct

SEQ ID NO: 44982 - DNA, 25 bp, Rattus norvegicus
aaggagcccaagtgccaggatatct

SEQ ID NO: 44983 - DNA, 25 bp, Rattus norvegicus
aaggagcccacacggttcactctta

SEQ ID NO: 44984 - DNA, 25 bp, Rattus norvegicus
aaggagcccacagggttcactctta

SEQ ID NO: 44985 - DNA, 25 bp, Rattus norvegicus
aaggagccccatctgcagcagatca

SEQ ID NO: 44986 - DNA, 25 bp, Rattus norvegicus
aaggagccccatgtgcagcagatca

SEQ ID NO: 44987 - DNA, 25 bp, Rattus norvegicus
aaggagccctaaactgctgtagaca

SEQ ID NO: 44988 - DNA, 25 bp, Rattus norvegicus
aaggagccctaatctgctgtagaca

SEQ ID NO: 44989 - DNA, 25 bp, Rattus norvegicus
aaggagccctataaggttctcccag

SEQ ID NO: 44990 - DNA, 25 bp, Rattus norvegicus
aaggagccctattaggttctcccag

SEQ ID NO: 44991 - DNA, 25 bp, Rattus norvegicus
aaggagcccttccagtgttctcttg

SEQ ID NO: 44992 - DNA, 25 bp, Rattus norvegicus
aaggagcccttcgagtgttctcttg

SEQ ID NO: 44993 - DNA, 25 bp, Rattus norvegicus
aaggagccctttaatgttagcagga

SEQ ID NO: 44994 - DNA, 25 bp, Rattus norvegicus
aaggagcccttttatgttagcagga

SEQ ID NO: 44995 - DNA, 25 bp, Rattus norvegicus
aaggagccgatgacgcagcagacgc

SEQ ID NO: 44996 - DNA, 25 bp, Rattus norvegicus
aaggagccgatgtcgcagcagacgc

SEQ ID NO: 44997 - DNA, 25 bp, Rattus norvegicus
aaggagccgccaaggtcaggactgc

SEQ ID NO: 44998 - DNA, 25 bp, Rattus norvegicus
aaggagccgccatggtcaggactgc

SEQ ID NO: 44999 - DNA, 25 bp, Rattus norvegicus
aaggagccgtgaaacttgacctctg

SEQ ID NO: 45000 - DNA, 25 bp, Rattus norvegicus
aaggagccgtgatacttgacctctg

SEQ ID NO: 45001 - DNA, 25 bp, Rattus norvegicus
aaggagcctacaatcaaggtcatcc

SEQ ID NO: 45002 - DNA, 25 bp, Rattus norvegicus
aaggagcctacattcaaggtcatcc

SEQ ID NO: 45003 - DNA, 25 bp, Rattus norvegicus
aaggagcctcatcgcagccacagtg

SEQ ID NO: 45004 - DNA, 25 bp, Rattus norvegicus
aaggagcctcatggcagccacagtg

SEQ ID NO: 45005 - DNA, 25 bp, Rattus norvegicus
aaggagcctccaatgtagaaccata

SEQ ID NO: 45006 - DNA, 25 bp, Rattus norvegicus
aaggagcctccattgtagaaccata

SEQ ID NO: 45007 - DNA, 25 bp, Rattus norvegicus
aaggagcctctgaccgatgggacaa

SEQ ID NO: 45008 - DNA, 25 bp, Rattus norvegicus
aaggagcctctgtccgatgggacaa

SEQ ID NO: 45009 - DNA, 25 bp, Rattus norvegicus
aaggagcctgacaagagacccctct

SEQ ID NO: 45010 - DNA, 25 bp, Rattus norvegicus
aaggagcctgactagagacccctct

SEQ ID NO: 45011 - DNA, 25 bp, Rattus norvegicus
aaggagcctgagcacatggcagccc

SEQ ID NO: 45012 - DNA, 25 bp, Rattus norvegicus
aaggagcctgaggacatggcagccc

SEQ ID NO: 45013 - DNA, 25 bp, Rattus norvegicus
aaggagcgcaaaagccaggcaccag

SEQ ID NO: 45014 - DNA, 25 bp, Rattus norvegicus
aaggagcgcaaatgccaggcaccag

SEQ ID NO: 45015 - DNA, 25 bp, Rattus norvegicus
aaggagcgcacgcagttcctgcaga

SEQ ID NO: 45016 - DNA, 25 bp, Rattus norvegicus
aaggagcgcacggagttcctgcaga

SEQ ID NO: 45017 - DNA, 25 bp, Rattus norvegicus
aaggagcgcctgctagagtattccc

SEQ ID NO: 45018 - DNA, 25 bp, Rattus norvegicus
aaggagcgcctggtagagtattccc

SEQ ID NO: 45019 - DNA, 25 bp, Rattus norvegicus
aaggagcgccttctgatccgggctc

SEQ ID NO: 45020 - DNA, 25 bp, Rattus norvegicus
aaggagcgccttgtgatccgggctc

SEQ ID NO: 45021 - DNA, 25 bp, Rattus norvegicus
aaggagcgctccaagctcccaaagg

SEQ ID NO: 45022 - DNA, 25 bp, Rattus norvegicus
aaggagcgctcctagctcccaaagg

SEQ ID NO: 45023 - DNA, 25 bp, Rattus norvegicus
aaggagcggctccacgtacatggaa

SEQ ID NO: 45024 - DNA, 25 bp, Rattus norvegicus
aaggagcggctcgacgtacatggaa

SEQ ID NO: 45025 - DNA, 25 bp, Rattus norvegicus
aaggagctcattatcttgccaaaag

SEQ ID NO: 45026 - DNA, 25 bp, Rattus norvegicus
aaggagctcattttcttgccaaaag

SEQ ID NO: 45027 - DNA, 25 bp, Rattus norvegicus
aaggagctccagaggcgttaccttt

SEQ ID NO: 45028 - DNA, 25 bp, Rattus norvegicus
aaggagctccagtggcgttaccttt

SEQ ID NO: 45029 - DNA, 25 bp, Rattus norvegicus
aaggagctcctgacttcgttacctg

SEQ ID NO: 45030 - DNA, 25 bp, Rattus norvegicus
aaggagctcctgtcttcgttacctg

SEQ ID NO: 45031 - DNA, 25 bp, Rattus norvegicus
aaggagctcgctcccaaacataatg

SEQ ID NO: 45032 - DNA, 25 bp, Rattus norvegicus
aaggagctcgctgccaaacataatg

SEQ ID NO: 45033 - DNA, 25 bp, Rattus norvegicus
aaggagctcgtgactgaagggtata

SEQ ID NO: 45034 - DNA, 25 bp, Rattus norvegicus
aaggagctcgtgtctgaagggtata

SEQ ID NO: 45035 - DNA, 25 bp, Rattus norvegicus
aaggagctctatcagggtttatatt

SEQ ID NO: 45036 - DNA, 25 bp, Rattus norvegicus
aaggagctctatgagggtttatatt

SEQ ID NO: 45037 - DNA, 25 bp, Rattus norvegicus
aaggagctctccatggtgcggattc

SEQ ID NO: 45038 - DNA, 25 bp, Rattus norvegicus
aaggagctctccttggtgcggattc

SEQ ID NO: 45039 - DNA, 25 bp, Rattus norvegicus
aaggagctctgtacattatctacta

SEQ ID NO: 45040 - DNA, 25 bp, Rattus norvegicus
aaggagctctgtcctatggcaccgg

SEQ ID NO: 45041 - DNA, 25 bp, Rattus norvegicus
aaggagctctgtgctatggcaccgg

SEQ ID NO: 45042 - DNA, 25 bp, Rattus norvegicus
aaggagctctgttcattatctacta

SEQ ID NO: 45043 - DNA, 25 bp, Rattus norvegicus
aaggagctgaagatcgccaagtcgc

SEQ ID NO: 45044 - DNA, 25 bp, Rattus norvegicus
aaggagctgaagttcgccaagtcgc

SEQ ID NO: 45045 - DNA, 25 bp, Rattus norvegicus
aaggagctgagtatgcgctacccaa

SEQ ID NO: 45046 - DNA, 25 bp, Rattus norvegicus
aaggagctgagtttgcgctacccaa

SEQ ID NO: 45047 - DNA, 25 bp, Rattus norvegicus
aaggagctgatcacaggtcacggct

SEQ ID NO: 45048 - DNA, 25 bp, Rattus norvegicus
aaggagctgatctcaggtcacggct

SEQ ID NO: 45049 - DNA, 25 bp, Rattus norvegicus
aaggagctgcttaatctccgatacc

SEQ ID NO: 45050 - DNA, 25 bp, Rattus norvegicus
aaggagctgcttatctatcgcaaag

SEQ ID NO: 45051 - DNA, 25 bp, Rattus norvegicus
aaggagctgctttatctccgatacc

SEQ ID NO: 45052 - DNA, 25 bp, Rattus norvegicus
aaggagctgcttttctatcgcaaag

SEQ ID NO: 45053 - DNA, 25 bp, Rattus norvegicus
aaggagctgggcagcatcaactcgc

SEQ ID NO: 45054 - DNA, 25 bp, Rattus norvegicus
aaggagctgggcagctctgtgttca

SEQ ID NO: 45055 - DNA, 25 bp, Rattus norvegicus
aaggagctgggctgcatcaactcgc

SEQ ID NO: 45056 - DNA, 25 bp, Rattus norvegicus
aaggagctgggctgctctgtgttca

SEQ ID NO: 45057 - DNA, 25 bp, Rattus norvegicus
aaggagctgtaaccacgcactgagt

SEQ ID NO: 45058 - DNA, 25 bp, Rattus norvegicus
aaggagctgtaagcacgcactgagt

SEQ ID NO: 45059 - DNA, 25 bp, Rattus norvegicus
aaggagctgtcacactttctccgag

SEQ ID NO: 45060 - DNA, 25 bp, Rattus norvegicus
aaggagctgtcagactttctccgag

SEQ ID NO: 45061 - DNA, 25 bp, Rattus norvegicus
aaggagctgttgacattctggatgc

SEQ ID NO: 45062 - DNA, 25 bp, Rattus norvegicus
aaggagctgttgactttatgtagac

SEQ ID NO: 45063 - DNA, 25 bp, Rattus norvegicus
aaggagctgttgtcattctggatgc

SEQ ID NO: 45064 - DNA, 25 bp, Rattus norvegicus
aaggagctgttgtctttatgtagac

SEQ ID NO: 45065 - DNA, 25 bp, Rattus norvegicus
aaggagcttcacattgagggttgga

SEQ ID NO: 45066 - DNA, 25 bp, Rattus norvegicus
aaggagcttcactttgagggttgga

SEQ ID NO: 45067 - DNA, 25 bp, Rattus norvegicus
aaggagcttctgatccacagtatcc

SEQ ID NO: 45068 - DNA, 25 bp, Rattus norvegicus
aaggagcttctgttccacagtatcc

SEQ ID NO: 45069 - DNA, 25 bp, Rattus norvegicus
aaggagcttgagatccacacggata

SEQ ID NO: 45070 - DNA, 25 bp, Rattus norvegicus
aaggagcttgagttccacacggata

SEQ ID NO: 45071 - DNA, 25 bp, Rattus norvegicus
aaggagctttgccaggccaacccgg

SEQ ID NO: 45072 - DNA, 25 bp, Rattus norvegicus
aaggagctttgcgaggccaacccgg

SEQ ID NO: 45073 - DNA, 25 bp, Rattus norvegicus
aaggaggaacatagccccttcatct

SEQ ID NO: 45074 - DNA, 25 bp, Rattus norvegicus
aaggaggaacattgccccttcatct

SEQ ID NO: 45075 - DNA, 25 bp, Rattus norvegicus
aaggaggaacttatcactgcacagg

SEQ ID NO: 45076 - DNA, 25 bp, Rattus norvegicus
aaggaggaacttttcactgcacagg

SEQ ID NO: 45077 - DNA, 25 bp, Rattus norvegicus
aaggaggaagctcactcgctcgaga

SEQ ID NO: 45078 - DNA, 25 bp, Rattus norvegicus
aaggaggaagctgactcgctcgaga

SEQ ID NO: 45079 - DNA, 25 bp, Rattus norvegicus
aaggaggaaggaccttgattccagg

SEQ ID NO: 45080 - DNA, 25 bp, Rattus norvegicus
aaggaggaaggagcttgattccagg

SEQ ID NO: 45081 - DNA, 25 bp, Rattus norvegicus
aaggaggaccagacaccacgtcact

SEQ ID NO: 45082 - DNA, 25 bp, Rattus norvegicus
aaggaggaccagtcaccacgtcact

SEQ ID NO: 45083 - DNA, 25 bp, Rattus norvegicus
aaggaggacctgcttcttcactggg

SEQ ID NO: 45084 - DNA, 25 bp, Rattus norvegicus
aaggaggacctggttcttcactggg

SEQ ID NO: 45085 - DNA, 25 bp, Rattus norvegicus
aaggaggacttccatgtggaccatt

SEQ ID NO: 45086 - DNA, 25 bp, Rattus norvegicus
aaggaggacttcgatgtggaccatt

SEQ ID NO: 45087 - DNA, 25 bp, Rattus norvegicus
aaggaggacttgagctggcttgtct

SEQ ID NO: 45088 - DNA, 25 bp, Rattus norvegicus
aaggaggacttgtgctggcttgtct

SEQ ID NO: 45089 - DNA, 25 bp, Rattus norvegicus
aaggaggagccccatctgtcactgt

SEQ ID NO: 45090 - DNA, 25 bp, Rattus norvegicus
aaggaggagcccgatctgtcactgt

SEQ ID NO: 45091 - DNA, 25 bp, Rattus norvegicus
aaggaggagtccattgggcccatca

SEQ ID NO: 45092 - DNA, 25 bp, Rattus norvegicus
aaggaggagtcctttgggcccatca

SEQ ID NO: 45093 - DNA, 25 bp, Rattus norvegicus
aaggaggagtctacacccctgctct

SEQ ID NO: 45094 - DNA, 25 bp, Rattus norvegicus
aaggaggagtcttcacccctgctct

SEQ ID NO: 45095 - DNA, 25 bp, Rattus norvegicus
aaggaggagttccaccaggacttgt

SEQ ID NO: 45096 - DNA, 25 bp, Rattus norvegicus
aaggaggagttcgaccaggacttgt

SEQ ID NO: 45097 - DNA, 25 bp, Rattus norvegicus
aaggaggattccagtctgcaggcca

SEQ ID NO: 45098 - DNA, 25 bp, Rattus norvegicus
aaggaggattcctgtctgcaggcca

SEQ ID NO: 45099 - DNA, 25 bp, Rattus norvegicus
aaggaggcagacatctggtccatgt

SEQ ID NO: 45100 - DNA, 25 bp, Rattus norvegicus
aaggaggcagacttctggtccatgt

SEQ ID NO: 45101 - DNA, 25 bp, Rattus norvegicus
aaggaggcagatcaccctgtcctgt

SEQ ID NO: 45102 - DNA, 25 bp, Rattus norvegicus
aaggaggcagatgaccctgtcctgt

SEQ ID NO: 45103 - DNA, 25 bp, Rattus norvegicus
aaggaggcagcgactgttcttggca

SEQ ID NO: 45104 - DNA, 25 bp, Rattus norvegicus
aaggaggcagcgtctgttcttggca

SEQ ID NO: 45105 - DNA, 25 bp, Rattus norvegicus
aaggaggcagtgatcttccagtcac

SEQ ID NO: 45106 - DNA, 25 bp, Rattus norvegicus
aaggaggcagtgttcttccagtcac

SEQ ID NO: 45107 - DNA, 25 bp, Rattus norvegicus
aaggaggcatcccagatacacccag

SEQ ID NO: 45108 - DNA, 25 bp, Rattus norvegicus
aaggaggcatccgagatacacccag

SEQ ID NO: 45109 - DNA, 25 bp, Rattus norvegicus
aaggaggccatcaagtcttcactca

SEQ ID NO: 45110 - DNA, 25 bp, Rattus norvegicus
aaggaggccatccagggcacctaca

SEQ ID NO: 45111 - DNA, 25 bp, Rattus norvegicus
aaggaggccatcgagggcacctaca

SEQ ID NO: 45112 - DNA, 25 bp, Rattus norvegicus
aaggaggccatctagtcttcactca

SEQ ID NO: 45113 - DNA, 25 bp, Rattus norvegicus
aaggaggcccagagttctcaagcca

SEQ ID NO: 45114 - DNA, 25 bp, Rattus norvegicus
aaggaggcccagtgttctcaagcca

SEQ ID NO: 45115 - DNA, 25 bp, Rattus norvegicus
aaggaggccctgagaagtctgcgat

SEQ ID NO: 45116 - DNA, 25 bp, Rattus norvegicus
aaggaggccctgtgaagtctgcgat

SEQ ID NO: 45117 - DNA, 25 bp, Rattus norvegicus
aaggaggcccttctgttccagagga

SEQ ID NO: 45118 - DNA, 25 bp, Rattus norvegicus
aaggaggcccttgtgttccagagga

SEQ ID NO: 45119 - DNA, 25 bp, Rattus norvegicus
aaggaggcctagaactcactacaca

SEQ ID NO: 45120 - DNA, 25 bp, Rattus norvegicus
aaggaggcctagtactcactacaca

SEQ ID NO: 45121 - DNA, 25 bp, Rattus norvegicus
aaggaggccttaccctagcacatct

SEQ ID NO: 45122 - DNA, 25 bp, Rattus norvegicus
aaggaggccttagcctagcacatct

SEQ ID NO: 45123 - DNA, 25 bp, Rattus norvegicus
aaggaggctagacgtggacttacac

SEQ ID NO: 45124 - DNA, 25 bp, Rattus norvegicus
aaggaggctagaggtggacttacac

SEQ ID NO: 45125 - DNA, 25 bp, Rattus norvegicus
aaggaggctctgaacaagtgctgga

SEQ ID NO: 45126 - DNA, 25 bp, Rattus norvegicus
aaggaggctctgtacaagtgctgga

SEQ ID NO: 45127 - DNA, 25 bp, Rattus norvegicus
aaggaggctcttatctctcagctga

SEQ ID NO: 45128 - DNA, 25 bp, Rattus norvegicus
aaggaggctcttttctctcagctga

SEQ ID NO: 45129 - DNA, 25 bp, Rattus norvegicus
aaggaggctgctctccttaggacta

SEQ ID NO: 45130 - DNA, 25 bp, Rattus norvegicus
aaggaggctgctgtccttaggacta

SEQ ID NO: 45131 - DNA, 25 bp, Rattus norvegicus
aaggaggctggacttgcattcttcc

SEQ ID NO: 45132 - DNA, 25 bp, Rattus norvegicus
aaggaggctggagttgcattcttcc

SEQ ID NO: 45133 - DNA, 25 bp, Rattus norvegicus
aaggaggctggccagatctgaatct

SEQ ID NO: 45134 - DNA, 25 bp, Rattus norvegicus
aaggaggctggcgagatctgaatct

SEQ ID NO: 45135 - DNA, 25 bp, Rattus norvegicus
aaggaggctgttagctcagtgctga

SEQ ID NO: 45136 - DNA, 25 bp, Rattus norvegicus
aaggaggctgtttgctcagtgctga

SEQ ID NO: 45137 - DNA, 25 bp, Rattus norvegicus
aaggagggaaccactgtctgagtct

SEQ ID NO: 45138 - DNA, 25 bp, Rattus norvegicus
aaggagggaacctctgtctgagtct

SEQ ID NO: 45139 - DNA, 25 bp, Rattus norvegicus
aaggagggaggcacagttctcacaa

SEQ ID NO: 45140 - DNA, 25 bp, Rattus norvegicus
aaggagggaggctcagttctcacaa

SEQ ID NO: 45141 - DNA, 25 bp, Rattus norvegicus
aaggagggatcacgccagccacccc

SEQ ID NO: 45142 - DNA, 25 bp, Rattus norvegicus
aaggagggatcaggccagccacccc

SEQ ID NO: 45143 - DNA, 25 bp, Rattus norvegicus
aaggagggatgtctgcagtctgagc

SEQ ID NO: 45144 - DNA, 25 bp, Rattus norvegicus
aaggagggatgtgtgcagtctgagc

SEQ ID NO: 45145 - DNA, 25 bp, Rattus norvegicus
aaggagggcagactctccctgaaac

SEQ ID NO: 45146 - DNA, 25 bp, Rattus norvegicus
aaggagggcagagtctccctgaaac

SEQ ID NO: 45147 - DNA, 25 bp, Rattus norvegicus
aaggagggcatccatcggaccgtca

SEQ ID NO: 45148 - DNA, 25 bp, Rattus norvegicus
aaggagggcatcgatcggaccgtca

SEQ ID NO: 45149 - DNA, 25 bp, Rattus norvegicus
aaggagggcattcctcccaggactt

SEQ ID NO: 45150 - DNA, 25 bp, Rattus norvegicus
aaggagggcattgctcccaggactt

SEQ ID NO: 45151 - DNA, 25 bp, Rattus norvegicus
aaggagggccacacagtgcttacca

SEQ ID NO: 45152 - DNA, 25 bp, Rattus norvegicus
aaggagggccacatctctgaggacc

SEQ ID NO: 45153 - DNA, 25 bp, Rattus norvegicus
aaggagggccactcagtgcttacca

SEQ ID NO: 45154 - DNA, 25 bp, Rattus norvegicus
aaggagggccacttctctgaggacc

SEQ ID NO: 45155 - DNA, 25 bp, Rattus norvegicus
aaggaggtagccactgccatccgag

SEQ ID NO: 45156 - DNA, 25 bp, Rattus norvegicus
aaggaggtagcctctgccatccgag

SEQ ID NO: 45157 - DNA, 25 bp, Rattus norvegicus
aaggaggtcactcagaaggtcactc

SEQ ID NO: 45158 - DNA, 25 bp, Rattus norvegicus
aaggaggtcactgagaaggtcactc

SEQ ID NO: 45159 - DNA, 25 bp, Rattus norvegicus
aaggaggtctttcgcttcctcaagc

SEQ ID NO: 45160 - DNA, 25 bp, Rattus norvegicus
aaggaggtctttggcttcctcaagc

SEQ ID NO: 45161 - DNA, 25 bp, Rattus norvegicus
aaggaggtgccactggtccacacag

SEQ ID NO: 45162 - DNA, 25 bp, Rattus norvegicus
aaggaggtgccagtggtccacacag

SEQ ID NO: 45163 - DNA, 25 bp, Rattus norvegicus
aaggaggtgcctcccttgctatgtg

SEQ ID NO: 45164 - DNA, 25 bp, Rattus norvegicus
aaggaggtgcctgccttgctatgtg

SEQ ID NO: 45165 - DNA, 25 bp, Rattus norvegicus
aaggaggtggtaccaatcccttcca

SEQ ID NO: 45166 - DNA, 25 bp, Rattus norvegicus
aaggaggtggtagcaatcccttcca

SEQ ID NO: 45167 - DNA, 25 bp, Rattus norvegicus
aaggaggttcccacgggacactgca

SEQ ID NO: 45168 - DNA, 25 bp, Rattus norvegicus
aaggaggttccctcgggacactgca

SEQ ID NO: 45169 - DNA, 25 bp, Rattus norvegicus
aaggagtacattcttccacacccag

SEQ ID NO: 45170 - DNA, 25 bp, Rattus norvegicus
aaggagtacattgttccacacccag

SEQ ID NO: 45171 - DNA, 25 bp, Rattus norvegicus
aaggagtacgccatgctgcataacc

SEQ ID NO: 45172 - DNA, 25 bp, Rattus norvegicus
aaggagtacgccttgctgcataacc

SEQ ID NO: 45173 - DNA, 25 bp, Rattus norvegicus
aaggagtactcccatcgaagctctc

SEQ ID NO: 45174 - DNA, 25 bp, Rattus norvegicus
aaggagtactccgatcgaagctctc

SEQ ID NO: 45175 - DNA, 25 bp, Rattus norvegicus
aaggagtactctctgttcctgacca

SEQ ID NO: 45176 - DNA, 25 bp, Rattus norvegicus
aaggagtactctgtgttcctgacca

SEQ ID NO: 45177 - DNA, 25 bp, Rattus norvegicus
aaggagtagccaatgctcactctag

SEQ ID NO: 45178 - DNA, 25 bp, Rattus norvegicus
aaggagtagccattgctcactctag

SEQ ID NO: 45179 - DNA, 25 bp, Rattus norvegicus
aaggagtagctactacctcatcctc

SEQ ID NO: 45180 - DNA, 25 bp, Rattus norvegicus
aaggagtagctagtacctcatcctc

SEQ ID NO: 45181 - DNA, 25 bp, Rattus norvegicus
aaggagtaggagctcgcttgcctct

SEQ ID NO: 45182 - DNA, 25 bp, Rattus norvegicus
aaggagtaggaggtcgcttgcctct

SEQ ID NO: 45183 - DNA, 25 bp, Rattus norvegicus
aaggagtatcttctgctcaccctga

SEQ ID NO: 45184 - DNA, 25 bp, Rattus norvegicus
aaggagtatcttgtgctcaccctga

SEQ ID NO: 45185 - DNA, 25 bp, Rattus norvegicus
aaggagtattccactgcctggcctg

SEQ ID NO: 45186 - DNA, 25 bp, Rattus norvegicus
aaggagtattcctctgcctggcctg

SEQ ID NO: 45187 - DNA, 25 bp, Rattus norvegicus
aaggagtcacaacagcttgtctcat

SEQ ID NO: 45188 - DNA, 25 bp, Rattus norvegicus
aaggagtcacaagagcttgtctcat

SEQ ID NO: 45189 - DNA, 25 bp, Rattus norvegicus
aaggagtcagccatcgaacgggaga

SEQ ID NO: 45190 - DNA, 25 bp, Rattus norvegicus
aaggagtcagccttcgaacgggaga

SEQ ID NO: 45191 - DNA, 25 bp, Rattus norvegicus
aaggagtcagtgacgctactacgga

SEQ ID NO: 45192 - DNA, 25 bp, Rattus norvegicus
aaggagtcagtgtcgctactacgga

SEQ ID NO: 45193 - DNA, 25 bp, Rattus norvegicus
aaggagtcatccctgttcttccctg

SEQ ID NO: 45194 - DNA, 25 bp, Rattus norvegicus
aaggagtcatccgtgttcttccctg

SEQ ID NO: 45195 - DNA, 25 bp, Rattus norvegicus
aaggagtccctgaggacgcctccag

SEQ ID NO: 45196 - DNA, 25 bp, Rattus norvegicus
aaggagtccctgtggacgcctccag

SEQ ID NO: 45197 - DNA, 25 bp, Rattus norvegicus
aaggagtcctgtagagcaggcctcc

SEQ ID NO: 45198 - DNA, 25 bp, Rattus norvegicus
aaggagtcctgttgagcaggcctcc

SEQ ID NO: 45199 - DNA, 25 bp, Rattus norvegicus
aaggagtccttcagcattcttatgg

SEQ ID NO: 45200 - DNA, 25 bp, Rattus norvegicus
aaggagtccttctgcattcttatgg

SEQ ID NO: 45201 - DNA, 25 bp, Rattus norvegicus
aaggagtcgcagctcatctctgacg

SEQ ID NO: 45202 - DNA, 25 bp, Rattus norvegicus
aaggagtcgcaggtcatctctgacg

SEQ ID NO: 45203 - DNA, 25 bp, Rattus norvegicus
aaggagtcgctcacatatgccagca

SEQ ID NO: 45204 - DNA, 25 bp, Rattus norvegicus
aaggagtcgctctcatatgccagca

SEQ ID NO: 45205 - DNA, 25 bp, Rattus norvegicus
aaggagtctaccctagataactagg

SEQ ID NO: 45206 - DNA, 25 bp, Rattus norvegicus
aaggagtctaccgtagataactagg

SEQ ID NO: 45207 - DNA, 25 bp, Rattus norvegicus
aaggagtctctcagttcagtgtcaa

SEQ ID NO: 45208 - DNA, 25 bp, Rattus norvegicus
aaggagtctctctgttcagtgtcaa

SEQ ID NO: 45209 - DNA, 25 bp, Rattus norvegicus
aaggagtctgtgagagcgcactgcc

SEQ ID NO: 45210 - DNA, 25 bp, Rattus norvegicus
aaggagtctgtgtgagcgcactgcc

SEQ ID NO: 45211 - DNA, 25 bp, Rattus norvegicus
aaggagtctgttaattctctgaagc

SEQ ID NO: 45212 - DNA, 25 bp, Rattus norvegicus
aaggagtctgtttattctctgaagc

SEQ ID NO: 45213 - DNA, 25 bp, Rattus norvegicus
aaggagtcttctactgagcgtcacg

SEQ ID NO: 45214 - DNA, 25 bp, Rattus norvegicus
aaggagtcttcttctgagcgtcacg

SEQ ID NO: 45215 - DNA, 25 bp, Rattus norvegicus
aaggagtgacctattccaacatcca

SEQ ID NO: 45216 - DNA, 25 bp, Rattus norvegicus
aaggagtgaccttttccaacatcca

SEQ ID NO: 45217 - DNA, 25 bp, Rattus norvegicus
aaggagtgcacccttatcctgccca

SEQ ID NO: 45218 - DNA, 25 bp, Rattus norvegicus
aaggagtgcaccgttatcctgccca

SEQ ID NO: 45219 - DNA, 25 bp, Rattus norvegicus
aaggagtgcactccatcatgtccct

SEQ ID NO: 45220 - DNA, 25 bp, Rattus norvegicus
aaggagtgcactgcatcatgtccct

SEQ ID NO: 45221 - DNA, 25 bp, Rattus norvegicus
aaggagtgcatcagagcttcctcag

SEQ ID NO: 45222 - DNA, 25 bp, Rattus norvegicus
aaggagtgcatctgagcttcctcag

SEQ ID NO: 45223 - DNA, 25 bp, Rattus norvegicus
aaggagtgccctctgcatgtatctt

SEQ ID NO: 45224 - DNA, 25 bp, Rattus norvegicus
aaggagtgccctgtgcatgtatctt

SEQ ID NO: 45225 - DNA, 25 bp, Rattus norvegicus
aaggagtgcctcagatgatccggtc

SEQ ID NO: 45226 - DNA, 25 bp, Rattus norvegicus
aaggagtgcctctgatgatccggtc

SEQ ID NO: 45227 - DNA, 25 bp, Rattus norvegicus
aaggagtgctcaccagtgctgcgtt

SEQ ID NO: 45228 - DNA, 25 bp, Rattus norvegicus
aaggagtgctcagcagtgctgcgtt

SEQ ID NO: 45229 - DNA, 25 bp, Rattus norvegicus
aaggagtgcttcctacaggatccct

SEQ ID NO: 45230 - DNA, 25 bp, Rattus norvegicus
aaggagtgcttcgtacaggatccct

SEQ ID NO: 45231 - DNA, 25 bp, Rattus norvegicus
aaggagtgtcccattacaggctctt

SEQ ID NO: 45232 - DNA, 25 bp, Rattus norvegicus
aaggagtgtccctttacaggctctt

SEQ ID NO: 45233 - DNA, 25 bp, Rattus norvegicus
aaggagtgtctcacttcaaccgctg

SEQ ID NO: 45234 - DNA, 25 bp, Rattus norvegicus
aaggagtgtctctcttcaaccgctg

SEQ ID NO: 45235 - DNA, 25 bp, Rattus norvegicus
aaggagtgtgagctgccatagacaa

SEQ ID NO: 45236 - DNA, 25 bp, Rattus norvegicus
aaggagtgtgaggtgccatagacaa

SEQ ID NO: 45237 - DNA, 25 bp, Rattus norvegicus
aaggagtgtgcacacttgtggccca

SEQ ID NO: 45238 - DNA, 25 bp, Rattus norvegicus
aaggagtgtgcagacttgtggccca

SEQ ID NO: 45239 - DNA, 25 bp, Rattus norvegicus
aaggagtgttgtacccatggaggct

SEQ ID NO: 45240 - DNA, 25 bp, Rattus norvegicus
aaggagtgttgttcccatggaggct

SEQ ID NO: 45241 - DNA, 25 bp, Rattus norvegicus
aaggagtgttttcgctgtgtcgaaa

SEQ ID NO: 45242 - DNA, 25 bp, Rattus norvegicus
aaggagtgttttggctgtgtcgaaa

SEQ ID NO: 45243 - DNA, 25 bp, Rattus norvegicus
aaggagttcagcacacttcatatta

SEQ ID NO: 45244 - DNA, 25 bp, Rattus norvegicus
aaggagttcagctcacttcatatta

SEQ ID NO: 45245 - DNA, 25 bp, Rattus norvegicus
aaggagttctacactctcagacaga

SEQ ID NO: 45246 - DNA, 25 bp, Rattus norvegicus
aaggagttctactctctcagacaga

SEQ ID NO: 45247 - DNA, 25 bp, Rattus norvegicus
aaggagttctcccagtgcacggtca

SEQ ID NO: 45248 - DNA, 25 bp, Rattus norvegicus
aaggagttctccgagtgcacggtca

SEQ ID NO: 45249 - DNA, 25 bp, Rattus norvegicus
aaggagttctgacagctcatagctg

SEQ ID NO: 45250 - DNA, 25 bp, Rattus norvegicus
aaggagttctgagagctcatagctg

SEQ ID NO: 45251 - DNA, 25 bp, Rattus norvegicus
aaggagttgagtaccagcaagctgg

SEQ ID NO: 45252 - DNA, 25 bp, Rattus norvegicus
aaggagttgagtcctcctccctgtg

SEQ ID NO: 45253 - DNA, 25 bp, Rattus norvegicus
aaggagttgagtgctcctccctgtg

SEQ ID NO: 45254 - DNA, 25 bp, Rattus norvegicus
aaggagttgagttccagcaagctgg

SEQ ID NO: 45255 - DNA, 25 bp, Rattus norvegicus
aaggagttgcgcatccacaaggaga

SEQ ID NO: 45256 - DNA, 25 bp, Rattus norvegicus
aaggagttgcgcttccacaaggaga

SEQ ID NO: 45257 - DNA, 25 bp, Rattus norvegicus
aaggagttgctccagacttccgtgc

SEQ ID NO: 45258 - DNA, 25 bp, Rattus norvegicus
aaggagttgctcgagacttccgtgc

SEQ ID NO: 45259 - DNA, 25 bp, Rattus norvegicus
aaggagttggacagaggccgacact

SEQ ID NO: 45260 - DNA, 25 bp, Rattus norvegicus
aaggagttggactgaggccgacact

SEQ ID NO: 45261 - DNA, 25 bp, Rattus norvegicus
aaggagttggctcccatctcccagg

SEQ ID NO: 45262 - DNA, 25 bp, Rattus norvegicus
aaggagttggctgccatctcccagg

SEQ ID NO: 45263 - DNA, 25 bp, Rattus norvegicus
aaggagttgggcacgtcctgcaaga

SEQ ID NO: 45264 - DNA, 25 bp, Rattus norvegicus
aaggagttgggctcgtcctgcaaga

SEQ ID NO: 45265 - DNA, 25 bp, Rattus norvegicus
aaggagttgttcagcctctcaaggc

SEQ ID NO: 45266 - DNA, 25 bp, Rattus norvegicus
aaggagttgttctgcctctcaaggc

SEQ ID NO: 45267 - DNA, 25 bp, Rattus norvegicus
aaggagtttcacaacagtcggtaca

SEQ ID NO: 45268 - DNA, 25 bp, Rattus norvegicus
aaggagtttcactacagtcggtaca

SEQ ID NO: 45269 - DNA, 25 bp, Rattus norvegicus
aaggagtttgtccaacttgtctgcc

SEQ ID NO: 45270 - DNA, 25 bp, Rattus norvegicus
aaggagtttgtcgaacttgtctgcc

SEQ ID NO: 45271 - DNA, 25 bp, Rattus norvegicus
aaggataacctgactttgggaatca

SEQ ID NO: 45272 - DNA, 25 bp, Rattus norvegicus
aaggataacctgctcaatgcctgga

SEQ ID NO: 45273 - DNA, 25 bp, Rattus norvegicus
aaggataacctggtcaatgcctgga

SEQ ID NO: 45274 - DNA, 25 bp, Rattus norvegicus
aaggataacctgtctttgggaatca

SEQ ID NO: 45275 - DNA, 25 bp, Rattus norvegicus
aaggataactgcatcgccactgagg

SEQ ID NO: 45276 - DNA, 25 bp, Rattus norvegicus
aaggataactgcttcgccactgagg

SEQ ID NO: 45277 - DNA, 25 bp, Rattus norvegicus
aaggataattaacaccgtcctgtgt

SEQ ID NO: 45278 - DNA, 25 bp, Rattus norvegicus
aaggataattaagaccgtcctgtgt

SEQ ID NO: 45279 - DNA, 25 bp, Rattus norvegicus
aaggatacacacagtgcctgccatg

SEQ ID NO: 45280 - DNA, 25 bp, Rattus norvegicus
aaggatacacacatgctttgcagca

SEQ ID NO: 45281 - DNA, 25 bp, Rattus norvegicus
aaggatacacactgtgcctgccatg

SEQ ID NO: 45282 - DNA, 25 bp, Rattus norvegicus
aaggatacacacttgctttgcagca

SEQ ID NO: 45283 - DNA, 25 bp, Rattus norvegicus
aaggatacacccacccaaaatctag

SEQ ID NO: 45284 - DNA, 25 bp, Rattus norvegicus
aaggatacaccctcccaaaatctag

SEQ ID NO: 45285 - DNA, 25 bp, Rattus norvegicus
aaggatacatttctttctgagtaag

SEQ ID NO: 45286 - DNA, 25 bp, Rattus norvegicus
aaggatacatttgtttctgagtaag

SEQ ID NO: 45287 - DNA, 25 bp, Rattus norvegicus
aaggataccaatagctgacacccac

SEQ ID NO: 45288 - DNA, 25 bp, Rattus norvegicus
aaggataccaattgctgacacccac

SEQ ID NO: 45289 - DNA, 25 bp, Rattus norvegicus
aaggataccttccatatctcccagt

SEQ ID NO: 45290 - DNA, 25 bp, Rattus norvegicus
aaggataccttcgatatctcccagt

SEQ ID NO: 45291 - DNA, 25 bp, Rattus norvegicus
aaggatactatcagggttcgctgga

SEQ ID NO: 45292 - DNA, 25 bp, Rattus norvegicus
aaggatactatctgggttcgctgga

SEQ ID NO: 45293 - DNA, 25 bp, Rattus norvegicus
aaggatacttgccttgtgggccata

SEQ ID NO: 45294 - DNA, 25 bp, Rattus norvegicus
aaggatacttgcgttgtgggccata

SEQ ID NO: 45295 - DNA, 25 bp, Rattus norvegicus
aaggatagaaggacccgagtctcga

SEQ ID NO: 45296 - DNA, 25 bp, Rattus norvegicus
aaggatagaaggtcccgagtctcga

SEQ ID NO: 45297 - DNA, 25 bp, Rattus norvegicus
aaggatagcaatcgctcattggctc

SEQ ID NO: 45298 - DNA, 25 bp, Rattus norvegicus
aaggatagcaatggctcattggctc

SEQ ID NO: 45299 - DNA, 25 bp, Rattus norvegicus
aaggatagtcacagaccgggagact

SEQ ID NO: 45300 - DNA, 25 bp, Rattus norvegicus
aaggatagtcactgaccgggagact

SEQ ID NO: 45301 - DNA, 25 bp, Rattus norvegicus
aaggatataacactcctacgcatct

SEQ ID NO: 45302 - DNA, 25 bp, Rattus norvegicus
aaggatataacagtcctacgcatct

SEQ ID NO: 45303 - DNA, 25 bp, Rattus norvegicus
aaggatatacctatctagcacttat

SEQ ID NO: 45304 - DNA, 25 bp, Rattus norvegicus
aaggatatacctttctagcacttat

SEQ ID NO: 45305 - DNA, 25 bp, Rattus norvegicus
aaggatatatccctcaggtgcatga

SEQ ID NO: 45306 - DNA, 25 bp, Rattus norvegicus
aaggatatatccgtcaggtgcatga

SEQ ID NO: 45307 - DNA, 25 bp, Rattus norvegicus
aaggatatcgacctcagtcctgtca

SEQ ID NO: 45308 - DNA, 25 bp, Rattus norvegicus
aaggatatcgacgtcagtcctgtca

SEQ ID NO: 45309 - DNA, 25 bp, Rattus norvegicus
aaggatatgtccaagttactggcat

SEQ ID NO: 45310 - DNA, 25 bp, Rattus norvegicus
aaggatatgtcctagttactggcat

SEQ ID NO: 45311 - DNA, 25 bp, Rattus norvegicus
aaggatatgtgcagcgtaacttatt

SEQ ID NO: 45312 - DNA, 25 bp, Rattus norvegicus
aaggatatgtgctgcgtaacttatt

SEQ ID NO: 45313 - DNA, 25 bp, Rattus norvegicus
aaggatatgtttctgtgctgatggc

SEQ ID NO: 45314 - DNA, 25 bp, Rattus norvegicus
aaggatatgtttgtgtgctgatggc

SEQ ID NO: 45315 - DNA, 25 bp, Rattus norvegicus
aaggatcaacgcattctcagtggtc

SEQ ID NO: 45316 - DNA, 25 bp, Rattus norvegicus
aaggatcaacgctttctcagtggtc

SEQ ID NO: 45317 - DNA, 25 bp, Rattus norvegicus
aaggatcaagccctattgccttgcg

SEQ ID NO: 45318 - DNA, 25 bp, Rattus norvegicus
aaggatcaagccgtattgccttgcg

SEQ ID NO: 45319 - DNA, 25 bp, Rattus norvegicus
aaggatcaattgatcctgaagccaa

SEQ ID NO: 45320 - DNA, 25 bp, Rattus norvegicus
aaggatcaattgttcctgaagccaa

SEQ ID NO: 45321 - DNA, 25 bp, Rattus norvegicus
aaggatcacaaactgtcccctgttg

SEQ ID NO: 45322 - DNA, 25 bp, Rattus norvegicus
aaggatcacaaagtgtcccctgttg

SEQ ID NO: 45323 - DNA, 25 bp, Rattus norvegicus
aaggatcacaacctcaatggaagga

SEQ ID NO: 45324 - DNA, 25 bp, Rattus norvegicus
aaggatcacaacgtcaatggaagga

SEQ ID NO: 45325 - DNA, 25 bp, Rattus norvegicus
aaggatcacaagcacaccggtgcgc

SEQ ID NO: 45326 - DNA, 25 bp, Rattus norvegicus
aaggatcacaaggacaccggtgcgc

SEQ ID NO: 45327 - DNA, 25 bp, Rattus norvegicus
aaggatcacttaaagcttgggcaga

SEQ ID NO: 45328 - DNA, 25 bp, Rattus norvegicus
aaggatcacttatagcttgggcaga

SEQ ID NO: 45329 - DNA, 25 bp, Rattus norvegicus
aaggatcacttgctgctagatgaca

SEQ ID NO: 45330 - DNA, 25 bp, Rattus norvegicus
aaggatcacttggtgctagatgaca

SEQ ID NO: 45331 - DNA, 25 bp, Rattus norvegicus
aaggatcagcccaatagctgtgctt

SEQ ID NO: 45332 - DNA, 25 bp, Rattus norvegicus
aaggatcagcccagtttgctgctca

SEQ ID NO: 45333 - DNA, 25 bp, Rattus norvegicus
aaggatcagccctatagctgtgctt

SEQ ID NO: 45334 - DNA, 25 bp, Rattus norvegicus
aaggatcagccctgtttgctgctca

SEQ ID NO: 45335 - DNA, 25 bp, Rattus norvegicus
aaggatcagtgaatgatggctgcta

SEQ ID NO: 45336 - DNA, 25 bp, Rattus norvegicus
aaggatcagtgattgatggctgcta

SEQ ID NO: 45337 - DNA, 25 bp, Rattus norvegicus
aaggatcatcagatccgtgaggtct

SEQ ID NO: 45338 - DNA, 25 bp, Rattus norvegicus
aaggatcatcagttccgtgaggtct

SEQ ID NO: 45339 - DNA, 25 bp, Rattus norvegicus
aaggatcattggattccggctgagc

SEQ ID NO: 45340 - DNA, 25 bp, Rattus norvegicus
aaggatcattggtttccggctgagc

SEQ ID NO: 45341 - DNA, 25 bp, Rattus norvegicus
aaggatcattttcccagctgcttac

SEQ ID NO: 45342 - DNA, 25 bp, Rattus norvegicus
aaggatcattttgccagctgcttac

SEQ ID NO: 45343 - DNA, 25 bp, Rattus norvegicus
aaggatccagagattagtccctaga

SEQ ID NO: 45344 - DNA, 25 bp, Rattus norvegicus
aaggatccagagtttagtccctaga

SEQ ID NO: 45345 - DNA, 25 bp, Rattus norvegicus
aaggatcccaggacagacggccatt

SEQ ID NO: 45346 - DNA, 25 bp, Rattus norvegicus
aaggatcccaggtcagacggccatt

SEQ ID NO: 45347 - DNA, 25 bp, Rattus norvegicus
aaggatccccttactgcagcggttg

SEQ ID NO: 45348 - DNA, 25 bp, Rattus norvegicus
aaggatcccctttctgcagcggttg

SEQ ID NO: 45349 - DNA, 25 bp, Rattus norvegicus
aaggatccctcaaaccggaagcaag

SEQ ID NO: 45350 - DNA, 25 bp, Rattus norvegicus
aaggatccctcataccggaagcaag

SEQ ID NO: 45351 - DNA, 25 bp, Rattus norvegicus
aaggatcctcttatgactcttggga

SEQ ID NO: 45352 - DNA, 25 bp, Rattus norvegicus
aaggatcctcttttgactcttggga

SEQ ID NO: 45353 - DNA, 25 bp, Rattus norvegicus
aaggatcctgacactgttcgacaga

SEQ ID NO: 45354 - DNA, 25 bp, Rattus norvegicus
aaggatcctgactctgttcgacaga

SEQ ID NO: 45355 - DNA, 25 bp, Rattus norvegicus
aaggatccttaaccttggagcacaa

SEQ ID NO: 45356 - DNA, 25 bp, Rattus norvegicus
aaggatccttaagcttggagcacaa

SEQ ID NO: 45357 - DNA, 25 bp, Rattus norvegicus
aaggatccttggagtgtgacctgtc

SEQ ID NO: 45358 - DNA, 25 bp, Rattus norvegicus
aaggatccttggtgtgtgacctgtc

SEQ ID NO: 45359 - DNA, 25 bp, Rattus norvegicus
aaggatcgagatcgcccactcgctg

SEQ ID NO: 45360 - DNA, 25 bp, Rattus norvegicus
aaggatcgagatggcccactcgctg

SEQ ID NO: 45361 - DNA, 25 bp, Rattus norvegicus
aaggatcgggtcagtgagtcccagt

SEQ ID NO: 45362 - DNA, 25 bp, Rattus norvegicus
aaggatcgggtctgtgagtcccagt

SEQ ID NO: 45363 - DNA, 25 bp, Rattus norvegicus
aaggatcggtgcatccggattcaga

SEQ ID NO: 45364 - DNA, 25 bp, Rattus norvegicus
aaggatcggtgcttccggattcaga

SEQ ID NO: 45365 - DNA, 25 bp, Rattus norvegicus
aaggatcgttcccactagaagcaat

SEQ ID NO: 45366 - DNA, 25 bp, Rattus norvegicus
aaggatcgttccgactagaagcaat

SEQ ID NO: 45367 - DNA, 25 bp, Rattus norvegicus
aaggatctacaaaaagaggccgcag

SEQ ID NO: 45368 - DNA, 25 bp, Rattus norvegicus
aaggatctacaataagaggccgcag

SEQ ID NO: 45369 - DNA, 25 bp, Rattus norvegicus
aaggatctactaccagtaccgtcgg

SEQ ID NO: 45370 - DNA, 25 bp, Rattus norvegicus
aaggatctactagcagtaccgtcgg

SEQ ID NO: 45371 - DNA, 25 bp, Rattus norvegicus
aaggatctatctcaggctccttttt

SEQ ID NO: 45372 - DNA, 25 bp, Rattus norvegicus
aaggatctatctgaggctccttttt

SEQ ID NO: 45373 - DNA, 25 bp, Rattus norvegicus
aaggatctatgaattcagggcacag

SEQ ID NO: 45374 - DNA, 25 bp, Rattus norvegicus
aaggatctatgatttcagggcacag

SEQ ID NO: 45375 - DNA, 25 bp, Rattus norvegicus
aaggatctccccagaatctgtgtgc

SEQ ID NO: 45376 - DNA, 25 bp, Rattus norvegicus
aaggatctcccctgaatctgtgtgc

SEQ ID NO: 45377 - DNA, 25 bp, Rattus norvegicus
aaggatctgaccagcctgagtctgc

SEQ ID NO: 45378 - DNA, 25 bp, Rattus norvegicus
aaggatctgacctgcctgagtctgc

SEQ ID NO: 45379 - DNA, 25 bp, Rattus norvegicus
aaggatctgactccagtctgtgaat

SEQ ID NO: 45380 - DNA, 25 bp, Rattus norvegicus
aaggatctgactgcagtctgtgaat

SEQ ID NO: 45381 - DNA, 25 bp, Rattus norvegicus
aaggatctgatgctcttttctagca

SEQ ID NO: 45382 - DNA, 25 bp, Rattus norvegicus
aaggatctgatggtcttttctagca

SEQ ID NO: 45383 - DNA, 25 bp, Rattus norvegicus
aaggatctgcaacctcaggtctagc

SEQ ID NO: 45384 - DNA, 25 bp, Rattus norvegicus
aaggatctgcaagctcaggtctagc

SEQ ID NO: 45385 - DNA, 25 bp, Rattus norvegicus
aaggatctgcccatgattctgaagg

SEQ ID NO: 45386 - DNA, 25 bp, Rattus norvegicus
aaggatctgcccttgattctgaagg

SEQ ID NO: 45387 - DNA, 25 bp, Rattus norvegicus
aaggatctgggtctgctccctttac

SEQ ID NO: 45388 - DNA, 25 bp, Rattus norvegicus
aaggatctgggtgtgctccctttac

SEQ ID NO: 45389 - DNA, 25 bp, Rattus norvegicus
aaggatctggtgaccctggcctgcg

SEQ ID NO: 45390 - DNA, 25 bp, Rattus norvegicus
aaggatctggtgtccctggcctgcg

SEQ ID NO: 45391 - DNA, 25 bp, Rattus norvegicus
aaggatcttcacagcgtggtactgg

SEQ ID NO: 45392 - DNA, 25 bp, Rattus norvegicus
aaggatcttcactgcgtggtactgg

SEQ ID NO: 45393 - DNA, 25 bp, Rattus norvegicus
aaggatctttctctcttttctaaga

SEQ ID NO: 45394 - DNA, 25 bp, Rattus norvegicus
aaggatctttctgtcttttctaaga

SEQ ID NO: 45395 - DNA, 25 bp, Rattus norvegicus
aaggatcttttgcacctggctaatc

SEQ ID NO: 45396 - DNA, 25 bp, Rattus norvegicus
aaggatcttttggacctggctaatc

SEQ ID NO: 45397 - DNA, 25 bp, Rattus norvegicus
aaggatgaacatacggggtgccccg

SEQ ID NO: 45398 - DNA, 25 bp, Rattus norvegicus
aaggatgaacattcggggtgccccg

SEQ ID NO: 45399 - DNA, 25 bp, Rattus norvegicus
aaggatgacatacttctcaccctct

SEQ ID NO: 45400 - DNA, 25 bp, Rattus norvegicus
aaggatgacatagttctcaccctct

SEQ ID NO: 45401 - DNA, 25 bp, Rattus norvegicus
aaggatgaccctcaacttatgttct

SEQ ID NO: 45402 - DNA, 25 bp, Rattus norvegicus
aaggatgaccctgaacttatgttct

SEQ ID NO: 45403 - DNA, 25 bp, Rattus norvegicus
aaggatgaccttcatccagtcctcc

SEQ ID NO: 45404 - DNA, 25 bp, Rattus norvegicus
aaggatgaccttgatccagtcctcc

SEQ ID NO: 45405 - DNA, 25 bp, Rattus norvegicus
aaggatgcacatcggcttttaaagg

SEQ ID NO: 45406 - DNA, 25 bp, Rattus norvegicus
aaggatgcacatgggcttttaaagg

SEQ ID NO: 45407 - DNA, 25 bp, Rattus norvegicus
aaggatgcactcagaaacttcttgt

SEQ ID NO: 45408 - DNA, 25 bp, Rattus norvegicus
aaggatgcactctgaaacttcttgt

SEQ ID NO: 45409 - DNA, 25 bp, Rattus norvegicus
aaggatgcagaaaccttcccgtcca

SEQ ID NO: 45410 - DNA, 25 bp, Rattus norvegicus
aaggatgcagaatccttcccgtcca

SEQ ID NO: 45411 - DNA, 25 bp, Rattus norvegicus
aaggatgcatcccaagttgtccttc

SEQ ID NO: 45412 - DNA, 25 bp, Rattus norvegicus
aaggatgcatccgaagttgtccttc

SEQ ID NO: 45413 - DNA, 25 bp, Rattus norvegicus
aaggatgccaaacaatgcgttcagg

SEQ ID NO: 45414 - DNA, 25 bp, Rattus norvegicus
aaggatgccaaagaatgcgttcagg

SEQ ID NO: 45415 - DNA, 25 bp, Rattus norvegicus
aaggatgccacaagccagagaacct

SEQ ID NO: 45416 - DNA, 25 bp, Rattus norvegicus
aaggatgccacatgccagagaacct

SEQ ID NO: 45417 - DNA, 25 bp, Rattus norvegicus
aaggatgcccctaaacagagcgaag

SEQ ID NO: 45418 - DNA, 25 bp, Rattus norvegicus
aaggatgccccttaacagagcgaag

SEQ ID NO: 45419 - DNA, 25 bp, Rattus norvegicus
aaggatgcccgtcctgccgaggagt

SEQ ID NO: 45420 - DNA, 25 bp, Rattus norvegicus
aaggatgcccgtgctgccgaggagt

SEQ ID NO: 45421 - DNA, 25 bp, Rattus norvegicus
aaggatgcccttatccaaagtcaag

SEQ ID NO: 45422 - DNA, 25 bp, Rattus norvegicus
aaggatgcccttttccaaagtcaag

SEQ ID NO: 45423 - DNA, 25 bp, Rattus norvegicus
aaggatgcctcactgatgtacaggg

SEQ ID NO: 45424 - DNA, 25 bp, Rattus norvegicus
aaggatgcctcagtgatgtacaggg

SEQ ID NO: 45425 - DNA, 25 bp, Rattus norvegicus
aaggatgcctctcttcttgcatcaa

SEQ ID NO: 45426 - DNA, 25 bp, Rattus norvegicus
aaggatgcctctgttcttgcatcaa

SEQ ID NO: 45427 - DNA, 25 bp, Rattus norvegicus
aaggatgcctgaaccagtccagaac

SEQ ID NO: 45428 - DNA, 25 bp, Rattus norvegicus
aaggatgcctgacacagcgccagct

SEQ ID NO: 45429 - DNA, 25 bp, Rattus norvegicus
aaggatgcctgagacagcgccagct

SEQ ID NO: 45430 - DNA, 25 bp, Rattus norvegicus
aaggatgcctgatccagtccagaac

SEQ ID NO: 45431 - DNA, 25 bp, Rattus norvegicus
aaggatgcctgcaggtttcacatgg

SEQ ID NO: 45432 - DNA, 25 bp, Rattus norvegicus
aaggatgcctgctggtttcacatgg

SEQ ID NO: 45433 - DNA, 25 bp, Rattus norvegicus
aaggatgcgcgtccacaggcaaaga

SEQ ID NO: 45434 - DNA, 25 bp, Rattus norvegicus
aaggatgcgcgtgcacaggcaaaga

SEQ ID NO: 45435 - DNA, 25 bp, Rattus norvegicus
aaggatgcggtaagttctttccccg

SEQ ID NO: 45436 - DNA, 25 bp, Rattus norvegicus
aaggatgcggtatgttctttccccg

SEQ ID NO: 45437 - DNA, 25 bp, Rattus norvegicus
aaggatgcgtccacacaagaagcaa

SEQ ID NO: 45438 - DNA, 25 bp, Rattus norvegicus
aaggatgcgtcctcacaagaagcaa

SEQ ID NO: 45439 - DNA, 25 bp, Rattus norvegicus
aaggatgctaagagcccttcttctc

SEQ ID NO: 45440 - DNA, 25 bp, Rattus norvegicus
aaggatgctaagtgcccttcttctc

SEQ ID NO: 45441 - DNA, 25 bp, Rattus norvegicus
aaggatgctcgtaaaggtcttcaag

SEQ ID NO: 45442 - DNA, 25 bp, Rattus norvegicus
aaggatgctcgttaaggtcttcaag

SEQ ID NO: 45443 - DNA, 25 bp, Rattus norvegicus
aaggatgctggacccgcacacttgc

SEQ ID NO: 45444 - DNA, 25 bp, Rattus norvegicus
aaggatgctggagccgcacacttgc

SEQ ID NO: 45445 - DNA, 25 bp, Rattus norvegicus
aaggatgctgttaaaatgacttctt

SEQ ID NO: 45446 - DNA, 25 bp, Rattus norvegicus
aaggatgctgtttaaatgacttctt

SEQ ID NO: 45447 - DNA, 25 bp, Rattus norvegicus
aaggatgcttttctagatgctacac

SEQ ID NO: 45448 - DNA, 25 bp, Rattus norvegicus
aaggatgcttttgtagatgctacac

SEQ ID NO: 45449 - DNA, 25 bp, Rattus norvegicus
aaggatggcatcactgtcaagggtg

SEQ ID NO: 45450 - DNA, 25 bp, Rattus norvegicus
aaggatggcatctctgtcaagggtg

SEQ ID NO: 45451 - DNA, 25 bp, Rattus norvegicus
aaggatggcatgcatactgtgagaa

SEQ ID NO: 45452 - DNA, 25 bp, Rattus norvegicus
aaggatggcatggatactgtgagaa

SEQ ID NO: 45453 - DNA, 25 bp, Rattus norvegicus
aaggatggccgaaagagaactgagt

SEQ ID NO: 45454 - DNA, 25 bp, Rattus norvegicus
aaggatggccgatagagaactgagt

SEQ ID NO: 45455 - DNA, 25 bp, Rattus norvegicus
aaggatggccttctgtgacatcagt

SEQ ID NO: 45456 - DNA, 25 bp, Rattus norvegicus
aaggatggccttgtgtgacatcagt

SEQ ID NO: 45457 - DNA, 25 bp, Rattus norvegicus
aaggatgggaaaccctggttggtgg

SEQ ID NO: 45458 - DNA, 25 bp, Rattus norvegicus
aaggatgggaaagcctggttggtgg

SEQ ID NO: 45459 - DNA, 25 bp, Rattus norvegicus
aaggatgggctcagtcttgtcagca

SEQ ID NO: 45460 - DNA, 25 bp, Rattus norvegicus
aaggatgggctctgtcttgtcagca

SEQ ID NO: 45461 - DNA, 25 bp, Rattus norvegicus
aaggatgggcttagaccaaccgcta

SEQ ID NO: 45462 - DNA, 25 bp, Rattus norvegicus
aaggatgggctttgaccaaccgcta

SEQ ID NO: 45463 - DNA, 25 bp, Rattus norvegicus
aaggatggtcccactcagatcaaga

SEQ ID NO: 45464 - DNA, 25 bp, Rattus norvegicus
aaggatggtccctctcagatcaaga

SEQ ID NO: 45465 - DNA, 25 bp, Rattus norvegicus
aaggatggttcaccaggaagtcagt

SEQ ID NO: 45466 - DNA, 25 bp, Rattus norvegicus
aaggatggttcagcaggaagtcagt

SEQ ID NO: 45467 - DNA, 25 bp, Rattus norvegicus
aaggatggttctccactggacagga

SEQ ID NO: 45468 - DNA, 25 bp, Rattus norvegicus
aaggatggttctgcactggacagga

SEQ ID NO: 45469 - DNA, 25 bp, Rattus norvegicus
aaggatgtacacctggccaagcctc

SEQ ID NO: 45470 - DNA, 25 bp, Rattus norvegicus
aaggatgtacacgtggccaagcctc

SEQ ID NO: 45471 - DNA, 25 bp, Rattus norvegicus
aaggatgtagaccagtggctctcaa

SEQ ID NO: 45472 - DNA, 25 bp, Rattus norvegicus
aaggatgtagacgagtggctctcaa

SEQ ID NO: 45473 - DNA, 25 bp, Rattus norvegicus
aaggatgtaggcaggtcctcagctc

SEQ ID NO: 45474 - DNA, 25 bp, Rattus norvegicus
aaggatgtaggctggtcctcagctc

SEQ ID NO: 45475 - DNA, 25 bp, Rattus norvegicus
aaggatgtatgaagcccatgcccac

SEQ ID NO: 45476 - DNA, 25 bp, Rattus norvegicus
aaggatgtatgatgcccatgcccac

SEQ ID NO: 45477 - DNA, 25 bp, Rattus norvegicus
aaggatgtcacactgcatcaggcct

SEQ ID NO: 45478 - DNA, 25 bp, Rattus norvegicus
aaggatgtcacagtgcatcaggcct

SEQ ID NO: 45479 - DNA, 25 bp, Rattus norvegicus
aaggatgtcactaggctcaggtcct

SEQ ID NO: 45480 - DNA, 25 bp, Rattus norvegicus
aaggatgtcactagggcttgggctt

SEQ ID NO: 45481 - DNA, 25 bp, Rattus norvegicus
aaggatgtcacttggctcaggtcct

SEQ ID NO: 45482 - DNA, 25 bp, Rattus norvegicus
aaggatgtcacttgggcttgggctt

SEQ ID NO: 45483 - DNA, 25 bp, Rattus norvegicus
aaggatgtcatcagcggcgtttcgg

SEQ ID NO: 45484 - DNA, 25 bp, Rattus norvegicus
aaggatgtcatctgcggcgtttcgg

SEQ ID NO: 45485 - DNA, 25 bp, Rattus norvegicus
aaggatgtccgcaagtcttcttaaa

SEQ ID NO: 45486 - DNA, 25 bp, Rattus norvegicus
aaggatgtccgctagtcttcttaaa

SEQ ID NO: 45487 - DNA, 25 bp, Rattus norvegicus
aaggatgtctgtccctgttctcagg

SEQ ID NO: 45488 - DNA, 25 bp, Rattus norvegicus
aaggatgtctgtgcctgttctcagg

SEQ ID NO: 45489 - DNA, 25 bp, Rattus norvegicus
aaggatgtcttcatcacgctgtttc

SEQ ID NO: 45490 - DNA, 25 bp, Rattus norvegicus
aaggatgtcttcttcacgctgtttc

SEQ ID NO: 45491 - DNA, 25 bp, Rattus norvegicus
aaggatgtgactatgcctgggcccc

SEQ ID NO: 45492 - DNA, 25 bp, Rattus norvegicus
aaggatgtgactttgcctgggcccc

SEQ ID NO: 45493 - DNA, 25 bp, Rattus norvegicus
aaggatgtgagcctttcacgtcact

SEQ ID NO: 45494 - DNA, 25 bp, Rattus norvegicus
aaggatgtgagcgtttcacgtcact

SEQ ID NO: 45495 - DNA, 25 bp, Rattus norvegicus
aaggatgtggagcacacctgtctgc

SEQ ID NO: 45496 - DNA, 25 bp, Rattus norvegicus
aaggatgtggaggacacctgtctgc

SEQ ID NO: 45497 - DNA, 25 bp, Rattus norvegicus
aaggatgtggctctgatcttcacta

SEQ ID NO: 45498 - DNA, 25 bp, Rattus norvegicus
aaggatgtggctgtgatcttcacta

SEQ ID NO: 45499 - DNA, 25 bp, Rattus norvegicus
aaggatgtgggtactctagacgaaa

SEQ ID NO: 45500 - DNA, 25 bp, Rattus norvegicus
aaggatgtgggttctctagacgaaa

SEQ ID NO: 45501 - DNA, 25 bp, Rattus norvegicus
aaggatgtggttatgcgtctgccca

SEQ ID NO: 45502 - DNA, 25 bp, Rattus norvegicus
aaggatgtggttttgcgtctgccca

SEQ ID NO: 45503 - DNA, 25 bp, Rattus norvegicus
aaggatgttctgatggtttcccgca

SEQ ID NO: 45504 - DNA, 25 bp, Rattus norvegicus
aaggatgttctgttggtttcccgca

SEQ ID NO: 45505 - DNA, 25 bp, Rattus norvegicus
aaggatgttgggagttgccttccac

SEQ ID NO: 45506 - DNA, 25 bp, Rattus norvegicus
aaggatgttgggtgttgccttccac

SEQ ID NO: 45507 - DNA, 25 bp, Rattus norvegicus
aaggatgtttagcttcagctgacag

SEQ ID NO: 45508 - DNA, 25 bp, Rattus norvegicus
aaggatgtttaggttcagctgacag

SEQ ID NO: 45509 - DNA, 25 bp, Rattus norvegicus
aaggatgtttggcatctcggtctcg

SEQ ID NO: 45510 - DNA, 25 bp, Rattus norvegicus
aaggatgtttgggatctcggtctcg

SEQ ID NO: 45511 - DNA, 25 bp, Rattus norvegicus
aaggatgttttcaagttgtgcatgg

SEQ ID NO: 45512 - DNA, 25 bp, Rattus norvegicus
aaggatgttttctagttgtgcatgg

SEQ ID NO: 45513 - DNA, 25 bp, Rattus norvegicus
aaggattaaggcatactgtattcat

SEQ ID NO: 45514 - DNA, 25 bp, Rattus norvegicus
aaggattaaggcttactgtattcat

SEQ ID NO: 45515 - DNA, 25 bp, Rattus norvegicus
aaggattacaggacacttctcagcc

SEQ ID NO: 45516 - DNA, 25 bp, Rattus norvegicus
aaggattacaggtcacttctcagcc

SEQ ID NO: 45517 - DNA, 25 bp, Rattus norvegicus
aaggattacatcaggcactgcattg

SEQ ID NO: 45518 - DNA, 25 bp, Rattus norvegicus
aaggattacatctggcactgcattg

SEQ ID NO: 45519 - DNA, 25 bp, Rattus norvegicus
aaggattaccctacatatgcactcg

SEQ ID NO: 45520 - DNA, 25 bp, Rattus norvegicus
aaggattacccttcatatgcactcg

SEQ ID NO: 45521 - DNA, 25 bp, Rattus norvegicus
aaggattaccttcgagagctgccaa

SEQ ID NO: 45522 - DNA, 25 bp, Rattus norvegicus
aaggattaccttggagagctgccaa

SEQ ID NO: 45523 - DNA, 25 bp, Rattus norvegicus
aaggattagccccttgactgtttct

SEQ ID NO: 45524 - DNA, 25 bp, Rattus norvegicus
aaggattagcccgttgactgtttct

SEQ ID NO: 45525 - DNA, 25 bp, Rattus norvegicus
aaggattagtgaagctctgccttcc

SEQ ID NO: 45526 - DNA, 25 bp, Rattus norvegicus
aaggattagtgatgctctgccttcc

SEQ ID NO: 45527 - DNA, 25 bp, Rattus norvegicus
aaggattatagcattgccctgataa

SEQ ID NO: 45528 - DNA, 25 bp, Rattus norvegicus
aaggattatagctttgccctgataa

SEQ ID NO: 45529 - DNA, 25 bp, Rattus norvegicus
aaggattcacatacctttccgtgat

SEQ ID NO: 45530 - DNA, 25 bp, Rattus norvegicus
aaggattcacattcctttccgtgat

SEQ ID NO: 45531 - DNA, 25 bp, Rattus norvegicus
aaggattcagtacctcagttctcag

SEQ ID NO: 45532 - DNA, 25 bp, Rattus norvegicus
aaggattcagtagctcagttctcag

SEQ ID NO: 45533 - DNA, 25 bp, Rattus norvegicus
aaggattccaagacaggtctccatc

SEQ ID NO: 45534 - DNA, 25 bp, Rattus norvegicus
aaggattccaagtcaggtctccatc

SEQ ID NO: 45535 - DNA, 25 bp, Rattus norvegicus
aaggattccactactttcagacctg

SEQ ID NO: 45536 - DNA, 25 bp, Rattus norvegicus
aaggattccacttctttcagacctg

SEQ ID NO: 45537 - DNA, 25 bp, Rattus norvegicus
aaggattccctgaatgcccaaggaa

SEQ ID NO: 45538 - DNA, 25 bp, Rattus norvegicus
aaggattccctgtatgcccaaggaa

SEQ ID NO: 45539 - DNA, 25 bp, Rattus norvegicus
aaggattcggagcatgctctcatcc

SEQ ID NO: 45540 - DNA, 25 bp, Rattus norvegicus
aaggattcggaggatgctctcatcc

SEQ ID NO: 45541 - DNA, 25 bp, Rattus norvegicus
aaggattcgggcatcaccctgggag

SEQ ID NO: 45542 - DNA, 25 bp, Rattus norvegicus
aaggattcgggcttcaccctgggag

SEQ ID NO: 45543 - DNA, 25 bp, Rattus norvegicus
aaggattctaccaactgggatggaa

SEQ ID NO: 45544 - DNA, 25 bp, Rattus norvegicus
aaggattctacctactgggatggaa

SEQ ID NO: 45545 - DNA, 25 bp, Rattus norvegicus
aaggattctgatagcttctatcaca

SEQ ID NO: 45546 - DNA, 25 bp, Rattus norvegicus
aaggattctgattgcttctatcaca

SEQ ID NO: 45547 - DNA, 25 bp, Rattus norvegicus
aaggattctgtgattgtctaagtga

SEQ ID NO: 45548 - DNA, 25 bp, Rattus norvegicus
aaggattctgtgtttgtctaagtga

SEQ ID NO: 45549 - DNA, 25 bp, Rattus norvegicus
aaggattcttggaccactgccaaag

SEQ ID NO: 45550 - DNA, 25 bp, Rattus norvegicus
aaggattcttggtccactgccaaag

SEQ ID NO: 45551 - DNA, 25 bp, Rattus norvegicus
aaggattgagatagacttctacaaa

SEQ ID NO: 45552 - DNA, 25 bp, Rattus norvegicus
aaggattgagattgacttctacaaa

SEQ ID NO: 45553 - DNA, 25 bp, Rattus norvegicus
aaggattgaggcctctgctgaaccc

SEQ ID NO: 45554 - DNA, 25 bp, Rattus norvegicus
aaggattgaggcgtctgctgaaccc

SEQ ID NO: 45555 - DNA, 25 bp, Rattus norvegicus
aaggattgagggacgcacaccccaa

SEQ ID NO: 45556 - DNA, 25 bp, Rattus norvegicus
aaggattgagggtcgcacaccccaa

SEQ ID NO: 45557 - DNA, 25 bp, Rattus norvegicus
aaggattgccatataccagccaatt

SEQ ID NO: 45558 - DNA, 25 bp, Rattus norvegicus
aaggattgccatttaccagccaatt

SEQ ID NO: 45559 - DNA, 25 bp, Rattus norvegicus
aaggattgccctatagccaggcata

SEQ ID NO: 45560 - DNA, 25 bp, Rattus norvegicus
aaggattgccctttagccaggcata

SEQ ID NO: 45561 - DNA, 25 bp, Rattus norvegicus
aaggattgcctcatgttctgtggga

SEQ ID NO: 45562 - DNA, 25 bp, Rattus norvegicus
aaggattgcctcttgttctgtggga

SEQ ID NO: 45563 - DNA, 25 bp, Rattus norvegicus
aaggattgctctatacaaccagtag

SEQ ID NO: 45564 - DNA, 25 bp, Rattus norvegicus
aaggattgctctttacaaccagtag

SEQ ID NO: 45565 - DNA, 25 bp, Rattus norvegicus
aaggattgcttaactgtcagctcaa

SEQ ID NO: 45566 - DNA, 25 bp, Rattus norvegicus
aaggattgcttatctgtcagctcaa

SEQ ID NO: 45567 - DNA, 25 bp, Rattus norvegicus
aaggattgggctaggacctggccaa

SEQ ID NO: 45568 - DNA, 25 bp, Rattus norvegicus
aaggattgggcttggacctggccaa

SEQ ID NO: 45569 - DNA, 25 bp, Rattus norvegicus
aaggattgtcagaaagcgtttcaga

SEQ ID NO: 45570 - DNA, 25 bp, Rattus norvegicus
aaggattgtcagtaagcgtttcaga

SEQ ID NO: 45571 - DNA, 25 bp, Rattus norvegicus
aaggattgtgacatccaggacattt

SEQ ID NO: 45572 - DNA, 25 bp, Rattus norvegicus
aaggattgtgacttccaggacattt

SEQ ID NO: 45573 - DNA, 25 bp, Rattus norvegicus
aaggatttattgctacggcttacgc

SEQ ID NO: 45574 - DNA, 25 bp, Rattus norvegicus
aaggatttattggtacggcttacgc

SEQ ID NO: 45575 - DNA, 25 bp, Rattus norvegicus
aaggatttcaacacttcgagatgaa

SEQ ID NO: 45576 - DNA, 25 bp, Rattus norvegicus
aaggatttcaactcttcgagatgaa

SEQ ID NO: 45577 - DNA, 25 bp, Rattus norvegicus
aaggatttcaccagctgtggctcca

SEQ ID NO: 45578 - DNA, 25 bp, Rattus norvegicus
aaggatttcacctgctgtggctcca

SEQ ID NO: 45579 - DNA, 25 bp, Rattus norvegicus
aaggatttcagacgattctagggat

SEQ ID NO: 45580 - DNA, 25 bp, Rattus norvegicus
aaggatttcagaggattctagggat

SEQ ID NO: 45581 - DNA, 25 bp, Rattus norvegicus
aaggatttcattcccagactttgtg

SEQ ID NO: 45582 - DNA, 25 bp, Rattus norvegicus
aaggatttcattgccagactttgtg

SEQ ID NO: 45583 - DNA, 25 bp, Rattus norvegicus
aaggatttccagcactgctgtcggc

SEQ ID NO: 45584 - DNA, 25 bp, Rattus norvegicus
aaggatttccaggactgctgtcggc

SEQ ID NO: 45585 - DNA, 25 bp, Rattus norvegicus
aaggatttccgtagtggctggttct

SEQ ID NO: 45586 - DNA, 25 bp, Rattus norvegicus
aaggatttccgttgtggctggttct

SEQ ID NO: 45587 - DNA, 25 bp, Rattus norvegicus
aaggatttctgtctgccctggataa

SEQ ID NO: 45588 - DNA, 25 bp, Rattus norvegicus
aaggatttctgtgtgccctggataa

SEQ ID NO: 45589 - DNA, 25 bp, Rattus norvegicus
aaggatttcttaattgccccatgga

SEQ ID NO: 45590 - DNA, 25 bp, Rattus norvegicus
aaggatttcttatttgccccatgga

SEQ ID NO: 45591 - DNA, 25 bp, Rattus norvegicus
aaggatttgcacacttgtcttgccc

SEQ ID NO: 45592 - DNA, 25 bp, Rattus norvegicus
aaggatttgcactcttgtcttgccc

SEQ ID NO: 45593 - DNA, 25 bp, Rattus norvegicus
aaggatttggctattccctcagaac

SEQ ID NO: 45594 - DNA, 25 bp, Rattus norvegicus
aaggatttggcttttccctcagaac

SEQ ID NO: 45595 - DNA, 25 bp, Rattus norvegicus
aaggatttgtaaacagccctgggaa

SEQ ID NO: 45596 - DNA, 25 bp, Rattus norvegicus
aaggatttgtaatcagccctgggaa

SEQ ID NO: 45597 - DNA, 25 bp, Rattus norvegicus
aaggatttgtatcgctttgaatttc

SEQ ID NO: 45598 - DNA, 25 bp, Rattus norvegicus
aaggatttgtatggctttgaatttc

SEQ ID NO: 45599 - DNA, 25 bp, Rattus norvegicus
aaggattttcctcggagccgcttag

SEQ ID NO: 45600 - DNA, 25 bp, Rattus norvegicus
aaggattttcctgggagccgcttag

SEQ ID NO: 45601 - DNA, 25 bp, Rattus norvegicus
aaggattttgatcccctcttgatca

SEQ ID NO: 45602 - DNA, 25 bp, Rattus norvegicus
aaggattttgatgccctcttgatca

SEQ ID NO: 45603 - DNA, 25 bp, Rattus norvegicus
aaggattttgcccttcaagtgtgaa

SEQ ID NO: 45604 - DNA, 25 bp, Rattus norvegicus
aaggattttgccgttcaagtgtgaa

SEQ ID NO: 45605 - DNA, 25 bp, Rattus norvegicus
aaggattttgtccttgctgtctcac

SEQ ID NO: 45606 - DNA, 25 bp, Rattus norvegicus
aaggattttgtcgttgctgtctcac

SEQ ID NO: 45607 - DNA, 25 bp, Rattus norvegicus
aaggcaaaacagcaaatgaacccaa

SEQ ID NO: 45608 - DNA, 25 bp, Rattus norvegicus
aaggcaaaacaggaaatgaacccaa

SEQ ID NO: 45609 - DNA, 25 bp, Rattus norvegicus
aaggcaaaacatcggactgccctga

SEQ ID NO: 45610 - DNA, 25 bp, Rattus norvegicus
aaggcaaaacatgggactgccctga

SEQ ID NO: 45611 - DNA, 25 bp, Rattus norvegicus
aaggcaaaatctccttcatccctcg

SEQ ID NO: 45612 - DNA, 25 bp, Rattus norvegicus
aaggcaaaatctgcttcatccctcg

SEQ ID NO: 45613 - DNA, 25 bp, Rattus norvegicus
aaggcaaaggccagtcttctcacag

SEQ ID NO: 45614 - DNA, 25 bp, Rattus norvegicus
aaggcaaaggcctgtcttctcacag

SEQ ID NO: 45615 - DNA, 25 bp, Rattus norvegicus
aaggcaaagtctcgactgctcacgt

SEQ ID NO: 45616 - DNA, 25 bp, Rattus norvegicus
aaggcaaagtctggactgctcacgt

SEQ ID NO: 45617 - DNA, 25 bp, Rattus norvegicus
aaggcaaagtggctgcttgatccct

SEQ ID NO: 45618 - DNA, 25 bp, Rattus norvegicus
aaggcaaagtgggtgcttgatccct

SEQ ID NO: 45619 - DNA, 25 bp, Rattus norvegicus
aaggcaaatagcactgctccctgtg

SEQ ID NO: 45620 - DNA, 25 bp, Rattus norvegicus
aaggcaaatagctctgctccctgtg

SEQ ID NO: 45621 - DNA, 25 bp, Rattus norvegicus
aaggcaaatttcatgcttccggcgc

SEQ ID NO: 45622 - DNA, 25 bp, Rattus norvegicus
aaggcaaatttcttgcttccggcgc

SEQ ID NO: 45623 - DNA, 25 bp, Rattus norvegicus
aaggcaacaaccaggataccacgtt

SEQ ID NO: 45624 - DNA, 25 bp, Rattus norvegicus
aaggcaacaacctggataccacgtt

SEQ ID NO: 45625 - DNA, 25 bp, Rattus norvegicus
aaggcaacaccaccacattttattt

SEQ ID NO: 45626 - DNA, 25 bp, Rattus norvegicus
aaggcaacaccagcacattttattt

SEQ ID NO: 45627 - DNA, 25 bp, Rattus norvegicus
aaggcaacagcacgcactccagaga

SEQ ID NO: 45628 - DNA, 25 bp, Rattus norvegicus
aaggcaacagcaggcactccagaga

SEQ ID NO: 45629 - DNA, 25 bp, Rattus norvegicus
aaggcaacagttatacatccgtaaa

SEQ ID NO: 45630 - DNA, 25 bp, Rattus norvegicus
aaggcaacagttttacatccgtaaa

SEQ ID NO: 45631 - DNA, 25 bp, Rattus norvegicus
aaggcaaccaccaccagcaaggagg

SEQ ID NO: 45632 - DNA, 25 bp, Rattus norvegicus
aaggcaaccacctccagcaaggagg

SEQ ID NO: 45633 - DNA, 25 bp, Rattus norvegicus
aaggcaacccctactggatggatcc

SEQ ID NO: 45634 - DNA, 25 bp, Rattus norvegicus
aaggcaaccccttctggatggatcc

SEQ ID NO: 45635 - DNA, 25 bp, Rattus norvegicus
aaggcaacccgaactgctgctgagt

SEQ ID NO: 45636 - DNA, 25 bp, Rattus norvegicus
aaggcaacccgatctgctgctgagt

SEQ ID NO: 45637 - DNA, 25 bp, Rattus norvegicus
aaggcaacctgcatatgacttcacc

SEQ ID NO: 45638 - DNA, 25 bp, Rattus norvegicus
aaggcaacctgcttatgacttcacc

SEQ ID NO: 45639 - DNA, 25 bp, Rattus norvegicus
aaggcaacgcgcacccagcccagat

SEQ ID NO: 45640 - DNA, 25 bp, Rattus norvegicus
aaggcaacgcgctcccagcccagat

SEQ ID NO: 45641 - DNA, 25 bp, Rattus norvegicus
aaggcaacgtccacgttatctctca

SEQ ID NO: 45642 - DNA, 25 bp, Rattus norvegicus
aaggcaacgtcctcgttatctctca

SEQ ID NO: 45643 - DNA, 25 bp, Rattus norvegicus
aaggcaactcgtataaggacagcat

SEQ ID NO: 45644 - DNA, 25 bp, Rattus norvegicus
aaggcaactcgtttaaggacagcat

SEQ ID NO: 45645 - DNA, 25 bp, Rattus norvegicus
aaggcaactgagctcgctaatcctt

SEQ ID NO: 45646 - DNA, 25 bp, Rattus norvegicus
aaggcaactgaggtcgctaatcctt

SEQ ID NO: 45647 - DNA, 25 bp, Rattus norvegicus
aaggcaactgatatcttccattcaa

SEQ ID NO: 45648 - DNA, 25 bp, Rattus norvegicus
aaggcaactgatttcttccattcaa

SEQ ID NO: 45649 - DNA, 25 bp, Rattus norvegicus
aaggcaactggtatactgtccaaaa

SEQ ID NO: 45650 - DNA, 25 bp, Rattus norvegicus
aaggcaactggtttactgtccaaaa

SEQ ID NO: 45651 - DNA, 25 bp, Rattus norvegicus
aaggcaactgtcactgtgttccagg

SEQ ID NO: 45652 - DNA, 25 bp, Rattus norvegicus
aaggcaactgtctctgtgttccagg

SEQ ID NO: 45653 - DNA, 25 bp, Rattus norvegicus
aaggcaacttcgcttcaaggcgtta

SEQ ID NO: 45654 - DNA, 25 bp, Rattus norvegicus
aaggcaacttcggttcaaggcgtta

SEQ ID NO: 45655 - DNA, 25 bp, Rattus norvegicus
aaggcaagagatctccttccttcct

SEQ ID NO: 45656 - DNA, 25 bp, Rattus norvegicus
aaggcaagagatgtccttccttcct

SEQ ID NO: 45657 - DNA, 25 bp, Rattus norvegicus
aaggcaagaggacagggcttcccct

SEQ ID NO: 45658 - DNA, 25 bp, Rattus norvegicus
aaggcaagaggagagggcttcccct

SEQ ID NO: 45659 - DNA, 25 bp, Rattus norvegicus
aaggcaagataaccgcactcagcaa

SEQ ID NO: 45660 - DNA, 25 bp, Rattus norvegicus
aaggcaagataagcgcactcagcaa

SEQ ID NO: 45661 - DNA, 25 bp, Rattus norvegicus
aaggcaagcgtaccctttgcttcca

SEQ ID NO: 45662 - DNA, 25 bp, Rattus norvegicus
aaggcaagcgtagcctttgcttcca

SEQ ID NO: 45663 - DNA, 25 bp, Rattus norvegicus
aaggcaaggactccgtgttcacgga

SEQ ID NO: 45664 - DNA, 25 bp, Rattus norvegicus
aaggcaaggactgcgtgttcacgga

SEQ ID NO: 45665 - DNA, 25 bp, Rattus norvegicus
aaggcaaggccacctgtccagtagc

SEQ ID NO: 45666 - DNA, 25 bp, Rattus norvegicus
aaggcaaggccagctgtccagtagc

SEQ ID NO: 45667 - DNA, 25 bp, Rattus norvegicus
aaggcaaggcctcactgttgggctc

SEQ ID NO: 45668 - DNA, 25 bp, Rattus norvegicus
aaggcaaggcctgactgttgggctc

SEQ ID NO: 45669 - DNA, 25 bp, Rattus norvegicus
aaggcaagggcaacatttttcagtg

SEQ ID NO: 45670 - DNA, 25 bp, Rattus norvegicus
aaggcaagggcatcatttttcagtg

SEQ ID NO: 45671 - DNA, 25 bp, Rattus norvegicus
aaggcaagtcagaaaccatcctctc

SEQ ID NO: 45672 - DNA, 25 bp, Rattus norvegicus
aaggcaagtcagtaaccatcctctc

SEQ ID NO: 45673 - DNA, 25 bp, Rattus norvegicus
aaggcaagttagatgagcactgtgt

SEQ ID NO: 45674 - DNA, 25 bp, Rattus norvegicus
aaggcaagttagttgagcactgtgt

SEQ ID NO: 45675 - DNA, 25 bp, Rattus norvegicus
aaggcaagtttgctgcctcctttct

SEQ ID NO: 45676 - DNA, 25 bp, Rattus norvegicus
aaggcaagtttggtgcctcctttct

SEQ ID NO: 45677 - DNA, 25 bp, Rattus norvegicus
aaggcaatagcccttttggcgctaa

SEQ ID NO: 45678 - DNA, 25 bp, Rattus norvegicus
aaggcaatagccgttttggcgctaa

SEQ ID NO: 45679 - DNA, 25 bp, Rattus norvegicus
aaggcaatcacaacttgctatgcaa

SEQ ID NO: 45680 - DNA, 25 bp, Rattus norvegicus
aaggcaatcacatcttgctatgcaa

SEQ ID NO: 45681 - DNA, 25 bp, Rattus norvegicus
aaggcaatctatccaggtgttaccc

SEQ ID NO: 45682 - DNA, 25 bp, Rattus norvegicus
aaggcaatctatgcaggtgttaccc

SEQ ID NO: 45683 - DNA, 25 bp, Rattus norvegicus
aaggcaatgctgagatattatctaa

SEQ ID NO: 45684 - DNA, 25 bp, Rattus norvegicus
aaggcaatgctgtgatattatctaa

SEQ ID NO: 45685 - DNA, 25 bp, Rattus norvegicus
aaggcaattcaaaccagtgttcatg

SEQ ID NO: 45686 - DNA, 25 bp, Rattus norvegicus
aaggcaattcaatccagtgttcatg

SEQ ID NO: 45687 - DNA, 25 bp, Rattus norvegicus
aaggcacaaagtcgcagagctgctc

SEQ ID NO: 45688 - DNA, 25 bp, Rattus norvegicus
aaggcacaaagtggcagagctgctc

SEQ ID NO: 45689 - DNA, 25 bp, Rattus norvegicus
aaggcacaatcaccttttgacctgc

SEQ ID NO: 45690 - DNA, 25 bp, Rattus norvegicus
aaggcacaatcagcttttgacctgc

SEQ ID NO: 45691 - DNA, 25 bp, Rattus norvegicus
aaggcacacatgataactctcacca

SEQ ID NO: 45692 - DNA, 25 bp, Rattus norvegicus
aaggcacacatgttaactctcacca

SEQ ID NO: 45693 - DNA, 25 bp, Rattus norvegicus
aaggcacacgtgctaagctgtttgt

SEQ ID NO: 45694 - DNA, 25 bp, Rattus norvegicus
aaggcacacgtggtaagctgtttgt

SEQ ID NO: 45695 - DNA, 25 bp, Rattus norvegicus
aaggcacactacaagggagctctca

SEQ ID NO: 45696 - DNA, 25 bp, Rattus norvegicus
aaggcacactactagggagctctca

SEQ ID NO: 45697 - DNA, 25 bp, Rattus norvegicus
aaggcacactccagcacattgaaaa

SEQ ID NO: 45698 - DNA, 25 bp, Rattus norvegicus
aaggcacactcccaatgtcctaagg

SEQ ID NO: 45699 - DNA, 25 bp, Rattus norvegicus
aaggcacactccgaatgtcctaagg

SEQ ID NO: 45700 - DNA, 25 bp, Rattus norvegicus
aaggcacactcctgcacattgaaaa

SEQ ID NO: 45701 - DNA, 25 bp, Rattus norvegicus
aaggcacagcacatctgaataacaa

SEQ ID NO: 45702 - DNA, 25 bp, Rattus norvegicus
aaggcacagcacttctgaataacaa

SEQ ID NO: 45703 - DNA, 25 bp, Rattus norvegicus
aaggcacagcatctattcttatgca

SEQ ID NO: 45704 - DNA, 25 bp, Rattus norvegicus
aaggcacagcatgtattcttatgca

SEQ ID NO: 45705 - DNA, 25 bp, Rattus norvegicus
aaggcacagctgcaggcacggccta

SEQ ID NO: 45706 - DNA, 25 bp, Rattus norvegicus
aaggcacagctggaggcacggccta

SEQ ID NO: 45707 - DNA, 25 bp, Rattus norvegicus
aaggcacaggcacttcttctgagaa

SEQ ID NO: 45708 - DNA, 25 bp, Rattus norvegicus
aaggcacaggcagttcttctgagaa

SEQ ID NO: 45709 - DNA, 25 bp, Rattus norvegicus
aaggcacaggccagtatgatggtct

SEQ ID NO: 45710 - DNA, 25 bp, Rattus norvegicus
aaggcacaggcctgtatgatggtct

SEQ ID NO: 45711 - DNA, 25 bp, Rattus norvegicus
aaggcacagggccagcgttttctct

SEQ ID NO: 45712 - DNA, 25 bp, Rattus norvegicus
aaggcacagggcgagcgttttctct

SEQ ID NO: 45713 - DNA, 25 bp, Rattus norvegicus
aaggcacaggttcgacagacttgaa

SEQ ID NO: 45714 - DNA, 25 bp, Rattus norvegicus
aaggcacaggttggacagacttgaa

SEQ ID NO: 45715 - DNA, 25 bp, Rattus norvegicus
aaggcacagtatagtttctacctca

SEQ ID NO: 45716 - DNA, 25 bp, Rattus norvegicus
aaggcacagtattgtttctacctca

SEQ ID NO: 45717 - DNA, 25 bp, Rattus norvegicus
aaggcacagtcacgagttctggaca

SEQ ID NO: 45718 - DNA, 25 bp, Rattus norvegicus
aaggcacagtcaggagttctggaca

SEQ ID NO: 45719 - DNA, 25 bp, Rattus norvegicus
aaggcacatctcagtctgacacaaa

SEQ ID NO: 45720 - DNA, 25 bp, Rattus norvegicus
aaggcacatctctgtctgacacaaa

SEQ ID NO: 45721 - DNA, 25 bp, Rattus norvegicus
aaggcacattcaaggcttcctgtct

SEQ ID NO: 45722 - DNA, 25 bp, Rattus norvegicus
aaggcacattcatggcttcctgtct

SEQ ID NO: 45723 - DNA, 25 bp, Rattus norvegicus
aaggcacattgtctctttggcacat

SEQ ID NO: 45724 - DNA, 25 bp, Rattus norvegicus
aaggcacattgtgtctttggcacat

SEQ ID NO: 45725 - DNA, 25 bp, Rattus norvegicus
aaggcaccacacaacgctgtctttt

SEQ ID NO: 45726 - DNA, 25 bp, Rattus norvegicus
aaggcaccacactacgctgtctttt

SEQ ID NO: 45727 - DNA, 25 bp, Rattus norvegicus
aaggcaccagacacttccgtgggaa

SEQ ID NO: 45728 - DNA, 25 bp, Rattus norvegicus
aaggcaccagactcttccgtgggaa

SEQ ID NO: 45729 - DNA, 25 bp, Rattus norvegicus
aaggcaccccatagctaatgaaata

SEQ ID NO: 45730 - DNA, 25 bp, Rattus norvegicus
aaggcaccccattgctaatgaaata

SEQ ID NO: 45731 - DNA, 25 bp, Rattus norvegicus
aaggcaccctcaaagtctgtcaaca

SEQ ID NO: 45732 - DNA, 25 bp, Rattus norvegicus
aaggcaccctcatagtctgtcaaca

SEQ ID NO: 45733 - DNA, 25 bp, Rattus norvegicus
aaggcaccctgaattgagtttcaat

SEQ ID NO: 45734 - DNA, 25 bp, Rattus norvegicus
aaggcaccctgatttgagtttcaat

SEQ ID NO: 45735 - DNA, 25 bp, Rattus norvegicus
aaggcaccctttctatgtggacttc

SEQ ID NO: 45736 - DNA, 25 bp, Rattus norvegicus
aaggcaccctttgtatgtggacttc

SEQ ID NO: 45737 - DNA, 25 bp, Rattus norvegicus
aaggcaccgagacttgcttcataat

SEQ ID NO: 45738 - DNA, 25 bp, Rattus norvegicus
aaggcaccgagagttgcttcataat

SEQ ID NO: 45739 - DNA, 25 bp, Rattus norvegicus
aaggcacctccaattctatcttgaa

SEQ ID NO: 45740 - DNA, 25 bp, Rattus norvegicus
aaggcacctccatttctatcttgaa

SEQ ID NO: 45741 - DNA, 25 bp, Rattus norvegicus
aaggcacctgatattgttttctatg

SEQ ID NO: 45742 - DNA, 25 bp, Rattus norvegicus
aaggcacctgattttgttttctatg

SEQ ID NO: 45743 - DNA, 25 bp, Rattus norvegicus
aaggcacctgcacattttgattttt

SEQ ID NO: 45744 - DNA, 25 bp, Rattus norvegicus
aaggcacctgcagattttgattttt

SEQ ID NO: 45745 - DNA, 25 bp, Rattus norvegicus
aaggcacctgccagttagctattct

SEQ ID NO: 45746 - DNA, 25 bp, Rattus norvegicus
aaggcacctgcctgttagctattct

SEQ ID NO: 45747 - DNA, 25 bp, Rattus norvegicus
aaggcacctgtactcatgcgcacat

SEQ ID NO: 45748 - DNA, 25 bp, Rattus norvegicus
aaggcacctgtagtcatgcgcacat

SEQ ID NO: 45749 - DNA, 25 bp, Rattus norvegicus
aaggcacctgtcaactttctagtat

SEQ ID NO: 45750 - DNA, 25 bp, Rattus norvegicus
aaggcacctgtctactttctagtat

SEQ ID NO: 45751 - DNA, 25 bp, Rattus norvegicus
aaggcaccttcacaatacccatttc

SEQ ID NO: 45752 - DNA, 25 bp, Rattus norvegicus
aaggcaccttcagaatacccatttc

SEQ ID NO: 45753 - DNA, 25 bp, Rattus norvegicus
aaggcaccttctcttgtttgtgagc

SEQ ID NO: 45754 - DNA, 25 bp, Rattus norvegicus
aaggcaccttctgttgtttgtgagc

SEQ ID NO: 45755 - DNA, 25 bp, Rattus norvegicus
aaggcaccttgcaaatctgctttag

SEQ ID NO: 45756 - DNA, 25 bp, Rattus norvegicus
aaggcaccttgctaatctgctttag

SEQ ID NO: 45757 - DNA, 25 bp, Rattus norvegicus
aaggcaccttgtactcaatcgggta

SEQ ID NO: 45758 - DNA, 25 bp, Rattus norvegicus
aaggcaccttgttctcaatcgggta

SEQ ID NO: 45759 - DNA, 25 bp, Rattus norvegicus
aaggcacgatccagcacagaaggca

SEQ ID NO: 45760 - DNA, 25 bp, Rattus norvegicus
aaggcacgatcctgcacagaaggca

SEQ ID NO: 45761 - DNA, 25 bp, Rattus norvegicus
aaggcacggaggatgtccaggaaat

SEQ ID NO: 45762 - DNA, 25 bp, Rattus norvegicus
aaggcacggaggttgtccaggaaat

SEQ ID NO: 45763 - DNA, 25 bp, Rattus norvegicus
aaggcacggcggctctgtccgcttc

SEQ ID NO: 45764 - DNA, 25 bp, Rattus norvegicus
aaggcacggcgggtctgtccgcttc

SEQ ID NO: 45765 - DNA, 25 bp, Rattus norvegicus
aaggcactagacacccagggtcttc

SEQ ID NO: 45766 - DNA, 25 bp, Rattus norvegicus
aaggcactagactcccagggtcttc

SEQ ID NO: 45767 - DNA, 25 bp, Rattus norvegicus
aaggcactatggcacttagctctga

SEQ ID NO: 45768 - DNA, 25 bp, Rattus norvegicus
aaggcactatgggacttagctctga

SEQ ID NO: 45769 - DNA, 25 bp, Rattus norvegicus
aaggcactcattatggacagggttc

SEQ ID NO: 45770 - DNA, 25 bp, Rattus norvegicus
aaggcactcattttggacagggttc

SEQ ID NO: 45771 - DNA, 25 bp, Rattus norvegicus
aaggcactccctatggacagagaga

SEQ ID NO: 45772 - DNA, 25 bp, Rattus norvegicus
aaggcactccctttggacagagaga

SEQ ID NO: 45773 - DNA, 25 bp, Rattus norvegicus
aaggcactccgcaaagcgttccggg

SEQ ID NO: 45774 - DNA, 25 bp, Rattus norvegicus
aaggcactccgctaagcgttccggg

SEQ ID NO: 45775 - DNA, 25 bp, Rattus norvegicus
aaggcactcctacgccgggttgagt

SEQ ID NO: 45776 - DNA, 25 bp, Rattus norvegicus
aaggcactcctaggccgggttgagt

SEQ ID NO: 45777 - DNA, 25 bp, Rattus norvegicus
aaggcactcctgaagattctgggca

SEQ ID NO: 45778 - DNA, 25 bp, Rattus norvegicus
aaggcactcctgtagattctgggca

SEQ ID NO: 45779 - DNA, 25 bp, Rattus norvegicus
aaggcactcggtctcatggtgagct

SEQ ID NO: 45780 - DNA, 25 bp, Rattus norvegicus
aaggcactcggtgtcatggtgagct

SEQ ID NO: 45781 - DNA, 25 bp, Rattus norvegicus
aaggcactgatcactccgctgaggg

SEQ ID NO: 45782 - DNA, 25 bp, Rattus norvegicus
aaggcactgatctctccgctgaggg

SEQ ID NO: 45783 - DNA, 25 bp, Rattus norvegicus
aaggcactgatgaaggctgctggct

SEQ ID NO: 45784 - DNA, 25 bp, Rattus norvegicus
aaggcactgatgtaggctgctggct

SEQ ID NO: 45785 - DNA, 25 bp, Rattus norvegicus
aaggcactgcaaactgttcccagta

SEQ ID NO: 45786 - DNA, 25 bp, Rattus norvegicus
aaggcactgcaatctgttcccagta

SEQ ID NO: 45787 - DNA, 25 bp, Rattus norvegicus
aaggcactgcacagttactgtaaag

SEQ ID NO: 45788 - DNA, 25 bp, Rattus norvegicus
aaggcactgcactgttactgtaaag

SEQ ID NO: 45789 - DNA, 25 bp, Rattus norvegicus
aaggcactgctcatttctccagttc

SEQ ID NO: 45790 - DNA, 25 bp, Rattus norvegicus
aaggcactgctcttttctccagttc

SEQ ID NO: 45791 - DNA, 25 bp, Rattus norvegicus
aaggcactggagctgcagaccatga

SEQ ID NO: 45792 - DNA, 25 bp, Rattus norvegicus
aaggcactggaggtgcagaccatga

SEQ ID NO: 45793 - DNA, 25 bp, Rattus norvegicus
aaggcactggatcccaagttagttg

SEQ ID NO: 45794 - DNA, 25 bp, Rattus norvegicus
aaggcactggatgccaagttagttg

SEQ ID NO: 45795 - DNA, 25 bp, Rattus norvegicus
aaggcactggccaaatctgaagaag

SEQ ID NO: 45796 - DNA, 25 bp, Rattus norvegicus
aaggcactggcctaatctgaagaag

SEQ ID NO: 45797 - DNA, 25 bp, Rattus norvegicus
aaggcactgtatcacactttctctg

SEQ ID NO: 45798 - DNA, 25 bp, Rattus norvegicus
aaggcactgtatgacactttctctg

SEQ ID NO: 45799 - DNA, 25 bp, Rattus norvegicus
aaggcactgtcccaggatgagctgt

SEQ ID NO: 45800 - DNA, 25 bp, Rattus norvegicus
aaggcactgtccgaggatgagctgt

SEQ ID NO: 45801 - DNA, 25 bp, Rattus norvegicus
aaggcacttaaccatccaatcagaa

SEQ ID NO: 45802 - DNA, 25 bp, Rattus norvegicus
aaggcacttaacgatccaatcagaa

SEQ ID NO: 45803 - DNA, 25 bp, Rattus norvegicus
aaggcacttacaccggcaacctata

SEQ ID NO: 45804 - DNA, 25 bp, Rattus norvegicus
aaggcacttacagcggcaacctata

SEQ ID NO: 45805 - DNA, 25 bp, Rattus norvegicus
aaggcacttagcagagtcagggtct

SEQ ID NO: 45806 - DNA, 25 bp, Rattus norvegicus
aaggcacttagctgagtcagggtct

SEQ ID NO: 45807 - DNA, 25 bp, Rattus norvegicus
aaggcacttctgagattatggcaag

SEQ ID NO: 45808 - DNA, 25 bp, Rattus norvegicus
aaggcacttctgtgattatggcaag

SEQ ID NO: 45809 - DNA, 25 bp, Rattus norvegicus
aaggcacttgctccccagtctaaag

SEQ ID NO: 45810 - DNA, 25 bp, Rattus norvegicus
aaggcacttgctgcccagtctaaag

SEQ ID NO: 45811 - DNA, 25 bp, Rattus norvegicus
aaggcacttggcaatcatgagtcag

SEQ ID NO: 45812 - DNA, 25 bp, Rattus norvegicus
aaggcacttggctatcatgagtcag

SEQ ID NO: 45813 - DNA, 25 bp, Rattus norvegicus
aaggcacttgtgcagtttctgtagt

SEQ ID NO: 45814 - DNA, 25 bp, Rattus norvegicus
aaggcacttgtggagtttctgtagt

SEQ ID NO: 45815 - DNA, 25 bp, Rattus norvegicus
aaggcagaaatcagggtctccaaag

SEQ ID NO: 45816 - DNA, 25 bp, Rattus norvegicus
aaggcagaaatctgggtctccaaag

SEQ ID NO: 45817 - DNA, 25 bp, Rattus norvegicus
aaggcagaacacaagccctgggcaa

SEQ ID NO: 45818 - DNA, 25 bp, Rattus norvegicus
aaggcagaacactagccctgggcaa

SEQ ID NO: 45819 - DNA, 25 bp, Rattus norvegicus
aaggcagaacgtctacctggagcta

SEQ ID NO: 45820 - DNA, 25 bp, Rattus norvegicus
aaggcagaacgtgtacctggagcta

SEQ ID NO: 45821 - DNA, 25 bp, Rattus norvegicus
aaggcagaactcatgtccaggagct

SEQ ID NO: 45822 - DNA, 25 bp, Rattus norvegicus
aaggcagaactcttgtccaggagct

SEQ ID NO: 45823 - DNA, 25 bp, Rattus norvegicus
aaggcagacaggcagccattttaag

SEQ ID NO: 45824 - DNA, 25 bp, Rattus norvegicus
aaggcagacagggagccattttaag

SEQ ID NO: 45825 - DNA, 25 bp, Rattus norvegicus
aaggcagacctaacggtatcacacc

SEQ ID NO: 45826 - DNA, 25 bp, Rattus norvegicus
aaggcagacctatcggtatcacacc

SEQ ID NO: 45827 - DNA, 25 bp, Rattus norvegicus
aaggcagacctccagtgcttattac

SEQ ID NO: 45828 - DNA, 25 bp, Rattus norvegicus
aaggcagacctcgagtgcttattac

SEQ ID NO: 45829 - DNA, 25 bp, Rattus norvegicus
aaggcagacggaactcttacttcaa

SEQ ID NO: 45830 - DNA, 25 bp, Rattus norvegicus
aaggcagacggatctcttacttcaa

SEQ ID NO: 45831 - DNA, 25 bp, Rattus norvegicus
aaggcagactatacctacagcggga

SEQ ID NO: 45832 - DNA, 25 bp, Rattus norvegicus
aaggcagactattcctacagcggga

SEQ ID NO: 45833 - DNA, 25 bp, Rattus norvegicus
aaggcagacttccaaacatcatgtt

SEQ ID NO: 45834 - DNA, 25 bp, Rattus norvegicus
aaggcagacttcgaaacatcatgtt

SEQ ID NO: 45835 - DNA, 25 bp, Rattus norvegicus
aaggcagagccaacttccgcaacgg

SEQ ID NO: 45836 - DNA, 25 bp, Rattus norvegicus
aaggcagagccatcttccgcaacgg

SEQ ID NO: 45837 - DNA, 25 bp, Rattus norvegicus
aaggcagaggagaacttctcactta

SEQ ID NO: 45838 - DNA, 25 bp, Rattus norvegicus
aaggcagaggagtacttctcactta

SEQ ID NO: 45839 - DNA, 25 bp, Rattus norvegicus
aaggcagaggcaacttgacgcccct

SEQ ID NO: 45840 - DNA, 25 bp, Rattus norvegicus
aaggcagaggcatcttgacgcccct

SEQ ID NO: 45841 - DNA, 25 bp, Rattus norvegicus
aaggcagaggccacccggtcaagca

SEQ ID NO: 45842 - DNA, 25 bp, Rattus norvegicus
aaggcagaggccctctccttggaga

SEQ ID NO: 45843 - DNA, 25 bp, Rattus norvegicus
aaggcagaggccgtctccttggaga

SEQ ID NO: 45844 - DNA, 25 bp, Rattus norvegicus
aaggcagaggcctcccggtcaagca

SEQ ID NO: 45845 - DNA, 25 bp, Rattus norvegicus
aaggcagagtatcttttccctcctg

SEQ ID NO: 45846 - DNA, 25 bp, Rattus norvegicus
aaggcagagtatgttttccctcctg

SEQ ID NO: 45847 - DNA, 25 bp, Rattus norvegicus
aaggcagagtgcctttgtaccctcc

SEQ ID NO: 45848 - DNA, 25 bp, Rattus norvegicus
aaggcagagtgcgtttgtaccctcc

SEQ ID NO: 45849 - DNA, 25 bp, Rattus norvegicus
aaggcagatcggattcctctgagga

SEQ ID NO: 45850 - DNA, 25 bp, Rattus norvegicus
aaggcagatcggtttcctctgagga

SEQ ID NO: 45851 - DNA, 25 bp, Rattus norvegicus
aaggcagatgacacaagggaaccag

SEQ ID NO: 45852 - DNA, 25 bp, Rattus norvegicus
aaggcagatgactcaagggaaccag

SEQ ID NO: 45853 - DNA, 25 bp, Rattus norvegicus
aaggcagatgcacgtcggtccacat

SEQ ID NO: 45854 - DNA, 25 bp, Rattus norvegicus
aaggcagatgcaggtcggtccacat

SEQ ID NO: 45855 - DNA, 25 bp, Rattus norvegicus
aaggcagatgctctccaggactcgg

SEQ ID NO: 45856 - DNA, 25 bp, Rattus norvegicus
aaggcagatgctgtccaggactcgg

SEQ ID NO: 45857 - DNA, 25 bp, Rattus norvegicus
aaggcagattaactccttcacccac

SEQ ID NO: 45858 - DNA, 25 bp, Rattus norvegicus
aaggcagattaagtccttcacccac

SEQ ID NO: 45859 - DNA, 25 bp, Rattus norvegicus
aaggcagattgcatgggccctgcga

SEQ ID NO: 45860 - DNA, 25 bp, Rattus norvegicus
aaggcagattgcttgggccctgcga

SEQ ID NO: 45861 - DNA, 25 bp, Rattus norvegicus
aaggcagcaaggacgtagctgtgtt

SEQ ID NO: 45862 - DNA, 25 bp, Rattus norvegicus
aaggcagcaaggatctgctcccgaa

SEQ ID NO: 45863 - DNA, 25 bp, Rattus norvegicus
aaggcagcaaggtcgtagctgtgtt

SEQ ID NO: 45864 - DNA, 25 bp, Rattus norvegicus
aaggcagcaaggttctgctcccgaa

SEQ ID NO: 45865 - DNA, 25 bp, Rattus norvegicus
aaggcagcaagtacacgtcattcat

SEQ ID NO: 45866 - DNA, 25 bp, Rattus norvegicus
aaggcagcaagttcacgtcattcat

SEQ ID NO: 45867 - DNA, 25 bp, Rattus norvegicus
aaggcagcagcaagagcttcaacaa

SEQ ID NO: 45868 - DNA, 25 bp, Rattus norvegicus
aaggcagcagcatgagcttcaacaa

SEQ ID NO: 45869 - DNA, 25 bp, Rattus norvegicus
aaggcagcagccacaggcaacggag

SEQ ID NO: 45870 - DNA, 25 bp, Rattus norvegicus
aaggcagcagcctcaggcaacggag

SEQ ID NO: 45871 - DNA, 25 bp, Rattus norvegicus
aaggcagcagctaatggtggccctc

SEQ ID NO: 45872 - DNA, 25 bp, Rattus norvegicus
aaggcagcagctctcagcagttaga

SEQ ID NO: 45873 - DNA, 25 bp, Rattus norvegicus
aaggcagcagctgtcagcagttaga

SEQ ID NO: 45874 - DNA, 25 bp, Rattus norvegicus
aaggcagcagcttatggtggccctc

SEQ ID NO: 45875 - DNA, 25 bp, Rattus norvegicus
aaggcagcatcacctcgaggctcaa

SEQ ID NO: 45876 - DNA, 25 bp, Rattus norvegicus
aaggcagcatcagctcgaggctcaa

SEQ ID NO: 45877 - DNA, 25 bp, Rattus norvegicus
aaggcagcatgaactcagcgagagt

SEQ ID NO: 45878 - DNA, 25 bp, Rattus norvegicus
aaggcagcatgatctcagcgagagt

SEQ ID NO: 45879 - DNA, 25 bp, Rattus norvegicus
aaggcagcatgtctgagccggcacc

SEQ ID NO: 45880 - DNA, 25 bp, Rattus norvegicus
aaggcagcatgtgtgagccggcacc

SEQ ID NO: 45881 - DNA, 25 bp, Rattus norvegicus
aaggcagcattcagtgcaaacccct

SEQ ID NO: 45882 - DNA, 25 bp, Rattus norvegicus
aaggcagcattctgtgcaaacccct

SEQ ID NO: 45883 - DNA, 25 bp, Rattus norvegicus
aaggcagccaccaacattatgtgtg

SEQ ID NO: 45884 - DNA, 25 bp, Rattus norvegicus
aaggcagccacctacattatgtgtg

SEQ ID NO: 45885 - DNA, 25 bp, Rattus norvegicus
aaggcagccagacacatagctacgt

SEQ ID NO: 45886 - DNA, 25 bp, Rattus norvegicus
aaggcagccagactgagcaccttgc

SEQ ID NO: 45887 - DNA, 25 bp, Rattus norvegicus
aaggcagccagagacatagctacgt

SEQ ID NO: 45888 - DNA, 25 bp, Rattus norvegicus
aaggcagccagagtgagcaccttgc

SEQ ID NO: 45889 - DNA, 25 bp, Rattus norvegicus
aaggcagccagcagagcctggttgt

SEQ ID NO: 45890 - DNA, 25 bp, Rattus norvegicus
aaggcagccagctgagcctggttgt

SEQ ID NO: 45891 - DNA, 25 bp, Rattus norvegicus
aaggcagccatccatacctggacag

SEQ ID NO: 45892 - DNA, 25 bp, Rattus norvegicus
aaggcagccatcgatacctggacag

SEQ ID NO: 45893 - DNA, 25 bp, Rattus norvegicus
aaggcagccattattctgtagcagg

SEQ ID NO: 45894 - DNA, 25 bp, Rattus norvegicus
aaggcagccatttttctgtagcagg

SEQ ID NO: 45895 - DNA, 25 bp, Rattus norvegicus
aaggcagcccggcttagcactgtgc

SEQ ID NO: 45896 - DNA, 25 bp, Rattus norvegicus
aaggcagcccgggttagcactgtgc

SEQ ID NO: 45897 - DNA, 25 bp, Rattus norvegicus
aaggcagccctccagattttgtaga

SEQ ID NO: 45898 - DNA, 25 bp, Rattus norvegicus
aaggcagccctcgagattttgtaga

SEQ ID NO: 45899 - DNA, 25 bp, Rattus norvegicus
aaggcagccctgcatgaccaactga

SEQ ID NO: 45900 - DNA, 25 bp, Rattus norvegicus
aaggcagccctggatgaccaactga

SEQ ID NO: 45901 - DNA, 25 bp, Rattus norvegicus
aaggcagcccttaggagctcttaga

SEQ ID NO: 45902 - DNA, 25 bp, Rattus norvegicus
aaggcagccctttggagctcttaga

SEQ ID NO: 45903 - DNA, 25 bp, Rattus norvegicus
aaggcagccgggatgactcctcctg

SEQ ID NO: 45904 - DNA, 25 bp, Rattus norvegicus
aaggcagccgggttgactcctcctg

SEQ ID NO: 45905 - DNA, 25 bp, Rattus norvegicus
aaggcagccttcaacagacatagga

SEQ ID NO: 45906 - DNA, 25 bp, Rattus norvegicus
aaggcagccttctacagacatagga

SEQ ID NO: 45907 - DNA, 25 bp, Rattus norvegicus
aaggcagcctttatcatccagcagt

SEQ ID NO: 45908 - DNA, 25 bp, Rattus norvegicus
aaggcagcctttttcatccagcagt

SEQ ID NO: 45909 - DNA, 25 bp, Rattus norvegicus
aaggcagcgatgaatgcatttttat

SEQ ID NO: 45910 - DNA, 25 bp, Rattus norvegicus
aaggcagcgatgtatgcatttttat

SEQ ID NO: 45911 - DNA, 25 bp, Rattus norvegicus
aaggcagcgtccctggcatctcagc

SEQ ID NO: 45912 - DNA, 25 bp, Rattus norvegicus
aaggcagcgtccgtggcatctcagc

SEQ ID NO: 45913 - DNA, 25 bp, Rattus norvegicus
aaggcagcgtttctgatggcgccta

SEQ ID NO: 45914 - DNA, 25 bp, Rattus norvegicus
aaggcagcgtttgtgatggcgccta

SEQ ID NO: 45915 - DNA, 25 bp, Rattus norvegicus
aaggcagctacgcttactccttcat

SEQ ID NO: 45916 - DNA, 25 bp, Rattus norvegicus
aaggcagctacggttactccttcat

SEQ ID NO: 45917 - DNA, 25 bp, Rattus norvegicus
aaggcagctctgaccgtggttgagc

SEQ ID NO: 45918 - DNA, 25 bp, Rattus norvegicus
aaggcagctctgtccgtggttgagc

SEQ ID NO: 45919 - DNA, 25 bp, Rattus norvegicus
aaggcagctgatcgcaccagaacca

SEQ ID NO: 45920 - DNA, 25 bp, Rattus norvegicus
aaggcagctgatggcaccagaacca

SEQ ID NO: 45921 - DNA, 25 bp, Rattus norvegicus
aaggcagctgctacgtacagagcta

SEQ ID NO: 45922 - DNA, 25 bp, Rattus norvegicus
aaggcagctgcttcgtacagagcta

SEQ ID NO: 45923 - DNA, 25 bp, Rattus norvegicus
aaggcagctgtcattggcagtctga

SEQ ID NO: 45924 - DNA, 25 bp, Rattus norvegicus
aaggcagctgtctttggcagtctga

SEQ ID NO: 45925 - DNA, 25 bp, Rattus norvegicus
aaggcagctgtgagcatcctggtca

SEQ ID NO: 45926 - DNA, 25 bp, Rattus norvegicus
aaggcagctgtgtgcatcctggtca

SEQ ID NO: 45927 - DNA, 25 bp, Rattus norvegicus
aaggcagcttaactgctttcctcct

SEQ ID NO: 45928 - DNA, 25 bp, Rattus norvegicus
aaggcagcttaagtgctttcctcct

SEQ ID NO: 45929 - DNA, 25 bp, Rattus norvegicus
aaggcagcttctaagagtcttaccc

SEQ ID NO: 45930 - DNA, 25 bp, Rattus norvegicus
aaggcagcttcttagagtcttaccc

SEQ ID NO: 45931 - DNA, 25 bp, Rattus norvegicus
aaggcagcttgaagagttcagccat

SEQ ID NO: 45932 - DNA, 25 bp, Rattus norvegicus
aaggcagcttgaccttcggtgccat

SEQ ID NO: 45933 - DNA, 25 bp, Rattus norvegicus
aaggcagcttgagcttcggtgccat

SEQ ID NO: 45934 - DNA, 25 bp, Rattus norvegicus
aaggcagcttgatgagttcagccat

SEQ ID NO: 45935 - DNA, 25 bp, Rattus norvegicus
aaggcaggacagacctactctctat

SEQ ID NO: 45936 - DNA, 25 bp, Rattus norvegicus
aaggcaggacagtcctactctctat

SEQ ID NO: 45937 - DNA, 25 bp, Rattus norvegicus
aaggcaggaggtatccttcttgctg

SEQ ID NO: 45938 - DNA, 25 bp, Rattus norvegicus
aaggcaggaggtttccttcttgctg

SEQ ID NO: 45939 - DNA, 25 bp, Rattus norvegicus
aaggcaggcagaacctcctaaacct

SEQ ID NO: 45940 - DNA, 25 bp, Rattus norvegicus
aaggcaggcagatcctcctaaacct

SEQ ID NO: 45941 - DNA, 25 bp, Rattus norvegicus
aaggcaggcattcagctctggagca

SEQ ID NO: 45942 - DNA, 25 bp, Rattus norvegicus
aaggcaggcattgagctctggagca

SEQ ID NO: 45943 - DNA, 25 bp, Rattus norvegicus
aaggcaggccagagactacttttga

SEQ ID NO: 45944 - DNA, 25 bp, Rattus norvegicus
aaggcaggccagtgactacttttga

SEQ ID NO: 45945 - DNA, 25 bp, Rattus norvegicus
aaggcaggccctctgtgtcaccaaa

SEQ ID NO: 45946 - DNA, 25 bp, Rattus norvegicus
aaggcaggccctgtgtgtcaccaaa

SEQ ID NO: 45947 - DNA, 25 bp, Rattus norvegicus
aaggcaggcctcatggcagtctcag

SEQ ID NO: 45948 - DNA, 25 bp, Rattus norvegicus
aaggcaggcctcttggcagtctcag

SEQ ID NO: 45949 - DNA, 25 bp, Rattus norvegicus
aaggcaggctgtcgccatgtagccc

SEQ ID NO: 45950 - DNA, 25 bp, Rattus norvegicus
aaggcaggctgtggccatgtagccc

SEQ ID NO: 45951 - DNA, 25 bp, Rattus norvegicus
aaggcaggcttgatgttgcagccca

SEQ ID NO: 45952 - DNA, 25 bp, Rattus norvegicus
aaggcaggcttgctaacgctctggt

SEQ ID NO: 45953 - DNA, 25 bp, Rattus norvegicus
aaggcaggcttggtaacgctctggt

SEQ ID NO: 45954 - DNA, 25 bp, Rattus norvegicus
aaggcaggcttgttgttgcagccca

SEQ ID NO: 45955 - DNA, 25 bp, Rattus norvegicus
aaggcagggaggcttccctcacatg

SEQ ID NO: 45956 - DNA, 25 bp, Rattus norvegicus
aaggcagggagggttccctcacatg

SEQ ID NO: 45957 - DNA, 25 bp, Rattus norvegicus
aaggcagggatgacaccaggctcta

SEQ ID NO: 45958 - DNA, 25 bp, Rattus norvegicus
aaggcagggatgtcaccaggctcta

SEQ ID NO: 45959 - DNA, 25 bp, Rattus norvegicus
aaggcagggattacctttgctccga

SEQ ID NO: 45960 - DNA, 25 bp, Rattus norvegicus
aaggcagggatttcctttgctccga

SEQ ID NO: 45961 - DNA, 25 bp, Rattus norvegicus
aaggcagggctgctccctaatagca

SEQ ID NO: 45962 - DNA, 25 bp, Rattus norvegicus
aaggcagggctggtccctaatagca

SEQ ID NO: 45963 - DNA, 25 bp, Rattus norvegicus
aaggcagggtagactctgaagcagt

SEQ ID NO: 45964 - DNA, 25 bp, Rattus norvegicus
aaggcagggtagtctctgaagcagt

SEQ ID NO: 45965 - DNA, 25 bp, Rattus norvegicus
aaggcaggtagcatggtttccaaat

SEQ ID NO: 45966 - DNA, 25 bp, Rattus norvegicus
aaggcaggtagcttggtttccaaat

SEQ ID NO: 45967 - DNA, 25 bp, Rattus norvegicus
aaggcaggtccaagtagtcgttaat

SEQ ID NO: 45968 - DNA, 25 bp, Rattus norvegicus
aaggcaggtccatgtagtcgttaat

SEQ ID NO: 45969 - DNA, 25 bp, Rattus norvegicus
aaggcaggtctgatcactttgcatg

SEQ ID NO: 45970 - DNA, 25 bp, Rattus norvegicus
aaggcaggtctgttcactttgcatg

SEQ ID NO: 45971 - DNA, 25 bp, Rattus norvegicus
aaggcaggttccacaccaataactt

SEQ ID NO: 45972 - DNA, 25 bp, Rattus norvegicus
aaggcaggttcctcaccaataactt

SEQ ID NO: 45973 - DNA, 25 bp, Rattus norvegicus
aaggcagtacagatgtccccaatag

SEQ ID NO: 45974 - DNA, 25 bp, Rattus norvegicus
aaggcagtacagttgtccccaatag

SEQ ID NO: 45975 - DNA, 25 bp, Rattus norvegicus
aaggcagtacctaaaccaagaattg

SEQ ID NO: 45976 - DNA, 25 bp, Rattus norvegicus
aaggcagtaccttaaccaagaattg

SEQ ID NO: 45977 - DNA, 25 bp, Rattus norvegicus
aaggcagtactcaccattctttagg

SEQ ID NO: 45978 - DNA, 25 bp, Rattus norvegicus
aaggcagtactctccattctttagg

SEQ ID NO: 45979 - DNA, 25 bp, Rattus norvegicus
aaggcagtatttattcaggctcccc

SEQ ID NO: 45980 - DNA, 25 bp, Rattus norvegicus
aaggcagtatttattgaccgtatga

SEQ ID NO: 45981 - DNA, 25 bp, Rattus norvegicus
aaggcagtattttttcaggctcccc

SEQ ID NO: 45982 - DNA, 25 bp, Rattus norvegicus
aaggcagtattttttgaccgtatga

SEQ ID NO: 45983 - DNA, 25 bp, Rattus norvegicus
aaggcagtcaacatgcatgtgatac

SEQ ID NO: 45984 - DNA, 25 bp, Rattus norvegicus
aaggcagtcaacttgcatgtgatac

SEQ ID NO: 45985 - DNA, 25 bp, Rattus norvegicus
aaggcagtcacacaagttttcccgg

SEQ ID NO: 45986 - DNA, 25 bp, Rattus norvegicus
aaggcagtcacagaagttttcccgg

SEQ ID NO: 45987 - DNA, 25 bp, Rattus norvegicus
aaggcagtcaggcatcctctgaggc

SEQ ID NO: 45988 - DNA, 25 bp, Rattus norvegicus
aaggcagtcagggatcctctgaggc

SEQ ID NO: 45989 - DNA, 25 bp, Rattus norvegicus
aaggcagtcagtattttccagatca

SEQ ID NO: 45990 - DNA, 25 bp, Rattus norvegicus
aaggcagtcagttttttccagatca

SEQ ID NO: 45991 - DNA, 25 bp, Rattus norvegicus
aaggcagtccgtcgaaagcaggcta

SEQ ID NO: 45992 - DNA, 25 bp, Rattus norvegicus
aaggcagtccgtggaaagcaggcta

SEQ ID NO: 45993 - DNA, 25 bp, Rattus norvegicus
aaggcagtcctacttgaccgactca

SEQ ID NO: 45994 - DNA, 25 bp, Rattus norvegicus
aaggcagtcctagttgaccgactca

SEQ ID NO: 45995 - DNA, 25 bp, Rattus norvegicus
aaggcagtcgtgctatggtgtctcc

SEQ ID NO: 45996 - DNA, 25 bp, Rattus norvegicus
aaggcagtcgtggtatggtgtctcc

SEQ ID NO: 45997 - DNA, 25 bp, Rattus norvegicus
aaggcagtctgcagcggatccacgg

SEQ ID NO: 45998 - DNA, 25 bp, Rattus norvegicus
aaggcagtctgctgcggatccacgg

SEQ ID NO: 45999 - DNA, 25 bp, Rattus norvegicus
aaggcagtcttcactttaatgttgt

SEQ ID NO: 46000 - DNA, 25 bp, Rattus norvegicus
aaggcagtcttctctttaatgttgt

SEQ ID NO: 46001 - DNA, 25 bp, Rattus norvegicus
aaggcagtgaccacggtttctgaaa

SEQ ID NO: 46002 - DNA, 25 bp, Rattus norvegicus
aaggcagtgacctcggtttctgaaa

SEQ ID NO: 46003 - DNA, 25 bp, Rattus norvegicus
aaggcagtgcaaaccttagctgcta

SEQ ID NO: 46004 - DNA, 25 bp, Rattus norvegicus
aaggcagtgcaatccttagctgcta

SEQ ID NO: 46005 - DNA, 25 bp, Rattus norvegicus
aaggcagtgcatctgtaatcacgat

SEQ ID NO: 46006 - DNA, 25 bp, Rattus norvegicus
aaggcagtgcatgtgtaatcacgat

SEQ ID NO: 46007 - DNA, 25 bp, Rattus norvegicus
aaggcagtggagcaaccctcagagt

SEQ ID NO: 46008 - DNA, 25 bp, Rattus norvegicus
aaggcagtggaggaaccctcagagt

SEQ ID NO: 46009 - DNA, 25 bp, Rattus norvegicus
aaggcagtggatactgtgctggcaa

SEQ ID NO: 46010 - DNA, 25 bp, Rattus norvegicus
aaggcagtggattctgtgctggcaa

SEQ ID NO: 46011 - DNA, 25 bp, Rattus norvegicus
aaggcagtggcgctgctctatccgc

SEQ ID NO: 46012 - DNA, 25 bp, Rattus norvegicus
aaggcagtggcggtgctctatccgc

SEQ ID NO: 46013 - DNA, 25 bp, Rattus norvegicus
aaggcagtgggcagcagtcctagcc

SEQ ID NO: 46014 - DNA, 25 bp, Rattus norvegicus
aaggcagtgggctgcagtcctagcc

SEQ ID NO: 46015 - DNA, 25 bp, Rattus norvegicus
aaggcagtggtcctagcagcacgtt

SEQ ID NO: 46016 - DNA, 25 bp, Rattus norvegicus
aaggcagtggtcgtagcagcacgtt

SEQ ID NO: 46017 - DNA, 25 bp, Rattus norvegicus
aaggcagtgtgcacacaaagcaagg

SEQ ID NO: 46018 - DNA, 25 bp, Rattus norvegicus
aaggcagtgtgccaccatcacctgg

SEQ ID NO: 46019 - DNA, 25 bp, Rattus norvegicus
aaggcagtgtgcgaccatcacctgg

SEQ ID NO: 46020 - DNA, 25 bp, Rattus norvegicus
aaggcagtgtgctcacaaagcaagg

SEQ ID NO: 46021 - DNA, 25 bp, Rattus norvegicus
aaggcagttaccagaggcccaccaa

SEQ ID NO: 46022 - DNA, 25 bp, Rattus norvegicus
aaggcagttacctgaggcccaccaa

SEQ ID NO: 46023 - DNA, 25 bp, Rattus norvegicus
aaggcagttactagagcggcagcac

SEQ ID NO: 46024 - DNA, 25 bp, Rattus norvegicus
aaggcagttacttgagcggcagcac

SEQ ID NO: 46025 - DNA, 25 bp, Rattus norvegicus
aaggcagttcatccggactttttta

SEQ ID NO: 46026 - DNA, 25 bp, Rattus norvegicus
aaggcagttcatgcggactttttta

SEQ ID NO: 46027 - DNA, 25 bp, Rattus norvegicus
aaggcagttccgctttggtgtgcct

SEQ ID NO: 46028 - DNA, 25 bp, Rattus norvegicus
aaggcagttccggtttggtgtgcct

SEQ ID NO: 46029 - DNA, 25 bp, Rattus norvegicus
aaggcagttctacgttcggcgccgc

SEQ ID NO: 46030 - DNA, 25 bp, Rattus norvegicus
aaggcagttctaggttcggcgccgc

SEQ ID NO: 46031 - DNA, 25 bp, Rattus norvegicus
aaggcagttctcagagccagtgcca

SEQ ID NO: 46032 - DNA, 25 bp, Rattus norvegicus
aaggcagttctctgagccagtgcca

SEQ ID NO: 46033 - DNA, 25 bp, Rattus norvegicus
aaggcagtttgtctataaacactga

SEQ ID NO: 46034 - DNA, 25 bp, Rattus norvegicus
aaggcagtttgtgtataaacactga

SEQ ID NO: 46035 - DNA, 25 bp, Rattus norvegicus
aaggcataagtcacggcactgtgta

SEQ ID NO: 46036 - DNA, 25 bp, Rattus norvegicus
aaggcataagtctcggcactgtgta

SEQ ID NO: 46037 - DNA, 25 bp, Rattus norvegicus
aaggcataggcaccaccacaagtaa

SEQ ID NO: 46038 - DNA, 25 bp, Rattus norvegicus
aaggcataggcagcaccacaagtaa

SEQ ID NO: 46039 - DNA, 25 bp, Rattus norvegicus
aaggcataggccctgagtttttaat

SEQ ID NO: 46040 - DNA, 25 bp, Rattus norvegicus
aaggcataggccgtgagtttttaat

SEQ ID NO: 46041 - DNA, 25 bp, Rattus norvegicus
aaggcatcaatcaagaaccgggttc

SEQ ID NO: 46042 - DNA, 25 bp, Rattus norvegicus
aaggcatcaatctagaaccgggttc

SEQ ID NO: 46043 - DNA, 25 bp, Rattus norvegicus
aaggcatcacgtcatggggttctat

SEQ ID NO: 46044 - DNA, 25 bp, Rattus norvegicus
aaggcatcacgtcctggggctttaa

SEQ ID NO: 46045 - DNA, 25 bp, Rattus norvegicus
aaggcatcacgtgatggggttctat

SEQ ID NO: 46046 - DNA, 25 bp, Rattus norvegicus
aaggcatcacgtgctggggctttaa

SEQ ID NO: 46047 - DNA, 25 bp, Rattus norvegicus
aaggcatcagggatgtgtcccttga

SEQ ID NO: 46048 - DNA, 25 bp, Rattus norvegicus
aaggcatcagggttgtgtcccttga

SEQ ID NO: 46049 - DNA, 25 bp, Rattus norvegicus
aaggcatcagtgagactagcatttt

SEQ ID NO: 46050 - DNA, 25 bp, Rattus norvegicus
aaggcatcagtgtgactagcatttt

SEQ ID NO: 46051 - DNA, 25 bp, Rattus norvegicus
aaggcatcatctactacactggaaa

SEQ ID NO: 46052 - DNA, 25 bp, Rattus norvegicus
aaggcatcatcttctacactggaaa

SEQ ID NO: 46053 - DNA, 25 bp, Rattus norvegicus
aaggcatccaccatcgagatcatgt

SEQ ID NO: 46054 - DNA, 25 bp, Rattus norvegicus
aaggcatccaccttcgagatcatgt

SEQ ID NO: 46055 - DNA, 25 bp, Rattus norvegicus
aaggcatccagtacagagggtctca

SEQ ID NO: 46056 - DNA, 25 bp, Rattus norvegicus
aaggcatccagtcacctagttggac

SEQ ID NO: 46057 - DNA, 25 bp, Rattus norvegicus
aaggcatccagtgacctagttggac

SEQ ID NO: 46058 - DNA, 25 bp, Rattus norvegicus
aaggcatccagttcagagggtctca

SEQ ID NO: 46059 - DNA, 25 bp, Rattus norvegicus
aaggcatcccttccctcttcgtgga

SEQ ID NO: 46060 - DNA, 25 bp, Rattus norvegicus
aaggcatcccttgcctcttcgtgga

SEQ ID NO: 46061 - DNA, 25 bp, Rattus norvegicus
aaggcatcctaacgagtccctgttt

SEQ ID NO: 46062 - DNA, 25 bp, Rattus norvegicus
aaggcatcctaaggagtccctgttt

SEQ ID NO: 46063 - DNA, 25 bp, Rattus norvegicus
aaggcatccttcaccctaagggaga

SEQ ID NO: 46064 - DNA, 25 bp, Rattus norvegicus
aaggcatccttctccctaagggaga

SEQ ID NO: 46065 - DNA, 25 bp, Rattus norvegicus
aaggcatcgagcatgtaccgcatga

SEQ ID NO: 46066 - DNA, 25 bp, Rattus norvegicus
aaggcatcgagcttgtaccgcatga

SEQ ID NO: 46067 - DNA, 25 bp, Rattus norvegicus
aaggcatcgtcaccaaactgttctg

SEQ ID NO: 46068 - DNA, 25 bp, Rattus norvegicus
aaggcatcgtcagcaaactgttctg

SEQ ID NO: 46069 - DNA, 25 bp, Rattus norvegicus
aaggcatctcaaacaaatctctcac

SEQ ID NO: 46070 - DNA, 25 bp, Rattus norvegicus
aaggcatctcaatcaaatctctcac

SEQ ID NO: 46071 - DNA, 25 bp, Rattus norvegicus
aaggcatctcttaccatattgaatg

SEQ ID NO: 46072 - DNA, 25 bp, Rattus norvegicus
aaggcatctctttccatattgaatg

SEQ ID NO: 46073 - DNA, 25 bp, Rattus norvegicus
aaggcatctgaaccctgaagaagtg

SEQ ID NO: 46074 - DNA, 25 bp, Rattus norvegicus
aaggcatctgaagcctgaagaagtg

SEQ ID NO: 46075 - DNA, 25 bp, Rattus norvegicus
aaggcatctgagcttaccctgagag

SEQ ID NO: 46076 - DNA, 25 bp, Rattus norvegicus
aaggcatctgaggttaccctgagag

SEQ ID NO: 46077 - DNA, 25 bp, Rattus norvegicus
aaggcatctgcacccattgacaatg

SEQ ID NO: 46078 - DNA, 25 bp, Rattus norvegicus
aaggcatctgcagccattgacaatg

SEQ ID NO: 46079 - DNA, 25 bp, Rattus norvegicus
aaggcatctgggaccgcacaacagt

SEQ ID NO: 46080 - DNA, 25 bp, Rattus norvegicus
aaggcatctgggtccgcacaacagt

SEQ ID NO: 46081 - DNA, 25 bp, Rattus norvegicus
aaggcatcttccacagatcccttct

SEQ ID NO: 46082 - DNA, 25 bp, Rattus norvegicus
aaggcatcttcctcagatcccttct

SEQ ID NO: 46083 - DNA, 25 bp, Rattus norvegicus
aaggcatcttgccatcagaggctaa

SEQ ID NO: 46084 - DNA, 25 bp, Rattus norvegicus
aaggcatcttgcgatcagaggctaa

SEQ ID NO: 46085 - DNA, 25 bp, Rattus norvegicus
aaggcatctttgcaacctgggccaa

SEQ ID NO: 46086 - DNA, 25 bp, Rattus norvegicus
aaggcatctttggaacctgggccaa

SEQ ID NO: 46087 - DNA, 25 bp, Rattus norvegicus
aaggcatgactgcatacttatctag

SEQ ID NO: 46088 - DNA, 25 bp, Rattus norvegicus
aaggcatgactggatacttatctag

SEQ ID NO: 46089 - DNA, 25 bp, Rattus norvegicus
aaggcatgacttatcttaaaatagt

SEQ ID NO: 46090 - DNA, 25 bp, Rattus norvegicus
aaggcatgacttttcttaaaatagt

SEQ ID NO: 46091 - DNA, 25 bp, Rattus norvegicus
aaggcatgagttctcagttttcagt

SEQ ID NO: 46092 - DNA, 25 bp, Rattus norvegicus
aaggcatgagttgtcagttttcagt

SEQ ID NO: 46093 - DNA, 25 bp, Rattus norvegicus
aaggcatgccctcatcaattatttc

SEQ ID NO: 46094 - DNA, 25 bp, Rattus norvegicus
aaggcatgccctgatcaattatttc

SEQ ID NO: 46095 - DNA, 25 bp, Rattus norvegicus
aaggcatgcctcaatatattggcta

SEQ ID NO: 46096 - DNA, 25 bp, Rattus norvegicus
aaggcatgcctctatatattggcta

SEQ ID NO: 46097 - DNA, 25 bp, Rattus norvegicus
aaggcatgcgccagcagagtgcagc

SEQ ID NO: 46098 - DNA, 25 bp, Rattus norvegicus
aaggcatgcgcctgcagagtgcagc

SEQ ID NO: 46099 - DNA, 25 bp, Rattus norvegicus
aaggcatgcttaattggttttgtca

SEQ ID NO: 46100 - DNA, 25 bp, Rattus norvegicus
aaggcatgcttatttggttttgtca

SEQ ID NO: 46101 - DNA, 25 bp, Rattus norvegicus
aaggcatggaccaaatgaacgggca

SEQ ID NO: 46102 - DNA, 25 bp, Rattus norvegicus
aaggcatggacctaatgaacgggca

SEQ ID NO: 46103 - DNA, 25 bp, Rattus norvegicus
aaggcatggagcagctggccagact

SEQ ID NO: 46104 - DNA, 25 bp, Rattus norvegicus
aaggcatggagcatctctacaacat

SEQ ID NO: 46105 - DNA, 25 bp, Rattus norvegicus
aaggcatggagctgctggccagact

SEQ ID NO: 46106 - DNA, 25 bp, Rattus norvegicus
aaggcatggagcttctctacaacat

SEQ ID NO: 46107 - DNA, 25 bp, Rattus norvegicus
aaggcatggagtagtcaccacccac

SEQ ID NO: 46108 - DNA, 25 bp, Rattus norvegicus
aaggcatggagttgtcaccacccac

SEQ ID NO: 46109 - DNA, 25 bp, Rattus norvegicus
aaggcatggcataaaggtgacatca

SEQ ID NO: 46110 - DNA, 25 bp, Rattus norvegicus
aaggcatggcattaaggtgacatca

SEQ ID NO: 46111 - DNA, 25 bp, Rattus norvegicus
aaggcatggcgtacatcgagcggaa

SEQ ID NO: 46112 - DNA, 25 bp, Rattus norvegicus
aaggcatggcgttcatcgagcggaa

SEQ ID NO: 46113 - DNA, 25 bp, Rattus norvegicus
aaggcatggctgaaagccccagttt

SEQ ID NO: 46114 - DNA, 25 bp, Rattus norvegicus
aaggcatggctgtaagccccagttt

SEQ ID NO: 46115 - DNA, 25 bp, Rattus norvegicus
aaggcatggtgtactgactcggctc

SEQ ID NO: 46116 - DNA, 25 bp, Rattus norvegicus
aaggcatggtgttctgactcggctc

SEQ ID NO: 46117 - DNA, 25 bp, Rattus norvegicus
aaggcatgtattatagtctcagcga

SEQ ID NO: 46118 - DNA, 25 bp, Rattus norvegicus
aaggcatgtattttagtctcagcga

SEQ ID NO: 46119 - DNA, 25 bp, Rattus norvegicus
aaggcatgtcagatctttttctcac

SEQ ID NO: 46120 - DNA, 25 bp, Rattus norvegicus
aaggcatgtcagttctttttctcac

SEQ ID NO: 46121 - DNA, 25 bp, Rattus norvegicus
aaggcatgttttctgctcttgtcac

SEQ ID NO: 46122 - DNA, 25 bp, Rattus norvegicus
aaggcatgttttgtgctcttgtcac

SEQ ID NO: 46123 - DNA, 25 bp, Rattus norvegicus
aaggcattacctctgcttcaaacga

SEQ ID NO: 46124 - DNA, 25 bp, Rattus norvegicus
aaggcattacctgtgcttcaaacga

SEQ ID NO: 46125 - DNA, 25 bp, Rattus norvegicus
aaggcattcatcaccatacttgatc

SEQ ID NO: 46126 - DNA, 25 bp, Rattus norvegicus
aaggcattcatctccatacttgatc

SEQ ID NO: 46127 - DNA, 25 bp, Rattus norvegicus
aaggcattccaactgtgtgttccaa

SEQ ID NO: 46128 - DNA, 25 bp, Rattus norvegicus
aaggcattccaagtgtgtgttccaa

SEQ ID NO: 46129 - DNA, 25 bp, Rattus norvegicus
aaggcattccctaacgtcgatagca

SEQ ID NO: 46130 - DNA, 25 bp, Rattus norvegicus
aaggcattcccttacgtcgatagca

SEQ ID NO: 46131 - DNA, 25 bp, Rattus norvegicus
aaggcattctagaccagagccagaa

SEQ ID NO: 46132 - DNA, 25 bp, Rattus norvegicus
aaggcattctagtccagagccagaa

SEQ ID NO: 46133 - DNA, 25 bp, Rattus norvegicus
aaggcattgaataggtttctctgaa

SEQ ID NO: 46134 - DNA, 25 bp, Rattus norvegicus
aaggcattgaattggtttctctgaa

SEQ ID NO: 46135 - DNA, 25 bp, Rattus norvegicus
aaggcattgatgagcgagtcctcca

SEQ ID NO: 46136 - DNA, 25 bp, Rattus norvegicus
aaggcattgatgtgcgagtcctcca

SEQ ID NO: 46137 - DNA, 25 bp, Rattus norvegicus
aaggcattgcttctactgtctaatt

SEQ ID NO: 46138 - DNA, 25 bp, Rattus norvegicus
aaggcattgcttgtactgtctaatt

SEQ ID NO: 46139 - DNA, 25 bp, Rattus norvegicus
aaggcattggctatgcagaacacta

SEQ ID NO: 46140 - DNA, 25 bp, Rattus norvegicus
aaggcattggctttgcagaacacta

SEQ ID NO: 46141 - DNA, 25 bp, Rattus norvegicus
aaggcattgtgactggcttccagag

SEQ ID NO: 46142 - DNA, 25 bp, Rattus norvegicus
aaggcattgtgagtggcttccagag

SEQ ID NO: 46143 - DNA, 25 bp, Rattus norvegicus
aaggcattgtggagtgtgtagctaa

SEQ ID NO: 46144 - DNA, 25 bp, Rattus norvegicus
aaggcattgtggtgtgtgtagctaa

SEQ ID NO: 46145 - DNA, 25 bp, Rattus norvegicus
aaggcatttactctgcttcatccct

SEQ ID NO: 46146 - DNA, 25 bp, Rattus norvegicus
aaggcatttactgtgcttcatccct

SEQ ID NO: 46147 - DNA, 25 bp, Rattus norvegicus
aaggcatttattactcccaaggagg

SEQ ID NO: 46148 - DNA, 25 bp, Rattus norvegicus
aaggcatttatttctcccaaggagg

SEQ ID NO: 46149 - DNA, 25 bp, Rattus norvegicus
aaggcatttcccaacaaagttgtgg

SEQ ID NO: 46150 - DNA, 25 bp, Rattus norvegicus
aaggcatttccctacaaagttgtgg

SEQ ID NO: 46151 - DNA, 25 bp, Rattus norvegicus
aaggcatttgagcagtaccgtcgca

SEQ ID NO: 46152 - DNA, 25 bp, Rattus norvegicus
aaggcatttgaggagtaccgtcgca

SEQ ID NO: 46153 - DNA, 25 bp, Rattus norvegicus
aaggcatttgggatctgaagcttgt

SEQ ID NO: 46154 - DNA, 25 bp, Rattus norvegicus
aaggcatttgggttctgaagcttgt

SEQ ID NO: 46155 - DNA, 25 bp, Rattus norvegicus
aaggcatttgtgcacctgaccttcc

SEQ ID NO: 46156 - DNA, 25 bp, Rattus norvegicus
aaggcatttgtggacctgaccttcc

SEQ ID NO: 46157 - DNA, 25 bp, Rattus norvegicus
aaggcattttcaagaagcccagtga

SEQ ID NO: 46158 - DNA, 25 bp, Rattus norvegicus
aaggcattttcatgaagcccagtga

SEQ ID NO: 46159 - DNA, 25 bp, Rattus norvegicus
aaggccaaagagagcgtcagatcct

SEQ ID NO: 46160 - DNA, 25 bp, Rattus norvegicus
aaggccaaagagtgcgtcagatcct

SEQ ID NO: 46161 - DNA, 25 bp, Rattus norvegicus
aaggccaaagcactgtacctagcag

SEQ ID NO: 46162 - DNA, 25 bp, Rattus norvegicus
aaggccaaagcagtgtacctagcag

SEQ ID NO: 46163 - DNA, 25 bp, Rattus norvegicus
aaggccaaagcgatgcacactgtgc

SEQ ID NO: 46164 - DNA, 25 bp, Rattus norvegicus
aaggccaaagcgttgcacactgtgc

SEQ ID NO: 46165 - DNA, 25 bp, Rattus norvegicus
aaggccaacctactagtctacagag

SEQ ID NO: 46166 - DNA, 25 bp, Rattus norvegicus
aaggccaacctagtagtctacagag

SEQ ID NO: 46167 - DNA, 25 bp, Rattus norvegicus
aaggccaacctgaattgtgtgaata

SEQ ID NO: 46168 - DNA, 25 bp, Rattus norvegicus
aaggccaacctgtattgtgtgaata

SEQ ID NO: 46169 - DNA, 25 bp, Rattus norvegicus
aaggccaacttcaaagaccactgag

SEQ ID NO: 46170 - DNA, 25 bp, Rattus norvegicus
aaggccaacttctaagaccactgag

SEQ ID NO: 46171 - DNA, 25 bp, Rattus norvegicus
aaggccaagcagaggacatctatga

SEQ ID NO: 46172 - DNA, 25 bp, Rattus norvegicus
aaggccaagcagtggacatctatga

SEQ ID NO: 46173 - DNA, 25 bp, Rattus norvegicus
aaggccaagcccaagtttagcatct

SEQ ID NO: 46174 - DNA, 25 bp, Rattus norvegicus
aaggccaagccccaggagtatagac

SEQ ID NO: 46175 - DNA, 25 bp, Rattus norvegicus
aaggccaagcccgaggagtatagac

SEQ ID NO: 46176 - DNA, 25 bp, Rattus norvegicus
aaggccaagccctagtttagcatct

SEQ ID NO: 46177 - DNA, 25 bp, Rattus norvegicus
aaggccaagcggcactagcagtcaa

SEQ ID NO: 46178 - DNA, 25 bp, Rattus norvegicus
aaggccaagcgggactagcagtcaa

SEQ ID NO: 46179 - DNA, 25 bp, Rattus norvegicus
aaggccaagctgctaaccctgctga

SEQ ID NO: 46180 - DNA, 25 bp, Rattus norvegicus
aaggccaagctggtaaccctgctga

SEQ ID NO: 46181 - DNA, 25 bp, Rattus norvegicus
aaggccaaggaaatcaccaatgttt

SEQ ID NO: 46182 - DNA, 25 bp, Rattus norvegicus
aaggccaaggaattcaccaatgttt

SEQ ID NO: 46183 - DNA, 25 bp, Rattus norvegicus
aaggccaaggatagtggctcctact

SEQ ID NO: 46184 - DNA, 25 bp, Rattus norvegicus
aaggccaaggattgtggctcctact

SEQ ID NO: 46185 - DNA, 25 bp, Rattus norvegicus
aaggccaaggcaaacctggagaaag

SEQ ID NO: 46186 - DNA, 25 bp, Rattus norvegicus
aaggccaaggcatacctggagaaag

SEQ ID NO: 46187 - DNA, 25 bp, Rattus norvegicus
aaggccaagggcatcctgcattctc

SEQ ID NO: 46188 - DNA, 25 bp, Rattus norvegicus
aaggccaagggcatttctgtcagtc

SEQ ID NO: 46189 - DNA, 25 bp, Rattus norvegicus
aaggccaagggcttcctgcattctc

SEQ ID NO: 46190 - DNA, 25 bp, Rattus norvegicus
aaggccaagggcttttctgtcagtc

SEQ ID NO: 46191 - DNA, 25 bp, Rattus norvegicus
aaggccaaggtcatcagtcgctgtg

SEQ ID NO: 46192 - DNA, 25 bp, Rattus norvegicus
aaggccaaggtcttcagtcgctgtg

SEQ ID NO: 46193 - DNA, 25 bp, Rattus norvegicus
aaggccaagtcccacagcaagtcac

SEQ ID NO: 46194 - DNA, 25 bp, Rattus norvegicus
aaggccaagtccgacagcaagtcac

SEQ ID NO: 46195 - DNA, 25 bp, Rattus norvegicus
aaggccaagtgcacgcagttctgca

SEQ ID NO: 46196 - DNA, 25 bp, Rattus norvegicus
aaggccaagtgctcgcagttctgca

SEQ ID NO: 46197 - DNA, 25 bp, Rattus norvegicus
aaggccaagtggcttgaccttcctg

SEQ ID NO: 46198 - DNA, 25 bp, Rattus norvegicus
aaggccaagtgggttgaccttcctg

SEQ ID NO: 46199 - DNA, 25 bp, Rattus norvegicus
aaggccaatcatactcttgagtttc

SEQ ID NO: 46200 - DNA, 25 bp, Rattus norvegicus
aaggccaatcattctcttgagtttc

SEQ ID NO: 46201 - DNA, 25 bp, Rattus norvegicus
aaggccaatctgcactagacattca

SEQ ID NO: 46202 - DNA, 25 bp, Rattus norvegicus
aaggccaatctggactagacattca

SEQ ID NO: 46203 - DNA, 25 bp, Rattus norvegicus
aaggccacaaggacggagttattct

SEQ ID NO: 46204 - DNA, 25 bp, Rattus norvegicus
aaggccacaaggtcggagttattct

SEQ ID NO: 46205 - DNA, 25 bp, Rattus norvegicus
aaggccacacttagttgtttgtgca

SEQ ID NO: 46206 - DNA, 25 bp, Rattus norvegicus
aaggccacactttgttgtttgtgca

SEQ ID NO: 46207 - DNA, 25 bp, Rattus norvegicus
aaggccacagccattcggacagagg

SEQ ID NO: 46208 - DNA, 25 bp, Rattus norvegicus
aaggccacagcctttcggacagagg

SEQ ID NO: 46209 - DNA, 25 bp, Rattus norvegicus
aaggccacatagagagtgatgtcat

SEQ ID NO: 46210 - DNA, 25 bp, Rattus norvegicus
aaggccacatagtgagtgatgtcat

SEQ ID NO: 46211 - DNA, 25 bp, Rattus norvegicus
aaggccacatgcaagtttgtccagg

SEQ ID NO: 46212 - DNA, 25 bp, Rattus norvegicus
aaggccacatgctagtttgtccagg

SEQ ID NO: 46213 - DNA, 25 bp, Rattus norvegicus
aaggccaccactcgctgttcgttta

SEQ ID NO: 46214 - DNA, 25 bp, Rattus norvegicus
aaggccaccactggctgttcgttta

SEQ ID NO: 46215 - DNA, 25 bp, Rattus norvegicus
aaggccaccaggaagcacggttata

SEQ ID NO: 46216 - DNA, 25 bp, Rattus norvegicus
aaggccaccaggctcttttggaggc

SEQ ID NO: 46217 - DNA, 25 bp, Rattus norvegicus
aaggccaccagggtcttttggaggc

SEQ ID NO: 46218 - DNA, 25 bp, Rattus norvegicus
aaggccaccaggtagcacggttata

SEQ ID NO: 46219 - DNA, 25 bp, Rattus norvegicus
aaggccaccgtgagcatctggcagg

SEQ ID NO: 46220 - DNA, 25 bp, Rattus norvegicus
aaggccaccgtgtgcatctggcagg

SEQ ID NO: 46221 - DNA, 25 bp, Rattus norvegicus
aaggccacctatcgtgccggcattg

SEQ ID NO: 46222 - DNA, 25 bp, Rattus norvegicus
aaggccacctatggtgccggcattg

SEQ ID NO: 46223 - DNA, 25 bp, Rattus norvegicus
aaggccacgggaaaaggctatcact

SEQ ID NO: 46224 - DNA, 25 bp, Rattus norvegicus
aaggccacgggataaggctatcact

SEQ ID NO: 46225 - DNA, 25 bp, Rattus norvegicus
aaggccactggcagagctagaacag

SEQ ID NO: 46226 - DNA, 25 bp, Rattus norvegicus
aaggccactggccatgatgacaccg

SEQ ID NO: 46227 - DNA, 25 bp, Rattus norvegicus
aaggccactggcgatgatgacaccg

SEQ ID NO: 46228 - DNA, 25 bp, Rattus norvegicus
aaggccactggctgagctagaacag

SEQ ID NO: 46229 - DNA, 25 bp, Rattus norvegicus
aaggccacttaacaagacagagggt

SEQ ID NO: 46230 - DNA, 25 bp, Rattus norvegicus
aaggccacttaagaagacagagggt

SEQ ID NO: 46231 - DNA, 25 bp, Rattus norvegicus
aaggccacttacaccttcctggtga

SEQ ID NO: 46232 - DNA, 25 bp, Rattus norvegicus
aaggccacttactccttcctggtga

SEQ ID NO: 46233 - DNA, 25 bp, Rattus norvegicus
aaggccacttcacagatgtttacat

SEQ ID NO: 46234 - DNA, 25 bp, Rattus norvegicus
aaggccacttcagagatgtttacat

SEQ ID NO: 46235 - DNA, 25 bp, Rattus norvegicus
aaggccactttgcagtcagtaacta

SEQ ID NO: 46236 - DNA, 25 bp, Rattus norvegicus
aaggccactttggagtcagtaacta

SEQ ID NO: 46237 - DNA, 25 bp, Rattus norvegicus
aaggccagaccgacagctgtggtca

SEQ ID NO: 46238 - DNA, 25 bp, Rattus norvegicus
aaggccagaccgtcagctgtggtca

SEQ ID NO: 46239 - DNA, 25 bp, Rattus norvegicus
aaggccagaggcatgtcccacaatg

SEQ ID NO: 46240 - DNA, 25 bp, Rattus norvegicus
aaggccagaggcttgtcccacaatg

SEQ ID NO: 46241 - DNA, 25 bp, Rattus norvegicus
aaggccagaggtaccaggcgctgaa

SEQ ID NO: 46242 - DNA, 25 bp, Rattus norvegicus
aaggccagaggttccaggcgctgaa

SEQ ID NO: 46243 - DNA, 25 bp, Rattus norvegicus
aaggccagagtgacagtgcagctca

SEQ ID NO: 46244 - DNA, 25 bp, Rattus norvegicus
aaggccagagtgtcagtgcagctca

SEQ ID NO: 46245 - DNA, 25 bp, Rattus norvegicus
aaggccagcacaatctacattggaa

SEQ ID NO: 46246 - DNA, 25 bp, Rattus norvegicus
aaggccagcacattctacattggaa

SEQ ID NO: 46247 - DNA, 25 bp, Rattus norvegicus
aaggccagcaggaagctctgtgagc

SEQ ID NO: 46248 - DNA, 25 bp, Rattus norvegicus
aaggccagcaggtagctctgtgagc

SEQ ID NO: 46249 - DNA, 25 bp, Rattus norvegicus
aaggccagcagtcagccagccagga

SEQ ID NO: 46250 - DNA, 25 bp, Rattus norvegicus
aaggccagcagtgagccagccagga

SEQ ID NO: 46251 - DNA, 25 bp, Rattus norvegicus
aaggccagccagctccttctggtga

SEQ ID NO: 46252 - DNA, 25 bp, Rattus norvegicus
aaggccagccagcttaccaatgaga

SEQ ID NO: 46253 - DNA, 25 bp, Rattus norvegicus
aaggccagccaggtccttctggtga

SEQ ID NO: 46254 - DNA, 25 bp, Rattus norvegicus
aaggccagccaggttaccaatgaga

SEQ ID NO: 46255 - DNA, 25 bp, Rattus norvegicus
aaggccagcccgctctatatttcaa

SEQ ID NO: 46256 - DNA, 25 bp, Rattus norvegicus
aaggccagcccggtctatatttcaa

SEQ ID NO: 46257 - DNA, 25 bp, Rattus norvegicus
aaggccagccgacgctccatagtga

SEQ ID NO: 46258 - DNA, 25 bp, Rattus norvegicus
aaggccagccgaggctccatagtga

SEQ ID NO: 46259 - DNA, 25 bp, Rattus norvegicus
aaggccagccggataccctgtctaa

SEQ ID NO: 46260 - DNA, 25 bp, Rattus norvegicus
aaggccagccggttaccctgtctaa

SEQ ID NO: 46261 - DNA, 25 bp, Rattus norvegicus
aaggccagcctactgaatgtggtga

SEQ ID NO: 46262 - DNA, 25 bp, Rattus norvegicus
aaggccagcctagtgaatgtggtga

SEQ ID NO: 46263 - DNA, 25 bp, Rattus norvegicus
aaggccagcctgaactatggagatc

SEQ ID NO: 46264 - DNA, 25 bp, Rattus norvegicus
aaggccagcctgaattgtgtattga

SEQ ID NO: 46265 - DNA, 25 bp, Rattus norvegicus
aaggccagcctgtactatggagatc

SEQ ID NO: 46266 - DNA, 25 bp, Rattus norvegicus
aaggccagcctgtattgtgtattga

SEQ ID NO: 46267 - DNA, 25 bp, Rattus norvegicus
aaggccagccttcgtgatactgtct

SEQ ID NO: 46268 - DNA, 25 bp, Rattus norvegicus
aaggccagccttggtgatactgtct

SEQ ID NO: 46269 - DNA, 25 bp, Rattus norvegicus
aaggccagcgtcagagagctatcct

SEQ ID NO: 46270 - DNA, 25 bp, Rattus norvegicus
aaggccagcgtctgagagctatcct

SEQ ID NO: 46271 - DNA, 25 bp, Rattus norvegicus
aaggccagctcactgtcaatccagg

SEQ ID NO: 46272 - DNA, 25 bp, Rattus norvegicus
aaggccagctcagtgtcaatccagg

SEQ ID NO: 46273 - DNA, 25 bp, Rattus norvegicus
aaggccagctgcaacgtacatgtca

SEQ ID NO: 46274 - DNA, 25 bp, Rattus norvegicus
aaggccagctgcagacccaggtgtc

SEQ ID NO: 46275 - DNA, 25 bp, Rattus norvegicus
aaggccagctgctacgtacatgtca

SEQ ID NO: 46276 - DNA, 25 bp, Rattus norvegicus
aaggccagctgctgacccaggtgtc

SEQ ID NO: 46277 - DNA, 25 bp, Rattus norvegicus
aaggccagcttgacctatacagaga

SEQ ID NO: 46278 - DNA, 25 bp, Rattus norvegicus
aaggccagcttgatcttccaagcaa

SEQ ID NO: 46279 - DNA, 25 bp, Rattus norvegicus
aaggccagcttgtcctatacagaga

SEQ ID NO: 46280 - DNA, 25 bp, Rattus norvegicus
aaggccagcttgttcttccaagcaa

SEQ ID NO: 46281 - DNA, 25 bp, Rattus norvegicus
aaggccaggaaactccccagcgaca

SEQ ID NO: 46282 - DNA, 25 bp, Rattus norvegicus
aaggccaggaaagtccccagcgaca

SEQ ID NO: 46283 - DNA, 25 bp, Rattus norvegicus
aaggccaggagcagtgtgctagtca

SEQ ID NO: 46284 - DNA, 25 bp, Rattus norvegicus
aaggccaggagctgtgtgctagtca

SEQ ID NO: 46285 - DNA, 25 bp, Rattus norvegicus
aaggccaggaggatccacttgagtc

SEQ ID NO: 46286 - DNA, 25 bp, Rattus norvegicus
aaggccaggaggttccacttgagtc

SEQ ID NO: 46287 - DNA, 25 bp, Rattus norvegicus
aaggccaggctactctgggctacaa

SEQ ID NO: 46288 - DNA, 25 bp, Rattus norvegicus
aaggccaggctagtctgggctacaa

SEQ ID NO: 46289 - DNA, 25 bp, Rattus norvegicus
aaggccaggtcaaatacttgtcacc

SEQ ID NO: 46290 - DNA, 25 bp, Rattus norvegicus
aaggccaggtcatatacttgtcacc

SEQ ID NO: 46291 - DNA, 25 bp, Rattus norvegicus
aaggccaggtggacctgtcagcagc

SEQ ID NO: 46292 - DNA, 25 bp, Rattus norvegicus
aaggccaggtggtcctgtcagcagc

SEQ ID NO: 46293 - DNA, 25 bp, Rattus norvegicus
aaggccagtgaaccagaagacatac

SEQ ID NO: 46294 - DNA, 25 bp, Rattus norvegicus
aaggccagtgaagcagaagacatac

SEQ ID NO: 46295 - DNA, 25 bp, Rattus norvegicus
aaggccagtgccagaaaacctctgc

SEQ ID NO: 46296 - DNA, 25 bp, Rattus norvegicus
aaggccagtgcctgaaaacctctgc

SEQ ID NO: 46297 - DNA, 25 bp, Rattus norvegicus
aaggccagtggaactgatacagaga

SEQ ID NO: 46298 - DNA, 25 bp, Rattus norvegicus
aaggccagtggatctgatacagaga

SEQ ID NO: 46299 - DNA, 25 bp, Rattus norvegicus
aaggccatacagctagttcacagtg

SEQ ID NO: 46300 - DNA, 25 bp, Rattus norvegicus
aaggccatacaggtagttcacagtg

SEQ ID NO: 46301 - DNA, 25 bp, Rattus norvegicus
aaggccatactgattcttccaatgt

SEQ ID NO: 46302 - DNA, 25 bp, Rattus norvegicus
aaggccatactgctttatattgcat

SEQ ID NO: 46303 - DNA, 25 bp, Rattus norvegicus
aaggccatactggtttatattgcat

SEQ ID NO: 46304 - DNA, 25 bp, Rattus norvegicus
aaggccatactgtttcttccaatgt

SEQ ID NO: 46305 - DNA, 25 bp, Rattus norvegicus
aaggccatagaaaacccggctcgtg

SEQ ID NO: 46306 - DNA, 25 bp, Rattus norvegicus
aaggccatagaatacccggctcgtg

SEQ ID NO: 46307 - DNA, 25 bp, Rattus norvegicus
aaggccatagcactgaccctgcagt

SEQ ID NO: 46308 - DNA, 25 bp, Rattus norvegicus
aaggccatagcagtgaccctgcagt

SEQ ID NO: 46309 - DNA, 25 bp, Rattus norvegicus
aaggccatatccacgcgaactcctg

SEQ ID NO: 46310 - DNA, 25 bp, Rattus norvegicus
aaggccatatcctcgcgaactcctg

SEQ ID NO: 46311 - DNA, 25 bp, Rattus norvegicus
aaggccatcataaggtattccctgc

SEQ ID NO: 46312 - DNA, 25 bp, Rattus norvegicus
aaggccatcatatggtattccctgc

SEQ ID NO: 46313 - DNA, 25 bp, Rattus norvegicus
aaggccatccatcaagtcttcgagg

SEQ ID NO: 46314 - DNA, 25 bp, Rattus norvegicus
aaggccatccatgaagtcttcgagg

SEQ ID NO: 46315 - DNA, 25 bp, Rattus norvegicus
aaggccatcctcattacctggtgag

SEQ ID NO: 46316 - DNA, 25 bp, Rattus norvegicus
aaggccatcctctttacctggtgag

SEQ ID NO: 46317 - DNA, 25 bp, Rattus norvegicus
aaggccatcctgaggctctgtggga

SEQ ID NO: 46318 - DNA, 25 bp, Rattus norvegicus
aaggccatcctgtggctctgtggga

SEQ ID NO: 46319 - DNA, 25 bp, Rattus norvegicus
aaggccatccttaattgcataacac

SEQ ID NO: 46320 - DNA, 25 bp, Rattus norvegicus
aaggccatccttccacacagattgc

SEQ ID NO: 46321 - DNA, 25 bp, Rattus norvegicus
aaggccatccttgcacacagattgc

SEQ ID NO: 46322 - DNA, 25 bp, Rattus norvegicus
aaggccatcctttattgcataacac

SEQ ID NO: 46323 - DNA, 25 bp, Rattus norvegicus
aaggccatcgaactgtaacttagcg

SEQ ID NO: 46324 - DNA, 25 bp, Rattus norvegicus
aaggccatcgaagtgtaacttagcg

SEQ ID NO: 46325 - DNA, 25 bp, Rattus norvegicus
aaggccatctctactattgtacttg

SEQ ID NO: 46326 - DNA, 25 bp, Rattus norvegicus
aaggccatctcttctattgtacttg

SEQ ID NO: 46327 - DNA, 25 bp, Rattus norvegicus
aaggccatctggcattttgtcactg

SEQ ID NO: 46328 - DNA, 25 bp, Rattus norvegicus
aaggccatctgggattttgtcactg

SEQ ID NO: 46329 - DNA, 25 bp, Rattus norvegicus
aaggccatcttgagcatcgagagct

SEQ ID NO: 46330 - DNA, 25 bp, Rattus norvegicus
aaggccatcttgtgcatcgagagct

SEQ ID NO: 46331 - DNA, 25 bp, Rattus norvegicus
aaggccatctttattagactgaact

SEQ ID NO: 46332 - DNA, 25 bp, Rattus norvegicus
aaggccatcttttttagactgaact

SEQ ID NO: 46333 - DNA, 25 bp, Rattus norvegicus
aaggccatgcaacctgcgggtcaga

SEQ ID NO: 46334 - DNA, 25 bp, Rattus norvegicus
aaggccatgcaagctgcgggtcaga

SEQ ID NO: 46335 - DNA, 25 bp, Rattus norvegicus
aaggccatgccaacacagtgcatag

SEQ ID NO: 46336 - DNA, 25 bp, Rattus norvegicus
aaggccatgccatcacagtgcatag

SEQ ID NO: 46337 - DNA, 25 bp, Rattus norvegicus
aaggccatgccgagggtgatattcc

SEQ ID NO: 46338 - DNA, 25 bp, Rattus norvegicus
aaggccatgccgtgggtgatattcc

SEQ ID NO: 46339 - DNA, 25 bp, Rattus norvegicus
aaggccatgctgacacatacaccgg

SEQ ID NO: 46340 - DNA, 25 bp, Rattus norvegicus
aaggccatgctgtcacatacaccgg

SEQ ID NO: 46341 - DNA, 25 bp, Rattus norvegicus
aaggccatggcactgttaccagaaa

SEQ ID NO: 46342 - DNA, 25 bp, Rattus norvegicus
aaggccatggcagtgttaccagaaa

SEQ ID NO: 46343 - DNA, 25 bp, Rattus norvegicus
aaggccatgggaacctggtggctca

SEQ ID NO: 46344 - DNA, 25 bp, Rattus norvegicus
aaggccatgggatcctggtggctca

SEQ ID NO: 46345 - DNA, 25 bp, Rattus norvegicus
aaggccatgttgagtcccaccagag

SEQ ID NO: 46346 - DNA, 25 bp, Rattus norvegicus
aaggccatgttgtgtcccaccagag

SEQ ID NO: 46347 - DNA, 25 bp, Rattus norvegicus
aaggccattcggatcactttttcca

SEQ ID NO: 46348 - DNA, 25 bp, Rattus norvegicus
aaggccattcggttcactttttcca

SEQ ID NO: 46349 - DNA, 25 bp, Rattus norvegicus
aaggccattctgcatgcctctcggt

SEQ ID NO: 46350 - DNA, 25 bp, Rattus norvegicus
aaggccattctggatgcctctcggt

SEQ ID NO: 46351 - DNA, 25 bp, Rattus norvegicus
aaggccattgctcctgtattgtgct

SEQ ID NO: 46352 - DNA, 25 bp, Rattus norvegicus
aaggccattgctgctgtattgtgct

SEQ ID NO: 46353 - DNA, 25 bp, Rattus norvegicus
aaggccattttgagctacataggtc

SEQ ID NO: 46354 - DNA, 25 bp, Rattus norvegicus
aaggccattttgtgctacataggtc

SEQ ID NO: 46355 - DNA, 25 bp, Rattus norvegicus
aaggcccaactcacgttgtttgcag

SEQ ID NO: 46356 - DNA, 25 bp, Rattus norvegicus
aaggcccaactctcgttgtttgcag

SEQ ID NO: 46357 - DNA, 25 bp, Rattus norvegicus
aaggcccaactgctgctcaagtagg

SEQ ID NO: 46358 - DNA, 25 bp, Rattus norvegicus
aaggcccaactggtgctcaagtagg

SEQ ID NO: 46359 - DNA, 25 bp, Rattus norvegicus
aaggcccaagcacaggcactggctc

SEQ ID NO: 46360 - DNA, 25 bp, Rattus norvegicus
aaggcccaagcagaggcactggctc

SEQ ID NO: 46361 - DNA, 25 bp, Rattus norvegicus
aaggcccaaggtagatgcagtcccc

SEQ ID NO: 46362 - DNA, 25 bp, Rattus norvegicus
aaggcccaaggttgatgcagtcccc

SEQ ID NO: 46363 - DNA, 25 bp, Rattus norvegicus
aaggcccaagtaatccggacagttg

SEQ ID NO: 46364 - DNA, 25 bp, Rattus norvegicus
aaggcccaagtattccggacagttg

SEQ ID NO: 46365 - DNA, 25 bp, Rattus norvegicus
aaggcccaagtccatgagcacggat

SEQ ID NO: 46366 - DNA, 25 bp, Rattus norvegicus
aaggcccaagtcctattacactttg

SEQ ID NO: 46367 - DNA, 25 bp, Rattus norvegicus
aaggcccaagtcgatgagcacggat

SEQ ID NO: 46368 - DNA, 25 bp, Rattus norvegicus
aaggcccaagtcgtattacactttg

SEQ ID NO: 46369 - DNA, 25 bp, Rattus norvegicus
aaggcccacaggagcatcggttaga

SEQ ID NO: 46370 - DNA, 25 bp, Rattus norvegicus
aaggcccacaggtgcatcggttaga

SEQ ID NO: 46371 - DNA, 25 bp, Rattus norvegicus
aaggcccaccttacatgtggtacac

SEQ ID NO: 46372 - DNA, 25 bp, Rattus norvegicus
aaggcccacctttcatgtggtacac

SEQ ID NO: 46373 - DNA, 25 bp, Rattus norvegicus
aaggcccactctcatttgctcctga

SEQ ID NO: 46374 - DNA, 25 bp, Rattus norvegicus
aaggcccactctgatttgctcctga

SEQ ID NO: 46375 - DNA, 25 bp, Rattus norvegicus
aaggcccactggactagacagcatc

SEQ ID NO: 46376 - DNA, 25 bp, Rattus norvegicus
aaggcccactggtctagacagcatc

SEQ ID NO: 46377 - DNA, 25 bp, Rattus norvegicus
aaggcccacttccattgtgtggtgg

SEQ ID NO: 46378 - DNA, 25 bp, Rattus norvegicus
aaggcccacttcgattgtgtggtgg

SEQ ID NO: 46379 - DNA, 25 bp, Rattus norvegicus
aaggcccagagacatcttctcgata

SEQ ID NO: 46380 - DNA, 25 bp, Rattus norvegicus
aaggcccagagagatcttctcgata

SEQ ID NO: 46381 - DNA, 25 bp, Rattus norvegicus
aaggcccagagcatcttacggacag

SEQ ID NO: 46382 - DNA, 25 bp, Rattus norvegicus
aaggcccagagcttcttacggacag

SEQ ID NO: 46383 - DNA, 25 bp, Rattus norvegicus
aaggcccagcatagttgtgtattgt

SEQ ID NO: 46384 - DNA, 25 bp, Rattus norvegicus
aaggcccagcattgttgtgtattgt

SEQ ID NO: 46385 - DNA, 25 bp, Rattus norvegicus
aaggcccagccactctaagaaaatt

SEQ ID NO: 46386 - DNA, 25 bp, Rattus norvegicus
aaggcccagccagtctaagaaaatt

SEQ ID NO: 46387 - DNA, 25 bp, Rattus norvegicus
aaggcccagcctcattaaagatact

SEQ ID NO: 46388 - DNA, 25 bp, Rattus norvegicus
aaggcccagcctgattaaagatact

SEQ ID NO: 46389 - DNA, 25 bp, Rattus norvegicus
aaggcccagctaccagagactgtga

SEQ ID NO: 46390 - DNA, 25 bp, Rattus norvegicus
aaggcccagctagcagagactgtga

SEQ ID NO: 46391 - DNA, 25 bp, Rattus norvegicus
aaggcccagctcagaggactttgtg

SEQ ID NO: 46392 - DNA, 25 bp, Rattus norvegicus
aaggcccagctctgaggactttgtg

SEQ ID NO: 46393 - DNA, 25 bp, Rattus norvegicus
aaggcccaggacatggtcaaatcta

SEQ ID NO: 46394 - DNA, 25 bp, Rattus norvegicus
aaggcccaggacttggtcaaatcta

SEQ ID NO: 46395 - DNA, 25 bp, Rattus norvegicus
aaggcccagggaaccagttggtcag

SEQ ID NO: 46396 - DNA, 25 bp, Rattus norvegicus
aaggcccagggaccactgttgacag

SEQ ID NO: 46397 - DNA, 25 bp, Rattus norvegicus
aaggcccagggagcactgttgacag

SEQ ID NO: 46398 - DNA, 25 bp, Rattus norvegicus
aaggcccagggatccagttggtcag

SEQ ID NO: 46399 - DNA, 25 bp, Rattus norvegicus
aaggcccatcctattgcctaagaat

SEQ ID NO: 46400 - DNA, 25 bp, Rattus norvegicus
aaggcccatccttttgcctaagaat

SEQ ID NO: 46401 - DNA, 25 bp, Rattus norvegicus
aaggccccagccatggatgtggtga

SEQ ID NO: 46402 - DNA, 25 bp, Rattus norvegicus
aaggccccagccttggatgtggtga

SEQ ID NO: 46403 - DNA, 25 bp, Rattus norvegicus
aaggccccagttatcgagggcttca

SEQ ID NO: 46404 - DNA, 25 bp, Rattus norvegicus
aaggccccagttttcgagggcttca

SEQ ID NO: 46405 - DNA, 25 bp, Rattus norvegicus
aaggccccatgactgaatgctgagt

SEQ ID NO: 46406 - DNA, 25 bp, Rattus norvegicus
aaggccccatgagtgaatgctgagt

SEQ ID NO: 46407 - DNA, 25 bp, Rattus norvegicus
aaggccccatggacgatgtgtatgt

SEQ ID NO: 46408 - DNA, 25 bp, Rattus norvegicus
aaggccccatggtcgatgtgtatgt

SEQ ID NO: 46409 - DNA, 25 bp, Rattus norvegicus
aaggccccattcagttgttcaacta

SEQ ID NO: 46410 - DNA, 25 bp, Rattus norvegicus
aaggccccattcctaactgaggagg

SEQ ID NO: 46411 - DNA, 25 bp, Rattus norvegicus
aaggccccattcgtaactgaggagg

SEQ ID NO: 46412 - DNA, 25 bp, Rattus norvegicus
aaggccccattctgttgttcaacta

SEQ ID NO: 46413 - DNA, 25 bp, Rattus norvegicus
aaggccccattgacatgctcttgaa

SEQ ID NO: 46414 - DNA, 25 bp, Rattus norvegicus
aaggccccattgagtctctgagagc

SEQ ID NO: 46415 - DNA, 25 bp, Rattus norvegicus
aaggccccattgtcatgctcttgaa

SEQ ID NO: 46416 - DNA, 25 bp, Rattus norvegicus
aaggccccattgtgtctctgagagc

SEQ ID NO: 46417 - DNA, 25 bp, Rattus norvegicus
aaggccccatttcctgtgtaacagg

SEQ ID NO: 46418 - DNA, 25 bp, Rattus norvegicus
aaggccccatttgctgtgtaacagg

SEQ ID NO: 46419 - DNA, 25 bp, Rattus norvegicus
aaggcccctaagacataatgcacat

SEQ ID NO: 46420 - DNA, 25 bp, Rattus norvegicus
aaggcccctaagtcataatgcacat

SEQ ID NO: 46421 - DNA, 25 bp, Rattus norvegicus
aaggcccctcgtcgatatctgaagc

SEQ ID NO: 46422 - DNA, 25 bp, Rattus norvegicus
aaggcccctcgtggatatctgaagc

SEQ ID NO: 46423 - DNA, 25 bp, Rattus norvegicus
aaggcccctgccagatgtaaagcga

SEQ ID NO: 46424 - DNA, 25 bp, Rattus norvegicus
aaggcccctgcctgatgtaaagcga

SEQ ID NO: 46425 - DNA, 25 bp, Rattus norvegicus
aaggccccttgacgctgattacagg

SEQ ID NO: 46426 - DNA, 25 bp, Rattus norvegicus
aaggccccttgaggctgattacagg

SEQ ID NO: 46427 - DNA, 25 bp, Rattus norvegicus
aaggccccttgcagccaggtgggaa

SEQ ID NO: 46428 - DNA, 25 bp, Rattus norvegicus
aaggccccttgctgccaggtgggaa

SEQ ID NO: 46429 - DNA, 25 bp, Rattus norvegicus
aaggcccgaagaatgtttttctatg

SEQ ID NO: 46430 - DNA, 25 bp, Rattus norvegicus
aaggcccgaagattgtttttctatg

SEQ ID NO: 46431 - DNA, 25 bp, Rattus norvegicus
aaggcccgagagatgtatcgctccg

SEQ ID NO: 46432 - DNA, 25 bp, Rattus norvegicus
aaggcccgagagttgtatcgctccg

SEQ ID NO: 46433 - DNA, 25 bp, Rattus norvegicus
aaggcccgaggaaacatcatgctga

SEQ ID NO: 46434 - DNA, 25 bp, Rattus norvegicus
aaggcccgaggatacatcatgctga

SEQ ID NO: 46435 - DNA, 25 bp, Rattus norvegicus
aaggcccgattgagatggatatgtc

SEQ ID NO: 46436 - DNA, 25 bp, Rattus norvegicus
aaggcccgattgtgatggatatgtc

SEQ ID NO: 46437 - DNA, 25 bp, Rattus norvegicus
aaggcccgcccacatcttggagggc

SEQ ID NO: 46438 - DNA, 25 bp, Rattus norvegicus
aaggcccgcccagatcttggagggc

SEQ ID NO: 46439 - DNA, 25 bp, Rattus norvegicus
aaggcccgctgtattgtacagcatt

SEQ ID NO: 46440 - DNA, 25 bp, Rattus norvegicus
aaggcccgctgttttgtacagcatt

SEQ ID NO: 46441 - DNA, 25 bp, Rattus norvegicus
aaggcccggaagcagttgcctacat

SEQ ID NO: 46442 - DNA, 25 bp, Rattus norvegicus
aaggcccggaaggagttgcctacat

SEQ ID NO: 46443 - DNA, 25 bp, Rattus norvegicus
aaggcccggacacgagataggatct

SEQ ID NO: 46444 - DNA, 25 bp, Rattus norvegicus
aaggcccggacaggagataggatct

SEQ ID NO: 46445 - DNA, 25 bp, Rattus norvegicus
aaggcccggccacaataagtgccaa

SEQ ID NO: 46446 - DNA, 25 bp, Rattus norvegicus
aaggcccggccagaataagtgccaa

SEQ ID NO: 46447 - DNA, 25 bp, Rattus norvegicus
aaggcccggtgacggcttgcacaca

SEQ ID NO: 46448 - DNA, 25 bp, Rattus norvegicus
aaggcccggtgagggcttgcacaca

SEQ ID NO: 46449 - DNA, 25 bp, Rattus norvegicus
aaggcccgtgaactattcctcatgt

SEQ ID NO: 46450 - DNA, 25 bp, Rattus norvegicus
aaggcccgtgaagtattcctcatgt

SEQ ID NO: 46451 - DNA, 25 bp, Rattus norvegicus
aaggccctaaacatgaatttctcta

SEQ ID NO: 46452 - DNA, 25 bp, Rattus norvegicus
aaggccctaaacttgaatttctcta

SEQ ID NO: 46453 - DNA, 25 bp, Rattus norvegicus
aaggccctaataagcgtcggagata

SEQ ID NO: 46454 - DNA, 25 bp, Rattus norvegicus
aaggccctaatatgcgtcggagata

SEQ ID NO: 46455 - DNA, 25 bp, Rattus norvegicus
aaggccctaattactgtgttgcgtc

SEQ ID NO: 46456 - DNA, 25 bp, Rattus norvegicus
aaggccctaatttctgtgttgcgtc

SEQ ID NO: 46457 - DNA, 25 bp, Rattus norvegicus
aaggccctcacgattatcaaggaga

SEQ ID NO: 46458 - DNA, 25 bp, Rattus norvegicus
aaggccctcacgtttatcaaggaga

SEQ ID NO: 46459 - DNA, 25 bp, Rattus norvegicus
aaggccctcactagaggatcacttt

SEQ ID NO: 46460 - DNA, 25 bp, Rattus norvegicus
aaggccctcacttgaggatcacttt

SEQ ID NO: 46461 - DNA, 25 bp, Rattus norvegicus
aaggccctcgacaatgtctgttttt

SEQ ID NO: 46462 - DNA, 25 bp, Rattus norvegicus
aaggccctcgactatgtctgttttt

SEQ ID NO: 46463 - DNA, 25 bp, Rattus norvegicus
aaggccctcgggagagccatgttta

SEQ ID NO: 46464 - DNA, 25 bp, Rattus norvegicus
aaggccctcgggtgagccatgttta

SEQ ID NO: 46465 - DNA, 25 bp, Rattus norvegicus
aaggccctgagaatgttgccaacga

SEQ ID NO: 46466 - DNA, 25 bp, Rattus norvegicus
aaggccctgagattgttgccaacga

SEQ ID NO: 46467 - DNA, 25 bp, Rattus norvegicus
aaggccctgagcagcaagcacgatt

SEQ ID NO: 46468 - DNA, 25 bp, Rattus norvegicus
aaggccctgagctgcaagcacgatt

SEQ ID NO: 46469 - DNA, 25 bp, Rattus norvegicus
aaggccctgaggctcaacaaacagc

SEQ ID NO: 46470 - DNA, 25 bp, Rattus norvegicus
aaggccctgagggtcaacaaacagc

SEQ ID NO: 46471 - DNA, 25 bp, Rattus norvegicus
aaggccctgatgcccctgaggagaa

SEQ ID NO: 46472 - DNA, 25 bp, Rattus norvegicus
aaggccctgatggccctgaggagaa

SEQ ID NO: 46473 - DNA, 25 bp, Rattus norvegicus
aaggccctgcgtcagctcagtcaaa

SEQ ID NO: 46474 - DNA, 25 bp, Rattus norvegicus
aaggccctgcgtgagctcagtcaaa

SEQ ID NO: 46475 - DNA, 25 bp, Rattus norvegicus
aaggccctgctgcactttgagcgtc

SEQ ID NO: 46476 - DNA, 25 bp, Rattus norvegicus
aaggccctgctggactttgagcgtc

SEQ ID NO: 46477 - DNA, 25 bp, Rattus norvegicus
aaggccctggatctagtccttagca

SEQ ID NO: 46478 - DNA, 25 bp, Rattus norvegicus
aaggccctggatgtagtccttagca

SEQ ID NO: 46479 - DNA, 25 bp, Rattus norvegicus
aaggccctgggaatgggcagaccat

SEQ ID NO: 46480 - DNA, 25 bp, Rattus norvegicus
aaggccctgggattgggcagaccat

SEQ ID NO: 46481 - DNA, 25 bp, Rattus norvegicus
aaggccctgggcagtttccaaatgg

SEQ ID NO: 46482 - DNA, 25 bp, Rattus norvegicus
aaggccctgggctgtttccaaatgg

SEQ ID NO: 46483 - DNA, 25 bp, Rattus norvegicus
aaggccctggtccttattatttcat

SEQ ID NO: 46484 - DNA, 25 bp, Rattus norvegicus
aaggccctggtcgttattatttcat

SEQ ID NO: 46485 - DNA, 25 bp, Rattus norvegicus
aaggcccttatgatatggtgttcca

SEQ ID NO: 46486 - DNA, 25 bp, Rattus norvegicus
aaggcccttatgttatggtgttcca

SEQ ID NO: 46487 - DNA, 25 bp, Rattus norvegicus
aaggcccttcatctactggtgctat

SEQ ID NO: 46488 - DNA, 25 bp, Rattus norvegicus
aaggcccttcatgtactggtgctat

SEQ ID NO: 46489 - DNA, 25 bp, Rattus norvegicus
aaggcccttgcaccttgtatactga

SEQ ID NO: 46490 - DNA, 25 bp, Rattus norvegicus
aaggcccttgcagcttgtatactga

SEQ ID NO: 46491 - DNA, 25 bp, Rattus norvegicus
aaggcccttggaccaattgtctaca

SEQ ID NO: 46492 - DNA, 25 bp, Rattus norvegicus
aaggcccttggagcaattgtctaca

SEQ ID NO: 46493 - DNA, 25 bp, Rattus norvegicus
aaggcccttgtgagtctcttaagtg

SEQ ID NO: 46494 - DNA, 25 bp, Rattus norvegicus
aaggcccttgtgtgtctcttaagtg

SEQ ID NO: 46495 - DNA, 25 bp, Rattus norvegicus
aaggccctttttccaggaggcgcag

SEQ ID NO: 46496 - DNA, 25 bp, Rattus norvegicus
aaggccctttttgcaggaggcgcag

SEQ ID NO: 46497 - DNA, 25 bp, Rattus norvegicus
aaggccgaaggtacactatgcccgg

SEQ ID NO: 46498 - DNA, 25 bp, Rattus norvegicus
aaggccgaaggtagggtcaagctct

SEQ ID NO: 46499 - DNA, 25 bp, Rattus norvegicus
aaggccgaaggttcactatgcccgg

SEQ ID NO: 46500 - DNA, 25 bp, Rattus norvegicus
aaggccgaaggttgggtcaagctct

SEQ ID NO: 46501 - DNA, 25 bp, Rattus norvegicus
aaggccgaagttctcagccaagaaa

SEQ ID NO: 46502 - DNA, 25 bp, Rattus norvegicus
aaggccgaagttgtcagccaagaaa

SEQ ID NO: 46503 - DNA, 25 bp, Rattus norvegicus
aaggccgacgagatgcagctgcagc

SEQ ID NO: 46504 - DNA, 25 bp, Rattus norvegicus
aaggccgacgagttgcagctgcagc

SEQ ID NO: 46505 - DNA, 25 bp, Rattus norvegicus
aaggccgagtctctcgtggatccta

SEQ ID NO: 46506 - DNA, 25 bp, Rattus norvegicus
aaggccgagtctgtcgtggatccta

SEQ ID NO: 46507 - DNA, 25 bp, Rattus norvegicus
aaggccgagtgacagcccaccatgc

SEQ ID NO: 46508 - DNA, 25 bp, Rattus norvegicus
aaggccgagtgagagcccaccatgc

SEQ ID NO: 46509 - DNA, 25 bp, Rattus norvegicus
aaggccgcaaatatatcgtcagttt

SEQ ID NO: 46510 - DNA, 25 bp, Rattus norvegicus
aaggccgcaaatttatcgtcagttt

SEQ ID NO: 46511 - DNA, 25 bp, Rattus norvegicus
aaggccgcactgctactactactga

SEQ ID NO: 46512 - DNA, 25 bp, Rattus norvegicus
aaggccgcactggtactactactga

SEQ ID NO: 46513 - DNA, 25 bp, Rattus norvegicus
aaggccgcagcacatggtccctgca

SEQ ID NO: 46514 - DNA, 25 bp, Rattus norvegicus
aaggccgcagcagatggtccctgca

SEQ ID NO: 46515 - DNA, 25 bp, Rattus norvegicus
aaggccgcaggccatagtcgcgctc

SEQ ID NO: 46516 - DNA, 25 bp, Rattus norvegicus
aaggccgcaggcgatagtcgcgctc

SEQ ID NO: 46517 - DNA, 25 bp, Rattus norvegicus
aaggccgccacacagagcggtctga

SEQ ID NO: 46518 - DNA, 25 bp, Rattus norvegicus
aaggccgccacagagagcggtctga

SEQ ID NO: 46519 - DNA, 25 bp, Rattus norvegicus
aaggccgccaggaagctctcgagtg

SEQ ID NO: 46520 - DNA, 25 bp, Rattus norvegicus
aaggccgccaggtagctctcgagtg

SEQ ID NO: 46521 - DNA, 25 bp, Rattus norvegicus
aaggccgccgtcatccgtgaagtga

SEQ ID NO: 46522 - DNA, 25 bp, Rattus norvegicus
aaggccgccgtcttccgtgaagtga

SEQ ID NO: 46523 - DNA, 25 bp, Rattus norvegicus
aaggccgctcgaccagtacagagat

SEQ ID NO: 46524 - DNA, 25 bp, Rattus norvegicus
aaggccgctcgagcagtacagagat

SEQ ID NO: 46525 - DNA, 25 bp, Rattus norvegicus
aaggccgcttatcatatcatttgta

SEQ ID NO: 46526 - DNA, 25 bp, Rattus norvegicus
aaggccgcttatgatatcatttgta

SEQ ID NO: 46527 - DNA, 25 bp, Rattus norvegicus
aaggccggactgagccactatgtga

SEQ ID NO: 46528 - DNA, 25 bp, Rattus norvegicus
aaggccggactgtgccactatgtga

SEQ ID NO: 46529 - DNA, 25 bp, Rattus norvegicus
aaggccggagtgaggcccctgctta

SEQ ID NO: 46530 - DNA, 25 bp, Rattus norvegicus
aaggccggagtgtggcccctgctta

SEQ ID NO: 46531 - DNA, 25 bp, Rattus norvegicus
aaggccggcagcactgttggaacct

SEQ ID NO: 46532 - DNA, 25 bp, Rattus norvegicus
aaggccggcagctctgttggaacct

SEQ ID NO: 46533 - DNA, 25 bp, Rattus norvegicus
aaggccggcatacatatcccaactt

SEQ ID NO: 46534 - DNA, 25 bp, Rattus norvegicus
aaggccggcatagatatcccaactt

SEQ ID NO: 46535 - DNA, 25 bp, Rattus norvegicus
aaggccggccagactgttacagtat

SEQ ID NO: 46536 - DNA, 25 bp, Rattus norvegicus
aaggccggccagtctgttacagtat

SEQ ID NO: 46537 - DNA, 25 bp, Rattus norvegicus
aaggccggctctatcctcctttgaa

SEQ ID NO: 46538 - DNA, 25 bp, Rattus norvegicus
aaggccggctctttcctcctttgaa

SEQ ID NO: 46539 - DNA, 25 bp, Rattus norvegicus
aaggccgggaatatgcacttctggg

SEQ ID NO: 46540 - DNA, 25 bp, Rattus norvegicus
aaggccgggaatttgcacttctggg

SEQ ID NO: 46541 - DNA, 25 bp, Rattus norvegicus
aaggccgggctgctcatacaggaca

SEQ ID NO: 46542 - DNA, 25 bp, Rattus norvegicus
aaggccgggctggtcatacaggaca

SEQ ID NO: 46543 - DNA, 25 bp, Rattus norvegicus
aaggccgggtgaacgcactggcaca

SEQ ID NO: 46544 - DNA, 25 bp, Rattus norvegicus
aaggccgggtgatcgcactggcaca

SEQ ID NO: 46545 - DNA, 25 bp, Rattus norvegicus
aaggccgtacacacaggaactgcaa

SEQ ID NO: 46546 - DNA, 25 bp, Rattus norvegicus
aaggccgtacactcaggaactgcaa

SEQ ID NO: 46547 - DNA, 25 bp, Rattus norvegicus
aaggccgtcaccaaatacaccagcg

SEQ ID NO: 46548 - DNA, 25 bp, Rattus norvegicus
aaggccgtcacctaatacaccagcg

SEQ ID NO: 46549 - DNA, 25 bp, Rattus norvegicus
aaggccgtctgtctctattctgcag

SEQ ID NO: 46550 - DNA, 25 bp, Rattus norvegicus
aaggccgtctgtgtctattctgcag

SEQ ID NO: 46551 - DNA, 25 bp, Rattus norvegicus
aaggccgtgtctaggagagaccccg

SEQ ID NO: 46552 - DNA, 25 bp, Rattus norvegicus
aaggccgtgtcttggagagaccccg

SEQ ID NO: 46553 - DNA, 25 bp, Rattus norvegicus
aaggccgtttgcacaacacagactc

SEQ ID NO: 46554 - DNA, 25 bp, Rattus norvegicus
aaggccgtttgctcaacacagactc

SEQ ID NO: 46555 - DNA, 25 bp, Rattus norvegicus
aaggcctaacagcttggctccgtgg

SEQ ID NO: 46556 - DNA, 25 bp, Rattus norvegicus
aaggcctaacaggttggctccgtgg

SEQ ID NO: 46557 - DNA, 25 bp, Rattus norvegicus
aaggcctaagtcatggctggccctg

SEQ ID NO: 46558 - DNA, 25 bp, Rattus norvegicus
aaggcctaagtcttggctggccctg

SEQ ID NO: 46559 - DNA, 25 bp, Rattus norvegicus
aaggcctacaagacagctcctgagc

SEQ ID NO: 46560 - DNA, 25 bp, Rattus norvegicus
aaggcctacaagtcagctcctgagc

SEQ ID NO: 46561 - DNA, 25 bp, Rattus norvegicus
aaggcctaccgcagagttgaatgta

SEQ ID NO: 46562 - DNA, 25 bp, Rattus norvegicus
aaggcctaccgctgagttgaatgta

SEQ ID NO: 46563 - DNA, 25 bp, Rattus norvegicus
aaggcctacgtcacatggatcacgc

SEQ ID NO: 46564 - DNA, 25 bp, Rattus norvegicus
aaggcctacgtctcatggatcacgc

SEQ ID NO: 46565 - DNA, 25 bp, Rattus norvegicus
aaggcctactatccccttggaagtg

SEQ ID NO: 46566 - DNA, 25 bp, Rattus norvegicus
aaggcctactatgcccttggaagtg

SEQ ID NO: 46567 - DNA, 25 bp, Rattus norvegicus
aaggcctactttacagtgcatgaag

SEQ ID NO: 46568 - DNA, 25 bp, Rattus norvegicus
aaggcctacttttcagtgcatgaag

SEQ ID NO: 46569 - DNA, 25 bp, Rattus norvegicus
aaggcctagaagagccagcgtcttt

SEQ ID NO: 46570 - DNA, 25 bp, Rattus norvegicus
aaggcctagaagtgccagcgtcttt

SEQ ID NO: 46571 - DNA, 25 bp, Rattus norvegicus
aaggcctagaggagaccccaagctg

SEQ ID NO: 46572 - DNA, 25 bp, Rattus norvegicus
aaggcctagaggtgaccccaagctg

SEQ ID NO: 46573 - DNA, 25 bp, Rattus norvegicus
aaggcctagatgataaacttgctct

SEQ ID NO: 46574 - DNA, 25 bp, Rattus norvegicus
aaggcctagatgttaaacttgctct

SEQ ID NO: 46575 - DNA, 25 bp, Rattus norvegicus
aaggcctaggacatgaacctgccct

SEQ ID NO: 46576 - DNA, 25 bp, Rattus norvegicus
aaggcctaggacttgaacctgccct

SEQ ID NO: 46577 - DNA, 25 bp, Rattus norvegicus
aaggcctaggtgctcagtcagtcag

SEQ ID NO: 46578 - DNA, 25 bp, Rattus norvegicus
aaggcctaggtggtcagtcagtcag

SEQ ID NO: 46579 - DNA, 25 bp, Rattus norvegicus
aaggcctatattccatttcctagtg

SEQ ID NO: 46580 - DNA, 25 bp, Rattus norvegicus
aaggcctatattgcatttcctagtg

SEQ ID NO: 46581 - DNA, 25 bp, Rattus norvegicus
aaggcctatttcagccatgacaaat

SEQ ID NO: 46582 - DNA, 25 bp, Rattus norvegicus
aaggcctatttctgccatgacaaat

SEQ ID NO: 46583 - DNA, 25 bp, Rattus norvegicus
aaggcctcaaggataatcctctgca

SEQ ID NO: 46584 - DNA, 25 bp, Rattus norvegicus
aaggcctcaaggttaatcctctgca

SEQ ID NO: 46585 - DNA, 25 bp, Rattus norvegicus
aaggcctcacaactgctgggcaagt

SEQ ID NO: 46586 - DNA, 25 bp, Rattus norvegicus
aaggcctcacaagtgctgggcaagt

SEQ ID NO: 46587 - DNA, 25 bp, Rattus norvegicus
aaggcctcacagcaaagcaggtcga

SEQ ID NO: 46588 - DNA, 25 bp, Rattus norvegicus
aaggcctcacaggaaagcaggtcga

SEQ ID NO: 46589 - DNA, 25 bp, Rattus norvegicus
aaggcctcacccatgttgagagtga

SEQ ID NO: 46590 - DNA, 25 bp, Rattus norvegicus
aaggcctcacccttgttgagagtga

SEQ ID NO: 46591 - DNA, 25 bp, Rattus norvegicus
aaggcctcacttatctttgactgta

SEQ ID NO: 46592 - DNA, 25 bp, Rattus norvegicus
aaggcctcacttttctttgactgta

SEQ ID NO: 46593 - DNA, 25 bp, Rattus norvegicus
aaggcctcaggtaacagagatacat

SEQ ID NO: 46594 - DNA, 25 bp, Rattus norvegicus
aaggcctcaggttacagagatacat

SEQ ID NO: 46595 - DNA, 25 bp, Rattus norvegicus
aaggcctcatggacactgatttttc

SEQ ID NO: 46596 - DNA, 25 bp, Rattus norvegicus
aaggcctcatggtcactgatttttc

SEQ ID NO: 46597 - DNA, 25 bp, Rattus norvegicus
aaggcctcattgctgtcgctgtgtt

SEQ ID NO: 46598 - DNA, 25 bp, Rattus norvegicus
aaggcctcattggtgtcgctgtgtt

SEQ ID NO: 46599 - DNA, 25 bp, Rattus norvegicus
aaggcctccaagatcattatttctg

SEQ ID NO: 46600 - DNA, 25 bp, Rattus norvegicus
aaggcctccaagttcattatttctg

SEQ ID NO: 46601 - DNA, 25 bp, Rattus norvegicus
aaggcctccactatctgagcgcgga

SEQ ID NO: 46602 - DNA, 25 bp, Rattus norvegicus
aaggcctccactttctgagcgcgga

SEQ ID NO: 46603 - DNA, 25 bp, Rattus norvegicus
aaggcctcccgtcagatgtgctaac

SEQ ID NO: 46604 - DNA, 25 bp, Rattus norvegicus
aaggcctcccgtgagatgtgctaac

SEQ ID NO: 46605 - DNA, 25 bp, Rattus norvegicus
aaggcctccctgattcacaaaactg

SEQ ID NO: 46606 - DNA, 25 bp, Rattus norvegicus
aaggcctccctgtttcacaaaactg

SEQ ID NO: 46607 - DNA, 25 bp, Rattus norvegicus
aaggcctcctgcagttagggtctgg

SEQ ID NO: 46608 - DNA, 25 bp, Rattus norvegicus
aaggcctcctgctgttagggtctgg

SEQ ID NO: 46609 - DNA, 25 bp, Rattus norvegicus
aaggcctccttgatcttcagcaggt

SEQ ID NO: 46610 - DNA, 25 bp, Rattus norvegicus
aaggcctccttgttcttcagcaggt

SEQ ID NO: 46611 - DNA, 25 bp, Rattus norvegicus
aaggcctcgaagaggccgcgcagcc

SEQ ID NO: 46612 - DNA, 25 bp, Rattus norvegicus
aaggcctcgaagtggccgcgcagcc

SEQ ID NO: 46613 - DNA, 25 bp, Rattus norvegicus
aaggcctcgaggactgttcatcaag

SEQ ID NO: 46614 - DNA, 25 bp, Rattus norvegicus
aaggcctcgaggacttcaggtcttc

SEQ ID NO: 46615 - DNA, 25 bp, Rattus norvegicus
aaggcctcgaggtctgttcatcaag

SEQ ID NO: 46616 - DNA, 25 bp, Rattus norvegicus
aaggcctcgaggtcttcaggtcttc

SEQ ID NO: 46617 - DNA, 25 bp, Rattus norvegicus
aaggcctctcatcaggctgaagaca

SEQ ID NO: 46618 - DNA, 25 bp, Rattus norvegicus
aaggcctctcatgaggctgaagaca

SEQ ID NO: 46619 - DNA, 25 bp, Rattus norvegicus
aaggcctctcccatgttagccagag

SEQ ID NO: 46620 - DNA, 25 bp, Rattus norvegicus
aaggcctctcccttgttagccagag

SEQ ID NO: 46621 - DNA, 25 bp, Rattus norvegicus
aaggcctctcttaggactccagttg

SEQ ID NO: 46622 - DNA, 25 bp, Rattus norvegicus
aaggcctctcttatcagtccttcat

SEQ ID NO: 46623 - DNA, 25 bp, Rattus norvegicus
aaggcctctcttcttattaaagatt

SEQ ID NO: 46624 - DNA, 25 bp, Rattus norvegicus
aaggcctctcttgttattaaagatt

SEQ ID NO: 46625 - DNA, 25 bp, Rattus norvegicus
aaggcctctctttggactccagttg

SEQ ID NO: 46626 - DNA, 25 bp, Rattus norvegicus
aaggcctctcttttcagtccttcat

SEQ ID NO: 46627 - DNA, 25 bp, Rattus norvegicus
aaggcctctgcaaacaaggacatga

SEQ ID NO: 46628 - DNA, 25 bp, Rattus norvegicus
aaggcctctgcatacaaggacatga

SEQ ID NO: 46629 - DNA, 25 bp, Rattus norvegicus
aaggcctcttacattatgaattcag

SEQ ID NO: 46630 - DNA, 25 bp, Rattus norvegicus
aaggcctcttactttatgaattcag

SEQ ID NO: 46631 - DNA, 25 bp, Rattus norvegicus
aaggcctcttatacgggagtgtaga

SEQ ID NO: 46632 - DNA, 25 bp, Rattus norvegicus
aaggcctcttattcgggagtgtaga

SEQ ID NO: 46633 - DNA, 25 bp, Rattus norvegicus
aaggcctcttctaccagcgtggaga

SEQ ID NO: 46634 - DNA, 25 bp, Rattus norvegicus
aaggcctcttcttccagcgtggaga

SEQ ID NO: 46635 - DNA, 25 bp, Rattus norvegicus
aaggcctcttggactctgacagtga

SEQ ID NO: 46636 - DNA, 25 bp, Rattus norvegicus
aaggcctcttggtctctgacagtga

SEQ ID NO: 46637 - DNA, 25 bp, Rattus norvegicus
aaggcctgaaggagggcatcccagc

SEQ ID NO: 46638 - DNA, 25 bp, Rattus norvegicus
aaggcctgaaggtgggcatcccagc

SEQ ID NO: 46639 - DNA, 25 bp, Rattus norvegicus
aaggcctgacagatccattcatgac

SEQ ID NO: 46640 - DNA, 25 bp, Rattus norvegicus
aaggcctgacagttccattcatgac

SEQ ID NO: 46641 - DNA, 25 bp, Rattus norvegicus
aaggcctgagctcagttgcacttgg

SEQ ID NO: 46642 - DNA, 25 bp, Rattus norvegicus
aaggcctgagctgagttgcacttgg

SEQ ID NO: 46643 - DNA, 25 bp, Rattus norvegicus
aaggcctgagtgagtgcagcctcct

SEQ ID NO: 46644 - DNA, 25 bp, Rattus norvegicus
aaggcctgagtgtgtgcagcctcct

SEQ ID NO: 46645 - DNA, 25 bp, Rattus norvegicus
aaggcctgattacgatccagactca

SEQ ID NO: 46646 - DNA, 25 bp, Rattus norvegicus
aaggcctgattaggatccagactca

SEQ ID NO: 46647 - DNA, 25 bp, Rattus norvegicus
aaggcctgcaggcataacctcaatc

SEQ ID NO: 46648 - DNA, 25 bp, Rattus norvegicus
aaggcctgcagggataacctcaatc

SEQ ID NO: 46649 - DNA, 25 bp, Rattus norvegicus
aaggcctgcagtcctgtgttccgga

SEQ ID NO: 46650 - DNA, 25 bp, Rattus norvegicus
aaggcctgcagtgctgtgttccgga

SEQ ID NO: 46651 - DNA, 25 bp, Rattus norvegicus
aaggcctgcatcaagtaccctgagt

SEQ ID NO: 46652 - DNA, 25 bp, Rattus norvegicus
aaggcctgcatctagtaccctgagt

SEQ ID NO: 46653 - DNA, 25 bp, Rattus norvegicus
aaggcctgccagatatttgtgagaa

SEQ ID NO: 46654 - DNA, 25 bp, Rattus norvegicus
aaggcctgccagttatttgtgagaa

SEQ ID NO: 46655 - DNA, 25 bp, Rattus norvegicus
aaggcctgccatcatgactgctgtt

SEQ ID NO: 46656 - DNA, 25 bp, Rattus norvegicus
aaggcctgccatgatgactgctgtt

SEQ ID NO: 46657 - DNA, 25 bp, Rattus norvegicus
aaggcctgccctagtctgagatcaa

SEQ ID NO: 46658 - DNA, 25 bp, Rattus norvegicus
aaggcctgcccttgtctgagatcaa

SEQ ID NO: 46659 - DNA, 25 bp, Rattus norvegicus
aaggcctgcctgactgatagtagga

SEQ ID NO: 46660 - DNA, 25 bp, Rattus norvegicus
aaggcctgcctgtctgatagtagga

SEQ ID NO: 46661 - DNA, 25 bp, Rattus norvegicus
aaggcctgcgcgcagactatcgacc

SEQ ID NO: 46662 - DNA, 25 bp, Rattus norvegicus
aaggcctgcgcggagactatcgacc

SEQ ID NO: 46663 - DNA, 25 bp, Rattus norvegicus
aaggcctgctccaggatatagggtc

SEQ ID NO: 46664 - DNA, 25 bp, Rattus norvegicus
aaggcctgctcctggatatagggtc

SEQ ID NO: 46665 - DNA, 25 bp, Rattus norvegicus
aaggcctgctgtcgaccattcagag

SEQ ID NO: 46666 - DNA, 25 bp, Rattus norvegicus
aaggcctgctgtctggtctggtacc

SEQ ID NO: 46667 - DNA, 25 bp, Rattus norvegicus
aaggcctgctgtggaccattcagag

SEQ ID NO: 46668 - DNA, 25 bp, Rattus norvegicus
aaggcctgctgtgtggtctggtacc

SEQ ID NO: 46669 - DNA, 25 bp, Rattus norvegicus
aaggcctgcttaccagtgagcagat

SEQ ID NO: 46670 - DNA, 25 bp, Rattus norvegicus
aaggcctgcttagcagtgagcagat

SEQ ID NO: 46671 - DNA, 25 bp, Rattus norvegicus
aaggcctggaatactttgagacatc

SEQ ID NO: 46672 - DNA, 25 bp, Rattus norvegicus
aaggcctggaattctttgagacatc

SEQ ID NO: 46673 - DNA, 25 bp, Rattus norvegicus
aaggcctggatgagttcctctgtgc

SEQ ID NO: 46674 - DNA, 25 bp, Rattus norvegicus
aaggcctggatgtgttcctctgtgc

SEQ ID NO: 46675 - DNA, 25 bp, Rattus norvegicus
aaggcctggccacatgcagtcccga

SEQ ID NO: 46676 - DNA, 25 bp, Rattus norvegicus
aaggcctggccagatgcagtcccga

SEQ ID NO: 46677 - DNA, 25 bp, Rattus norvegicus
aaggcctggcggaagcagtcacgaa

SEQ ID NO: 46678 - DNA, 25 bp, Rattus norvegicus
aaggcctggcggtagcagtcacgaa

SEQ ID NO: 46679 - DNA, 25 bp, Rattus norvegicus
aaggcctgggctctactactgtgaa

SEQ ID NO: 46680 - DNA, 25 bp, Rattus norvegicus
aaggcctgggctgtactactgtgaa

SEQ ID NO: 46681 - DNA, 25 bp, Rattus norvegicus
aaggcctgggttaagttcctggcat

SEQ ID NO: 46682 - DNA, 25 bp, Rattus norvegicus
aaggcctgggtttagttcctggcat

SEQ ID NO: 46683 - DNA, 25 bp, Rattus norvegicus
aaggcctgtagcatcatttttggtg

SEQ ID NO: 46684 - DNA, 25 bp, Rattus norvegicus
aaggcctgtagcttcatttttggtg

SEQ ID NO: 46685 - DNA, 25 bp, Rattus norvegicus
aaggcctgtcccctatgtctaggaa

SEQ ID NO: 46686 - DNA, 25 bp, Rattus norvegicus
aaggcctgtcccgtatgtctaggaa

SEQ ID NO: 46687 - DNA, 25 bp, Rattus norvegicus
aaggcctgtctcacaagtgcagtgg

SEQ ID NO: 46688 - DNA, 25 bp, Rattus norvegicus
aaggcctgtctctcaagtgcagtgg

SEQ ID NO: 46689 - DNA, 25 bp, Rattus norvegicus
aaggcctgtgacctgcgtcctccgg

SEQ ID NO: 46690 - DNA, 25 bp, Rattus norvegicus
aaggcctgtgacgtgcgtcctccgg

SEQ ID NO: 46691 - DNA, 25 bp, Rattus norvegicus
aaggcctgtgggaacttttgcgctg

SEQ ID NO: 46692 - DNA, 25 bp, Rattus norvegicus
aaggcctgtgggtacttttgcgctg

SEQ ID NO: 46693 - DNA, 25 bp, Rattus norvegicus
aaggcctgtgttcgagggtctgcca

SEQ ID NO: 46694 - DNA, 25 bp, Rattus norvegicus
aaggcctgtgttggagggtctgcca

SEQ ID NO: 46695 - DNA, 25 bp, Rattus norvegicus
aaggcctgttaaaattctgttgtat

SEQ ID NO: 46696 - DNA, 25 bp, Rattus norvegicus
aaggcctgttaatattctgttgtat

SEQ ID NO: 46697 - DNA, 25 bp, Rattus norvegicus
aaggccttagcgagtagatgtctgt

SEQ ID NO: 46698 - DNA, 25 bp, Rattus norvegicus
aaggccttagcgtgtagatgtctgt

SEQ ID NO: 46699 - DNA, 25 bp, Rattus norvegicus
aaggccttagttctgatccccaggg

SEQ ID NO: 46700 - DNA, 25 bp, Rattus norvegicus
aaggccttagttgtgatccccaggg

SEQ ID NO: 46701 - DNA, 25 bp, Rattus norvegicus
aaggccttcatgagtgcccggcaaa

SEQ ID NO: 46702 - DNA, 25 bp, Rattus norvegicus
aaggccttcatgtgtgcccggcaaa

SEQ ID NO: 46703 - DNA, 25 bp, Rattus norvegicus
aaggccttccaccaggtgtacaatc

SEQ ID NO: 46704 - DNA, 25 bp, Rattus norvegicus
aaggccttccacgaggtgtacaatc

SEQ ID NO: 46705 - DNA, 25 bp, Rattus norvegicus
aaggccttccatattccttttatct

SEQ ID NO: 46706 - DNA, 25 bp, Rattus norvegicus
aaggccttccattttccttttatct

SEQ ID NO: 46707 - DNA, 25 bp, Rattus norvegicus
aaggccttccgtcaaatgggacttg

SEQ ID NO: 46708 - DNA, 25 bp, Rattus norvegicus
aaggccttccgtgaaatgggacttg

SEQ ID NO: 46709 - DNA, 25 bp, Rattus norvegicus
aaggccttctccatcaaacagctat

SEQ ID NO: 46710 - DNA, 25 bp, Rattus norvegicus
aaggccttctccttcaaacagctat

SEQ ID NO: 46711 - DNA, 25 bp, Rattus norvegicus
aaggccttgagaaacctgatcccac

SEQ ID NO: 46712 - DNA, 25 bp, Rattus norvegicus
aaggccttgagatacctgatcccac

SEQ ID NO: 46713 - DNA, 25 bp, Rattus norvegicus
aaggccttgaggatctcatcagtca

SEQ ID NO: 46714 - DNA, 25 bp, Rattus norvegicus
aaggccttgaggttctcatcagtca

SEQ ID NO: 46715 - DNA, 25 bp, Rattus norvegicus
aaggccttgctgctaatactcctgt

SEQ ID NO: 46716 - DNA, 25 bp, Rattus norvegicus
aaggccttgctggtaatactcctgt

SEQ ID NO: 46717 - DNA, 25 bp, Rattus norvegicus
aaggccttggaacccagctgctata

SEQ ID NO: 46718 - DNA, 25 bp, Rattus norvegicus
aaggccttggaagccagctgctata

SEQ ID NO: 46719 - DNA, 25 bp, Rattus norvegicus
aaggccttgggcagtagctctgata

SEQ ID NO: 46720 - DNA, 25 bp, Rattus norvegicus
aaggccttgggctgtagctctgata

SEQ ID NO: 46721 - DNA, 25 bp, Rattus norvegicus
aaggccttggtgatgcagctcttat

SEQ ID NO: 46722 - DNA, 25 bp, Rattus norvegicus
aaggccttggtgttgcagctcttat

SEQ ID NO: 46723 - DNA, 25 bp, Rattus norvegicus
aaggccttgttcactaaatgtccag

SEQ ID NO: 46724 - DNA, 25 bp, Rattus norvegicus
aaggccttgttctctaaatgtccag

SEQ ID NO: 46725 - DNA, 25 bp, Rattus norvegicus
aaggcctttcagcaaggcttgcctg

SEQ ID NO: 46726 - DNA, 25 bp, Rattus norvegicus
aaggcctttcaggaaggcttgcctg

SEQ ID NO: 46727 - DNA, 25 bp, Rattus norvegicus
aaggcctttcatcctgcaatcctgg

SEQ ID NO: 46728 - DNA, 25 bp, Rattus norvegicus
aaggcctttcatgctgcaatcctgg

SEQ ID NO: 46729 - DNA, 25 bp, Rattus norvegicus
aaggcctttccacttgtgtatgcgc

SEQ ID NO: 46730 - DNA, 25 bp, Rattus norvegicus
aaggcctttccagttgtgtatgcgc

SEQ ID NO: 46731 - DNA, 25 bp, Rattus norvegicus
aaggcctttctcatagagcccctga

SEQ ID NO: 46732 - DNA, 25 bp, Rattus norvegicus
aaggcctttctcttagagcccctga

SEQ ID NO: 46733 - DNA, 25 bp, Rattus norvegicus
aaggcctttctgataccgtggtgca

SEQ ID NO: 46734 - DNA, 25 bp, Rattus norvegicus
aaggcctttctgttaccgtggtgca

SEQ ID NO: 46735 - DNA, 25 bp, Rattus norvegicus
aaggcctttcttaggcacatctatc

SEQ ID NO: 46736 - DNA, 25 bp, Rattus norvegicus
aaggcctttctttggcacatctatc

SEQ ID NO: 46737 - DNA, 25 bp, Rattus norvegicus
aaggcctttgatctccatgggtact

SEQ ID NO: 46738 - DNA, 25 bp, Rattus norvegicus
aaggcctttgatgtccatgggtact

SEQ ID NO: 46739 - DNA, 25 bp, Rattus norvegicus
aaggcctttgcacaccccgagctat

SEQ ID NO: 46740 - DNA, 25 bp, Rattus norvegicus
aaggcctttgcagaccccgagctat

SEQ ID NO: 46741 - DNA, 25 bp, Rattus norvegicus
aaggcctttgctatgattgcataca

SEQ ID NO: 46742 - DNA, 25 bp, Rattus norvegicus
aaggcctttgctttgattgcataca

SEQ ID NO: 46743 - DNA, 25 bp, Rattus norvegicus
aaggcctttggcacaacactaacaa

SEQ ID NO: 46744 - DNA, 25 bp, Rattus norvegicus
aaggcctttggcagactcctttttg

SEQ ID NO: 46745 - DNA, 25 bp, Rattus norvegicus
aaggcctttggctcaacactaacaa

SEQ ID NO: 46746 - DNA, 25 bp, Rattus norvegicus
aaggcctttggctgactcctttttg

SEQ ID NO: 46747 - DNA, 25 bp, Rattus norvegicus
aaggcctttttaccaagcatctctg

SEQ ID NO: 46748 - DNA, 25 bp, Rattus norvegicus
aaggcctttttactgctggtgtgaa

SEQ ID NO: 46749 - DNA, 25 bp, Rattus norvegicus
aaggcctttttagcaagcatctctg

SEQ ID NO: 46750 - DNA, 25 bp, Rattus norvegicus
aaggcctttttagtgctggtgtgaa

SEQ ID NO: 46751 - DNA, 25 bp, Rattus norvegicus
aaggcgaagactagactcgccccag

SEQ ID NO: 46752 - DNA, 25 bp, Rattus norvegicus
aaggcgaagacttgactcgccccag

SEQ ID NO: 46753 - DNA, 25 bp, Rattus norvegicus
aaggcgaagctccaacctgattccg

SEQ ID NO: 46754 - DNA, 25 bp, Rattus norvegicus
aaggcgaagctcgaacctgattccg

SEQ ID NO: 46755 - DNA, 25 bp, Rattus norvegicus
aaggcgaaggacatgcacaccagca

SEQ ID NO: 46756 - DNA, 25 bp, Rattus norvegicus
aaggcgaaggacttgcacaccagca

SEQ ID NO: 46757 - DNA, 25 bp, Rattus norvegicus
aaggcgaaggtcagcctgcaggcaa

SEQ ID NO: 46758 - DNA, 25 bp, Rattus norvegicus
aaggcgaaggtctgcctgcaggcaa

SEQ ID NO: 46759 - DNA, 25 bp, Rattus norvegicus
aaggcgaccgaaccgaaatgtgtaa

SEQ ID NO: 46760 - DNA, 25 bp, Rattus norvegicus
aaggcgaccgaagcgaaatgtgtaa

SEQ ID NO: 46761 - DNA, 25 bp, Rattus norvegicus
aaggcgactgcacacccacaaaggt

SEQ ID NO: 46762 - DNA, 25 bp, Rattus norvegicus
aaggcgactgcagacccacaaaggt

SEQ ID NO: 46763 - DNA, 25 bp, Rattus norvegicus
aaggcgacttgtcgaactagtgctt

SEQ ID NO: 46764 - DNA, 25 bp, Rattus norvegicus
aaggcgacttgtggaactagtgctt

SEQ ID NO: 46765 - DNA, 25 bp, Rattus norvegicus
aaggcgagagccagcgatgccccaa

SEQ ID NO: 46766 - DNA, 25 bp, Rattus norvegicus
aaggcgagagcctgcgatgccccaa

SEQ ID NO: 46767 - DNA, 25 bp, Rattus norvegicus
aaggcgagcactcgtgacagccgat

SEQ ID NO: 46768 - DNA, 25 bp, Rattus norvegicus
aaggcgagcactggtgacagccgat

SEQ ID NO: 46769 - DNA, 25 bp, Rattus norvegicus
aaggcgagggacaagctctaccatc

SEQ ID NO: 46770 - DNA, 25 bp, Rattus norvegicus
aaggcgagggactagctctaccatc

SEQ ID NO: 46771 - DNA, 25 bp, Rattus norvegicus
aaggcgagtactacctgacccatac

SEQ ID NO: 46772 - DNA, 25 bp, Rattus norvegicus
aaggcgagtacttcctgacccatac

SEQ ID NO: 46773 - DNA, 25 bp, Rattus norvegicus
aaggcgatcaccatcaccacctagc

SEQ ID NO: 46774 - DNA, 25 bp, Rattus norvegicus
aaggcgatcaccttcaccacctagc

SEQ ID NO: 46775 - DNA, 25 bp, Rattus norvegicus
aaggcgatcattagccaaggcccac

SEQ ID NO: 46776 - DNA, 25 bp, Rattus norvegicus
aaggcgatcatttgccaaggcccac

SEQ ID NO: 46777 - DNA, 25 bp, Rattus norvegicus
aaggcgatctgacctgtggagacta

SEQ ID NO: 46778 - DNA, 25 bp, Rattus norvegicus
aaggcgatctgagctgtggagacta

SEQ ID NO: 46779 - DNA, 25 bp, Rattus norvegicus
aaggcgatgaggatgcctcgcgcat

SEQ ID NO: 46780 - DNA, 25 bp, Rattus norvegicus
aaggcgatgaggttgcctcgcgcat

SEQ ID NO: 46781 - DNA, 25 bp, Rattus norvegicus
aaggcgatgcttctttgttctgaac

SEQ ID NO: 46782 - DNA, 25 bp, Rattus norvegicus
aaggcgatgcttgtttgttctgaac

SEQ ID NO: 46783 - DNA, 25 bp, Rattus norvegicus
aaggcgatggccatgcctgcacagg

SEQ ID NO: 46784 - DNA, 25 bp, Rattus norvegicus
aaggcgatggccttgcctgcacagg

SEQ ID NO: 46785 - DNA, 25 bp, Rattus norvegicus
aaggcgcacgccagaagtgggcatt

SEQ ID NO: 46786 - DNA, 25 bp, Rattus norvegicus
aaggcgcacgcctgaagtgggcatt

SEQ ID NO: 46787 - DNA, 25 bp, Rattus norvegicus
aaggcgcatctgaggacgcacacag

SEQ ID NO: 46788 - DNA, 25 bp, Rattus norvegicus
aaggcgcatctgtggacgcacacag

SEQ ID NO: 46789 - DNA, 25 bp, Rattus norvegicus
aaggcgccaaccctgaaatcctggg

SEQ ID NO: 46790 - DNA, 25 bp, Rattus norvegicus
aaggcgccaaccgtgaaatcctggg

SEQ ID NO: 46791 - DNA, 25 bp, Rattus norvegicus
aaggcgcccaggcatgcgttacaca

SEQ ID NO: 46792 - DNA, 25 bp, Rattus norvegicus
aaggcgcccagggatgcgttacaca

SEQ ID NO: 46793 - DNA, 25 bp, Rattus norvegicus
aaggcgccctctaaataagcacact

SEQ ID NO: 46794 - DNA, 25 bp, Rattus norvegicus
aaggcgccctcttaataagcacact

SEQ ID NO: 46795 - DNA, 25 bp, Rattus norvegicus
aaggcgccgtttcctagtacttcct

SEQ ID NO: 46796 - DNA, 25 bp, Rattus norvegicus
aaggcgccgtttgctagtacttcct

SEQ ID NO: 46797 - DNA, 25 bp, Rattus norvegicus
aaggcgcgcgttctgcagcagcaaa

SEQ ID NO: 46798 - DNA, 25 bp, Rattus norvegicus
aaggcgcgcgttgtgcagcagcaaa

SEQ ID NO: 46799 - DNA, 25 bp, Rattus norvegicus
aaggcgcggcagactctctgtggtt

SEQ ID NO: 46800 - DNA, 25 bp, Rattus norvegicus
aaggcgcggcagtctctctgtggtt

SEQ ID NO: 46801 - DNA, 25 bp, Rattus norvegicus
aaggcgcgggagatggtgtgcaagt

SEQ ID NO: 46802 - DNA, 25 bp, Rattus norvegicus
aaggcgcgggagttggtgtgcaagt

SEQ ID NO: 46803 - DNA, 25 bp, Rattus norvegicus
aaggcgcgggatccaggacgtgctg

SEQ ID NO: 46804 - DNA, 25 bp, Rattus norvegicus
aaggcgcgggatgcaggacgtgctg

SEQ ID NO: 46805 - DNA, 25 bp, Rattus norvegicus
aaggcgcgtaacaggtgcacattta

SEQ ID NO: 46806 - DNA, 25 bp, Rattus norvegicus
aaggcgcgtaactggtgcacattta

SEQ ID NO: 46807 - DNA, 25 bp, Rattus norvegicus
aaggcgctacgcagagcctggcgca

SEQ ID NO: 46808 - DNA, 25 bp, Rattus norvegicus
aaggcgctacgctgagcctggcgca

SEQ ID NO: 46809 - DNA, 25 bp, Rattus norvegicus
aaggcgctagccaatgtctgagctg

SEQ ID NO: 46810 - DNA, 25 bp, Rattus norvegicus
aaggcgctagcctatgtctgagctg

SEQ ID NO: 46811 - DNA, 25 bp, Rattus norvegicus
aaggcgctcaagacactgggcatca

SEQ ID NO: 46812 - DNA, 25 bp, Rattus norvegicus
aaggcgctcaagtcactgggcatca

SEQ ID NO: 46813 - DNA, 25 bp, Rattus norvegicus
aaggcgctgagtccatgttgctgtc

SEQ ID NO: 46814 - DNA, 25 bp, Rattus norvegicus
aaggcgctgagtgcatgttgctgtc

SEQ ID NO: 46815 - DNA, 25 bp, Rattus norvegicus
aaggcgctgcggacaatctccagaa

SEQ ID NO: 46816 - DNA, 25 bp, Rattus norvegicus
aaggcgctgcggtcaatctccagaa

SEQ ID NO: 46817 - DNA, 25 bp, Rattus norvegicus
aaggcgctgtttacaggttacactg

SEQ ID NO: 46818 - DNA, 25 bp, Rattus norvegicus
aaggcgctgtttcaagctcgtggct

SEQ ID NO: 46819 - DNA, 25 bp, Rattus norvegicus
aaggcgctgtttgaagctcgtggct

SEQ ID NO: 46820 - DNA, 25 bp, Rattus norvegicus
aaggcgctgttttcaggttacactg

SEQ ID NO: 46821 - DNA, 25 bp, Rattus norvegicus
aaggcggacccaaactgatggcagt

SEQ ID NO: 46822 - DNA, 25 bp, Rattus norvegicus
aaggcggacccatactgatggcagt

SEQ ID NO: 46823 - DNA, 25 bp, Rattus norvegicus
aaggcggactccaggtctgagagcc

SEQ ID NO: 46824 - DNA, 25 bp, Rattus norvegicus
aaggcggactcctggtctgagagcc

SEQ ID NO: 46825 - DNA, 25 bp, Rattus norvegicus
aaggcggactgcatctgtatgtagt

SEQ ID NO: 46826 - DNA, 25 bp, Rattus norvegicus
aaggcggactgcttctgtatgtagt

SEQ ID NO: 46827 - DNA, 25 bp, Rattus norvegicus
aaggcggagattacaatcaatcgga

SEQ ID NO: 46828 - DNA, 25 bp, Rattus norvegicus
aaggcggagatttcaatcaatcgga

SEQ ID NO: 46829 - DNA, 25 bp, Rattus norvegicus
aaggcggcacagatcgctcagctcc

SEQ ID NO: 46830 - DNA, 25 bp, Rattus norvegicus
aaggcggcacagttcgctcagctcc

SEQ ID NO: 46831 - DNA, 25 bp, Rattus norvegicus
aaggcggccaggcaacttgcccctg

SEQ ID NO: 46832 - DNA, 25 bp, Rattus norvegicus
aaggcggccagggaacttgcccctg

SEQ ID NO: 46833 - DNA, 25 bp, Rattus norvegicus
aaggcggcctttcaatttgccacgt

SEQ ID NO: 46834 - DNA, 25 bp, Rattus norvegicus
aaggcggcctttgaatttgccacgt

SEQ ID NO: 46835 - DNA, 25 bp, Rattus norvegicus
aaggcggcttctcgatcagcaacta

SEQ ID NO: 46836 - DNA, 25 bp, Rattus norvegicus
aaggcggcttctggatcagcaacta

SEQ ID NO: 46837 - DNA, 25 bp, Rattus norvegicus
aaggcgggaaacatgccacacctgt

SEQ ID NO: 46838 - DNA, 25 bp, Rattus norvegicus
aaggcgggaaacttgccacacctgt

SEQ ID NO: 46839 - DNA, 25 bp, Rattus norvegicus
aaggcgggagtgcagaccaccacac

SEQ ID NO: 46840 - DNA, 25 bp, Rattus norvegicus
aaggcgggagtggagaccaccacac

SEQ ID NO: 46841 - DNA, 25 bp, Rattus norvegicus
aaggcgggctggcagaattccattc

SEQ ID NO: 46842 - DNA, 25 bp, Rattus norvegicus
aaggcgggctgggagaattccattc

SEQ ID NO: 46843 - DNA, 25 bp, Rattus norvegicus
aaggcggtagaaaccttgcgggcca

SEQ ID NO: 46844 - DNA, 25 bp, Rattus norvegicus
aaggcggtagaatccttgcgggcca

SEQ ID NO: 46845 - DNA, 25 bp, Rattus norvegicus
aaggcggtgtgcaatatcgtcaata

SEQ ID NO: 46846 - DNA, 25 bp, Rattus norvegicus
aaggcggtgtgctatatcgtcaata

SEQ ID NO: 46847 - DNA, 25 bp, Rattus norvegicus
aaggcggtgttgactcttgggccat

SEQ ID NO: 46848 - DNA, 25 bp, Rattus norvegicus
aaggcggtgttgtctcttgggccat

SEQ ID NO: 46849 - DNA, 25 bp, Rattus norvegicus
aaggcgtacccgagactgggatcga

SEQ ID NO: 46850 - DNA, 25 bp, Rattus norvegicus
aaggcgtacccgtgactgggatcga

SEQ ID NO: 46851 - DNA, 25 bp, Rattus norvegicus
aaggcgtacttaacagtgcaacagc

SEQ ID NO: 46852 - DNA, 25 bp, Rattus norvegicus
aaggcgtacttatcagtgcaacagc

SEQ ID NO: 46853 - DNA, 25 bp, Rattus norvegicus
aaggcgtattaacctccacgacctc

SEQ ID NO: 46854 - DNA, 25 bp, Rattus norvegicus
aaggcgtattaagctccacgacctc

SEQ ID NO: 46855 - DNA, 25 bp, Rattus norvegicus
aaggcgtcagtgcagtccctgagtc

SEQ ID NO: 46856 - DNA, 25 bp, Rattus norvegicus
aaggcgtcagtggagtccctgagtc

SEQ ID NO: 46857 - DNA, 25 bp, Rattus norvegicus
aaggcgtccagaagatcctcatcgg

SEQ ID NO: 46858 - DNA, 25 bp, Rattus norvegicus
aaggcgtccagatgatcctcatcgg

SEQ ID NO: 46859 - DNA, 25 bp, Rattus norvegicus
aaggcgtccctgacttagtccatgt

SEQ ID NO: 46860 - DNA, 25 bp, Rattus norvegicus
aaggcgtccctgtcttagtccatgt

SEQ ID NO: 46861 - DNA, 25 bp, Rattus norvegicus
aaggcgtcgcttaaacatttccagt

SEQ ID NO: 46862 - DNA, 25 bp, Rattus norvegicus
aaggcgtcgctttaacatttccagt

SEQ ID NO: 46863 - DNA, 25 bp, Rattus norvegicus
aaggcgtcgtccaggtccatgtagt

SEQ ID NO: 46864 - DNA, 25 bp, Rattus norvegicus
aaggcgtcgtcctggtccatgtagt

SEQ ID NO: 46865 - DNA, 25 bp, Rattus norvegicus
aaggcgtcttacagtaaatagtcca

SEQ ID NO: 46866 - DNA, 25 bp, Rattus norvegicus
aaggcgtcttactgtaaatagtcca

SEQ ID NO: 46867 - DNA, 25 bp, Rattus norvegicus
aaggcgtgaaatccgtctgggaaat

SEQ ID NO: 46868 - DNA, 25 bp, Rattus norvegicus
aaggcgtgaaatgcgtctgggaaat

SEQ ID NO: 46869 - DNA, 25 bp, Rattus norvegicus
aaggcgtgagtgagcaaggaaccca

SEQ ID NO: 46870 - DNA, 25 bp, Rattus norvegicus
aaggcgtgagtgtgcaaggaaccca

SEQ ID NO: 46871 - DNA, 25 bp, Rattus norvegicus
aaggcgtgcataatctgaccagcag

SEQ ID NO: 46872 - DNA, 25 bp, Rattus norvegicus
aaggcgtgcatattctgaccagcag

SEQ ID NO: 46873 - DNA, 25 bp, Rattus norvegicus
aaggcgtgcgccatgtagttgtcat

SEQ ID NO: 46874 - DNA, 25 bp, Rattus norvegicus
aaggcgtgcgccttgtagttgtcat

SEQ ID NO: 46875 - DNA, 25 bp, Rattus norvegicus
aaggcgtgctgtagtgacccactgg

SEQ ID NO: 46876 - DNA, 25 bp, Rattus norvegicus
aaggcgtgctgttgtgacccactgg

SEQ ID NO: 46877 - DNA, 25 bp, Rattus norvegicus
aaggcgtggaccattcttgcggact

SEQ ID NO: 46878 - DNA, 25 bp, Rattus norvegicus
aaggcgtggacctttcttgcggact

SEQ ID NO: 46879 - DNA, 25 bp, Rattus norvegicus
aaggcgtggaggagtccctgtttct

SEQ ID NO: 46880 - DNA, 25 bp, Rattus norvegicus
aaggcgtggaggtgtccctgtttct

SEQ ID NO: 46881 - DNA, 25 bp, Rattus norvegicus
aaggcgtgggtccagtagtaactct

SEQ ID NO: 46882 - DNA, 25 bp, Rattus norvegicus
aaggcgtgggtcgagtagtaactct

SEQ ID NO: 46883 - DNA, 25 bp, Rattus norvegicus
aaggcgtgtgatacatgcccagcca

SEQ ID NO: 46884 - DNA, 25 bp, Rattus norvegicus
aaggcgtgtgattcatgcccagcca

SEQ ID NO: 46885 - DNA, 25 bp, Rattus norvegicus
aaggcgtgtggcagcttccaagttg

SEQ ID NO: 46886 - DNA, 25 bp, Rattus norvegicus
aaggcgtgtggctgcttccaagttg

SEQ ID NO: 46887 - DNA, 25 bp, Rattus norvegicus
aaggcgttcctcacattagctgaag

SEQ ID NO: 46888 - DNA, 25 bp, Rattus norvegicus
aaggcgttcctctcattagctgaag

SEQ ID NO: 46889 - DNA, 25 bp, Rattus norvegicus
aaggcgttctgtacaaccagttcct

SEQ ID NO: 46890 - DNA, 25 bp, Rattus norvegicus
aaggcgttctgttcaaccagttcct

SEQ ID NO: 46891 - DNA, 25 bp, Rattus norvegicus
aaggcgttgcctctttactgagtaa

SEQ ID NO: 46892 - DNA, 25 bp, Rattus norvegicus
aaggcgttgcctgtttactgagtaa

SEQ ID NO: 46893 - DNA, 25 bp, Rattus norvegicus
aaggcgttgcttcagtgattccctc

SEQ ID NO: 46894 - DNA, 25 bp, Rattus norvegicus
aaggcgttgcttgagtgattccctc

SEQ ID NO: 46895 - DNA, 25 bp, Rattus norvegicus
aaggcgtttatcattgtgaagcttt

SEQ ID NO: 46896 - DNA, 25 bp, Rattus norvegicus
aaggcgtttatctttgtgaagcttt

SEQ ID NO: 46897 - DNA, 25 bp, Rattus norvegicus
aaggcgtttctcctagcttggtgtc

SEQ ID NO: 46898 - DNA, 25 bp, Rattus norvegicus
aaggcgtttctcgtagcttggtgtc

SEQ ID NO: 46899 - DNA, 25 bp, Rattus norvegicus
aaggcgtttggaatgcctttgccac

SEQ ID NO: 46900 - DNA, 25 bp, Rattus norvegicus
aaggcgtttggattgcctttgccac

SEQ ID NO: 46901 - DNA, 25 bp, Rattus norvegicus
aaggctaaacacagctatgcagaaa

SEQ ID NO: 46902 - DNA, 25 bp, Rattus norvegicus
aaggctaaacactgctatgcagaaa

SEQ ID NO: 46903 - DNA, 25 bp, Rattus norvegicus
aaggctaaactgctgcactatcaca

SEQ ID NO: 46904 - DNA, 25 bp, Rattus norvegicus
aaggctaaactggtgcactatcaca

SEQ ID NO: 46905 - DNA, 25 bp, Rattus norvegicus
aaggctaaatacctctcttcatcac

SEQ ID NO: 46906 - DNA, 25 bp, Rattus norvegicus
aaggctaaatacgtctcttcatcac

SEQ ID NO: 46907 - DNA, 25 bp, Rattus norvegicus
aaggctaaatccactgcttgttcct

SEQ ID NO: 46908 - DNA, 25 bp, Rattus norvegicus
aaggctaaatcctctgcttgttcct

SEQ ID NO: 46909 - DNA, 25 bp, Rattus norvegicus
aaggctaaatttccactctccccaa

SEQ ID NO: 46910 - DNA, 25 bp, Rattus norvegicus
aaggctaaatttgcactctccccaa

SEQ ID NO: 46911 - DNA, 25 bp, Rattus norvegicus
aaggctaagaatcgccacctggctg

SEQ ID NO: 46912 - DNA, 25 bp, Rattus norvegicus
aaggctaagaatggccacctggctg

SEQ ID NO: 46913 - DNA, 25 bp, Rattus norvegicus
aaggctaagcgtactcagtcctcag

SEQ ID NO: 46914 - DNA, 25 bp, Rattus norvegicus
aaggctaagcgttctcagtcctcag

SEQ ID NO: 46915 - DNA, 25 bp, Rattus norvegicus
aaggctaaggcgacttctttcttgg

SEQ ID NO: 46916 - DNA, 25 bp, Rattus norvegicus
aaggctaaggcgtcttctttcttgg

SEQ ID NO: 46917 - DNA, 25 bp, Rattus norvegicus
aaggctaaggctcttggcatccagg

SEQ ID NO: 46918 - DNA, 25 bp, Rattus norvegicus
aaggctaaggctgttggcatccagg

SEQ ID NO: 46919 - DNA, 25 bp, Rattus norvegicus
aaggctaagtccatggtcgatcaaa

SEQ ID NO: 46920 - DNA, 25 bp, Rattus norvegicus
aaggctaagtccttggtcgatcaaa

SEQ ID NO: 46921 - DNA, 25 bp, Rattus norvegicus
aaggctacaaagaggcagctctgct

SEQ ID NO: 46922 - DNA, 25 bp, Rattus norvegicus
aaggctacaaagtggcagctctgct

SEQ ID NO: 46923 - DNA, 25 bp, Rattus norvegicus
aaggctacaggcaaccaggagctcc

SEQ ID NO: 46924 - DNA, 25 bp, Rattus norvegicus
aaggctacaggctaccaggagctcc

SEQ ID NO: 46925 - DNA, 25 bp, Rattus norvegicus
aaggctaccagtattccacaatgca

SEQ ID NO: 46926 - DNA, 25 bp, Rattus norvegicus
aaggctaccagttttccacaatgca

SEQ ID NO: 46927 - DNA, 25 bp, Rattus norvegicus
aaggctaccatgactcttgtgatga

SEQ ID NO: 46928 - DNA, 25 bp, Rattus norvegicus
aaggctaccatgtctcttgtgatga

SEQ ID NO: 46929 - DNA, 25 bp, Rattus norvegicus
aaggctacccagctgccatgagtgg

SEQ ID NO: 46930 - DNA, 25 bp, Rattus norvegicus
aaggctacccaggtgccatgagtgg

SEQ ID NO: 46931 - DNA, 25 bp, Rattus norvegicus
aaggctaccctccactaagtagcaa

SEQ ID NO: 46932 - DNA, 25 bp, Rattus norvegicus
aaggctaccctcgactaagtagcaa

SEQ ID NO: 46933 - DNA, 25 bp, Rattus norvegicus
aaggctaccgttaatgaggtcatct

SEQ ID NO: 46934 - DNA, 25 bp, Rattus norvegicus
aaggctaccgtttatgaggtcatct

SEQ ID NO: 46935 - DNA, 25 bp, Rattus norvegicus
aaggctacctaccatgtctgtgttc

SEQ ID NO: 46936 - DNA, 25 bp, Rattus norvegicus
aaggctacctacgatgtctgtgttc

SEQ ID NO: 46937 - DNA, 25 bp, Rattus norvegicus
aaggctacctgactgcactatggct

SEQ ID NO: 46938 - DNA, 25 bp, Rattus norvegicus
aaggctacctgagtgcactatggct

SEQ ID NO: 46939 - DNA, 25 bp, Rattus norvegicus
aaggctacctgtctgtatttcgtgc

SEQ ID NO: 46940 - DNA, 25 bp, Rattus norvegicus
aaggctacctgtgtgtatttcgtgc

SEQ ID NO: 46941 - DNA, 25 bp, Rattus norvegicus
aaggctaccttgagagtgatttaac

SEQ ID NO: 46942 - DNA, 25 bp, Rattus norvegicus
aaggctaccttgtgagtgatttaac

SEQ ID NO: 46943 - DNA, 25 bp, Rattus norvegicus
aaggctacctttctattctctcctg

SEQ ID NO: 46944 - DNA, 25 bp, Rattus norvegicus
aaggctacctttgtattctctcctg

SEQ ID NO: 46945 - DNA, 25 bp, Rattus norvegicus
aaggctactactacaggacacctac

SEQ ID NO: 46946 - DNA, 25 bp, Rattus norvegicus
aaggctactacttcaggacacctac

SEQ ID NO: 46947 - DNA, 25 bp, Rattus norvegicus
aaggctactcccaggcttggaatgg

SEQ ID NO: 46948 - DNA, 25 bp, Rattus norvegicus
aaggctactccctggcttggaatgg

SEQ ID NO: 46949 - DNA, 25 bp, Rattus norvegicus
aaggctactgtcacatcgtggtgga

SEQ ID NO: 46950 - DNA, 25 bp, Rattus norvegicus
aaggctactgtctcatcgtggtgga

SEQ ID NO: 46951 - DNA, 25 bp, Rattus norvegicus
aaggctactgtgctcctgagtatgt

SEQ ID NO: 46952 - DNA, 25 bp, Rattus norvegicus
aaggctactgtggtcctgagtatgt

SEQ ID NO: 46953 - DNA, 25 bp, Rattus norvegicus
aaggctactgttacatcctgacctg

SEQ ID NO: 46954 - DNA, 25 bp, Rattus norvegicus
aaggctactgtttcatcctgacctg

SEQ ID NO: 46955 - DNA, 25 bp, Rattus norvegicus
aaggctacttagacctctgacgtgg

SEQ ID NO: 46956 - DNA, 25 bp, Rattus norvegicus
aaggctacttagtcctctgacgtgg

SEQ ID NO: 46957 - DNA, 25 bp, Rattus norvegicus
aaggctagccgaaagacctctaatg

SEQ ID NO: 46958 - DNA, 25 bp, Rattus norvegicus
aaggctagccgatagacctctaatg

SEQ ID NO: 46959 - DNA, 25 bp, Rattus norvegicus
aaggctagccttagatctcatttag

SEQ ID NO: 46960 - DNA, 25 bp, Rattus norvegicus
aaggctagcctttgatctcatttag

SEQ ID NO: 46961 - DNA, 25 bp, Rattus norvegicus
aaggctagcgacagcaggcttctga

SEQ ID NO: 46962 - DNA, 25 bp, Rattus norvegicus
aaggctagcgactgcaggcttctga

SEQ ID NO: 46963 - DNA, 25 bp, Rattus norvegicus
aaggctagtcccattggtcttcagg

SEQ ID NO: 46964 - DNA, 25 bp, Rattus norvegicus
aaggctagtccctttggtcttcagg

SEQ ID NO: 46965 - DNA, 25 bp, Rattus norvegicus
aaggctatcccactgcgtgttggta

SEQ ID NO: 46966 - DNA, 25 bp, Rattus norvegicus
aaggctatcccagtgcgtgttggta

SEQ ID NO: 46967 - DNA, 25 bp, Rattus norvegicus
aaggctatcctgcttttcaaagcaa

SEQ ID NO: 46968 - DNA, 25 bp, Rattus norvegicus
aaggctatcctggttttcaaagcaa

SEQ ID NO: 46969 - DNA, 25 bp, Rattus norvegicus
aaggctatctgtactgggtaccggt

SEQ ID NO: 46970 - DNA, 25 bp, Rattus norvegicus
aaggctatctgttctgggtaccggt

SEQ ID NO: 46971 - DNA, 25 bp, Rattus norvegicus
aaggctatgataaggctcagcagga

SEQ ID NO: 46972 - DNA, 25 bp, Rattus norvegicus
aaggctatgatatggctcagcagga

SEQ ID NO: 46973 - DNA, 25 bp, Rattus norvegicus
aaggctatgcaccatcctgcaatag

SEQ ID NO: 46974 - DNA, 25 bp, Rattus norvegicus
aaggctatgcacgatcctgcaatag

SEQ ID NO: 46975 - DNA, 25 bp, Rattus norvegicus
aaggctatgcccctggtacagaatt

SEQ ID NO: 46976 - DNA, 25 bp, Rattus norvegicus
aaggctatgcccgtggtacagaatt

SEQ ID NO: 46977 - DNA, 25 bp, Rattus norvegicus
aaggctatgttccaaagactctgtc

SEQ ID NO: 46978 - DNA, 25 bp, Rattus norvegicus
aaggctatgttcgaaagactctgtc

SEQ ID NO: 46979 - DNA, 25 bp, Rattus norvegicus
aaggctatgtttccgaagatctccg

SEQ ID NO: 46980 - DNA, 25 bp, Rattus norvegicus
aaggctatgtttgcgaagatctccg

SEQ ID NO: 46981 - DNA, 25 bp, Rattus norvegicus
aaggctattcctaggtcatgtccat

SEQ ID NO: 46982 - DNA, 25 bp, Rattus norvegicus
aaggctattccttggtcatgtccat

SEQ ID NO: 46983 - DNA, 25 bp, Rattus norvegicus
aaggctattctgattggcgctgtgt

SEQ ID NO: 46984 - DNA, 25 bp, Rattus norvegicus
aaggctattctgtttggcgctgtgt

SEQ ID NO: 46985 - DNA, 25 bp, Rattus norvegicus
aaggctattgcgagtctgctgctac

SEQ ID NO: 46986 - DNA, 25 bp, Rattus norvegicus
aaggctattgcgtgtctgctgctac

SEQ ID NO: 46987 - DNA, 25 bp, Rattus norvegicus
aaggctatttctcgagttcacactg

SEQ ID NO: 46988 - DNA, 25 bp, Rattus norvegicus
aaggctatttctggagttcacactg

SEQ ID NO: 46989 - DNA, 25 bp, Rattus norvegicus
aaggctcaaaggacgtgggcacctc

SEQ ID NO: 46990 - DNA, 25 bp, Rattus norvegicus
aaggctcaaaggtcgtgggcacctc

SEQ ID NO: 46991 - DNA, 25 bp, Rattus norvegicus
aaggctcaaattacattcccgtgta

SEQ ID NO: 46992 - DNA, 25 bp, Rattus norvegicus
aaggctcaaatttcattcccgtgta

SEQ ID NO: 46993 - DNA, 25 bp, Rattus norvegicus
aaggctcaactaaagcacgctggag

SEQ ID NO: 46994 - DNA, 25 bp, Rattus norvegicus
aaggctcaactatagcacgctggag

SEQ ID NO: 46995 - DNA, 25 bp, Rattus norvegicus
aaggctcacagcagtcctggcatag

SEQ ID NO: 46996 - DNA, 25 bp, Rattus norvegicus
aaggctcacagctgtcctggcatag

SEQ ID NO: 46997 - DNA, 25 bp, Rattus norvegicus
aaggctcaccgcagaagcagtagca

SEQ ID NO: 46998 - DNA, 25 bp, Rattus norvegicus
aaggctcaccgctgaagcagtagca

SEQ ID NO: 46999 - DNA, 25 bp, Rattus norvegicus
aaggctcaccgtaatggtcattgat

SEQ ID NO: 47000 - DNA, 25 bp, Rattus norvegicus
aaggctcaccgttatggtcattgat

SEQ ID NO: 47001 - DNA, 25 bp, Rattus norvegicus
aaggctcactgcattggtagatgat

SEQ ID NO: 47002 - DNA, 25 bp, Rattus norvegicus
aaggctcactgctttggtagatgat

SEQ ID NO: 47003 - DNA, 25 bp, Rattus norvegicus
aaggctcagatgcagctctcggacg

SEQ ID NO: 47004 - DNA, 25 bp, Rattus norvegicus
aaggctcagatggagctctcggacg

SEQ ID NO: 47005 - DNA, 25 bp, Rattus norvegicus
aaggctcagcaactgcaggatccat

SEQ ID NO: 47006 - DNA, 25 bp, Rattus norvegicus
aaggctcagcaagtgcaggatccat

SEQ ID NO: 47007 - DNA, 25 bp, Rattus norvegicus
aaggctcagccaagaaactttcccg

SEQ ID NO: 47008 - DNA, 25 bp, Rattus norvegicus
aaggctcagccatgaaactttcccg

SEQ ID NO: 47009 - DNA, 25 bp, Rattus norvegicus
aaggctcagctgctggtgattgccc

SEQ ID NO: 47010 - DNA, 25 bp, Rattus norvegicus
aaggctcagctggtggtgattgccc

SEQ ID NO: 47011 - DNA, 25 bp, Rattus norvegicus
aaggctcagggcaacctcactgagg

SEQ ID NO: 47012 - DNA, 25 bp, Rattus norvegicus
aaggctcagggctacctcactgagg

SEQ ID NO: 47013 - DNA, 25 bp, Rattus norvegicus
aaggctcaggtacccaatcctggag

SEQ ID NO: 47014 - DNA, 25 bp, Rattus norvegicus
aaggctcaggtagccaatcctggag

SEQ ID NO: 47015 - DNA, 25 bp, Rattus norvegicus
aaggctcagtggaatccgccagaat

SEQ ID NO: 47016 - DNA, 25 bp, Rattus norvegicus
aaggctcagtggtatccgccagaat

SEQ ID NO: 47017 - DNA, 25 bp, Rattus norvegicus
aaggctcatctccttggatttcaca

SEQ ID NO: 47018 - DNA, 25 bp, Rattus norvegicus
aaggctcatctcgttggatttcaca

SEQ ID NO: 47019 - DNA, 25 bp, Rattus norvegicus
aaggctcatctgaagcaccttatcc

SEQ ID NO: 47020 - DNA, 25 bp, Rattus norvegicus
aaggctcatctgtagcaccttatcc

SEQ ID NO: 47021 - DNA, 25 bp, Rattus norvegicus
aaggctcattagctgagactccgaa

SEQ ID NO: 47022 - DNA, 25 bp, Rattus norvegicus
aaggctcattaggtgagactccgaa

SEQ ID NO: 47023 - DNA, 25 bp, Rattus norvegicus
aaggctcatttcacatacaactcta

SEQ ID NO: 47024 - DNA, 25 bp, Rattus norvegicus
aaggctcatttctcatacaactcta

SEQ ID NO: 47025 - DNA, 25 bp, Rattus norvegicus
aaggctcatttgattctgcggcggc

SEQ ID NO: 47026 - DNA, 25 bp, Rattus norvegicus
aaggctcatttgtttctgcggcggc

SEQ ID NO: 47027 - DNA, 25 bp, Rattus norvegicus
aaggctccaaaaacatattccgggt

SEQ ID NO: 47028 - DNA, 25 bp, Rattus norvegicus
aaggctccaaaatcatattccgggt

SEQ ID NO: 47029 - DNA, 25 bp, Rattus norvegicus
aaggctccacctcaggcttttaatg

SEQ ID NO: 47030 - DNA, 25 bp, Rattus norvegicus
aaggctccacctgaggcttttaatg

SEQ ID NO: 47031 - DNA, 25 bp, Rattus norvegicus
aaggctccagaacttcagttgtcac

SEQ ID NO: 47032 - DNA, 25 bp, Rattus norvegicus
aaggctccagaagttcagttgtcac

SEQ ID NO: 47033 - DNA, 25 bp, Rattus norvegicus
aaggctccagatcttactgctgaca

SEQ ID NO: 47034 - DNA, 25 bp, Rattus norvegicus
aaggctccagatgttactgctgaca

SEQ ID NO: 47035 - DNA, 25 bp, Rattus norvegicus
aaggctccagcgaatctgcatgaat

SEQ ID NO: 47036 - DNA, 25 bp, Rattus norvegicus
aaggctccagcgtatctgcatgaat

SEQ ID NO: 47037 - DNA, 25 bp, Rattus norvegicus
aaggctccagttaattttaagatca

SEQ ID NO: 47038 - DNA, 25 bp, Rattus norvegicus
aaggctccagtttattttaagatca

SEQ ID NO: 47039 - DNA, 25 bp, Rattus norvegicus
aaggctccattaccatgtaccaaat

SEQ ID NO: 47040 - DNA, 25 bp, Rattus norvegicus
aaggctccattagcatgtaccaaat

SEQ ID NO: 47041 - DNA, 25 bp, Rattus norvegicus
aaggctccattcatgcctcagtggc

SEQ ID NO: 47042 - DNA, 25 bp, Rattus norvegicus
aaggctccattcttgcctcagtggc

SEQ ID NO: 47043 - DNA, 25 bp, Rattus norvegicus
aaggctccatttagcagaggtacca

SEQ ID NO: 47044 - DNA, 25 bp, Rattus norvegicus
aaggctccatttatccactctgtag

SEQ ID NO: 47045 - DNA, 25 bp, Rattus norvegicus
aaggctccattttgcagaggtacca

SEQ ID NO: 47046 - DNA, 25 bp, Rattus norvegicus
aaggctccatttttccactctgtag

SEQ ID NO: 47047 - DNA, 25 bp, Rattus norvegicus
aaggctcccattagaggccatccct

SEQ ID NO: 47048 - DNA, 25 bp, Rattus norvegicus
aaggctcccatttgaggccatccct

SEQ ID NO: 47049 - DNA, 25 bp, Rattus norvegicus
aaggctcccgcacctgaggcaggaa

SEQ ID NO: 47050 - DNA, 25 bp, Rattus norvegicus
aaggctcccgcagctgaggcaggaa

SEQ ID NO: 47051 - DNA, 25 bp, Rattus norvegicus
aaggctccgaagatcaaccattcag

SEQ ID NO: 47052 - DNA, 25 bp, Rattus norvegicus
aaggctccgaagttcaaccattcag

SEQ ID NO: 47053 - DNA, 25 bp, Rattus norvegicus
aaggctccgatgcaacctatggttc

SEQ ID NO: 47054 - DNA, 25 bp, Rattus norvegicus
aaggctccgatggaacctatggttc

SEQ ID NO: 47055 - DNA, 25 bp, Rattus norvegicus
aaggctccgttgagttctgatcttg

SEQ ID NO: 47056 - DNA, 25 bp, Rattus norvegicus
aaggctccgttgtgttctgatcttg

SEQ ID NO: 47057 - DNA, 25 bp, Rattus norvegicus
aaggctcctaacaaatggctttaat

SEQ ID NO: 47058 - DNA, 25 bp, Rattus norvegicus
aaggctcctaacatcctgagctgaa

SEQ ID NO: 47059 - DNA, 25 bp, Rattus norvegicus
aaggctcctaactaatggctttaat

SEQ ID NO: 47060 - DNA, 25 bp, Rattus norvegicus
aaggctcctaacttcctgagctgaa

SEQ ID NO: 47061 - DNA, 25 bp, Rattus norvegicus
aaggctcctaagacgttcatggctt

SEQ ID NO: 47062 - DNA, 25 bp, Rattus norvegicus
aaggctcctaagtcgttcatggctt

SEQ ID NO: 47063 - DNA, 25 bp, Rattus norvegicus
aaggctcctcatagtatatccatgg

SEQ ID NO: 47064 - DNA, 25 bp, Rattus norvegicus
aaggctcctcattgtatatccatgg

SEQ ID NO: 47065 - DNA, 25 bp, Rattus norvegicus
aaggctcctcccatcagaaaggaca

SEQ ID NO: 47066 - DNA, 25 bp, Rattus norvegicus
aaggctcctcccttcagaaaggaca

SEQ ID NO: 47067 - DNA, 25 bp, Rattus norvegicus
aaggctccttgtatttgcaaatcga

SEQ ID NO: 47068 - DNA, 25 bp, Rattus norvegicus
aaggctccttgtttttgcaaatcga

SEQ ID NO: 47069 - DNA, 25 bp, Rattus norvegicus
aaggctccttttccagctcatggct

SEQ ID NO: 47070 - DNA, 25 bp, Rattus norvegicus
aaggctccttttgcagctcatggct

SEQ ID NO: 47071 - DNA, 25 bp, Rattus norvegicus
aaggctcgaatgactaaccctctga

SEQ ID NO: 47072 - DNA, 25 bp, Rattus norvegicus
aaggctcgaatgtctaaccctctga

SEQ ID NO: 47073 - DNA, 25 bp, Rattus norvegicus
aaggctcgagctactcgggtcaata

SEQ ID NO: 47074 - DNA, 25 bp, Rattus norvegicus
aaggctcgagcttctcgggtcaata

SEQ ID NO: 47075 - DNA, 25 bp, Rattus norvegicus
aaggctcgctcactgatggccaagt

SEQ ID NO: 47076 - DNA, 25 bp, Rattus norvegicus
aaggctcgctcagtgatggccaagt

SEQ ID NO: 47077 - DNA, 25 bp, Rattus norvegicus
aaggctcgcttgatgggttttgtcc

SEQ ID NO: 47078 - DNA, 25 bp, Rattus norvegicus
aaggctcgcttgttgggttttgtcc

SEQ ID NO: 47079 - DNA, 25 bp, Rattus norvegicus
aaggctcggccccatgtagtaagcg

SEQ ID NO: 47080 - DNA, 25 bp, Rattus norvegicus
aaggctcggcccgatgtagtaagcg

SEQ ID NO: 47081 - DNA, 25 bp, Rattus norvegicus
aaggctcgggagaggttccatcgca

SEQ ID NO: 47082 - DNA, 25 bp, Rattus norvegicus
aaggctcgggagtggttccatcgca

SEQ ID NO: 47083 - DNA, 25 bp, Rattus norvegicus
aaggctcgtagaacgtggctgcact

SEQ ID NO: 47084 - DNA, 25 bp, Rattus norvegicus
aaggctcgtagatcgtggctgcact

SEQ ID NO: 47085 - DNA, 25 bp, Rattus norvegicus
aaggctcgtcagaacatgcgggtgt

SEQ ID NO: 47086 - DNA, 25 bp, Rattus norvegicus
aaggctcgtcagtacatgcgggtgt

SEQ ID NO: 47087 - DNA, 25 bp, Rattus norvegicus
aaggctctaagcacggactgtggtg

SEQ ID NO: 47088 - DNA, 25 bp, Rattus norvegicus
aaggctctaagctcggactgtggtg

SEQ ID NO: 47089 - DNA, 25 bp, Rattus norvegicus
aaggctctacatagggttcctggct

SEQ ID NO: 47090 - DNA, 25 bp, Rattus norvegicus
aaggctctacattgggttcctggct

SEQ ID NO: 47091 - DNA, 25 bp, Rattus norvegicus
aaggctctagaccagcttggctgca

SEQ ID NO: 47092 - DNA, 25 bp, Rattus norvegicus
aaggctctagacgagcttggctgca

SEQ ID NO: 47093 - DNA, 25 bp, Rattus norvegicus
aaggctctagagacaccagtcaatt

SEQ ID NO: 47094 - DNA, 25 bp, Rattus norvegicus
aaggctctagagtcaccagtcaatt

SEQ ID NO: 47095 - DNA, 25 bp, Rattus norvegicus
aaggctctatttagaaggctgtgaa

SEQ ID NO: 47096 - DNA, 25 bp, Rattus norvegicus
aaggctctattttgaaggctgtgaa

SEQ ID NO: 47097 - DNA, 25 bp, Rattus norvegicus
aaggctctcactcggcaagattcta

SEQ ID NO: 47098 - DNA, 25 bp, Rattus norvegicus
aaggctctcactgggcaagattcta

SEQ ID NO: 47099 - DNA, 25 bp, Rattus norvegicus
aaggctctcaggaggtggtcatcga

SEQ ID NO: 47100 - DNA, 25 bp, Rattus norvegicus
aaggctctcaggtggtggtcatcga

SEQ ID NO: 47101 - DNA, 25 bp, Rattus norvegicus
aaggctctccagatctagggcagca

SEQ ID NO: 47102 - DNA, 25 bp, Rattus norvegicus
aaggctctccagttctagggcagca

SEQ ID NO: 47103 - DNA, 25 bp, Rattus norvegicus
aaggctctccatatcgccgagaact

SEQ ID NO: 47104 - DNA, 25 bp, Rattus norvegicus
aaggctctccatttcgccgagaact

SEQ ID NO: 47105 - DNA, 25 bp, Rattus norvegicus
aaggctctcctaaatgctggttcag

SEQ ID NO: 47106 - DNA, 25 bp, Rattus norvegicus
aaggctctcctatatgctggttcag

SEQ ID NO: 47107 - DNA, 25 bp, Rattus norvegicus
aaggctctctttcctgattacctac

SEQ ID NO: 47108 - DNA, 25 bp, Rattus norvegicus
aaggctctctttgctgattacctac

SEQ ID NO: 47109 - DNA, 25 bp, Rattus norvegicus
aaggctctgagcagcctccaatgtg

SEQ ID NO: 47110 - DNA, 25 bp, Rattus norvegicus
aaggctctgagctgcctccaatgtg

SEQ ID NO: 47111 - DNA, 25 bp, Rattus norvegicus
aaggctctgaggacattacggttat

SEQ ID NO: 47112 - DNA, 25 bp, Rattus norvegicus
aaggctctgaggcagctcactagac

SEQ ID NO: 47113 - DNA, 25 bp, Rattus norvegicus
aaggctctgagggagctcactagac

SEQ ID NO: 47114 - DNA, 25 bp, Rattus norvegicus
aaggctctgaggtcattacggttat

SEQ ID NO: 47115 - DNA, 25 bp, Rattus norvegicus
aaggctctgatcattttgtttttag

SEQ ID NO: 47116 - DNA, 25 bp, Rattus norvegicus
aaggctctgatctttttgtttttag

SEQ ID NO: 47117 - DNA, 25 bp, Rattus norvegicus
aaggctctgcatacgtacttttcat

SEQ ID NO: 47118 - DNA, 25 bp, Rattus norvegicus
aaggctctgcattcgtacttttcat

SEQ ID NO: 47119 - DNA, 25 bp, Rattus norvegicus
aaggctctgctcagcatttcaaaac

SEQ ID NO: 47120 - DNA, 25 bp, Rattus norvegicus
aaggctctgctctgcatttcaaaac

SEQ ID NO: 47121 - DNA, 25 bp, Rattus norvegicus
aaggctctggacattgtaggtcact

SEQ ID NO: 47122 - DNA, 25 bp, Rattus norvegicus
aaggctctggactttgtaggtcact

SEQ ID NO: 47123 - DNA, 25 bp, Rattus norvegicus
aaggctctggccaatgtcaacattg

SEQ ID NO: 47124 - DNA, 25 bp, Rattus norvegicus
aaggctctggcctatgtcaacattg

SEQ ID NO: 47125 - DNA, 25 bp, Rattus norvegicus
aaggctctgggaactctgggcatga

SEQ ID NO: 47126 - DNA, 25 bp, Rattus norvegicus
aaggctctgggatctctgggcatga

SEQ ID NO: 47127 - DNA, 25 bp, Rattus norvegicus
aaggctctggtacactcggctatag

SEQ ID NO: 47128 - DNA, 25 bp, Rattus norvegicus
aaggctctggtagactcggctatag

SEQ ID NO: 47129 - DNA, 25 bp, Rattus norvegicus
aaggctctggtgatttctatttcta

SEQ ID NO: 47130 - DNA, 25 bp, Rattus norvegicus
aaggctctggtgttttctatttcta

SEQ ID NO: 47131 - DNA, 25 bp, Rattus norvegicus
aaggctctgtctccgagcagggcac

SEQ ID NO: 47132 - DNA, 25 bp, Rattus norvegicus
aaggctctgtctgcgagcagggcac

SEQ ID NO: 47133 - DNA, 25 bp, Rattus norvegicus
aaggctctgttgcatttgtacctca

SEQ ID NO: 47134 - DNA, 25 bp, Rattus norvegicus
aaggctctgttggatttgtacctca

SEQ ID NO: 47135 - DNA, 25 bp, Rattus norvegicus
aaggctcttagcatgttttcttgga

SEQ ID NO: 47136 - DNA, 25 bp, Rattus norvegicus
aaggctcttagcttgttttcttgga

SEQ ID NO: 47137 - DNA, 25 bp, Rattus norvegicus
aaggctcttaggctatagcccggat

SEQ ID NO: 47138 - DNA, 25 bp, Rattus norvegicus
aaggctcttagggtatagcccggat

SEQ ID NO: 47139 - DNA, 25 bp, Rattus norvegicus
aaggctcttagtaaacacctgccct

SEQ ID NO: 47140 - DNA, 25 bp, Rattus norvegicus
aaggctcttagttaacacctgccct

SEQ ID NO: 47141 - DNA, 25 bp, Rattus norvegicus
aaggctcttcctaaattcctctgga

SEQ ID NO: 47142 - DNA, 25 bp, Rattus norvegicus
aaggctcttccttaattcctctgga

SEQ ID NO: 47143 - DNA, 25 bp, Rattus norvegicus
aaggctcttctgacaccagatggag

SEQ ID NO: 47144 - DNA, 25 bp, Rattus norvegicus
aaggctcttctgtcaccagatggag

SEQ ID NO: 47145 - DNA, 25 bp, Rattus norvegicus
aaggctgaaaacattcatgcggcca

SEQ ID NO: 47146 - DNA, 25 bp, Rattus norvegicus
aaggctgaaaactttcatgcggcca

SEQ ID NO: 47147 - DNA, 25 bp, Rattus norvegicus
aaggctgaaatccagcgctacttca

SEQ ID NO: 47148 - DNA, 25 bp, Rattus norvegicus
aaggctgaaatcgagcgctacttca

SEQ ID NO: 47149 - DNA, 25 bp, Rattus norvegicus
aaggctgaaatgatccacttcccaa

SEQ ID NO: 47150 - DNA, 25 bp, Rattus norvegicus
aaggctgaaatgttccacttcccaa

SEQ ID NO: 47151 - DNA, 25 bp, Rattus norvegicus
aaggctgaacaaacatggatttttc

SEQ ID NO: 47152 - DNA, 25 bp, Rattus norvegicus
aaggctgaacaatcatggatttttc

SEQ ID NO: 47153 - DNA, 25 bp, Rattus norvegicus
aaggctgaaggaaggcgttctccca

SEQ ID NO: 47154 - DNA, 25 bp, Rattus norvegicus
aaggctgaaggatggcgttctccca

SEQ ID NO: 47155 - DNA, 25 bp, Rattus norvegicus
aaggctgaaggtcttctggccgcac

SEQ ID NO: 47156 - DNA, 25 bp, Rattus norvegicus
aaggctgaaggtgttctggccgcac

SEQ ID NO: 47157 - DNA, 25 bp, Rattus norvegicus
aaggctgaatctaagcgtccccaga

SEQ ID NO: 47158 - DNA, 25 bp, Rattus norvegicus
aaggctgaatcttagcgtccccaga

SEQ ID NO: 47159 - DNA, 25 bp, Rattus norvegicus
aaggctgacaacacctgtagcttca

SEQ ID NO: 47160 - DNA, 25 bp, Rattus norvegicus
aaggctgacaactcctgtagcttca

SEQ ID NO: 47161 - DNA, 25 bp, Rattus norvegicus
aaggctgacacaattctactcttcc

SEQ ID NO: 47162 - DNA, 25 bp, Rattus norvegicus
aaggctgacacatttctactcttcc

SEQ ID NO: 47163 - DNA, 25 bp, Rattus norvegicus
aaggctgaccacctgtgttcagtct

SEQ ID NO: 47164 - DNA, 25 bp, Rattus norvegicus
aaggctgaccacgtgtgttcagtct

SEQ ID NO: 47165 - DNA, 25 bp, Rattus norvegicus
aaggctgaccatcttcgagcaggag

SEQ ID NO: 47166 - DNA, 25 bp, Rattus norvegicus
aaggctgaccatgttcgagcaggag

SEQ ID NO: 47167 - DNA, 25 bp, Rattus norvegicus
aaggctgaccctatgctatcagatt

SEQ ID NO: 47168 - DNA, 25 bp, Rattus norvegicus
aaggctgaccctttgctatcagatt

SEQ ID NO: 47169 - DNA, 25 bp, Rattus norvegicus
aaggctgacctcctacttgaaatgt

SEQ ID NO: 47170 - DNA, 25 bp, Rattus norvegicus
aaggctgacctcgtacttgaaatgt

SEQ ID NO: 47171 - DNA, 25 bp, Rattus norvegicus
aaggctgacgtaatcttaaagtaca

SEQ ID NO: 47172 - DNA, 25 bp, Rattus norvegicus
aaggctgacgtattcttaaagtaca

SEQ ID NO: 47173 - DNA, 25 bp, Rattus norvegicus
aaggctgactacagccagccacaga

SEQ ID NO: 47174 - DNA, 25 bp, Rattus norvegicus
aaggctgactactgccagccacaga

SEQ ID NO: 47175 - DNA, 25 bp, Rattus norvegicus
aaggctgactatctacttccctttc

SEQ ID NO: 47176 - DNA, 25 bp, Rattus norvegicus
aaggctgactatgtacttccctttc

SEQ ID NO: 47177 - DNA, 25 bp, Rattus norvegicus
aaggctgactggcttgctaacggta

SEQ ID NO: 47178 - DNA, 25 bp, Rattus norvegicus
aaggctgactgggttgctaacggta

SEQ ID NO: 47179 - DNA, 25 bp, Rattus norvegicus
aaggctgacttgagtgagcatgtct

SEQ ID NO: 47180 - DNA, 25 bp, Rattus norvegicus
aaggctgacttgtgtgagcatgtct

SEQ ID NO: 47181 - DNA, 25 bp, Rattus norvegicus
aaggctgagactcttgttctccttc

SEQ ID NO: 47182 - DNA, 25 bp, Rattus norvegicus
aaggctgagactgttgttctccttc

SEQ ID NO: 47183 - DNA, 25 bp, Rattus norvegicus
aaggctgagatcacttttgtgctct

SEQ ID NO: 47184 - DNA, 25 bp, Rattus norvegicus
aaggctgagatctcttttgtgctct

SEQ ID NO: 47185 - DNA, 25 bp, Rattus norvegicus
aaggctgagctaagctgcggcccac

SEQ ID NO: 47186 - DNA, 25 bp, Rattus norvegicus
aaggctgagctatgctgcggcccac

SEQ ID NO: 47187 - DNA, 25 bp, Rattus norvegicus
aaggctgagctcaagtgtcccgtgt

SEQ ID NO: 47188 - DNA, 25 bp, Rattus norvegicus
aaggctgagctctagtgtcccgtgt

SEQ ID NO: 47189 - DNA, 25 bp, Rattus norvegicus
aaggctgaggcactgaaccccggac

SEQ ID NO: 47190 - DNA, 25 bp, Rattus norvegicus
aaggctgaggcagtgaaccccggac

SEQ ID NO: 47191 - DNA, 25 bp, Rattus norvegicus
aaggctgatcagatgctcccggagg

SEQ ID NO: 47192 - DNA, 25 bp, Rattus norvegicus
aaggctgatcagttgctcccggagg

SEQ ID NO: 47193 - DNA, 25 bp, Rattus norvegicus
aaggctgatgcaccaggccctagag

SEQ ID NO: 47194 - DNA, 25 bp, Rattus norvegicus
aaggctgatgcagcaggccctagag

SEQ ID NO: 47195 - DNA, 25 bp, Rattus norvegicus
aaggctgatgctactcagtggccgg

SEQ ID NO: 47196 - DNA, 25 bp, Rattus norvegicus
aaggctgatgcttctcagtggccgg

SEQ ID NO: 47197 - DNA, 25 bp, Rattus norvegicus
aaggctgcactacaggccttgcctg

SEQ ID NO: 47198 - DNA, 25 bp, Rattus norvegicus
aaggctgcactagaggccttgcctg

SEQ ID NO: 47199 - DNA, 25 bp, Rattus norvegicus
aaggctgcagcccagtttctgaata

SEQ ID NO: 47200 - DNA, 25 bp, Rattus norvegicus
aaggctgcagcccatgagacgatga

SEQ ID NO: 47201 - DNA, 25 bp, Rattus norvegicus
aaggctgcagccgagtttctgaata

SEQ ID NO: 47202 - DNA, 25 bp, Rattus norvegicus
aaggctgcagccgatgagacgatga

SEQ ID NO: 47203 - DNA, 25 bp, Rattus norvegicus
aaggctgcaggacctattcacacag

SEQ ID NO: 47204 - DNA, 25 bp, Rattus norvegicus
aaggctgcaggagctattcacacag

SEQ ID NO: 47205 - DNA, 25 bp, Rattus norvegicus
aaggctgcagtcaccgagtattgct

SEQ ID NO: 47206 - DNA, 25 bp, Rattus norvegicus
aaggctgcagtctccgagtattgct

SEQ ID NO: 47207 - DNA, 25 bp, Rattus norvegicus
aaggctgcatggagggttcgcactt

SEQ ID NO: 47208 - DNA, 25 bp, Rattus norvegicus
aaggctgcatggtgggttcgcactt

SEQ ID NO: 47209 - DNA, 25 bp, Rattus norvegicus
aaggctgccaacagaacagattcca

SEQ ID NO: 47210 - DNA, 25 bp, Rattus norvegicus
aaggctgccaactgaacagattcca

SEQ ID NO: 47211 - DNA, 25 bp, Rattus norvegicus
aaggctgccaagcagactgctgccg

SEQ ID NO: 47212 - DNA, 25 bp, Rattus norvegicus
aaggctgccaaggagactgctgccg

SEQ ID NO: 47213 - DNA, 25 bp, Rattus norvegicus
aaggctgccaggaatcaggctgcta

SEQ ID NO: 47214 - DNA, 25 bp, Rattus norvegicus
aaggctgccaggctttccacggact

SEQ ID NO: 47215 - DNA, 25 bp, Rattus norvegicus
aaggctgccagggtttccacggact

SEQ ID NO: 47216 - DNA, 25 bp, Rattus norvegicus
aaggctgccaggtatcaggctgcta

SEQ ID NO: 47217 - DNA, 25 bp, Rattus norvegicus
aaggctgccctccaactcggagaga

SEQ ID NO: 47218 - DNA, 25 bp, Rattus norvegicus
aaggctgccctcgaactcggagaga

SEQ ID NO: 47219 - DNA, 25 bp, Rattus norvegicus
aaggctgcccttctcgaggcaaagg

SEQ ID NO: 47220 - DNA, 25 bp, Rattus norvegicus
aaggctgcccttgtcgaggcaaagg

SEQ ID NO: 47221 - DNA, 25 bp, Rattus norvegicus
aaggctgccgacaaggataactgct

SEQ ID NO: 47222 - DNA, 25 bp, Rattus norvegicus
aaggctgccgactaggataactgct

SEQ ID NO: 47223 - DNA, 25 bp, Rattus norvegicus
aaggctgccggcagtgtcgagtcac

SEQ ID NO: 47224 - DNA, 25 bp, Rattus norvegicus
aaggctgccggctgtgtcgagtcac

SEQ ID NO: 47225 - DNA, 25 bp, Rattus norvegicus
aaggctgccgtgattatccgcacct

SEQ ID NO: 47226 - DNA, 25 bp, Rattus norvegicus
aaggctgccgtgtttatccgcacct

SEQ ID NO: 47227 - DNA, 25 bp, Rattus norvegicus
aaggctgcctagagtccaggtgctg

SEQ ID NO: 47228 - DNA, 25 bp, Rattus norvegicus
aaggctgcctagtgtccaggtgctg

SEQ ID NO: 47229 - DNA, 25 bp, Rattus norvegicus
aaggctgcctataaacactggttgg

SEQ ID NO: 47230 - DNA, 25 bp, Rattus norvegicus
aaggctgcctatcagagtctgatac

SEQ ID NO: 47231 - DNA, 25 bp, Rattus norvegicus
aaggctgcctatgagagtctgatac

SEQ ID NO: 47232 - DNA, 25 bp, Rattus norvegicus
aaggctgcctattaacactggttgg

SEQ ID NO: 47233 - DNA, 25 bp, Rattus norvegicus
aaggctgcctctctgcatgtgggta

SEQ ID NO: 47234 - DNA, 25 bp, Rattus norvegicus
aaggctgcctctgtgcatgtgggta

SEQ ID NO: 47235 - DNA, 25 bp, Rattus norvegicus
aaggctgcctgaaaggttgcagaaa

SEQ ID NO: 47236 - DNA, 25 bp, Rattus norvegicus
aaggctgcctgataggttgcagaaa

SEQ ID NO: 47237 - DNA, 25 bp, Rattus norvegicus
aaggctgcctggatccttctgttca

SEQ ID NO: 47238 - DNA, 25 bp, Rattus norvegicus
aaggctgcctggttccttctgttca

SEQ ID NO: 47239 - DNA, 25 bp, Rattus norvegicus
aaggctgcctttacttcagcatgga

SEQ ID NO: 47240 - DNA, 25 bp, Rattus norvegicus
aaggctgccttttcttcagcatgga

SEQ ID NO: 47241 - DNA, 25 bp, Rattus norvegicus
aaggctgcgaagaagcctagtcacc

SEQ ID NO: 47242 - DNA, 25 bp, Rattus norvegicus
aaggctgcgaagtagcctagtcacc

SEQ ID NO: 47243 - DNA, 25 bp, Rattus norvegicus
aaggctgctaccacggttgcaaagg

SEQ ID NO: 47244 - DNA, 25 bp, Rattus norvegicus
aaggctgctacctcggttgcaaagg

SEQ ID NO: 47245 - DNA, 25 bp, Rattus norvegicus
aaggctgctcagacacgcaatttcc

SEQ ID NO: 47246 - DNA, 25 bp, Rattus norvegicus
aaggctgctcagtcacgcaatttcc

SEQ ID NO: 47247 - DNA, 25 bp, Rattus norvegicus
aaggctgctctcaccagctgctgca

SEQ ID NO: 47248 - DNA, 25 bp, Rattus norvegicus
aaggctgctctctccagctgctgca

SEQ ID NO: 47249 - DNA, 25 bp, Rattus norvegicus
aaggctgctcttctcataacgggtg

SEQ ID NO: 47250 - DNA, 25 bp, Rattus norvegicus
aaggctgctcttgtcataacgggtg

SEQ ID NO: 47251 - DNA, 25 bp, Rattus norvegicus
aaggctgctgctagacattggacgg

SEQ ID NO: 47252 - DNA, 25 bp, Rattus norvegicus
aaggctgctgctatcaggacccatc

SEQ ID NO: 47253 - DNA, 25 bp, Rattus norvegicus
aaggctgctgcttgacattggacgg

SEQ ID NO: 47254 - DNA, 25 bp, Rattus norvegicus
aaggctgctgctttcaggacccatc

SEQ ID NO: 47255 - DNA, 25 bp, Rattus norvegicus
aaggctgctgggaagtacaaacaac

SEQ ID NO: 47256 - DNA, 25 bp, Rattus norvegicus
aaggctgctgggagcctccagatac

SEQ ID NO: 47257 - DNA, 25 bp, Rattus norvegicus
aaggctgctgggtagtacaaacaac

SEQ ID NO: 47258 - DNA, 25 bp, Rattus norvegicus
aaggctgctgggtgcctccagatac

SEQ ID NO: 47259 - DNA, 25 bp, Rattus norvegicus
aaggctgctggtccttgtttccacc

SEQ ID NO: 47260 - DNA, 25 bp, Rattus norvegicus
aaggctgctggtgcttgtttccacc

SEQ ID NO: 47261 - DNA, 25 bp, Rattus norvegicus
aaggctgctgtgagatgccactctt

SEQ ID NO: 47262 - DNA, 25 bp, Rattus norvegicus
aaggctgctgtgtgatgccactctt

SEQ ID NO: 47263 - DNA, 25 bp, Rattus norvegicus
aaggctgcttcacaccggtcaagaa

SEQ ID NO: 47264 - DNA, 25 bp, Rattus norvegicus
aaggctgcttcacactcctttagaa

SEQ ID NO: 47265 - DNA, 25 bp, Rattus norvegicus
aaggctgcttcagaccggtcaagaa

SEQ ID NO: 47266 - DNA, 25 bp, Rattus norvegicus
aaggctgcttcagactcctttagaa

SEQ ID NO: 47267 - DNA, 25 bp, Rattus norvegicus
aaggctgctttgaagacatcatgaa

SEQ ID NO: 47268 - DNA, 25 bp, Rattus norvegicus
aaggctgctttgtagacatcatgaa

SEQ ID NO: 47269 - DNA, 25 bp, Rattus norvegicus
aaggctggaattcccctcaatgaca

SEQ ID NO: 47270 - DNA, 25 bp, Rattus norvegicus
aaggctggaattgccctcaatgaca

SEQ ID NO: 47271 - DNA, 25 bp, Rattus norvegicus
aaggctggactccaggtggcatcca

SEQ ID NO: 47272 - DNA, 25 bp, Rattus norvegicus
aaggctggactcgaggtggcatcca

SEQ ID NO: 47273 - DNA, 25 bp, Rattus norvegicus
aaggctggactgaaaaacattcaaa

SEQ ID NO: 47274 - DNA, 25 bp, Rattus norvegicus
aaggctggactgtaaaacattcaaa

SEQ ID NO: 47275 - DNA, 25 bp, Rattus norvegicus
aaggctggagccactcaaatgccct

SEQ ID NO: 47276 - DNA, 25 bp, Rattus norvegicus
aaggctggagcctctcaaatgccct

SEQ ID NO: 47277 - DNA, 25 bp, Rattus norvegicus
aaggctggaggaatgcatcacgtct

SEQ ID NO: 47278 - DNA, 25 bp, Rattus norvegicus
aaggctggaggattgcatcacgtct

SEQ ID NO: 47279 - DNA, 25 bp, Rattus norvegicus
aaggctggataactgaccattgtct

SEQ ID NO: 47280 - DNA, 25 bp, Rattus norvegicus
aaggctggataagtgaccattgtct

SEQ ID NO: 47281 - DNA, 25 bp, Rattus norvegicus
aaggctggatcacacttggcgctca

SEQ ID NO: 47282 - DNA, 25 bp, Rattus norvegicus
aaggctggatcagacttggcgctca

SEQ ID NO: 47283 - DNA, 25 bp, Rattus norvegicus
aaggctggatgtctagagtgtttct

SEQ ID NO: 47284 - DNA, 25 bp, Rattus norvegicus
aaggctggatgtgtagagtgtttct

SEQ ID NO: 47285 - DNA, 25 bp, Rattus norvegicus
aaggctggattcctggtatgatacc

SEQ ID NO: 47286 - DNA, 25 bp, Rattus norvegicus
aaggctggattcgtggtatgatacc

SEQ ID NO: 47287 - DNA, 25 bp, Rattus norvegicus
aaggctggcaaacgcccttgtgcag

SEQ ID NO: 47288 - DNA, 25 bp, Rattus norvegicus
aaggctggcaaaggcccttgtgcag

SEQ ID NO: 47289 - DNA, 25 bp, Rattus norvegicus
aaggctggcactattggacctgggt

SEQ ID NO: 47290 - DNA, 25 bp, Rattus norvegicus
aaggctggcacttttggacctgggt

SEQ ID NO: 47291 - DNA, 25 bp, Rattus norvegicus
aaggctggcagcagtaacttctctc

SEQ ID NO: 47292 - DNA, 25 bp, Rattus norvegicus
aaggctggcagctgtaacttctctc

SEQ ID NO: 47293 - DNA, 25 bp, Rattus norvegicus
aaggctggcagtaatgtctggtcta

SEQ ID NO: 47294 - DNA, 25 bp, Rattus norvegicus
aaggctggcagtcttctccaggatt

SEQ ID NO: 47295 - DNA, 25 bp, Rattus norvegicus
aaggctggcagtgttctccaggatt

SEQ ID NO: 47296 - DNA, 25 bp, Rattus norvegicus
aaggctggcagttatgtctggtcta

SEQ ID NO: 47297 - DNA, 25 bp, Rattus norvegicus
aaggctggcattacccattatcttt

SEQ ID NO: 47298 - DNA, 25 bp, Rattus norvegicus
aaggctggcatttcccattatcttt

SEQ ID NO: 47299 - DNA, 25 bp, Rattus norvegicus
aaggctggcctacttgggactctgt

SEQ ID NO: 47300 - DNA, 25 bp, Rattus norvegicus
aaggctggcctagttgggactctgt

SEQ ID NO: 47301 - DNA, 25 bp, Rattus norvegicus
aaggctggcctgcatgggaaccaaa

SEQ ID NO: 47302 - DNA, 25 bp, Rattus norvegicus
aaggctggcctggatgggaaccaaa

SEQ ID NO: 47303 - DNA, 25 bp, Rattus norvegicus
aaggctggccttaatttagctcacg

SEQ ID NO: 47304 - DNA, 25 bp, Rattus norvegicus
aaggctggccttctttacaattgtc

SEQ ID NO: 47305 - DNA, 25 bp, Rattus norvegicus
aaggctggccttgtttacaattgtc

SEQ ID NO: 47306 - DNA, 25 bp, Rattus norvegicus
aaggctggcctttatttagctcacg

SEQ ID NO: 47307 - DNA, 25 bp, Rattus norvegicus
aaggctggcgagactctgtggaaac

SEQ ID NO: 47308 - DNA, 25 bp, Rattus norvegicus
aaggctggcgagtctctgtggaaac

SEQ ID NO: 47309 - DNA, 25 bp, Rattus norvegicus
aaggctggctcccaattttcctaat

SEQ ID NO: 47310 - DNA, 25 bp, Rattus norvegicus
aaggctggctccgaattttcctaat

SEQ ID NO: 47311 - DNA, 25 bp, Rattus norvegicus
aaggctggctctagactggtggtat

SEQ ID NO: 47312 - DNA, 25 bp, Rattus norvegicus
aaggctggctcttgactggtggtat

SEQ ID NO: 47313 - DNA, 25 bp, Rattus norvegicus
aaggctggctggactttgttacact

SEQ ID NO: 47314 - DNA, 25 bp, Rattus norvegicus
aaggctggctggtctttgttacact

SEQ ID NO: 47315 - DNA, 25 bp, Rattus norvegicus
aaggctgggacaacagcaatcccga

SEQ ID NO: 47316 - DNA, 25 bp, Rattus norvegicus
aaggctgggacatcagcaatcccga

SEQ ID NO: 47317 - DNA, 25 bp, Rattus norvegicus
aaggctggtatcagcttgctacgat

SEQ ID NO: 47318 - DNA, 25 bp, Rattus norvegicus
aaggctggtatctgcttgctacgat

SEQ ID NO: 47319 - DNA, 25 bp, Rattus norvegicus
aaggctggtgaacactgttcccact

SEQ ID NO: 47320 - DNA, 25 bp, Rattus norvegicus
aaggctggtgaagactgttcccact

SEQ ID NO: 47321 - DNA, 25 bp, Rattus norvegicus
aaggctggtgacatgtgggccattc

SEQ ID NO: 47322 - DNA, 25 bp, Rattus norvegicus
aaggctggtgacttgtgggccattc

SEQ ID NO: 47323 - DNA, 25 bp, Rattus norvegicus
aaggctggtggacacccagatccag

SEQ ID NO: 47324 - DNA, 25 bp, Rattus norvegicus
aaggctggtggagacccagatccag

SEQ ID NO: 47325 - DNA, 25 bp, Rattus norvegicus
aaggctggtggtctactatactcca

SEQ ID NO: 47326 - DNA, 25 bp, Rattus norvegicus
aaggctggtggtgtactatactcca

SEQ ID NO: 47327 - DNA, 25 bp, Rattus norvegicus
aaggctggtttcattttgtgcgttt

SEQ ID NO: 47328 - DNA, 25 bp, Rattus norvegicus
aaggctggtttctttttgtgcgttt

SEQ ID NO: 47329 - DNA, 25 bp, Rattus norvegicus
aaggctggttttcccattctgtttc

SEQ ID NO: 47330 - DNA, 25 bp, Rattus norvegicus
aaggctggttttgccattctgtttc

SEQ ID NO: 47331 - DNA, 25 bp, Rattus norvegicus
aaggctgtaactaacctcgactctt

SEQ ID NO: 47332 - DNA, 25 bp, Rattus norvegicus
aaggctgtaacttacctcgactctt

SEQ ID NO: 47333 - DNA, 25 bp, Rattus norvegicus
aaggctgtacaaagtgctgatgcaa

SEQ ID NO: 47334 - DNA, 25 bp, Rattus norvegicus
aaggctgtacaatgtgctgatgcaa

SEQ ID NO: 47335 - DNA, 25 bp, Rattus norvegicus
aaggctgtacacattcctctgacta

SEQ ID NO: 47336 - DNA, 25 bp, Rattus norvegicus
aaggctgtacactttcctctgacta

SEQ ID NO: 47337 - DNA, 25 bp, Rattus norvegicus
aaggctgtagccaagtatcttcgat

SEQ ID NO: 47338 - DNA, 25 bp, Rattus norvegicus
aaggctgtagcctagtatcttcgat

SEQ ID NO: 47339 - DNA, 25 bp, Rattus norvegicus
aaggctgtatgtatctctctgtggt

SEQ ID NO: 47340 - DNA, 25 bp, Rattus norvegicus
aaggctgtatgtttctctctgtggt

SEQ ID NO: 47341 - DNA, 25 bp, Rattus norvegicus
aaggctgtcaagacctctacaggtc

SEQ ID NO: 47342 - DNA, 25 bp, Rattus norvegicus
aaggctgtcaagtcctctacaggtc

SEQ ID NO: 47343 - DNA, 25 bp, Rattus norvegicus
aaggctgtcaccagcttcagaacaa

SEQ ID NO: 47344 - DNA, 25 bp, Rattus norvegicus
aaggctgtcacctgcttcagaacaa

SEQ ID NO: 47345 - DNA, 25 bp, Rattus norvegicus
aaggctgtcagtattcttcctggtc

SEQ ID NO: 47346 - DNA, 25 bp, Rattus norvegicus
aaggctgtcagttttcttcctggtc

SEQ ID NO: 47347 - DNA, 25 bp, Rattus norvegicus
aaggctgtccacaagatctgccaca

SEQ ID NO: 47348 - DNA, 25 bp, Rattus norvegicus
aaggctgtccactagatctgccaca

SEQ ID NO: 47349 - DNA, 25 bp, Rattus norvegicus
aaggctgtccagattcaccaagata

SEQ ID NO: 47350 - DNA, 25 bp, Rattus norvegicus
aaggctgtccagtttcaccaagata

SEQ ID NO: 47351 - DNA, 25 bp, Rattus norvegicus
aaggctgtccgacccctgaaaaaca

SEQ ID NO: 47352 - DNA, 25 bp, Rattus norvegicus
aaggctgtccgagccctgaaaaaca

SEQ ID NO: 47353 - DNA, 25 bp, Rattus norvegicus
aaggctgtccttatcttccaaattg

SEQ ID NO: 47354 - DNA, 25 bp, Rattus norvegicus
aaggctgtccttcgcacttgggacc

SEQ ID NO: 47355 - DNA, 25 bp, Rattus norvegicus
aaggctgtccttggcacttgggacc

SEQ ID NO: 47356 - DNA, 25 bp, Rattus norvegicus
aaggctgtccttttcttccaaattg

SEQ ID NO: 47357 - DNA, 25 bp, Rattus norvegicus
aaggctgtctatctttgcactgaac

SEQ ID NO: 47358 - DNA, 25 bp, Rattus norvegicus
aaggctgtctatgtttgcactgaac

SEQ ID NO: 47359 - DNA, 25 bp, Rattus norvegicus
aaggctgtctctcgagctcaagcaa

SEQ ID NO: 47360 - DNA, 25 bp, Rattus norvegicus
aaggctgtctctggagctcaagcaa

SEQ ID NO: 47361 - DNA, 25 bp, Rattus norvegicus
aaggctgtctgtcgagctctgagca

SEQ ID NO: 47362 - DNA, 25 bp, Rattus norvegicus
aaggctgtctgtggagctctgagca

SEQ ID NO: 47363 - DNA, 25 bp, Rattus norvegicus
aaggctgtgacaactgtaattcgat

SEQ ID NO: 47364 - DNA, 25 bp, Rattus norvegicus
aaggctgtgacatctgtaattcgat

SEQ ID NO: 47365 - DNA, 25 bp, Rattus norvegicus
aaggctgtgagtcctcagcttcctg

SEQ ID NO: 47366 - DNA, 25 bp, Rattus norvegicus
aaggctgtgagtgctcagcttcctg

SEQ ID NO: 47367 - DNA, 25 bp, Rattus norvegicus
aaggctgtgcaacgacctacaccac

SEQ ID NO: 47368 - DNA, 25 bp, Rattus norvegicus
aaggctgtgcaaggacctacaccac

SEQ ID NO: 47369 - DNA, 25 bp, Rattus norvegicus
aaggctgtgcacatgcaaccgacat

SEQ ID NO: 47370 - DNA, 25 bp, Rattus norvegicus
aaggctgtgcacttgcaaccgacat

SEQ ID NO: 47371 - DNA, 25 bp, Rattus norvegicus
aaggctgtgcatcagtagccctcca

SEQ ID NO: 47372 - DNA, 25 bp, Rattus norvegicus
aaggctgtgcatgagtagccctcca

SEQ ID NO: 47373 - DNA, 25 bp, Rattus norvegicus
aaggctgtgccaaccgtaagagaat

SEQ ID NO: 47374 - DNA, 25 bp, Rattus norvegicus
aaggctgtgccatccgtaagagaat

SEQ ID NO: 47375 - DNA, 25 bp, Rattus norvegicus
aaggctgtggaaattcagctcctca

SEQ ID NO: 47376 - DNA, 25 bp, Rattus norvegicus
aaggctgtggaatttcagctcctca

SEQ ID NO: 47377 - DNA, 25 bp, Rattus norvegicus
aaggctgtggatacacgtgaccaaa

SEQ ID NO: 47378 - DNA, 25 bp, Rattus norvegicus
aaggctgtggattcacgtgaccaaa

SEQ ID NO: 47379 - DNA, 25 bp, Rattus norvegicus
aaggctgtggcactggacctgttcc

SEQ ID NO: 47380 - DNA, 25 bp, Rattus norvegicus
aaggctgtggcagtggacctgttcc

SEQ ID NO: 47381 - DNA, 25 bp, Rattus norvegicus
aaggctgtggctccatctaccattt

SEQ ID NO: 47382 - DNA, 25 bp, Rattus norvegicus
aaggctgtggctgcatctaccattt

SEQ ID NO: 47383 - DNA, 25 bp, Rattus norvegicus
aaggctgtgggcacagaaccatcct

SEQ ID NO: 47384 - DNA, 25 bp, Rattus norvegicus
aaggctgtgggctcagaaccatcct

SEQ ID NO: 47385 - DNA, 25 bp, Rattus norvegicus
aaggctgtggtgacccgacaggaaa

SEQ ID NO: 47386 - DNA, 25 bp, Rattus norvegicus
aaggctgtggtgtcccgacaggaaa

SEQ ID NO: 47387 - DNA, 25 bp, Rattus norvegicus
aaggctgtgtagaccccttgaatca

SEQ ID NO: 47388 - DNA, 25 bp, Rattus norvegicus
aaggctgtgtagtccccttgaatca

SEQ ID NO: 47389 - DNA, 25 bp, Rattus norvegicus
aaggctgtgtccagcccagcagaga

SEQ ID NO: 47390 - DNA, 25 bp, Rattus norvegicus
aaggctgtgtcctgcccagcagaga

SEQ ID NO: 47391 - DNA, 25 bp, Rattus norvegicus
aaggctgtgtctatataccgggaat

SEQ ID NO: 47392 - DNA, 25 bp, Rattus norvegicus
aaggctgtgtctttataccgggaat

SEQ ID NO: 47393 - DNA, 25 bp, Rattus norvegicus
aaggctgtgtggctagatcctctaa

SEQ ID NO: 47394 - DNA, 25 bp, Rattus norvegicus
aaggctgtgtgggtagatcctctaa

SEQ ID NO: 47395 - DNA, 25 bp, Rattus norvegicus
aaggctgtgtgtcttcaaacactac

SEQ ID NO: 47396 - DNA, 25 bp, Rattus norvegicus
aaggctgtgtgtgttcaaacactac

SEQ ID NO: 47397 - DNA, 25 bp, Rattus norvegicus
aaggctgttcttccacctgagagca

SEQ ID NO: 47398 - DNA, 25 bp, Rattus norvegicus
aaggctgttcttcgatgtaaaataa

SEQ ID NO: 47399 - DNA, 25 bp, Rattus norvegicus
aaggctgttcttgcacctgagagca

SEQ ID NO: 47400 - DNA, 25 bp, Rattus norvegicus
aaggctgttcttggatgtaaaataa

SEQ ID NO: 47401 - DNA, 25 bp, Rattus norvegicus
aaggctgttgatcatttctgtagaa

SEQ ID NO: 47402 - DNA, 25 bp, Rattus norvegicus
aaggctgttgatgatttctgtagaa

SEQ ID NO: 47403 - DNA, 25 bp, Rattus norvegicus
aaggctgttggcaccatcaccaagc

SEQ ID NO: 47404 - DNA, 25 bp, Rattus norvegicus
aaggctgttggctccatcaccaagc

SEQ ID NO: 47405 - DNA, 25 bp, Rattus norvegicus
aaggctgttgttccttgtctcagca

SEQ ID NO: 47406 - DNA, 25 bp, Rattus norvegicus
aaggctgttgttgcttgtctcagca

SEQ ID NO: 47407 - DNA, 25 bp, Rattus norvegicus
aaggctgtttctaaaggctgttaca

SEQ ID NO: 47408 - DNA, 25 bp, Rattus norvegicus
aaggctgtttcttaaggctgttaca

SEQ ID NO: 47409 - DNA, 25 bp, Rattus norvegicus
aaggcttaaccaagaggcccactac

SEQ ID NO: 47410 - DNA, 25 bp, Rattus norvegicus
aaggcttaaccatgaggcccactac

SEQ ID NO: 47411 - DNA, 25 bp, Rattus norvegicus
aaggcttaccttctgcaggctttta

SEQ ID NO: 47412 - DNA, 25 bp, Rattus norvegicus
aaggcttaccttgtgcaggctttta

SEQ ID NO: 47413 - DNA, 25 bp, Rattus norvegicus
aaggcttacttgatgagccacgccc

SEQ ID NO: 47414 - DNA, 25 bp, Rattus norvegicus
aaggcttacttgttgagccacgccc

SEQ ID NO: 47415 - DNA, 25 bp, Rattus norvegicus
aaggcttagaatatcttccagagat

SEQ ID NO: 47416 - DNA, 25 bp, Rattus norvegicus
aaggcttagaatttcttccagagat

SEQ ID NO: 47417 - DNA, 25 bp, Rattus norvegicus
aaggcttaggaaaggtggccctcat

SEQ ID NO: 47418 - DNA, 25 bp, Rattus norvegicus
aaggcttaggaatggtggccctcat

SEQ ID NO: 47419 - DNA, 25 bp, Rattus norvegicus
aaggcttatccgctaactgcagatg

SEQ ID NO: 47420 - DNA, 25 bp, Rattus norvegicus
aaggcttatccggtaactgcagatg

SEQ ID NO: 47421 - DNA, 25 bp, Rattus norvegicus
aaggcttatgagctgtccacgctga

SEQ ID NO: 47422 - DNA, 25 bp, Rattus norvegicus
aaggcttatgaggtgtccacgctga

SEQ ID NO: 47423 - DNA, 25 bp, Rattus norvegicus
aaggcttatggtacactctctaaac

SEQ ID NO: 47424 - DNA, 25 bp, Rattus norvegicus
aaggcttatggttcactctctaaac

SEQ ID NO: 47425 - DNA, 25 bp, Rattus norvegicus
aaggcttattttcactcctggttct

SEQ ID NO: 47426 - DNA, 25 bp, Rattus norvegicus
aaggcttattttgactcctggttct

SEQ ID NO: 47427 - DNA, 25 bp, Rattus norvegicus
aaggcttcaaggctctgcaaggcgc

SEQ ID NO: 47428 - DNA, 25 bp, Rattus norvegicus
aaggcttcaagggtctgcaaggcgc

SEQ ID NO: 47429 - DNA, 25 bp, Rattus norvegicus
aaggcttcaagtatcttcgcagtta

SEQ ID NO: 47430 - DNA, 25 bp, Rattus norvegicus
aaggcttcaagtttcttcgcagtta

SEQ ID NO: 47431 - DNA, 25 bp, Rattus norvegicus
aaggcttcacatcaacgtgctctgc

SEQ ID NO: 47432 - DNA, 25 bp, Rattus norvegicus
aaggcttcacatgaacgtgctctgc

SEQ ID NO: 47433 - DNA, 25 bp, Rattus norvegicus
aaggcttcaccgaaatcgatcactc

SEQ ID NO: 47434 - DNA, 25 bp, Rattus norvegicus
aaggcttcaccgtaatcgatcactc

SEQ ID NO: 47435 - DNA, 25 bp, Rattus norvegicus
aaggcttcacttcctggttgttggg

SEQ ID NO: 47436 - DNA, 25 bp, Rattus norvegicus
aaggcttcacttgctggttgttggg

SEQ ID NO: 47437 - DNA, 25 bp, Rattus norvegicus
aaggcttcagaactcctgtgtacaa

SEQ ID NO: 47438 - DNA, 25 bp, Rattus norvegicus
aaggcttcagaagtcctgtgtacaa

SEQ ID NO: 47439 - DNA, 25 bp, Rattus norvegicus
aaggcttcagacagcacaagaggga

SEQ ID NO: 47440 - DNA, 25 bp, Rattus norvegicus
aaggcttcagactgcacaagaggga

SEQ ID NO: 47441 - DNA, 25 bp, Rattus norvegicus
aaggcttccaaaccacacaaggtgg

SEQ ID NO: 47442 - DNA, 25 bp, Rattus norvegicus
aaggcttccaaagcacacaaggtgg

SEQ ID NO: 47443 - DNA, 25 bp, Rattus norvegicus
aaggcttcccaaatctctaagagct

SEQ ID NO: 47444 - DNA, 25 bp, Rattus norvegicus
aaggcttcccaattctctaagagct

SEQ ID NO: 47445 - DNA, 25 bp, Rattus norvegicus
aaggcttcccagaacaggaccagag

SEQ ID NO: 47446 - DNA, 25 bp, Rattus norvegicus
aaggcttcccagtacaggaccagag

SEQ ID NO: 47447 - DNA, 25 bp, Rattus norvegicus
aaggcttcccgaaggagttggcaag

SEQ ID NO: 47448 - DNA, 25 bp, Rattus norvegicus
aaggcttcccgatggagttggcaag

SEQ ID NO: 47449 - DNA, 25 bp, Rattus norvegicus
aaggcttccctgagagagtgagaac

SEQ ID NO: 47450 - DNA, 25 bp, Rattus norvegicus
aaggcttccctgtgagagtgagaac

SEQ ID NO: 47451 - DNA, 25 bp, Rattus norvegicus
aaggcttccgccagctagtggaaaa

SEQ ID NO: 47452 - DNA, 25 bp, Rattus norvegicus
aaggcttccgcctgctagtggaaaa

SEQ ID NO: 47453 - DNA, 25 bp, Rattus norvegicus
aaggcttccgctcgatggcgcagta

SEQ ID NO: 47454 - DNA, 25 bp, Rattus norvegicus
aaggcttccgctggatggcgcagta

SEQ ID NO: 47455 - DNA, 25 bp, Rattus norvegicus
aaggcttccgtccagaacgaaccat

SEQ ID NO: 47456 - DNA, 25 bp, Rattus norvegicus
aaggcttccgtcgagaacgaaccat

SEQ ID NO: 47457 - DNA, 25 bp, Rattus norvegicus
aaggcttcctacacgccggaggtga

SEQ ID NO: 47458 - DNA, 25 bp, Rattus norvegicus
aaggcttcctactcgccggaggtga

SEQ ID NO: 47459 - DNA, 25 bp, Rattus norvegicus
aaggcttcctatcctactcgaaggg

SEQ ID NO: 47460 - DNA, 25 bp, Rattus norvegicus
aaggcttcctatgctactcgaaggg

SEQ ID NO: 47461 - DNA, 25 bp, Rattus norvegicus
aaggcttccttgagagcaggcacca

SEQ ID NO: 47462 - DNA, 25 bp, Rattus norvegicus
aaggcttccttgtgagcaggcacca

SEQ ID NO: 47463 - DNA, 25 bp, Rattus norvegicus
aaggcttcgaaaacctgcacttggt

SEQ ID NO: 47464 - DNA, 25 bp, Rattus norvegicus
aaggcttcgaaatcctgcacttggt

SEQ ID NO: 47465 - DNA, 25 bp, Rattus norvegicus
aaggcttcgcaaaggctatgcaccc

SEQ ID NO: 47466 - DNA, 25 bp, Rattus norvegicus
aaggcttcgcaatggctatgcaccc

SEQ ID NO: 47467 - DNA, 25 bp, Rattus norvegicus
aaggcttcgcctaccaagttcagga

SEQ ID NO: 47468 - DNA, 25 bp, Rattus norvegicus
aaggcttcgccttccaagttcagga

SEQ ID NO: 47469 - DNA, 25 bp, Rattus norvegicus
aaggcttcggtaaatcccacagcgg

SEQ ID NO: 47470 - DNA, 25 bp, Rattus norvegicus
aaggcttcggtatatcccacagcgg

SEQ ID NO: 47471 - DNA, 25 bp, Rattus norvegicus
aaggcttctcagcagtcctgctcaa

SEQ ID NO: 47472 - DNA, 25 bp, Rattus norvegicus
aaggcttctcaggagtcctgctcaa

SEQ ID NO: 47473 - DNA, 25 bp, Rattus norvegicus
aaggcttctccacgaacagcgacag

SEQ ID NO: 47474 - DNA, 25 bp, Rattus norvegicus
aaggcttctccaggaacagcgacag

SEQ ID NO: 47475 - DNA, 25 bp, Rattus norvegicus
aaggcttctctcacgaggagacggt

SEQ ID NO: 47476 - DNA, 25 bp, Rattus norvegicus
aaggcttctctctcgaggagacggt

SEQ ID NO: 47477 - DNA, 25 bp, Rattus norvegicus
aaggcttctcttaatgcctggatcg

SEQ ID NO: 47478 - DNA, 25 bp, Rattus norvegicus
aaggcttctctttatgcctggatcg

SEQ ID NO: 47479 - DNA, 25 bp, Rattus norvegicus
aaggcttctggcattgttttcttga

SEQ ID NO: 47480 - DNA, 25 bp, Rattus norvegicus
aaggcttctggctttgttttcttga

SEQ ID NO: 47481 - DNA, 25 bp, Rattus norvegicus
aaggcttctgtaccagaggcagcac

SEQ ID NO: 47482 - DNA, 25 bp, Rattus norvegicus
aaggcttctgtagcagaggcagcac

SEQ ID NO: 47483 - DNA, 25 bp, Rattus norvegicus
aaggcttcttccacgtctttgggag

SEQ ID NO: 47484 - DNA, 25 bp, Rattus norvegicus
aaggcttcttcctcgtctttgggag

SEQ ID NO: 47485 - DNA, 25 bp, Rattus norvegicus
aaggcttctttcatagtcttcagat

SEQ ID NO: 47486 - DNA, 25 bp, Rattus norvegicus
aaggcttctttcatcctgttagaga

SEQ ID NO: 47487 - DNA, 25 bp, Rattus norvegicus
aaggcttctttcttagtcttcagat

SEQ ID NO: 47488 - DNA, 25 bp, Rattus norvegicus
aaggcttctttcttcctgttagaga

SEQ ID NO: 47489 - DNA, 25 bp, Rattus norvegicus
aaggcttctttgactaagcgtcttt

SEQ ID NO: 47490 - DNA, 25 bp, Rattus norvegicus
aaggcttctttgtctaagcgtcttt

SEQ ID NO: 47491 - DNA, 25 bp, Rattus norvegicus
aaggcttgaaagaccctgcttacaa

SEQ ID NO: 47492 - DNA, 25 bp, Rattus norvegicus
aaggcttgaaagtccctgcttacaa

SEQ ID NO: 47493 - DNA, 25 bp, Rattus norvegicus
aaggcttgaagcatctcttccagca

SEQ ID NO: 47494 - DNA, 25 bp, Rattus norvegicus
aaggcttgaagcttctcttccagca

SEQ ID NO: 47495 - DNA, 25 bp, Rattus norvegicus
aaggcttgacttcagctcatatagt

SEQ ID NO: 47496 - DNA, 25 bp, Rattus norvegicus
aaggcttgacttgagctcatatagt

SEQ ID NO: 47497 - DNA, 25 bp, Rattus norvegicus
aaggcttgaggactgaggacattac

SEQ ID NO: 47498 - DNA, 25 bp, Rattus norvegicus
aaggcttgaggagtgaggacattac

SEQ ID NO: 47499 - DNA, 25 bp, Rattus norvegicus
aaggcttgaggtctctccttggcca

SEQ ID NO: 47500 - DNA, 25 bp, Rattus norvegicus
aaggcttgaggtgtctccttggcca

SEQ ID NO: 47501 - DNA, 25 bp, Rattus norvegicus
aaggcttgcacacagtcatgtctaa

SEQ ID NO: 47502 - DNA, 25 bp, Rattus norvegicus
aaggcttgcacagagtcatgtctaa

SEQ ID NO: 47503 - DNA, 25 bp, Rattus norvegicus
aaggcttgcataatcacggtgactc

SEQ ID NO: 47504 - DNA, 25 bp, Rattus norvegicus
aaggcttgcatattcacggtgactc

SEQ ID NO: 47505 - DNA, 25 bp, Rattus norvegicus
aaggcttgccgaatgttgccaaccg

SEQ ID NO: 47506 - DNA, 25 bp, Rattus norvegicus
aaggcttgccgattgttgccaaccg

SEQ ID NO: 47507 - DNA, 25 bp, Rattus norvegicus
aaggcttgccggcactgtgcacata

SEQ ID NO: 47508 - DNA, 25 bp, Rattus norvegicus
aaggcttgccgggactgtgcacata

SEQ ID NO: 47509 - DNA, 25 bp, Rattus norvegicus
aaggcttgcctgaacacggcactct

SEQ ID NO: 47510 - DNA, 25 bp, Rattus norvegicus
aaggcttgcctgaggagcagaagaa

SEQ ID NO: 47511 - DNA, 25 bp, Rattus norvegicus
aaggcttgcctgcaatgcataggtc

SEQ ID NO: 47512 - DNA, 25 bp, Rattus norvegicus
aaggcttgcctggaatgcataggtc

SEQ ID NO: 47513 - DNA, 25 bp, Rattus norvegicus
aaggcttgcctgtacacggcactct

SEQ ID NO: 47514 - DNA, 25 bp, Rattus norvegicus
aaggcttgcctgtggagcagaagaa

SEQ ID NO: 47515 - DNA, 25 bp, Rattus norvegicus
aaggcttgccttatgaccttctagg

SEQ ID NO: 47516 - DNA, 25 bp, Rattus norvegicus
aaggcttgccttttgaccttctagg

SEQ ID NO: 47517 - DNA, 25 bp, Rattus norvegicus
aaggcttgcgacaaactgtggcagc

SEQ ID NO: 47518 - DNA, 25 bp, Rattus norvegicus
aaggcttgcgactaactgtggcagc

SEQ ID NO: 47519 - DNA, 25 bp, Rattus norvegicus
aaggcttgctaaacttccagaggaa

SEQ ID NO: 47520 - DNA, 25 bp, Rattus norvegicus
aaggcttgctaatcttccagaggaa

SEQ ID NO: 47521 - DNA, 25 bp, Rattus norvegicus
aaggcttgcttgatcttcatcctgt

SEQ ID NO: 47522 - DNA, 25 bp, Rattus norvegicus
aaggcttgcttgttcttcatcctgt

SEQ ID NO: 47523 - DNA, 25 bp, Rattus norvegicus
aaggcttggaacacctacgtggaat

SEQ ID NO: 47524 - DNA, 25 bp, Rattus norvegicus
aaggcttggaactcctacgtggaat

SEQ ID NO: 47525 - DNA, 25 bp, Rattus norvegicus
aaggcttggactcaagcaggcgaaa

SEQ ID NO: 47526 - DNA, 25 bp, Rattus norvegicus
aaggcttggactcgctggccaatca

SEQ ID NO: 47527 - DNA, 25 bp, Rattus norvegicus
aaggcttggactgaagcaggcgaaa

SEQ ID NO: 47528 - DNA, 25 bp, Rattus norvegicus
aaggcttggactggctggccaatca

SEQ ID NO: 47529 - DNA, 25 bp, Rattus norvegicus
aaggcttgggagctcatcgtttcta

SEQ ID NO: 47530 - DNA, 25 bp, Rattus norvegicus
aaggcttgggaggtcatcgtttcta

SEQ ID NO: 47531 - DNA, 25 bp, Rattus norvegicus
aaggcttgggctcctagtgttcaat

SEQ ID NO: 47532 - DNA, 25 bp, Rattus norvegicus
aaggcttgggctgctagtgttcaat

SEQ ID NO: 47533 - DNA, 25 bp, Rattus norvegicus
aaggcttgggtcacattgatgcaaa

SEQ ID NO: 47534 - DNA, 25 bp, Rattus norvegicus
aaggcttgggtctcattgatgcaaa

SEQ ID NO: 47535 - DNA, 25 bp, Rattus norvegicus
aaggcttggtgcaacggtcagattt

SEQ ID NO: 47536 - DNA, 25 bp, Rattus norvegicus
aaggcttggtgctacggtcagattt

SEQ ID NO: 47537 - DNA, 25 bp, Rattus norvegicus
aaggcttgtctcatagccaaagcag

SEQ ID NO: 47538 - DNA, 25 bp, Rattus norvegicus
aaggcttgtctcttagccaaagcag

SEQ ID NO: 47539 - DNA, 25 bp, Rattus norvegicus
aaggcttgtgaaatctgccatacat

SEQ ID NO: 47540 - DNA, 25 bp, Rattus norvegicus
aaggcttgtgaattctgccatacat

SEQ ID NO: 47541 - DNA, 25 bp, Rattus norvegicus
aaggcttgttacctctgctgtttaa

SEQ ID NO: 47542 - DNA, 25 bp, Rattus norvegicus
aaggcttgttacgtctgctgtttaa

SEQ ID NO: 47543 - DNA, 25 bp, Rattus norvegicus
aaggcttgttagcagctctcttgct

SEQ ID NO: 47544 - DNA, 25 bp, Rattus norvegicus
aaggcttgttaggagctctcttgct

SEQ ID NO: 47545 - DNA, 25 bp, Rattus norvegicus
aaggctttactgctaacctcaggca

SEQ ID NO: 47546 - DNA, 25 bp, Rattus norvegicus
aaggctttactggtaacctcaggca

SEQ ID NO: 47547 - DNA, 25 bp, Rattus norvegicus
aaggctttagtgatcatctgtgttc

SEQ ID NO: 47548 - DNA, 25 bp, Rattus norvegicus
aaggctttagtgttcatctgtgttc

SEQ ID NO: 47549 - DNA, 25 bp, Rattus norvegicus
aaggctttatatccagtagatctac

SEQ ID NO: 47550 - DNA, 25 bp, Rattus norvegicus
aaggctttatatgcagtagatctac

SEQ ID NO: 47551 - DNA, 25 bp, Rattus norvegicus
aaggctttatcacttccaccaagaa

SEQ ID NO: 47552 - DNA, 25 bp, Rattus norvegicus
aaggctttatcagttccaccaagaa

SEQ ID NO: 47553 - DNA, 25 bp, Rattus norvegicus
aaggctttatttcatgcccagcaca

SEQ ID NO: 47554 - DNA, 25 bp, Rattus norvegicus
aaggctttatttgatgcccagcaca

SEQ ID NO: 47555 - DNA, 25 bp, Rattus norvegicus
aaggctttcaacagctgccatactg

SEQ ID NO: 47556 - DNA, 25 bp, Rattus norvegicus
aaggctttcaactgctgccatactg

SEQ ID NO: 47557 - DNA, 25 bp, Rattus norvegicus
aaggctttcacactatcagtatctc

SEQ ID NO: 47558 - DNA, 25 bp, Rattus norvegicus
aaggctttcacagtatcagtatctc

SEQ ID NO: 47559 - DNA, 25 bp, Rattus norvegicus
aaggctttccagatctctgactggc

SEQ ID NO: 47560 - DNA, 25 bp, Rattus norvegicus
aaggctttccagttctctgactggc

SEQ ID NO: 47561 - DNA, 25 bp, Rattus norvegicus
aaggctttccttacattaattctga

SEQ ID NO: 47562 - DNA, 25 bp, Rattus norvegicus
aaggctttccttcagtttgtcttgg

SEQ ID NO: 47563 - DNA, 25 bp, Rattus norvegicus
aaggctttccttgagtttgtcttgg

SEQ ID NO: 47564 - DNA, 25 bp, Rattus norvegicus
aaggctttcctttcattaattctga

SEQ ID NO: 47565 - DNA, 25 bp, Rattus norvegicus
aaggctttcggaagcgctggttcac

SEQ ID NO: 47566 - DNA, 25 bp, Rattus norvegicus
aaggctttcggatgcgctggttcac

SEQ ID NO: 47567 - DNA, 25 bp, Rattus norvegicus
aaggctttctagatgtggcccacta

SEQ ID NO: 47568 - DNA, 25 bp, Rattus norvegicus
aaggctttctagttgtggcccacta

SEQ ID NO: 47569 - DNA, 25 bp, Rattus norvegicus
aaggctttctcaagcaaagtcgaag

SEQ ID NO: 47570 - DNA, 25 bp, Rattus norvegicus
aaggctttctcatgcaaagtcgaag

SEQ ID NO: 47571 - DNA, 25 bp, Rattus norvegicus
aaggctttctgacctgcagtgagtc

SEQ ID NO: 47572 - DNA, 25 bp, Rattus norvegicus
aaggctttctgagctgcagtgagtc

SEQ ID NO: 47573 - DNA, 25 bp, Rattus norvegicus
aaggctttctggaatcgactgtact

SEQ ID NO: 47574 - DNA, 25 bp, Rattus norvegicus
aaggctttctggatcactgactcaa

SEQ ID NO: 47575 - DNA, 25 bp, Rattus norvegicus
aaggctttctggtatcgactgtact

SEQ ID NO: 47576 - DNA, 25 bp, Rattus norvegicus
aaggctttctggttcactgactcaa

SEQ ID NO: 47577 - DNA, 25 bp, Rattus norvegicus
aaggctttcttcacacagagctgga

SEQ ID NO: 47578 - DNA, 25 bp, Rattus norvegicus
aaggctttcttcctttctcaacata

SEQ ID NO: 47579 - DNA, 25 bp, Rattus norvegicus
aaggctttcttcgtttctcaacata

SEQ ID NO: 47580 - DNA, 25 bp, Rattus norvegicus
aaggctttcttctcacagagctgga

SEQ ID NO: 47581 - DNA, 25 bp, Rattus norvegicus
aaggctttctttcccaatattggcg

SEQ ID NO: 47582 - DNA, 25 bp, Rattus norvegicus
aaggctttctttgccaatattggcg

SEQ ID NO: 47583 - DNA, 25 bp, Rattus norvegicus
aaggctttgaaaagaaccaagttgc

SEQ ID NO: 47584 - DNA, 25 bp, Rattus norvegicus
aaggctttgaaatgaaccaagttgc

SEQ ID NO: 47585 - DNA, 25 bp, Rattus norvegicus
aaggctttgacacgtcatcacgggc

SEQ ID NO: 47586 - DNA, 25 bp, Rattus norvegicus
aaggctttgacaggtcatcacgggc

SEQ ID NO: 47587 - DNA, 25 bp, Rattus norvegicus
aaggctttgagcctccttcctttgt

SEQ ID NO: 47588 - DNA, 25 bp, Rattus norvegicus
aaggctttgagcgtccttcctttgt

SEQ ID NO: 47589 - DNA, 25 bp, Rattus norvegicus
aaggctttgagtcaggtcccaagtg

SEQ ID NO: 47590 - DNA, 25 bp, Rattus norvegicus
aaggctttgagtgaggtcccaagtg

SEQ ID NO: 47591 - DNA, 25 bp, Rattus norvegicus
aaggctttgataagaaccacgttct

SEQ ID NO: 47592 - DNA, 25 bp, Rattus norvegicus
aaggctttgatatgaaccacgttct

SEQ ID NO: 47593 - DNA, 25 bp, Rattus norvegicus
aaggctttgattacctcctgaaggc

SEQ ID NO: 47594 - DNA, 25 bp, Rattus norvegicus
aaggctttgatttcctcctgaaggc

SEQ ID NO: 47595 - DNA, 25 bp, Rattus norvegicus
aaggctttgccgactacacagcacc

SEQ ID NO: 47596 - DNA, 25 bp, Rattus norvegicus
aaggctttgccgtctacacagcacc

SEQ ID NO: 47597 - DNA, 25 bp, Rattus norvegicus
aaggctttgctactgaaggctgaac

SEQ ID NO: 47598 - DNA, 25 bp, Rattus norvegicus
aaggctttgctagtgaaggctgaac

SEQ ID NO: 47599 - DNA, 25 bp, Rattus norvegicus
aaggctttggagacagtcagttgct

SEQ ID NO: 47600 - DNA, 25 bp, Rattus norvegicus
aaggctttggagtcagtcagttgct

SEQ ID NO: 47601 - DNA, 25 bp, Rattus norvegicus
aaggctttggatcacctacgcaatg

SEQ ID NO: 47602 - DNA, 25 bp, Rattus norvegicus
aaggctttggatgacctacgcaatg

SEQ ID NO: 47603 - DNA, 25 bp, Rattus norvegicus
aaggctttggcccaccgtcaaccag

SEQ ID NO: 47604 - DNA, 25 bp, Rattus norvegicus
aaggctttggccgaccgtcaaccag

SEQ ID NO: 47605 - DNA, 25 bp, Rattus norvegicus
aaggctttgtcaccatagccatcca

SEQ ID NO: 47606 - DNA, 25 bp, Rattus norvegicus
aaggctttgtcagcatagccatcca

SEQ ID NO: 47607 - DNA, 25 bp, Rattus norvegicus
aaggctttgtggatctgttgtccgt

SEQ ID NO: 47608 - DNA, 25 bp, Rattus norvegicus
aaggctttgtggttctgttgtccgt

SEQ ID NO: 47609 - DNA, 25 bp, Rattus norvegicus
aaggctttgttaagcttctgagaag

SEQ ID NO: 47610 - DNA, 25 bp, Rattus norvegicus
aaggctttgttatgcttctgagaag

SEQ ID NO: 47611 - DNA, 25 bp, Rattus norvegicus
aaggcttttccccagagctatgcat

SEQ ID NO: 47612 - DNA, 25 bp, Rattus norvegicus
aaggcttttcccgagagctatgcat

SEQ ID NO: 47613 - DNA, 25 bp, Rattus norvegicus
aaggcttttgtgatccagtgcattt

SEQ ID NO: 47614 - DNA, 25 bp, Rattus norvegicus
aaggcttttgtgttccagtgcattt

SEQ ID NO: 47615 - DNA, 25 bp, Rattus norvegicus
aagggaaacctcagccacagcagga

SEQ ID NO: 47616 - DNA, 25 bp, Rattus norvegicus
aagggaaacctctgccacagcagga

SEQ ID NO: 47617 - DNA, 25 bp, Rattus norvegicus
aagggaaagcctacttgatctccct

SEQ ID NO: 47618 - DNA, 25 bp, Rattus norvegicus
aagggaaagccttcttgatctccct

SEQ ID NO: 47619 - DNA, 25 bp, Rattus norvegicus
aagggaaatcttctctgttggtgaa

SEQ ID NO: 47620 - DNA, 25 bp, Rattus norvegicus
aagggaaatcttgtctgttggtgaa

SEQ ID NO: 47621 - DNA, 25 bp, Rattus norvegicus
aagggaaatgctctgcctcagtggc

SEQ ID NO: 47622 - DNA, 25 bp, Rattus norvegicus
aagggaaatgctgtgcctcagtggc

SEQ ID NO: 47623 - DNA, 25 bp, Rattus norvegicus
aagggaaatgtgagttatctggaaa

SEQ ID NO: 47624 - DNA, 25 bp, Rattus norvegicus
aagggaaatgtgtgttatctggaaa

SEQ ID NO: 47625 - DNA, 25 bp, Rattus norvegicus
aagggaacacctcgtttgaatctgt

SEQ ID NO: 47626 - DNA, 25 bp, Rattus norvegicus
aagggaacacctggtttgaatctgt

SEQ ID NO: 47627 - DNA, 25 bp, Rattus norvegicus
aagggaaccacactgtgtaccgcat

SEQ ID NO: 47628 - DNA, 25 bp, Rattus norvegicus
aagggaaccacagtgtgtaccgcat

SEQ ID NO: 47629 - DNA, 25 bp, Rattus norvegicus
aagggaaccagcagctttttccagg

SEQ ID NO: 47630 - DNA, 25 bp, Rattus norvegicus
aagggaaccagctgctttttccagg

SEQ ID NO: 47631 - DNA, 25 bp, Rattus norvegicus
aagggaacctttcatttgcaccatg

SEQ ID NO: 47632 - DNA, 25 bp, Rattus norvegicus
aagggaacctttgatttgcaccatg

SEQ ID NO: 47633 - DNA, 25 bp, Rattus norvegicus
aagggaactcgtcttacacacacac

SEQ ID NO: 47634 - DNA, 25 bp, Rattus norvegicus
aagggaactcgtgttacacacacac

SEQ ID NO: 47635 - DNA, 25 bp, Rattus norvegicus
aagggaactgttatcagtctgttga

SEQ ID NO: 47636 - DNA, 25 bp, Rattus norvegicus
aagggaactgttttcagtctgttga

SEQ ID NO: 47637 - DNA, 25 bp, Rattus norvegicus
aagggaagccacagactttccagcg

SEQ ID NO: 47638 - DNA, 25 bp, Rattus norvegicus
aagggaagccactgactttccagcg

SEQ ID NO: 47639 - DNA, 25 bp, Rattus norvegicus
aagggaagctttcctcaggacgtaa

SEQ ID NO: 47640 - DNA, 25 bp, Rattus norvegicus
aagggaagctttgctcaggacgtaa

SEQ ID NO: 47641 - DNA, 25 bp, Rattus norvegicus
aagggaaggcgcaacaagacaaaag

SEQ ID NO: 47642 - DNA, 25 bp, Rattus norvegicus
aagggaaggcgctacaagacaaaag

SEQ ID NO: 47643 - DNA, 25 bp, Rattus norvegicus
aagggaagggtcacagccccataag

SEQ ID NO: 47644 - DNA, 25 bp, Rattus norvegicus
aagggaagggtctcagccccataag

SEQ ID NO: 47645 - DNA, 25 bp, Rattus norvegicus
aagggaaggtctatctgctcctaca

SEQ ID NO: 47646 - DNA, 25 bp, Rattus norvegicus
aagggaaggtctttctgctcctaca

SEQ ID NO: 47647 - DNA, 25 bp, Rattus norvegicus
aagggaagttttcctgcacgcgcac

SEQ ID NO: 47648 - DNA, 25 bp, Rattus norvegicus
aagggaagttttgctgcacgcgcac

SEQ ID NO: 47649 - DNA, 25 bp, Rattus norvegicus
aagggaatccacagagcgcaccatg

SEQ ID NO: 47650 - DNA, 25 bp, Rattus norvegicus
aagggaatccactgagcgcaccatg

SEQ ID NO: 47651 - DNA, 25 bp, Rattus norvegicus
aagggaatcttccagccaaactaag

SEQ ID NO: 47652 - DNA, 25 bp, Rattus norvegicus
aagggaatcttcgagccaaactaag

SEQ ID NO: 47653 - DNA, 25 bp, Rattus norvegicus
aagggaatgcccacgaagctgtcag

SEQ ID NO: 47654 - DNA, 25 bp, Rattus norvegicus
aagggaatgccctcgaagctgtcag

SEQ ID NO: 47655 - DNA, 25 bp, Rattus norvegicus
aagggaatgtgccagaatgctgaac

SEQ ID NO: 47656 - DNA, 25 bp, Rattus norvegicus
aagggaatgtgcgagaatgctgaac

SEQ ID NO: 47657 - DNA, 25 bp, Rattus norvegicus
aagggacaaatcacaccctggtgca

SEQ ID NO: 47658 - DNA, 25 bp, Rattus norvegicus
aagggacaaatctcaccctggtgca

SEQ ID NO: 47659 - DNA, 25 bp, Rattus norvegicus
aagggacaacagaggcactttccat

SEQ ID NO: 47660 - DNA, 25 bp, Rattus norvegicus
aagggacaacagtggcactttccat

SEQ ID NO: 47661 - DNA, 25 bp, Rattus norvegicus
aagggacaatcgcttgcagtcagta

SEQ ID NO: 47662 - DNA, 25 bp, Rattus norvegicus
aagggacaatcggttgcagtcagta

SEQ ID NO: 47663 - DNA, 25 bp, Rattus norvegicus
aagggacaatggcttctgttcctgg

SEQ ID NO: 47664 - DNA, 25 bp, Rattus norvegicus
aagggacaatgggttctgttcctgg

SEQ ID NO: 47665 - DNA, 25 bp, Rattus norvegicus
aagggacaattacccacttgccccg

SEQ ID NO: 47666 - DNA, 25 bp, Rattus norvegicus
aagggacaattagccacttgccccg

SEQ ID NO: 47667 - DNA, 25 bp, Rattus norvegicus
aagggacacagcattgcaaaaaagg

SEQ ID NO: 47668 - DNA, 25 bp, Rattus norvegicus
aagggacacagctttgcaaaaaagg

SEQ ID NO: 47669 - DNA, 25 bp, Rattus norvegicus
aagggacaccacagaccttagtgtt

SEQ ID NO: 47670 - DNA, 25 bp, Rattus norvegicus
aagggacaccactgaccttagtgtt

SEQ ID NO: 47671 - DNA, 25 bp, Rattus norvegicus
aagggacaccatagtactgtttcat

SEQ ID NO: 47672 - DNA, 25 bp, Rattus norvegicus
aagggacaccattgtactgtttcat

SEQ ID NO: 47673 - DNA, 25 bp, Rattus norvegicus
aagggacacctcagatggcatacat

SEQ ID NO: 47674 - DNA, 25 bp, Rattus norvegicus
aagggacacctctgatggcatacat

SEQ ID NO: 47675 - DNA, 25 bp, Rattus norvegicus
aagggacacgccatctgagagcctc

SEQ ID NO: 47676 - DNA, 25 bp, Rattus norvegicus
aagggacacgccttctgagagcctc

SEQ ID NO: 47677 - DNA, 25 bp, Rattus norvegicus
aagggacactctaaggcagggccct

SEQ ID NO: 47678 - DNA, 25 bp, Rattus norvegicus
aagggacactcttaggcagggccct

SEQ ID NO: 47679 - DNA, 25 bp, Rattus norvegicus
aagggacactgtcatctcattgcct

SEQ ID NO: 47680 - DNA, 25 bp, Rattus norvegicus
aagggacactgtgatctcattgcct

SEQ ID NO: 47681 - DNA, 25 bp, Rattus norvegicus
aagggacagcctccctgtgagtctc

SEQ ID NO: 47682 - DNA, 25 bp, Rattus norvegicus
aagggacagcctgcctgtgagtctc

SEQ ID NO: 47683 - DNA, 25 bp, Rattus norvegicus
aagggacagctcaactagttcctgt

SEQ ID NO: 47684 - DNA, 25 bp, Rattus norvegicus
aagggacagctctactagttcctgt

SEQ ID NO: 47685 - DNA, 25 bp, Rattus norvegicus
aagggacaggatacctgcccataca

SEQ ID NO: 47686 - DNA, 25 bp, Rattus norvegicus
aagggacaggattcctgcccataca

SEQ ID NO: 47687 - DNA, 25 bp, Rattus norvegicus
aagggacaggcacgtctgcattcct

SEQ ID NO: 47688 - DNA, 25 bp, Rattus norvegicus
aagggacaggcaggtctgcattcct

SEQ ID NO: 47689 - DNA, 25 bp, Rattus norvegicus
aagggacatcaaagcaaggaaaaat

SEQ ID NO: 47690 - DNA, 25 bp, Rattus norvegicus
aagggacatcaatgcaaggaaaaat

SEQ ID NO: 47691 - DNA, 25 bp, Rattus norvegicus
aagggacatctcatatttccaccac

SEQ ID NO: 47692 - DNA, 25 bp, Rattus norvegicus
aagggacatctcttatttccaccac

SEQ ID NO: 47693 - DNA, 25 bp, Rattus norvegicus
aagggacatgctcctgactgaccgc

SEQ ID NO: 47694 - DNA, 25 bp, Rattus norvegicus
aagggacatgctgctgactgaccgc

SEQ ID NO: 47695 - DNA, 25 bp, Rattus norvegicus
aagggacattagaagctgctgcagg

SEQ ID NO: 47696 - DNA, 25 bp, Rattus norvegicus
aagggacattagtagctgctgcagg

SEQ ID NO: 47697 - DNA, 25 bp, Rattus norvegicus
aagggaccaaccagtcttctgttgt

SEQ ID NO: 47698 - DNA, 25 bp, Rattus norvegicus
aagggaccaacctgtcttctgttgt

SEQ ID NO: 47699 - DNA, 25 bp, Rattus norvegicus
aagggaccaatgagggctactaaca

SEQ ID NO: 47700 - DNA, 25 bp, Rattus norvegicus
aagggaccaatgtgggctactaaca

SEQ ID NO: 47701 - DNA, 25 bp, Rattus norvegicus
aagggaccatatcaccaaggcaact

SEQ ID NO: 47702 - DNA, 25 bp, Rattus norvegicus
aagggaccatatgaccaaggcaact

SEQ ID NO: 47703 - DNA, 25 bp, Rattus norvegicus
aagggacccaggagcagtgactgcc

SEQ ID NO: 47704 - DNA, 25 bp, Rattus norvegicus
aagggacccaggtgcagtgactgcc

SEQ ID NO: 47705 - DNA, 25 bp, Rattus norvegicus
aagggacccttcagtgggagagcac

SEQ ID NO: 47706 - DNA, 25 bp, Rattus norvegicus
aagggacccttctgtgggagagcac

SEQ ID NO: 47707 - DNA, 25 bp, Rattus norvegicus
aagggaccggcacctttggtgtaca

SEQ ID NO: 47708 - DNA, 25 bp, Rattus norvegicus
aagggaccggcagctttggtgtaca

SEQ ID NO: 47709 - DNA, 25 bp, Rattus norvegicus
aagggaccgtccagcatgggacttg

SEQ ID NO: 47710 - DNA, 25 bp, Rattus norvegicus
aagggaccgtcctgcatgggacttg

SEQ ID NO: 47711 - DNA, 25 bp, Rattus norvegicus
aagggacctcgtactgcactggaag

SEQ ID NO: 47712 - DNA, 25 bp, Rattus norvegicus
aagggacctcgttctgcactggaag

SEQ ID NO: 47713 - DNA, 25 bp, Rattus norvegicus
aagggaccttcaatccacttgacta

SEQ ID NO: 47714 - DNA, 25 bp, Rattus norvegicus
aagggaccttcattccacttgacta

SEQ ID NO: 47715 - DNA, 25 bp, Rattus norvegicus
aagggacgacagcttgcttatctct

SEQ ID NO: 47716 - DNA, 25 bp, Rattus norvegicus
aagggacgacaggttgcttatctct

SEQ ID NO: 47717 - DNA, 25 bp, Rattus norvegicus
aagggacgtcacagaggaacccact

SEQ ID NO: 47718 - DNA, 25 bp, Rattus norvegicus
aagggacgtcactgaggaacccact

SEQ ID NO: 47719 - DNA, 25 bp, Rattus norvegicus
aagggactcgaaagtctctgtggtt

SEQ ID NO: 47720 - DNA, 25 bp, Rattus norvegicus
aagggactcgaatgtctctgtggtt

SEQ ID NO: 47721 - DNA, 25 bp, Rattus norvegicus
aagggactcttcagaatgggcgacc

SEQ ID NO: 47722 - DNA, 25 bp, Rattus norvegicus
aagggactcttctgaatgggcgacc

SEQ ID NO: 47723 - DNA, 25 bp, Rattus norvegicus
aagggactgaacaccaagctcctgg

SEQ ID NO: 47724 - DNA, 25 bp, Rattus norvegicus
aagggactgaactccaagctcctgg

SEQ ID NO: 47725 - DNA, 25 bp, Rattus norvegicus
aagggactgctgatcagttcagaat

SEQ ID NO: 47726 - DNA, 25 bp, Rattus norvegicus
aagggactgctgttcagttcagaat

SEQ ID NO: 47727 - DNA, 25 bp, Rattus norvegicus
aagggactggctatacattatttaa

SEQ ID NO: 47728 - DNA, 25 bp, Rattus norvegicus
aagggactggctttacattatttaa

SEQ ID NO: 47729 - DNA, 25 bp, Rattus norvegicus
aagggactggtcatcttctttcctg

SEQ ID NO: 47730 - DNA, 25 bp, Rattus norvegicus
aagggactggtcttcttctttcctg

SEQ ID NO: 47731 - DNA, 25 bp, Rattus norvegicus
aagggactggttcttcttgctttca

SEQ ID NO: 47732 - DNA, 25 bp, Rattus norvegicus
aagggactggttgttcttgctttca

SEQ ID NO: 47733 - DNA, 25 bp, Rattus norvegicus
aagggacttagcctcagacacctct

SEQ ID NO: 47734 - DNA, 25 bp, Rattus norvegicus
aagggacttagcgtcagacacctct

SEQ ID NO: 47735 - DNA, 25 bp, Rattus norvegicus
aagggacttcacatccgagagcaac

SEQ ID NO: 47736 - DNA, 25 bp, Rattus norvegicus
aagggacttcacttccgagagcaac

SEQ ID NO: 47737 - DNA, 25 bp, Rattus norvegicus
aagggacttcctatcatattcacac

SEQ ID NO: 47738 - DNA, 25 bp, Rattus norvegicus
aagggacttcctttcatattcacac

SEQ ID NO: 47739 - DNA, 25 bp, Rattus norvegicus
aagggacttctcactcattgatgac

SEQ ID NO: 47740 - DNA, 25 bp, Rattus norvegicus
aagggacttctctctcattgatgac

SEQ ID NO: 47741 - DNA, 25 bp, Rattus norvegicus
aagggagaagagaggccacacacaa

SEQ ID NO: 47742 - DNA, 25 bp, Rattus norvegicus
aagggagaagagtggccacacacaa

SEQ ID NO: 47743 - DNA, 25 bp, Rattus norvegicus
aagggagaagtcacacaggctcaaa

SEQ ID NO: 47744 - DNA, 25 bp, Rattus norvegicus
aagggagaagtctcacaggctcaaa

SEQ ID NO: 47745 - DNA, 25 bp, Rattus norvegicus
aagggagaatcccatctgtgaattt

SEQ ID NO: 47746 - DNA, 25 bp, Rattus norvegicus
aagggagaatccgatctgtgaattt

SEQ ID NO: 47747 - DNA, 25 bp, Rattus norvegicus
aagggagacaccatctacctggttc

SEQ ID NO: 47748 - DNA, 25 bp, Rattus norvegicus
aagggagacaccttctacctggttc

SEQ ID NO: 47749 - DNA, 25 bp, Rattus norvegicus
aagggagacatgatgcccctcaggt

SEQ ID NO: 47750 - DNA, 25 bp, Rattus norvegicus
aagggagacatgttgcccctcaggt

SEQ ID NO: 47751 - DNA, 25 bp, Rattus norvegicus
aagggagacggtacctgcactgtca

SEQ ID NO: 47752 - DNA, 25 bp, Rattus norvegicus
aagggagacggttcctgcactgtca

SEQ ID NO: 47753 - DNA, 25 bp, Rattus norvegicus
aagggagacgtcagcatgctattat

SEQ ID NO: 47754 - DNA, 25 bp, Rattus norvegicus
aagggagacgtctgcatgctattat

SEQ ID NO: 47755 - DNA, 25 bp, Rattus norvegicus
aagggagagactaccaataccattg

SEQ ID NO: 47756 - DNA, 25 bp, Rattus norvegicus
aagggagagacttccaataccattg

SEQ ID NO: 47757 - DNA, 25 bp, Rattus norvegicus
aagggagatatgattgatgctgcaa

SEQ ID NO: 47758 - DNA, 25 bp, Rattus norvegicus
aagggagatatgtttgatgctgcaa

SEQ ID NO: 47759 - DNA, 25 bp, Rattus norvegicus
aagggagatgtcatacacatgcatt

SEQ ID NO: 47760 - DNA, 25 bp, Rattus norvegicus
aagggagatgtcttacacatgcatt

SEQ ID NO: 47761 - DNA, 25 bp, Rattus norvegicus
aagggagcaccaccagtgacaagaa

SEQ ID NO: 47762 - DNA, 25 bp, Rattus norvegicus
aagggagcaccagcagtgacaagaa

SEQ ID NO: 47763 - DNA, 25 bp, Rattus norvegicus
aagggagcacggcattcatgttaaa

SEQ ID NO: 47764 - DNA, 25 bp, Rattus norvegicus
aagggagcacgggattcatgttaaa

SEQ ID NO: 47765 - DNA, 25 bp, Rattus norvegicus
aagggagcacgtatctggtaacaga

SEQ ID NO: 47766 - DNA, 25 bp, Rattus norvegicus
aagggagcacgtttctggtaacaga

SEQ ID NO: 47767 - DNA, 25 bp, Rattus norvegicus
aagggagcagagatgccttccaacc

SEQ ID NO: 47768 - DNA, 25 bp, Rattus norvegicus
aagggagcagagttgccttccaacc

SEQ ID NO: 47769 - DNA, 25 bp, Rattus norvegicus
aagggagcagcactacctctgcaca

SEQ ID NO: 47770 - DNA, 25 bp, Rattus norvegicus
aagggagcagcagtacctctgcaca

SEQ ID NO: 47771 - DNA, 25 bp, Rattus norvegicus
aagggagcagccaatacattccctg

SEQ ID NO: 47772 - DNA, 25 bp, Rattus norvegicus
aagggagcagcctatacattccctg

SEQ ID NO: 47773 - DNA, 25 bp, Rattus norvegicus
aagggagcagctcacttgtcactgg

SEQ ID NO: 47774 - DNA, 25 bp, Rattus norvegicus
aagggagcagctgacttgtcactgg

SEQ ID NO: 47775 - DNA, 25 bp, Rattus norvegicus
aagggagcatcaccacttaggtcct

SEQ ID NO: 47776 - DNA, 25 bp, Rattus norvegicus
aagggagcatcagcacttaggtcct

SEQ ID NO: 47777 - DNA, 25 bp, Rattus norvegicus
aagggagcatctatggactctctgt

SEQ ID NO: 47778 - DNA, 25 bp, Rattus norvegicus
aagggagcatctttggactctctgt

SEQ ID NO: 47779 - DNA, 25 bp, Rattus norvegicus
aagggagccaacaagagtcttcttt

SEQ ID NO: 47780 - DNA, 25 bp, Rattus norvegicus
aagggagccaactagagtcttcttt

SEQ ID NO: 47781 - DNA, 25 bp, Rattus norvegicus
aagggagccctgagcatcagtgtta

SEQ ID NO: 47782 - DNA, 25 bp, Rattus norvegicus
aagggagccctgtgcatcagtgtta

SEQ ID NO: 47783 - DNA, 25 bp, Rattus norvegicus
aagggagccggtagtagccctgcct

SEQ ID NO: 47784 - DNA, 25 bp, Rattus norvegicus
aagggagccggttgtagccctgcct

SEQ ID NO: 47785 - DNA, 25 bp, Rattus norvegicus
aagggagcctgactcagtcactctg

SEQ ID NO: 47786 - DNA, 25 bp, Rattus norvegicus
aagggagcctgagtcagtcactctg

SEQ ID NO: 47787 - DNA, 25 bp, Rattus norvegicus
aagggagctcacacagtgggtctca

SEQ ID NO: 47788 - DNA, 25 bp, Rattus norvegicus
aagggagctcactcagtgggtctca

SEQ ID NO: 47789 - DNA, 25 bp, Rattus norvegicus
aagggagctccaatgttttctccat

SEQ ID NO: 47790 - DNA, 25 bp, Rattus norvegicus
aagggagctccattgttttctccat

SEQ ID NO: 47791 - DNA, 25 bp, Rattus norvegicus
aagggagctccgacacactaagagt

SEQ ID NO: 47792 - DNA, 25 bp, Rattus norvegicus
aagggagctccgcatgtgacgtcac

SEQ ID NO: 47793 - DNA, 25 bp, Rattus norvegicus
aagggagctccggatgtgacgtcac

SEQ ID NO: 47794 - DNA, 25 bp, Rattus norvegicus
aagggagctccgtcacactaagagt

SEQ ID NO: 47795 - DNA, 25 bp, Rattus norvegicus
aagggagctcgaattgtttctgcta

SEQ ID NO: 47796 - DNA, 25 bp, Rattus norvegicus
aagggagctcgatttgtttctgcta

SEQ ID NO: 47797 - DNA, 25 bp, Rattus norvegicus
aagggagctgggatcctttatcagt

SEQ ID NO: 47798 - DNA, 25 bp, Rattus norvegicus
aagggagctgggttcctttatcagt

SEQ ID NO: 47799 - DNA, 25 bp, Rattus norvegicus
aagggagcttccagagttctgctca

SEQ ID NO: 47800 - DNA, 25 bp, Rattus norvegicus
aagggagcttcctgagttctgctca

SEQ ID NO: 47801 - DNA, 25 bp, Rattus norvegicus
aagggaggaagcacctctgacctca

SEQ ID NO: 47802 - DNA, 25 bp, Rattus norvegicus
aagggaggaagctcctctgacctca

SEQ ID NO: 47803 - DNA, 25 bp, Rattus norvegicus
aagggaggacagagcaaccctccac

SEQ ID NO: 47804 - DNA, 25 bp, Rattus norvegicus
aagggaggacagtgcaaccctccac

SEQ ID NO: 47805 - DNA, 25 bp, Rattus norvegicus
aagggaggacccagttcctagacag

SEQ ID NO: 47806 - DNA, 25 bp, Rattus norvegicus
aagggaggaccctgttcctagacag

SEQ ID NO: 47807 - DNA, 25 bp, Rattus norvegicus
aagggaggatatctccttgtccctc

SEQ ID NO: 47808 - DNA, 25 bp, Rattus norvegicus
aagggaggatatgtccttgtccctc

SEQ ID NO: 47809 - DNA, 25 bp, Rattus norvegicus
aagggaggcagacgtgctggtgcac

SEQ ID NO: 47810 - DNA, 25 bp, Rattus norvegicus
aagggaggcagaggtgctggtgcac

SEQ ID NO: 47811 - DNA, 25 bp, Rattus norvegicus
aagggaggcatgatgctcatttcat

SEQ ID NO: 47812 - DNA, 25 bp, Rattus norvegicus
aagggaggcatgttgctcatttcat

SEQ ID NO: 47813 - DNA, 25 bp, Rattus norvegicus
aagggaggccctctggtacttccag

SEQ ID NO: 47814 - DNA, 25 bp, Rattus norvegicus
aagggaggccctgtggtacttccag

SEQ ID NO: 47815 - DNA, 25 bp, Rattus norvegicus
aagggaggcgccacggtgaaagccg

SEQ ID NO: 47816 - DNA, 25 bp, Rattus norvegicus
aagggaggcgcctcggtgaaagccg

SEQ ID NO: 47817 - DNA, 25 bp, Rattus norvegicus
aagggaggctgccttcaagcaccag

SEQ ID NO: 47818 - DNA, 25 bp, Rattus norvegicus
aagggaggctgcgttcaagcaccag

SEQ ID NO: 47819 - DNA, 25 bp, Rattus norvegicus
aagggagggctcattcagtgtgaac

SEQ ID NO: 47820 - DNA, 25 bp, Rattus norvegicus
aagggagggctctttcagtgtgaac

SEQ ID NO: 47821 - DNA, 25 bp, Rattus norvegicus
aagggagggtcactcaatccttctc

SEQ ID NO: 47822 - DNA, 25 bp, Rattus norvegicus
aagggagggtcagtcaatccttctc

SEQ ID NO: 47823 - DNA, 25 bp, Rattus norvegicus
aagggaggtacaagctgctctgacc

SEQ ID NO: 47824 - DNA, 25 bp, Rattus norvegicus
aagggaggtacatgctgctctgacc

SEQ ID NO: 47825 - DNA, 25 bp, Rattus norvegicus
aagggaggtctcagattgtctgcct

SEQ ID NO: 47826 - DNA, 25 bp, Rattus norvegicus
aagggaggtctctgattgtctgcct

SEQ ID NO: 47827 - DNA, 25 bp, Rattus norvegicus
aagggaggtttcatgcctcctcgat

SEQ ID NO: 47828 - DNA, 25 bp, Rattus norvegicus
aagggaggtttcttgcctcctcgat

SEQ ID NO: 47829 - DNA, 25 bp, Rattus norvegicus
aagggagtacatccacttgaccgtt

SEQ ID NO: 47830 - DNA, 25 bp, Rattus norvegicus
aagggagtacatcccaccactggga

SEQ ID NO: 47831 - DNA, 25 bp, Rattus norvegicus
aagggagtacatgcacttgaccgtt

SEQ ID NO: 47832 - DNA, 25 bp, Rattus norvegicus
aagggagtacatgccaccactggga

SEQ ID NO: 47833 - DNA, 25 bp, Rattus norvegicus
aagggagtaggcagccatccttctg

SEQ ID NO: 47834 - DNA, 25 bp, Rattus norvegicus
aagggagtaggctgccatccttctg

SEQ ID NO: 47835 - DNA, 25 bp, Rattus norvegicus
aagggagtccaaaagtgtgcactag

SEQ ID NO: 47836 - DNA, 25 bp, Rattus norvegicus
aagggagtccaatagtgtgcactag

SEQ ID NO: 47837 - DNA, 25 bp, Rattus norvegicus
aagggagtcgccacagcagcacgaa

SEQ ID NO: 47838 - DNA, 25 bp, Rattus norvegicus
aagggagtcgcctcagcagcacgaa

SEQ ID NO: 47839 - DNA, 25 bp, Rattus norvegicus
aagggagtcttacatttccgccttg

SEQ ID NO: 47840 - DNA, 25 bp, Rattus norvegicus
aagggagtcttagatttccgccttg

SEQ ID NO: 47841 - DNA, 25 bp, Rattus norvegicus
aagggagtgaccattggtgcctctt

SEQ ID NO: 47842 - DNA, 25 bp, Rattus norvegicus
aagggagtgacctttggtgcctctt

SEQ ID NO: 47843 - DNA, 25 bp, Rattus norvegicus
aagggagtgactatttgatgacaag

SEQ ID NO: 47844 - DNA, 25 bp, Rattus norvegicus
aagggagtgactttttgatgacaag

SEQ ID NO: 47845 - DNA, 25 bp, Rattus norvegicus
aagggagtgagtatcttgactcagt

SEQ ID NO: 47846 - DNA, 25 bp, Rattus norvegicus
aagggagtgagtttcttgactcagt

SEQ ID NO: 47847 - DNA, 25 bp, Rattus norvegicus
aagggagtggacagggcaccatcta

SEQ ID NO: 47848 - DNA, 25 bp, Rattus norvegicus
aagggagtggactgggcaccatcta

SEQ ID NO: 47849 - DNA, 25 bp, Rattus norvegicus
aagggagtgtccaactggtaaatag

SEQ ID NO: 47850 - DNA, 25 bp, Rattus norvegicus
aagggagtgtcctactggtaaatag

SEQ ID NO: 47851 - DNA, 25 bp, Rattus norvegicus
aagggagttcgtctacgggcactct

SEQ ID NO: 47852 - DNA, 25 bp, Rattus norvegicus
aagggagttcgtgtacgggcactct

SEQ ID NO: 47853 - DNA, 25 bp, Rattus norvegicus
aagggagttcttcgacagctaggac

SEQ ID NO: 47854 - DNA, 25 bp, Rattus norvegicus
aagggagttcttggacagctaggac

SEQ ID NO: 47855 - DNA, 25 bp, Rattus norvegicus
aagggataacttctagctcccgctg

SEQ ID NO: 47856 - DNA, 25 bp, Rattus norvegicus
aagggataacttgtagctcccgctg

SEQ ID NO: 47857 - DNA, 25 bp, Rattus norvegicus
aagggatacataattacaggacaag

SEQ ID NO: 47858 - DNA, 25 bp, Rattus norvegicus
aagggatacatatttacaggacaag

SEQ ID NO: 47859 - DNA, 25 bp, Rattus norvegicus
aagggatacccacatgagccagatt

SEQ ID NO: 47860 - DNA, 25 bp, Rattus norvegicus
aagggatacccagatgagccagatt

SEQ ID NO: 47861 - DNA, 25 bp, Rattus norvegicus
aagggatatcgcactgcacttgaac

SEQ ID NO: 47862 - DNA, 25 bp, Rattus norvegicus
aagggatatcgctctgcacttgaac

SEQ ID NO: 47863 - DNA, 25 bp, Rattus norvegicus
aagggatcaaatccctaatcagtgc

SEQ ID NO: 47864 - DNA, 25 bp, Rattus norvegicus
aagggatcaaatgcctaatcagtgc

SEQ ID NO: 47865 - DNA, 25 bp, Rattus norvegicus
aagggatcagatccatgtcccggcg

SEQ ID NO: 47866 - DNA, 25 bp, Rattus norvegicus
aagggatcagatgcatgtcccggcg

SEQ ID NO: 47867 - DNA, 25 bp, Rattus norvegicus
aagggatcatgtactgactgaatac

SEQ ID NO: 47868 - DNA, 25 bp, Rattus norvegicus
aagggatcatgttctgactgaatac

SEQ ID NO: 47869 - DNA, 25 bp, Rattus norvegicus
aagggatccaagacaccacattgcc

SEQ ID NO: 47870 - DNA, 25 bp, Rattus norvegicus
aagggatccaagtcaccacattgcc

SEQ ID NO: 47871 - DNA, 25 bp, Rattus norvegicus
aagggatccacgatctagactggcc

SEQ ID NO: 47872 - DNA, 25 bp, Rattus norvegicus
aagggatccacgttctagactggcc

SEQ ID NO: 47873 - DNA, 25 bp, Rattus norvegicus
aagggatccctgcatcggttctctt

SEQ ID NO: 47874 - DNA, 25 bp, Rattus norvegicus
aagggatccctggatcggttctctt

SEQ ID NO: 47875 - DNA, 25 bp, Rattus norvegicus
aagggatcctcaatgttaagtacat

SEQ ID NO: 47876 - DNA, 25 bp, Rattus norvegicus
aagggatcctcattgttaagtacat

SEQ ID NO: 47877 - DNA, 25 bp, Rattus norvegicus
aagggatcctctagagtctcgcgaa

SEQ ID NO: 47878 - DNA, 25 bp, Rattus norvegicus
aagggatcctcttgagtctcgcgaa

SEQ ID NO: 47879 - DNA, 25 bp, Rattus norvegicus
aagggatcctgtatttcttgctgac

SEQ ID NO: 47880 - DNA, 25 bp, Rattus norvegicus
aagggatcctgtttttcttgctgac

SEQ ID NO: 47881 - DNA, 25 bp, Rattus norvegicus
aagggatcgaggactgtgccatcta

SEQ ID NO: 47882 - DNA, 25 bp, Rattus norvegicus
aagggatcgaggtctgtgccatcta

SEQ ID NO: 47883 - DNA, 25 bp, Rattus norvegicus
aagggatctgcactgacagggctcc

SEQ ID NO: 47884 - DNA, 25 bp, Rattus norvegicus
aagggatctgcagtgacagggctcc

SEQ ID NO: 47885 - DNA, 25 bp, Rattus norvegicus
aagggatcttacaccccatgtgcag

SEQ ID NO: 47886 - DNA, 25 bp, Rattus norvegicus
aagggatcttactccccatgtgcag

SEQ ID NO: 47887 - DNA, 25 bp, Rattus norvegicus
aagggatgcactactagaccagata

SEQ ID NO: 47888 - DNA, 25 bp, Rattus norvegicus
aagggatgcacttctagaccagata

SEQ ID NO: 47889 - DNA, 25 bp, Rattus norvegicus
aagggatgcccaatagcttcaaaac

SEQ ID NO: 47890 - DNA, 25 bp, Rattus norvegicus
aagggatgcccattagcttcaaaac

SEQ ID NO: 47891 - DNA, 25 bp, Rattus norvegicus
aagggatgcttaccctcagagagcc

SEQ ID NO: 47892 - DNA, 25 bp, Rattus norvegicus
aagggatgcttagcctcagagagcc

SEQ ID NO: 47893 - DNA, 25 bp, Rattus norvegicus
aagggatggcttaccctagctcaaa

SEQ ID NO: 47894 - DNA, 25 bp, Rattus norvegicus
aagggatggctttccctagctcaaa

SEQ ID NO: 47895 - DNA, 25 bp, Rattus norvegicus
aagggatgtcagaccaggccatcat

SEQ ID NO: 47896 - DNA, 25 bp, Rattus norvegicus
aagggatgtcagtccaggccatcat

SEQ ID NO: 47897 - DNA, 25 bp, Rattus norvegicus
aagggatgtgcacctccttgtgtga

SEQ ID NO: 47898 - DNA, 25 bp, Rattus norvegicus
aagggatgtgcagctccttgtgtga

SEQ ID NO: 47899 - DNA, 25 bp, Rattus norvegicus
aagggatgtgtcaaattcttatgat

SEQ ID NO: 47900 - DNA, 25 bp, Rattus norvegicus
aagggatgtgtctaattcttatgat

SEQ ID NO: 47901 - DNA, 25 bp, Rattus norvegicus
aagggattcaccatccttctgtgac

SEQ ID NO: 47902 - DNA, 25 bp, Rattus norvegicus
aagggattcaccttccttctgtgac

SEQ ID NO: 47903 - DNA, 25 bp, Rattus norvegicus
aagggattcagcctggcggacatcc

SEQ ID NO: 47904 - DNA, 25 bp, Rattus norvegicus
aagggattcagcgtggcggacatcc

SEQ ID NO: 47905 - DNA, 25 bp, Rattus norvegicus
aagggattccagagacccaagtcca

SEQ ID NO: 47906 - DNA, 25 bp, Rattus norvegicus
aagggattccagtgacccaagtcca

SEQ ID NO: 47907 - DNA, 25 bp, Rattus norvegicus
aagggattcggcattgtcaccatga

SEQ ID NO: 47908 - DNA, 25 bp, Rattus norvegicus
aagggattcggctttgtcaccatga

SEQ ID NO: 47909 - DNA, 25 bp, Rattus norvegicus
aagggattctctagtccaacctgaa

SEQ ID NO: 47910 - DNA, 25 bp, Rattus norvegicus
aagggattctcttgtccaacctgaa

SEQ ID NO: 47911 - DNA, 25 bp, Rattus norvegicus
aagggattgcaaccatcctacccac

SEQ ID NO: 47912 - DNA, 25 bp, Rattus norvegicus
aagggattgcaagcatcctacccac

SEQ ID NO: 47913 - DNA, 25 bp, Rattus norvegicus
aagggattgctgacatttccccagc

SEQ ID NO: 47914 - DNA, 25 bp, Rattus norvegicus
aagggattgctgtcatttccccagc

SEQ ID NO: 47915 - DNA, 25 bp, Rattus norvegicus
aagggattgggcaatgaccgtccat

SEQ ID NO: 47916 - DNA, 25 bp, Rattus norvegicus
aagggattgggctatgaccgtccat

SEQ ID NO: 47917 - DNA, 25 bp, Rattus norvegicus
aagggattgtgacgtctgtatgtaa

SEQ ID NO: 47918 - DNA, 25 bp, Rattus norvegicus
aagggattgtgaggtctgtatgtaa

SEQ ID NO: 47919 - DNA, 25 bp, Rattus norvegicus
aagggatttgttatgtctgtaaagt

SEQ ID NO: 47920 - DNA, 25 bp, Rattus norvegicus
aagggatttgttttgtctgtaaagt

SEQ ID NO: 47921 - DNA, 25 bp, Rattus norvegicus
aagggattttgtcatgtccgccaga

SEQ ID NO: 47922 - DNA, 25 bp, Rattus norvegicus
aagggattttgtgatgtccgccaga

SEQ ID NO: 47923 - DNA, 25 bp, Rattus norvegicus
aagggcaaactcatcctttagccac

SEQ ID NO: 47924 - DNA, 25 bp, Rattus norvegicus
aagggcaaactcttcctttagccac

SEQ ID NO: 47925 - DNA, 25 bp, Rattus norvegicus
aagggcaaactgagcttgtcatgaa

SEQ ID NO: 47926 - DNA, 25 bp, Rattus norvegicus
aagggcaaactgtgcttgtcatgaa

SEQ ID NO: 47927 - DNA, 25 bp, Rattus norvegicus
aagggcaacttacagctttctccag

SEQ ID NO: 47928 - DNA, 25 bp, Rattus norvegicus
aagggcaacttagagctttctccag

SEQ ID NO: 47929 - DNA, 25 bp, Rattus norvegicus
aagggcaacttcagatgtgaccaca

SEQ ID NO: 47930 - DNA, 25 bp, Rattus norvegicus
aagggcaacttctgatgtgaccaca

SEQ ID NO: 47931 - DNA, 25 bp, Rattus norvegicus
aagggcaattgaagctggccttccc

SEQ ID NO: 47932 - DNA, 25 bp, Rattus norvegicus
aagggcaattgatgctggccttccc

SEQ ID NO: 47933 - DNA, 25 bp, Rattus norvegicus
aagggcacaaaccaagaatggcaag

SEQ ID NO: 47934 - DNA, 25 bp, Rattus norvegicus
aagggcacaaacgaagaatggcaag

SEQ ID NO: 47935 - DNA, 25 bp, Rattus norvegicus
aagggcacaaccatggctgactctg

SEQ ID NO: 47936 - DNA, 25 bp, Rattus norvegicus
aagggcacaaccttggctgactctg

SEQ ID NO: 47937 - DNA, 25 bp, Rattus norvegicus
aagggcacacacaggcctgccttgg

SEQ ID NO: 47938 - DNA, 25 bp, Rattus norvegicus
aagggcacacactggcctgccttgg

SEQ ID NO: 47939 - DNA, 25 bp, Rattus norvegicus
aagggcacagaacccttcctggaat

SEQ ID NO: 47940 - DNA, 25 bp, Rattus norvegicus
aagggcacagaagccttcctggaat

SEQ ID NO: 47941 - DNA, 25 bp, Rattus norvegicus
aagggcacccagaagccagatgtgg

SEQ ID NO: 47942 - DNA, 25 bp, Rattus norvegicus
aagggcacccagtagccagatgtgg

SEQ ID NO: 47943 - DNA, 25 bp, Rattus norvegicus
aagggcaccctacaaccagagagca

SEQ ID NO: 47944 - DNA, 25 bp, Rattus norvegicus
aagggcaccctagaaccagagagca

SEQ ID NO: 47945 - DNA, 25 bp, Rattus norvegicus
aagggcacgcacatcaattttgcaa

SEQ ID NO: 47946 - DNA, 25 bp, Rattus norvegicus
aagggcacgcacttcaattttgcaa

SEQ ID NO: 47947 - DNA, 25 bp, Rattus norvegicus
aagggcacgctgagacgccatgacg

SEQ ID NO: 47948 - DNA, 25 bp, Rattus norvegicus
aagggcacgctgtgacgccatgacg

SEQ ID NO: 47949 - DNA, 25 bp, Rattus norvegicus
aagggcacgggcacatttccacatg

SEQ ID NO: 47950 - DNA, 25 bp, Rattus norvegicus
aagggcacgggctcatttccacatg

SEQ ID NO: 47951 - DNA, 25 bp, Rattus norvegicus
aagggcactgggatctggagacaca

SEQ ID NO: 47952 - DNA, 25 bp, Rattus norvegicus
aagggcactgggttctggagacaca

SEQ ID NO: 47953 - DNA, 25 bp, Rattus norvegicus
aagggcactttactagttagaatca

SEQ ID NO: 47954 - DNA, 25 bp, Rattus norvegicus
aagggcactttagtagttagaatca

SEQ ID NO: 47955 - DNA, 25 bp, Rattus norvegicus
aagggcagacacaaactccaacact

SEQ ID NO: 47956 - DNA, 25 bp, Rattus norvegicus
aagggcagacactaactccaacact

SEQ ID NO: 47957 - DNA, 25 bp, Rattus norvegicus
aagggcagacagcactgtgttctcc

SEQ ID NO: 47958 - DNA, 25 bp, Rattus norvegicus
aagggcagacaggactgtgttctcc

SEQ ID NO: 47959 - DNA, 25 bp, Rattus norvegicus
aagggcagacatatttctccaagaa

SEQ ID NO: 47960 - DNA, 25 bp, Rattus norvegicus
aagggcagacatttttctccaagaa

SEQ ID NO: 47961 - DNA, 25 bp, Rattus norvegicus
aagggcagacggaacatgtcccagc

SEQ ID NO: 47962 - DNA, 25 bp, Rattus norvegicus
aagggcagacggtacatgtcccagc

SEQ ID NO: 47963 - DNA, 25 bp, Rattus norvegicus
aagggcagagatcctttccctgtgg

SEQ ID NO: 47964 - DNA, 25 bp, Rattus norvegicus
aagggcagagatgctttccctgtgg

SEQ ID NO: 47965 - DNA, 25 bp, Rattus norvegicus
aagggcagagccagaatgcattcat

SEQ ID NO: 47966 - DNA, 25 bp, Rattus norvegicus
aagggcagagcctgaatgcattcat

SEQ ID NO: 47967 - DNA, 25 bp, Rattus norvegicus
aagggcagagctcccactgtgtttc

SEQ ID NO: 47968 - DNA, 25 bp, Rattus norvegicus
aagggcagagctgccactgtgtttc

SEQ ID NO: 47969 - DNA, 25 bp, Rattus norvegicus
aagggcagcagtaatgtcatcctga

SEQ ID NO: 47970 - DNA, 25 bp, Rattus norvegicus
aagggcagcagttatgtcatcctga

SEQ ID NO: 47971 - DNA, 25 bp, Rattus norvegicus
aagggcagcatcaaggccatctgtg

SEQ ID NO: 47972 - DNA, 25 bp, Rattus norvegicus
aagggcagcatctaggccatctgtg

SEQ ID NO: 47973 - DNA, 25 bp, Rattus norvegicus
aagggcagcattccagtcgcaggca

SEQ ID NO: 47974 - DNA, 25 bp, Rattus norvegicus
aagggcagcattgcagtcgcaggca

SEQ ID NO: 47975 - DNA, 25 bp, Rattus norvegicus
aagggcagccccatcaggaaggaca

SEQ ID NO: 47976 - DNA, 25 bp, Rattus norvegicus
aagggcagccccttcaggaaggaca

SEQ ID NO: 47977 - DNA, 25 bp, Rattus norvegicus
aagggcagcctgagctcatagtaag

SEQ ID NO: 47978 - DNA, 25 bp, Rattus norvegicus
aagggcagcctgtgctcatagtaag

SEQ ID NO: 47979 - DNA, 25 bp, Rattus norvegicus
aagggcagccttccagctcatatct

SEQ ID NO: 47980 - DNA, 25 bp, Rattus norvegicus
aagggcagccttcttaaatgacaga

SEQ ID NO: 47981 - DNA, 25 bp, Rattus norvegicus
aagggcagccttgcagctcatatct

SEQ ID NO: 47982 - DNA, 25 bp, Rattus norvegicus
aagggcagccttgttaaatgacaga

SEQ ID NO: 47983 - DNA, 25 bp, Rattus norvegicus
aagggcagcgctacctggtgagcat

SEQ ID NO: 47984 - DNA, 25 bp, Rattus norvegicus
aagggcagcgcttcctggtgagcat

SEQ ID NO: 47985 - DNA, 25 bp, Rattus norvegicus
aagggcagcgttagatgtgacattt

SEQ ID NO: 47986 - DNA, 25 bp, Rattus norvegicus
aagggcagcgtttgatgtgacattt

SEQ ID NO: 47987 - DNA, 25 bp, Rattus norvegicus
aagggcagctctctcctcataagac

SEQ ID NO: 47988 - DNA, 25 bp, Rattus norvegicus
aagggcagctctgtcctcataagac

SEQ ID NO: 47989 - DNA, 25 bp, Rattus norvegicus
aagggcagctgcaatttattttcct

SEQ ID NO: 47990 - DNA, 25 bp, Rattus norvegicus
aagggcagctgctatttattttcct

SEQ ID NO: 47991 - DNA, 25 bp, Rattus norvegicus
aagggcagctggactgcactggcct

SEQ ID NO: 47992 - DNA, 25 bp, Rattus norvegicus
aagggcagctggtctgcactggcct

SEQ ID NO: 47993 - DNA, 25 bp, Rattus norvegicus
aagggcaggaacactttgacacaga

SEQ ID NO: 47994 - DNA, 25 bp, Rattus norvegicus
aagggcaggaactctttgacacaga

SEQ ID NO: 47995 - DNA, 25 bp, Rattus norvegicus
aagggcaggacacaacccactccta

SEQ ID NO: 47996 - DNA, 25 bp, Rattus norvegicus
aagggcaggacacaggtctccagct

SEQ ID NO: 47997 - DNA, 25 bp, Rattus norvegicus
aagggcaggacagaacccactccta

SEQ ID NO: 47998 - DNA, 25 bp, Rattus norvegicus
aagggcaggacagaggtctccagct

SEQ ID NO: 47999 - DNA, 25 bp, Rattus norvegicus
aagggcaggactactatgggatgaa

SEQ ID NO: 48000 - DNA, 25 bp, Rattus norvegicus
aagggcaggacttctatgggatgaa

SEQ ID NO: 48001 - DNA, 25 bp, Rattus norvegicus
aagggcaggcagaagtcacacttac

SEQ ID NO: 48002 - DNA, 25 bp, Rattus norvegicus
aagggcaggcagtagtcacacttac

SEQ ID NO: 48003 - DNA, 25 bp, Rattus norvegicus
aagggcaggcctcgctcatattaaa

SEQ ID NO: 48004 - DNA, 25 bp, Rattus norvegicus
aagggcaggcctggctcatattaaa

SEQ ID NO: 48005 - DNA, 25 bp, Rattus norvegicus
aagggcaggctgattatcaccactg

SEQ ID NO: 48006 - DNA, 25 bp, Rattus norvegicus
aagggcaggctgtttatcaccactg

SEQ ID NO: 48007 - DNA, 25 bp, Rattus norvegicus
aagggcagggacacctcagtgcaaa

SEQ ID NO: 48008 - DNA, 25 bp, Rattus norvegicus
aagggcagggactcctcagtgcaaa

SEQ ID NO: 48009 - DNA, 25 bp, Rattus norvegicus
aagggcaggtccatggcaggccact

SEQ ID NO: 48010 - DNA, 25 bp, Rattus norvegicus
aagggcaggtccttggcaggccact

SEQ ID NO: 48011 - DNA, 25 bp, Rattus norvegicus
aagggcagtgagcacattgtctcca

SEQ ID NO: 48012 - DNA, 25 bp, Rattus norvegicus
aagggcagtgaggacattgtctcca

SEQ ID NO: 48013 - DNA, 25 bp, Rattus norvegicus
aagggcagtggcaggctcaacatca

SEQ ID NO: 48014 - DNA, 25 bp, Rattus norvegicus
aagggcagtggctggctcaacatca

SEQ ID NO: 48015 - DNA, 25 bp, Rattus norvegicus
aagggcagttgaatgtcaccagcaa

SEQ ID NO: 48016 - DNA, 25 bp, Rattus norvegicus
aagggcagttgattgtcaccagcaa

SEQ ID NO: 48017 - DNA, 25 bp, Rattus norvegicus
aagggcatagttccactctgtttta

SEQ ID NO: 48018 - DNA, 25 bp, Rattus norvegicus
aagggcatagttgcactctgtttta

SEQ ID NO: 48019 - DNA, 25 bp, Rattus norvegicus
aagggcatattcctcagatctgtcc

SEQ ID NO: 48020 - DNA, 25 bp, Rattus norvegicus
aagggcatattcgtcagatctgtcc

SEQ ID NO: 48021 - DNA, 25 bp, Rattus norvegicus
aagggcatcaccaagagaccagtca

SEQ ID NO: 48022 - DNA, 25 bp, Rattus norvegicus
aagggcatcacctagagaccagtca

SEQ ID NO: 48023 - DNA, 25 bp, Rattus norvegicus
aagggcatcctgaaccaagaagtga

SEQ ID NO: 48024 - DNA, 25 bp, Rattus norvegicus
aagggcatcctgcgctacactgagg

SEQ ID NO: 48025 - DNA, 25 bp, Rattus norvegicus
aagggcatcctgggctacactgagg

SEQ ID NO: 48026 - DNA, 25 bp, Rattus norvegicus
aagggcatcctgtaccaagaagtga

SEQ ID NO: 48027 - DNA, 25 bp, Rattus norvegicus
aagggcatccttcggccaactatcc

SEQ ID NO: 48028 - DNA, 25 bp, Rattus norvegicus
aagggcatccttgggccaactatcc

SEQ ID NO: 48029 - DNA, 25 bp, Rattus norvegicus
aagggcatcgacactcatcagtgac

SEQ ID NO: 48030 - DNA, 25 bp, Rattus norvegicus
aagggcatcgactctcatcagtgac

SEQ ID NO: 48031 - DNA, 25 bp, Rattus norvegicus
aagggcatctgacccgtgctatttg

SEQ ID NO: 48032 - DNA, 25 bp, Rattus norvegicus
aagggcatctgagccgtgctatttg

SEQ ID NO: 48033 - DNA, 25 bp, Rattus norvegicus
aagggcatcttccagtgacgctagt

SEQ ID NO: 48034 - DNA, 25 bp, Rattus norvegicus
aagggcatcttcgagtgacgctagt

SEQ ID NO: 48035 - DNA, 25 bp, Rattus norvegicus
aagggcatgcagaaccgacagcggc

SEQ ID NO: 48036 - DNA, 25 bp, Rattus norvegicus
aagggcatgcagcatcccgagactc

SEQ ID NO: 48037 - DNA, 25 bp, Rattus norvegicus
aagggcatgcaggatcccgagactc

SEQ ID NO: 48038 - DNA, 25 bp, Rattus norvegicus
aagggcatgcagtaccgacagcggc

SEQ ID NO: 48039 - DNA, 25 bp, Rattus norvegicus
aagggcatgggaatgcagctttaaa

SEQ ID NO: 48040 - DNA, 25 bp, Rattus norvegicus
aagggcatgggattgcagctttaaa

SEQ ID NO: 48041 - DNA, 25 bp, Rattus norvegicus
aagggcattcgaatgtgagcgccca

SEQ ID NO: 48042 - DNA, 25 bp, Rattus norvegicus
aagggcattcgattgtgagcgccca

SEQ ID NO: 48043 - DNA, 25 bp, Rattus norvegicus
aagggcattgccaccagaagggatt

SEQ ID NO: 48044 - DNA, 25 bp, Rattus norvegicus
aagggcattgcctccagaagggatt

SEQ ID NO: 48045 - DNA, 25 bp, Rattus norvegicus
aagggcattgctctccaggtattcc

SEQ ID NO: 48046 - DNA, 25 bp, Rattus norvegicus
aagggcattgctgtccaggtattcc

SEQ ID NO: 48047 - DNA, 25 bp, Rattus norvegicus
aagggcatttcactaccactgagga

SEQ ID NO: 48048 - DNA, 25 bp, Rattus norvegicus
aagggcatttcagtaccactgagga

SEQ ID NO: 48049 - DNA, 25 bp, Rattus norvegicus
aagggccaacctcagacgttagact

SEQ ID NO: 48050 - DNA, 25 bp, Rattus norvegicus
aagggccaacctgagacgttagact

SEQ ID NO: 48051 - DNA, 25 bp, Rattus norvegicus
aagggccaacttacacagagatttc

SEQ ID NO: 48052 - DNA, 25 bp, Rattus norvegicus
aagggccaactttcacagagatttc

SEQ ID NO: 48053 - DNA, 25 bp, Rattus norvegicus
aagggccaaggacctcaaagtcaga

SEQ ID NO: 48054 - DNA, 25 bp, Rattus norvegicus
aagggccaaggagctcaaagtcaga

SEQ ID NO: 48055 - DNA, 25 bp, Rattus norvegicus
aagggccaagttacaggtctccgct

SEQ ID NO: 48056 - DNA, 25 bp, Rattus norvegicus
aagggccaagtttcaggtctccgct

SEQ ID NO: 48057 - DNA, 25 bp, Rattus norvegicus
aagggccacagccaattgtggtgac

SEQ ID NO: 48058 - DNA, 25 bp, Rattus norvegicus
aagggccacagcgaattgtggtgac

SEQ ID NO: 48059 - DNA, 25 bp, Rattus norvegicus
aagggccacaggctaatgccacggc

SEQ ID NO: 48060 - DNA, 25 bp, Rattus norvegicus
aagggccacagggtaatgccacggc

SEQ ID NO: 48061 - DNA, 25 bp, Rattus norvegicus
aagggccacatgaacttgggctcca

SEQ ID NO: 48062 - DNA, 25 bp, Rattus norvegicus
aagggccacatgtacttgggctcca

SEQ ID NO: 48063 - DNA, 25 bp, Rattus norvegicus
aagggccactatagactggctgcct

SEQ ID NO: 48064 - DNA, 25 bp, Rattus norvegicus
aagggccactattgactggctgcct

SEQ ID NO: 48065 - DNA, 25 bp, Rattus norvegicus
aagggccagacgctcatcaatttgt

SEQ ID NO: 48066 - DNA, 25 bp, Rattus norvegicus
aagggccagacggtcatcaatttgt

SEQ ID NO: 48067 - DNA, 25 bp, Rattus norvegicus
aagggccagagcacgaatggaagac

SEQ ID NO: 48068 - DNA, 25 bp, Rattus norvegicus
aagggccagagcatctaccagaggt

SEQ ID NO: 48069 - DNA, 25 bp, Rattus norvegicus
aagggccagagctcgaatggaagac

SEQ ID NO: 48070 - DNA, 25 bp, Rattus norvegicus
aagggccagagcttctaccagaggt

SEQ ID NO: 48071 - DNA, 25 bp, Rattus norvegicus
aagggccagccaagactgttcctgg

SEQ ID NO: 48072 - DNA, 25 bp, Rattus norvegicus
aagggccagccatgactgttcctgg

SEQ ID NO: 48073 - DNA, 25 bp, Rattus norvegicus
aagggccagcctacttagcatccag

SEQ ID NO: 48074 - DNA, 25 bp, Rattus norvegicus
aagggccagccttcttagcatccag

SEQ ID NO: 48075 - DNA, 25 bp, Rattus norvegicus
aagggccagcgacagctcaccggac

SEQ ID NO: 48076 - DNA, 25 bp, Rattus norvegicus
aagggccagcgactgccttcatttt

SEQ ID NO: 48077 - DNA, 25 bp, Rattus norvegicus
aagggccagcgagagctcaccggac

SEQ ID NO: 48078 - DNA, 25 bp, Rattus norvegicus
aagggccagcgagtgccttcatttt

SEQ ID NO: 48079 - DNA, 25 bp, Rattus norvegicus
aagggccagcggatttcttcctgag

SEQ ID NO: 48080 - DNA, 25 bp, Rattus norvegicus
aagggccagcggttttcttcctgag

SEQ ID NO: 48081 - DNA, 25 bp, Rattus norvegicus
aagggccaggcacaagaccctggct

SEQ ID NO: 48082 - DNA, 25 bp, Rattus norvegicus
aagggccaggcagaagaccctggct

SEQ ID NO: 48083 - DNA, 25 bp, Rattus norvegicus
aagggccaggccaagtgtttgagaa

SEQ ID NO: 48084 - DNA, 25 bp, Rattus norvegicus
aagggccaggcctagtgtttgagaa

SEQ ID NO: 48085 - DNA, 25 bp, Rattus norvegicus
aagggccagggcacactcaataaag

SEQ ID NO: 48086 - DNA, 25 bp, Rattus norvegicus
aagggccagggctcactcaataaag

SEQ ID NO: 48087 - DNA, 25 bp, Rattus norvegicus
aagggccagggtactgtgtcagcct

SEQ ID NO: 48088 - DNA, 25 bp, Rattus norvegicus
aagggccagggttctgtgtcagcct

SEQ ID NO: 48089 - DNA, 25 bp, Rattus norvegicus
aagggccagtcaatcccaaaggtca

SEQ ID NO: 48090 - DNA, 25 bp, Rattus norvegicus
aagggccagtcattcccaaaggtca

SEQ ID NO: 48091 - DNA, 25 bp, Rattus norvegicus
aagggccagtgacccttactccaat

SEQ ID NO: 48092 - DNA, 25 bp, Rattus norvegicus
aagggccagtgagccttactccaat

SEQ ID NO: 48093 - DNA, 25 bp, Rattus norvegicus
aagggccatcatctgagtcttccat

SEQ ID NO: 48094 - DNA, 25 bp, Rattus norvegicus
aagggccatcatgtgagtcttccat

SEQ ID NO: 48095 - DNA, 25 bp, Rattus norvegicus
aagggccatggcaacaaccaggcaa

SEQ ID NO: 48096 - DNA, 25 bp, Rattus norvegicus
aagggccatggctacaaccaggcaa

SEQ ID NO: 48097 - DNA, 25 bp, Rattus norvegicus
aagggcccaagcaccgcagcaaagc

SEQ ID NO: 48098 - DNA, 25 bp, Rattus norvegicus
aagggcccaagctccgcagcaaagc

SEQ ID NO: 48099 - DNA, 25 bp, Rattus norvegicus
aagggcccactgaagacagctgctt

SEQ ID NO: 48100 - DNA, 25 bp, Rattus norvegicus
aagggcccactgtagacagctgctt

SEQ ID NO: 48101 - DNA, 25 bp, Rattus norvegicus
aagggcccagcactgcatctgttgg

SEQ ID NO: 48102 - DNA, 25 bp, Rattus norvegicus
aagggcccagcagtgcatctgttgg

SEQ ID NO: 48103 - DNA, 25 bp, Rattus norvegicus
aagggcccagccatttggttctgta

SEQ ID NO: 48104 - DNA, 25 bp, Rattus norvegicus
aagggcccagccttttggttctgta

SEQ ID NO: 48105 - DNA, 25 bp, Rattus norvegicus
aagggcccaggacaatctagacaga

SEQ ID NO: 48106 - DNA, 25 bp, Rattus norvegicus
aagggcccaggagaatctagacaga

SEQ ID NO: 48107 - DNA, 25 bp, Rattus norvegicus
aagggcccagtaaggcttcgaggct

SEQ ID NO: 48108 - DNA, 25 bp, Rattus norvegicus
aagggcccagtatggcttcgaggct

SEQ ID NO: 48109 - DNA, 25 bp, Rattus norvegicus
aagggcccatacagtggtccaattg

SEQ ID NO: 48110 - DNA, 25 bp, Rattus norvegicus
aagggcccatactgtggtccaattg

SEQ ID NO: 48111 - DNA, 25 bp, Rattus norvegicus
aagggcccatatcatctgcttggca

SEQ ID NO: 48112 - DNA, 25 bp, Rattus norvegicus
aagggcccatatgatctgcttggca

SEQ ID NO: 48113 - DNA, 25 bp, Rattus norvegicus
aagggcccattaacaatttcctcct

SEQ ID NO: 48114 - DNA, 25 bp, Rattus norvegicus
aagggcccattatcaatttcctcct

SEQ ID NO: 48115 - DNA, 25 bp, Rattus norvegicus
aagggcccatttctttggactcagc

SEQ ID NO: 48116 - DNA, 25 bp, Rattus norvegicus
aagggcccatttgtttggactcagc

SEQ ID NO: 48117 - DNA, 25 bp, Rattus norvegicus
aagggccccaacagtttcacatgga

SEQ ID NO: 48118 - DNA, 25 bp, Rattus norvegicus
aagggccccaactgtttcacatgga

SEQ ID NO: 48119 - DNA, 25 bp, Rattus norvegicus
aagggccccaggaagcagcaggaat

SEQ ID NO: 48120 - DNA, 25 bp, Rattus norvegicus
aagggccccaggagtccaaggacag

SEQ ID NO: 48121 - DNA, 25 bp, Rattus norvegicus
aagggccccaggtagcagcaggaat

SEQ ID NO: 48122 - DNA, 25 bp, Rattus norvegicus
aagggccccaggtgtccaaggacag

SEQ ID NO: 48123 - DNA, 25 bp, Rattus norvegicus
aagggccccagtcaggatcatttgt

SEQ ID NO: 48124 - DNA, 25 bp, Rattus norvegicus
aagggccccagtgaggatcatttgt

SEQ ID NO: 48125 - DNA, 25 bp, Rattus norvegicus
aagggccccggtagttcttgcagag

SEQ ID NO: 48126 - DNA, 25 bp, Rattus norvegicus
aagggccccggttgttcttgcagag

SEQ ID NO: 48127 - DNA, 25 bp, Rattus norvegicus
aagggcccgtgcagctagtgatcag

SEQ ID NO: 48128 - DNA, 25 bp, Rattus norvegicus
aagggcccgtgctgctagtgatcag

SEQ ID NO: 48129 - DNA, 25 bp, Rattus norvegicus
aagggccctgagctcctggatttca

SEQ ID NO: 48130 - DNA, 25 bp, Rattus norvegicus
aagggccctgaggtcctggatttca

SEQ ID NO: 48131 - DNA, 25 bp, Rattus norvegicus
aagggccctgcaaactctgcggaat

SEQ ID NO: 48132 - DNA, 25 bp, Rattus norvegicus
aagggccctgcatactctgcggaat

SEQ ID NO: 48133 - DNA, 25 bp, Rattus norvegicus
aagggccctgctcaggctatagcct

SEQ ID NO: 48134 - DNA, 25 bp, Rattus norvegicus
aagggccctgctgaggctatagcct

SEQ ID NO: 48135 - DNA, 25 bp, Rattus norvegicus
aagggccctgtcagtactgtagaga

SEQ ID NO: 48136 - DNA, 25 bp, Rattus norvegicus
aagggccctgtctgtactgtagaga

SEQ ID NO: 48137 - DNA, 25 bp, Rattus norvegicus
aagggccctgtgaactctggccaag

SEQ ID NO: 48138 - DNA, 25 bp, Rattus norvegicus
aagggccctgtgtactctggccaag

SEQ ID NO: 48139 - DNA, 25 bp, Rattus norvegicus
aagggccctgttactttcacattgt

SEQ ID NO: 48140 - DNA, 25 bp, Rattus norvegicus
aagggccctgtttctttcacattgt

SEQ ID NO: 48141 - DNA, 25 bp, Rattus norvegicus
aagggccctttgagcagcagcagtg

SEQ ID NO: 48142 - DNA, 25 bp, Rattus norvegicus
aagggccctttgtgcagcagcagtg

SEQ ID NO: 48143 - DNA, 25 bp, Rattus norvegicus
aagggccgcggccatgtgcaaccaa

SEQ ID NO: 48144 - DNA, 25 bp, Rattus norvegicus
aagggccgcggcgatgtgcaaccaa

SEQ ID NO: 48145 - DNA, 25 bp, Rattus norvegicus
aagggccgctacacactagatgtgt

SEQ ID NO: 48146 - DNA, 25 bp, Rattus norvegicus
aagggccgctactcactagatgtgt

SEQ ID NO: 48147 - DNA, 25 bp, Rattus norvegicus
aagggccgcttcctcaagatcgccg

SEQ ID NO: 48148 - DNA, 25 bp, Rattus norvegicus
aagggccgcttcgtcaagatcgccg

SEQ ID NO: 48149 - DNA, 25 bp, Rattus norvegicus
aagggccggatgaggagaccctctt

SEQ ID NO: 48150 - DNA, 25 bp, Rattus norvegicus
aagggccggatgtggagaccctctt

SEQ ID NO: 48151 - DNA, 25 bp, Rattus norvegicus
aagggccgtgataccataactcatg

SEQ ID NO: 48152 - DNA, 25 bp, Rattus norvegicus
aagggccgtgattccataactcatg

SEQ ID NO: 48153 - DNA, 25 bp, Rattus norvegicus
aagggccgtggcatgatttcacata

SEQ ID NO: 48154 - DNA, 25 bp, Rattus norvegicus
aagggccgtggcttgatttcacata

SEQ ID NO: 48155 - DNA, 25 bp, Rattus norvegicus
aagggcctaatgctgtttgccttgc

SEQ ID NO: 48156 - DNA, 25 bp, Rattus norvegicus
aagggcctaatggtgtttgccttgc

SEQ ID NO: 48157 - DNA, 25 bp, Rattus norvegicus
aagggcctagccaggacagttcaga

SEQ ID NO: 48158 - DNA, 25 bp, Rattus norvegicus
aagggcctagcctggacagttcaga

SEQ ID NO: 48159 - DNA, 25 bp, Rattus norvegicus
aagggcctaggaaagtgtccagcct

SEQ ID NO: 48160 - DNA, 25 bp, Rattus norvegicus
aagggcctaggatagtgtccagcct

SEQ ID NO: 48161 - DNA, 25 bp, Rattus norvegicus
aagggcctatatactcagtctcact

SEQ ID NO: 48162 - DNA, 25 bp, Rattus norvegicus
aagggcctatattctcagtctcact

SEQ ID NO: 48163 - DNA, 25 bp, Rattus norvegicus
aagggcctcagaagacatcccactt

SEQ ID NO: 48164 - DNA, 25 bp, Rattus norvegicus
aagggcctcagatgacatcccactt

SEQ ID NO: 48165 - DNA, 25 bp, Rattus norvegicus
aagggcctgaagaatgagtggattt

SEQ ID NO: 48166 - DNA, 25 bp, Rattus norvegicus
aagggcctgaagtatgagtggattt

SEQ ID NO: 48167 - DNA, 25 bp, Rattus norvegicus
aagggcctgactatcgtctctgtgc

SEQ ID NO: 48168 - DNA, 25 bp, Rattus norvegicus
aagggcctgactttcgtctctgtgc

SEQ ID NO: 48169 - DNA, 25 bp, Rattus norvegicus
aagggcctgatgatctttcttattc

SEQ ID NO: 48170 - DNA, 25 bp, Rattus norvegicus
aagggcctgatgttctttcttattc

SEQ ID NO: 48171 - DNA, 25 bp, Rattus norvegicus
aagggcctgcaccaagttgcttttg

SEQ ID NO: 48172 - DNA, 25 bp, Rattus norvegicus
aagggcctgcacgaagttgcttttg

SEQ ID NO: 48173 - DNA, 25 bp, Rattus norvegicus
aagggcctgctcactactaagggaa

SEQ ID NO: 48174 - DNA, 25 bp, Rattus norvegicus
aagggcctgctcagtctaaacactg

SEQ ID NO: 48175 - DNA, 25 bp, Rattus norvegicus
aagggcctgctctctactaagggaa

SEQ ID NO: 48176 - DNA, 25 bp, Rattus norvegicus
aagggcctgctctgtctaaacactg

SEQ ID NO: 48177 - DNA, 25 bp, Rattus norvegicus
aagggcctggaaccatctgagttca

SEQ ID NO: 48178 - DNA, 25 bp, Rattus norvegicus
aagggcctggaagcatctgagttca

SEQ ID NO: 48179 - DNA, 25 bp, Rattus norvegicus
aagggcctggagaacattgactaag

SEQ ID NO: 48180 - DNA, 25 bp, Rattus norvegicus
aagggcctggagtacattgactaag

SEQ ID NO: 48181 - DNA, 25 bp, Rattus norvegicus
aagggcctggcaactatactttact

SEQ ID NO: 48182 - DNA, 25 bp, Rattus norvegicus
aagggcctggcatctatactttact

SEQ ID NO: 48183 - DNA, 25 bp, Rattus norvegicus
aagggcctggccaggtagactctta

SEQ ID NO: 48184 - DNA, 25 bp, Rattus norvegicus
aagggcctggcctggtagactctta

SEQ ID NO: 48185 - DNA, 25 bp, Rattus norvegicus
aagggcctgggcatctactcgctgg

SEQ ID NO: 48186 - DNA, 25 bp, Rattus norvegicus
aagggcctgggcttctactcgctgg

SEQ ID NO: 48187 - DNA, 25 bp, Rattus norvegicus
aagggcctggtccaattgacttttg

SEQ ID NO: 48188 - DNA, 25 bp, Rattus norvegicus
aagggcctggtcgaattgacttttg

SEQ ID NO: 48189 - DNA, 25 bp, Rattus norvegicus
aagggccttcggaaacgcaacgcag

SEQ ID NO: 48190 - DNA, 25 bp, Rattus norvegicus
aagggccttcggtaacgcaacgcag

SEQ ID NO: 48191 - DNA, 25 bp, Rattus norvegicus
aagggccttctcagcaggagcgata

SEQ ID NO: 48192 - DNA, 25 bp, Rattus norvegicus
aagggccttctctgcaggagcgata

SEQ ID NO: 48193 - DNA, 25 bp, Rattus norvegicus
aagggccttcttactgtggtgctat

SEQ ID NO: 48194 - DNA, 25 bp, Rattus norvegicus
aagggccttctttctgtggtgctat

SEQ ID NO: 48195 - DNA, 25 bp, Rattus norvegicus
aagggcctttctccttatgaactag

SEQ ID NO: 48196 - DNA, 25 bp, Rattus norvegicus
aagggcctttctgcttatgaactag

SEQ ID NO: 48197 - DNA, 25 bp, Rattus norvegicus
aagggcgacggcaatgcacacagta

SEQ ID NO: 48198 - DNA, 25 bp, Rattus norvegicus
aagggcgacggctatgcacacagta

SEQ ID NO: 48199 - DNA, 25 bp, Rattus norvegicus
aagggcgagggtaccaggcatatct

SEQ ID NO: 48200 - DNA, 25 bp, Rattus norvegicus
aagggcgagggttccaggcatatct

SEQ ID NO: 48201 - DNA, 25 bp, Rattus norvegicus
aagggcgagtctcctcttgagcaac

SEQ ID NO: 48202 - DNA, 25 bp, Rattus norvegicus
aagggcgagtctgctcttgagcaac

SEQ ID NO: 48203 - DNA, 25 bp, Rattus norvegicus
aagggcgatgtaatctcggccgtca

SEQ ID NO: 48204 - DNA, 25 bp, Rattus norvegicus
aagggcgatgtattctcggccgtca

SEQ ID NO: 48205 - DNA, 25 bp, Rattus norvegicus
aagggcgcacctctaataggacaaa

SEQ ID NO: 48206 - DNA, 25 bp, Rattus norvegicus
aagggcgcacctgtaataggacaaa

SEQ ID NO: 48207 - DNA, 25 bp, Rattus norvegicus
aagggcgcacggagccgggaccagc

SEQ ID NO: 48208 - DNA, 25 bp, Rattus norvegicus
aagggcgcacggtgccgggaccagc

SEQ ID NO: 48209 - DNA, 25 bp, Rattus norvegicus
aagggcgcagacatgaaggtattca

SEQ ID NO: 48210 - DNA, 25 bp, Rattus norvegicus
aagggcgcagacttgaaggtattca

SEQ ID NO: 48211 - DNA, 25 bp, Rattus norvegicus
aagggcgcagcactgcagagcatcc

SEQ ID NO: 48212 - DNA, 25 bp, Rattus norvegicus
aagggcgcagcagtgcagagcatcc

SEQ ID NO: 48213 - DNA, 25 bp, Rattus norvegicus
aagggcgcatcactccagagctgct

SEQ ID NO: 48214 - DNA, 25 bp, Rattus norvegicus
aagggcgcatcagtccagagctgct

SEQ ID NO: 48215 - DNA, 25 bp, Rattus norvegicus
aagggcggacagaacatcttggtaa

SEQ ID NO: 48216 - DNA, 25 bp, Rattus norvegicus
aagggcggacagtacatcttggtaa

SEQ ID NO: 48217 - DNA, 25 bp, Rattus norvegicus
aagggcggaccactaagcaatcaaa

SEQ ID NO: 48218 - DNA, 25 bp, Rattus norvegicus
aagggcggaccagtaagcaatcaaa

SEQ ID NO: 48219 - DNA, 25 bp, Rattus norvegicus
aagggcggccgcaggttgactaaat

SEQ ID NO: 48220 - DNA, 25 bp, Rattus norvegicus
aagggcggccgctggttgactaaat

SEQ ID NO: 48221 - DNA, 25 bp, Rattus norvegicus
aagggcgggacaactgacagccact

SEQ ID NO: 48222 - DNA, 25 bp, Rattus norvegicus
aagggcgggacatctgacagccact

SEQ ID NO: 48223 - DNA, 25 bp, Rattus norvegicus
aagggcgggctcagtgaggccggca

SEQ ID NO: 48224 - DNA, 25 bp, Rattus norvegicus
aagggcgggctctgtgaggccggca

SEQ ID NO: 48225 - DNA, 25 bp, Rattus norvegicus
aagggcgtctacagggctgtctgaa

SEQ ID NO: 48226 - DNA, 25 bp, Rattus norvegicus
aagggcgtctactgggctgtctgaa

SEQ ID NO: 48227 - DNA, 25 bp, Rattus norvegicus
aagggcgtgaacaccgtcaggctga

SEQ ID NO: 48228 - DNA, 25 bp, Rattus norvegicus
aagggcgtgaactccgtcaggctga

SEQ ID NO: 48229 - DNA, 25 bp, Rattus norvegicus
aagggcgtgtccattaatgcctcat

SEQ ID NO: 48230 - DNA, 25 bp, Rattus norvegicus
aagggcgtgtcctttaatgcctcat

SEQ ID NO: 48231 - DNA, 25 bp, Rattus norvegicus
aagggctaaggacacactccccatt

SEQ ID NO: 48232 - DNA, 25 bp, Rattus norvegicus
aagggctaaggagacactccccatt

SEQ ID NO: 48233 - DNA, 25 bp, Rattus norvegicus
aagggctaaggtactgttctgtcct

SEQ ID NO: 48234 - DNA, 25 bp, Rattus norvegicus
aagggctaaggttctgttctgtcct

SEQ ID NO: 48235 - DNA, 25 bp, Rattus norvegicus
aagggctaccatcccaacttctgtc

SEQ ID NO: 48236 - DNA, 25 bp, Rattus norvegicus
aagggctaccatgccaacttctgtc

SEQ ID NO: 48237 - DNA, 25 bp, Rattus norvegicus
aagggctaccttaccagagaagtca

SEQ ID NO: 48238 - DNA, 25 bp, Rattus norvegicus
aagggctacctttccagagaagtca

SEQ ID NO: 48239 - DNA, 25 bp, Rattus norvegicus
aagggctagaggcagatctacccaa

SEQ ID NO: 48240 - DNA, 25 bp, Rattus norvegicus
aagggctagagggagatctacccaa

SEQ ID NO: 48241 - DNA, 25 bp, Rattus norvegicus
aagggctagcttcgtgtcggattcc

SEQ ID NO: 48242 - DNA, 25 bp, Rattus norvegicus
aagggctagcttggtgtcggattcc

SEQ ID NO: 48243 - DNA, 25 bp, Rattus norvegicus
aagggctatagcatgctgacttcac

SEQ ID NO: 48244 - DNA, 25 bp, Rattus norvegicus
aagggctatagcttgctgacttcac

SEQ ID NO: 48245 - DNA, 25 bp, Rattus norvegicus
aagggctatcttactattcacatcc

SEQ ID NO: 48246 - DNA, 25 bp, Rattus norvegicus
aagggctatctttctattcacatcc

SEQ ID NO: 48247 - DNA, 25 bp, Rattus norvegicus
aagggctcacaaatcactgtcgggt

SEQ ID NO: 48248 - DNA, 25 bp, Rattus norvegicus
aagggctcacaattcactgtcgggt

SEQ ID NO: 48249 - DNA, 25 bp, Rattus norvegicus
aagggctcacctctgttgagcgagt

SEQ ID NO: 48250 - DNA, 25 bp, Rattus norvegicus
aagggctcacctgtgttgagcgagt

SEQ ID NO: 48251 - DNA, 25 bp, Rattus norvegicus
aagggctcactgatgccattttgtt

SEQ ID NO: 48252 - DNA, 25 bp, Rattus norvegicus
aagggctcactgttgccattttgtt

SEQ ID NO: 48253 - DNA, 25 bp, Rattus norvegicus
aagggctcagaaagacttaggcgaa

SEQ ID NO: 48254 - DNA, 25 bp, Rattus norvegicus
aagggctcagaatgacttaggcgaa

SEQ ID NO: 48255 - DNA, 25 bp, Rattus norvegicus
aagggctcagccacctcggcgagca

SEQ ID NO: 48256 - DNA, 25 bp, Rattus norvegicus
aagggctcagcctcctcggcgagca

SEQ ID NO: 48257 - DNA, 25 bp, Rattus norvegicus
aagggctcaggacctcaggaccact

SEQ ID NO: 48258 - DNA, 25 bp, Rattus norvegicus
aagggctcaggagctcaggaccact

SEQ ID NO: 48259 - DNA, 25 bp, Rattus norvegicus
aagggctcaggcacctggatccgct

SEQ ID NO: 48260 - DNA, 25 bp, Rattus norvegicus
aagggctcaggctcctggatccgct

SEQ ID NO: 48261 - DNA, 25 bp, Rattus norvegicus
aagggctcagggaagctcctaggca

SEQ ID NO: 48262 - DNA, 25 bp, Rattus norvegicus
aagggctcagggtagctcctaggca

SEQ ID NO: 48263 - DNA, 25 bp, Rattus norvegicus
aagggctcagtgcttgctgatatgt

SEQ ID NO: 48264 - DNA, 25 bp, Rattus norvegicus
aagggctcagtggttgctgatatgt

SEQ ID NO: 48265 - DNA, 25 bp, Rattus norvegicus
aagggctcattaacttcgctgaaac

SEQ ID NO: 48266 - DNA, 25 bp, Rattus norvegicus
aagggctcattatcttcgctgaaac

SEQ ID NO: 48267 - DNA, 25 bp, Rattus norvegicus
aagggctccaacactggctctgtat

SEQ ID NO: 48268 - DNA, 25 bp, Rattus norvegicus
aagggctccaactctggctctgtat

SEQ ID NO: 48269 - DNA, 25 bp, Rattus norvegicus
aagggctccatccttagagatgtcg

SEQ ID NO: 48270 - DNA, 25 bp, Rattus norvegicus
aagggctccatcgttagagatgtcg

SEQ ID NO: 48271 - DNA, 25 bp, Rattus norvegicus
aagggctccatgatggttcatttcc

SEQ ID NO: 48272 - DNA, 25 bp, Rattus norvegicus
aagggctccatgttggttcatttcc

SEQ ID NO: 48273 - DNA, 25 bp, Rattus norvegicus
aagggctcccaacccaacaggaggc

SEQ ID NO: 48274 - DNA, 25 bp, Rattus norvegicus
aagggctcccaagccaacaggaggc

SEQ ID NO: 48275 - DNA, 25 bp, Rattus norvegicus
aagggctcccagcactaattcatct

SEQ ID NO: 48276 - DNA, 25 bp, Rattus norvegicus
aagggctcccaggactaattcatct

SEQ ID NO: 48277 - DNA, 25 bp, Rattus norvegicus
aagggctcccgtcccaagaacatga

SEQ ID NO: 48278 - DNA, 25 bp, Rattus norvegicus
aagggctcccgtgccaagaacatga

SEQ ID NO: 48279 - DNA, 25 bp, Rattus norvegicus
aagggctccgtcagtttatatggaa

SEQ ID NO: 48280 - DNA, 25 bp, Rattus norvegicus
aagggctccgtctgtttatatggaa

SEQ ID NO: 48281 - DNA, 25 bp, Rattus norvegicus
aagggctcctctaaagacctcaaag

SEQ ID NO: 48282 - DNA, 25 bp, Rattus norvegicus
aagggctcctcttaagacctcaaag

SEQ ID NO: 48283 - DNA, 25 bp, Rattus norvegicus
aagggctcgaaccaaagtgacacta

SEQ ID NO: 48284 - DNA, 25 bp, Rattus norvegicus
aagggctcgaacgaaagtgacacta

SEQ ID NO: 48285 - DNA, 25 bp, Rattus norvegicus
aagggctcgctcagactatgttctt

SEQ ID NO: 48286 - DNA, 25 bp, Rattus norvegicus
aagggctcgctctgactatgttctt

SEQ ID NO: 48287 - DNA, 25 bp, Rattus norvegicus
aagggctctcacctagtactttgtt

SEQ ID NO: 48288 - DNA, 25 bp, Rattus norvegicus
aagggctctcacgtagtactttgtt

SEQ ID NO: 48289 - DNA, 25 bp, Rattus norvegicus
aagggctctgaacctcacatgagaa

SEQ ID NO: 48290 - DNA, 25 bp, Rattus norvegicus
aagggctctgaagctcacatgagaa

SEQ ID NO: 48291 - DNA, 25 bp, Rattus norvegicus
aagggctctggactcagtctagctt

SEQ ID NO: 48292 - DNA, 25 bp, Rattus norvegicus
aagggctctggagtcagtctagctt

SEQ ID NO: 48293 - DNA, 25 bp, Rattus norvegicus
aagggctctggtagctgaggtctct

SEQ ID NO: 48294 - DNA, 25 bp, Rattus norvegicus
aagggctctggttgctgaggtctct

SEQ ID NO: 48295 - DNA, 25 bp, Rattus norvegicus
aagggctctgttaagcgccacaggg

SEQ ID NO: 48296 - DNA, 25 bp, Rattus norvegicus
aagggctctgtttagcgccacaggg

SEQ ID NO: 48297 - DNA, 25 bp, Rattus norvegicus
aagggctcttgcctggtactctgta

SEQ ID NO: 48298 - DNA, 25 bp, Rattus norvegicus
aagggctcttgcgtggtactctgta

SEQ ID NO: 48299 - DNA, 25 bp, Rattus norvegicus
aagggctctttgctcagccttccag

SEQ ID NO: 48300 - DNA, 25 bp, Rattus norvegicus
aagggctctttggtcagccttccag

SEQ ID NO: 48301 - DNA, 25 bp, Rattus norvegicus
aagggctgagacagcttcatccggc

SEQ ID NO: 48302 - DNA, 25 bp, Rattus norvegicus
aagggctgagactgcttcatccggc

SEQ ID NO: 48303 - DNA, 25 bp, Rattus norvegicus
aagggctgagctccatgtctaaata

SEQ ID NO: 48304 - DNA, 25 bp, Rattus norvegicus
aagggctgagctgcatgtctaaata

SEQ ID NO: 48305 - DNA, 25 bp, Rattus norvegicus
aagggctgagtcattggcctttcaa

SEQ ID NO: 48306 - DNA, 25 bp, Rattus norvegicus
aagggctgagtctttggcctttcaa

SEQ ID NO: 48307 - DNA, 25 bp, Rattus norvegicus
aagggctgagttcacacctttccta

SEQ ID NO: 48308 - DNA, 25 bp, Rattus norvegicus
aagggctgagttgacacctttccta

SEQ ID NO: 48309 - DNA, 25 bp, Rattus norvegicus
aagggctgcaagactgtgttcacca

SEQ ID NO: 48310 - DNA, 25 bp, Rattus norvegicus
aagggctgcaagtctgtgttcacca

SEQ ID NO: 48311 - DNA, 25 bp, Rattus norvegicus
aagggctgcagaccagctttgccca

SEQ ID NO: 48312 - DNA, 25 bp, Rattus norvegicus
aagggctgcagagcagctttgccca

SEQ ID NO: 48313 - DNA, 25 bp, Rattus norvegicus
aagggctgcagcactacctgccctg

SEQ ID NO: 48314 - DNA, 25 bp, Rattus norvegicus
aagggctgcagctctacctgccctg

SEQ ID NO: 48315 - DNA, 25 bp, Rattus norvegicus
aagggctgcatcaagcttcttatct

SEQ ID NO: 48316 - DNA, 25 bp, Rattus norvegicus
aagggctgcatcagttccctggatg

SEQ ID NO: 48317 - DNA, 25 bp, Rattus norvegicus
aagggctgcatctagcttcttatct

SEQ ID NO: 48318 - DNA, 25 bp, Rattus norvegicus
aagggctgcatctgttccctggatg

SEQ ID NO: 48319 - DNA, 25 bp, Rattus norvegicus
aagggctgcccacgatgtctgtttt

SEQ ID NO: 48320 - DNA, 25 bp, Rattus norvegicus
aagggctgcccaggatgtctgtttt

SEQ ID NO: 48321 - DNA, 25 bp, Rattus norvegicus
aagggctgccttagcaatcatctgc

SEQ ID NO: 48322 - DNA, 25 bp, Rattus norvegicus
aagggctgcctttgcaatcatctgc

SEQ ID NO: 48323 - DNA, 25 bp, Rattus norvegicus
aagggctgcgctcacgactgctgac

SEQ ID NO: 48324 - DNA, 25 bp, Rattus norvegicus
aagggctgcgctgacgactgctgac

SEQ ID NO: 48325 - DNA, 25 bp, Rattus norvegicus
aagggctgctatatctgctgttcac

SEQ ID NO: 48326 - DNA, 25 bp, Rattus norvegicus
aagggctgctatttctgctgttcac

SEQ ID NO: 48327 - DNA, 25 bp, Rattus norvegicus
aagggctgctggatccaacagacac

SEQ ID NO: 48328 - DNA, 25 bp, Rattus norvegicus
aagggctgctggttccaacagacac

SEQ ID NO: 48329 - DNA, 25 bp, Rattus norvegicus
aagggctgggagatgcatgacctaa

SEQ ID NO: 48330 - DNA, 25 bp, Rattus norvegicus
aagggctgggagttgcatgacctaa

SEQ ID NO: 48331 - DNA, 25 bp, Rattus norvegicus
aagggctgggatatagaaacacaca

SEQ ID NO: 48332 - DNA, 25 bp, Rattus norvegicus
aagggctgggatttagaaacacaca

SEQ ID NO: 48333 - DNA, 25 bp, Rattus norvegicus
aagggctgggccaatgaccactgtt

SEQ ID NO: 48334 - DNA, 25 bp, Rattus norvegicus
aagggctgggcctatgaccactgtt

SEQ ID NO: 48335 - DNA, 25 bp, Rattus norvegicus
aagggctggtacaccccatatatcg

SEQ ID NO: 48336 - DNA, 25 bp, Rattus norvegicus
aagggctggtactccccatatatcg

SEQ ID NO: 48337 - DNA, 25 bp, Rattus norvegicus
aagggctggtcaagaactcggatat

SEQ ID NO: 48338 - DNA, 25 bp, Rattus norvegicus
aagggctggtcatgaactcggatat

SEQ ID NO: 48339 - DNA, 25 bp, Rattus norvegicus
aagggctggtgcagtattgctgccc

SEQ ID NO: 48340 - DNA, 25 bp, Rattus norvegicus
aagggctggtgctgtattgctgccc

SEQ ID NO: 48341 - DNA, 25 bp, Rattus norvegicus
aagggctggtgtacacttgtttact

SEQ ID NO: 48342 - DNA, 25 bp, Rattus norvegicus
aagggctggtgttcacttgtttact

SEQ ID NO: 48343 - DNA, 25 bp, Rattus norvegicus
aagggctgtcagatatattaaggtt

SEQ ID NO: 48344 - DNA, 25 bp, Rattus norvegicus
aagggctgtcagttatattaaggtt

SEQ ID NO: 48345 - DNA, 25 bp, Rattus norvegicus
aagggctgtcccaagtcaatagaaa

SEQ ID NO: 48346 - DNA, 25 bp, Rattus norvegicus
aagggctgtccctagtcaatagaaa

SEQ ID NO: 48347 - DNA, 25 bp, Rattus norvegicus
aagggctgtccgaaagcactcttac

SEQ ID NO: 48348 - DNA, 25 bp, Rattus norvegicus
aagggctgtccgtaagcactcttac

SEQ ID NO: 48349 - DNA, 25 bp, Rattus norvegicus
aagggctgtcttagcttcagactga

SEQ ID NO: 48350 - DNA, 25 bp, Rattus norvegicus
aagggctgtctttgcttcagactga

SEQ ID NO: 48351 - DNA, 25 bp, Rattus norvegicus
aagggctgtgctagagatgtgaata

SEQ ID NO: 48352 - DNA, 25 bp, Rattus norvegicus
aagggctgtgcttgagatgtgaata

SEQ ID NO: 48353 - DNA, 25 bp, Rattus norvegicus
aagggctgtggaaccgagactgact

SEQ ID NO: 48354 - DNA, 25 bp, Rattus norvegicus
aagggctgtggatccgagactgact

SEQ ID NO: 48355 - DNA, 25 bp, Rattus norvegicus
aagggctgttgcatgcggatttatt

SEQ ID NO: 48356 - DNA, 25 bp, Rattus norvegicus
aagggctgttgcttgcggatttatt

SEQ ID NO: 48357 - DNA, 25 bp, Rattus norvegicus
aagggcttaaggaagacgtatgtca

SEQ ID NO: 48358 - DNA, 25 bp, Rattus norvegicus
aagggcttaaggtagacgtatgtca

SEQ ID NO: 48359 - DNA, 25 bp, Rattus norvegicus
aagggcttacccaaccatctaatct

SEQ ID NO: 48360 - DNA, 25 bp, Rattus norvegicus
aagggcttaccctaccatctaatct

SEQ ID NO: 48361 - DNA, 25 bp, Rattus norvegicus
aagggcttaggacgtctactctcac

SEQ ID NO: 48362 - DNA, 25 bp, Rattus norvegicus
aagggcttaggaggtctactctcac

SEQ ID NO: 48363 - DNA, 25 bp, Rattus norvegicus
aagggcttaggcactgacgacagca

SEQ ID NO: 48364 - DNA, 25 bp, Rattus norvegicus
aagggcttaggctctgacgacagca

SEQ ID NO: 48365 - DNA, 25 bp, Rattus norvegicus
aagggcttatcacagaaacacacac

SEQ ID NO: 48366 - DNA, 25 bp, Rattus norvegicus
aagggcttatcagagaaacacacac

SEQ ID NO: 48367 - DNA, 25 bp, Rattus norvegicus
aagggcttcaaaacatccagcacca

SEQ ID NO: 48368 - DNA, 25 bp, Rattus norvegicus
aagggcttcaaatcatccagcacca

SEQ ID NO: 48369 - DNA, 25 bp, Rattus norvegicus
aagggcttcaagatggctcttctat

SEQ ID NO: 48370 - DNA, 25 bp, Rattus norvegicus
aagggcttcaagcaacgaaccagca

SEQ ID NO: 48371 - DNA, 25 bp, Rattus norvegicus
aagggcttcaaggaacgaaccagca

SEQ ID NO: 48372 - DNA, 25 bp, Rattus norvegicus
aagggcttcaagttggctcttctat

SEQ ID NO: 48373 - DNA, 25 bp, Rattus norvegicus
aagggcttcatgagaactatggtat

SEQ ID NO: 48374 - DNA, 25 bp, Rattus norvegicus
aagggcttcatgtgaactatggtat

SEQ ID NO: 48375 - DNA, 25 bp, Rattus norvegicus
aagggcttccataaccactgtcaga

SEQ ID NO: 48376 - DNA, 25 bp, Rattus norvegicus
aagggcttccattaccactgtcaga

SEQ ID NO: 48377 - DNA, 25 bp, Rattus norvegicus
aagggcttcctacatcttcacaact

SEQ ID NO: 48378 - DNA, 25 bp, Rattus norvegicus
aagggcttcctagatcttcacaact

SEQ ID NO: 48379 - DNA, 25 bp, Rattus norvegicus
aagggcttcctgaagttctattcaa

SEQ ID NO: 48380 - DNA, 25 bp, Rattus norvegicus
aagggcttcctgtagttctattcaa

SEQ ID NO: 48381 - DNA, 25 bp, Rattus norvegicus
aagggcttctctatgagctggatat

SEQ ID NO: 48382 - DNA, 25 bp, Rattus norvegicus
aagggcttctctttgagctggatat

SEQ ID NO: 48383 - DNA, 25 bp, Rattus norvegicus
aagggcttctggaaactacctctgc

SEQ ID NO: 48384 - DNA, 25 bp, Rattus norvegicus
aagggcttctggtaactacctctgc

SEQ ID NO: 48385 - DNA, 25 bp, Rattus norvegicus
aagggcttgacgcacctttgatcca

SEQ ID NO: 48386 - DNA, 25 bp, Rattus norvegicus
aagggcttgacggacctttgatcca

SEQ ID NO: 48387 - DNA, 25 bp, Rattus norvegicus
aagggcttgactatgacaggctgaa

SEQ ID NO: 48388 - DNA, 25 bp, Rattus norvegicus
aagggcttgactttgacaggctgaa

SEQ ID NO: 48389 - DNA, 25 bp, Rattus norvegicus
aagggcttgatgacacgtgtgtctc

SEQ ID NO: 48390 - DNA, 25 bp, Rattus norvegicus
aagggcttgatgtcacgtgtgtctc

SEQ ID NO: 48391 - DNA, 25 bp, Rattus norvegicus
aagggcttgcacaatctctcttgct

SEQ ID NO: 48392 - DNA, 25 bp, Rattus norvegicus
aagggcttgcactatctctcttgct

SEQ ID NO: 48393 - DNA, 25 bp, Rattus norvegicus
aagggcttgccccaaaacctgatga

SEQ ID NO: 48394 - DNA, 25 bp, Rattus norvegicus
aagggcttgcccgaaaacctgatga

SEQ ID NO: 48395 - DNA, 25 bp, Rattus norvegicus
aagggcttggcaaacactactgcct

SEQ ID NO: 48396 - DNA, 25 bp, Rattus norvegicus
aagggcttggcatacactactgcct

SEQ ID NO: 48397 - DNA, 25 bp, Rattus norvegicus
aagggcttggccagtgctaaggcca

SEQ ID NO: 48398 - DNA, 25 bp, Rattus norvegicus
aagggcttggccatcacatttgtgt

SEQ ID NO: 48399 - DNA, 25 bp, Rattus norvegicus
aagggcttggccattgagttgaaat

SEQ ID NO: 48400 - DNA, 25 bp, Rattus norvegicus
aagggcttggcctgtgctaaggcca

SEQ ID NO: 48401 - DNA, 25 bp, Rattus norvegicus
aagggcttggccttcacatttgtgt

SEQ ID NO: 48402 - DNA, 25 bp, Rattus norvegicus
aagggcttggcctttgagttgaaat

SEQ ID NO: 48403 - DNA, 25 bp, Rattus norvegicus
aagggcttgggactttcaatagctt

SEQ ID NO: 48404 - DNA, 25 bp, Rattus norvegicus
aagggcttgggagtttcaatagctt

SEQ ID NO: 48405 - DNA, 25 bp, Rattus norvegicus
aagggctttaccacttaactctcag

SEQ ID NO: 48406 - DNA, 25 bp, Rattus norvegicus
aagggctttacctcttaactctcag

SEQ ID NO: 48407 - DNA, 25 bp, Rattus norvegicus
aagggctttactagtcttcccacag

SEQ ID NO: 48408 - DNA, 25 bp, Rattus norvegicus
aagggctttacttgtcttcccacag

SEQ ID NO: 48409 - DNA, 25 bp, Rattus norvegicus
aagggctttagcactggtttggcca

SEQ ID NO: 48410 - DNA, 25 bp, Rattus norvegicus
aagggctttagcagctttgtcagaa

SEQ ID NO: 48411 - DNA, 25 bp, Rattus norvegicus
aagggctttagctctggtttggcca

SEQ ID NO: 48412 - DNA, 25 bp, Rattus norvegicus
aagggctttagctgctttgtcagaa

SEQ ID NO: 48413 - DNA, 25 bp, Rattus norvegicus
aagggctttatgagattggtccaga

SEQ ID NO: 48414 - DNA, 25 bp, Rattus norvegicus
aagggctttatgtgattggtccaga

SEQ ID NO: 48415 - DNA, 25 bp, Rattus norvegicus
aagggctttcagcactctctctctc

SEQ ID NO: 48416 - DNA, 25 bp, Rattus norvegicus
aagggctttcaggactctctctctc

SEQ ID NO: 48417 - DNA, 25 bp, Rattus norvegicus
aagggctttcatccagtttttattt

SEQ ID NO: 48418 - DNA, 25 bp, Rattus norvegicus
aagggctttcatgcagtttttattt

SEQ ID NO: 48419 - DNA, 25 bp, Rattus norvegicus
aagggctttctacctctttggcaag

SEQ ID NO: 48420 - DNA, 25 bp, Rattus norvegicus
aagggctttctagctctttggcaag

SEQ ID NO: 48421 - DNA, 25 bp, Rattus norvegicus
aagggctttgccagccggacgcagc

SEQ ID NO: 48422 - DNA, 25 bp, Rattus norvegicus
aagggctttgcctgccggacgcagc

SEQ ID NO: 48423 - DNA, 25 bp, Rattus norvegicus
aagggctttggcagcaggatttcca

SEQ ID NO: 48424 - DNA, 25 bp, Rattus norvegicus
aagggctttggctgcaggatttcca

SEQ ID NO: 48425 - DNA, 25 bp, Rattus norvegicus
aagggctttgtgaccatttcacgat

SEQ ID NO: 48426 - DNA, 25 bp, Rattus norvegicus
aagggctttgtgtccatttcacgat

SEQ ID NO: 48427 - DNA, 25 bp, Rattus norvegicus
aagggcttttggacaggtcagagtc

SEQ ID NO: 48428 - DNA, 25 bp, Rattus norvegicus
aagggcttttggtcaggtcagagtc

SEQ ID NO: 48429 - DNA, 25 bp, Rattus norvegicus
aagggggatggcaccccaggctcta

SEQ ID NO: 48430 - DNA, 25 bp, Rattus norvegicus
aagggggatggctccccaggctcta

SEQ ID NO: 48431 - DNA, 25 bp, Rattus norvegicus
aagggtaaagcaatgtcagccacaa

SEQ ID NO: 48432 - DNA, 25 bp, Rattus norvegicus
aagggtaaagcattgtcagccacaa

SEQ ID NO: 48433 - DNA, 25 bp, Rattus norvegicus
aagggtaactgcaaccttcacggca

SEQ ID NO: 48434 - DNA, 25 bp, Rattus norvegicus
aagggtaactgctaccttcacggca

SEQ ID NO: 48435 - DNA, 25 bp, Rattus norvegicus
aagggtaagctcagactcaaatgtt

SEQ ID NO: 48436 - DNA, 25 bp, Rattus norvegicus
aagggtaagctctgactcaaatgtt

SEQ ID NO: 48437 - DNA, 25 bp, Rattus norvegicus
aagggtaaggatatattcactaaat

SEQ ID NO: 48438 - DNA, 25 bp, Rattus norvegicus
aagggtaaggatttattcactaaat

SEQ ID NO: 48439 - DNA, 25 bp, Rattus norvegicus
aagggtacacaacatggactgggtt

SEQ ID NO: 48440 - DNA, 25 bp, Rattus norvegicus
aagggtacacaagatggactgggtt

SEQ ID NO: 48441 - DNA, 25 bp, Rattus norvegicus
aagggtacaggcacctgggcaacac

SEQ ID NO: 48442 - DNA, 25 bp, Rattus norvegicus
aagggtacaggctcctgggcaacac

SEQ ID NO: 48443 - DNA, 25 bp, Rattus norvegicus
aagggtacagtcaggttgccgctcc

SEQ ID NO: 48444 - DNA, 25 bp, Rattus norvegicus
aagggtacagtctggttgccgctcc

SEQ ID NO: 48445 - DNA, 25 bp, Rattus norvegicus
aagggtaccatgactgtccgggtca

SEQ ID NO: 48446 - DNA, 25 bp, Rattus norvegicus
aagggtaccatgtctgtccgggtca

SEQ ID NO: 48447 - DNA, 25 bp, Rattus norvegicus
aagggtactctcctgtgcagacagc

SEQ ID NO: 48448 - DNA, 25 bp, Rattus norvegicus
aagggtactctcgtgtgcagacagc

SEQ ID NO: 48449 - DNA, 25 bp, Rattus norvegicus
aagggtactgccaacgctcggatgc

SEQ ID NO: 48450 - DNA, 25 bp, Rattus norvegicus
aagggtactgcctacgctcggatgc

SEQ ID NO: 48451 - DNA, 25 bp, Rattus norvegicus
aagggtagacgtctgctgcgtcctt

SEQ ID NO: 48452 - DNA, 25 bp, Rattus norvegicus
aagggtagacgtgtgctgcgtcctt

SEQ ID NO: 48453 - DNA, 25 bp, Rattus norvegicus
aagggtagataaaccctgccaccac

SEQ ID NO: 48454 - DNA, 25 bp, Rattus norvegicus
aagggtagataatccctgccaccac

SEQ ID NO: 48455 - DNA, 25 bp, Rattus norvegicus
aagggtagcattactgggttcctgt

SEQ ID NO: 48456 - DNA, 25 bp, Rattus norvegicus
aagggtagcatttctgggttcctgt

SEQ ID NO: 48457 - DNA, 25 bp, Rattus norvegicus
aagggtaggtctactcaccctgaag

SEQ ID NO: 48458 - DNA, 25 bp, Rattus norvegicus
aagggtaggtcttctcaccctgaag

SEQ ID NO: 48459 - DNA, 25 bp, Rattus norvegicus
aagggtatacttacttctgttatgt

SEQ ID NO: 48460 - DNA, 25 bp, Rattus norvegicus
aagggtatacttatgacagcactca

SEQ ID NO: 48461 - DNA, 25 bp, Rattus norvegicus
aagggtatactttcttctgttatgt

SEQ ID NO: 48462 - DNA, 25 bp, Rattus norvegicus
aagggtatacttttgacagcactca

SEQ ID NO: 48463 - DNA, 25 bp, Rattus norvegicus
aagggtatcgacctgagaactccac

SEQ ID NO: 48464 - DNA, 25 bp, Rattus norvegicus
aagggtatcgacgtgagaactccac

SEQ ID NO: 48465 - DNA, 25 bp, Rattus norvegicus
aagggtatcgtaagttcaggtctaa

SEQ ID NO: 48466 - DNA, 25 bp, Rattus norvegicus
aagggtatcgtatgttcaggtctaa

SEQ ID NO: 48467 - DNA, 25 bp, Rattus norvegicus
aagggtatgtgaactatagttgctc

SEQ ID NO: 48468 - DNA, 25 bp, Rattus norvegicus
aagggtatgtgatctatagttgctc

SEQ ID NO: 48469 - DNA, 25 bp, Rattus norvegicus
aagggtatgtgtagctctttcaaag

SEQ ID NO: 48470 - DNA, 25 bp, Rattus norvegicus
aagggtatgtgttgctctttcaaag

SEQ ID NO: 48471 - DNA, 25 bp, Rattus norvegicus
aagggtattagtaagctgctgcagc

SEQ ID NO: 48472 - DNA, 25 bp, Rattus norvegicus
aagggtattagttagctgctgcagc

SEQ ID NO: 48473 - DNA, 25 bp, Rattus norvegicus
aagggtcaaaccagtaggtgcagaa

SEQ ID NO: 48474 - DNA, 25 bp, Rattus norvegicus
aagggtcaaacctgtaggtgcagaa

SEQ ID NO: 48475 - DNA, 25 bp, Rattus norvegicus
aagggtcaacacatctgtcggcatt

SEQ ID NO: 48476 - DNA, 25 bp, Rattus norvegicus
aagggtcaacacttctgtcggcatt

SEQ ID NO: 48477 - DNA, 25 bp, Rattus norvegicus
aagggtcacaccatctgatcttagc

SEQ ID NO: 48478 - DNA, 25 bp, Rattus norvegicus
aagggtcacaccttctgatcttagc

SEQ ID NO: 48479 - DNA, 25 bp, Rattus norvegicus
aagggtcacactagcctctaacatg

SEQ ID NO: 48480 - DNA, 25 bp, Rattus norvegicus
aagggtcacacttgcctctaacatg

SEQ ID NO: 48481 - DNA, 25 bp, Rattus norvegicus
aagggtcaccgtaggcatagagctt

SEQ ID NO: 48482 - DNA, 25 bp, Rattus norvegicus
aagggtcaccgttggcatagagctt

SEQ ID NO: 48483 - DNA, 25 bp, Rattus norvegicus
aagggtcacctaagactcggacgcg

SEQ ID NO: 48484 - DNA, 25 bp, Rattus norvegicus
aagggtcacctatgactcggacgcg

SEQ ID NO: 48485 - DNA, 25 bp, Rattus norvegicus
aagggtcagaggatcccatactcct

SEQ ID NO: 48486 - DNA, 25 bp, Rattus norvegicus
aagggtcagaggttcccatactcct

SEQ ID NO: 48487 - DNA, 25 bp, Rattus norvegicus
aagggtcaggtgcttcatcctccca

SEQ ID NO: 48488 - DNA, 25 bp, Rattus norvegicus
aagggtcaggtggttcatcctccca

SEQ ID NO: 48489 - DNA, 25 bp, Rattus norvegicus
aagggtcatacaaagtctctgggtc

SEQ ID NO: 48490 - DNA, 25 bp, Rattus norvegicus
aagggtcatacatagtctctgggtc

SEQ ID NO: 48491 - DNA, 25 bp, Rattus norvegicus
aagggtcatactccatggttttgcc

SEQ ID NO: 48492 - DNA, 25 bp, Rattus norvegicus
aagggtcatactgcatggttttgcc

SEQ ID NO: 48493 - DNA, 25 bp, Rattus norvegicus
aagggtcatatccaactcactttct

SEQ ID NO: 48494 - DNA, 25 bp, Rattus norvegicus
aagggtcatatcgaactcactttct

SEQ ID NO: 48495 - DNA, 25 bp, Rattus norvegicus
aagggtcatggcatgtgagccacct

SEQ ID NO: 48496 - DNA, 25 bp, Rattus norvegicus
aagggtcatggcttgtgagccacct

SEQ ID NO: 48497 - DNA, 25 bp, Rattus norvegicus
aagggtcatttaacagagcggcagt

SEQ ID NO: 48498 - DNA, 25 bp, Rattus norvegicus
aagggtcatttatcagagcggcagt

SEQ ID NO: 48499 - DNA, 25 bp, Rattus norvegicus
aagggtccaaataattcgattcaat

SEQ ID NO: 48500 - DNA, 25 bp, Rattus norvegicus
aagggtccaaattattcgattcaat

SEQ ID NO: 48501 - DNA, 25 bp, Rattus norvegicus
aagggtccaagcaccactttgaaag

SEQ ID NO: 48502 - DNA, 25 bp, Rattus norvegicus
aagggtccaagctccactttgaaag

SEQ ID NO: 48503 - DNA, 25 bp, Rattus norvegicus
aagggtccacagagattgtccctcc

SEQ ID NO: 48504 - DNA, 25 bp, Rattus norvegicus
aagggtccacagtgattgtccctcc

SEQ ID NO: 48505 - DNA, 25 bp, Rattus norvegicus
aagggtccagctctggagatcgcaa

SEQ ID NO: 48506 - DNA, 25 bp, Rattus norvegicus
aagggtccagctgtggagatcgcaa

SEQ ID NO: 48507 - DNA, 25 bp, Rattus norvegicus
aagggtccaggcagctttagtccat

SEQ ID NO: 48508 - DNA, 25 bp, Rattus norvegicus
aagggtccaggctgctttagtccat

SEQ ID NO: 48509 - DNA, 25 bp, Rattus norvegicus
aagggtccatgcagccttagcccac

SEQ ID NO: 48510 - DNA, 25 bp, Rattus norvegicus
aagggtccatgctgccttagcccac

SEQ ID NO: 48511 - DNA, 25 bp, Rattus norvegicus
aagggtcccagaattgtccagaagt

SEQ ID NO: 48512 - DNA, 25 bp, Rattus norvegicus
aagggtcccagatttgtccagaagt

SEQ ID NO: 48513 - DNA, 25 bp, Rattus norvegicus
aagggtcccaggagtgacagtcact

SEQ ID NO: 48514 - DNA, 25 bp, Rattus norvegicus
aagggtcccaggtgtgacagtcact

SEQ ID NO: 48515 - DNA, 25 bp, Rattus norvegicus
aagggtccccatcaaaggctggtat

SEQ ID NO: 48516 - DNA, 25 bp, Rattus norvegicus
aagggtccccatgaaaggctggtat

SEQ ID NO: 48517 - DNA, 25 bp, Rattus norvegicus
aagggtcccgtgactacagaggcat

SEQ ID NO: 48518 - DNA, 25 bp, Rattus norvegicus
aagggtcccgtgtctacagaggcat

SEQ ID NO: 48519 - DNA, 25 bp, Rattus norvegicus
aagggtccctctccatgtgttaggt

SEQ ID NO: 48520 - DNA, 25 bp, Rattus norvegicus
aagggtccctctgcatgtgttaggt

SEQ ID NO: 48521 - DNA, 25 bp, Rattus norvegicus
aagggtccgctgcagtccgttcaag

SEQ ID NO: 48522 - DNA, 25 bp, Rattus norvegicus
aagggtccgctggagtccgttcaag

SEQ ID NO: 48523 - DNA, 25 bp, Rattus norvegicus
aagggtcctcagcttctacagagca

SEQ ID NO: 48524 - DNA, 25 bp, Rattus norvegicus
aagggtcctcaggttctacagagca

SEQ ID NO: 48525 - DNA, 25 bp, Rattus norvegicus
aagggtcctgacacagatgaccatg

SEQ ID NO: 48526 - DNA, 25 bp, Rattus norvegicus
aagggtcctgactcagatgaccatg

SEQ ID NO: 48527 - DNA, 25 bp, Rattus norvegicus
aagggtcgagctaggcttgcgcacc

SEQ ID NO: 48528 - DNA, 25 bp, Rattus norvegicus
aagggtcgagcttggcttgcgcacc

SEQ ID NO: 48529 - DNA, 25 bp, Rattus norvegicus
aagggtcgcgcccgacctcgagctt

SEQ ID NO: 48530 - DNA, 25 bp, Rattus norvegicus
aagggtcgcgccggacctcgagctt

SEQ ID NO: 48531 - DNA, 25 bp, Rattus norvegicus
aagggtcgctttcctgttcatcgaa

SEQ ID NO: 48532 - DNA, 25 bp, Rattus norvegicus
aagggtcgctttgctgttcatcgaa

SEQ ID NO: 48533 - DNA, 25 bp, Rattus norvegicus
aagggtcgggataactgttctgaag

SEQ ID NO: 48534 - DNA, 25 bp, Rattus norvegicus
aagggtcgggattactgttctgaag

SEQ ID NO: 48535 - DNA, 25 bp, Rattus norvegicus
aagggtcgtaggctctgccaaccaa

SEQ ID NO: 48536 - DNA, 25 bp, Rattus norvegicus
aagggtcgtagggtctgccaaccaa

SEQ ID NO: 48537 - DNA, 25 bp, Rattus norvegicus
aagggtcgtccaatccgtggcatgt

SEQ ID NO: 48538 - DNA, 25 bp, Rattus norvegicus
aagggtcgtccattccgtggcatgt

SEQ ID NO: 48539 - DNA, 25 bp, Rattus norvegicus
aagggtctacagcaagtggagttcc

SEQ ID NO: 48540 - DNA, 25 bp, Rattus norvegicus
aagggtctacaggaagtggagttcc

SEQ ID NO: 48541 - DNA, 25 bp, Rattus norvegicus
aagggtctacatagcaggtttacag

SEQ ID NO: 48542 - DNA, 25 bp, Rattus norvegicus
aagggtctacattgcaggtttacag

SEQ ID NO: 48543 - DNA, 25 bp, Rattus norvegicus
aagggtctcaatccggagttgtcta

SEQ ID NO: 48544 - DNA, 25 bp, Rattus norvegicus
aagggtctcaatgcggagttgtcta

SEQ ID NO: 48545 - DNA, 25 bp, Rattus norvegicus
aagggtctcattatttagctttgga

SEQ ID NO: 48546 - DNA, 25 bp, Rattus norvegicus
aagggtctcattttttagctttgga

SEQ ID NO: 48547 - DNA, 25 bp, Rattus norvegicus
aagggtctcgtgcagctaacagcct

SEQ ID NO: 48548 - DNA, 25 bp, Rattus norvegicus
aagggtctcgtggagctaacagcct

SEQ ID NO: 48549 - DNA, 25 bp, Rattus norvegicus
aagggtctgaaactgggtcactgca

SEQ ID NO: 48550 - DNA, 25 bp, Rattus norvegicus
aagggtctgaaagtgggtcactgca

SEQ ID NO: 48551 - DNA, 25 bp, Rattus norvegicus
aagggtctgatcaggtggatgaacc

SEQ ID NO: 48552 - DNA, 25 bp, Rattus norvegicus
aagggtctgatctggtggatgaacc

SEQ ID NO: 48553 - DNA, 25 bp, Rattus norvegicus
aagggtcttcagagcttggtcctcc

SEQ ID NO: 48554 - DNA, 25 bp, Rattus norvegicus
aagggtcttcagtgcttggtcctcc

SEQ ID NO: 48555 - DNA, 25 bp, Rattus norvegicus
aagggtcttcttcataaatcacaat

SEQ ID NO: 48556 - DNA, 25 bp, Rattus norvegicus
aagggtcttcttgataaatcacaat

SEQ ID NO: 48557 - DNA, 25 bp, Rattus norvegicus
aagggtcttgccacattatttgctc

SEQ ID NO: 48558 - DNA, 25 bp, Rattus norvegicus
aagggtcttgcctcattatttgctc

SEQ ID NO: 48559 - DNA, 25 bp, Rattus norvegicus
aagggtgaacgcatctgagccagaa

SEQ ID NO: 48560 - DNA, 25 bp, Rattus norvegicus
aagggtgaacgcttctgagccagaa

SEQ ID NO: 48561 - DNA, 25 bp, Rattus norvegicus
aagggtgaactacagcctccggagc

SEQ ID NO: 48562 - DNA, 25 bp, Rattus norvegicus
aagggtgaactagagcctccggagc

SEQ ID NO: 48563 - DNA, 25 bp, Rattus norvegicus
aagggtgacacactgttgcttgcct

SEQ ID NO: 48564 - DNA, 25 bp, Rattus norvegicus
aagggtgacacagtgttgcttgcct

SEQ ID NO: 48565 - DNA, 25 bp, Rattus norvegicus
aagggtgacagcatctgccttctcc

SEQ ID NO: 48566 - DNA, 25 bp, Rattus norvegicus
aagggtgacagccactctttggagt

SEQ ID NO: 48567 - DNA, 25 bp, Rattus norvegicus
aagggtgacagcgactctttggagt

SEQ ID NO: 48568 - DNA, 25 bp, Rattus norvegicus
aagggtgacagcttctgccttctcc

SEQ ID NO: 48569 - DNA, 25 bp, Rattus norvegicus
aagggtgaccccattgctgccctgt

SEQ ID NO: 48570 - DNA, 25 bp, Rattus norvegicus
aagggtgacccctttgctgccctgt

SEQ ID NO: 48571 - DNA, 25 bp, Rattus norvegicus
aagggtgactggaatgacatcgact

SEQ ID NO: 48572 - DNA, 25 bp, Rattus norvegicus
aagggtgactggtatgacatcgact

SEQ ID NO: 48573 - DNA, 25 bp, Rattus norvegicus
aagggtgattctcaccatttcttcc

SEQ ID NO: 48574 - DNA, 25 bp, Rattus norvegicus
aagggtgattctgaccatttcttcc

SEQ ID NO: 48575 - DNA, 25 bp, Rattus norvegicus
aagggtgcaacgctcatcgctgctc

SEQ ID NO: 48576 - DNA, 25 bp, Rattus norvegicus
aagggtgcaacggtcatcgctgctc

SEQ ID NO: 48577 - DNA, 25 bp, Rattus norvegicus
aagggtgcaaggctgtctgtcccat

SEQ ID NO: 48578 - DNA, 25 bp, Rattus norvegicus
aagggtgcaagggtgtctgtcccat

SEQ ID NO: 48579 - DNA, 25 bp, Rattus norvegicus
aagggtgcccagacgagatttatgt

SEQ ID NO: 48580 - DNA, 25 bp, Rattus norvegicus
aagggtgcccagtcgagatttatgt

SEQ ID NO: 48581 - DNA, 25 bp, Rattus norvegicus
aagggtgccccaatctgtcaggaat

SEQ ID NO: 48582 - DNA, 25 bp, Rattus norvegicus
aagggtgccccattctgtcaggaat

SEQ ID NO: 48583 - DNA, 25 bp, Rattus norvegicus
aagggtgcctcgagctccatgatgt

SEQ ID NO: 48584 - DNA, 25 bp, Rattus norvegicus
aagggtgcctcgtgctccatgatgt

SEQ ID NO: 48585 - DNA, 25 bp, Rattus norvegicus
aagggtgcctggaccatcccgtgga

SEQ ID NO: 48586 - DNA, 25 bp, Rattus norvegicus
aagggtgcctggtccatcccgtgga

SEQ ID NO: 48587 - DNA, 25 bp, Rattus norvegicus
aagggtgcggctacttccaagctct

SEQ ID NO: 48588 - DNA, 25 bp, Rattus norvegicus
aagggtgcggcttcttccaagctct

SEQ ID NO: 48589 - DNA, 25 bp, Rattus norvegicus
aagggtgctcacagaaggttctggc

SEQ ID NO: 48590 - DNA, 25 bp, Rattus norvegicus
aagggtgctcactgaaggttctggc

SEQ ID NO: 48591 - DNA, 25 bp, Rattus norvegicus
aagggtgctcccagaggtacactat

SEQ ID NO: 48592 - DNA, 25 bp, Rattus norvegicus
aagggtgctccctgaggtacactat

SEQ ID NO: 48593 - DNA, 25 bp, Rattus norvegicus
aagggtgctcctatctccttgagct

SEQ ID NO: 48594 - DNA, 25 bp, Rattus norvegicus
aagggtgctcctctctgcagagtgc

SEQ ID NO: 48595 - DNA, 25 bp, Rattus norvegicus
aagggtgctcctgtctgcagagtgc

SEQ ID NO: 48596 - DNA, 25 bp, Rattus norvegicus
aagggtgctcctttctccttgagct

SEQ ID NO: 48597 - DNA, 25 bp, Rattus norvegicus
aagggtgctgaacaaaacctctaca

SEQ ID NO: 48598 - DNA, 25 bp, Rattus norvegicus
aagggtgctgaagaaaacctctaca

SEQ ID NO: 48599 - DNA, 25 bp, Rattus norvegicus
aagggtgctgccagtgcttaactac

SEQ ID NO: 48600 - DNA, 25 bp, Rattus norvegicus
aagggtgctgcctgtgcttaactac

SEQ ID NO: 48601 - DNA, 25 bp, Rattus norvegicus
aagggtgctgcgaaacggctctgct

SEQ ID NO: 48602 - DNA, 25 bp, Rattus norvegicus
aagggtgctgcgtaacggctctgct

SEQ ID NO: 48603 - DNA, 25 bp, Rattus norvegicus
aagggtgcttagctgtccttagttc

SEQ ID NO: 48604 - DNA, 25 bp, Rattus norvegicus
aagggtgcttaggtgtccttagttc

SEQ ID NO: 48605 - DNA, 25 bp, Rattus norvegicus
aagggtgcttcaaggccattgtggc

SEQ ID NO: 48606 - DNA, 25 bp, Rattus norvegicus
aagggtgcttcatggccattgtggc

SEQ ID NO: 48607 - DNA, 25 bp, Rattus norvegicus
aagggtggacctccttcttactctg

SEQ ID NO: 48608 - DNA, 25 bp, Rattus norvegicus
aagggtggacctgcttcttactctg

SEQ ID NO: 48609 - DNA, 25 bp, Rattus norvegicus
aagggtggagagattcagcctgtca

SEQ ID NO: 48610 - DNA, 25 bp, Rattus norvegicus
aagggtggagagtttcagcctgtca

SEQ ID NO: 48611 - DNA, 25 bp, Rattus norvegicus
aagggtggcaagatagtttctgtcc

SEQ ID NO: 48612 - DNA, 25 bp, Rattus norvegicus
aagggtggcaagttagtttctgtcc

SEQ ID NO: 48613 - DNA, 25 bp, Rattus norvegicus
aagggtggcagacttcagctttttt

SEQ ID NO: 48614 - DNA, 25 bp, Rattus norvegicus
aagggtggcagagttcagctttttt

SEQ ID NO: 48615 - DNA, 25 bp, Rattus norvegicus
aagggtggccgtacagtccacagac

SEQ ID NO: 48616 - DNA, 25 bp, Rattus norvegicus
aagggtggccgttcagtccacagac

SEQ ID NO: 48617 - DNA, 25 bp, Rattus norvegicus
aagggtgggatcaccaacattctgg

SEQ ID NO: 48618 - DNA, 25 bp, Rattus norvegicus
aagggtgggatctccaacattctgg

SEQ ID NO: 48619 - DNA, 25 bp, Rattus norvegicus
aagggtgggattagtctccagcctc

SEQ ID NO: 48620 - DNA, 25 bp, Rattus norvegicus
aagggtgggatttgtctccagcctc

SEQ ID NO: 48621 - DNA, 25 bp, Rattus norvegicus
aagggtgggcacatttaggcctctc

SEQ ID NO: 48622 - DNA, 25 bp, Rattus norvegicus
aagggtgggcacttttaggcctctc

SEQ ID NO: 48623 - DNA, 25 bp, Rattus norvegicus
aagggtgggcatatcacagttccag

SEQ ID NO: 48624 - DNA, 25 bp, Rattus norvegicus
aagggtgggcatttcacagttccag

SEQ ID NO: 48625 - DNA, 25 bp, Rattus norvegicus
aagggtggtaagaccagactcacca

SEQ ID NO: 48626 - DNA, 25 bp, Rattus norvegicus
aagggtggtaagtccagactcacca

SEQ ID NO: 48627 - DNA, 25 bp, Rattus norvegicus
aagggtggtcctcatcattctgaat

SEQ ID NO: 48628 - DNA, 25 bp, Rattus norvegicus
aagggtggtcctgatcattctgaat

SEQ ID NO: 48629 - DNA, 25 bp, Rattus norvegicus
aagggtggtcgtaaggcaccagctc

SEQ ID NO: 48630 - DNA, 25 bp, Rattus norvegicus
aagggtggtcgttaggcaccagctc

SEQ ID NO: 48631 - DNA, 25 bp, Rattus norvegicus
aagggtggttcactttgacctccag

SEQ ID NO: 48632 - DNA, 25 bp, Rattus norvegicus
aagggtggttcagtttgacctccag

SEQ ID NO: 48633 - DNA, 25 bp, Rattus norvegicus
aagggtgtcacacgcctcaagtcta

SEQ ID NO: 48634 - DNA, 25 bp, Rattus norvegicus
aagggtgtcacaggcctcaagtcta

SEQ ID NO: 48635 - DNA, 25 bp, Rattus norvegicus
aagggtgtctccctgaagcctgccc

SEQ ID NO: 48636 - DNA, 25 bp, Rattus norvegicus
aagggtgtctccgtgaagcctgccc

SEQ ID NO: 48637 - DNA, 25 bp, Rattus norvegicus
aagggtgtgagcatgccccatggct

SEQ ID NO: 48638 - DNA, 25 bp, Rattus norvegicus
aagggtgtgagcttgccccatggct

SEQ ID NO: 48639 - DNA, 25 bp, Rattus norvegicus
aagggtgtgagtcatcgtcttctcc

SEQ ID NO: 48640 - DNA, 25 bp, Rattus norvegicus
aagggtgtgagtgatcgtcttctcc

SEQ ID NO: 48641 - DNA, 25 bp, Rattus norvegicus
aagggtgtgcaccactatcacctga

SEQ ID NO: 48642 - DNA, 25 bp, Rattus norvegicus
aagggtgtgcacgactatcacctga

SEQ ID NO: 48643 - DNA, 25 bp, Rattus norvegicus
aagggtgtgccactctgccaccaga

SEQ ID NO: 48644 - DNA, 25 bp, Rattus norvegicus
aagggtgtgccagtctgccaccaga

SEQ ID NO: 48645 - DNA, 25 bp, Rattus norvegicus
aagggtgtgtagaactgcgtctgca

SEQ ID NO: 48646 - DNA, 25 bp, Rattus norvegicus
aagggtgtgtagtactgcgtctgca

SEQ ID NO: 48647 - DNA, 25 bp, Rattus norvegicus
aagggtgtgtccatgtcacctaggt

SEQ ID NO: 48648 - DNA, 25 bp, Rattus norvegicus
aagggtgtgtccttgtcacctaggt

SEQ ID NO: 48649 - DNA, 25 bp, Rattus norvegicus
aagggtgttactaaggccatgggca

SEQ ID NO: 48650 - DNA, 25 bp, Rattus norvegicus
aagggtgttacttaggccatgggca

SEQ ID NO: 48651 - DNA, 25 bp, Rattus norvegicus
aagggtgttagactgcaatagcaat

SEQ ID NO: 48652 - DNA, 25 bp, Rattus norvegicus
aagggtgttagagtgcaatagcaat

SEQ ID NO: 48653 - DNA, 25 bp, Rattus norvegicus
aagggtgttcacctatgcgacaaca

SEQ ID NO: 48654 - DNA, 25 bp, Rattus norvegicus
aagggtgttcacgtatgcgacaaca

SEQ ID NO: 48655 - DNA, 25 bp, Rattus norvegicus
aagggtgttctaatcattttgcatg

SEQ ID NO: 48656 - DNA, 25 bp, Rattus norvegicus
aagggtgttctattcattttgcatg

SEQ ID NO: 48657 - DNA, 25 bp, Rattus norvegicus
aagggttaaagcacagcatgctcta

SEQ ID NO: 48658 - DNA, 25 bp, Rattus norvegicus
aagggttaaagctcagcatgctcta

SEQ ID NO: 48659 - DNA, 25 bp, Rattus norvegicus
aagggttactcacgcttcttgtgcc

SEQ ID NO: 48660 - DNA, 25 bp, Rattus norvegicus
aagggttactcaggcttcttgtgcc

SEQ ID NO: 48661 - DNA, 25 bp, Rattus norvegicus
aagggttagcctccagatcatagca

SEQ ID NO: 48662 - DNA, 25 bp, Rattus norvegicus
aagggttagcctgcagatcatagca

SEQ ID NO: 48663 - DNA, 25 bp, Rattus norvegicus
aagggttattgaattcttcacattc

SEQ ID NO: 48664 - DNA, 25 bp, Rattus norvegicus
aagggttattgatttcttcacattc

SEQ ID NO: 48665 - DNA, 25 bp, Rattus norvegicus
aagggttcaagaaagcagtcaccaa

SEQ ID NO: 48666 - DNA, 25 bp, Rattus norvegicus
aagggttcaagaccaactcaggcaa

SEQ ID NO: 48667 - DNA, 25 bp, Rattus norvegicus
aagggttcaagagcaactcaggcaa

SEQ ID NO: 48668 - DNA, 25 bp, Rattus norvegicus
aagggttcaagatagcagtcaccaa

SEQ ID NO: 48669 - DNA, 25 bp, Rattus norvegicus
aagggttcaagtcttctcggctgta

SEQ ID NO: 48670 - DNA, 25 bp, Rattus norvegicus
aagggttcaagtgttctcggctgta

SEQ ID NO: 48671 - DNA, 25 bp, Rattus norvegicus
aagggttcacacacatgcatcatta

SEQ ID NO: 48672 - DNA, 25 bp, Rattus norvegicus
aagggttcacactcatgcatcatta

SEQ ID NO: 48673 - DNA, 25 bp, Rattus norvegicus
aagggttcatttcagcttgcagtcg

SEQ ID NO: 48674 - DNA, 25 bp, Rattus norvegicus
aagggttcatttgagcttgcagtcg

SEQ ID NO: 48675 - DNA, 25 bp, Rattus norvegicus
aagggttccaacacgcatagaaggc

SEQ ID NO: 48676 - DNA, 25 bp, Rattus norvegicus
aagggttccaactcgcatagaaggc

SEQ ID NO: 48677 - DNA, 25 bp, Rattus norvegicus
aagggttcccagcattgacatttga

SEQ ID NO: 48678 - DNA, 25 bp, Rattus norvegicus
aagggttcccaggattgacatttga

SEQ ID NO: 48679 - DNA, 25 bp, Rattus norvegicus
aagggttccctccatggtgagcacc

SEQ ID NO: 48680 - DNA, 25 bp, Rattus norvegicus
aagggttccctcgatggtgagcacc

SEQ ID NO: 48681 - DNA, 25 bp, Rattus norvegicus
aagggttcctcaattctgagcttct

SEQ ID NO: 48682 - DNA, 25 bp, Rattus norvegicus
aagggttcctcatttctgagcttct

SEQ ID NO: 48683 - DNA, 25 bp, Rattus norvegicus
aagggttctatcatctcacatttcc

SEQ ID NO: 48684 - DNA, 25 bp, Rattus norvegicus
aagggttctatcttctcacatttcc

SEQ ID NO: 48685 - DNA, 25 bp, Rattus norvegicus
aagggttctcaacgttgcatttcgc

SEQ ID NO: 48686 - DNA, 25 bp, Rattus norvegicus
aagggttctcaaggttgcatttcgc

SEQ ID NO: 48687 - DNA, 25 bp, Rattus norvegicus
aagggttctcctactgatgtgacaa

SEQ ID NO: 48688 - DNA, 25 bp, Rattus norvegicus
aagggttctccttctgatgtgacaa

SEQ ID NO: 48689 - DNA, 25 bp, Rattus norvegicus
aagggttctcggctcatttcagagc

SEQ ID NO: 48690 - DNA, 25 bp, Rattus norvegicus
aagggttctcgggtcatttcagagc

SEQ ID NO: 48691 - DNA, 25 bp, Rattus norvegicus
aagggttctggtacactcaggtctc

SEQ ID NO: 48692 - DNA, 25 bp, Rattus norvegicus
aagggttctggttcactcaggtctc

SEQ ID NO: 48693 - DNA, 25 bp, Rattus norvegicus
aagggttcttaccaccatgcctgat

SEQ ID NO: 48694 - DNA, 25 bp, Rattus norvegicus
aagggttcttacgaccatgcctgat

SEQ ID NO: 48695 - DNA, 25 bp, Rattus norvegicus
aagggttcttttcctcactgggatg

SEQ ID NO: 48696 - DNA, 25 bp, Rattus norvegicus
aagggttcttttgctcactgggatg

SEQ ID NO: 48697 - DNA, 25 bp, Rattus norvegicus
aagggttgaacaaggtatgaactaa

SEQ ID NO: 48698 - DNA, 25 bp, Rattus norvegicus
aagggttgaacatggtatgaactaa

SEQ ID NO: 48699 - DNA, 25 bp, Rattus norvegicus
aagggttgagatacactcctgtcct

SEQ ID NO: 48700 - DNA, 25 bp, Rattus norvegicus
aagggttgagattcactcctgtcct

SEQ ID NO: 48701 - DNA, 25 bp, Rattus norvegicus
aagggttgcactactgttattgtaa

SEQ ID NO: 48702 - DNA, 25 bp, Rattus norvegicus
aagggttgcacttctgttattgtaa

SEQ ID NO: 48703 - DNA, 25 bp, Rattus norvegicus
aagggttgcatacttttactggagt

SEQ ID NO: 48704 - DNA, 25 bp, Rattus norvegicus
aagggttgcatagttttactggagt

SEQ ID NO: 48705 - DNA, 25 bp, Rattus norvegicus
aagggttgccttaaactggcaggtg

SEQ ID NO: 48706 - DNA, 25 bp, Rattus norvegicus
aagggttgcctttaactggcaggtg

SEQ ID NO: 48707 - DNA, 25 bp, Rattus norvegicus
aagggttgctttcccacggtgcaca

SEQ ID NO: 48708 - DNA, 25 bp, Rattus norvegicus
aagggttgctttgccacggtgcaca

SEQ ID NO: 48709 - DNA, 25 bp, Rattus norvegicus
aagggttggacgcacccttctcatt

SEQ ID NO: 48710 - DNA, 25 bp, Rattus norvegicus
aagggttggacggacccttctcatt

SEQ ID NO: 48711 - DNA, 25 bp, Rattus norvegicus
aagggttggcccacatgattgccga

SEQ ID NO: 48712 - DNA, 25 bp, Rattus norvegicus
aagggttggccctcatgattgccga

SEQ ID NO: 48713 - DNA, 25 bp, Rattus norvegicus
aagggttgtcgtccacatgcttcgg

SEQ ID NO: 48714 - DNA, 25 bp, Rattus norvegicus
aagggttgtcgtgcacatgcttcgg

SEQ ID NO: 48715 - DNA, 25 bp, Rattus norvegicus
aagggtttagccacggatgcttcga

SEQ ID NO: 48716 - DNA, 25 bp, Rattus norvegicus
aagggtttagcctcggatgcttcga

SEQ ID NO: 48717 - DNA, 25 bp, Rattus norvegicus
aagggtttcaaacccactgactgtg

SEQ ID NO: 48718 - DNA, 25 bp, Rattus norvegicus
aagggtttcaaagccactgactgtg

SEQ ID NO: 48719 - DNA, 25 bp, Rattus norvegicus
aagggtttctatcatgtcctgtcca

SEQ ID NO: 48720 - DNA, 25 bp, Rattus norvegicus
aagggtttctatgatgtcctgtcca

SEQ ID NO: 48721 - DNA, 25 bp, Rattus norvegicus
aagggtttctctacacaagtcctat

SEQ ID NO: 48722 - DNA, 25 bp, Rattus norvegicus
aagggtttctcttcacaagtcctat

SEQ ID NO: 48723 - DNA, 25 bp, Rattus norvegicus
aagggtttctgaccttaccgatcac

SEQ ID NO: 48724 - DNA, 25 bp, Rattus norvegicus
aagggtttctgagcttaccgatcac

SEQ ID NO: 48725 - DNA, 25 bp, Rattus norvegicus
aagggtttctgtatgatcccacagc

SEQ ID NO: 48726 - DNA, 25 bp, Rattus norvegicus
aagggtttctgtttgatcccacagc

SEQ ID NO: 48727 - DNA, 25 bp, Rattus norvegicus
aagggtttgagtatgcatttggcta

SEQ ID NO: 48728 - DNA, 25 bp, Rattus norvegicus
aagggtttgagtttgcatttggcta

SEQ ID NO: 48729 - DNA, 25 bp, Rattus norvegicus
aagggtttgccccactgacttgctc

SEQ ID NO: 48730 - DNA, 25 bp, Rattus norvegicus
aagggtttgcccgactgacttgctc

SEQ ID NO: 48731 - DNA, 25 bp, Rattus norvegicus
aagggtttgtatagtgctcctcttt

SEQ ID NO: 48732 - DNA, 25 bp, Rattus norvegicus
aagggtttgtattgtgctcctcttt

SEQ ID NO: 48733 - DNA, 25 bp, Rattus norvegicus
aagggttttctaagactgagctagc

SEQ ID NO: 48734 - DNA, 25 bp, Rattus norvegicus
aagggttttctatgactgagctagc

SEQ ID NO: 48735 - DNA, 25 bp, Rattus norvegicus
aagggttttcttacatgttccactg

SEQ ID NO: 48736 - DNA, 25 bp, Rattus norvegicus
aagggttttctttcatgttccactg

SEQ ID NO: 48737 - DNA, 25 bp, Rattus norvegicus
aaggtaaacttgaacagagcccaca

SEQ ID NO: 48738 - DNA, 25 bp, Rattus norvegicus
aaggtaaacttgtacagagcccaca

SEQ ID NO: 48739 - DNA, 25 bp, Rattus norvegicus
aaggtaaagcaaaagttcccagaat

SEQ ID NO: 48740 - DNA, 25 bp, Rattus norvegicus
aaggtaaagcaatagttcccagaat

SEQ ID NO: 48741 - DNA, 25 bp, Rattus norvegicus
aaggtaaagtgcatcctccagacac

SEQ ID NO: 48742 - DNA, 25 bp, Rattus norvegicus
aaggtaaagtgcttcctccagacac

SEQ ID NO: 48743 - DNA, 25 bp, Rattus norvegicus
aaggtaaatcagcatcttcccagcc

SEQ ID NO: 48744 - DNA, 25 bp, Rattus norvegicus
aaggtaaatcaggatcttcccagcc

SEQ ID NO: 48745 - DNA, 25 bp, Rattus norvegicus
aaggtaaatggtcccgctgagctaa

SEQ ID NO: 48746 - DNA, 25 bp, Rattus norvegicus
aaggtaaatggtgccgctgagctaa

SEQ ID NO: 48747 - DNA, 25 bp, Rattus norvegicus
aaggtaacctctcacctgaggctgt

SEQ ID NO: 48748 - DNA, 25 bp, Rattus norvegicus
aaggtaacctctgacctgaggctgt

SEQ ID NO: 48749 - DNA, 25 bp, Rattus norvegicus
aaggtaacttctcatctcaactgga

SEQ ID NO: 48750 - DNA, 25 bp, Rattus norvegicus
aaggtaacttctgatctcaactgga

SEQ ID NO: 48751 - DNA, 25 bp, Rattus norvegicus
aaggtaagcctgctattgctcaccg

SEQ ID NO: 48752 - DNA, 25 bp, Rattus norvegicus
aaggtaagcctggtattgctcaccg

SEQ ID NO: 48753 - DNA, 25 bp, Rattus norvegicus
aaggtaaggtcactgtctcccatgt

SEQ ID NO: 48754 - DNA, 25 bp, Rattus norvegicus
aaggtaaggtcagtgtctcccatgt

SEQ ID NO: 48755 - DNA, 25 bp, Rattus norvegicus
aaggtaatcacaaagctagccggca

SEQ ID NO: 48756 - DNA, 25 bp, Rattus norvegicus
aaggtaatcacatagctagccggca

SEQ ID NO: 48757 - DNA, 25 bp, Rattus norvegicus
aaggtaatcgggagacgtaggcaat

SEQ ID NO: 48758 - DNA, 25 bp, Rattus norvegicus
aaggtaatcgggtgacgtaggcaat

SEQ ID NO: 48759 - DNA, 25 bp, Rattus norvegicus
aaggtaatggatccacccagccgac

SEQ ID NO: 48760 - DNA, 25 bp, Rattus norvegicus
aaggtaatggatgcacccagccgac

SEQ ID NO: 48761 - DNA, 25 bp, Rattus norvegicus
aaggtaatgtcaccgctattctttc

SEQ ID NO: 48762 - DNA, 25 bp, Rattus norvegicus
aaggtaatgtcagcgctattctttc

SEQ ID NO: 48763 - DNA, 25 bp, Rattus norvegicus
aaggtaattcatccgcaagtgtgat

SEQ ID NO: 48764 - DNA, 25 bp, Rattus norvegicus
aaggtaattcatgcgcaagtgtgat

SEQ ID NO: 48765 - DNA, 25 bp, Rattus norvegicus
aaggtaatttcaatccaggtaacat

SEQ ID NO: 48766 - DNA, 25 bp, Rattus norvegicus
aaggtaatttcattccaggtaacat

SEQ ID NO: 48767 - DNA, 25 bp, Rattus norvegicus
aaggtacacacccattcaccatgtc

SEQ ID NO: 48768 - DNA, 25 bp, Rattus norvegicus
aaggtacacaccgattcaccatgtc

SEQ ID NO: 48769 - DNA, 25 bp, Rattus norvegicus
aaggtacaccagaccgtcgcatgga

SEQ ID NO: 48770 - DNA, 25 bp, Rattus norvegicus
aaggtacaccagtccgtcgcatgga

SEQ ID NO: 48771 - DNA, 25 bp, Rattus norvegicus
aaggtacatgcaaggccagcatcta

SEQ ID NO: 48772 - DNA, 25 bp, Rattus norvegicus
aaggtacatgcatggccagcatcta

SEQ ID NO: 48773 - DNA, 25 bp, Rattus norvegicus
aaggtaccacaaaagtgctttatgc

SEQ ID NO: 48774 - DNA, 25 bp, Rattus norvegicus
aaggtaccacaatagtgctttatgc

SEQ ID NO: 48775 - DNA, 25 bp, Rattus norvegicus
aaggtaccacacactctctgaaggc

SEQ ID NO: 48776 - DNA, 25 bp, Rattus norvegicus
aaggtaccacactctctctgaaggc

SEQ ID NO: 48777 - DNA, 25 bp, Rattus norvegicus
aaggtaccagacatggtcacctcca

SEQ ID NO: 48778 - DNA, 25 bp, Rattus norvegicus
aaggtaccagacttggtcacctcca

SEQ ID NO: 48779 - DNA, 25 bp, Rattus norvegicus
aaggtacccgttccactgtaaatgt

SEQ ID NO: 48780 - DNA, 25 bp, Rattus norvegicus
aaggtacccgttgcactgtaaatgt

SEQ ID NO: 48781 - DNA, 25 bp, Rattus norvegicus
aaggtaccggagaatctcaactgag

SEQ ID NO: 48782 - DNA, 25 bp, Rattus norvegicus
aaggtaccggagtatctcaactgag

SEQ ID NO: 48783 - DNA, 25 bp, Rattus norvegicus
aaggtacctgtcactgtcagacacc

SEQ ID NO: 48784 - DNA, 25 bp, Rattus norvegicus
aaggtacctgtctctgtcagacacc

SEQ ID NO: 48785 - DNA, 25 bp, Rattus norvegicus
aaggtacctgtgatcagagtggcct

SEQ ID NO: 48786 - DNA, 25 bp, Rattus norvegicus
aaggtacctgtgttcagagtggcct

SEQ ID NO: 48787 - DNA, 25 bp, Rattus norvegicus
aaggtacgttacaggaatatcagaa

SEQ ID NO: 48788 - DNA, 25 bp, Rattus norvegicus
aaggtacgttactggaatatcagaa

SEQ ID NO: 48789 - DNA, 25 bp, Rattus norvegicus
aaggtactcagtcctaaatctggca

SEQ ID NO: 48790 - DNA, 25 bp, Rattus norvegicus
aaggtactcagtgctaaatctggca

SEQ ID NO: 48791 - DNA, 25 bp, Rattus norvegicus
aaggtactctggaagcttccttcct

SEQ ID NO: 48792 - DNA, 25 bp, Rattus norvegicus
aaggtactctggtagcttccttcct

SEQ ID NO: 48793 - DNA, 25 bp, Rattus norvegicus
aaggtactctgtcgatatccccttg

SEQ ID NO: 48794 - DNA, 25 bp, Rattus norvegicus
aaggtactctgtggatatccccttg

SEQ ID NO: 48795 - DNA, 25 bp, Rattus norvegicus
aaggtactgcatatggacagtgtat

SEQ ID NO: 48796 - DNA, 25 bp, Rattus norvegicus
aaggtactgcatttggacagtgtat

SEQ ID NO: 48797 - DNA, 25 bp, Rattus norvegicus
aaggtactggttccactactagccg

SEQ ID NO: 48798 - DNA, 25 bp, Rattus norvegicus
aaggtactggttgcactactagccg

SEQ ID NO: 48799 - DNA, 25 bp, Rattus norvegicus
aaggtacttagaccgacagcagtct

SEQ ID NO: 48800 - DNA, 25 bp, Rattus norvegicus
aaggtacttagagcgacagcagtct

SEQ ID NO: 48801 - DNA, 25 bp, Rattus norvegicus
aaggtagaatcccagcgtcgtgctt

SEQ ID NO: 48802 - DNA, 25 bp, Rattus norvegicus
aaggtagaatccgagcgtcgtgctt

SEQ ID NO: 48803 - DNA, 25 bp, Rattus norvegicus
aaggtagacgacacttttcctcaga

SEQ ID NO: 48804 - DNA, 25 bp, Rattus norvegicus
aaggtagacgactcttttcctcaga

SEQ ID NO: 48805 - DNA, 25 bp, Rattus norvegicus
aaggtagacttcactactgtgcgcc

SEQ ID NO: 48806 - DNA, 25 bp, Rattus norvegicus
aaggtagacttctctactgtgcgcc

SEQ ID NO: 48807 - DNA, 25 bp, Rattus norvegicus
aaggtagatgccaaaggtgcccatt

SEQ ID NO: 48808 - DNA, 25 bp, Rattus norvegicus
aaggtagatgcctaaggtgcccatt

SEQ ID NO: 48809 - DNA, 25 bp, Rattus norvegicus
aaggtagcacccacacaaagatgtg

SEQ ID NO: 48810 - DNA, 25 bp, Rattus norvegicus
aaggtagcaccctcacaaagatgtg

SEQ ID NO: 48811 - DNA, 25 bp, Rattus norvegicus
aaggtagcaggtagcatcttctccc

SEQ ID NO: 48812 - DNA, 25 bp, Rattus norvegicus
aaggtagcaggttgcatcttctccc

SEQ ID NO: 48813 - DNA, 25 bp, Rattus norvegicus
aaggtagccaatactgacactcata

SEQ ID NO: 48814 - DNA, 25 bp, Rattus norvegicus
aaggtagccaattctgacactcata

SEQ ID NO: 48815 - DNA, 25 bp, Rattus norvegicus
aaggtagccacccagagcggacact

SEQ ID NO: 48816 - DNA, 25 bp, Rattus norvegicus
aaggtagccaccgagagcggacact

SEQ ID NO: 48817 - DNA, 25 bp, Rattus norvegicus
aaggtagcccagaagtggcccagtt

SEQ ID NO: 48818 - DNA, 25 bp, Rattus norvegicus
aaggtagcccagtagtggcccagtt

SEQ ID NO: 48819 - DNA, 25 bp, Rattus norvegicus
aaggtagcgcatcctgacaagccag

SEQ ID NO: 48820 - DNA, 25 bp, Rattus norvegicus
aaggtagcgcatgctgacaagccag

SEQ ID NO: 48821 - DNA, 25 bp, Rattus norvegicus
aaggtagctgtgatacaagccccag

SEQ ID NO: 48822 - DNA, 25 bp, Rattus norvegicus
aaggtagctgtgttacaagccccag

SEQ ID NO: 48823 - DNA, 25 bp, Rattus norvegicus
aaggtagctttcaatccatcgcaaa

SEQ ID NO: 48824 - DNA, 25 bp, Rattus norvegicus
aaggtagctttctatccatcgcaaa

SEQ ID NO: 48825 - DNA, 25 bp, Rattus norvegicus
aaggtagctttgcttcatcctaact

SEQ ID NO: 48826 - DNA, 25 bp, Rattus norvegicus
aaggtagctttggttcatcctaact

SEQ ID NO: 48827 - DNA, 25 bp, Rattus norvegicus
aaggtaggcatgaagcctccgtctc

SEQ ID NO: 48828 - DNA, 25 bp, Rattus norvegicus
aaggtaggcatgtagcctccgtctc

SEQ ID NO: 48829 - DNA, 25 bp, Rattus norvegicus
aaggtagggtgtagcccacagtcgt

SEQ ID NO: 48830 - DNA, 25 bp, Rattus norvegicus
aaggtagggtgttgcccacagtcgt

SEQ ID NO: 48831 - DNA, 25 bp, Rattus norvegicus
aaggtagtcaatcaagttctgtttc

SEQ ID NO: 48832 - DNA, 25 bp, Rattus norvegicus
aaggtagtcaatgaagttctgtttc

SEQ ID NO: 48833 - DNA, 25 bp, Rattus norvegicus
aaggtagtgatgatactgtgacaaa

SEQ ID NO: 48834 - DNA, 25 bp, Rattus norvegicus
aaggtagtgatgttactgtgacaaa

SEQ ID NO: 48835 - DNA, 25 bp, Rattus norvegicus
aaggtagtgcctaaggtggaacagt

SEQ ID NO: 48836 - DNA, 25 bp, Rattus norvegicus
aaggtagtgccttaggtggaacagt

SEQ ID NO: 48837 - DNA, 25 bp, Rattus norvegicus
aaggtagttggcataagggcacagt

SEQ ID NO: 48838 - DNA, 25 bp, Rattus norvegicus
aaggtagttggcttaagggcacagt

SEQ ID NO: 48839 - DNA, 25 bp, Rattus norvegicus
aaggtataaggcacatccctgggct

SEQ ID NO: 48840 - DNA, 25 bp, Rattus norvegicus
aaggtataaggctcatccctgggct

SEQ ID NO: 48841 - DNA, 25 bp, Rattus norvegicus
aaggtatacactcatctccatggct

SEQ ID NO: 48842 - DNA, 25 bp, Rattus norvegicus
aaggtatacactgatctccatggct

SEQ ID NO: 48843 - DNA, 25 bp, Rattus norvegicus
aaggtatacctcagttccacggttg

SEQ ID NO: 48844 - DNA, 25 bp, Rattus norvegicus
aaggtatacctctgttccacggttg

SEQ ID NO: 48845 - DNA, 25 bp, Rattus norvegicus
aaggtatatgagagctctatttgca

SEQ ID NO: 48846 - DNA, 25 bp, Rattus norvegicus
aaggtatatgagtgctctatttgca

SEQ ID NO: 48847 - DNA, 25 bp, Rattus norvegicus
aaggtatcaatacccacagatccct

SEQ ID NO: 48848 - DNA, 25 bp, Rattus norvegicus
aaggtatcaatagccacagatccct

SEQ ID NO: 48849 - DNA, 25 bp, Rattus norvegicus
aaggtatcaggtactcatcccttga

SEQ ID NO: 48850 - DNA, 25 bp, Rattus norvegicus
aaggtatcaggttctcatcccttga

SEQ ID NO: 48851 - DNA, 25 bp, Rattus norvegicus
aaggtatcatctcatgtagtcactc

SEQ ID NO: 48852 - DNA, 25 bp, Rattus norvegicus
aaggtatcatctgatgtagtcactc

SEQ ID NO: 48853 - DNA, 25 bp, Rattus norvegicus
aaggtatccttgagtgtgtcaaagc

SEQ ID NO: 48854 - DNA, 25 bp, Rattus norvegicus
aaggtatccttgtgtgtgtcaaagc

SEQ ID NO: 48855 - DNA, 25 bp, Rattus norvegicus
aaggtatctggtcccaagcctgata

SEQ ID NO: 48856 - DNA, 25 bp, Rattus norvegicus
aaggtatctggtgccaagcctgata

SEQ ID NO: 48857 - DNA, 25 bp, Rattus norvegicus
aaggtatgactgaatcccagccaga

SEQ ID NO: 48858 - DNA, 25 bp, Rattus norvegicus
aaggtatgactgtatcccagccaga

SEQ ID NO: 48859 - DNA, 25 bp, Rattus norvegicus
aaggtatgcatgctgtcctgtaata

SEQ ID NO: 48860 - DNA, 25 bp, Rattus norvegicus
aaggtatgcatggtgtcctgtaata

SEQ ID NO: 48861 - DNA, 25 bp, Rattus norvegicus
aaggtatggactacctcttctccca

SEQ ID NO: 48862 - DNA, 25 bp, Rattus norvegicus
aaggtatggacttcctcttctccca

SEQ ID NO: 48863 - DNA, 25 bp, Rattus norvegicus
aaggtatggcttcccggtgaacttc

SEQ ID NO: 48864 - DNA, 25 bp, Rattus norvegicus
aaggtatggcttgccggtgaacttc

SEQ ID NO: 48865 - DNA, 25 bp, Rattus norvegicus
aaggtatggtgtatttcagccttca

SEQ ID NO: 48866 - DNA, 25 bp, Rattus norvegicus
aaggtatggtgtttttcagccttca

SEQ ID NO: 48867 - DNA, 25 bp, Rattus norvegicus
aaggtatgtcttctcagcatttgga

SEQ ID NO: 48868 - DNA, 25 bp, Rattus norvegicus
aaggtatgtcttgtcagcatttgga

SEQ ID NO: 48869 - DNA, 25 bp, Rattus norvegicus
aaggtatgtgcaaatatactctgaa

SEQ ID NO: 48870 - DNA, 25 bp, Rattus norvegicus
aaggtatgtgcatatatactctgaa

SEQ ID NO: 48871 - DNA, 25 bp, Rattus norvegicus
aaggtatgtgccactaggccctgct

SEQ ID NO: 48872 - DNA, 25 bp, Rattus norvegicus
aaggtatgtgcctctaggccctgct

SEQ ID NO: 48873 - DNA, 25 bp, Rattus norvegicus
aaggtattacctctatccaactgtc

SEQ ID NO: 48874 - DNA, 25 bp, Rattus norvegicus
aaggtattacctgtatccaactgtc

SEQ ID NO: 48875 - DNA, 25 bp, Rattus norvegicus
aaggtattatgtagccgaggccagc

SEQ ID NO: 48876 - DNA, 25 bp, Rattus norvegicus
aaggtattatgttgccgaggccagc

SEQ ID NO: 48877 - DNA, 25 bp, Rattus norvegicus
aaggtattctacagaggatgtctct

SEQ ID NO: 48878 - DNA, 25 bp, Rattus norvegicus
aaggtattctactgaggatgtctct

SEQ ID NO: 48879 - DNA, 25 bp, Rattus norvegicus
aaggtattcttcctgagaaagctga

SEQ ID NO: 48880 - DNA, 25 bp, Rattus norvegicus
aaggtattcttcgtgagaaagctga

SEQ ID NO: 48881 - DNA, 25 bp, Rattus norvegicus
aaggtcaaaaagagttccagtcatt

SEQ ID NO: 48882 - DNA, 25 bp, Rattus norvegicus
aaggtcaaaaagtgttccagtcatt

SEQ ID NO: 48883 - DNA, 25 bp, Rattus norvegicus
aaggtcaaaggcctacctgtcacac

SEQ ID NO: 48884 - DNA, 25 bp, Rattus norvegicus
aaggtcaaaggcgtacctgtcacac

SEQ ID NO: 48885 - DNA, 25 bp, Rattus norvegicus
aaggtcaaagtcaccagcctatgga

SEQ ID NO: 48886 - DNA, 25 bp, Rattus norvegicus
aaggtcaaagtctccagcctatgga

SEQ ID NO: 48887 - DNA, 25 bp, Rattus norvegicus
aaggtcaacttcaccaagcggtggc

SEQ ID NO: 48888 - DNA, 25 bp, Rattus norvegicus
aaggtcaacttctccaagcggtggc

SEQ ID NO: 48889 - DNA, 25 bp, Rattus norvegicus
aaggtcaagaccagcactactccgt

SEQ ID NO: 48890 - DNA, 25 bp, Rattus norvegicus
aaggtcaagacctgcactactccgt

SEQ ID NO: 48891 - DNA, 25 bp, Rattus norvegicus
aaggtcaaggacactacagcacaat

SEQ ID NO: 48892 - DNA, 25 bp, Rattus norvegicus
aaggtcaaggactctacagcacaat

SEQ ID NO: 48893 - DNA, 25 bp, Rattus norvegicus
aaggtcaaggctatgcttcttgtcg

SEQ ID NO: 48894 - DNA, 25 bp, Rattus norvegicus
aaggtcaaggctttgcttcttgtcg

SEQ ID NO: 48895 - DNA, 25 bp, Rattus norvegicus
aaggtcaagggtcctctagggccta

SEQ ID NO: 48896 - DNA, 25 bp, Rattus norvegicus
aaggtcaagggtgctctagggccta

SEQ ID NO: 48897 - DNA, 25 bp, Rattus norvegicus
aaggtcaagtttccctctagcgaga

SEQ ID NO: 48898 - DNA, 25 bp, Rattus norvegicus
aaggtcaagtttgcctctagcgaga

SEQ ID NO: 48899 - DNA, 25 bp, Rattus norvegicus
aaggtcacacctcaagctgtccaga

SEQ ID NO: 48900 - DNA, 25 bp, Rattus norvegicus
aaggtcacacctgaagctgtccaga

SEQ ID NO: 48901 - DNA, 25 bp, Rattus norvegicus
aaggtcacacgacaggacgctcagt

SEQ ID NO: 48902 - DNA, 25 bp, Rattus norvegicus
aaggtcacacgagaggacgctcagt

SEQ ID NO: 48903 - DNA, 25 bp, Rattus norvegicus
aaggtcacacggatttcgcttgtca

SEQ ID NO: 48904 - DNA, 25 bp, Rattus norvegicus
aaggtcacacggttttcgcttgtca

SEQ ID NO: 48905 - DNA, 25 bp, Rattus norvegicus
aaggtcacaggcaatagcattcaaa

SEQ ID NO: 48906 - DNA, 25 bp, Rattus norvegicus
aaggtcacaggctatagcattcaaa

SEQ ID NO: 48907 - DNA, 25 bp, Rattus norvegicus
aaggtcacatcactcatgttctcat

SEQ ID NO: 48908 - DNA, 25 bp, Rattus norvegicus
aaggtcacatcagtcatgttctcat

SEQ ID NO: 48909 - DNA, 25 bp, Rattus norvegicus
aaggtcaccaagaccgcacagaagg

SEQ ID NO: 48910 - DNA, 25 bp, Rattus norvegicus
aaggtcaccaagtccgcacagaagg

SEQ ID NO: 48911 - DNA, 25 bp, Rattus norvegicus
aaggtcaccaggactaatgctgcct

SEQ ID NO: 48912 - DNA, 25 bp, Rattus norvegicus
aaggtcaccaggtctaatgctgcct

SEQ ID NO: 48913 - DNA, 25 bp, Rattus norvegicus
aaggtcaccagtagttggattttct

SEQ ID NO: 48914 - DNA, 25 bp, Rattus norvegicus
aaggtcaccagttgttggattttct

SEQ ID NO: 48915 - DNA, 25 bp, Rattus norvegicus
aaggtcaccatcagttacctggcag

SEQ ID NO: 48916 - DNA, 25 bp, Rattus norvegicus
aaggtcaccatctgttacctggcag

SEQ ID NO: 48917 - DNA, 25 bp, Rattus norvegicus
aaggtcacgcctactcaggatttga

SEQ ID NO: 48918 - DNA, 25 bp, Rattus norvegicus
aaggtcacgccttctcaggatttga

SEQ ID NO: 48919 - DNA, 25 bp, Rattus norvegicus
aaggtcacggtgacagcattccgga

SEQ ID NO: 48920 - DNA, 25 bp, Rattus norvegicus
aaggtcacggtgtcagcattccgga

SEQ ID NO: 48921 - DNA, 25 bp, Rattus norvegicus
aaggtcactcacaccatcactgatg

SEQ ID NO: 48922 - DNA, 25 bp, Rattus norvegicus
aaggtcactcactccatcactgatg

SEQ ID NO: 48923 - DNA, 25 bp, Rattus norvegicus
aaggtcactccgcacattgagaagt

SEQ ID NO: 48924 - DNA, 25 bp, Rattus norvegicus
aaggtcactccggacattgagaagt

SEQ ID NO: 48925 - DNA, 25 bp, Rattus norvegicus
aaggtcactcttctgttttatcaag

SEQ ID NO: 48926 - DNA, 25 bp, Rattus norvegicus
aaggtcactcttgtgttttatcaag

SEQ ID NO: 48927 - DNA, 25 bp, Rattus norvegicus
aaggtcactgaaagccacttcctgt

SEQ ID NO: 48928 - DNA, 25 bp, Rattus norvegicus
aaggtcactgaatgccacttcctgt

SEQ ID NO: 48929 - DNA, 25 bp, Rattus norvegicus
aaggtcactgtacaagatctcttca

SEQ ID NO: 48930 - DNA, 25 bp, Rattus norvegicus
aaggtcactgtagaagatctcttca

SEQ ID NO: 48931 - DNA, 25 bp, Rattus norvegicus
aaggtcactgtgaactatccaccca

SEQ ID NO: 48932 - DNA, 25 bp, Rattus norvegicus
aaggtcactgtgtactatccaccca

SEQ ID NO: 48933 - DNA, 25 bp, Rattus norvegicus
aaggtcacttcacatgccatagtca

SEQ ID NO: 48934 - DNA, 25 bp, Rattus norvegicus
aaggtcacttcagatgccatagtca

SEQ ID NO: 48935 - DNA, 25 bp, Rattus norvegicus
aaggtcactttacatgtgagcacca

SEQ ID NO: 48936 - DNA, 25 bp, Rattus norvegicus
aaggtcactttagatgtgagcacca

SEQ ID NO: 48937 - DNA, 25 bp, Rattus norvegicus
aaggtcagagctacaactgctgccc

SEQ ID NO: 48938 - DNA, 25 bp, Rattus norvegicus
aaggtcagagcttcaactgctgccc

SEQ ID NO: 48939 - DNA, 25 bp, Rattus norvegicus
aaggtcagcacacaggtcagcttct

SEQ ID NO: 48940 - DNA, 25 bp, Rattus norvegicus
aaggtcagcacagaggtcagcttct

SEQ ID NO: 48941 - DNA, 25 bp, Rattus norvegicus
aaggtcagccgcatagcagactgga

SEQ ID NO: 48942 - DNA, 25 bp, Rattus norvegicus
aaggtcagccgcttagcagactgga

SEQ ID NO: 48943 - DNA, 25 bp, Rattus norvegicus
aaggtcaggactacagggctgcgcc

SEQ ID NO: 48944 - DNA, 25 bp, Rattus norvegicus
aaggtcaggacttcagggctgcgcc

SEQ ID NO: 48945 - DNA, 25 bp, Rattus norvegicus
aaggtcaggtgcattgttctgtctc

SEQ ID NO: 48946 - DNA, 25 bp, Rattus norvegicus
aaggtcaggtgctttgttctgtctc

SEQ ID NO: 48947 - DNA, 25 bp, Rattus norvegicus
aaggtcagtaccatctacacgcatc

SEQ ID NO: 48948 - DNA, 25 bp, Rattus norvegicus
aaggtcagtaccttctacacgcatc

SEQ ID NO: 48949 - DNA, 25 bp, Rattus norvegicus
aaggtcagtcttccatgcatacagc

SEQ ID NO: 48950 - DNA, 25 bp, Rattus norvegicus
aaggtcagtcttgcatgcatacagc

SEQ ID NO: 48951 - DNA, 25 bp, Rattus norvegicus
aaggtcagtgacaactgtccagaca

SEQ ID NO: 48952 - DNA, 25 bp, Rattus norvegicus
aaggtcagtgacatcttctatgaga

SEQ ID NO: 48953 - DNA, 25 bp, Rattus norvegicus
aaggtcagtgactactgtccagaca

SEQ ID NO: 48954 - DNA, 25 bp, Rattus norvegicus
aaggtcagtgacttcttctatgaga

SEQ ID NO: 48955 - DNA, 25 bp, Rattus norvegicus
aaggtcagtgttaccttgaaactag

SEQ ID NO: 48956 - DNA, 25 bp, Rattus norvegicus
aaggtcagtgtttccttgaaactag

SEQ ID NO: 48957 - DNA, 25 bp, Rattus norvegicus
aaggtcagttctaggacccgagcac

SEQ ID NO: 48958 - DNA, 25 bp, Rattus norvegicus
aaggtcagttcttggacccgagcac

SEQ ID NO: 48959 - DNA, 25 bp, Rattus norvegicus
aaggtcagtttaccactacagtaag

SEQ ID NO: 48960 - DNA, 25 bp, Rattus norvegicus
aaggtcagtttagcactacagtaag

SEQ ID NO: 48961 - DNA, 25 bp, Rattus norvegicus
aaggtcataaggatggaatggccac

SEQ ID NO: 48962 - DNA, 25 bp, Rattus norvegicus
aaggtcataaggttggaatggccac

SEQ ID NO: 48963 - DNA, 25 bp, Rattus norvegicus
aaggtcataagtatctcatctggct

SEQ ID NO: 48964 - DNA, 25 bp, Rattus norvegicus
aaggtcataagtttctcatctggct

SEQ ID NO: 48965 - DNA, 25 bp, Rattus norvegicus
aaggtcatcaagacgtatgccaaat

SEQ ID NO: 48966 - DNA, 25 bp, Rattus norvegicus
aaggtcatcaagtcgtatgccaaat

SEQ ID NO: 48967 - DNA, 25 bp, Rattus norvegicus
aaggtcatcagcaggctatgctctg

SEQ ID NO: 48968 - DNA, 25 bp, Rattus norvegicus
aaggtcatcagctggctatgctctg

SEQ ID NO: 48969 - DNA, 25 bp, Rattus norvegicus
aaggtcatcattcactatgtcagga

SEQ ID NO: 48970 - DNA, 25 bp, Rattus norvegicus
aaggtcatcattgactatgtcagga

SEQ ID NO: 48971 - DNA, 25 bp, Rattus norvegicus
aaggtcatccctatgaggccatggc

SEQ ID NO: 48972 - DNA, 25 bp, Rattus norvegicus
aaggtcatccctttgaggccatggc

SEQ ID NO: 48973 - DNA, 25 bp, Rattus norvegicus
aaggtcatcctccaagacataggga

SEQ ID NO: 48974 - DNA, 25 bp, Rattus norvegicus
aaggtcatcctcctatgttccagga

SEQ ID NO: 48975 - DNA, 25 bp, Rattus norvegicus
aaggtcatcctcgaagacataggga

SEQ ID NO: 48976 - DNA, 25 bp, Rattus norvegicus
aaggtcatcctcgtatgttccagga

SEQ ID NO: 48977 - DNA, 25 bp, Rattus norvegicus
aaggtcatccttagctaagtggaga

SEQ ID NO: 48978 - DNA, 25 bp, Rattus norvegicus
aaggtcatccttcccgtgattgagg

SEQ ID NO: 48979 - DNA, 25 bp, Rattus norvegicus
aaggtcatccttgccgtgattgagg

SEQ ID NO: 48980 - DNA, 25 bp, Rattus norvegicus
aaggtcatcctttgctaagtggaga

SEQ ID NO: 48981 - DNA, 25 bp, Rattus norvegicus
aaggtcatctcaaccaattggaagc

SEQ ID NO: 48982 - DNA, 25 bp, Rattus norvegicus
aaggtcatctcaacccgggagcagg

SEQ ID NO: 48983 - DNA, 25 bp, Rattus norvegicus
aaggtcatctcatccaattggaagc

SEQ ID NO: 48984 - DNA, 25 bp, Rattus norvegicus
aaggtcatctcatcccgggagcagg

SEQ ID NO: 48985 - DNA, 25 bp, Rattus norvegicus
aaggtcatcttcatcagtctctcga

SEQ ID NO: 48986 - DNA, 25 bp, Rattus norvegicus
aaggtcatcttcttcagtctctcga

SEQ ID NO: 48987 - DNA, 25 bp, Rattus norvegicus
aaggtcatgcaactagctactggtt

SEQ ID NO: 48988 - DNA, 25 bp, Rattus norvegicus
aaggtcatgcaagtagctactggtt

SEQ ID NO: 48989 - DNA, 25 bp, Rattus norvegicus
aaggtcatgctgcatcgtatcccac

SEQ ID NO: 48990 - DNA, 25 bp, Rattus norvegicus
aaggtcatgctggatcgtatcccac

SEQ ID NO: 48991 - DNA, 25 bp, Rattus norvegicus
aaggtcatggttactagttcctgaa

SEQ ID NO: 48992 - DNA, 25 bp, Rattus norvegicus
aaggtcatggtttctagttcctgaa

SEQ ID NO: 48993 - DNA, 25 bp, Rattus norvegicus
aaggtcatgttcaatggtgtcaaaa

SEQ ID NO: 48994 - DNA, 25 bp, Rattus norvegicus
aaggtcatgttctatggtgtcaaaa

SEQ ID NO: 48995 - DNA, 25 bp, Rattus norvegicus
aaggtcattgacaaccagcgggaac

SEQ ID NO: 48996 - DNA, 25 bp, Rattus norvegicus
aaggtcattgactaccagcgggaac

SEQ ID NO: 48997 - DNA, 25 bp, Rattus norvegicus
aaggtcattgccattaccagcatcc

SEQ ID NO: 48998 - DNA, 25 bp, Rattus norvegicus
aaggtcattgcctttaccagcatcc

SEQ ID NO: 48999 - DNA, 25 bp, Rattus norvegicus
aaggtcatttgtccagctgtcagaa

SEQ ID NO: 49000 - DNA, 25 bp, Rattus norvegicus
aaggtcatttgtgcagctgtcagaa

SEQ ID NO: 49001 - DNA, 25 bp, Rattus norvegicus
aaggtccaagctactgaacacttta

SEQ ID NO: 49002 - DNA, 25 bp, Rattus norvegicus
aaggtccaagcttctgaacacttta

SEQ ID NO: 49003 - DNA, 25 bp, Rattus norvegicus
aaggtccaagtaattctccatccta

SEQ ID NO: 49004 - DNA, 25 bp, Rattus norvegicus
aaggtccaagtatttctccatccta

SEQ ID NO: 49005 - DNA, 25 bp, Rattus norvegicus
aaggtccagcagactgagctcacaa

SEQ ID NO: 49006 - DNA, 25 bp, Rattus norvegicus
aaggtccagcagtctgagctcacaa

SEQ ID NO: 49007 - DNA, 25 bp, Rattus norvegicus
aaggtccagcatccctcgtcattga

SEQ ID NO: 49008 - DNA, 25 bp, Rattus norvegicus
aaggtccagcatgcctcgtcattga

SEQ ID NO: 49009 - DNA, 25 bp, Rattus norvegicus
aaggtccaggctattgcttagagta

SEQ ID NO: 49010 - DNA, 25 bp, Rattus norvegicus
aaggtccaggcttttgcttagagta

SEQ ID NO: 49011 - DNA, 25 bp, Rattus norvegicus
aaggtccaggtaatctagcacccag

SEQ ID NO: 49012 - DNA, 25 bp, Rattus norvegicus
aaggtccaggtattctagcacccag

SEQ ID NO: 49013 - DNA, 25 bp, Rattus norvegicus
aaggtccaggttaaactgcctgcct

SEQ ID NO: 49014 - DNA, 25 bp, Rattus norvegicus
aaggtccaggtttaactgcctgcct

SEQ ID NO: 49015 - DNA, 25 bp, Rattus norvegicus
aaggtccagtggactgacaccctgg

SEQ ID NO: 49016 - DNA, 25 bp, Rattus norvegicus
aaggtccagtggatcctgagccaac

SEQ ID NO: 49017 - DNA, 25 bp, Rattus norvegicus
aaggtccagtggtctgacaccctgg

SEQ ID NO: 49018 - DNA, 25 bp, Rattus norvegicus
aaggtccagtggttcctgagccaac

SEQ ID NO: 49019 - DNA, 25 bp, Rattus norvegicus
aaggtccatacactctgggtgaaca

SEQ ID NO: 49020 - DNA, 25 bp, Rattus norvegicus
aaggtccatacagtctgggtgaaca

SEQ ID NO: 49021 - DNA, 25 bp, Rattus norvegicus
aaggtccatatcacatgtgcactca

SEQ ID NO: 49022 - DNA, 25 bp, Rattus norvegicus
aaggtccatatctcatgtgcactca

SEQ ID NO: 49023 - DNA, 25 bp, Rattus norvegicus
aaggtccattcaacttgttctcctg

SEQ ID NO: 49024 - DNA, 25 bp, Rattus norvegicus
aaggtccattcatcttgttctcctg

SEQ ID NO: 49025 - DNA, 25 bp, Rattus norvegicus
aaggtcccatatagactgagtcagc

SEQ ID NO: 49026 - DNA, 25 bp, Rattus norvegicus
aaggtcccatattgactgagtcagc

SEQ ID NO: 49027 - DNA, 25 bp, Rattus norvegicus
aaggtcccatctaactcaggcatga

SEQ ID NO: 49028 - DNA, 25 bp, Rattus norvegicus
aaggtcccatcttactcaggcatga

SEQ ID NO: 49029 - DNA, 25 bp, Rattus norvegicus
aaggtcccatgaatactgtattcag

SEQ ID NO: 49030 - DNA, 25 bp, Rattus norvegicus
aaggtcccatgattactgtattcag

SEQ ID NO: 49031 - DNA, 25 bp, Rattus norvegicus
aaggtcccattgctactggagttca

SEQ ID NO: 49032 - DNA, 25 bp, Rattus norvegicus
aaggtcccattggtactggagttca

SEQ ID NO: 49033 - DNA, 25 bp, Rattus norvegicus
aaggtcccatttactaattgttcat

SEQ ID NO: 49034 - DNA, 25 bp, Rattus norvegicus
aaggtcccattttctaattgttcat

SEQ ID NO: 49035 - DNA, 25 bp, Rattus norvegicus
aaggtcccctggatcagtattcaga

SEQ ID NO: 49036 - DNA, 25 bp, Rattus norvegicus
aaggtcccctggttcagtattcaga

SEQ ID NO: 49037 - DNA, 25 bp, Rattus norvegicus
aaggtcccggccaccggagctgtgc

SEQ ID NO: 49038 - DNA, 25 bp, Rattus norvegicus
aaggtcccggcctccggagctgtgc

SEQ ID NO: 49039 - DNA, 25 bp, Rattus norvegicus
aaggtccctgaccattttgaggcca

SEQ ID NO: 49040 - DNA, 25 bp, Rattus norvegicus
aaggtccctgacctatttgcctggg

SEQ ID NO: 49041 - DNA, 25 bp, Rattus norvegicus
aaggtccctgacgattttgaggcca

SEQ ID NO: 49042 - DNA, 25 bp, Rattus norvegicus
aaggtccctgacgtatttgcctggg

SEQ ID NO: 49043 - DNA, 25 bp, Rattus norvegicus
aaggtccctgtactgggagtcagta

SEQ ID NO: 49044 - DNA, 25 bp, Rattus norvegicus
aaggtccctgtagtgggagtcagta

SEQ ID NO: 49045 - DNA, 25 bp, Rattus norvegicus
aaggtcccttctattttctatggca

SEQ ID NO: 49046 - DNA, 25 bp, Rattus norvegicus
aaggtcccttcttttttctatggca

SEQ ID NO: 49047 - DNA, 25 bp, Rattus norvegicus
aaggtccgcaacacttcatagcaga

SEQ ID NO: 49048 - DNA, 25 bp, Rattus norvegicus
aaggtccgcaactcttcatagcaga

SEQ ID NO: 49049 - DNA, 25 bp, Rattus norvegicus
aaggtccgctatactaacagctcca

SEQ ID NO: 49050 - DNA, 25 bp, Rattus norvegicus
aaggtccgctattctaacagctcca

SEQ ID NO: 49051 - DNA, 25 bp, Rattus norvegicus
aaggtccggagtatgtctgcacagc

SEQ ID NO: 49052 - DNA, 25 bp, Rattus norvegicus
aaggtccggagtttgtctgcacagc

SEQ ID NO: 49053 - DNA, 25 bp, Rattus norvegicus
aaggtcctactacagtctttcatag

SEQ ID NO: 49054 - DNA, 25 bp, Rattus norvegicus
aaggtcctactagagtctttcatag

SEQ ID NO: 49055 - DNA, 25 bp, Rattus norvegicus
aaggtcctaggactccttcaggtgt

SEQ ID NO: 49056 - DNA, 25 bp, Rattus norvegicus
aaggtcctaggagtccttcaggtgt

SEQ ID NO: 49057 - DNA, 25 bp, Rattus norvegicus
aaggtcctattaaccagggcactag

SEQ ID NO: 49058 - DNA, 25 bp, Rattus norvegicus
aaggtcctattatccagggcactag

SEQ ID NO: 49059 - DNA, 25 bp, Rattus norvegicus
aaggtcctcagaatgtttcctcatc

SEQ ID NO: 49060 - DNA, 25 bp, Rattus norvegicus
aaggtcctcagattgtttcctcatc

SEQ ID NO: 49061 - DNA, 25 bp, Rattus norvegicus
aaggtcctcagcaagggaagcacca

SEQ ID NO: 49062 - DNA, 25 bp, Rattus norvegicus
aaggtcctcagctagggaagcacca

SEQ ID NO: 49063 - DNA, 25 bp, Rattus norvegicus
aaggtcctcagtcggagcatggcca

SEQ ID NO: 49064 - DNA, 25 bp, Rattus norvegicus
aaggtcctcagtgggagcatggcca

SEQ ID NO: 49065 - DNA, 25 bp, Rattus norvegicus
aaggtcctcattcctgtttgtgata

SEQ ID NO: 49066 - DNA, 25 bp, Rattus norvegicus
aaggtcctcattgctgtttgtgata

SEQ ID NO: 49067 - DNA, 25 bp, Rattus norvegicus
aaggtcctccttctgcttgttgggt

SEQ ID NO: 49068 - DNA, 25 bp, Rattus norvegicus
aaggtcctccttgtgcttgttgggt

SEQ ID NO: 49069 - DNA, 25 bp, Rattus norvegicus
aaggtcctcgctaacagattcccat

SEQ ID NO: 49070 - DNA, 25 bp, Rattus norvegicus
aaggtcctcgcttacagattcccat

SEQ ID NO: 49071 - DNA, 25 bp, Rattus norvegicus
aaggtcctgacactcaacatcggga

SEQ ID NO: 49072 - DNA, 25 bp, Rattus norvegicus
aaggtcctgacagtcaacatcggga

SEQ ID NO: 49073 - DNA, 25 bp, Rattus norvegicus
aaggtcctgactaatcaacagacgg

SEQ ID NO: 49074 - DNA, 25 bp, Rattus norvegicus
aaggtcctgacttatcaacagacgg

SEQ ID NO: 49075 - DNA, 25 bp, Rattus norvegicus
aaggtcctgattcataatccaacaa

SEQ ID NO: 49076 - DNA, 25 bp, Rattus norvegicus
aaggtcctgattgataatccaacaa

SEQ ID NO: 49077 - DNA, 25 bp, Rattus norvegicus
aaggtcctgcagctcaccaaagact

SEQ ID NO: 49078 - DNA, 25 bp, Rattus norvegicus
aaggtcctgcaggtcaccaaagact

SEQ ID NO: 49079 - DNA, 25 bp, Rattus norvegicus
aaggtcctgctcactttttcttgtc

SEQ ID NO: 49080 - DNA, 25 bp, Rattus norvegicus
aaggtcctgctctctttttcttgtc

SEQ ID NO: 49081 - DNA, 25 bp, Rattus norvegicus
aaggtcctgctgaatggtctgggct

SEQ ID NO: 49082 - DNA, 25 bp, Rattus norvegicus
aaggtcctgctgtatggtctgggct

SEQ ID NO: 49083 - DNA, 25 bp, Rattus norvegicus
aaggtcctggctatcagcagtgact

SEQ ID NO: 49084 - DNA, 25 bp, Rattus norvegicus
aaggtcctggctttcagcagtgact

SEQ ID NO: 49085 - DNA, 25 bp, Rattus norvegicus
aaggtcctgtgtctggttcatccca

SEQ ID NO: 49086 - DNA, 25 bp, Rattus norvegicus
aaggtcctgtgtgtggttcatccca

SEQ ID NO: 49087 - DNA, 25 bp, Rattus norvegicus
aaggtcctgtttcaagtgctgctgc

SEQ ID NO: 49088 - DNA, 25 bp, Rattus norvegicus
aaggtcctgtttgaagtgctgctgc

SEQ ID NO: 49089 - DNA, 25 bp, Rattus norvegicus
aaggtccttcatcctagtacttagg

SEQ ID NO: 49090 - DNA, 25 bp, Rattus norvegicus
aaggtccttcatgctagtacttagg

SEQ ID NO: 49091 - DNA, 25 bp, Rattus norvegicus
aaggtccttgaacggctgttgctca

SEQ ID NO: 49092 - DNA, 25 bp, Rattus norvegicus
aaggtccttgaagggctgttgctca

SEQ ID NO: 49093 - DNA, 25 bp, Rattus norvegicus
aaggtccttttcactaggtccatag

SEQ ID NO: 49094 - DNA, 25 bp, Rattus norvegicus
aaggtccttttctctaggtccatag

SEQ ID NO: 49095 - DNA, 25 bp, Rattus norvegicus
aaggtccttttgctgagcgtttgag

SEQ ID NO: 49096 - DNA, 25 bp, Rattus norvegicus
aaggtccttttggtgagcgtttgag

SEQ ID NO: 49097 - DNA, 25 bp, Rattus norvegicus
aaggtcgaaggacagctttctacaa

SEQ ID NO: 49098 - DNA, 25 bp, Rattus norvegicus
aaggtcgaaggagagctttctacaa

SEQ ID NO: 49099 - DNA, 25 bp, Rattus norvegicus
aaggtcgaagtgaaaccagtcacgg

SEQ ID NO: 49100 - DNA, 25 bp, Rattus norvegicus
aaggtcgaagtgtaaccagtcacgg

SEQ ID NO: 49101 - DNA, 25 bp, Rattus norvegicus
aaggtcgatgcactgctgctctctg

SEQ ID NO: 49102 - DNA, 25 bp, Rattus norvegicus
aaggtcgatgcagtgctgctctctg

SEQ ID NO: 49103 - DNA, 25 bp, Rattus norvegicus
aaggtcgcattcagacactagtcat

SEQ ID NO: 49104 - DNA, 25 bp, Rattus norvegicus
aaggtcgcattctgacactagtcat

SEQ ID NO: 49105 - DNA, 25 bp, Rattus norvegicus
aaggtcgcttacagattgccgcctg

SEQ ID NO: 49106 - DNA, 25 bp, Rattus norvegicus
aaggtcgcttactgattgccgcctg

SEQ ID NO: 49107 - DNA, 25 bp, Rattus norvegicus
aaggtcggcttgagcgcacctccgg

SEQ ID NO: 49108 - DNA, 25 bp, Rattus norvegicus
aaggtcggcttgtgcgcacctccgg

SEQ ID NO: 49109 - DNA, 25 bp, Rattus norvegicus
aaggtcggtctgcttattgtctatt

SEQ ID NO: 49110 - DNA, 25 bp, Rattus norvegicus
aaggtcggtctggttattgtctatt

SEQ ID NO: 49111 - DNA, 25 bp, Rattus norvegicus
aaggtcgtcagcactactttgttgc

SEQ ID NO: 49112 - DNA, 25 bp, Rattus norvegicus
aaggtcgtcagctctactttgttgc

SEQ ID NO: 49113 - DNA, 25 bp, Rattus norvegicus
aaggtcgtcattacatcgtggaagc

SEQ ID NO: 49114 - DNA, 25 bp, Rattus norvegicus
aaggtcgtcatttcatcgtggaagc

SEQ ID NO: 49115 - DNA, 25 bp, Rattus norvegicus
aaggtctaacttctgcagctatcgg

SEQ ID NO: 49116 - DNA, 25 bp, Rattus norvegicus
aaggtctaacttgtgcagctatcgg

SEQ ID NO: 49117 - DNA, 25 bp, Rattus norvegicus
aaggtctactccaactacaatctag

SEQ ID NO: 49118 - DNA, 25 bp, Rattus norvegicus
aaggtctactcctactacaatctag

SEQ ID NO: 49119 - DNA, 25 bp, Rattus norvegicus
aaggtctacttcactgtcttcttta

SEQ ID NO: 49120 - DNA, 25 bp, Rattus norvegicus
aaggtctacttctctgtcttcttta

SEQ ID NO: 49121 - DNA, 25 bp, Rattus norvegicus
aaggtctaggaaacccagtctgcta

SEQ ID NO: 49122 - DNA, 25 bp, Rattus norvegicus
aaggtctaggaatcccagtctgcta

SEQ ID NO: 49123 - DNA, 25 bp, Rattus norvegicus
aaggtctatctaaggtttcctgact

SEQ ID NO: 49124 - DNA, 25 bp, Rattus norvegicus
aaggtctatctatggtttcctgact

SEQ ID NO: 49125 - DNA, 25 bp, Rattus norvegicus
aaggtctatgtcaagaacctcactg

SEQ ID NO: 49126 - DNA, 25 bp, Rattus norvegicus
aaggtctatgtctagaacctcactg

SEQ ID NO: 49127 - DNA, 25 bp, Rattus norvegicus
aaggtctattataccttccttgcat

SEQ ID NO: 49128 - DNA, 25 bp, Rattus norvegicus
aaggtctattattccttccttgcat

SEQ ID NO: 49129 - DNA, 25 bp, Rattus norvegicus
aaggtctcaagcctcctggcaggtg

SEQ ID NO: 49130 - DNA, 25 bp, Rattus norvegicus
aaggtctcaagcgtcctggcaggtg

SEQ ID NO: 49131 - DNA, 25 bp, Rattus norvegicus
aaggtctccctgaatgctgtacctt

SEQ ID NO: 49132 - DNA, 25 bp, Rattus norvegicus
aaggtctccctgaggacacctattt

SEQ ID NO: 49133 - DNA, 25 bp, Rattus norvegicus
aaggtctccctgtatgctgtacctt

SEQ ID NO: 49134 - DNA, 25 bp, Rattus norvegicus
aaggtctccctgtggacacctattt

SEQ ID NO: 49135 - DNA, 25 bp, Rattus norvegicus
aaggtctcctgtcctgatgccaggg

SEQ ID NO: 49136 - DNA, 25 bp, Rattus norvegicus
aaggtctcctgtgctgatgccaggg

SEQ ID NO: 49137 - DNA, 25 bp, Rattus norvegicus
aaggtctcgaatatggtccctagca

SEQ ID NO: 49138 - DNA, 25 bp, Rattus norvegicus
aaggtctcgaatttggtccctagca

SEQ ID NO: 49139 - DNA, 25 bp, Rattus norvegicus
aaggtctcgcctacaacatgattga

SEQ ID NO: 49140 - DNA, 25 bp, Rattus norvegicus
aaggtctcgccttcaacatgattga

SEQ ID NO: 49141 - DNA, 25 bp, Rattus norvegicus
aaggtctctcctagctattcttggc

SEQ ID NO: 49142 - DNA, 25 bp, Rattus norvegicus
aaggtctctcctaggtgcctcagat

SEQ ID NO: 49143 - DNA, 25 bp, Rattus norvegicus
aaggtctctccttgctattcttggc

SEQ ID NO: 49144 - DNA, 25 bp, Rattus norvegicus
aaggtctctccttggtgcctcagat

SEQ ID NO: 49145 - DNA, 25 bp, Rattus norvegicus
aaggtctctctgaatcctcaaaggt

SEQ ID NO: 49146 - DNA, 25 bp, Rattus norvegicus
aaggtctctctgtatcctcaaaggt

SEQ ID NO: 49147 - DNA, 25 bp, Rattus norvegicus
aaggtctctggtatttagcatgcta

SEQ ID NO: 49148 - DNA, 25 bp, Rattus norvegicus
aaggtctctggtttttagcatgcta

SEQ ID NO: 49149 - DNA, 25 bp, Rattus norvegicus
aaggtctcttccaatgattccattt

SEQ ID NO: 49150 - DNA, 25 bp, Rattus norvegicus
aaggtctcttcctatgattccattt

SEQ ID NO: 49151 - DNA, 25 bp, Rattus norvegicus
aaggtctcttctcctgagtctcaga

SEQ ID NO: 49152 - DNA, 25 bp, Rattus norvegicus
aaggtctcttctgctgagtctcaga

SEQ ID NO: 49153 - DNA, 25 bp, Rattus norvegicus
aaggtctgaagaaccctggcttaga

SEQ ID NO: 49154 - DNA, 25 bp, Rattus norvegicus
aaggtctgaagatccctggcttaga

SEQ ID NO: 49155 - DNA, 25 bp, Rattus norvegicus
aaggtctgacgccatctccagagat

SEQ ID NO: 49156 - DNA, 25 bp, Rattus norvegicus
aaggtctgacgcgatctccagagat

SEQ ID NO: 49157 - DNA, 25 bp, Rattus norvegicus
aaggtctgagacctgcttcatgcca

SEQ ID NO: 49158 - DNA, 25 bp, Rattus norvegicus
aaggtctgagacgtgcttcatgcca

SEQ ID NO: 49159 - DNA, 25 bp, Rattus norvegicus
aaggtctgcctgaccctgtgtgtaa

SEQ ID NO: 49160 - DNA, 25 bp, Rattus norvegicus
aaggtctgcctgtccctgtgtgtaa

SEQ ID NO: 49161 - DNA, 25 bp, Rattus norvegicus
aaggtctgcggacctacttctcagc

SEQ ID NO: 49162 - DNA, 25 bp, Rattus norvegicus
aaggtctgcggagctacttctcagc

SEQ ID NO: 49163 - DNA, 25 bp, Rattus norvegicus
aaggtctgctggcaacctctgaact

SEQ ID NO: 49164 - DNA, 25 bp, Rattus norvegicus
aaggtctgctgggaacctctgaact

SEQ ID NO: 49165 - DNA, 25 bp, Rattus norvegicus
aaggtctggaggattctatatacac

SEQ ID NO: 49166 - DNA, 25 bp, Rattus norvegicus
aaggtctggaggtttctatatacac

SEQ ID NO: 49167 - DNA, 25 bp, Rattus norvegicus
aaggtctggatcattgtgctgcctc

SEQ ID NO: 49168 - DNA, 25 bp, Rattus norvegicus
aaggtctggatctttgtgctgcctc

SEQ ID NO: 49169 - DNA, 25 bp, Rattus norvegicus
aaggtctgggatattgtgcacaact

SEQ ID NO: 49170 - DNA, 25 bp, Rattus norvegicus
aaggtctgggattttgtgcacaact

SEQ ID NO: 49171 - DNA, 25 bp, Rattus norvegicus
aaggtctgtagtccctaggactgca

SEQ ID NO: 49172 - DNA, 25 bp, Rattus norvegicus
aaggtctgtagtgcctaggactgca

SEQ ID NO: 49173 - DNA, 25 bp, Rattus norvegicus
aaggtctgtcagaggcctgtgtcac

SEQ ID NO: 49174 - DNA, 25 bp, Rattus norvegicus
aaggtctgtcagtggcctgtgtcac

SEQ ID NO: 49175 - DNA, 25 bp, Rattus norvegicus
aaggtctgtcttccggtgagtctcc

SEQ ID NO: 49176 - DNA, 25 bp, Rattus norvegicus
aaggtctgtcttgcggtgagtctcc

SEQ ID NO: 49177 - DNA, 25 bp, Rattus norvegicus
aaggtctgtgagatccactttctct

SEQ ID NO: 49178 - DNA, 25 bp, Rattus norvegicus
aaggtctgtgagttccactttctct

SEQ ID NO: 49179 - DNA, 25 bp, Rattus norvegicus
aaggtctgtgccctggctgctacca

SEQ ID NO: 49180 - DNA, 25 bp, Rattus norvegicus
aaggtctgtgccgtggctgctacca

SEQ ID NO: 49181 - DNA, 25 bp, Rattus norvegicus
aaggtctgtggaaggtttcttgtcc

SEQ ID NO: 49182 - DNA, 25 bp, Rattus norvegicus
aaggtctgtggatggtttcttgtcc

SEQ ID NO: 49183 - DNA, 25 bp, Rattus norvegicus
aaggtctgtttgaagtccgagccca

SEQ ID NO: 49184 - DNA, 25 bp, Rattus norvegicus
aaggtctgtttgtagtccgagccca

SEQ ID NO: 49185 - DNA, 25 bp, Rattus norvegicus
aaggtcttactgacaagttctgtgt

SEQ ID NO: 49186 - DNA, 25 bp, Rattus norvegicus
aaggtcttactgtcaagttctgtgt

SEQ ID NO: 49187 - DNA, 25 bp, Rattus norvegicus
aaggtcttagcaattaatattcagc

SEQ ID NO: 49188 - DNA, 25 bp, Rattus norvegicus
aaggtcttagcacataagccccgtg

SEQ ID NO: 49189 - DNA, 25 bp, Rattus norvegicus
aaggtcttagcagataagccccgtg

SEQ ID NO: 49190 - DNA, 25 bp, Rattus norvegicus
aaggtcttagcatttaatattcagc

SEQ ID NO: 49191 - DNA, 25 bp, Rattus norvegicus
aaggtcttagtcactgatctctctc

SEQ ID NO: 49192 - DNA, 25 bp, Rattus norvegicus
aaggtcttagtctctgatctctctc

SEQ ID NO: 49193 - DNA, 25 bp, Rattus norvegicus
aaggtcttcaccattgcatactgct

SEQ ID NO: 49194 - DNA, 25 bp, Rattus norvegicus
aaggtcttcacctttgcatactgct

SEQ ID NO: 49195 - DNA, 25 bp, Rattus norvegicus
aaggtcttcctcagagtgttctttt

SEQ ID NO: 49196 - DNA, 25 bp, Rattus norvegicus
aaggtcttcctctgagtgttctttt

SEQ ID NO: 49197 - DNA, 25 bp, Rattus norvegicus
aaggtcttccttcccattcggaggt

SEQ ID NO: 49198 - DNA, 25 bp, Rattus norvegicus
aaggtcttccttgccattcggaggt

SEQ ID NO: 49199 - DNA, 25 bp, Rattus norvegicus
aaggtcttctctcacaagggctgca

SEQ ID NO: 49200 - DNA, 25 bp, Rattus norvegicus
aaggtcttctctgacaagggctgca

SEQ ID NO: 49201 - DNA, 25 bp, Rattus norvegicus
aaggtcttgagtagcccaggctggc

SEQ ID NO: 49202 - DNA, 25 bp, Rattus norvegicus
aaggtcttgagttgcccaggctggc

SEQ ID NO: 49203 - DNA, 25 bp, Rattus norvegicus
aaggtcttgatgacttcgcctttaa

SEQ ID NO: 49204 - DNA, 25 bp, Rattus norvegicus
aaggtcttgatgtcttcgcctttaa

SEQ ID NO: 49205 - DNA, 25 bp, Rattus norvegicus
aaggtcttgcccagatctgttctgc

SEQ ID NO: 49206 - DNA, 25 bp, Rattus norvegicus
aaggtcttgccctgatctgttctgc

SEQ ID NO: 49207 - DNA, 25 bp, Rattus norvegicus
aaggtcttggcaagtattattttag

SEQ ID NO: 49208 - DNA, 25 bp, Rattus norvegicus
aaggtcttggcatgtattattttag

SEQ ID NO: 49209 - DNA, 25 bp, Rattus norvegicus
aaggtcttggccagaggaatatcat

SEQ ID NO: 49210 - DNA, 25 bp, Rattus norvegicus
aaggtcttggcctgaggaatatcat

SEQ ID NO: 49211 - DNA, 25 bp, Rattus norvegicus
aaggtcttggtgacagataccactg

SEQ ID NO: 49212 - DNA, 25 bp, Rattus norvegicus
aaggtcttggtgtcagataccactg

SEQ ID NO: 49213 - DNA, 25 bp, Rattus norvegicus
aaggtcttggttatctatattaaat

SEQ ID NO: 49214 - DNA, 25 bp, Rattus norvegicus
aaggtcttggttttctatattaaat

SEQ ID NO: 49215 - DNA, 25 bp, Rattus norvegicus
aaggtcttgtgtactcgctgtatca

SEQ ID NO: 49216 - DNA, 25 bp, Rattus norvegicus
aaggtcttgtgttctcgctgtatca

SEQ ID NO: 49217 - DNA, 25 bp, Rattus norvegicus
aaggtcttgttgaccaccattgctt

SEQ ID NO: 49218 - DNA, 25 bp, Rattus norvegicus
aaggtcttgttgtccaccattgctt

SEQ ID NO: 49219 - DNA, 25 bp, Rattus norvegicus
aaggtctttatcagctttctgtcag

SEQ ID NO: 49220 - DNA, 25 bp, Rattus norvegicus
aaggtctttatctgctttctgtcag

SEQ ID NO: 49221 - DNA, 25 bp, Rattus norvegicus
aaggtctttgacagactggtccctt

SEQ ID NO: 49222 - DNA, 25 bp, Rattus norvegicus
aaggtctttgacattgagctgagca

SEQ ID NO: 49223 - DNA, 25 bp, Rattus norvegicus
aaggtctttgaccttttctcagcca

SEQ ID NO: 49224 - DNA, 25 bp, Rattus norvegicus
aaggtctttgacgttttctcagcca

SEQ ID NO: 49225 - DNA, 25 bp, Rattus norvegicus
aaggtctttgactgactggtccctt

SEQ ID NO: 49226 - DNA, 25 bp, Rattus norvegicus
aaggtctttgactttgagctgagca

SEQ ID NO: 49227 - DNA, 25 bp, Rattus norvegicus
aaggtctttgatatgcggcagtgtc

SEQ ID NO: 49228 - DNA, 25 bp, Rattus norvegicus
aaggtctttgatttgcggcagtgtc

SEQ ID NO: 49229 - DNA, 25 bp, Rattus norvegicus
aaggtgaagaccaagaattcccagc

SEQ ID NO: 49230 - DNA, 25 bp, Rattus norvegicus
aaggtgaagaccacctgtcatgtct

SEQ ID NO: 49231 - DNA, 25 bp, Rattus norvegicus
aaggtgaagacctagaattcccagc

SEQ ID NO: 49232 - DNA, 25 bp, Rattus norvegicus
aaggtgaagacctcctgtcatgtct

SEQ ID NO: 49233 - DNA, 25 bp, Rattus norvegicus
aaggtgaaggccaacaagcgccagg

SEQ ID NO: 49234 - DNA, 25 bp, Rattus norvegicus
aaggtgaaggcctacaagcgccagg

SEQ ID NO: 49235 - DNA, 25 bp, Rattus norvegicus
aaggtgaagtccactgggatccgag

SEQ ID NO: 49236 - DNA, 25 bp, Rattus norvegicus
aaggtgaagtcctctgggatccgag

SEQ ID NO: 49237 - DNA, 25 bp, Rattus norvegicus
aaggtgaatcttcctcactcagaaa

SEQ ID NO: 49238 - DNA, 25 bp, Rattus norvegicus
aaggtgaatcttgctcactcagaaa

SEQ ID NO: 49239 - DNA, 25 bp, Rattus norvegicus
aaggtgaatgctagtttgcgcagtc

SEQ ID NO: 49240 - DNA, 25 bp, Rattus norvegicus
aaggtgaatgcttgtttgcgcagtc

SEQ ID NO: 49241 - DNA, 25 bp, Rattus norvegicus
aaggtgacacctcgcagtctagggt

SEQ ID NO: 49242 - DNA, 25 bp, Rattus norvegicus
aaggtgacacctggcagtctagggt

SEQ ID NO: 49243 - DNA, 25 bp, Rattus norvegicus
aaggtgacatttcctggtgtcttta

SEQ ID NO: 49244 - DNA, 25 bp, Rattus norvegicus
aaggtgacatttgctggtgtcttta

SEQ ID NO: 49245 - DNA, 25 bp, Rattus norvegicus
aaggtgaccagcatctgcgaccaca

SEQ ID NO: 49246 - DNA, 25 bp, Rattus norvegicus
aaggtgaccagcttctgcgaccaca

SEQ ID NO: 49247 - DNA, 25 bp, Rattus norvegicus
aaggtgaccataagggatcctcccc

SEQ ID NO: 49248 - DNA, 25 bp, Rattus norvegicus
aaggtgaccatatgggatcctcccc

SEQ ID NO: 49249 - DNA, 25 bp, Rattus norvegicus
aaggtgacccagaatgctctgtcgc

SEQ ID NO: 49250 - DNA, 25 bp, Rattus norvegicus
aaggtgacccagtatgctctgtcgc

SEQ ID NO: 49251 - DNA, 25 bp, Rattus norvegicus
aaggtgaccccgcagggctaacatg

SEQ ID NO: 49252 - DNA, 25 bp, Rattus norvegicus
aaggtgaccccggagggctaacatg

SEQ ID NO: 49253 - DNA, 25 bp, Rattus norvegicus
aaggtgacctcaatttcccggattg

SEQ ID NO: 49254 - DNA, 25 bp, Rattus norvegicus
aaggtgacctcacatgcacctgtct

SEQ ID NO: 49255 - DNA, 25 bp, Rattus norvegicus
aaggtgacctcagatgcacctgtct

SEQ ID NO: 49256 - DNA, 25 bp, Rattus norvegicus
aaggtgacctcattttcccggattg

SEQ ID NO: 49257 - DNA, 25 bp, Rattus norvegicus
aaggtgacctccaagtgtggttcct

SEQ ID NO: 49258 - DNA, 25 bp, Rattus norvegicus
aaggtgacctcctagtgtggttcct

SEQ ID NO: 49259 - DNA, 25 bp, Rattus norvegicus
aaggtgacgataacgaaatgccctg

SEQ ID NO: 49260 - DNA, 25 bp, Rattus norvegicus
aaggtgacgatatcgaaatgccctg

SEQ ID NO: 49261 - DNA, 25 bp, Rattus norvegicus
aaggtgacgcccaagccagcgtcca

SEQ ID NO: 49262 - DNA, 25 bp, Rattus norvegicus
aaggtgacgccctagccagcgtcca

SEQ ID NO: 49263 - DNA, 25 bp, Rattus norvegicus
aaggtgacggcgaacttctcctgaa

SEQ ID NO: 49264 - DNA, 25 bp, Rattus norvegicus
aaggtgacggcgtacttctcctgaa

SEQ ID NO: 49265 - DNA, 25 bp, Rattus norvegicus
aaggtgactgcaaggagccactcct

SEQ ID NO: 49266 - DNA, 25 bp, Rattus norvegicus
aaggtgactgcatggagccactcct

SEQ ID NO: 49267 - DNA, 25 bp, Rattus norvegicus
aaggtgactgggagagctttctttc

SEQ ID NO: 49268 - DNA, 25 bp, Rattus norvegicus
aaggtgactgggtgagctttctttc

SEQ ID NO: 49269 - DNA, 25 bp, Rattus norvegicus
aaggtgacttaaaaccagtgtttct

SEQ ID NO: 49270 - DNA, 25 bp, Rattus norvegicus
aaggtgacttaataccagtgtttct

SEQ ID NO: 49271 - DNA, 25 bp, Rattus norvegicus
aaggtgagctttcttctgtcttgaa

SEQ ID NO: 49272 - DNA, 25 bp, Rattus norvegicus
aaggtgagctttgttctgtcttgaa

SEQ ID NO: 49273 - DNA, 25 bp, Rattus norvegicus
aaggtgaggcctacctttcagtgtt

SEQ ID NO: 49274 - DNA, 25 bp, Rattus norvegicus
aaggtgaggccttcctttcagtgtt

SEQ ID NO: 49275 - DNA, 25 bp, Rattus norvegicus
aaggtgaggctgactcctatgccat

SEQ ID NO: 49276 - DNA, 25 bp, Rattus norvegicus
aaggtgaggctgtctcctatgccat

SEQ ID NO: 49277 - DNA, 25 bp, Rattus norvegicus
aaggtgataaatctcttccggccca

SEQ ID NO: 49278 - DNA, 25 bp, Rattus norvegicus
aaggtgataaatgtcttccggccca

SEQ ID NO: 49279 - DNA, 25 bp, Rattus norvegicus
aaggtgatacccaagaactaatgtg

SEQ ID NO: 49280 - DNA, 25 bp, Rattus norvegicus
aaggtgataccctagaactaatgtg

SEQ ID NO: 49281 - DNA, 25 bp, Rattus norvegicus
aaggtgatacttcgaggttctctca

SEQ ID NO: 49282 - DNA, 25 bp, Rattus norvegicus
aaggtgatacttggaggttctctca

SEQ ID NO: 49283 - DNA, 25 bp, Rattus norvegicus
aaggtgatatcacaggccgcttctc

SEQ ID NO: 49284 - DNA, 25 bp, Rattus norvegicus
aaggtgatatcagaggccgcttctc

SEQ ID NO: 49285 - DNA, 25 bp, Rattus norvegicus
aaggtgatatctccttctggtcatg

SEQ ID NO: 49286 - DNA, 25 bp, Rattus norvegicus
aaggtgatatctgcttctggtcatg

SEQ ID NO: 49287 - DNA, 25 bp, Rattus norvegicus
aaggtgatatgtctcccagtcaact

SEQ ID NO: 49288 - DNA, 25 bp, Rattus norvegicus
aaggtgatatgtgtcccagtcaact

SEQ ID NO: 49289 - DNA, 25 bp, Rattus norvegicus
aaggtgatccgccatgacgactttg

SEQ ID NO: 49290 - DNA, 25 bp, Rattus norvegicus
aaggtgatccgcgatgacgactttg

SEQ ID NO: 49291 - DNA, 25 bp, Rattus norvegicus
aaggtgatcctcataaactcttggg

SEQ ID NO: 49292 - DNA, 25 bp, Rattus norvegicus
aaggtgatcctcttaaactcttggg

SEQ ID NO: 49293 - DNA, 25 bp, Rattus norvegicus
aaggtgatctttcagagtccctctc

SEQ ID NO: 49294 - DNA, 25 bp, Rattus norvegicus
aaggtgatctttgagagtccctctc

SEQ ID NO: 49295 - DNA, 25 bp, Rattus norvegicus
aaggtgatgatcctcatgctggcag

SEQ ID NO: 49296 - DNA, 25 bp, Rattus norvegicus
aaggtgatgatcgtcatgctggcag

SEQ ID NO: 49297 - DNA, 25 bp, Rattus norvegicus
aaggtgatgctcatcggcttgggaa

SEQ ID NO: 49298 - DNA, 25 bp, Rattus norvegicus
aaggtgatgctcttcggcttgggaa

SEQ ID NO: 49299 - DNA, 25 bp, Rattus norvegicus
aaggtgatggacattccccattagc

SEQ ID NO: 49300 - DNA, 25 bp, Rattus norvegicus
aaggtgatggactttccccattagc

SEQ ID NO: 49301 - DNA, 25 bp, Rattus norvegicus
aaggtgatggctactattcagtgca

SEQ ID NO: 49302 - DNA, 25 bp, Rattus norvegicus
aaggtgatggcttctattcagtgca

SEQ ID NO: 49303 - DNA, 25 bp, Rattus norvegicus
aaggtgattataaccctggcaggaa

SEQ ID NO: 49304 - DNA, 25 bp, Rattus norvegicus
aaggtgattatatccctggcaggaa

SEQ ID NO: 49305 - DNA, 25 bp, Rattus norvegicus
aaggtgattgacctgactgtgcccc

SEQ ID NO: 49306 - DNA, 25 bp, Rattus norvegicus
aaggtgattgacgtgactgtgcccc

SEQ ID NO: 49307 - DNA, 25 bp, Rattus norvegicus
aaggtgcacagcagggagaccctct

SEQ ID NO: 49308 - DNA, 25 bp, Rattus norvegicus
aaggtgcacagctgggagaccctct

SEQ ID NO: 49309 - DNA, 25 bp, Rattus norvegicus
aaggtgcacatcaggccaatttttt

SEQ ID NO: 49310 - DNA, 25 bp, Rattus norvegicus
aaggtgcacatctggccaatttttt

SEQ ID NO: 49311 - DNA, 25 bp, Rattus norvegicus
aaggtgcacctgacgttagcatggg

SEQ ID NO: 49312 - DNA, 25 bp, Rattus norvegicus
aaggtgcacctgtcgttagcatggg

SEQ ID NO: 49313 - DNA, 25 bp, Rattus norvegicus
aaggtgcacgtgctagccctggcca

SEQ ID NO: 49314 - DNA, 25 bp, Rattus norvegicus
aaggtgcacgtggtagccctggcca

SEQ ID NO: 49315 - DNA, 25 bp, Rattus norvegicus
aaggtgcactggaactaacctccaa

SEQ ID NO: 49316 - DNA, 25 bp, Rattus norvegicus
aaggtgcactggtactaacctccaa

SEQ ID NO: 49317 - DNA, 25 bp, Rattus norvegicus
aaggtgcagaccacctccagcaggg

SEQ ID NO: 49318 - DNA, 25 bp, Rattus norvegicus
aaggtgcagacctcctccagcaggg

SEQ ID NO: 49319 - DNA, 25 bp, Rattus norvegicus
aaggtgcagaggacctaactccgtg

SEQ ID NO: 49320 - DNA, 25 bp, Rattus norvegicus
aaggtgcagaggtcctaactccgtg

SEQ ID NO: 49321 - DNA, 25 bp, Rattus norvegicus
aaggtgcagccaccctcagaggtca

SEQ ID NO: 49322 - DNA, 25 bp, Rattus norvegicus
aaggtgcagccagcctcagaggtca

SEQ ID NO: 49323 - DNA, 25 bp, Rattus norvegicus
aaggtgcaggcacgtttctccttac

SEQ ID NO: 49324 - DNA, 25 bp, Rattus norvegicus
aaggtgcaggcaggtttctccttac

SEQ ID NO: 49325 - DNA, 25 bp, Rattus norvegicus
aaggtgcagtgcaagcgtcatctgg

SEQ ID NO: 49326 - DNA, 25 bp, Rattus norvegicus
aaggtgcagtgctagcgtcatctgg

SEQ ID NO: 49327 - DNA, 25 bp, Rattus norvegicus
aaggtgcatgacagtccacttagat

SEQ ID NO: 49328 - DNA, 25 bp, Rattus norvegicus
aaggtgcatgactgtccacttagat

SEQ ID NO: 49329 - DNA, 25 bp, Rattus norvegicus
aaggtgcattctatagccacaccct

SEQ ID NO: 49330 - DNA, 25 bp, Rattus norvegicus
aaggtgcattctttagccacaccct

SEQ ID NO: 49331 - DNA, 25 bp, Rattus norvegicus
aaggtgccaccgaatccagaactga

SEQ ID NO: 49332 - DNA, 25 bp, Rattus norvegicus
aaggtgccaccgtatccagaactga

SEQ ID NO: 49333 - DNA, 25 bp, Rattus norvegicus
aaggtgccagagattccccaggtga

SEQ ID NO: 49334 - DNA, 25 bp, Rattus norvegicus
aaggtgccagagtttccccaggtga

SEQ ID NO: 49335 - DNA, 25 bp, Rattus norvegicus
aaggtgccattgaagatctgccgga

SEQ ID NO: 49336 - DNA, 25 bp, Rattus norvegicus
aaggtgccattgtagatctgccgga

SEQ ID NO: 49337 - DNA, 25 bp, Rattus norvegicus
aaggtgcccatgagagcactcggct

SEQ ID NO: 49338 - DNA, 25 bp, Rattus norvegicus
aaggtgcccatgctgactggcacag

SEQ ID NO: 49339 - DNA, 25 bp, Rattus norvegicus
aaggtgcccatggtgactggcacag

SEQ ID NO: 49340 - DNA, 25 bp, Rattus norvegicus
aaggtgcccatgtgagcactcggct

SEQ ID NO: 49341 - DNA, 25 bp, Rattus norvegicus
aaggtgccctctacactttgtggcc

SEQ ID NO: 49342 - DNA, 25 bp, Rattus norvegicus
aaggtgccctcttcactttgtggcc

SEQ ID NO: 49343 - DNA, 25 bp, Rattus norvegicus
aaggtgccctttcatctcattatgc

SEQ ID NO: 49344 - DNA, 25 bp, Rattus norvegicus
aaggtgccctttgatctcattatgc

SEQ ID NO: 49345 - DNA, 25 bp, Rattus norvegicus
aaggtgccgcgccagccgggcaatc

SEQ ID NO: 49346 - DNA, 25 bp, Rattus norvegicus
aaggtgccgcgcgagccgggcaatc

SEQ ID NO: 49347 - DNA, 25 bp, Rattus norvegicus
aaggtgccgggcaccgacaagctgc

SEQ ID NO: 49348 - DNA, 25 bp, Rattus norvegicus
aaggtgccgggctccgacaagctgc

SEQ ID NO: 49349 - DNA, 25 bp, Rattus norvegicus
aaggtgcctaaaaagactgcgtcta

SEQ ID NO: 49350 - DNA, 25 bp, Rattus norvegicus
aaggtgcctaaatagactgcgtcta

SEQ ID NO: 49351 - DNA, 25 bp, Rattus norvegicus
aaggtgcctcttcctggattaattt

SEQ ID NO: 49352 - DNA, 25 bp, Rattus norvegicus
aaggtgcctcttgctggattaattt

SEQ ID NO: 49353 - DNA, 25 bp, Rattus norvegicus
aaggtgcctgtaaatttttgactca

SEQ ID NO: 49354 - DNA, 25 bp, Rattus norvegicus
aaggtgcctgtatatttttgactca

SEQ ID NO: 49355 - DNA, 25 bp, Rattus norvegicus
aaggtgcgcatgcagtttgaactga

SEQ ID NO: 49356 - DNA, 25 bp, Rattus norvegicus
aaggtgcgcatggagtttgaactga

SEQ ID NO: 49357 - DNA, 25 bp, Rattus norvegicus
aaggtgcgccttagttgagaggcaa

SEQ ID NO: 49358 - DNA, 25 bp, Rattus norvegicus
aaggtgcgcctttgttgagaggcaa

SEQ ID NO: 49359 - DNA, 25 bp, Rattus norvegicus
aaggtgcggccacacagactgcttt

SEQ ID NO: 49360 - DNA, 25 bp, Rattus norvegicus
aaggtgcggccagacagactgcttt

SEQ ID NO: 49361 - DNA, 25 bp, Rattus norvegicus
aaggtgctaactcagatgggctccc

SEQ ID NO: 49362 - DNA, 25 bp, Rattus norvegicus
aaggtgctaactgagatgggctccc

SEQ ID NO: 49363 - DNA, 25 bp, Rattus norvegicus
aaggtgctaaggcagttttctcagg

SEQ ID NO: 49364 - DNA, 25 bp, Rattus norvegicus
aaggtgctaagggagttttctcagg

SEQ ID NO: 49365 - DNA, 25 bp, Rattus norvegicus
aaggtgctatccctctgtaagggct

SEQ ID NO: 49366 - DNA, 25 bp, Rattus norvegicus
aaggtgctatccgtctgtaagggct

SEQ ID NO: 49367 - DNA, 25 bp, Rattus norvegicus
aaggtgctatgacatacgtggcccc

SEQ ID NO: 49368 - DNA, 25 bp, Rattus norvegicus
aaggtgctatgagatacgtggcccc

SEQ ID NO: 49369 - DNA, 25 bp, Rattus norvegicus
aaggtgctcctcagaactgcacata

SEQ ID NO: 49370 - DNA, 25 bp, Rattus norvegicus
aaggtgctcctctgaactgcacata

SEQ ID NO: 49371 - DNA, 25 bp, Rattus norvegicus
aaggtgctgaccctgtggcccaccg

SEQ ID NO: 49372 - DNA, 25 bp, Rattus norvegicus
aaggtgctgaccgtgtggcccaccg

SEQ ID NO: 49373 - DNA, 25 bp, Rattus norvegicus
aaggtgctgataaccctccatgaag

SEQ ID NO: 49374 - DNA, 25 bp, Rattus norvegicus
aaggtgctgatatccctccatgaag

SEQ ID NO: 49375 - DNA, 25 bp, Rattus norvegicus
aaggtgctgcagatccagtggcttt

SEQ ID NO: 49376 - DNA, 25 bp, Rattus norvegicus
aaggtgctgcagttccagtggcttt

SEQ ID NO: 49377 - DNA, 25 bp, Rattus norvegicus
aaggtgctgccccagatgattctgc

SEQ ID NO: 49378 - DNA, 25 bp, Rattus norvegicus
aaggtgctgcccgagatgattctgc

SEQ ID NO: 49379 - DNA, 25 bp, Rattus norvegicus
aaggtgctgcggacctccgagttca

SEQ ID NO: 49380 - DNA, 25 bp, Rattus norvegicus
aaggtgctgcggtcctccgagttca

SEQ ID NO: 49381 - DNA, 25 bp, Rattus norvegicus
aaggtgctgcttaagactggcttta

SEQ ID NO: 49382 - DNA, 25 bp, Rattus norvegicus
aaggtgctgctttagactggcttta

SEQ ID NO: 49383 - DNA, 25 bp, Rattus norvegicus
aaggtgctggttctatctccgggcc

SEQ ID NO: 49384 - DNA, 25 bp, Rattus norvegicus
aaggtgctggttgtatctccgggcc

SEQ ID NO: 49385 - DNA, 25 bp, Rattus norvegicus
aaggtgctgttactcgagcctcaat

SEQ ID NO: 49386 - DNA, 25 bp, Rattus norvegicus
aaggtgctgttagtcgagcctcaat

SEQ ID NO: 49387 - DNA, 25 bp, Rattus norvegicus
aaggtgctgttgcacatttcagcct

SEQ ID NO: 49388 - DNA, 25 bp, Rattus norvegicus
aaggtgctgttggacatttcagcct

SEQ ID NO: 49389 - DNA, 25 bp, Rattus norvegicus
aaggtgcttattaatggttctccag

SEQ ID NO: 49390 - DNA, 25 bp, Rattus norvegicus
aaggtgcttatttatggttctccag

SEQ ID NO: 49391 - DNA, 25 bp, Rattus norvegicus
aaggtgcttgccacatgggcctacc

SEQ ID NO: 49392 - DNA, 25 bp, Rattus norvegicus
aaggtgcttgcctcatgggcctacc

SEQ ID NO: 49393 - DNA, 25 bp, Rattus norvegicus
aaggtgcttgtcaactgagccatct

SEQ ID NO: 49394 - DNA, 25 bp, Rattus norvegicus
aaggtgcttgtctactgagccatct

SEQ ID NO: 49395 - DNA, 25 bp, Rattus norvegicus
aaggtgctttcccattgtctatgca

SEQ ID NO: 49396 - DNA, 25 bp, Rattus norvegicus
aaggtgctttccgattgtctatgca

SEQ ID NO: 49397 - DNA, 25 bp, Rattus norvegicus
aaggtgcttttcaccatttgagcca

SEQ ID NO: 49398 - DNA, 25 bp, Rattus norvegicus
aaggtgcttttcagtgtccatgtca

SEQ ID NO: 49399 - DNA, 25 bp, Rattus norvegicus
aaggtgcttttctccatttgagcca

SEQ ID NO: 49400 - DNA, 25 bp, Rattus norvegicus
aaggtgcttttctgtgtccatgtca

SEQ ID NO: 49401 - DNA, 25 bp, Rattus norvegicus
aaggtggaaacgcttgctgcagaat

SEQ ID NO: 49402 - DNA, 25 bp, Rattus norvegicus
aaggtggaaacggttgctgcagaat

SEQ ID NO: 49403 - DNA, 25 bp, Rattus norvegicus
aaggtggaaatcacacttctccctg

SEQ ID NO: 49404 - DNA, 25 bp, Rattus norvegicus
aaggtggaaatctcacttctccctg

SEQ ID NO: 49405 - DNA, 25 bp, Rattus norvegicus
aaggtggaacctctaccctcaagtg

SEQ ID NO: 49406 - DNA, 25 bp, Rattus norvegicus
aaggtggaacctgtaccctcaagtg

SEQ ID NO: 49407 - DNA, 25 bp, Rattus norvegicus
aaggtggaacttctgtgtgcaatac

SEQ ID NO: 49408 - DNA, 25 bp, Rattus norvegicus
aaggtggaacttgtgtgtgcaatac

SEQ ID NO: 49409 - DNA, 25 bp, Rattus norvegicus
aaggtggacactagtctctgggttc

SEQ ID NO: 49410 - DNA, 25 bp, Rattus norvegicus
aaggtggacacttgtctctgggttc

SEQ ID NO: 49411 - DNA, 25 bp, Rattus norvegicus
aaggtggacatcctgctggacatgc

SEQ ID NO: 49412 - DNA, 25 bp, Rattus norvegicus
aaggtggacatcgtgctggacatgc

SEQ ID NO: 49413 - DNA, 25 bp, Rattus norvegicus
aaggtggacctgacccagatgcaga

SEQ ID NO: 49414 - DNA, 25 bp, Rattus norvegicus
aaggtggacctgtcccagatgcaga

SEQ ID NO: 49415 - DNA, 25 bp, Rattus norvegicus
aaggtggactacatcgaccttcagc

SEQ ID NO: 49416 - DNA, 25 bp, Rattus norvegicus
aaggtggactacttcgaccttcagc

SEQ ID NO: 49417 - DNA, 25 bp, Rattus norvegicus
aaggtggactgaagggtctcctcca

SEQ ID NO: 49418 - DNA, 25 bp, Rattus norvegicus
aaggtggactgatgggtctcctcca

SEQ ID NO: 49419 - DNA, 25 bp, Rattus norvegicus
aaggtggagaccatcctccttcaag

SEQ ID NO: 49420 - DNA, 25 bp, Rattus norvegicus
aaggtggagaccttcctccttcaag

SEQ ID NO: 49421 - DNA, 25 bp, Rattus norvegicus
aaggtggagacgctgagtcccgagg

SEQ ID NO: 49422 - DNA, 25 bp, Rattus norvegicus
aaggtggagacggtgagtcccgagg

SEQ ID NO: 49423 - DNA, 25 bp, Rattus norvegicus
aaggtggaggctattctgattctga

SEQ ID NO: 49424 - DNA, 25 bp, Rattus norvegicus
aaggtggaggcttttctgattctga

SEQ ID NO: 49425 - DNA, 25 bp, Rattus norvegicus
aaggtggagggcacccaccacgtca

SEQ ID NO: 49426 - DNA, 25 bp, Rattus norvegicus
aaggtggagggctcccaccacgtca

SEQ ID NO: 49427 - DNA, 25 bp, Rattus norvegicus
aaggtggagtctagtcttctgtgtc

SEQ ID NO: 49428 - DNA, 25 bp, Rattus norvegicus
aaggtggagtctctgtggcccatct

SEQ ID NO: 49429 - DNA, 25 bp, Rattus norvegicus
aaggtggagtctgtgtggcccatct

SEQ ID NO: 49430 - DNA, 25 bp, Rattus norvegicus
aaggtggagtcttgtcttctgtgtc

SEQ ID NO: 49431 - DNA, 25 bp, Rattus norvegicus
aaggtggatatgaggccttcggctc

SEQ ID NO: 49432 - DNA, 25 bp, Rattus norvegicus
aaggtggatatgtggccttcggctc

SEQ ID NO: 49433 - DNA, 25 bp, Rattus norvegicus
aaggtggattcacggtccgactgcc

SEQ ID NO: 49434 - DNA, 25 bp, Rattus norvegicus
aaggtggattcagggtccgactgcc

SEQ ID NO: 49435 - DNA, 25 bp, Rattus norvegicus
aaggtggattttagagagctctgcc

SEQ ID NO: 49436 - DNA, 25 bp, Rattus norvegicus
aaggtggatttttgagagctctgcc

SEQ ID NO: 49437 - DNA, 25 bp, Rattus norvegicus
aaggtggcaaacactcctcctggct

SEQ ID NO: 49438 - DNA, 25 bp, Rattus norvegicus
aaggtggcaaactctcctcctggct

SEQ ID NO: 49439 - DNA, 25 bp, Rattus norvegicus
aaggtggcaaagacagcaggctgac

SEQ ID NO: 49440 - DNA, 25 bp, Rattus norvegicus
aaggtggcaaagtcagcaggctgac

SEQ ID NO: 49441 - DNA, 25 bp, Rattus norvegicus
aaggtggcacttactccaagtcatc

SEQ ID NO: 49442 - DNA, 25 bp, Rattus norvegicus
aaggtggcactttctccaagtcatc

SEQ ID NO: 49443 - DNA, 25 bp, Rattus norvegicus
aaggtggcatgccatcaactctcac

SEQ ID NO: 49444 - DNA, 25 bp, Rattus norvegicus
aaggtggcatgcgatcaactctcac

SEQ ID NO: 49445 - DNA, 25 bp, Rattus norvegicus
aaggtggccatcactgacaccagta

SEQ ID NO: 49446 - DNA, 25 bp, Rattus norvegicus
aaggtggccatctctgacaccagta

SEQ ID NO: 49447 - DNA, 25 bp, Rattus norvegicus
aaggtggccccactgtcaggtgaaa

SEQ ID NO: 49448 - DNA, 25 bp, Rattus norvegicus
aaggtggccccagtgtcaggtgaaa

SEQ ID NO: 49449 - DNA, 25 bp, Rattus norvegicus
aaggtggcccttaccatcaaaggag

SEQ ID NO: 49450 - DNA, 25 bp, Rattus norvegicus
aaggtggccctttccatcaaaggag

SEQ ID NO: 49451 - DNA, 25 bp, Rattus norvegicus
aaggtggcctaaacacatgaaaagc

SEQ ID NO: 49452 - DNA, 25 bp, Rattus norvegicus
aaggtggcctaatcacatgaaaagc

SEQ ID NO: 49453 - DNA, 25 bp, Rattus norvegicus
aaggtggcctcacactgactccaga

SEQ ID NO: 49454 - DNA, 25 bp, Rattus norvegicus
aaggtggcctcagactgactccaga

SEQ ID NO: 49455 - DNA, 25 bp, Rattus norvegicus
aaggtggcctccctgtgtttatgtg

SEQ ID NO: 49456 - DNA, 25 bp, Rattus norvegicus
aaggtggcctccgtgtgtttatgtg

SEQ ID NO: 49457 - DNA, 25 bp, Rattus norvegicus
aaggtggccttcctcagtgcccaga

SEQ ID NO: 49458 - DNA, 25 bp, Rattus norvegicus
aaggtggccttcgtcagtgcccaga

SEQ ID NO: 49459 - DNA, 25 bp, Rattus norvegicus
aaggtggctatgagctcttctggga

SEQ ID NO: 49460 - DNA, 25 bp, Rattus norvegicus
aaggtggctatgtgctcttctggga

SEQ ID NO: 49461 - DNA, 25 bp, Rattus norvegicus
aaggtggctgcaactgacggctgct

SEQ ID NO: 49462 - DNA, 25 bp, Rattus norvegicus
aaggtggctgcatctgacggctgct

SEQ ID NO: 49463 - DNA, 25 bp, Rattus norvegicus
aaggtggctgctaccatctggaaaa

SEQ ID NO: 49464 - DNA, 25 bp, Rattus norvegicus
aaggtggctgcttccatctggaaaa

SEQ ID NO: 49465 - DNA, 25 bp, Rattus norvegicus
aaggtggctggcaacagttcctgtc

SEQ ID NO: 49466 - DNA, 25 bp, Rattus norvegicus
aaggtggctggctacagttcctgtc

SEQ ID NO: 49467 - DNA, 25 bp, Rattus norvegicus
aaggtggcttcgatcttgagctgcc

SEQ ID NO: 49468 - DNA, 25 bp, Rattus norvegicus
aaggtggcttcgttcttgagctgcc

SEQ ID NO: 49469 - DNA, 25 bp, Rattus norvegicus
aaggtggcttctatgtggtccagaa

SEQ ID NO: 49470 - DNA, 25 bp, Rattus norvegicus
aaggtggcttctttgtggtccagaa

SEQ ID NO: 49471 - DNA, 25 bp, Rattus norvegicus
aaggtgggattcacacagaccactc

SEQ ID NO: 49472 - DNA, 25 bp, Rattus norvegicus
aaggtgggattctcacagaccactc

SEQ ID NO: 49473 - DNA, 25 bp, Rattus norvegicus
aaggtgggctagaccattgccttcc

SEQ ID NO: 49474 - DNA, 25 bp, Rattus norvegicus
aaggtgggctagtccattgccttcc

SEQ ID NO: 49475 - DNA, 25 bp, Rattus norvegicus
aaggtgggtagaacatgttttcagt

SEQ ID NO: 49476 - DNA, 25 bp, Rattus norvegicus
aaggtgggtagatcatgttttcagt

SEQ ID NO: 49477 - DNA, 25 bp, Rattus norvegicus
aaggtgggttgacttcagctctttg

SEQ ID NO: 49478 - DNA, 25 bp, Rattus norvegicus
aaggtgggttgagttcagctctttg

SEQ ID NO: 49479 - DNA, 25 bp, Rattus norvegicus
aaggtggtacttctaacacttcaga

SEQ ID NO: 49480 - DNA, 25 bp, Rattus norvegicus
aaggtggtacttgtaacacttcaga

SEQ ID NO: 49481 - DNA, 25 bp, Rattus norvegicus
aaggtggtcactatctttagccctg

SEQ ID NO: 49482 - DNA, 25 bp, Rattus norvegicus
aaggtggtcactttctttagccctg

SEQ ID NO: 49483 - DNA, 25 bp, Rattus norvegicus
aaggtggtcgtgatcatcaaaccca

SEQ ID NO: 49484 - DNA, 25 bp, Rattus norvegicus
aaggtggtcgtgttcatcaaaccca

SEQ ID NO: 49485 - DNA, 25 bp, Rattus norvegicus
aaggtggtcttcatgggctagccca

SEQ ID NO: 49486 - DNA, 25 bp, Rattus norvegicus
aaggtggtcttcttgggctagccca

SEQ ID NO: 49487 - DNA, 25 bp, Rattus norvegicus
aaggtggtgactactggtgacatag

SEQ ID NO: 49488 - DNA, 25 bp, Rattus norvegicus
aaggtggtgacttctggtgacatag

SEQ ID NO: 49489 - DNA, 25 bp, Rattus norvegicus
aaggtggtgatgctcgctatttgca

SEQ ID NO: 49490 - DNA, 25 bp, Rattus norvegicus
aaggtggtgatggtcgctatttgca

SEQ ID NO: 49491 - DNA, 25 bp, Rattus norvegicus
aaggtggtgctgactcgcagcccga

SEQ ID NO: 49492 - DNA, 25 bp, Rattus norvegicus
aaggtggtgctgatgtattcttaac

SEQ ID NO: 49493 - DNA, 25 bp, Rattus norvegicus
aaggtggtgctgtctcgcagcccga

SEQ ID NO: 49494 - DNA, 25 bp, Rattus norvegicus
aaggtggtgctgttgtattcttaac

SEQ ID NO: 49495 - DNA, 25 bp, Rattus norvegicus
aaggtggtgtcaatgaaagctttca

SEQ ID NO: 49496 - DNA, 25 bp, Rattus norvegicus
aaggtggtgtcattgaaagctttca

SEQ ID NO: 49497 - DNA, 25 bp, Rattus norvegicus
aaggtggtttaaactctgtgacaaa

SEQ ID NO: 49498 - DNA, 25 bp, Rattus norvegicus
aaggtggtttaatctctgtgacaaa

SEQ ID NO: 49499 - DNA, 25 bp, Rattus norvegicus
aaggtggtttatacttccctgcagt

SEQ ID NO: 49500 - DNA, 25 bp, Rattus norvegicus
aaggtggtttattcttccctgcagt

SEQ ID NO: 49501 - DNA, 25 bp, Rattus norvegicus
aaggtggtttctatggcccagaggc

SEQ ID NO: 49502 - DNA, 25 bp, Rattus norvegicus
aaggtggtttctttggcccagaggc

SEQ ID NO: 49503 - DNA, 25 bp, Rattus norvegicus
aaggtgtaacgtactgttcgcatgc

SEQ ID NO: 49504 - DNA, 25 bp, Rattus norvegicus
aaggtgtaacgttctgttcgcatgc

SEQ ID NO: 49505 - DNA, 25 bp, Rattus norvegicus
aaggtgtaactcattagcatttggg

SEQ ID NO: 49506 - DNA, 25 bp, Rattus norvegicus
aaggtgtaactctttagcatttggg

SEQ ID NO: 49507 - DNA, 25 bp, Rattus norvegicus
aaggtgtaattaagctcccgcgccg

SEQ ID NO: 49508 - DNA, 25 bp, Rattus norvegicus
aaggtgtaattatgctcccgcgccg

SEQ ID NO: 49509 - DNA, 25 bp, Rattus norvegicus
aaggtgtacctgagcatctactggc

SEQ ID NO: 49510 - DNA, 25 bp, Rattus norvegicus
aaggtgtacctgtgcatctactggc

SEQ ID NO: 49511 - DNA, 25 bp, Rattus norvegicus
aaggtgtacgaccagatgcccgaac

SEQ ID NO: 49512 - DNA, 25 bp, Rattus norvegicus
aaggtgtacgacgagatgcccgaac

SEQ ID NO: 49513 - DNA, 25 bp, Rattus norvegicus
aaggtgtacggcaatatgcctctcc

SEQ ID NO: 49514 - DNA, 25 bp, Rattus norvegicus
aaggtgtacggctatatgcctctcc

SEQ ID NO: 49515 - DNA, 25 bp, Rattus norvegicus
aaggtgtagcatcgactctttttta

SEQ ID NO: 49516 - DNA, 25 bp, Rattus norvegicus
aaggtgtagcatggactctttttta

SEQ ID NO: 49517 - DNA, 25 bp, Rattus norvegicus
aaggtgtagcgaagcgcacgcctct

SEQ ID NO: 49518 - DNA, 25 bp, Rattus norvegicus
aaggtgtagcgatgcgcacgcctct

SEQ ID NO: 49519 - DNA, 25 bp, Rattus norvegicus
aaggtgtataatagtctgctgtaga

SEQ ID NO: 49520 - DNA, 25 bp, Rattus norvegicus
aaggtgtataattgtctgctgtaga

SEQ ID NO: 49521 - DNA, 25 bp, Rattus norvegicus
aaggtgtatacgaccacagctggcc

SEQ ID NO: 49522 - DNA, 25 bp, Rattus norvegicus
aaggtgtatacgtccacagctggcc

SEQ ID NO: 49523 - DNA, 25 bp, Rattus norvegicus
aaggtgtatctcacgtggctggcac

SEQ ID NO: 49524 - DNA, 25 bp, Rattus norvegicus
aaggtgtatctctcgtggctggcac

SEQ ID NO: 49525 - DNA, 25 bp, Rattus norvegicus
aaggtgtatcttctacttcaataaa

SEQ ID NO: 49526 - DNA, 25 bp, Rattus norvegicus
aaggtgtatcttgtacttcaataaa

SEQ ID NO: 49527 - DNA, 25 bp, Rattus norvegicus
aaggtgtatgccaaccacagtctca

SEQ ID NO: 49528 - DNA, 25 bp, Rattus norvegicus
aaggtgtatgcctaccacagtctca

SEQ ID NO: 49529 - DNA, 25 bp, Rattus norvegicus
aaggtgtatgtgagcttcactcgct

SEQ ID NO: 49530 - DNA, 25 bp, Rattus norvegicus
aaggtgtatgtgtgcttcactcgct

SEQ ID NO: 49531 - DNA, 25 bp, Rattus norvegicus
aaggtgtcagtgctggtcccacaga

SEQ ID NO: 49532 - DNA, 25 bp, Rattus norvegicus
aaggtgtcagtggtggtcccacaga

SEQ ID NO: 49533 - DNA, 25 bp, Rattus norvegicus
aaggtgtcagttcgaccctcagctg

SEQ ID NO: 49534 - DNA, 25 bp, Rattus norvegicus
aaggtgtcagttggaccctcagctg

SEQ ID NO: 49535 - DNA, 25 bp, Rattus norvegicus
aaggtgtccactatggctgtcgtga

SEQ ID NO: 49536 - DNA, 25 bp, Rattus norvegicus
aaggtgtccactttggctgtcgtga

SEQ ID NO: 49537 - DNA, 25 bp, Rattus norvegicus
aaggtgtccatgcatctgcgggcca

SEQ ID NO: 49538 - DNA, 25 bp, Rattus norvegicus
aaggtgtccatggatctgcgggcca

SEQ ID NO: 49539 - DNA, 25 bp, Rattus norvegicus
aaggtgtcccatcacaacctgactg

SEQ ID NO: 49540 - DNA, 25 bp, Rattus norvegicus
aaggtgtcccatgacaacctgactg

SEQ ID NO: 49541 - DNA, 25 bp, Rattus norvegicus
aaggtgtccccaatcatgactgtca

SEQ ID NO: 49542 - DNA, 25 bp, Rattus norvegicus
aaggtgtccccattcatgactgtca

SEQ ID NO: 49543 - DNA, 25 bp, Rattus norvegicus
aaggtgtcccgaatgtgttgtctgt

SEQ ID NO: 49544 - DNA, 25 bp, Rattus norvegicus
aaggtgtcccgattgtgttgtctgt

SEQ ID NO: 49545 - DNA, 25 bp, Rattus norvegicus
aaggtgtccctgacaccccatggtg

SEQ ID NO: 49546 - DNA, 25 bp, Rattus norvegicus
aaggtgtccctgtcaccccatggtg

SEQ ID NO: 49547 - DNA, 25 bp, Rattus norvegicus
aaggtgtcggtgatgttcctgtaca

SEQ ID NO: 49548 - DNA, 25 bp, Rattus norvegicus
aaggtgtcggtgttgttcctgtaca

SEQ ID NO: 49549 - DNA, 25 bp, Rattus norvegicus
aaggtgtctgtgaagtcctagcttc

SEQ ID NO: 49550 - DNA, 25 bp, Rattus norvegicus
aaggtgtctgtgtagtcctagcttc

SEQ ID NO: 49551 - DNA, 25 bp, Rattus norvegicus
aaggtgtctgttcttattctgttac

SEQ ID NO: 49552 - DNA, 25 bp, Rattus norvegicus
aaggtgtctgttgttattctgttac

SEQ ID NO: 49553 - DNA, 25 bp, Rattus norvegicus
aaggtgtcttcactgatcagccatt

SEQ ID NO: 49554 - DNA, 25 bp, Rattus norvegicus
aaggtgtcttcactgccctagcgtt

SEQ ID NO: 49555 - DNA, 25 bp, Rattus norvegicus
aaggtgtcttcagtgatcagccatt

SEQ ID NO: 49556 - DNA, 25 bp, Rattus norvegicus
aaggtgtcttcagtgccctagcgtt

SEQ ID NO: 49557 - DNA, 25 bp, Rattus norvegicus
aaggtgtcttccagggatgcagtcc

SEQ ID NO: 49558 - DNA, 25 bp, Rattus norvegicus
aaggtgtcttcctgggatgcagtcc

SEQ ID NO: 49559 - DNA, 25 bp, Rattus norvegicus
aaggtgtgaagtcaccgtctcacca

SEQ ID NO: 49560 - DNA, 25 bp, Rattus norvegicus
aaggtgtgaagtgaccgtctcacca

SEQ ID NO: 49561 - DNA, 25 bp, Rattus norvegicus
aaggtgtgacacatcctttaatccc

SEQ ID NO: 49562 - DNA, 25 bp, Rattus norvegicus
aaggtgtgacacttcctttaatccc

SEQ ID NO: 49563 - DNA, 25 bp, Rattus norvegicus
aaggtgtgagacaatttctttgaat

SEQ ID NO: 49564 - DNA, 25 bp, Rattus norvegicus
aaggtgtgagactatttctttgaat

SEQ ID NO: 49565 - DNA, 25 bp, Rattus norvegicus
aaggtgtgagagactcctacccact

SEQ ID NO: 49566 - DNA, 25 bp, Rattus norvegicus
aaggtgtgagagtctcctacccact

SEQ ID NO: 49567 - DNA, 25 bp, Rattus norvegicus
aaggtgtgagtccatttgtcctccg

SEQ ID NO: 49568 - DNA, 25 bp, Rattus norvegicus
aaggtgtgagtcgatttgtcctccg

SEQ ID NO: 49569 - DNA, 25 bp, Rattus norvegicus
aaggtgtgattgctgcctcttctca

SEQ ID NO: 49570 - DNA, 25 bp, Rattus norvegicus
aaggtgtgattggtgcctcttctca

SEQ ID NO: 49571 - DNA, 25 bp, Rattus norvegicus
aaggtgtgcaccaatcaacatggag

SEQ ID NO: 49572 - DNA, 25 bp, Rattus norvegicus
aaggtgtgcacctatcaacatggag

SEQ ID NO: 49573 - DNA, 25 bp, Rattus norvegicus
aaggtgtgcagcaggttctgctcca

SEQ ID NO: 49574 - DNA, 25 bp, Rattus norvegicus
aaggtgtgcagcctatatgatacgc

SEQ ID NO: 49575 - DNA, 25 bp, Rattus norvegicus
aaggtgtgcagcgtatatgatacgc

SEQ ID NO: 49576 - DNA, 25 bp, Rattus norvegicus
aaggtgtgcagctggttctgctcca

SEQ ID NO: 49577 - DNA, 25 bp, Rattus norvegicus
aaggtgtgcatcaagcgactgtggc

SEQ ID NO: 49578 - DNA, 25 bp, Rattus norvegicus
aaggtgtgcatctagcgactgtggc

SEQ ID NO: 49579 - DNA, 25 bp, Rattus norvegicus
aaggtgtgcatgctgtcttgtgcct

SEQ ID NO: 49580 - DNA, 25 bp, Rattus norvegicus
aaggtgtgcatggtgtcttgtgcct

SEQ ID NO: 49581 - DNA, 25 bp, Rattus norvegicus
aaggtgtgcccgaaccggcccatgt

SEQ ID NO: 49582 - DNA, 25 bp, Rattus norvegicus
aaggtgtgcccgtaccggcccatgt

SEQ ID NO: 49583 - DNA, 25 bp, Rattus norvegicus
aaggtgtgccttcattgtacagaag

SEQ ID NO: 49584 - DNA, 25 bp, Rattus norvegicus
aaggtgtgccttgattgtacagaag

SEQ ID NO: 49585 - DNA, 25 bp, Rattus norvegicus
aaggtgtgctgcctagttccctgga

SEQ ID NO: 49586 - DNA, 25 bp, Rattus norvegicus
aaggtgtgctgcgtagttccctgga

SEQ ID NO: 49587 - DNA, 25 bp, Rattus norvegicus
aaggtgtggcctacagactgtttcc

SEQ ID NO: 49588 - DNA, 25 bp, Rattus norvegicus
aaggtgtggccttcagactgtttcc

SEQ ID NO: 49589 - DNA, 25 bp, Rattus norvegicus
aaggtgtggctactcctacgtgacc

SEQ ID NO: 49590 - DNA, 25 bp, Rattus norvegicus
aaggtgtggctagtcctacgtgacc

SEQ ID NO: 49591 - DNA, 25 bp, Rattus norvegicus
aaggtgtggttcacttgaccctgta

SEQ ID NO: 49592 - DNA, 25 bp, Rattus norvegicus
aaggtgtggttctcttgaccctgta

SEQ ID NO: 49593 - DNA, 25 bp, Rattus norvegicus
aaggtgtgtattatagtcaaagatc

SEQ ID NO: 49594 - DNA, 25 bp, Rattus norvegicus
aaggtgtgtattttagtcaaagatc

SEQ ID NO: 49595 - DNA, 25 bp, Rattus norvegicus
aaggtgtgtcctaggccatttctaa

SEQ ID NO: 49596 - DNA, 25 bp, Rattus norvegicus
aaggtgtgtccttggccatttctaa

SEQ ID NO: 49597 - DNA, 25 bp, Rattus norvegicus
aaggtgtgtgcaaacgtgacggact

SEQ ID NO: 49598 - DNA, 25 bp, Rattus norvegicus
aaggtgtgtgcaccactgccctgct

SEQ ID NO: 49599 - DNA, 25 bp, Rattus norvegicus
aaggtgtgtgcagcactgccctgct

SEQ ID NO: 49600 - DNA, 25 bp, Rattus norvegicus
aaggtgtgtgcatacgtgacggact

SEQ ID NO: 49601 - DNA, 25 bp, Rattus norvegicus
aaggtgtgttccatcggcaagcagg

SEQ ID NO: 49602 - DNA, 25 bp, Rattus norvegicus
aaggtgtgttccttcggcaagcagg

SEQ ID NO: 49603 - DNA, 25 bp, Rattus norvegicus
aaggtgttagcgcattgttactgaa

SEQ ID NO: 49604 - DNA, 25 bp, Rattus norvegicus
aaggtgttagcggattgttactgaa

SEQ ID NO: 49605 - DNA, 25 bp, Rattus norvegicus
aaggtgttagtgactccgctttcta

SEQ ID NO: 49606 - DNA, 25 bp, Rattus norvegicus
aaggtgttagtgtctccgctttcta

SEQ ID NO: 49607 - DNA, 25 bp, Rattus norvegicus
aaggtgttcagccagtcggttgtaa

SEQ ID NO: 49608 - DNA, 25 bp, Rattus norvegicus
aaggtgttcagcgagtcggttgtaa

SEQ ID NO: 49609 - DNA, 25 bp, Rattus norvegicus
aaggtgttcattcgaggccctgccc

SEQ ID NO: 49610 - DNA, 25 bp, Rattus norvegicus
aaggtgttcattggaggccctgccc

SEQ ID NO: 49611 - DNA, 25 bp, Rattus norvegicus
aaggtgttcgagactgctacacgca

SEQ ID NO: 49612 - DNA, 25 bp, Rattus norvegicus
aaggtgttcgagtctgctacacgca

SEQ ID NO: 49613 - DNA, 25 bp, Rattus norvegicus
aaggtgttctagctgtttgcatcaa

SEQ ID NO: 49614 - DNA, 25 bp, Rattus norvegicus
aaggtgttctaggtgtttgcatcaa

SEQ ID NO: 49615 - DNA, 25 bp, Rattus norvegicus
aaggtgttcttcagtcttttagact

SEQ ID NO: 49616 - DNA, 25 bp, Rattus norvegicus
aaggtgttcttctgtcttttagact

SEQ ID NO: 49617 - DNA, 25 bp, Rattus norvegicus
aaggtgttgcagagtggctcagccc

SEQ ID NO: 49618 - DNA, 25 bp, Rattus norvegicus
aaggtgttgcagtgtggctcagccc

SEQ ID NO: 49619 - DNA, 25 bp, Rattus norvegicus
aaggtgttgccaccaggcggcatca

SEQ ID NO: 49620 - DNA, 25 bp, Rattus norvegicus
aaggtgttgccagcaggcggcatca

SEQ ID NO: 49621 - DNA, 25 bp, Rattus norvegicus
aaggtgttgcctacagcctgagaca

SEQ ID NO: 49622 - DNA, 25 bp, Rattus norvegicus
aaggtgttgccttcagcctgagaca

SEQ ID NO: 49623 - DNA, 25 bp, Rattus norvegicus
aaggtgttgcttcaatcggccaaag

SEQ ID NO: 49624 - DNA, 25 bp, Rattus norvegicus
aaggtgttgcttgaatcggccaaag

SEQ ID NO: 49625 - DNA, 25 bp, Rattus norvegicus
aaggtgttggctctgcaatcctcaa

SEQ ID NO: 49626 - DNA, 25 bp, Rattus norvegicus
aaggtgttggctgtgcaatcctcaa

SEQ ID NO: 49627 - DNA, 25 bp, Rattus norvegicus
aaggtgtttaccaactcagctcttc

SEQ ID NO: 49628 - DNA, 25 bp, Rattus norvegicus
aaggtgtttacctactcagctcttc

SEQ ID NO: 49629 - DNA, 25 bp, Rattus norvegicus
aaggtgtttcctccggatcctgctg

SEQ ID NO: 49630 - DNA, 25 bp, Rattus norvegicus
aaggtgtttcctgcggatcctgctg

SEQ ID NO: 49631 - DNA, 25 bp, Rattus norvegicus
aaggtgtttcgcacagtaggcacat

SEQ ID NO: 49632 - DNA, 25 bp, Rattus norvegicus
aaggtgtttcgctcagtaggcacat

SEQ ID NO: 49633 - DNA, 25 bp, Rattus norvegicus
aaggttaatcctcccgtatgaaaga

SEQ ID NO: 49634 - DNA, 25 bp, Rattus norvegicus
aaggttaatcctgccgtatgaaaga

SEQ ID NO: 49635 - DNA, 25 bp, Rattus norvegicus
aaggttaatgtgaatccagccccag

SEQ ID NO: 49636 - DNA, 25 bp, Rattus norvegicus
aaggttaatgtgtatccagccccag

SEQ ID NO: 49637 - DNA, 25 bp, Rattus norvegicus
aaggttacaatgaccctggtcctag

SEQ ID NO: 49638 - DNA, 25 bp, Rattus norvegicus
aaggttacaatgtccctggtcctag

SEQ ID NO: 49639 - DNA, 25 bp, Rattus norvegicus
aaggttacagtgaggcttccagccc

SEQ ID NO: 49640 - DNA, 25 bp, Rattus norvegicus
aaggttacagtgtggcttccagccc

SEQ ID NO: 49641 - DNA, 25 bp, Rattus norvegicus
aaggttacccttatcctggagatgc

SEQ ID NO: 49642 - DNA, 25 bp, Rattus norvegicus
aaggttacccttttcctggagatgc

SEQ ID NO: 49643 - DNA, 25 bp, Rattus norvegicus
aaggttactctgaagcatgcatcat

SEQ ID NO: 49644 - DNA, 25 bp, Rattus norvegicus
aaggttactctgtagcatgcatcat

SEQ ID NO: 49645 - DNA, 25 bp, Rattus norvegicus
aaggttactgctatattactggaca

SEQ ID NO: 49646 - DNA, 25 bp, Rattus norvegicus
aaggttactgctttattactggaca

SEQ ID NO: 49647 - DNA, 25 bp, Rattus norvegicus
aaggttactgtgaactctccccaca

SEQ ID NO: 49648 - DNA, 25 bp, Rattus norvegicus
aaggttactgtgtactctccccaca

SEQ ID NO: 49649 - DNA, 25 bp, Rattus norvegicus
aaggttagatctatgccacttcttt

SEQ ID NO: 49650 - DNA, 25 bp, Rattus norvegicus
aaggttagatctttgccacttcttt

SEQ ID NO: 49651 - DNA, 25 bp, Rattus norvegicus
aaggttagccatctagacacctcac

SEQ ID NO: 49652 - DNA, 25 bp, Rattus norvegicus
aaggttagccatgtagacacctcac

SEQ ID NO: 49653 - DNA, 25 bp, Rattus norvegicus
aaggttagcctcacctgcatggtca

SEQ ID NO: 49654 - DNA, 25 bp, Rattus norvegicus
aaggttagcctctcctgcatggtca

SEQ ID NO: 49655 - DNA, 25 bp, Rattus norvegicus
aaggttagcctgcacagcatctcgt

SEQ ID NO: 49656 - DNA, 25 bp, Rattus norvegicus
aaggttagcctggacagcatctcgt

SEQ ID NO: 49657 - DNA, 25 bp, Rattus norvegicus
aaggttaggctgagtaccgccaaga

SEQ ID NO: 49658 - DNA, 25 bp, Rattus norvegicus
aaggttaggctgtgtaccgccaaga

SEQ ID NO: 49659 - DNA, 25 bp, Rattus norvegicus
aaggttatagcgactctactgtggc

SEQ ID NO: 49660 - DNA, 25 bp, Rattus norvegicus
aaggttatagcgtctctactgtggc

SEQ ID NO: 49661 - DNA, 25 bp, Rattus norvegicus
aaggttataggtacagatccccagc

SEQ ID NO: 49662 - DNA, 25 bp, Rattus norvegicus
aaggttataggttcagatccccagc

SEQ ID NO: 49663 - DNA, 25 bp, Rattus norvegicus
aaggttatagtcagccatgcctaga

SEQ ID NO: 49664 - DNA, 25 bp, Rattus norvegicus
aaggttatagtctgccatgcctaga

SEQ ID NO: 49665 - DNA, 25 bp, Rattus norvegicus
aaggttatcaggacaccacatggga

SEQ ID NO: 49666 - DNA, 25 bp, Rattus norvegicus
aaggttatcaggtcaccacatggga

SEQ ID NO: 49667 - DNA, 25 bp, Rattus norvegicus
aaggttatgacaatggccctggaca

SEQ ID NO: 49668 - DNA, 25 bp, Rattus norvegicus
aaggttatgacattggccctggaca

SEQ ID NO: 49669 - DNA, 25 bp, Rattus norvegicus
aaggttatttccaaagacagtgata

SEQ ID NO: 49670 - DNA, 25 bp, Rattus norvegicus
aaggttatttcctaagacagtgata

SEQ ID NO: 49671 - DNA, 25 bp, Rattus norvegicus
aaggttcaaaggctttctatgacat

SEQ ID NO: 49672 - DNA, 25 bp, Rattus norvegicus
aaggttcaaagggtttctatgacat

SEQ ID NO: 49673 - DNA, 25 bp, Rattus norvegicus
aaggttcaacaaccacattaagatc

SEQ ID NO: 49674 - DNA, 25 bp, Rattus norvegicus
aaggttcaacaagcacattaagatc

SEQ ID NO: 49675 - DNA, 25 bp, Rattus norvegicus
aaggttcaaggccagactgacctac

SEQ ID NO: 49676 - DNA, 25 bp, Rattus norvegicus
aaggttcaaggcgagactgacctac

SEQ ID NO: 49677 - DNA, 25 bp, Rattus norvegicus
aaggttcagatgatgcctgcaccga

SEQ ID NO: 49678 - DNA, 25 bp, Rattus norvegicus
aaggttcagatgttgcctgcaccga

SEQ ID NO: 49679 - DNA, 25 bp, Rattus norvegicus
aaggttcagctgcagccctctggaa

SEQ ID NO: 49680 - DNA, 25 bp, Rattus norvegicus
aaggttcagctggagccctctggaa

SEQ ID NO: 49681 - DNA, 25 bp, Rattus norvegicus
aaggttcagcttcggtaggcgccac

SEQ ID NO: 49682 - DNA, 25 bp, Rattus norvegicus
aaggttcagcttgggtaggcgccac

SEQ ID NO: 49683 - DNA, 25 bp, Rattus norvegicus
aaggttcagtgaccagtcatttcct

SEQ ID NO: 49684 - DNA, 25 bp, Rattus norvegicus
aaggttcagtgagcagtcatttcct

SEQ ID NO: 49685 - DNA, 25 bp, Rattus norvegicus
aaggttcataacatcggcactgggt

SEQ ID NO: 49686 - DNA, 25 bp, Rattus norvegicus
aaggttcataacttcggcactgggt

SEQ ID NO: 49687 - DNA, 25 bp, Rattus norvegicus
aaggttcatcaccacttgaagtgca

SEQ ID NO: 49688 - DNA, 25 bp, Rattus norvegicus
aaggttcatcacgacttgaagtgca

SEQ ID NO: 49689 - DNA, 25 bp, Rattus norvegicus
aaggttcatgggaaatccccagaca

SEQ ID NO: 49690 - DNA, 25 bp, Rattus norvegicus
aaggttcatgggtaatccccagaca

SEQ ID NO: 49691 - DNA, 25 bp, Rattus norvegicus
aaggttccaacacaccatctttggg

SEQ ID NO: 49692 - DNA, 25 bp, Rattus norvegicus
aaggttccaacagaccatctttggg

SEQ ID NO: 49693 - DNA, 25 bp, Rattus norvegicus
aaggttccagcaaggttttgtctca

SEQ ID NO: 49694 - DNA, 25 bp, Rattus norvegicus
aaggttccagcatggttttgtctca

SEQ ID NO: 49695 - DNA, 25 bp, Rattus norvegicus
aaggttccagctcgtggattctcgg

SEQ ID NO: 49696 - DNA, 25 bp, Rattus norvegicus
aaggttccagctggtggattctcgg

SEQ ID NO: 49697 - DNA, 25 bp, Rattus norvegicus
aaggttccagttacacttcttcctg

SEQ ID NO: 49698 - DNA, 25 bp, Rattus norvegicus
aaggttccagtttcacttcttcctg

SEQ ID NO: 49699 - DNA, 25 bp, Rattus norvegicus
aaggttccccttacaatatctctga

SEQ ID NO: 49700 - DNA, 25 bp, Rattus norvegicus
aaggttcccctttcaatatctctga

SEQ ID NO: 49701 - DNA, 25 bp, Rattus norvegicus
aaggttccgggcagaaacatctatt

SEQ ID NO: 49702 - DNA, 25 bp, Rattus norvegicus
aaggttccgggctgaaacatctatt

SEQ ID NO: 49703 - DNA, 25 bp, Rattus norvegicus
aaggttcctcctcaatttgatttct

SEQ ID NO: 49704 - DNA, 25 bp, Rattus norvegicus
aaggttcctcctgaatttgatttct

SEQ ID NO: 49705 - DNA, 25 bp, Rattus norvegicus
aaggttcctctgaacgacctagtga

SEQ ID NO: 49706 - DNA, 25 bp, Rattus norvegicus
aaggttcctctgtacgacctagtga

SEQ ID NO: 49707 - DNA, 25 bp, Rattus norvegicus
aaggttccttctccaacgagggcca

SEQ ID NO: 49708 - DNA, 25 bp, Rattus norvegicus
aaggttccttctgcaacgagggcca

SEQ ID NO: 49709 - DNA, 25 bp, Rattus norvegicus
aaggttcctttgaatggatctccgc

SEQ ID NO: 49710 - DNA, 25 bp, Rattus norvegicus
aaggttcctttgtatggatctccgc

SEQ ID NO: 49711 - DNA, 25 bp, Rattus norvegicus
aaggttcgagagctgaatcctctgt

SEQ ID NO: 49712 - DNA, 25 bp, Rattus norvegicus
aaggttcgagaggtgaatcctctgt

SEQ ID NO: 49713 - DNA, 25 bp, Rattus norvegicus
aaggttcgccatctcctaagtggga

SEQ ID NO: 49714 - DNA, 25 bp, Rattus norvegicus
aaggttcgccatgtcctaagtggga

SEQ ID NO: 49715 - DNA, 25 bp, Rattus norvegicus
aaggttcgccttcagaatctatgac

SEQ ID NO: 49716 - DNA, 25 bp, Rattus norvegicus
aaggttcgccttgagaatctatgac

SEQ ID NO: 49717 - DNA, 25 bp, Rattus norvegicus
aaggttcggaccaattggctcctgg

SEQ ID NO: 49718 - DNA, 25 bp, Rattus norvegicus
aaggttcggaccatgcggatgcacc

SEQ ID NO: 49719 - DNA, 25 bp, Rattus norvegicus
aaggttcggacctattggctcctgg

SEQ ID NO: 49720 - DNA, 25 bp, Rattus norvegicus
aaggttcggaccttgcggatgcacc

SEQ ID NO: 49721 - DNA, 25 bp, Rattus norvegicus
aaggttcggagcagttttctctaca

SEQ ID NO: 49722 - DNA, 25 bp, Rattus norvegicus
aaggttcggagctgttttctctaca

SEQ ID NO: 49723 - DNA, 25 bp, Rattus norvegicus
aaggttctacgcattgatgcatcta

SEQ ID NO: 49724 - DNA, 25 bp, Rattus norvegicus
aaggttctacgctttgatgcatcta

SEQ ID NO: 49725 - DNA, 25 bp, Rattus norvegicus
aaggttctagccaacagcagctttg

SEQ ID NO: 49726 - DNA, 25 bp, Rattus norvegicus
aaggttctagcctacagcagctttg

SEQ ID NO: 49727 - DNA, 25 bp, Rattus norvegicus
aaggttctagctagagggtcagcct

SEQ ID NO: 49728 - DNA, 25 bp, Rattus norvegicus
aaggttctagcttgagggtcagcct

SEQ ID NO: 49729 - DNA, 25 bp, Rattus norvegicus
aaggttctagggagctcggtacgca

SEQ ID NO: 49730 - DNA, 25 bp, Rattus norvegicus
aaggttctagggtgctcggtacgca

SEQ ID NO: 49731 - DNA, 25 bp, Rattus norvegicus
aaggttctagttcataggtctccta

SEQ ID NO: 49732 - DNA, 25 bp, Rattus norvegicus
aaggttctagttgataggtctccta

SEQ ID NO: 49733 - DNA, 25 bp, Rattus norvegicus
aaggttctcaacaagcaaggccagg

SEQ ID NO: 49734 - DNA, 25 bp, Rattus norvegicus
aaggttctcaactagcaaggccagg

SEQ ID NO: 49735 - DNA, 25 bp, Rattus norvegicus
aaggttctcaatcatatttactgtg

SEQ ID NO: 49736 - DNA, 25 bp, Rattus norvegicus
aaggttctcaatgatatttactgtg

SEQ ID NO: 49737 - DNA, 25 bp, Rattus norvegicus
aaggttctcagccatagcggagcaa

SEQ ID NO: 49738 - DNA, 25 bp, Rattus norvegicus
aaggttctcagcgatagcggagcaa

SEQ ID NO: 49739 - DNA, 25 bp, Rattus norvegicus
aaggttctcttgacagctatcatct

SEQ ID NO: 49740 - DNA, 25 bp, Rattus norvegicus
aaggttctcttgtcagctatcatct

SEQ ID NO: 49741 - DNA, 25 bp, Rattus norvegicus
aaggttctctttctcttggccacaa

SEQ ID NO: 49742 - DNA, 25 bp, Rattus norvegicus
aaggttctctttgtcttggccacaa

SEQ ID NO: 49743 - DNA, 25 bp, Rattus norvegicus
aaggttctgaggagtctgctttaaa

SEQ ID NO: 49744 - DNA, 25 bp, Rattus norvegicus
aaggttctgaggtgtctgctttaaa

SEQ ID NO: 49745 - DNA, 25 bp, Rattus norvegicus
aaggttctgcgaatccctgaaacgt

SEQ ID NO: 49746 - DNA, 25 bp, Rattus norvegicus
aaggttctgcgattccctgaaacgt

SEQ ID NO: 49747 - DNA, 25 bp, Rattus norvegicus
aaggttctggaaccggccgggacag

SEQ ID NO: 49748 - DNA, 25 bp, Rattus norvegicus
aaggttctggaaccgtgcttctctc

SEQ ID NO: 49749 - DNA, 25 bp, Rattus norvegicus
aaggttctggaagcggccgggacag

SEQ ID NO: 49750 - DNA, 25 bp, Rattus norvegicus
aaggttctggaagcgtgcttctctc

SEQ ID NO: 49751 - DNA, 25 bp, Rattus norvegicus
aaggttctgtggctctgttcatgta

SEQ ID NO: 49752 - DNA, 25 bp, Rattus norvegicus
aaggttctgtgggtctgttcatgta

SEQ ID NO: 49753 - DNA, 25 bp, Rattus norvegicus
aaggttctgtgtaggtaactcctgc

SEQ ID NO: 49754 - DNA, 25 bp, Rattus norvegicus
aaggttctgtgttggtaactcctgc

SEQ ID NO: 49755 - DNA, 25 bp, Rattus norvegicus
aaggttcttaatatcgccagcgtta

SEQ ID NO: 49756 - DNA, 25 bp, Rattus norvegicus
aaggttcttaatttcgccagcgtta

SEQ ID NO: 49757 - DNA, 25 bp, Rattus norvegicus
aaggttcttactaaactgctgacag

SEQ ID NO: 49758 - DNA, 25 bp, Rattus norvegicus
aaggttcttacttaactgctgacag

SEQ ID NO: 49759 - DNA, 25 bp, Rattus norvegicus
aaggttcttcctccctagaatgtgc

SEQ ID NO: 49760 - DNA, 25 bp, Rattus norvegicus
aaggttcttcctgcctagaatgtgc

SEQ ID NO: 49761 - DNA, 25 bp, Rattus norvegicus
aaggttcttcgtacagtggttgcac

SEQ ID NO: 49762 - DNA, 25 bp, Rattus norvegicus
aaggttcttcgttcagtggttgcac

SEQ ID NO: 49763 - DNA, 25 bp, Rattus norvegicus
aaggttcttgagacccagtgctggg

SEQ ID NO: 49764 - DNA, 25 bp, Rattus norvegicus
aaggttcttgagtcccagtgctggg

SEQ ID NO: 49765 - DNA, 25 bp, Rattus norvegicus
aaggttcttggtccctgtgaacaca

SEQ ID NO: 49766 - DNA, 25 bp, Rattus norvegicus
aaggttcttggtgcctgtgaacaca

SEQ ID NO: 49767 - DNA, 25 bp, Rattus norvegicus
aaggttctttgtcagcgatttgttc

SEQ ID NO: 49768 - DNA, 25 bp, Rattus norvegicus
aaggttctttgtgagcgatttgttc

SEQ ID NO: 49769 - DNA, 25 bp, Rattus norvegicus
aaggttgaacagagctccacagagt

SEQ ID NO: 49770 - DNA, 25 bp, Rattus norvegicus
aaggttgaacagtgctccacagagt

SEQ ID NO: 49771 - DNA, 25 bp, Rattus norvegicus
aaggttgaaggcctccagagtcgat

SEQ ID NO: 49772 - DNA, 25 bp, Rattus norvegicus
aaggttgaaggcgtccagagtcgat

SEQ ID NO: 49773 - DNA, 25 bp, Rattus norvegicus
aaggttgaatatacgcaccagagaa

SEQ ID NO: 49774 - DNA, 25 bp, Rattus norvegicus
aaggttgaatattcgcaccagagaa

SEQ ID NO: 49775 - DNA, 25 bp, Rattus norvegicus
aaggttgacaggcatcggcttctgc

SEQ ID NO: 49776 - DNA, 25 bp, Rattus norvegicus
aaggttgacagggatcggcttctgc

SEQ ID NO: 49777 - DNA, 25 bp, Rattus norvegicus
aaggttgcaacgatggagtctcatc

SEQ ID NO: 49778 - DNA, 25 bp, Rattus norvegicus
aaggttgcaacgttggagtctcatc

SEQ ID NO: 49779 - DNA, 25 bp, Rattus norvegicus
aaggttgcagcccttgaccgtttga

SEQ ID NO: 49780 - DNA, 25 bp, Rattus norvegicus
aaggttgcagccgttgaccgtttga

SEQ ID NO: 49781 - DNA, 25 bp, Rattus norvegicus
aaggttgcagtcatggtggccatct

SEQ ID NO: 49782 - DNA, 25 bp, Rattus norvegicus
aaggttgcagtcttggtggccatct

SEQ ID NO: 49783 - DNA, 25 bp, Rattus norvegicus
aaggttgcagtgatctccttgtgcc

SEQ ID NO: 49784 - DNA, 25 bp, Rattus norvegicus
aaggttgcagtgttctccttgtgcc

SEQ ID NO: 49785 - DNA, 25 bp, Rattus norvegicus
aaggttgcatttcgcacccttccct

SEQ ID NO: 49786 - DNA, 25 bp, Rattus norvegicus
aaggttgcatttggcacccttccct

SEQ ID NO: 49787 - DNA, 25 bp, Rattus norvegicus
aaggttgccaagaagaaatcacatt

SEQ ID NO: 49788 - DNA, 25 bp, Rattus norvegicus
aaggttgccaagtagaaatcacatt

SEQ ID NO: 49789 - DNA, 25 bp, Rattus norvegicus
aaggttgccctcagttacgtaatga

SEQ ID NO: 49790 - DNA, 25 bp, Rattus norvegicus
aaggttgccctctgttacgtaatga

SEQ ID NO: 49791 - DNA, 25 bp, Rattus norvegicus
aaggttgccggcatgatgtcttcaa

SEQ ID NO: 49792 - DNA, 25 bp, Rattus norvegicus
aaggttgccggcttgatgtcttcaa

SEQ ID NO: 49793 - DNA, 25 bp, Rattus norvegicus
aaggttgcctacatgcaggagtgtc

SEQ ID NO: 49794 - DNA, 25 bp, Rattus norvegicus
aaggttgcctacttgcaggagtgtc

SEQ ID NO: 49795 - DNA, 25 bp, Rattus norvegicus
aaggttgcctccatggaagaatcca

SEQ ID NO: 49796 - DNA, 25 bp, Rattus norvegicus
aaggttgcctccttggaagaatcca

SEQ ID NO: 49797 - DNA, 25 bp, Rattus norvegicus
aaggttgctctaacatctgtgagta

SEQ ID NO: 49798 - DNA, 25 bp, Rattus norvegicus
aaggttgctctatcatctgtgagta

SEQ ID NO: 49799 - DNA, 25 bp, Rattus norvegicus
aaggttgctgatatcggtcttgcca

SEQ ID NO: 49800 - DNA, 25 bp, Rattus norvegicus
aaggttgctgatttcggtcttgcca

SEQ ID NO: 49801 - DNA, 25 bp, Rattus norvegicus
aaggttgctgctatctctgagtcac

SEQ ID NO: 49802 - DNA, 25 bp, Rattus norvegicus
aaggttgctgctttctctgagtcac

SEQ ID NO: 49803 - DNA, 25 bp, Rattus norvegicus
aaggttgctggcatgagtgtcccag

SEQ ID NO: 49804 - DNA, 25 bp, Rattus norvegicus
aaggttgctggcttgagtgtcccag

SEQ ID NO: 49805 - DNA, 25 bp, Rattus norvegicus
aaggttgctgttactcgtagtcact

SEQ ID NO: 49806 - DNA, 25 bp, Rattus norvegicus
aaggttgctgtttctcgtagtcact

SEQ ID NO: 49807 - DNA, 25 bp, Rattus norvegicus
aaggttggagtacgcaaggttatca

SEQ ID NO: 49808 - DNA, 25 bp, Rattus norvegicus
aaggttggagtaggcaaggttatca

SEQ ID NO: 49809 - DNA, 25 bp, Rattus norvegicus
aaggttggccctcttatgccaggag

SEQ ID NO: 49810 - DNA, 25 bp, Rattus norvegicus
aaggttggccctgttatgccaggag

SEQ ID NO: 49811 - DNA, 25 bp, Rattus norvegicus
aaggttggctctagtaggccttaat

SEQ ID NO: 49812 - DNA, 25 bp, Rattus norvegicus
aaggttggctcttgtaggccttaat

SEQ ID NO: 49813 - DNA, 25 bp, Rattus norvegicus
aaggttgggactcgagccatcttcc

SEQ ID NO: 49814 - DNA, 25 bp, Rattus norvegicus
aaggttgggactggagccatcttcc

SEQ ID NO: 49815 - DNA, 25 bp, Rattus norvegicus
aaggttggtagcacaccagcacagc

SEQ ID NO: 49816 - DNA, 25 bp, Rattus norvegicus
aaggttggtagctcaccagcacagc

SEQ ID NO: 49817 - DNA, 25 bp, Rattus norvegicus
aaggttggtcccacctaggcaggca

SEQ ID NO: 49818 - DNA, 25 bp, Rattus norvegicus
aaggttggtccctcctaggcaggca

SEQ ID NO: 49819 - DNA, 25 bp, Rattus norvegicus
aaggttgtaaaacaggtcccatcag

SEQ ID NO: 49820 - DNA, 25 bp, Rattus norvegicus
aaggttgtaaaagaggtcccatcag

SEQ ID NO: 49821 - DNA, 25 bp, Rattus norvegicus
aaggttgtaacgactgtaacgctga

SEQ ID NO: 49822 - DNA, 25 bp, Rattus norvegicus
aaggttgtaacgtctgtaacgctga

SEQ ID NO: 49823 - DNA, 25 bp, Rattus norvegicus
aaggttgtaactacagtgccatgac

SEQ ID NO: 49824 - DNA, 25 bp, Rattus norvegicus
aaggttgtaacttcagtgccatgac

SEQ ID NO: 49825 - DNA, 25 bp, Rattus norvegicus
aaggttgtaaggagcccatgcctgc

SEQ ID NO: 49826 - DNA, 25 bp, Rattus norvegicus
aaggttgtaaggtgcccatgcctgc

SEQ ID NO: 49827 - DNA, 25 bp, Rattus norvegicus
aaggttgtaattagctccgtgagaa

SEQ ID NO: 49828 - DNA, 25 bp, Rattus norvegicus
aaggttgtaatttgctccgtgagaa

SEQ ID NO: 49829 - DNA, 25 bp, Rattus norvegicus
aaggttgtcagtcatggcggctctc

SEQ ID NO: 49830 - DNA, 25 bp, Rattus norvegicus
aaggttgtcagtgatggcggctctc

SEQ ID NO: 49831 - DNA, 25 bp, Rattus norvegicus
aaggttgtccagagactgcatttag

SEQ ID NO: 49832 - DNA, 25 bp, Rattus norvegicus
aaggttgtccagtgactgcatttag

SEQ ID NO: 49833 - DNA, 25 bp, Rattus norvegicus
aaggttgtcttcagacgtcttggag

SEQ ID NO: 49834 - DNA, 25 bp, Rattus norvegicus
aaggttgtcttctgacgtcttggag

SEQ ID NO: 49835 - DNA, 25 bp, Rattus norvegicus
aaggttgtgctcagccaggccagta

SEQ ID NO: 49836 - DNA, 25 bp, Rattus norvegicus
aaggttgtgctctgccaggccagta

SEQ ID NO: 49837 - DNA, 25 bp, Rattus norvegicus
aaggttgtggaaaagctctcctcgg

SEQ ID NO: 49838 - DNA, 25 bp, Rattus norvegicus
aaggttgtggaatagctctcctcgg

SEQ ID NO: 49839 - DNA, 25 bp, Rattus norvegicus
aaggttgtggctaatctggcccacc

SEQ ID NO: 49840 - DNA, 25 bp, Rattus norvegicus
aaggttgtggctaccaagtctttgc

SEQ ID NO: 49841 - DNA, 25 bp, Rattus norvegicus
aaggttgtggcttatctggcccacc

SEQ ID NO: 49842 - DNA, 25 bp, Rattus norvegicus
aaggttgtggcttccaagtctttgc

SEQ ID NO: 49843 - DNA, 25 bp, Rattus norvegicus
aaggttgtgtcaccaaagccctggg

SEQ ID NO: 49844 - DNA, 25 bp, Rattus norvegicus
aaggttgtgtcagcaaagccctggg

SEQ ID NO: 49845 - DNA, 25 bp, Rattus norvegicus
aaggttgttcccacctaccatgctg

SEQ ID NO: 49846 - DNA, 25 bp, Rattus norvegicus
aaggttgttccctcctaccatgctg

SEQ ID NO: 49847 - DNA, 25 bp, Rattus norvegicus
aaggttgttcttcatgcattccagc

SEQ ID NO: 49848 - DNA, 25 bp, Rattus norvegicus
aaggttgttcttgatgcattccagc

SEQ ID NO: 49849 - DNA, 25 bp, Rattus norvegicus
aaggtttaaactcgctcactgctaa

SEQ ID NO: 49850 - DNA, 25 bp, Rattus norvegicus
aaggtttaaactggctcactgctaa

SEQ ID NO: 49851 - DNA, 25 bp, Rattus norvegicus
aaggtttacattacttccattgctg

SEQ ID NO: 49852 - DNA, 25 bp, Rattus norvegicus
aaggtttacatttcttccattgctg

SEQ ID NO: 49853 - DNA, 25 bp, Rattus norvegicus
aaggtttagcatagtcgggactggt

SEQ ID NO: 49854 - DNA, 25 bp, Rattus norvegicus
aaggtttagcattgtcgggactggt

SEQ ID NO: 49855 - DNA, 25 bp, Rattus norvegicus
aaggtttagtgaacaattttccata

SEQ ID NO: 49856 - DNA, 25 bp, Rattus norvegicus
aaggtttagtgatcaattttccata

SEQ ID NO: 49857 - DNA, 25 bp, Rattus norvegicus
aaggtttatactcccttcttgcttt

SEQ ID NO: 49858 - DNA, 25 bp, Rattus norvegicus
aaggtttatactgccttcttgcttt

SEQ ID NO: 49859 - DNA, 25 bp, Rattus norvegicus
aaggtttatagtcatgcccagcccc

SEQ ID NO: 49860 - DNA, 25 bp, Rattus norvegicus
aaggtttatagtgatgcccagcccc

SEQ ID NO: 49861 - DNA, 25 bp, Rattus norvegicus
aaggtttatgaaatgctgagcccca

SEQ ID NO: 49862 - DNA, 25 bp, Rattus norvegicus
aaggtttatgaattgctgagcccca

SEQ ID NO: 49863 - DNA, 25 bp, Rattus norvegicus
aaggtttatgacataatggtgcatg

SEQ ID NO: 49864 - DNA, 25 bp, Rattus norvegicus
aaggtttatgacttaatggtgcatg

SEQ ID NO: 49865 - DNA, 25 bp, Rattus norvegicus
aaggtttattctactcagaactgga

SEQ ID NO: 49866 - DNA, 25 bp, Rattus norvegicus
aaggtttattcttctcagaactgga

SEQ ID NO: 49867 - DNA, 25 bp, Rattus norvegicus
aaggtttcaaagaaatgccattcat

SEQ ID NO: 49868 - DNA, 25 bp, Rattus norvegicus
aaggtttcaaagtaatgccattcat

SEQ ID NO: 49869 - DNA, 25 bp, Rattus norvegicus
aaggtttcacttcgccagtgcagac

SEQ ID NO: 49870 - DNA, 25 bp, Rattus norvegicus
aaggtttcacttggccagtgcagac

SEQ ID NO: 49871 - DNA, 25 bp, Rattus norvegicus
aaggtttcagaacgctggccagcac

SEQ ID NO: 49872 - DNA, 25 bp, Rattus norvegicus
aaggtttcagaaggctggccagcac

SEQ ID NO: 49873 - DNA, 25 bp, Rattus norvegicus
aaggtttcatgtcctcagtctgcaa

SEQ ID NO: 49874 - DNA, 25 bp, Rattus norvegicus
aaggtttcatgtgctcagtctgcaa

SEQ ID NO: 49875 - DNA, 25 bp, Rattus norvegicus
aaggtttccaatctgttcaggaagc

SEQ ID NO: 49876 - DNA, 25 bp, Rattus norvegicus
aaggtttccaatgtgttcaggaagc

SEQ ID NO: 49877 - DNA, 25 bp, Rattus norvegicus
aaggtttccacgattccacattaga

SEQ ID NO: 49878 - DNA, 25 bp, Rattus norvegicus
aaggtttccacgtttccacattaga

SEQ ID NO: 49879 - DNA, 25 bp, Rattus norvegicus
aaggtttccaggatctccttgagag

SEQ ID NO: 49880 - DNA, 25 bp, Rattus norvegicus
aaggtttccaggttctccttgagag

SEQ ID NO: 49881 - DNA, 25 bp, Rattus norvegicus
aaggtttccagtcatccaggcgtat

SEQ ID NO: 49882 - DNA, 25 bp, Rattus norvegicus
aaggtttccagtgatccaggcgtat

SEQ ID NO: 49883 - DNA, 25 bp, Rattus norvegicus
aaggtttccccacctatggcacaga

SEQ ID NO: 49884 - DNA, 25 bp, Rattus norvegicus
aaggtttccccagctatggcacaga

SEQ ID NO: 49885 - DNA, 25 bp, Rattus norvegicus
aaggtttcctctaagaactcgctgg

SEQ ID NO: 49886 - DNA, 25 bp, Rattus norvegicus
aaggtttcctcttagaactcgctgg

SEQ ID NO: 49887 - DNA, 25 bp, Rattus norvegicus
aaggtttcctggaccacaagcacgc

SEQ ID NO: 49888 - DNA, 25 bp, Rattus norvegicus
aaggtttcctggtccacaagcacgc

SEQ ID NO: 49889 - DNA, 25 bp, Rattus norvegicus
aaggtttcgctcatgccaaggctag

SEQ ID NO: 49890 - DNA, 25 bp, Rattus norvegicus
aaggtttcgctcttgccaaggctag

SEQ ID NO: 49891 - DNA, 25 bp, Rattus norvegicus
aaggtttcgtttactgtctgcactg

SEQ ID NO: 49892 - DNA, 25 bp, Rattus norvegicus
aaggtttcgttttctgtctgcactg

SEQ ID NO: 49893 - DNA, 25 bp, Rattus norvegicus
aaggtttctaccacagggacatttg

SEQ ID NO: 49894 - DNA, 25 bp, Rattus norvegicus
aaggtttctacctcagggacatttg

SEQ ID NO: 49895 - DNA, 25 bp, Rattus norvegicus
aaggtttctatacgcaaaggctcaa

SEQ ID NO: 49896 - DNA, 25 bp, Rattus norvegicus
aaggtttctataggcaaaggctcaa

SEQ ID NO: 49897 - DNA, 25 bp, Rattus norvegicus
aaggtttctctactttgtggctctc

SEQ ID NO: 49898 - DNA, 25 bp, Rattus norvegicus
aaggtttctctagtttgtggctctc

SEQ ID NO: 49899 - DNA, 25 bp, Rattus norvegicus
aaggtttctgtcatatctccttgag

SEQ ID NO: 49900 - DNA, 25 bp, Rattus norvegicus
aaggtttctgtcttatctccttgag

SEQ ID NO: 49901 - DNA, 25 bp, Rattus norvegicus
aaggtttctgtgaccatacctggct

SEQ ID NO: 49902 - DNA, 25 bp, Rattus norvegicus
aaggtttctgtgtccatacctggct

SEQ ID NO: 49903 - DNA, 25 bp, Rattus norvegicus
aaggtttcttgaccaggcccagaga

SEQ ID NO: 49904 - DNA, 25 bp, Rattus norvegicus
aaggtttcttgagcaggcccagaga

SEQ ID NO: 49905 - DNA, 25 bp, Rattus norvegicus
aaggtttctttgcatgacagctcag

SEQ ID NO: 49906 - DNA, 25 bp, Rattus norvegicus
aaggtttctttggatgacagctcag

SEQ ID NO: 49907 - DNA, 25 bp, Rattus norvegicus
aaggtttcttttcagtatgcgtaat

SEQ ID NO: 49908 - DNA, 25 bp, Rattus norvegicus
aaggtttcttttgagtatgcgtaat

SEQ ID NO: 49909 - DNA, 25 bp, Rattus norvegicus
aaggtttgacctacttgcagcttct

SEQ ID NO: 49910 - DNA, 25 bp, Rattus norvegicus
aaggtttgaccttcttgcagcttct

SEQ ID NO: 49911 - DNA, 25 bp, Rattus norvegicus
aaggtttgactacagccatagctac

SEQ ID NO: 49912 - DNA, 25 bp, Rattus norvegicus
aaggtttgactagagccatagctac

SEQ ID NO: 49913 - DNA, 25 bp, Rattus norvegicus
aaggtttgcaccctatgttcggaat

SEQ ID NO: 49914 - DNA, 25 bp, Rattus norvegicus
aaggtttgcaccgtatgttcggaat

SEQ ID NO: 49915 - DNA, 25 bp, Rattus norvegicus
aaggtttgctacacactgaccggct

SEQ ID NO: 49916 - DNA, 25 bp, Rattus norvegicus
aaggtttgctactcactgaccggct

SEQ ID NO: 49917 - DNA, 25 bp, Rattus norvegicus
aaggtttgctctctcagccatggac

SEQ ID NO: 49918 - DNA, 25 bp, Rattus norvegicus
aaggtttgctctgtcagccatggac

SEQ ID NO: 49919 - DNA, 25 bp, Rattus norvegicus
aaggtttgctgtcttgtccttgtac

SEQ ID NO: 49920 - DNA, 25 bp, Rattus norvegicus
aaggtttgctgtgttgtccttgtac

SEQ ID NO: 49921 - DNA, 25 bp, Rattus norvegicus
aaggtttgcttgatgtcacctgcaa

SEQ ID NO: 49922 - DNA, 25 bp, Rattus norvegicus
aaggtttgcttgttgtcacctgcaa

SEQ ID NO: 49923 - DNA, 25 bp, Rattus norvegicus
aaggtttgctttccttgggtggaca

SEQ ID NO: 49924 - DNA, 25 bp, Rattus norvegicus
aaggtttgctttgcttgggtggaca

SEQ ID NO: 49925 - DNA, 25 bp, Rattus norvegicus
aaggtttggagtatgccttgctggc

SEQ ID NO: 49926 - DNA, 25 bp, Rattus norvegicus
aaggtttggagtttgccttgctggc

SEQ ID NO: 49927 - DNA, 25 bp, Rattus norvegicus
aaggtttggctgacgcggaactcac

SEQ ID NO: 49928 - DNA, 25 bp, Rattus norvegicus
aaggtttggctgtcgcggaactcac

SEQ ID NO: 49929 - DNA, 25 bp, Rattus norvegicus
aaggtttggtctatctcattgggaa

SEQ ID NO: 49930 - DNA, 25 bp, Rattus norvegicus
aaggtttggtctttctcattgggaa

SEQ ID NO: 49931 - DNA, 25 bp, Rattus norvegicus
aaggtttgtactctttaccatcaca

SEQ ID NO: 49932 - DNA, 25 bp, Rattus norvegicus
aaggtttgtactgtttaccatcaca

SEQ ID NO: 49933 - DNA, 25 bp, Rattus norvegicus
aaggtttgtgccatttcacagtcta

SEQ ID NO: 49934 - DNA, 25 bp, Rattus norvegicus
aaggtttgtgccttttcacagtcta

SEQ ID NO: 49935 - DNA, 25 bp, Rattus norvegicus
aaggtttgtgcgcacttgatcagag

SEQ ID NO: 49936 - DNA, 25 bp, Rattus norvegicus
aaggtttgtgcggacttgatcagag

SEQ ID NO: 49937 - DNA, 25 bp, Rattus norvegicus
aaggttttaaggagctacttctgat

SEQ ID NO: 49938 - DNA, 25 bp, Rattus norvegicus
aaggttttaaggtgctacttctgat

SEQ ID NO: 49939 - DNA, 25 bp, Rattus norvegicus
aaggttttagagcacgcagcttcaa

SEQ ID NO: 49940 - DNA, 25 bp, Rattus norvegicus
aaggttttagaggacgcagcttcaa

SEQ ID NO: 49941 - DNA, 25 bp, Rattus norvegicus
aaggttttcaggcagtgccttgctc

SEQ ID NO: 49942 - DNA, 25 bp, Rattus norvegicus
aaggttttcagggagtgccttgctc

SEQ ID NO: 49943 - DNA, 25 bp, Rattus norvegicus
aaggttttcagtagggcgctccagg

SEQ ID NO: 49944 - DNA, 25 bp, Rattus norvegicus
aaggttttcagttgggcgctccagg

SEQ ID NO: 49945 - DNA, 25 bp, Rattus norvegicus
aaggttttcttcagagccccataca

SEQ ID NO: 49946 - DNA, 25 bp, Rattus norvegicus
aaggttttcttctgagccccataca

SEQ ID NO: 49947 - DNA, 25 bp, Rattus norvegicus
aaggttttgaagaaggcgctgccca

SEQ ID NO: 49948 - DNA, 25 bp, Rattus norvegicus
aaggttttgaagtaggcgctgccca

SEQ ID NO: 49949 - DNA, 25 bp, Rattus norvegicus
aaggttttgagaacttgccctctta

SEQ ID NO: 49950 - DNA, 25 bp, Rattus norvegicus
aaggttttgagatcttgccctctta

SEQ ID NO: 49951 - DNA, 25 bp, Rattus norvegicus
aaggttttgaggacgacgcagagcc

SEQ ID NO: 49952 - DNA, 25 bp, Rattus norvegicus
aaggttttgaggtcgacgcagagcc

SEQ ID NO: 49953 - DNA, 25 bp, Rattus norvegicus
aaggttttgctcacacatagatcac

SEQ ID NO: 49954 - DNA, 25 bp, Rattus norvegicus
aaggttttgctctcacatagatcac

SEQ ID NO: 49955 - DNA, 25 bp, Rattus norvegicus
aaggttttggcacgcaggacatagc

SEQ ID NO: 49956 - DNA, 25 bp, Rattus norvegicus
aaggttttggcaggcaggacatagc

SEQ ID NO: 49957 - DNA, 25 bp, Rattus norvegicus
aaggtttttcagatctaggtctagt

SEQ ID NO: 49958 - DNA, 25 bp, Rattus norvegicus
aaggtttttcagttctaggtctagt

SEQ ID NO: 49959 - DNA, 25 bp, Rattus norvegicus
aaggtttttgaactctcatcctggc

SEQ ID NO: 49960 - DNA, 25 bp, Rattus norvegicus
aaggtttttgaagtctcatcctggc

SEQ ID NO: 49961 - DNA, 25 bp, Rattus norvegicus
aagtaaaacctgacattaacacaag

SEQ ID NO: 49962 - DNA, 25 bp, Rattus norvegicus
aagtaaaacctgtcattaacacaag

SEQ ID NO: 49963 - DNA, 25 bp, Rattus norvegicus
aagtaaaactgaccgaggcatctca

SEQ ID NO: 49964 - DNA, 25 bp, Rattus norvegicus
aagtaaaactgagcgaggcatctca

SEQ ID NO: 49965 - DNA, 25 bp, Rattus norvegicus
aagtaaacggctctcctgcagagtc

SEQ ID NO: 49966 - DNA, 25 bp, Rattus norvegicus
aagtaaacggctgtcctgcagagtc

SEQ ID NO: 49967 - DNA, 25 bp, Rattus norvegicus
aagtaaactgacaggcatctcttcc

SEQ ID NO: 49968 - DNA, 25 bp, Rattus norvegicus
aagtaaactgactggcatctcttcc

SEQ ID NO: 49969 - DNA, 25 bp, Rattus norvegicus
aagtaaagcacacccgtgacatcca

SEQ ID NO: 49970 - DNA, 25 bp, Rattus norvegicus
aagtaaagcacagccgtgacatcca

SEQ ID NO: 49971 - DNA, 25 bp, Rattus norvegicus
aagtaaagcccaagacgcagtccca

SEQ ID NO: 49972 - DNA, 25 bp, Rattus norvegicus
aagtaaagcccatgacgcagtccca

SEQ ID NO: 49973 - DNA, 25 bp, Rattus norvegicus
aagtaaagctccctgaagattttca

SEQ ID NO: 49974 - DNA, 25 bp, Rattus norvegicus
aagtaaagctccgtgaagattttca

SEQ ID NO: 49975 - DNA, 25 bp, Rattus norvegicus
aagtaaagctctagctctgcgtgga

SEQ ID NO: 49976 - DNA, 25 bp, Rattus norvegicus
aagtaaagctcttgctctgcgtgga

SEQ ID NO: 49977 - DNA, 25 bp, Rattus norvegicus
aagtaaaggccaagtgcttcttccc

SEQ ID NO: 49978 - DNA, 25 bp, Rattus norvegicus
aagtaaaggccatgtgcttcttccc

SEQ ID NO: 49979 - DNA, 25 bp, Rattus norvegicus
aagtaaaggctgatcctgagggctc

SEQ ID NO: 49980 - DNA, 25 bp, Rattus norvegicus
aagtaaaggctgttcctgagggctc

SEQ ID NO: 49981 - DNA, 25 bp, Rattus norvegicus
aagtaaatcagaagcctccagccca

SEQ ID NO: 49982 - DNA, 25 bp, Rattus norvegicus
aagtaaatcagatgcctccagccca

SEQ ID NO: 49983 - DNA, 25 bp, Rattus norvegicus
aagtaaatcggtatgcctctgcctt

SEQ ID NO: 49984 - DNA, 25 bp, Rattus norvegicus
aagtaaatcggtttgcctctgcctt

SEQ ID NO: 49985 - DNA, 25 bp, Rattus norvegicus
aagtaaatctgacgcactgtgttgt

SEQ ID NO: 49986 - DNA, 25 bp, Rattus norvegicus
aagtaaatctgaggcactgtgttgt

SEQ ID NO: 49987 - DNA, 25 bp, Rattus norvegicus
aagtaaatgctacctctgacctctg

SEQ ID NO: 49988 - DNA, 25 bp, Rattus norvegicus
aagtaaatgctagctctgacctctg

SEQ ID NO: 49989 - DNA, 25 bp, Rattus norvegicus
aagtaaatggcgactcttccgtgct

SEQ ID NO: 49990 - DNA, 25 bp, Rattus norvegicus
aagtaaatggcgtctcttccgtgct

SEQ ID NO: 49991 - DNA, 25 bp, Rattus norvegicus
aagtaacaactcattctggcccatg

SEQ ID NO: 49992 - DNA, 25 bp, Rattus norvegicus
aagtaacaactctttctggcccatg

SEQ ID NO: 49993 - DNA, 25 bp, Rattus norvegicus
aagtaacacctacgtctacttccag

SEQ ID NO: 49994 - DNA, 25 bp, Rattus norvegicus
aagtaacacctaggtctacttccag

SEQ ID NO: 49995 - DNA, 25 bp, Rattus norvegicus
aagtaacagcccagaccgttctaca

SEQ ID NO: 49996 - DNA, 25 bp, Rattus norvegicus
aagtaacagccctgaccgttctaca

SEQ ID NO: 49997 - DNA, 25 bp, Rattus norvegicus
aagtaacagctcaggaggacccaaa

SEQ ID NO: 49998 - DNA, 25 bp, Rattus norvegicus
aagtaacagctctggaggacccaaa

SEQ ID NO: 49999 - DNA, 25 bp, Rattus norvegicus
aagtaacagtgcactaggccagata

SEQ ID NO: 50000 - DNA, 25 bp, Rattus norvegicus
aagtaacagtgctctaggccagata

SEQ ID NO: 50001 - DNA, 25 bp, Rattus norvegicus
aagtaacatgctatttcaccaaaga

SEQ ID NO: 50002 - DNA, 25 bp, Rattus norvegicus
aagtaacatgctttttcaccaaaga

SEQ ID NO: 50003 - DNA, 25 bp, Rattus norvegicus
aagtaaccatgcaaccgactatgaa

SEQ ID NO: 50004 - DNA, 25 bp, Rattus norvegicus
aagtaaccatgctaccgactatgaa

SEQ ID NO: 50005 - DNA, 25 bp, Rattus norvegicus
aagtaaccggaaccttgccctgaag

SEQ ID NO: 50006 - DNA, 25 bp, Rattus norvegicus
aagtaaccggaagcttgccctgaag

SEQ ID NO: 50007 - DNA, 25 bp, Rattus norvegicus
aagtaaccttgcaactgcccctgag

SEQ ID NO: 50008 - DNA, 25 bp, Rattus norvegicus
aagtaaccttgctactgcccctgag

SEQ ID NO: 50009 - DNA, 25 bp, Rattus norvegicus
aagtaactaaacactgctgggcagc

SEQ ID NO: 50010 - DNA, 25 bp, Rattus norvegicus
aagtaactaaactctgctgggcagc

SEQ ID NO: 50011 - DNA, 25 bp, Rattus norvegicus
aagtaactcacaagctctccagcta

SEQ ID NO: 50012 - DNA, 25 bp, Rattus norvegicus
aagtaactcacatgctctccagcta

SEQ ID NO: 50013 - DNA, 25 bp, Rattus norvegicus
aagtaactccagcagcaaggcttcc

SEQ ID NO: 50014 - DNA, 25 bp, Rattus norvegicus
aagtaactccaggagcaaggcttcc

SEQ ID NO: 50015 - DNA, 25 bp, Rattus norvegicus
aagtaactcttaccttccagtgtgt

SEQ ID NO: 50016 - DNA, 25 bp, Rattus norvegicus
aagtaactcttagcttccagtgtgt

SEQ ID NO: 50017 - DNA, 25 bp, Rattus norvegicus
aagtaactgctgctctctcagcgag

SEQ ID NO: 50018 - DNA, 25 bp, Rattus norvegicus
aagtaactgctggtctctcagcgag

SEQ ID NO: 50019 - DNA, 25 bp, Rattus norvegicus
aagtaactgcttaccgtgaatgtga

SEQ ID NO: 50020 - DNA, 25 bp, Rattus norvegicus
aagtaactgctttccgtgaatgtga

SEQ ID NO: 50021 - DNA, 25 bp, Rattus norvegicus
aagtaactgtgtctgtcctgttcgt

SEQ ID NO: 50022 - DNA, 25 bp, Rattus norvegicus
aagtaactgtgtgtgtcctgttcgt

SEQ ID NO: 50023 - DNA, 25 bp, Rattus norvegicus
aagtaacttcagctgtgcttaaaca

SEQ ID NO: 50024 - DNA, 25 bp, Rattus norvegicus
aagtaacttcaggtgtgcttaaaca

SEQ ID NO: 50025 - DNA, 25 bp, Rattus norvegicus
aagtaactttatccacccgatgtaa

SEQ ID NO: 50026 - DNA, 25 bp, Rattus norvegicus
aagtaactttatgcacccgatgtaa

SEQ ID NO: 50027 - DNA, 25 bp, Rattus norvegicus
aagtaagacaaaatcctgccctctg

SEQ ID NO: 50028 - DNA, 25 bp, Rattus norvegicus
aagtaagacaaattcctgccctctg

SEQ ID NO: 50029 - DNA, 25 bp, Rattus norvegicus
aagtaagattacacagccctcattt

SEQ ID NO: 50030 - DNA, 25 bp, Rattus norvegicus
aagtaagattactcagccctcattt

SEQ ID NO: 50031 - DNA, 25 bp, Rattus norvegicus
aagtaagcagctatccctggtggaa

SEQ ID NO: 50032 - DNA, 25 bp, Rattus norvegicus
aagtaagcagctttccctggtggaa

SEQ ID NO: 50033 - DNA, 25 bp, Rattus norvegicus
aagtaagcagtccaaccttcctgga

SEQ ID NO: 50034 - DNA, 25 bp, Rattus norvegicus
aagtaagcagtcgaaccttcctgga

SEQ ID NO: 50035 - DNA, 25 bp, Rattus norvegicus
aagtaagcattcatcctcagctcta

SEQ ID NO: 50036 - DNA, 25 bp, Rattus norvegicus
aagtaagcattcttcctcagctcta

SEQ ID NO: 50037 - DNA, 25 bp, Rattus norvegicus
aagtaagccagcagccctttctgtc

SEQ ID NO: 50038 - DNA, 25 bp, Rattus norvegicus
aagtaagccagctgccctttctgtc

SEQ ID NO: 50039 - DNA, 25 bp, Rattus norvegicus
aagtaagcggctaggcaaatccagc

SEQ ID NO: 50040 - DNA, 25 bp, Rattus norvegicus
aagtaagcggcttggcaaatccagc

SEQ ID NO: 50041 - DNA, 25 bp, Rattus norvegicus
aagtaaggctccacagtagcctgat

SEQ ID NO: 50042 - DNA, 25 bp, Rattus norvegicus
aagtaaggctcctcagtagcctgat

SEQ ID NO: 50043 - DNA, 25 bp, Rattus norvegicus
aagtaaggctgaaggcttctcccct

SEQ ID NO: 50044 - DNA, 25 bp, Rattus norvegicus
aagtaaggctgatggcttctcccct

SEQ ID NO: 50045 - DNA, 25 bp, Rattus norvegicus
aagtaaggtcttcggtctgcagtcc

SEQ ID NO: 50046 - DNA, 25 bp, Rattus norvegicus
aagtaaggtcttgggtctgcagtcc

SEQ ID NO: 50047 - DNA, 25 bp, Rattus norvegicus
aagtaagtagacagctgtggccaag

SEQ ID NO: 50048 - DNA, 25 bp, Rattus norvegicus
aagtaagtagactgctgtggccaag

SEQ ID NO: 50049 - DNA, 25 bp, Rattus norvegicus
aagtaagtcccacagctgcctccta

SEQ ID NO: 50050 - DNA, 25 bp, Rattus norvegicus
aagtaagtcccagagctgcctccta

SEQ ID NO: 50051 - DNA, 25 bp, Rattus norvegicus
aagtaatagcatacactctggtgat

SEQ ID NO: 50052 - DNA, 25 bp, Rattus norvegicus
aagtaatagcattcactctggtgat

SEQ ID NO: 50053 - DNA, 25 bp, Rattus norvegicus
aagtaatatctccacggttagccct

SEQ ID NO: 50054 - DNA, 25 bp, Rattus norvegicus
aagtaatatctcgacggttagccct

SEQ ID NO: 50055 - DNA, 25 bp, Rattus norvegicus
aagtaatcatctcagtcccttctgc

SEQ ID NO: 50056 - DNA, 25 bp, Rattus norvegicus
aagtaatcatctgagtcccttctgc

SEQ ID NO: 50057 - DNA, 25 bp, Rattus norvegicus
aagtaatgaggtctccggcactgga

SEQ ID NO: 50058 - DNA, 25 bp, Rattus norvegicus
aagtaatgaggtgtccggcactgga

SEQ ID NO: 50059 - DNA, 25 bp, Rattus norvegicus
aagtaatgagtcatgggaacaccca

SEQ ID NO: 50060 - DNA, 25 bp, Rattus norvegicus
aagtaatgagtcttgggaacaccca

SEQ ID NO: 50061 - DNA, 25 bp, Rattus norvegicus
aagtaatgccatatctgagaaaatt

SEQ ID NO: 50062 - DNA, 25 bp, Rattus norvegicus
aagtaatgccatttctgagaaaatt

SEQ ID NO: 50063 - DNA, 25 bp, Rattus norvegicus
aagtaatgccttcatggttccactg

SEQ ID NO: 50064 - DNA, 25 bp, Rattus norvegicus
aagtaatgccttgatggttccactg

SEQ ID NO: 50065 - DNA, 25 bp, Rattus norvegicus
aagtaatgctcacctctgtttcatg

SEQ ID NO: 50066 - DNA, 25 bp, Rattus norvegicus
aagtaatgctcagctctgtttcatg

SEQ ID NO: 50067 - DNA, 25 bp, Rattus norvegicus
aagtaatgtaacaccgtgcctggca

SEQ ID NO: 50068 - DNA, 25 bp, Rattus norvegicus
aagtaatgtaactccgtgcctggca

SEQ ID NO: 50069 - DNA, 25 bp, Rattus norvegicus
aagtaatgtgttacctgtgtctgta

SEQ ID NO: 50070 - DNA, 25 bp, Rattus norvegicus
aagtaatgtgtttcctgtgtctgta

SEQ ID NO: 50071 - DNA, 25 bp, Rattus norvegicus
aagtaattgcacctgtaatcttggg

SEQ ID NO: 50072 - DNA, 25 bp, Rattus norvegicus
aagtaattgcacgtgtaatcttggg

SEQ ID NO: 50073 - DNA, 25 bp, Rattus norvegicus
aagtaattgctcacttcctttctaa

SEQ ID NO: 50074 - DNA, 25 bp, Rattus norvegicus
aagtaattgctctcttcctttctaa

SEQ ID NO: 50075 - DNA, 25 bp, Rattus norvegicus
aagtaatttacacagcgagtttcag

SEQ ID NO: 50076 - DNA, 25 bp, Rattus norvegicus
aagtaatttacagagcgagtttcag

SEQ ID NO: 50077 - DNA, 25 bp, Rattus norvegicus
aagtacaaatatacagtgttctctt

SEQ ID NO: 50078 - DNA, 25 bp, Rattus norvegicus
aagtacaaatattcagtgttctctt

SEQ ID NO: 50079 - DNA, 25 bp, Rattus norvegicus
aagtacaacatcattgcggacagct

SEQ ID NO: 50080 - DNA, 25 bp, Rattus norvegicus
aagtacaacatccttccggaggcag

SEQ ID NO: 50081 - DNA, 25 bp, Rattus norvegicus
aagtacaacatcgttccggaggcag

SEQ ID NO: 50082 - DNA, 25 bp, Rattus norvegicus
aagtacaacatctttgcggacagct

SEQ ID NO: 50083 - DNA, 25 bp, Rattus norvegicus
aagtacaacgtcactttcgactact

SEQ ID NO: 50084 - DNA, 25 bp, Rattus norvegicus
aagtacaacgtctctttcgactact

SEQ ID NO: 50085 - DNA, 25 bp, Rattus norvegicus
aagtacaactttccagccagggcgc

SEQ ID NO: 50086 - DNA, 25 bp, Rattus norvegicus
aagtacaactttgcagccagggcgc

SEQ ID NO: 50087 - DNA, 25 bp, Rattus norvegicus
aagtacaatgtaccagcttgacttt

SEQ ID NO: 50088 - DNA, 25 bp, Rattus norvegicus
aagtacaatgtagcagcttgacttt

SEQ ID NO: 50089 - DNA, 25 bp, Rattus norvegicus
aagtacacaaagcagcagcggagaa

SEQ ID NO: 50090 - DNA, 25 bp, Rattus norvegicus
aagtacacaaaggagcagcggagaa

SEQ ID NO: 50091 - DNA, 25 bp, Rattus norvegicus
aagtacacacacacataagcactgt

SEQ ID NO: 50092 - DNA, 25 bp, Rattus norvegicus
aagtacacacactcataagcactgt

SEQ ID NO: 50093 - DNA, 25 bp, Rattus norvegicus
aagtacacacatacttccctatgtt

SEQ ID NO: 50094 - DNA, 25 bp, Rattus norvegicus
aagtacacacattcttccctatgtt

SEQ ID NO: 50095 - DNA, 25 bp, Rattus norvegicus
aagtacacacgtcgcttcacatcta

SEQ ID NO: 50096 - DNA, 25 bp, Rattus norvegicus
aagtacacacgtggcttcacatcta

SEQ ID NO: 50097 - DNA, 25 bp, Rattus norvegicus
aagtacacagacatgccccgtggga

SEQ ID NO: 50098 - DNA, 25 bp, Rattus norvegicus
aagtacacagacttgccccgtggga

SEQ ID NO: 50099 - DNA, 25 bp, Rattus norvegicus
aagtacacagagatcacctcttcca

SEQ ID NO: 50100 - DNA, 25 bp, Rattus norvegicus
aagtacacagagttcacctcttcca

SEQ ID NO: 50101 - DNA, 25 bp, Rattus norvegicus
aagtacaccaagagccgaggccggg

SEQ ID NO: 50102 - DNA, 25 bp, Rattus norvegicus
aagtacaccaagtgccgaggccggg

SEQ ID NO: 50103 - DNA, 25 bp, Rattus norvegicus
aagtacacctttatgtcatagctgt

SEQ ID NO: 50104 - DNA, 25 bp, Rattus norvegicus
aagtacacctttttgtcatagctgt

SEQ ID NO: 50105 - DNA, 25 bp, Rattus norvegicus
aagtacacttcacggagcagccacc

SEQ ID NO: 50106 - DNA, 25 bp, Rattus norvegicus
aagtacacttcagggagcagccacc

SEQ ID NO: 50107 - DNA, 25 bp, Rattus norvegicus
aagtacactttgcattggccaacag

SEQ ID NO: 50108 - DNA, 25 bp, Rattus norvegicus
aagtacactttggattggccaacag

SEQ ID NO: 50109 - DNA, 25 bp, Rattus norvegicus
aagtacagaaataagtggcccatca

SEQ ID NO: 50110 - DNA, 25 bp, Rattus norvegicus
aagtacagaaattagtggcccatca

SEQ ID NO: 50111 - DNA, 25 bp, Rattus norvegicus
aagtacagatgtagcgcctgcctgg

SEQ ID NO: 50112 - DNA, 25 bp, Rattus norvegicus
aagtacagatgttgcgcctgcctgg

SEQ ID NO: 50113 - DNA, 25 bp, Rattus norvegicus
aagtacagcctgctatcctggattg

SEQ ID NO: 50114 - DNA, 25 bp, Rattus norvegicus
aagtacagcctggtatcctggattg

SEQ ID NO: 50115 - DNA, 25 bp, Rattus norvegicus
aagtacagggccctcagtcagctgg

SEQ ID NO: 50116 - DNA, 25 bp, Rattus norvegicus
aagtacagggccgtcagtcagctgg

SEQ ID NO: 50117 - DNA, 25 bp, Rattus norvegicus
aagtacagggctccgtgccactgca

SEQ ID NO: 50118 - DNA, 25 bp, Rattus norvegicus
aagtacagggctgcgtgccactgca

SEQ ID NO: 50119 - DNA, 25 bp, Rattus norvegicus
aagtacagggtgctgggctcactac

SEQ ID NO: 50120 - DNA, 25 bp, Rattus norvegicus
aagtacagggtggtgggctcactac

SEQ ID NO: 50121 - DNA, 25 bp, Rattus norvegicus
aagtacagtctaagttggcaagtta

SEQ ID NO: 50122 - DNA, 25 bp, Rattus norvegicus
aagtacagtctacggcgtctgacac

SEQ ID NO: 50123 - DNA, 25 bp, Rattus norvegicus
aagtacagtctagggcgtctgacac

SEQ ID NO: 50124 - DNA, 25 bp, Rattus norvegicus
aagtacagtctatgttggcaagtta

SEQ ID NO: 50125 - DNA, 25 bp, Rattus norvegicus
aagtacagtgccatgctgtgaccat

SEQ ID NO: 50126 - DNA, 25 bp, Rattus norvegicus
aagtacagtgccttgctgtgaccat

SEQ ID NO: 50127 - DNA, 25 bp, Rattus norvegicus
aagtacagtgtaatagccccaggat

SEQ ID NO: 50128 - DNA, 25 bp, Rattus norvegicus
aagtacagtgtattagccccaggat

SEQ ID NO: 50129 - DNA, 25 bp, Rattus norvegicus
aagtacataggtccacactgccctg

SEQ ID NO: 50130 - DNA, 25 bp, Rattus norvegicus
aagtacataggtgcacactgccctg

SEQ ID NO: 50131 - DNA, 25 bp, Rattus norvegicus
aagtacatcatgacctgtgactata

SEQ ID NO: 50132 - DNA, 25 bp, Rattus norvegicus
aagtacatcatgtcctgtgactata

SEQ ID NO: 50133 - DNA, 25 bp, Rattus norvegicus
aagtacatcattaggtccccggtgt

SEQ ID NO: 50134 - DNA, 25 bp, Rattus norvegicus
aagtacatcatttggtccccggtgt

SEQ ID NO: 50135 - DNA, 25 bp, Rattus norvegicus
aagtacatccctctgcttgagtggt

SEQ ID NO: 50136 - DNA, 25 bp, Rattus norvegicus
aagtacatccctgtgcttgagtggt

SEQ ID NO: 50137 - DNA, 25 bp, Rattus norvegicus
aagtacatccttcctttactgaact

SEQ ID NO: 50138 - DNA, 25 bp, Rattus norvegicus
aagtacatccttgctttactgaact

SEQ ID NO: 50139 - DNA, 25 bp, Rattus norvegicus
aagtacatcgtccaaatccctgtct

SEQ ID NO: 50140 - DNA, 25 bp, Rattus norvegicus
aagtacatcgtcgaaatccctgtct

SEQ ID NO: 50141 - DNA, 25 bp, Rattus norvegicus
aagtacattgtcaggctgtctgact

SEQ ID NO: 50142 - DNA, 25 bp, Rattus norvegicus
aagtacattgtctggctgtctgact

SEQ ID NO: 50143 - DNA, 25 bp, Rattus norvegicus
aagtacattttcacctgcgacttct

SEQ ID NO: 50144 - DNA, 25 bp, Rattus norvegicus
aagtacattttcaggtcttgagacc

SEQ ID NO: 50145 - DNA, 25 bp, Rattus norvegicus
aagtacattttctcctgcgacttct

SEQ ID NO: 50146 - DNA, 25 bp, Rattus norvegicus
aagtacattttctggtcttgagacc

SEQ ID NO: 50147 - DNA, 25 bp, Rattus norvegicus
aagtaccaaggaagtgcctgccggc

SEQ ID NO: 50148 - DNA, 25 bp, Rattus norvegicus
aagtaccaaggatgtgcctgccggc

SEQ ID NO: 50149 - DNA, 25 bp, Rattus norvegicus
aagtaccacagactcaaccatgact

SEQ ID NO: 50150 - DNA, 25 bp, Rattus norvegicus
aagtaccacagagtcaaccatgact

SEQ ID NO: 50151 - DNA, 25 bp, Rattus norvegicus
aagtaccactctatggagcatctct

SEQ ID NO: 50152 - DNA, 25 bp, Rattus norvegicus
aagtaccactctttggagcatctct

SEQ ID NO: 50153 - DNA, 25 bp, Rattus norvegicus
aagtaccagagcaccttggtaagga

SEQ ID NO: 50154 - DNA, 25 bp, Rattus norvegicus
aagtaccagagctccttggtaagga

SEQ ID NO: 50155 - DNA, 25 bp, Rattus norvegicus
aagtaccagctcaccattcacaaga

SEQ ID NO: 50156 - DNA, 25 bp, Rattus norvegicus
aagtaccagctctccattcacaaga

SEQ ID NO: 50157 - DNA, 25 bp, Rattus norvegicus
aagtaccagtgcaccatggagaata

SEQ ID NO: 50158 - DNA, 25 bp, Rattus norvegicus
aagtaccagtgctccatggagaata

SEQ ID NO: 50159 - DNA, 25 bp, Rattus norvegicus
aagtaccatcttccagtgttcacat

SEQ ID NO: 50160 - DNA, 25 bp, Rattus norvegicus
aagtaccatcttgcagtgttcacat

SEQ ID NO: 50161 - DNA, 25 bp, Rattus norvegicus
aagtaccatggaccatgcccggcat

SEQ ID NO: 50162 - DNA, 25 bp, Rattus norvegicus
aagtaccatggactgccagaggcca

SEQ ID NO: 50163 - DNA, 25 bp, Rattus norvegicus
aagtaccatggagcatgcccggcat

SEQ ID NO: 50164 - DNA, 25 bp, Rattus norvegicus
aagtaccatggagtgccagaggcca

SEQ ID NO: 50165 - DNA, 25 bp, Rattus norvegicus
aagtaccattagcaccctgggtaat

SEQ ID NO: 50166 - DNA, 25 bp, Rattus norvegicus
aagtaccattaggaccctgggtaat

SEQ ID NO: 50167 - DNA, 25 bp, Rattus norvegicus
aagtaccattgtcccatgagacccc

SEQ ID NO: 50168 - DNA, 25 bp, Rattus norvegicus
aagtaccattgtgccatgagacccc

SEQ ID NO: 50169 - DNA, 25 bp, Rattus norvegicus
aagtacccaaagagcctgtcggata

SEQ ID NO: 50170 - DNA, 25 bp, Rattus norvegicus
aagtacccaaagtgcctgtcggata

SEQ ID NO: 50171 - DNA, 25 bp, Rattus norvegicus
aagtacccagaaagtagttttgatg

SEQ ID NO: 50172 - DNA, 25 bp, Rattus norvegicus
aagtacccagaatgtagttttgatg

SEQ ID NO: 50173 - DNA, 25 bp, Rattus norvegicus
aagtaccccacacaagctatcaaat

SEQ ID NO: 50174 - DNA, 25 bp, Rattus norvegicus
aagtaccccacagaagctatcaaat

SEQ ID NO: 50175 - DNA, 25 bp, Rattus norvegicus
aagtaccccataagcggcatgtagt

SEQ ID NO: 50176 - DNA, 25 bp, Rattus norvegicus
aagtaccccatatgcggcatgtagt

SEQ ID NO: 50177 - DNA, 25 bp, Rattus norvegicus
aagtaccccgccagtataattgcat

SEQ ID NO: 50178 - DNA, 25 bp, Rattus norvegicus
aagtaccccgcctgtataattgcat

SEQ ID NO: 50179 - DNA, 25 bp, Rattus norvegicus
aagtaccccttcctatggcattagt

SEQ ID NO: 50180 - DNA, 25 bp, Rattus norvegicus
aagtaccccttcgtatggcattagt

SEQ ID NO: 50181 - DNA, 25 bp, Rattus norvegicus
aagtacccgatcacagctcgagtgg

SEQ ID NO: 50182 - DNA, 25 bp, Rattus norvegicus
aagtacccgatctcagctcgagtgg

SEQ ID NO: 50183 - DNA, 25 bp, Rattus norvegicus
aagtacccggatacagcagcagctg

SEQ ID NO: 50184 - DNA, 25 bp, Rattus norvegicus
aagtacccggattcagcagcagctg

SEQ ID NO: 50185 - DNA, 25 bp, Rattus norvegicus
aagtacccggctccacagctgtgat

SEQ ID NO: 50186 - DNA, 25 bp, Rattus norvegicus
aagtacccggctgcacagctgtgat

SEQ ID NO: 50187 - DNA, 25 bp, Rattus norvegicus
aagtacccgtggagtcacatacaga

SEQ ID NO: 50188 - DNA, 25 bp, Rattus norvegicus
aagtacccgtggtgtcacatacaga

SEQ ID NO: 50189 - DNA, 25 bp, Rattus norvegicus
aagtaccgaagcctgcccaagctca

SEQ ID NO: 50190 - DNA, 25 bp, Rattus norvegicus
aagtaccgaagcgtgcccaagctca

SEQ ID NO: 50191 - DNA, 25 bp, Rattus norvegicus
aagtaccgccctcatctgcgtatgg

SEQ ID NO: 50192 - DNA, 25 bp, Rattus norvegicus
aagtaccgccctgatctgcgtatgg

SEQ ID NO: 50193 - DNA, 25 bp, Rattus norvegicus
aagtaccggcctaagcagagactga

SEQ ID NO: 50194 - DNA, 25 bp, Rattus norvegicus
aagtaccggccttagcagagactga

SEQ ID NO: 50195 - DNA, 25 bp, Rattus norvegicus
aagtacctaacaagagcccgcagtg

SEQ ID NO: 50196 - DNA, 25 bp, Rattus norvegicus
aagtacctaacatgagcccgcagtg

SEQ ID NO: 50197 - DNA, 25 bp, Rattus norvegicus
aagtacctacctatgagttcaccag

SEQ ID NO: 50198 - DNA, 25 bp, Rattus norvegicus
aagtacctacctttgagttcaccag

SEQ ID NO: 50199 - DNA, 25 bp, Rattus norvegicus
aagtacctctttcgtgaagcctcgg

SEQ ID NO: 50200 - DNA, 25 bp, Rattus norvegicus
aagtacctctttggtgaagcctcgg

SEQ ID NO: 50201 - DNA, 25 bp, Rattus norvegicus
aagtacctgctgctgggcaatgctg

SEQ ID NO: 50202 - DNA, 25 bp, Rattus norvegicus
aagtacctgctggtgggcaatgctg

SEQ ID NO: 50203 - DNA, 25 bp, Rattus norvegicus
aagtacctggccaagaagttcaaca

SEQ ID NO: 50204 - DNA, 25 bp, Rattus norvegicus
aagtacctggcccatgggctaccag

SEQ ID NO: 50205 - DNA, 25 bp, Rattus norvegicus
aagtacctggccgatgggctaccag

SEQ ID NO: 50206 - DNA, 25 bp, Rattus norvegicus
aagtacctggcctagaagttcaaca

SEQ ID NO: 50207 - DNA, 25 bp, Rattus norvegicus
aagtacctgggaagagagaactcaa

SEQ ID NO: 50208 - DNA, 25 bp, Rattus norvegicus
aagtacctgggatgagagaactcaa

SEQ ID NO: 50209 - DNA, 25 bp, Rattus norvegicus
aagtacctgtgcctcctgacagttt

SEQ ID NO: 50210 - DNA, 25 bp, Rattus norvegicus
aagtacctgtgcgtcctgacagttt

SEQ ID NO: 50211 - DNA, 25 bp, Rattus norvegicus
aagtaccttccactccttagagtgt

SEQ ID NO: 50212 - DNA, 25 bp, Rattus norvegicus
aagtaccttccagtccttagagtgt

SEQ ID NO: 50213 - DNA, 25 bp, Rattus norvegicus
aagtaccttcctccccagattttat

SEQ ID NO: 50214 - DNA, 25 bp, Rattus norvegicus
aagtaccttcctgcccagattttat

SEQ ID NO: 50215 - DNA, 25 bp, Rattus norvegicus
aagtaccttcgtcgaggtgcctcag

SEQ ID NO: 50216 - DNA, 25 bp, Rattus norvegicus
aagtaccttcgtggaggtgcctcag

SEQ ID NO: 50217 - DNA, 25 bp, Rattus norvegicus
aagtaccttgtacggaatgacagat

SEQ ID NO: 50218 - DNA, 25 bp, Rattus norvegicus
aagtaccttgtagggaatgacagat

SEQ ID NO: 50219 - DNA, 25 bp, Rattus norvegicus
aagtacctttgtcttttcagcagcc

SEQ ID NO: 50220 - DNA, 25 bp, Rattus norvegicus
aagtacctttgtgttttcagcagcc

SEQ ID NO: 50221 - DNA, 25 bp, Rattus norvegicus
aagtacgagcggatcagcgagaaga

SEQ ID NO: 50222 - DNA, 25 bp, Rattus norvegicus
aagtacgagcggttcagcgagaaga

SEQ ID NO: 50223 - DNA, 25 bp, Rattus norvegicus
aagtacgagctgctaccgggtctgc

SEQ ID NO: 50224 - DNA, 25 bp, Rattus norvegicus
aagtacgagctggtaccgggtctgc

SEQ ID NO: 50225 - DNA, 25 bp, Rattus norvegicus
aagtacgatgagcagctcaccccta

SEQ ID NO: 50226 - DNA, 25 bp, Rattus norvegicus
aagtacgatgaggagctcaccccta

SEQ ID NO: 50227 - DNA, 25 bp, Rattus norvegicus
aagtacgcactcactcaggatgtct

SEQ ID NO: 50228 - DNA, 25 bp, Rattus norvegicus
aagtacgcactctctcaggatgtct

SEQ ID NO: 50229 - DNA, 25 bp, Rattus norvegicus
aagtacgccaagatatcacctttga

SEQ ID NO: 50230 - DNA, 25 bp, Rattus norvegicus
aagtacgccaagttatcacctttga

SEQ ID NO: 50231 - DNA, 25 bp, Rattus norvegicus
aagtacgcggccagcagctacctga

SEQ ID NO: 50232 - DNA, 25 bp, Rattus norvegicus
aagtacgcggcctgcagctacctga

SEQ ID NO: 50233 - DNA, 25 bp, Rattus norvegicus
aagtacgcgtgcaccaccaagtggg

SEQ ID NO: 50234 - DNA, 25 bp, Rattus norvegicus
aagtacgcgtgctccaccaagtggg

SEQ ID NO: 50235 - DNA, 25 bp, Rattus norvegicus
aagtacgctgtgctctgagaaactc

SEQ ID NO: 50236 - DNA, 25 bp, Rattus norvegicus
aagtacgctgtggtctgagaaactc

SEQ ID NO: 50237 - DNA, 25 bp, Rattus norvegicus
aagtacggacttaagcttgtagaca

SEQ ID NO: 50238 - DNA, 25 bp, Rattus norvegicus
aagtacggactttagcttgtagaca

SEQ ID NO: 50239 - DNA, 25 bp, Rattus norvegicus
aagtacggagccataccagatcggg

SEQ ID NO: 50240 - DNA, 25 bp, Rattus norvegicus
aagtacggagccttaccagatcggg

SEQ ID NO: 50241 - DNA, 25 bp, Rattus norvegicus
aagtacggctgacttttccaacaca

SEQ ID NO: 50242 - DNA, 25 bp, Rattus norvegicus
aagtacggctgagttttccaacaca

SEQ ID NO: 50243 - DNA, 25 bp, Rattus norvegicus
aagtacggtggcaggcctgctgctt

SEQ ID NO: 50244 - DNA, 25 bp, Rattus norvegicus
aagtacggtggctggcctgctgctt

SEQ ID NO: 50245 - DNA, 25 bp, Rattus norvegicus
aagtacgtgaggcttcatgcggttc

SEQ ID NO: 50246 - DNA, 25 bp, Rattus norvegicus
aagtacgtgagggttcatgcggttc

SEQ ID NO: 50247 - DNA, 25 bp, Rattus norvegicus
aagtacgtgtacatcaccatcgtca

SEQ ID NO: 50248 - DNA, 25 bp, Rattus norvegicus
aagtacgtgtacttcaccatcgtca

SEQ ID NO: 50249 - DNA, 25 bp, Rattus norvegicus
aagtactacatgaacccttcctcaa

SEQ ID NO: 50250 - DNA, 25 bp, Rattus norvegicus
aagtactacatgtacccttcctcaa

SEQ ID NO: 50251 - DNA, 25 bp, Rattus norvegicus
aagtactagaacatctctctgcacc

SEQ ID NO: 50252 - DNA, 25 bp, Rattus norvegicus
aagtactagaacttctctctgcacc

SEQ ID NO: 50253 - DNA, 25 bp, Rattus norvegicus
aagtactatcacatcctcttggttt

SEQ ID NO: 50254 - DNA, 25 bp, Rattus norvegicus
aagtactatcacttcctcttggttt

SEQ ID NO: 50255 - DNA, 25 bp, Rattus norvegicus
aagtactctgtgattccttgtggcc

SEQ ID NO: 50256 - DNA, 25 bp, Rattus norvegicus
aagtactctgtgtttccttgtggcc

SEQ ID NO: 50257 - DNA, 25 bp, Rattus norvegicus
aagtactcttggcaggactcgcaga

SEQ ID NO: 50258 - DNA, 25 bp, Rattus norvegicus
aagtactcttgggaggactcgcaga

SEQ ID NO: 50259 - DNA, 25 bp, Rattus norvegicus
aagtactgaatacctctttctgtta

SEQ ID NO: 50260 - DNA, 25 bp, Rattus norvegicus
aagtactgaatagctctttctgtta

SEQ ID NO: 50261 - DNA, 25 bp, Rattus norvegicus
aagtactgacagaggccaaaggccc

SEQ ID NO: 50262 - DNA, 25 bp, Rattus norvegicus
aagtactgacagtggccaaaggccc

SEQ ID NO: 50263 - DNA, 25 bp, Rattus norvegicus
aagtactgcaacctcttagtgcggg

SEQ ID NO: 50264 - DNA, 25 bp, Rattus norvegicus
aagtactgcaacgtcttagtgcggg

SEQ ID NO: 50265 - DNA, 25 bp, Rattus norvegicus
aagtactgcactcgctgaacgactc

SEQ ID NO: 50266 - DNA, 25 bp, Rattus norvegicus
aagtactgcactggctgaacgactc

SEQ ID NO: 50267 - DNA, 25 bp, Rattus norvegicus
aagtactgctccatgggctttgtaa

SEQ ID NO: 50268 - DNA, 25 bp, Rattus norvegicus
aagtactgctccttgggctttgtaa

SEQ ID NO: 50269 - DNA, 25 bp, Rattus norvegicus
aagtactggctgaaacacacctcta

SEQ ID NO: 50270 - DNA, 25 bp, Rattus norvegicus
aagtactggctgaatctctagccct

SEQ ID NO: 50271 - DNA, 25 bp, Rattus norvegicus
aagtactggctgtaacacacctcta

SEQ ID NO: 50272 - DNA, 25 bp, Rattus norvegicus
aagtactggctgtatctctagccct

SEQ ID NO: 50273 - DNA, 25 bp, Rattus norvegicus
aagtactggttcagctttcttcacg

SEQ ID NO: 50274 - DNA, 25 bp, Rattus norvegicus
aagtactggttctgctttcttcacg

SEQ ID NO: 50275 - DNA, 25 bp, Rattus norvegicus
aagtactgtgtgatctcttttctcc

SEQ ID NO: 50276 - DNA, 25 bp, Rattus norvegicus
aagtactgtgtgttctcttttctcc

SEQ ID NO: 50277 - DNA, 25 bp, Rattus norvegicus
aagtactgttgcagctttggtcaag

SEQ ID NO: 50278 - DNA, 25 bp, Rattus norvegicus
aagtactgttgctgctttggtcaag

SEQ ID NO: 50279 - DNA, 25 bp, Rattus norvegicus
aagtactgttttctgtgctctatga

SEQ ID NO: 50280 - DNA, 25 bp, Rattus norvegicus
aagtactgttttgtgtgctctatga

SEQ ID NO: 50281 - DNA, 25 bp, Rattus norvegicus
aagtacttaagaaatgggtgccaca

SEQ ID NO: 50282 - DNA, 25 bp, Rattus norvegicus
aagtacttaagatatgggtgccaca

SEQ ID NO: 50283 - DNA, 25 bp, Rattus norvegicus
aagtacttcaagatggtgccaggtg

SEQ ID NO: 50284 - DNA, 25 bp, Rattus norvegicus
aagtacttcaagttggtgccaggtg

SEQ ID NO: 50285 - DNA, 25 bp, Rattus norvegicus
aagtacttcacaacggtgctgagca

SEQ ID NO: 50286 - DNA, 25 bp, Rattus norvegicus
aagtacttcacatcggtgctgagca

SEQ ID NO: 50287 - DNA, 25 bp, Rattus norvegicus
aagtacttccaaattgccttgagtc

SEQ ID NO: 50288 - DNA, 25 bp, Rattus norvegicus
aagtacttccaatttgccttgagtc

SEQ ID NO: 50289 - DNA, 25 bp, Rattus norvegicus
aagtacttccttcgcctaagagatc

SEQ ID NO: 50290 - DNA, 25 bp, Rattus norvegicus
aagtacttccttggcctaagagatc

SEQ ID NO: 50291 - DNA, 25 bp, Rattus norvegicus
aagtacttcgctcacttttctttag

SEQ ID NO: 50292 - DNA, 25 bp, Rattus norvegicus
aagtacttcgctgacttttctttag

SEQ ID NO: 50293 - DNA, 25 bp, Rattus norvegicus
aagtacttgggcatgagcgctctgt

SEQ ID NO: 50294 - DNA, 25 bp, Rattus norvegicus
aagtacttgggcttgagcgctctgt

SEQ ID NO: 50295 - DNA, 25 bp, Rattus norvegicus
aagtactttaaacccgtctctcctg

SEQ ID NO: 50296 - DNA, 25 bp, Rattus norvegicus
aagtactttaaagccgtctctcctg

SEQ ID NO: 50297 - DNA, 25 bp, Rattus norvegicus
aagtactttgacacaggagactaca

SEQ ID NO: 50298 - DNA, 25 bp, Rattus norvegicus
aagtactttgactcaggagactaca

SEQ ID NO: 50299 - DNA, 25 bp, Rattus norvegicus
aagtactttgtaagctgatatcagc

SEQ ID NO: 50300 - DNA, 25 bp, Rattus norvegicus
aagtactttgtatgctgatatcagc

SEQ ID NO: 50301 - DNA, 25 bp, Rattus norvegicus
aagtacttttcacagttgcttgcta

SEQ ID NO: 50302 - DNA, 25 bp, Rattus norvegicus
aagtacttttcagagttgcttgcta

SEQ ID NO: 50303 - DNA, 25 bp, Rattus norvegicus
aagtagaaaagcacccacactcctg

SEQ ID NO: 50304 - DNA, 25 bp, Rattus norvegicus
aagtagaaaagctcccacactcctg

SEQ ID NO: 50305 - DNA, 25 bp, Rattus norvegicus
aagtagaaagctctcgctcacgctc

SEQ ID NO: 50306 - DNA, 25 bp, Rattus norvegicus
aagtagaaagctgtcgctcacgctc

SEQ ID NO: 50307 - DNA, 25 bp, Rattus norvegicus
aagtagaaatcaccacccagctgta

SEQ ID NO: 50308 - DNA, 25 bp, Rattus norvegicus
aagtagaaatcagcacccagctgta

SEQ ID NO: 50309 - DNA, 25 bp, Rattus norvegicus
aagtagaagttaactgctgcacagt

SEQ ID NO: 50310 - DNA, 25 bp, Rattus norvegicus
aagtagaagttatctgctgcacagt

SEQ ID NO: 50311 - DNA, 25 bp, Rattus norvegicus
aagtagacacagacatagccagcct

SEQ ID NO: 50312 - DNA, 25 bp, Rattus norvegicus
aagtagacacagtcatagccagcct

SEQ ID NO: 50313 - DNA, 25 bp, Rattus norvegicus
aagtagacacttaaccaggtttcat

SEQ ID NO: 50314 - DNA, 25 bp, Rattus norvegicus
aagtagacactttaccaggtttcat

SEQ ID NO: 50315 - DNA, 25 bp, Rattus norvegicus
aagtagacaggcagggttccacaca

SEQ ID NO: 50316 - DNA, 25 bp, Rattus norvegicus
aagtagacaggctgggttccacaca

SEQ ID NO: 50317 - DNA, 25 bp, Rattus norvegicus
aagtagaccaatctcttctgcacag

SEQ ID NO: 50318 - DNA, 25 bp, Rattus norvegicus
aagtagaccaatgtcttctgcacag

SEQ ID NO: 50319 - DNA, 25 bp, Rattus norvegicus
aagtagaccattacttctgcgaagt

SEQ ID NO: 50320 - DNA, 25 bp, Rattus norvegicus
aagtagaccatttcttctgcgaagt

SEQ ID NO: 50321 - DNA, 25 bp, Rattus norvegicus
aagtagactcatcccttgcttgtat

SEQ ID NO: 50322 - DNA, 25 bp, Rattus norvegicus
aagtagactcatgccttgcttgtat

SEQ ID NO: 50323 - DNA, 25 bp, Rattus norvegicus
aagtagagaaggcagccccaaggca

SEQ ID NO: 50324 - DNA, 25 bp, Rattus norvegicus
aagtagagaagggagccccaaggca

SEQ ID NO: 50325 - DNA, 25 bp, Rattus norvegicus
aagtagagcactaggctccccggac

SEQ ID NO: 50326 - DNA, 25 bp, Rattus norvegicus
aagtagagcacttggctccccggac

SEQ ID NO: 50327 - DNA, 25 bp, Rattus norvegicus
aagtagatcacactctcactgcctt

SEQ ID NO: 50328 - DNA, 25 bp, Rattus norvegicus
aagtagatcacagtctcactgcctt

SEQ ID NO: 50329 - DNA, 25 bp, Rattus norvegicus
aagtagatcaccatgccacctggga

SEQ ID NO: 50330 - DNA, 25 bp, Rattus norvegicus
aagtagatcaccttgccacctggga

SEQ ID NO: 50331 - DNA, 25 bp, Rattus norvegicus
aagtagatccacactgacatttcag

SEQ ID NO: 50332 - DNA, 25 bp, Rattus norvegicus
aagtagatccactctgacatttcag

SEQ ID NO: 50333 - DNA, 25 bp, Rattus norvegicus
aagtagatctccacgggaacggtgc

SEQ ID NO: 50334 - DNA, 25 bp, Rattus norvegicus
aagtagatctcctcgggaacggtgc

SEQ ID NO: 50335 - DNA, 25 bp, Rattus norvegicus
aagtagatgcccattgtatttgtct

SEQ ID NO: 50336 - DNA, 25 bp, Rattus norvegicus
aagtagatgccctttgtatttgtct

SEQ ID NO: 50337 - DNA, 25 bp, Rattus norvegicus
aagtagatgctcaaagccctgaagg

SEQ ID NO: 50338 - DNA, 25 bp, Rattus norvegicus
aagtagatgctctaagccctgaagg

SEQ ID NO: 50339 - DNA, 25 bp, Rattus norvegicus
aagtagatgcttagcccgagggaac

SEQ ID NO: 50340 - DNA, 25 bp, Rattus norvegicus
aagtagatgctttgcccgagggaac

SEQ ID NO: 50341 - DNA, 25 bp, Rattus norvegicus
aagtagcaatccagccaaaggctgt

SEQ ID NO: 50342 - DNA, 25 bp, Rattus norvegicus
aagtagcaatcctgccaaaggctgt

SEQ ID NO: 50343 - DNA, 25 bp, Rattus norvegicus
aagtagcacagaaaatgcaagcccc

SEQ ID NO: 50344 - DNA, 25 bp, Rattus norvegicus
aagtagcacagacaggctcgccgtg

SEQ ID NO: 50345 - DNA, 25 bp, Rattus norvegicus
aagtagcacagagaggctcgccgtg

SEQ ID NO: 50346 - DNA, 25 bp, Rattus norvegicus
aagtagcacagataatgcaagcccc

SEQ ID NO: 50347 - DNA, 25 bp, Rattus norvegicus
aagtagcagctccttgttctttgaa

SEQ ID NO: 50348 - DNA, 25 bp, Rattus norvegicus
aagtagcagctcgttgttctttgaa

SEQ ID NO: 50349 - DNA, 25 bp, Rattus norvegicus
aagtagcaggatcgacagtccccaa

SEQ ID NO: 50350 - DNA, 25 bp, Rattus norvegicus
aagtagcaggatggacagtccccaa

SEQ ID NO: 50351 - DNA, 25 bp, Rattus norvegicus
aagtagcatattacatcctccatgg

SEQ ID NO: 50352 - DNA, 25 bp, Rattus norvegicus
aagtagcatatttcatcctccatgg

SEQ ID NO: 50353 - DNA, 25 bp, Rattus norvegicus
aagtagcatgttcaaagttcagccc

SEQ ID NO: 50354 - DNA, 25 bp, Rattus norvegicus
aagtagcatgttgaaagttcagccc

SEQ ID NO: 50355 - DNA, 25 bp, Rattus norvegicus
aagtagccacagattctatagagaa

SEQ ID NO: 50356 - DNA, 25 bp, Rattus norvegicus
aagtagccacagtttctatagagaa

SEQ ID NO: 50357 - DNA, 25 bp, Rattus norvegicus
aagtagccagaacctccagctagct

SEQ ID NO: 50358 - DNA, 25 bp, Rattus norvegicus
aagtagccagaagctccagctagct

SEQ ID NO: 50359 - DNA, 25 bp, Rattus norvegicus
aagtagccagccagaggtctttcaa

SEQ ID NO: 50360 - DNA, 25 bp, Rattus norvegicus
aagtagccagcctgaggtctttcaa

SEQ ID NO: 50361 - DNA, 25 bp, Rattus norvegicus
aagtagccatatccctcttgggacc

SEQ ID NO: 50362 - DNA, 25 bp, Rattus norvegicus
aagtagccatatgcctcttgggacc

SEQ ID NO: 50363 - DNA, 25 bp, Rattus norvegicus
aagtagcccgtgagatcctcctcct

SEQ ID NO: 50364 - DNA, 25 bp, Rattus norvegicus
aagtagcccgtgtgatcctcctcct

SEQ ID NO: 50365 - DNA, 25 bp, Rattus norvegicus
aagtagccctgacagctcacgagga

SEQ ID NO: 50366 - DNA, 25 bp, Rattus norvegicus
aagtagccctgagagctcacgagga

SEQ ID NO: 50367 - DNA, 25 bp, Rattus norvegicus
aagtagcctgtcacaactgtgttta

SEQ ID NO: 50368 - DNA, 25 bp, Rattus norvegicus
aagtagcctgtctcaactgtgttta

SEQ ID NO: 50369 - DNA, 25 bp, Rattus norvegicus
aagtagccttgactgttgccttggt

SEQ ID NO: 50370 - DNA, 25 bp, Rattus norvegicus
aagtagccttgagtgttgccttggt

SEQ ID NO: 50371 - DNA, 25 bp, Rattus norvegicus
aagtagccttgcatataacacaaac

SEQ ID NO: 50372 - DNA, 25 bp, Rattus norvegicus
aagtagccttgcttataacacaaac

SEQ ID NO: 50373 - DNA, 25 bp, Rattus norvegicus
aagtagcgcatgatgcgacccagca

SEQ ID NO: 50374 - DNA, 25 bp, Rattus norvegicus
aagtagcgcatgttgcgacccagca

SEQ ID NO: 50375 - DNA, 25 bp, Rattus norvegicus
aagtagctcacaatctcaatctcag

SEQ ID NO: 50376 - DNA, 25 bp, Rattus norvegicus
aagtagctcacattctcaatctcag

SEQ ID NO: 50377 - DNA, 25 bp, Rattus norvegicus
aagtagctcttaattttgccaatga

SEQ ID NO: 50378 - DNA, 25 bp, Rattus norvegicus
aagtagctcttatttttgccaatga

SEQ ID NO: 50379 - DNA, 25 bp, Rattus norvegicus
aagtagctcttgctggagcaaccaa

SEQ ID NO: 50380 - DNA, 25 bp, Rattus norvegicus
aagtagctcttggtggagcaaccaa

SEQ ID NO: 50381 - DNA, 25 bp, Rattus norvegicus
aagtagctgaagctgcggtctctct

SEQ ID NO: 50382 - DNA, 25 bp, Rattus norvegicus
aagtagctgaaggtgcggtctctct

SEQ ID NO: 50383 - DNA, 25 bp, Rattus norvegicus
aagtagctggctccttttgcttccc

SEQ ID NO: 50384 - DNA, 25 bp, Rattus norvegicus
aagtagctggctgcttttgcttccc

SEQ ID NO: 50385 - DNA, 25 bp, Rattus norvegicus
aagtagctgtctccatctctttaac

SEQ ID NO: 50386 - DNA, 25 bp, Rattus norvegicus
aagtagctgtctgcatctctttaac

SEQ ID NO: 50387 - DNA, 25 bp, Rattus norvegicus
aagtagcttaggatggcctcaaata

SEQ ID NO: 50388 - DNA, 25 bp, Rattus norvegicus
aagtagcttaggttggcctcaaata

SEQ ID NO: 50389 - DNA, 25 bp, Rattus norvegicus
aagtagcttctacggtgtccagttc

SEQ ID NO: 50390 - DNA, 25 bp, Rattus norvegicus
aagtagcttctactgctttgggaca

SEQ ID NO: 50391 - DNA, 25 bp, Rattus norvegicus
aagtagcttctagggtgtccagttc

SEQ ID NO: 50392 - DNA, 25 bp, Rattus norvegicus
aagtagcttctagtgctttgggaca

SEQ ID NO: 50393 - DNA, 25 bp, Rattus norvegicus
aagtagctttgactgcagctgatga

SEQ ID NO: 50394 - DNA, 25 bp, Rattus norvegicus
aagtagctttgagtgcagctgatga

SEQ ID NO: 50395 - DNA, 25 bp, Rattus norvegicus
aagtagctttgtacagtgctgcaga

SEQ ID NO: 50396 - DNA, 25 bp, Rattus norvegicus
aagtagctttgttcagtgctgcaga

SEQ ID NO: 50397 - DNA, 25 bp, Rattus norvegicus
aagtaggaaattcttgctcccctca

SEQ ID NO: 50398 - DNA, 25 bp, Rattus norvegicus
aagtaggaaattgttgctcccctca

SEQ ID NO: 50399 - DNA, 25 bp, Rattus norvegicus
aagtaggaacctcaggccttcttca

SEQ ID NO: 50400 - DNA, 25 bp, Rattus norvegicus
aagtaggaacctgaggccttcttca

SEQ ID NO: 50401 - DNA, 25 bp, Rattus norvegicus
aagtaggactccagggcggcacgat

SEQ ID NO: 50402 - DNA, 25 bp, Rattus norvegicus
aagtaggactcctgggcggcacgat

SEQ ID NO: 50403 - DNA, 25 bp, Rattus norvegicus
aagtaggagacaccttctcctagga

SEQ ID NO: 50404 - DNA, 25 bp, Rattus norvegicus
aagtaggagacagcttctcctagga

SEQ ID NO: 50405 - DNA, 25 bp, Rattus norvegicus
aagtaggagcaacccacctgccaca

SEQ ID NO: 50406 - DNA, 25 bp, Rattus norvegicus
aagtaggagcaagccacctgccaca

SEQ ID NO: 50407 - DNA, 25 bp, Rattus norvegicus
aagtaggagcggacgccgcagatcc

SEQ ID NO: 50408 - DNA, 25 bp, Rattus norvegicus
aagtaggagcggtcgccgcagatcc

SEQ ID NO: 50409 - DNA, 25 bp, Rattus norvegicus
aagtaggagtctacgcccctgctcc

SEQ ID NO: 50410 - DNA, 25 bp, Rattus norvegicus
aagtaggagtcttcgcccctgctcc

SEQ ID NO: 50411 - DNA, 25 bp, Rattus norvegicus
aagtaggatattacacacatgtgca

SEQ ID NO: 50412 - DNA, 25 bp, Rattus norvegicus
aagtaggatatttcacacatgtgca

SEQ ID NO: 50413 - DNA, 25 bp, Rattus norvegicus
aagtaggatcttacagccttccgtt

SEQ ID NO: 50414 - DNA, 25 bp, Rattus norvegicus
aagtaggatctttcagccttccgtt

SEQ ID NO: 50415 - DNA, 25 bp, Rattus norvegicus
aagtaggatggacccaggcacctga

SEQ ID NO: 50416 - DNA, 25 bp, Rattus norvegicus
aagtaggatggagccaggcacctga

SEQ ID NO: 50417 - DNA, 25 bp, Rattus norvegicus
aagtaggcactgacttcatgtgttc

SEQ ID NO: 50418 - DNA, 25 bp, Rattus norvegicus
aagtaggcactgtcttcatgtgttc

SEQ ID NO: 50419 - DNA, 25 bp, Rattus norvegicus
aagtaggcagaacctcacccatgtt

SEQ ID NO: 50420 - DNA, 25 bp, Rattus norvegicus
aagtaggcagaagctcacccatgtt

SEQ ID NO: 50421 - DNA, 25 bp, Rattus norvegicus
aagtaggcagagacttcagcttagc

SEQ ID NO: 50422 - DNA, 25 bp, Rattus norvegicus
aagtaggcagagtcttcagcttagc

SEQ ID NO: 50423 - DNA, 25 bp, Rattus norvegicus
aagtaggcatgcagtgggcctccca

SEQ ID NO: 50424 - DNA, 25 bp, Rattus norvegicus
aagtaggcatgctgtgggcctccca

SEQ ID NO: 50425 - DNA, 25 bp, Rattus norvegicus
aagtaggcattactctgcagggaaa

SEQ ID NO: 50426 - DNA, 25 bp, Rattus norvegicus
aagtaggcattagtctgcagggaaa

SEQ ID NO: 50427 - DNA, 25 bp, Rattus norvegicus
aagtaggccaacaggagccctggta

SEQ ID NO: 50428 - DNA, 25 bp, Rattus norvegicus
aagtaggccaactggagccctggta

SEQ ID NO: 50429 - DNA, 25 bp, Rattus norvegicus
aagtaggccatgagtgtgcccctga

SEQ ID NO: 50430 - DNA, 25 bp, Rattus norvegicus
aagtaggccatgtgtgtgcccctga

SEQ ID NO: 50431 - DNA, 25 bp, Rattus norvegicus
aagtaggcccaacacagttctccat

SEQ ID NO: 50432 - DNA, 25 bp, Rattus norvegicus
aagtaggcccaagacagttctccat

SEQ ID NO: 50433 - DNA, 25 bp, Rattus norvegicus
aagtaggcccagatgttgttataaa

SEQ ID NO: 50434 - DNA, 25 bp, Rattus norvegicus
aagtaggcccagttgttgttataaa

SEQ ID NO: 50435 - DNA, 25 bp, Rattus norvegicus
aagtaggcccatacaggtcgactat

SEQ ID NO: 50436 - DNA, 25 bp, Rattus norvegicus
aagtaggcccattcaggtcgactat

SEQ ID NO: 50437 - DNA, 25 bp, Rattus norvegicus
aagtaggcccttcctacactggcac

SEQ ID NO: 50438 - DNA, 25 bp, Rattus norvegicus
aagtaggcccttgctacactggcac

SEQ ID NO: 50439 - DNA, 25 bp, Rattus norvegicus
aagtaggctgctaaatgtcctggaa

SEQ ID NO: 50440 - DNA, 25 bp, Rattus norvegicus
aagtaggctgcttaatgtcctggaa

SEQ ID NO: 50441 - DNA, 25 bp, Rattus norvegicus
aagtaggcttaaccccatctcttcc

SEQ ID NO: 50442 - DNA, 25 bp, Rattus norvegicus
aagtaggcttaagcccatctcttcc

SEQ ID NO: 50443 - DNA, 25 bp, Rattus norvegicus
aagtagggaagactctgcccagccc

SEQ ID NO: 50444 - DNA, 25 bp, Rattus norvegicus
aagtagggaagagtctgcccagccc

SEQ ID NO: 50445 - DNA, 25 bp, Rattus norvegicus
aagtagggcgacactcattttcctc

SEQ ID NO: 50446 - DNA, 25 bp, Rattus norvegicus
aagtagggcgactctcattttcctc

SEQ ID NO: 50447 - DNA, 25 bp, Rattus norvegicus
aagtagggtcatagctggttcccag

SEQ ID NO: 50448 - DNA, 25 bp, Rattus norvegicus
aagtagggtcattgctggttcccag

SEQ ID NO: 50449 - DNA, 25 bp, Rattus norvegicus
aagtagggtgtgatcacctctgcat

SEQ ID NO: 50450 - DNA, 25 bp, Rattus norvegicus
aagtagggtgtgttcacctctgcat

SEQ ID NO: 50451 - DNA, 25 bp, Rattus norvegicus
aagtaggtaccactcctcaggatga

SEQ ID NO: 50452 - DNA, 25 bp, Rattus norvegicus
aagtaggtaccagtcctcaggatga

SEQ ID NO: 50453 - DNA, 25 bp, Rattus norvegicus
aagtaggtccctcggatgtctcagc

SEQ ID NO: 50454 - DNA, 25 bp, Rattus norvegicus
aagtaggtccctgggatgtctcagc

SEQ ID NO: 50455 - DNA, 25 bp, Rattus norvegicus
aagtaggtcctacttgctggagata

SEQ ID NO: 50456 - DNA, 25 bp, Rattus norvegicus
aagtaggtcctagttgctggagata

SEQ ID NO: 50457 - DNA, 25 bp, Rattus norvegicus
aagtaggtcttgcagaaccacctcc

SEQ ID NO: 50458 - DNA, 25 bp, Rattus norvegicus
aagtaggtcttggagaaccacctcc

SEQ ID NO: 50459 - DNA, 25 bp, Rattus norvegicus
aagtaggttaccattttgaggcaat

SEQ ID NO: 50460 - DNA, 25 bp, Rattus norvegicus
aagtaggttacctttttgaggcaat

SEQ ID NO: 50461 - DNA, 25 bp, Rattus norvegicus
aagtaggttcgtagcgtatcccact

SEQ ID NO: 50462 - DNA, 25 bp, Rattus norvegicus
aagtaggttcgttgcgtatcccact

SEQ ID NO: 50463 - DNA, 25 bp, Rattus norvegicus
aagtagtaagccagtgccacaaagt

SEQ ID NO: 50464 - DNA, 25 bp, Rattus norvegicus
aagtagtaagcctgtgccacaaagt

SEQ ID NO: 50465 - DNA, 25 bp, Rattus norvegicus
aagtagtaatacaagcgctggcgat

SEQ ID NO: 50466 - DNA, 25 bp, Rattus norvegicus
aagtagtaatactagcgctggcgat

SEQ ID NO: 50467 - DNA, 25 bp, Rattus norvegicus
aagtagtagcccaggtgctggagcc

SEQ ID NO: 50468 - DNA, 25 bp, Rattus norvegicus
aagtagtagccctggtgctggagcc

SEQ ID NO: 50469 - DNA, 25 bp, Rattus norvegicus
aagtagtcagggatatctcgcttct

SEQ ID NO: 50470 - DNA, 25 bp, Rattus norvegicus
aagtagtcagggttatctcgcttct

SEQ ID NO: 50471 - DNA, 25 bp, Rattus norvegicus
aagtagtccaacatgtgcctcagaa

SEQ ID NO: 50472 - DNA, 25 bp, Rattus norvegicus
aagtagtccaacttgtgcctcagaa

SEQ ID NO: 50473 - DNA, 25 bp, Rattus norvegicus
aagtagtccaagatgttcggcagcg

SEQ ID NO: 50474 - DNA, 25 bp, Rattus norvegicus
aagtagtccaagttgttcggcagcg

SEQ ID NO: 50475 - DNA, 25 bp, Rattus norvegicus
aagtagtccacacatgggtgtccaa

SEQ ID NO: 50476 - DNA, 25 bp, Rattus norvegicus
aagtagtccacagatgggtgtccaa

SEQ ID NO: 50477 - DNA, 25 bp, Rattus norvegicus
aagtagtccagcagttgggttcaac

SEQ ID NO: 50478 - DNA, 25 bp, Rattus norvegicus
aagtagtccagctgttgggttcaac

SEQ ID NO: 50479 - DNA, 25 bp, Rattus norvegicus
aagtagtcctctacagagctcagtg

SEQ ID NO: 50480 - DNA, 25 bp, Rattus norvegicus
aagtagtcctcttcagagctcagtg

SEQ ID NO: 50481 - DNA, 25 bp, Rattus norvegicus
aagtagtcgctcacggtagcagtac

SEQ ID NO: 50482 - DNA, 25 bp, Rattus norvegicus
aagtagtcgctctcggtagcagtac

SEQ ID NO: 50483 - DNA, 25 bp, Rattus norvegicus
aagtagtctgtcaggcctggtgcag

SEQ ID NO: 50484 - DNA, 25 bp, Rattus norvegicus
aagtagtctgtctggcctggtgcag

SEQ ID NO: 50485 - DNA, 25 bp, Rattus norvegicus
aagtagtcttccatcaaactctgct

SEQ ID NO: 50486 - DNA, 25 bp, Rattus norvegicus
aagtagtcttccttcaaactctgct

SEQ ID NO: 50487 - DNA, 25 bp, Rattus norvegicus
aagtagtcttggcactttgcccaca

SEQ ID NO: 50488 - DNA, 25 bp, Rattus norvegicus
aagtagtcttgggactttgcccaca

SEQ ID NO: 50489 - DNA, 25 bp, Rattus norvegicus
aagtagtgaagtcgccctgggccta

SEQ ID NO: 50490 - DNA, 25 bp, Rattus norvegicus
aagtagtgaagtggccctgggccta

SEQ ID NO: 50491 - DNA, 25 bp, Rattus norvegicus
aagtagtgcattcaccttgtgcccc

SEQ ID NO: 50492 - DNA, 25 bp, Rattus norvegicus
aagtagtgcattgaccttgtgcccc

SEQ ID NO: 50493 - DNA, 25 bp, Rattus norvegicus
aagtagtggcagattggctcaaaag

SEQ ID NO: 50494 - DNA, 25 bp, Rattus norvegicus
aagtagtggcagtttggctcaaaag

SEQ ID NO: 50495 - DNA, 25 bp, Rattus norvegicus
aagtagtgttgacccaaagcttact

SEQ ID NO: 50496 - DNA, 25 bp, Rattus norvegicus
aagtagtgttgagccaaagcttact

SEQ ID NO: 50497 - DNA, 25 bp, Rattus norvegicus
aagtagttctcaacatggccttgaa

SEQ ID NO: 50498 - DNA, 25 bp, Rattus norvegicus
aagtagttctcatcatggccttgaa

SEQ ID NO: 50499 - DNA, 25 bp, Rattus norvegicus
aagtagttcttgatggtgccttcat

SEQ ID NO: 50500 - DNA, 25 bp, Rattus norvegicus
aagtagttcttgttggtgccttcat

SEQ ID NO: 50501 - DNA, 25 bp, Rattus norvegicus
aagtagttgtgtctctccagagcca

SEQ ID NO: 50502 - DNA, 25 bp, Rattus norvegicus
aagtagttgtgtgtctccagagcca

SEQ ID NO: 50503 - DNA, 25 bp, Rattus norvegicus
aagtagtttacaacctttcagaaag

SEQ ID NO: 50504 - DNA, 25 bp, Rattus norvegicus
aagtagtttacatcctttcagaaag

SEQ ID NO: 50505 - DNA, 25 bp, Rattus norvegicus
aagtagtttggactgtcacattcag

SEQ ID NO: 50506 - DNA, 25 bp, Rattus norvegicus
aagtagtttggagtgtcacattcag

SEQ ID NO: 50507 - DNA, 25 bp, Rattus norvegicus
aagtataacatcacctctgacacac

SEQ ID NO: 50508 - DNA, 25 bp, Rattus norvegicus
aagtataacatctcctctgacacac

SEQ ID NO: 50509 - DNA, 25 bp, Rattus norvegicus
aagtataactggagtgccaaggcta

SEQ ID NO: 50510 - DNA, 25 bp, Rattus norvegicus
aagtataactggtgtgccaaggcta

SEQ ID NO: 50511 - DNA, 25 bp, Rattus norvegicus
aagtatacagcgactgccatgtcca

SEQ ID NO: 50512 - DNA, 25 bp, Rattus norvegicus
aagtatacagcgtctgccatgtcca

SEQ ID NO: 50513 - DNA, 25 bp, Rattus norvegicus
aagtataccatgctttctcaaacat

SEQ ID NO: 50514 - DNA, 25 bp, Rattus norvegicus
aagtataccatggtttctcaaacat

SEQ ID NO: 50515 - DNA, 25 bp, Rattus norvegicus
aagtataccattatctctacctgaa

SEQ ID NO: 50516 - DNA, 25 bp, Rattus norvegicus
aagtataccattttctctacctgaa

SEQ ID NO: 50517 - DNA, 25 bp, Rattus norvegicus
aagtatactcttactgcttcatgga

SEQ ID NO: 50518 - DNA, 25 bp, Rattus norvegicus
aagtatactctttctgcttcatgga

SEQ ID NO: 50519 - DNA, 25 bp, Rattus norvegicus
aagtataggcagagctccgggagca

SEQ ID NO: 50520 - DNA, 25 bp, Rattus norvegicus
aagtataggcagtgctccgggagca

SEQ ID NO: 50521 - DNA, 25 bp, Rattus norvegicus
aagtataggcctctctgttggccct

SEQ ID NO: 50522 - DNA, 25 bp, Rattus norvegicus
aagtataggcctgtctgttggccct

SEQ ID NO: 50523 - DNA, 25 bp, Rattus norvegicus
aagtatagggccatggagcttcctc

SEQ ID NO: 50524 - DNA, 25 bp, Rattus norvegicus
aagtatagggccttggagcttcctc

SEQ ID NO: 50525 - DNA, 25 bp, Rattus norvegicus
aagtatagtctccattctcttcagg

SEQ ID NO: 50526 - DNA, 25 bp, Rattus norvegicus
aagtatagtctcgattctcttcagg

SEQ ID NO: 50527 - DNA, 25 bp, Rattus norvegicus
aagtatatccctcccggctcagagg

SEQ ID NO: 50528 - DNA, 25 bp, Rattus norvegicus
aagtatatccctgccggctcagagg

SEQ ID NO: 50529 - DNA, 25 bp, Rattus norvegicus
aagtatatccttagatgtacggcaa

SEQ ID NO: 50530 - DNA, 25 bp, Rattus norvegicus
aagtatatcctttgatgtacggcaa

SEQ ID NO: 50531 - DNA, 25 bp, Rattus norvegicus
aagtatatcttcagtgtctcgggag

SEQ ID NO: 50532 - DNA, 25 bp, Rattus norvegicus
aagtatatcttcatagtgtggacca

SEQ ID NO: 50533 - DNA, 25 bp, Rattus norvegicus
aagtatatcttctgtgtctcgggag

SEQ ID NO: 50534 - DNA, 25 bp, Rattus norvegicus
aagtatatcttcttagtgtggacca

SEQ ID NO: 50535 - DNA, 25 bp, Rattus norvegicus
aagtatatgagcatcatgggactaa

SEQ ID NO: 50536 - DNA, 25 bp, Rattus norvegicus
aagtatatgagcttcatgggactaa

SEQ ID NO: 50537 - DNA, 25 bp, Rattus norvegicus
aagtatattactactactgaccaga

SEQ ID NO: 50538 - DNA, 25 bp, Rattus norvegicus
aagtatattacttctactgaccaga

SEQ ID NO: 50539 - DNA, 25 bp, Rattus norvegicus
aagtatattttcagggactcagcga

SEQ ID NO: 50540 - DNA, 25 bp, Rattus norvegicus
aagtatattttctgggactcagcga

SEQ ID NO: 50541 - DNA, 25 bp, Rattus norvegicus
aagtatcaaagaacactccccacat

SEQ ID NO: 50542 - DNA, 25 bp, Rattus norvegicus
aagtatcaaagatcactccccacat

SEQ ID NO: 50543 - DNA, 25 bp, Rattus norvegicus
aagtatcacaccatacagtttgtat

SEQ ID NO: 50544 - DNA, 25 bp, Rattus norvegicus
aagtatcacaccttacagtttgtat

SEQ ID NO: 50545 - DNA, 25 bp, Rattus norvegicus
aagtatcactccactgagttggcat

SEQ ID NO: 50546 - DNA, 25 bp, Rattus norvegicus
aagtatcactcctctgagttggcat

SEQ ID NO: 50547 - DNA, 25 bp, Rattus norvegicus
aagtatcaggctcaagttgccccag

SEQ ID NO: 50548 - DNA, 25 bp, Rattus norvegicus
aagtatcaggctgaagttgccccag

SEQ ID NO: 50549 - DNA, 25 bp, Rattus norvegicus
aagtatcagggcaagctcatagcat

SEQ ID NO: 50550 - DNA, 25 bp, Rattus norvegicus
aagtatcagggctagctcatagcat

SEQ ID NO: 50551 - DNA, 25 bp, Rattus norvegicus
aagtatcagttgactgcacagcagt

SEQ ID NO: 50552 - DNA, 25 bp, Rattus norvegicus
aagtatcagttgtctgcacagcagt

SEQ ID NO: 50553 - DNA, 25 bp, Rattus norvegicus
aagtatcatgtacgccagtgctgca

SEQ ID NO: 50554 - DNA, 25 bp, Rattus norvegicus
aagtatcatgtaggccagtgctgca

SEQ ID NO: 50555 - DNA, 25 bp, Rattus norvegicus
aagtatccaataaatgctgtccagt

SEQ ID NO: 50556 - DNA, 25 bp, Rattus norvegicus
aagtatccaatatatgctgtccagt

SEQ ID NO: 50557 - DNA, 25 bp, Rattus norvegicus
aagtatccacatcgctcacgggtac

SEQ ID NO: 50558 - DNA, 25 bp, Rattus norvegicus
aagtatccacatggctcacgggtac

SEQ ID NO: 50559 - DNA, 25 bp, Rattus norvegicus
aagtatccagaccaggtggtcatca

SEQ ID NO: 50560 - DNA, 25 bp, Rattus norvegicus
aagtatccagacgaggtggtcatca

SEQ ID NO: 50561 - DNA, 25 bp, Rattus norvegicus
aagtatccagtgactgtcgtctgtg

SEQ ID NO: 50562 - DNA, 25 bp, Rattus norvegicus
aagtatccagtgtctgtcgtctgtg

SEQ ID NO: 50563 - DNA, 25 bp, Rattus norvegicus
aagtatccatctacctgtctgtaat

SEQ ID NO: 50564 - DNA, 25 bp, Rattus norvegicus
aagtatccatcttcctgtctgtaat

SEQ ID NO: 50565 - DNA, 25 bp, Rattus norvegicus
aagtatccccgtatactgtgttgag

SEQ ID NO: 50566 - DNA, 25 bp, Rattus norvegicus
aagtatccccgtttactgtgttgag

SEQ ID NO: 50567 - DNA, 25 bp, Rattus norvegicus
aagtatcctagaatctttctcctga

SEQ ID NO: 50568 - DNA, 25 bp, Rattus norvegicus
aagtatcctagattctttctcctga

SEQ ID NO: 50569 - DNA, 25 bp, Rattus norvegicus
aagtatccttaccagtgctctgtaa

SEQ ID NO: 50570 - DNA, 25 bp, Rattus norvegicus
aagtatccttacgagtgctctgtaa

SEQ ID NO: 50571 - DNA, 25 bp, Rattus norvegicus
aagtatcgagacacgctggtgctcc

SEQ ID NO: 50572 - DNA, 25 bp, Rattus norvegicus
aagtatcgagactcgctggtgctcc

SEQ ID NO: 50573 - DNA, 25 bp, Rattus norvegicus
aagtatcggtgcaccttgataccac

SEQ ID NO: 50574 - DNA, 25 bp, Rattus norvegicus
aagtatcggtgctccttgataccac

SEQ ID NO: 50575 - DNA, 25 bp, Rattus norvegicus
aagtatcgtagtaaagccttctaca

SEQ ID NO: 50576 - DNA, 25 bp, Rattus norvegicus
aagtatcgtagttaagccttctaca

SEQ ID NO: 50577 - DNA, 25 bp, Rattus norvegicus
aagtatcgtgctctctccgagcaag

SEQ ID NO: 50578 - DNA, 25 bp, Rattus norvegicus
aagtatcgtgctgtctccgagcaag

SEQ ID NO: 50579 - DNA, 25 bp, Rattus norvegicus
aagtatctaccaccacttctttgtg

SEQ ID NO: 50580 - DNA, 25 bp, Rattus norvegicus
aagtatctaccagcacttctttgtg

SEQ ID NO: 50581 - DNA, 25 bp, Rattus norvegicus
aagtatctctttatcagcactagaa

SEQ ID NO: 50582 - DNA, 25 bp, Rattus norvegicus
aagtatctctttttcagcactagaa

SEQ ID NO: 50583 - DNA, 25 bp, Rattus norvegicus
aagtatctgaccctgtcttacccat

SEQ ID NO: 50584 - DNA, 25 bp, Rattus norvegicus
aagtatctgaccgtgtcttacccat

SEQ ID NO: 50585 - DNA, 25 bp, Rattus norvegicus
aagtatctgccaccaaattgtacca

SEQ ID NO: 50586 - DNA, 25 bp, Rattus norvegicus
aagtatctgccagcaaattgtacca

SEQ ID NO: 50587 - DNA, 25 bp, Rattus norvegicus
aagtatctgtccaggcatcacgtgg

SEQ ID NO: 50588 - DNA, 25 bp, Rattus norvegicus
aagtatctgtcctggcatcacgtgg

SEQ ID NO: 50589 - DNA, 25 bp, Rattus norvegicus
aagtatcttaggcaccacgtgcctc

SEQ ID NO: 50590 - DNA, 25 bp, Rattus norvegicus
aagtatcttagggaccacgtgcctc

SEQ ID NO: 50591 - DNA, 25 bp, Rattus norvegicus
aagtatcttctcacttgtggcagat

SEQ ID NO: 50592 - DNA, 25 bp, Rattus norvegicus
aagtatcttctctcttgtggcagat

SEQ ID NO: 50593 - DNA, 25 bp, Rattus norvegicus
aagtatcttgacctttcgccattga

SEQ ID NO: 50594 - DNA, 25 bp, Rattus norvegicus
aagtatcttgacgtttcgccattga

SEQ ID NO: 50595 - DNA, 25 bp, Rattus norvegicus
aagtatcttgcactcgactcacctt

SEQ ID NO: 50596 - DNA, 25 bp, Rattus norvegicus
aagtatcttgcagtcgactcacctt

SEQ ID NO: 50597 - DNA, 25 bp, Rattus norvegicus
aagtatctttagccatcacccctgt

SEQ ID NO: 50598 - DNA, 25 bp, Rattus norvegicus
aagtatctttaggcatcacccctgt

SEQ ID NO: 50599 - DNA, 25 bp, Rattus norvegicus
aagtatctttgccttaactccactg

SEQ ID NO: 50600 - DNA, 25 bp, Rattus norvegicus
aagtatctttgcgttaactccactg

SEQ ID NO: 50601 - DNA, 25 bp, Rattus norvegicus
aagtatcttttactcacctgatgta

SEQ ID NO: 50602 - DNA, 25 bp, Rattus norvegicus
aagtatcttttagtcacctgatgta

SEQ ID NO: 50603 - DNA, 25 bp, Rattus norvegicus
aagtatgaactgcacttctcccact

SEQ ID NO: 50604 - DNA, 25 bp, Rattus norvegicus
aagtatgaactggacttctcccact

SEQ ID NO: 50605 - DNA, 25 bp, Rattus norvegicus
aagtatgaagacaagctgtttttct

SEQ ID NO: 50606 - DNA, 25 bp, Rattus norvegicus
aagtatgaagactagctgtttttct

SEQ ID NO: 50607 - DNA, 25 bp, Rattus norvegicus
aagtatgaccccatgctatttctaa

SEQ ID NO: 50608 - DNA, 25 bp, Rattus norvegicus
aagtatgaccccttgctatttctaa

SEQ ID NO: 50609 - DNA, 25 bp, Rattus norvegicus
aagtatgaccttcgacaggctccct

SEQ ID NO: 50610 - DNA, 25 bp, Rattus norvegicus
aagtatgaccttggacaggctccct

SEQ ID NO: 50611 - DNA, 25 bp, Rattus norvegicus
aagtatgactatctcatgaccctcc

SEQ ID NO: 50612 - DNA, 25 bp, Rattus norvegicus
aagtatgactatgtcatgaccctcc

SEQ ID NO: 50613 - DNA, 25 bp, Rattus norvegicus
aagtatgagccacccagatctgaag

SEQ ID NO: 50614 - DNA, 25 bp, Rattus norvegicus
aagtatgagccagccagatctgaag

SEQ ID NO: 50615 - DNA, 25 bp, Rattus norvegicus
aagtatgaggctcgccttgctctga

SEQ ID NO: 50616 - DNA, 25 bp, Rattus norvegicus
aagtatgaggctggccttgctctga

SEQ ID NO: 50617 - DNA, 25 bp, Rattus norvegicus
aagtatgatcctaccccagacagca

SEQ ID NO: 50618 - DNA, 25 bp, Rattus norvegicus
aagtatgatccttccccagacagca

SEQ ID NO: 50619 - DNA, 25 bp, Rattus norvegicus
aagtatgcaaagacccaatgccctt

SEQ ID NO: 50620 - DNA, 25 bp, Rattus norvegicus
aagtatgcaaagtcccaatgccctt

SEQ ID NO: 50621 - DNA, 25 bp, Rattus norvegicus
aagtatgcagtaccacttgctggcc

SEQ ID NO: 50622 - DNA, 25 bp, Rattus norvegicus
aagtatgcagtagcacttgctggcc

SEQ ID NO: 50623 - DNA, 25 bp, Rattus norvegicus
aagtatgcatgtcaccttcaaggtt

SEQ ID NO: 50624 - DNA, 25 bp, Rattus norvegicus
aagtatgcatgtgaccttcaaggtt

SEQ ID NO: 50625 - DNA, 25 bp, Rattus norvegicus
aagtatgcatttagctcccagtgtt

SEQ ID NO: 50626 - DNA, 25 bp, Rattus norvegicus
aagtatgcattttgctcccagtgtt

SEQ ID NO: 50627 - DNA, 25 bp, Rattus norvegicus
aagtatgccaaaattctcagataac

SEQ ID NO: 50628 - DNA, 25 bp, Rattus norvegicus
aagtatgccaaatttctcagataac

SEQ ID NO: 50629 - DNA, 25 bp, Rattus norvegicus
aagtatgcctcccaagttcaagcgc

SEQ ID NO: 50630 - DNA, 25 bp, Rattus norvegicus
aagtatgcctccgaagttcaagcgc

SEQ ID NO: 50631 - DNA, 25 bp, Rattus norvegicus
aagtatgctgctcagcttcacctgg

SEQ ID NO: 50632 - DNA, 25 bp, Rattus norvegicus
aagtatgctgctgagcttcacctgg

SEQ ID NO: 50633 - DNA, 25 bp, Rattus norvegicus
aagtatggagcaaaacttcagagat

SEQ ID NO: 50634 - DNA, 25 bp, Rattus norvegicus
aagtatggagcataacttcagagat

SEQ ID NO: 50635 - DNA, 25 bp, Rattus norvegicus
aagtatggcaaacggctttccggtg

SEQ ID NO: 50636 - DNA, 25 bp, Rattus norvegicus
aagtatggcaaagggctttccggtg

SEQ ID NO: 50637 - DNA, 25 bp, Rattus norvegicus
aagtatggcataaagattctctcac

SEQ ID NO: 50638 - DNA, 25 bp, Rattus norvegicus
aagtatggcatatagattctctcac

SEQ ID NO: 50639 - DNA, 25 bp, Rattus norvegicus
aagtatggcatcaacacagatcccc

SEQ ID NO: 50640 - DNA, 25 bp, Rattus norvegicus
aagtatggcatctacacagatcccc

SEQ ID NO: 50641 - DNA, 25 bp, Rattus norvegicus
aagtatggcggaaaggccctctctc

SEQ ID NO: 50642 - DNA, 25 bp, Rattus norvegicus
aagtatggcggataggccctctctc

SEQ ID NO: 50643 - DNA, 25 bp, Rattus norvegicus
aagtatgggagtcctctgactacct

SEQ ID NO: 50644 - DNA, 25 bp, Rattus norvegicus
aagtatgggagtgctctgactacct

SEQ ID NO: 50645 - DNA, 25 bp, Rattus norvegicus
aagtatgggcttagcttctggagaa

SEQ ID NO: 50646 - DNA, 25 bp, Rattus norvegicus
aagtatgggctttgcttctggagaa

SEQ ID NO: 50647 - DNA, 25 bp, Rattus norvegicus
aagtatgtagtgacaacagcaggaa

SEQ ID NO: 50648 - DNA, 25 bp, Rattus norvegicus
aagtatgtagtgtcaacagcaggaa

SEQ ID NO: 50649 - DNA, 25 bp, Rattus norvegicus
aagtatgtatatatagtctagccaa

SEQ ID NO: 50650 - DNA, 25 bp, Rattus norvegicus
aagtatgtatatttagtctagccaa

SEQ ID NO: 50651 - DNA, 25 bp, Rattus norvegicus
aagtatgtcactacagccctgtgga

SEQ ID NO: 50652 - DNA, 25 bp, Rattus norvegicus
aagtatgtcacttcagccctgtgga

SEQ ID NO: 50653 - DNA, 25 bp, Rattus norvegicus
aagtatgtccataggcctgcagagg

SEQ ID NO: 50654 - DNA, 25 bp, Rattus norvegicus
aagtatgtccattggcctgcagagg

SEQ ID NO: 50655 - DNA, 25 bp, Rattus norvegicus
aagtatgtcctgctcaacacgtcca

SEQ ID NO: 50656 - DNA, 25 bp, Rattus norvegicus
aagtatgtcctggtcaacacgtcca

SEQ ID NO: 50657 - DNA, 25 bp, Rattus norvegicus
aagtatgtgctaacatgccctgctt

SEQ ID NO: 50658 - DNA, 25 bp, Rattus norvegicus
aagtatgtgctatcatgccctgctt

SEQ ID NO: 50659 - DNA, 25 bp, Rattus norvegicus
aagtatgtgtataagcggcagccgc

SEQ ID NO: 50660 - DNA, 25 bp, Rattus norvegicus
aagtatgtgtattagcggcagccgc

SEQ ID NO: 50661 - DNA, 25 bp, Rattus norvegicus
aagtatgtgtctcgctccttgggag

SEQ ID NO: 50662 - DNA, 25 bp, Rattus norvegicus
aagtatgtgtctggctccttgggag

SEQ ID NO: 50663 - DNA, 25 bp, Rattus norvegicus
aagtatgttcagcttctcagagaaa

SEQ ID NO: 50664 - DNA, 25 bp, Rattus norvegicus
aagtatgttcaggttctcagagaaa

SEQ ID NO: 50665 - DNA, 25 bp, Rattus norvegicus
aagtatgttttccacagtcctttct

SEQ ID NO: 50666 - DNA, 25 bp, Rattus norvegicus
aagtatgttttcgacagtcctttct

SEQ ID NO: 50667 - DNA, 25 bp, Rattus norvegicus
aagtattaacatacaggagggctat

SEQ ID NO: 50668 - DNA, 25 bp, Rattus norvegicus
aagtattaacattcaggagggctat

SEQ ID NO: 50669 - DNA, 25 bp, Rattus norvegicus
aagtattacagtagtacagttccca

SEQ ID NO: 50670 - DNA, 25 bp, Rattus norvegicus
aagtattacagttgtacagttccca

SEQ ID NO: 50671 - DNA, 25 bp, Rattus norvegicus
aagtattactacaatggcgcctcca

SEQ ID NO: 50672 - DNA, 25 bp, Rattus norvegicus
aagtattactactatggcgcctcca

SEQ ID NO: 50673 - DNA, 25 bp, Rattus norvegicus
aagtattactttcccgtgcgcgcca

SEQ ID NO: 50674 - DNA, 25 bp, Rattus norvegicus
aagtattactttgccgtgcgcgcca

SEQ ID NO: 50675 - DNA, 25 bp, Rattus norvegicus
aagtattatgctatcttaccagcaa

SEQ ID NO: 50676 - DNA, 25 bp, Rattus norvegicus
aagtattatgctttcttaccagcaa

SEQ ID NO: 50677 - DNA, 20 bp, Rattus norvegicus
aagtattcagtgtcctgcca

SEQ ID NO: 50678 - DNA, 25 bp, Rattus norvegicus
aagtattccaataagccaggctgag

SEQ ID NO: 50679 - DNA, 25 bp, Rattus norvegicus
aagtattccaatagaggctcacagc

SEQ ID NO: 50680 - DNA, 25 bp, Rattus norvegicus
aagtattccaattagccaggctgag

SEQ ID NO: 50681 - DNA, 25 bp, Rattus norvegicus
aagtattccaattgaggctcacagc

SEQ ID NO: 50682 - DNA, 25 bp, Rattus norvegicus
aagtattccacacctgagtcagtca

SEQ ID NO: 50683 - DNA, 25 bp, Rattus norvegicus
aagtattccacagctgagtcagtca

SEQ ID NO: 50684 - DNA, 20 bp, Rattus norvegicus
aagtattccgtgtcctgcca

SEQ ID NO: 50685 - DNA, 25 bp, Rattus norvegicus
aagtattcctaccacgtaaccatct

SEQ ID NO: 50686 - DNA, 25 bp, Rattus norvegicus
aagtattcctacgacgtaaccatct

SEQ ID NO: 50687 - DNA, 25 bp, Rattus norvegicus
aagtattcctcgactcccttttgag

SEQ ID NO: 50688 - DNA, 25 bp, Rattus norvegicus
aagtattcctcgtctcccttttgag

SEQ ID NO: 50689 - DNA, 20 bp, Rattus norvegicus
aagtattcggtgtcctgcca

SEQ ID NO: 50690 - DNA, 25 bp, Rattus norvegicus
aagtattcgtcaccatccttttgtc

SEQ ID NO: 50691 - DNA, 25 bp, Rattus norvegicus
aagtattcgtcagcatccttttgtc

SEQ ID NO: 50692 - DNA, 25 bp, Rattus norvegicus
aagtattctaccaaccatgctgctt

SEQ ID NO: 50693 - DNA, 25 bp, Rattus norvegicus
aagtattctacctaccatgctgctt

SEQ ID NO: 50694 - DNA, 25 bp, Rattus norvegicus
aagtattctgtcaagcgctttaaga

SEQ ID NO: 50695 - DNA, 25 bp, Rattus norvegicus
aagtattctgtctagcgctttaaga

SEQ ID NO: 50696 - DNA, 25 bp, Rattus norvegicus
aagtattctgtgataatgttaatgc

SEQ ID NO: 50697 - DNA, 20 bp, Rattus norvegicus
aagtattctgtgtcctgcca

SEQ ID NO: 50698 - DNA, 25 bp, Rattus norvegicus
aagtattctgtgttaatgttaatgc

SEQ ID NO: 50699 - DNA, 25 bp, Rattus norvegicus
aagtattcttcacgtacccttcact

SEQ ID NO: 50700 - DNA, 25 bp, Rattus norvegicus
aagtattcttcaggtacccttcact

SEQ ID NO: 50701 - DNA, 25 bp, Rattus norvegicus
aagtattcttctctcgttttatcca

SEQ ID NO: 50702 - DNA, 25 bp, Rattus norvegicus
aagtattcttctgtcgttttatcca

SEQ ID NO: 50703 - DNA, 25 bp, Rattus norvegicus
aagtattgcatccaggtgtcagccc

SEQ ID NO: 50704 - DNA, 25 bp, Rattus norvegicus
aagtattgcatcgaggtgtcagccc

SEQ ID NO: 50705 - DNA, 25 bp, Rattus norvegicus
aagtattgcttcaattccaacgtcg

SEQ ID NO: 50706 - DNA, 25 bp, Rattus norvegicus
aagtattgcttctattccaacgtcg

SEQ ID NO: 50707 - DNA, 25 bp, Rattus norvegicus
aagtattgtcttccccagggtggga

SEQ ID NO: 50708 - DNA, 25 bp, Rattus norvegicus
aagtattgtcttgcccagggtggga

SEQ ID NO: 50709 - DNA, 25 bp, Rattus norvegicus
aagtatttacaccagttcccttctg

SEQ ID NO: 50710 - DNA, 25 bp, Rattus norvegicus
aagtatttacacgagttcccttctg

SEQ ID NO: 50711 - DNA, 25 bp, Rattus norvegicus
aagtatttccaccataaccagctag

SEQ ID NO: 50712 - DNA, 25 bp, Rattus norvegicus
aagtatttccacgataaccagctag

SEQ ID NO: 50713 - DNA, 25 bp, Rattus norvegicus
aagtatttcccacccgagagacaca

SEQ ID NO: 50714 - DNA, 25 bp, Rattus norvegicus
aagtatttcccagccgagagacaca

SEQ ID NO: 50715 - DNA, 25 bp, Rattus norvegicus
aagtatttctccaaattccatcctc

SEQ ID NO: 50716 - DNA, 25 bp, Rattus norvegicus
aagtatttctcctaattccatcctc

SEQ ID NO: 50717 - DNA, 25 bp, Rattus norvegicus
aagtatttctgcatggttcctggtt

SEQ ID NO: 50718 - DNA, 25 bp, Rattus norvegicus
aagtatttctgcttggttcctggtt

SEQ ID NO: 50719 - DNA, 25 bp, Rattus norvegicus
aagtatttcttgattgtcattccag

SEQ ID NO: 50720 - DNA, 25 bp, Rattus norvegicus
aagtatttcttgtttgtcattccag

SEQ ID NO: 50721 - DNA, 25 bp, Rattus norvegicus
aagtatttgaccagtctcttgccaa

SEQ ID NO: 50722 - DNA, 25 bp, Rattus norvegicus
aagtatttgacctgtctcttgccaa

SEQ ID NO: 50723 - DNA, 25 bp, Rattus norvegicus
aagtatttgctgagcacccactcgt

SEQ ID NO: 50724 - DNA, 25 bp, Rattus norvegicus
aagtatttgctgtgcacccactcgt

SEQ ID NO: 50725 - DNA, 25 bp, Rattus norvegicus
aagtatttgtacagctttctgcttt

SEQ ID NO: 50726 - DNA, 25 bp, Rattus norvegicus
aagtatttgtactgctttctgcttt

SEQ ID NO: 50727 - DNA, 25 bp, Rattus norvegicus
aagtattttaggctaacagtcatct

SEQ ID NO: 50728 - DNA, 25 bp, Rattus norvegicus
aagtattttagggtaacagtcatct

SEQ ID NO: 50729 - DNA, 25 bp, Rattus norvegicus
aagtattttccaactctaactgagg

SEQ ID NO: 50730 - DNA, 25 bp, Rattus norvegicus
aagtattttccatctctaactgagg

SEQ ID NO: 50731 - DNA, 25 bp, Rattus norvegicus
aagtattttctgaacattgtgccaa

SEQ ID NO: 50732 - DNA, 25 bp, Rattus norvegicus
aagtattttctgtacattgtgccaa

SEQ ID NO: 50733 - DNA, 25 bp, Rattus norvegicus
aagtattttcttacttcctagatgt

SEQ ID NO: 50734 - DNA, 25 bp, Rattus norvegicus
aagtattttctttcttcctagatgt

SEQ ID NO: 50735 - DNA, 25 bp, Rattus norvegicus
aagtatttttcaatctcctacctca

SEQ ID NO: 50736 - DNA, 25 bp, Rattus norvegicus
aagtatttttcattctcctacctca

SEQ ID NO: 50737 - DNA, 25 bp, Rattus norvegicus
aagtcaaagttcacacttccagcta

SEQ ID NO: 50738 - DNA, 25 bp, Rattus norvegicus
aagtcaaagttctcacttccagcta

SEQ ID NO: 50739 - DNA, 25 bp, Rattus norvegicus
aagtcaaattccaaacgttcagagt

SEQ ID NO: 50740 - DNA, 25 bp, Rattus norvegicus
aagtcaaattcctaacgttcagagt

SEQ ID NO: 50741 - DNA, 25 bp, Rattus norvegicus
aagtcaaattgcactctgcttgggc

SEQ ID NO: 50742 - DNA, 25 bp, Rattus norvegicus
aagtcaaattgctctctgcttgggc

SEQ ID NO: 50743 - DNA, 25 bp, Rattus norvegicus
aagtcaacacagattctttctcgga

SEQ ID NO: 50744 - DNA, 25 bp, Rattus norvegicus
aagtcaacacagtttctttctcgga

SEQ ID NO: 50745 - DNA, 25 bp, Rattus norvegicus
aagtcaacactcagttacctggcag

SEQ ID NO: 50746 - DNA, 25 bp, Rattus norvegicus
aagtcaacactctgttacctggcag

SEQ ID NO: 50747 - DNA, 25 bp, Rattus norvegicus
aagtcaacagtccactttcacttgc

SEQ ID NO: 50748 - DNA, 25 bp, Rattus norvegicus
aagtcaacagtcgactttcacttgc

SEQ ID NO: 50749 - DNA, 25 bp, Rattus norvegicus
aagtcaacagtgcagcattccctgc

SEQ ID NO: 50750 - DNA, 25 bp, Rattus norvegicus
aagtcaacagtggagcattccctgc

SEQ ID NO: 50751 - DNA, 25 bp, Rattus norvegicus
aagtcaacagttcccagctaagata

SEQ ID NO: 50752 - DNA, 25 bp, Rattus norvegicus
aagtcaacagttgccagctaagata

SEQ ID NO: 50753 - DNA, 25 bp, Rattus norvegicus
aagtcaaccagcatcagggaggatt

SEQ ID NO: 50754 - DNA, 25 bp, Rattus norvegicus
aagtcaaccagcttcagggaggatt

SEQ ID NO: 50755 - DNA, 25 bp, Rattus norvegicus
aagtcaaccaggatctgcccaagga

SEQ ID NO: 50756 - DNA, 25 bp, Rattus norvegicus
aagtcaaccaggttctgcccaagga

SEQ ID NO: 50757 - DNA, 25 bp, Rattus norvegicus
aagtcaaccccacagatgcagtgcc

SEQ ID NO: 50758 - DNA, 25 bp, Rattus norvegicus
aagtcaaccccagagatgcagtgcc

SEQ ID NO: 50759 - DNA, 25 bp, Rattus norvegicus
aagtcaacctgaccatgtgttattt

SEQ ID NO: 50760 - DNA, 25 bp, Rattus norvegicus
aagtcaacctgagcatgtgttattt

SEQ ID NO: 50761 - DNA, 25 bp, Rattus norvegicus
aagtcaactgataattagtcctttt

SEQ ID NO: 50762 - DNA, 25 bp, Rattus norvegicus
aagtcaactgattattagtcctttt

SEQ ID NO: 50763 - DNA, 25 bp, Rattus norvegicus
aagtcaactgtcagactcatacgcc

SEQ ID NO: 50764 - DNA, 25 bp, Rattus norvegicus
aagtcaactgtctgactcatacgcc

SEQ ID NO: 50765 - DNA, 25 bp, Rattus norvegicus
aagtcaactgttagaactacttgag

SEQ ID NO: 50766 - DNA, 25 bp, Rattus norvegicus
aagtcaactgtttgaactacttgag

SEQ ID NO: 50767 - DNA, 25 bp, Rattus norvegicus
aagtcaagacccacaaaagccagaa

SEQ ID NO: 50768 - DNA, 25 bp, Rattus norvegicus
aagtcaagaccctcaaaagccagaa

SEQ ID NO: 50769 - DNA, 25 bp, Rattus norvegicus
aagtcaagactcaaacccaggccct

SEQ ID NO: 50770 - DNA, 25 bp, Rattus norvegicus
aagtcaagactctaacccaggccct

SEQ ID NO: 50771 - DNA, 25 bp, Rattus norvegicus
aagtcaagagctcagcctacaggaa

SEQ ID NO: 50772 - DNA, 25 bp, Rattus norvegicus
aagtcaagagctgagcctacaggaa

SEQ ID NO: 50773 - DNA, 25 bp, Rattus norvegicus
aagtcaagcatacgcacagtggtga

SEQ ID NO: 50774 - DNA, 25 bp, Rattus norvegicus
aagtcaagcataggcacagtggtga

SEQ ID NO: 50775 - DNA, 25 bp, Rattus norvegicus
aagtcaaggctcctcctttgtgtgc

SEQ ID NO: 50776 - DNA, 25 bp, Rattus norvegicus
aagtcaaggctcgtcctttgtgtgc

SEQ ID NO: 50777 - DNA, 25 bp, Rattus norvegicus
aagtcaaggtcaacaccatttccca

SEQ ID NO: 50778 - DNA, 25 bp, Rattus norvegicus
aagtcaaggtcatcaccatttccca

SEQ ID NO: 50779 - DNA, 25 bp, Rattus norvegicus
aagtcaagtgccatcaatgctaaag

SEQ ID NO: 50780 - DNA, 25 bp, Rattus norvegicus
aagtcaagtgccttcaatgctaaag

SEQ ID NO: 50781 - DNA, 25 bp, Rattus norvegicus
aagtcaagtgcgctttgctcttcag

SEQ ID NO: 50782 - DNA, 25 bp, Rattus norvegicus
aagtcaagtgcggtttgctcttcag

SEQ ID NO: 50783 - DNA, 25 bp, Rattus norvegicus
aagtcaagttgcacagtgtggctgc

SEQ ID NO: 50784 - DNA, 25 bp, Rattus norvegicus
aagtcaagttgcacttcaggccggg

SEQ ID NO: 50785 - DNA, 25 bp, Rattus norvegicus
aagtcaagttgctcagtgtggctgc

SEQ ID NO: 50786 - DNA, 25 bp, Rattus norvegicus
aagtcaagttgctcttcaggccggg

SEQ ID NO: 50787 - DNA, 25 bp, Rattus norvegicus
aagtcaataaagacaggcctgcctg

SEQ ID NO: 50788 - DNA, 25 bp, Rattus norvegicus
aagtcaataaagtcaggcctgcctg

SEQ ID NO: 50789 - DNA, 25 bp, Rattus norvegicus
aagtcaatcctgatcgtgtaagctc

SEQ ID NO: 50790 - DNA, 25 bp, Rattus norvegicus
aagtcaatcctgttcgtgtaagctc

SEQ ID NO: 50791 - DNA, 25 bp, Rattus norvegicus
aagtcaatctggagcttccttagaa

SEQ ID NO: 50792 - DNA, 25 bp, Rattus norvegicus
aagtcaatctggtgcttccttagaa

SEQ ID NO: 50793 - DNA, 25 bp, Rattus norvegicus
aagtcaatgactacccaggctgaaa

SEQ ID NO: 50794 - DNA, 25 bp, Rattus norvegicus
aagtcaatgacttcccaggctgaaa

SEQ ID NO: 50795 - DNA, 25 bp, Rattus norvegicus
aagtcaatgatgcttctgctggtac

SEQ ID NO: 50796 - DNA, 25 bp, Rattus norvegicus
aagtcaatgatggttctgctggtac

SEQ ID NO: 50797 - DNA, 25 bp, Rattus norvegicus
aagtcaatgcttagtaactcatata

SEQ ID NO: 50798 - DNA, 25 bp, Rattus norvegicus
aagtcaatgctttgtaactcatata

SEQ ID NO: 50799 - DNA, 25 bp, Rattus norvegicus
aagtcaatgtttaactgtcctcctc

SEQ ID NO: 50800 - DNA, 25 bp, Rattus norvegicus
aagtcaatgttttactgtcctcctc

SEQ ID NO: 50801 - DNA, 25 bp, Rattus norvegicus
aagtcaattctgaatcggattccga

SEQ ID NO: 50802 - DNA, 25 bp, Rattus norvegicus
aagtcaattctgtatcggattccga

SEQ ID NO: 50803 - DNA, 25 bp, Rattus norvegicus
aagtcaatttgtactacctcagctg

SEQ ID NO: 50804 - DNA, 25 bp, Rattus norvegicus
aagtcaatttgttctacctcagctg

SEQ ID NO: 50805 - DNA, 25 bp, Rattus norvegicus
aagtcacaaaacagggcctcttcta

SEQ ID NO: 50806 - DNA, 25 bp, Rattus norvegicus
aagtcacaaaactgggcctcttcta

SEQ ID NO: 50807 - DNA, 25 bp, Rattus norvegicus
aagtcacaaaagcatctgtgtgata

SEQ ID NO: 50808 - DNA, 25 bp, Rattus norvegicus
aagtcacaaaaggatctgtgtgata

SEQ ID NO: 50809 - DNA, 25 bp, Rattus norvegicus
aagtcacaacatagcacatggtatg

SEQ ID NO: 50810 - DNA, 25 bp, Rattus norvegicus
aagtcacaacattgcacatggtatg

SEQ ID NO: 50811 - DNA, 25 bp, Rattus norvegicus
aagtcacaacccagcagtgtacaca

SEQ ID NO: 50812 - DNA, 25 bp, Rattus norvegicus
aagtcacaaccctgcagtgtacaca

SEQ ID NO: 50813 - DNA, 25 bp, Rattus norvegicus
aagtcacaagctacagcgggtccaa

SEQ ID NO: 50814 - DNA, 25 bp, Rattus norvegicus
aagtcacaagcttcagcgggtccaa

SEQ ID NO: 50815 - DNA, 25 bp, Rattus norvegicus
aagtcacaatgtctagatgctgcag

SEQ ID NO: 50816 - DNA, 25 bp, Rattus norvegicus
aagtcacaatgtgtagatgctgcag

SEQ ID NO: 50817 - DNA, 25 bp, Rattus norvegicus
aagtcacacaaaaggcttccgcttt

SEQ ID NO: 50818 - DNA, 25 bp, Rattus norvegicus
aagtcacacaaatggcttccgcttt

SEQ ID NO: 50819 - DNA, 25 bp, Rattus norvegicus
aagtcacaccccaggatcatgagaa

SEQ ID NO: 50820 - DNA, 25 bp, Rattus norvegicus
aagtcacacccctggatcatgagaa

SEQ ID NO: 50821 - DNA, 25 bp, Rattus norvegicus
aagtcacactctcttagaagtaggg

SEQ ID NO: 50822 - DNA, 25 bp, Rattus norvegicus
aagtcacactctgttagaagtaggg

SEQ ID NO: 50823 - DNA, 25 bp, Rattus norvegicus
aagtcacactggcttccggtgcgtg

SEQ ID NO: 50824 - DNA, 25 bp, Rattus norvegicus
aagtcacactgggttccggtgcgtg

SEQ ID NO: 50825 - DNA, 25 bp, Rattus norvegicus
aagtcacagactcatggatcagaat

SEQ ID NO: 50826 - DNA, 25 bp, Rattus norvegicus
aagtcacagactccaggcaatgtta

SEQ ID NO: 50827 - DNA, 25 bp, Rattus norvegicus
aagtcacagactgatggatcagaat

SEQ ID NO: 50828 - DNA, 25 bp, Rattus norvegicus
aagtcacagactgcaggcaatgtta

SEQ ID NO: 50829 - DNA, 25 bp, Rattus norvegicus
aagtcacagcacaggatcttagcta

SEQ ID NO: 50830 - DNA, 25 bp, Rattus norvegicus
aagtcacagcactggatcttagcta

SEQ ID NO: 50831 - DNA, 25 bp, Rattus norvegicus
aagtcacagccactggccctagaca

SEQ ID NO: 50832 - DNA, 25 bp, Rattus norvegicus
aagtcacagccagtggccctagaca

SEQ ID NO: 50833 - DNA, 25 bp, Rattus norvegicus
aagtcacaggacagcctttcttcca

SEQ ID NO: 50834 - DNA, 25 bp, Rattus norvegicus
aagtcacaggactgcctttcttcca

SEQ ID NO: 50835 - DNA, 25 bp, Rattus norvegicus
aagtcacaggcaatcctttgacagc

SEQ ID NO: 50836 - DNA, 25 bp, Rattus norvegicus
aagtcacaggcattcctttgacagc

SEQ ID NO: 50837 - DNA, 25 bp, Rattus norvegicus
aagtcacagggcaattgtgtgtctc

SEQ ID NO: 50838 - DNA, 25 bp, Rattus norvegicus
aagtcacagggcatcagacagcacc

SEQ ID NO: 50839 - DNA, 25 bp, Rattus norvegicus
aagtcacagggctattgtgtgtctc

SEQ ID NO: 50840 - DNA, 25 bp, Rattus norvegicus
aagtcacagggcttcagacagcacc

SEQ ID NO: 50841 - DNA, 25 bp, Rattus norvegicus
aagtcacagtctcggactacgacat

SEQ ID NO: 50842 - DNA, 25 bp, Rattus norvegicus
aagtcacagtctgggactacgacat

SEQ ID NO: 50843 - DNA, 25 bp, Rattus norvegicus
aagtcacatcataggagagccgttt

SEQ ID NO: 50844 - DNA, 25 bp, Rattus norvegicus
aagtcacatcattggagagccgttt

SEQ ID NO: 50845 - DNA, 25 bp, Rattus norvegicus
aagtcacatgatacccagggtcagg

SEQ ID NO: 50846 - DNA, 25 bp, Rattus norvegicus
aagtcacatgatctagacctgcaga

SEQ ID NO: 50847 - DNA, 25 bp, Rattus norvegicus
aagtcacatgatgtagacctgcaga

SEQ ID NO: 50848 - DNA, 25 bp, Rattus norvegicus
aagtcacatgattcccagggtcagg

SEQ ID NO: 50849 - DNA, 25 bp, Rattus norvegicus
aagtcacatgcacagcattctgtta

SEQ ID NO: 50850 - DNA, 25 bp, Rattus norvegicus
aagtcacatgcagagcattctgtta

SEQ ID NO: 50851 - DNA, 25 bp, Rattus norvegicus
aagtcacatggcagctgccacaggt

SEQ ID NO: 50852 - DNA, 25 bp, Rattus norvegicus
aagtcacatggctgctgccacaggt

SEQ ID NO: 50853 - DNA, 25 bp, Rattus norvegicus
aagtcacatggtcagcagaggcctt

SEQ ID NO: 50854 - DNA, 25 bp, Rattus norvegicus
aagtcacatggtgagcagaggcctt

SEQ ID NO: 50855 - DNA, 25 bp, Rattus norvegicus
aagtcacattcacacacatcacatt

SEQ ID NO: 50856 - DNA, 25 bp, Rattus norvegicus
aagtcacattcagacacatcacatt

SEQ ID NO: 50857 - DNA, 25 bp, Rattus norvegicus
aagtcacatttcagccagacggtgt

SEQ ID NO: 50858 - DNA, 25 bp, Rattus norvegicus
aagtcacatttctgccagacggtgt

SEQ ID NO: 50859 - DNA, 25 bp, Rattus norvegicus
aagtcaccacagagggcgcaaggct

SEQ ID NO: 50860 - DNA, 25 bp, Rattus norvegicus
aagtcaccacagtgggcgcaaggct

SEQ ID NO: 50861 - DNA, 25 bp, Rattus norvegicus
aagtcaccacttatgtcacttcttg

SEQ ID NO: 50862 - DNA, 25 bp, Rattus norvegicus
aagtcaccacttttgtcacttcttg

SEQ ID NO: 50863 - DNA, 25 bp, Rattus norvegicus
aagtcaccaggaacagactctctga

SEQ ID NO: 50864 - DNA, 25 bp, Rattus norvegicus
aagtcaccaggatcagactctctga

SEQ ID NO: 50865 - DNA, 25 bp, Rattus norvegicus
aagtcaccataactgcttttttgca

SEQ ID NO: 50866 - DNA, 25 bp, Rattus norvegicus
aagtcaccataagtgcttttttgca

SEQ ID NO: 50867 - DNA, 25 bp, Rattus norvegicus
aagtcaccatgaccctgtgggtaga

SEQ ID NO: 50868 - DNA, 25 bp, Rattus norvegicus
aagtcaccatgagcctgtgggtaga

SEQ ID NO: 50869 - DNA, 25 bp, Rattus norvegicus
aagtcaccatggaccctgaagagca

SEQ ID NO: 50870 - DNA, 25 bp, Rattus norvegicus
aagtcaccatggtccctgaagagca

SEQ ID NO: 50871 - DNA, 25 bp, Rattus norvegicus
aagtcacccagtacatagtttctac

SEQ ID NO: 50872 - DNA, 25 bp, Rattus norvegicus
aagtcacccagttcatagtttctac

SEQ ID NO: 50873 - DNA, 25 bp, Rattus norvegicus
aagtcacccatcagtttgtgaagtg

SEQ ID NO: 50874 - DNA, 25 bp, Rattus norvegicus
aagtcacccatctgtttgtgaagtg

SEQ ID NO: 50875 - DNA, 25 bp, Rattus norvegicus
aagtcacccggcatctgaaagggag

SEQ ID NO: 50876 - DNA, 25 bp, Rattus norvegicus
aagtcacccggcttctgaaagggag

SEQ ID NO: 50877 - DNA, 25 bp, Rattus norvegicus
aagtcacccttcctcggtacctatg

SEQ ID NO: 50878 - DNA, 25 bp, Rattus norvegicus
aagtcacccttcgtcggtacctatg

SEQ ID NO: 50879 - DNA, 25 bp, Rattus norvegicus
aagtcaccgaccatgcaaatactga

SEQ ID NO: 50880 - DNA, 25 bp, Rattus norvegicus
aagtcaccgaccttgcaaatactga

SEQ ID NO: 50881 - DNA, 25 bp, Rattus norvegicus
aagtcaccggacacctttaactatg

SEQ ID NO: 50882 - DNA, 25 bp, Rattus norvegicus
aagtcaccggactcctttaactatg

SEQ ID NO: 50883 - DNA, 25 bp, Rattus norvegicus
aagtcaccgggccttggaaatagat

SEQ ID NO: 50884 - DNA, 25 bp, Rattus norvegicus
aagtcaccgggcgttggaaatagat

SEQ ID NO: 50885 - DNA, 25 bp, Rattus norvegicus
aagtcaccgtttacagtaatttgct

SEQ ID NO: 50886 - DNA, 25 bp, Rattus norvegicus
aagtcaccgttttcagtaatttgct

SEQ ID NO: 50887 - DNA, 25 bp, Rattus norvegicus
aagtcacctcatagtaatgccgaga

SEQ ID NO: 50888 - DNA, 25 bp, Rattus norvegicus
aagtcacctcattgtaatgccgaga

SEQ ID NO: 50889 - DNA, 25 bp, Rattus norvegicus
aagtcacctcttatgaagtctcaag

SEQ ID NO: 50890 - DNA, 25 bp, Rattus norvegicus
aagtcacctcttttgaagtctcaag

SEQ ID NO: 50891 - DNA, 25 bp, Rattus norvegicus
aagtcacctgaaccttgtggctggg

SEQ ID NO: 50892 - DNA, 25 bp, Rattus norvegicus
aagtcacctgaagcttgtggctggg

SEQ ID NO: 50893 - DNA, 25 bp, Rattus norvegicus
aagtcaccttcactttccataatag

SEQ ID NO: 50894 - DNA, 25 bp, Rattus norvegicus
aagtcaccttcagtttccataatag

SEQ ID NO: 50895 - DNA, 25 bp, Rattus norvegicus
aagtcacctttgaagctagcaccag

SEQ ID NO: 50896 - DNA, 25 bp, Rattus norvegicus
aagtcacctttgaggagtcgcctct

SEQ ID NO: 50897 - DNA, 25 bp, Rattus norvegicus
aagtcacctttgtagctagcaccag

SEQ ID NO: 50898 - DNA, 25 bp, Rattus norvegicus
aagtcacctttgtggagtcgcctct

SEQ ID NO: 50899 - DNA, 25 bp, Rattus norvegicus
aagtcacgaagacctctctttacag

SEQ ID NO: 50900 - DNA, 25 bp, Rattus norvegicus
aagtcacgaagagctctctttacag

SEQ ID NO: 50901 - DNA, 25 bp, Rattus norvegicus
aagtcacgcgtacatggtggctctg

SEQ ID NO: 50902 - DNA, 25 bp, Rattus norvegicus
aagtcacgcgtagatggtggctctg

SEQ ID NO: 50903 - DNA, 25 bp, Rattus norvegicus
aagtcacggcatcattttcataata

SEQ ID NO: 50904 - DNA, 25 bp, Rattus norvegicus
aagtcacggcatgattttcataata

SEQ ID NO: 50905 - DNA, 25 bp, Rattus norvegicus
aagtcacgtcacatttaccaatagt

SEQ ID NO: 50906 - DNA, 25 bp, Rattus norvegicus
aagtcacgtcacttttaccaatagt

SEQ ID NO: 50907 - DNA, 25 bp, Rattus norvegicus
aagtcacgtgtgaatcctgacaagg

SEQ ID NO: 50908 - DNA, 25 bp, Rattus norvegicus
aagtcacgtgtgtatcctgacaagg

SEQ ID NO: 50909 - DNA, 25 bp, Rattus norvegicus
aagtcactaaatctctggcttgaaa

SEQ ID NO: 50910 - DNA, 25 bp, Rattus norvegicus
aagtcactaaatgtctggcttgaaa

SEQ ID NO: 50911 - DNA, 25 bp, Rattus norvegicus
aagtcactacttacacagcgtggcg

SEQ ID NO: 50912 - DNA, 25 bp, Rattus norvegicus
aagtcactactttcacagcgtggcg

SEQ ID NO: 50913 - DNA, 25 bp, Rattus norvegicus
aagtcactagtgctaaaattccaag

SEQ ID NO: 50914 - DNA, 25 bp, Rattus norvegicus
aagtcactagtggtaaaattccaag

SEQ ID NO: 50915 - DNA, 25 bp, Rattus norvegicus
aagtcactatgcaggtctttctaaa

SEQ ID NO: 50916 - DNA, 25 bp, Rattus norvegicus
aagtcactatgctggtctttctaaa

SEQ ID NO: 50917 - DNA, 25 bp, Rattus norvegicus
aagtcactcatcacatttctggttc

SEQ ID NO: 50918 - DNA, 25 bp, Rattus norvegicus
aagtcactcatcaccggtcattgat

SEQ ID NO: 50919 - DNA, 25 bp, Rattus norvegicus
aagtcactcatctcatttctggttc

SEQ ID NO: 50920 - DNA, 25 bp, Rattus norvegicus
aagtcactcatctccggtcattgat

SEQ ID NO: 50921 - DNA, 25 bp, Rattus norvegicus
aagtcactccacacactacggaaga

SEQ ID NO: 50922 - DNA, 25 bp, Rattus norvegicus
aagtcactccactcactacggaaga

SEQ ID NO: 50923 - DNA, 25 bp, Rattus norvegicus
aagtcactcggtctgggctttgcca

SEQ ID NO: 50924 - DNA, 25 bp, Rattus norvegicus
aagtcactcggtgtgggctttgcca

SEQ ID NO: 50925 - DNA, 25 bp, Rattus norvegicus
aagtcactctccagggaatcactga

SEQ ID NO: 50926 - DNA, 25 bp, Rattus norvegicus
aagtcactctccctgttattagatg

SEQ ID NO: 50927 - DNA, 25 bp, Rattus norvegicus
aagtcactctccgtgttattagatg

SEQ ID NO: 50928 - DNA, 25 bp, Rattus norvegicus
aagtcactctcctgggaatcactga

SEQ ID NO: 50929 - DNA, 25 bp, Rattus norvegicus
aagtcactctgcaatgtcagaagct

SEQ ID NO: 50930 - DNA, 25 bp, Rattus norvegicus
aagtcactctgctatgtcagaagct

SEQ ID NO: 50931 - DNA, 25 bp, Rattus norvegicus
aagtcactgccaaacaaacttggat

SEQ ID NO: 50932 - DNA, 25 bp, Rattus norvegicus
aagtcactgccatacaaacttggat

SEQ ID NO: 50933 - DNA, 25 bp, Rattus norvegicus
aagtcactgccgcacacgtacaaag

SEQ ID NO: 50934 - DNA, 25 bp, Rattus norvegicus
aagtcactgccggacacgtacaaag

SEQ ID NO: 50935 - DNA, 25 bp, Rattus norvegicus
aagtcactgctacgcttttcaagta

SEQ ID NO: 50936 - DNA, 25 bp, Rattus norvegicus
aagtcactgctaggcttttcaagta

SEQ ID NO: 50937 - DNA, 25 bp, Rattus norvegicus
aagtcactggcgacttctgaatgaa

SEQ ID NO: 50938 - DNA, 25 bp, Rattus norvegicus
aagtcactggcgtcttctgaatgaa

SEQ ID NO: 50939 - DNA, 25 bp, Rattus norvegicus
aagtcactgggcactgaacctccaa

SEQ ID NO: 50940 - DNA, 25 bp, Rattus norvegicus
aagtcactgggctctgaacctccaa

SEQ ID NO: 50941 - DNA, 25 bp, Rattus norvegicus
aagtcactgtgcagcgggcgctact

SEQ ID NO: 50942 - DNA, 25 bp, Rattus norvegicus
aagtcactgtgctgcgggcgctact

SEQ ID NO: 50943 - DNA, 25 bp, Rattus norvegicus
aagtcacttcaaccagtggcaggtt

SEQ ID NO: 50944 - DNA, 25 bp, Rattus norvegicus
aagtcacttcaagcagtggcaggtt

SEQ ID NO: 50945 - DNA, 25 bp, Rattus norvegicus
aagtcacttccgatcctttgctgaa

SEQ ID NO: 50946 - DNA, 25 bp, Rattus norvegicus
aagtcacttccgatgttcatttgag

SEQ ID NO: 50947 - DNA, 25 bp, Rattus norvegicus
aagtcacttccgttcctttgctgaa

SEQ ID NO: 50948 - DNA, 25 bp, Rattus norvegicus
aagtcacttccgttgttcatttgag

SEQ ID NO: 50949 - DNA, 25 bp, Rattus norvegicus
aagtcacttcctacagtggaggagt

SEQ ID NO: 50950 - DNA, 25 bp, Rattus norvegicus
aagtcacttccttcagtggaggagt

SEQ ID NO: 50951 - DNA, 25 bp, Rattus norvegicus
aagtcactttccagagtcccttctg

SEQ ID NO: 50952 - DNA, 25 bp, Rattus norvegicus
aagtcactttcctgagtcccttctg

SEQ ID NO: 50953 - DNA, 25 bp, Rattus norvegicus
aagtcactttctacctgatgtccgc

SEQ ID NO: 50954 - DNA, 25 bp, Rattus norvegicus
aagtcactttcttcctgatgtccgc

SEQ ID NO: 50955 - DNA, 25 bp, Rattus norvegicus
aagtcagaaccgagtggctaaagct

SEQ ID NO: 50956 - DNA, 25 bp, Rattus norvegicus
aagtcagaaccgtgtggctaaagct

SEQ ID NO: 50957 - DNA, 25 bp, Rattus norvegicus
aagtcagaagctcagctgcaagctc

SEQ ID NO: 50958 - DNA, 25 bp, Rattus norvegicus
aagtcagaagctgagctgcaagctc

SEQ ID NO: 50959 - DNA, 25 bp, Rattus norvegicus
aagtcagaccctctttcgacaaaca

SEQ ID NO: 50960 - DNA, 25 bp, Rattus norvegicus
aagtcagaccctgtttcgacaaaca

SEQ ID NO: 50961 - DNA, 25 bp, Rattus norvegicus
aagtcagactaaatgccttccacag

SEQ ID NO: 50962 - DNA, 25 bp, Rattus norvegicus
aagtcagactaattgccttccacag

SEQ ID NO: 50963 - DNA, 25 bp, Rattus norvegicus
aagtcagactttcttgtagctcttt

SEQ ID NO: 50964 - DNA, 25 bp, Rattus norvegicus
aagtcagactttgttgtagctcttt

SEQ ID NO: 50965 - DNA, 25 bp, Rattus norvegicus
aagtcagagtcaataaggccaaagg

SEQ ID NO: 50966 - DNA, 25 bp, Rattus norvegicus
aagtcagagtcattaaggccaaagg

SEQ ID NO: 50967 - DNA, 25 bp, Rattus norvegicus
aagtcagagtgaccctttcctcaat

SEQ ID NO: 50968 - DNA, 25 bp, Rattus norvegicus
aagtcagagtgagcctttcctcaat

SEQ ID NO: 50969 - DNA, 25 bp, Rattus norvegicus
aagtcagatcaacctcacagggcaa

SEQ ID NO: 50970 - DNA, 25 bp, Rattus norvegicus
aagtcagatcaagctcacagggcaa

SEQ ID NO: 50971 - DNA, 25 bp, Rattus norvegicus
aagtcagatcacacctgtggtggct

SEQ ID NO: 50972 - DNA, 25 bp, Rattus norvegicus
aagtcagatcactcctgtggtggct

SEQ ID NO: 50973 - DNA, 25 bp, Rattus norvegicus
aagtcagatccaacagtgctcactg

SEQ ID NO: 50974 - DNA, 25 bp, Rattus norvegicus
aagtcagatccatcagtgctcactg

SEQ ID NO: 50975 - DNA, 25 bp, Rattus norvegicus
aagtcagatgacaccaaaagcagct

SEQ ID NO: 50976 - DNA, 25 bp, Rattus norvegicus
aagtcagatgactccaaaagcagct

SEQ ID NO: 50977 - DNA, 25 bp, Rattus norvegicus
aagtcagatgcgcagtggaagtcat

SEQ ID NO: 50978 - DNA, 25 bp, Rattus norvegicus
aagtcagatgcggagtggaagtcat

SEQ ID NO: 50979 - DNA, 25 bp, Rattus norvegicus
aagtcagatgctcttgtccccggtt

SEQ ID NO: 50980 - DNA, 25 bp, Rattus norvegicus
aagtcagatgctgttgtccccggtt

SEQ ID NO: 50981 - DNA, 25 bp, Rattus norvegicus
aagtcagatttccttcttgagacag

SEQ ID NO: 50982 - DNA, 25 bp, Rattus norvegicus
aagtcagatttcgttcttgagacag

SEQ ID NO: 50983 - DNA, 25 bp, Rattus norvegicus
aagtcagcaacaattctgaagtgaa

SEQ ID NO: 50984 - DNA, 25 bp, Rattus norvegicus
aagtcagcaacatttctgaagtgaa

SEQ ID NO: 50985 - DNA, 25 bp, Rattus norvegicus
aagtcagcaagcctgtgcacggagt

SEQ ID NO: 50986 - DNA, 25 bp, Rattus norvegicus
aagtcagcaagcgtgtgcacggagt

SEQ ID NO: 50987 - DNA, 25 bp, Rattus norvegicus
aagtcagcacaccttcctatttaag

SEQ ID NO: 50988 - DNA, 25 bp, Rattus norvegicus
aagtcagcacacgttcctatttaag

SEQ ID NO: 50989 - DNA, 25 bp, Rattus norvegicus
aagtcagcagttcatctgtgtgcaa

SEQ ID NO: 50990 - DNA, 25 bp, Rattus norvegicus
aagtcagcagttgatctgtgtgcaa

SEQ ID NO: 50991 - DNA, 25 bp, Rattus norvegicus
aagtcagccaccatcgtagcagatc

SEQ ID NO: 50992 - DNA, 25 bp, Rattus norvegicus
aagtcagccaccttcgtagcagatc

SEQ ID NO: 50993 - DNA, 25 bp, Rattus norvegicus
aagtcagccagcagccctaaatagc

SEQ ID NO: 50994 - DNA, 25 bp, Rattus norvegicus
aagtcagccagctgccctaaatagc

SEQ ID NO: 50995 - DNA, 25 bp, Rattus norvegicus
aagtcagccagtattatttgtccac

SEQ ID NO: 50996 - DNA, 25 bp, Rattus norvegicus
aagtcagccagtcttgagttcaaat

SEQ ID NO: 50997 - DNA, 25 bp, Rattus norvegicus
aagtcagccagtgttgagttcaaat

SEQ ID NO: 50998 - DNA, 25 bp, Rattus norvegicus
aagtcagccagttttatttgtccac

SEQ ID NO: 50999 - DNA, 25 bp, Rattus norvegicus
aagtcagccatgctgatgcgtgcaa

SEQ ID NO: 51000 - DNA, 25 bp, Rattus norvegicus
aagtcagccatggtgatgcgtgcaa

SEQ ID NO: 51001 - DNA, 25 bp, Rattus norvegicus
aagtcagccattatgttccaggaag

SEQ ID NO: 51002 - DNA, 25 bp, Rattus norvegicus
aagtcagccattttgttccaggaag

SEQ ID NO: 51003 - DNA, 25 bp, Rattus norvegicus
aagtcagccctacgatttagcttct

SEQ ID NO: 51004 - DNA, 25 bp, Rattus norvegicus
aagtcagccctaggatttagcttct

SEQ ID NO: 51005 - DNA, 25 bp, Rattus norvegicus
aagtcagccgtcaatgatgccgcct

SEQ ID NO: 51006 - DNA, 25 bp, Rattus norvegicus
aagtcagccgtctatgatgccgcct

SEQ ID NO: 51007 - DNA, 25 bp, Rattus norvegicus
aagtcagcctagagaacctttgtct

SEQ ID NO: 51008 - DNA, 25 bp, Rattus norvegicus
aagtcagcctagtgaacctttgtct

SEQ ID NO: 51009 - DNA, 25 bp, Rattus norvegicus
aagtcagcctcaatgtctgaactgc

SEQ ID NO: 51010 - DNA, 25 bp, Rattus norvegicus
aagtcagcctcattgtctgaactgc

SEQ ID NO: 51011 - DNA, 25 bp, Rattus norvegicus
aagtcagcctgacagacaccagtca

SEQ ID NO: 51012 - DNA, 25 bp, Rattus norvegicus
aagtcagcctgagagacaccagtca

SEQ ID NO: 51013 - DNA, 25 bp, Rattus norvegicus
aagtcagcctgcatgagcgtttgtc

SEQ ID NO: 51014 - DNA, 25 bp, Rattus norvegicus
aagtcagcctgcatgctgccgtgct

SEQ ID NO: 51015 - DNA, 25 bp, Rattus norvegicus
aagtcagcctgccaacttagtgcac

SEQ ID NO: 51016 - DNA, 25 bp, Rattus norvegicus
aagtcagcctgcgaacttagtgcac

SEQ ID NO: 51017 - DNA, 25 bp, Rattus norvegicus
aagtcagcctgcttgagcgtttgtc

SEQ ID NO: 51018 - DNA, 25 bp, Rattus norvegicus
aagtcagcctgcttgctgccgtgct

SEQ ID NO: 51019 - DNA, 25 bp, Rattus norvegicus
aagtcagcgtctctgcgagcatctt

SEQ ID NO: 51020 - DNA, 25 bp, Rattus norvegicus
aagtcagcgtctgtgcgagcatctt

SEQ ID NO: 51021 - DNA, 25 bp, Rattus norvegicus
aagtcagcgttgattaaatccaagt

SEQ ID NO: 51022 - DNA, 25 bp, Rattus norvegicus
aagtcagcgttgtttaaatccaagt

SEQ ID NO: 51023 - DNA, 25 bp, Rattus norvegicus
aagtcagctacaattggccacaggg

SEQ ID NO: 51024 - DNA, 25 bp, Rattus norvegicus
aagtcagctacatttggccacaggg

SEQ ID NO: 51025 - DNA, 25 bp, Rattus norvegicus
aagtcagctcagcacatggctccag

SEQ ID NO: 51026 - DNA, 25 bp, Rattus norvegicus
aagtcagctcaggacatggctccag

SEQ ID NO: 51027 - DNA, 25 bp, Rattus norvegicus
aagtcagctctgagactccagatga

SEQ ID NO: 51028 - DNA, 25 bp, Rattus norvegicus
aagtcagctctgtgactccagatga

SEQ ID NO: 51029 - DNA, 25 bp, Rattus norvegicus
aagtcagcttcgagggctctttaga

SEQ ID NO: 51030 - DNA, 25 bp, Rattus norvegicus
aagtcagcttcgtgggctctttaga

SEQ ID NO: 51031 - DNA, 25 bp, Rattus norvegicus
aagtcaggaaatcccgtgagctaca

SEQ ID NO: 51032 - DNA, 25 bp, Rattus norvegicus
aagtcaggaaatgccgtgagctaca

SEQ ID NO: 51033 - DNA, 25 bp, Rattus norvegicus
aagtcaggcctgaagctcctaatag

SEQ ID NO: 51034 - DNA, 25 bp, Rattus norvegicus
aagtcaggcctgtagctcctaatag

SEQ ID NO: 51035 - DNA, 25 bp, Rattus norvegicus
aagtcagggactatatagcttgtaa

SEQ ID NO: 51036 - DNA, 25 bp, Rattus norvegicus
aagtcagggactttatagcttgtaa

SEQ ID NO: 51037 - DNA, 25 bp, Rattus norvegicus
aagtcagggcccctctcaaggagta

SEQ ID NO: 51038 - DNA, 25 bp, Rattus norvegicus
aagtcagggcccgtctcaaggagta

SEQ ID NO: 51039 - DNA, 25 bp, Rattus norvegicus
aagtcagggtaccacaagctccaaa

SEQ ID NO: 51040 - DNA, 25 bp, Rattus norvegicus
aagtcagggtacgacaagctccaaa

SEQ ID NO: 51041 - DNA, 25 bp, Rattus norvegicus
aagtcagggtcaccttcagctgtta

SEQ ID NO: 51042 - DNA, 25 bp, Rattus norvegicus
aagtcagggtcagcttcagctgtta

SEQ ID NO: 51043 - DNA, 25 bp, Rattus norvegicus
aagtcagggtccattgcctttagat

SEQ ID NO: 51044 - DNA, 25 bp, Rattus norvegicus
aagtcagggtcctttgcctttagat

SEQ ID NO: 51045 - DNA, 25 bp, Rattus norvegicus
aagtcaggtcggctgacccctatga

SEQ ID NO: 51046 - DNA, 25 bp, Rattus norvegicus
aagtcaggtcgggtgacccctatga

SEQ ID NO: 51047 - DNA, 25 bp, Rattus norvegicus
aagtcaggtgccaagttctggaagg

SEQ ID NO: 51048 - DNA, 25 bp, Rattus norvegicus
aagtcaggtgcctagttctggaagg

SEQ ID NO: 51049 - DNA, 25 bp, Rattus norvegicus
aagtcagtaaacaacactcctccat

SEQ ID NO: 51050 - DNA, 25 bp, Rattus norvegicus
aagtcagtaaactacactcctccat

SEQ ID NO: 51051 - DNA, 25 bp, Rattus norvegicus
aagtcagtacctagtgcagcaacta

SEQ ID NO: 51052 - DNA, 25 bp, Rattus norvegicus
aagtcagtaccttgtgcagcaacta

SEQ ID NO: 51053 - DNA, 25 bp, Rattus norvegicus
aagtcagtactgagagcaacccaaa

SEQ ID NO: 51054 - DNA, 25 bp, Rattus norvegicus
aagtcagtactgtgagcaacccaaa

SEQ ID NO: 51055 - DNA, 25 bp, Rattus norvegicus
aagtcagtatttattctctcatcaa

SEQ ID NO: 51056 - DNA, 25 bp, Rattus norvegicus
aagtcagtattttttctctcatcaa

SEQ ID NO: 51057 - DNA, 25 bp, Rattus norvegicus
aagtcagtcaatccccatttgaatt

SEQ ID NO: 51058 - DNA, 25 bp, Rattus norvegicus
aagtcagtcaatgcccatttgaatt

SEQ ID NO: 51059 - DNA, 25 bp, Rattus norvegicus
aagtcagtccaacttgtcttccaca

SEQ ID NO: 51060 - DNA, 25 bp, Rattus norvegicus
aagtcagtccaagttgtcttccaca

SEQ ID NO: 51061 - DNA, 25 bp, Rattus norvegicus
aagtcagtctgccatttaaccttga

SEQ ID NO: 51062 - DNA, 25 bp, Rattus norvegicus
aagtcagtctgcgatttaaccttga

SEQ ID NO: 51063 - DNA, 25 bp, Rattus norvegicus
aagtcagtctgtcctggatcctaca

SEQ ID NO: 51064 - DNA, 25 bp, Rattus norvegicus
aagtcagtctgtgctggatcctaca

SEQ ID NO: 51065 - DNA, 25 bp, Rattus norvegicus
aagtcagtcttaaccaattattgaa

SEQ ID NO: 51066 - DNA, 25 bp, Rattus norvegicus
aagtcagtcttatccaattattgaa

SEQ ID NO: 51067 - DNA, 25 bp, Rattus norvegicus
aagtcagtgacccaattgcatttaa

SEQ ID NO: 51068 - DNA, 25 bp, Rattus norvegicus
aagtcagtgaccgaattgcatttaa

SEQ ID NO: 51069 - DNA, 25 bp, Rattus norvegicus
aagtcagtgagacctctgtcttctc

SEQ ID NO: 51070 - DNA, 25 bp, Rattus norvegicus
aagtcagtgagagctctgtcttctc

SEQ ID NO: 51071 - DNA, 25 bp, Rattus norvegicus
aagtcagtgagcacactccagggcc

SEQ ID NO: 51072 - DNA, 25 bp, Rattus norvegicus
aagtcagtgagctcactccagggcc

SEQ ID NO: 51073 - DNA, 25 bp, Rattus norvegicus
aagtcagtgcctctaattgtatact

SEQ ID NO: 51074 - DNA, 25 bp, Rattus norvegicus
aagtcagtgcctgtaattgtatact

SEQ ID NO: 51075 - DNA, 25 bp, Rattus norvegicus
aagtcagtgctacccaagtgagcct

SEQ ID NO: 51076 - DNA, 25 bp, Rattus norvegicus
aagtcagtgctagccaagtgagcct

SEQ ID NO: 51077 - DNA, 25 bp, Rattus norvegicus
aagtcagtgctgattctctgttttt

SEQ ID NO: 51078 - DNA, 25 bp, Rattus norvegicus
aagtcagtgctgcacatgacgcagt

SEQ ID NO: 51079 - DNA, 25 bp, Rattus norvegicus
aagtcagtgctggacatgacgcagt

SEQ ID NO: 51080 - DNA, 25 bp, Rattus norvegicus
aagtcagtgctgtttctctgttttt

SEQ ID NO: 51081 - DNA, 25 bp, Rattus norvegicus
aagtcagtgggaaccctggttgcat

SEQ ID NO: 51082 - DNA, 25 bp, Rattus norvegicus
aagtcagtgggatccctggttgcat

SEQ ID NO: 51083 - DNA, 25 bp, Rattus norvegicus
aagtcagtgtagacctgagctggga

SEQ ID NO: 51084 - DNA, 25 bp, Rattus norvegicus
aagtcagtgtagtcctgagctggga

SEQ ID NO: 51085 - DNA, 25 bp, Rattus norvegicus
aagtcagtgttcattccactgtcct

SEQ ID NO: 51086 - DNA, 25 bp, Rattus norvegicus
aagtcagtgttctttccactgtcct

SEQ ID NO: 51087 - DNA, 25 bp, Rattus norvegicus
aagtcagttaaccacatcctgaact

SEQ ID NO: 51088 - DNA, 25 bp, Rattus norvegicus
aagtcagttaacgacatcctgaact

SEQ ID NO: 51089 - DNA, 25 bp, Rattus norvegicus
aagtcagttctgatcctttttccaa

SEQ ID NO: 51090 - DNA, 25 bp, Rattus norvegicus
aagtcagttctgttcctttttccaa

SEQ ID NO: 51091 - DNA, 25 bp, Rattus norvegicus
aagtcagtttttcatgtttgtggtt

SEQ ID NO: 51092 - DNA, 25 bp, Rattus norvegicus
aagtcagtttttgatgtttgtggtt

SEQ ID NO: 51093 - DNA, 25 bp, Rattus norvegicus
aagtcatacttgctcattcccacac

SEQ ID NO: 51094 - DNA, 25 bp, Rattus norvegicus
aagtcatacttggtcattcccacac

SEQ ID NO: 51095 - DNA, 25 bp, Rattus norvegicus
aagtcatagcatatacactgacggg

SEQ ID NO: 51096 - DNA, 25 bp, Rattus norvegicus
aagtcatagcatttacactgacggg

SEQ ID NO: 51097 - DNA, 25 bp, Rattus norvegicus
aagtcatagctcatacttcttggct

SEQ ID NO: 51098 - DNA, 25 bp, Rattus norvegicus
aagtcatagctcttacttcttggct

SEQ ID NO: 51099 - DNA, 25 bp, Rattus norvegicus
aagtcataggaaaccagttcccaga

SEQ ID NO: 51100 - DNA, 25 bp, Rattus norvegicus
aagtcataggaatccagttcccaga

SEQ ID NO: 51101 - DNA, 25 bp, Rattus norvegicus
aagtcataggttcgctgtcgctgca

SEQ ID NO: 51102 - DNA, 25 bp, Rattus norvegicus
aagtcataggttggctgtcgctgca

SEQ ID NO: 51103 - DNA, 25 bp, Rattus norvegicus
aagtcatatattcttccatgttcat

SEQ ID NO: 51104 - DNA, 25 bp, Rattus norvegicus
aagtcatatattgttccatgttcat

SEQ ID NO: 51105 - DNA, 25 bp, Rattus norvegicus
aagtcatcaactagtaccatcaccc

SEQ ID NO: 51106 - DNA, 25 bp, Rattus norvegicus
aagtcatcaacttgtaccatcaccc

SEQ ID NO: 51107 - DNA, 25 bp, Rattus norvegicus
aagtcatcaagcatgtttcctctga

SEQ ID NO: 51108 - DNA, 25 bp, Rattus norvegicus
aagtcatcaagcttgtttcctctga

SEQ ID NO: 51109 - DNA, 25 bp, Rattus norvegicus
aagtcatcaccacttcccagaatat

SEQ ID NO: 51110 - DNA, 25 bp, Rattus norvegicus
aagtcatcaccagttcccagaatat

SEQ ID NO: 51111 - DNA, 25 bp, Rattus norvegicus
aagtcatcagaacctggacaccagt

SEQ ID NO: 51112 - DNA, 25 bp, Rattus norvegicus
aagtcatcagaagctggacaccagt

SEQ ID NO: 51113 - DNA, 25 bp, Rattus norvegicus
aagtcatcaggtatggtgcccaatc

SEQ ID NO: 51114 - DNA, 25 bp, Rattus norvegicus
aagtcatcaggtttggtgcccaatc

SEQ ID NO: 51115 - DNA, 25 bp, Rattus norvegicus
aagtcatcatacctgagtgctttga

SEQ ID NO: 51116 - DNA, 25 bp, Rattus norvegicus
aagtcatcatacgtgagtgctttga

SEQ ID NO: 51117 - DNA, 25 bp, Rattus norvegicus
aagtcatcccaaatactgctttttg

SEQ ID NO: 51118 - DNA, 25 bp, Rattus norvegicus
aagtcatcccaattactgctttttg

SEQ ID NO: 51119 - DNA, 25 bp, Rattus norvegicus
aagtcatcctatattcctcatcacg

SEQ ID NO: 51120 - DNA, 25 bp, Rattus norvegicus
aagtcatcctattttcctcatcacg

SEQ ID NO: 51121 - DNA, 25 bp, Rattus norvegicus
aagtcatcctcccatctccgagtgt

SEQ ID NO: 51122 - DNA, 25 bp, Rattus norvegicus
aagtcatcctccgatctccgagtgt

SEQ ID NO: 51123 - DNA, 25 bp, Rattus norvegicus
aagtcatcctctaagtggccatcat

SEQ ID NO: 51124 - DNA, 25 bp, Rattus norvegicus
aagtcatcctcttagtggccatcat

SEQ ID NO: 51125 - DNA, 25 bp, Rattus norvegicus
aagtcatccttcactacattttgag

SEQ ID NO: 51126 - DNA, 25 bp, Rattus norvegicus
aagtcatccttctctacattttgag

SEQ ID NO: 51127 - DNA, 25 bp, Rattus norvegicus
aagtcatctactagcattttgccag

SEQ ID NO: 51128 - DNA, 25 bp, Rattus norvegicus
aagtcatctactcctaacggttatg

SEQ ID NO: 51129 - DNA, 25 bp, Rattus norvegicus
aagtcatctactgctaacggttatg

SEQ ID NO: 51130 - DNA, 25 bp, Rattus norvegicus
aagtcatctacttgcattttgccag

SEQ ID NO: 51131 - DNA, 25 bp, Rattus norvegicus
aagtcatctattaaaataccactgg

SEQ ID NO: 51132 - DNA, 25 bp, Rattus norvegicus
aagtcatctatttaaataccactgg

SEQ ID NO: 51133 - DNA, 25 bp, Rattus norvegicus
aagtcatctcatcgcctcaatactc

SEQ ID NO: 51134 - DNA, 25 bp, Rattus norvegicus
aagtcatctcatggcctcaatactc

SEQ ID NO: 51135 - DNA, 25 bp, Rattus norvegicus
aagtcatctccccacgacagagtag

SEQ ID NO: 51136 - DNA, 25 bp, Rattus norvegicus
aagtcatctcccgacgacagagtag

SEQ ID NO: 51137 - DNA, 25 bp, Rattus norvegicus
aagtcatctgatctggaaagcgagt

SEQ ID NO: 51138 - DNA, 25 bp, Rattus norvegicus
aagtcatctgatgtggaaagcgagt

SEQ ID NO: 51139 - DNA, 25 bp, Rattus norvegicus
aagtcatcttatatgagcacttgta

SEQ ID NO: 51140 - DNA, 25 bp, Rattus norvegicus
aagtcatcttatttgagcacttgta

SEQ ID NO: 51141 - DNA, 25 bp, Rattus norvegicus
aagtcatcttccctgataggatccc

SEQ ID NO: 51142 - DNA, 25 bp, Rattus norvegicus
aagtcatcttccgtgataggatccc

SEQ ID NO: 51143 - DNA, 25 bp, Rattus norvegicus
aagtcatgaaccaaagtgctccccg

SEQ ID NO: 51144 - DNA, 25 bp, Rattus norvegicus
aagtcatgaacctaagtgctccccg

SEQ ID NO: 51145 - DNA, 25 bp, Rattus norvegicus
aagtcatgcattcctgccaggcaga

SEQ ID NO: 51146 - DNA, 25 bp, Rattus norvegicus
aagtcatgcattgctgccaggcaga

SEQ ID NO: 51147 - DNA, 25 bp, Rattus norvegicus
aagtcatgcttgagatactttgtca

SEQ ID NO: 51148 - DNA, 25 bp, Rattus norvegicus
aagtcatgcttgtgatactttgtca

SEQ ID NO: 51149 - DNA, 25 bp, Rattus norvegicus
aagtcatgctttcttgcccattatt

SEQ ID NO: 51150 - DNA, 25 bp, Rattus norvegicus
aagtcatgctttgttgcccattatt

SEQ ID NO: 51151 - DNA, 25 bp, Rattus norvegicus
aagtcatgggaaatctctccagggt

SEQ ID NO: 51152 - DNA, 25 bp, Rattus norvegicus
aagtcatgggaattctctccagggt

SEQ ID NO: 51153 - DNA, 25 bp, Rattus norvegicus
aagtcatgggagcagagcctctgtc

SEQ ID NO: 51154 - DNA, 25 bp, Rattus norvegicus
aagtcatgggaggagagcctctgtc

SEQ ID NO: 51155 - DNA, 25 bp, Rattus norvegicus
aagtcatggttcagggtctgcgaag

SEQ ID NO: 51156 - DNA, 25 bp, Rattus norvegicus
aagtcatggttctgggtctgcgaag

SEQ ID NO: 51157 - DNA, 25 bp, Rattus norvegicus
aagtcatgtaccacgattggcggtt

SEQ ID NO: 51158 - DNA, 25 bp, Rattus norvegicus
aagtcatgtacctcgattggcggtt

SEQ ID NO: 51159 - DNA, 25 bp, Rattus norvegicus
aagtcatgtccaaatttcaattttc

SEQ ID NO: 51160 - DNA, 25 bp, Rattus norvegicus
aagtcatgtccaagatgatcttcaa

SEQ ID NO: 51161 - DNA, 25 bp, Rattus norvegicus
aagtcatgtccatatttcaattttc

SEQ ID NO: 51162 - DNA, 25 bp, Rattus norvegicus
aagtcatgtccatgatgatcttcaa

SEQ ID NO: 51163 - DNA, 25 bp, Rattus norvegicus
aagtcatgttctacagttctggatg

SEQ ID NO: 51164 - DNA, 25 bp, Rattus norvegicus
aagtcatgttcttcagttctggatg

SEQ ID NO: 51165 - DNA, 25 bp, Rattus norvegicus
aagtcattacttctagcagctgtta

SEQ ID NO: 51166 - DNA, 25 bp, Rattus norvegicus
aagtcattacttgtagcagctgtta

SEQ ID NO: 51167 - DNA, 25 bp, Rattus norvegicus
aagtcattagcgcttgcttatgaga

SEQ ID NO: 51168 - DNA, 25 bp, Rattus norvegicus
aagtcattagcggttgcttatgaga

SEQ ID NO: 51169 - DNA, 25 bp, Rattus norvegicus
aagtcattcacactggtgtcctaca

SEQ ID NO: 51170 - DNA, 25 bp, Rattus norvegicus
aagtcattcacagtggtgtcctaca

SEQ ID NO: 51171 - DNA, 25 bp, Rattus norvegicus
aagtcattcatgattgcccatgggc

SEQ ID NO: 51172 - DNA, 25 bp, Rattus norvegicus
aagtcattcatgtttgcccatgggc

SEQ ID NO: 51173 - DNA, 25 bp, Rattus norvegicus
aagtcattccatcactgggattgca

SEQ ID NO: 51174 - DNA, 25 bp, Rattus norvegicus
aagtcattccatgactgggattgca

SEQ ID NO: 51175 - DNA, 25 bp, Rattus norvegicus
aagtcattccttagtcgctaggcat

SEQ ID NO: 51176 - DNA, 25 bp, Rattus norvegicus
aagtcattcctttgtcgctaggcat

SEQ ID NO: 51177 - DNA, 25 bp, Rattus norvegicus
aagtcattctacctgagctcctggt

SEQ ID NO: 51178 - DNA, 25 bp, Rattus norvegicus
aagtcattctacgtgagctcctggt

SEQ ID NO: 51179 - DNA, 25 bp, Rattus norvegicus
aagtcattctgtaccaactctggga

SEQ ID NO: 51180 - DNA, 25 bp, Rattus norvegicus
aagtcattctgttccaactctggga

SEQ ID NO: 51181 - DNA, 25 bp, Rattus norvegicus
aagtcattgaaacccgagcccaaaa

SEQ ID NO: 51182 - DNA, 25 bp, Rattus norvegicus
aagtcattgaaagccgagcccaaaa

SEQ ID NO: 51183 - DNA, 25 bp, Rattus norvegicus
aagtcattgattatgccacacctag

SEQ ID NO: 51184 - DNA, 25 bp, Rattus norvegicus
aagtcattgattttgccacacctag

SEQ ID NO: 51185 - DNA, 25 bp, Rattus norvegicus
aagtcattgcttacagggctcttga

SEQ ID NO: 51186 - DNA, 25 bp, Rattus norvegicus
aagtcattgctttcagggctcttga

SEQ ID NO: 51187 - DNA, 25 bp, Rattus norvegicus
aagtcattggagcttcttgctagaa

SEQ ID NO: 51188 - DNA, 25 bp, Rattus norvegicus
aagtcattggaggttcttgctagaa

SEQ ID NO: 51189 - DNA, 25 bp, Rattus norvegicus
aagtcattggcgctctcctgtatgg

SEQ ID NO: 51190 - DNA, 25 bp, Rattus norvegicus
aagtcattggcggtctcctgtatgg

SEQ ID NO: 51191 - DNA, 25 bp, Rattus norvegicus
aagtcattgggaccggaagcttctt

SEQ ID NO: 51192 - DNA, 25 bp, Rattus norvegicus
aagtcattgggagcggaagcttctt

SEQ ID NO: 51193 - DNA, 25 bp, Rattus norvegicus
aagtcattgtcgaaccaactgccag

SEQ ID NO: 51194 - DNA, 25 bp, Rattus norvegicus
aagtcattgtcgtaccaactgccag

SEQ ID NO: 51195 - DNA, 25 bp, Rattus norvegicus
aagtcatttattcccacacccaatc

SEQ ID NO: 51196 - DNA, 25 bp, Rattus norvegicus
aagtcatttattgccacacccaatc

SEQ ID NO: 51197 - DNA, 25 bp, Rattus norvegicus
aagtcatttccactctgcacaagaa

SEQ ID NO: 51198 - DNA, 25 bp, Rattus norvegicus
aagtcatttccagtctgcacaagaa

SEQ ID NO: 51199 - DNA, 25 bp, Rattus norvegicus
aagtcatttcccatcaatttctgcc

SEQ ID NO: 51200 - DNA, 25 bp, Rattus norvegicus
aagtcatttcccttcaatttctgcc

SEQ ID NO: 51201 - DNA, 25 bp, Rattus norvegicus
aagtcatttcttatgtgcctgagga

SEQ ID NO: 51202 - DNA, 25 bp, Rattus norvegicus
aagtcatttcttttgtgcctgagga

SEQ ID NO: 51203 - DNA, 25 bp, Rattus norvegicus
aagtccaacaacagaggagtgggta

SEQ ID NO: 51204 - DNA, 25 bp, Rattus norvegicus
aagtccaacaactgaggagtgggta

SEQ ID NO: 51205 - DNA, 25 bp, Rattus norvegicus
aagtccaacactaatgcttctgctg

SEQ ID NO: 51206 - DNA, 25 bp, Rattus norvegicus
aagtccaacacttatgcttctgctg

SEQ ID NO: 51207 - DNA, 25 bp, Rattus norvegicus
aagtccaacagaagcactcattgaa

SEQ ID NO: 51208 - DNA, 25 bp, Rattus norvegicus
aagtccaacagatgcactcattgaa

SEQ ID NO: 51209 - DNA, 25 bp, Rattus norvegicus
aagtccaaccaaaaggaagcctttg

SEQ ID NO: 51210 - DNA, 25 bp, Rattus norvegicus
aagtccaaccaataggaagcctttg

SEQ ID NO: 51211 - DNA, 25 bp, Rattus norvegicus
aagtccaagaggcaccttagatatc

SEQ ID NO: 51212 - DNA, 25 bp, Rattus norvegicus
aagtccaagagggaccttagatatc

SEQ ID NO: 51213 - DNA, 25 bp, Rattus norvegicus
aagtccaagcccagagttaacattt

SEQ ID NO: 51214 - DNA, 25 bp, Rattus norvegicus
aagtccaagccctgagttaacattt

SEQ ID NO: 51215 - DNA, 25 bp, Rattus norvegicus
aagtccaaggatctcaggtggttct

SEQ ID NO: 51216 - DNA, 25 bp, Rattus norvegicus
aagtccaaggatgtcaggtggttct

SEQ ID NO: 51217 - DNA, 25 bp, Rattus norvegicus
aagtccaagggcagcctccagaatg

SEQ ID NO: 51218 - DNA, 25 bp, Rattus norvegicus
aagtccaagggctgcctccagaatg

SEQ ID NO: 51219 - DNA, 25 bp, Rattus norvegicus
aagtccaagttgacagccagaattt

SEQ ID NO: 51220 - DNA, 25 bp, Rattus norvegicus
aagtccaagttgtcagccagaattt

SEQ ID NO: 51221 - DNA, 25 bp, Rattus norvegicus
aagtccaatgctcagcagcaccaaa

SEQ ID NO: 51222 - DNA, 25 bp, Rattus norvegicus
aagtccaatgctcggtccttgtatt

SEQ ID NO: 51223 - DNA, 25 bp, Rattus norvegicus
aagtccaatgctgagcagcaccaaa

SEQ ID NO: 51224 - DNA, 25 bp, Rattus norvegicus
aagtccaatgctgggtccttgtatt

SEQ ID NO: 51225 - DNA, 25 bp, Rattus norvegicus
aagtccacacgcattcagacacatg

SEQ ID NO: 51226 - DNA, 25 bp, Rattus norvegicus
aagtccacacgctttcagacacatg

SEQ ID NO: 51227 - DNA, 25 bp, Rattus norvegicus
aagtccacatcaagtcagctttctc

SEQ ID NO: 51228 - DNA, 25 bp, Rattus norvegicus
aagtccacatcatgtcagctttctc

SEQ ID NO: 51229 - DNA, 25 bp, Rattus norvegicus
aagtccacatgaaagcgtacctctg

SEQ ID NO: 51230 - DNA, 25 bp, Rattus norvegicus
aagtccacatgatagcgtacctctg

SEQ ID NO: 51231 - DNA, 25 bp, Rattus norvegicus
aagtccacattaagaaccttccctg

SEQ ID NO: 51232 - DNA, 25 bp, Rattus norvegicus
aagtccacattatgaaccttccctg

SEQ ID NO: 51233 - DNA, 25 bp, Rattus norvegicus
aagtccacccatcccatggagtggg

SEQ ID NO: 51234 - DNA, 25 bp, Rattus norvegicus
aagtccacccatgccatggagtggg

SEQ ID NO: 51235 - DNA, 25 bp, Rattus norvegicus
aagtccacccctctggtataatcgg

SEQ ID NO: 51236 - DNA, 25 bp, Rattus norvegicus
aagtccacccctgtggtataatcgg

SEQ ID NO: 51237 - DNA, 25 bp, Rattus norvegicus
aagtccacctgtaatatttccacca

SEQ ID NO: 51238 - DNA, 25 bp, Rattus norvegicus
aagtccacctgttatatttccacca

SEQ ID NO: 51239 - DNA, 25 bp, Rattus norvegicus
aagtccacctttccagggatggcat

SEQ ID NO: 51240 - DNA, 25 bp, Rattus norvegicus
aagtccacctttgcagggatggcat

SEQ ID NO: 51241 - DNA, 25 bp, Rattus norvegicus
aagtccacgcccagcagcggtgatg

SEQ ID NO: 51242 - DNA, 25 bp, Rattus norvegicus
aagtccacgccctgcagcggtgatg

SEQ ID NO: 51243 - DNA, 25 bp, Rattus norvegicus
aagtccacggtgagccggctgctac

SEQ ID NO: 51244 - DNA, 25 bp, Rattus norvegicus
aagtccacggtgtgccggctgctac

SEQ ID NO: 51245 - DNA, 25 bp, Rattus norvegicus
aagtccacgtaaatgctgcaggcag

SEQ ID NO: 51246 - DNA, 25 bp, Rattus norvegicus
aagtccacgtaattgctgcaggcag

SEQ ID NO: 51247 - DNA, 25 bp, Rattus norvegicus
aagtccacgtctcatctgtacatag

SEQ ID NO: 51248 - DNA, 25 bp, Rattus norvegicus
aagtccacgtctgatctgtacatag

SEQ ID NO: 51249 - DNA, 25 bp, Rattus norvegicus
aagtccacgtggctttctctgtcag

SEQ ID NO: 51250 - DNA, 25 bp, Rattus norvegicus
aagtccacgtgggtttctctgtcag

SEQ ID NO: 51251 - DNA, 25 bp, Rattus norvegicus
aagtccactccgagcagctttagag

SEQ ID NO: 51252 - DNA, 25 bp, Rattus norvegicus
aagtccactccgtgcagctttagag

SEQ ID NO: 51253 - DNA, 25 bp, Rattus norvegicus
aagtccactcttactgagttcaggt

SEQ ID NO: 51254 - DNA, 25 bp, Rattus norvegicus
aagtccactctttctgagttcaggt

SEQ ID NO: 51255 - DNA, 25 bp, Rattus norvegicus
aagtccactgatattgatggtccaa

SEQ ID NO: 51256 - DNA, 25 bp, Rattus norvegicus
aagtccactgattttgatggtccaa

SEQ ID NO: 51257 - DNA, 25 bp, Rattus norvegicus
aagtccactggtaaacccacactgt

SEQ ID NO: 51258 - DNA, 25 bp, Rattus norvegicus
aagtccactggttaacccacactgt

SEQ ID NO: 51259 - DNA, 25 bp, Rattus norvegicus
aagtccacttgtctgtatgggcagc

SEQ ID NO: 51260 - DNA, 25 bp, Rattus norvegicus
aagtccacttgtgtgtatgggcagc

SEQ ID NO: 51261 - DNA, 25 bp, Rattus norvegicus
aagtccactttccattgcttccgtg

SEQ ID NO: 51262 - DNA, 25 bp, Rattus norvegicus
aagtccactttcgattgcttccgtg

SEQ ID NO: 51263 - DNA, 25 bp, Rattus norvegicus
aagtccagaaaccatatcctgctcc

SEQ ID NO: 51264 - DNA, 25 bp, Rattus norvegicus
aagtccagaaacgatatcctgctcc

SEQ ID NO: 51265 - DNA, 25 bp, Rattus norvegicus
aagtccagagacagaagccagccag

SEQ ID NO: 51266 - DNA, 25 bp, Rattus norvegicus
aagtccagagactgaagccagccag

SEQ ID NO: 51267 - DNA, 25 bp, Rattus norvegicus
aagtccagatcgagttcaagaaccc

SEQ ID NO: 51268 - DNA, 25 bp, Rattus norvegicus
aagtccagatcgtgttcaagaaccc

SEQ ID NO: 51269 - DNA, 25 bp, Rattus norvegicus
aagtccagattgaagtgtccagctc

SEQ ID NO: 51270 - DNA, 25 bp, Rattus norvegicus
aagtccagattgtagtgtccagctc

SEQ ID NO: 51271 - DNA, 25 bp, Rattus norvegicus
aagtccagcacactgcctaggagca

SEQ ID NO: 51272 - DNA, 25 bp, Rattus norvegicus
aagtccagcacagtgcctaggagca

SEQ ID NO: 51273 - DNA, 25 bp, Rattus norvegicus
aagtccagcattacgtcagtgcggt

SEQ ID NO: 51274 - DNA, 25 bp, Rattus norvegicus
aagtccagcatttcgtcagtgcggt

SEQ ID NO: 51275 - DNA, 25 bp, Rattus norvegicus
aagtccagccacaaatacattcggg

SEQ ID NO: 51276 - DNA, 25 bp, Rattus norvegicus
aagtccagccactaatacattcggg

SEQ ID NO: 51277 - DNA, 25 bp, Rattus norvegicus
aagtccagctctagcaccagcagtg

SEQ ID NO: 51278 - DNA, 25 bp, Rattus norvegicus
aagtccagctcttgcaccagcagtg

SEQ ID NO: 51279 - DNA, 25 bp, Rattus norvegicus
aagtccagctgactaacgtgcgtgc

SEQ ID NO: 51280 - DNA, 25 bp, Rattus norvegicus
aagtccagctgagtaacgtgcgtgc

SEQ ID NO: 51281 - DNA, 25 bp, Rattus norvegicus
aagtccaggataattctaagtgtat

SEQ ID NO: 51282 - DNA, 25 bp, Rattus norvegicus
aagtccaggatatttctaagtgtat

SEQ ID NO: 51283 - DNA, 25 bp, Rattus norvegicus
aagtccaggatcagcaggtcgtgca

SEQ ID NO: 51284 - DNA, 25 bp, Rattus norvegicus
aagtccaggatctgcaggtcgtgca

SEQ ID NO: 51285 - DNA, 25 bp, Rattus norvegicus
aagtccaggcgtcatgtgctcaggc

SEQ ID NO: 51286 - DNA, 25 bp, Rattus norvegicus
aagtccaggcgtgatgtgctcaggc

SEQ ID NO: 51287 - DNA, 25 bp, Rattus norvegicus
aagtccagggtgaccagtgcgccaa

SEQ ID NO: 51288 - DNA, 25 bp, Rattus norvegicus
aagtccagggtgtccagtgcgccaa

SEQ ID NO: 51289 - DNA, 25 bp, Rattus norvegicus
aagtccaggtggagctgaccgtttt

SEQ ID NO: 51290 - DNA, 25 bp, Rattus norvegicus
aagtccaggtggtgctgaccgtttt

SEQ ID NO: 51291 - DNA, 25 bp, Rattus norvegicus
aagtccagtatgctgttctccaagt

SEQ ID NO: 51292 - DNA, 25 bp, Rattus norvegicus
aagtccagtatggtgttctccaagt

SEQ ID NO: 51293 - DNA, 25 bp, Rattus norvegicus
aagtccagtccacgaagctttggca

SEQ ID NO: 51294 - DNA, 25 bp, Rattus norvegicus
aagtccagtccaggaagctttggca

SEQ ID NO: 51295 - DNA, 25 bp, Rattus norvegicus
aagtccagtgagatgtggccaagtt

SEQ ID NO: 51296 - DNA, 25 bp, Rattus norvegicus
aagtccagtgagttgtggccaagtt

SEQ ID NO: 51297 - DNA, 25 bp, Rattus norvegicus
aagtccagtgtgctttccaccagga

SEQ ID NO: 51298 - DNA, 25 bp, Rattus norvegicus
aagtccagtgtggtttccaccagga

SEQ ID NO: 51299 - DNA, 25 bp, Rattus norvegicus
aagtccagttttatgattttcacag

SEQ ID NO: 51300 - DNA, 25 bp, Rattus norvegicus
aagtccagttttttgattttcacag

SEQ ID NO: 51301 - DNA, 25 bp, Rattus norvegicus
aagtccataaatacattacatcatg

SEQ ID NO: 51302 - DNA, 25 bp, Rattus norvegicus
aagtccataaattcattacatcatg

SEQ ID NO: 51303 - DNA, 25 bp, Rattus norvegicus
aagtccatatagatgagaagtctca

SEQ ID NO: 51304 - DNA, 25 bp, Rattus norvegicus
aagtccatatagttgagaagtctca

SEQ ID NO: 51305 - DNA, 25 bp, Rattus norvegicus
aagtccatcagcagtaaccgcagta

SEQ ID NO: 51306 - DNA, 25 bp, Rattus norvegicus
aagtccatcagctgtaaccgcagta

SEQ ID NO: 51307 - DNA, 25 bp, Rattus norvegicus
aagtccatcccgcagaagatgaaaa

SEQ ID NO: 51308 - DNA, 25 bp, Rattus norvegicus
aagtccatcccggagaagatgaaaa

SEQ ID NO: 51309 - DNA, 25 bp, Rattus norvegicus
aagtccatcgccatgagcctacgac

SEQ ID NO: 51310 - DNA, 25 bp, Rattus norvegicus
aagtccatcgccttgagcctacgac

SEQ ID NO: 51311 - DNA, 25 bp, Rattus norvegicus
aagtccatgctcccgctggcaggga

SEQ ID NO: 51312 - DNA, 25 bp, Rattus norvegicus
aagtccatgctcgcgctggcaggga

SEQ ID NO: 51313 - DNA, 25 bp, Rattus norvegicus
aagtccatggacaacgggcgcacgt

SEQ ID NO: 51314 - DNA, 25 bp, Rattus norvegicus
aagtccatggactacgggcgcacgt

SEQ ID NO: 51315 - DNA, 25 bp, Rattus norvegicus
aagtccattcctctttgccagaact

SEQ ID NO: 51316 - DNA, 25 bp, Rattus norvegicus
aagtccattcctgtttgccagaact

SEQ ID NO: 51317 - DNA, 25 bp, Rattus norvegicus
aagtccattgctattaagtcccaga

SEQ ID NO: 51318 - DNA, 25 bp, Rattus norvegicus
aagtccattgcttttaagtcccaga

SEQ ID NO: 51319 - DNA, 25 bp, Rattus norvegicus
aagtccattttccagctgtgatcat

SEQ ID NO: 51320 - DNA, 25 bp, Rattus norvegicus
aagtccattttcgagctgtgatcat

SEQ ID NO: 51321 - DNA, 25 bp, Rattus norvegicus
aagtccattttgagtgtgcgtgtac

SEQ ID NO: 51322 - DNA, 25 bp, Rattus norvegicus
aagtccattttgctaagccggcgtc

SEQ ID NO: 51323 - DNA, 25 bp, Rattus norvegicus
aagtccattttggtaagccggcgtc

SEQ ID NO: 51324 - DNA, 25 bp, Rattus norvegicus
aagtccattttgtgtgtgcgtgtac

SEQ ID NO: 51325 - DNA, 25 bp, Rattus norvegicus
aagtcccaaaacattgcaatccagg

SEQ ID NO: 51326 - DNA, 25 bp, Rattus norvegicus
aagtcccaaaactttgcaatccagg

SEQ ID NO: 51327 - DNA, 25 bp, Rattus norvegicus
aagtcccaagacaacgagcagaaat

SEQ ID NO: 51328 - DNA, 25 bp, Rattus norvegicus
aagtcccaagactacgagcagaaat

SEQ ID NO: 51329 - DNA, 25 bp, Rattus norvegicus
aagtcccacataacgtgtgcttgca

SEQ ID NO: 51330 - DNA, 25 bp, Rattus norvegicus
aagtcccacatatcgtgtgcttgca

SEQ ID NO: 51331 - DNA, 25 bp, Rattus norvegicus
aagtcccacattcctttactagctg

SEQ ID NO: 51332 - DNA, 25 bp, Rattus norvegicus
aagtcccacattgctttactagctg

SEQ ID NO: 51333 - DNA, 25 bp, Rattus norvegicus
aagtcccacgccagaagaagctgat

SEQ ID NO: 51334 - DNA, 25 bp, Rattus norvegicus
aagtcccacgcctgaagaagctgat

SEQ ID NO: 51335 - DNA, 25 bp, Rattus norvegicus
aagtcccacgtactgttctggctag

SEQ ID NO: 51336 - DNA, 25 bp, Rattus norvegicus
aagtcccacgtagtgttctggctag

SEQ ID NO: 51337 - DNA, 25 bp, Rattus norvegicus
aagtcccagagtagattggcagagt

SEQ ID NO: 51338 - DNA, 25 bp, Rattus norvegicus
aagtcccagagttgattggcagagt

SEQ ID NO: 51339 - DNA, 25 bp, Rattus norvegicus
aagtcccaggacacgtgaggtagag

SEQ ID NO: 51340 - DNA, 25 bp, Rattus norvegicus
aagtcccaggactcgtgaggtagag

SEQ ID NO: 51341 - DNA, 25 bp, Rattus norvegicus
aagtcccaggagatggcatcttcca

SEQ ID NO: 51342 - DNA, 25 bp, Rattus norvegicus
aagtcccaggagttggcatcttcca

SEQ ID NO: 51343 - DNA, 25 bp, Rattus norvegicus
aagtcccaggccagaggctgggcac

SEQ ID NO: 51344 - DNA, 25 bp, Rattus norvegicus
aagtcccaggcctgaggctgggcac

SEQ ID NO: 51345 - DNA, 25 bp, Rattus norvegicus
aagtcccagtatacctcatttttca

SEQ ID NO: 51346 - DNA, 25 bp, Rattus norvegicus
aagtcccagtattcctcatttttca

SEQ ID NO: 51347 - DNA, 25 bp, Rattus norvegicus
aagtcccagtcccaaacatgaatac

SEQ ID NO: 51348 - DNA, 25 bp, Rattus norvegicus
aagtcccagtccgaaacatgaatac

SEQ ID NO: 51349 - DNA, 25 bp, Rattus norvegicus
aagtcccatattctggtatgctccc

SEQ ID NO: 51350 - DNA, 25 bp, Rattus norvegicus
aagtcccatattgtggtatgctccc

SEQ ID NO: 51351 - DNA, 25 bp, Rattus norvegicus
aagtcccatgtcaccttggtggttc

SEQ ID NO: 51352 - DNA, 25 bp, Rattus norvegicus
aagtcccatgtctccttggtggttc

SEQ ID NO: 51353 - DNA, 25 bp, Rattus norvegicus
aagtccccaaagatgtaaccgtgcg

SEQ ID NO: 51354 - DNA, 25 bp, Rattus norvegicus
aagtccccaaagttgtaaccgtgcg

SEQ ID NO: 51355 - DNA, 25 bp, Rattus norvegicus
aagtccccaatcatttgtatgtgtg

SEQ ID NO: 51356 - DNA, 25 bp, Rattus norvegicus
aagtccccaatcttttgtatgtgtg

SEQ ID NO: 51357 - DNA, 25 bp, Rattus norvegicus
aagtccccacatcctagaaaactct

SEQ ID NO: 51358 - DNA, 25 bp, Rattus norvegicus
aagtccccacatgctagaaaactct

SEQ ID NO: 51359 - DNA, 25 bp, Rattus norvegicus
aagtccccagaaaggtgcctcgttt

SEQ ID NO: 51360 - DNA, 25 bp, Rattus norvegicus
aagtccccagaatggtgcctcgttt

SEQ ID NO: 51361 - DNA, 25 bp, Rattus norvegicus
aagtccccatgtctgacgctggaga

SEQ ID NO: 51362 - DNA, 25 bp, Rattus norvegicus
aagtccccatgtgtgacgctggaga

SEQ ID NO: 51363 - DNA, 25 bp, Rattus norvegicus
aagtccccattgctgaagagaccgg

SEQ ID NO: 51364 - DNA, 25 bp, Rattus norvegicus
aagtccccattggtgaagagaccgg

SEQ ID NO: 51365 - DNA, 25 bp, Rattus norvegicus
aagtcccctcagagagtcttattat

SEQ ID NO: 51366 - DNA, 25 bp, Rattus norvegicus
aagtcccctcagtgagtcttattat

SEQ ID NO: 51367 - DNA, 25 bp, Rattus norvegicus
aagtcccctgtcagctgcaatgtca

SEQ ID NO: 51368 - DNA, 25 bp, Rattus norvegicus
aagtcccctgtctgctgcaatgtca

SEQ ID NO: 51369 - DNA, 25 bp, Rattus norvegicus
aagtcccctttcagctgtgtattac

SEQ ID NO: 51370 - DNA, 25 bp, Rattus norvegicus
aagtcccctttctgctgtgtattac

SEQ ID NO: 51371 - DNA, 25 bp, Rattus norvegicus
aagtcccgagacacaatggcacatc

SEQ ID NO: 51372 - DNA, 25 bp, Rattus norvegicus
aagtcccgagactcaatggcacatc

SEQ ID NO: 51373 - DNA, 25 bp, Rattus norvegicus
aagtcccgagagctgtaccaggcaa

SEQ ID NO: 51374 - DNA, 25 bp, Rattus norvegicus
aagtcccgagaggtgtaccaggcaa

SEQ ID NO: 51375 - DNA, 25 bp, Rattus norvegicus
aagtcccgctctatcagagcaggtt

SEQ ID NO: 51376 - DNA, 25 bp, Rattus norvegicus
aagtcccgctctttcagagcaggtt

SEQ ID NO: 51377 - DNA, 25 bp, Rattus norvegicus
aagtcccgcttgaggagagtctcca

SEQ ID NO: 51378 - DNA, 25 bp, Rattus norvegicus
aagtcccgcttgtggagagtctcca

SEQ ID NO: 51379 - DNA, 25 bp, Rattus norvegicus
aagtccctaaacaacacaggccatg

SEQ ID NO: 51380 - DNA, 25 bp, Rattus norvegicus
aagtccctaaactacacaggccatg

SEQ ID NO: 51381 - DNA, 25 bp, Rattus norvegicus
aagtccctaatgacctctcttaagg

SEQ ID NO: 51382 - DNA, 25 bp, Rattus norvegicus
aagtccctaatgtcctctcttaagg

SEQ ID NO: 51383 - DNA, 25 bp, Rattus norvegicus
aagtccctaggtcctgaagcctcag

SEQ ID NO: 51384 - DNA, 25 bp, Rattus norvegicus
aagtccctaggtgctgaagcctcag

SEQ ID NO: 51385 - DNA, 25 bp, Rattus norvegicus
aagtccctattaatcctattgcaaa

SEQ ID NO: 51386 - DNA, 25 bp, Rattus norvegicus
aagtccctattattcctattgcaaa

SEQ ID NO: 51387 - DNA, 25 bp, Rattus norvegicus
aagtccctattgactgctcttatga

SEQ ID NO: 51388 - DNA, 25 bp, Rattus norvegicus
aagtccctattgtctgctcttatga

SEQ ID NO: 51389 - DNA, 25 bp, Rattus norvegicus
aagtccctcctcaggcagcaaatgg

SEQ ID NO: 51390 - DNA, 25 bp, Rattus norvegicus
aagtccctcctctggcagcaaatgg

SEQ ID NO: 51391 - DNA, 25 bp, Rattus norvegicus
aagtccctcctgaggcatgaagttt

SEQ ID NO: 51392 - DNA, 25 bp, Rattus norvegicus
aagtccctcctgtggcatgaagttt

SEQ ID NO: 51393 - DNA, 25 bp, Rattus norvegicus
aagtccctccttacagaggtcacag

SEQ ID NO: 51394 - DNA, 25 bp, Rattus norvegicus
aagtccctccttcggctgagatgtt

SEQ ID NO: 51395 - DNA, 25 bp, Rattus norvegicus
aagtccctccttgggctgagatgtt

SEQ ID NO: 51396 - DNA, 25 bp, Rattus norvegicus
aagtccctcctttcagaggtcacag

SEQ ID NO: 51397 - DNA, 25 bp, Rattus norvegicus
aagtccctcggtccggctgttgata

SEQ ID NO: 51398 - DNA, 25 bp, Rattus norvegicus
aagtccctcggtgcggctgttgata

SEQ ID NO: 51399 - DNA, 25 bp, Rattus norvegicus
aagtccctctgcagaggtcagtcat

SEQ ID NO: 51400 - DNA, 25 bp, Rattus norvegicus
aagtccctctgctgaggtcagtcat

SEQ ID NO: 51401 - DNA, 25 bp, Rattus norvegicus
aagtccctgacaaccatcatggagc

SEQ ID NO: 51402 - DNA, 25 bp, Rattus norvegicus
aagtccctgacatccatcatggagc

SEQ ID NO: 51403 - DNA, 25 bp, Rattus norvegicus
aagtccctgaccattagcaatctgc

SEQ ID NO: 51404 - DNA, 25 bp, Rattus norvegicus
aagtccctgacctttagcaatctgc

SEQ ID NO: 51405 - DNA, 25 bp, Rattus norvegicus
aagtccctgactaagcactatttac

SEQ ID NO: 51406 - DNA, 25 bp, Rattus norvegicus
aagtccctgacttagcactatttac

SEQ ID NO: 51407 - DNA, 25 bp, Rattus norvegicus
aagtccctgagccactgaggagcgc

SEQ ID NO: 51408 - DNA, 25 bp, Rattus norvegicus
aagtccctgagcgactgaggagcgc

SEQ ID NO: 51409 - DNA, 25 bp, Rattus norvegicus
aagtccctgggaaaatgtgtgtcac

SEQ ID NO: 51410 - DNA, 25 bp, Rattus norvegicus
aagtccctgggactggtgtgtgtgt

SEQ ID NO: 51411 - DNA, 25 bp, Rattus norvegicus
aagtccctgggagtggtgtgtgtgt

SEQ ID NO: 51412 - DNA, 25 bp, Rattus norvegicus
aagtccctgggataatgtgtgtcac

SEQ ID NO: 51413 - DNA, 25 bp, Rattus norvegicus
aagtcccttaagatccatactatga

SEQ ID NO: 51414 - DNA, 25 bp, Rattus norvegicus
aagtcccttaagttccatactatga

SEQ ID NO: 51415 - DNA, 25 bp, Rattus norvegicus
aagtcccttaggctttgctcacagg

SEQ ID NO: 51416 - DNA, 25 bp, Rattus norvegicus
aagtcccttagggtttgctcacagg

SEQ ID NO: 51417 - DNA, 25 bp, Rattus norvegicus
aagtcccttgcactgagcgctaggc

SEQ ID NO: 51418 - DNA, 25 bp, Rattus norvegicus
aagtcccttgcagtgagcgctaggc

SEQ ID NO: 51419 - DNA, 25 bp, Rattus norvegicus
aagtcccttgtgagctcagcctgag

SEQ ID NO: 51420 - DNA, 25 bp, Rattus norvegicus
aagtcccttgtgtgctcagcctgag

SEQ ID NO: 51421 - DNA, 25 bp, Rattus norvegicus
aagtccgaagctctgaagccatttt

SEQ ID NO: 51422 - DNA, 25 bp, Rattus norvegicus
aagtccgaagctgtgaagccatttt

SEQ ID NO: 51423 - DNA, 25 bp, Rattus norvegicus
aagtccgacgaaaacgaggctgctg

SEQ ID NO: 51424 - DNA, 25 bp, Rattus norvegicus
aagtccgacgaatacgaggctgctg

SEQ ID NO: 51425 - DNA, 25 bp, Rattus norvegicus
aagtccgaggaaaccattcaatatc

SEQ ID NO: 51426 - DNA, 25 bp, Rattus norvegicus
aagtccgaggaatccattcaatatc

SEQ ID NO: 51427 - DNA, 25 bp, Rattus norvegicus
aagtccgagggcacagatggccacg

SEQ ID NO: 51428 - DNA, 25 bp, Rattus norvegicus
aagtccgagggctcagatggccacg

SEQ ID NO: 51429 - DNA, 25 bp, Rattus norvegicus
aagtccgatgctcgcgccaagacat

SEQ ID NO: 51430 - DNA, 25 bp, Rattus norvegicus
aagtccgatgctggcgccaagacat

SEQ ID NO: 51431 - DNA, 25 bp, Rattus norvegicus
aagtccgcaaagaactggtcccaga

SEQ ID NO: 51432 - DNA, 25 bp, Rattus norvegicus
aagtccgcaaagtactggtcccaga

SEQ ID NO: 51433 - DNA, 25 bp, Rattus norvegicus
aagtccgcaccgctgagagctacga

SEQ ID NO: 51434 - DNA, 25 bp, Rattus norvegicus
aagtccgcaccggtgagagctacga

SEQ ID NO: 51435 - DNA, 25 bp, Rattus norvegicus
aagtccgctgctctgtggatgctgt

SEQ ID NO: 51436 - DNA, 25 bp, Rattus norvegicus
aagtccgctgctgtgtggatgctgt

SEQ ID NO: 51437 - DNA, 25 bp, Rattus norvegicus
aagtccggcacacagcaggtgctgc

SEQ ID NO: 51438 - DNA, 25 bp, Rattus norvegicus
aagtccggcacagagcaggtgctgc

SEQ ID NO: 51439 - DNA, 25 bp, Rattus norvegicus
aagtccgggataaaccgttgccaga

SEQ ID NO: 51440 - DNA, 25 bp, Rattus norvegicus
aagtccgggatataccgttgccaga

SEQ ID NO: 51441 - DNA, 25 bp, Rattus norvegicus
aagtccgtcagcagtggagctcatt

SEQ ID NO: 51442 - DNA, 25 bp, Rattus norvegicus
aagtccgtcagctgtggagctcatt

SEQ ID NO: 51443 - DNA, 25 bp, Rattus norvegicus
aagtccgttgtcagcatggcgggaa

SEQ ID NO: 51444 - DNA, 25 bp, Rattus norvegicus
aagtccgttgtctgcatggcgggaa

SEQ ID NO: 51445 - DNA, 25 bp, Rattus norvegicus
aagtcctaaacacccactgcgtgtg

SEQ ID NO: 51446 - DNA, 25 bp, Rattus norvegicus
aagtcctaaacagccactgcgtgtg

SEQ ID NO: 51447 - DNA, 25 bp, Rattus norvegicus
aagtcctaaatcacatcctgctttg

SEQ ID NO: 51448 - DNA, 25 bp, Rattus norvegicus
aagtcctaaatctcatcctgctttg

SEQ ID NO: 51449 - DNA, 25 bp, Rattus norvegicus
aagtcctaagtaagtgccctgctgt

SEQ ID NO: 51450 - DNA, 25 bp, Rattus norvegicus
aagtcctaagtatgtgccctgctgt

SEQ ID NO: 51451 - DNA, 25 bp, Rattus norvegicus
aagtcctacatcatctgtcatcaga

SEQ ID NO: 51452 - DNA, 25 bp, Rattus norvegicus
aagtcctacatcttctgtcatcaga

SEQ ID NO: 51453 - DNA, 25 bp, Rattus norvegicus
aagtcctactagagctccagagttc

SEQ ID NO: 51454 - DNA, 25 bp, Rattus norvegicus
aagtcctactagtgctccagagttc

SEQ ID NO: 51455 - DNA, 25 bp, Rattus norvegicus
aagtcctactgcatctcctaaaagg

SEQ ID NO: 51456 - DNA, 25 bp, Rattus norvegicus
aagtcctactgcttctcctaaaagg

SEQ ID NO: 51457 - DNA, 25 bp, Rattus norvegicus
aagtcctagaggcttcgaactccta

SEQ ID NO: 51458 - DNA, 25 bp, Rattus norvegicus
aagtcctagagggttcgaactccta

SEQ ID NO: 51459 - DNA, 25 bp, Rattus norvegicus
aagtcctaggttctgtagatgccca

SEQ ID NO: 51460 - DNA, 25 bp, Rattus norvegicus
aagtcctaggttgtgtagatgccca

SEQ ID NO: 51461 - DNA, 25 bp, Rattus norvegicus
aagtcctcaaaaatccctggatctt

SEQ ID NO: 51462 - DNA, 25 bp, Rattus norvegicus
aagtcctcaaaattccctggatctt

SEQ ID NO: 51463 - DNA, 25 bp, Rattus norvegicus
aagtcctcaagccacaggtccagtc

SEQ ID NO: 51464 - DNA, 25 bp, Rattus norvegicus
aagtcctcaagcgacaggtccagtc

SEQ ID NO: 51465 - DNA, 25 bp, Rattus norvegicus
aagtcctcacttacgatcatagctg

SEQ ID NO: 51466 - DNA, 25 bp, Rattus norvegicus
aagtcctcactttcgatcatagctg

SEQ ID NO: 51467 - DNA, 25 bp, Rattus norvegicus
aagtcctcagacattattttcagtg

SEQ ID NO: 51468 - DNA, 25 bp, Rattus norvegicus
aagtcctcagactttattttcagtg

SEQ ID NO: 51469 - DNA, 25 bp, Rattus norvegicus
aagtcctcagatctttcttcattca

SEQ ID NO: 51470 - DNA, 25 bp, Rattus norvegicus
aagtcctcagatgtttcttcattca

SEQ ID NO: 51471 - DNA, 25 bp, Rattus norvegicus
aagtcctcagccattgacattcggg

SEQ ID NO: 51472 - DNA, 25 bp, Rattus norvegicus
aagtcctcagccctggcagagtaca

SEQ ID NO: 51473 - DNA, 25 bp, Rattus norvegicus
aagtcctcagccgtggcagagtaca

SEQ ID NO: 51474 - DNA, 25 bp, Rattus norvegicus
aagtcctcagcctttgacattcggg

SEQ ID NO: 51475 - DNA, 25 bp, Rattus norvegicus
aagtcctcaggaccaccagcgagtc

SEQ ID NO: 51476 - DNA, 25 bp, Rattus norvegicus
aagtcctcaggagcaccagcgagtc

SEQ ID NO: 51477 - DNA, 25 bp, Rattus norvegicus
aagtcctcaggtcctgtcaggctgt

SEQ ID NO: 51478 - DNA, 25 bp, Rattus norvegicus
aagtcctcaggtgctgtcaggctgt

SEQ ID NO: 51479 - DNA, 25 bp, Rattus norvegicus
aagtcctcagttactcccggactga

SEQ ID NO: 51480 - DNA, 25 bp, Rattus norvegicus
aagtcctcagtttctcccggactga

SEQ ID NO: 51481 - DNA, 25 bp, Rattus norvegicus
aagtcctcattgctaggtggcccac

SEQ ID NO: 51482 - DNA, 25 bp, Rattus norvegicus
aagtcctcattggtaggtggcccac

SEQ ID NO: 51483 - DNA, 25 bp, Rattus norvegicus
aagtcctccagcaaagtctgttgta

SEQ ID NO: 51484 - DNA, 25 bp, Rattus norvegicus
aagtcctccagctaagtctgttgta

SEQ ID NO: 51485 - DNA, 25 bp, Rattus norvegicus
aagtcctccaggctctggaactcga

SEQ ID NO: 51486 - DNA, 25 bp, Rattus norvegicus
aagtcctccagggtctggaactcga

SEQ ID NO: 51487 - DNA, 25 bp, Rattus norvegicus
aagtcctccttgaatttggctcaca

SEQ ID NO: 51488 - DNA, 25 bp, Rattus norvegicus
aagtcctccttgtatttggctcaca

SEQ ID NO: 51489 - DNA, 25 bp, Rattus norvegicus
aagtcctcgcttatggtggcacgca

SEQ ID NO: 51490 - DNA, 25 bp, Rattus norvegicus
aagtcctcgcttttggtggcacgca

SEQ ID NO: 51491 - DNA, 25 bp, Rattus norvegicus
aagtcctcggtcagcctggacaaaa

SEQ ID NO: 51492 - DNA, 25 bp, Rattus norvegicus
aagtcctcggtctgcctggacaaaa

SEQ ID NO: 51493 - DNA, 25 bp, Rattus norvegicus
aagtcctcgtcaataccttcatggc

SEQ ID NO: 51494 - DNA, 25 bp, Rattus norvegicus
aagtcctcgtcattaccttcatggc

SEQ ID NO: 51495 - DNA, 25 bp, Rattus norvegicus
aagtcctctaacatgtgtgcgtttc

SEQ ID NO: 51496 - DNA, 25 bp, Rattus norvegicus
aagtcctctaacttgtgtgcgtttc

SEQ ID NO: 51497 - DNA, 25 bp, Rattus norvegicus
aagtcctctactaactcagctagac

SEQ ID NO: 51498 - DNA, 25 bp, Rattus norvegicus
aagtcctctacttactcagctagac

SEQ ID NO: 51499 - DNA, 25 bp, Rattus norvegicus
aagtcctctatgatgcttacgaacc

SEQ ID NO: 51500 - DNA, 25 bp, Rattus norvegicus
aagtcctctatgttgcttacgaacc

SEQ ID NO: 51501 - DNA, 25 bp, Rattus norvegicus
aagtcctctcccacaaaagagatgc

SEQ ID NO: 51502 - DNA, 25 bp, Rattus norvegicus
aagtcctctccctcaaaagagatgc

SEQ ID NO: 51503 - DNA, 25 bp, Rattus norvegicus
aagtcctctgatacttgtcctggca

SEQ ID NO: 51504 - DNA, 25 bp, Rattus norvegicus
aagtcctctgattcttgtcctggca

SEQ ID NO: 51505 - DNA, 25 bp, Rattus norvegicus
aagtcctctggcagttctagtgtga

SEQ ID NO: 51506 - DNA, 25 bp, Rattus norvegicus
aagtcctctggctgttctagtgtga

SEQ ID NO: 51507 - DNA, 25 bp, Rattus norvegicus
aagtcctctgtgagacctagtactt

SEQ ID NO: 51508 - DNA, 25 bp, Rattus norvegicus
aagtcctctgtgtgacctagtactt

SEQ ID NO: 51509 - DNA, 25 bp, Rattus norvegicus
aagtcctgaagacgcaggccagcca

SEQ ID NO: 51510 - DNA, 25 bp, Rattus norvegicus
aagtcctgaagaggcaggccagcca

SEQ ID NO: 51511 - DNA, 25 bp, Rattus norvegicus
aagtcctgacccagcttcggaaaca

SEQ ID NO: 51512 - DNA, 25 bp, Rattus norvegicus
aagtcctgaccctgcttcggaaaca

SEQ ID NO: 51513 - DNA, 25 bp, Rattus norvegicus
aagtcctgaccgatctggaggcatg

SEQ ID NO: 51514 - DNA, 25 bp, Rattus norvegicus
aagtcctgaccgttctggaggcatg

SEQ ID NO: 51515 - DNA, 25 bp, Rattus norvegicus
aagtcctgagacctgaagattgtaa

SEQ ID NO: 51516 - DNA, 25 bp, Rattus norvegicus
aagtcctgagacgtgaagattgtaa

SEQ ID NO: 51517 - DNA, 25 bp, Rattus norvegicus
aagtcctgagctcagatgtgcgcct

SEQ ID NO: 51518 - DNA, 25 bp, Rattus norvegicus
aagtcctgagctgagatgtgcgcct

SEQ ID NO: 51519 - DNA, 25 bp, Rattus norvegicus
aagtcctgcaacacctggagtcaat

SEQ ID NO: 51520 - DNA, 25 bp, Rattus norvegicus
aagtcctgcaactcctggagtcaat

SEQ ID NO: 51521 - DNA, 25 bp, Rattus norvegicus
aagtcctgcacgaagcggaaggcca

SEQ ID NO: 51522 - DNA, 25 bp, Rattus norvegicus
aagtcctgcacgtagcggaaggcca

SEQ ID NO: 51523 - DNA, 25 bp, Rattus norvegicus
aagtcctgcagcactgctgtagtaa

SEQ ID NO: 51524 - DNA, 25 bp, Rattus norvegicus
aagtcctgcagctctgctgtagtaa

SEQ ID NO: 51525 - DNA, 25 bp, Rattus norvegicus
aagtcctgcaggcatttctttgagg

SEQ ID NO: 51526 - DNA, 25 bp, Rattus norvegicus
aagtcctgcagggatttctttgagg

SEQ ID NO: 51527 - DNA, 25 bp, Rattus norvegicus
aagtcctgcagtacctagtcgatca

SEQ ID NO: 51528 - DNA, 25 bp, Rattus norvegicus
aagtcctgcagttcctagtcgatca

SEQ ID NO: 51529 - DNA, 25 bp, Rattus norvegicus
aagtcctgctgtctgttggcacact

SEQ ID NO: 51530 - DNA, 25 bp, Rattus norvegicus
aagtcctgctgtgtgttggcacact

SEQ ID NO: 51531 - DNA, 25 bp, Rattus norvegicus
aagtcctggaagacatgttgctaac

SEQ ID NO: 51532 - DNA, 25 bp, Rattus norvegicus
aagtcctggaagtcatgttgctaac

SEQ ID NO: 51533 - DNA, 25 bp, Rattus norvegicus
aagtcctggaccaaggcaaggccga

SEQ ID NO: 51534 - DNA, 25 bp, Rattus norvegicus
aagtcctggacctaggcaaggccga

SEQ ID NO: 51535 - DNA, 25 bp, Rattus norvegicus
aagtcctggagcagtgttgtgagtt

SEQ ID NO: 51536 - DNA, 25 bp, Rattus norvegicus
aagtcctggagctgtgttgtgagtt

SEQ ID NO: 51537 - DNA, 25 bp, Rattus norvegicus
aagtcctggcatattcatttcagag

SEQ ID NO: 51538 - DNA, 25 bp, Rattus norvegicus
aagtcctggcattttcatttcagag

SEQ ID NO: 51539 - DNA, 25 bp, Rattus norvegicus
aagtcctggcttctgggctgcacag

SEQ ID NO: 51540 - DNA, 25 bp, Rattus norvegicus
aagtcctggcttgtgggctgcacag

SEQ ID NO: 51541 - DNA, 25 bp, Rattus norvegicus
aagtcctggtctcatgatgcttcaa

SEQ ID NO: 51542 - DNA, 25 bp, Rattus norvegicus
aagtcctggtctgatgatgcttcaa

SEQ ID NO: 51543 - DNA, 25 bp, Rattus norvegicus
aagtcctgtcagaattgggagccct

SEQ ID NO: 51544 - DNA, 25 bp, Rattus norvegicus
aagtcctgtcagcaatgccaagcct

SEQ ID NO: 51545 - DNA, 25 bp, Rattus norvegicus
aagtcctgtcaggaatgccaagcct

SEQ ID NO: 51546 - DNA, 25 bp, Rattus norvegicus
aagtcctgtcagtattgggagccct

SEQ ID NO: 51547 - DNA, 25 bp, Rattus norvegicus
aagtcctgtctactgtcttgagttt

SEQ ID NO: 51548 - DNA, 25 bp, Rattus norvegicus
aagtcctgtctagtgtcttgagttt

SEQ ID NO: 51549 - DNA, 25 bp, Rattus norvegicus
aagtcctgttacagtggcccctgtc

SEQ ID NO: 51550 - DNA, 25 bp, Rattus norvegicus
aagtcctgttactgtggcccctgtc

SEQ ID NO: 51551 - DNA, 25 bp, Rattus norvegicus
aagtcctgttggcacattcctttgg

SEQ ID NO: 51552 - DNA, 25 bp, Rattus norvegicus
aagtcctgttgggacattcctttgg

SEQ ID NO: 51553 - DNA, 25 bp, Rattus norvegicus
aagtccttacatccaagctgtggct

SEQ ID NO: 51554 - DNA, 25 bp, Rattus norvegicus
aagtccttacatgcaagctgtggct

SEQ ID NO: 51555 - DNA, 25 bp, Rattus norvegicus
aagtccttactgaatggctcctggt

SEQ ID NO: 51556 - DNA, 25 bp, Rattus norvegicus
aagtccttactgtatggctcctggt

SEQ ID NO: 51557 - DNA, 25 bp, Rattus norvegicus
aagtccttagcgattggccgtgact

SEQ ID NO: 51558 - DNA, 25 bp, Rattus norvegicus
aagtccttagcgtttggccgtgact

SEQ ID NO: 51559 - DNA, 25 bp, Rattus norvegicus
aagtccttagtccacagtgcctgct

SEQ ID NO: 51560 - DNA, 25 bp, Rattus norvegicus
aagtccttagtcgacagtgcctgct

SEQ ID NO: 51561 - DNA, 25 bp, Rattus norvegicus
aagtccttcctgatttgtgagcttg

SEQ ID NO: 51562 - DNA, 25 bp, Rattus norvegicus
aagtccttcctgttttgtgagcttg

SEQ ID NO: 51563 - DNA, 25 bp, Rattus norvegicus
aagtccttctcacagtgcccagaga

SEQ ID NO: 51564 - DNA, 25 bp, Rattus norvegicus
aagtccttctcagagtgcccagaga

SEQ ID NO: 51565 - DNA, 25 bp, Rattus norvegicus
aagtccttctccactaacggcattg

SEQ ID NO: 51566 - DNA, 25 bp, Rattus norvegicus
aagtccttctcctctaacggcattg

SEQ ID NO: 51567 - DNA, 25 bp, Rattus norvegicus
aagtccttctctagtcctgtggcag

SEQ ID NO: 51568 - DNA, 25 bp, Rattus norvegicus
aagtccttctcttgtcctgtggcag

SEQ ID NO: 51569 - DNA, 25 bp, Rattus norvegicus
aagtccttctgcaacccgtccaaat

SEQ ID NO: 51570 - DNA, 25 bp, Rattus norvegicus
aagtccttctgcatctgtgcctaga

SEQ ID NO: 51571 - DNA, 25 bp, Rattus norvegicus
aagtccttctgctacccgtccaaat

SEQ ID NO: 51572 - DNA, 25 bp, Rattus norvegicus
aagtccttctgcttctgtgcctaga

SEQ ID NO: 51573 - DNA, 25 bp, Rattus norvegicus
aagtccttcttgaccaagatctggt

SEQ ID NO: 51574 - DNA, 25 bp, Rattus norvegicus
aagtccttcttgatttctgacacaa

SEQ ID NO: 51575 - DNA, 25 bp, Rattus norvegicus
aagtccttcttgtccaagatctggt

SEQ ID NO: 51576 - DNA, 25 bp, Rattus norvegicus
aagtccttcttgttttctgacacaa

SEQ ID NO: 51577 - DNA, 25 bp, Rattus norvegicus
aagtccttgacacagggctggccaa

SEQ ID NO: 51578 - DNA, 25 bp, Rattus norvegicus
aagtccttgacagagggctggccaa

SEQ ID NO: 51579 - DNA, 25 bp, Rattus norvegicus
aagtccttgcatcgtgaaactccct

SEQ ID NO: 51580 - DNA, 25 bp, Rattus norvegicus
aagtccttgcatggtgaaactccct

SEQ ID NO: 51581 - DNA, 25 bp, Rattus norvegicus
aagtccttgcctcgagcgttttgac

SEQ ID NO: 51582 - DNA, 25 bp, Rattus norvegicus
aagtccttgcctggagcgttttgac

SEQ ID NO: 51583 - DNA, 25 bp, Rattus norvegicus
aagtccttggaacgtatccccagcg

SEQ ID NO: 51584 - DNA, 25 bp, Rattus norvegicus
aagtccttggaaggtatccccagcg

SEQ ID NO: 51585 - DNA, 25 bp, Rattus norvegicus
aagtccttggacaagctgtcttgga

SEQ ID NO: 51586 - DNA, 25 bp, Rattus norvegicus
aagtccttggactagctgtcttgga

SEQ ID NO: 51587 - DNA, 25 bp, Rattus norvegicus
aagtccttggagatgctggagctcg

SEQ ID NO: 51588 - DNA, 25 bp, Rattus norvegicus
aagtccttggagttgctggagctcg

SEQ ID NO: 51589 - DNA, 25 bp, Rattus norvegicus
aagtccttggccaggaggagtcaca

SEQ ID NO: 51590 - DNA, 25 bp, Rattus norvegicus
aagtccttggcctggaggagtcaca

SEQ ID NO: 51591 - DNA, 25 bp, Rattus norvegicus
aagtccttggctccaggacgcgccg

SEQ ID NO: 51592 - DNA, 25 bp, Rattus norvegicus
aagtccttggctgcaggacgcgccg

SEQ ID NO: 51593 - DNA, 25 bp, Rattus norvegicus
aagtccttgggcatctcaaatagaa

SEQ ID NO: 51594 - DNA, 25 bp, Rattus norvegicus
aagtccttgggcttctcaaatagaa

SEQ ID NO: 51595 - DNA, 25 bp, Rattus norvegicus
aagtccttggttctatgttcctgta

SEQ ID NO: 51596 - DNA, 25 bp, Rattus norvegicus
aagtccttggttgtatgttcctgta

SEQ ID NO: 51597 - DNA, 25 bp, Rattus norvegicus
aagtcctttagtcttctatatcaaa

SEQ ID NO: 51598 - DNA, 25 bp, Rattus norvegicus
aagtcctttagtgttctatatcaaa

SEQ ID NO: 51599 - DNA, 25 bp, Rattus norvegicus
aagtcctttattagccattttgtag

SEQ ID NO: 51600 - DNA, 25 bp, Rattus norvegicus
aagtcctttatttgccattttgtag

SEQ ID NO: 51601 - DNA, 25 bp, Rattus norvegicus
aagtcctttcgacggctggagagat

SEQ ID NO: 51602 - DNA, 25 bp, Rattus norvegicus
aagtcctttcgagggctggagagat

SEQ ID NO: 51603 - DNA, 25 bp, Rattus norvegicus
aagtcctttgcacgagggcaccagg

SEQ ID NO: 51604 - DNA, 25 bp, Rattus norvegicus
aagtcctttgcaggagggcaccagg

SEQ ID NO: 51605 - DNA, 25 bp, Rattus norvegicus
aagtccttttcacaggcatcagggc

SEQ ID NO: 51606 - DNA, 25 bp, Rattus norvegicus
aagtccttttcagaggcatcagggc

SEQ ID NO: 51607 - DNA, 25 bp, Rattus norvegicus
aagtcgaacaacaccaggtctccgc

SEQ ID NO: 51608 - DNA, 25 bp, Rattus norvegicus
aagtcgaacaactccaggtctccgc

SEQ ID NO: 51609 - DNA, 25 bp, Rattus norvegicus
aagtcgaacgacagggcagcgatga

SEQ ID NO: 51610 - DNA, 25 bp, Rattus norvegicus
aagtcgaacgactgggcagcgatga

SEQ ID NO: 51611 - DNA, 25 bp, Rattus norvegicus
aagtcgaacttcagagctgctccaa

SEQ ID NO: 51612 - DNA, 25 bp, Rattus norvegicus
aagtcgaacttctgagctgctccaa

SEQ ID NO: 51613 - DNA, 25 bp, Rattus norvegicus
aagtcgaattccactgggcagggct

SEQ ID NO: 51614 - DNA, 25 bp, Rattus norvegicus
aagtcgaattcctctgggcagggct

SEQ ID NO: 51615 - DNA, 25 bp, Rattus norvegicus
aagtcgacttcacgtttccatcaca

SEQ ID NO: 51616 - DNA, 25 bp, Rattus norvegicus
aagtcgacttcaggtttccatcaca

SEQ ID NO: 51617 - DNA, 25 bp, Rattus norvegicus
aagtcgagagtgatggatttcttcc

SEQ ID NO: 51618 - DNA, 25 bp, Rattus norvegicus
aagtcgagagtgttggatttcttcc

SEQ ID NO: 51619 - DNA, 25 bp, Rattus norvegicus
aagtcgagcagccattctatgcaat

SEQ ID NO: 51620 - DNA, 25 bp, Rattus norvegicus
aagtcgagcagcgattctatgcaat

SEQ ID NO: 51621 - DNA, 25 bp, Rattus norvegicus
aagtcgaggcagcaacaaccactac

SEQ ID NO: 51622 - DNA, 25 bp, Rattus norvegicus
aagtcgaggcaggaacaaccactac

SEQ ID NO: 51623 - DNA, 25 bp, Rattus norvegicus
aagtcgaggttacccttggctacat

SEQ ID NO: 51624 - DNA, 25 bp, Rattus norvegicus
aagtcgaggttagccttggctacat

SEQ ID NO: 51625 - DNA, 25 bp, Rattus norvegicus
aagtcgagtgctacagttaaggaac

SEQ ID NO: 51626 - DNA, 25 bp, Rattus norvegicus
aagtcgagtgcttcagttaaggaac

SEQ ID NO: 51627 - DNA, 25 bp, Rattus norvegicus
aagtcgagttagctcttcgtttcca

SEQ ID NO: 51628 - DNA, 25 bp, Rattus norvegicus
aagtcgagttaggtcttcgtttcca

SEQ ID NO: 51629 - DNA, 25 bp, Rattus norvegicus
aagtcgatcaatatctctcatggag

SEQ ID NO: 51630 - DNA, 25 bp, Rattus norvegicus
aagtcgatcaatttctctcatggag

SEQ ID NO: 51631 - DNA, 25 bp, Rattus norvegicus
aagtcgatcccacccatactgttgg

SEQ ID NO: 51632 - DNA, 25 bp, Rattus norvegicus
aagtcgatcccagccatactgttgg

SEQ ID NO: 51633 - DNA, 25 bp, Rattus norvegicus
aagtcgatcgtgagcagcggtacca

SEQ ID NO: 51634 - DNA, 25 bp, Rattus norvegicus
aagtcgatcgtgtgcagcggtacca

SEQ ID NO: 51635 - DNA, 25 bp, Rattus norvegicus
aagtcgatctggaagtctggccacc

SEQ ID NO: 51636 - DNA, 25 bp, Rattus norvegicus
aagtcgatctggtagtctggccacc

SEQ ID NO: 51637 - DNA, 25 bp, Rattus norvegicus
aagtcgatgccacttctctcagctg

SEQ ID NO: 51638 - DNA, 25 bp, Rattus norvegicus
aagtcgatgccagttctctcagctg

SEQ ID NO: 51639 - DNA, 25 bp, Rattus norvegicus
aagtcgatgtgtacccacagtggat

SEQ ID NO: 51640 - DNA, 25 bp, Rattus norvegicus
aagtcgatgtgttcccacagtggat

SEQ ID NO: 51641 - DNA, 25 bp, Rattus norvegicus
aagtcgcatagtcttgcttgttcct

SEQ ID NO: 51642 - DNA, 25 bp, Rattus norvegicus
aagtcgcatagtgttgcttgttcct

SEQ ID NO: 51643 - DNA, 25 bp, Rattus norvegicus
aagtcgcatcgcacagactgagcag

SEQ ID NO: 51644 - DNA, 25 bp, Rattus norvegicus
aagtcgcatcgctcagactgagcag

SEQ ID NO: 51645 - DNA, 25 bp, Rattus norvegicus
aagtcgccagccagctcagggaagg

SEQ ID NO: 51646 - DNA, 25 bp, Rattus norvegicus
aagtcgccagcctgctcagggaagg

SEQ ID NO: 51647 - DNA, 25 bp, Rattus norvegicus
aagtcgccctcacaaaccaatgtgg

SEQ ID NO: 51648 - DNA, 25 bp, Rattus norvegicus
aagtcgccctcagaaaccaatgtgg

SEQ ID NO: 51649 - DNA, 25 bp, Rattus norvegicus
aagtcgccgtgtaaaaatttctcag

SEQ ID NO: 51650 - DNA, 25 bp, Rattus norvegicus
aagtcgccgtgttaaaatttctcag

SEQ ID NO: 51651 - DNA, 25 bp, Rattus norvegicus
aagtcgcctcagctcccttgagtag

SEQ ID NO: 51652 - DNA, 25 bp, Rattus norvegicus
aagtcgcctcaggtcccttgagtag

SEQ ID NO: 51653 - DNA, 25 bp, Rattus norvegicus
aagtcgcctctcctgttacagaaag

SEQ ID NO: 51654 - DNA, 25 bp, Rattus norvegicus
aagtcgcctctcgtgttacagaaag

SEQ ID NO: 51655 - DNA, 25 bp, Rattus norvegicus
aagtcgcgacaccaagagcacgaga

SEQ ID NO: 51656 - DNA, 25 bp, Rattus norvegicus
aagtcgcgacacgaagagcacgaga

SEQ ID NO: 51657 - DNA, 25 bp, Rattus norvegicus
aagtcgcgcgtcatcactgtctgct

SEQ ID NO: 51658 - DNA, 25 bp, Rattus norvegicus
aagtcgcgcgtcttcactgtctgct

SEQ ID NO: 51659 - DNA, 25 bp, Rattus norvegicus
aagtcgctacgacttctctcaaact

SEQ ID NO: 51660 - DNA, 25 bp, Rattus norvegicus
aagtcgctacgagttctctcaaact

SEQ ID NO: 51661 - DNA, 25 bp, Rattus norvegicus
aagtcgctccgtacagttactagta

SEQ ID NO: 51662 - DNA, 25 bp, Rattus norvegicus
aagtcgctccgttcagttactagta

SEQ ID NO: 51663 - DNA, 25 bp, Rattus norvegicus
aagtcgctgcctctaagagtgttcc

SEQ ID NO: 51664 - DNA, 25 bp, Rattus norvegicus
aagtcgctgcctgtaagagtgttcc

SEQ ID NO: 51665 - DNA, 25 bp, Rattus norvegicus
aagtcgctggacacattttttcctc

SEQ ID NO: 51666 - DNA, 25 bp, Rattus norvegicus
aagtcgctggactcattttttcctc

SEQ ID NO: 51667 - DNA, 25 bp, Rattus norvegicus
aagtcgctggccatcatcgtgagca

SEQ ID NO: 51668 - DNA, 25 bp, Rattus norvegicus
aagtcgctggccttcatcgtgagca

SEQ ID NO: 51669 - DNA, 25 bp, Rattus norvegicus
aagtcgctggtaaacattctgtaca

SEQ ID NO: 51670 - DNA, 25 bp, Rattus norvegicus
aagtcgctggtatacattctgtaca

SEQ ID NO: 51671 - DNA, 25 bp, Rattus norvegicus
aagtcggaagctcagccagtgcctt

SEQ ID NO: 51672 - DNA, 25 bp, Rattus norvegicus
aagtcggaagctgagccagtgcctt

SEQ ID NO: 51673 - DNA, 25 bp, Rattus norvegicus
aagtcggaggtgagccttacttact

SEQ ID NO: 51674 - DNA, 25 bp, Rattus norvegicus
aagtcggaggtgtgccttacttact

SEQ ID NO: 51675 - DNA, 25 bp, Rattus norvegicus
aagtcggcctgaatgaacttttatc

SEQ ID NO: 51676 - DNA, 25 bp, Rattus norvegicus
aagtcggcctgattgaacttttatc

SEQ ID NO: 51677 - DNA, 25 bp, Rattus norvegicus
aagtcggccttactttgttcgcagc

SEQ ID NO: 51678 - DNA, 25 bp, Rattus norvegicus
aagtcggccttagtttgttcgcagc

SEQ ID NO: 51679 - DNA, 25 bp, Rattus norvegicus
aagtcggcgcggcactcgcctcgaa

SEQ ID NO: 51680 - DNA, 25 bp, Rattus norvegicus
aagtcggcgcgggactcgcctcgaa

SEQ ID NO: 51681 - DNA, 25 bp, Rattus norvegicus
aagtcggctgccagtcaagtggaca

SEQ ID NO: 51682 - DNA, 25 bp, Rattus norvegicus
aagtcggctgcctgtcaagtggaca

SEQ ID NO: 51683 - DNA, 25 bp, Rattus norvegicus
aagtcgggtgagattatggcattga

SEQ ID NO: 51684 - DNA, 25 bp, Rattus norvegicus
aagtcgggtgagtttatggcattga

SEQ ID NO: 51685 - DNA, 25 bp, Rattus norvegicus
aagtcggtcaggaagctacgcctca

SEQ ID NO: 51686 - DNA, 25 bp, Rattus norvegicus
aagtcggtcaggtagctacgcctca

SEQ ID NO: 51687 - DNA, 25 bp, Rattus norvegicus
aagtcggtcagtactaacggtgcag

SEQ ID NO: 51688 - DNA, 25 bp, Rattus norvegicus
aagtcggtcagttctaacggtgcag

SEQ ID NO: 51689 - DNA, 25 bp, Rattus norvegicus
aagtcggtgaatacttcctgaggtt

SEQ ID NO: 51690 - DNA, 25 bp, Rattus norvegicus
aagtcggtgaattcttcctgaggtt

SEQ ID NO: 51691 - DNA, 25 bp, Rattus norvegicus
aagtcggtgcagcactgacttgtcc

SEQ ID NO: 51692 - DNA, 25 bp, Rattus norvegicus
aagtcggtgcaggactgacttgtcc

SEQ ID NO: 51693 - DNA, 25 bp, Rattus norvegicus
aagtcggtgttgatctggagtctct

SEQ ID NO: 51694 - DNA, 25 bp, Rattus norvegicus
aagtcggtgttgttctggagtctct

SEQ ID NO: 51695 - DNA, 25 bp, Rattus norvegicus
aagtcgtagcttccatgtgtgccaa

SEQ ID NO: 51696 - DNA, 25 bp, Rattus norvegicus
aagtcgtagcttgcatgtgtgccaa

SEQ ID NO: 51697 - DNA, 25 bp, Rattus norvegicus
aagtcgtcacttaccagctgttgct

SEQ ID NO: 51698 - DNA, 25 bp, Rattus norvegicus
aagtcgtcactttccagctgttgct

SEQ ID NO: 51699 - DNA, 25 bp, Rattus norvegicus
aagtcgtccaagcaggccagctgaa

SEQ ID NO: 51700 - DNA, 25 bp, Rattus norvegicus
aagtcgtccaaggaggccagctgaa

SEQ ID NO: 51701 - DNA, 25 bp, Rattus norvegicus
aagtcgtcccgcagttcggctgtgc

SEQ ID NO: 51702 - DNA, 25 bp, Rattus norvegicus
aagtcgtcccgctgttcggctgtgc

SEQ ID NO: 51703 - DNA, 25 bp, Rattus norvegicus
aagtcgtcctcacatgccagcaaag

SEQ ID NO: 51704 - DNA, 25 bp, Rattus norvegicus
aagtcgtcctcagatgccagcaaag

SEQ ID NO: 51705 - DNA, 25 bp, Rattus norvegicus
aagtcgtcctctaaacaacttgcaa

SEQ ID NO: 51706 - DNA, 25 bp, Rattus norvegicus
aagtcgtcctcttaacaacttgcaa

SEQ ID NO: 51707 - DNA, 25 bp, Rattus norvegicus
aagtcgtcctttctgtgtcctgtgt

SEQ ID NO: 51708 - DNA, 25 bp, Rattus norvegicus
aagtcgtcctttgtgtgtcctgtgt

SEQ ID NO: 51709 - DNA, 25 bp, Rattus norvegicus
aagtcgtcgctgcacaaatattgtt

SEQ ID NO: 51710 - DNA, 25 bp, Rattus norvegicus
aagtcgtcgctggacaaatattgtt

SEQ ID NO: 51711 - DNA, 25 bp, Rattus norvegicus
aagtcgtctcatataaaagctcacc

SEQ ID NO: 51712 - DNA, 25 bp, Rattus norvegicus
aagtcgtctcatttaaaagctcacc

SEQ ID NO: 51713 - DNA, 25 bp, Rattus norvegicus
aagtcgtgactcaccttctcatatc

SEQ ID NO: 51714 - DNA, 25 bp, Rattus norvegicus
aagtcgtgactctccttctcatatc

SEQ ID NO: 51715 - DNA, 25 bp, Rattus norvegicus
aagtcgtgatggagtcagcagcccc

SEQ ID NO: 51716 - DNA, 25 bp, Rattus norvegicus
aagtcgtgatggtgtcagcagcccc

SEQ ID NO: 51717 - DNA, 25 bp, Rattus norvegicus
aagtcgtgcaccagcccggactcga

SEQ ID NO: 51718 - DNA, 25 bp, Rattus norvegicus
aagtcgtgcacctgcccggactcga

SEQ ID NO: 51719 - DNA, 25 bp, Rattus norvegicus
aagtcgtggacaccagttctgccga

SEQ ID NO: 51720 - DNA, 25 bp, Rattus norvegicus
aagtcgtggacagcagttctgccga

SEQ ID NO: 51721 - DNA, 25 bp, Rattus norvegicus
aagtcgtggctacctcgggtttgcc

SEQ ID NO: 51722 - DNA, 25 bp, Rattus norvegicus
aagtcgtggctagctcgggtttgcc

SEQ ID NO: 51723 - DNA, 25 bp, Rattus norvegicus
aagtcgtgtattctgttttatagtg

SEQ ID NO: 51724 - DNA, 25 bp, Rattus norvegicus
aagtcgtgtattgtgttttatagtg

SEQ ID NO: 51725 - DNA, 25 bp, Rattus norvegicus
aagtcgttctttcacctcacatgta

SEQ ID NO: 51726 - DNA, 25 bp, Rattus norvegicus
aagtcgttctttgacctcacatgta

SEQ ID NO: 51727 - DNA, 25 bp, Rattus norvegicus
aagtcgttggctcctgtattaacac

SEQ ID NO: 51728 - DNA, 25 bp, Rattus norvegicus
aagtcgttggctgctgtattaacac

SEQ ID NO: 51729 - DNA, 25 bp, Rattus norvegicus
aagtcgttttaaactgtcatgtcag

SEQ ID NO: 51730 - DNA, 25 bp, Rattus norvegicus
aagtcgttttaatctgtcatgtcag

SEQ ID NO: 51731 - DNA, 25 bp, Rattus norvegicus
aagtctaactgcactgttactaaag

SEQ ID NO: 51732 - DNA, 25 bp, Rattus norvegicus
aagtctaactgctctgttactaaag

SEQ ID NO: 51733 - DNA, 25 bp, Rattus norvegicus
aagtctaagtccaggtacaagagaa

SEQ ID NO: 51734 - DNA, 25 bp, Rattus norvegicus
aagtctaagtcctggtacaagagaa

SEQ ID NO: 51735 - DNA, 25 bp, Rattus norvegicus
aagtctaatcctatattgctagtca

SEQ ID NO: 51736 - DNA, 25 bp, Rattus norvegicus
aagtctaatcctttattgctagtca

SEQ ID NO: 51737 - DNA, 25 bp, Rattus norvegicus
aagtctacaagtaagcggccagcct

SEQ ID NO: 51738 - DNA, 25 bp, Rattus norvegicus
aagtctacaagttagcggccagcct

SEQ ID NO: 51739 - DNA, 25 bp, Rattus norvegicus
aagtctacagtcaaggtcctgccct

SEQ ID NO: 51740 - DNA, 25 bp, Rattus norvegicus
aagtctacagtctaggtcctgccct

SEQ ID NO: 51741 - DNA, 25 bp, Rattus norvegicus
aagtctacataaagcccaagcctgc

SEQ ID NO: 51742 - DNA, 25 bp, Rattus norvegicus
aagtctacataatgcccaagcctgc

SEQ ID NO: 51743 - DNA, 25 bp, Rattus norvegicus
aagtctaccagcatgttcctctgtt

SEQ ID NO: 51744 - DNA, 25 bp, Rattus norvegicus
aagtctaccagcttgttcctctgtt

SEQ ID NO: 51745 - DNA, 25 bp, Rattus norvegicus
aagtctacccaaagacagctgtgtc

SEQ ID NO: 51746 - DNA, 25 bp, Rattus norvegicus
aagtctacccaatgacagctgtgtc

SEQ ID NO: 51747 - DNA, 25 bp, Rattus norvegicus
aagtctaccttgctctgagggttga

SEQ ID NO: 51748 - DNA, 25 bp, Rattus norvegicus
aagtctaccttggtctgagggttga

SEQ ID NO: 51749 - DNA, 25 bp, Rattus norvegicus
aagtctacgccgaaggaccacgacg

SEQ ID NO: 51750 - DNA, 25 bp, Rattus norvegicus
aagtctacgccgtaggaccacgacg

SEQ ID NO: 51751 - DNA, 25 bp, Rattus norvegicus
aagtctacgtatatcccagtacaga

SEQ ID NO: 51752 - DNA, 25 bp, Rattus norvegicus
aagtctacgtatttcccagtacaga

SEQ ID NO: 51753 - DNA, 25 bp, Rattus norvegicus
aagtctactaacagagggcccacct

SEQ ID NO: 51754 - DNA, 25 bp, Rattus norvegicus
aagtctactaactgagggcccacct

SEQ ID NO: 51755 - DNA, 25 bp, Rattus norvegicus
aagtctactcccaaaagtcagccat

SEQ ID NO: 51756 - DNA, 25 bp, Rattus norvegicus
aagtctactccctaaagtcagccat

SEQ ID NO: 51757 - DNA, 25 bp, Rattus norvegicus
aagtctactgatcttcctgctggtt

SEQ ID NO: 51758 - DNA, 25 bp, Rattus norvegicus
aagtctactgatgttcctgctggtt

SEQ ID NO: 51759 - DNA, 25 bp, Rattus norvegicus
aagtctacttgcattgcatgcagcc

SEQ ID NO: 51760 - DNA, 25 bp, Rattus norvegicus
aagtctacttgctttgcatgcagcc

SEQ ID NO: 51761 - DNA, 25 bp, Rattus norvegicus
aagtctagaaatccctcagttgtct

SEQ ID NO: 51762 - DNA, 25 bp, Rattus norvegicus
aagtctagaaatgcctcagttgtct

SEQ ID NO: 51763 - DNA, 25 bp, Rattus norvegicus
aagtctagactaagggacttcgaca

SEQ ID NO: 51764 - DNA, 25 bp, Rattus norvegicus
aagtctagactatgggacttcgaca

SEQ ID NO: 51765 - DNA, 25 bp, Rattus norvegicus
aagtctagcacacaacacttggcta

SEQ ID NO: 51766 - DNA, 25 bp, Rattus norvegicus
aagtctagcacagaacacttggcta

SEQ ID NO: 51767 - DNA, 25 bp, Rattus norvegicus
aagtctagctatcaccagtgagttt

SEQ ID NO: 51768 - DNA, 25 bp, Rattus norvegicus
aagtctagctatgaccagtgagttt

SEQ ID NO: 51769 - DNA, 25 bp, Rattus norvegicus
aagtctagtcaccttcagatgggca

SEQ ID NO: 51770 - DNA, 25 bp, Rattus norvegicus
aagtctagtcacgttcagatgggca

SEQ ID NO: 51771 - DNA, 25 bp, Rattus norvegicus
aagtctagtccactttaaatgtcaa

SEQ ID NO: 51772 - DNA, 25 bp, Rattus norvegicus
aagtctagtccagtttaaatgtcaa

SEQ ID NO: 51773 - DNA, 25 bp, Rattus norvegicus
aagtctagtgctactttgggtcatt

SEQ ID NO: 51774 - DNA, 25 bp, Rattus norvegicus
aagtctagtgcttctttgggtcatt

SEQ ID NO: 51775 - DNA, 25 bp, Rattus norvegicus
aagtctagtgttccatgcagtggtg

SEQ ID NO: 51776 - DNA, 25 bp, Rattus norvegicus
aagtctagtgttgcatgcagtggtg

SEQ ID NO: 51777 - DNA, 25 bp, Rattus norvegicus
aagtctagttcccaagccctcacat

SEQ ID NO: 51778 - DNA, 25 bp, Rattus norvegicus
aagtctagttccgaagccctcacat

SEQ ID NO: 51779 - DNA, 25 bp, Rattus norvegicus
aagtctagttctctacatgcagtta

SEQ ID NO: 51780 - DNA, 25 bp, Rattus norvegicus
aagtctagttctgtacatgcagtta

SEQ ID NO: 51781 - DNA, 25 bp, Rattus norvegicus
aagtctagttgtcaagagcctctgt

SEQ ID NO: 51782 - DNA, 25 bp, Rattus norvegicus
aagtctagttgtgaagagcctctgt

SEQ ID NO: 51783 - DNA, 25 bp, Rattus norvegicus
aagtctataagaagcccggtgggtc

SEQ ID NO: 51784 - DNA, 25 bp, Rattus norvegicus
aagtctataagatgcccggtgggtc

SEQ ID NO: 51785 - DNA, 25 bp, Rattus norvegicus
aagtctatagacagtagtacaggca

SEQ ID NO: 51786 - DNA, 25 bp, Rattus norvegicus
aagtctatagactgtagtacaggca

SEQ ID NO: 51787 - DNA, 25 bp, Rattus norvegicus
aagtctatgatgacttcaggatgca

SEQ ID NO: 51788 - DNA, 25 bp, Rattus norvegicus
aagtctatgatgtcttcaggatgca

SEQ ID NO: 51789 - DNA, 25 bp, Rattus norvegicus
aagtctatgcttaacacgtgatttt

SEQ ID NO: 51790 - DNA, 25 bp, Rattus norvegicus
aagtctatgctttacacgtgatttt

SEQ ID NO: 51791 - DNA, 25 bp, Rattus norvegicus
aagtctattatcagggacacgccct

SEQ ID NO: 51792 - DNA, 25 bp, Rattus norvegicus
aagtctattatctgggacacgccct

SEQ ID NO: 51793 - DNA, 25 bp, Rattus norvegicus
aagtctattcacagtgtcttcctca

SEQ ID NO: 51794 - DNA, 25 bp, Rattus norvegicus
aagtctattcactgtgtcttcctca

SEQ ID NO: 51795 - DNA, 25 bp, Rattus norvegicus
aagtctattgttcgacaggcataca

SEQ ID NO: 51796 - DNA, 25 bp, Rattus norvegicus
aagtctattgttggacaggcataca

SEQ ID NO: 51797 - DNA, 25 bp, Rattus norvegicus
aagtctcaatgtcttctccagaggc

SEQ ID NO: 51798 - DNA, 25 bp, Rattus norvegicus
aagtctcaatgtgttctccagaggc

SEQ ID NO: 51799 - DNA, 25 bp, Rattus norvegicus
aagtctcactatctaagccccagct

SEQ ID NO: 51800 - DNA, 25 bp, Rattus norvegicus
aagtctcactatgtaagccccagct

SEQ ID NO: 51801 - DNA, 25 bp, Rattus norvegicus
aagtctcactttccagggacctgaa

SEQ ID NO: 51802 - DNA, 25 bp, Rattus norvegicus
aagtctcactttgcagggacctgaa

SEQ ID NO: 51803 - DNA, 25 bp, Rattus norvegicus
aagtctcagaagctggatccccaga

SEQ ID NO: 51804 - DNA, 25 bp, Rattus norvegicus
aagtctcagaaggtggatccccaga

SEQ ID NO: 51805 - DNA, 25 bp, Rattus norvegicus
aagtctcagactctctcgggagggt

SEQ ID NO: 51806 - DNA, 25 bp, Rattus norvegicus
aagtctcagactgtctcgggagggt

SEQ ID NO: 51807 - DNA, 25 bp, Rattus norvegicus
aagtctcagcttcactgtctgctga

SEQ ID NO: 51808 - DNA, 25 bp, Rattus norvegicus
aagtctcagcttgactgtctgctga

SEQ ID NO: 51809 - DNA, 25 bp, Rattus norvegicus
aagtctcagggtagtgagcaagtaa

SEQ ID NO: 51810 - DNA, 25 bp, Rattus norvegicus
aagtctcagggttgtgagcaagtaa

SEQ ID NO: 51811 - DNA, 25 bp, Rattus norvegicus
aagtctcagtgtatgtagccctttg

SEQ ID NO: 51812 - DNA, 25 bp, Rattus norvegicus
aagtctcagtgtttgtagccctttg

SEQ ID NO: 51813 - DNA, 25 bp, Rattus norvegicus
aagtctcagttcaccttcagtttca

SEQ ID NO: 51814 - DNA, 25 bp, Rattus norvegicus
aagtctcagttctccttcagtttca

SEQ ID NO: 51815 - DNA, 25 bp, Rattus norvegicus
aagtctcatcgcatgtccattgtaa

SEQ ID NO: 51816 - DNA, 25 bp, Rattus norvegicus
aagtctcatcgccataactgggatc

SEQ ID NO: 51817 - DNA, 25 bp, Rattus norvegicus
aagtctcatcgcgataactgggatc

SEQ ID NO: 51818 - DNA, 25 bp, Rattus norvegicus
aagtctcatcgcttgtccattgtaa

SEQ ID NO: 51819 - DNA, 25 bp, Rattus norvegicus
aagtctcatgagacacctttgtctt

SEQ ID NO: 51820 - DNA, 25 bp, Rattus norvegicus
aagtctcatgagctgtatctgccgg

SEQ ID NO: 51821 - DNA, 25 bp, Rattus norvegicus
aagtctcatgaggtgtatctgccgg

SEQ ID NO: 51822 - DNA, 25 bp, Rattus norvegicus
aagtctcatgagtcacctttgtctt

SEQ ID NO: 51823 - DNA, 25 bp, Rattus norvegicus
aagtctcatgtcaagagccgccgct

SEQ ID NO: 51824 - DNA, 25 bp, Rattus norvegicus
aagtctcatgtctagagccgccgct

SEQ ID NO: 51825 - DNA, 25 bp, Rattus norvegicus
aagtctcattcaattcccaggcctt

SEQ ID NO: 51826 - DNA, 25 bp, Rattus norvegicus
aagtctcattcatttcccaggcctt

SEQ ID NO: 51827 - DNA, 25 bp, Rattus norvegicus
aagtctccaaatacaagtgtttcaa

SEQ ID NO: 51828 - DNA, 25 bp, Rattus norvegicus
aagtctccaaattcaagtgtttcaa

SEQ ID NO: 51829 - DNA, 25 bp, Rattus norvegicus
aagtctccagggaccgttggcacca

SEQ ID NO: 51830 - DNA, 25 bp, Rattus norvegicus
aagtctccagggtccgttggcacca

SEQ ID NO: 51831 - DNA, 25 bp, Rattus norvegicus
aagtctccatttaaatgccttgtgg

SEQ ID NO: 51832 - DNA, 25 bp, Rattus norvegicus
aagtctccattttaatgccttgtgg

SEQ ID NO: 51833 - DNA, 25 bp, Rattus norvegicus
aagtctccccaaatcaggtcaacct

SEQ ID NO: 51834 - DNA, 25 bp, Rattus norvegicus
aagtctccccaacgctgtgtggtgg

SEQ ID NO: 51835 - DNA, 25 bp, Rattus norvegicus
aagtctccccaaggctgtgtggtgg

SEQ ID NO: 51836 - DNA, 25 bp, Rattus norvegicus
aagtctccccaattcaggtcaacct

SEQ ID NO: 51837 - DNA, 25 bp, Rattus norvegicus
aagtctccccagaactgtgccagga

SEQ ID NO: 51838 - DNA, 25 bp, Rattus norvegicus
aagtctccccagtactgtgccagga

SEQ ID NO: 51839 - DNA, 25 bp, Rattus norvegicus
aagtctccctcgagctccgggattt

SEQ ID NO: 51840 - DNA, 25 bp, Rattus norvegicus
aagtctccctcgtgctccgggattt

SEQ ID NO: 51841 - DNA, 25 bp, Rattus norvegicus
aagtctccctgtactgacatgttct

SEQ ID NO: 51842 - DNA, 25 bp, Rattus norvegicus
aagtctccctgttctgacatgttct

SEQ ID NO: 51843 - DNA, 25 bp, Rattus norvegicus
aagtctcccttcaggtgttggatca

SEQ ID NO: 51844 - DNA, 25 bp, Rattus norvegicus
aagtctcccttccatggttttagca

SEQ ID NO: 51845 - DNA, 25 bp, Rattus norvegicus
aagtctcccttcgatggttttagca

SEQ ID NO: 51846 - DNA, 25 bp, Rattus norvegicus
aagtctcccttctggtgttggatca

SEQ ID NO: 51847 - DNA, 25 bp, Rattus norvegicus
aagtctccgctcatagtcattacag

SEQ ID NO: 51848 - DNA, 25 bp, Rattus norvegicus
aagtctccgctcttagtcattacag

SEQ ID NO: 51849 - DNA, 25 bp, Rattus norvegicus
aagtctccgggaaatggccgagcgc

SEQ ID NO: 51850 - DNA, 25 bp, Rattus norvegicus
aagtctccgggaacagctctaacat

SEQ ID NO: 51851 - DNA, 25 bp, Rattus norvegicus
aagtctccgggatatggccgagcgc

SEQ ID NO: 51852 - DNA, 25 bp, Rattus norvegicus
aagtctccgggatcagctctaacat

SEQ ID NO: 51853 - DNA, 25 bp, Rattus norvegicus
aagtctcctcaaaagtgtcgctggc

SEQ ID NO: 51854 - DNA, 25 bp, Rattus norvegicus
aagtctcctcaatagtgtcgctggc

SEQ ID NO: 51855 - DNA, 25 bp, Rattus norvegicus
aagtctcctctacaacaccattttg

SEQ ID NO: 51856 - DNA, 25 bp, Rattus norvegicus
aagtctcctctagaacaccattttg

SEQ ID NO: 51857 - DNA, 25 bp, Rattus norvegicus
aagtctcctggccagaggatgatgt

SEQ ID NO: 51858 - DNA, 25 bp, Rattus norvegicus
aagtctcctggcgagaggatgatgt

SEQ ID NO: 51859 - DNA, 25 bp, Rattus norvegicus
aagtctccttatcaggaattcactg

SEQ ID NO: 51860 - DNA, 25 bp, Rattus norvegicus
aagtctccttatgaggaattcactg

SEQ ID NO: 51861 - DNA, 25 bp, Rattus norvegicus
aagtctccttccaagcacaacaagg

SEQ ID NO: 51862 - DNA, 25 bp, Rattus norvegicus
aagtctccttcctagcacaacaagg

SEQ ID NO: 51863 - DNA, 25 bp, Rattus norvegicus
aagtctcctttaatgcctgcctctg

SEQ ID NO: 51864 - DNA, 25 bp, Rattus norvegicus
aagtctcctttattgcctgcctctg

SEQ ID NO: 51865 - DNA, 25 bp, Rattus norvegicus
aagtctcgaagtctaatctgctgcg

SEQ ID NO: 51866 - DNA, 25 bp, Rattus norvegicus
aagtctcgaagtgtaatctgctgcg

SEQ ID NO: 51867 - DNA, 25 bp, Rattus norvegicus
aagtctcgaggaatagatttgttta

SEQ ID NO: 51868 - DNA, 25 bp, Rattus norvegicus
aagtctcgaggattagatttgttta

SEQ ID NO: 51869 - DNA, 25 bp, Rattus norvegicus
aagtctcgcgatccggtagccggct

SEQ ID NO: 51870 - DNA, 25 bp, Rattus norvegicus
aagtctcgcgatgcggtagccggct

SEQ ID NO: 51871 - DNA, 25 bp, Rattus norvegicus
aagtctcgctcactaaactctctag

SEQ ID NO: 51872 - DNA, 25 bp, Rattus norvegicus
aagtctcgctcagtaaactctctag

SEQ ID NO: 51873 - DNA, 25 bp, Rattus norvegicus
aagtctcgcttcaaccactttttct

SEQ ID NO: 51874 - DNA, 25 bp, Rattus norvegicus
aagtctcgcttctaccactttttct

SEQ ID NO: 51875 - DNA, 25 bp, Rattus norvegicus
aagtctcgcttgagcttcgggcagg

SEQ ID NO: 51876 - DNA, 25 bp, Rattus norvegicus
aagtctcgcttgtgcttcgggcagg

SEQ ID NO: 51877 - DNA, 25 bp, Rattus norvegicus
aagtctcggaggacccagtctgcag

SEQ ID NO: 51878 - DNA, 25 bp, Rattus norvegicus
aagtctcggaggtcccagtctgcag

SEQ ID NO: 51879 - DNA, 25 bp, Rattus norvegicus
aagtctcggataagtttgcgttcat

SEQ ID NO: 51880 - DNA, 25 bp, Rattus norvegicus
aagtctcggatatgtttgcgttcat

SEQ ID NO: 51881 - DNA, 25 bp, Rattus norvegicus
aagtctcgggaaacaaacgcatcaa

SEQ ID NO: 51882 - DNA, 25 bp, Rattus norvegicus
aagtctcgggaatcaaacgcatcaa

SEQ ID NO: 51883 - DNA, 25 bp, Rattus norvegicus
aagtctcgtagtcttatgttctagt

SEQ ID NO: 51884 - DNA, 25 bp, Rattus norvegicus
aagtctcgtagtgttatgttctagt

SEQ ID NO: 51885 - DNA, 25 bp, Rattus norvegicus
aagtctctaagtcctcgggagacct

SEQ ID NO: 51886 - DNA, 25 bp, Rattus norvegicus
aagtctctaagtgctcgggagacct

SEQ ID NO: 51887 - DNA, 25 bp, Rattus norvegicus
aagtctctactcctttgtttgtcca

SEQ ID NO: 51888 - DNA, 25 bp, Rattus norvegicus
aagtctctactcgtttgtttgtcca

SEQ ID NO: 51889 - DNA, 25 bp, Rattus norvegicus
aagtctctagttctcacaaacatag

SEQ ID NO: 51890 - DNA, 25 bp, Rattus norvegicus
aagtctctagttgtcacaaacatag

SEQ ID NO: 51891 - DNA, 25 bp, Rattus norvegicus
aagtctctatttatgtgggcaggtc

SEQ ID NO: 51892 - DNA, 25 bp, Rattus norvegicus
aagtctctatttttgtgggcaggtc

SEQ ID NO: 51893 - DNA, 25 bp, Rattus norvegicus
aagtctctcaaaacacaagtagctg

SEQ ID NO: 51894 - DNA, 25 bp, Rattus norvegicus
aagtctctcaaatcacaagtagctg

SEQ ID NO: 51895 - DNA, 25 bp, Rattus norvegicus
aagtctctctagctgcaaggctgtg

SEQ ID NO: 51896 - DNA, 25 bp, Rattus norvegicus
aagtctctctaggtgcaaggctgtg

SEQ ID NO: 51897 - DNA, 25 bp, Rattus norvegicus
aagtctctgaagctgatgggatcca

SEQ ID NO: 51898 - DNA, 25 bp, Rattus norvegicus
aagtctctgaaggtgatgggatcca

SEQ ID NO: 51899 - DNA, 25 bp, Rattus norvegicus
aagtctctgaccatcaagtctagta

SEQ ID NO: 51900 - DNA, 25 bp, Rattus norvegicus
aagtctctgacccaaccaagctaag

SEQ ID NO: 51901 - DNA, 25 bp, Rattus norvegicus
aagtctctgaccgaaccaagctaag

SEQ ID NO: 51902 - DNA, 25 bp, Rattus norvegicus
aagtctctgaccttcaagtctagta

SEQ ID NO: 51903 - DNA, 25 bp, Rattus norvegicus
aagtctctgagccacaccatcgaga

SEQ ID NO: 51904 - DNA, 25 bp, Rattus norvegicus
aagtctctgagcgacaccatcgaga

SEQ ID NO: 51905 - DNA, 25 bp, Rattus norvegicus
aagtctctgagtatcgtgtcagcct

SEQ ID NO: 51906 - DNA, 25 bp, Rattus norvegicus
aagtctctgagtttcgtgtcagcct

SEQ ID NO: 51907 - DNA, 25 bp, Rattus norvegicus
aagtctctgatcaccttctcggaat

SEQ ID NO: 51908 - DNA, 25 bp, Rattus norvegicus
aagtctctgatctccttctcggaat

SEQ ID NO: 51909 - DNA, 25 bp, Rattus norvegicus
aagtctctgattcacaagcctgttc

SEQ ID NO: 51910 - DNA, 25 bp, Rattus norvegicus
aagtctctgattgacaagcctgttc

SEQ ID NO: 51911 - DNA, 25 bp, Rattus norvegicus
aagtctctgcagctcaaagcagccc

SEQ ID NO: 51912 - DNA, 25 bp, Rattus norvegicus
aagtctctgcaggtcaaagcagccc

SEQ ID NO: 51913 - DNA, 25 bp, Rattus norvegicus
aagtctctgcatagtctgttggtgt

SEQ ID NO: 51914 - DNA, 25 bp, Rattus norvegicus
aagtctctgcattgtctgttggtgt

SEQ ID NO: 51915 - DNA, 25 bp, Rattus norvegicus
aagtctctgcttccttttcagtttc

SEQ ID NO: 51916 - DNA, 25 bp, Rattus norvegicus
aagtctctgcttgcttttcagtttc

SEQ ID NO: 51917 - DNA, 25 bp, Rattus norvegicus
aagtctctggccaggaaagggatcc

SEQ ID NO: 51918 - DNA, 25 bp, Rattus norvegicus
aagtctctggcctggaaagggatcc

SEQ ID NO: 51919 - DNA, 25 bp, Rattus norvegicus
aagtctctgtacatggctacacaca

SEQ ID NO: 51920 - DNA, 25 bp, Rattus norvegicus
aagtctctgtacttggctacacaca

SEQ ID NO: 51921 - DNA, 25 bp, Rattus norvegicus
aagtctctgtccactgagatgtatg

SEQ ID NO: 51922 - DNA, 25 bp, Rattus norvegicus
aagtctctgtcctctgagatgtatg

SEQ ID NO: 51923 - DNA, 25 bp, Rattus norvegicus
aagtctcttaatcgtctctgacaca

SEQ ID NO: 51924 - DNA, 25 bp, Rattus norvegicus
aagtctcttaatggtctctgacaca

SEQ ID NO: 51925 - DNA, 25 bp, Rattus norvegicus
aagtctcttcacataacctgtggtt

SEQ ID NO: 51926 - DNA, 25 bp, Rattus norvegicus
aagtctcttcacttaacctgtggtt

SEQ ID NO: 51927 - DNA, 25 bp, Rattus norvegicus
aagtctcttctgaggctcactgtaa

SEQ ID NO: 51928 - DNA, 25 bp, Rattus norvegicus
aagtctcttctgtggctcactgtaa

SEQ ID NO: 51929 - DNA, 25 bp, Rattus norvegicus
aagtctcttgctattccttgtggaa

SEQ ID NO: 51930 - DNA, 25 bp, Rattus norvegicus
aagtctcttgcttttccttgtggaa

SEQ ID NO: 51931 - DNA, 25 bp, Rattus norvegicus
aagtctcttgtgaatcctcagttcc

SEQ ID NO: 51932 - DNA, 25 bp, Rattus norvegicus
aagtctcttgtgtatcctcagttcc

SEQ ID NO: 51933 - DNA, 25 bp, Rattus norvegicus
aagtctctttatcaggtgcccagcc

SEQ ID NO: 51934 - DNA, 25 bp, Rattus norvegicus
aagtctctttatgaggtgcccagcc

SEQ ID NO: 51935 - DNA, 25 bp, Rattus norvegicus
aagtctctttttccacatttcctgt

SEQ ID NO: 51936 - DNA, 25 bp, Rattus norvegicus
aagtctctttttgcacatttcctgt

SEQ ID NO: 51937 - DNA, 25 bp, Rattus norvegicus
aagtctgaaaccacagccatgagga

SEQ ID NO: 51938 - DNA, 25 bp, Rattus norvegicus
aagtctgaaacctcagccatgagga

SEQ ID NO: 51939 - DNA, 25 bp, Rattus norvegicus
aagtctgaacaaccatgaatcccaa

SEQ ID NO: 51940 - DNA, 25 bp, Rattus norvegicus
aagtctgaacaagcatgaatcccaa

SEQ ID NO: 51941 - DNA, 25 bp, Rattus norvegicus
aagtctgaaggcctcaaagccctga

SEQ ID NO: 51942 - DNA, 25 bp, Rattus norvegicus
aagtctgaaggcgtcaaagccctga

SEQ ID NO: 51943 - DNA, 25 bp, Rattus norvegicus
aagtctgaatcacctggcttttcca

SEQ ID NO: 51944 - DNA, 25 bp, Rattus norvegicus
aagtctgaatcagctggcttttcca

SEQ ID NO: 51945 - DNA, 25 bp, Rattus norvegicus
aagtctgacagccagttggtctgca

SEQ ID NO: 51946 - DNA, 25 bp, Rattus norvegicus
aagtctgacagcgagttggtctgca

SEQ ID NO: 51947 - DNA, 25 bp, Rattus norvegicus
aagtctgacgacctttgttcaatcc

SEQ ID NO: 51948 - DNA, 25 bp, Rattus norvegicus
aagtctgacgacgtttgttcaatcc

SEQ ID NO: 51949 - DNA, 25 bp, Rattus norvegicus
aagtctgacgccaactgcgaggcag

SEQ ID NO: 51950 - DNA, 25 bp, Rattus norvegicus
aagtctgacgcctactgcgaggcag

SEQ ID NO: 51951 - DNA, 25 bp, Rattus norvegicus
aagtctgactcgcacatatcccaga

SEQ ID NO: 51952 - DNA, 25 bp, Rattus norvegicus
aagtctgactcggacatatcccaga

SEQ ID NO: 51953 - DNA, 25 bp, Rattus norvegicus
aagtctgactttagtttgccacgga

SEQ ID NO: 51954 - DNA, 25 bp, Rattus norvegicus
aagtctgacttttgtttgccacgga

SEQ ID NO: 51955 - DNA, 25 bp, Rattus norvegicus
aagtctgagactctcgatgccactt

SEQ ID NO: 51956 - DNA, 25 bp, Rattus norvegicus
aagtctgagactgtcgatgccactt

SEQ ID NO: 51957 - DNA, 25 bp, Rattus norvegicus
aagtctgagagtattttcctcctcc

SEQ ID NO: 51958 - DNA, 25 bp, Rattus norvegicus
aagtctgagagttttttcctcctcc

SEQ ID NO: 51959 - DNA, 25 bp, Rattus norvegicus
aagtctgaggacctgagtactctcc

SEQ ID NO: 51960 - DNA, 25 bp, Rattus norvegicus
aagtctgaggacgtgagtactctcc

SEQ ID NO: 51961 - DNA, 25 bp, Rattus norvegicus
aagtctgaggctagccgtctggaca

SEQ ID NO: 51962 - DNA, 25 bp, Rattus norvegicus
aagtctgaggcttgccgtctggaca

SEQ ID NO: 51963 - DNA, 25 bp, Rattus norvegicus
aagtctgagtggatctcttgagctg

SEQ ID NO: 51964 - DNA, 25 bp, Rattus norvegicus
aagtctgagtggttctcttgagctg

SEQ ID NO: 51965 - DNA, 25 bp, Rattus norvegicus
aagtctgataagatggtcataattc

SEQ ID NO: 51966 - DNA, 25 bp, Rattus norvegicus
aagtctgataagttggtcataattc

SEQ ID NO: 51967 - DNA, 25 bp, Rattus norvegicus
aagtctgataccagctggtccacaa

SEQ ID NO: 51968 - DNA, 25 bp, Rattus norvegicus
aagtctgatacctgctggtccacaa

SEQ ID NO: 51969 - DNA, 25 bp, Rattus norvegicus
aagtctgatcttaaagttcctctta

SEQ ID NO: 51970 - DNA, 25 bp, Rattus norvegicus
aagtctgatctttaagttcctctta

SEQ ID NO: 51971 - DNA, 25 bp, Rattus norvegicus
aagtctgattgtcctttttctctca

SEQ ID NO: 51972 - DNA, 25 bp, Rattus norvegicus
aagtctgattgtgctttttctctca

SEQ ID NO: 51973 - DNA, 25 bp, Rattus norvegicus
aagtctgcaatacggagcgcacgac

SEQ ID NO: 51974 - DNA, 25 bp, Rattus norvegicus
aagtctgcaatagggagcgcacgac

SEQ ID NO: 51975 - DNA, 25 bp, Rattus norvegicus
aagtctgcagacacatttcatagat

SEQ ID NO: 51976 - DNA, 25 bp, Rattus norvegicus
aagtctgcagacagctacaccgagg

SEQ ID NO: 51977 - DNA, 25 bp, Rattus norvegicus
aagtctgcagactcatttcatagat

SEQ ID NO: 51978 - DNA, 25 bp, Rattus norvegicus
aagtctgcagactgctacaccgagg

SEQ ID NO: 51979 - DNA, 25 bp, Rattus norvegicus
aagtctgcagccaaactggtttcac

SEQ ID NO: 51980 - DNA, 25 bp, Rattus norvegicus
aagtctgcagcctaactggtttcac

SEQ ID NO: 51981 - DNA, 25 bp, Rattus norvegicus
aagtctgcagggacaagcactgggc

SEQ ID NO: 51982 - DNA, 25 bp, Rattus norvegicus
aagtctgcagggtcaagcactgggc

SEQ ID NO: 51983 - DNA, 25 bp, Rattus norvegicus
aagtctgcagtaccccagctgagaa

SEQ ID NO: 51984 - DNA, 25 bp, Rattus norvegicus
aagtctgcagtagcccagctgagaa

SEQ ID NO: 51985 - DNA, 25 bp, Rattus norvegicus
aagtctgcagttcattgcacaggca

SEQ ID NO: 51986 - DNA, 25 bp, Rattus norvegicus
aagtctgcagttgattgcacaggca

SEQ ID NO: 51987 - DNA, 25 bp, Rattus norvegicus
aagtctgcattccaatttcttgatt

SEQ ID NO: 51988 - DNA, 25 bp, Rattus norvegicus
aagtctgcattcgaatttcttgatt

SEQ ID NO: 51989 - DNA, 25 bp, Rattus norvegicus
aagtctgccacacctgacagtccaa

SEQ ID NO: 51990 - DNA, 25 bp, Rattus norvegicus
aagtctgccacagctgacagtccaa

SEQ ID NO: 51991 - DNA, 25 bp, Rattus norvegicus
aagtctgccattatcttgtactata

SEQ ID NO: 51992 - DNA, 25 bp, Rattus norvegicus
aagtctgccattcttaactacatag

SEQ ID NO: 51993 - DNA, 25 bp, Rattus norvegicus
aagtctgccattgttaactacatag

SEQ ID NO: 51994 - DNA, 25 bp, Rattus norvegicus
aagtctgccattttcttgtactata

SEQ ID NO: 51995 - DNA, 25 bp, Rattus norvegicus
aagtctgcccagcaagcgtacaagt

SEQ ID NO: 51996 - DNA, 25 bp, Rattus norvegicus
aagtctgcccaggaagcgtacaagt

SEQ ID NO: 51997 - DNA, 25 bp, Rattus norvegicus
aagtctgcctgcaggaactgtcatc

SEQ ID NO: 51998 - DNA, 25 bp, Rattus norvegicus
aagtctgcctgctggaactgtcatc

SEQ ID NO: 51999 - DNA, 25 bp, Rattus norvegicus
aagtctgccttacctctagagcgac

SEQ ID NO: 52000 - DNA, 25 bp, Rattus norvegicus
aagtctgccttagctctagagcgac

SEQ ID NO: 52001 - DNA, 25 bp, Rattus norvegicus
aagtctgctaagaagtttacctaag

SEQ ID NO: 52002 - DNA, 25 bp, Rattus norvegicus
aagtctgctaagagctttgttcatt

SEQ ID NO: 52003 - DNA, 25 bp, Rattus norvegicus
aagtctgctaagtagtttacctaag

SEQ ID NO: 52004 - DNA, 25 bp, Rattus norvegicus
aagtctgctaagtgctttgttcatt

SEQ ID NO: 52005 - DNA, 25 bp, Rattus norvegicus
aagtctgctcctatttgtagtcata

SEQ ID NO: 52006 - DNA, 25 bp, Rattus norvegicus
aagtctgctcctttttgtagtcata

SEQ ID NO: 52007 - DNA, 25 bp, Rattus norvegicus
aagtctgctctcagggtcagagctt

SEQ ID NO: 52008 - DNA, 25 bp, Rattus norvegicus
aagtctgctctctgggtcagagctt

SEQ ID NO: 52009 - DNA, 25 bp, Rattus norvegicus
aagtctgctcttctaaagccccatg

SEQ ID NO: 52010 - DNA, 25 bp, Rattus norvegicus
aagtctgctcttgtaaagccccatg

SEQ ID NO: 52011 - DNA, 25 bp, Rattus norvegicus
aagtctgctgccctgaagtgttgag

SEQ ID NO: 52012 - DNA, 25 bp, Rattus norvegicus
aagtctgctgccgtgaagtgttgag

SEQ ID NO: 52013 - DNA, 25 bp, Rattus norvegicus
aagtctgctgtgaaatggatctcat

SEQ ID NO: 52014 - DNA, 25 bp, Rattus norvegicus
aagtctgctgtgtaatggatctcat

SEQ ID NO: 52015 - DNA, 25 bp, Rattus norvegicus
aagtctgctgttactttttcctagc

SEQ ID NO: 52016 - DNA, 25 bp, Rattus norvegicus
aagtctgctgtttctttttcctagc

SEQ ID NO: 52017 - DNA, 25 bp, Rattus norvegicus
aagtctgcttacagtctgtagcaac

SEQ ID NO: 52018 - DNA, 25 bp, Rattus norvegicus
aagtctgcttactgtctgtagcaac

SEQ ID NO: 52019 - DNA, 25 bp, Rattus norvegicus
aagtctgcttcactcacgtctgctt

SEQ ID NO: 52020 - DNA, 25 bp, Rattus norvegicus
aagtctgcttcagtcacgtctgctt

SEQ ID NO: 52021 - DNA, 25 bp, Rattus norvegicus
aagtctgcttgaacccatacaatgt

SEQ ID NO: 52022 - DNA, 25 bp, Rattus norvegicus
aagtctgcttgatcccatacaatgt

SEQ ID NO: 52023 - DNA, 25 bp, Rattus norvegicus
aagtctgcttgcatactgggcaggg

SEQ ID NO: 52024 - DNA, 25 bp, Rattus norvegicus
aagtctgcttgcattgtgaagccca

SEQ ID NO: 52025 - DNA, 25 bp, Rattus norvegicus
aagtctgcttgcttactgggcaggg

SEQ ID NO: 52026 - DNA, 25 bp, Rattus norvegicus
aagtctgcttgctttgtgaagccca

SEQ ID NO: 52027 - DNA, 25 bp, Rattus norvegicus
aagtctgctttgatggtgatggttt

SEQ ID NO: 52028 - DNA, 25 bp, Rattus norvegicus
aagtctgctttgttggtgatggttt

SEQ ID NO: 52029 - DNA, 25 bp, Rattus norvegicus
aagtctggacaacggctgctgtttc

SEQ ID NO: 52030 - DNA, 25 bp, Rattus norvegicus
aagtctggacaagggctgctgtttc

SEQ ID NO: 52031 - DNA, 25 bp, Rattus norvegicus
aagtctggaccacgctgaaaacata

SEQ ID NO: 52032 - DNA, 25 bp, Rattus norvegicus
aagtctggaccaggctgaaaacata

SEQ ID NO: 52033 - DNA, 25 bp, Rattus norvegicus
aagtctggagacaaccgcggcaagt

SEQ ID NO: 52034 - DNA, 25 bp, Rattus norvegicus
aagtctggagactaccgcggcaagt

SEQ ID NO: 52035 - DNA, 25 bp, Rattus norvegicus
aagtctggagggagtgtatcagcca

SEQ ID NO: 52036 - DNA, 25 bp, Rattus norvegicus
aagtctggagggtgtgtatcagcca

SEQ ID NO: 52037 - DNA, 25 bp, Rattus norvegicus
aagtctggatgtcgaatctcattca

SEQ ID NO: 52038 - DNA, 25 bp, Rattus norvegicus
aagtctggatgtggaatctcattca

SEQ ID NO: 52039 - DNA, 25 bp, Rattus norvegicus
aagtctggcacaatcactgtaaaca

SEQ ID NO: 52040 - DNA, 25 bp, Rattus norvegicus
aagtctggcacattcactgtaaaca

SEQ ID NO: 52041 - DNA, 25 bp, Rattus norvegicus
aagtctggcaggaacgctaatcccc

SEQ ID NO: 52042 - DNA, 25 bp, Rattus norvegicus
aagtctggcaggtacgctaatcccc

SEQ ID NO: 52043 - DNA, 25 bp, Rattus norvegicus
aagtctggcctgctgtgatggccct

SEQ ID NO: 52044 - DNA, 25 bp, Rattus norvegicus
aagtctggcctggtgtgatggccct

SEQ ID NO: 52045 - DNA, 25 bp, Rattus norvegicus
aagtctggctctagttgatcaccat

SEQ ID NO: 52046 - DNA, 25 bp, Rattus norvegicus
aagtctggctcttgttgatcaccat

SEQ ID NO: 52047 - DNA, 25 bp, Rattus norvegicus
aagtctgggccaccacagcgagtta

SEQ ID NO: 52048 - DNA, 25 bp, Rattus norvegicus
aagtctgggccagcacagcgagtta

SEQ ID NO: 52049 - DNA, 25 bp, Rattus norvegicus
aagtctggtgttagggcccatgcac

SEQ ID NO: 52050 - DNA, 25 bp, Rattus norvegicus
aagtctggtgtttgggcccatgcac

SEQ ID NO: 52051 - DNA, 25 bp, Rattus norvegicus
aagtctggttctcaagctgacagaa

SEQ ID NO: 52052 - DNA, 25 bp, Rattus norvegicus
aagtctggttctgaagctgacagaa

SEQ ID NO: 52053 - DNA, 25 bp, Rattus norvegicus
aagtctggtttcatttgcttcactg

SEQ ID NO: 52054 - DNA, 25 bp, Rattus norvegicus
aagtctggtttcttttgcttcactg

SEQ ID NO: 52055 - DNA, 25 bp, Rattus norvegicus
aagtctggtttgagtgtcttgcctc

SEQ ID NO: 52056 - DNA, 25 bp, Rattus norvegicus
aagtctggtttgtgtgtcttgcctc

SEQ ID NO: 52057 - DNA, 25 bp, Rattus norvegicus
aagtctgtaacgatagcagccaggg

SEQ ID NO: 52058 - DNA, 25 bp, Rattus norvegicus
aagtctgtaacgttagcagccaggg

SEQ ID NO: 52059 - DNA, 25 bp, Rattus norvegicus
aagtctgtaccgctgatcttttcaa

SEQ ID NO: 52060 - DNA, 25 bp, Rattus norvegicus
aagtctgtaccggtgatcttttcaa

SEQ ID NO: 52061 - DNA, 25 bp, Rattus norvegicus
aagtctgtagtacacggctgctcta

SEQ ID NO: 52062 - DNA, 25 bp, Rattus norvegicus
aagtctgtagtagacggctgctcta

SEQ ID NO: 52063 - DNA, 25 bp, Rattus norvegicus
aagtctgtattgaactcccaagaat

SEQ ID NO: 52064 - DNA, 25 bp, Rattus norvegicus
aagtctgtattgtactcccaagaat

SEQ ID NO: 52065 - DNA, 25 bp, Rattus norvegicus
aagtctgtcatccttggtcctgtgg

SEQ ID NO: 52066 - DNA, 25 bp, Rattus norvegicus
aagtctgtcatcgttggtcctgtgg

SEQ ID NO: 52067 - DNA, 25 bp, Rattus norvegicus
aagtctgtcctgcaccagtccattt

SEQ ID NO: 52068 - DNA, 25 bp, Rattus norvegicus
aagtctgtcctggaccagtccattt

SEQ ID NO: 52069 - DNA, 25 bp, Rattus norvegicus
aagtctgtctacaactcatggcagt

SEQ ID NO: 52070 - DNA, 25 bp, Rattus norvegicus
aagtctgtctactactcatggcagt

SEQ ID NO: 52071 - DNA, 25 bp, Rattus norvegicus
aagtctgtctgaacatcccaagtag

SEQ ID NO: 52072 - DNA, 25 bp, Rattus norvegicus
aagtctgtctgatcatcccaagtag

SEQ ID NO: 52073 - DNA, 25 bp, Rattus norvegicus
aagtctgtctggctcttaatgccct

SEQ ID NO: 52074 - DNA, 25 bp, Rattus norvegicus
aagtctgtctgggtcttaatgccct

SEQ ID NO: 52075 - DNA, 25 bp, Rattus norvegicus
aagtctgtctgtcacactcgggtag

SEQ ID NO: 52076 - DNA, 25 bp, Rattus norvegicus
aagtctgtctgtgacactcgggtag

SEQ ID NO: 52077 - DNA, 25 bp, Rattus norvegicus
aagtctgtgataattctcctgtacc

SEQ ID NO: 52078 - DNA, 25 bp, Rattus norvegicus
aagtctgtgatatttctcctgtacc

SEQ ID NO: 52079 - DNA, 25 bp, Rattus norvegicus
aagtctgtgatgattggaaccgctc

SEQ ID NO: 52080 - DNA, 25 bp, Rattus norvegicus
aagtctgtgatgtttggaaccgctc

SEQ ID NO: 52081 - DNA, 25 bp, Rattus norvegicus
aagtctgtgcagaaagagctgaagc

SEQ ID NO: 52082 - DNA, 25 bp, Rattus norvegicus
aagtctgtgcagacaacttctgaac

SEQ ID NO: 52083 - DNA, 25 bp, Rattus norvegicus
aagtctgtgcagaccagctactgaa

SEQ ID NO: 52084 - DNA, 25 bp, Rattus norvegicus
aagtctgtgcagtaagagctgaagc

SEQ ID NO: 52085 - DNA, 25 bp, Rattus norvegicus
aagtctgtgcagtcaacttctgaac

SEQ ID NO: 52086 - DNA, 25 bp, Rattus norvegicus
aagtctgtgcagtccagctactgaa

SEQ ID NO: 52087 - DNA, 25 bp, Rattus norvegicus
aagtctgtgcttcccaaaatttcaa

SEQ ID NO: 52088 - DNA, 25 bp, Rattus norvegicus
aagtctgtgcttgccaaaatttcaa

SEQ ID NO: 52089 - DNA, 25 bp, Rattus norvegicus
aagtctgtggaacttcagccctgca

SEQ ID NO: 52090 - DNA, 25 bp, Rattus norvegicus
aagtctgtggaagttcagccctgca

SEQ ID NO: 52091 - DNA, 25 bp, Rattus norvegicus
aagtctgtggcccttcgaagcacct

SEQ ID NO: 52092 - DNA, 25 bp, Rattus norvegicus
aagtctgtggccgttcgaagcacct

SEQ ID NO: 52093 - DNA, 25 bp, Rattus norvegicus
aagtctgtggctaatgaagttccta

SEQ ID NO: 52094 - DNA, 25 bp, Rattus norvegicus
aagtctgtggcttatgaagttccta

SEQ ID NO: 52095 - DNA, 25 bp, Rattus norvegicus
aagtctgtgtgactgcatgcttcta

SEQ ID NO: 52096 - DNA, 25 bp, Rattus norvegicus
aagtctgtgtgagtgcatgcttcta

SEQ ID NO: 52097 - DNA, 25 bp, Rattus norvegicus
aagtctgtgtggagcttggcttcac

SEQ ID NO: 52098 - DNA, 25 bp, Rattus norvegicus
aagtctgtgtggtgcttggcttcac

SEQ ID NO: 52099 - DNA, 25 bp, Rattus norvegicus
aagtctgtgttacggtgaatcggta

SEQ ID NO: 52100 - DNA, 25 bp, Rattus norvegicus
aagtctgtgttagggtgaatcggta

SEQ ID NO: 52101 - DNA, 25 bp, Rattus norvegicus
aagtctgttaatcccatggtgttta

SEQ ID NO: 52102 - DNA, 25 bp, Rattus norvegicus
aagtctgttaatgccatggtgttta

SEQ ID NO: 52103 - DNA, 25 bp, Rattus norvegicus
aagtctgttagtaaagagcccaaag

SEQ ID NO: 52104 - DNA, 25 bp, Rattus norvegicus
aagtctgttagttaagagcccaaag

SEQ ID NO: 52105 - DNA, 25 bp, Rattus norvegicus
aagtctgttcatacctttctgttca

SEQ ID NO: 52106 - DNA, 25 bp, Rattus norvegicus
aagtctgttcattcctttctgttca

SEQ ID NO: 52107 - DNA, 25 bp, Rattus norvegicus
aagtctgttcggctgtgtgctatac

SEQ ID NO: 52108 - DNA, 25 bp, Rattus norvegicus
aagtctgttcgggtgtgtgctatac

SEQ ID NO: 52109 - DNA, 25 bp, Rattus norvegicus
aagtctgttctgattatgtcaccga

SEQ ID NO: 52110 - DNA, 25 bp, Rattus norvegicus
aagtctgttctgcaaaacaagcaac

SEQ ID NO: 52111 - DNA, 25 bp, Rattus norvegicus
aagtctgttctgccggcattgtggg

SEQ ID NO: 52112 - DNA, 25 bp, Rattus norvegicus
aagtctgttctggaaaacaagcaac

SEQ ID NO: 52113 - DNA, 25 bp, Rattus norvegicus
aagtctgttctggcggcattgtggg

SEQ ID NO: 52114 - DNA, 25 bp, Rattus norvegicus
aagtctgttctgtttatgtcaccga

SEQ ID NO: 52115 - DNA, 25 bp, Rattus norvegicus
aagtctgttgaaaatctcccaagat

SEQ ID NO: 52116 - DNA, 25 bp, Rattus norvegicus
aagtctgttgaatatctcccaagat

SEQ ID NO: 52117 - DNA, 25 bp, Rattus norvegicus
aagtctgttgatatggaggccctgt

SEQ ID NO: 52118 - DNA, 25 bp, Rattus norvegicus
aagtctgttgatttggaggccctgt

SEQ ID NO: 52119 - DNA, 25 bp, Rattus norvegicus
aagtctgttgctagtgtacctgttt

SEQ ID NO: 52120 - DNA, 25 bp, Rattus norvegicus
aagtctgttgcttgtgtacctgttt

SEQ ID NO: 52121 - DNA, 25 bp, Rattus norvegicus
aagtctgttgtacccaatcctgagg

SEQ ID NO: 52122 - DNA, 25 bp, Rattus norvegicus
aagtctgttgtagccaatcctgagg

SEQ ID NO: 52123 - DNA, 25 bp, Rattus norvegicus
aagtctgttgtgagtggcttcattt

SEQ ID NO: 52124 - DNA, 25 bp, Rattus norvegicus
aagtctgttgtgtgtggcttcattt

SEQ ID NO: 52125 - DNA, 25 bp, Rattus norvegicus
aagtctgtttataaccgcttcatcc

SEQ ID NO: 52126 - DNA, 25 bp, Rattus norvegicus
aagtctgtttattaccgcttcatcc

SEQ ID NO: 52127 - DNA, 25 bp, Rattus norvegicus
aagtctgtttgcaaggactctgtcc

SEQ ID NO: 52128 - DNA, 25 bp, Rattus norvegicus
aagtctgtttgctaggactctgtcc

SEQ ID NO: 52129 - DNA, 25 bp, Rattus norvegicus
aagtctgttttcaattgcctaccac

SEQ ID NO: 52130 - DNA, 25 bp, Rattus norvegicus
aagtctgttttctattgcctaccac

SEQ ID NO: 52131 - DNA, 25 bp, Rattus norvegicus
aagtctgttttgctgtgtctggtta

SEQ ID NO: 52132 - DNA, 25 bp, Rattus norvegicus
aagtctgttttggtgtgtctggtta

SEQ ID NO: 52133 - DNA, 25 bp, Rattus norvegicus
aagtcttaacttatgctatttgaat

SEQ ID NO: 52134 - DNA, 25 bp, Rattus norvegicus
aagtcttaacttttgctatttgaat

SEQ ID NO: 52135 - DNA, 25 bp, Rattus norvegicus
aagtcttaagagctgatgtgatcca

SEQ ID NO: 52136 - DNA, 25 bp, Rattus norvegicus
aagtcttaagaggtgatgtgatcca

SEQ ID NO: 52137 - DNA, 25 bp, Rattus norvegicus
aagtcttaagctccattcctttgaa

SEQ ID NO: 52138 - DNA, 25 bp, Rattus norvegicus
aagtcttaagctgcattcctttgaa

SEQ ID NO: 52139 - DNA, 25 bp, Rattus norvegicus
aagtcttaagtgattgccccatcca

SEQ ID NO: 52140 - DNA, 25 bp, Rattus norvegicus
aagtcttaagtgtttgccccatcca

SEQ ID NO: 52141 - DNA, 25 bp, Rattus norvegicus
aagtcttactatatgcttgttagag

SEQ ID NO: 52142 - DNA, 25 bp, Rattus norvegicus
aagtcttactatttgcttgttagag

SEQ ID NO: 52143 - DNA, 25 bp, Rattus norvegicus
aagtcttactgcagtggcaacccgt

SEQ ID NO: 52144 - DNA, 25 bp, Rattus norvegicus
aagtcttactgctgtggcaacccgt

SEQ ID NO: 52145 - DNA, 25 bp, Rattus norvegicus
aagtcttagaggaatggcagccctg

SEQ ID NO: 52146 - DNA, 25 bp, Rattus norvegicus
aagtcttagaggtatggcagccctg

SEQ ID NO: 52147 - DNA, 25 bp, Rattus norvegicus
aagtcttagcacaggcgaggatgga

SEQ ID NO: 52148 - DNA, 25 bp, Rattus norvegicus
aagtcttagcactggcgaggatgga

SEQ ID NO: 52149 - DNA, 25 bp, Rattus norvegicus
aagtcttagctcattggtaacctgt

SEQ ID NO: 52150 - DNA, 25 bp, Rattus norvegicus
aagtcttagctctttggtaacctgt

SEQ ID NO: 52151 - DNA, 25 bp, Rattus norvegicus
aagtcttaggttccttttgagtctg

SEQ ID NO: 52152 - DNA, 25 bp, Rattus norvegicus
aagtcttaggttgcttttgagtctg

SEQ ID NO: 52153 - DNA, 25 bp, Rattus norvegicus
aagtcttattcactctgttctctct

SEQ ID NO: 52154 - DNA, 25 bp, Rattus norvegicus
aagtcttattcagtctgttctctct

SEQ ID NO: 52155 - DNA, 25 bp, Rattus norvegicus
aagtcttattctctggtattttcac

SEQ ID NO: 52156 - DNA, 25 bp, Rattus norvegicus
aagtcttattctgtggtattttcac

SEQ ID NO: 52157 - DNA, 25 bp, Rattus norvegicus
aagtcttatttaaggcagtcgggct

SEQ ID NO: 52158 - DNA, 25 bp, Rattus norvegicus
aagtcttatttatggcagtcgggct

SEQ ID NO: 52159 - DNA, 25 bp, Rattus norvegicus
aagtcttcaagtacccaagctactc

SEQ ID NO: 52160 - DNA, 25 bp, Rattus norvegicus
aagtcttcaagttcccaagctactc

SEQ ID NO: 52161 - DNA, 25 bp, Rattus norvegicus
aagtcttcactgattcttgaactgg

SEQ ID NO: 52162 - DNA, 25 bp, Rattus norvegicus
aagtcttcactgtttcttgaactgg

SEQ ID NO: 52163 - DNA, 25 bp, Rattus norvegicus
aagtcttcagacaagccactcttgg

SEQ ID NO: 52164 - DNA, 25 bp, Rattus norvegicus
aagtcttcagacataaagctatgta

SEQ ID NO: 52165 - DNA, 25 bp, Rattus norvegicus
aagtcttcagactagccactcttgg

SEQ ID NO: 52166 - DNA, 25 bp, Rattus norvegicus
aagtcttcagacttaaagctatgta

SEQ ID NO: 52167 - DNA, 25 bp, Rattus norvegicus
aagtcttcagcgcttaagtagccag

SEQ ID NO: 52168 - DNA, 25 bp, Rattus norvegicus
aagtcttcagcggttaagtagccag

SEQ ID NO: 52169 - DNA, 25 bp, Rattus norvegicus
aagtcttcagtgcagttcatttatt

SEQ ID NO: 52170 - DNA, 25 bp, Rattus norvegicus
aagtcttcagtggagttcatttatt

SEQ ID NO: 52171 - DNA, 25 bp, Rattus norvegicus
aagtcttccactctcttacgtatgg

SEQ ID NO: 52172 - DNA, 25 bp, Rattus norvegicus
aagtcttccactgtcttacgtatgg

SEQ ID NO: 52173 - DNA, 25 bp, Rattus norvegicus
aagtcttccaggatatacccagctc

SEQ ID NO: 52174 - DNA, 25 bp, Rattus norvegicus
aagtcttccaggttatacccagctc

SEQ ID NO: 52175 - DNA, 25 bp, Rattus norvegicus
aagtcttcctcactttgtgctctct

SEQ ID NO: 52176 - DNA, 25 bp, Rattus norvegicus
aagtcttcctcagtttgtgctctct

SEQ ID NO: 52177 - DNA, 25 bp, Rattus norvegicus
aagtcttcctccactgtgtattggc

SEQ ID NO: 52178 - DNA, 25 bp, Rattus norvegicus
aagtcttcctcctctgtgtattggc

SEQ ID NO: 52179 - DNA, 25 bp, Rattus norvegicus
aagtcttcctctacatttgcagtat

SEQ ID NO: 52180 - DNA, 25 bp, Rattus norvegicus
aagtcttcctcttcatttgcagtat

SEQ ID NO: 52181 - DNA, 25 bp, Rattus norvegicus
aagtcttcctgccaggatagctcat

SEQ ID NO: 52182 - DNA, 25 bp, Rattus norvegicus
aagtcttcctgcgaggatagctcat

SEQ ID NO: 52183 - DNA, 25 bp, Rattus norvegicus
aagtcttccttactgattacaacag

SEQ ID NO: 52184 - DNA, 25 bp, Rattus norvegicus
aagtcttccttagtgattacaacag

SEQ ID NO: 52185 - DNA, 25 bp, Rattus norvegicus
aagtcttccttcacctttgagaaag

SEQ ID NO: 52186 - DNA, 25 bp, Rattus norvegicus
aagtcttccttcagaatgcctttgg

SEQ ID NO: 52187 - DNA, 25 bp, Rattus norvegicus
aagtcttccttctcctttgagaaag

SEQ ID NO: 52188 - DNA, 25 bp, Rattus norvegicus
aagtcttccttctgaatgcctttgg

SEQ ID NO: 52189 - DNA, 25 bp, Rattus norvegicus
aagtcttcggagcacttccagaccg

SEQ ID NO: 52190 - DNA, 25 bp, Rattus norvegicus
aagtcttcggaggacttccagaccg

SEQ ID NO: 52191 - DNA, 25 bp, Rattus norvegicus
aagtcttcgtgcacggtgatgtgac

SEQ ID NO: 52192 - DNA, 25 bp, Rattus norvegicus
aagtcttcgtgctcggtgatgtgac

SEQ ID NO: 52193 - DNA, 25 bp, Rattus norvegicus
aagtcttcgtggctgtctcggagta

SEQ ID NO: 52194 - DNA, 25 bp, Rattus norvegicus
aagtcttcgtgggtgtctcggagta

SEQ ID NO: 52195 - DNA, 25 bp, Rattus norvegicus
aagtcttctaagcactcctcgaagc

SEQ ID NO: 52196 - DNA, 25 bp, Rattus norvegicus
aagtcttctaaggactcctcgaagc

SEQ ID NO: 52197 - DNA, 25 bp, Rattus norvegicus
aagtcttctatcagtttggcctcat

SEQ ID NO: 52198 - DNA, 25 bp, Rattus norvegicus
aagtcttctatctgtttggcctcat

SEQ ID NO: 52199 - DNA, 25 bp, Rattus norvegicus
aagtcttctctcattcaccaaggag

SEQ ID NO: 52200 - DNA, 25 bp, Rattus norvegicus
aagtcttctctctttcaccaaggag

SEQ ID NO: 52201 - DNA, 25 bp, Rattus norvegicus
aagtcttctgccatcttgaggtccc

SEQ ID NO: 52202 - DNA, 25 bp, Rattus norvegicus
aagtcttctgccttcttgaggtccc

SEQ ID NO: 52203 - DNA, 25 bp, Rattus norvegicus
aagtcttctgggaccgactactatt

SEQ ID NO: 52204 - DNA, 25 bp, Rattus norvegicus
aagtcttctgggtccgactactatt

SEQ ID NO: 52205 - DNA, 25 bp, Rattus norvegicus
aagtcttctgtgaaccccaacccag

SEQ ID NO: 52206 - DNA, 25 bp, Rattus norvegicus
aagtcttctgtgtaccccaacccag

SEQ ID NO: 52207 - DNA, 25 bp, Rattus norvegicus
aagtcttcttctacaaagctctgct

SEQ ID NO: 52208 - DNA, 25 bp, Rattus norvegicus
aagtcttcttcttcaaagctctgct

SEQ ID NO: 52209 - DNA, 25 bp, Rattus norvegicus
aagtcttgaaagactgtgcctgccc

SEQ ID NO: 52210 - DNA, 25 bp, Rattus norvegicus
aagtcttgaaagtctgtgcctgccc

SEQ ID NO: 52211 - DNA, 25 bp, Rattus norvegicus
aagtcttgaagacctgcctgtcctt

SEQ ID NO: 52212 - DNA, 25 bp, Rattus norvegicus
aagtcttgaagagctgcctgtcctt

SEQ ID NO: 52213 - DNA, 25 bp, Rattus norvegicus
aagtcttgaagcagatcctcaccat

SEQ ID NO: 52214 - DNA, 25 bp, Rattus norvegicus
aagtcttgaagctgatcctcaccat

SEQ ID NO: 52215 - DNA, 25 bp, Rattus norvegicus
aagtcttgacaacccaaatctccgc

SEQ ID NO: 52216 - DNA, 25 bp, Rattus norvegicus
aagtcttgacaagccaaatctccgc

SEQ ID NO: 52217 - DNA, 25 bp, Rattus norvegicus
aagtcttgagggatagctcctgtaa

SEQ ID NO: 52218 - DNA, 25 bp, Rattus norvegicus
aagtcttgagggttagctcctgtaa

SEQ ID NO: 52219 - DNA, 25 bp, Rattus norvegicus
aagtcttgagtcctatcagtcacta

SEQ ID NO: 52220 - DNA, 25 bp, Rattus norvegicus
aagtcttgagtcgtatcagtcacta

SEQ ID NO: 52221 - DNA, 25 bp, Rattus norvegicus
aagtcttgatccagggactggtgaa

SEQ ID NO: 52222 - DNA, 25 bp, Rattus norvegicus
aagtcttgatcctgggactggtgaa

SEQ ID NO: 52223 - DNA, 25 bp, Rattus norvegicus
aagtcttgatctcaggatgaggtct

SEQ ID NO: 52224 - DNA, 25 bp, Rattus norvegicus
aagtcttgatctgaggatgaggtct

SEQ ID NO: 52225 - DNA, 25 bp, Rattus norvegicus
aagtcttgcagaaactagacagcct

SEQ ID NO: 52226 - DNA, 25 bp, Rattus norvegicus
aagtcttgcagatactagacagcct

SEQ ID NO: 52227 - DNA, 25 bp, Rattus norvegicus
aagtcttgctaaaaatcccttccct

SEQ ID NO: 52228 - DNA, 25 bp, Rattus norvegicus
aagtcttgctaataatcccttccct

SEQ ID NO: 52229 - DNA, 25 bp, Rattus norvegicus
aagtcttgctaccttttcacccttg

SEQ ID NO: 52230 - DNA, 25 bp, Rattus norvegicus
aagtcttgctacgttttcacccttg

SEQ ID NO: 52231 - DNA, 25 bp, Rattus norvegicus
aagtcttgcttcattgggatatcaa

SEQ ID NO: 52232 - DNA, 25 bp, Rattus norvegicus
aagtcttgcttctttgggatatcaa

SEQ ID NO: 52233 - DNA, 25 bp, Rattus norvegicus
aagtcttggagcacggaactctacc

SEQ ID NO: 52234 - DNA, 25 bp, Rattus norvegicus
aagtcttggagctcggaactctacc

SEQ ID NO: 52235 - DNA, 25 bp, Rattus norvegicus
aagtcttggcggcagcgatcacacc

SEQ ID NO: 52236 - DNA, 25 bp, Rattus norvegicus
aagtcttggcgggagcgatcacacc

SEQ ID NO: 52237 - DNA, 25 bp, Rattus norvegicus
aagtcttggctgcaggtgtccatcc

SEQ ID NO: 52238 - DNA, 25 bp, Rattus norvegicus
aagtcttggctggaggtgtccatcc

SEQ ID NO: 52239 - DNA, 25 bp, Rattus norvegicus
aagtcttgggcacacaggcctttgg

SEQ ID NO: 52240 - DNA, 25 bp, Rattus norvegicus
aagtcttgggcagacaggcctttgg

SEQ ID NO: 52241 - DNA, 25 bp, Rattus norvegicus
aagtcttggtccaggatcaaccaca

SEQ ID NO: 52242 - DNA, 25 bp, Rattus norvegicus
aagtcttggtcctggatcaaccaca

SEQ ID NO: 52243 - DNA, 25 bp, Rattus norvegicus
aagtcttggttgacttgctgaaggc

SEQ ID NO: 52244 - DNA, 25 bp, Rattus norvegicus
aagtcttggttgtcttgctgaaggc

SEQ ID NO: 52245 - DNA, 25 bp, Rattus norvegicus
aagtcttgtgagatgccctgtcact

SEQ ID NO: 52246 - DNA, 25 bp, Rattus norvegicus
aagtcttgtgagttgccctgtcact

SEQ ID NO: 52247 - DNA, 25 bp, Rattus norvegicus
aagtcttgtgcacagcagggtacaa

SEQ ID NO: 52248 - DNA, 25 bp, Rattus norvegicus
aagtcttgtgcagagcagggtacaa

SEQ ID NO: 52249 - DNA, 25 bp, Rattus norvegicus
aagtcttgtgctatgctttggacac

SEQ ID NO: 52250 - DNA, 25 bp, Rattus norvegicus
aagtcttgtgctttgctttggacac

SEQ ID NO: 52251 - DNA, 25 bp, Rattus norvegicus
aagtcttgtgttaggttccccactg

SEQ ID NO: 52252 - DNA, 25 bp, Rattus norvegicus
aagtcttgtgtttggttccccactg

SEQ ID NO: 52253 - DNA, 25 bp, Rattus norvegicus
aagtctttaactcctgtgtataaca

SEQ ID NO: 52254 - DNA, 25 bp, Rattus norvegicus
aagtctttaactgctgtgtataaca

SEQ ID NO: 52255 - DNA, 25 bp, Rattus norvegicus
aagtctttaatgaggtcctcagctc

SEQ ID NO: 52256 - DNA, 25 bp, Rattus norvegicus
aagtctttaatgtggtcctcagctc

SEQ ID NO: 52257 - DNA, 25 bp, Rattus norvegicus
aagtctttaattatgtgtggtgtgt

SEQ ID NO: 52258 - DNA, 25 bp, Rattus norvegicus
aagtctttaattttgtgtggtgtgt

SEQ ID NO: 52259 - DNA, 25 bp, Rattus norvegicus
aagtctttacatagcctgaccttct

SEQ ID NO: 52260 - DNA, 25 bp, Rattus norvegicus
aagtctttacattgcctgaccttct

SEQ ID NO: 52261 - DNA, 25 bp, Rattus norvegicus
aagtctttaccacggagttctgcta

SEQ ID NO: 52262 - DNA, 25 bp, Rattus norvegicus
aagtctttaccagggagttctgcta

SEQ ID NO: 52263 - DNA, 25 bp, Rattus norvegicus
aagtctttaggtacattttatatca

SEQ ID NO: 52264 - DNA, 25 bp, Rattus norvegicus
aagtctttaggttcattttatatca

SEQ ID NO: 52265 - DNA, 25 bp, Rattus norvegicus
aagtctttcaggctctgcacgaagg

SEQ ID NO: 52266 - DNA, 25 bp, Rattus norvegicus
aagtctttcagggtctgcacgaagg

SEQ ID NO: 52267 - DNA, 25 bp, Rattus norvegicus
aagtctttcccaccaggatggacag

SEQ ID NO: 52268 - DNA, 25 bp, Rattus norvegicus
aagtctttcccagcaggatggacag

SEQ ID NO: 52269 - DNA, 25 bp, Rattus norvegicus
aagtctttcctcatctcacctttgt

SEQ ID NO: 52270 - DNA, 25 bp, Rattus norvegicus
aagtctttcctcttctcacctttgt

SEQ ID NO: 52271 - DNA, 25 bp, Rattus norvegicus
aagtctttctcaacggtgttgatca

SEQ ID NO: 52272 - DNA, 25 bp, Rattus norvegicus
aagtctttctcatcggtgttgatca

SEQ ID NO: 52273 - DNA, 25 bp, Rattus norvegicus
aagtctttctggctcaggactgtaa

SEQ ID NO: 52274 - DNA, 25 bp, Rattus norvegicus
aagtctttctgggtcaggactgtaa

SEQ ID NO: 52275 - DNA, 25 bp, Rattus norvegicus
aagtctttcttgagcagtaccttgc

SEQ ID NO: 52276 - DNA, 25 bp, Rattus norvegicus
aagtctttcttgtgcagtaccttgc

SEQ ID NO: 52277 - DNA, 25 bp, Rattus norvegicus
aagtctttctttatggacccacatg

SEQ ID NO: 52278 - DNA, 25 bp, Rattus norvegicus
aagtctttctttttggacccacatg

SEQ ID NO: 52279 - DNA, 25 bp, Rattus norvegicus
aagtctttgaacaccaaccactgaa

SEQ ID NO: 52280 - DNA, 25 bp, Rattus norvegicus
aagtctttgaactccaaccactgaa

SEQ ID NO: 52281 - DNA, 25 bp, Rattus norvegicus
aagtctttgaggaaccccataccat

SEQ ID NO: 52282 - DNA, 25 bp, Rattus norvegicus
aagtctttgaggtaccccataccat

SEQ ID NO: 52283 - DNA, 25 bp, Rattus norvegicus
aagtctttgatgacagtggcccata

SEQ ID NO: 52284 - DNA, 25 bp, Rattus norvegicus
aagtctttgatgtcagtggcccata

SEQ ID NO: 52285 - DNA, 25 bp, Rattus norvegicus
aagtctttgccccttatgtgctata

SEQ ID NO: 52286 - DNA, 25 bp, Rattus norvegicus
aagtctttgcccgttatgtgctata

SEQ ID NO: 52287 - DNA, 25 bp, Rattus norvegicus
aagtctttgctcagtgaacatggtc

SEQ ID NO: 52288 - DNA, 25 bp, Rattus norvegicus
aagtctttgctctgtgaacatggtc

SEQ ID NO: 52289 - DNA, 25 bp, Rattus norvegicus
aagtctttgggcagagttactcctc

SEQ ID NO: 52290 - DNA, 25 bp, Rattus norvegicus
aagtctttgggctgagttactcctc

SEQ ID NO: 52291 - DNA, 25 bp, Rattus norvegicus
aagtctttgtctccgtatgatatgc

SEQ ID NO: 52292 - DNA, 25 bp, Rattus norvegicus
aagtctttgtctcgttgcattccta

SEQ ID NO: 52293 - DNA, 25 bp, Rattus norvegicus
aagtctttgtctgcgtatgatatgc

SEQ ID NO: 52294 - DNA, 25 bp, Rattus norvegicus
aagtctttgtctggttgcattccta

SEQ ID NO: 52295 - DNA, 25 bp, Rattus norvegicus
aagtctttgtggcttctttgcagaa

SEQ ID NO: 52296 - DNA, 25 bp, Rattus norvegicus
aagtctttgtgggttctttgcagaa

SEQ ID NO: 52297 - DNA, 25 bp, Rattus norvegicus
aagtctttgttaatcctggttctca

SEQ ID NO: 52298 - DNA, 25 bp, Rattus norvegicus
aagtctttgttattcctggttctca

SEQ ID NO: 52299 - DNA, 25 bp, Rattus norvegicus
aagtctttgttcagtgccttcgctg

SEQ ID NO: 52300 - DNA, 25 bp, Rattus norvegicus
aagtctttgttctgtgccttcgctg

SEQ ID NO: 52301 - DNA, 25 bp, Rattus norvegicus
aagtcttttaacacatccaggaggg

SEQ ID NO: 52302 - DNA, 25 bp, Rattus norvegicus
aagtcttttaactcatccaggaggg

SEQ ID NO: 52303 - DNA, 25 bp, Rattus norvegicus
aagtcttttctgacccccagaatct

SEQ ID NO: 52304 - DNA, 25 bp, Rattus norvegicus
aagtcttttctgactgcttcggtgt

SEQ ID NO: 52305 - DNA, 25 bp, Rattus norvegicus
aagtcttttctgtcccccagaatct

SEQ ID NO: 52306 - DNA, 25 bp, Rattus norvegicus
aagtcttttctgtctgcttcggtgt

SEQ ID NO: 52307 - DNA, 25 bp, Rattus norvegicus
aagtcttttgtcattgttacctcaa

SEQ ID NO: 52308 - DNA, 25 bp, Rattus norvegicus
aagtcttttgtctttgttacctcaa

SEQ ID NO: 52309 - DNA, 25 bp, Rattus norvegicus
aagtcttttgttcctgtttcagaag

SEQ ID NO: 52310 - DNA, 25 bp, Rattus norvegicus
aagtcttttgttgctgtttcagaag

SEQ ID NO: 52311 - DNA, 25 bp, Rattus norvegicus
aagtctttttcaaacagcattggga

SEQ ID NO: 52312 - DNA, 25 bp, Rattus norvegicus
aagtctttttcatacagcattggga

SEQ ID NO: 52313 - DNA, 25 bp, Rattus norvegicus
aagtgaaacccgaggcaaccgacag

SEQ ID NO: 52314 - DNA, 25 bp, Rattus norvegicus
aagtgaaacccgtggcaaccgacag

SEQ ID NO: 52315 - DNA, 25 bp, Rattus norvegicus
aagtgaaactccaagcacattccct

SEQ ID NO: 52316 - DNA, 25 bp, Rattus norvegicus
aagtgaaactcctagcacattccct

SEQ ID NO: 52317 - DNA, 25 bp, Rattus norvegicus
aagtgaaacttactcctggagttca

SEQ ID NO: 52318 - DNA, 25 bp, Rattus norvegicus
aagtgaaacttagtcctggagttca

SEQ ID NO: 52319 - DNA, 25 bp, Rattus norvegicus
aagtgaaatgtgctctctggctcct

SEQ ID NO: 52320 - DNA, 25 bp, Rattus norvegicus
aagtgaaatgtggtctctggctcct

SEQ ID NO: 52321 - DNA, 25 bp, Rattus norvegicus
aagtgaacaccccatggctagatgt

SEQ ID NO: 52322 - DNA, 25 bp, Rattus norvegicus
aagtgaacacccgatggctagatgt

SEQ ID NO: 52323 - DNA, 25 bp, Rattus norvegicus
aagtgaacagttcctaccgcatcag

SEQ ID NO: 52324 - DNA, 25 bp, Rattus norvegicus
aagtgaacagttgctaccgcatcag

SEQ ID NO: 52325 - DNA, 25 bp, Rattus norvegicus
aagtgaacatctagctggctgtctc

SEQ ID NO: 52326 - DNA, 25 bp, Rattus norvegicus
aagtgaacatcttgctggctgtctc

SEQ ID NO: 52327 - DNA, 25 bp, Rattus norvegicus
aagtgaacatgacgagcggcctgct

SEQ ID NO: 52328 - DNA, 25 bp, Rattus norvegicus
aagtgaacatgaggagcggcctgct

SEQ ID NO: 52329 - DNA, 25 bp, Rattus norvegicus
aagtgaacccacagagtctctacag

SEQ ID NO: 52330 - DNA, 25 bp, Rattus norvegicus
aagtgaacccactgagtctctacag

SEQ ID NO: 52331 - DNA, 25 bp, Rattus norvegicus
aagtgaacctggctctgtctcgggc

SEQ ID NO: 52332 - DNA, 25 bp, Rattus norvegicus
aagtgaacctgggtctgtctcgggc

SEQ ID NO: 52333 - DNA, 25 bp, Rattus norvegicus
aagtgaacctgtaccatgccaagaa

SEQ ID NO: 52334 - DNA, 25 bp, Rattus norvegicus
aagtgaacctgttccatgccaagaa

SEQ ID NO: 52335 - DNA, 25 bp, Rattus norvegicus
aagtgaaccttcctgtttcagcttc

SEQ ID NO: 52336 - DNA, 25 bp, Rattus norvegicus
aagtgaaccttcgtgtttcagcttc

SEQ ID NO: 52337 - DNA, 25 bp, Rattus norvegicus
aagtgaacgccaactcttccggaat

SEQ ID NO: 52338 - DNA, 25 bp, Rattus norvegicus
aagtgaacgccatctcttccggaat

SEQ ID NO: 52339 - DNA, 25 bp, Rattus norvegicus
aagtgaactctaccggtgctgagcc

SEQ ID NO: 52340 - DNA, 25 bp, Rattus norvegicus
aagtgaactctagcggtgctgagcc

SEQ ID NO: 52341 - DNA, 25 bp, Rattus norvegicus
aagtgaactctgctcgtttgatgct

SEQ ID NO: 52342 - DNA, 25 bp, Rattus norvegicus
aagtgaactctggtcgtttgatgct

SEQ ID NO: 52343 - DNA, 25 bp, Rattus norvegicus
aagtgaactgacaccacacagggct

SEQ ID NO: 52344 - DNA, 25 bp, Rattus norvegicus
aagtgaactgactccacacagggct

SEQ ID NO: 52345 - DNA, 25 bp, Rattus norvegicus
aagtgaactgatcccctttgaagat

SEQ ID NO: 52346 - DNA, 25 bp, Rattus norvegicus
aagtgaactgatgccctttgaagat

SEQ ID NO: 52347 - DNA, 25 bp, Rattus norvegicus
aagtgaactgtgctcttctcagagg

SEQ ID NO: 52348 - DNA, 25 bp, Rattus norvegicus
aagtgaactgtggtcttctcagagg

SEQ ID NO: 52349 - DNA, 25 bp, Rattus norvegicus
aagtgaactttcatctctctttctg

SEQ ID NO: 52350 - DNA, 25 bp, Rattus norvegicus
aagtgaactttcttctctctttctg

SEQ ID NO: 52351 - DNA, 25 bp, Rattus norvegicus
aagtgaagacctctgatcggcgccc

SEQ ID NO: 52352 - DNA, 25 bp, Rattus norvegicus
aagtgaagacctgtgatcggcgccc

SEQ ID NO: 52353 - DNA, 25 bp, Rattus norvegicus
aagtgaagagcaacataaccctgga

SEQ ID NO: 52354 - DNA, 25 bp, Rattus norvegicus
aagtgaagagcatcataaccctgga

SEQ ID NO: 52355 - DNA, 25 bp, Rattus norvegicus
aagtgaagagccagcggccctacta

SEQ ID NO: 52356 - DNA, 25 bp, Rattus norvegicus
aagtgaagagcctgcggccctacta

SEQ ID NO: 52357 - DNA, 25 bp, Rattus norvegicus
aagtgaagcaccaagcttgtcccta

SEQ ID NO: 52358 - DNA, 25 bp, Rattus norvegicus
aagtgaagcacctagcttgtcccta

SEQ ID NO: 52359 - DNA, 25 bp, Rattus norvegicus
aagtgaagcactccggatcttgcaa

SEQ ID NO: 52360 - DNA, 25 bp, Rattus norvegicus
aagtgaagcactgcggatcttgcaa

SEQ ID NO: 52361 - DNA, 25 bp, Rattus norvegicus
aagtgaagccgcaggatggccttaa

SEQ ID NO: 52362 - DNA, 25 bp, Rattus norvegicus
aagtgaagccgctggatggccttaa

SEQ ID NO: 52363 - DNA, 25 bp, Rattus norvegicus
aagtgaagctgaacgggttcgccca

SEQ ID NO: 52364 - DNA, 25 bp, Rattus norvegicus
aagtgaagctgatcgggttcgccca

SEQ ID NO: 52365 - DNA, 25 bp, Rattus norvegicus
aagtgaagcttgcagctgctgccca

SEQ ID NO: 52366 - DNA, 25 bp, Rattus norvegicus
aagtgaagcttggagctgctgccca

SEQ ID NO: 52367 - DNA, 25 bp, Rattus norvegicus
aagtgaaggaacagctgcctagaga

SEQ ID NO: 52368 - DNA, 25 bp, Rattus norvegicus
aagtgaaggaactgctgcctagaga

SEQ ID NO: 52369 - DNA, 25 bp, Rattus norvegicus
aagtgaaggagtctaaccctgccct

SEQ ID NO: 52370 - DNA, 25 bp, Rattus norvegicus
aagtgaaggagtgtaaccctgccct

SEQ ID NO: 52371 - DNA, 25 bp, Rattus norvegicus
aagtgaaggcccctggtctgtctta

SEQ ID NO: 52372 - DNA, 25 bp, Rattus norvegicus
aagtgaaggcccgtggtctgtctta

SEQ ID NO: 52373 - DNA, 25 bp, Rattus norvegicus
aagtgaaggtcaatgtcccaagaaa

SEQ ID NO: 52374 - DNA, 25 bp, Rattus norvegicus
aagtgaaggtcattgtcccaagaaa

SEQ ID NO: 52375 - DNA, 25 bp, Rattus norvegicus
aagtgaagtccacgtctcagcgaga

SEQ ID NO: 52376 - DNA, 25 bp, Rattus norvegicus
aagtgaagtccactcttcttctctg

SEQ ID NO: 52377 - DNA, 25 bp, Rattus norvegicus
aagtgaagtccaggtctcagcgaga

SEQ ID NO: 52378 - DNA, 25 bp, Rattus norvegicus
aagtgaagtccagtcttcttctctg

SEQ ID NO: 52379 - DNA, 25 bp, Rattus norvegicus
aagtgaagtcccatgggtacccctg

SEQ ID NO: 52380 - DNA, 25 bp, Rattus norvegicus
aagtgaagtcccttgggtacccctg

SEQ ID NO: 52381 - DNA, 25 bp, Rattus norvegicus
aagtgaataccgctcatgacagatt

SEQ ID NO: 52382 - DNA, 25 bp, Rattus norvegicus
aagtgaataccggtcatgacagatt

SEQ ID NO: 52383 - DNA, 25 bp, Rattus norvegicus
aagtgaatccaaacttcagcgactg

SEQ ID NO: 52384 - DNA, 25 bp, Rattus norvegicus
aagtgaatccaatcttcagcgactg

SEQ ID NO: 52385 - DNA, 25 bp, Rattus norvegicus
aagtgaatccagacgtcacccatgt

SEQ ID NO: 52386 - DNA, 25 bp, Rattus norvegicus
aagtgaatccagtcgtcacccatgt

SEQ ID NO: 52387 - DNA, 25 bp, Rattus norvegicus
aagtgaatcccacagtgtcgctctg

SEQ ID NO: 52388 - DNA, 25 bp, Rattus norvegicus
aagtgaatcccagagtgtcgctctg

SEQ ID NO: 52389 - DNA, 25 bp, Rattus norvegicus
aagtgaatcctgacgacaggctgat

SEQ ID NO: 52390 - DNA, 25 bp, Rattus norvegicus
aagtgaatcctgtcgacaggctgat

SEQ ID NO: 52391 - DNA, 25 bp, Rattus norvegicus
aagtgaatctctccgtttgaagcca

SEQ ID NO: 52392 - DNA, 25 bp, Rattus norvegicus
aagtgaatctctgcgtttgaagcca

SEQ ID NO: 52393 - DNA, 25 bp, Rattus norvegicus
aagtgaatctgtcggcattttagcc

SEQ ID NO: 52394 - DNA, 25 bp, Rattus norvegicus
aagtgaatctgtgggcattttagcc

SEQ ID NO: 52395 - DNA, 25 bp, Rattus norvegicus
aagtgaatggctacgtctgtgaacc

SEQ ID NO: 52396 - DNA, 25 bp, Rattus norvegicus
aagtgaatggcttcgtctgtgaacc

SEQ ID NO: 52397 - DNA, 25 bp, Rattus norvegicus
aagtgaattcataccgtgcatgtca

SEQ ID NO: 52398 - DNA, 25 bp, Rattus norvegicus
aagtgaattcatcctgagcgacata

SEQ ID NO: 52399 - DNA, 25 bp, Rattus norvegicus
aagtgaattcatgctgagcgacata

SEQ ID NO: 52400 - DNA, 25 bp, Rattus norvegicus
aagtgaattcattccgtgcatgtca

SEQ ID NO: 52401 - DNA, 25 bp, Rattus norvegicus
aagtgaattccaaacgctgctgaaa

SEQ ID NO: 52402 - DNA, 25 bp, Rattus norvegicus
aagtgaattccatacgctgctgaaa

SEQ ID NO: 52403 - DNA, 25 bp, Rattus norvegicus
aagtgaattctcacctttttcttga

SEQ ID NO: 52404 - DNA, 25 bp, Rattus norvegicus
aagtgaattctccaatcaagcccct

SEQ ID NO: 52405 - DNA, 25 bp, Rattus norvegicus
aagtgaattctcgaatcaagcccct

SEQ ID NO: 52406 - DNA, 25 bp, Rattus norvegicus
aagtgaattctctcctttttcttga

SEQ ID NO: 52407 - DNA, 25 bp, Rattus norvegicus
aagtgacaacgccaggagtgctctg

SEQ ID NO: 52408 - DNA, 25 bp, Rattus norvegicus
aagtgacaacgcgaggagtgctctg

SEQ ID NO: 52409 - DNA, 25 bp, Rattus norvegicus
aagtgacaagcgagggtcccctgca

SEQ ID NO: 52410 - DNA, 25 bp, Rattus norvegicus
aagtgacaagcgtgggtcccctgca

SEQ ID NO: 52411 - DNA, 25 bp, Rattus norvegicus
aagtgacaattaacttcccgaagaa

SEQ ID NO: 52412 - DNA, 25 bp, Rattus norvegicus
aagtgacaattatcttcccgaagaa

SEQ ID NO: 52413 - DNA, 25 bp, Rattus norvegicus
aagtgacacaacaatggctctcctg

SEQ ID NO: 52414 - DNA, 25 bp, Rattus norvegicus
aagtgacacaactatggctctcctg

SEQ ID NO: 52415 - DNA, 25 bp, Rattus norvegicus
aagtgacacaagagtttctggtcag

SEQ ID NO: 52416 - DNA, 25 bp, Rattus norvegicus
aagtgacacaagtgtttctggtcag

SEQ ID NO: 52417 - DNA, 25 bp, Rattus norvegicus
aagtgacacaccctttgacaagctc

SEQ ID NO: 52418 - DNA, 25 bp, Rattus norvegicus
aagtgacacaccgtttgacaagctc

SEQ ID NO: 52419 - DNA, 25 bp, Rattus norvegicus
aagtgacaccaacctcaatatgaga

SEQ ID NO: 52420 - DNA, 25 bp, Rattus norvegicus
aagtgacaccaagctcaatatgaga

SEQ ID NO: 52421 - DNA, 25 bp, Rattus norvegicus
aagtgacaccctccccagaagtagg

SEQ ID NO: 52422 - DNA, 25 bp, Rattus norvegicus
aagtgacaccctgcccagaagtagg

SEQ ID NO: 52423 - DNA, 25 bp, Rattus norvegicus
aagtgacacgctcttcttgatgaca

SEQ ID NO: 52424 - DNA, 25 bp, Rattus norvegicus
aagtgacacgctgttcttgatgaca

SEQ ID NO: 52425 - DNA, 25 bp, Rattus norvegicus
aagtgacactagactcatgccggaa

SEQ ID NO: 52426 - DNA, 25 bp, Rattus norvegicus
aagtgacactagtctcatgccggaa

SEQ ID NO: 52427 - DNA, 25 bp, Rattus norvegicus
aagtgacactgtcgaccttcgctac

SEQ ID NO: 52428 - DNA, 25 bp, Rattus norvegicus
aagtgacactgtggaccttcgctac

SEQ ID NO: 52429 - DNA, 25 bp, Rattus norvegicus
aagtgacagcctaaccactggaggt

SEQ ID NO: 52430 - DNA, 25 bp, Rattus norvegicus
aagtgacagccttaccactggaggt

SEQ ID NO: 52431 - DNA, 25 bp, Rattus norvegicus
aagtgacaggtgcagcctggcctct

SEQ ID NO: 52432 - DNA, 25 bp, Rattus norvegicus
aagtgacaggtggagcctggcctct

SEQ ID NO: 52433 - DNA, 25 bp, Rattus norvegicus
aagtgacagtacatggattccagga

SEQ ID NO: 52434 - DNA, 25 bp, Rattus norvegicus
aagtgacagtacttggattccagga

SEQ ID NO: 52435 - DNA, 25 bp, Rattus norvegicus
aagtgacatacacttggctgctcaa

SEQ ID NO: 52436 - DNA, 25 bp, Rattus norvegicus
aagtgacatacagttggctgctcaa

SEQ ID NO: 52437 - DNA, 25 bp, Rattus norvegicus
aagtgacatagaacagcctgctttt

SEQ ID NO: 52438 - DNA, 25 bp, Rattus norvegicus
aagtgacatagatcagcctgctttt

SEQ ID NO: 52439 - DNA, 25 bp, Rattus norvegicus
aagtgacatcctaagcatgggcttt

SEQ ID NO: 52440 - DNA, 25 bp, Rattus norvegicus
aagtgacatcctactacattgtggt

SEQ ID NO: 52441 - DNA, 25 bp, Rattus norvegicus
aagtgacatccttagcatgggcttt

SEQ ID NO: 52442 - DNA, 25 bp, Rattus norvegicus
aagtgacatccttctacattgtggt

SEQ ID NO: 52443 - DNA, 25 bp, Rattus norvegicus
aagtgacatcgtagacaacctggat

SEQ ID NO: 52444 - DNA, 25 bp, Rattus norvegicus
aagtgacatcgttgacaacctggat

SEQ ID NO: 52445 - DNA, 25 bp, Rattus norvegicus
aagtgacatgttacagcagaccgaa

SEQ ID NO: 52446 - DNA, 25 bp, Rattus norvegicus
aagtgacatgttagtctcagacaat

SEQ ID NO: 52447 - DNA, 25 bp, Rattus norvegicus
aagtgacatgtttcagcagaccgaa

SEQ ID NO: 52448 - DNA, 25 bp, Rattus norvegicus
aagtgacatgtttgtctcagacaat

SEQ ID NO: 52449 - DNA, 25 bp, Rattus norvegicus
aagtgaccaaacatctcattttgat

SEQ ID NO: 52450 - DNA, 25 bp, Rattus norvegicus
aagtgaccaaacttctcattttgat

SEQ ID NO: 52451 - DNA, 25 bp, Rattus norvegicus
aagtgaccaatgcagtggccagtcc

SEQ ID NO: 52452 - DNA, 25 bp, Rattus norvegicus
aagtgaccaatggagtggccagtcc

SEQ ID NO: 52453 - DNA, 25 bp, Rattus norvegicus
aagtgaccaccgagagtgatgacca

SEQ ID NO: 52454 - DNA, 25 bp, Rattus norvegicus
aagtgaccaccgtgagtgatgacca

SEQ ID NO: 52455 - DNA, 25 bp, Rattus norvegicus
aagtgaccactgcatcttcagcaac

SEQ ID NO: 52456 - DNA, 25 bp, Rattus norvegicus
aagtgaccactggatcttcagcaac

SEQ ID NO: 52457 - DNA, 25 bp, Rattus norvegicus
aagtgaccagaaaccctgcagtgga

SEQ ID NO: 52458 - DNA, 25 bp, Rattus norvegicus
aagtgaccagaatccctgcagtgga

SEQ ID NO: 52459 - DNA, 25 bp, Rattus norvegicus
aagtgaccagcacaagctctcggga

SEQ ID NO: 52460 - DNA, 25 bp, Rattus norvegicus
aagtgaccagcagaagctctcggga

SEQ ID NO: 52461 - DNA, 25 bp, Rattus norvegicus
aagtgaccagttacggtgccttctc

SEQ ID NO: 52462 - DNA, 25 bp, Rattus norvegicus
aagtgaccagtttcggtgccttctc

SEQ ID NO: 52463 - DNA, 25 bp, Rattus norvegicus
aagtgaccatgtacaggcaattcct

SEQ ID NO: 52464 - DNA, 25 bp, Rattus norvegicus
aagtgaccatgtcgctcttctgtga

SEQ ID NO: 52465 - DNA, 25 bp, Rattus norvegicus
aagtgaccatgtggctcttctgtga

SEQ ID NO: 52466 - DNA, 25 bp, Rattus norvegicus
aagtgaccatgttcaggcaattcct

SEQ ID NO: 52467 - DNA, 25 bp, Rattus norvegicus
aagtgacccacaatcagactggaaa

SEQ ID NO: 52468 - DNA, 25 bp, Rattus norvegicus
aagtgacccacattcagactggaaa

SEQ ID NO: 52469 - DNA, 25 bp, Rattus norvegicus
aagtgacccactaagcaggaaagac

SEQ ID NO: 52470 - DNA, 25 bp, Rattus norvegicus
aagtgacccactacagcaatctgct

SEQ ID NO: 52471 - DNA, 25 bp, Rattus norvegicus
aagtgacccacttagcaggaaagac

SEQ ID NO: 52472 - DNA, 25 bp, Rattus norvegicus
aagtgacccacttcagcaatctgct

SEQ ID NO: 52473 - DNA, 25 bp, Rattus norvegicus
aagtgacccatgcttctggctggca

SEQ ID NO: 52474 - DNA, 25 bp, Rattus norvegicus
aagtgacccatggttctggctggca

SEQ ID NO: 52475 - DNA, 25 bp, Rattus norvegicus
aagtgacccctgaagcatgatgtgt

SEQ ID NO: 52476 - DNA, 25 bp, Rattus norvegicus
aagtgacccctgtagcatgatgtgt

SEQ ID NO: 52477 - DNA, 25 bp, Rattus norvegicus
aagtgacccgcaaggatgcccagaa

SEQ ID NO: 52478 - DNA, 25 bp, Rattus norvegicus
aagtgacccgcatggatgcccagaa

SEQ ID NO: 52479 - DNA, 25 bp, Rattus norvegicus
aagtgaccctgacactctagtgaag

SEQ ID NO: 52480 - DNA, 25 bp, Rattus norvegicus
aagtgaccctgagactctagtgaag

SEQ ID NO: 52481 - DNA, 25 bp, Rattus norvegicus
aagtgaccgccaagcaatgcgttct

SEQ ID NO: 52482 - DNA, 25 bp, Rattus norvegicus
aagtgaccgccatgcaatgcgttct

SEQ ID NO: 52483 - DNA, 25 bp, Rattus norvegicus
aagtgaccggaaactgccatgacaa

SEQ ID NO: 52484 - DNA, 25 bp, Rattus norvegicus
aagtgaccggaatctgccatgacaa

SEQ ID NO: 52485 - DNA, 25 bp, Rattus norvegicus
aagtgaccggtgatggatcctggat

SEQ ID NO: 52486 - DNA, 25 bp, Rattus norvegicus
aagtgaccggtgttggatcctggat

SEQ ID NO: 52487 - DNA, 25 bp, Rattus norvegicus
aagtgacctgcaatgaattcccaag

SEQ ID NO: 52488 - DNA, 25 bp, Rattus norvegicus
aagtgacctgcattgaattcccaag

SEQ ID NO: 52489 - DNA, 25 bp, Rattus norvegicus
aagtgaccttagatgccagctgaga

SEQ ID NO: 52490 - DNA, 25 bp, Rattus norvegicus
aagtgaccttagttgccagctgaga

SEQ ID NO: 52491 - DNA, 25 bp, Rattus norvegicus
aagtgaccttcgattggataaagct

SEQ ID NO: 52492 - DNA, 25 bp, Rattus norvegicus
aagtgaccttcgtttggataaagct

SEQ ID NO: 52493 - DNA, 25 bp, Rattus norvegicus
aagtgaccttgtctttatctcgtgt

SEQ ID NO: 52494 - DNA, 25 bp, Rattus norvegicus
aagtgaccttgtgtttatctcgtgt

SEQ ID NO: 52495 - DNA, 25 bp, Rattus norvegicus
aagtgacgaacactgctgctgccct

SEQ ID NO: 52496 - DNA, 25 bp, Rattus norvegicus
aagtgacgaacagtgctgctgccct

SEQ ID NO: 52497 - DNA, 25 bp, Rattus norvegicus
aagtgacggacgatctagtctgttt

SEQ ID NO: 52498 - DNA, 25 bp, Rattus norvegicus
aagtgacggacgttctagtctgttt

SEQ ID NO: 52499 - DNA, 25 bp, Rattus norvegicus
aagtgacgggcacaactaccctcta

SEQ ID NO: 52500 - DNA, 25 bp, Rattus norvegicus
aagtgacgggcagaactaccctcta

SEQ ID NO: 52501 - DNA, 25 bp, Rattus norvegicus
aagtgacgtagcagggcacagcgca

SEQ ID NO: 52502 - DNA, 25 bp, Rattus norvegicus
aagtgacgtagctgggcacagcgca

SEQ ID NO: 52503 - DNA, 25 bp, Rattus norvegicus
aagtgactaagacttctcctctgct

SEQ ID NO: 52504 - DNA, 25 bp, Rattus norvegicus
aagtgactaagagttctcctctgct

SEQ ID NO: 52505 - DNA, 25 bp, Rattus norvegicus
aagtgactaggtcactctgggctgt

SEQ ID NO: 52506 - DNA, 25 bp, Rattus norvegicus
aagtgactaggtgactctgggctgt

SEQ ID NO: 52507 - DNA, 25 bp, Rattus norvegicus
aagtgactatctccaataggcttgt

SEQ ID NO: 52508 - DNA, 25 bp, Rattus norvegicus
aagtgactatctgcaataggcttgt

SEQ ID NO: 52509 - DNA, 25 bp, Rattus norvegicus
aagtgactattacactgcccttcag

SEQ ID NO: 52510 - DNA, 25 bp, Rattus norvegicus
aagtgactattagactgcccttcag

SEQ ID NO: 52511 - DNA, 25 bp, Rattus norvegicus
aagtgactcaatagcttcatttgtg

SEQ ID NO: 52512 - DNA, 25 bp, Rattus norvegicus
aagtgactcaattgcttcatttgtg

SEQ ID NO: 52513 - DNA, 25 bp, Rattus norvegicus
aagtgactccttatgccttgaggtg

SEQ ID NO: 52514 - DNA, 25 bp, Rattus norvegicus
aagtgactccttttgccttgaggtg

SEQ ID NO: 52515 - DNA, 25 bp, Rattus norvegicus
aagtgactcgcaagccgtaacggtt

SEQ ID NO: 52516 - DNA, 25 bp, Rattus norvegicus
aagtgactcgcatgccgtaacggtt

SEQ ID NO: 52517 - DNA, 25 bp, Rattus norvegicus
aagtgactctgtcttgattccttgc

SEQ ID NO: 52518 - DNA, 25 bp, Rattus norvegicus
aagtgactctgtgttgattccttgc

SEQ ID NO: 52519 - DNA, 25 bp, Rattus norvegicus
aagtgactgagaccctctaacgtcg

SEQ ID NO: 52520 - DNA, 25 bp, Rattus norvegicus
aagtgactgagagcctctaacgtcg

SEQ ID NO: 52521 - DNA, 25 bp, Rattus norvegicus
aagtgactgatgaacctagaggaaa

SEQ ID NO: 52522 - DNA, 25 bp, Rattus norvegicus
aagtgactgatgtacctagaggaaa

SEQ ID NO: 52523 - DNA, 25 bp, Rattus norvegicus
aagtgactgccacgcggttgtgtat

SEQ ID NO: 52524 - DNA, 25 bp, Rattus norvegicus
aagtgactgccaggcggttgtgtat

SEQ ID NO: 52525 - DNA, 25 bp, Rattus norvegicus
aagtgactgctgaatcccgctgtaa

SEQ ID NO: 52526 - DNA, 25 bp, Rattus norvegicus
aagtgactgctgctcaattgatgta

SEQ ID NO: 52527 - DNA, 25 bp, Rattus norvegicus
aagtgactgctggtcaattgatgta

SEQ ID NO: 52528 - DNA, 25 bp, Rattus norvegicus
aagtgactgctgtatcccgctgtaa

SEQ ID NO: 52529 - DNA, 25 bp, Rattus norvegicus
aagtgactgcttatcattgaaggca

SEQ ID NO: 52530 - DNA, 25 bp, Rattus norvegicus
aagtgactgcttttcattgaaggca

SEQ ID NO: 52531 - DNA, 25 bp, Rattus norvegicus
aagtgactgttgctgtcaggtgccc

SEQ ID NO: 52532 - DNA, 25 bp, Rattus norvegicus
aagtgactgttggtgtcaggtgccc

SEQ ID NO: 52533 - DNA, 25 bp, Rattus norvegicus
aagtgacttcacctgttgcatccgt

SEQ ID NO: 52534 - DNA, 25 bp, Rattus norvegicus
aagtgacttcacgtgttgcatccgt

SEQ ID NO: 52535 - DNA, 25 bp, Rattus norvegicus
aagtgacttcagcttgggtgaccca

SEQ ID NO: 52536 - DNA, 25 bp, Rattus norvegicus
aagtgacttcaggttgggtgaccca

SEQ ID NO: 52537 - DNA, 25 bp, Rattus norvegicus
aagtgacttctgcttcctgggctat

SEQ ID NO: 52538 - DNA, 25 bp, Rattus norvegicus
aagtgacttctggttcctgggctat

SEQ ID NO: 52539 - DNA, 25 bp, Rattus norvegicus
aagtgacttgtgaggcatgctggct

SEQ ID NO: 52540 - DNA, 25 bp, Rattus norvegicus
aagtgacttgtgtggcatgctggct

SEQ ID NO: 52541 - DNA, 25 bp, Rattus norvegicus
aagtgactttcgctgggttctgcag

SEQ ID NO: 52542 - DNA, 25 bp, Rattus norvegicus
aagtgactttcggtgggttctgcag

SEQ ID NO: 52543 - DNA, 25 bp, Rattus norvegicus
aagtgactttgcacctctccagagg

SEQ ID NO: 52544 - DNA, 25 bp, Rattus norvegicus
aagtgactttgcagcatactctgct

SEQ ID NO: 52545 - DNA, 25 bp, Rattus norvegicus
aagtgactttgctcctctccagagg

SEQ ID NO: 52546 - DNA, 25 bp, Rattus norvegicus
aagtgactttgctgcatactctgct

SEQ ID NO: 52547 - DNA, 25 bp, Rattus norvegicus
aagtgagaaggcattctttatgcag

SEQ ID NO: 52548 - DNA, 25 bp, Rattus norvegicus
aagtgagaaggctttctttatgcag

SEQ ID NO: 52549 - DNA, 25 bp, Rattus norvegicus
aagtgagacacaagcccttcacgtg

SEQ ID NO: 52550 - DNA, 25 bp, Rattus norvegicus
aagtgagacacatgcccttcacgtg

SEQ ID NO: 52551 - DNA, 25 bp, Rattus norvegicus
aagtgagaccggctgcagactagtt

SEQ ID NO: 52552 - DNA, 25 bp, Rattus norvegicus
aagtgagaccgggtgcagactagtt

SEQ ID NO: 52553 - DNA, 25 bp, Rattus norvegicus
aagtgagactcaagcatccttgctt

SEQ ID NO: 52554 - DNA, 25 bp, Rattus norvegicus
aagtgagactcatgcatccttgctt

SEQ ID NO: 52555 - DNA, 25 bp, Rattus norvegicus
aagtgagactccagcagccaagcgc

SEQ ID NO: 52556 - DNA, 25 bp, Rattus norvegicus
aagtgagactcctgcagccaagcgc

SEQ ID NO: 52557 - DNA, 25 bp, Rattus norvegicus
aagtgagactgtcctcttgtggagt

SEQ ID NO: 52558 - DNA, 25 bp, Rattus norvegicus
aagtgagactgtgctcttgtggagt

SEQ ID NO: 52559 - DNA, 25 bp, Rattus norvegicus
aagtgagagcagacctcttagtatt

SEQ ID NO: 52560 - DNA, 25 bp, Rattus norvegicus
aagtgagagcagtcctcttagtatt

SEQ ID NO: 52561 - DNA, 25 bp, Rattus norvegicus
aagtgagagcccagtggcagttctt

SEQ ID NO: 52562 - DNA, 25 bp, Rattus norvegicus
aagtgagagccctgtggcagttctt

SEQ ID NO: 52563 - DNA, 25 bp, Rattus norvegicus
aagtgagatattcagctccccacag

SEQ ID NO: 52564 - DNA, 25 bp, Rattus norvegicus
aagtgagatattgagctccccacag

SEQ ID NO: 52565 - DNA, 25 bp, Rattus norvegicus
aagtgagatcgcacccaacagagac

SEQ ID NO: 52566 - DNA, 25 bp, Rattus norvegicus
aagtgagatcgctcccaacagagac

SEQ ID NO: 52567 - DNA, 25 bp, Rattus norvegicus
aagtgagatgtcaaagcgccctccc

SEQ ID NO: 52568 - DNA, 25 bp, Rattus norvegicus
aagtgagatgtctaagcgccctccc

SEQ ID NO: 52569 - DNA, 25 bp, Rattus norvegicus
aagtgagatttacccaatagctgga

SEQ ID NO: 52570 - DNA, 25 bp, Rattus norvegicus
aagtgagatttagccaatagctgga

SEQ ID NO: 52571 - DNA, 25 bp, Rattus norvegicus
aagtgagcacacacgcgtacacaca

SEQ ID NO: 52572 - DNA, 25 bp, Rattus norvegicus
aagtgagcacactcgcgtacacaca

SEQ ID NO: 52573 - DNA, 25 bp, Rattus norvegicus
aagtgagcacagcttcctgacctgc

SEQ ID NO: 52574 - DNA, 25 bp, Rattus norvegicus
aagtgagcacaggttcctgacctgc

SEQ ID NO: 52575 - DNA, 25 bp, Rattus norvegicus
aagtgagcacttccaggaaattctg

SEQ ID NO: 52576 - DNA, 25 bp, Rattus norvegicus
aagtgagcacttgcaggaaattctg

SEQ ID NO: 52577 - DNA, 25 bp, Rattus norvegicus
aagtgagcagccagcacctggatga

SEQ ID NO: 52578 - DNA, 25 bp, Rattus norvegicus
aagtgagcagcctgcacctggatga

SEQ ID NO: 52579 - DNA, 25 bp, Rattus norvegicus
aagtgagcaggaatgcccacctctt

SEQ ID NO: 52580 - DNA, 25 bp, Rattus norvegicus
aagtgagcaggattgcccacctctt

SEQ ID NO: 52581 - DNA, 25 bp, Rattus norvegicus
aagtgagcagttattgagcaggaat

SEQ ID NO: 52582 - DNA, 25 bp, Rattus norvegicus
aagtgagcagtttttgagcaggaat

SEQ ID NO: 52583 - DNA, 25 bp, Rattus norvegicus
aagtgagcatccagatggcttcacc

SEQ ID NO: 52584 - DNA, 25 bp, Rattus norvegicus
aagtgagcatcctgatggcttcacc

SEQ ID NO: 52585 - DNA, 25 bp, Rattus norvegicus
aagtgagcccagagtacttctccat

SEQ ID NO: 52586 - DNA, 25 bp, Rattus norvegicus
aagtgagcccagtgtacttctccat

SEQ ID NO: 52587 - DNA, 25 bp, Rattus norvegicus
aagtgagccctcctctcatgggatg

SEQ ID NO: 52588 - DNA, 25 bp, Rattus norvegicus
aagtgagccctcgtctcatgggatg

SEQ ID NO: 52589 - DNA, 25 bp, Rattus norvegicus
aagtgagcctgacctttaccagtta

SEQ ID NO: 52590 - DNA, 25 bp, Rattus norvegicus
aagtgagcctgagctttaccagtta

SEQ ID NO: 52591 - DNA, 25 bp, Rattus norvegicus
aagtgagccttgatccattgttcaa

SEQ ID NO: 52592 - DNA, 25 bp, Rattus norvegicus
aagtgagccttgttccattgttcaa

SEQ ID NO: 52593 - DNA, 25 bp, Rattus norvegicus
aagtgagcctttcagtcacctggta

SEQ ID NO: 52594 - DNA, 25 bp, Rattus norvegicus
aagtgagcctttgagtcacctggta

SEQ ID NO: 52595 - DNA, 25 bp, Rattus norvegicus
aagtgagcgattcgtggctcctacg

SEQ ID NO: 52596 - DNA, 25 bp, Rattus norvegicus
aagtgagcgattggtggctcctacg

SEQ ID NO: 52597 - DNA, 25 bp, Rattus norvegicus
aagtgagcggtcagccaagaagttc

SEQ ID NO: 52598 - DNA, 25 bp, Rattus norvegicus
aagtgagcggtctgccaagaagttc

SEQ ID NO: 52599 - DNA, 25 bp, Rattus norvegicus
aagtgagcgtctcatcatgcagctt

SEQ ID NO: 52600 - DNA, 25 bp, Rattus norvegicus
aagtgagcgtctgatcatgcagctt

SEQ ID NO: 52601 - DNA, 25 bp, Rattus norvegicus
aagtgagctattcctgcagtcctgc

SEQ ID NO: 52602 - DNA, 25 bp, Rattus norvegicus
aagtgagctattgctgcagtcctgc

SEQ ID NO: 52603 - DNA, 25 bp, Rattus norvegicus
aagtgagctcagaaggcttcgtgcc

SEQ ID NO: 52604 - DNA, 25 bp, Rattus norvegicus
aagtgagctcagtaggcttcgtgcc

SEQ ID NO: 52605 - DNA, 25 bp, Rattus norvegicus
aagtgagctgccagtggcttcccag

SEQ ID NO: 52606 - DNA, 25 bp, Rattus norvegicus
aagtgagctgcctgtggcttcccag

SEQ ID NO: 52607 - DNA, 25 bp, Rattus norvegicus
aagtgagcttgtaggctccatttat

SEQ ID NO: 52608 - DNA, 25 bp, Rattus norvegicus
aagtgagcttgttggctccatttat

SEQ ID NO: 52609 - DNA, 25 bp, Rattus norvegicus
aagtgagctttgagaccttctccta

SEQ ID NO: 52610 - DNA, 25 bp, Rattus norvegicus
aagtgagctttgtgaccttctccta

SEQ ID NO: 52611 - DNA, 25 bp, Rattus norvegicus
aagtgaggaaccaggccagcagtca

SEQ ID NO: 52612 - DNA, 25 bp, Rattus norvegicus
aagtgaggaacctggccagcagtca

SEQ ID NO: 52613 - DNA, 25 bp, Rattus norvegicus
aagtgaggaccacgcttctagctat

SEQ ID NO: 52614 - DNA, 25 bp, Rattus norvegicus
aagtgaggaccaggcttctagctat

SEQ ID NO: 52615 - DNA, 25 bp, Rattus norvegicus
aagtgaggacccatgctgatgccaa

SEQ ID NO: 52616 - DNA, 25 bp, Rattus norvegicus
aagtgaggacccttgctgatgccaa

SEQ ID NO: 52617 - DNA, 25 bp, Rattus norvegicus
aagtgaggagacagctggagcccca

SEQ ID NO: 52618 - DNA, 25 bp, Rattus norvegicus
aagtgaggagactgctggagcccca

SEQ ID NO: 52619 - DNA, 25 bp, Rattus norvegicus
aagtgaggagtcagccagcaggtct

SEQ ID NO: 52620 - DNA, 25 bp, Rattus norvegicus
aagtgaggagtctgccagcaggtct

SEQ ID NO: 52621 - DNA, 25 bp, Rattus norvegicus
aagtgaggagttcagttatctgaac

SEQ ID NO: 52622 - DNA, 25 bp, Rattus norvegicus
aagtgaggagttgagttatctgaac

SEQ ID NO: 52623 - DNA, 25 bp, Rattus norvegicus
aagtgaggcactattcccatcagag

SEQ ID NO: 52624 - DNA, 25 bp, Rattus norvegicus
aagtgaggcacttttcccatcagag

SEQ ID NO: 52625 - DNA, 25 bp, Rattus norvegicus
aagtgaggccaccaacctgacgcat

SEQ ID NO: 52626 - DNA, 25 bp, Rattus norvegicus
aagtgaggccacgaacctgacgcat

SEQ ID NO: 52627 - DNA, 25 bp, Rattus norvegicus
aagtgaggcctgagcagccacggca

SEQ ID NO: 52628 - DNA, 25 bp, Rattus norvegicus
aagtgaggcctgtgcagccacggca

SEQ ID NO: 52629 - DNA, 25 bp, Rattus norvegicus
aagtgaggctgtagctggcctacaa

SEQ ID NO: 52630 - DNA, 25 bp, Rattus norvegicus
aagtgaggctgttgctggcctacaa

SEQ ID NO: 52631 - DNA, 25 bp, Rattus norvegicus
aagtgaggcttacaccagggtgcaa

SEQ ID NO: 52632 - DNA, 25 bp, Rattus norvegicus
aagtgaggcttagaccagggtgcaa

SEQ ID NO: 52633 - DNA, 25 bp, Rattus norvegicus
aagtgagggagcaggctcctttcct

SEQ ID NO: 52634 - DNA, 25 bp, Rattus norvegicus
aagtgagggagctggctcctttcct

SEQ ID NO: 52635 - DNA, 25 bp, Rattus norvegicus
aagtgagggctccatctatgttgct

SEQ ID NO: 52636 - DNA, 25 bp, Rattus norvegicus
aagtgagggctcgatctatgttgct

SEQ ID NO: 52637 - DNA, 25 bp, Rattus norvegicus
aagtgaggtcttacagccttgctgc

SEQ ID NO: 52638 - DNA, 25 bp, Rattus norvegicus
aagtgaggtcttcccaggccttgga

SEQ ID NO: 52639 - DNA, 25 bp, Rattus norvegicus
aagtgaggtcttgccaggccttgga

SEQ ID NO: 52640 - DNA, 25 bp, Rattus norvegicus
aagtgaggtctttcagccttgctgc

SEQ ID NO: 52641 - DNA, 25 bp, Rattus norvegicus
aagtgaggtgtccataccaggagct

SEQ ID NO: 52642 - DNA, 25 bp, Rattus norvegicus
aagtgaggtgtcgataccaggagct

SEQ ID NO: 52643 - DNA, 25 bp, Rattus norvegicus
aagtgaggtgtgacaggactcgtct

SEQ ID NO: 52644 - DNA, 25 bp, Rattus norvegicus
aagtgaggtgtgtcaggactcgtct

SEQ ID NO: 52645 - DNA, 25 bp, Rattus norvegicus
aagtgaggttgtcgtcctccctgga

SEQ ID NO: 52646 - DNA, 25 bp, Rattus norvegicus
aagtgaggttgtggtcctccctgga

SEQ ID NO: 52647 - DNA, 25 bp, Rattus norvegicus
aagtgagtattcaggcaatgcctac

SEQ ID NO: 52648 - DNA, 25 bp, Rattus norvegicus
aagtgagtattctggcaatgcctac

SEQ ID NO: 52649 - DNA, 25 bp, Rattus norvegicus
aagtgagtcaggagattgctgtact

SEQ ID NO: 52650 - DNA, 25 bp, Rattus norvegicus
aagtgagtcaggtgattgctgtact

SEQ ID NO: 52651 - DNA, 25 bp, Rattus norvegicus
aagtgagtcctacctagcgctgggc

SEQ ID NO: 52652 - DNA, 25 bp, Rattus norvegicus
aagtgagtcctagctagcgctgggc

SEQ ID NO: 52653 - DNA, 25 bp, Rattus norvegicus
aagtgagtggctacggtgtcagcta

SEQ ID NO: 52654 - DNA, 25 bp, Rattus norvegicus
aagtgagtggcttcggtgtcagcta

SEQ ID NO: 52655 - DNA, 25 bp, Rattus norvegicus
aagtgagtgggtatctgcatataaa

SEQ ID NO: 52656 - DNA, 25 bp, Rattus norvegicus
aagtgagtgggtttctgcatataaa

SEQ ID NO: 52657 - DNA, 25 bp, Rattus norvegicus
aagtgagttcatatgtctgtgtcga

SEQ ID NO: 52658 - DNA, 25 bp, Rattus norvegicus
aagtgagttcatttgtctgtgtcga

SEQ ID NO: 52659 - DNA, 25 bp, Rattus norvegicus
aagtgagttccgacaagccactggg

SEQ ID NO: 52660 - DNA, 25 bp, Rattus norvegicus
aagtgagttccgtcaagccactggg

SEQ ID NO: 52661 - DNA, 25 bp, Rattus norvegicus
aagtgagtttatatccagcctggac

SEQ ID NO: 52662 - DNA, 25 bp, Rattus norvegicus
aagtgagtttatttccagcctggac

SEQ ID NO: 52663 - DNA, 25 bp, Rattus norvegicus
aagtgataagcaacagccgccggaa

SEQ ID NO: 52664 - DNA, 25 bp, Rattus norvegicus
aagtgataagcatcagccgccggaa

SEQ ID NO: 52665 - DNA, 25 bp, Rattus norvegicus
aagtgataccccaacgtgcatatgt

SEQ ID NO: 52666 - DNA, 25 bp, Rattus norvegicus
aagtgatacccctacgtgcatatgt

SEQ ID NO: 52667 - DNA, 25 bp, Rattus norvegicus
aagtgataccctcccttggttaaat

SEQ ID NO: 52668 - DNA, 25 bp, Rattus norvegicus
aagtgataccctgccttggttaaat

SEQ ID NO: 52669 - DNA, 25 bp, Rattus norvegicus
aagtgatacctgcagttcctagctc

SEQ ID NO: 52670 - DNA, 25 bp, Rattus norvegicus
aagtgatacctggagttcctagctc

SEQ ID NO: 52671 - DNA, 25 bp, Rattus norvegicus
aagtgatactatcctggcagttctt

SEQ ID NO: 52672 - DNA, 25 bp, Rattus norvegicus
aagtgatactatgctggcagttctt

SEQ ID NO: 52673 - DNA, 25 bp, Rattus norvegicus
aagtgatagcctatggtcttcccag

SEQ ID NO: 52674 - DNA, 25 bp, Rattus norvegicus
aagtgatagcctttggtcttcccag

SEQ ID NO: 52675 - DNA, 25 bp, Rattus norvegicus
aagtgataggtccttgttcctgctt

SEQ ID NO: 52676 - DNA, 25 bp, Rattus norvegicus
aagtgataggtcgttgttcctgctt

SEQ ID NO: 52677 - DNA, 25 bp, Rattus norvegicus
aagtgatcacagctagccttggccc

SEQ ID NO: 52678 - DNA, 25 bp, Rattus norvegicus
aagtgatcacaggtagccttggccc

SEQ ID NO: 52679 - DNA, 25 bp, Rattus norvegicus
aagtgatcatataagtgctgttcta

SEQ ID NO: 52680 - DNA, 25 bp, Rattus norvegicus
aagtgatcatattagtgctgttcta

SEQ ID NO: 52681 - DNA, 25 bp, Rattus norvegicus
aagtgatcattcaatcggccaggga

SEQ ID NO: 52682 - DNA, 25 bp, Rattus norvegicus
aagtgatcattctatcggccaggga

SEQ ID NO: 52683 - DNA, 25 bp, Rattus norvegicus
aagtgatccccaccttgaggtccat

SEQ ID NO: 52684 - DNA, 25 bp, Rattus norvegicus
aagtgatccccagcttgaggtccat

SEQ ID NO: 52685 - DNA, 25 bp, Rattus norvegicus
aagtgatcctgtaacattggttaaa

SEQ ID NO: 52686 - DNA, 25 bp, Rattus norvegicus
aagtgatcctgttacattggttaaa

SEQ ID NO: 52687 - DNA, 25 bp, Rattus norvegicus
aagtgatccttgagaatttgtgaaa

SEQ ID NO: 52688 - DNA, 25 bp, Rattus norvegicus
aagtgatccttgcagagtctgttcc

SEQ ID NO: 52689 - DNA, 25 bp, Rattus norvegicus
aagtgatccttggagagtctgttcc

SEQ ID NO: 52690 - DNA, 25 bp, Rattus norvegicus
aagtgatccttgtgaatttgtgaaa

SEQ ID NO: 52691 - DNA, 25 bp, Rattus norvegicus
aagtgatcgctgaattgctttctcg

SEQ ID NO: 52692 - DNA, 25 bp, Rattus norvegicus
aagtgatcgctgtattgctttctcg

SEQ ID NO: 52693 - DNA, 25 bp, Rattus norvegicus
aagtgatcttaactcccagcctcag

SEQ ID NO: 52694 - DNA, 25 bp, Rattus norvegicus
aagtgatcttaagtcccagcctcag

SEQ ID NO: 52695 - DNA, 25 bp, Rattus norvegicus
aagtgatgactaatccccgttgttg

SEQ ID NO: 52696 - DNA, 25 bp, Rattus norvegicus
aagtgatgactattccccgttgttg

SEQ ID NO: 52697 - DNA, 25 bp, Rattus norvegicus
aagtgatgaggcctttgttctatct

SEQ ID NO: 52698 - DNA, 25 bp, Rattus norvegicus
aagtgatgaggcgtttgttctatct

SEQ ID NO: 52699 - DNA, 25 bp, Rattus norvegicus
aagtgatgataactctgtgccccga

SEQ ID NO: 52700 - DNA, 25 bp, Rattus norvegicus
aagtgatgataagtctgtgccccga

SEQ ID NO: 52701 - DNA, 25 bp, Rattus norvegicus
aagtgatgatacacgggctgctaga

SEQ ID NO: 52702 - DNA, 25 bp, Rattus norvegicus
aagtgatgatactcgggctgctaga

SEQ ID NO: 52703 - DNA, 25 bp, Rattus norvegicus
aagtgatgatccatgccaggctctg

SEQ ID NO: 52704 - DNA, 25 bp, Rattus norvegicus
aagtgatgatccttgccaggctctg

SEQ ID NO: 52705 - DNA, 25 bp, Rattus norvegicus
aagtgatgcagtcgccacaccgagc

SEQ ID NO: 52706 - DNA, 25 bp, Rattus norvegicus
aagtgatgcagtggccacaccgagc

SEQ ID NO: 52707 - DNA, 25 bp, Rattus norvegicus
aagtgatgcgagaatcctcctcttg

SEQ ID NO: 52708 - DNA, 25 bp, Rattus norvegicus
aagtgatgcgagtatcctcctcttg

SEQ ID NO: 52709 - DNA, 25 bp, Rattus norvegicus
aagtgatggagcacctgccagagaa

SEQ ID NO: 52710 - DNA, 25 bp, Rattus norvegicus
aagtgatggagctcctgccagagaa

SEQ ID NO: 52711 - DNA, 25 bp, Rattus norvegicus
aagtgatggcttctgtggatattgt

SEQ ID NO: 52712 - DNA, 25 bp, Rattus norvegicus
aagtgatggcttgtgtggatattgt

SEQ ID NO: 52713 - DNA, 25 bp, Rattus norvegicus
aagtgatggttacggctcctttctg

SEQ ID NO: 52714 - DNA, 25 bp, Rattus norvegicus
aagtgatggttagggctcctttctg

SEQ ID NO: 52715 - DNA, 25 bp, Rattus norvegicus
aagtgatggttcatgcgcgtggtac

SEQ ID NO: 52716 - DNA, 25 bp, Rattus norvegicus
aagtgatggttcttgcgcgtggtac

SEQ ID NO: 52717 - DNA, 25 bp, Rattus norvegicus
aagtgatgtctgaggcttactgccc

SEQ ID NO: 52718 - DNA, 25 bp, Rattus norvegicus
aagtgatgtctgtggcttactgccc

SEQ ID NO: 52719 - DNA, 25 bp, Rattus norvegicus
aagtgatgtggtagtcagccattca

SEQ ID NO: 52720 - DNA, 25 bp, Rattus norvegicus
aagtgatgtggttgtcagccattca

SEQ ID NO: 52721 - DNA, 25 bp, Rattus norvegicus
aagtgatgtgtcacaggtcctgtgt

SEQ ID NO: 52722 - DNA, 25 bp, Rattus norvegicus
aagtgatgtgtctcaggtcctgtgt

SEQ ID NO: 52723 - DNA, 25 bp, Rattus norvegicus
aagtgattcacccttgttccttggt

SEQ ID NO: 52724 - DNA, 25 bp, Rattus norvegicus
aagtgattcaccgttgttccttggt

SEQ ID NO: 52725 - DNA, 25 bp, Rattus norvegicus
aagtgattcagcatccaagagacaa

SEQ ID NO: 52726 - DNA, 25 bp, Rattus norvegicus
aagtgattcagcttccaagagacaa

SEQ ID NO: 52727 - DNA, 25 bp, Rattus norvegicus
aagtgattccacagaggcccagtgc

SEQ ID NO: 52728 - DNA, 25 bp, Rattus norvegicus
aagtgattccactgaggcccagtgc

SEQ ID NO: 52729 - DNA, 25 bp, Rattus norvegicus
aagtgattcgcaaaatttctctctg

SEQ ID NO: 52730 - DNA, 25 bp, Rattus norvegicus
aagtgattcgcataatttctctctg

SEQ ID NO: 52731 - DNA, 25 bp, Rattus norvegicus
aagtgattcgttactctgttgcgtt

SEQ ID NO: 52732 - DNA, 25 bp, Rattus norvegicus
aagtgattcgtttctctgttgcgtt

SEQ ID NO: 52733 - DNA, 25 bp, Rattus norvegicus
aagtgattctttagttcagcagaca

SEQ ID NO: 52734 - DNA, 25 bp, Rattus norvegicus
aagtgattcttttgttcagcagaca

SEQ ID NO: 52735 - DNA, 25 bp, Rattus norvegicus
aagtgattgtccctagtgcagaata

SEQ ID NO: 52736 - DNA, 25 bp, Rattus norvegicus
aagtgattgtccgtagtgcagaata

SEQ ID NO: 52737 - DNA, 25 bp, Rattus norvegicus
aagtgattgtgaagccggactttca

SEQ ID NO: 52738 - DNA, 25 bp, Rattus norvegicus
aagtgattgtgatgccggactttca

SEQ ID NO: 52739 - DNA, 25 bp, Rattus norvegicus
aagtgattgtgccagcttctgtcca

SEQ ID NO: 52740 - DNA, 25 bp, Rattus norvegicus
aagtgattgtgcgagcttctgtcca

SEQ ID NO: 52741 - DNA, 25 bp, Rattus norvegicus
aagtgattgtgtaccctgatggtcc

SEQ ID NO: 52742 - DNA, 25 bp, Rattus norvegicus
aagtgattgtgttccctgatggtcc

SEQ ID NO: 52743 - DNA, 25 bp, Rattus norvegicus
aagtgatttagcagccattctgcca

SEQ ID NO: 52744 - DNA, 25 bp, Rattus norvegicus
aagtgatttagctgccattctgcca

SEQ ID NO: 52745 - DNA, 25 bp, Rattus norvegicus
aagtgatttggcaccgagtctccat

SEQ ID NO: 52746 - DNA, 25 bp, Rattus norvegicus
aagtgatttggctccgagtctccat

SEQ ID NO: 52747 - DNA, 25 bp, Rattus norvegicus
aagtgattttctacgcccagtggaa

SEQ ID NO: 52748 - DNA, 25 bp, Rattus norvegicus
aagtgattttcttcgcccagtggaa

SEQ ID NO: 52749 - DNA, 25 bp, Rattus norvegicus
aagtgcaaaagcatgtgtttctaat

SEQ ID NO: 52750 - DNA, 25 bp, Rattus norvegicus
aagtgcaaaagcttgtgtttctaat

SEQ ID NO: 52751 - DNA, 25 bp, Rattus norvegicus
aagtgcaaaattatgttcttcattt

SEQ ID NO: 52752 - DNA, 25 bp, Rattus norvegicus
aagtgcaaaattttgttcttcattt

SEQ ID NO: 52753 - DNA, 25 bp, Rattus norvegicus
aagtgcaacacacccacatgtgcca

SEQ ID NO: 52754 - DNA, 25 bp, Rattus norvegicus
aagtgcaacacagccacatgtgcca

SEQ ID NO: 52755 - DNA, 25 bp, Rattus norvegicus
aagtgcaacacccatgacaccatcg

SEQ ID NO: 52756 - DNA, 25 bp, Rattus norvegicus
aagtgcaacaccgatgacaccatcg

SEQ ID NO: 52757 - DNA, 25 bp, Rattus norvegicus
aagtgcaacagcaacagcgccgcca

SEQ ID NO: 52758 - DNA, 25 bp, Rattus norvegicus
aagtgcaacagctacagcgccgcca

SEQ ID NO: 52759 - DNA, 25 bp, Rattus norvegicus
aagtgcaagcacatcccaggtcgtg

SEQ ID NO: 52760 - DNA, 25 bp, Rattus norvegicus
aagtgcaagcacttcccaggtcgtg

SEQ ID NO: 52761 - DNA, 25 bp, Rattus norvegicus
aagtgcaatgtcatacccaaggcct

SEQ ID NO: 52762 - DNA, 25 bp, Rattus norvegicus
aagtgcaatgtcttacccaaggcct

SEQ ID NO: 52763 - DNA, 25 bp, Rattus norvegicus
aagtgcacagctcgtgacgctccta

SEQ ID NO: 52764 - DNA, 25 bp, Rattus norvegicus
aagtgcacagctggtgacgctccta

SEQ ID NO: 52765 - DNA, 25 bp, Rattus norvegicus
aagtgcacaggcatgctattctacc

SEQ ID NO: 52766 - DNA, 25 bp, Rattus norvegicus
aagtgcacaggcttgctattctacc

SEQ ID NO: 52767 - DNA, 25 bp, Rattus norvegicus
aagtgcacagttctcatccttgaaa

SEQ ID NO: 52768 - DNA, 25 bp, Rattus norvegicus
aagtgcacagttgtcatccttgaaa

SEQ ID NO: 52769 - DNA, 25 bp, Rattus norvegicus
aagtgcacatgtctcttagaccctg

SEQ ID NO: 52770 - DNA, 25 bp, Rattus norvegicus
aagtgcacatgtgtcttagaccctg

SEQ ID NO: 52771 - DNA, 25 bp, Rattus norvegicus
aagtgcaccagcatcttcatgttac

SEQ ID NO: 52772 - DNA, 25 bp, Rattus norvegicus
aagtgcaccagcttcttcatgttac

SEQ ID NO: 52773 - DNA, 25 bp, Rattus norvegicus
aagtgcacccagagttcagcgagtt

SEQ ID NO: 52774 - DNA, 25 bp, Rattus norvegicus
aagtgcacccagtgttcagcgagtt

SEQ ID NO: 52775 - DNA, 25 bp, Rattus norvegicus
aagtgcacctctaggatatagacaa

SEQ ID NO: 52776 - DNA, 25 bp, Rattus norvegicus
aagtgcacctcttggatatagacaa

SEQ ID NO: 52777 - DNA, 25 bp, Rattus norvegicus
aagtgcacgtgtcctcagactcggg

SEQ ID NO: 52778 - DNA, 25 bp, Rattus norvegicus
aagtgcacgtgtgctcagactcggg

SEQ ID NO: 52779 - DNA, 25 bp, Rattus norvegicus
aagtgcagacctcaaaactcccctg

SEQ ID NO: 52780 - DNA, 25 bp, Rattus norvegicus
aagtgcagacctgaaaactcccctg

SEQ ID NO: 52781 - DNA, 25 bp, Rattus norvegicus
aagtgcagatcactgccacccatgc

SEQ ID NO: 52782 - DNA, 25 bp, Rattus norvegicus
aagtgcagatcagtgccacccatgc

SEQ ID NO: 52783 - DNA, 25 bp, Rattus norvegicus
aagtgcagccagctcaatcaattcc

SEQ ID NO: 52784 - DNA, 25 bp, Rattus norvegicus
aagtgcagccaggtcaatcaattcc

SEQ ID NO: 52785 - DNA, 25 bp, Rattus norvegicus
aagtgcagctacaccgaggaggctc

SEQ ID NO: 52786 - DNA, 25 bp, Rattus norvegicus
aagtgcagctactccgaggaggctc

SEQ ID NO: 52787 - DNA, 25 bp, Rattus norvegicus
aagtgcagctgcatcacttttgctt

SEQ ID NO: 52788 - DNA, 25 bp, Rattus norvegicus
aagtgcagctgcttcacttttgctt

SEQ ID NO: 52789 - DNA, 25 bp, Rattus norvegicus
aagtgcagggctcaccgttcaatgt

SEQ ID NO: 52790 - DNA, 25 bp, Rattus norvegicus
aagtgcagggctgaccgttcaatgt

SEQ ID NO: 52791 - DNA, 25 bp, Rattus norvegicus
aagtgcagggtcactggcctgattc

SEQ ID NO: 52792 - DNA, 25 bp, Rattus norvegicus
aagtgcagggtctctggcctgattc

SEQ ID NO: 52793 - DNA, 25 bp, Rattus norvegicus
aagtgcagtattatgtgttctctct

SEQ ID NO: 52794 - DNA, 25 bp, Rattus norvegicus
aagtgcagtattttgtgttctctct

SEQ ID NO: 52795 - DNA, 25 bp, Rattus norvegicus
aagtgcagtccacggctttacttgc

SEQ ID NO: 52796 - DNA, 25 bp, Rattus norvegicus
aagtgcagtccagggctttacttgc

SEQ ID NO: 52797 - DNA, 25 bp, Rattus norvegicus
aagtgcagtctgatcctcagcatca

SEQ ID NO: 52798 - DNA, 25 bp, Rattus norvegicus
aagtgcagtctgttcctcagcatca

SEQ ID NO: 52799 - DNA, 25 bp, Rattus norvegicus
aagtgcagtgatcatgtccacacgc

SEQ ID NO: 52800 - DNA, 25 bp, Rattus norvegicus
aagtgcagtgatgatgtccacacgc

SEQ ID NO: 52801 - DNA, 25 bp, Rattus norvegicus
aagtgcagtgttacctgcactcttg

SEQ ID NO: 52802 - DNA, 25 bp, Rattus norvegicus
aagtgcagtgttagccccagaagca

SEQ ID NO: 52803 - DNA, 25 bp, Rattus norvegicus
aagtgcagtgtttcctgcactcttg

SEQ ID NO: 52804 - DNA, 25 bp, Rattus norvegicus
aagtgcagtgtttgccccagaagca

SEQ ID NO: 52805 - DNA, 25 bp, Rattus norvegicus
aagtgcagttcactcaacgtctctc

SEQ ID NO: 52806 - DNA, 25 bp, Rattus norvegicus
aagtgcagttcagtcaacgtctctc

SEQ ID NO: 52807 - DNA, 25 bp, Rattus norvegicus
aagtgcagtttccttcaccttgaat

SEQ ID NO: 52808 - DNA, 25 bp, Rattus norvegicus
aagtgcagtttcgttcaccttgaat

SEQ ID NO: 52809 - DNA, 25 bp, Rattus norvegicus
aagtgcatataacaccctaccacac

SEQ ID NO: 52810 - DNA, 25 bp, Rattus norvegicus
aagtgcatataagaccctaccacac

SEQ ID NO: 52811 - DNA, 25 bp, Rattus norvegicus
aagtgcatcactccgtttgaggcca

SEQ ID NO: 52812 - DNA, 25 bp, Rattus norvegicus
aagtgcatcactgcgtttgaggcca

SEQ ID NO: 52813 - DNA, 25 bp, Rattus norvegicus
aagtgcatccctctgcttttttctt

SEQ ID NO: 52814 - DNA, 25 bp, Rattus norvegicus
aagtgcatccctgtgcttttttctt

SEQ ID NO: 52815 - DNA, 25 bp, Rattus norvegicus
aagtgcatccttcagatgtagcctt

SEQ ID NO: 52816 - DNA, 25 bp, Rattus norvegicus
aagtgcatccttgagatgtagcctt

SEQ ID NO: 52817 - DNA, 25 bp, Rattus norvegicus
aagtgcatctctcagggtgggattt

SEQ ID NO: 52818 - DNA, 25 bp, Rattus norvegicus
aagtgcatctctgagggtgggattt

SEQ ID NO: 52819 - DNA, 25 bp, Rattus norvegicus
aagtgcatctgtctatcctggttaa

SEQ ID NO: 52820 - DNA, 25 bp, Rattus norvegicus
aagtgcatctgtgtatcctggttaa

SEQ ID NO: 52821 - DNA, 25 bp, Rattus norvegicus
aagtgcatcttgagtgaaactcaat

SEQ ID NO: 52822 - DNA, 25 bp, Rattus norvegicus
aagtgcatcttgtgtgaaactcaat

SEQ ID NO: 52823 - DNA, 25 bp, Rattus norvegicus
aagtgcatgcctagcagcagtagcc

SEQ ID NO: 52824 - DNA, 25 bp, Rattus norvegicus
aagtgcatgccttgcagcagtagcc

SEQ ID NO: 52825 - DNA, 25 bp, Rattus norvegicus
aagtgcatggacctgtacacaccca

SEQ ID NO: 52826 - DNA, 25 bp, Rattus norvegicus
aagtgcatggacgtgtacacaccca

SEQ ID NO: 52827 - DNA, 25 bp, Rattus norvegicus
aagtgcatggagacgctggagccct

SEQ ID NO: 52828 - DNA, 25 bp, Rattus norvegicus
aagtgcatggagtcgctggagccct

SEQ ID NO: 52829 - DNA, 25 bp, Rattus norvegicus
aagtgcatggttacctgcttctaat

SEQ ID NO: 52830 - DNA, 25 bp, Rattus norvegicus
aagtgcatggtttcctgcttctaat

SEQ ID NO: 52831 - DNA, 25 bp, Rattus norvegicus
aagtgcatgtttatcgtcagcgtcg

SEQ ID NO: 52832 - DNA, 25 bp, Rattus norvegicus
aagtgcatgtttttcgtcagcgtcg

SEQ ID NO: 52833 - DNA, 25 bp, Rattus norvegicus
aagtgcattagcatgctgactcaga

SEQ ID NO: 52834 - DNA, 25 bp, Rattus norvegicus
aagtgcattagcttgctgactcaga

SEQ ID NO: 52835 - DNA, 25 bp, Rattus norvegicus
aagtgcattctccttgtgtctgcag

SEQ ID NO: 52836 - DNA, 25 bp, Rattus norvegicus
aagtgcattctcgttgtgtctgcag

SEQ ID NO: 52837 - DNA, 25 bp, Rattus norvegicus
aagtgcattgagaattgcccagccc

SEQ ID NO: 52838 - DNA, 25 bp, Rattus norvegicus
aagtgcattgagtattgcccagccc

SEQ ID NO: 52839 - DNA, 25 bp, Rattus norvegicus
aagtgcatttctaactggtgaagga

SEQ ID NO: 52840 - DNA, 25 bp, Rattus norvegicus
aagtgcatttcttactggtgaagga

SEQ ID NO: 52841 - DNA, 25 bp, Rattus norvegicus
aagtgcatttgcagcacaggttgtg

SEQ ID NO: 52842 - DNA, 25 bp, Rattus norvegicus
aagtgcatttgctgcacaggttgtg

SEQ ID NO: 52843 - DNA, 25 bp, Rattus norvegicus
aagtgccaagacatgtccgaagact

SEQ ID NO: 52844 - DNA, 25 bp, Rattus norvegicus
aagtgccaagacttgtccgaagact

SEQ ID NO: 52845 - DNA, 25 bp, Rattus norvegicus
aagtgccacaccagaggttcctcca

SEQ ID NO: 52846 - DNA, 25 bp, Rattus norvegicus
aagtgccacacctgaggttcctcca

SEQ ID NO: 52847 - DNA, 25 bp, Rattus norvegicus
aagtgccactgcatcatagcaactc

SEQ ID NO: 52848 - DNA, 25 bp, Rattus norvegicus
aagtgccactgcttcatagcaactc

SEQ ID NO: 52849 - DNA, 25 bp, Rattus norvegicus
aagtgccagctgctccttgagagag

SEQ ID NO: 52850 - DNA, 25 bp, Rattus norvegicus
aagtgccagctggtccttgagagag

SEQ ID NO: 52851 - DNA, 25 bp, Rattus norvegicus
aagtgccaggaccagatgcttcgtg

SEQ ID NO: 52852 - DNA, 25 bp, Rattus norvegicus
aagtgccaggacgagatgcttcgtg

SEQ ID NO: 52853 - DNA, 25 bp, Rattus norvegicus
aagtgccaggtgagccagagcgctt

SEQ ID NO: 52854 - DNA, 25 bp, Rattus norvegicus
aagtgccaggtgtgccagagcgctt

SEQ ID NO: 52855 - DNA, 25 bp, Rattus norvegicus
aagtgccagtaaccaggaccgtcgg

SEQ ID NO: 52856 - DNA, 25 bp, Rattus norvegicus
aagtgccagtaagcaggaccgtcgg

SEQ ID NO: 52857 - DNA, 25 bp, Rattus norvegicus
aagtgccagtataccctgggttttg

SEQ ID NO: 52858 - DNA, 25 bp, Rattus norvegicus
aagtgccagtattccctgggttttg

SEQ ID NO: 52859 - DNA, 25 bp, Rattus norvegicus
aagtgccagtcacagggctctgtag

SEQ ID NO: 52860 - DNA, 25 bp, Rattus norvegicus
aagtgccagtcagagggctctgtag

SEQ ID NO: 52861 - DNA, 25 bp, Rattus norvegicus
aagtgccagtccagctgttggttgc

SEQ ID NO: 52862 - DNA, 25 bp, Rattus norvegicus
aagtgccagtcctgctgttggttgc

SEQ ID NO: 52863 - DNA, 25 bp, Rattus norvegicus
aagtgccagttcctcttgatggtta

SEQ ID NO: 52864 - DNA, 25 bp, Rattus norvegicus
aagtgccagttcgtcttgatggtta

SEQ ID NO: 52865 - DNA, 25 bp, Rattus norvegicus
aagtgccatgcaaactctctgtatg

SEQ ID NO: 52866 - DNA, 25 bp, Rattus norvegicus
aagtgccatgcatactctctgtatg

SEQ ID NO: 52867 - DNA, 25 bp, Rattus norvegicus
aagtgccatttgagtgtgagagtat

SEQ ID NO: 52868 - DNA, 25 bp, Rattus norvegicus
aagtgccatttgtgtgtgagagtat

SEQ ID NO: 52869 - DNA, 25 bp, Rattus norvegicus
aagtgcccaagaacctttctgggaa

SEQ ID NO: 52870 - DNA, 25 bp, Rattus norvegicus
aagtgcccaagatcctttctgggaa

SEQ ID NO: 52871 - DNA, 25 bp, Rattus norvegicus
aagtgcccaagtctaatttagctat

SEQ ID NO: 52872 - DNA, 25 bp, Rattus norvegicus
aagtgcccaagtgtaatttagctat

SEQ ID NO: 52873 - DNA, 25 bp, Rattus norvegicus
aagtgcccagacaatgaccagatgt

SEQ ID NO: 52874 - DNA, 25 bp, Rattus norvegicus
aagtgcccagactatgaccagatgt

SEQ ID NO: 52875 - DNA, 25 bp, Rattus norvegicus
aagtgcccaggcagctgacgcaaaa

SEQ ID NO: 52876 - DNA, 25 bp, Rattus norvegicus
aagtgcccaggcagcttgtgtcaga

SEQ ID NO: 52877 - DNA, 25 bp, Rattus norvegicus
aagtgcccaggctgctgacgcaaaa

SEQ ID NO: 52878 - DNA, 25 bp, Rattus norvegicus
aagtgcccaggctgcttgtgtcaga

SEQ ID NO: 52879 - DNA, 25 bp, Rattus norvegicus
aagtgcccatagatgctgagccatt

SEQ ID NO: 52880 - DNA, 25 bp, Rattus norvegicus
aagtgcccatagttgctgagccatt

SEQ ID NO: 52881 - DNA, 25 bp, Rattus norvegicus
aagtgcccatgaaggcgtgcttgga

SEQ ID NO: 52882 - DNA, 25 bp, Rattus norvegicus
aagtgcccatgatggcgtgcttgga

SEQ ID NO: 52883 - DNA, 25 bp, Rattus norvegicus
aagtgccccactctggaacagtacg

SEQ ID NO: 52884 - DNA, 25 bp, Rattus norvegicus
aagtgccccactgtggaacagtacg

SEQ ID NO: 52885 - DNA, 25 bp, Rattus norvegicus
aagtgccccattagtgaagggagct

SEQ ID NO: 52886 - DNA, 25 bp, Rattus norvegicus
aagtgccccatttgtgaagggagct

SEQ ID NO: 52887 - DNA, 25 bp, Rattus norvegicus
aagtgcccggcgagcttcggcacga

SEQ ID NO: 52888 - DNA, 25 bp, Rattus norvegicus
aagtgcccggcgtgcttcggcacga

SEQ ID NO: 52889 - DNA, 25 bp, Rattus norvegicus
aagtgccctcaacacacgtagtaga

SEQ ID NO: 52890 - DNA, 25 bp, Rattus norvegicus
aagtgccctcaagacacgtagtaga

SEQ ID NO: 52891 - DNA, 25 bp, Rattus norvegicus
aagtgccctctgctgatagccagga

SEQ ID NO: 52892 - DNA, 25 bp, Rattus norvegicus
aagtgccctctggtgatagccagga

SEQ ID NO: 52893 - DNA, 25 bp, Rattus norvegicus
aagtgccctgaaagtgagcccagcc

SEQ ID NO: 52894 - DNA, 25 bp, Rattus norvegicus
aagtgccctgaatgtgagcccagcc

SEQ ID NO: 52895 - DNA, 25 bp, Rattus norvegicus
aagtgccctgaccatttctaacatt

SEQ ID NO: 52896 - DNA, 25 bp, Rattus norvegicus
aagtgccctgacgatttctaacatt

SEQ ID NO: 52897 - DNA, 25 bp, Rattus norvegicus
aagtgccctgtcacatcatttcaag

SEQ ID NO: 52898 - DNA, 25 bp, Rattus norvegicus
aagtgccctgtctcatcatttcaag

SEQ ID NO: 52899 - DNA, 25 bp, Rattus norvegicus
aagtgccctgtgagtttaaacctct

SEQ ID NO: 52900 - DNA, 25 bp, Rattus norvegicus
aagtgccctgtgtgtttaaacctct

SEQ ID NO: 52901 - DNA, 25 bp, Rattus norvegicus
aagtgccgagctagaccttggacct

SEQ ID NO: 52902 - DNA, 25 bp, Rattus norvegicus
aagtgccgagcttgaccttggacct

SEQ ID NO: 52903 - DNA, 25 bp, Rattus norvegicus
aagtgccgcattattgattttcaca

SEQ ID NO: 52904 - DNA, 25 bp, Rattus norvegicus
aagtgccgcatttttgattttcaca

SEQ ID NO: 52905 - DNA, 25 bp, Rattus norvegicus
aagtgccgctccatgaagctcctga

SEQ ID NO: 52906 - DNA, 25 bp, Rattus norvegicus
aagtgccgctccttgaagctcctga

SEQ ID NO: 52907 - DNA, 25 bp, Rattus norvegicus
aagtgccggaatacattctggatgc

SEQ ID NO: 52908 - DNA, 25 bp, Rattus norvegicus
aagtgccggaattcattctggatgc

SEQ ID NO: 52909 - DNA, 25 bp, Rattus norvegicus
aagtgccggcggatcttggatgaac

SEQ ID NO: 52910 - DNA, 25 bp, Rattus norvegicus
aagtgccggcggttcttggatgaac

SEQ ID NO: 52911 - DNA, 25 bp, Rattus norvegicus
aagtgccgtgtcatactataccaca

SEQ ID NO: 52912 - DNA, 25 bp, Rattus norvegicus
aagtgccgtgtcttactataccaca

SEQ ID NO: 52913 - DNA, 25 bp, Rattus norvegicus
aagtgcctatgtcttggaagcctga

SEQ ID NO: 52914 - DNA, 25 bp, Rattus norvegicus
aagtgcctatgtgttggaagcctga

SEQ ID NO: 52915 - DNA, 25 bp, Rattus norvegicus
aagtgcctcagtctgcctatggaaa

SEQ ID NO: 52916 - DNA, 25 bp, Rattus norvegicus
aagtgcctcagtgtgcctatggaaa

SEQ ID NO: 52917 - DNA, 25 bp, Rattus norvegicus
aagtgcctccctctgagcagtgtaa

SEQ ID NO: 52918 - DNA, 25 bp, Rattus norvegicus
aagtgcctccctgtgagcagtgtaa

SEQ ID NO: 52919 - DNA, 25 bp, Rattus norvegicus
aagtgcctcctgacatggctgttgt

SEQ ID NO: 52920 - DNA, 25 bp, Rattus norvegicus
aagtgcctcctgtcatggctgttgt

SEQ ID NO: 52921 - DNA, 25 bp, Rattus norvegicus
aagtgcctgatgacgtggaggtcca

SEQ ID NO: 52922 - DNA, 25 bp, Rattus norvegicus
aagtgcctgatgtcgtggaggtcca

SEQ ID NO: 52923 - DNA, 25 bp, Rattus norvegicus
aagtgcctgcccactggaaggcctt

SEQ ID NO: 52924 - DNA, 25 bp, Rattus norvegicus
aagtgcctgccctctggaaggcctt

SEQ ID NO: 52925 - DNA, 25 bp, Rattus norvegicus
aagtgcctggatatgtcttctttca

SEQ ID NO: 52926 - DNA, 25 bp, Rattus norvegicus
aagtgcctggatttgtcttctttca

SEQ ID NO: 52927 - DNA, 25 bp, Rattus norvegicus
aagtgcctggccctaagttgtcctc

SEQ ID NO: 52928 - DNA, 25 bp, Rattus norvegicus
aagtgcctggccgtaagttgtcctc

SEQ ID NO: 52929 - DNA, 25 bp, Rattus norvegicus
aagtgcctggctccccgagcagttc

SEQ ID NO: 52930 - DNA, 25 bp, Rattus norvegicus
aagtgcctggctgcccgagcagttc

SEQ ID NO: 52931 - DNA, 25 bp, Rattus norvegicus
aagtgcctgtaacccctaagctatc

SEQ ID NO: 52932 - DNA, 25 bp, Rattus norvegicus
aagtgcctgtaagccctaagctatc

SEQ ID NO: 52933 - DNA, 25 bp, Rattus norvegicus
aagtgcctgtttccaaggagcccta

SEQ ID NO: 52934 - DNA, 25 bp, Rattus norvegicus
aagtgcctgtttgcaaggagcccta

SEQ ID NO: 52935 - DNA, 25 bp, Rattus norvegicus
aagtgccttacaactgggtctcata

SEQ ID NO: 52936 - DNA, 25 bp, Rattus norvegicus
aagtgccttacatctgggtctcata

SEQ ID NO: 52937 - DNA, 25 bp, Rattus norvegicus
aagtgccttagaatctgagtcacag

SEQ ID NO: 52938 - DNA, 25 bp, Rattus norvegicus
aagtgccttagattctgagtcacag

SEQ ID NO: 52939 - DNA, 25 bp, Rattus norvegicus
aagtgccttatgaattgccctgagt

SEQ ID NO: 52940 - DNA, 25 bp, Rattus norvegicus
aagtgccttatgcacctgtggccta

SEQ ID NO: 52941 - DNA, 25 bp, Rattus norvegicus
aagtgccttatggacctgtggccta

SEQ ID NO: 52942 - DNA, 25 bp, Rattus norvegicus
aagtgccttatgtattgccctgagt

SEQ ID NO: 52943 - DNA, 25 bp, Rattus norvegicus
aagtgccttcggcttgtcctcttag

SEQ ID NO: 52944 - DNA, 25 bp, Rattus norvegicus
aagtgccttcgggttgtcctcttag

SEQ ID NO: 52945 - DNA, 25 bp, Rattus norvegicus
aagtgccttctccacagtgtgatac

SEQ ID NO: 52946 - DNA, 25 bp, Rattus norvegicus
aagtgccttctcgacagtgtgatac

SEQ ID NO: 52947 - DNA, 25 bp, Rattus norvegicus
aagtgccttcttagcatgttgtcat

SEQ ID NO: 52948 - DNA, 25 bp, Rattus norvegicus
aagtgccttcttcataaatgtgctc

SEQ ID NO: 52949 - DNA, 25 bp, Rattus norvegicus
aagtgccttcttgataaatgtgctc

SEQ ID NO: 52950 - DNA, 25 bp, Rattus norvegicus
aagtgccttctttgcatgttgtcat

SEQ ID NO: 52951 - DNA, 25 bp, Rattus norvegicus
aagtgccttgtaaatcgcccagaaa

SEQ ID NO: 52952 - DNA, 25 bp, Rattus norvegicus
aagtgccttgtatatcgcccagaaa

SEQ ID NO: 52953 - DNA, 25 bp, Rattus norvegicus
aagtgccttgttatctctgatataa

SEQ ID NO: 52954 - DNA, 25 bp, Rattus norvegicus
aagtgccttgttttctctgatataa

SEQ ID NO: 52955 - DNA, 25 bp, Rattus norvegicus
aagtgcctttacctggagataacca

SEQ ID NO: 52956 - DNA, 25 bp, Rattus norvegicus
aagtgcctttacgtggagataacca

SEQ ID NO: 52957 - DNA, 25 bp, Rattus norvegicus
aagtgcctttccaagtagctttgtt

SEQ ID NO: 52958 - DNA, 25 bp, Rattus norvegicus
aagtgcctttcctagtagctttgtt

SEQ ID NO: 52959 - DNA, 25 bp, Rattus norvegicus
aagtgcctttgacttgctagggaac

SEQ ID NO: 52960 - DNA, 25 bp, Rattus norvegicus
aagtgcctttgagttgctagggaac

SEQ ID NO: 52961 - DNA, 25 bp, Rattus norvegicus
aagtgcctttggctcaaattccagt

SEQ ID NO: 52962 - DNA, 25 bp, Rattus norvegicus
aagtgcctttgggtcaaattccagt

SEQ ID NO: 52963 - DNA, 25 bp, Rattus norvegicus
aagtgcctttgtatccagttgttct

SEQ ID NO: 52964 - DNA, 25 bp, Rattus norvegicus
aagtgcctttgtttccagttgttct

SEQ ID NO: 52965 - DNA, 25 bp, Rattus norvegicus
aagtgcgacacacagtccggttgtt

SEQ ID NO: 52966 - DNA, 25 bp, Rattus norvegicus
aagtgcgacacagagtccggttgtt

SEQ ID NO: 52967 - DNA, 25 bp, Rattus norvegicus
aagtgcgagagaaaaaggcctccaa

SEQ ID NO: 52968 - DNA, 25 bp, Rattus norvegicus
aagtgcgagagataaaggcctccaa

SEQ ID NO: 52969 - DNA, 25 bp, Rattus norvegicus
aagtgcgagcatctggagtcttccg

SEQ ID NO: 52970 - DNA, 25 bp, Rattus norvegicus
aagtgcgagcatgtggagtcttccg

SEQ ID NO: 52971 - DNA, 25 bp, Rattus norvegicus
aagtgcgagcctacctgcctcaatc

SEQ ID NO: 52972 - DNA, 25 bp, Rattus norvegicus
aagtgcgagccttcctgcctcaatc

SEQ ID NO: 52973 - DNA, 25 bp, Rattus norvegicus
aagtgcgcagtccatggcagaccat

SEQ ID NO: 52974 - DNA, 25 bp, Rattus norvegicus
aagtgcgcagtcgatggcagaccat

SEQ ID NO: 52975 - DNA, 25 bp, Rattus norvegicus
aagtgcgccccaatgagatctgttg

SEQ ID NO: 52976 - DNA, 25 bp, Rattus norvegicus
aagtgcgccccattgagatctgttg

SEQ ID NO: 52977 - DNA, 25 bp, Rattus norvegicus
aagtgcgccttcctattattttgca

SEQ ID NO: 52978 - DNA, 25 bp, Rattus norvegicus
aagtgcgccttcgtattattttgca

SEQ ID NO: 52979 - DNA, 25 bp, Rattus norvegicus
aagtgcgctcaccaacgagttcatg

SEQ ID NO: 52980 - DNA, 25 bp, Rattus norvegicus
aagtgcgctcacgaacgagttcatg

SEQ ID NO: 52981 - DNA, 25 bp, Rattus norvegicus
aagtgcgctgaccactcctgagatg

SEQ ID NO: 52982 - DNA, 25 bp, Rattus norvegicus
aagtgcgctgacgactcctgagatg

SEQ ID NO: 52983 - DNA, 25 bp, Rattus norvegicus
aagtgcgctgctactattctagaaa

SEQ ID NO: 52984 - DNA, 25 bp, Rattus norvegicus
aagtgcgctgcttctattctagaaa

SEQ ID NO: 52985 - DNA, 25 bp, Rattus norvegicus
aagtgcggactcactttataagctg

SEQ ID NO: 52986 - DNA, 25 bp, Rattus norvegicus
aagtgcggactctctttataagctg

SEQ ID NO: 52987 - DNA, 25 bp, Rattus norvegicus
aagtgcggagtccacctccaccata

SEQ ID NO: 52988 - DNA, 25 bp, Rattus norvegicus
aagtgcggagtcgacctccaccata

SEQ ID NO: 52989 - DNA, 25 bp, Rattus norvegicus
aagtgcggccggattggtgcaatct

SEQ ID NO: 52990 - DNA, 25 bp, Rattus norvegicus
aagtgcggccggtttggtgcaatct

SEQ ID NO: 52991 - DNA, 25 bp, Rattus norvegicus
aagtgcggctaccattagcgtttgc

SEQ ID NO: 52992 - DNA, 25 bp, Rattus norvegicus
aagtgcggctacgattagcgtttgc

SEQ ID NO: 52993 - DNA, 25 bp, Rattus norvegicus
aagtgcggctgcacgagatgtgcct

SEQ ID NO: 52994 - DNA, 25 bp, Rattus norvegicus
aagtgcggctgctcgagatgtgcct

SEQ ID NO: 52995 - DNA, 25 bp, Rattus norvegicus
aagtgcggtcatacctgttctaacg

SEQ ID NO: 52996 - DNA, 25 bp, Rattus norvegicus
aagtgcggtcattcctgttctaacg

SEQ ID NO: 52997 - DNA, 25 bp, Rattus norvegicus
aagtgcgtatttagccagacttgct

SEQ ID NO: 52998 - DNA, 25 bp, Rattus norvegicus
aagtgcgtattttgccagacttgct

SEQ ID NO: 52999 - DNA, 25 bp, Rattus norvegicus
aagtgcgtgcttacctggaggtcac

SEQ ID NO: 53000 - DNA, 25 bp, Rattus norvegicus
aagtgcgtgctttcctggaggtcac

SEQ ID NO: 53001 - DNA, 25 bp, Rattus norvegicus
aagtgcgtgtaacacctgggacata

SEQ ID NO: 53002 - DNA, 25 bp, Rattus norvegicus
aagtgcgtgtaagacctgggacata

SEQ ID NO: 53003 - DNA, 25 bp, Rattus norvegicus
aagtgcgtgtgtcaccccgaacgtg

SEQ ID NO: 53004 - DNA, 25 bp, Rattus norvegicus
aagtgcgtgtgtcacctttatagct

SEQ ID NO: 53005 - DNA, 25 bp, Rattus norvegicus
aagtgcgtgtgtgaccccgaacgtg

SEQ ID NO: 53006 - DNA, 25 bp, Rattus norvegicus
aagtgcgtgtgtgacctttatagct

SEQ ID NO: 53007 - DNA, 25 bp, Rattus norvegicus
aagtgcgttctccagatagttttcc

SEQ ID NO: 53008 - DNA, 25 bp, Rattus norvegicus
aagtgcgttctcgagatagttttcc

SEQ ID NO: 53009 - DNA, 25 bp, Rattus norvegicus
aagtgctaacagatcttgctgtgga

SEQ ID NO: 53010 - DNA, 25 bp, Rattus norvegicus
aagtgctaacagttcttgctgtgga

SEQ ID NO: 53011 - DNA, 25 bp, Rattus norvegicus
aagtgctaagctcagtgtcccttat

SEQ ID NO: 53012 - DNA, 25 bp, Rattus norvegicus
aagtgctaagctgagtgtcccttat

SEQ ID NO: 53013 - DNA, 25 bp, Rattus norvegicus
aagtgctaagtgatgtctctgctgg

SEQ ID NO: 53014 - DNA, 25 bp, Rattus norvegicus
aagtgctaagtgttgtctctgctgg

SEQ ID NO: 53015 - DNA, 25 bp, Rattus norvegicus
aagtgctacaatccctcaagggcat

SEQ ID NO: 53016 - DNA, 25 bp, Rattus norvegicus
aagtgctacaatgcctcaagggcat

SEQ ID NO: 53017 - DNA, 25 bp, Rattus norvegicus
aagtgctaccatatcgaggcctagt

SEQ ID NO: 53018 - DNA, 25 bp, Rattus norvegicus
aagtgctaccatttcgaggcctagt

SEQ ID NO: 53019 - DNA, 25 bp, Rattus norvegicus
aagtgctacctcctcggcttcggat

SEQ ID NO: 53020 - DNA, 25 bp, Rattus norvegicus
aagtgctacctcgtcggcttcggat

SEQ ID NO: 53021 - DNA, 25 bp, Rattus norvegicus
aagtgctagaatcaaatgtgtgtcc

SEQ ID NO: 53022 - DNA, 25 bp, Rattus norvegicus
aagtgctagaatgaaatgtgtgtcc

SEQ ID NO: 53023 - DNA, 25 bp, Rattus norvegicus
aagtgctagagtccaccgaaactgg

SEQ ID NO: 53024 - DNA, 25 bp, Rattus norvegicus
aagtgctagagtgcaccgaaactgg

SEQ ID NO: 53025 - DNA, 25 bp, Rattus norvegicus
aagtgctagcaaaggttccctttca

SEQ ID NO: 53026 - DNA, 25 bp, Rattus norvegicus
aagtgctagcaatggttccctttca

SEQ ID NO: 53027 - DNA, 25 bp, Rattus norvegicus
aagtgctatttgctcttctcgtctc

SEQ ID NO: 53028 - DNA, 25 bp, Rattus norvegicus
aagtgctatttggtcttctcgtctc

SEQ ID NO: 53029 - DNA, 25 bp, Rattus norvegicus
aagtgctcagagctctatgctgcct

SEQ ID NO: 53030 - DNA, 25 bp, Rattus norvegicus
aagtgctcagagctggctacagcaa

SEQ ID NO: 53031 - DNA, 25 bp, Rattus norvegicus
aagtgctcagaggtctatgctgcct

SEQ ID NO: 53032 - DNA, 25 bp, Rattus norvegicus
aagtgctcagaggtggctacagcaa

SEQ ID NO: 53033 - DNA, 25 bp, Rattus norvegicus
aagtgctcagtcatttctcctatag

SEQ ID NO: 53034 - DNA, 25 bp, Rattus norvegicus
aagtgctcagtcttttctcctatag

SEQ ID NO: 53035 - DNA, 25 bp, Rattus norvegicus
aagtgctcatcaacaccacagagga

SEQ ID NO: 53036 - DNA, 25 bp, Rattus norvegicus
aagtgctcatcatcaccacagagga

SEQ ID NO: 53037 - DNA, 25 bp, Rattus norvegicus
aagtgctccaaccttgcagtcgtct

SEQ ID NO: 53038 - DNA, 25 bp, Rattus norvegicus
aagtgctccaacgttgcagtcgtct

SEQ ID NO: 53039 - DNA, 25 bp, Rattus norvegicus
aagtgctccaagcagcttgcctctg

SEQ ID NO: 53040 - DNA, 25 bp, Rattus norvegicus
aagtgctccaaggagcttgcctctg

SEQ ID NO: 53041 - DNA, 25 bp, Rattus norvegicus
aagtgctcccgcacttgaccatctg

SEQ ID NO: 53042 - DNA, 25 bp, Rattus norvegicus
aagtgctcccgctcttgaccatctg

SEQ ID NO: 53043 - DNA, 25 bp, Rattus norvegicus
aagtgctccgagatcacgttccaga

SEQ ID NO: 53044 - DNA, 25 bp, Rattus norvegicus
aagtgctccgagttcacgttccaga

SEQ ID NO: 53045 - DNA, 25 bp, Rattus norvegicus
aagtgctcctatacctaatgtataa

SEQ ID NO: 53046 - DNA, 25 bp, Rattus norvegicus
aagtgctcctattcctaatgtataa

SEQ ID NO: 53047 - DNA, 25 bp, Rattus norvegicus
aagtgctcgccaagagatttccatc

SEQ ID NO: 53048 - DNA, 25 bp, Rattus norvegicus
aagtgctcgccatgagatttccatc

SEQ ID NO: 53049 - DNA, 25 bp, Rattus norvegicus
aagtgctcggaacgcctaagtctga

SEQ ID NO: 53050 - DNA, 25 bp, Rattus norvegicus
aagtgctcggaaggcctaagtctga

SEQ ID NO: 53051 - DNA, 25 bp, Rattus norvegicus
aagtgctcgggccattccagtttta

SEQ ID NO: 53052 - DNA, 25 bp, Rattus norvegicus
aagtgctcgggcgattccagtttta

SEQ ID NO: 53053 - DNA, 25 bp, Rattus norvegicus
aagtgctctaccattgagctccatg

SEQ ID NO: 53054 - DNA, 25 bp, Rattus norvegicus
aagtgctctacctttgagctccatg

SEQ ID NO: 53055 - DNA, 25 bp, Rattus norvegicus
aagtgctctcttcgtaaatgtggta

SEQ ID NO: 53056 - DNA, 25 bp, Rattus norvegicus
aagtgctctcttggtaaatgtggta

SEQ ID NO: 53057 - DNA, 25 bp, Rattus norvegicus
aagtgctctggtatagtggttcaca

SEQ ID NO: 53058 - DNA, 25 bp, Rattus norvegicus
aagtgctctggtttagtggttcaca

SEQ ID NO: 53059 - DNA, 25 bp, Rattus norvegicus
aagtgctcttatagccttgacgtgt

SEQ ID NO: 53060 - DNA, 25 bp, Rattus norvegicus
aagtgctcttattgccttgacgtgt

SEQ ID NO: 53061 - DNA, 25 bp, Rattus norvegicus
aagtgctcttggcttgggttatcct

SEQ ID NO: 53062 - DNA, 25 bp, Rattus norvegicus
aagtgctcttgggttgggttatcct

SEQ ID NO: 53063 - DNA, 25 bp, Rattus norvegicus
aagtgctctttcatgccaatttata

SEQ ID NO: 53064 - DNA, 25 bp, Rattus norvegicus
aagtgctctttcttgccaatttata

SEQ ID NO: 53065 - DNA, 25 bp, Rattus norvegicus
aagtgctgaaaacctctgctgggct

SEQ ID NO: 53066 - DNA, 25 bp, Rattus norvegicus
aagtgctgaaaagctctgctgggct

SEQ ID NO: 53067 - DNA, 25 bp, Rattus norvegicus
aagtgctgaagaatattgcctccta

SEQ ID NO: 53068 - DNA, 25 bp, Rattus norvegicus
aagtgctgaagattattgcctccta

SEQ ID NO: 53069 - DNA, 25 bp, Rattus norvegicus
aagtgctgaagccatggtctcccta

SEQ ID NO: 53070 - DNA, 25 bp, Rattus norvegicus
aagtgctgaagcgatggtctcccta

SEQ ID NO: 53071 - DNA, 25 bp, Rattus norvegicus
aagtgctgaatgcttcgacacctgc

SEQ ID NO: 53072 - DNA, 25 bp, Rattus norvegicus
aagtgctgaatggttcgacacctgc

SEQ ID NO: 53073 - DNA, 25 bp, Rattus norvegicus
aagtgctgacgtagtatttcccagt

SEQ ID NO: 53074 - DNA, 25 bp, Rattus norvegicus
aagtgctgacgttgtatttcccagt

SEQ ID NO: 53075 - DNA, 25 bp, Rattus norvegicus
aagtgctgacttactcttcttaagg

SEQ ID NO: 53076 - DNA, 25 bp, Rattus norvegicus
aagtgctgactttctcttcttaagg

SEQ ID NO: 53077 - DNA, 25 bp, Rattus norvegicus
aagtgctgagctccgtcatcagggc

SEQ ID NO: 53078 - DNA, 25 bp, Rattus norvegicus
aagtgctgagctgcgtcatcagggc

SEQ ID NO: 53079 - DNA, 25 bp, Rattus norvegicus
aagtgctgaggtagttgtcccccgt

SEQ ID NO: 53080 - DNA, 25 bp, Rattus norvegicus
aagtgctgaggtcctactgctgtgc

SEQ ID NO: 53081 - DNA, 25 bp, Rattus norvegicus
aagtgctgaggtgctactgctgtgc

SEQ ID NO: 53082 - DNA, 25 bp, Rattus norvegicus
aagtgctgaggttgttgtcccccgt

SEQ ID NO: 53083 - DNA, 25 bp, Rattus norvegicus
aagtgctgagtcatggaagctacaa

SEQ ID NO: 53084 - DNA, 25 bp, Rattus norvegicus
aagtgctgagtcttggaagctacaa

SEQ ID NO: 53085 - DNA, 25 bp, Rattus norvegicus
aagtgctgattgatgcccgtgactg

SEQ ID NO: 53086 - DNA, 25 bp, Rattus norvegicus
aagtgctgattgttgcccgtgactg

SEQ ID NO: 53087 - DNA, 25 bp, Rattus norvegicus
aagtgctgcctgatttcccagaggt

SEQ ID NO: 53088 - DNA, 25 bp, Rattus norvegicus
aagtgctgcctgttttcccagaggt

SEQ ID NO: 53089 - DNA, 25 bp, Rattus norvegicus
aagtgctgctgccttttcaccttaa

SEQ ID NO: 53090 - DNA, 25 bp, Rattus norvegicus
aagtgctgctgcgttttcaccttaa

SEQ ID NO: 53091 - DNA, 25 bp, Rattus norvegicus
aagtgctgctggacagtgttttata

SEQ ID NO: 53092 - DNA, 25 bp, Rattus norvegicus
aagtgctgctggtcagtgttttata

SEQ ID NO: 53093 - DNA, 25 bp, Rattus norvegicus
aagtgctgcttgatggagtctcacg

SEQ ID NO: 53094 - DNA, 25 bp, Rattus norvegicus
aagtgctgcttgttggagtctcacg

SEQ ID NO: 53095 - DNA, 25 bp, Rattus norvegicus
aagtgctggagtcattcttgagaat

SEQ ID NO: 53096 - DNA, 25 bp, Rattus norvegicus
aagtgctggagtgattcttgagaat

SEQ ID NO: 53097 - DNA, 25 bp, Rattus norvegicus
aagtgctggcttcctatctttgcac

SEQ ID NO: 53098 - DNA, 25 bp, Rattus norvegicus
aagtgctggcttgctatctttgcac

SEQ ID NO: 53099 - DNA, 25 bp, Rattus norvegicus
aagtgctgggacatgatcctggatc

SEQ ID NO: 53100 - DNA, 25 bp, Rattus norvegicus
aagtgctgggacttgatcctggatc

SEQ ID NO: 53101 - DNA, 25 bp, Rattus norvegicus
aagtgctggttcagtttgctgattc

SEQ ID NO: 53102 - DNA, 25 bp, Rattus norvegicus
aagtgctggttctgtttgctgattc

SEQ ID NO: 53103 - DNA, 25 bp, Rattus norvegicus
aagtgctgtacaaaggccacggaga

SEQ ID NO: 53104 - DNA, 25 bp, Rattus norvegicus
aagtgctgtacaaatcttcttgccc

SEQ ID NO: 53105 - DNA, 25 bp, Rattus norvegicus
aagtgctgtacataggccacggaga

SEQ ID NO: 53106 - DNA, 25 bp, Rattus norvegicus
aagtgctgtacatatcttcttgccc

SEQ ID NO: 53107 - DNA, 25 bp, Rattus norvegicus
aagtgctgtagcactcaagtgctct

SEQ ID NO: 53108 - DNA, 25 bp, Rattus norvegicus
aagtgctgtagctctcaagtgctct

SEQ ID NO: 53109 - DNA, 25 bp, Rattus norvegicus
aagtgctgtcagaactaagtcgtgg

SEQ ID NO: 53110 - DNA, 25 bp, Rattus norvegicus
aagtgctgtcagtactaagtcgtgg

SEQ ID NO: 53111 - DNA, 25 bp, Rattus norvegicus
aagtgctgtccgagtgctgaattct

SEQ ID NO: 53112 - DNA, 25 bp, Rattus norvegicus
aagtgctgtccgtgtgctgaattct

SEQ ID NO: 53113 - DNA, 25 bp, Rattus norvegicus
aagtgctgtctaaggacttttgaac

SEQ ID NO: 53114 - DNA, 25 bp, Rattus norvegicus
aagtgctgtctatggacttttgaac

SEQ ID NO: 53115 - DNA, 25 bp, Rattus norvegicus
aagtgctgtgacaaaccatgcggac

SEQ ID NO: 53116 - DNA, 25 bp, Rattus norvegicus
aagtgctgtgactaaccatgcggac

SEQ ID NO: 53117 - DNA, 25 bp, Rattus norvegicus
aagtgctgttctaccattgagttac

SEQ ID NO: 53118 - DNA, 25 bp, Rattus norvegicus
aagtgctgttcttccattgagttac

SEQ ID NO: 53119 - DNA, 25 bp, Rattus norvegicus
aagtgcttacttaggtcatgacccc

SEQ ID NO: 53120 - DNA, 25 bp, Rattus norvegicus
aagtgcttactttggtcatgacccc

SEQ ID NO: 53121 - DNA, 25 bp, Rattus norvegicus
aagtgcttagctccactccctaaag

SEQ ID NO: 53122 - DNA, 25 bp, Rattus norvegicus
aagtgcttagctgcactccctaaag

SEQ ID NO: 53123 - DNA, 25 bp, Rattus norvegicus
aagtgcttcaagaccctaggcaaca

SEQ ID NO: 53124 - DNA, 25 bp, Rattus norvegicus
aagtgcttcaagtccctaggcaaca

SEQ ID NO: 53125 - DNA, 25 bp, Rattus norvegicus
aagtgcttcactcagaagtccacgc

SEQ ID NO: 53126 - DNA, 25 bp, Rattus norvegicus
aagtgcttcactgagaagtccacgc

SEQ ID NO: 53127 - DNA, 25 bp, Rattus norvegicus
aagtgcttcagccattgttatgtaa

SEQ ID NO: 53128 - DNA, 25 bp, Rattus norvegicus
aagtgcttcagcgattgttatgtaa

SEQ ID NO: 53129 - DNA, 25 bp, Rattus norvegicus
aagtgcttcctcatggtgacaccag

SEQ ID NO: 53130 - DNA, 25 bp, Rattus norvegicus
aagtgcttcctcttggtgacaccag

SEQ ID NO: 53131 - DNA, 25 bp, Rattus norvegicus
aagtgcttcggccagaggaccagtc

SEQ ID NO: 53132 - DNA, 25 bp, Rattus norvegicus
aagtgcttcggcgagaggaccagtc

SEQ ID NO: 53133 - DNA, 25 bp, Rattus norvegicus
aagtgcttctgacgcggctacctta

SEQ ID NO: 53134 - DNA, 25 bp, Rattus norvegicus
aagtgcttctgaggcggctacctta

SEQ ID NO: 53135 - DNA, 25 bp, Rattus norvegicus
aagtgcttctgcacctgatgtagat

SEQ ID NO: 53136 - DNA, 25 bp, Rattus norvegicus
aagtgcttctgctcctgatgtagat

SEQ ID NO: 53137 - DNA, 25 bp, Rattus norvegicus
aagtgcttctggctctgagtctggc

SEQ ID NO: 53138 - DNA, 25 bp, Rattus norvegicus
aagtgcttctgggtctgagtctggc

SEQ ID NO: 53139 - DNA, 25 bp, Rattus norvegicus
aagtgcttctgtccaaaccttgttt

SEQ ID NO: 53140 - DNA, 25 bp, Rattus norvegicus
aagtgcttctgtgcaaaccttgttt

SEQ ID NO: 53141 - DNA, 25 bp, Rattus norvegicus
aagtgcttggaacgtttctctcaga

SEQ ID NO: 53142 - DNA, 25 bp, Rattus norvegicus
aagtgcttggaactctcgtcactca

SEQ ID NO: 53143 - DNA, 25 bp, Rattus norvegicus
aagtgcttggaaggtttctctcaga

SEQ ID NO: 53144 - DNA, 25 bp, Rattus norvegicus
aagtgcttggaagtctcgtcactca

SEQ ID NO: 53145 - DNA, 25 bp, Rattus norvegicus
aagtgcttggccaggactagatcta

SEQ ID NO: 53146 - DNA, 25 bp, Rattus norvegicus
aagtgcttggcctggactagatcta

SEQ ID NO: 53147 - DNA, 25 bp, Rattus norvegicus
aagtgcttgggtacgagccaggctt

SEQ ID NO: 53148 - DNA, 25 bp, Rattus norvegicus
aagtgcttgggttcgagccaggctt

SEQ ID NO: 53149 - DNA, 25 bp, Rattus norvegicus
aagtgcttgtccatgtagtcaccca

SEQ ID NO: 53150 - DNA, 25 bp, Rattus norvegicus
aagtgcttgtccttgtagtcaccca

SEQ ID NO: 53151 - DNA, 25 bp, Rattus norvegicus
aagtgcttgtgaatgctcaccatgc

SEQ ID NO: 53152 - DNA, 25 bp, Rattus norvegicus
aagtgcttgtgacgatcagatttca

SEQ ID NO: 53153 - DNA, 25 bp, Rattus norvegicus
aagtgcttgtgaggatcagatttca

SEQ ID NO: 53154 - DNA, 25 bp, Rattus norvegicus
aagtgcttgtgattgctcaccatgc

SEQ ID NO: 53155 - DNA, 25 bp, Rattus norvegicus
aagtgctttaaccagagttccagtc

SEQ ID NO: 53156 - DNA, 25 bp, Rattus norvegicus
aagtgctttaacgagagttccagtc

SEQ ID NO: 53157 - DNA, 25 bp, Rattus norvegicus
aagtgctttcctctcaaagacaagc

SEQ ID NO: 53158 - DNA, 25 bp, Rattus norvegicus
aagtgctttcctgtcaaagacaagc

SEQ ID NO: 53159 - DNA, 25 bp, Rattus norvegicus
aagtgctttcttccctttgtagcaa

SEQ ID NO: 53160 - DNA, 25 bp, Rattus norvegicus
aagtgctttcttcggtgacacagga

SEQ ID NO: 53161 - DNA, 25 bp, Rattus norvegicus
aagtgctttcttgcctttgtagcaa

SEQ ID NO: 53162 - DNA, 25 bp, Rattus norvegicus
aagtgctttcttgggtgacacagga

SEQ ID NO: 53163 - DNA, 25 bp, Rattus norvegicus
aagtgctttgggaaagatgactaaa

SEQ ID NO: 53164 - DNA, 25 bp, Rattus norvegicus
aagtgctttgggtaagatgactaaa

SEQ ID NO: 53165 - DNA, 25 bp, Rattus norvegicus
aagtgctttgtaagcctcctggatg

SEQ ID NO: 53166 - DNA, 25 bp, Rattus norvegicus
aagtgctttgtatgcctcctggatg

SEQ ID NO: 53167 - DNA, 25 bp, Rattus norvegicus
aagtgctttgtcaaaagccctcgtc

SEQ ID NO: 53168 - DNA, 25 bp, Rattus norvegicus
aagtgctttgtctaaagccctcgtc

SEQ ID NO: 53169 - DNA, 25 bp, Rattus norvegicus
aagtgctttgttatccaaggccgag

SEQ ID NO: 53170 - DNA, 25 bp, Rattus norvegicus
aagtgctttgttttccaaggccgag

SEQ ID NO: 53171 - DNA, 25 bp, Rattus norvegicus
aagtgcttttccatttcctaactga

SEQ ID NO: 53172 - DNA, 25 bp, Rattus norvegicus
aagtgcttttccttttcctaactga

SEQ ID NO: 53173 - DNA, 25 bp, Rattus norvegicus
aagtgcttttgaagcctgcctgttc

SEQ ID NO: 53174 - DNA, 25 bp, Rattus norvegicus
aagtgcttttgatgcctgcctgttc

SEQ ID NO: 53175 - DNA, 25 bp, Rattus norvegicus
aagtgcttttgcatcggcagttctc

SEQ ID NO: 53176 - DNA, 25 bp, Rattus norvegicus
aagtgcttttgcttcggcagttctc

SEQ ID NO: 53177 - DNA, 25 bp, Rattus norvegicus
aagtgctttttaagtagcctcgcct

SEQ ID NO: 53178 - DNA, 25 bp, Rattus norvegicus
aagtgctttttatgtagcctcgcct

SEQ ID NO: 53179 - DNA, 25 bp, Rattus norvegicus
aagtggaaacacactcacctcctga

SEQ ID NO: 53180 - DNA, 25 bp, Rattus norvegicus
aagtggaaacactctcacctcctga

SEQ ID NO: 53181 - DNA, 25 bp, Rattus norvegicus
aagtggaaacggctgcgctcacgac

SEQ ID NO: 53182 - DNA, 25 bp, Rattus norvegicus
aagtggaaacgggtgcgctcacgac

SEQ ID NO: 53183 - DNA, 25 bp, Rattus norvegicus
aagtggaaagcacgcttccctcgga

SEQ ID NO: 53184 - DNA, 25 bp, Rattus norvegicus
aagtggaaagcaggcttccctcgga

SEQ ID NO: 53185 - DNA, 25 bp, Rattus norvegicus
aagtggaaaggcacacctgcgaaga

SEQ ID NO: 53186 - DNA, 25 bp, Rattus norvegicus
aagtggaaaggctcacctgcgaaga

SEQ ID NO: 53187 - DNA, 25 bp, Rattus norvegicus
aagtggaaagtcattggccccattt

SEQ ID NO: 53188 - DNA, 25 bp, Rattus norvegicus
aagtggaaagtctttggccccattt

SEQ ID NO: 53189 - DNA, 25 bp, Rattus norvegicus
aagtggaacatgatgtcaccccagc

SEQ ID NO: 53190 - DNA, 25 bp, Rattus norvegicus
aagtggaacatgttgtcaccccagc

SEQ ID NO: 53191 - DNA, 25 bp, Rattus norvegicus
aagtggaaggtcaggtgccctgccc

SEQ ID NO: 53192 - DNA, 25 bp, Rattus norvegicus
aagtggaaggtctggtgccctgccc

SEQ ID NO: 53193 - DNA, 25 bp, Rattus norvegicus
aagtggaagtgactcctgtgcctgc

SEQ ID NO: 53194 - DNA, 25 bp, Rattus norvegicus
aagtggaagtgagtcctgtgcctgc

SEQ ID NO: 53195 - DNA, 25 bp, Rattus norvegicus
aagtggaattgtagaggccgcctct

SEQ ID NO: 53196 - DNA, 25 bp, Rattus norvegicus
aagtggaattgttgaggccgcctct

SEQ ID NO: 53197 - DNA, 25 bp, Rattus norvegicus
aagtggacaagtacttcattgctgt

SEQ ID NO: 53198 - DNA, 25 bp, Rattus norvegicus
aagtggacaagttcttcattgctgt

SEQ ID NO: 53199 - DNA, 25 bp, Rattus norvegicus
aagtggacacccagagtcttccttt

SEQ ID NO: 53200 - DNA, 25 bp, Rattus norvegicus
aagtggacaccctgagtcttccttt

SEQ ID NO: 53201 - DNA, 25 bp, Rattus norvegicus
aagtggacacctagcaggctgtggt

SEQ ID NO: 53202 - DNA, 25 bp, Rattus norvegicus
aagtggacaccttgcaggctgtggt

SEQ ID NO: 53203 - DNA, 25 bp, Rattus norvegicus
aagtggacacttaagttatgcctgt

SEQ ID NO: 53204 - DNA, 25 bp, Rattus norvegicus
aagtggacacttccacctaggtatt

SEQ ID NO: 53205 - DNA, 25 bp, Rattus norvegicus
aagtggacacttgcacctaggtatt

SEQ ID NO: 53206 - DNA, 25 bp, Rattus norvegicus
aagtggacactttagttatgcctgt

SEQ ID NO: 53207 - DNA, 25 bp, Rattus norvegicus
aagtggacagctcctgaagccatca

SEQ ID NO: 53208 - DNA, 25 bp, Rattus norvegicus
aagtggacagctgctgaagccatca

SEQ ID NO: 53209 - DNA, 25 bp, Rattus norvegicus
aagtggacatacacctgtgtgttaa

SEQ ID NO: 53210 - DNA, 25 bp, Rattus norvegicus
aagtggacatactcctgtgtgttaa

SEQ ID NO: 53211 - DNA, 25 bp, Rattus norvegicus
aagtggacattcacctggcctggat

SEQ ID NO: 53212 - DNA, 25 bp, Rattus norvegicus
aagtggacattctcctggcctggat

SEQ ID NO: 53213 - DNA, 25 bp, Rattus norvegicus
aagtggaccaagactgtcacctgca

SEQ ID NO: 53214 - DNA, 25 bp, Rattus norvegicus
aagtggaccaagtctgtcacctgca

SEQ ID NO: 53215 - DNA, 25 bp, Rattus norvegicus
aagtggaccgtaatcttgctgctgt

SEQ ID NO: 53216 - DNA, 25 bp, Rattus norvegicus
aagtggaccgtattcttgctgctgt

SEQ ID NO: 53217 - DNA, 25 bp, Rattus norvegicus
aagtggaccgtgatgcaagactgat

SEQ ID NO: 53218 - DNA, 25 bp, Rattus norvegicus
aagtggaccgtgttgcaagactgat

SEQ ID NO: 53219 - DNA, 25 bp, Rattus norvegicus
aagtggacctgtacaaaccaaatgt

SEQ ID NO: 53220 - DNA, 25 bp, Rattus norvegicus
aagtggacctgttcaaaccaaatgt

SEQ ID NO: 53221 - DNA, 25 bp, Rattus norvegicus
aagtggacgagcagacccagatcat

SEQ ID NO: 53222 - DNA, 25 bp, Rattus norvegicus
aagtggacgagctgacccagatcat

SEQ ID NO: 53223 - DNA, 25 bp, Rattus norvegicus
aagtggacgtgtaccctgcggctcc

SEQ ID NO: 53224 - DNA, 25 bp, Rattus norvegicus
aagtggacgtgttccctgcggctcc

SEQ ID NO: 53225 - DNA, 25 bp, Rattus norvegicus
aagtggactcggctcctctgaagag

SEQ ID NO: 53226 - DNA, 25 bp, Rattus norvegicus
aagtggactcgggtcctctgaagag

SEQ ID NO: 53227 - DNA, 25 bp, Rattus norvegicus
aagtggactgatctgctctgtatac

SEQ ID NO: 53228 - DNA, 25 bp, Rattus norvegicus
aagtggactgatgtgctctgtatac

SEQ ID NO: 53229 - DNA, 25 bp, Rattus norvegicus
aagtggactgtcaccaagacctgca

SEQ ID NO: 53230 - DNA, 25 bp, Rattus norvegicus
aagtggactgtctccaagacctgca

SEQ ID NO: 53231 - DNA, 25 bp, Rattus norvegicus
aagtggacttcaccggacaaatttc

SEQ ID NO: 53232 - DNA, 25 bp, Rattus norvegicus
aagtggacttcagcggacaaatttc

SEQ ID NO: 53233 - DNA, 25 bp, Rattus norvegicus
aagtggacttgtatgctgataattc

SEQ ID NO: 53234 - DNA, 25 bp, Rattus norvegicus
aagtggacttgtttgctgataattc

SEQ ID NO: 53235 - DNA, 25 bp, Rattus norvegicus
aagtggacttttcggcattttctga

SEQ ID NO: 53236 - DNA, 25 bp, Rattus norvegicus
aagtggacttttgggcattttctga

SEQ ID NO: 53237 - DNA, 25 bp, Rattus norvegicus
aagtggagacgtctctcagtttcca

SEQ ID NO: 53238 - DNA, 25 bp, Rattus norvegicus
aagtggagacgtgtctcagtttcca

SEQ ID NO: 53239 - DNA, 25 bp, Rattus norvegicus
aagtggagcaccagtgccagaccac

SEQ ID NO: 53240 - DNA, 25 bp, Rattus norvegicus
aagtggagcacctgtgccagaccac

SEQ ID NO: 53241 - DNA, 25 bp, Rattus norvegicus
aagtggagccatctccgaggaccgt

SEQ ID NO: 53242 - DNA, 25 bp, Rattus norvegicus
aagtggagccatgtccgaggaccgt

SEQ ID NO: 53243 - DNA, 25 bp, Rattus norvegicus
aagtggagcggcaaccaaggcctgt

SEQ ID NO: 53244 - DNA, 25 bp, Rattus norvegicus
aagtggagcggctaccaaggcctgt

SEQ ID NO: 53245 - DNA, 25 bp, Rattus norvegicus
aagtggagcggtcccaatccaggaa

SEQ ID NO: 53246 - DNA, 25 bp, Rattus norvegicus
aagtggagcggtgccaatccaggaa

SEQ ID NO: 53247 - DNA, 25 bp, Rattus norvegicus
aagtggagctccagaaggccagcaa

SEQ ID NO: 53248 - DNA, 25 bp, Rattus norvegicus
aagtggagctcctgaaggccagcaa

SEQ ID NO: 53249 - DNA, 25 bp, Rattus norvegicus
aagtggagctgtactctgctgcagt

SEQ ID NO: 53250 - DNA, 25 bp, Rattus norvegicus
aagtggagctgttctctgctgcagt

SEQ ID NO: 53251 - DNA, 25 bp, Rattus norvegicus
aagtggagctttcccgtggctttgc

SEQ ID NO: 53252 - DNA, 25 bp, Rattus norvegicus
aagtggagctttgccgtggctttgc

SEQ ID NO: 53253 - DNA, 25 bp, Rattus norvegicus
aagtggagtcagatcttcaacccta

SEQ ID NO: 53254 - DNA, 25 bp, Rattus norvegicus
aagtggagtcagttcttcaacccta

SEQ ID NO: 53255 - DNA, 25 bp, Rattus norvegicus
aagtggagttccatgtttggctaat

SEQ ID NO: 53256 - DNA, 25 bp, Rattus norvegicus
aagtggagttccttgtttggctaat

SEQ ID NO: 53257 - DNA, 25 bp, Rattus norvegicus
aagtggatacatatcacgcttaggg

SEQ ID NO: 53258 - DNA, 25 bp, Rattus norvegicus
aagtggatacatttcacgcttaggg

SEQ ID NO: 53259 - DNA, 25 bp, Rattus norvegicus
aagtggatactcacaccggcagaag

SEQ ID NO: 53260 - DNA, 25 bp, Rattus norvegicus
aagtggatactctcaccggcagaag

SEQ ID NO: 53261 - DNA, 25 bp, Rattus norvegicus
aagtggatcattcgaccttacccat

SEQ ID NO: 53262 - DNA, 25 bp, Rattus norvegicus
aagtggatcattggaccttacccat

SEQ ID NO: 53263 - DNA, 25 bp, Rattus norvegicus
aagtggatccaactggtagtggcat

SEQ ID NO: 53264 - DNA, 25 bp, Rattus norvegicus
aagtggatccaagtggtagtggcat

SEQ ID NO: 53265 - DNA, 25 bp, Rattus norvegicus
aagtggatccaccttgagatgcatg

SEQ ID NO: 53266 - DNA, 25 bp, Rattus norvegicus
aagtggatccacgttgagatgcatg

SEQ ID NO: 53267 - DNA, 25 bp, Rattus norvegicus
aagtggatcctccacactgacacgt

SEQ ID NO: 53268 - DNA, 25 bp, Rattus norvegicus
aagtggatcctcgacactgacacgt

SEQ ID NO: 53269 - DNA, 25 bp, Rattus norvegicus
aagtggatcgtgctctggccctgca

SEQ ID NO: 53270 - DNA, 25 bp, Rattus norvegicus
aagtggatcgtggtctggccctgca

SEQ ID NO: 53271 - DNA, 25 bp, Rattus norvegicus
aagtggatgagacccgcaagtgcta

SEQ ID NO: 53272 - DNA, 25 bp, Rattus norvegicus
aagtggatgagagccgcaagtgcta

SEQ ID NO: 53273 - DNA, 25 bp, Rattus norvegicus
aagtggatgagcagacctgtgagaa

SEQ ID NO: 53274 - DNA, 25 bp, Rattus norvegicus
aagtggatgagctgacctgtgagaa

SEQ ID NO: 53275 - DNA, 25 bp, Rattus norvegicus
aagtggatggcacctgcagccctga

SEQ ID NO: 53276 - DNA, 25 bp, Rattus norvegicus
aagtggatggcagctgcagccctga

SEQ ID NO: 53277 - DNA, 25 bp, Rattus norvegicus
aagtggatgggcacccctgcaaaca

SEQ ID NO: 53278 - DNA, 25 bp, Rattus norvegicus
aagtggatgggctcccctgcaaaca

SEQ ID NO: 53279 - DNA, 25 bp, Rattus norvegicus
aagtggatgtctctgcatgtgttgt

SEQ ID NO: 53280 - DNA, 25 bp, Rattus norvegicus
aagtggatgtctgtgcatgtgttgt

SEQ ID NO: 53281 - DNA, 25 bp, Rattus norvegicus
aagtggatgtttctgtcagcgcagt

SEQ ID NO: 53282 - DNA, 25 bp, Rattus norvegicus
aagtggatgtttgtgtcagcgcagt

SEQ ID NO: 53283 - DNA, 25 bp, Rattus norvegicus
aagtggattaggctcaggtcctaga

SEQ ID NO: 53284 - DNA, 25 bp, Rattus norvegicus
aagtggattagggtcaggtcctaga

SEQ ID NO: 53285 - DNA, 25 bp, Rattus norvegicus
aagtggattctccagccacaggcat

SEQ ID NO: 53286 - DNA, 25 bp, Rattus norvegicus
aagtggattctcgagccacaggcat

SEQ ID NO: 53287 - DNA, 25 bp, Rattus norvegicus
aagtggatttgaaatccccttcctt

SEQ ID NO: 53288 - DNA, 25 bp, Rattus norvegicus
aagtggatttgacccatcgtgatgc

SEQ ID NO: 53289 - DNA, 25 bp, Rattus norvegicus
aagtggatttgagccatcgtgatgc

SEQ ID NO: 53290 - DNA, 25 bp, Rattus norvegicus
aagtggatttgatatccccttcctt

SEQ ID NO: 53291 - DNA, 25 bp, Rattus norvegicus
aagtggatttgtataggatggagtc

SEQ ID NO: 53292 - DNA, 25 bp, Rattus norvegicus
aagtggatttgtttaggatggagtc

SEQ ID NO: 53293 - DNA, 25 bp, Rattus norvegicus
aagtggcaaagcatgaagtgtctcc

SEQ ID NO: 53294 - DNA, 25 bp, Rattus norvegicus
aagtggcaaagcttgaagtgtctcc

SEQ ID NO: 53295 - DNA, 25 bp, Rattus norvegicus
aagtggcaaatcaggttaaagcgta

SEQ ID NO: 53296 - DNA, 25 bp, Rattus norvegicus
aagtggcaaatctggttaaagcgta

SEQ ID NO: 53297 - DNA, 25 bp, Rattus norvegicus
aagtggcacaggacccagaccgagg

SEQ ID NO: 53298 - DNA, 25 bp, Rattus norvegicus
aagtggcacaggtcccagaccgagg

SEQ ID NO: 53299 - DNA, 25 bp, Rattus norvegicus
aagtggcacagtcttgacctgccca

SEQ ID NO: 53300 - DNA, 25 bp, Rattus norvegicus
aagtggcacagtgttgacctgccca

SEQ ID NO: 53301 - DNA, 25 bp, Rattus norvegicus
aagtggcactacagagaatctctac

SEQ ID NO: 53302 - DNA, 25 bp, Rattus norvegicus
aagtggcactactgagaatctctac

SEQ ID NO: 53303 - DNA, 25 bp, Rattus norvegicus
aagtggcactttaaagaggtgtggc

SEQ ID NO: 53304 - DNA, 25 bp, Rattus norvegicus
aagtggcacttttaagaggtgtggc

SEQ ID NO: 53305 - DNA, 25 bp, Rattus norvegicus
aagtggcagcctactaaaactaaga

SEQ ID NO: 53306 - DNA, 25 bp, Rattus norvegicus
aagtggcagccttctaaaactaaga

SEQ ID NO: 53307 - DNA, 25 bp, Rattus norvegicus
aagtggcatcctcaatctgcctcag

SEQ ID NO: 53308 - DNA, 25 bp, Rattus norvegicus
aagtggcatcctgaatctgcctcag

SEQ ID NO: 53309 - DNA, 25 bp, Rattus norvegicus
aagtggcatgccctctgctgtagcc

SEQ ID NO: 53310 - DNA, 25 bp, Rattus norvegicus
aagtggcatgccgtctgctgtagcc

SEQ ID NO: 53311 - DNA, 25 bp, Rattus norvegicus
aagtggccaagtatcgcttcctgaa

SEQ ID NO: 53312 - DNA, 25 bp, Rattus norvegicus
aagtggccaagtttcgcttcctgaa

SEQ ID NO: 53313 - DNA, 25 bp, Rattus norvegicus
aagtggccaataaaatccccgtgtc

SEQ ID NO: 53314 - DNA, 25 bp, Rattus norvegicus
aagtggccaatataatccccgtgtc

SEQ ID NO: 53315 - DNA, 25 bp, Rattus norvegicus
aagtggccacatacagactctgctt

SEQ ID NO: 53316 - DNA, 25 bp, Rattus norvegicus
aagtggccacattcagactctgctt

SEQ ID NO: 53317 - DNA, 25 bp, Rattus norvegicus
aagtggccagatcgcgctacagtga

SEQ ID NO: 53318 - DNA, 25 bp, Rattus norvegicus
aagtggccagatggcgctacagtga

SEQ ID NO: 53319 - DNA, 25 bp, Rattus norvegicus
aagtggccataaagctctggacacc

SEQ ID NO: 53320 - DNA, 25 bp, Rattus norvegicus
aagtggccataatgctctggacacc

SEQ ID NO: 53321 - DNA, 25 bp, Rattus norvegicus
aagtggccattcatcatgcccaagc

SEQ ID NO: 53322 - DNA, 25 bp, Rattus norvegicus
aagtggccattcttcatgcccaagc

SEQ ID NO: 53323 - DNA, 25 bp, Rattus norvegicus
aagtggcccagacccttggaccctg

SEQ ID NO: 53324 - DNA, 25 bp, Rattus norvegicus
aagtggcccagagccttggaccctg

SEQ ID NO: 53325 - DNA, 25 bp, Rattus norvegicus
aagtggcccgtcatcgagctcaagg

SEQ ID NO: 53326 - DNA, 25 bp, Rattus norvegicus
aagtggcccgtcttcgagctcaagg

SEQ ID NO: 53327 - DNA, 25 bp, Rattus norvegicus
aagtggccctgactgttaattgctc

SEQ ID NO: 53328 - DNA, 25 bp, Rattus norvegicus
aagtggccctgagtgttaattgctc

SEQ ID NO: 53329 - DNA, 25 bp, Rattus norvegicus
aagtggcccttgattcagtccctag

SEQ ID NO: 53330 - DNA, 25 bp, Rattus norvegicus
aagtggcccttgtttcagtccctag

SEQ ID NO: 53331 - DNA, 25 bp, Rattus norvegicus
aagtggccggtaaggccaagcccaa

SEQ ID NO: 53332 - DNA, 25 bp, Rattus norvegicus
aagtggccggtatggccaagcccaa

SEQ ID NO: 53333 - DNA, 25 bp, Rattus norvegicus
aagtggcctatcacaatctctgaca

SEQ ID NO: 53334 - DNA, 25 bp, Rattus norvegicus
aagtggcctatctcaatctctgaca

SEQ ID NO: 53335 - DNA, 25 bp, Rattus norvegicus
aagtggcctattcgaatgtttccct

SEQ ID NO: 53336 - DNA, 25 bp, Rattus norvegicus
aagtggcctattggaatgtttccct

SEQ ID NO: 53337 - DNA, 25 bp, Rattus norvegicus
aagtggcctccactggaagccagac

SEQ ID NO: 53338 - DNA, 25 bp, Rattus norvegicus
aagtggcctccagtggaagccagac

SEQ ID NO: 53339 - DNA, 25 bp, Rattus norvegicus
aagtggccttggactccaaattcag

SEQ ID NO: 53340 - DNA, 25 bp, Rattus norvegicus
aagtggccttggtctccaaattcag

SEQ ID NO: 53341 - DNA, 25 bp, Rattus norvegicus
aagtggcctttcatttgtgcatcga

SEQ ID NO: 53342 - DNA, 25 bp, Rattus norvegicus
aagtggcctttcttttgtgcatcga

SEQ ID NO: 53343 - DNA, 25 bp, Rattus norvegicus
aagtggcctttgagttacatgcgtg

SEQ ID NO: 53344 - DNA, 25 bp, Rattus norvegicus
aagtggcctttgtgttacatgcgtg

SEQ ID NO: 53345 - DNA, 25 bp, Rattus norvegicus
aagtggcgagacctcatcaggatga

SEQ ID NO: 53346 - DNA, 25 bp, Rattus norvegicus
aagtggcgagacgtcatcaggatga

SEQ ID NO: 53347 - DNA, 25 bp, Rattus norvegicus
aagtggcgattcaccggattcgaat

SEQ ID NO: 53348 - DNA, 25 bp, Rattus norvegicus
aagtggcgattctccggattcgaat

SEQ ID NO: 53349 - DNA, 25 bp, Rattus norvegicus
aagtggcgccttagcaacaactctg

SEQ ID NO: 53350 - DNA, 25 bp, Rattus norvegicus
aagtggcgcctttgcaacaactctg

SEQ ID NO: 53351 - DNA, 25 bp, Rattus norvegicus
aagtggcgtcagctgggcctacaca

SEQ ID NO: 53352 - DNA, 25 bp, Rattus norvegicus
aagtggcgtcaggtgggcctacaca

SEQ ID NO: 53353 - DNA, 25 bp, Rattus norvegicus
aagtggcgttgactaggcctcccaa

SEQ ID NO: 53354 - DNA, 25 bp, Rattus norvegicus
aagtggcgttgagtaggcctcccaa

SEQ ID NO: 53355 - DNA, 25 bp, Rattus norvegicus
aagtggctaatcatctctgctgtat

SEQ ID NO: 53356 - DNA, 25 bp, Rattus norvegicus
aagtggctaatcttctctgctgtat

SEQ ID NO: 53357 - DNA, 25 bp, Rattus norvegicus
aagtggctacctacaggactcctga

SEQ ID NO: 53358 - DNA, 25 bp, Rattus norvegicus
aagtggctaccttcaggactcctga

SEQ ID NO: 53359 - DNA, 25 bp, Rattus norvegicus
aagtggctactgcaagggtccaatc

SEQ ID NO: 53360 - DNA, 25 bp, Rattus norvegicus
aagtggctactggaagggtccaatc

SEQ ID NO: 53361 - DNA, 25 bp, Rattus norvegicus
aagtggctagatccacccgtgacgg

SEQ ID NO: 53362 - DNA, 25 bp, Rattus norvegicus
aagtggctagatgcacccgtgacgg

SEQ ID NO: 53363 - DNA, 25 bp, Rattus norvegicus
aagtggctagcgcacgtgtctcgaa

SEQ ID NO: 53364 - DNA, 25 bp, Rattus norvegicus
aagtggctagcggacgtgtctcgaa

SEQ ID NO: 53365 - DNA, 25 bp, Rattus norvegicus
aagtggctagtgaatgctgcctcca

SEQ ID NO: 53366 - DNA, 25 bp, Rattus norvegicus
aagtggctagtgtatgctgcctcca

SEQ ID NO: 53367 - DNA, 25 bp, Rattus norvegicus
aagtggctatgacaacctgaccttc

SEQ ID NO: 53368 - DNA, 25 bp, Rattus norvegicus
aagtggctatgagaacctgaccttc

SEQ ID NO: 53369 - DNA, 25 bp, Rattus norvegicus
aagtggctatgtccaccttctcagt

SEQ ID NO: 53370 - DNA, 25 bp, Rattus norvegicus
aagtggctatgtgcaccttctcagt

SEQ ID NO: 53371 - DNA, 25 bp, Rattus norvegicus
aagtggctcacaactatttttaatg

SEQ ID NO: 53372 - DNA, 25 bp, Rattus norvegicus
aagtggctcacaactgaggactcca

SEQ ID NO: 53373 - DNA, 25 bp, Rattus norvegicus
aagtggctcacatctatttttaatg

SEQ ID NO: 53374 - DNA, 25 bp, Rattus norvegicus
aagtggctcacatctgaggactcca

SEQ ID NO: 53375 - DNA, 25 bp, Rattus norvegicus
aagtggctcaccagatatgggacag

SEQ ID NO: 53376 - DNA, 25 bp, Rattus norvegicus
aagtggctcacctgatatgggacag

SEQ ID NO: 53377 - DNA, 25 bp, Rattus norvegicus
aagtggctcaggaccgcaaacctga

SEQ ID NO: 53378 - DNA, 25 bp, Rattus norvegicus
aagtggctcaggtccgcaaacctga

SEQ ID NO: 53379 - DNA, 25 bp, Rattus norvegicus
aagtggctcggcaggacggatcaaa

SEQ ID NO: 53380 - DNA, 25 bp, Rattus norvegicus
aagtggctcggccactgagccatca

SEQ ID NO: 53381 - DNA, 25 bp, Rattus norvegicus
aagtggctcggcgactgagccatca

SEQ ID NO: 53382 - DNA, 25 bp, Rattus norvegicus
aagtggctcggctggacggatcaaa

SEQ ID NO: 53383 - DNA, 25 bp, Rattus norvegicus
aagtggctctggatctgaatcctac

SEQ ID NO: 53384 - DNA, 25 bp, Rattus norvegicus
aagtggctctggttctgaatcctac

SEQ ID NO: 53385 - DNA, 25 bp, Rattus norvegicus
aagtggctgaagaacatcgtctaca

SEQ ID NO: 53386 - DNA, 25 bp, Rattus norvegicus
aagtggctgaagtacatcgtctaca

SEQ ID NO: 53387 - DNA, 25 bp, Rattus norvegicus
aagtggctgagcacctgtctggcct

SEQ ID NO: 53388 - DNA, 25 bp, Rattus norvegicus
aagtggctgagcacgtacagtacat

SEQ ID NO: 53389 - DNA, 25 bp, Rattus norvegicus
aagtggctgagcactggaaggccct

SEQ ID NO: 53390 - DNA, 25 bp, Rattus norvegicus
aagtggctgagctcctgtctggcct

SEQ ID NO: 53391 - DNA, 25 bp, Rattus norvegicus
aagtggctgagctcgtacagtacat

SEQ ID NO: 53392 - DNA, 25 bp, Rattus norvegicus
aagtggctgagctctggaaggccct

SEQ ID NO: 53393 - DNA, 25 bp, Rattus norvegicus
aagtggctggcgacatctttgacat

SEQ ID NO: 53394 - DNA, 25 bp, Rattus norvegicus
aagtggctggcgtcatctttgacat

SEQ ID NO: 53395 - DNA, 25 bp, Rattus norvegicus
aagtggctgggactttagcaccctg

SEQ ID NO: 53396 - DNA, 25 bp, Rattus norvegicus
aagtggctgggagtttagcaccctg

SEQ ID NO: 53397 - DNA, 25 bp, Rattus norvegicus
aagtggctgtttacactcacagcag

SEQ ID NO: 53398 - DNA, 25 bp, Rattus norvegicus
aagtggctgttttcactcacagcag

SEQ ID NO: 53399 - DNA, 25 bp, Rattus norvegicus
aagtggcttcagcagcttcctatga

SEQ ID NO: 53400 - DNA, 25 bp, Rattus norvegicus
aagtggcttcaggagcttcctatga

SEQ ID NO: 53401 - DNA, 25 bp, Rattus norvegicus
aagtggcttcataagtcactgcctg

SEQ ID NO: 53402 - DNA, 25 bp, Rattus norvegicus
aagtggcttcattagtcactgcctg

SEQ ID NO: 53403 - DNA, 25 bp, Rattus norvegicus
aagtggcttcctagttgcctaagag

SEQ ID NO: 53404 - DNA, 25 bp, Rattus norvegicus
aagtggcttccttgttgcctaagag

SEQ ID NO: 53405 - DNA, 25 bp, Rattus norvegicus
aagtggcttgcacaagggcccaatg

SEQ ID NO: 53406 - DNA, 25 bp, Rattus norvegicus
aagtggcttgcagaagggcccaatg

SEQ ID NO: 53407 - DNA, 25 bp, Rattus norvegicus
aagtggcttgtgataagtggttgac

SEQ ID NO: 53408 - DNA, 25 bp, Rattus norvegicus
aagtggcttgtgttaagtggttgac

SEQ ID NO: 53409 - DNA, 25 bp, Rattus norvegicus
aagtggctttggagtcttgtcctat

SEQ ID NO: 53410 - DNA, 25 bp, Rattus norvegicus
aagtggctttggtgtcttgtcctat

SEQ ID NO: 53411 - DNA, 25 bp, Rattus norvegicus
aagtgggaagttagattgcagcatc

SEQ ID NO: 53412 - DNA, 25 bp, Rattus norvegicus
aagtgggaagtttgattgcagcatc

SEQ ID NO: 53413 - DNA, 25 bp, Rattus norvegicus
aagtgggacaacaggcctcctgaga

SEQ ID NO: 53414 - DNA, 25 bp, Rattus norvegicus
aagtgggacaactggcctcctgaga

SEQ ID NO: 53415 - DNA, 25 bp, Rattus norvegicus
aagtgggaccttagtctgtctatcg

SEQ ID NO: 53416 - DNA, 25 bp, Rattus norvegicus
aagtgggacctttgtctgtctatcg

SEQ ID NO: 53417 - DNA, 25 bp, Rattus norvegicus
aagtgggacgccacaagatccttga

SEQ ID NO: 53418 - DNA, 25 bp, Rattus norvegicus
aagtgggacgcctcaagatccttga

SEQ ID NO: 53419 - DNA, 25 bp, Rattus norvegicus
aagtgggactaaatgctccttcctt

SEQ ID NO: 53420 - DNA, 25 bp, Rattus norvegicus
aagtgggactaattgctccttcctt

SEQ ID NO: 53421 - DNA, 25 bp, Rattus norvegicus
aagtgggactccagtgctgctcacg

SEQ ID NO: 53422 - DNA, 25 bp, Rattus norvegicus
aagtgggactcctgtgctgctcacg

SEQ ID NO: 53423 - DNA, 25 bp, Rattus norvegicus
aagtgggacttcctgcagcactgcc

SEQ ID NO: 53424 - DNA, 25 bp, Rattus norvegicus
aagtgggacttcgtgcagcactgcc

SEQ ID NO: 53425 - DNA, 25 bp, Rattus norvegicus
aagtgggagcgacctccattacagc

SEQ ID NO: 53426 - DNA, 25 bp, Rattus norvegicus
aagtgggagcgagctccattacagc

SEQ ID NO: 53427 - DNA, 25 bp, Rattus norvegicus
aagtgggagctcatccagctggctg

SEQ ID NO: 53428 - DNA, 25 bp, Rattus norvegicus
aagtgggagctcttccagctggctg

SEQ ID NO: 53429 - DNA, 25 bp, Rattus norvegicus
aagtgggaggccagcgttcaaagcc

SEQ ID NO: 53430 - DNA, 25 bp, Rattus norvegicus
aagtgggaggcctgcgttcaaagcc

SEQ ID NO: 53431 - DNA, 25 bp, Rattus norvegicus
aagtgggagggcagtctctcacgtc

SEQ ID NO: 53432 - DNA, 25 bp, Rattus norvegicus
aagtgggagggctgtctctcacgtc

SEQ ID NO: 53433 - DNA, 25 bp, Rattus norvegicus
aagtgggattccatttcagggccct

SEQ ID NO: 53434 - DNA, 25 bp, Rattus norvegicus
aagtgggattccttttcagggccct

SEQ ID NO: 53435 - DNA, 25 bp, Rattus norvegicus
aagtgggcaaaacagctctgctgaa

SEQ ID NO: 53436 - DNA, 25 bp, Rattus norvegicus
aagtgggcaaaagagctctgctgaa

SEQ ID NO: 53437 - DNA, 25 bp, Rattus norvegicus
aagtgggcaccgacttgctcgaaga

SEQ ID NO: 53438 - DNA, 25 bp, Rattus norvegicus
aagtgggcaccgtcttgctcgaaga

SEQ ID NO: 53439 - DNA, 25 bp, Rattus norvegicus
aagtgggcacgaagaatctcttcct

SEQ ID NO: 53440 - DNA, 25 bp, Rattus norvegicus
aagtgggcacgatgaatctcttcct

SEQ ID NO: 53441 - DNA, 25 bp, Rattus norvegicus
aagtgggcacttaaggtgtcacctc

SEQ ID NO: 53442 - DNA, 25 bp, Rattus norvegicus
aagtgggcactttaggtgtcacctc

SEQ ID NO: 53443 - DNA, 25 bp, Rattus norvegicus
aagtgggcagcgaatctagatctgg

SEQ ID NO: 53444 - DNA, 25 bp, Rattus norvegicus
aagtgggcagcgtatctagatctgg

SEQ ID NO: 53445 - DNA, 25 bp, Rattus norvegicus
aagtgggcaggtaaacattctcggt

SEQ ID NO: 53446 - DNA, 25 bp, Rattus norvegicus
aagtgggcaggttaacattctcggt

SEQ ID NO: 53447 - DNA, 25 bp, Rattus norvegicus
aagtgggccacaataaggacttgga

SEQ ID NO: 53448 - DNA, 25 bp, Rattus norvegicus
aagtgggccacattaaggacttgga

SEQ ID NO: 53449 - DNA, 25 bp, Rattus norvegicus
aagtgggccactcttcaactttgat

SEQ ID NO: 53450 - DNA, 25 bp, Rattus norvegicus
aagtgggccactgttcaactttgat

SEQ ID NO: 53451 - DNA, 25 bp, Rattus norvegicus
aagtgggcctaaataaactctgtca

SEQ ID NO: 53452 - DNA, 25 bp, Rattus norvegicus
aagtgggcctaattaaactctgtca

SEQ ID NO: 53453 - DNA, 25 bp, Rattus norvegicus
aagtgggcctgaaggaccgccagca

SEQ ID NO: 53454 - DNA, 25 bp, Rattus norvegicus
aagtgggcctgatggaccgccagca

SEQ ID NO: 53455 - DNA, 25 bp, Rattus norvegicus
aagtgggccttaaactgatcctcct

SEQ ID NO: 53456 - DNA, 25 bp, Rattus norvegicus
aagtgggccttatactgatcctcct

SEQ ID NO: 53457 - DNA, 25 bp, Rattus norvegicus
aagtgggccttcaatctctacgaca

SEQ ID NO: 53458 - DNA, 25 bp, Rattus norvegicus
aagtgggccttctatctctacgaca

SEQ ID NO: 53459 - DNA, 25 bp, Rattus norvegicus
aagtgggcgatcaagttatctgtta

SEQ ID NO: 53460 - DNA, 25 bp, Rattus norvegicus
aagtgggcgatctagttatctgtta

SEQ ID NO: 53461 - DNA, 25 bp, Rattus norvegicus
aagtgggctcctaccatgttcagtc

SEQ ID NO: 53462 - DNA, 25 bp, Rattus norvegicus
aagtgggctccttccatgttcagtc

SEQ ID NO: 53463 - DNA, 25 bp, Rattus norvegicus
aagtgggctgatccagcttcgaagc

SEQ ID NO: 53464 - DNA, 25 bp, Rattus norvegicus
aagtgggctgatgcagcttcgaagc

SEQ ID NO: 53465 - DNA, 25 bp, Rattus norvegicus
aagtgggtaatcaccagtgtattag

SEQ ID NO: 53466 - DNA, 25 bp, Rattus norvegicus
aagtgggtaatctccagtgtattag

SEQ ID NO: 53467 - DNA, 25 bp, Rattus norvegicus
aagtgggtactgacccagggcatgc

SEQ ID NO: 53468 - DNA, 25 bp, Rattus norvegicus
aagtgggtactgtcccagggcatgc

SEQ ID NO: 53469 - DNA, 25 bp, Rattus norvegicus
aagtgggtagctacatgctggctct

SEQ ID NO: 53470 - DNA, 25 bp, Rattus norvegicus
aagtgggtagcttcatgctggctct

SEQ ID NO: 53471 - DNA, 25 bp, Rattus norvegicus
aagtgggtatgcacctcagggatgc

SEQ ID NO: 53472 - DNA, 25 bp, Rattus norvegicus
aagtgggtatgctcctcagggatgc

SEQ ID NO: 53473 - DNA, 25 bp, Rattus norvegicus
aagtgggtcactcggctcataaagt

SEQ ID NO: 53474 - DNA, 25 bp, Rattus norvegicus
aagtgggtcactgggctcataaagt

SEQ ID NO: 53475 - DNA, 25 bp, Rattus norvegicus
aagtgggtcgcaacatcgagtgcac

SEQ ID NO: 53476 - DNA, 25 bp, Rattus norvegicus
aagtgggtcgcatcatcgagtgcac

SEQ ID NO: 53477 - DNA, 25 bp, Rattus norvegicus
aagtgggtcgggaatctctgtgttc

SEQ ID NO: 53478 - DNA, 25 bp, Rattus norvegicus
aagtgggtcgggtatctctgtgttc

SEQ ID NO: 53479 - DNA, 25 bp, Rattus norvegicus
aagtgggtctcacacaagtcccaag

SEQ ID NO: 53480 - DNA, 25 bp, Rattus norvegicus
aagtgggtctcagacaagtcccaag

SEQ ID NO: 53481 - DNA, 25 bp, Rattus norvegicus
aagtgggtctgcactatgtttccag

SEQ ID NO: 53482 - DNA, 25 bp, Rattus norvegicus
aagtgggtctgctctatgtttccag

SEQ ID NO: 53483 - DNA, 25 bp, Rattus norvegicus
aagtgggtgcacctatacatctccg

SEQ ID NO: 53484 - DNA, 25 bp, Rattus norvegicus
aagtgggtgcacgtatacatctccg

SEQ ID NO: 53485 - DNA, 25 bp, Rattus norvegicus
aagtgggtgccaaccgatgtcgcag

SEQ ID NO: 53486 - DNA, 25 bp, Rattus norvegicus
aagtgggtgccatccgatgtcgcag

SEQ ID NO: 53487 - DNA, 25 bp, Rattus norvegicus
aagtgggtggctcccagaagtctta

SEQ ID NO: 53488 - DNA, 25 bp, Rattus norvegicus
aagtgggtggctgccagaagtctta

SEQ ID NO: 53489 - DNA, 25 bp, Rattus norvegicus
aagtgggttctaatttcagcccaga

SEQ ID NO: 53490 - DNA, 25 bp, Rattus norvegicus
aagtgggttctacgcatctaagctt

SEQ ID NO: 53491 - DNA, 25 bp, Rattus norvegicus
aagtgggttctaggcatctaagctt

SEQ ID NO: 53492 - DNA, 25 bp, Rattus norvegicus
aagtgggttctattttcagcccaga

SEQ ID NO: 53493 - DNA, 25 bp, Rattus norvegicus
aagtggtacgtgactggttctgtaa

SEQ ID NO: 53494 - DNA, 25 bp, Rattus norvegicus
aagtggtacgtgtctggttctgtaa

SEQ ID NO: 53495 - DNA, 25 bp, Rattus norvegicus
aagtggtacttgctctcaaaggcct

SEQ ID NO: 53496 - DNA, 25 bp, Rattus norvegicus
aagtggtacttggtctcaaaggcct

SEQ ID NO: 53497 - DNA, 25 bp, Rattus norvegicus
aagtggtagtgcacatgcgtgatgc

SEQ ID NO: 53498 - DNA, 25 bp, Rattus norvegicus
aagtggtagtgctcatgcgtgatgc

SEQ ID NO: 53499 - DNA, 25 bp, Rattus norvegicus
aagtggtatctactcagtccataaa

SEQ ID NO: 53500 - DNA, 25 bp, Rattus norvegicus
aagtggtatctagtcagtccataaa

SEQ ID NO: 53501 - DNA, 25 bp, Rattus norvegicus
aagtggtatcttcattcctcagtga

SEQ ID NO: 53502 - DNA, 25 bp, Rattus norvegicus
aagtggtatcttgattcctcagtga

SEQ ID NO: 53503 - DNA, 25 bp, Rattus norvegicus
aagtggtcaagactagcatcggtaa

SEQ ID NO: 53504 - DNA, 25 bp, Rattus norvegicus
aagtggtcaagagtagcatcggtaa

SEQ ID NO: 53505 - DNA, 25 bp, Rattus norvegicus
aagtggtcacacatctacagcttgc

SEQ ID NO: 53506 - DNA, 25 bp, Rattus norvegicus
aagtggtcacacttctacagcttgc

SEQ ID NO: 53507 - DNA, 25 bp, Rattus norvegicus
aagtggtcattcctatctacagcgg

SEQ ID NO: 53508 - DNA, 25 bp, Rattus norvegicus
aagtggtcattcgtatctacagcgg

SEQ ID NO: 53509 - DNA, 25 bp, Rattus norvegicus
aagtggtccacacgaacaccatgac

SEQ ID NO: 53510 - DNA, 25 bp, Rattus norvegicus
aagtggtccacaggaacaccatgac

SEQ ID NO: 53511 - DNA, 25 bp, Rattus norvegicus
aagtggtccagtccatctcggagct

SEQ ID NO: 53512 - DNA, 25 bp, Rattus norvegicus
aagtggtccagtgcatctcggagct

SEQ ID NO: 53513 - DNA, 25 bp, Rattus norvegicus
aagtggtccatcaccaagttcaata

SEQ ID NO: 53514 - DNA, 25 bp, Rattus norvegicus
aagtggtccatctccaagttcaata

SEQ ID NO: 53515 - DNA, 25 bp, Rattus norvegicus
aagtggtcccatcatccaagctgtc

SEQ ID NO: 53516 - DNA, 25 bp, Rattus norvegicus
aagtggtcccatgatccaagctgtc

SEQ ID NO: 53517 - DNA, 25 bp, Rattus norvegicus
aagtggtccccgcagtgactggacc

SEQ ID NO: 53518 - DNA, 25 bp, Rattus norvegicus
aagtggtccccggagtgactggacc

SEQ ID NO: 53519 - DNA, 25 bp, Rattus norvegicus
aagtggtcctcactaacactgctct

SEQ ID NO: 53520 - DNA, 25 bp, Rattus norvegicus
aagtggtcctcagtaacactgctct

SEQ ID NO: 53521 - DNA, 25 bp, Rattus norvegicus
aagtggtcgttgaagcatttctgaa

SEQ ID NO: 53522 - DNA, 25 bp, Rattus norvegicus
aagtggtcgttgtagcatttctgaa

SEQ ID NO: 53523 - DNA, 25 bp, Rattus norvegicus
aagtggtctctgattctagccaggc

SEQ ID NO: 53524 - DNA, 25 bp, Rattus norvegicus
aagtggtctctgtttctagccaggc

SEQ ID NO: 53525 - DNA, 25 bp, Rattus norvegicus
aagtggtctggcatgagtgctgtta

SEQ ID NO: 53526 - DNA, 25 bp, Rattus norvegicus
aagtggtctggcttgagtgctgtta

SEQ ID NO: 53527 - DNA, 25 bp, Rattus norvegicus
aagtggtctgtactcattcctgatg

SEQ ID NO: 53528 - DNA, 25 bp, Rattus norvegicus
aagtggtctgtagtcattcctgatg

SEQ ID NO: 53529 - DNA, 25 bp, Rattus norvegicus
aagtggtctgtcaccagctgtggaa

SEQ ID NO: 53530 - DNA, 25 bp, Rattus norvegicus
aagtggtctgtctccagctgtggaa

SEQ ID NO: 53531 - DNA, 25 bp, Rattus norvegicus
aagtggtcttcaaatccctgtgggt

SEQ ID NO: 53532 - DNA, 25 bp, Rattus norvegicus
aagtggtcttcatatccctgtgggt

SEQ ID NO: 53533 - DNA, 25 bp, Rattus norvegicus
aagtggtgagccctgaatccccaaa

SEQ ID NO: 53534 - DNA, 25 bp, Rattus norvegicus
aagtggtgagccgtgaatccccaaa

SEQ ID NO: 53535 - DNA, 25 bp, Rattus norvegicus
aagtggtgagctctagtttctctag

SEQ ID NO: 53536 - DNA, 25 bp, Rattus norvegicus
aagtggtgagctgtagtttctctag

SEQ ID NO: 53537 - DNA, 25 bp, Rattus norvegicus
aagtggtgcagtccttcctgatgtc

SEQ ID NO: 53538 - DNA, 25 bp, Rattus norvegicus
aagtggtgcagtgcttcctgatgtc

SEQ ID NO: 53539 - DNA, 25 bp, Rattus norvegicus
aagtggtggactagctttgtgaaga

SEQ ID NO: 53540 - DNA, 25 bp, Rattus norvegicus
aagtggtggacttgctttgtgaaga

SEQ ID NO: 53541 - DNA, 25 bp, Rattus norvegicus
aagtggtggagtcagcacacgcttc

SEQ ID NO: 53542 - DNA, 25 bp, Rattus norvegicus
aagtggtggagtgagcacacgcttc

SEQ ID NO: 53543 - DNA, 25 bp, Rattus norvegicus
aagtggtggcgcaacttatctgcat

SEQ ID NO: 53544 - DNA, 25 bp, Rattus norvegicus
aagtggtggcgcagctttcctgaga

SEQ ID NO: 53545 - DNA, 25 bp, Rattus norvegicus
aagtggtggcgctacttatctgcat

SEQ ID NO: 53546 - DNA, 25 bp, Rattus norvegicus
aagtggtggcgctgctttcctgaga

SEQ ID NO: 53547 - DNA, 25 bp, Rattus norvegicus
aagtggtggcttcagattaagcact

SEQ ID NO: 53548 - DNA, 25 bp, Rattus norvegicus
aagtggtggcttgagattaagcact

SEQ ID NO: 53549 - DNA, 25 bp, Rattus norvegicus
aagtggtgggccacactgacagccg

SEQ ID NO: 53550 - DNA, 25 bp, Rattus norvegicus
aagtggtgggcctcactgacagccg

SEQ ID NO: 53551 - DNA, 25 bp, Rattus norvegicus
aagtggtgtagaatgcaaggcccct

SEQ ID NO: 53552 - DNA, 25 bp, Rattus norvegicus
aagtggtgtagattgcaaggcccct

SEQ ID NO: 53553 - DNA, 25 bp, Rattus norvegicus
aagtggtgtcatattagtgctgtaa

SEQ ID NO: 53554 - DNA, 25 bp, Rattus norvegicus
aagtggtgtcattttagtgctgtaa

SEQ ID NO: 53555 - DNA, 25 bp, Rattus norvegicus
aagtggtgtctaagatgacccctcc

SEQ ID NO: 53556 - DNA, 25 bp, Rattus norvegicus
aagtggtgtctactccagtaactcc

SEQ ID NO: 53557 - DNA, 25 bp, Rattus norvegicus
aagtggtgtctagtccagtaactcc

SEQ ID NO: 53558 - DNA, 25 bp, Rattus norvegicus
aagtggtgtctatgatgacccctcc

SEQ ID NO: 53559 - DNA, 25 bp, Rattus norvegicus
aagtggtgtgccatcatacaggcaa

SEQ ID NO: 53560 - DNA, 25 bp, Rattus norvegicus
aagtggtgtgccttcatacaggcaa

SEQ ID NO: 53561 - DNA, 25 bp, Rattus norvegicus
aagtggttcaatatgtcccctacag

SEQ ID NO: 53562 - DNA, 25 bp, Rattus norvegicus
aagtggttcaatttgtcccctacag

SEQ ID NO: 53563 - DNA, 25 bp, Rattus norvegicus
aagtggttgattcttgttgccgccc

SEQ ID NO: 53564 - DNA, 25 bp, Rattus norvegicus
aagtggttgattgttgttgccgccc

SEQ ID NO: 53565 - DNA, 25 bp, Rattus norvegicus
aagtggttgtgtagtgtgccgccat

SEQ ID NO: 53566 - DNA, 25 bp, Rattus norvegicus
aagtggttgtgttgtgtgccgccat

SEQ ID NO: 53567 - DNA, 25 bp, Rattus norvegicus
aagtggtttcacagttgtgctggct

SEQ ID NO: 53568 - DNA, 25 bp, Rattus norvegicus
aagtggtttcactgttgtgctggct

SEQ ID NO: 53569 - DNA, 25 bp, Rattus norvegicus
aagtggtttctaccctcatgtgtaa

SEQ ID NO: 53570 - DNA, 25 bp, Rattus norvegicus
aagtggtttctagcctcatgtgtaa

SEQ ID NO: 53571 - DNA, 25 bp, Rattus norvegicus
aagtggtttgcaacttcacgctttc

SEQ ID NO: 53572 - DNA, 25 bp, Rattus norvegicus
aagtggtttgcatcttcacgctttc

SEQ ID NO: 53573 - DNA, 25 bp, Rattus norvegicus
aagtggtttggcacagatgtgctac

SEQ ID NO: 53574 - DNA, 25 bp, Rattus norvegicus
aagtggtttggctcagatgtgctac

SEQ ID NO: 53575 - DNA, 25 bp, Rattus norvegicus
aagtggttttatcagtttcaagcag

SEQ ID NO: 53576 - DNA, 25 bp, Rattus norvegicus
aagtggttttatgagtttcaagcag

SEQ ID NO: 53577 - DNA, 25 bp, Rattus norvegicus
aagtggttttcaagcacctgtcaaa

SEQ ID NO: 53578 - DNA, 25 bp, Rattus norvegicus
aagtggttttcacccaggtgcaggt

SEQ ID NO: 53579 - DNA, 25 bp, Rattus norvegicus
aagtggttttcagccaggtgcaggt

SEQ ID NO: 53580 - DNA, 25 bp, Rattus norvegicus
aagtggttttcatgcacctgtcaaa

SEQ ID NO: 53581 - DNA, 25 bp, Rattus norvegicus
aagtggttttctaggatctgccagt

SEQ ID NO: 53582 - DNA, 25 bp, Rattus norvegicus
aagtggttttcttggatctgccagt

SEQ ID NO: 53583 - DNA, 25 bp, Rattus norvegicus
aagtggttttgcacaggctcatcca

SEQ ID NO: 53584 - DNA, 25 bp, Rattus norvegicus
aagtggttttgctcaggctcatcca

SEQ ID NO: 53585 - DNA, 25 bp, Rattus norvegicus
aagtggttttgtactctgagtttat

SEQ ID NO: 53586 - DNA, 25 bp, Rattus norvegicus
aagtggttttgtctggcttctgctc

SEQ ID NO: 53587 - DNA, 25 bp, Rattus norvegicus
aagtggttttgtgtggcttctgctc

SEQ ID NO: 53588 - DNA, 25 bp, Rattus norvegicus
aagtggttttgttctctgagtttat

SEQ ID NO: 53589 - DNA, 25 bp, Rattus norvegicus
aagtgtaaggttcagcctgtcccgg

SEQ ID NO: 53590 - DNA, 25 bp, Rattus norvegicus
aagtgtaaggttgagcctgtcccgg

SEQ ID NO: 53591 - DNA, 25 bp, Rattus norvegicus
aagtgtaatacaagtctatcgatag

SEQ ID NO: 53592 - DNA, 25 bp, Rattus norvegicus
aagtgtaatacatgtctatcgatag

SEQ ID NO: 53593 - DNA, 25 bp, Rattus norvegicus
aagtgtacacacacgggaagcttag

SEQ ID NO: 53594 - DNA, 25 bp, Rattus norvegicus
aagtgtacacactcgggaagcttag

SEQ ID NO: 53595 - DNA, 25 bp, Rattus norvegicus
aagtgtacactaacatttctcccca

SEQ ID NO: 53596 - DNA, 25 bp, Rattus norvegicus
aagtgtacactatcatttctcccca

SEQ ID NO: 53597 - DNA, 25 bp, Rattus norvegicus
aagtgtacactcagcaccctgatct

SEQ ID NO: 53598 - DNA, 25 bp, Rattus norvegicus
aagtgtacactctgcaccctgatct

SEQ ID NO: 53599 - DNA, 25 bp, Rattus norvegicus
aagtgtaccttaccatatccagtag

SEQ ID NO: 53600 - DNA, 25 bp, Rattus norvegicus
aagtgtaccttagcatatccagtag

SEQ ID NO: 53601 - DNA, 25 bp, Rattus norvegicus
aagtgtacgtggctgactaccctga

SEQ ID NO: 53602 - DNA, 25 bp, Rattus norvegicus
aagtgtacgtgggtgactaccctga

SEQ ID NO: 53603 - DNA, 25 bp, Rattus norvegicus
aagtgtacgttcacctgggactgaa

SEQ ID NO: 53604 - DNA, 25 bp, Rattus norvegicus
aagtgtacgttctcctgggactgaa

SEQ ID NO: 53605 - DNA, 25 bp, Rattus norvegicus
aagtgtactggcagccattcttttc

SEQ ID NO: 53606 - DNA, 25 bp, Rattus norvegicus
aagtgtactggctgccattcttttc

SEQ ID NO: 53607 - DNA, 25 bp, Rattus norvegicus
aagtgtagacagacactccccatgc

SEQ ID NO: 53608 - DNA, 25 bp, Rattus norvegicus
aagtgtagacagtcactccccatgc

SEQ ID NO: 53609 - DNA, 25 bp, Rattus norvegicus
aagtgtagacatcgccctttttatt

SEQ ID NO: 53610 - DNA, 25 bp, Rattus norvegicus
aagtgtagacatggccctttttatt

SEQ ID NO: 53611 - DNA, 25 bp, Rattus norvegicus
aagtgtagactactgcccaggccaa

SEQ ID NO: 53612 - DNA, 25 bp, Rattus norvegicus
aagtgtagactagtgcccaggccaa

SEQ ID NO: 53613 - DNA, 25 bp, Rattus norvegicus
aagtgtagctataggctctcaggct

SEQ ID NO: 53614 - DNA, 25 bp, Rattus norvegicus
aagtgtagctattggctctcaggct

SEQ ID NO: 53615 - DNA, 25 bp, Rattus norvegicus
aagtgtagctttatacctgtcacct

SEQ ID NO: 53616 - DNA, 25 bp, Rattus norvegicus
aagtgtagctttttacctgtcacct

SEQ ID NO: 53617 - DNA, 25 bp, Rattus norvegicus
aagtgtagggccacctgtggtagcc

SEQ ID NO: 53618 - DNA, 25 bp, Rattus norvegicus
aagtgtagggcctcctgtggtagcc

SEQ ID NO: 53619 - DNA, 25 bp, Rattus norvegicus
aagtgtaggtggacctgccctgaca

SEQ ID NO: 53620 - DNA, 25 bp, Rattus norvegicus
aagtgtaggtggtcctgccctgaca

SEQ ID NO: 53621 - DNA, 25 bp, Rattus norvegicus
aagtgtataccaacaggcccagcag

SEQ ID NO: 53622 - DNA, 25 bp, Rattus norvegicus
aagtgtataccatcaggcccagcag

SEQ ID NO: 53623 - DNA, 25 bp, Rattus norvegicus
aagtgtatagtgatggccaagcatc

SEQ ID NO: 53624 - DNA, 25 bp, Rattus norvegicus
aagtgtatagtgttggccaagcatc

SEQ ID NO: 53625 - DNA, 25 bp, Rattus norvegicus
aagtgtatcaccacaaggccaagtc

SEQ ID NO: 53626 - DNA, 25 bp, Rattus norvegicus
aagtgtatcacctcaaggccaagtc

SEQ ID NO: 53627 - DNA, 25 bp, Rattus norvegicus
aagtgtatcattcttattccacgag

SEQ ID NO: 53628 - DNA, 25 bp, Rattus norvegicus
aagtgtatcattgttattccacgag

SEQ ID NO: 53629 - DNA, 25 bp, Rattus norvegicus
aagtgtatcgtgagtgggtccctaa

SEQ ID NO: 53630 - DNA, 25 bp, Rattus norvegicus
aagtgtatcgtgtgtgggtccctaa

SEQ ID NO: 53631 - DNA, 25 bp, Rattus norvegicus
aagtgtatctacagtggtttctgcc

SEQ ID NO: 53632 - DNA, 25 bp, Rattus norvegicus
aagtgtatctactgtggtttctgcc

SEQ ID NO: 53633 - DNA, 25 bp, Rattus norvegicus
aagtgtatctgtacctccttatctg

SEQ ID NO: 53634 - DNA, 25 bp, Rattus norvegicus
aagtgtatctgttcctccttatctg

SEQ ID NO: 53635 - DNA, 25 bp, Rattus norvegicus
aagtgtatctttatgcttctgttct

SEQ ID NO: 53636 - DNA, 25 bp, Rattus norvegicus
aagtgtatctttttgcttctgttct

SEQ ID NO: 53637 - DNA, 25 bp, Rattus norvegicus
aagtgtatgactagtcagatcccag

SEQ ID NO: 53638 - DNA, 25 bp, Rattus norvegicus
aagtgtatgacttgtcagatcccag

SEQ ID NO: 53639 - DNA, 25 bp, Rattus norvegicus
aagtgtatgcacattctgtgtattt

SEQ ID NO: 53640 - DNA, 25 bp, Rattus norvegicus
aagtgtatgcactttctgtgtattt

SEQ ID NO: 53641 - DNA, 25 bp, Rattus norvegicus
aagtgtatgcatagggtccatcccc

SEQ ID NO: 53642 - DNA, 25 bp, Rattus norvegicus
aagtgtatgcattgggtccatcccc

SEQ ID NO: 53643 - DNA, 25 bp, Rattus norvegicus
aagtgtatgcctaccagaaactaga

SEQ ID NO: 53644 - DNA, 25 bp, Rattus norvegicus
aagtgtatgccttccagaaactaga

SEQ ID NO: 53645 - DNA, 25 bp, Rattus norvegicus
aagtgtatgtgtagtactcctcggt

SEQ ID NO: 53646 - DNA, 25 bp, Rattus norvegicus
aagtgtatgtgttgtactcctcggt

SEQ ID NO: 53647 - DNA, 25 bp, Rattus norvegicus
aagtgtattagcaccttttatgcag

SEQ ID NO: 53648 - DNA, 25 bp, Rattus norvegicus
aagtgtattagctccttttatgcag

SEQ ID NO: 53649 - DNA, 25 bp, Rattus norvegicus
aagtgtattagtatccctcttctag

SEQ ID NO: 53650 - DNA, 25 bp, Rattus norvegicus
aagtgtattagtttccctcttctag

SEQ ID NO: 53651 - DNA, 25 bp, Rattus norvegicus
aagtgtattcatccctttacgcaac

SEQ ID NO: 53652 - DNA, 25 bp, Rattus norvegicus
aagtgtattcatgcctttacgcaac

SEQ ID NO: 53653 - DNA, 25 bp, Rattus norvegicus
aagtgtattccaccttttgacaata

SEQ ID NO: 53654 - DNA, 25 bp, Rattus norvegicus
aagtgtattccagcttttgacaata

SEQ ID NO: 53655 - DNA, 25 bp, Rattus norvegicus
aagtgtattcttagccaggcctggt

SEQ ID NO: 53656 - DNA, 25 bp, Rattus norvegicus
aagtgtattctttgccaggcctggt

SEQ ID NO: 53657 - DNA, 25 bp, Rattus norvegicus
aagtgtattgtaaccaattccttgg

SEQ ID NO: 53658 - DNA, 25 bp, Rattus norvegicus
aagtgtattgtatccaattccttgg

SEQ ID NO: 53659 - DNA, 25 bp, Rattus norvegicus
aagtgtatttaaatctccagtggac

SEQ ID NO: 53660 - DNA, 25 bp, Rattus norvegicus
aagtgtatttaattctccagtggac

SEQ ID NO: 53661 - DNA, 25 bp, Rattus norvegicus
aagtgtatttcacacttcctcctct

SEQ ID NO: 53662 - DNA, 25 bp, Rattus norvegicus
aagtgtatttcagacttcctcctct

SEQ ID NO: 53663 - DNA, 25 bp, Rattus norvegicus
aagtgtcaaatgatccgccaccggc

SEQ ID NO: 53664 - DNA, 25 bp, Rattus norvegicus
aagtgtcaaatgttccgccaccggc

SEQ ID NO: 53665 - DNA, 25 bp, Rattus norvegicus
aagtgtcacatactccattcatttg

SEQ ID NO: 53666 - DNA, 25 bp, Rattus norvegicus
aagtgtcacatagtccattcatttg

SEQ ID NO: 53667 - DNA, 25 bp, Rattus norvegicus
aagtgtcacatcctctgcatagaat

SEQ ID NO: 53668 - DNA, 25 bp, Rattus norvegicus
aagtgtcacatcgtctgcatagaat

SEQ ID NO: 53669 - DNA, 25 bp, Rattus norvegicus
aagtgtcaccatacttcaactcaga

SEQ ID NO: 53670 - DNA, 25 bp, Rattus norvegicus
aagtgtcaccattcttcaactcaga

SEQ ID NO: 53671 - DNA, 25 bp, Rattus norvegicus
aagtgtcacccgctacaaaccttct

SEQ ID NO: 53672 - DNA, 25 bp, Rattus norvegicus
aagtgtcacccggtacaaaccttct

SEQ ID NO: 53673 - DNA, 25 bp, Rattus norvegicus
aagtgtcacctgaccttgcgcctag

SEQ ID NO: 53674 - DNA, 25 bp, Rattus norvegicus
aagtgtcacctgtccttgcgcctag

SEQ ID NO: 53675 - DNA, 25 bp, Rattus norvegicus
aagtgtcaccttactctgggattat

SEQ ID NO: 53676 - DNA, 25 bp, Rattus norvegicus
aagtgtcacctttctctgggattat

SEQ ID NO: 53677 - DNA, 25 bp, Rattus norvegicus
aagtgtcactgaatgggtgggcttt

SEQ ID NO: 53678 - DNA, 25 bp, Rattus norvegicus
aagtgtcactgattgggtgggcttt

SEQ ID NO: 53679 - DNA, 25 bp, Rattus norvegicus
aagtgtcactggctgagtactcaat

SEQ ID NO: 53680 - DNA, 25 bp, Rattus norvegicus
aagtgtcactgggtgagtactcaat

SEQ ID NO: 53681 - DNA, 25 bp, Rattus norvegicus
aagtgtcagatgagcgacgccctga

SEQ ID NO: 53682 - DNA, 25 bp, Rattus norvegicus
aagtgtcagatgtgcgacgccctga

SEQ ID NO: 53683 - DNA, 25 bp, Rattus norvegicus
aagtgtcagcatatcagacgtgtgc

SEQ ID NO: 53684 - DNA, 25 bp, Rattus norvegicus
aagtgtcagcatttcagacgtgtgc

SEQ ID NO: 53685 - DNA, 25 bp, Rattus norvegicus
aagtgtcagcggcttagcgtgcata

SEQ ID NO: 53686 - DNA, 25 bp, Rattus norvegicus
aagtgtcagcgggttagcgtgcata

SEQ ID NO: 53687 - DNA, 25 bp, Rattus norvegicus
aagtgtcagctcctgcagcacagga

SEQ ID NO: 53688 - DNA, 25 bp, Rattus norvegicus
aagtgtcagctcgtgcagcacagga

SEQ ID NO: 53689 - DNA, 25 bp, Rattus norvegicus
aagtgtcaggcgagttgtcagtcct

SEQ ID NO: 53690 - DNA, 25 bp, Rattus norvegicus
aagtgtcaggcgtgttgtcagtcct

SEQ ID NO: 53691 - DNA, 25 bp, Rattus norvegicus
aagtgtcagtcaatcacctacgggt

SEQ ID NO: 53692 - DNA, 25 bp, Rattus norvegicus
aagtgtcagtcattcacctacgggt

SEQ ID NO: 53693 - DNA, 25 bp, Rattus norvegicus
aagtgtcagtgcacagactgggaaa

SEQ ID NO: 53694 - DNA, 25 bp, Rattus norvegicus
aagtgtcagtgctcagactgggaaa

SEQ ID NO: 53695 - DNA, 25 bp, Rattus norvegicus
aagtgtcatattcgtggccacaggg

SEQ ID NO: 53696 - DNA, 25 bp, Rattus norvegicus
aagtgtcatattggtggccacaggg

SEQ ID NO: 53697 - DNA, 25 bp, Rattus norvegicus
aagtgtcatcgaatcgcacctgatc

SEQ ID NO: 53698 - DNA, 25 bp, Rattus norvegicus
aagtgtcatcgattcgcacctgatc

SEQ ID NO: 53699 - DNA, 25 bp, Rattus norvegicus
aagtgtcatcttaccttgcagcctt

SEQ ID NO: 53700 - DNA, 25 bp, Rattus norvegicus
aagtgtcatctttccttgcagcctt

SEQ ID NO: 53701 - DNA, 25 bp, Rattus norvegicus
aagtgtccaaccactgtggtgcctt

SEQ ID NO: 53702 - DNA, 25 bp, Rattus norvegicus
aagtgtccaacctctgtggtgcctt

SEQ ID NO: 53703 - DNA, 25 bp, Rattus norvegicus
aagtgtccaaggcttgtaacagata

SEQ ID NO: 53704 - DNA, 25 bp, Rattus norvegicus
aagtgtccaagggttgtaacagata

SEQ ID NO: 53705 - DNA, 25 bp, Rattus norvegicus
aagtgtccaccaagaggtccctggg

SEQ ID NO: 53706 - DNA, 25 bp, Rattus norvegicus
aagtgtccaccatgaggtccctggg

SEQ ID NO: 53707 - DNA, 25 bp, Rattus norvegicus
aagtgtccactgacccattgaatgc

SEQ ID NO: 53708 - DNA, 25 bp, Rattus norvegicus
aagtgtccactgtcccattgaatgc

SEQ ID NO: 53709 - DNA, 25 bp, Rattus norvegicus
aagtgtccagatactcagatgtttg

SEQ ID NO: 53710 - DNA, 25 bp, Rattus norvegicus
aagtgtccagattctcagatgtttg

SEQ ID NO: 53711 - DNA, 25 bp, Rattus norvegicus
aagtgtccatgaccttcggagcagc

SEQ ID NO: 53712 - DNA, 25 bp, Rattus norvegicus
aagtgtccatgactttctgggccag

SEQ ID NO: 53713 - DNA, 25 bp, Rattus norvegicus
aagtgtccatgagcttcggagcagc

SEQ ID NO: 53714 - DNA, 25 bp, Rattus norvegicus
aagtgtccatgagtttctgggccag

SEQ ID NO: 53715 - DNA, 25 bp, Rattus norvegicus
aagtgtccattgcagtggagcccat

SEQ ID NO: 53716 - DNA, 25 bp, Rattus norvegicus
aagtgtccattggagtggagcccat

SEQ ID NO: 53717 - DNA, 25 bp, Rattus norvegicus
aagtgtcccactaaacggctgaaca

SEQ ID NO: 53718 - DNA, 25 bp, Rattus norvegicus
aagtgtcccacttaacggctgaaca

SEQ ID NO: 53719 - DNA, 25 bp, Rattus norvegicus
aagtgtcccaggacatttctgtcag

SEQ ID NO: 53720 - DNA, 25 bp, Rattus norvegicus
aagtgtcccaggtcatttctgtcag

SEQ ID NO: 53721 - DNA, 25 bp, Rattus norvegicus
aagtgtcccatcagacgggcattct

SEQ ID NO: 53722 - DNA, 25 bp, Rattus norvegicus
aagtgtcccatctgacgggcattct

SEQ ID NO: 53723 - DNA, 25 bp, Rattus norvegicus
aagtgtccctaaaggatgtcacatg

SEQ ID NO: 53724 - DNA, 25 bp, Rattus norvegicus
aagtgtccctaatggatgtcacatg

SEQ ID NO: 53725 - DNA, 25 bp, Rattus norvegicus
aagtgtccctacaggacccaccatt

SEQ ID NO: 53726 - DNA, 25 bp, Rattus norvegicus
aagtgtccctactggacccaccatt

SEQ ID NO: 53727 - DNA, 25 bp, Rattus norvegicus
aagtgtccctctccactgggtggca

SEQ ID NO: 53728 - DNA, 25 bp, Rattus norvegicus
aagtgtccctctgcactgggtggca

SEQ ID NO: 53729 - DNA, 25 bp, Rattus norvegicus
aagtgtccgggcagtattaccccat

SEQ ID NO: 53730 - DNA, 25 bp, Rattus norvegicus
aagtgtccgggctgtattaccccat

SEQ ID NO: 53731 - DNA, 25 bp, Rattus norvegicus
aagtgtccgtgcaagtggctttcgc

SEQ ID NO: 53732 - DNA, 25 bp, Rattus norvegicus
aagtgtccgtgctagtggctttcgc

SEQ ID NO: 53733 - DNA, 25 bp, Rattus norvegicus
aagtgtcctcacatgttgagccgtt

SEQ ID NO: 53734 - DNA, 25 bp, Rattus norvegicus
aagtgtcctcacttgttgagccgtt

SEQ ID NO: 53735 - DNA, 25 bp, Rattus norvegicus
aagtgtcctcagagctactctggag

SEQ ID NO: 53736 - DNA, 25 bp, Rattus norvegicus
aagtgtcctcagtgctactctggag

SEQ ID NO: 53737 - DNA, 25 bp, Rattus norvegicus
aagtgtcctcatctggagtcttcac

SEQ ID NO: 53738 - DNA, 25 bp, Rattus norvegicus
aagtgtcctcatgtggagtcttcac

SEQ ID NO: 53739 - DNA, 25 bp, Rattus norvegicus
aagtgtcctctgagccttgtgtgat

SEQ ID NO: 53740 - DNA, 25 bp, Rattus norvegicus
aagtgtcctctgtgccttgtgtgat

SEQ ID NO: 53741 - DNA, 25 bp, Rattus norvegicus
aagtgtcctcttctagacgtagctg

SEQ ID NO: 53742 - DNA, 25 bp, Rattus norvegicus
aagtgtcctcttgtagacgtagctg

SEQ ID NO: 53743 - DNA, 25 bp, Rattus norvegicus
aagtgtcctggcaatgtcatggtgc

SEQ ID NO: 53744 - DNA, 25 bp, Rattus norvegicus
aagtgtcctggctatgtcatggtgc

SEQ ID NO: 53745 - DNA, 25 bp, Rattus norvegicus
aagtgtcctttgagctccggtacaa

SEQ ID NO: 53746 - DNA, 25 bp, Rattus norvegicus
aagtgtcctttgtgctccggtacaa

SEQ ID NO: 53747 - DNA, 25 bp, Rattus norvegicus
aagtgtcggacaaccgctgcctctg

SEQ ID NO: 53748 - DNA, 25 bp, Rattus norvegicus
aagtgtcggacatccgctgcctctg

SEQ ID NO: 53749 - DNA, 25 bp, Rattus norvegicus
aagtgtcggagcacatctcctggga

SEQ ID NO: 53750 - DNA, 25 bp, Rattus norvegicus
aagtgtcggagctcatctcctggga

SEQ ID NO: 53751 - DNA, 25 bp, Rattus norvegicus
aagtgtcggcgtacttggcaagcac

SEQ ID NO: 53752 - DNA, 25 bp, Rattus norvegicus
aagtgtcggcgttcttggcaagcac

SEQ ID NO: 53753 - DNA, 25 bp, Rattus norvegicus
aagtgtcgggctctgaagcagcatc

SEQ ID NO: 53754 - DNA, 25 bp, Rattus norvegicus
aagtgtcgggctgtgaagcagcatc

SEQ ID NO: 53755 - DNA, 25 bp, Rattus norvegicus
aagtgtcgtgggacaaggccaacct

SEQ ID NO: 53756 - DNA, 25 bp, Rattus norvegicus
aagtgtcgtgggtcaaggccaacct

SEQ ID NO: 53757 - DNA, 25 bp, Rattus norvegicus
aagtgtctaagcaggctcgagctca

SEQ ID NO: 53758 - DNA, 25 bp, Rattus norvegicus
aagtgtctaagctggctcgagctca

SEQ ID NO: 53759 - DNA, 25 bp, Rattus norvegicus
aagtgtctaataattgtcccataaa

SEQ ID NO: 53760 - DNA, 25 bp, Rattus norvegicus
aagtgtctaatatttgtcccataaa

SEQ ID NO: 53761 - DNA, 25 bp, Rattus norvegicus
aagtgtctcagcacctactgtttag

SEQ ID NO: 53762 - DNA, 25 bp, Rattus norvegicus
aagtgtctcagctcctactgtttag

SEQ ID NO: 53763 - DNA, 25 bp, Rattus norvegicus
aagtgtctcatcactcggatcatct

SEQ ID NO: 53764 - DNA, 25 bp, Rattus norvegicus
aagtgtctcatctctcggatcatct

SEQ ID NO: 53765 - DNA, 25 bp, Rattus norvegicus
aagtgtctccacagaggactgaaca

SEQ ID NO: 53766 - DNA, 25 bp, Rattus norvegicus
aagtgtctccactgaggactgaaca

SEQ ID NO: 53767 - DNA, 25 bp, Rattus norvegicus
aagtgtctccatagcttatgtttgt

SEQ ID NO: 53768 - DNA, 25 bp, Rattus norvegicus
aagtgtctccattgcttatgtttgt

SEQ ID NO: 53769 - DNA, 25 bp, Rattus norvegicus
aagtgtctccccctaagaaggcagt

SEQ ID NO: 53770 - DNA, 25 bp, Rattus norvegicus
aagtgtctccccgtaagaaggcagt

SEQ ID NO: 53771 - DNA, 25 bp, Rattus norvegicus
aagtgtctcctaagtgggtggcaac

SEQ ID NO: 53772 - DNA, 25 bp, Rattus norvegicus
aagtgtctcctatgtgggtggcaac

SEQ ID NO: 53773 - DNA, 25 bp, Rattus norvegicus
aagtgtctcctgaacctgttttata

SEQ ID NO: 53774 - DNA, 25 bp, Rattus norvegicus
aagtgtctcctgtacctgttttata

SEQ ID NO: 53775 - DNA, 25 bp, Rattus norvegicus
aagtgtctcgttattgttcatctct

SEQ ID NO: 53776 - DNA, 25 bp, Rattus norvegicus
aagtgtctcgtttttgttcatctct

SEQ ID NO: 53777 - DNA, 25 bp, Rattus norvegicus
aagtgtctctcaactcgggcagcaa

SEQ ID NO: 53778 - DNA, 25 bp, Rattus norvegicus
aagtgtctctcacatgtttctactc

SEQ ID NO: 53779 - DNA, 25 bp, Rattus norvegicus
aagtgtctctcagatgtttctactc

SEQ ID NO: 53780 - DNA, 25 bp, Rattus norvegicus
aagtgtctctcatctcgggcagcaa

SEQ ID NO: 53781 - DNA, 25 bp, Rattus norvegicus
aagtgtctgaacatcccaagccttg

SEQ ID NO: 53782 - DNA, 25 bp, Rattus norvegicus
aagtgtctgaacttcccaagccttg

SEQ ID NO: 53783 - DNA, 25 bp, Rattus norvegicus
aagtgtctgccaacttccgctgaaa

SEQ ID NO: 53784 - DNA, 25 bp, Rattus norvegicus
aagtgtctgccatcttccgctgaaa

SEQ ID NO: 53785 - DNA, 25 bp, Rattus norvegicus
aagtgtctgcttccttgggacaaga

SEQ ID NO: 53786 - DNA, 25 bp, Rattus norvegicus
aagtgtctgcttgcttgggacaaga

SEQ ID NO: 53787 - DNA, 25 bp, Rattus norvegicus
aagtgtctggacatgtttctgacta

SEQ ID NO: 53788 - DNA, 25 bp, Rattus norvegicus
aagtgtctggacttgtttctgacta

SEQ ID NO: 53789 - DNA, 25 bp, Rattus norvegicus
aagtgtctggagatgtccggttcca

SEQ ID NO: 53790 - DNA, 25 bp, Rattus norvegicus
aagtgtctggagttgtccggttcca

SEQ ID NO: 53791 - DNA, 25 bp, Rattus norvegicus
aagtgtctggcacttggtgctccca

SEQ ID NO: 53792 - DNA, 25 bp, Rattus norvegicus
aagtgtctggcagttggtgctccca

SEQ ID NO: 53793 - DNA, 25 bp, Rattus norvegicus
aagtgtctgggaaccatgtactcct

SEQ ID NO: 53794 - DNA, 25 bp, Rattus norvegicus
aagtgtctgggatccatgtactcct

SEQ ID NO: 53795 - DNA, 25 bp, Rattus norvegicus
aagtgtctggtgacagctgaggatc

SEQ ID NO: 53796 - DNA, 25 bp, Rattus norvegicus
aagtgtctggtgtcagctgaggatc

SEQ ID NO: 53797 - DNA, 25 bp, Rattus norvegicus
aagtgtctgtcactggaacctgctt

SEQ ID NO: 53798 - DNA, 25 bp, Rattus norvegicus
aagtgtctgtcagtggaacctgctt

SEQ ID NO: 53799 - DNA, 25 bp, Rattus norvegicus
aagtgtctgtgaactcactgacctg

SEQ ID NO: 53800 - DNA, 25 bp, Rattus norvegicus
aagtgtctgtgatctcactgacctg

SEQ ID NO: 53801 - DNA, 25 bp, Rattus norvegicus
aagtgtctgtggctatatgttatca

SEQ ID NO: 53802 - DNA, 25 bp, Rattus norvegicus
aagtgtctgtgggtatatgttatca

SEQ ID NO: 53803 - DNA, 25 bp, Rattus norvegicus
aagtgtcttaaaagactgtggacct

SEQ ID NO: 53804 - DNA, 25 bp, Rattus norvegicus
aagtgtcttaaatgactgtggacct

SEQ ID NO: 53805 - DNA, 25 bp, Rattus norvegicus
aagtgtcttcaccagtctccttgga

SEQ ID NO: 53806 - DNA, 25 bp, Rattus norvegicus
aagtgtcttcacgagtctccttgga

SEQ ID NO: 53807 - DNA, 25 bp, Rattus norvegicus
aagtgtcttcagcatcctgttcaac

SEQ ID NO: 53808 - DNA, 25 bp, Rattus norvegicus
aagtgtcttcaggatcctgttcaac

SEQ ID NO: 53809 - DNA, 25 bp, Rattus norvegicus
aagtgtcttccacatcctgtatcta

SEQ ID NO: 53810 - DNA, 25 bp, Rattus norvegicus
aagtgtcttccacttgttgaccaag

SEQ ID NO: 53811 - DNA, 25 bp, Rattus norvegicus
aagtgtcttccagatcctgtatcta

SEQ ID NO: 53812 - DNA, 25 bp, Rattus norvegicus
aagtgtcttccagttgttgaccaag

SEQ ID NO: 53813 - DNA, 25 bp, Rattus norvegicus
aagtgtcttcccctggccttgggcg

SEQ ID NO: 53814 - DNA, 25 bp, Rattus norvegicus
aagtgtcttcccgtggccttgggcg

SEQ ID NO: 53815 - DNA, 25 bp, Rattus norvegicus
aagtgtcttccgcaagactcttcgt

SEQ ID NO: 53816 - DNA, 25 bp, Rattus norvegicus
aagtgtcttccggaagactcttcgt

SEQ ID NO: 53817 - DNA, 25 bp, Rattus norvegicus
aagtgtcttcgcatcagcccttgcg

SEQ ID NO: 53818 - DNA, 25 bp, Rattus norvegicus
aagtgtcttcgcttcagcccttgcg

SEQ ID NO: 53819 - DNA, 25 bp, Rattus norvegicus
aagtgtcttctacgtgggcactgac

SEQ ID NO: 53820 - DNA, 25 bp, Rattus norvegicus
aagtgtcttctaggtgggcactgac

SEQ ID NO: 53821 - DNA, 25 bp, Rattus norvegicus
aagtgtcttgttcagcttgcctttt

SEQ ID NO: 53822 - DNA, 25 bp, Rattus norvegicus
aagtgtcttgttgagcttgcctttt

SEQ ID NO: 53823 - DNA, 25 bp, Rattus norvegicus
aagtgtctttctagtttcaggaggg

SEQ ID NO: 53824 - DNA, 25 bp, Rattus norvegicus
aagtgtctttcttgtttcaggaggg

SEQ ID NO: 53825 - DNA, 25 bp, Rattus norvegicus
aagtgtcttttaagctcctttgtac

SEQ ID NO: 53826 - DNA, 25 bp, Rattus norvegicus
aagtgtcttttatgctcctttgtac

SEQ ID NO: 53827 - DNA, 25 bp, Rattus norvegicus
aagtgtgaacagctcaccttcaggg

SEQ ID NO: 53828 - DNA, 25 bp, Rattus norvegicus
aagtgtgaacaggtcaccttcaggg

SEQ ID NO: 53829 - DNA, 25 bp, Rattus norvegicus
aagtgtgaactgcaccctgttgcta

SEQ ID NO: 53830 - DNA, 25 bp, Rattus norvegicus
aagtgtgaactggaccctgttgcta

SEQ ID NO: 53831 - DNA, 25 bp, Rattus norvegicus
aagtgtgacatccatatccgcaaag

SEQ ID NO: 53832 - DNA, 25 bp, Rattus norvegicus
aagtgtgacatcgatatccgcaaag

SEQ ID NO: 53833 - DNA, 25 bp, Rattus norvegicus
aagtgtgaccacagagcaaggctcc

SEQ ID NO: 53834 - DNA, 25 bp, Rattus norvegicus
aagtgtgaccactgagcaaggctcc

SEQ ID NO: 53835 - DNA, 25 bp, Rattus norvegicus
aagtgtgaccgaatgacctgagaat

SEQ ID NO: 53836 - DNA, 25 bp, Rattus norvegicus
aagtgtgaccgattgacctgagaat

SEQ ID NO: 53837 - DNA, 25 bp, Rattus norvegicus
aagtgtgaccttaaacctctcattc

SEQ ID NO: 53838 - DNA, 25 bp, Rattus norvegicus
aagtgtgaccttcattgttcacacc

SEQ ID NO: 53839 - DNA, 25 bp, Rattus norvegicus
aagtgtgaccttgattgttcacacc

SEQ ID NO: 53840 - DNA, 25 bp, Rattus norvegicus
aagtgtgacctttaacctctcattc

SEQ ID NO: 53841 - DNA, 25 bp, Rattus norvegicus
aagtgtgacgcgcaagccagcatct

SEQ ID NO: 53842 - DNA, 25 bp, Rattus norvegicus
aagtgtgacgcggaagccagcatct

SEQ ID NO: 53843 - DNA, 25 bp, Rattus norvegicus
aagtgtgactgtcttgtagctacct

SEQ ID NO: 53844 - DNA, 25 bp, Rattus norvegicus
aagtgtgactgtgttgtagctacct

SEQ ID NO: 53845 - DNA, 25 bp, Rattus norvegicus
aagtgtgagaatagcctcctgcgct

SEQ ID NO: 53846 - DNA, 25 bp, Rattus norvegicus
aagtgtgagaattgcctcctgcgct

SEQ ID NO: 53847 - DNA, 25 bp, Rattus norvegicus
aagtgtgagagactccaagctcctg

SEQ ID NO: 53848 - DNA, 25 bp, Rattus norvegicus
aagtgtgagagagtccaagctcctg

SEQ ID NO: 53849 - DNA, 25 bp, Rattus norvegicus
aagtgtgagcacaggcgtattcaga

SEQ ID NO: 53850 - DNA, 25 bp, Rattus norvegicus
aagtgtgagcaccaaccagtggtcc

SEQ ID NO: 53851 - DNA, 25 bp, Rattus norvegicus
aagtgtgagcacgaaccagtggtcc

SEQ ID NO: 53852 - DNA, 25 bp, Rattus norvegicus
aagtgtgagcactggcgtattcaga

SEQ ID NO: 53853 - DNA, 25 bp, Rattus norvegicus
aagtgtgagcatacccaggcacagt

SEQ ID NO: 53854 - DNA, 25 bp, Rattus norvegicus
aagtgtgagcattcccaggcacagt

SEQ ID NO: 53855 - DNA, 25 bp, Rattus norvegicus
aagtgtgagctccacttgtttcgaa

SEQ ID NO: 53856 - DNA, 25 bp, Rattus norvegicus
aagtgtgagctcgacttgtttcgaa

SEQ ID NO: 53857 - DNA, 25 bp, Rattus norvegicus
aagtgtgaggccaggatcttgctag

SEQ ID NO: 53858 - DNA, 25 bp, Rattus norvegicus
aagtgtgaggcctggatcttgctag

SEQ ID NO: 53859 - DNA, 25 bp, Rattus norvegicus
aagtgtgatcatatcctaggttcct

SEQ ID NO: 53860 - DNA, 25 bp, Rattus norvegicus
aagtgtgatcatttcctaggttcct

SEQ ID NO: 53861 - DNA, 25 bp, Rattus norvegicus
aagtgtgatctgaactctccagctg

SEQ ID NO: 53862 - DNA, 25 bp, Rattus norvegicus
aagtgtgatctgtactctccagctg

SEQ ID NO: 53863 - DNA, 25 bp, Rattus norvegicus
aagtgtgatcttctacaggtaatgc

SEQ ID NO: 53864 - DNA, 25 bp, Rattus norvegicus
aagtgtgatcttgtacaggtaatgc

SEQ ID NO: 53865 - DNA, 25 bp, Rattus norvegicus
aagtgtgatgccagcggcaagagtt

SEQ ID NO: 53866 - DNA, 25 bp, Rattus norvegicus
aagtgtgatgcctgcggcaagagtt

SEQ ID NO: 53867 - DNA, 25 bp, Rattus norvegicus
aagtgtgatgtcagcaccgtgtgct

SEQ ID NO: 53868 - DNA, 25 bp, Rattus norvegicus
aagtgtgatgtctgcaccgtgtgct

SEQ ID NO: 53869 - DNA, 25 bp, Rattus norvegicus
aagtgtgcaaggctgctcagtcgcc

SEQ ID NO: 53870 - DNA, 25 bp, Rattus norvegicus
aagtgtgcaagggtgctcagtcgcc

SEQ ID NO: 53871 - DNA, 25 bp, Rattus norvegicus
aagtgtgcaagtcctgtgactccca

SEQ ID NO: 53872 - DNA, 25 bp, Rattus norvegicus
aagtgtgcaagtgctgtgactccca

SEQ ID NO: 53873 - DNA, 25 bp, Rattus norvegicus
aagtgtgcacaccagacagcctggc

SEQ ID NO: 53874 - DNA, 25 bp, Rattus norvegicus
aagtgtgcacacgagacagcctggc

SEQ ID NO: 53875 - DNA, 25 bp, Rattus norvegicus
aagtgtgcacatacattctttagaa

SEQ ID NO: 53876 - DNA, 25 bp, Rattus norvegicus
aagtgtgcacatctgttcgactctc

SEQ ID NO: 53877 - DNA, 25 bp, Rattus norvegicus
aagtgtgcacatgtgttcgactctc

SEQ ID NO: 53878 - DNA, 25 bp, Rattus norvegicus
aagtgtgcacattcattctttagaa

SEQ ID NO: 53879 - DNA, 25 bp, Rattus norvegicus
aagtgtgcactaactcgagcttacc

SEQ ID NO: 53880 - DNA, 25 bp, Rattus norvegicus
aagtgtgcactatctcgagcttacc

SEQ ID NO: 53881 - DNA, 25 bp, Rattus norvegicus
aagtgtgcatcgctgagtcctaagt

SEQ ID NO: 53882 - DNA, 25 bp, Rattus norvegicus
aagtgtgcatcggtgagtcctaagt

SEQ ID NO: 53883 - DNA, 25 bp, Rattus norvegicus
aagtgtgccactccaggcaaagcat

SEQ ID NO: 53884 - DNA, 25 bp, Rattus norvegicus
aagtgtgccactgcaggcaaagcat

SEQ ID NO: 53885 - DNA, 25 bp, Rattus norvegicus
aagtgtgccagcaactgggtcacag

SEQ ID NO: 53886 - DNA, 25 bp, Rattus norvegicus
aagtgtgccagctactgggtcacag

SEQ ID NO: 53887 - DNA, 25 bp, Rattus norvegicus
aagtgtgccagtacatgaactatgc

SEQ ID NO: 53888 - DNA, 25 bp, Rattus norvegicus
aagtgtgccagttcatgaactatgc

SEQ ID NO: 53889 - DNA, 25 bp, Rattus norvegicus
aagtgtgcccacctgcatgtgaagg

SEQ ID NO: 53890 - DNA, 25 bp, Rattus norvegicus
aagtgtgcccacgtgcatgtgaagg

SEQ ID NO: 53891 - DNA, 25 bp, Rattus norvegicus
aagtgtgccctaacctgatcaccat

SEQ ID NO: 53892 - DNA, 25 bp, Rattus norvegicus
aagtgtgccctatcctgatcaccat

SEQ ID NO: 53893 - DNA, 25 bp, Rattus norvegicus
aagtgtgcccttaaggtgagcctgc

SEQ ID NO: 53894 - DNA, 25 bp, Rattus norvegicus
aagtgtgcccttactttgtaatgtc

SEQ ID NO: 53895 - DNA, 25 bp, Rattus norvegicus
aagtgtgccctttaggtgagcctgc

SEQ ID NO: 53896 - DNA, 25 bp, Rattus norvegicus
aagtgtgccctttctttgtaatgtc

SEQ ID NO: 53897 - DNA, 25 bp, Rattus norvegicus
aagtgtgccggccatgtctatctgc

SEQ ID NO: 53898 - DNA, 25 bp, Rattus norvegicus
aagtgtgccggcgatgtctatctgc

SEQ ID NO: 53899 - DNA, 25 bp, Rattus norvegicus
aagtgtgcctataccttttagccct

SEQ ID NO: 53900 - DNA, 25 bp, Rattus norvegicus
aagtgtgcctattccttttagccct

SEQ ID NO: 53901 - DNA, 25 bp, Rattus norvegicus
aagtgtgcctggaacctgcagagat

SEQ ID NO: 53902 - DNA, 25 bp, Rattus norvegicus
aagtgtgcctggtacctgcagagat

SEQ ID NO: 53903 - DNA, 25 bp, Rattus norvegicus
aagtgtgcgcagaggctgcttgcaa

SEQ ID NO: 53904 - DNA, 25 bp, Rattus norvegicus
aagtgtgcgcagtggctgcttgcaa

SEQ ID NO: 53905 - DNA, 25 bp, Rattus norvegicus
aagtgtgctatgagggccagccagt

SEQ ID NO: 53906 - DNA, 25 bp, Rattus norvegicus
aagtgtgctatgtgggccagccagt

SEQ ID NO: 53907 - DNA, 25 bp, Rattus norvegicus
aagtgtgctcatccctttaaaaatg

SEQ ID NO: 53908 - DNA, 25 bp, Rattus norvegicus
aagtgtgctcatgcctttaaaaatg

SEQ ID NO: 53909 - DNA, 25 bp, Rattus norvegicus
aagtgtgctctacactgtgtgcgcc

SEQ ID NO: 53910 - DNA, 25 bp, Rattus norvegicus
aagtgtgctctagactgtgtgcgcc

SEQ ID NO: 53911 - DNA, 25 bp, Rattus norvegicus
aagtgtgctggtcacatgtcgagca

SEQ ID NO: 53912 - DNA, 25 bp, Rattus norvegicus
aagtgtgctggtgacatgtcgagca

SEQ ID NO: 53913 - DNA, 25 bp, Rattus norvegicus
aagtgtgctgtcatggtactagcgt

SEQ ID NO: 53914 - DNA, 25 bp, Rattus norvegicus
aagtgtgctgtcttggtactagcgt

SEQ ID NO: 53915 - DNA, 25 bp, Rattus norvegicus
aagtgtgcttaaccctgtgtttatc

SEQ ID NO: 53916 - DNA, 25 bp, Rattus norvegicus
aagtgtgcttaagcctgtgtttatc

SEQ ID NO: 53917 - DNA, 25 bp, Rattus norvegicus
aagtgtgctttcagcatgagccctt

SEQ ID NO: 53918 - DNA, 25 bp, Rattus norvegicus
aagtgtgctttctgcatgagccctt

SEQ ID NO: 53919 - DNA, 25 bp, Rattus norvegicus
aagtgtggaaagaccctgcggttct

SEQ ID NO: 53920 - DNA, 25 bp, Rattus norvegicus
aagtgtggaaagtccctgcggttct

SEQ ID NO: 53921 - DNA, 25 bp, Rattus norvegicus
aagtgtggaatcatttcctcaagaa

SEQ ID NO: 53922 - DNA, 25 bp, Rattus norvegicus
aagtgtggaatcttttcctcaagaa

SEQ ID NO: 53923 - DNA, 25 bp, Rattus norvegicus
aagtgtggacaacggcagtctcccc

SEQ ID NO: 53924 - DNA, 25 bp, Rattus norvegicus
aagtgtggacaagggcagtctcccc

SEQ ID NO: 53925 - DNA, 25 bp, Rattus norvegicus
aagtgtggagccagaagtctgtttt

SEQ ID NO: 53926 - DNA, 25 bp, Rattus norvegicus
aagtgtggagcctgaagtctgtttt

SEQ ID NO: 53927 - DNA, 25 bp, Rattus norvegicus
aagtgtggcagcagagcacagcctt

SEQ ID NO: 53928 - DNA, 25 bp, Rattus norvegicus
aagtgtggcagcagagtgttcccga

SEQ ID NO: 53929 - DNA, 25 bp, Rattus norvegicus
aagtgtggcagctgagcacagcctt

SEQ ID NO: 53930 - DNA, 25 bp, Rattus norvegicus
aagtgtggcagctgagtgttcccga

SEQ ID NO: 53931 - DNA, 25 bp, Rattus norvegicus
aagtgtggccccagctcataatttt

SEQ ID NO: 53932 - DNA, 25 bp, Rattus norvegicus
aagtgtggcccctgctcataatttt

SEQ ID NO: 53933 - DNA, 25 bp, Rattus norvegicus
aagtgtggcggcaatctgttcaccc

SEQ ID NO: 53934 - DNA, 25 bp, Rattus norvegicus
aagtgtggcggctatctgttcaccc

SEQ ID NO: 53935 - DNA, 25 bp, Rattus norvegicus
aagtgtggctacatctacctggagt

SEQ ID NO: 53936 - DNA, 25 bp, Rattus norvegicus
aagtgtggctacttctacctggagt

SEQ ID NO: 53937 - DNA, 25 bp, Rattus norvegicus
aagtgtggcttaaattgggcatccc

SEQ ID NO: 53938 - DNA, 25 bp, Rattus norvegicus
aagtgtggcttatattgggcatccc

SEQ ID NO: 53939 - DNA, 25 bp, Rattus norvegicus
aagtgtgggacaatgctcttgcgca

SEQ ID NO: 53940 - DNA, 25 bp, Rattus norvegicus
aagtgtgggacattgctcttgcgca

SEQ ID NO: 53941 - DNA, 25 bp, Rattus norvegicus
aagtgtgggatcaccattctctttg

SEQ ID NO: 53942 - DNA, 25 bp, Rattus norvegicus
aagtgtgggatctccattctctttg

SEQ ID NO: 53943 - DNA, 25 bp, Rattus norvegicus
aagtgtgggttcactctagcctaat

SEQ ID NO: 53944 - DNA, 25 bp, Rattus norvegicus
aagtgtgggttctctctagcctaat

SEQ ID NO: 53945 - DNA, 25 bp, Rattus norvegicus
aagtgtggtcatctcatgttagccc

SEQ ID NO: 53946 - DNA, 25 bp, Rattus norvegicus
aagtgtggtcatgtcatgttagccc

SEQ ID NO: 53947 - DNA, 25 bp, Rattus norvegicus
aagtgtgtacccatgatccagggat

SEQ ID NO: 53948 - DNA, 25 bp, Rattus norvegicus
aagtgtgtacccttgatccagggat

SEQ ID NO: 53949 - DNA, 25 bp, Rattus norvegicus
aagtgtgtacgtagccagtttcaat

SEQ ID NO: 53950 - DNA, 25 bp, Rattus norvegicus
aagtgtgtacgttgccagtttcaat

SEQ ID NO: 53951 - DNA, 25 bp, Rattus norvegicus
aagtgtgtagatactgtgagtctta

SEQ ID NO: 53952 - DNA, 25 bp, Rattus norvegicus
aagtgtgtagattctgtgagtctta

SEQ ID NO: 53953 - DNA, 25 bp, Rattus norvegicus
aagtgtgtcaggctgcagctcatta

SEQ ID NO: 53954 - DNA, 25 bp, Rattus norvegicus
aagtgtgtcagggtgcagctcatta

SEQ ID NO: 53955 - DNA, 25 bp, Rattus norvegicus
aagtgtgtccacaggtcttaaacct

SEQ ID NO: 53956 - DNA, 25 bp, Rattus norvegicus
aagtgtgtccactggtcttaaacct

SEQ ID NO: 53957 - DNA, 25 bp, Rattus norvegicus
aagtgtgtccgcctcgcggttcctc

SEQ ID NO: 53958 - DNA, 25 bp, Rattus norvegicus
aagtgtgtccgcgtcgcggttcctc

SEQ ID NO: 53959 - DNA, 25 bp, Rattus norvegicus
aagtgtgtccggcttcaacctcagg

SEQ ID NO: 53960 - DNA, 25 bp, Rattus norvegicus
aagtgtgtccgggttcaacctcagg

SEQ ID NO: 53961 - DNA, 25 bp, Rattus norvegicus
aagtgtgtccttagtctcctggttc

SEQ ID NO: 53962 - DNA, 25 bp, Rattus norvegicus
aagtgtgtccttattcaggccttaa

SEQ ID NO: 53963 - DNA, 25 bp, Rattus norvegicus
aagtgtgtcctttgtctcctggttc

SEQ ID NO: 53964 - DNA, 25 bp, Rattus norvegicus
aagtgtgtcctttttcaggccttaa

SEQ ID NO: 53965 - DNA, 25 bp, Rattus norvegicus
aagtgtgtctcacaggcatctttgt

SEQ ID NO: 53966 - DNA, 25 bp, Rattus norvegicus
aagtgtgtctcagaggcatctttgt

SEQ ID NO: 53967 - DNA, 25 bp, Rattus norvegicus
aagtgtgtctccaaaggctacgtct

SEQ ID NO: 53968 - DNA, 25 bp, Rattus norvegicus
aagtgtgtctcctaaggctacgtct

SEQ ID NO: 53969 - DNA, 25 bp, Rattus norvegicus
aagtgtgtctgtctatcctatgcta

SEQ ID NO: 53970 - DNA, 25 bp, Rattus norvegicus
aagtgtgtctgtgtatcctatgcta

SEQ ID NO: 53971 - DNA, 25 bp, Rattus norvegicus
aagtgtgtctttacatggtgtgtca

SEQ ID NO: 53972 - DNA, 25 bp, Rattus norvegicus
aagtgtgtcttttcatggtgtgtca

SEQ ID NO: 53973 - DNA, 25 bp, Rattus norvegicus
aagtgtgtgaggcttctccagcaaa

SEQ ID NO: 53974 - DNA, 25 bp, Rattus norvegicus
aagtgtgtgagggttctccagcaaa

SEQ ID NO: 53975 - DNA, 25 bp, Rattus norvegicus
aagtgtgtgatcagcgttattgaac

SEQ ID NO: 53976 - DNA, 25 bp, Rattus norvegicus
aagtgtgtgatctgcgttattgaac

SEQ ID NO: 53977 - DNA, 25 bp, Rattus norvegicus
aagtgtgtgccgagtactagttgcc

SEQ ID NO: 53978 - DNA, 25 bp, Rattus norvegicus
aagtgtgtgccgtgtactagttgcc

SEQ ID NO: 53979 - DNA, 25 bp, Rattus norvegicus
aagtgtgtgcttaaactgcttccaa

SEQ ID NO: 53980 - DNA, 25 bp, Rattus norvegicus
aagtgtgtgctttaactgcttccaa

SEQ ID NO: 53981 - DNA, 25 bp, Rattus norvegicus
aagtgtgtggccacatgcctttaat

SEQ ID NO: 53982 - DNA, 25 bp, Rattus norvegicus
aagtgtgtggcctcatgcctttaat

SEQ ID NO: 53983 - DNA, 25 bp, Rattus norvegicus
aagtgtgtgtatagccataacccca

SEQ ID NO: 53984 - DNA, 25 bp, Rattus norvegicus
aagtgtgtgtattgccataacccca

SEQ ID NO: 53985 - DNA, 25 bp, Rattus norvegicus
aagtgtgtgtgtcaggccagacaat

SEQ ID NO: 53986 - DNA, 25 bp, Rattus norvegicus
aagtgtgtgtgtgaggccagacaat

SEQ ID NO: 53987 - DNA, 25 bp, Rattus norvegicus
aagtgtgttaatagctatctagtac

SEQ ID NO: 53988 - DNA, 25 bp, Rattus norvegicus
aagtgtgttaatctctatcctgtta

SEQ ID NO: 53989 - DNA, 25 bp, Rattus norvegicus
aagtgtgttaatgtctatcctgtta

SEQ ID NO: 53990 - DNA, 25 bp, Rattus norvegicus
aagtgtgttaattgctatctagtac

SEQ ID NO: 53991 - DNA, 25 bp, Rattus norvegicus
aagtgtgttagtagtctggccgtgt

SEQ ID NO: 53992 - DNA, 25 bp, Rattus norvegicus
aagtgtgttagttgtctggccgtgt

SEQ ID NO: 53993 - DNA, 25 bp, Rattus norvegicus
aagtgtgttcccataatgagcacct

SEQ ID NO: 53994 - DNA, 25 bp, Rattus norvegicus
aagtgtgttcccttaatgagcacct

SEQ ID NO: 53995 - DNA, 25 bp, Rattus norvegicus
aagtgtgttctgcaccatggtacta

SEQ ID NO: 53996 - DNA, 25 bp, Rattus norvegicus
aagtgtgttctggaccatggtacta

SEQ ID NO: 53997 - DNA, 25 bp, Rattus norvegicus
aagtgtgtttacctgctttcatgta

SEQ ID NO: 53998 - DNA, 25 bp, Rattus norvegicus
aagtgtgtttacgtgctttcatgta

SEQ ID NO: 53999 - DNA, 25 bp, Rattus norvegicus
aagtgtgtttcaagtgccttctggg

SEQ ID NO: 54000 - DNA, 25 bp, Rattus norvegicus
aagtgtgtttcatgtgccttctggg

SEQ ID NO: 54001 - DNA, 25 bp, Rattus norvegicus
aagtgtgtttctatcactgggcctt

SEQ ID NO: 54002 - DNA, 25 bp, Rattus norvegicus
aagtgtgtttctttcactgggcctt

SEQ ID NO: 54003 - DNA, 25 bp, Rattus norvegicus
aagtgtgtttttccaggtagtccta

SEQ ID NO: 54004 - DNA, 25 bp, Rattus norvegicus
aagtgtgtttttgcaggtagtccta

SEQ ID NO: 54005 - DNA, 25 bp, Rattus norvegicus
aagtgttacaacaggatctacgtgt

SEQ ID NO: 54006 - DNA, 25 bp, Rattus norvegicus
aagtgttacaactggatctacgtgt

SEQ ID NO: 54007 - DNA, 25 bp, Rattus norvegicus
aagtgttacaagcttgcccaatatg

SEQ ID NO: 54008 - DNA, 25 bp, Rattus norvegicus
aagtgttacaaggttgcccaatatg

SEQ ID NO: 54009 - DNA, 25 bp, Rattus norvegicus
aagtgttacaatctgcttctaaggt

SEQ ID NO: 54010 - DNA, 25 bp, Rattus norvegicus
aagtgttacaatgtgcttctaaggt

SEQ ID NO: 54011 - DNA, 25 bp, Rattus norvegicus
aagtgttaggttcattgttacatcc

SEQ ID NO: 54012 - DNA, 25 bp, Rattus norvegicus
aagtgttaggttgattgttacatcc

SEQ ID NO: 54013 - DNA, 25 bp, Rattus norvegicus
aagtgttagtgaccttggcctgcca

SEQ ID NO: 54014 - DNA, 25 bp, Rattus norvegicus
aagtgttagtgagcttggcctgcca

SEQ ID NO: 54015 - DNA, 25 bp, Rattus norvegicus
aagtgttatagcatcatgtgctcga

SEQ ID NO: 54016 - DNA, 25 bp, Rattus norvegicus
aagtgttatagcttcatgtgctcga

SEQ ID NO: 54017 - DNA, 25 bp, Rattus norvegicus
aagtgttattgaactcctaccctct

SEQ ID NO: 54018 - DNA, 25 bp, Rattus norvegicus
aagtgttattgatctcctaccctct

SEQ ID NO: 54019 - DNA, 25 bp, Rattus norvegicus
aagtgttcatttctccaggatcaat

SEQ ID NO: 54020 - DNA, 25 bp, Rattus norvegicus
aagtgttcatttgtccaggatcaat

SEQ ID NO: 54021 - DNA, 25 bp, Rattus norvegicus
aagtgttccacacagacgtcgtcaa

SEQ ID NO: 54022 - DNA, 25 bp, Rattus norvegicus
aagtgttccacagagacgtcgtcaa

SEQ ID NO: 54023 - DNA, 25 bp, Rattus norvegicus
aagtgttccaggaggctcacgcgca

SEQ ID NO: 54024 - DNA, 25 bp, Rattus norvegicus
aagtgttccaggtggctcacgcgca

SEQ ID NO: 54025 - DNA, 25 bp, Rattus norvegicus
aagtgttccgaaaattccggcagtg

SEQ ID NO: 54026 - DNA, 25 bp, Rattus norvegicus
aagtgttccgaatattccggcagtg

SEQ ID NO: 54027 - DNA, 25 bp, Rattus norvegicus
aagtgttccgtccttgttatcagca

SEQ ID NO: 54028 - DNA, 25 bp, Rattus norvegicus
aagtgttccgtcgttgttatcagca

SEQ ID NO: 54029 - DNA, 25 bp, Rattus norvegicus
aagtgttcctcaagttgtcacatcc

SEQ ID NO: 54030 - DNA, 25 bp, Rattus norvegicus
aagtgttcctcatgttgtcacatcc

SEQ ID NO: 54031 - DNA, 25 bp, Rattus norvegicus
aagtgttcgggcctaacagcaagct

SEQ ID NO: 54032 - DNA, 25 bp, Rattus norvegicus
aagtgttcgggcgtaacagcaagct

SEQ ID NO: 54033 - DNA, 25 bp, Rattus norvegicus
aagtgttcgtttcatttccttgctc

SEQ ID NO: 54034 - DNA, 25 bp, Rattus norvegicus
aagtgttcgtttgatttccttgctc

SEQ ID NO: 54035 - DNA, 25 bp, Rattus norvegicus
aagtgttctagtccattctgtctat

SEQ ID NO: 54036 - DNA, 25 bp, Rattus norvegicus
aagtgttctagtgcattctgtctat

SEQ ID NO: 54037 - DNA, 25 bp, Rattus norvegicus
aagtgttctcatctgttactccccg

SEQ ID NO: 54038 - DNA, 25 bp, Rattus norvegicus
aagtgttctcatgtgttactccccg

SEQ ID NO: 54039 - DNA, 25 bp, Rattus norvegicus
aagtgttctgaaaacatgcgagtga

SEQ ID NO: 54040 - DNA, 25 bp, Rattus norvegicus
aagtgttctgaatacatgcgagtga

SEQ ID NO: 54041 - DNA, 25 bp, Rattus norvegicus
aagtgttctgacatcccgtgtgtgt

SEQ ID NO: 54042 - DNA, 25 bp, Rattus norvegicus
aagtgttctgacttcccgtgtgtgt

SEQ ID NO: 54043 - DNA, 25 bp, Rattus norvegicus
aagtgttctgcaattacccagtcga

SEQ ID NO: 54044 - DNA, 25 bp, Rattus norvegicus
aagtgttctgcatttacccagtcga

SEQ ID NO: 54045 - DNA, 25 bp, Rattus norvegicus
aagtgttctgctcagtgtctgtgac

SEQ ID NO: 54046 - DNA, 25 bp, Rattus norvegicus
aagtgttctgctgagtgtctgtgac

SEQ ID NO: 54047 - DNA, 25 bp, Rattus norvegicus
aagtgttctgtaaggtgtcgtgtta

SEQ ID NO: 54048 - DNA, 25 bp, Rattus norvegicus
aagtgttctgtacgtcacggctgtc

SEQ ID NO: 54049 - DNA, 25 bp, Rattus norvegicus
aagtgttctgtaggtcacggctgtc

SEQ ID NO: 54050 - DNA, 25 bp, Rattus norvegicus
aagtgttctgtatggtgtcgtgtta

SEQ ID NO: 54051 - DNA, 25 bp, Rattus norvegicus
aagtgttcttagaggctgattcggg

SEQ ID NO: 54052 - DNA, 25 bp, Rattus norvegicus
aagtgttcttagtggctgattcggg

SEQ ID NO: 54053 - DNA, 25 bp, Rattus norvegicus
aagtgttgaacaacgtgaagcccaa

SEQ ID NO: 54054 - DNA, 25 bp, Rattus norvegicus
aagtgttgaacatcgtgaagcccaa

SEQ ID NO: 54055 - DNA, 25 bp, Rattus norvegicus
aagtgttgactccaggcggttatct

SEQ ID NO: 54056 - DNA, 25 bp, Rattus norvegicus
aagtgttgactcgaggcggttatct

SEQ ID NO: 54057 - DNA, 25 bp, Rattus norvegicus
aagtgttgagagaagcccaggccat

SEQ ID NO: 54058 - DNA, 25 bp, Rattus norvegicus
aagtgttgagagtagcccaggccat

SEQ ID NO: 54059 - DNA, 25 bp, Rattus norvegicus
aagtgttgaggactccagagaccga

SEQ ID NO: 54060 - DNA, 25 bp, Rattus norvegicus
aagtgttgaggagtccagagaccga

SEQ ID NO: 54061 - DNA, 25 bp, Rattus norvegicus
aagtgttgattaccctggtgcatgc

SEQ ID NO: 54062 - DNA, 25 bp, Rattus norvegicus
aagtgttgattagcctggtgcatgc

SEQ ID NO: 54063 - DNA, 25 bp, Rattus norvegicus
aagtgttgccgacctccggtgagac

SEQ ID NO: 54064 - DNA, 25 bp, Rattus norvegicus
aagtgttgccgagctccggtgagac

SEQ ID NO: 54065 - DNA, 25 bp, Rattus norvegicus
aagtgttgctgtcttaagtcatcca

SEQ ID NO: 54066 - DNA, 25 bp, Rattus norvegicus
aagtgttgctgtgttaagtcatcca

SEQ ID NO: 54067 - DNA, 25 bp, Rattus norvegicus
aagtgttggcataacattacctggg

SEQ ID NO: 54068 - DNA, 25 bp, Rattus norvegicus
aagtgttggcattacattacctggg

SEQ ID NO: 54069 - DNA, 25 bp, Rattus norvegicus
aagtgttggtgtccgcttgacgtaa

SEQ ID NO: 54070 - DNA, 25 bp, Rattus norvegicus
aagtgttggtgtgcgcttgacgtaa

SEQ ID NO: 54071 - DNA, 25 bp, Rattus norvegicus
aagtgttgtactccctgggacctaa

SEQ ID NO: 54072 - DNA, 25 bp, Rattus norvegicus
aagtgttgtactgcctgggacctaa

SEQ ID NO: 54073 - DNA, 25 bp, Rattus norvegicus
aagtgttgtattattgctgcatgca

SEQ ID NO: 54074 - DNA, 25 bp, Rattus norvegicus
aagtgttgtattcctgcagctgcga

SEQ ID NO: 54075 - DNA, 25 bp, Rattus norvegicus
aagtgttgtattgctgcagctgcga

SEQ ID NO: 54076 - DNA, 25 bp, Rattus norvegicus
aagtgttgtatttttgctgcatgca

SEQ ID NO: 54077 - DNA, 25 bp, Rattus norvegicus
aagtgttgtctaagagttgccttgt

SEQ ID NO: 54078 - DNA, 25 bp, Rattus norvegicus
aagtgttgtctatgagttgccttgt

SEQ ID NO: 54079 - DNA, 25 bp, Rattus norvegicus
aagtgttgtcttaggatgtagaaca

SEQ ID NO: 54080 - DNA, 25 bp, Rattus norvegicus
aagtgttgtcttcttctcctacaca

SEQ ID NO: 54081 - DNA, 25 bp, Rattus norvegicus
aagtgttgtcttgttctcctacaca

SEQ ID NO: 54082 - DNA, 25 bp, Rattus norvegicus
aagtgttgtctttggatgtagaaca

SEQ ID NO: 54083 - DNA, 25 bp, Rattus norvegicus
aagtgttgttatctcctagtctcct

SEQ ID NO: 54084 - DNA, 25 bp, Rattus norvegicus
aagtgttgttatgtcctagtctcct

SEQ ID NO: 54085 - DNA, 25 bp, Rattus norvegicus
aagtgtttaaaaactgggctcttga

SEQ ID NO: 54086 - DNA, 25 bp, Rattus norvegicus
aagtgtttaaaatctgggctcttga

SEQ ID NO: 54087 - DNA, 25 bp, Rattus norvegicus
aagtgtttaaccacacaggagtacg

SEQ ID NO: 54088 - DNA, 25 bp, Rattus norvegicus
aagtgtttaacctcacaggagtacg

SEQ ID NO: 54089 - DNA, 25 bp, Rattus norvegicus
aagtgtttaccaccaaattgtctca

SEQ ID NO: 54090 - DNA, 25 bp, Rattus norvegicus
aagtgtttaccagcaaattgtctca

SEQ ID NO: 54091 - DNA, 25 bp, Rattus norvegicus
aagtgtttccagaggtgacctctgt

SEQ ID NO: 54092 - DNA, 25 bp, Rattus norvegicus
aagtgtttccagtggtgacctctgt

SEQ ID NO: 54093 - DNA, 25 bp, Rattus norvegicus
aagtgtttctcgagaaatcctgtgg

SEQ ID NO: 54094 - DNA, 25 bp, Rattus norvegicus
aagtgtttctcgtgaaatcctgtgg

SEQ ID NO: 54095 - DNA, 25 bp, Rattus norvegicus
aagtgtttcttcagaacatggatta

SEQ ID NO: 54096 - DNA, 25 bp, Rattus norvegicus
aagtgtttcttctgaacatggatta

SEQ ID NO: 54097 - DNA, 25 bp, Rattus norvegicus
aagtgtttgcatcctgttcattttt

SEQ ID NO: 54098 - DNA, 25 bp, Rattus norvegicus
aagtgtttgcatgctgttcattttt

SEQ ID NO: 54099 - DNA, 25 bp, Rattus norvegicus
aagtgtttgcgccttctgttgaaac

SEQ ID NO: 54100 - DNA, 25 bp, Rattus norvegicus
aagtgtttgcgcgttctgttgaaac

SEQ ID NO: 54101 - DNA, 25 bp, Rattus norvegicus
aagtgtttgctgagtttgcttggtt

SEQ ID NO: 54102 - DNA, 25 bp, Rattus norvegicus
aagtgtttgctgtgtttgcttggtt

SEQ ID NO: 54103 - DNA, 25 bp, Rattus norvegicus
aagtgtttgcttcgctttgtttttg

SEQ ID NO: 54104 - DNA, 25 bp, Rattus norvegicus
aagtgtttgcttggctttgtttttg

SEQ ID NO: 54105 - DNA, 25 bp, Rattus norvegicus
aagtgtttggacaagtgtactctaa

SEQ ID NO: 54106 - DNA, 25 bp, Rattus norvegicus
aagtgtttggactagtgtactctaa

SEQ ID NO: 54107 - DNA, 25 bp, Rattus norvegicus
aagtgtttggagcacagcacctgct

SEQ ID NO: 54108 - DNA, 25 bp, Rattus norvegicus
aagtgtttggaggacagcacctgct

SEQ ID NO: 54109 - DNA, 25 bp, Rattus norvegicus
aagtgtttggatatcttgcatgtag

SEQ ID NO: 54110 - DNA, 25 bp, Rattus norvegicus
aagtgtttggatttcttgcatgtag

SEQ ID NO: 54111 - DNA, 25 bp, Rattus norvegicus
aagtgtttggccagacttgccgaaa

SEQ ID NO: 54112 - DNA, 25 bp, Rattus norvegicus
aagtgtttggcctgacttgccgaaa

SEQ ID NO: 54113 - DNA, 25 bp, Rattus norvegicus
aagtgtttggtcatgcttcttgtat

SEQ ID NO: 54114 - DNA, 25 bp, Rattus norvegicus
aagtgtttggtcttgcttcttgtat

SEQ ID NO: 54115 - DNA, 25 bp, Rattus norvegicus
aagtgtttgtaaatctccctcacca

SEQ ID NO: 54116 - DNA, 25 bp, Rattus norvegicus
aagtgtttgtaattctccctcacca

SEQ ID NO: 54117 - DNA, 25 bp, Rattus norvegicus
aagtgtttgtccattagaagctcaa

SEQ ID NO: 54118 - DNA, 25 bp, Rattus norvegicus
aagtgtttgtcctttagaagctcaa

SEQ ID NO: 54119 - DNA, 25 bp, Rattus norvegicus
aagtgtttgttcagtgactgtaggc

SEQ ID NO: 54120 - DNA, 25 bp, Rattus norvegicus
aagtgtttgttctgtgactgtaggc

SEQ ID NO: 54121 - DNA, 25 bp, Rattus norvegicus
aagtgttttacaatgtgacttaaca

SEQ ID NO: 54122 - DNA, 25 bp, Rattus norvegicus
aagtgttttacattgtgacttaaca

SEQ ID NO: 54123 - DNA, 25 bp, Rattus norvegicus
aagtgttttactcttgtggctcatt

SEQ ID NO: 54124 - DNA, 25 bp, Rattus norvegicus
aagtgttttactgttgtggctcatt

SEQ ID NO: 54125 - DNA, 25 bp, Rattus norvegicus
aagtgttttatgcttcaatggctaa

SEQ ID NO: 54126 - DNA, 25 bp, Rattus norvegicus
aagtgttttatggttcaatggctaa

SEQ ID NO: 54127 - DNA, 25 bp, Rattus norvegicus
aagtgttttcatcgttggaggtcaa

SEQ ID NO: 54128 - DNA, 25 bp, Rattus norvegicus
aagtgttttcatggttggaggtcaa

SEQ ID NO: 54129 - DNA, 25 bp, Rattus norvegicus
aagtgttttcctcgtcttgagactc

SEQ ID NO: 54130 - DNA, 25 bp, Rattus norvegicus
aagtgttttcctggtcttgagactc

SEQ ID NO: 54131 - DNA, 25 bp, Rattus norvegicus
aagtgttttgtgcacgttgcctaag

SEQ ID NO: 54132 - DNA, 25 bp, Rattus norvegicus
aagtgttttgtggacgttgcctaag

SEQ ID NO: 54133 - DNA, 25 bp, Rattus norvegicus
aagttaaaccctagttgctcctgtg

SEQ ID NO: 54134 - DNA, 25 bp, Rattus norvegicus
aagttaaacccttgttgctcctgtg

SEQ ID NO: 54135 - DNA, 25 bp, Rattus norvegicus
aagttaaatctcctcctctgagctc

SEQ ID NO: 54136 - DNA, 25 bp, Rattus norvegicus
aagttaaatctcgtcctctgagctc

SEQ ID NO: 54137 - DNA, 25 bp, Rattus norvegicus
aagttaaccaggacttcccagcata

SEQ ID NO: 54138 - DNA, 25 bp, Rattus norvegicus
aagttaaccaggtcttcccagcata

SEQ ID NO: 54139 - DNA, 25 bp, Rattus norvegicus
aagttaacctttactcacagaatat

SEQ ID NO: 54140 - DNA, 25 bp, Rattus norvegicus
aagttaaccttttctcacagaatat

SEQ ID NO: 54141 - DNA, 25 bp, Rattus norvegicus
aagttaactttccttgagtatccag

SEQ ID NO: 54142 - DNA, 25 bp, Rattus norvegicus
aagttaactttcgttgagtatccag

SEQ ID NO: 54143 - DNA, 25 bp, Rattus norvegicus
aagttaagccacactcctattttat

SEQ ID NO: 54144 - DNA, 25 bp, Rattus norvegicus
aagttaagccactctcctattttat

SEQ ID NO: 54145 - DNA, 25 bp, Rattus norvegicus
aagttaagctgcattctgccgaagc

SEQ ID NO: 54146 - DNA, 25 bp, Rattus norvegicus
aagttaagctgctttctgccgaagc

SEQ ID NO: 54147 - DNA, 25 bp, Rattus norvegicus
aagttaagtcccacatggcaagcct

SEQ ID NO: 54148 - DNA, 25 bp, Rattus norvegicus
aagttaagtccctcatggcaagcct

SEQ ID NO: 54149 - DNA, 25 bp, Rattus norvegicus
aagttaagttccagttgcccctcat

SEQ ID NO: 54150 - DNA, 25 bp, Rattus norvegicus
aagttaagttcctgttgcccctcat

SEQ ID NO: 54151 - DNA, 25 bp, Rattus norvegicus
aagttaatcaacctctggtcctctt

SEQ ID NO: 54152 - DNA, 25 bp, Rattus norvegicus
aagttaatcaacgtctggtcctctt

SEQ ID NO: 54153 - DNA, 25 bp, Rattus norvegicus
aagttaattagcacactaccccact

SEQ ID NO: 54154 - DNA, 25 bp, Rattus norvegicus
aagttaattagctcactaccccact

SEQ ID NO: 54155 - DNA, 25 bp, Rattus norvegicus
aagttacaacccattcagtctccct

SEQ ID NO: 54156 - DNA, 25 bp, Rattus norvegicus
aagttacaaccctttcagtctccct

SEQ ID NO: 54157 - DNA, 25 bp, Rattus norvegicus
aagttacaactgattagatcactgt

SEQ ID NO: 54158 - DNA, 25 bp, Rattus norvegicus
aagttacaactgtttagatcactgt

SEQ ID NO: 54159 - DNA, 25 bp, Rattus norvegicus
aagttacaagttactgcttcataga

SEQ ID NO: 54160 - DNA, 25 bp, Rattus norvegicus
aagttacaagtttctgcttcataga

SEQ ID NO: 54161 - DNA, 25 bp, Rattus norvegicus
aagttacacagaattaccaatgctc

SEQ ID NO: 54162 - DNA, 25 bp, Rattus norvegicus
aagttacacagatttaccaatgctc

SEQ ID NO: 54163 - DNA, 25 bp, Rattus norvegicus
aagttacacagtacttcagctgaga

SEQ ID NO: 54164 - DNA, 25 bp, Rattus norvegicus
aagttacacagttcttcagctgaga

SEQ ID NO: 54165 - DNA, 25 bp, Rattus norvegicus
aagttacacattatgctgctcgaag

SEQ ID NO: 54166 - DNA, 25 bp, Rattus norvegicus
aagttacacattttgctgctcgaag

SEQ ID NO: 54167 - DNA, 25 bp, Rattus norvegicus
aagttacacctcagaatgcttcctt

SEQ ID NO: 54168 - DNA, 25 bp, Rattus norvegicus
aagttacacctctgaatgcttcctt

SEQ ID NO: 54169 - DNA, 25 bp, Rattus norvegicus
aagttacagcagctgctctgtggcg

SEQ ID NO: 54170 - DNA, 25 bp, Rattus norvegicus
aagttacagcaggtgctctgtggcg

SEQ ID NO: 54171 - DNA, 25 bp, Rattus norvegicus
aagttacagggccatgctctccaag

SEQ ID NO: 54172 - DNA, 25 bp, Rattus norvegicus
aagttacagggcgatgctctccaag

SEQ ID NO: 54173 - DNA, 25 bp, Rattus norvegicus
aagttaccaccacagttcttgcctc

SEQ ID NO: 54174 - DNA, 25 bp, Rattus norvegicus
aagttaccaccagagttcttgcctc

SEQ ID NO: 54175 - DNA, 25 bp, Rattus norvegicus
aagttaccatgcaacagcctgcggt

SEQ ID NO: 54176 - DNA, 25 bp, Rattus norvegicus
aagttaccatgccttggcctgattt

SEQ ID NO: 54177 - DNA, 25 bp, Rattus norvegicus
aagttaccatgcgttggcctgattt

SEQ ID NO: 54178 - DNA, 25 bp, Rattus norvegicus
aagttaccatgctacagcctgcggt

SEQ ID NO: 54179 - DNA, 25 bp, Rattus norvegicus
aagttaccctgaagatgcccatggc

SEQ ID NO: 54180 - DNA, 25 bp, Rattus norvegicus
aagttaccctgacaacatgcgaagc

SEQ ID NO: 54181 - DNA, 25 bp, Rattus norvegicus
aagttaccctgagaacatgcgaagc

SEQ ID NO: 54182 - DNA, 25 bp, Rattus norvegicus
aagttaccctgatgatgcccatggc

SEQ ID NO: 54183 - DNA, 25 bp, Rattus norvegicus
aagttaccggagctgatgcctccag

SEQ ID NO: 54184 - DNA, 25 bp, Rattus norvegicus
aagttaccggaggtgatgcctccag

SEQ ID NO: 54185 - DNA, 25 bp, Rattus norvegicus
aagttacctgaactcctgggcaata

SEQ ID NO: 54186 - DNA, 25 bp, Rattus norvegicus
aagttacctgaagtcctgggcaata

SEQ ID NO: 54187 - DNA, 25 bp, Rattus norvegicus
aagttaccttctattttgcatcctg

SEQ ID NO: 54188 - DNA, 25 bp, Rattus norvegicus
aagttaccttcttttttgcatcctg

SEQ ID NO: 54189 - DNA, 25 bp, Rattus norvegicus
aagttactacatcggctctgcatca

SEQ ID NO: 54190 - DNA, 25 bp, Rattus norvegicus
aagttactacatgggctctgcatca

SEQ ID NO: 54191 - DNA, 25 bp, Rattus norvegicus
aagttactcagccttgggcgtttcg

SEQ ID NO: 54192 - DNA, 25 bp, Rattus norvegicus
aagttactcagcgttgggcgtttcg

SEQ ID NO: 54193 - DNA, 25 bp, Rattus norvegicus
aagttactctcaagaaccaccagtg

SEQ ID NO: 54194 - DNA, 25 bp, Rattus norvegicus
aagttactctcatgaaccaccagtg

SEQ ID NO: 54195 - DNA, 25 bp, Rattus norvegicus
aagttactgaagagtgacaagtcca

SEQ ID NO: 54196 - DNA, 25 bp, Rattus norvegicus
aagttactgaagtgtgacaagtcca

SEQ ID NO: 54197 - DNA, 25 bp, Rattus norvegicus
aagttactgagcacctttcctagga

SEQ ID NO: 54198 - DNA, 25 bp, Rattus norvegicus
aagttactgagctcctttcctagga

SEQ ID NO: 54199 - DNA, 25 bp, Rattus norvegicus
aagttactgctcactgttcaaatga

SEQ ID NO: 54200 - DNA, 25 bp, Rattus norvegicus
aagttactgctctctgttcaaatga

SEQ ID NO: 54201 - DNA, 25 bp, Rattus norvegicus
aagttactgcttccgtgtgttatac

SEQ ID NO: 54202 - DNA, 25 bp, Rattus norvegicus
aagttactgcttgcgtgtgttatac

SEQ ID NO: 54203 - DNA, 25 bp, Rattus norvegicus
aagttactgtagctgatcacatcca

SEQ ID NO: 54204 - DNA, 25 bp, Rattus norvegicus
aagttactgtaggtgatcacatcca

SEQ ID NO: 54205 - DNA, 25 bp, Rattus norvegicus
aagttagaacctatcattgagtagt

SEQ ID NO: 54206 - DNA, 25 bp, Rattus norvegicus
aagttagaacctttcattgagtagt

SEQ ID NO: 54207 - DNA, 25 bp, Rattus norvegicus
aagttagaacttaggccattggaat

SEQ ID NO: 54208 - DNA, 25 bp, Rattus norvegicus
aagttagaactttggccattggaat

SEQ ID NO: 54209 - DNA, 25 bp, Rattus norvegicus
aagttagagcagctacgtgcagcct

SEQ ID NO: 54210 - DNA, 25 bp, Rattus norvegicus
aagttagagcaggtacgtgcagcct

SEQ ID NO: 54211 - DNA, 25 bp, Rattus norvegicus
aagttagcatttacccaagaccaag

SEQ ID NO: 54212 - DNA, 25 bp, Rattus norvegicus
aagttagcattttcccaagaccaag

SEQ ID NO: 54213 - DNA, 25 bp, Rattus norvegicus
aagttagccatcctagttttcgctg

SEQ ID NO: 54214 - DNA, 25 bp, Rattus norvegicus
aagttagccatcgtagttttcgctg

SEQ ID NO: 54215 - DNA, 25 bp, Rattus norvegicus
aagttagcctttcatcgtgcgtcta

SEQ ID NO: 54216 - DNA, 25 bp, Rattus norvegicus
aagttagcctttgatcgtgcgtcta

SEQ ID NO: 54217 - DNA, 25 bp, Rattus norvegicus
aagttagcggccagcctcgggtaca

SEQ ID NO: 54218 - DNA, 25 bp, Rattus norvegicus
aagttagcggcctgcctcgggtaca

SEQ ID NO: 54219 - DNA, 25 bp, Rattus norvegicus
aagttagctggtacgcaggtcgtgt

SEQ ID NO: 54220 - DNA, 25 bp, Rattus norvegicus
aagttagctggttcgcaggtcgtgt

SEQ ID NO: 54221 - DNA, 25 bp, Rattus norvegicus
aagttaggcttcatggtctgggact

SEQ ID NO: 54222 - DNA, 25 bp, Rattus norvegicus
aagttaggcttcttggtctgggact

SEQ ID NO: 54223 - DNA, 25 bp, Rattus norvegicus
aagttaggtggtatgctgttgctgt

SEQ ID NO: 54224 - DNA, 25 bp, Rattus norvegicus
aagttaggtggtttgctgttgctgt

SEQ ID NO: 54225 - DNA, 25 bp, Rattus norvegicus
aagttagtcaagagcctgagttttt

SEQ ID NO: 54226 - DNA, 25 bp, Rattus norvegicus
aagttagtcaagtgcctgagttttt

SEQ ID NO: 54227 - DNA, 25 bp, Rattus norvegicus
aagttagtcaccagagcccgaggga

SEQ ID NO: 54228 - DNA, 25 bp, Rattus norvegicus
aagttagtcacctgagcccgaggga

SEQ ID NO: 54229 - DNA, 25 bp, Rattus norvegicus
aagttagtcggtcgaccagccatac

SEQ ID NO: 54230 - DNA, 25 bp, Rattus norvegicus
aagttagtcggtggaccagccatac

SEQ ID NO: 54231 - DNA, 25 bp, Rattus norvegicus
aagttagtgatcagctcttttgagg

SEQ ID NO: 54232 - DNA, 25 bp, Rattus norvegicus
aagttagtgatctgctcttttgagg

SEQ ID NO: 54233 - DNA, 25 bp, Rattus norvegicus
aagttagttatgaggtcacacccaa

SEQ ID NO: 54234 - DNA, 25 bp, Rattus norvegicus
aagttagttatgtggtcacacccaa

SEQ ID NO: 54235 - DNA, 25 bp, Rattus norvegicus
aagttagttcctcaaccagcagccc

SEQ ID NO: 54236 - DNA, 25 bp, Rattus norvegicus
aagttagttcctgaaccagcagccc

SEQ ID NO: 54237 - DNA, 25 bp, Rattus norvegicus
aagttatacttcagccccgcaaaag

SEQ ID NO: 54238 - DNA, 25 bp, Rattus norvegicus
aagttatacttctgccccgcaaaag

SEQ ID NO: 54239 - DNA, 25 bp, Rattus norvegicus
aagttatagattcagtccccagctc

SEQ ID NO: 54240 - DNA, 25 bp, Rattus norvegicus
aagttatagattgagtccccagctc

SEQ ID NO: 54241 - DNA, 25 bp, Rattus norvegicus
aagttatccaatcccaagtggccag

SEQ ID NO: 54242 - DNA, 25 bp, Rattus norvegicus
aagttatccaatgccaagtggccag

SEQ ID NO: 54243 - DNA, 25 bp, Rattus norvegicus
aagttatcccgacctccatgaaaag

SEQ ID NO: 54244 - DNA, 25 bp, Rattus norvegicus
aagttatcccgagctccatgaaaag

SEQ ID NO: 54245 - DNA, 25 bp, Rattus norvegicus
aagttatccttcctgtgccagatag

SEQ ID NO: 54246 - DNA, 25 bp, Rattus norvegicus
aagttatccttcgtgtgccagatag

SEQ ID NO: 54247 - DNA, 25 bp, Rattus norvegicus
aagttatctaccactcagacatcgg

SEQ ID NO: 54248 - DNA, 25 bp, Rattus norvegicus
aagttatctacctctcagacatcgg

SEQ ID NO: 54249 - DNA, 25 bp, Rattus norvegicus
aagttatctatgatctccttagtgg

SEQ ID NO: 54250 - DNA, 25 bp, Rattus norvegicus
aagttatctatgttctccttagtgg

SEQ ID NO: 54251 - DNA, 25 bp, Rattus norvegicus
aagttatctgggactgtgagtgttc

SEQ ID NO: 54252 - DNA, 25 bp, Rattus norvegicus
aagttatctgggtctgtgagtgttc

SEQ ID NO: 54253 - DNA, 25 bp, Rattus norvegicus
aagttatctgtgaaggtccctggct

SEQ ID NO: 54254 - DNA, 25 bp, Rattus norvegicus
aagttatctgtgtaggtccctggct

SEQ ID NO: 54255 - DNA, 25 bp, Rattus norvegicus
aagttatgcatgctgttgttcatca

SEQ ID NO: 54256 - DNA, 25 bp, Rattus norvegicus
aagttatgcatggtgttgttcatca

SEQ ID NO: 54257 - DNA, 25 bp, Rattus norvegicus
aagttatgtattatccaggctcaaa

SEQ ID NO: 54258 - DNA, 25 bp, Rattus norvegicus
aagttatgtattttccaggctcaaa

SEQ ID NO: 54259 - DNA, 25 bp, Rattus norvegicus
aagttattacctatcaatgactata

SEQ ID NO: 54260 - DNA, 25 bp, Rattus norvegicus
aagttattacctttcaatgactata

SEQ ID NO: 54261 - DNA, 25 bp, Rattus norvegicus
aagttattcccaccggaagcgagtt

SEQ ID NO: 54262 - DNA, 25 bp, Rattus norvegicus
aagttattcccagcggaagcgagtt

SEQ ID NO: 54263 - DNA, 25 bp, Rattus norvegicus
aagttattctcacctctgtattcat

SEQ ID NO: 54264 - DNA, 25 bp, Rattus norvegicus
aagttattctcagctctgtattcat

SEQ ID NO: 54265 - DNA, 25 bp, Rattus norvegicus
aagttattgcctagaccctggtgaa

SEQ ID NO: 54266 - DNA, 25 bp, Rattus norvegicus
aagttattgccttgaccctggtgaa

SEQ ID NO: 54267 - DNA, 25 bp, Rattus norvegicus
aagttatttaccatctgctgttgag

SEQ ID NO: 54268 - DNA, 25 bp, Rattus norvegicus
aagttatttaccttctgctgttgag

SEQ ID NO: 54269 - DNA, 25 bp, Rattus norvegicus
aagttatttagtcgtgtctgtcaca

SEQ ID NO: 54270 - DNA, 25 bp, Rattus norvegicus
aagttatttagtggtgtctgtcaca

SEQ ID NO: 54271 - DNA, 25 bp, Rattus norvegicus
aagttatttcttactgtagctgcta

SEQ ID NO: 54272 - DNA, 25 bp, Rattus norvegicus
aagttatttctttctgtagctgcta

SEQ ID NO: 54273 - DNA, 25 bp, Rattus norvegicus
aagttatttgacaggttgaacctca

SEQ ID NO: 54274 - DNA, 25 bp, Rattus norvegicus
aagttatttgactggttgaacctca

SEQ ID NO: 54275 - DNA, 25 bp, Rattus norvegicus
aagttattttacctctcctgagcac

SEQ ID NO: 54276 - DNA, 25 bp, Rattus norvegicus
aagttattttacgtctcctgagcac

SEQ ID NO: 54277 - DNA, 25 bp, Rattus norvegicus
aagttcaacggcacagtcaaggctg

SEQ ID NO: 54278 - DNA, 25 bp, Rattus norvegicus
aagttcaacggctcagtcaaggctg

SEQ ID NO: 54279 - DNA, 25 bp, Rattus norvegicus
aagttcaagaacatctgctccctgg

SEQ ID NO: 54280 - DNA, 25 bp, Rattus norvegicus
aagttcaagaacttctgctccctgg

SEQ ID NO: 54281 - DNA, 25 bp, Rattus norvegicus
aagttcaaggccagcagacagtagg

SEQ ID NO: 54282 - DNA, 25 bp, Rattus norvegicus
aagttcaaggccagcgtgcactacg

SEQ ID NO: 54283 - DNA, 25 bp, Rattus norvegicus
aagttcaaggcctgcagacagtagg

SEQ ID NO: 54284 - DNA, 25 bp, Rattus norvegicus
aagttcaaggcctgcgtgcactacg

SEQ ID NO: 54285 - DNA, 25 bp, Rattus norvegicus
aagttcaagggcctccttagtcaca

SEQ ID NO: 54286 - DNA, 25 bp, Rattus norvegicus
aagttcaagggcgtccttagtcaca

SEQ ID NO: 54287 - DNA, 25 bp, Rattus norvegicus
aagttcaatcatctctgtggtccag

SEQ ID NO: 54288 - DNA, 25 bp, Rattus norvegicus
aagttcaatcatgtctgtggtccag

SEQ ID NO: 54289 - DNA, 25 bp, Rattus norvegicus
aagttcaatccccatgtccaacatg

SEQ ID NO: 54290 - DNA, 25 bp, Rattus norvegicus
aagttcaatcccgatgtccaacatg

SEQ ID NO: 54291 - DNA, 25 bp, Rattus norvegicus
aagttcaatctcctgctttgtggtc

SEQ ID NO: 54292 - DNA, 25 bp, Rattus norvegicus
aagttcaatctcgtgctttgtggtc

SEQ ID NO: 54293 - DNA, 25 bp, Rattus norvegicus
aagttcaatgatctcgtgtggcacg

SEQ ID NO: 54294 - DNA, 25 bp, Rattus norvegicus
aagttcaatgatgtcgtgtggcacg

SEQ ID NO: 54295 - DNA, 25 bp, Rattus norvegicus
aagttcaatgtgcatttcactcaaa

SEQ ID NO: 54296 - DNA, 25 bp, Rattus norvegicus
aagttcaatgtggatttcactcaaa

SEQ ID NO: 54297 - DNA, 25 bp, Rattus norvegicus
aagttcaatttcaagcgtggctagg

SEQ ID NO: 54298 - DNA, 25 bp, Rattus norvegicus
aagttcaatttctagcgtggctagg

SEQ ID NO: 54299 - DNA, 25 bp, Rattus norvegicus
aagttcacaagcacacaggcttaca

SEQ ID NO: 54300 - DNA, 25 bp, Rattus norvegicus
aagttcacaagctcacaggcttaca

SEQ ID NO: 54301 - DNA, 25 bp, Rattus norvegicus
aagttcacacacacatgggtcagca

SEQ ID NO: 54302 - DNA, 25 bp, Rattus norvegicus
aagttcacacactcatgggtcagca

SEQ ID NO: 54303 - DNA, 25 bp, Rattus norvegicus
aagttcacagatctcatccagctcg

SEQ ID NO: 54304 - DNA, 25 bp, Rattus norvegicus
aagttcacagatgtcatccagctcg

SEQ ID NO: 54305 - DNA, 25 bp, Rattus norvegicus
aagttcacagcgagctttctttttc

SEQ ID NO: 54306 - DNA, 25 bp, Rattus norvegicus
aagttcacagcgtgctttctttttc

SEQ ID NO: 54307 - DNA, 25 bp, Rattus norvegicus
aagttcacaggtattgaagctgacc

SEQ ID NO: 54308 - DNA, 25 bp, Rattus norvegicus
aagttcacaggttttgaagctgacc

SEQ ID NO: 54309 - DNA, 25 bp, Rattus norvegicus
aagttcacagtaaccctgactcagt

SEQ ID NO: 54310 - DNA, 25 bp, Rattus norvegicus
aagttcacagtatccctgactcagt

SEQ ID NO: 54311 - DNA, 25 bp, Rattus norvegicus
aagttcacagtgaccccatatctga

SEQ ID NO: 54312 - DNA, 25 bp, Rattus norvegicus
aagttcacagtgtccccatatctga

SEQ ID NO: 54313 - DNA, 25 bp, Rattus norvegicus
aagttcaccaagctttgctcttgtg

SEQ ID NO: 54314 - DNA, 25 bp, Rattus norvegicus
aagttcaccaaggtttgctcttgtg

SEQ ID NO: 54315 - DNA, 25 bp, Rattus norvegicus
aagttcaccatgacagcatcatcag

SEQ ID NO: 54316 - DNA, 25 bp, Rattus norvegicus
aagttcaccatgtcagcatcatcag

SEQ ID NO: 54317 - DNA, 25 bp, Rattus norvegicus
aagttcacgctcagtgtctggctgt

SEQ ID NO: 54318 - DNA, 25 bp, Rattus norvegicus
aagttcacgctctgtgtctggctgt

SEQ ID NO: 54319 - DNA, 25 bp, Rattus norvegicus
aagttcacgtcaccagcagattcct

SEQ ID NO: 54320 - DNA, 25 bp, Rattus norvegicus
aagttcacgtcagcagcagattcct

SEQ ID NO: 54321 - DNA, 25 bp, Rattus norvegicus
aagttcactactactctggatactc

SEQ ID NO: 54322 - DNA, 25 bp, Rattus norvegicus
aagttcactacttctctggatactc

SEQ ID NO: 54323 - DNA, 25 bp, Rattus norvegicus
aagttcactcggaggcagctgcagg

SEQ ID NO: 54324 - DNA, 25 bp, Rattus norvegicus
aagttcactcggtggcagctgcagg

SEQ ID NO: 54325 - DNA, 25 bp, Rattus norvegicus
aagttcactctacacacgcataaaa

SEQ ID NO: 54326 - DNA, 25 bp, Rattus norvegicus
aagttcactctagacacgcataaaa

SEQ ID NO: 54327 - DNA, 25 bp, Rattus norvegicus
aagttcactgatatctttgccggtc

SEQ ID NO: 54328 - DNA, 25 bp, Rattus norvegicus
aagttcactgatttctttgccggtc

SEQ ID NO: 54329 - DNA, 25 bp, Rattus norvegicus
aagttcagaatcatgccttaaattg

SEQ ID NO: 54330 - DNA, 25 bp, Rattus norvegicus
aagttcagaatcttgccttaaattg

SEQ ID NO: 54331 - DNA, 25 bp, Rattus norvegicus
aagttcagaccgacttcattggcca

SEQ ID NO: 54332 - DNA, 25 bp, Rattus norvegicus
aagttcagaccgtcttcattggcca

SEQ ID NO: 54333 - DNA, 25 bp, Rattus norvegicus
aagttcagactgcacatcggaggag

SEQ ID NO: 54334 - DNA, 25 bp, Rattus norvegicus
aagttcagactggacatcggaggag

SEQ ID NO: 54335 - DNA, 25 bp, Rattus norvegicus
aagttcagcctcaccatcagctcgt

SEQ ID NO: 54336 - DNA, 25 bp, Rattus norvegicus
aagttcagcctcctgcattatacag

SEQ ID NO: 54337 - DNA, 25 bp, Rattus norvegicus
aagttcagcctcgtgcattatacag

SEQ ID NO: 54338 - DNA, 25 bp, Rattus norvegicus
aagttcagcctctccatcagctcgt

SEQ ID NO: 54339 - DNA, 25 bp, Rattus norvegicus
aagttcagccttcatgaattgcatg

SEQ ID NO: 54340 - DNA, 25 bp, Rattus norvegicus
aagttcagccttgatgaattgcatg

SEQ ID NO: 54341 - DNA, 25 bp, Rattus norvegicus
aagttcagcttaagttttgatgcat

SEQ ID NO: 54342 - DNA, 25 bp, Rattus norvegicus
aagttcagcttatgttttgatgcat

SEQ ID NO: 54343 - DNA, 25 bp, Rattus norvegicus
aagttcaggaacatgccctatggct

SEQ ID NO: 54344 - DNA, 25 bp, Rattus norvegicus
aagttcaggaacttgccctatggct

SEQ ID NO: 54345 - DNA, 25 bp, Rattus norvegicus
aagttcaggatgcagctcccgggac

SEQ ID NO: 54346 - DNA, 25 bp, Rattus norvegicus
aagttcaggatggagctcccgggac

SEQ ID NO: 54347 - DNA, 25 bp, Rattus norvegicus
aagttcaggcttcagctctgaccat

SEQ ID NO: 54348 - DNA, 25 bp, Rattus norvegicus
aagttcaggcttgagctctgaccat

SEQ ID NO: 54349 - DNA, 25 bp, Rattus norvegicus
aagttcagggctctttctagggtca

SEQ ID NO: 54350 - DNA, 25 bp, Rattus norvegicus
aagttcagggctgtttctagggtca

SEQ ID NO: 54351 - DNA, 25 bp, Rattus norvegicus
aagttcaggttcaccaaccaaagag

SEQ ID NO: 54352 - DNA, 25 bp, Rattus norvegicus
aagttcaggttctccaaccaaagag

SEQ ID NO: 54353 - DNA, 25 bp, Rattus norvegicus
aagttcagtctcatggttcggttta

SEQ ID NO: 54354 - DNA, 25 bp, Rattus norvegicus
aagttcagtctcttggttcggttta

SEQ ID NO: 54355 - DNA, 25 bp, Rattus norvegicus
aagttcagtgctaaccctcgagcga

SEQ ID NO: 54356 - DNA, 25 bp, Rattus norvegicus
aagttcagtgcttaccctcgagcga

SEQ ID NO: 54357 - DNA, 25 bp, Rattus norvegicus
aagttcagttcaacttgggtgccac

SEQ ID NO: 54358 - DNA, 25 bp, Rattus norvegicus
aagttcagttcatcttgggtgccac

SEQ ID NO: 54359 - DNA, 25 bp, Rattus norvegicus
aagttcatcataatctttcccctcc

SEQ ID NO: 54360 - DNA, 25 bp, Rattus norvegicus
aagttcatcatattctttcccctcc

SEQ ID NO: 54361 - DNA, 25 bp, Rattus norvegicus
aagttcatccaccttgtgactttgt

SEQ ID NO: 54362 - DNA, 25 bp, Rattus norvegicus
aagttcatccacgttgtgactttgt

SEQ ID NO: 54363 - DNA, 25 bp, Rattus norvegicus
aagttcatccgtaacctcgcggaca

SEQ ID NO: 54364 - DNA, 25 bp, Rattus norvegicus
aagttcatccgttacctcgcggaca

SEQ ID NO: 54365 - DNA, 25 bp, Rattus norvegicus
aagttcatcctgaaggtcctggaca

SEQ ID NO: 54366 - DNA, 25 bp, Rattus norvegicus
aagttcatcctgtaggtcctggaca

SEQ ID NO: 54367 - DNA, 25 bp, Rattus norvegicus
aagttcatcgctacaaccggcatgg

SEQ ID NO: 54368 - DNA, 25 bp, Rattus norvegicus
aagttcatcgcttcaaccggcatgg

SEQ ID NO: 54369 - DNA, 25 bp, Rattus norvegicus
aagttcatgactctgatgcccaaca

SEQ ID NO: 54370 - DNA, 25 bp, Rattus norvegicus
aagttcatgactgtgatgcccaaca

SEQ ID NO: 54371 - DNA, 25 bp, Rattus norvegicus
aagttcatgcggcttcctttaagaa

SEQ ID NO: 54372 - DNA, 25 bp, Rattus norvegicus
aagttcatgcgggttcctttaagaa

SEQ ID NO: 54373 - DNA, 25 bp, Rattus norvegicus
aagttcatggagaccttcaaggccc

SEQ ID NO: 54374 - DNA, 25 bp, Rattus norvegicus
aagttcatggagtccttcaaggccc

SEQ ID NO: 54375 - DNA, 25 bp, Rattus norvegicus
aagttcatgggtctttgccagcttc

SEQ ID NO: 54376 - DNA, 25 bp, Rattus norvegicus
aagttcatgggtgtttgccagcttc

SEQ ID NO: 54377 - DNA, 25 bp, Rattus norvegicus
aagttcatggttatcctcaagagtt

SEQ ID NO: 54378 - DNA, 25 bp, Rattus norvegicus
aagttcatggttttcctcaagagtt

SEQ ID NO: 54379 - DNA, 25 bp, Rattus norvegicus
aagttcatgtgaatacccaccatcc

SEQ ID NO: 54380 - DNA, 25 bp, Rattus norvegicus
aagttcatgtgattacccaccatcc

SEQ ID NO: 54381 - DNA, 25 bp, Rattus norvegicus
aagttcattccacaggtagccaggt

SEQ ID NO: 54382 - DNA, 25 bp, Rattus norvegicus
aagttcattccagaggtagccaggt

SEQ ID NO: 54383 - DNA, 25 bp, Rattus norvegicus
aagttcattgacatagcagccgcta

SEQ ID NO: 54384 - DNA, 25 bp, Rattus norvegicus
aagttcattgacttagcagccgcta

SEQ ID NO: 54385 - DNA, 25 bp, Rattus norvegicus
aagttcatttgcagcttctacaccg

SEQ ID NO: 54386 - DNA, 25 bp, Rattus norvegicus
aagttcatttgctgcttctacaccg

SEQ ID NO: 54387 - DNA, 25 bp, Rattus norvegicus
aagttccaaaggctgtgatctcaga

SEQ ID NO: 54388 - DNA, 25 bp, Rattus norvegicus
aagttccaaagggtgtgatctcaga

SEQ ID NO: 54389 - DNA, 25 bp, Rattus norvegicus
aagttccaaagtcctcctacagtct

SEQ ID NO: 54390 - DNA, 25 bp, Rattus norvegicus
aagttccaaagtgctcctacagtct

SEQ ID NO: 54391 - DNA, 25 bp, Rattus norvegicus
aagttccaacagaagccacaggctg

SEQ ID NO: 54392 - DNA, 25 bp, Rattus norvegicus
aagttccaacagtagccacaggctg

SEQ ID NO: 54393 - DNA, 25 bp, Rattus norvegicus
aagttccaagggatcgtggctctgc

SEQ ID NO: 54394 - DNA, 25 bp, Rattus norvegicus
aagttccaagggttcgtggctctgc

SEQ ID NO: 54395 - DNA, 25 bp, Rattus norvegicus
aagttccacacgaaacttcacttga

SEQ ID NO: 54396 - DNA, 25 bp, Rattus norvegicus
aagttccacacgtaacttcacttga

SEQ ID NO: 54397 - DNA, 25 bp, Rattus norvegicus
aagttccactacatggtgcacacgt

SEQ ID NO: 54398 - DNA, 25 bp, Rattus norvegicus
aagttccactacttggtgcacacgt

SEQ ID NO: 54399 - DNA, 25 bp, Rattus norvegicus
aagttccactgtaagttccaccatt

SEQ ID NO: 54400 - DNA, 25 bp, Rattus norvegicus
aagttccactgttagttccaccatt

SEQ ID NO: 54401 - DNA, 25 bp, Rattus norvegicus
aagttccacttccagagctttagtc

SEQ ID NO: 54402 - DNA, 25 bp, Rattus norvegicus
aagttccacttcgagagctttagtc

SEQ ID NO: 54403 - DNA, 25 bp, Rattus norvegicus
aagttccagagaagggacgtgccca

SEQ ID NO: 54404 - DNA, 25 bp, Rattus norvegicus
aagttccagagactttatctcctcc

SEQ ID NO: 54405 - DNA, 25 bp, Rattus norvegicus
aagttccagagagtttatctcctcc

SEQ ID NO: 54406 - DNA, 25 bp, Rattus norvegicus
aagttccagagatgggacgtgccca

SEQ ID NO: 54407 - DNA, 25 bp, Rattus norvegicus
aagttccagcttcttcaggaaacaa

SEQ ID NO: 54408 - DNA, 25 bp, Rattus norvegicus
aagttccagcttgttcaggaaacaa

SEQ ID NO: 54409 - DNA, 25 bp, Rattus norvegicus
aagttccaggaactcagctatttgt

SEQ ID NO: 54410 - DNA, 25 bp, Rattus norvegicus
aagttccaggaagtcagctatttgt

SEQ ID NO: 54411 - DNA, 25 bp, Rattus norvegicus
aagttccaggctcccaggtgaagca

SEQ ID NO: 54412 - DNA, 25 bp, Rattus norvegicus
aagttccaggctgccaggtgaagca

SEQ ID NO: 54413 - DNA, 25 bp, Rattus norvegicus
aagttccagtggacattgcttggca

SEQ ID NO: 54414 - DNA, 25 bp, Rattus norvegicus
aagttccagtggtcattgcttggca

SEQ ID NO: 54415 - DNA, 25 bp, Rattus norvegicus
aagttccagttcacatgccttctca

SEQ ID NO: 54416 - DNA, 25 bp, Rattus norvegicus
aagttccagttctcatgccttctca

SEQ ID NO: 54417 - DNA, 25 bp, Rattus norvegicus
aagttccagtttcagcgccttgggt

SEQ ID NO: 54418 - DNA, 25 bp, Rattus norvegicus
aagttccagtttgagcgccttgggt

SEQ ID NO: 54419 - DNA, 25 bp, Rattus norvegicus
aagttccattatcagccatctgcct

SEQ ID NO: 54420 - DNA, 25 bp, Rattus norvegicus
aagttccattatgagccatctgcct

SEQ ID NO: 54421 - DNA, 25 bp, Rattus norvegicus
aagttccattgccttggcgcaggtg

SEQ ID NO: 54422 - DNA, 25 bp, Rattus norvegicus
aagttccattgcgttggcgcaggtg

SEQ ID NO: 54423 - DNA, 25 bp, Rattus norvegicus
aagttcccacagaagggctggtagg

SEQ ID NO: 54424 - DNA, 25 bp, Rattus norvegicus
aagttcccacagtagggctggtagg

SEQ ID NO: 54425 - DNA, 25 bp, Rattus norvegicus
aagttcccagaaatgctgacccctg

SEQ ID NO: 54426 - DNA, 25 bp, Rattus norvegicus
aagttcccagaattgctgacccctg

SEQ ID NO: 54427 - DNA, 25 bp, Rattus norvegicus
aagttcccagataggtcatttccct

SEQ ID NO: 54428 - DNA, 25 bp, Rattus norvegicus
aagttcccagattggtcatttccct

SEQ ID NO: 54429 - DNA, 25 bp, Rattus norvegicus
aagttcccaggcaacaaaagagatg

SEQ ID NO: 54430 - DNA, 25 bp, Rattus norvegicus
aagttcccaggccaatatacattga

SEQ ID NO: 54431 - DNA, 25 bp, Rattus norvegicus
aagttcccaggcgaatatacattga

SEQ ID NO: 54432 - DNA, 25 bp, Rattus norvegicus
aagttcccaggctacaaaagagatg

SEQ ID NO: 54433 - DNA, 25 bp, Rattus norvegicus
aagttcccatcgctctgtgtagacc

SEQ ID NO: 54434 - DNA, 25 bp, Rattus norvegicus
aagttcccatcggtctgtgtagacc

SEQ ID NO: 54435 - DNA, 25 bp, Rattus norvegicus
aagttccctggtcaagcatgtctct

SEQ ID NO: 54436 - DNA, 25 bp, Rattus norvegicus
aagttccctggtgaagcatgtctct

SEQ ID NO: 54437 - DNA, 25 bp, Rattus norvegicus
aagttccctgtgaaaaggtctcgat

SEQ ID NO: 54438 - DNA, 25 bp, Rattus norvegicus
aagttccctgtgcatccttaaacag

SEQ ID NO: 54439 - DNA, 25 bp, Rattus norvegicus
aagttccctgtggatccttaaacag

SEQ ID NO: 54440 - DNA, 25 bp, Rattus norvegicus
aagttccctgtgtaaaggtctcgat

SEQ ID NO: 54441 - DNA, 25 bp, Rattus norvegicus
aagttccgaaggaatctctccatat

SEQ ID NO: 54442 - DNA, 25 bp, Rattus norvegicus
aagttccgaaggtatctctccatat

SEQ ID NO: 54443 - DNA, 25 bp, Rattus norvegicus
aagttccggtgtcctgtcttgaaaa

SEQ ID NO: 54444 - DNA, 25 bp, Rattus norvegicus
aagttccggtgtgctgtcttgaaaa

SEQ ID NO: 54445 - DNA, 25 bp, Rattus norvegicus
aagttccgttttcgacacagaccat

SEQ ID NO: 54446 - DNA, 25 bp, Rattus norvegicus
aagttccgttttggacacagaccat

SEQ ID NO: 54447 - DNA, 25 bp, Rattus norvegicus
aagttcctaacaaccccaaacagtg

SEQ ID NO: 54448 - DNA, 25 bp, Rattus norvegicus
aagttcctaacatccccaaacagtg

SEQ ID NO: 54449 - DNA, 25 bp, Rattus norvegicus
aagttcctagagagaccgccactat

SEQ ID NO: 54450 - DNA, 25 bp, Rattus norvegicus
aagttcctagagtgaccgccactat

SEQ ID NO: 54451 - DNA, 25 bp, Rattus norvegicus
aagttcctagctaagatgatgttca

SEQ ID NO: 54452 - DNA, 25 bp, Rattus norvegicus
aagttcctagcttagatgatgttca

SEQ ID NO: 54453 - DNA, 25 bp, Rattus norvegicus
aagttcctcaacaaaccacgtgccg

SEQ ID NO: 54454 - DNA, 25 bp, Rattus norvegicus
aagttcctcaactaaccacgtgccg

SEQ ID NO: 54455 - DNA, 25 bp, Rattus norvegicus
aagttcctcaatctgctgagtccca

SEQ ID NO: 54456 - DNA, 25 bp, Rattus norvegicus
aagttcctcaatgtgctgagtccca

SEQ ID NO: 54457 - DNA, 25 bp, Rattus norvegicus
aagttcctcaggatgggcacttgtc

SEQ ID NO: 54458 - DNA, 25 bp, Rattus norvegicus
aagttcctcaggttgggcacttgtc

SEQ ID NO: 54459 - DNA, 25 bp, Rattus norvegicus
aagttcctcctaagctaggtgtggt

SEQ ID NO: 54460 - DNA, 25 bp, Rattus norvegicus
aagttcctcctatgctaggtgtggt

SEQ ID NO: 54461 - DNA, 25 bp, Rattus norvegicus
aagttcctctgtactgcatttgtaa

SEQ ID NO: 54462 - DNA, 25 bp, Rattus norvegicus
aagttcctctgttctgcatttgtaa

SEQ ID NO: 54463 - DNA, 25 bp, Rattus norvegicus
aagttcctgacgctgtttctagcca

SEQ ID NO: 54464 - DNA, 25 bp, Rattus norvegicus
aagttcctgacggtgtttctagcca

SEQ ID NO: 54465 - DNA, 25 bp, Rattus norvegicus
aagttcctgctgagcttcctcgtgg

SEQ ID NO: 54466 - DNA, 25 bp, Rattus norvegicus
aagttcctgctgtgcttcctcgtgg

SEQ ID NO: 54467 - DNA, 25 bp, Rattus norvegicus
aagttcctggaacgtgaggtgccct

SEQ ID NO: 54468 - DNA, 25 bp, Rattus norvegicus
aagttcctggaaggtgaggtgccct

SEQ ID NO: 54469 - DNA, 25 bp, Rattus norvegicus
aagttcctggatcccaatagcctgg

SEQ ID NO: 54470 - DNA, 25 bp, Rattus norvegicus
aagttcctggatgccaatagcctgg

SEQ ID NO: 54471 - DNA, 25 bp, Rattus norvegicus
aagttcctggctaagcacagatcct

SEQ ID NO: 54472 - DNA, 25 bp, Rattus norvegicus
aagttcctggcttagcacagatcct

SEQ ID NO: 54473 - DNA, 25 bp, Rattus norvegicus
aagttcctggtcagttctgtgtgct

SEQ ID NO: 54474 - DNA, 25 bp, Rattus norvegicus
aagttcctggtctgttctgtgtgct

SEQ ID NO: 54475 - DNA, 25 bp, Rattus norvegicus
aagttcctggtgcaaggcgtgaaca

SEQ ID NO: 54476 - DNA, 25 bp, Rattus norvegicus
aagttcctggtggaaggcgtgaaca

SEQ ID NO: 54477 - DNA, 25 bp, Rattus norvegicus
aagttcctgtccattcatcaggcaa

SEQ ID NO: 54478 - DNA, 25 bp, Rattus norvegicus
aagttcctgtcctttcatcaggcaa

SEQ ID NO: 54479 - DNA, 25 bp, Rattus norvegicus
aagttcctgtggaagacccactcag

SEQ ID NO: 54480 - DNA, 25 bp, Rattus norvegicus
aagttcctgtggtagacccactcag

SEQ ID NO: 54481 - DNA, 25 bp, Rattus norvegicus
aagttcctgtgtcgctttggcctca

SEQ ID NO: 54482 - DNA, 25 bp, Rattus norvegicus
aagttcctgtgtggctttggcctca

SEQ ID NO: 54483 - DNA, 25 bp, Rattus norvegicus
aagttcctgttgaggttagctccca

SEQ ID NO: 54484 - DNA, 25 bp, Rattus norvegicus
aagttcctgttgtggttagctccca

SEQ ID NO: 54485 - DNA, 25 bp, Rattus norvegicus
aagttcctgtttacaaatcctgctt

SEQ ID NO: 54486 - DNA, 25 bp, Rattus norvegicus
aagttcctgttttcaaatcctgctt

SEQ ID NO: 54487 - DNA, 25 bp, Rattus norvegicus
aagttccttaagagatgatcctgct

SEQ ID NO: 54488 - DNA, 25 bp, Rattus norvegicus
aagttccttaagtgatgatcctgct

SEQ ID NO: 54489 - DNA, 25 bp, Rattus norvegicus
aagttccttgtacctgatcacgtga

SEQ ID NO: 54490 - DNA, 25 bp, Rattus norvegicus
aagttccttgtagctgatcacgtga

SEQ ID NO: 54491 - DNA, 25 bp, Rattus norvegicus
aagttcctttgtctcagatgagtca

SEQ ID NO: 54492 - DNA, 25 bp, Rattus norvegicus
aagttcctttgtgtcagatgagtca

SEQ ID NO: 54493 - DNA, 25 bp, Rattus norvegicus
aagttccttttccagtctgtctgta

SEQ ID NO: 54494 - DNA, 25 bp, Rattus norvegicus
aagttccttttcgagtctgtctgta

SEQ ID NO: 54495 - DNA, 25 bp, Rattus norvegicus
aagttcgagcgtcccagaggccgaa

SEQ ID NO: 54496 - DNA, 25 bp, Rattus norvegicus
aagttcgagcgtgccagaggccgaa

SEQ ID NO: 54497 - DNA, 25 bp, Rattus norvegicus
aagttcgatcagaaagaaagcttta

SEQ ID NO: 54498 - DNA, 25 bp, Rattus norvegicus
aagttcgatcagtaagaaagcttta

SEQ ID NO: 54499 - DNA, 25 bp, Rattus norvegicus
aagttcgcacgcaccagaagcaagt

SEQ ID NO: 54500 - DNA, 25 bp, Rattus norvegicus
aagttcgcacgctccagaagcaagt

SEQ ID NO: 54501 - DNA, 25 bp, Rattus norvegicus
aagttcgccaagctcatcgtggaga

SEQ ID NO: 54502 - DNA, 25 bp, Rattus norvegicus
aagttcgccaaggtcatcgtggaga

SEQ ID NO: 54503 - DNA, 25 bp, Rattus norvegicus
aagttcgccatgaatcccttttatg

SEQ ID NO: 54504 - DNA, 25 bp, Rattus norvegicus
aagttcgccatgtatcccttttatg

SEQ ID NO: 54505 - DNA, 25 bp, Rattus norvegicus
aagttcgccccaagagtcctgacag

SEQ ID NO: 54506 - DNA, 25 bp, Rattus norvegicus
aagttcgccccatgagtcctgacag

SEQ ID NO: 54507 - DNA, 25 bp, Rattus norvegicus
aagttcgccgggattatgaagccat

SEQ ID NO: 54508 - DNA, 25 bp, Rattus norvegicus
aagttcgccgggtttatgaagccat

SEQ ID NO: 54509 - DNA, 25 bp, Rattus norvegicus
aagttcgcgtgtcttggactaatca

SEQ ID NO: 54510 - DNA, 25 bp, Rattus norvegicus
aagttcgcgtgtgttggactaatca

SEQ ID NO: 54511 - DNA, 25 bp, Rattus norvegicus
aagttcgcttccagcggacgctggt

SEQ ID NO: 54512 - DNA, 25 bp, Rattus norvegicus
aagttcgcttcctgcggacgctggt

SEQ ID NO: 54513 - DNA, 25 bp, Rattus norvegicus
aagttcggctagaatttgtgtgttt

SEQ ID NO: 54514 - DNA, 25 bp, Rattus norvegicus
aagttcggctagtatttgtgtgttt

SEQ ID NO: 54515 - DNA, 25 bp, Rattus norvegicus
aagttcggcttgaacgacatccccg

SEQ ID NO: 54516 - DNA, 25 bp, Rattus norvegicus
aagttcggcttgtacgacatccccg

SEQ ID NO: 54517 - DNA, 25 bp, Rattus norvegicus
aagttcggtttcattgacatcactg

SEQ ID NO: 54518 - DNA, 25 bp, Rattus norvegicus
aagttcggtttctttgacatcactg

SEQ ID NO: 54519 - DNA, 25 bp, Rattus norvegicus
aagttcgtcatcactatcgacacta

SEQ ID NO: 54520 - DNA, 25 bp, Rattus norvegicus
aagttcgtcatctctatcgacacta

SEQ ID NO: 54521 - DNA, 25 bp, Rattus norvegicus
aagttcgtctgtcgtattgctgcag

SEQ ID NO: 54522 - DNA, 25 bp, Rattus norvegicus
aagttcgtctgtggtattgctgcag

SEQ ID NO: 54523 - DNA, 25 bp, Rattus norvegicus
aagttcgtgaccctgcagctcgtaa

SEQ ID NO: 54524 - DNA, 25 bp, Rattus norvegicus
aagttcgtgaccgtgcagctcgtaa

SEQ ID NO: 54525 - DNA, 25 bp, Rattus norvegicus
aagttcgtgcagatctggagatcta

SEQ ID NO: 54526 - DNA, 25 bp, Rattus norvegicus
aagttcgtgcagttctggagatcta

SEQ ID NO: 54527 - DNA, 25 bp, Rattus norvegicus
aagttcgtgcggctgcgcaacaagt

SEQ ID NO: 54528 - DNA, 25 bp, Rattus norvegicus
aagttcgtgcgggtgcgcaacaagt

SEQ ID NO: 54529 - DNA, 25 bp, Rattus norvegicus
aagttctaaacaattccgctgtagg

SEQ ID NO: 54530 - DNA, 25 bp, Rattus norvegicus
aagttctaaacacctctgccaacag

SEQ ID NO: 54531 - DNA, 25 bp, Rattus norvegicus
aagttctaaacagctctgccaacag

SEQ ID NO: 54532 - DNA, 25 bp, Rattus norvegicus
aagttctaaacatttccgctgtagg

SEQ ID NO: 54533 - DNA, 25 bp, Rattus norvegicus
aagttctaactactcttggcccatg

SEQ ID NO: 54534 - DNA, 25 bp, Rattus norvegicus
aagttctaactagtcttggcccatg

SEQ ID NO: 54535 - DNA, 25 bp, Rattus norvegicus
aagttctaccagagagcaggccgtc

SEQ ID NO: 54536 - DNA, 25 bp, Rattus norvegicus
aagttctaccagtgagcaggccgtc

SEQ ID NO: 54537 - DNA, 25 bp, Rattus norvegicus
aagttctagagacccaagtcctctt

SEQ ID NO: 54538 - DNA, 25 bp, Rattus norvegicus
aagttctagagagccaagtcctctt

SEQ ID NO: 54539 - DNA, 25 bp, Rattus norvegicus
aagttctagcacacaagagtcaaaa

SEQ ID NO: 54540 - DNA, 25 bp, Rattus norvegicus
aagttctagcactcaagagtcaaaa

SEQ ID NO: 54541 - DNA, 25 bp, Rattus norvegicus
aagttctagcttaagtgttggcact

SEQ ID NO: 54542 - DNA, 25 bp, Rattus norvegicus
aagttctagctttagtgttggcact

SEQ ID NO: 54543 - DNA, 25 bp, Rattus norvegicus
aagttctaggctagtctgggctact

SEQ ID NO: 54544 - DNA, 25 bp, Rattus norvegicus
aagttctaggcttgtctgggctact

SEQ ID NO: 54545 - DNA, 25 bp, Rattus norvegicus
aagttctagttcctgagtggcacct

SEQ ID NO: 54546 - DNA, 25 bp, Rattus norvegicus
aagttctagttcgtgagtggcacct

SEQ ID NO: 54547 - DNA, 25 bp, Rattus norvegicus
aagttctatattcgccatgacccat

SEQ ID NO: 54548 - DNA, 25 bp, Rattus norvegicus
aagttctatattggccatgacccat

SEQ ID NO: 54549 - DNA, 25 bp, Rattus norvegicus
aagttctatgccctggacaaagaag

SEQ ID NO: 54550 - DNA, 25 bp, Rattus norvegicus
aagttctatgccgtggacaaagaag

SEQ ID NO: 54551 - DNA, 25 bp, Rattus norvegicus
aagttctatttgcaaaggccacagt

SEQ ID NO: 54552 - DNA, 25 bp, Rattus norvegicus
aagttctatttggaaaggccacagt

SEQ ID NO: 54553 - DNA, 25 bp, Rattus norvegicus
aagttctcagaaagcagtcttcccc

SEQ ID NO: 54554 - DNA, 25 bp, Rattus norvegicus
aagttctcagaatgcagtcttcccc

SEQ ID NO: 54555 - DNA, 25 bp, Rattus norvegicus
aagttctcagccaatgtttctaatg

SEQ ID NO: 54556 - DNA, 25 bp, Rattus norvegicus
aagttctcagcctatgtttctaatg

SEQ ID NO: 54557 - DNA, 25 bp, Rattus norvegicus
aagttctcatcaaatctgagtcaga

SEQ ID NO: 54558 - DNA, 25 bp, Rattus norvegicus
aagttctcatcatatctgagtcaga

SEQ ID NO: 54559 - DNA, 25 bp, Rattus norvegicus
aagttctccacactggacagcgcag

SEQ ID NO: 54560 - DNA, 25 bp, Rattus norvegicus
aagttctccacagtggacagcgcag

SEQ ID NO: 54561 - DNA, 25 bp, Rattus norvegicus
aagttctccagcagcatctttgttg

SEQ ID NO: 54562 - DNA, 25 bp, Rattus norvegicus
aagttctccagctgcatctttgttg

SEQ ID NO: 54563 - DNA, 25 bp, Rattus norvegicus
aagttctcccatagaggactcttgc

SEQ ID NO: 54564 - DNA, 25 bp, Rattus norvegicus
aagttctcccattgaggactcttgc

SEQ ID NO: 54565 - DNA, 25 bp, Rattus norvegicus
aagttctcctccactacagaaagat

SEQ ID NO: 54566 - DNA, 25 bp, Rattus norvegicus
aagttctcctcctctacagaaagat

SEQ ID NO: 54567 - DNA, 25 bp, Rattus norvegicus
aagttctccttacccagaagctgga

SEQ ID NO: 54568 - DNA, 25 bp, Rattus norvegicus
aagttctccttagccagaagctgga

SEQ ID NO: 54569 - DNA, 25 bp, Rattus norvegicus
aagttctctagaaaagcagccagtg

SEQ ID NO: 54570 - DNA, 25 bp, Rattus norvegicus
aagttctctagataagcagccagtg

SEQ ID NO: 54571 - DNA, 25 bp, Rattus norvegicus
aagttctctatgacacagtccctgt

SEQ ID NO: 54572 - DNA, 25 bp, Rattus norvegicus
aagttctctatgtcacagtccctgt

SEQ ID NO: 54573 - DNA, 25 bp, Rattus norvegicus
aagttctctcagaggcaacaggcta

SEQ ID NO: 54574 - DNA, 25 bp, Rattus norvegicus
aagttctctcagtggcaacaggcta

SEQ ID NO: 54575 - DNA, 25 bp, Rattus norvegicus
aagttctcttctaactgcttttgca

SEQ ID NO: 54576 - DNA, 25 bp, Rattus norvegicus
aagttctcttcttactgcttttgca

SEQ ID NO: 54577 - DNA, 25 bp, Rattus norvegicus
aagttctctttgcttgcattgcata

SEQ ID NO: 54578 - DNA, 25 bp, Rattus norvegicus
aagttctctttggttgcattgcata

SEQ ID NO: 54579 - DNA, 25 bp, Rattus norvegicus
aagttctcttttctggtcattatgg

SEQ ID NO: 54580 - DNA, 25 bp, Rattus norvegicus
aagttctcttttgtggtcattatgg

SEQ ID NO: 54581 - DNA, 25 bp, Rattus norvegicus
aagttctgaaagacttcctcagcag

SEQ ID NO: 54582 - DNA, 25 bp, Rattus norvegicus
aagttctgaaagtcttcctcagcag

SEQ ID NO: 54583 - DNA, 25 bp, Rattus norvegicus
aagttctgagacatgctccagggct

SEQ ID NO: 54584 - DNA, 25 bp, Rattus norvegicus
aagttctgagacttgctccagggct

SEQ ID NO: 54585 - DNA, 25 bp, Rattus norvegicus
aagttctgagagagctcgggctgcc

SEQ ID NO: 54586 - DNA, 25 bp, Rattus norvegicus
aagttctgagagtgctcgggctgcc

SEQ ID NO: 54587 - DNA, 25 bp, Rattus norvegicus
aagttctgagcacagcacggccctc

SEQ ID NO: 54588 - DNA, 25 bp, Rattus norvegicus
aagttctgagcagagcacggccctc

SEQ ID NO: 54589 - DNA, 25 bp, Rattus norvegicus
aagttctgaggcagcagctcagtcg

SEQ ID NO: 54590 - DNA, 25 bp, Rattus norvegicus
aagttctgaggctgcagctcagtcg

SEQ ID NO: 54591 - DNA, 25 bp, Rattus norvegicus
aagttctgcaacagccatgtgctaa

SEQ ID NO: 54592 - DNA, 25 bp, Rattus norvegicus
aagttctgcaactgccatgtgctaa

SEQ ID NO: 54593 - DNA, 25 bp, Rattus norvegicus
aagttctgcagcacatttctctgaa

SEQ ID NO: 54594 - DNA, 25 bp, Rattus norvegicus
aagttctgcagctcatttctctgaa

SEQ ID NO: 54595 - DNA, 25 bp, Rattus norvegicus
aagttctgcgcgatattataatgct

SEQ ID NO: 54596 - DNA, 25 bp, Rattus norvegicus
aagttctgcgcgttattataatgct

SEQ ID NO: 54597 - DNA, 25 bp, Rattus norvegicus
aagttctggaacagctcttcctgta

SEQ ID NO: 54598 - DNA, 25 bp, Rattus norvegicus
aagttctggaactgctcttcctgta

SEQ ID NO: 54599 - DNA, 25 bp, Rattus norvegicus
aagttctggaagctctccaggccgt

SEQ ID NO: 54600 - DNA, 25 bp, Rattus norvegicus
aagttctggaaggtctccaggccgt

SEQ ID NO: 54601 - DNA, 25 bp, Rattus norvegicus
aagttctgggaaactggcgtctctc

SEQ ID NO: 54602 - DNA, 25 bp, Rattus norvegicus
aagttctgggaatctggcgtctctc

SEQ ID NO: 54603 - DNA, 25 bp, Rattus norvegicus
aagttctgggaccagagcctcccaa

SEQ ID NO: 54604 - DNA, 25 bp, Rattus norvegicus
aagttctgggacgagagcctcccaa

SEQ ID NO: 54605 - DNA, 25 bp, Rattus norvegicus
aagttctgggttacatcatgtttta

SEQ ID NO: 54606 - DNA, 25 bp, Rattus norvegicus
aagttctgggtttcatcatgtttta

SEQ ID NO: 54607 - DNA, 25 bp, Rattus norvegicus
aagttctgtactagtagactctcca

SEQ ID NO: 54608 - DNA, 25 bp, Rattus norvegicus
aagttctgtactctggcttccaagt

SEQ ID NO: 54609 - DNA, 25 bp, Rattus norvegicus
aagttctgtactgtggcttccaagt

SEQ ID NO: 54610 - DNA, 25 bp, Rattus norvegicus
aagttctgtacttgtagactctcca

SEQ ID NO: 54611 - DNA, 25 bp, Rattus norvegicus
aagttctgtcccatgcttggctgag

SEQ ID NO: 54612 - DNA, 25 bp, Rattus norvegicus
aagttctgtcccttgcttggctgag

SEQ ID NO: 54613 - DNA, 25 bp, Rattus norvegicus
aagttctgtgctacactagtgctac

SEQ ID NO: 54614 - DNA, 25 bp, Rattus norvegicus
aagttctgtgcttcactagtgctac

SEQ ID NO: 54615 - DNA, 25 bp, Rattus norvegicus
aagttctgtggaactaccatcgctg

SEQ ID NO: 54616 - DNA, 25 bp, Rattus norvegicus
aagttctgtggaattaccataacaa

SEQ ID NO: 54617 - DNA, 25 bp, Rattus norvegicus
aagttctgtggacacttcaagttcc

SEQ ID NO: 54618 - DNA, 25 bp, Rattus norvegicus
aagttctgtggagacttcaagttcc

SEQ ID NO: 54619 - DNA, 25 bp, Rattus norvegicus
aagttctgtggatctaccatcgctg

SEQ ID NO: 54620 - DNA, 25 bp, Rattus norvegicus
aagttctgtggatttaccataacaa

SEQ ID NO: 54621 - DNA, 25 bp, Rattus norvegicus
aagttctgtggcctggtgtgtcata

SEQ ID NO: 54622 - DNA, 25 bp, Rattus norvegicus
aagttctgtggcgtggtgtgtcata

SEQ ID NO: 54623 - DNA, 25 bp, Rattus norvegicus
aagttcttaaagagcccgcatgcat

SEQ ID NO: 54624 - DNA, 25 bp, Rattus norvegicus
aagttcttaaagtgcccgcatgcat

SEQ ID NO: 54625 - DNA, 25 bp, Rattus norvegicus
aagttcttaattattgctgtatagc

SEQ ID NO: 54626 - DNA, 25 bp, Rattus norvegicus
aagttcttaatttttgctgtatagc

SEQ ID NO: 54627 - DNA, 25 bp, Rattus norvegicus
aagttcttacagagaccctgtcagg

SEQ ID NO: 54628 - DNA, 25 bp, Rattus norvegicus
aagttcttacagtgaccctgtcagg

SEQ ID NO: 54629 - DNA, 25 bp, Rattus norvegicus
aagttcttcactcacctaaggtggg

SEQ ID NO: 54630 - DNA, 25 bp, Rattus norvegicus
aagttcttcactgacctaaggtggg

SEQ ID NO: 54631 - DNA, 25 bp, Rattus norvegicus
aagttcttcatcatcaagtagtgag

SEQ ID NO: 54632 - DNA, 25 bp, Rattus norvegicus
aagttcttcatcttcaagtagtgag

SEQ ID NO: 54633 - DNA, 25 bp, Rattus norvegicus
aagttcttccagatggtgggcctga

SEQ ID NO: 54634 - DNA, 25 bp, Rattus norvegicus
aagttcttccagttggtgggcctga

SEQ ID NO: 54635 - DNA, 25 bp, Rattus norvegicus
aagttcttcgtcatgttcttaccat

SEQ ID NO: 54636 - DNA, 25 bp, Rattus norvegicus
aagttcttcgtccttcagacagggt

SEQ ID NO: 54637 - DNA, 25 bp, Rattus norvegicus
aagttcttcgtcgttcagacagggt

SEQ ID NO: 54638 - DNA, 25 bp, Rattus norvegicus
aagttcttcgtcttgttcttaccat

SEQ ID NO: 54639 - DNA, 25 bp, Rattus norvegicus
aagttcttgagacaccggctcggta

SEQ ID NO: 54640 - DNA, 25 bp, Rattus norvegicus
aagttcttgagagaccggctcggta

SEQ ID NO: 54641 - DNA, 25 bp, Rattus norvegicus
aagttcttgctgcacctctggcaaa

SEQ ID NO: 54642 - DNA, 25 bp, Rattus norvegicus
aagttcttgctggacctctggcaaa

SEQ ID NO: 54643 - DNA, 25 bp, Rattus norvegicus
aagttcttggttcatctcttcctaa

SEQ ID NO: 54644 - DNA, 25 bp, Rattus norvegicus
aagttcttggttgatctcttcctaa

SEQ ID NO: 54645 - DNA, 25 bp, Rattus norvegicus
aagttctttagcagccttattagga

SEQ ID NO: 54646 - DNA, 25 bp, Rattus norvegicus
aagttctttagctgccttattagga

SEQ ID NO: 54647 - DNA, 25 bp, Rattus norvegicus
aagttctttattcatatgtgtcctg

SEQ ID NO: 54648 - DNA, 25 bp, Rattus norvegicus
aagttctttattgatatgtgtcctg

SEQ ID NO: 54649 - DNA, 25 bp, Rattus norvegicus
aagttctttgctcctgaatgtggcc

SEQ ID NO: 54650 - DNA, 25 bp, Rattus norvegicus
aagttctttgctccttctgacctga

SEQ ID NO: 54651 - DNA, 25 bp, Rattus norvegicus
aagttctttgctgctgaatgtggcc

SEQ ID NO: 54652 - DNA, 25 bp, Rattus norvegicus
aagttctttgctgcttctgacctga

SEQ ID NO: 54653 - DNA, 25 bp, Rattus norvegicus
aagttctttgtcattgagcaggcaa

SEQ ID NO: 54654 - DNA, 25 bp, Rattus norvegicus
aagttctttgtctttgagcaggcaa

SEQ ID NO: 54655 - DNA, 25 bp, Rattus norvegicus
aagttcttttgaaatgattggccaa

SEQ ID NO: 54656 - DNA, 25 bp, Rattus norvegicus
aagttcttttgatatgattggccaa

SEQ ID NO: 54657 - DNA, 25 bp, Rattus norvegicus
aagttgaaacggctcacggttctgg

SEQ ID NO: 54658 - DNA, 25 bp, Rattus norvegicus
aagttgaaacgggtcacggttctgg

SEQ ID NO: 54659 - DNA, 25 bp, Rattus norvegicus
aagttgaacactagtcttttgatga

SEQ ID NO: 54660 - DNA, 25 bp, Rattus norvegicus
aagttgaacacttgtcttttgatga

SEQ ID NO: 54661 - DNA, 25 bp, Rattus norvegicus
aagttgaacttcagtattgctattc

SEQ ID NO: 54662 - DNA, 25 bp, Rattus norvegicus
aagttgaacttctgtattgctattc

SEQ ID NO: 54663 - DNA, 25 bp, Rattus norvegicus
aagttgaagagccactgtccttcta

SEQ ID NO: 54664 - DNA, 25 bp, Rattus norvegicus
aagttgaagagcgactgtccttcta

SEQ ID NO: 54665 - DNA, 25 bp, Rattus norvegicus
aagttgaagccacccttacaggata

SEQ ID NO: 54666 - DNA, 25 bp, Rattus norvegicus
aagttgaagccagccttacaggata

SEQ ID NO: 54667 - DNA, 25 bp, Rattus norvegicus
aagttgacaactcccgcgacccgag

SEQ ID NO: 54668 - DNA, 25 bp, Rattus norvegicus
aagttgacaactgccgcgacccgag

SEQ ID NO: 54669 - DNA, 25 bp, Rattus norvegicus
aagttgacagccaagattgcccacc

SEQ ID NO: 54670 - DNA, 25 bp, Rattus norvegicus
aagttgacagcctagattgcccacc

SEQ ID NO: 54671 - DNA, 25 bp, Rattus norvegicus
aagttgacattgctcttgctgggag

SEQ ID NO: 54672 - DNA, 25 bp, Rattus norvegicus
aagttgacattggtcttgctgggag

SEQ ID NO: 54673 - DNA, 25 bp, Rattus norvegicus
aagttgacctggcagcatctgtttc

SEQ ID NO: 54674 - DNA, 25 bp, Rattus norvegicus
aagttgacctgggagcatctgtttc

SEQ ID NO: 54675 - DNA, 25 bp, Rattus norvegicus
aagttgacgattcctctgggtctat

SEQ ID NO: 54676 - DNA, 25 bp, Rattus norvegicus
aagttgacgattgctctgggtctat

SEQ ID NO: 54677 - DNA, 25 bp, Rattus norvegicus
aagttgactctgcatacttggctta

SEQ ID NO: 54678 - DNA, 25 bp, Rattus norvegicus
aagttgactctggatacttggctta

SEQ ID NO: 54679 - DNA, 25 bp, Rattus norvegicus
aagttgactgtgacttttgttttca

SEQ ID NO: 54680 - DNA, 25 bp, Rattus norvegicus
aagttgactgtgtcttttgttttca

SEQ ID NO: 54681 - DNA, 25 bp, Rattus norvegicus
aagttgagagacacactccacttcc

SEQ ID NO: 54682 - DNA, 25 bp, Rattus norvegicus
aagttgagagactcactccacttcc

SEQ ID NO: 54683 - DNA, 25 bp, Rattus norvegicus
aagttgagctagacctcggtcgctg

SEQ ID NO: 54684 - DNA, 25 bp, Rattus norvegicus
aagttgagctagtcctcggtcgctg

SEQ ID NO: 54685 - DNA, 25 bp, Rattus norvegicus
aagttgaggcacacttctgcactgg

SEQ ID NO: 54686 - DNA, 25 bp, Rattus norvegicus
aagttgaggcactcttctgcactgg

SEQ ID NO: 54687 - DNA, 25 bp, Rattus norvegicus
aagttgagtcccacttgagcacaga

SEQ ID NO: 54688 - DNA, 25 bp, Rattus norvegicus
aagttgagtccctcttgagcacaga

SEQ ID NO: 54689 - DNA, 25 bp, Rattus norvegicus
aagttgagtcttccgtattcacgca

SEQ ID NO: 54690 - DNA, 25 bp, Rattus norvegicus
aagttgagtcttgcgtattcacgca

SEQ ID NO: 54691 - DNA, 25 bp, Rattus norvegicus
aagttgagttccagttgtgagggca

SEQ ID NO: 54692 - DNA, 25 bp, Rattus norvegicus
aagttgagttcctgttgtgagggca

SEQ ID NO: 54693 - DNA, 25 bp, Rattus norvegicus
aagttgatctttccctgtcatgaga

SEQ ID NO: 54694 - DNA, 25 bp, Rattus norvegicus
aagttgatctttgcctgtcatgaga

SEQ ID NO: 54695 - DNA, 25 bp, Rattus norvegicus
aagttgatgcaacgctgcagggact

SEQ ID NO: 54696 - DNA, 25 bp, Rattus norvegicus
aagttgatgcaaggctgcagggact

SEQ ID NO: 54697 - DNA, 25 bp, Rattus norvegicus
aagttgatggaaacgggccacagcc

SEQ ID NO: 54698 - DNA, 25 bp, Rattus norvegicus
aagttgatggaatcgggccacagcc

SEQ ID NO: 54699 - DNA, 25 bp, Rattus norvegicus
aagttgatggctcccactccacagg

SEQ ID NO: 54700 - DNA, 25 bp, Rattus norvegicus
aagttgatggctgccactccacagg

SEQ ID NO: 54701 - DNA, 25 bp, Rattus norvegicus
aagttgatggtgatccagtttacag

SEQ ID NO: 54702 - DNA, 25 bp, Rattus norvegicus
aagttgatggtgttccagtttacag

SEQ ID NO: 54703 - DNA, 25 bp, Rattus norvegicus
aagttgatgttccttctgtcagcaa

SEQ ID NO: 54704 - DNA, 25 bp, Rattus norvegicus
aagttgatgttcgttctgtcagcaa

SEQ ID NO: 54705 - DNA, 25 bp, Rattus norvegicus
aagttgattactatgtagtgctgag

SEQ ID NO: 54706 - DNA, 25 bp, Rattus norvegicus
aagttgattactttgtagtgctgag

SEQ ID NO: 54707 - DNA, 25 bp, Rattus norvegicus
aagttgattttgatgctgagcccag

SEQ ID NO: 54708 - DNA, 25 bp, Rattus norvegicus
aagttgattttgttgctgagcccag

SEQ ID NO: 54709 - DNA, 25 bp, Rattus norvegicus
aagttgcaaagaagactgtgtccgg

SEQ ID NO: 54710 - DNA, 25 bp, Rattus norvegicus
aagttgcaaagatgactgtgtccgg

SEQ ID NO: 54711 - DNA, 25 bp, Rattus norvegicus
aagttgcaccggcttttactcaaga

SEQ ID NO: 54712 - DNA, 25 bp, Rattus norvegicus
aagttgcaccgggttttactcaaga

SEQ ID NO: 54713 - DNA, 25 bp, Rattus norvegicus
aagttgcacgcaccttaggtctgta

SEQ ID NO: 54714 - DNA, 25 bp, Rattus norvegicus
aagttgcacgcagcttaggtctgta

SEQ ID NO: 54715 - DNA, 25 bp, Rattus norvegicus
aagttgcattctagccaaattcccc

SEQ ID NO: 54716 - DNA, 25 bp, Rattus norvegicus
aagttgcattcttgccaaattcccc

SEQ ID NO: 54717 - DNA, 25 bp, Rattus norvegicus
aagttgcatttacaaccctccttgg

SEQ ID NO: 54718 - DNA, 25 bp, Rattus norvegicus
aagttgcatttagaaccctccttgg

SEQ ID NO: 54719 - DNA, 25 bp, Rattus norvegicus
aagttgccacatcgaattctgtgta

SEQ ID NO: 54720 - DNA, 25 bp, Rattus norvegicus
aagttgccacatggaattctgtgta

SEQ ID NO: 54721 - DNA, 25 bp, Rattus norvegicus
aagttgccatcgatcctcttgagtc

SEQ ID NO: 54722 - DNA, 25 bp, Rattus norvegicus
aagttgccatcgttcctcttgagtc

SEQ ID NO: 54723 - DNA, 25 bp, Rattus norvegicus
aagttgcccaggatggctctatttt

SEQ ID NO: 54724 - DNA, 25 bp, Rattus norvegicus
aagttgcccaggttggctctatttt

SEQ ID NO: 54725 - DNA, 25 bp, Rattus norvegicus
aagttgccctagagactgctgagtc

SEQ ID NO: 54726 - DNA, 25 bp, Rattus norvegicus
aagttgccctagtgactgctgagtc

SEQ ID NO: 54727 - DNA, 25 bp, Rattus norvegicus
aagttgccgaggagatcgcactgcc

SEQ ID NO: 54728 - DNA, 25 bp, Rattus norvegicus
aagttgccgaggtgatcgcactgcc

SEQ ID NO: 54729 - DNA, 25 bp, Rattus norvegicus
aagttgcctaaaaccatttggaaat

SEQ ID NO: 54730 - DNA, 25 bp, Rattus norvegicus
aagttgcctaaatccatttggaaat

SEQ ID NO: 54731 - DNA, 25 bp, Rattus norvegicus
aagttgcctcccaactagcactttt

SEQ ID NO: 54732 - DNA, 25 bp, Rattus norvegicus
aagttgcctccctactagcactttt

SEQ ID NO: 54733 - DNA, 25 bp, Rattus norvegicus
aagttgcctggaagctttgtggttt

SEQ ID NO: 54734 - DNA, 25 bp, Rattus norvegicus
aagttgcctggatgctttgtggttt

SEQ ID NO: 54735 - DNA, 25 bp, Rattus norvegicus
aagttgccttacactgttagctgca

SEQ ID NO: 54736 - DNA, 25 bp, Rattus norvegicus
aagttgccttactctgttagctgca

SEQ ID NO: 54737 - DNA, 25 bp, Rattus norvegicus
aagttgccttgaaggcacattatga

SEQ ID NO: 54738 - DNA, 25 bp, Rattus norvegicus
aagttgccttgatggcacattatga

SEQ ID NO: 54739 - DNA, 25 bp, Rattus norvegicus
aagttgcgcaacaggcaccatggcc

SEQ ID NO: 54740 - DNA, 25 bp, Rattus norvegicus
aagttgcgcaactggcaccatggcc

SEQ ID NO: 54741 - DNA, 25 bp, Rattus norvegicus
aagttgctaagaccgtttgtccttt

SEQ ID NO: 54742 - DNA, 25 bp, Rattus norvegicus
aagttgctaagagcgtttgtccttt

SEQ ID NO: 54743 - DNA, 25 bp, Rattus norvegicus
aagttgctacagagtctgtgctgcc

SEQ ID NO: 54744 - DNA, 25 bp, Rattus norvegicus
aagttgctacagtgtctgtgctgcc

SEQ ID NO: 54745 - DNA, 25 bp, Rattus norvegicus
aagttgctatctcagacttgcctca

SEQ ID NO: 54746 - DNA, 25 bp, Rattus norvegicus
aagttgctatctgagacttgcctca

SEQ ID NO: 54747 - DNA, 25 bp, Rattus norvegicus
aagttgctattcaggttttctatac

SEQ ID NO: 54748 - DNA, 25 bp, Rattus norvegicus
aagttgctattctggttttctatac

SEQ ID NO: 54749 - DNA, 25 bp, Rattus norvegicus
aagttgctcatcatactggtttaac

SEQ ID NO: 54750 - DNA, 25 bp, Rattus norvegicus
aagttgctcatcttactggtttaac

SEQ ID NO: 54751 - DNA, 25 bp, Rattus norvegicus
aagttgctccttcgctgtggacaga

SEQ ID NO: 54752 - DNA, 25 bp, Rattus norvegicus
aagttgctccttggctgtggacaga

SEQ ID NO: 54753 - DNA, 25 bp, Rattus norvegicus
aagttgctcggacgctgtttgaacc

SEQ ID NO: 54754 - DNA, 25 bp, Rattus norvegicus
aagttgctcggaggctgtttgaacc

SEQ ID NO: 54755 - DNA, 25 bp, Rattus norvegicus
aagttgctcgggactactagctacc

SEQ ID NO: 54756 - DNA, 25 bp, Rattus norvegicus
aagttgctcgggtctactagctacc

SEQ ID NO: 54757 - DNA, 25 bp, Rattus norvegicus
aagttgctctagctagatcaacggg

SEQ ID NO: 54758 - DNA, 25 bp, Rattus norvegicus
aagttgctctaggtagatcaacggg

SEQ ID NO: 54759 - DNA, 25 bp, Rattus norvegicus
aagttgctcttgacctttctgttca

SEQ ID NO: 54760 - DNA, 25 bp, Rattus norvegicus
aagttgctcttgtcctttctgttca

SEQ ID NO: 54761 - DNA, 25 bp, Rattus norvegicus
aagttgctctttacagacctgcagt

SEQ ID NO: 54762 - DNA, 25 bp, Rattus norvegicus
aagttgctctttcatgttttgtcta

SEQ ID NO: 54763 - DNA, 25 bp, Rattus norvegicus
aagttgctctttctcagggtgttat

SEQ ID NO: 54764 - DNA, 25 bp, Rattus norvegicus
aagttgctctttgatgttttgtcta

SEQ ID NO: 54765 - DNA, 25 bp, Rattus norvegicus
aagttgctctttgtcagggtgttat

SEQ ID NO: 54766 - DNA, 25 bp, Rattus norvegicus
aagttgctcttttcagacctgcagt

SEQ ID NO: 54767 - DNA, 25 bp, Rattus norvegicus
aagttgctgctccaccggccatttt

SEQ ID NO: 54768 - DNA, 25 bp, Rattus norvegicus
aagttgctgctcgaccggccatttt

SEQ ID NO: 54769 - DNA, 25 bp, Rattus norvegicus
aagttgctggatcacctcttccgta

SEQ ID NO: 54770 - DNA, 25 bp, Rattus norvegicus
aagttgctggatgacctcttccgta

SEQ ID NO: 54771 - DNA, 25 bp, Rattus norvegicus
aagttgctggccatacagacctact

SEQ ID NO: 54772 - DNA, 25 bp, Rattus norvegicus
aagttgctggccttacagacctact

SEQ ID NO: 54773 - DNA, 25 bp, Rattus norvegicus
aagttgctggtgcatgctgaccctc

SEQ ID NO: 54774 - DNA, 25 bp, Rattus norvegicus
aagttgctggtggatgctgaccctc

SEQ ID NO: 54775 - DNA, 25 bp, Rattus norvegicus
aagttgctgtgcatagtgataaaac

SEQ ID NO: 54776 - DNA, 25 bp, Rattus norvegicus
aagttgctgtgcttagtgataaaac

SEQ ID NO: 54777 - DNA, 25 bp, Rattus norvegicus
aagttgcttctcatttgttgatcgc

SEQ ID NO: 54778 - DNA, 25 bp, Rattus norvegicus
aagttgcttctcttttgttgatcgc

SEQ ID NO: 54779 - DNA, 25 bp, Rattus norvegicus
aagttgcttctgcacaggaatcccc

SEQ ID NO: 54780 - DNA, 25 bp, Rattus norvegicus
aagttgcttctggacaggaatcccc

SEQ ID NO: 54781 - DNA, 25 bp, Rattus norvegicus
aagttgcttgaacggcttttggaca

SEQ ID NO: 54782 - DNA, 25 bp, Rattus norvegicus
aagttgcttgaagggcttttggaca

SEQ ID NO: 54783 - DNA, 25 bp, Rattus norvegicus
aagttgcttgcacagcagcatcccc

SEQ ID NO: 54784 - DNA, 25 bp, Rattus norvegicus
aagttgcttgcaccagttcccaggt

SEQ ID NO: 54785 - DNA, 25 bp, Rattus norvegicus
aagttgcttgcagagcagcatcccc

SEQ ID NO: 54786 - DNA, 25 bp, Rattus norvegicus
aagttgcttgcagcagttcccaggt

SEQ ID NO: 54787 - DNA, 25 bp, Rattus norvegicus
aagttgcttgtgacttagtttccct

SEQ ID NO: 54788 - DNA, 25 bp, Rattus norvegicus
aagttgcttgtgtcttagtttccct

SEQ ID NO: 54789 - DNA, 25 bp, Rattus norvegicus
aagttgctttgtctcgtccactaaa

SEQ ID NO: 54790 - DNA, 25 bp, Rattus norvegicus
aagttgctttgtgtcgtccactaaa

SEQ ID NO: 54791 - DNA, 25 bp, Rattus norvegicus
aagttggaagaaccccagcgctccc

SEQ ID NO: 54792 - DNA, 25 bp, Rattus norvegicus
aagttggaagaagcccagcgctccc

SEQ ID NO: 54793 - DNA, 25 bp, Rattus norvegicus
aagttggacagaaaagacaggtcag

SEQ ID NO: 54794 - DNA, 25 bp, Rattus norvegicus
aagttggacagataagacaggtcag

SEQ ID NO: 54795 - DNA, 25 bp, Rattus norvegicus
aagttggactcccaggcggtaatgc

SEQ ID NO: 54796 - DNA, 25 bp, Rattus norvegicus
aagttggactccgaggcggtaatgc

SEQ ID NO: 54797 - DNA, 25 bp, Rattus norvegicus
aagttggagagcaccctgagttaca

SEQ ID NO: 54798 - DNA, 25 bp, Rattus norvegicus
aagttggagagctccctgagttaca

SEQ ID NO: 54799 - DNA, 25 bp, Rattus norvegicus
aagttggagaggcagctcctgcttc

SEQ ID NO: 54800 - DNA, 25 bp, Rattus norvegicus
aagttggagagggagctcctgcttc

SEQ ID NO: 54801 - DNA, 25 bp, Rattus norvegicus
aagttggagatgcttcagattctga

SEQ ID NO: 54802 - DNA, 25 bp, Rattus norvegicus
aagttggagatggttcagattctga

SEQ ID NO: 54803 - DNA, 25 bp, Rattus norvegicus
aagttggagctcacatgggaaggaa

SEQ ID NO: 54804 - DNA, 25 bp, Rattus norvegicus
aagttggagctctcatgggaaggaa

SEQ ID NO: 54805 - DNA, 25 bp, Rattus norvegicus
aagttggaggccaggctgtctatgc

SEQ ID NO: 54806 - DNA, 25 bp, Rattus norvegicus
aagttggaggcctggctgtctatgc

SEQ ID NO: 54807 - DNA, 25 bp, Rattus norvegicus
aagttggatactcgaccaggctcaa

SEQ ID NO: 54808 - DNA, 25 bp, Rattus norvegicus
aagttggatactggaccaggctcaa

SEQ ID NO: 54809 - DNA, 25 bp, Rattus norvegicus
aagttggcaacgatgctgtcttcct

SEQ ID NO: 54810 - DNA, 25 bp, Rattus norvegicus
aagttggcaacgttgctgtcttcct

SEQ ID NO: 54811 - DNA, 25 bp, Rattus norvegicus
aagttggcaactctggagtcttccg

SEQ ID NO: 54812 - DNA, 25 bp, Rattus norvegicus
aagttggcaactgtggagtcttccg

SEQ ID NO: 54813 - DNA, 25 bp, Rattus norvegicus
aagttggccaggaaattcaggtcaa

SEQ ID NO: 54814 - DNA, 25 bp, Rattus norvegicus
aagttggccaggtaattcaggtcaa

SEQ ID NO: 54815 - DNA, 25 bp, Rattus norvegicus
aagttggcccagagtgacagctttc

SEQ ID NO: 54816 - DNA, 25 bp, Rattus norvegicus
aagttggcccagtgtgacagctttc

SEQ ID NO: 54817 - DNA, 25 bp, Rattus norvegicus
aagttggccctacagctacatatgg

SEQ ID NO: 54818 - DNA, 25 bp, Rattus norvegicus
aagttggccctagagctacatatgg

SEQ ID NO: 54819 - DNA, 25 bp, Rattus norvegicus
aagttggcctggattgtgggctcta

SEQ ID NO: 54820 - DNA, 25 bp, Rattus norvegicus
aagttggcctggcataagctgcccc

SEQ ID NO: 54821 - DNA, 25 bp, Rattus norvegicus
aagttggcctgggataagctgcccc

SEQ ID NO: 54822 - DNA, 25 bp, Rattus norvegicus
aagttggcctggtttgtgggctcta

SEQ ID NO: 54823 - DNA, 25 bp, Rattus norvegicus
aagttggcctttcattcagctgaac

SEQ ID NO: 54824 - DNA, 25 bp, Rattus norvegicus
aagttggcctttgattcagctgaac

SEQ ID NO: 54825 - DNA, 25 bp, Rattus norvegicus
aagttggctccaagggtcaccttga

SEQ ID NO: 54826 - DNA, 25 bp, Rattus norvegicus
aagttggctccatgggtcaccttga

SEQ ID NO: 54827 - DNA, 25 bp, Rattus norvegicus
aagttggctcctatgttgctagaca

SEQ ID NO: 54828 - DNA, 25 bp, Rattus norvegicus
aagttggctcctcacatgacagtgg

SEQ ID NO: 54829 - DNA, 25 bp, Rattus norvegicus
aagttggctcctgacatgacagtgg

SEQ ID NO: 54830 - DNA, 25 bp, Rattus norvegicus
aagttggctcctttgttgctagaca

SEQ ID NO: 54831 - DNA, 25 bp, Rattus norvegicus
aagttggctcttctattgtcttaag

SEQ ID NO: 54832 - DNA, 25 bp, Rattus norvegicus
aagttggctcttgtattgtcttaag

SEQ ID NO: 54833 - DNA, 25 bp, Rattus norvegicus
aagttggctgacagaacgtttttgt

SEQ ID NO: 54834 - DNA, 25 bp, Rattus norvegicus
aagttggctgactgaacgtttttgt

SEQ ID NO: 54835 - DNA, 25 bp, Rattus norvegicus
aagttggctgcgcacacctttccag

SEQ ID NO: 54836 - DNA, 25 bp, Rattus norvegicus
aagttggctgcggacacctttccag

SEQ ID NO: 54837 - DNA, 25 bp, Rattus norvegicus
aagttggctgttctggctgacatat

SEQ ID NO: 54838 - DNA, 25 bp, Rattus norvegicus
aagttggctgttgtggctgacatat

SEQ ID NO: 54839 - DNA, 25 bp, Rattus norvegicus
aagttggcttttctccttctgggat

SEQ ID NO: 54840 - DNA, 25 bp, Rattus norvegicus
aagttggcttttgtccttctgggat

SEQ ID NO: 54841 - DNA, 25 bp, Rattus norvegicus
aagttgggactacccacatcttcac

SEQ ID NO: 54842 - DNA, 25 bp, Rattus norvegicus
aagttgggactagccacatcttcac

SEQ ID NO: 54843 - DNA, 25 bp, Rattus norvegicus
aagttgggacttcgacctggcctga

SEQ ID NO: 54844 - DNA, 25 bp, Rattus norvegicus
aagttgggacttggacctggcctga

SEQ ID NO: 54845 - DNA, 25 bp, Rattus norvegicus
aagttgggatgcagtgaattgacac

SEQ ID NO: 54846 - DNA, 25 bp, Rattus norvegicus
aagttgggatgctgtgaattgacac

SEQ ID NO: 54847 - DNA, 25 bp, Rattus norvegicus
aagttgggcagacactgaggctcca

SEQ ID NO: 54848 - DNA, 25 bp, Rattus norvegicus
aagttgggcagagactgaggctcca

SEQ ID NO: 54849 - DNA, 25 bp, Rattus norvegicus
aagttgggctggatccaggacccca

SEQ ID NO: 54850 - DNA, 25 bp, Rattus norvegicus
aagttgggctggttccaggacccca

SEQ ID NO: 54851 - DNA, 25 bp, Rattus norvegicus
aagttgggctttcctgataggtcct

SEQ ID NO: 54852 - DNA, 25 bp, Rattus norvegicus
aagttgggctttgctgataggtcct

SEQ ID NO: 54853 - DNA, 25 bp, Rattus norvegicus
aagttgggtatgagtagttcttgct

SEQ ID NO: 54854 - DNA, 25 bp, Rattus norvegicus
aagttgggtatgtgtagttcttgct

SEQ ID NO: 54855 - DNA, 25 bp, Rattus norvegicus
aagttgggtcgtcagtcacctggca

SEQ ID NO: 54856 - DNA, 25 bp, Rattus norvegicus
aagttgggtcgtgagtcacctggca

SEQ ID NO: 54857 - DNA, 25 bp, Rattus norvegicus
aagttgggtgttcagctgctctgtc

SEQ ID NO: 54858 - DNA, 25 bp, Rattus norvegicus
aagttgggtgttgagctgctctgtc

SEQ ID NO: 54859 - DNA, 25 bp, Rattus norvegicus
aagttgggtttcacgcaagccgacg

SEQ ID NO: 54860 - DNA, 25 bp, Rattus norvegicus
aagttgggtttctcgcaagccgacg

SEQ ID NO: 54861 - DNA, 25 bp, Rattus norvegicus
aagttggtacaaacactgtggacat

SEQ ID NO: 54862 - DNA, 25 bp, Rattus norvegicus
aagttggtacaatcactgtggacat

SEQ ID NO: 54863 - DNA, 25 bp, Rattus norvegicus
aagttggtcaatacagcctgaggcc

SEQ ID NO: 54864 - DNA, 25 bp, Rattus norvegicus
aagttggtcaattcagcctgaggcc

SEQ ID NO: 54865 - DNA, 25 bp, Rattus norvegicus
aagttggtctctcctgtgtggttct

SEQ ID NO: 54866 - DNA, 25 bp, Rattus norvegicus
aagttggtctctgctgtgtggttct

SEQ ID NO: 54867 - DNA, 25 bp, Rattus norvegicus
aagttggtgcggatttgctttatca

SEQ ID NO: 54868 - DNA, 25 bp, Rattus norvegicus
aagttggtgcggttttgctttatca

SEQ ID NO: 54869 - DNA, 25 bp, Rattus norvegicus
aagttggtgggcaacgggcgtgagg

SEQ ID NO: 54870 - DNA, 25 bp, Rattus norvegicus
aagttggtgggctacgggcgtgagg

SEQ ID NO: 54871 - DNA, 25 bp, Rattus norvegicus
aagttggtgtagctgtcccaagcct

SEQ ID NO: 54872 - DNA, 25 bp, Rattus norvegicus
aagttggtgtaggtgtcccaagcct

SEQ ID NO: 54873 - DNA, 25 bp, Rattus norvegicus
aagttggtgttgctttaaatgtatc

SEQ ID NO: 54874 - DNA, 25 bp, Rattus norvegicus
aagttggtgttggtttaaatgtatc

SEQ ID NO: 54875 - DNA, 25 bp, Rattus norvegicus
aagttggttcttcgctgtcagtgaa

SEQ ID NO: 54876 - DNA, 25 bp, Rattus norvegicus
aagttggttcttggctgtcagtgaa

SEQ ID NO: 54877 - DNA, 25 bp, Rattus norvegicus
aagttgtaacacacagtttctctgg

SEQ ID NO: 54878 - DNA, 25 bp, Rattus norvegicus
aagttgtaacactcagtttctctgg

SEQ ID NO: 54879 - DNA, 25 bp, Rattus norvegicus
aagttgtatattattcacccctgat

SEQ ID NO: 54880 - DNA, 25 bp, Rattus norvegicus
aagttgtatatttttcacccctgat

SEQ ID NO: 54881 - DNA, 25 bp, Rattus norvegicus
aagttgtatctcatttggctgtgca

SEQ ID NO: 54882 - DNA, 25 bp, Rattus norvegicus
aagttgtatctcttttggctgtgca

SEQ ID NO: 54883 - DNA, 25 bp, Rattus norvegicus
aagttgtcaccgaggcctatgcatc

SEQ ID NO: 54884 - DNA, 25 bp, Rattus norvegicus
aagttgtcaccgcacttaggctgca

SEQ ID NO: 54885 - DNA, 25 bp, Rattus norvegicus
aagttgtcaccggacttaggctgca

SEQ ID NO: 54886 - DNA, 25 bp, Rattus norvegicus
aagttgtcaccgtggcctatgcatc

SEQ ID NO: 54887 - DNA, 25 bp, Rattus norvegicus
aagttgtcccttaactatgcacatg

SEQ ID NO: 54888 - DNA, 25 bp, Rattus norvegicus
aagttgtccctttactatgcacatg

SEQ ID NO: 54889 - DNA, 25 bp, Rattus norvegicus
aagttgtcctctcgttctctaccta

SEQ ID NO: 54890 - DNA, 25 bp, Rattus norvegicus
aagttgtcctctggttctctaccta

SEQ ID NO: 54891 - DNA, 25 bp, Rattus norvegicus
aagttgtcctgcacctgtctgggag

SEQ ID NO: 54892 - DNA, 25 bp, Rattus norvegicus
aagttgtcctgctcctgtctgggag

SEQ ID NO: 54893 - DNA, 25 bp, Rattus norvegicus
aagttgtccttgaaggtcaccgagt

SEQ ID NO: 54894 - DNA, 25 bp, Rattus norvegicus
aagttgtccttgcacctcattacat

SEQ ID NO: 54895 - DNA, 25 bp, Rattus norvegicus
aagttgtccttggacctcattacat

SEQ ID NO: 54896 - DNA, 25 bp, Rattus norvegicus
aagttgtccttgtaggtcaccgagt

SEQ ID NO: 54897 - DNA, 25 bp, Rattus norvegicus
aagttgtcggacacaccagccccta

SEQ ID NO: 54898 - DNA, 25 bp, Rattus norvegicus
aagttgtcggactcaccagccccta

SEQ ID NO: 54899 - DNA, 25 bp, Rattus norvegicus
aagttgtcgggaccatggagcacac

SEQ ID NO: 54900 - DNA, 25 bp, Rattus norvegicus
aagttgtcgggagcatggagcacac

SEQ ID NO: 54901 - DNA, 25 bp, Rattus norvegicus
aagttgtctctccacagtctcttag

SEQ ID NO: 54902 - DNA, 25 bp, Rattus norvegicus
aagttgtctctcgacagtctcttag

SEQ ID NO: 54903 - DNA, 25 bp, Rattus norvegicus
aagttgtctctgattaccatgctgt

SEQ ID NO: 54904 - DNA, 25 bp, Rattus norvegicus
aagttgtctctgtttaccatgctgt

SEQ ID NO: 54905 - DNA, 25 bp, Rattus norvegicus
aagttgtctgatacctgtgttatgt

SEQ ID NO: 54906 - DNA, 25 bp, Rattus norvegicus
aagttgtctgattcctgtgttatgt

SEQ ID NO: 54907 - DNA, 25 bp, Rattus norvegicus
aagttgtcttctcagttccatatgc

SEQ ID NO: 54908 - DNA, 25 bp, Rattus norvegicus
aagttgtcttctgagttccatatgc

SEQ ID NO: 54909 - DNA, 25 bp, Rattus norvegicus
aagttgtcttgtctgtacgctcgca

SEQ ID NO: 54910 - DNA, 25 bp, Rattus norvegicus
aagttgtcttgtgtgtacgctcgca

SEQ ID NO: 54911 - DNA, 25 bp, Rattus norvegicus
aagttgtgacatatcctacagagat

SEQ ID NO: 54912 - DNA, 25 bp, Rattus norvegicus
aagttgtgacatttcctacagagat

SEQ ID NO: 54913 - DNA, 25 bp, Rattus norvegicus
aagttgtgcagcacgaagtcggcgt

SEQ ID NO: 54914 - DNA, 25 bp, Rattus norvegicus
aagttgtgcagctcgaagtcggcgt

SEQ ID NO: 54915 - DNA, 25 bp, Rattus norvegicus
aagttgtgctgccatccagagtaca

SEQ ID NO: 54916 - DNA, 25 bp, Rattus norvegicus
aagttgtgctgcgatccagagtaca

SEQ ID NO: 54917 - DNA, 25 bp, Rattus norvegicus
aagttgtgctggagctgagaccgtc

SEQ ID NO: 54918 - DNA, 25 bp, Rattus norvegicus
aagttgtgctggtgctgagaccgtc

SEQ ID NO: 54919 - DNA, 25 bp, Rattus norvegicus
aagttgtggatcaatatctggtatc

SEQ ID NO: 54920 - DNA, 25 bp, Rattus norvegicus
aagttgtggatctatatctggtatc

SEQ ID NO: 54921 - DNA, 25 bp, Rattus norvegicus
aagttgtgtatgactagtccccatc

SEQ ID NO: 54922 - DNA, 25 bp, Rattus norvegicus
aagttgtgtatgtctagtccccatc

SEQ ID NO: 54923 - DNA, 25 bp, Rattus norvegicus
aagttgtgtcatatgaaaacagcag

SEQ ID NO: 54924 - DNA, 25 bp, Rattus norvegicus
aagttgtgtcatttgaaaacagcag

SEQ ID NO: 54925 - DNA, 25 bp, Rattus norvegicus
aagttgtgtctgatctcgtgtggat

SEQ ID NO: 54926 - DNA, 25 bp, Rattus norvegicus
aagttgtgtctgttctcgtgtggat

SEQ ID NO: 54927 - DNA, 25 bp, Rattus norvegicus
aagttgttacaaccagattttcctg

SEQ ID NO: 54928 - DNA, 25 bp, Rattus norvegicus
aagttgttacaagcagattttcctg

SEQ ID NO: 54929 - DNA, 25 bp, Rattus norvegicus
aagttgttcatcacatcgttcgtat

SEQ ID NO: 54930 - DNA, 25 bp, Rattus norvegicus
aagttgttcatctcatcgttcgtat

SEQ ID NO: 54931 - DNA, 25 bp, Rattus norvegicus
aagttgttctttctgtcctgttgca

SEQ ID NO: 54932 - DNA, 25 bp, Rattus norvegicus
aagttgttctttgtgtcctgttgca

SEQ ID NO: 54933 - DNA, 25 bp, Rattus norvegicus
aagttgttggatcttacccctgtca

SEQ ID NO: 54934 - DNA, 25 bp, Rattus norvegicus
aagttgttggatgttacccctgtca

SEQ ID NO: 54935 - DNA, 25 bp, Rattus norvegicus
aagttgttgggcagtgcctggcaca

SEQ ID NO: 54936 - DNA, 25 bp, Rattus norvegicus
aagttgttgggctgtgcctggcaca

SEQ ID NO: 54937 - DNA, 25 bp, Rattus norvegicus
aagttgttgtttaatctgcctgaag

SEQ ID NO: 54938 - DNA, 25 bp, Rattus norvegicus
aagttgttgttttatctgcctgaag

SEQ ID NO: 54939 - DNA, 25 bp, Rattus norvegicus
aagttgtttacacccttggcagctg

SEQ ID NO: 54940 - DNA, 25 bp, Rattus norvegicus
aagttgtttacagccttggcagctg

SEQ ID NO: 54941 - DNA, 25 bp, Rattus norvegicus
aagttgtttcctctgccagtgagtt

SEQ ID NO: 54942 - DNA, 25 bp, Rattus norvegicus
aagttgtttcctgtgccagtgagtt

SEQ ID NO: 54943 - DNA, 25 bp, Rattus norvegicus
aagttgtttgtcaccttgtttcctg

SEQ ID NO: 54944 - DNA, 25 bp, Rattus norvegicus
aagttgtttgtctccttgtttcctg

SEQ ID NO: 54945 - DNA, 25 bp, Rattus norvegicus
aagtttaaacttatatcccaggcat

SEQ ID NO: 54946 - DNA, 25 bp, Rattus norvegicus
aagtttaaacttttatcccaggcat

SEQ ID NO: 54947 - DNA, 25 bp, Rattus norvegicus
aagtttaagtctcctggcgtagctg

SEQ ID NO: 54948 - DNA, 25 bp, Rattus norvegicus
aagtttaagtctgctggcgtagctg

SEQ ID NO: 54949 - DNA, 25 bp, Rattus norvegicus
aagtttaatgtcacctgagctttcc

SEQ ID NO: 54950 - DNA, 25 bp, Rattus norvegicus
aagtttaatgtctcctgagctttcc

SEQ ID NO: 54951 - DNA, 25 bp, Rattus norvegicus
aagtttacaagtaatgccacacaaa

SEQ ID NO: 54952 - DNA, 25 bp, Rattus norvegicus
aagtttacaagttatgccacacaaa

SEQ ID NO: 54953 - DNA, 25 bp, Rattus norvegicus
aagtttacattcactgggcctagct

SEQ ID NO: 54954 - DNA, 25 bp, Rattus norvegicus
aagtttacattctctgggcctagct

SEQ ID NO: 54955 - DNA, 25 bp, Rattus norvegicus
aagtttaccatgcaattgtttacca

SEQ ID NO: 54956 - DNA, 25 bp, Rattus norvegicus
aagtttaccatggaattgtttacca

SEQ ID NO: 54957 - DNA, 25 bp, Rattus norvegicus
aagtttaccctcactgggagatcag

SEQ ID NO: 54958 - DNA, 25 bp, Rattus norvegicus
aagtttaccctctctgggagatcag

SEQ ID NO: 54959 - DNA, 25 bp, Rattus norvegicus
aagtttacgcttatgtgctctcggc

SEQ ID NO: 54960 - DNA, 25 bp, Rattus norvegicus
aagtttacgcttttgtgctctcggc

SEQ ID NO: 54961 - DNA, 25 bp, Rattus norvegicus
aagtttactcatctcattgcttcat

SEQ ID NO: 54962 - DNA, 25 bp, Rattus norvegicus
aagtttactcatgtcattgcttcat

SEQ ID NO: 54963 - DNA, 25 bp, Rattus norvegicus
aagtttactcgcaggtccggaggct

SEQ ID NO: 54964 - DNA, 25 bp, Rattus norvegicus
aagtttactcgctggtccggaggct

SEQ ID NO: 54965 - DNA, 25 bp, Rattus norvegicus
aagtttagaatcaagactccctgag

SEQ ID NO: 54966 - DNA, 25 bp, Rattus norvegicus
aagtttagaatctagactccctgag

SEQ ID NO: 54967 - DNA, 25 bp, Rattus norvegicus
aagtttagcatcagaccacatcgga

SEQ ID NO: 54968 - DNA, 25 bp, Rattus norvegicus
aagtttagcatctgaccacatcgga

SEQ ID NO: 54969 - DNA, 25 bp, Rattus norvegicus
aagtttagccaacaccttccagatc

SEQ ID NO: 54970 - DNA, 25 bp, Rattus norvegicus
aagtttagccaagaccttccagatc

SEQ ID NO: 54971 - DNA, 25 bp, Rattus norvegicus
aagtttagccagctgggcccttcat

SEQ ID NO: 54972 - DNA, 25 bp, Rattus norvegicus
aagtttagccaggtgggcccttcat

SEQ ID NO: 54973 - DNA, 25 bp, Rattus norvegicus
aagtttagctttctgttggctctaa

SEQ ID NO: 54974 - DNA, 25 bp, Rattus norvegicus
aagtttagctttgtgttggctctaa

SEQ ID NO: 54975 - DNA, 25 bp, Rattus norvegicus
aagtttaggtatctctttccttcat

SEQ ID NO: 54976 - DNA, 25 bp, Rattus norvegicus
aagtttaggtatgtctttccttcat

SEQ ID NO: 54977 - DNA, 25 bp, Rattus norvegicus
aagtttataggccttcttcctgcta

SEQ ID NO: 54978 - DNA, 25 bp, Rattus norvegicus
aagtttataggcgttcttcctgcta

SEQ ID NO: 54979 - DNA, 25 bp, Rattus norvegicus
aagtttatccccatgcctgttctgt

SEQ ID NO: 54980 - DNA, 25 bp, Rattus norvegicus
aagtttatccccttgcctgttctgt

SEQ ID NO: 54981 - DNA, 25 bp, Rattus norvegicus
aagtttatcctccatgggccgacag

SEQ ID NO: 54982 - DNA, 25 bp, Rattus norvegicus
aagtttatcctcgatgggccgacag

SEQ ID NO: 54983 - DNA, 25 bp, Rattus norvegicus
aagtttatctttaggtggcttggat

SEQ ID NO: 54984 - DNA, 25 bp, Rattus norvegicus
aagtttatcttttggtggcttggat

SEQ ID NO: 54985 - DNA, 25 bp, Rattus norvegicus
aagtttatgggcctcacctgtcagg

SEQ ID NO: 54986 - DNA, 25 bp, Rattus norvegicus
aagtttatgggcgtcacctgtcagg

SEQ ID NO: 54987 - DNA, 25 bp, Rattus norvegicus
aagtttatgggtcgtctgtgtgtct

SEQ ID NO: 54988 - DNA, 25 bp, Rattus norvegicus
aagtttatgggtggtctgtgtgtct

SEQ ID NO: 54989 - DNA, 25 bp, Rattus norvegicus
aagtttatgtgtatgcttgaagcta

SEQ ID NO: 54990 - DNA, 25 bp, Rattus norvegicus
aagtttatgtgtttgcttgaagcta

SEQ ID NO: 54991 - DNA, 25 bp, Rattus norvegicus
aagtttattcgcaagacccgtgaga

SEQ ID NO: 54992 - DNA, 25 bp, Rattus norvegicus
aagtttattcgctagacccgtgaga

SEQ ID NO: 54993 - DNA, 25 bp, Rattus norvegicus
aagtttatttgcaactgcccttctt

SEQ ID NO: 54994 - DNA, 25 bp, Rattus norvegicus
aagtttatttgctactgcccttctt

SEQ ID NO: 54995 - DNA, 25 bp, Rattus norvegicus
aagtttatttggctccattaggaat

SEQ ID NO: 54996 - DNA, 25 bp, Rattus norvegicus
aagtttatttgggtccattaggaat

SEQ ID NO: 54997 - DNA, 25 bp, Rattus norvegicus
aagtttcaaaccatgacagagtcta

SEQ ID NO: 54998 - DNA, 25 bp, Rattus norvegicus
aagtttcaaaccttgacagagtcta

SEQ ID NO: 54999 - DNA, 25 bp, Rattus norvegicus
aagtttcaacagaattttgcctaat

SEQ ID NO: 55000 - DNA, 25 bp, Rattus norvegicus
aagtttcaacagtattttgcctaat

SEQ ID NO: 55001 - DNA, 25 bp, Rattus norvegicus
aagtttcaatctctagagcccacat

SEQ ID NO: 55002 - DNA, 25 bp, Rattus norvegicus
aagtttcaatctgtagagcccacat

SEQ ID NO: 55003 - DNA, 25 bp, Rattus norvegicus
aagtttcaatgcaccctaggctagt

SEQ ID NO: 55004 - DNA, 25 bp, Rattus norvegicus
aagtttcaatgctccctaggctagt

SEQ ID NO: 55005 - DNA, 25 bp, Rattus norvegicus
aagtttcacataagcttccttttaa

SEQ ID NO: 55006 - DNA, 25 bp, Rattus norvegicus
aagtttcacatatgcttccttttaa

SEQ ID NO: 55007 - DNA, 25 bp, Rattus norvegicus
aagtttcaccctcaagccagtgggc

SEQ ID NO: 55008 - DNA, 25 bp, Rattus norvegicus
aagtttcaccctgaagccagtgggc

SEQ ID NO: 55009 - DNA, 25 bp, Rattus norvegicus
aagtttcactccagggttctgagac

SEQ ID NO: 55010 - DNA, 25 bp, Rattus norvegicus
aagtttcactcctgggttctgagac

SEQ ID NO: 55011 - DNA, 25 bp, Rattus norvegicus
aagtttcagatcactattctccact

SEQ ID NO: 55012 - DNA, 25 bp, Rattus norvegicus
aagtttcagatctctattctccact

SEQ ID NO: 55013 - DNA, 25 bp, Rattus norvegicus
aagtttcagcatcggtgtcctggct

SEQ ID NO: 55014 - DNA, 25 bp, Rattus norvegicus
aagtttcagcatgggtgtcctggct

SEQ ID NO: 55015 - DNA, 25 bp, Rattus norvegicus
aagtttcagcccacttacgtgatga

SEQ ID NO: 55016 - DNA, 25 bp, Rattus norvegicus
aagtttcagccctcttacgtgatga

SEQ ID NO: 55017 - DNA, 25 bp, Rattus norvegicus
aagtttcagctgcaaatcagtctct

SEQ ID NO: 55018 - DNA, 25 bp, Rattus norvegicus
aagtttcagctggaaatcagtctct

SEQ ID NO: 55019 - DNA, 25 bp, Rattus norvegicus
aagtttcagtcactcctgttacctg

SEQ ID NO: 55020 - DNA, 25 bp, Rattus norvegicus
aagtttcagtcagtcctgttacctg

SEQ ID NO: 55021 - DNA, 25 bp, Rattus norvegicus
aagtttcagtgtctcttctacaaaa

SEQ ID NO: 55022 - DNA, 25 bp, Rattus norvegicus
aagtttcagtgtgtcttctacaaaa

SEQ ID NO: 55023 - DNA, 25 bp, Rattus norvegicus
aagtttcattaccagtcccctgtga

SEQ ID NO: 55024 - DNA, 25 bp, Rattus norvegicus
aagtttcattacgagtcccctgtga

SEQ ID NO: 55025 - DNA, 25 bp, Rattus norvegicus
aagtttccaaatcccagttagtcat

SEQ ID NO: 55026 - DNA, 25 bp, Rattus norvegicus
aagtttccaaatgccagttagtcat

SEQ ID NO: 55027 - DNA, 25 bp, Rattus norvegicus
aagtttccaatgagcattagatcag

SEQ ID NO: 55028 - DNA, 25 bp, Rattus norvegicus
aagtttccaatgtgcattagatcag

SEQ ID NO: 55029 - DNA, 25 bp, Rattus norvegicus
aagtttccacaaatcttacctctga

SEQ ID NO: 55030 - DNA, 25 bp, Rattus norvegicus
aagtttccacaattcttacctctga

SEQ ID NO: 55031 - DNA, 25 bp, Rattus norvegicus
aagtttccactgcttgatccaggta

SEQ ID NO: 55032 - DNA, 25 bp, Rattus norvegicus
aagtttccactggttgatccaggta

SEQ ID NO: 55033 - DNA, 25 bp, Rattus norvegicus
aagtttccagaaccccagtgtgtag

SEQ ID NO: 55034 - DNA, 25 bp, Rattus norvegicus
aagtttccagaagcccagtgtgtag

SEQ ID NO: 55035 - DNA, 25 bp, Rattus norvegicus
aagtttccaggacgcctgtcagagc

SEQ ID NO: 55036 - DNA, 25 bp, Rattus norvegicus
aagtttccaggaggcctgtcagagc

SEQ ID NO: 55037 - DNA, 25 bp, Rattus norvegicus
aagtttccatctcatacacttcatc

SEQ ID NO: 55038 - DNA, 25 bp, Rattus norvegicus
aagtttccatctgatacacttcatc

SEQ ID NO: 55039 - DNA, 25 bp, Rattus norvegicus
aagtttccattactatccttcaggg

SEQ ID NO: 55040 - DNA, 25 bp, Rattus norvegicus
aagtttccattactggcttcttcca

SEQ ID NO: 55041 - DNA, 25 bp, Rattus norvegicus
aagtttccattagtatccttcaggg

SEQ ID NO: 55042 - DNA, 25 bp, Rattus norvegicus
aagtttccattagtggcttcttcca

SEQ ID NO: 55043 - DNA, 25 bp, Rattus norvegicus
aagtttcccatccaggatgccagca

SEQ ID NO: 55044 - DNA, 25 bp, Rattus norvegicus
aagtttcccatcgaggatgccagca

SEQ ID NO: 55045 - DNA, 25 bp, Rattus norvegicus
aagtttccgaaaactatgcatctgg

SEQ ID NO: 55046 - DNA, 25 bp, Rattus norvegicus
aagtttccgaaatctatgcatctgg

SEQ ID NO: 55047 - DNA, 25 bp, Rattus norvegicus
aagtttccgatcaatttgcgctctc

SEQ ID NO: 55048 - DNA, 25 bp, Rattus norvegicus
aagtttccgatctatttgcgctctc

SEQ ID NO: 55049 - DNA, 25 bp, Rattus norvegicus
aagtttcctaaaccaggtgtaacat

SEQ ID NO: 55050 - DNA, 25 bp, Rattus norvegicus
aagtttcctaaagcaggtgtaacat

SEQ ID NO: 55051 - DNA, 25 bp, Rattus norvegicus
aagtttcctcacagtccttttacat

SEQ ID NO: 55052 - DNA, 25 bp, Rattus norvegicus
aagtttcctcactgtccttttacat

SEQ ID NO: 55053 - DNA, 25 bp, Rattus norvegicus
aagtttcctggaaattggcgagaga

SEQ ID NO: 55054 - DNA, 25 bp, Rattus norvegicus
aagtttcctggaacagccacaatga

SEQ ID NO: 55055 - DNA, 25 bp, Rattus norvegicus
aagtttcctggatattggcgagaga

SEQ ID NO: 55056 - DNA, 25 bp, Rattus norvegicus
aagtttcctggatcagccacaatga

SEQ ID NO: 55057 - DNA, 25 bp, Rattus norvegicus
aagtttcgattcctgcgcaatgggc

SEQ ID NO: 55058 - DNA, 25 bp, Rattus norvegicus
aagtttcgattcgtgcgcaatgggc

SEQ ID NO: 55059 - DNA, 25 bp, Rattus norvegicus
aagtttcgcttaagggagcctggct

SEQ ID NO: 55060 - DNA, 25 bp, Rattus norvegicus
aagtttcgcttatgggagcctggct

SEQ ID NO: 55061 - DNA, 25 bp, Rattus norvegicus
aagtttcgtgcacccttcaggaagc

SEQ ID NO: 55062 - DNA, 25 bp, Rattus norvegicus
aagtttcgtgcagccttcaggaagc

SEQ ID NO: 55063 - DNA, 25 bp, Rattus norvegicus
aagtttctaaagatggcagccttgt

SEQ ID NO: 55064 - DNA, 25 bp, Rattus norvegicus
aagtttctaaagttggcagccttgt

SEQ ID NO: 55065 - DNA, 25 bp, Rattus norvegicus
aagtttctacaaacgatcactcttg

SEQ ID NO: 55066 - DNA, 25 bp, Rattus norvegicus
aagtttctacaatcgatcactcttg

SEQ ID NO: 55067 - DNA, 25 bp, Rattus norvegicus
aagtttctactgattcttccagcaa

SEQ ID NO: 55068 - DNA, 25 bp, Rattus norvegicus
aagtttctactgtttcttccagcaa

SEQ ID NO: 55069 - DNA, 25 bp, Rattus norvegicus
aagtttctagaacgatgttccctga

SEQ ID NO: 55070 - DNA, 25 bp, Rattus norvegicus
aagtttctagaaggatgttccctga

SEQ ID NO: 55071 - DNA, 25 bp, Rattus norvegicus
aagtttctagatatcaggccagcct

SEQ ID NO: 55072 - DNA, 25 bp, Rattus norvegicus
aagtttctagatttcaggccagcct

SEQ ID NO: 55073 - DNA, 25 bp, Rattus norvegicus
aagtttctcagaatctcagcactcc

SEQ ID NO: 55074 - DNA, 25 bp, Rattus norvegicus
aagtttctcagacgcacacctgcgc

SEQ ID NO: 55075 - DNA, 25 bp, Rattus norvegicus
aagtttctcagaggcacacctgcgc

SEQ ID NO: 55076 - DNA, 25 bp, Rattus norvegicus
aagtttctcagattctcagcactcc

SEQ ID NO: 55077 - DNA, 25 bp, Rattus norvegicus
aagtttctcatcaggctttcggaca

SEQ ID NO: 55078 - DNA, 25 bp, Rattus norvegicus
aagtttctcatctggctttcggaca

SEQ ID NO: 55079 - DNA, 25 bp, Rattus norvegicus
aagtttctcctcagtctttagatag

SEQ ID NO: 55080 - DNA, 25 bp, Rattus norvegicus
aagtttctcctcattcagatttcct

SEQ ID NO: 55081 - DNA, 25 bp, Rattus norvegicus
aagtttctcctctgtctttagatag

SEQ ID NO: 55082 - DNA, 25 bp, Rattus norvegicus
aagtttctcctctttcagatttcct

SEQ ID NO: 55083 - DNA, 25 bp, Rattus norvegicus
aagtttctcgaacagcatcctggtg

SEQ ID NO: 55084 - DNA, 25 bp, Rattus norvegicus
aagtttctcgaagagcatcctggtg

SEQ ID NO: 55085 - DNA, 25 bp, Rattus norvegicus
aagtttctctttattgtatgcctaa

SEQ ID NO: 55086 - DNA, 25 bp, Rattus norvegicus
aagtttctcttttttgtatgcctaa

SEQ ID NO: 55087 - DNA, 25 bp, Rattus norvegicus
aagtttctgaacatgggagcacccc

SEQ ID NO: 55088 - DNA, 25 bp, Rattus norvegicus
aagtttctgaacttgggagcacccc

SEQ ID NO: 55089 - DNA, 25 bp, Rattus norvegicus
aagtttctgagaagcgccagtcccc

SEQ ID NO: 55090 - DNA, 25 bp, Rattus norvegicus
aagtttctgagacacctggctgata

SEQ ID NO: 55091 - DNA, 25 bp, Rattus norvegicus
aagtttctgagagacctggctgata

SEQ ID NO: 55092 - DNA, 25 bp, Rattus norvegicus
aagtttctgagatgcgccagtcccc

SEQ ID NO: 55093 - DNA, 25 bp, Rattus norvegicus
aagtttctgcccagctagagtatct

SEQ ID NO: 55094 - DNA, 25 bp, Rattus norvegicus
aagtttctgccctgctagagtatct

SEQ ID NO: 55095 - DNA, 25 bp, Rattus norvegicus
aagtttctgtggctgcctctgaaat

SEQ ID NO: 55096 - DNA, 25 bp, Rattus norvegicus
aagtttctgtgggtgcctctgaaat

SEQ ID NO: 55097 - DNA, 25 bp, Rattus norvegicus
aagtttcttccacagatacaggctt

SEQ ID NO: 55098 - DNA, 25 bp, Rattus norvegicus
aagtttcttccagagatacaggctt

SEQ ID NO: 55099 - DNA, 25 bp, Rattus norvegicus
aagtttcttccgctatttgacagag

SEQ ID NO: 55100 - DNA, 25 bp, Rattus norvegicus
aagtttcttccggtatttgacagag

SEQ ID NO: 55101 - DNA, 25 bp, Rattus norvegicus
aagtttcttgcaccatcgccggcgg

SEQ ID NO: 55102 - DNA, 25 bp, Rattus norvegicus
aagtttcttgcagcatcgccggcgg

SEQ ID NO: 55103 - DNA, 25 bp, Rattus norvegicus
aagtttgaacatctgtggacgggat

SEQ ID NO: 55104 - DNA, 25 bp, Rattus norvegicus
aagtttgaacatgtgtggacgggat

SEQ ID NO: 55105 - DNA, 25 bp, Rattus norvegicus
aagtttgacacaagccttggtcctc

SEQ ID NO: 55106 - DNA, 25 bp, Rattus norvegicus
aagtttgacacactttcttgctttc

SEQ ID NO: 55107 - DNA, 25 bp, Rattus norvegicus
aagtttgacacagtttcttgctttc

SEQ ID NO: 55108 - DNA, 25 bp, Rattus norvegicus
aagtttgacacatgccttggtcctc

SEQ ID NO: 55109 - DNA, 25 bp, Rattus norvegicus
aagtttgacaccatccggattctgg

SEQ ID NO: 55110 - DNA, 25 bp, Rattus norvegicus
aagtttgacaccttccggattctgg

SEQ ID NO: 55111 - DNA, 25 bp, Rattus norvegicus
aagtttgacctcaataccaagtgcc

SEQ ID NO: 55112 - DNA, 25 bp, Rattus norvegicus
aagtttgacctctataccaagtgcc

SEQ ID NO: 55113 - DNA, 25 bp, Rattus norvegicus
aagtttgacctgaacagcccctggg

SEQ ID NO: 55114 - DNA, 25 bp, Rattus norvegicus
aagtttgacctgtacagcccctggg

SEQ ID NO: 55115 - DNA, 25 bp, Rattus norvegicus
aagtttgacgaccttgagcctttgg

SEQ ID NO: 55116 - DNA, 25 bp, Rattus norvegicus
aagtttgacgacgttgagcctttgg

SEQ ID NO: 55117 - DNA, 25 bp, Rattus norvegicus
aagtttgactcaacccggaggacag

SEQ ID NO: 55118 - DNA, 25 bp, Rattus norvegicus
aagtttgactcatcccggaggacag

SEQ ID NO: 55119 - DNA, 25 bp, Rattus norvegicus
aagtttgactttcagtctctccctc

SEQ ID NO: 55120 - DNA, 25 bp, Rattus norvegicus
aagtttgactttgagtctctccctc

SEQ ID NO: 55121 - DNA, 25 bp, Rattus norvegicus
aagtttgagcccagctggtgtccaa

SEQ ID NO: 55122 - DNA, 25 bp, Rattus norvegicus
aagtttgagccctgctggtgtccaa

SEQ ID NO: 55123 - DNA, 25 bp, Rattus norvegicus
aagtttgaggagaggcccaggcttc

SEQ ID NO: 55124 - DNA, 25 bp, Rattus norvegicus
aagtttgaggagtggcccaggcttc

SEQ ID NO: 55125 - DNA, 25 bp, Rattus norvegicus
aagtttgaggccaggttcttccatt

SEQ ID NO: 55126 - DNA, 25 bp, Rattus norvegicus
aagtttgaggcctggttcttccatt

SEQ ID NO: 55127 - DNA, 25 bp, Rattus norvegicus
aagtttgaggctacacaaaaccttg

SEQ ID NO: 55128 - DNA, 25 bp, Rattus norvegicus
aagtttgaggcttcacaaaaccttg

SEQ ID NO: 55129 - DNA, 25 bp, Rattus norvegicus
aagtttgagttactccatccagagg

SEQ ID NO: 55130 - DNA, 25 bp, Rattus norvegicus
aagtttgagttagtccatccagagg

SEQ ID NO: 55131 - DNA, 25 bp, Rattus norvegicus
aagtttgatgtccacatgctgccag

SEQ ID NO: 55132 - DNA, 25 bp, Rattus norvegicus
aagtttgatgtcgacatgctgccag

SEQ ID NO: 55133 - DNA, 25 bp, Rattus norvegicus
aagtttgcaagccagtctccaagat

SEQ ID NO: 55134 - DNA, 25 bp, Rattus norvegicus
aagtttgcaagcgagtctccaagat

SEQ ID NO: 55135 - DNA, 25 bp, Rattus norvegicus
aagtttgcaattccagttcactcca

SEQ ID NO: 55136 - DNA, 25 bp, Rattus norvegicus
aagtttgcaattgcagttcactcca

SEQ ID NO: 55137 - DNA, 25 bp, Rattus norvegicus
aagtttgcacagcatgctttccgca

SEQ ID NO: 55138 - DNA, 25 bp, Rattus norvegicus
aagtttgcacaggatgctttccgca

SEQ ID NO: 55139 - DNA, 25 bp, Rattus norvegicus
aagtttgcacctctcgtcctgcagg

SEQ ID NO: 55140 - DNA, 25 bp, Rattus norvegicus
aagtttgcacctgtcgtcctgcagg

SEQ ID NO: 55141 - DNA, 25 bp, Rattus norvegicus
aagtttgcagagctactggaccccg

SEQ ID NO: 55142 - DNA, 25 bp, Rattus norvegicus
aagtttgcagaggtactggaccccg

SEQ ID NO: 55143 - DNA, 25 bp, Rattus norvegicus
aagtttgcagttctagagtccatgg

SEQ ID NO: 55144 - DNA, 25 bp, Rattus norvegicus
aagtttgcagttgtagagtccatgg

SEQ ID NO: 55145 - DNA, 25 bp, Rattus norvegicus
aagtttgcatctagtctccacatct

SEQ ID NO: 55146 - DNA, 25 bp, Rattus norvegicus
aagtttgcatcttgtctccacatct

SEQ ID NO: 55147 - DNA, 25 bp, Rattus norvegicus
aagtttgcctgacgctgactgcact

SEQ ID NO: 55148 - DNA, 25 bp, Rattus norvegicus
aagtttgcctgaggctgactgcact

SEQ ID NO: 55149 - DNA, 25 bp, Rattus norvegicus
aagtttgccttcataagctcatcct

SEQ ID NO: 55150 - DNA, 25 bp, Rattus norvegicus
aagtttgccttcttaagctcatcct

SEQ ID NO: 55151 - DNA, 25 bp, Rattus norvegicus
aagtttgccttgatcggacatttca

SEQ ID NO: 55152 - DNA, 25 bp, Rattus norvegicus
aagtttgccttgttcggacatttca

SEQ ID NO: 55153 - DNA, 25 bp, Rattus norvegicus
aagtttgcgcgcagcgacgagcgca

SEQ ID NO: 55154 - DNA, 25 bp, Rattus norvegicus
aagtttgcgcgctgcgacgagcgca

SEQ ID NO: 55155 - DNA, 25 bp, Rattus norvegicus
aagtttgcggtcagtgtaaatctca

SEQ ID NO: 55156 - DNA, 25 bp, Rattus norvegicus
aagtttgcggtctgtgtaaatctca

SEQ ID NO: 55157 - DNA, 25 bp, Rattus norvegicus
aagtttgctaagctcttggaaatca

SEQ ID NO: 55158 - DNA, 25 bp, Rattus norvegicus
aagtttgctaaggtcttggaaatca

SEQ ID NO: 55159 - DNA, 25 bp, Rattus norvegicus
aagtttgctcacagaggcttctagt

SEQ ID NO: 55160 - DNA, 25 bp, Rattus norvegicus
aagtttgctcactgaggcttctagt

SEQ ID NO: 55161 - DNA, 25 bp, Rattus norvegicus
aagtttgctgcacgtgtactgagta

SEQ ID NO: 55162 - DNA, 25 bp, Rattus norvegicus
aagtttgctgcaggtgtactgagta

SEQ ID NO: 55163 - DNA, 25 bp, Rattus norvegicus
aagtttgctggtactactgactctg

SEQ ID NO: 55164 - DNA, 25 bp, Rattus norvegicus
aagtttgctggttctactgactctg

SEQ ID NO: 55165 - DNA, 25 bp, Rattus norvegicus
aagtttggaaatactctggcaggca

SEQ ID NO: 55166 - DNA, 25 bp, Rattus norvegicus
aagtttggaaattctctggcaggca

SEQ ID NO: 55167 - DNA, 25 bp, Rattus norvegicus
aagtttggacagagggcagtagccc

SEQ ID NO: 55168 - DNA, 25 bp, Rattus norvegicus
aagtttggacagtgggcagtagccc

SEQ ID NO: 55169 - DNA, 25 bp, Rattus norvegicus
aagtttggatctctgtctgtgactc

SEQ ID NO: 55170 - DNA, 25 bp, Rattus norvegicus
aagtttggatctgtgtctgtgactc

SEQ ID NO: 55171 - DNA, 25 bp, Rattus norvegicus
aagtttggcatccttcgtgataaaa

SEQ ID NO: 55172 - DNA, 25 bp, Rattus norvegicus
aagtttggcatcgttcgtgataaaa

SEQ ID NO: 55173 - DNA, 25 bp, Rattus norvegicus
aagtttggccgcaccgcccgggctg

SEQ ID NO: 55174 - DNA, 25 bp, Rattus norvegicus
aagtttggccgctccgcccgggctg

SEQ ID NO: 55175 - DNA, 25 bp, Rattus norvegicus
aagtttggctgtactatagcccctt

SEQ ID NO: 55176 - DNA, 25 bp, Rattus norvegicus
aagtttggctgttctatagcccctt

SEQ ID NO: 55177 - DNA, 25 bp, Rattus norvegicus
aagtttggcttgaacgctgcctgag

SEQ ID NO: 55178 - DNA, 25 bp, Rattus norvegicus
aagtttggcttgacactgctcctaa

SEQ ID NO: 55179 - DNA, 25 bp, Rattus norvegicus
aagtttggcttgtacgctgcctgag

SEQ ID NO: 55180 - DNA, 25 bp, Rattus norvegicus
aagtttggcttgtcactgctcctaa

SEQ ID NO: 55181 - DNA, 25 bp, Rattus norvegicus
aagtttgggcagacctggtgactga

SEQ ID NO: 55182 - DNA, 25 bp, Rattus norvegicus
aagtttgggcagtcctggtgactga

SEQ ID NO: 55183 - DNA, 25 bp, Rattus norvegicus
aagtttgggccaattgttggtgata

SEQ ID NO: 55184 - DNA, 25 bp, Rattus norvegicus
aagtttgggccatttgttggtgata

SEQ ID NO: 55185 - DNA, 25 bp, Rattus norvegicus
aagtttggtactcagtctgtccaca

SEQ ID NO: 55186 - DNA, 25 bp, Rattus norvegicus
aagtttggtactgagtctgtccaca

SEQ ID NO: 55187 - DNA, 25 bp, Rattus norvegicus
aagtttggtgatatcgtctggagga

SEQ ID NO: 55188 - DNA, 25 bp, Rattus norvegicus
aagtttggtgatttcgtctggagga

SEQ ID NO: 55189 - DNA, 25 bp, Rattus norvegicus
aagtttggttgccaagctctcttga

SEQ ID NO: 55190 - DNA, 25 bp, Rattus norvegicus
aagtttggttgcgaagctctcttga

SEQ ID NO: 55191 - DNA, 25 bp, Rattus norvegicus
aagtttggttggatcccagcacaca

SEQ ID NO: 55192 - DNA, 25 bp, Rattus norvegicus
aagtttggttggttcccagcacaca

SEQ ID NO: 55193 - DNA, 25 bp, Rattus norvegicus
aagtttgtaccaattggcctcagcc

SEQ ID NO: 55194 - DNA, 25 bp, Rattus norvegicus
aagtttgtaccatttggcctcagcc

SEQ ID NO: 55195 - DNA, 25 bp, Rattus norvegicus
aagtttgtcacacgtttcagtttat

SEQ ID NO: 55196 - DNA, 25 bp, Rattus norvegicus
aagtttgtcacaggtttcagtttat

SEQ ID NO: 55197 - DNA, 25 bp, Rattus norvegicus
aagtttgtcagtcaccatcccgagc

SEQ ID NO: 55198 - DNA, 25 bp, Rattus norvegicus
aagtttgtcagtgaccatcccgagc

SEQ ID NO: 55199 - DNA, 25 bp, Rattus norvegicus
aagtttgtccttccttcccaagcag

SEQ ID NO: 55200 - DNA, 25 bp, Rattus norvegicus
aagtttgtccttgcttcccaagcag

SEQ ID NO: 55201 - DNA, 25 bp, Rattus norvegicus
aagtttgtgcttctttcctgagcta

SEQ ID NO: 55202 - DNA, 25 bp, Rattus norvegicus
aagtttgtgcttgtttcctgagcta

SEQ ID NO: 55203 - DNA, 25 bp, Rattus norvegicus
aagtttgtggcaaattctgtctaat

SEQ ID NO: 55204 - DNA, 25 bp, Rattus norvegicus
aagtttgtggcatattctgtctaat

SEQ ID NO: 55205 - DNA, 25 bp, Rattus norvegicus
aagtttgtggcgcttaatgccctcc

SEQ ID NO: 55206 - DNA, 25 bp, Rattus norvegicus
aagtttgtggcggttaatgccctcc

SEQ ID NO: 55207 - DNA, 25 bp, Rattus norvegicus
aagtttgtggctcctgaagaagtcc

SEQ ID NO: 55208 - DNA, 25 bp, Rattus norvegicus
aagtttgtggctgctgaagaagtcc

SEQ ID NO: 55209 - DNA, 25 bp, Rattus norvegicus
aagtttgtggtaagagcttcggttg

SEQ ID NO: 55210 - DNA, 25 bp, Rattus norvegicus
aagtttgtggtatgagcttcggttg

SEQ ID NO: 55211 - DNA, 25 bp, Rattus norvegicus
aagtttgtgtctctctaatcgacta

SEQ ID NO: 55212 - DNA, 25 bp, Rattus norvegicus
aagtttgtgtctgtctaatcgacta

SEQ ID NO: 55213 - DNA, 25 bp, Rattus norvegicus
aagtttgttcagacgatctgcgcag

SEQ ID NO: 55214 - DNA, 25 bp, Rattus norvegicus
aagtttgttcagtcgatctgcgcag

SEQ ID NO: 55215 - DNA, 25 bp, Rattus norvegicus
aagtttgtttgcctttagcatggag

SEQ ID NO: 55216 - DNA, 25 bp, Rattus norvegicus
aagtttgtttgcgtttagcatggag

SEQ ID NO: 55217 - DNA, 25 bp, Rattus norvegicus
aagtttgttttgagcctgaatggtt

SEQ ID NO: 55218 - DNA, 25 bp, Rattus norvegicus
aagtttgttttgtgcctgaatggtt

SEQ ID NO: 55219 - DNA, 25 bp, Rattus norvegicus
aagttttaaatccagctcttcctca

SEQ ID NO: 55220 - DNA, 25 bp, Rattus norvegicus
aagttttaaatcgagctcttcctca

SEQ ID NO: 55221 - DNA, 25 bp, Rattus norvegicus
aagttttaatccagatgcctctcac

SEQ ID NO: 55222 - DNA, 25 bp, Rattus norvegicus
aagttttaatcctgatgcctctcac

SEQ ID NO: 55223 - DNA, 25 bp, Rattus norvegicus
aagttttactccctcagacacaagt

SEQ ID NO: 55224 - DNA, 25 bp, Rattus norvegicus
aagttttactccgtcagacacaagt

SEQ ID NO: 55225 - DNA, 25 bp, Rattus norvegicus
aagttttactctctctttgctatca

SEQ ID NO: 55226 - DNA, 25 bp, Rattus norvegicus
aagttttactctgtctttgctatca

SEQ ID NO: 55227 - DNA, 25 bp, Rattus norvegicus
aagttttactgcctataccaccatg

SEQ ID NO: 55228 - DNA, 25 bp, Rattus norvegicus
aagttttactgcgtataccaccatg

SEQ ID NO: 55229 - DNA, 25 bp, Rattus norvegicus
aagttttatcttatctaggagggca

SEQ ID NO: 55230 - DNA, 25 bp, Rattus norvegicus
aagttttatcttttctaggagggca

SEQ ID NO: 55231 - DNA, 25 bp, Rattus norvegicus
aagttttcatctatggaccatttgt

SEQ ID NO: 55232 - DNA, 25 bp, Rattus norvegicus
aagttttcatctttggaccatttgt

SEQ ID NO: 55233 - DNA, 25 bp, Rattus norvegicus
aagttttccagaccgccaggagacc

SEQ ID NO: 55234 - DNA, 25 bp, Rattus norvegicus
aagttttccagagcgccaggagacc

SEQ ID NO: 55235 - DNA, 25 bp, Rattus norvegicus
aagttttccagtcaccgtaccattg

SEQ ID NO: 55236 - DNA, 25 bp, Rattus norvegicus
aagttttccagtgaccgtaccattg

SEQ ID NO: 55237 - DNA, 25 bp, Rattus norvegicus
aagttttccattatagtgtgaagct

SEQ ID NO: 55238 - DNA, 25 bp, Rattus norvegicus
aagttttccattttagtgtgaagct

SEQ ID NO: 55239 - DNA, 25 bp, Rattus norvegicus
aagttttccctgaagactctggtgg

SEQ ID NO: 55240 - DNA, 25 bp, Rattus norvegicus
aagttttccctgtagactctggtgg

SEQ ID NO: 55241 - DNA, 25 bp, Rattus norvegicus
aagttttcgacgagtggcaggtcct

SEQ ID NO: 55242 - DNA, 25 bp, Rattus norvegicus
aagttttcgacgtgtggcaggtcct

SEQ ID NO: 55243 - DNA, 25 bp, Rattus norvegicus
aagttttcgatactggtggtggcca

SEQ ID NO: 55244 - DNA, 25 bp, Rattus norvegicus
aagttttcgatagtggtggtggcca

SEQ ID NO: 55245 - DNA, 25 bp, Rattus norvegicus
aagttttcgccaagaattcctcaag

SEQ ID NO: 55246 - DNA, 25 bp, Rattus norvegicus
aagttttcgccatgaattcctcaag

SEQ ID NO: 55247 - DNA, 25 bp, Rattus norvegicus
aagttttctgatcttcccattcact

SEQ ID NO: 55248 - DNA, 25 bp, Rattus norvegicus
aagttttctgatgttcccattcact

SEQ ID NO: 55249 - DNA, 25 bp, Rattus norvegicus
aagttttctgccagaaatcagtgag

SEQ ID NO: 55250 - DNA, 25 bp, Rattus norvegicus
aagttttctgcctgaaatcagtgag

SEQ ID NO: 55251 - DNA, 25 bp, Rattus norvegicus
aagttttctgcgaagctctagatgg

SEQ ID NO: 55252 - DNA, 25 bp, Rattus norvegicus
aagttttctgcgtagctctagatgg

SEQ ID NO: 55253 - DNA, 25 bp, Rattus norvegicus
aagttttcttgtagcactgctctac

SEQ ID NO: 55254 - DNA, 25 bp, Rattus norvegicus
aagttttcttgttgcactgctctac

SEQ ID NO: 55255 - DNA, 25 bp, Rattus norvegicus
aagttttctttgctttcccaatatg

SEQ ID NO: 55256 - DNA, 25 bp, Rattus norvegicus
aagttttctttggtttcccaatatg

SEQ ID NO: 55257 - DNA, 25 bp, Rattus norvegicus
aagttttgagtcattccatgcccac

SEQ ID NO: 55258 - DNA, 25 bp, Rattus norvegicus
aagttttgagtctttccatgcccac

SEQ ID NO: 55259 - DNA, 25 bp, Rattus norvegicus
aagttttgatttacagctgctgtaa

SEQ ID NO: 55260 - DNA, 25 bp, Rattus norvegicus
aagttttgattttcagctgctgtaa

SEQ ID NO: 55261 - DNA, 25 bp, Rattus norvegicus
aagttttgcatgaatccaacccaga

SEQ ID NO: 55262 - DNA, 25 bp, Rattus norvegicus
aagttttgcatgtatccaacccaga

SEQ ID NO: 55263 - DNA, 25 bp, Rattus norvegicus
aagttttgtcctcgatgatcttctc

SEQ ID NO: 55264 - DNA, 25 bp, Rattus norvegicus
aagttttgtcctggatgatcttctc

SEQ ID NO: 55265 - DNA, 25 bp, Rattus norvegicus
aagttttgtttacatcaagtggaat

SEQ ID NO: 55266 - DNA, 25 bp, Rattus norvegicus
aagttttgtttagatcaagtggaat

SEQ ID NO: 55267 - DNA, 25 bp, Rattus norvegicus
aagtttttaaccctcattggtgcat

SEQ ID NO: 55268 - DNA, 25 bp, Rattus norvegicus
aagtttttaaccgtcattggtgcat

SEQ ID NO: 55269 - DNA, 25 bp, Rattus norvegicus
aagtttttccaaaagatttcattct

SEQ ID NO: 55270 - DNA, 25 bp, Rattus norvegicus
aagtttttccaatagatttcattct

SEQ ID NO: 55271 - DNA, 25 bp, Rattus norvegicus
aagtttttctgacgacaccgtcatg

SEQ ID NO: 55272 - DNA, 25 bp, Rattus norvegicus
aagtttttctgaggacaccgtcatg

SEQ ID NO: 55273 - DNA, 25 bp, Rattus norvegicus
aagtttttgcaacctgtctgggtct

SEQ ID NO: 55274 - DNA, 25 bp, Rattus norvegicus
aagtttttgcaagctgtctgggtct

SEQ ID NO: 55275 - DNA, 25 bp, Rattus norvegicus
aagtttttgccaatcaacacagtaa

SEQ ID NO: 55276 - DNA, 25 bp, Rattus norvegicus
aagtttttgccattcaacacagtaa

SEQ ID NO: 55277 - DNA, 25 bp, Rattus norvegicus
aagtttttgtgcattgctcacccat

SEQ ID NO: 55278 - DNA, 25 bp, Rattus norvegicus
aagtttttgtgctttgctcacccat

SEQ ID NO: 55279 - DNA, 25 bp, Rattus norvegicus
aataaaaagctgaggtgtctgccgt

SEQ ID NO: 55280 - DNA, 25 bp, Rattus norvegicus
aataaaaagctgtggtgtctgccgt

SEQ ID NO: 55281 - DNA, 25 bp, Rattus norvegicus
aataaaaatgccctcacacgtacac

SEQ ID NO: 55282 - DNA, 25 bp, Rattus norvegicus
aataaaaatgccgtcacacgtacac

SEQ ID NO: 55283 - DNA, 25 bp, Rattus norvegicus
aataaaacagcaacacaggacttag

SEQ ID NO: 55284 - DNA, 25 bp, Rattus norvegicus
aataaaacagcatcacaggacttag

SEQ ID NO: 55285 - DNA, 25 bp, Rattus norvegicus
aataaaactgcaccctacacctgct

SEQ ID NO: 55286 - DNA, 25 bp, Rattus norvegicus
aataaaactgcagcctacacctgct

SEQ ID NO: 55287 - DNA, 25 bp, Rattus norvegicus
aataaaactgccaggctggctccgg

SEQ ID NO: 55288 - DNA, 25 bp, Rattus norvegicus
aataaaactgcctggctggctccgg

SEQ ID NO: 55289 - DNA, 25 bp, Rattus norvegicus
aataaaactggcagcatcctgtata

SEQ ID NO: 55290 - DNA, 25 bp, Rattus norvegicus
aataaaactggctgcatcctgtata

SEQ ID NO: 55291 - DNA, 25 bp, Rattus norvegicus
aataaaactgtcaccttcttgcttt

SEQ ID NO: 55292 - DNA, 25 bp, Rattus norvegicus
aataaaactgtctccttcttgcttt

SEQ ID NO: 55293 - DNA, 25 bp, Rattus norvegicus
aataaaagcattccccacatagcag

SEQ ID NO: 55294 - DNA, 25 bp, Rattus norvegicus
aataaaagcattgcccacatagcag

SEQ ID NO: 55295 - DNA, 25 bp, Rattus norvegicus
aataaaagctgaacactcccaagag

SEQ ID NO: 55296 - DNA, 25 bp, Rattus norvegicus
aataaaagctgatcactcccaagag

SEQ ID NO: 55297 - DNA, 25 bp, Rattus norvegicus
aataaaaggtctctgccttctgggt

SEQ ID NO: 55298 - DNA, 25 bp, Rattus norvegicus
aataaaaggtctgtgccttctgggt

SEQ ID NO: 55299 - DNA, 25 bp, Rattus norvegicus
aataaaagtgtgaccctgtgcaagc

SEQ ID NO: 55300 - DNA, 25 bp, Rattus norvegicus
aataaaagtgtgtccctgtgcaagc

SEQ ID NO: 55301 - DNA, 25 bp, Rattus norvegicus
aataaaatagttcttcatctgcaaa

SEQ ID NO: 55302 - DNA, 25 bp, Rattus norvegicus
aataaaatagttgttcatctgcaaa

SEQ ID NO: 55303 - DNA, 25 bp, Rattus norvegicus
aataaaatcctccacgttgaccaga

SEQ ID NO: 55304 - DNA, 25 bp, Rattus norvegicus
aataaaatcctcgacgttgaccaga

SEQ ID NO: 55305 - DNA, 25 bp, Rattus norvegicus
aataaaatctcacctcctttctgtg

SEQ ID NO: 55306 - DNA, 25 bp, Rattus norvegicus
aataaaatctcagctcctttctgtg

SEQ ID NO: 55307 - DNA, 25 bp, Rattus norvegicus
aataaaatgactcaggccgaggtcc

SEQ ID NO: 55308 - DNA, 25 bp, Rattus norvegicus
aataaaatgactgaggccgaggtcc

SEQ ID NO: 55309 - DNA, 25 bp, Rattus norvegicus
aataaaattgtcctgcagtcccttc

SEQ ID NO: 55310 - DNA, 25 bp, Rattus norvegicus
aataaaattgtcgtgcagtcccttc

SEQ ID NO: 55311 - DNA, 25 bp, Rattus norvegicus
aataaaatttttaggctgtacatag

SEQ ID NO: 55312 - DNA, 25 bp, Rattus norvegicus
aataaaattttttggctgtacatag

SEQ ID NO: 55313 - DNA, 25 bp, Rattus norvegicus
aataaacaaattccctgcagttggt

SEQ ID NO: 55314 - DNA, 25 bp, Rattus norvegicus
aataaacaaattgcctgcagttggt

SEQ ID NO: 55315 - DNA, 25 bp, Rattus norvegicus
aataaacaccagcagtcacaacacc

SEQ ID NO: 55316 - DNA, 25 bp, Rattus norvegicus
aataaacaccaggagtcacaacacc

SEQ ID NO: 55317 - DNA, 25 bp, Rattus norvegicus
aataaacatttccacagcctcccgg

SEQ ID NO: 55318 - DNA, 25 bp, Rattus norvegicus
aataaacatttcgacagcctcccgg

SEQ ID NO: 55319 - DNA, 25 bp, Rattus norvegicus
aataaaccaaagactgatcacttcc

SEQ ID NO: 55320 - DNA, 25 bp, Rattus norvegicus
aataaaccaaagtctgatcacttcc

SEQ ID NO: 55321 - DNA, 25 bp, Rattus norvegicus
aataaaccaactcctgtaagctgcc

SEQ ID NO: 55322 - DNA, 25 bp, Rattus norvegicus
aataaaccaactgctgtaagctgcc

SEQ ID NO: 55323 - DNA, 25 bp, Rattus norvegicus
aataaaccacacacgctaggatcaa

SEQ ID NO: 55324 - DNA, 25 bp, Rattus norvegicus
aataaaccacactcgctaggatcaa

SEQ ID NO: 55325 - DNA, 25 bp, Rattus norvegicus
aataaacccattcctagaacctgct

SEQ ID NO: 55326 - DNA, 25 bp, Rattus norvegicus
aataaacccattgctagaacctgct

SEQ ID NO: 55327 - DNA, 25 bp, Rattus norvegicus
aataaacctcaacttgccttgtgct

SEQ ID NO: 55328 - DNA, 25 bp, Rattus norvegicus
aataaacctcaagttgccttgtgct

SEQ ID NO: 55329 - DNA, 25 bp, Rattus norvegicus
aataaaccttcgctcagcacagata

SEQ ID NO: 55330 - DNA, 25 bp, Rattus norvegicus
aataaaccttcggtcagcacagata

SEQ ID NO: 55331 - DNA, 25 bp, Rattus norvegicus
aataaactaatcatgggctaggcgt

SEQ ID NO: 55332 - DNA, 25 bp, Rattus norvegicus
aataaactaatcttgggctaggcgt

SEQ ID NO: 55333 - DNA, 25 bp, Rattus norvegicus
aataaactccaactttccaaggctg

SEQ ID NO: 55334 - DNA, 25 bp, Rattus norvegicus
aataaactccaagtttccaaggctg

SEQ ID NO: 55335 - DNA, 25 bp, Rattus norvegicus
aataaactgtatcctgaaccgcctc

SEQ ID NO: 55336 - DNA, 25 bp, Rattus norvegicus
aataaactgtatgctgaaccgcctc

SEQ ID NO: 55337 - DNA, 25 bp, Rattus norvegicus
aataaactgttgctgcagtccctgt

SEQ ID NO: 55338 - DNA, 25 bp, Rattus norvegicus
aataaactgttggtgcagtccctgt

SEQ ID NO: 55339 - DNA, 25 bp, Rattus norvegicus
aataaacttctcaacctattcccag

SEQ ID NO: 55340 - DNA, 25 bp, Rattus norvegicus
aataaacttctctacctattcccag

SEQ ID NO: 55341 - DNA, 25 bp, Rattus norvegicus
aataaagaagccaccagcctgcggg

SEQ ID NO: 55342 - DNA, 25 bp, Rattus norvegicus
aataaagaagcctccagcctgcggg

SEQ ID NO: 55343 - DNA, 25 bp, Rattus norvegicus
aataaagaccatatcttgtgtcact

SEQ ID NO: 55344 - DNA, 25 bp, Rattus norvegicus
aataaagaccatttcttgtgtcact

SEQ ID NO: 55345 - DNA, 25 bp, Rattus norvegicus
aataaagacttgactggatctctgg

SEQ ID NO: 55346 - DNA, 25 bp, Rattus norvegicus
aataaagacttgtctggatctctgg

SEQ ID NO: 55347 - DNA, 25 bp, Rattus norvegicus
aataaagagcccaaggccctgctgt

SEQ ID NO: 55348 - DNA, 25 bp, Rattus norvegicus
aataaagagccctaggccctgctgt

SEQ ID NO: 55349 - DNA, 25 bp, Rattus norvegicus
aataaagaggcaactggctcaaaga

SEQ ID NO: 55350 - DNA, 25 bp, Rattus norvegicus
aataaagaggcatctggctcaaaga

SEQ ID NO: 55351 - DNA, 25 bp, Rattus norvegicus
aataaagagtgcattctgcccctca

SEQ ID NO: 55352 - DNA, 25 bp, Rattus norvegicus
aataaagagtgctttctgcccctca

SEQ ID NO: 55353 - DNA, 25 bp, Rattus norvegicus
aataaagatcatcttccctcctcgg

SEQ ID NO: 55354 - DNA, 25 bp, Rattus norvegicus
aataaagatcatgttccctcctcgg

SEQ ID NO: 55355 - DNA, 25 bp, Rattus norvegicus
aataaagccagccacaggcctcgtg

SEQ ID NO: 55356 - DNA, 25 bp, Rattus norvegicus
aataaagccagcgacaggcctcgtg

SEQ ID NO: 55357 - DNA, 25 bp, Rattus norvegicus
aataaagccaggctcaggctccatg

SEQ ID NO: 55358 - DNA, 25 bp, Rattus norvegicus
aataaagccagggtcaggctccatg

SEQ ID NO: 55359 - DNA, 25 bp, Rattus norvegicus
aataaagccccgcagagtggagcct

SEQ ID NO: 55360 - DNA, 25 bp, Rattus norvegicus
aataaagccccggagagtggagcct

SEQ ID NO: 55361 - DNA, 25 bp, Rattus norvegicus
aataaagccttcatgagctctcctc

SEQ ID NO: 55362 - DNA, 25 bp, Rattus norvegicus
aataaagccttcttgagctctcctc

SEQ ID NO: 55363 - DNA, 25 bp, Rattus norvegicus
aataaagctccaaggtgctccactc

SEQ ID NO: 55364 - DNA, 25 bp, Rattus norvegicus
aataaagctccatggtgctccactc

SEQ ID NO: 55365 - DNA, 25 bp, Rattus norvegicus
aataaaggctatcattccctcaggg

SEQ ID NO: 55366 - DNA, 25 bp, Rattus norvegicus
aataaaggctatgattccctcaggg

SEQ ID NO: 55367 - DNA, 25 bp, Rattus norvegicus
aataaagggagcctgcagcctctgt

SEQ ID NO: 55368 - DNA, 25 bp, Rattus norvegicus
aataaagggagcgtgcagcctctgt

SEQ ID NO: 55369 - DNA, 25 bp, Rattus norvegicus
aataaaggtgccctcacaaccattc

SEQ ID NO: 55370 - DNA, 25 bp, Rattus norvegicus
aataaaggtgcccttgtcaatgcct

SEQ ID NO: 55371 - DNA, 25 bp, Rattus norvegicus
aataaaggtgccgtcacaaccattc

SEQ ID NO: 55372 - DNA, 25 bp, Rattus norvegicus
aataaaggtgccgttgtcaatgcct

SEQ ID NO: 55373 - DNA, 25 bp, Rattus norvegicus
aataaagtacgtagctctgtctccc

SEQ ID NO: 55374 - DNA, 25 bp, Rattus norvegicus
aataaagtacgttgctctgtctccc

SEQ ID NO: 55375 - DNA, 25 bp, Rattus norvegicus
aataaagtcagtcgctctagagaga

SEQ ID NO: 55376 - DNA, 25 bp, Rattus norvegicus
aataaagtcagtggctctagagaga

SEQ ID NO: 55377 - DNA, 25 bp, Rattus norvegicus
aataaagtccaaaaaccaccctctg

SEQ ID NO: 55378 - DNA, 25 bp, Rattus norvegicus
aataaagtccaataaccaccctctg

SEQ ID NO: 55379 - DNA, 25 bp, Rattus norvegicus
aataaagtgctcattctcgggcttt

SEQ ID NO: 55380 - DNA, 25 bp, Rattus norvegicus
aataaagtgctctttctcgggcttt

SEQ ID NO: 55381 - DNA, 25 bp, Rattus norvegicus
aataaagtggtcacccgtgcaaggg

SEQ ID NO: 55382 - DNA, 25 bp, Rattus norvegicus
aataaagtggtctcccgtgcaaggg

SEQ ID NO: 55383 - DNA, 25 bp, Rattus norvegicus
aataaagtgtggctctggcgttgtc

SEQ ID NO: 55384 - DNA, 25 bp, Rattus norvegicus
aataaagtgtgggtctggcgttgtc

SEQ ID NO: 55385 - DNA, 25 bp, Rattus norvegicus
aataaagttccaattcctgctccaa

SEQ ID NO: 55386 - DNA, 25 bp, Rattus norvegicus
aataaagttccatttcctgctccaa

SEQ ID NO: 55387 - DNA, 25 bp, Rattus norvegicus
aataaatagttgagccctagactga

SEQ ID NO: 55388 - DNA, 25 bp, Rattus norvegicus
aataaatagttgtgccctagactga

SEQ ID NO: 55389 - DNA, 25 bp, Rattus norvegicus
aataaatatctacccagccagtatt

SEQ ID NO: 55390 - DNA, 25 bp, Rattus norvegicus
aataaatatctagccagccagtatt

SEQ ID NO: 55391 - DNA, 25 bp, Rattus norvegicus
aataaatcacctcactttctatcca

SEQ ID NO: 55392 - DNA, 25 bp, Rattus norvegicus
aataaatcacctgactttctatcca

SEQ ID NO: 55393 - DNA, 25 bp, Rattus norvegicus
aataaatcccaactgtactatgagg

SEQ ID NO: 55394 - DNA, 25 bp, Rattus norvegicus
aataaatcccaagtgtactatgagg

SEQ ID NO: 55395 - DNA, 25 bp, Rattus norvegicus
aataaatccttcagagctccacaac

SEQ ID NO: 55396 - DNA, 25 bp, Rattus norvegicus
aataaatccttctgagctccacaac

SEQ ID NO: 55397 - DNA, 25 bp, Rattus norvegicus
aataaatctgtccactccccttttg

SEQ ID NO: 55398 - DNA, 25 bp, Rattus norvegicus
aataaatctgtcgactccccttttg

SEQ ID NO: 55399 - DNA, 25 bp, Rattus norvegicus
aataaatgctccctcttcctgagac

SEQ ID NO: 55400 - DNA, 25 bp, Rattus norvegicus
aataaatgctccgtcttcctgagac

SEQ ID NO: 55401 - DNA, 25 bp, Rattus norvegicus
aataaatgctgtaacgctgcgaggg

SEQ ID NO: 55402 - DNA, 25 bp, Rattus norvegicus
aataaatgctgttacgctgcgaggg

SEQ ID NO: 55403 - DNA, 25 bp, Rattus norvegicus
aataaatgtgccactgaggaacact

SEQ ID NO: 55404 - DNA, 25 bp, Rattus norvegicus
aataaatgtgcctctgaggaacact

SEQ ID NO: 55405 - DNA, 25 bp, Rattus norvegicus
aataaatgttcaactgccttcagga

SEQ ID NO: 55406 - DNA, 25 bp, Rattus norvegicus
aataaatgttcatctgccttcagga

SEQ ID NO: 55407 - DNA, 25 bp, Rattus norvegicus
aataaattaacacccctattcagat

SEQ ID NO: 55408 - DNA, 25 bp, Rattus norvegicus
aataaattaacagccctattcagat

SEQ ID NO: 55409 - DNA, 25 bp, Rattus norvegicus
aataaattccatatggcagccagaa

SEQ ID NO: 55410 - DNA, 25 bp, Rattus norvegicus
aataaattccatttggcagccagaa

SEQ ID NO: 55411 - DNA, 25 bp, Rattus norvegicus
aataaattctctcctcaccaaatag

SEQ ID NO: 55412 - DNA, 25 bp, Rattus norvegicus
aataaattctctgctcaccaaatag

SEQ ID NO: 55413 - DNA, 25 bp, Rattus norvegicus
aataaattggtcctggcccttctct

SEQ ID NO: 55414 - DNA, 25 bp, Rattus norvegicus
aataaattggtcgtggcccttctct

SEQ ID NO: 55415 - DNA, 25 bp, Rattus norvegicus
aataacaacacaccttcagtaccag

SEQ ID NO: 55416 - DNA, 25 bp, Rattus norvegicus
aataacaacacagcttcagtaccag

SEQ ID NO: 55417 - DNA, 25 bp, Rattus norvegicus
aataacaatctcacatccgtttctg

SEQ ID NO: 55418 - DNA, 25 bp, Rattus norvegicus
aataacaatctctcatccgtttctg

SEQ ID NO: 55419 - DNA, 25 bp, Rattus norvegicus
aataacacagtacggcttcttcagt

SEQ ID NO: 55420 - DNA, 25 bp, Rattus norvegicus
aataacacagtagggcttcttcagt

SEQ ID NO: 55421 - DNA, 25 bp, Rattus norvegicus
aataacactgttagctctactgccc

SEQ ID NO: 55422 - DNA, 25 bp, Rattus norvegicus
aataacactgtttgctctactgccc

SEQ ID NO: 55423 - DNA, 25 bp, Rattus norvegicus
aataacataggccaccaccaaagag

SEQ ID NO: 55424 - DNA, 25 bp, Rattus norvegicus
aataacataggcgaccaccaaagag

SEQ ID NO: 55425 - DNA, 25 bp, Rattus norvegicus
aataacatctcaattccctggaaag

SEQ ID NO: 55426 - DNA, 25 bp, Rattus norvegicus
aataacatctcatttccctggaaag

SEQ ID NO: 55427 - DNA, 25 bp, Rattus norvegicus
aataacatctctatccattaaccct

SEQ ID NO: 55428 - DNA, 25 bp, Rattus norvegicus
aataacatctctttccattaaccct

SEQ ID NO: 55429 - DNA, 25 bp, Rattus norvegicus
aataacatgatcagtgttggcttcc

SEQ ID NO: 55430 - DNA, 25 bp, Rattus norvegicus
aataacatgatctgtgttggcttcc

SEQ ID NO: 55431 - DNA, 25 bp, Rattus norvegicus
aataacatgccacaccagagtcaag

SEQ ID NO: 55432 - DNA, 25 bp, Rattus norvegicus
aataacatgccagaccagagtcaag

SEQ ID NO: 55433 - DNA, 25 bp, Rattus norvegicus
aataacatggacatcctcgccttat

SEQ ID NO: 55434 - DNA, 25 bp, Rattus norvegicus
aataacatggacttcctcgccttat

SEQ ID NO: 55435 - DNA, 25 bp, Rattus norvegicus
aataacatggatagaagagactttc

SEQ ID NO: 55436 - DNA, 25 bp, Rattus norvegicus
aataacatggattgaagagactttc

SEQ ID NO: 55437 - DNA, 25 bp, Rattus norvegicus
aataacatttgaatggtcccttcta

SEQ ID NO: 55438 - DNA, 25 bp, Rattus norvegicus
aataacatttgattggtcccttcta

SEQ ID NO: 55439 - DNA, 25 bp, Rattus norvegicus
aataaccaagtgatattctctgttg

SEQ ID NO: 55440 - DNA, 25 bp, Rattus norvegicus
aataaccaagtgttattctctgttg

SEQ ID NO: 55441 - DNA, 25 bp, Rattus norvegicus
aataaccactttcatcatcgaccgt

SEQ ID NO: 55442 - DNA, 25 bp, Rattus norvegicus
aataaccactttgatcatcgaccgt

SEQ ID NO: 55443 - DNA, 25 bp, Rattus norvegicus
aataaccaggtcagtagcccagtcc

SEQ ID NO: 55444 - DNA, 25 bp, Rattus norvegicus
aataaccaggtctgtagcccagtcc

SEQ ID NO: 55445 - DNA, 25 bp, Rattus norvegicus
aataaccagtgtagcctcattcagc

SEQ ID NO: 55446 - DNA, 25 bp, Rattus norvegicus
aataaccagtgttgcctcattcagc

SEQ ID NO: 55447 - DNA, 25 bp, Rattus norvegicus
aataaccatgcaaaagttgctcttt

SEQ ID NO: 55448 - DNA, 25 bp, Rattus norvegicus
aataaccatgcataagttgctcttt

SEQ ID NO: 55449 - DNA, 25 bp, Rattus norvegicus
aataaccatgtgacagaggcacttt

SEQ ID NO: 55450 - DNA, 25 bp, Rattus norvegicus
aataaccatgtgtcagaggcacttt

SEQ ID NO: 55451 - DNA, 25 bp, Rattus norvegicus
aataacccatctctctcagcagtaa

SEQ ID NO: 55452 - DNA, 25 bp, Rattus norvegicus
aataacccatctgtctcagcagtaa

SEQ ID NO: 55453 - DNA, 25 bp, Rattus norvegicus
aataaccctagcaagcctagtgcct

SEQ ID NO: 55454 - DNA, 25 bp, Rattus norvegicus
aataaccctagctagcctagtgcct

SEQ ID NO: 55455 - DNA, 25 bp, Rattus norvegicus
aataaccggcgaaactgctgcattt

SEQ ID NO: 55456 - DNA, 25 bp, Rattus norvegicus
aataaccggcgatactgctgcattt

SEQ ID NO: 55457 - DNA, 25 bp, Rattus norvegicus
aataacctatggcttctgggacaga

SEQ ID NO: 55458 - DNA, 25 bp, Rattus norvegicus
aataacctatgggttctgggacaga

SEQ ID NO: 55459 - DNA, 25 bp, Rattus norvegicus
aataacctctgtcggacaagttggg

SEQ ID NO: 55460 - DNA, 25 bp, Rattus norvegicus
aataacctctgtgggacaagttggg

SEQ ID NO: 55461 - DNA, 25 bp, Rattus norvegicus
aataacctgcatcttctacctggac

SEQ ID NO: 55462 - DNA, 25 bp, Rattus norvegicus
aataacctgcatgttctacctggac

SEQ ID NO: 55463 - DNA, 25 bp, Rattus norvegicus
aataacctggctaggaagtcattgg

SEQ ID NO: 55464 - DNA, 25 bp, Rattus norvegicus
aataacctggcttggaagtcattgg

SEQ ID NO: 55465 - DNA, 25 bp, Rattus norvegicus
aataacctggtcagggcagcttata

SEQ ID NO: 55466 - DNA, 25 bp, Rattus norvegicus
aataacctggtctgggcagcttata

SEQ ID NO: 55467 - DNA, 25 bp, Rattus norvegicus
aataaccttctaatgttgtgctgaa

SEQ ID NO: 55468 - DNA, 25 bp, Rattus norvegicus
aataaccttctattgttgtgctgaa

SEQ ID NO: 55469 - DNA, 25 bp, Rattus norvegicus
aataaccttgaactcattggcacag

SEQ ID NO: 55470 - DNA, 25 bp, Rattus norvegicus
aataaccttgaagtcattggcacag

SEQ ID NO: 55471 - DNA, 25 bp, Rattus norvegicus
aataacgatttcactccggattgta

SEQ ID NO: 55472 - DNA, 25 bp, Rattus norvegicus
aataacgatttctctccggattgta

SEQ ID NO: 55473 - DNA, 25 bp, Rattus norvegicus
aataacgcccgacagcgcctgcgtg

SEQ ID NO: 55474 - DNA, 25 bp, Rattus norvegicus
aataacgcccgagagcgcctgcgtg

SEQ ID NO: 55475 - DNA, 25 bp, Rattus norvegicus
aataacgcctggcacctgaggtgtg

SEQ ID NO: 55476 - DNA, 25 bp, Rattus norvegicus
aataacgcctgggacctgaggtgtg

SEQ ID NO: 55477 - DNA, 25 bp, Rattus norvegicus
aataacggtgagattccagctgtag

SEQ ID NO: 55478 - DNA, 25 bp, Rattus norvegicus
aataacggtgagtttccagctgtag

SEQ ID NO: 55479 - DNA, 25 bp, Rattus norvegicus
aataacgtctccagtttgctcttaa

SEQ ID NO: 55480 - DNA, 25 bp, Rattus norvegicus
aataacgtctcctgtttgctcttaa

SEQ ID NO: 55481 - DNA, 25 bp, Rattus norvegicus
aataactactctaaagaccaccctg

SEQ ID NO: 55482 - DNA, 25 bp, Rattus norvegicus
aataactactcttaagaccaccctg

SEQ ID NO: 55483 - DNA, 25 bp, Rattus norvegicus
aataactagggaattctgaggaatg

SEQ ID NO: 55484 - DNA, 25 bp, Rattus norvegicus
aataactagggatttctgaggaatg

SEQ ID NO: 55485 - DNA, 25 bp, Rattus norvegicus
aataactcactaatatgccgaaatt

SEQ ID NO: 55486 - DNA, 25 bp, Rattus norvegicus
aataactcactattatgccgaaatt

SEQ ID NO: 55487 - DNA, 25 bp, Rattus norvegicus
aataactcagcaccttctgcagaac

SEQ ID NO: 55488 - DNA, 25 bp, Rattus norvegicus
aataactcagcagcttctgcagaac

SEQ ID NO: 55489 - DNA, 25 bp, Rattus norvegicus
aataactcagccaggcagcccctgg

SEQ ID NO: 55490 - DNA, 25 bp, Rattus norvegicus
aataactcagcctggcagcccctgg

SEQ ID NO: 55491 - DNA, 25 bp, Rattus norvegicus
aataactcagtcactaagtcgcaaa

SEQ ID NO: 55492 - DNA, 25 bp, Rattus norvegicus
aataactcagtctctaagtcgcaaa

SEQ ID NO: 55493 - DNA, 25 bp, Rattus norvegicus
aataactcccttatgctcaaactgt

SEQ ID NO: 55494 - DNA, 25 bp, Rattus norvegicus
aataactcccttttgctcaaactgt

SEQ ID NO: 55495 - DNA, 25 bp, Rattus norvegicus
aataactcctccattgtagctgatt

SEQ ID NO: 55496 - DNA, 25 bp, Rattus norvegicus
aataactcctcctttgtagctgatt

SEQ ID NO: 55497 - DNA, 25 bp, Rattus norvegicus
aataactgacatcgtccccgtgtga

SEQ ID NO: 55498 - DNA, 25 bp, Rattus norvegicus
aataactgacatggtccccgtgtga

SEQ ID NO: 55499 - DNA, 25 bp, Rattus norvegicus
aataactgcacacttgagacaccca

SEQ ID NO: 55500 - DNA, 25 bp, Rattus norvegicus
aataactgcacagttgagacaccca

SEQ ID NO: 55501 - DNA, 25 bp, Rattus norvegicus
aataactgctccaatgttttcctcc

SEQ ID NO: 55502 - DNA, 25 bp, Rattus norvegicus
aataactgctcctatgttttcctcc

SEQ ID NO: 55503 - DNA, 25 bp, Rattus norvegicus
aataactggatcattctgctgacaa

SEQ ID NO: 55504 - DNA, 25 bp, Rattus norvegicus
aataactggatctttctgctgacaa

SEQ ID NO: 55505 - DNA, 25 bp, Rattus norvegicus
aataactggctactttgcttcacca

SEQ ID NO: 55506 - DNA, 25 bp, Rattus norvegicus
aataactggctagtttgcttcacca

SEQ ID NO: 55507 - DNA, 25 bp, Rattus norvegicus
aataactgtccaaggcgtctctgtt

SEQ ID NO: 55508 - DNA, 25 bp, Rattus norvegicus
aataactgtccatggcgtctctgtt

SEQ ID NO: 55509 - DNA, 25 bp, Rattus norvegicus
aataactgtgctataggtcctgctt

SEQ ID NO: 55510 - DNA, 25 bp, Rattus norvegicus
aataactgtgctttaggtcctgctt

SEQ ID NO: 55511 - DNA, 25 bp, Rattus norvegicus
aataacttaggacgcatggtagtgc

SEQ ID NO: 55512 - DNA, 25 bp, Rattus norvegicus
aataacttaggaggcatggtagtgc

SEQ ID NO: 55513 - DNA, 25 bp, Rattus norvegicus
aataacttcaatacctctcacgtgt

SEQ ID NO: 55514 - DNA, 25 bp, Rattus norvegicus
aataacttcaattcctctcacgtgt

SEQ ID NO: 55515 - DNA, 25 bp, Rattus norvegicus
aataacttgcttcgatctcgttgct

SEQ ID NO: 55516 - DNA, 25 bp, Rattus norvegicus
aataacttgcttggatctcgttgct

SEQ ID NO: 55517 - DNA, 25 bp, Rattus norvegicus
aataactttctacagccacttcatg

SEQ ID NO: 55518 - DNA, 25 bp, Rattus norvegicus
aataactttctagagccacttcatg

SEQ ID NO: 55519 - DNA, 25 bp, Rattus norvegicus
aataacttttctccatcacacacac

SEQ ID NO: 55520 - DNA, 25 bp, Rattus norvegicus
aataacttttctgcatcacacacac

SEQ ID NO: 55521 - DNA, 25 bp, Rattus norvegicus
aataactttttacatgcacctccta

SEQ ID NO: 55522 - DNA, 25 bp, Rattus norvegicus
aataactttttagatgcacctccta

SEQ ID NO: 55523 - DNA, 25 bp, Rattus norvegicus
aataagaagttcactgtgcgctatt

SEQ ID NO: 55524 - DNA, 25 bp, Rattus norvegicus
aataagaagttctctgtgcgctatt

SEQ ID NO: 55525 - DNA, 25 bp, Rattus norvegicus
aataagacatacctctacctatgct

SEQ ID NO: 55526 - DNA, 25 bp, Rattus norvegicus
aataagacatacgtctacctatgct

SEQ ID NO: 55527 - DNA, 25 bp, Rattus norvegicus
aataagacggaccatgattgaggaa

SEQ ID NO: 55528 - DNA, 25 bp, Rattus norvegicus
aataagacggacgatgattgaggaa

SEQ ID NO: 55529 - DNA, 25 bp, Rattus norvegicus
aataagagttgcatggccagagctg

SEQ ID NO: 55530 - DNA, 25 bp, Rattus norvegicus
aataagagttgcttggccagagctg

SEQ ID NO: 55531 - DNA, 25 bp, Rattus norvegicus
aataagagttgtctctttctgtaaa

SEQ ID NO: 55532 - DNA, 25 bp, Rattus norvegicus
aataagagttgtgtctttctgtaaa

SEQ ID NO: 55533 - DNA, 25 bp, Rattus norvegicus
aataagatccggcagctccttcagc

SEQ ID NO: 55534 - DNA, 25 bp, Rattus norvegicus
aataagatccgggagctccttcagc

SEQ ID NO: 55535 - DNA, 25 bp, Rattus norvegicus
aataagatcgagaccattcccagcg

SEQ ID NO: 55536 - DNA, 25 bp, Rattus norvegicus
aataagatcgagtccattcccagcg

SEQ ID NO: 55537 - DNA, 25 bp, Rattus norvegicus
aataagatctcacttgcacgtgcaa

SEQ ID NO: 55538 - DNA, 25 bp, Rattus norvegicus
aataagatctcagttgcacgtgcaa

SEQ ID NO: 55539 - DNA, 25 bp, Rattus norvegicus
aataagatgtccatgtggccctctg

SEQ ID NO: 55540 - DNA, 25 bp, Rattus norvegicus
aataagatgtccttgtggccctctg

SEQ ID NO: 55541 - DNA, 25 bp, Rattus norvegicus
aataagcaagccatctctgaagagt

SEQ ID NO: 55542 - DNA, 25 bp, Rattus norvegicus
aataagcaagccttctctgaagagt

SEQ ID NO: 55543 - DNA, 25 bp, Rattus norvegicus
aataagcaccaaccgtccttggtca

SEQ ID NO: 55544 - DNA, 25 bp, Rattus norvegicus
aataagcaccaagcgtccttggtca

SEQ ID NO: 55545 - DNA, 25 bp, Rattus norvegicus
aataagcagaggctgtctgacagag

SEQ ID NO: 55546 - DNA, 25 bp, Rattus norvegicus
aataagcagagggtgtctgacagag

SEQ ID NO: 55547 - DNA, 25 bp, Rattus norvegicus
aataagcaggcaacttccagctctg

SEQ ID NO: 55548 - DNA, 25 bp, Rattus norvegicus
aataagcaggcatcttccagctctg

SEQ ID NO: 55549 - DNA, 25 bp, Rattus norvegicus
aataagcataccatctgtgctggcc

SEQ ID NO: 55550 - DNA, 25 bp, Rattus norvegicus
aataagcataccttctgtgctggcc

SEQ ID NO: 55551 - DNA, 25 bp, Rattus norvegicus
aataagccagcccacactagaattc

SEQ ID NO: 55552 - DNA, 25 bp, Rattus norvegicus
aataagccagccgacactagaattc

SEQ ID NO: 55553 - DNA, 25 bp, Rattus norvegicus
aataagccagtgctggtcagccctt

SEQ ID NO: 55554 - DNA, 25 bp, Rattus norvegicus
aataagccagtggtggtcagccctt

SEQ ID NO: 55555 - DNA, 25 bp, Rattus norvegicus
aataagccgtttacctttggcagag

SEQ ID NO: 55556 - DNA, 25 bp, Rattus norvegicus
aataagccgttttcctttggcagag

SEQ ID NO: 55557 - DNA, 25 bp, Rattus norvegicus
aataagcctcacactgttcgatggt

SEQ ID NO: 55558 - DNA, 25 bp, Rattus norvegicus
aataagcctcactctgttcgatggt

SEQ ID NO: 55559 - DNA, 25 bp, Rattus norvegicus
aataagcctttaatacgctggagga

SEQ ID NO: 55560 - DNA, 25 bp, Rattus norvegicus
aataagcctttattacgctggagga

SEQ ID NO: 55561 - DNA, 25 bp, Rattus norvegicus
aataagccttttcactttgggtgat

SEQ ID NO: 55562 - DNA, 25 bp, Rattus norvegicus
aataagccttttgactttgggtgat

SEQ ID NO: 55563 - DNA, 25 bp, Rattus norvegicus
aataagcgtccacgctctttatgaa

SEQ ID NO: 55564 - DNA, 25 bp, Rattus norvegicus
aataagcgtccaggctctttatgaa

SEQ ID NO: 55565 - DNA, 25 bp, Rattus norvegicus
aataagctatcgatgggccccaaat

SEQ ID NO: 55566 - DNA, 25 bp, Rattus norvegicus
aataagctatcgttgggccccaaat

SEQ ID NO: 55567 - DNA, 25 bp, Rattus norvegicus
aataagctcaccatagttggctatt

SEQ ID NO: 55568 - DNA, 25 bp, Rattus norvegicus
aataagctcaccttagttggctatt

SEQ ID NO: 55569 - DNA, 25 bp, Rattus norvegicus
aataagctctgcaaactccagcgag

SEQ ID NO: 55570 - DNA, 25 bp, Rattus norvegicus
aataagctctgctaactccagcgag

SEQ ID NO: 55571 - DNA, 25 bp, Rattus norvegicus
aataagctggctctcaaattcctac

SEQ ID NO: 55572 - DNA, 25 bp, Rattus norvegicus
aataagctggctgtcaaattcctac

SEQ ID NO: 55573 - DNA, 25 bp, Rattus norvegicus
aataagctgtggaatcctaccagga

SEQ ID NO: 55574 - DNA, 25 bp, Rattus norvegicus
aataagctgtggtatcctaccagga

SEQ ID NO: 55575 - DNA, 25 bp, Rattus norvegicus
aataagcttctgagttgaattgttt

SEQ ID NO: 55576 - DNA, 25 bp, Rattus norvegicus
aataagcttctgtgttgaattgttt

SEQ ID NO: 55577 - DNA, 25 bp, Rattus norvegicus
aataaggaacaaagatgtcacttga

SEQ ID NO: 55578 - DNA, 25 bp, Rattus norvegicus
aataaggaacaatgatgtcacttga

SEQ ID NO: 55579 - DNA, 25 bp, Rattus norvegicus
aataaggaacccagctgtgcctatt

SEQ ID NO: 55580 - DNA, 25 bp, Rattus norvegicus
aataaggaaccctgctgtgcctatt

SEQ ID NO: 55581 - DNA, 25 bp, Rattus norvegicus
aataaggacttacggacactacatc

SEQ ID NO: 55582 - DNA, 25 bp, Rattus norvegicus
aataaggacttagggacactacatc

SEQ ID NO: 55583 - DNA, 25 bp, Rattus norvegicus
aataaggagttcatgctgtgccgct

SEQ ID NO: 55584 - DNA, 25 bp, Rattus norvegicus
aataaggagttcttgctgtgccgct

SEQ ID NO: 55585 - DNA, 25 bp, Rattus norvegicus
aataaggcccacctgggtgtgactt

SEQ ID NO: 55586 - DNA, 25 bp, Rattus norvegicus
aataaggcccacgtgggtgtgactt

SEQ ID NO: 55587 - DNA, 25 bp, Rattus norvegicus
aataaggccctgagcagactgcaga

SEQ ID NO: 55588 - DNA, 25 bp, Rattus norvegicus
aataaggccctgcagagcttttggg

SEQ ID NO: 55589 - DNA, 25 bp, Rattus norvegicus
aataaggccctggagagcttttggg

SEQ ID NO: 55590 - DNA, 25 bp, Rattus norvegicus
aataaggccctgtgcagactgcaga

SEQ ID NO: 55591 - DNA, 25 bp, Rattus norvegicus
aataaggcctctctagccatggcta

SEQ ID NO: 55592 - DNA, 25 bp, Rattus norvegicus
aataaggcctctgtagccatggcta

SEQ ID NO: 55593 - DNA, 25 bp, Rattus norvegicus
aataaggctgtaaaattctctctca

SEQ ID NO: 55594 - DNA, 25 bp, Rattus norvegicus
aataaggctgtataattctctctca

SEQ ID NO: 55595 - DNA, 25 bp, Rattus norvegicus
aataaggcttgcaaacttccagaaa

SEQ ID NO: 55596 - DNA, 25 bp, Rattus norvegicus
aataaggcttgctaacttccagaaa

SEQ ID NO: 55597 - DNA, 25 bp, Rattus norvegicus
aataagggctggaatttcgcctctg

SEQ ID NO: 55598 - DNA, 25 bp, Rattus norvegicus
aataagggctggtatttcgcctctg

SEQ ID NO: 55599 - DNA, 25 bp, Rattus norvegicus
aataagggcttcacttcagtctcac

SEQ ID NO: 55600 - DNA, 25 bp, Rattus norvegicus
aataagggcttctcttcagtctcac

SEQ ID NO: 55601 - DNA, 25 bp, Rattus norvegicus
aataagggtgtgagcgtacatgcgt

SEQ ID NO: 55602 - DNA, 25 bp, Rattus norvegicus
aataagggtgtgtgcgtacatgcgt

SEQ ID NO: 55603 - DNA, 25 bp, Rattus norvegicus
aataaggtcattcctccctaatctt

SEQ ID NO: 55604 - DNA, 25 bp, Rattus norvegicus
aataaggtcattgctccctaatctt

SEQ ID NO: 55605 - DNA, 25 bp, Rattus norvegicus
aataagtacagaaggctggtgcgat

SEQ ID NO: 55606 - DNA, 25 bp, Rattus norvegicus
aataagtacagatggctggtgcgat

SEQ ID NO: 55607 - DNA, 25 bp, Rattus norvegicus
aataagtccctcattaggcatcctg

SEQ ID NO: 55608 - DNA, 25 bp, Rattus norvegicus
aataagtccctctttaggcatcctg

SEQ ID NO: 55609 - DNA, 25 bp, Rattus norvegicus
aataagtcgatcagtatttctgtgt

SEQ ID NO: 55610 - DNA, 25 bp, Rattus norvegicus
aataagtcgatctgtatttctgtgt

SEQ ID NO: 55611 - DNA, 25 bp, Rattus norvegicus
aataagtgcaacaagagagcctggc

SEQ ID NO: 55612 - DNA, 25 bp, Rattus norvegicus
aataagtgcaactagagagcctggc

SEQ ID NO: 55613 - DNA, 25 bp, Rattus norvegicus
aataagtgcttgcagctcttagccc

SEQ ID NO: 55614 - DNA, 25 bp, Rattus norvegicus
aataagtgcttggagctcttagccc

SEQ ID NO: 55615 - DNA, 25 bp, Rattus norvegicus
aataagttcacccttcctagctctt

SEQ ID NO: 55616 - DNA, 25 bp, Rattus norvegicus
aataagttcaccgttcctagctctt

SEQ ID NO: 55617 - DNA, 25 bp, Rattus norvegicus
aataagttcctgagtggctttggcc

SEQ ID NO: 55618 - DNA, 25 bp, Rattus norvegicus
aataagttcctgtgtggctttggcc

SEQ ID NO: 55619 - DNA, 25 bp, Rattus norvegicus
aataagttctacatccctgttctca

SEQ ID NO: 55620 - DNA, 25 bp, Rattus norvegicus
aataagttctacttccctgttctca

SEQ ID NO: 55621 - DNA, 25 bp, Rattus norvegicus
aataagttgcttactcaggagtccc

SEQ ID NO: 55622 - DNA, 25 bp, Rattus norvegicus
aataagttgctttctcaggagtccc

SEQ ID NO: 55623 - DNA, 25 bp, Rattus norvegicus
aataagttgtttaagctgtcacggg

SEQ ID NO: 55624 - DNA, 25 bp, Rattus norvegicus
aataagttgttttagctgtcacggg

SEQ ID NO: 55625 - DNA, 25 bp, Rattus norvegicus
aataagtttggtactctccacggcg

SEQ ID NO: 55626 - DNA, 25 bp, Rattus norvegicus
aataagtttggttctctccacggcg

SEQ ID NO: 55627 - DNA, 25 bp, Rattus norvegicus
aataagtttgttaccctctggtgtg

SEQ ID NO: 55628 - DNA, 25 bp, Rattus norvegicus
aataagtttgtttccctctggtgtg

SEQ ID NO: 55629 - DNA, 25 bp, Rattus norvegicus
aataagttttgaatggctccatgaa

SEQ ID NO: 55630 - DNA, 25 bp, Rattus norvegicus
aataagttttgattggctccatgaa

SEQ ID NO: 55631 - DNA, 25 bp, Rattus norvegicus
aataataacaagacgcggaagaggc

SEQ ID NO: 55632 - DNA, 25 bp, Rattus norvegicus
aataataacaagtcgcggaagaggc

SEQ ID NO: 55633 - DNA, 25 bp, Rattus norvegicus
aataataccgagaggagcttgtggg

SEQ ID NO: 55634 - DNA, 25 bp, Rattus norvegicus
aataataccgagtggagcttgtggg

SEQ ID NO: 55635 - DNA, 25 bp, Rattus norvegicus
aataatacgcgactccctgtaatcc

SEQ ID NO: 55636 - DNA, 25 bp, Rattus norvegicus
aataatacgcgagtccctgtaatcc

SEQ ID NO: 55637 - DNA, 25 bp, Rattus norvegicus
aataatactctgatggactgggcgt

SEQ ID NO: 55638 - DNA, 25 bp, Rattus norvegicus
aataatactctgttggactgggcgt

SEQ ID NO: 55639 - DNA, 25 bp, Rattus norvegicus
aataatacttgcctacctacctcac

SEQ ID NO: 55640 - DNA, 25 bp, Rattus norvegicus
aataatacttgcctgcttgtgacag

SEQ ID NO: 55641 - DNA, 25 bp, Rattus norvegicus
aataatacttgcgtacctacctcac

SEQ ID NO: 55642 - DNA, 25 bp, Rattus norvegicus
aataatacttgcgtgcttgtgacag

SEQ ID NO: 55643 - DNA, 25 bp, Rattus norvegicus
aataatataatgatgcctctagagc

SEQ ID NO: 55644 - DNA, 25 bp, Rattus norvegicus
aataatataatgttgcctctagagc

SEQ ID NO: 55645 - DNA, 25 bp, Rattus norvegicus
aataatatctctcctcccaaaagtt

SEQ ID NO: 55646 - DNA, 25 bp, Rattus norvegicus
aataatatctctgctcccaaaagtt

SEQ ID NO: 55647 - DNA, 25 bp, Rattus norvegicus
aataatattggactacccgctgcaa

SEQ ID NO: 55648 - DNA, 25 bp, Rattus norvegicus
aataatattggagtacccgctgcaa

SEQ ID NO: 55649 - DNA, 25 bp, Rattus norvegicus
aataatattgtgacctaagcttttt

SEQ ID NO: 55650 - DNA, 25 bp, Rattus norvegicus
aataatattgtgtcctaagcttttt

SEQ ID NO: 55651 - DNA, 25 bp, Rattus norvegicus
aataatcaccatctcagcccaaaga

SEQ ID NO: 55652 - DNA, 25 bp, Rattus norvegicus
aataatcaccatgtcagcccaaaga

SEQ ID NO: 55653 - DNA, 25 bp, Rattus norvegicus
aataatcactccctcatcctaattg

SEQ ID NO: 55654 - DNA, 25 bp, Rattus norvegicus
aataatcactccgtcatcctaattg

SEQ ID NO: 55655 - DNA, 25 bp, Rattus norvegicus
aataatcagctaacttgttccaatg

SEQ ID NO: 55656 - DNA, 25 bp, Rattus norvegicus
aataatcagctatcttgttccaatg

SEQ ID NO: 55657 - DNA, 25 bp, Rattus norvegicus
aataatcagctgctatcggtggact

SEQ ID NO: 55658 - DNA, 25 bp, Rattus norvegicus
aataatcagctggtatcggtggact

SEQ ID NO: 55659 - DNA, 25 bp, Rattus norvegicus
aataatccctgtccatcctgtgagt

SEQ ID NO: 55660 - DNA, 25 bp, Rattus norvegicus
aataatccctgtgcatcctgtgagt

SEQ ID NO: 55661 - DNA, 25 bp, Rattus norvegicus
aataatcctttcacattacctgctg

SEQ ID NO: 55662 - DNA, 25 bp, Rattus norvegicus
aataatcctttctcattacctgctg

SEQ ID NO: 55663 - DNA, 25 bp, Rattus norvegicus
aataatctgactctgggctgggtgt

SEQ ID NO: 55664 - DNA, 25 bp, Rattus norvegicus
aataatctgactgtgggctgggtgt

SEQ ID NO: 55665 - DNA, 25 bp, Rattus norvegicus
aataatcttcatcaccgagacgcac

SEQ ID NO: 55666 - DNA, 25 bp, Rattus norvegicus
aataatcttcatgaccgagacgcac

SEQ ID NO: 55667 - DNA, 25 bp, Rattus norvegicus
aataatgactcacgccggagagatg

SEQ ID NO: 55668 - DNA, 25 bp, Rattus norvegicus
aataatgactcaggccggagagatg

SEQ ID NO: 55669 - DNA, 25 bp, Rattus norvegicus
aataatgactggaccctgtcacgca

SEQ ID NO: 55670 - DNA, 25 bp, Rattus norvegicus
aataatgactggtccctgtcacgca

SEQ ID NO: 55671 - DNA, 25 bp, Rattus norvegicus
aataatgatttccttctccacagca

SEQ ID NO: 55672 - DNA, 25 bp, Rattus norvegicus
aataatgatttcgttctccacagca

SEQ ID NO: 55673 - DNA, 25 bp, Rattus norvegicus
aataatgatttgagtgccaggctaa

SEQ ID NO: 55674 - DNA, 25 bp, Rattus norvegicus
aataatgatttgtgtgccaggctaa

SEQ ID NO: 55675 - DNA, 25 bp, Rattus norvegicus
aataatgcactgagcccaactgaga

SEQ ID NO: 55676 - DNA, 25 bp, Rattus norvegicus
aataatgcactgtgcccaactgaga

SEQ ID NO: 55677 - DNA, 25 bp, Rattus norvegicus
aataatgcctgcagggtagtctcca

SEQ ID NO: 55678 - DNA, 25 bp, Rattus norvegicus
aataatgcctgctgggtagtctcca

SEQ ID NO: 55679 - DNA, 25 bp, Rattus norvegicus
aataatgcctgtactcagccatgct

SEQ ID NO: 55680 - DNA, 25 bp, Rattus norvegicus
aataatgcctgttctcagccatgct

SEQ ID NO: 55681 - DNA, 25 bp, Rattus norvegicus
aataatgctattcacaggattctga

SEQ ID NO: 55682 - DNA, 25 bp, Rattus norvegicus
aataatgctattgacaggattctga

SEQ ID NO: 55683 - DNA, 25 bp, Rattus norvegicus
aataatgctgatatggtgaccaggc

SEQ ID NO: 55684 - DNA, 25 bp, Rattus norvegicus
aataatgctgatttggtgaccaggc

SEQ ID NO: 55685 - DNA, 25 bp, Rattus norvegicus
aataatgctgctccttgttaccttt

SEQ ID NO: 55686 - DNA, 25 bp, Rattus norvegicus
aataatgctgctgcttgttaccttt

SEQ ID NO: 55687 - DNA, 25 bp, Rattus norvegicus
aataatgcttgtactggccagggat

SEQ ID NO: 55688 - DNA, 25 bp, Rattus norvegicus
aataatgcttgttctggccagggat

SEQ ID NO: 55689 - DNA, 25 bp, Rattus norvegicus
aataatgcttttcaactggatgtat

SEQ ID NO: 55690 - DNA, 25 bp, Rattus norvegicus
aataatgcttttgaactggatgtat

SEQ ID NO: 55691 - DNA, 25 bp, Rattus norvegicus
aataatggcattcacccaactctac

SEQ ID NO: 55692 - DNA, 25 bp, Rattus norvegicus
aataatggcattgacccaactctac

SEQ ID NO: 55693 - DNA, 25 bp, Rattus norvegicus
aataatggctttcgcaaatgtgcta

SEQ ID NO: 55694 - DNA, 25 bp, Rattus norvegicus
aataatggctttggcaaatgtgcta

SEQ ID NO: 55695 - DNA, 25 bp, Rattus norvegicus
aataatgggagcaggacctgatgtg

SEQ ID NO: 55696 - DNA, 25 bp, Rattus norvegicus
aataatgggagctggacctgatgtg

SEQ ID NO: 55697 - DNA, 25 bp, Rattus norvegicus
aataatggtattcggcctggcctag

SEQ ID NO: 55698 - DNA, 25 bp, Rattus norvegicus
aataatggtattgggcctggcctag

SEQ ID NO: 55699 - DNA, 25 bp, Rattus norvegicus
aataatggtgctcactgctcacctg

SEQ ID NO: 55700 - DNA, 25 bp, Rattus norvegicus
aataatggtgctgactgctcacctg

SEQ ID NO: 55701 - DNA, 25 bp, Rattus norvegicus
aataatgtagacagggaagttccct

SEQ ID NO: 55702 - DNA, 25 bp, Rattus norvegicus
aataatgtagactgggaagttccct

SEQ ID NO: 55703 - DNA, 25 bp, Rattus norvegicus
aataatgtcattacactttgtgtcc

SEQ ID NO: 55704 - DNA, 25 bp, Rattus norvegicus
aataatgtcatttcactttgtgtcc

SEQ ID NO: 55705 - DNA, 25 bp, Rattus norvegicus
aataatgtctcgatttcagatttga

SEQ ID NO: 55706 - DNA, 25 bp, Rattus norvegicus
aataatgtctcgttttcagatttga

SEQ ID NO: 55707 - DNA, 25 bp, Rattus norvegicus
aataatgtgatgaatgcctgtctat

SEQ ID NO: 55708 - DNA, 25 bp, Rattus norvegicus
aataatgtgatgtatgcctgtctat

SEQ ID NO: 55709 - DNA, 25 bp, Rattus norvegicus
aataatgtggccctatcatgtgtag

SEQ ID NO: 55710 - DNA, 25 bp, Rattus norvegicus
aataatgtggccgtatcatgtgtag

SEQ ID NO: 55711 - DNA, 25 bp, Rattus norvegicus
aataatgtgttcagttttgtaatgt

SEQ ID NO: 55712 - DNA, 25 bp, Rattus norvegicus
aataatgtgttctgttttgtaatgt

SEQ ID NO: 55713 - DNA, 25 bp, Rattus norvegicus
aataatgttactcgccttgttgggt

SEQ ID NO: 55714 - DNA, 25 bp, Rattus norvegicus
aataatgttactggccttgttgggt

SEQ ID NO: 55715 - DNA, 25 bp, Rattus norvegicus
aataatgttcctatgcctggtacac

SEQ ID NO: 55716 - DNA, 25 bp, Rattus norvegicus
aataatgttcctttgcctggtacac

SEQ ID NO: 55717 - DNA, 25 bp, Rattus norvegicus
aataatgttgtcaccattttacaga

SEQ ID NO: 55718 - DNA, 25 bp, Rattus norvegicus
aataatgttgtctccattttacaga

SEQ ID NO: 55719 - DNA, 25 bp, Rattus norvegicus
aataattactccattgcttgcttgt

SEQ ID NO: 55720 - DNA, 25 bp, Rattus norvegicus
aataattactcctttgcttgcttgt

SEQ ID NO: 55721 - DNA, 25 bp, Rattus norvegicus
aataattatgacatgcccacgtgca

SEQ ID NO: 55722 - DNA, 25 bp, Rattus norvegicus
aataattatgacttgcccacgtgca

SEQ ID NO: 55723 - DNA, 25 bp, Rattus norvegicus
aataattccgttacaactactgtgt

SEQ ID NO: 55724 - DNA, 25 bp, Rattus norvegicus
aataattccgtttcaactactgtgt

SEQ ID NO: 55725 - DNA, 25 bp, Rattus norvegicus
aataattcctatacctggcagactt

SEQ ID NO: 55726 - DNA, 25 bp, Rattus norvegicus
aataattcctattcctggcagactt

SEQ ID NO: 55727 - DNA, 25 bp, Rattus norvegicus
aataattcttagcttcactcttaat

SEQ ID NO: 55728 - DNA, 25 bp, Rattus norvegicus
aataattcttaggttcactcttaat

SEQ ID NO: 55729 - DNA, 25 bp, Rattus norvegicus
aataattgcttgaaccctaggtaat

SEQ ID NO: 55730 - DNA, 25 bp, Rattus norvegicus
aataattgcttgtaccctaggtaat

SEQ ID NO: 55731 - DNA, 25 bp, Rattus norvegicus
aataattgtgtactggatgtggaga

SEQ ID NO: 55732 - DNA, 25 bp, Rattus norvegicus
aataattgtgtagtggatgtggaga

SEQ ID NO: 55733 - DNA, 25 bp, Rattus norvegicus
aataattgttccactgggtctctgg

SEQ ID NO: 55734 - DNA, 25 bp, Rattus norvegicus
aataattgttcctctgggtctctgg

SEQ ID NO: 55735 - DNA, 25 bp, Rattus norvegicus
aataatttatccacttgaccaccct

SEQ ID NO: 55736 - DNA, 25 bp, Rattus norvegicus
aataatttatcctcttgaccaccct

SEQ ID NO: 55737 - DNA, 25 bp, Rattus norvegicus
aataattttcagacatgtaccacat

SEQ ID NO: 55738 - DNA, 25 bp, Rattus norvegicus
aataattttcagtcatgtaccacat

SEQ ID NO: 55739 - DNA, 25 bp, Rattus norvegicus
aataattttccgctcttaactgtgg

SEQ ID NO: 55740 - DNA, 25 bp, Rattus norvegicus
aataattttccggtcttaactgtgg

SEQ ID NO: 55741 - DNA, 25 bp, Rattus norvegicus
aataattttgctcattgtttttggg

SEQ ID NO: 55742 - DNA, 25 bp, Rattus norvegicus
aataattttgctgattgtttttggg

SEQ ID NO: 55743 - DNA, 25 bp, Rattus norvegicus
aatacaaaattgctgccctgtggca

SEQ ID NO: 55744 - DNA, 25 bp, Rattus norvegicus
aatacaaaattggtgccctgtggca

SEQ ID NO: 55745 - DNA, 25 bp, Rattus norvegicus
aatacaaagccacctccttggagga

SEQ ID NO: 55746 - DNA, 25 bp, Rattus norvegicus
aatacaaagccagctccttggagga

SEQ ID NO: 55747 - DNA, 25 bp, Rattus norvegicus
aatacaaagggcacagggaggctcc

SEQ ID NO: 55748 - DNA, 25 bp, Rattus norvegicus
aatacaaagggctcagggaggctcc

SEQ ID NO: 55749 - DNA, 25 bp, Rattus norvegicus
aatacaaatcacatcctgacccagg

SEQ ID NO: 55750 - DNA, 25 bp, Rattus norvegicus
aatacaaatcacttcctgacccagg

SEQ ID NO: 55751 - DNA, 25 bp, Rattus norvegicus
aatacaactgcgctggctcaatgcc

SEQ ID NO: 55752 - DNA, 25 bp, Rattus norvegicus
aatacaactgcggtggctcaatgcc

SEQ ID NO: 55753 - DNA, 25 bp, Rattus norvegicus
aatacaactgctccgcccattagtt

SEQ ID NO: 55754 - DNA, 25 bp, Rattus norvegicus
aatacaactgctgcgcccattagtt

SEQ ID NO: 55755 - DNA, 25 bp, Rattus norvegicus
aatacaactggtactcaccacagca

SEQ ID NO: 55756 - DNA, 25 bp, Rattus norvegicus
aatacaactggttctcaccacagca

SEQ ID NO: 55757 - DNA, 25 bp, Rattus norvegicus
aatacaacttgaactttcaggagta

SEQ ID NO: 55758 - DNA, 25 bp, Rattus norvegicus
aatacaacttgatctttcaggagta

SEQ ID NO: 55759 - DNA, 25 bp, Rattus norvegicus
aatacaaggctgacaacccaggcag

SEQ ID NO: 55760 - DNA, 25 bp, Rattus norvegicus
aatacaaggctgtcaacccaggcag

SEQ ID NO: 55761 - DNA, 25 bp, Rattus norvegicus
aatacaagtgtgctggctttcccta

SEQ ID NO: 55762 - DNA, 25 bp, Rattus norvegicus
aatacaagtgtggtggctttcccta

SEQ ID NO: 55763 - DNA, 25 bp, Rattus norvegicus
aatacaagtgttcccgggtcttgca

SEQ ID NO: 55764 - DNA, 25 bp, Rattus norvegicus
aatacaagtgttgccgggtcttgca

SEQ ID NO: 55765 - DNA, 25 bp, Rattus norvegicus
aatacaatcacgctctgagctccct

SEQ ID NO: 55766 - DNA, 25 bp, Rattus norvegicus
aatacaatcacggtctgagctccct

SEQ ID NO: 55767 - DNA, 25 bp, Rattus norvegicus
aatacaatggctccaaccaacgctt

SEQ ID NO: 55768 - DNA, 25 bp, Rattus norvegicus
aatacaatggctgcaaccaacgctt

SEQ ID NO: 55769 - DNA, 25 bp, Rattus norvegicus
aatacaatggtacttttcgaatgat

SEQ ID NO: 55770 - DNA, 25 bp, Rattus norvegicus
aatacaatggtagttttcgaatgat

SEQ ID NO: 55771 - DNA, 25 bp, Rattus norvegicus
aatacaatgtcaacaggtcacctga

SEQ ID NO: 55772 - DNA, 25 bp, Rattus norvegicus
aatacaatgtcatcaggtcacctga

SEQ ID NO: 55773 - DNA, 25 bp, Rattus norvegicus
aatacaattcctcgcattgtggtga

SEQ ID NO: 55774 - DNA, 25 bp, Rattus norvegicus
aatacaattcctggcattgtggtga

SEQ ID NO: 55775 - DNA, 25 bp, Rattus norvegicus
aatacaattggcacgtgctgcgtct

SEQ ID NO: 55776 - DNA, 25 bp, Rattus norvegicus
aatacaattggctcgtgctgcgtct

SEQ ID NO: 55777 - DNA, 25 bp, Rattus norvegicus
aatacacacatcatctagcttctcg

SEQ ID NO: 55778 - DNA, 25 bp, Rattus norvegicus
aatacacacatcttctagcttctcg

SEQ ID NO: 55779 - DNA, 25 bp, Rattus norvegicus
aatacacatcagatgaagttaagga

SEQ ID NO: 55780 - DNA, 25 bp, Rattus norvegicus
aatacacatcagttgaagttaagga

SEQ ID NO: 55781 - DNA, 25 bp, Rattus norvegicus
aatacaccagcgctaagtaaacttt

SEQ ID NO: 55782 - DNA, 25 bp, Rattus norvegicus
aatacaccagcggtaagtaaacttt

SEQ ID NO: 55783 - DNA, 25 bp, Rattus norvegicus
aatacaccaggtatgtgctctaatt

SEQ ID NO: 55784 - DNA, 25 bp, Rattus norvegicus
aatacaccaggtttgtgctctaatt

SEQ ID NO: 55785 - DNA, 25 bp, Rattus norvegicus
aatacaccccataacttttctggcg

SEQ ID NO: 55786 - DNA, 25 bp, Rattus norvegicus
aatacaccccattacttttctggcg

SEQ ID NO: 55787 - DNA, 25 bp, Rattus norvegicus
aatacacctcataagtttggctagg

SEQ ID NO: 55788 - DNA, 25 bp, Rattus norvegicus
aatacacctcattagtttggctagg

SEQ ID NO: 55789 - DNA, 25 bp, Rattus norvegicus
aatacacctctaacttgcatgggaa

SEQ ID NO: 55790 - DNA, 25 bp, Rattus norvegicus
aatacacctctatcttgcatgggaa

SEQ ID NO: 55791 - DNA, 25 bp, Rattus norvegicus
aatacaccttacatttcgaacctga

SEQ ID NO: 55792 - DNA, 25 bp, Rattus norvegicus
aatacaccttacttttcgaacctga

SEQ ID NO: 55793 - DNA, 25 bp, Rattus norvegicus
aatacaccttttatgcaatgcctgt

SEQ ID NO: 55794 - DNA, 25 bp, Rattus norvegicus
aatacaccttttttgcaatgcctgt

SEQ ID NO: 55795 - DNA, 25 bp, Rattus norvegicus
aatacacgatataccatcaattcat

SEQ ID NO: 55796 - DNA, 25 bp, Rattus norvegicus
aatacacgatattccatcaattcat

SEQ ID NO: 55797 - DNA, 25 bp, Rattus norvegicus
aatacactcaagctcagattcctgg

SEQ ID NO: 55798 - DNA, 25 bp, Rattus norvegicus
aatacactcaaggtcagattcctgg

SEQ ID NO: 55799 - DNA, 25 bp, Rattus norvegicus
aatacactctacagggcagtgccag

SEQ ID NO: 55800 - DNA, 25 bp, Rattus norvegicus
aatacactctactgggcagtgccag

SEQ ID NO: 55801 - DNA, 25 bp, Rattus norvegicus
aatacactctcaatatccctaatct

SEQ ID NO: 55802 - DNA, 25 bp, Rattus norvegicus
aatacactctcattatccctaatct

SEQ ID NO: 55803 - DNA, 25 bp, Rattus norvegicus
aatacactgagaacctagtggccta

SEQ ID NO: 55804 - DNA, 25 bp, Rattus norvegicus
aatacactgagatcctagtggccta

SEQ ID NO: 55805 - DNA, 25 bp, Rattus norvegicus
aatacactgcagacaagctaccaaa

SEQ ID NO: 55806 - DNA, 25 bp, Rattus norvegicus
aatacactgcagacacgcacgtgca

SEQ ID NO: 55807 - DNA, 25 bp, Rattus norvegicus
aatacactgcagtcaagctaccaaa

SEQ ID NO: 55808 - DNA, 25 bp, Rattus norvegicus
aatacactgcagtcacgcacgtgca

SEQ ID NO: 55809 - DNA, 25 bp, Rattus norvegicus
aatacactggtgctgtccttcttaa

SEQ ID NO: 55810 - DNA, 25 bp, Rattus norvegicus
aatacactggtggtgtccttcttaa

SEQ ID NO: 55811 - DNA, 25 bp, Rattus norvegicus
aatacacttcctcgtgaggcgtctc

SEQ ID NO: 55812 - DNA, 25 bp, Rattus norvegicus
aatacacttcctggtgaggcgtctc

SEQ ID NO: 55813 - DNA, 25 bp, Rattus norvegicus
aatacacttgctcagatgccttaaa

SEQ ID NO: 55814 - DNA, 25 bp, Rattus norvegicus
aatacacttgctgagatgccttaaa

SEQ ID NO: 55815 - DNA, 25 bp, Rattus norvegicus
aatacacttgtgactcactgtcctt

SEQ ID NO: 55816 - DNA, 25 bp, Rattus norvegicus
aatacacttgtgtctcactgtcctt

SEQ ID NO: 55817 - DNA, 25 bp, Rattus norvegicus
aatacacttgttccatttacaccaa

SEQ ID NO: 55818 - DNA, 25 bp, Rattus norvegicus
aatacacttgttcgatgccccaggg

SEQ ID NO: 55819 - DNA, 25 bp, Rattus norvegicus
aatacacttgttgcatttacaccaa

SEQ ID NO: 55820 - DNA, 25 bp, Rattus norvegicus
aatacacttgttggatgccccaggg

SEQ ID NO: 55821 - DNA, 25 bp, Rattus norvegicus
aatacagaccagacacatcttccct

SEQ ID NO: 55822 - DNA, 25 bp, Rattus norvegicus
aatacagaccagtcacatcttccct

SEQ ID NO: 55823 - DNA, 25 bp, Rattus norvegicus
aatacagacgaccatactgctcttc

SEQ ID NO: 55824 - DNA, 25 bp, Rattus norvegicus
aatacagacgacgatactgctcttc

SEQ ID NO: 55825 - DNA, 25 bp, Rattus norvegicus
aatacagactaccttcgctgagcag

SEQ ID NO: 55826 - DNA, 25 bp, Rattus norvegicus
aatacagactacgttcgctgagcag

SEQ ID NO: 55827 - DNA, 25 bp, Rattus norvegicus
aatacagagcgcacatgcccaagta

SEQ ID NO: 55828 - DNA, 25 bp, Rattus norvegicus
aatacagagcgctcatgcccaagta

SEQ ID NO: 55829 - DNA, 25 bp, Rattus norvegicus
aatacagagctacgcccgagtgggt

SEQ ID NO: 55830 - DNA, 25 bp, Rattus norvegicus
aatacagagctaggcccgagtgggt

SEQ ID NO: 55831 - DNA, 25 bp, Rattus norvegicus
aatacagagcttagtgagacaccaa

SEQ ID NO: 55832 - DNA, 25 bp, Rattus norvegicus
aatacagagctttgtgagacaccaa

SEQ ID NO: 55833 - DNA, 25 bp, Rattus norvegicus
aatacagaggcgcaccaaccattgg

SEQ ID NO: 55834 - DNA, 25 bp, Rattus norvegicus
aatacagaggcggaccaaccattgg

SEQ ID NO: 55835 - DNA, 25 bp, Rattus norvegicus
aatacagatgtcatactcggtaaaa

SEQ ID NO: 55836 - DNA, 25 bp, Rattus norvegicus
aatacagatgtcttactcggtaaaa

SEQ ID NO: 55837 - DNA, 25 bp, Rattus norvegicus
aatacagattgcacccttgttttcc

SEQ ID NO: 55838 - DNA, 25 bp, Rattus norvegicus
aatacagattgctcccttgttttcc

SEQ ID NO: 55839 - DNA, 25 bp, Rattus norvegicus
aatacagcacctacgatggctttta

SEQ ID NO: 55840 - DNA, 25 bp, Rattus norvegicus
aatacagcaccttcgatggctttta

SEQ ID NO: 55841 - DNA, 25 bp, Rattus norvegicus
aatacagcaggaattagcataacta

SEQ ID NO: 55842 - DNA, 25 bp, Rattus norvegicus
aatacagcaggatttagcataacta

SEQ ID NO: 55843 - DNA, 25 bp, Rattus norvegicus
aatacagcagtgctcatggcgtcgc

SEQ ID NO: 55844 - DNA, 25 bp, Rattus norvegicus
aatacagcagtggtcatggcgtcgc

SEQ ID NO: 55845 - DNA, 25 bp, Rattus norvegicus
aatacagccgtgctaatattagaag

SEQ ID NO: 55846 - DNA, 25 bp, Rattus norvegicus
aatacagccgtggtaatattagaag

SEQ ID NO: 55847 - DNA, 25 bp, Rattus norvegicus
aatacagcctcaccactaaacaagt

SEQ ID NO: 55848 - DNA, 25 bp, Rattus norvegicus
aatacagcctcagcactaaacaagt

SEQ ID NO: 55849 - DNA, 25 bp, Rattus norvegicus
aatacagcctttctttattccaaga

SEQ ID NO: 55850 - DNA, 25 bp, Rattus norvegicus
aatacagcctttgtttattccaaga

SEQ ID NO: 55851 - DNA, 25 bp, Rattus norvegicus
aatacagctctcctggatcggaaac

SEQ ID NO: 55852 - DNA, 25 bp, Rattus norvegicus
aatacagctctcgtggatcggaaac

SEQ ID NO: 55853 - DNA, 25 bp, Rattus norvegicus
aatacagctttgcttcagtgtggaa

SEQ ID NO: 55854 - DNA, 25 bp, Rattus norvegicus
aatacagctttggttcagtgtggaa

SEQ ID NO: 55855 - DNA, 25 bp, Rattus norvegicus
aatacaggcaaaatcaggaggatga

SEQ ID NO: 55856 - DNA, 25 bp, Rattus norvegicus
aatacaggcaaattcaggaggatga

SEQ ID NO: 55857 - DNA, 25 bp, Rattus norvegicus
aatacaggccctaagatctctgctg

SEQ ID NO: 55858 - DNA, 25 bp, Rattus norvegicus
aatacaggcccttagatctctgctg

SEQ ID NO: 55859 - DNA, 25 bp, Rattus norvegicus
aatacaggctctctcatagcagcgt

SEQ ID NO: 55860 - DNA, 25 bp, Rattus norvegicus
aatacaggctctgtcatagcagcgt

SEQ ID NO: 55861 - DNA, 25 bp, Rattus norvegicus
aatacaggctgtactgtccttttag

SEQ ID NO: 55862 - DNA, 25 bp, Rattus norvegicus
aatacaggctgttctgtccttttag

SEQ ID NO: 55863 - DNA, 25 bp, Rattus norvegicus
aatacaggtcctcgttgaagccgac

SEQ ID NO: 55864 - DNA, 25 bp, Rattus norvegicus
aatacaggtcctggttgaagccgac

SEQ ID NO: 55865 - DNA, 25 bp, Rattus norvegicus
aatacaggttggctggtctccactt

SEQ ID NO: 55866 - DNA, 25 bp, Rattus norvegicus
aatacaggttgggtggtctccactt

SEQ ID NO: 55867 - DNA, 25 bp, Rattus norvegicus
aatacagtatgccttaatccttttt

SEQ ID NO: 55868 - DNA, 25 bp, Rattus norvegicus
aatacagtatgcgttaatccttttt

SEQ ID NO: 55869 - DNA, 25 bp, Rattus norvegicus
aatacagtctatatcccacgatcat

SEQ ID NO: 55870 - DNA, 25 bp, Rattus norvegicus
aatacagtctatttcccacgatcat

SEQ ID NO: 55871 - DNA, 25 bp, Rattus norvegicus
aatacagtgcccctttcagttctga

SEQ ID NO: 55872 - DNA, 25 bp, Rattus norvegicus
aatacagtgcccgtttcagttctga

SEQ ID NO: 55873 - DNA, 25 bp, Rattus norvegicus
aatacagtgctgaggccagaagcca

SEQ ID NO: 55874 - DNA, 25 bp, Rattus norvegicus
aatacagtgctgtggccagaagcca

SEQ ID NO: 55875 - DNA, 25 bp, Rattus norvegicus
aatacagttccaatttccttcaacg

SEQ ID NO: 55876 - DNA, 25 bp, Rattus norvegicus
aatacagttccattttccttcaacg

SEQ ID NO: 55877 - DNA, 25 bp, Rattus norvegicus
aatacagttgttctcacttcatgat

SEQ ID NO: 55878 - DNA, 25 bp, Rattus norvegicus
aatacagttgttgtcacttcatgat

SEQ ID NO: 55879 - DNA, 25 bp, Rattus norvegicus
aatacagtttcacctcccaagttaa

SEQ ID NO: 55880 - DNA, 25 bp, Rattus norvegicus
aatacagtttcagctcccaagttaa

SEQ ID NO: 55881 - DNA, 25 bp, Rattus norvegicus
aatacatacccaatactttagtgaa

SEQ ID NO: 55882 - DNA, 25 bp, Rattus norvegicus
aatacatacccattactttagtgaa

SEQ ID NO: 55883 - DNA, 25 bp, Rattus norvegicus
aatacatacgttctctcgtttgccc

SEQ ID NO: 55884 - DNA, 25 bp, Rattus norvegicus
aatacatacgttgtctcgtttgccc

SEQ ID NO: 55885 - DNA, 25 bp, Rattus norvegicus
aatacatagcttccctgtggaacca

SEQ ID NO: 55886 - DNA, 25 bp, Rattus norvegicus
aatacatagcttgcctgtggaacca

SEQ ID NO: 55887 - DNA, 25 bp, Rattus norvegicus
aatacatattcacgtgttcagtgtg

SEQ ID NO: 55888 - DNA, 25 bp, Rattus norvegicus
aatacatattcaggtgttcagtgtg

SEQ ID NO: 55889 - DNA, 25 bp, Rattus norvegicus
aatacatattctaccatgctcacgc

SEQ ID NO: 55890 - DNA, 25 bp, Rattus norvegicus
aatacatattcttccatgctcacgc

SEQ ID NO: 55891 - DNA, 25 bp, Rattus norvegicus
aatacatcacagcagtagcggattg

SEQ ID NO: 55892 - DNA, 25 bp, Rattus norvegicus
aatacatcacaggagtagcggattg

SEQ ID NO: 55893 - DNA, 25 bp, Rattus norvegicus
aatacatcagttatcgacacaggct

SEQ ID NO: 55894 - DNA, 25 bp, Rattus norvegicus
aatacatcagttttcgacacaggct

SEQ ID NO: 55895 - DNA, 25 bp, Rattus norvegicus
aatacatcctatattcctatcattt

SEQ ID NO: 55896 - DNA, 25 bp, Rattus norvegicus
aatacatcctattttcctatcattt

SEQ ID NO: 55897 - DNA, 25 bp, Rattus norvegicus
aatacatctaggacctgaacccaag

SEQ ID NO: 55898 - DNA, 25 bp, Rattus norvegicus
aatacatctaggtcctgaacccaag

SEQ ID NO: 55899 - DNA, 25 bp, Rattus norvegicus
aatacatggccgctctcaacctaca

SEQ ID NO: 55900 - DNA, 25 bp, Rattus norvegicus
aatacatggccggtctcaacctaca

SEQ ID NO: 55901 - DNA, 25 bp, Rattus norvegicus
aatacatggtagagctcgcctttaa

SEQ ID NO: 55902 - DNA, 25 bp, Rattus norvegicus
aatacatggtagtgctcgcctttaa

SEQ ID NO: 55903 - DNA, 25 bp, Rattus norvegicus
aatacatggtgtcagcttcggtgat

SEQ ID NO: 55904 - DNA, 25 bp, Rattus norvegicus
aatacatggtgtcggatcagttatc

SEQ ID NO: 55905 - DNA, 25 bp, Rattus norvegicus
aatacatggtgtgagcttcggtgat

SEQ ID NO: 55906 - DNA, 25 bp, Rattus norvegicus
aatacatggtgtgggatcagttatc

SEQ ID NO: 55907 - DNA, 25 bp, Rattus norvegicus
aatacatgtggtcattctgcctctt

SEQ ID NO: 55908 - DNA, 25 bp, Rattus norvegicus
aatacatgtggtgattctgcctctt

SEQ ID NO: 55909 - DNA, 25 bp, Rattus norvegicus
aatacattcagaagccgagtgggaa

SEQ ID NO: 55910 - DNA, 25 bp, Rattus norvegicus
aatacattcagatgccgagtgggaa

SEQ ID NO: 55911 - DNA, 25 bp, Rattus norvegicus
aatacattcattaaccaccacgcat

SEQ ID NO: 55912 - DNA, 25 bp, Rattus norvegicus
aatacattcatttaccaccacgcat

SEQ ID NO: 55913 - DNA, 25 bp, Rattus norvegicus
aatacattcctcatgccaaatctac

SEQ ID NO: 55914 - DNA, 25 bp, Rattus norvegicus
aatacattcctcttgccaaatctac

SEQ ID NO: 55915 - DNA, 25 bp, Rattus norvegicus
aatacattctgtatggtccacagca

SEQ ID NO: 55916 - DNA, 25 bp, Rattus norvegicus
aatacattctgtttggtccacagca

SEQ ID NO: 55917 - DNA, 25 bp, Rattus norvegicus
aatacattcttcctgtcacatgagc

SEQ ID NO: 55918 - DNA, 25 bp, Rattus norvegicus
aatacattcttcgtgtcacatgagc

SEQ ID NO: 55919 - DNA, 25 bp, Rattus norvegicus
aatacattggctccctggttaacag

SEQ ID NO: 55920 - DNA, 25 bp, Rattus norvegicus
aatacattggctcgcaggcttgtta

SEQ ID NO: 55921 - DNA, 25 bp, Rattus norvegicus
aatacattggctgcctggttaacag

SEQ ID NO: 55922 - DNA, 25 bp, Rattus norvegicus
aatacattggctggcaggcttgtta

SEQ ID NO: 55923 - DNA, 25 bp, Rattus norvegicus
aatacatttcggctcataccacata

SEQ ID NO: 55924 - DNA, 25 bp, Rattus norvegicus
aatacatttcgggtcataccacata

SEQ ID NO: 55925 - DNA, 25 bp, Rattus norvegicus
aatacatttctcattgtgcttaatc

SEQ ID NO: 55926 - DNA, 25 bp, Rattus norvegicus
aatacatttctctttgtgcttaatc

SEQ ID NO: 55927 - DNA, 25 bp, Rattus norvegicus
aatacatttgtacatcagagggcaa

SEQ ID NO: 55928 - DNA, 25 bp, Rattus norvegicus
aatacatttgtagatcagagggcaa

SEQ ID NO: 55929 - DNA, 25 bp, Rattus norvegicus
aatacatttgtcaattgttggcaca

SEQ ID NO: 55930 - DNA, 25 bp, Rattus norvegicus
aatacatttgtctattgttggcaca

SEQ ID NO: 55931 - DNA, 25 bp, Rattus norvegicus
aataccaacctcctttggatcctgg

SEQ ID NO: 55932 - DNA, 25 bp, Rattus norvegicus
aataccaacctcgtttggatcctgg

SEQ ID NO: 55933 - DNA, 25 bp, Rattus norvegicus
aataccaagtacaccatgcgttcct

SEQ ID NO: 55934 - DNA, 25 bp, Rattus norvegicus
aataccaagtactccatgcgttcct

SEQ ID NO: 55935 - DNA, 25 bp, Rattus norvegicus
aataccacactacgcgggtgtccct

SEQ ID NO: 55936 - DNA, 25 bp, Rattus norvegicus
aataccacactaggcgggtgtccct

SEQ ID NO: 55937 - DNA, 25 bp, Rattus norvegicus
aataccacacttacaaattctgcta

SEQ ID NO: 55938 - DNA, 25 bp, Rattus norvegicus
aataccacactttcaaattctgcta

SEQ ID NO: 55939 - DNA, 25 bp, Rattus norvegicus
aataccaccttcacttttgggatca

SEQ ID NO: 55940 - DNA, 25 bp, Rattus norvegicus
aataccaccttctcttttgggatca

SEQ ID NO: 55941 - DNA, 25 bp, Rattus norvegicus
aataccacctttcgaactggccata

SEQ ID NO: 55942 - DNA, 25 bp, Rattus norvegicus
aataccacctttggaactggccata

SEQ ID NO: 55943 - DNA, 25 bp, Rattus norvegicus
aataccactgggactgtcacagagt

SEQ ID NO: 55944 - DNA, 25 bp, Rattus norvegicus
aataccactgggataatacaaattt

SEQ ID NO: 55945 - DNA, 25 bp, Rattus norvegicus
aataccactgggtctgtcacagagt

SEQ ID NO: 55946 - DNA, 25 bp, Rattus norvegicus
aataccactgggttaatacaaattt

SEQ ID NO: 55947 - DNA, 25 bp, Rattus norvegicus
aataccagagcgctttcttgccttc

SEQ ID NO: 55948 - DNA, 25 bp, Rattus norvegicus
aataccagagcggtttcttgccttc

SEQ ID NO: 55949 - DNA, 25 bp, Rattus norvegicus
aataccagagggatttccagcttcc

SEQ ID NO: 55950 - DNA, 25 bp, Rattus norvegicus
aataccagagggttttccagcttcc

SEQ ID NO: 55951 - DNA, 25 bp, Rattus norvegicus
aataccagagttatttctccacagg

SEQ ID NO: 55952 - DNA, 25 bp, Rattus norvegicus
aataccagagttttttctccacagg

SEQ ID NO: 55953 - DNA, 25 bp, Rattus norvegicus
aataccagcacgacgatggccgggt

SEQ ID NO: 55954 - DNA, 25 bp, Rattus norvegicus
aataccagcacgtcgatggccgggt

SEQ ID NO: 55955 - DNA, 25 bp, Rattus norvegicus
aataccagcctgcagtggaggcctt

SEQ ID NO: 55956 - DNA, 25 bp, Rattus norvegicus
aataccagcctggagtggaggcctt

SEQ ID NO: 55957 - DNA, 25 bp, Rattus norvegicus
aataccaggttcagcatatcatacg

SEQ ID NO: 55958 - DNA, 25 bp, Rattus norvegicus
aataccaggttctgcatatcatacg

SEQ ID NO: 55959 - DNA, 25 bp, Rattus norvegicus
aataccataaccaaagcagctctta

SEQ ID NO: 55960 - DNA, 25 bp, Rattus norvegicus
aataccataacctaagcagctctta

SEQ ID NO: 55961 - DNA, 25 bp, Rattus norvegicus
aataccatacggctattctctgtca

SEQ ID NO: 55962 - DNA, 25 bp, Rattus norvegicus
aataccatacgggtattctctgtca

SEQ ID NO: 55963 - DNA, 25 bp, Rattus norvegicus
aataccatataaagagcctcagatg

SEQ ID NO: 55964 - DNA, 25 bp, Rattus norvegicus
aataccatataatgagcctcagatg

SEQ ID NO: 55965 - DNA, 25 bp, Rattus norvegicus
aataccatatgacggccctggcaaa

SEQ ID NO: 55966 - DNA, 25 bp, Rattus norvegicus
aataccatatgagggccctggcaaa

SEQ ID NO: 55967 - DNA, 25 bp, Rattus norvegicus
aataccatcagcatacacacttcgt

SEQ ID NO: 55968 - DNA, 25 bp, Rattus norvegicus
aataccatcagcttacacacttcgt

SEQ ID NO: 55969 - DNA, 25 bp, Rattus norvegicus
aataccatgagccacaattcccaag

SEQ ID NO: 55970 - DNA, 25 bp, Rattus norvegicus
aataccatgagcgacaattcccaag

SEQ ID NO: 55971 - DNA, 25 bp, Rattus norvegicus
aataccatggtgagactctaaccaa

SEQ ID NO: 55972 - DNA, 25 bp, Rattus norvegicus
aataccatggtgtgactctaaccaa

SEQ ID NO: 55973 - DNA, 25 bp, Rattus norvegicus
aataccattgctcccattgtgtcca

SEQ ID NO: 55974 - DNA, 25 bp, Rattus norvegicus
aataccattgctgccattgtgtcca

SEQ ID NO: 55975 - DNA, 25 bp, Rattus norvegicus
aataccattgttaagatctctgcca

SEQ ID NO: 55976 - DNA, 25 bp, Rattus norvegicus
aataccattgtttagatctctgcca

SEQ ID NO: 55977 - DNA, 25 bp, Rattus norvegicus
aatacccaaggaaccagccggctat

SEQ ID NO: 55978 - DNA, 25 bp, Rattus norvegicus
aatacccaaggatccagccggctat

SEQ ID NO: 55979 - DNA, 25 bp, Rattus norvegicus
aatacccaagtaaataaggccaaag

SEQ ID NO: 55980 - DNA, 25 bp, Rattus norvegicus
aatacccaagtatataaggccaaag

SEQ ID NO: 55981 - DNA, 25 bp, Rattus norvegicus
aatacccagactacactgtgtgatg

SEQ ID NO: 55982 - DNA, 25 bp, Rattus norvegicus
aatacccagactcctgtgcagttct

SEQ ID NO: 55983 - DNA, 25 bp, Rattus norvegicus
aatacccagactgctgtgcagttct

SEQ ID NO: 55984 - DNA, 25 bp, Rattus norvegicus
aatacccagacttcactgtgtgatg

SEQ ID NO: 55985 - DNA, 25 bp, Rattus norvegicus
aatacccagtgaagcgctttctcca

SEQ ID NO: 55986 - DNA, 25 bp, Rattus norvegicus
aatacccagtgatgcgctttctcca

SEQ ID NO: 55987 - DNA, 25 bp, Rattus norvegicus
aatacccagtttaggatttgcaatt

SEQ ID NO: 55988 - DNA, 25 bp, Rattus norvegicus
aatacccagttttggatttgcaatt

SEQ ID NO: 55989 - DNA, 25 bp, Rattus norvegicus
aatacccatcctctttagtactaag

SEQ ID NO: 55990 - DNA, 25 bp, Rattus norvegicus
aatacccatcctgtttagtactaag

SEQ ID NO: 55991 - DNA, 25 bp, Rattus norvegicus
aatacccatcgtagtgggccagcct

SEQ ID NO: 55992 - DNA, 25 bp, Rattus norvegicus
aatacccatcgttgtgggccagcct

SEQ ID NO: 55993 - DNA, 25 bp, Rattus norvegicus
aatacccatgacagtttaagtgcaa

SEQ ID NO: 55994 - DNA, 25 bp, Rattus norvegicus
aatacccatgactgtttaagtgcaa

SEQ ID NO: 55995 - DNA, 25 bp, Rattus norvegicus
aatacccatgtacatcaaattcata

SEQ ID NO: 55996 - DNA, 25 bp, Rattus norvegicus
aatacccatgtagatcaaattcata

SEQ ID NO: 55997 - DNA, 25 bp, Rattus norvegicus
aataccccaggtagcttagcgcaga

SEQ ID NO: 55998 - DNA, 25 bp, Rattus norvegicus
aataccccaggttgcttagcgcaga

SEQ ID NO: 55999 - DNA, 25 bp, Rattus norvegicus
aataccccatccatggcagtggcga

SEQ ID NO: 56000 - DNA, 25 bp, Rattus norvegicus
aataccccatccttggcagtggcga

SEQ ID NO: 56001 - DNA, 25 bp, Rattus norvegicus
aatacccctagcactgtccatatgc

SEQ ID NO: 56002 - DNA, 25 bp, Rattus norvegicus
aatacccctagctctgtccatatgc

SEQ ID NO: 56003 - DNA, 25 bp, Rattus norvegicus
aatacccctagtcaaatagccccat

SEQ ID NO: 56004 - DNA, 25 bp, Rattus norvegicus
aatacccctagtgaaatagccccat

SEQ ID NO: 56005 - DNA, 25 bp, Rattus norvegicus
aatacccctggccaccgggctgtgg

SEQ ID NO: 56006 - DNA, 25 bp, Rattus norvegicus
aatacccctggcgaccgggctgtgg

SEQ ID NO: 56007 - DNA, 25 bp, Rattus norvegicus
aatacccggagacctacagtgcttg

SEQ ID NO: 56008 - DNA, 25 bp, Rattus norvegicus
aatacccggagagctacagtgcttg

SEQ ID NO: 56009 - DNA, 25 bp, Rattus norvegicus
aatacccgggacagagactcaggat

SEQ ID NO: 56010 - DNA, 25 bp, Rattus norvegicus
aatacccgggactgagactcaggat

SEQ ID NO: 56011 - DNA, 25 bp, Rattus norvegicus
aataccctattacttttcagtcaga

SEQ ID NO: 56012 - DNA, 25 bp, Rattus norvegicus
aataccctattagttttcagtcaga

SEQ ID NO: 56013 - DNA, 25 bp, Rattus norvegicus
aataccctccagagtagtgtcctgt

SEQ ID NO: 56014 - DNA, 25 bp, Rattus norvegicus
aataccctccagtgtagtgtcctgt

SEQ ID NO: 56015 - DNA, 25 bp, Rattus norvegicus
aataccctccttatatggaccatgt

SEQ ID NO: 56016 - DNA, 25 bp, Rattus norvegicus
aataccctccttttatggaccatgt

SEQ ID NO: 56017 - DNA, 25 bp, Rattus norvegicus
aataccctcggaaatacggctgtag

SEQ ID NO: 56018 - DNA, 25 bp, Rattus norvegicus
aataccctcggatatacggctgtag

SEQ ID NO: 56019 - DNA, 25 bp, Rattus norvegicus
aataccctggagatctaatgctcat

SEQ ID NO: 56020 - DNA, 25 bp, Rattus norvegicus
aataccctggagttctaatgctcat

SEQ ID NO: 56021 - DNA, 25 bp, Rattus norvegicus
aataccctggtgaaatactcagacc

SEQ ID NO: 56022 - DNA, 25 bp, Rattus norvegicus
aataccctggtgtaatactcagacc

SEQ ID NO: 56023 - DNA, 25 bp, Rattus norvegicus
aataccctggttcatcaatccctag

SEQ ID NO: 56024 - DNA, 25 bp, Rattus norvegicus
aataccctggttgatcaatccctag

SEQ ID NO: 56025 - DNA, 25 bp, Rattus norvegicus
aatacccttgcgactttgtaatgag

SEQ ID NO: 56026 - DNA, 25 bp, Rattus norvegicus
aatacccttgcgtctttgtaatgag

SEQ ID NO: 56027 - DNA, 25 bp, Rattus norvegicus
aatacccttgctcgccacatttgag

SEQ ID NO: 56028 - DNA, 25 bp, Rattus norvegicus
aatacccttgctggccacatttgag

SEQ ID NO: 56029 - DNA, 25 bp, Rattus norvegicus
aatacccttttcatctcaatcatgg

SEQ ID NO: 56030 - DNA, 25 bp, Rattus norvegicus
aatacccttttcttctcaatcatgg

SEQ ID NO: 56031 - DNA, 25 bp, Rattus norvegicus
aataccgaaagcatgttcaaagaat

SEQ ID NO: 56032 - DNA, 25 bp, Rattus norvegicus
aataccgaaagcttgttcaaagaat

SEQ ID NO: 56033 - DNA, 25 bp, Rattus norvegicus
aataccgagggcaatcggcatgatt

SEQ ID NO: 56034 - DNA, 25 bp, Rattus norvegicus
aataccgagggctatcggcatgatt

SEQ ID NO: 56035 - DNA, 25 bp, Rattus norvegicus
aataccgagtagcatccttgcagcg

SEQ ID NO: 56036 - DNA, 25 bp, Rattus norvegicus
aataccgagtaggatccttgcagcg

SEQ ID NO: 56037 - DNA, 25 bp, Rattus norvegicus
aataccgagtatagattcctgccgc

SEQ ID NO: 56038 - DNA, 25 bp, Rattus norvegicus
aataccgagtattgattcctgccgc

SEQ ID NO: 56039 - DNA, 25 bp, Rattus norvegicus
aataccgattttaagctttgacata

SEQ ID NO: 56040 - DNA, 25 bp, Rattus norvegicus
aataccgatttttagctttgacata

SEQ ID NO: 56041 - DNA, 25 bp, Rattus norvegicus
aataccgcaactatgacattcccaa

SEQ ID NO: 56042 - DNA, 25 bp, Rattus norvegicus
aataccgcaactttgacattcccaa

SEQ ID NO: 56043 - DNA, 25 bp, Rattus norvegicus
aataccgcatgcatattgcaatggt

SEQ ID NO: 56044 - DNA, 25 bp, Rattus norvegicus
aataccgcatgcttattgcaatggt

SEQ ID NO: 56045 - DNA, 25 bp, Rattus norvegicus
aataccgccagacctgtgcatgaga

SEQ ID NO: 56046 - DNA, 25 bp, Rattus norvegicus
aataccgccagagctgtgcatgaga

SEQ ID NO: 56047 - DNA, 25 bp, Rattus norvegicus
aataccgctgggaagccattgtcta

SEQ ID NO: 56048 - DNA, 25 bp, Rattus norvegicus
aataccgctgggtagccattgtcta

SEQ ID NO: 56049 - DNA, 25 bp, Rattus norvegicus
aataccgtctgcaggaatccttgga

SEQ ID NO: 56050 - DNA, 25 bp, Rattus norvegicus
aataccgtctgctggaatccttgga

SEQ ID NO: 56051 - DNA, 25 bp, Rattus norvegicus
aataccgtgaatcctggtacgccat

SEQ ID NO: 56052 - DNA, 25 bp, Rattus norvegicus
aataccgtgaatgctggtacgccat

SEQ ID NO: 56053 - DNA, 25 bp, Rattus norvegicus
aataccgttatcactgttcctgttg

SEQ ID NO: 56054 - DNA, 25 bp, Rattus norvegicus
aataccgttatctctgttcctgttg

SEQ ID NO: 56055 - DNA, 25 bp, Rattus norvegicus
aatacctaaggtctccacctagtct

SEQ ID NO: 56056 - DNA, 25 bp, Rattus norvegicus
aatacctaaggtgtccacctagtct

SEQ ID NO: 56057 - DNA, 25 bp, Rattus norvegicus
aatacctacagcactctgcagagca

SEQ ID NO: 56058 - DNA, 25 bp, Rattus norvegicus
aatacctacagctctctgcagagca

SEQ ID NO: 56059 - DNA, 25 bp, Rattus norvegicus
aatacctacctaaacatcatttccg

SEQ ID NO: 56060 - DNA, 25 bp, Rattus norvegicus
aatacctacctatacatcatttccg

SEQ ID NO: 56061 - DNA, 25 bp, Rattus norvegicus
aatacctacctgagggtcccagaag

SEQ ID NO: 56062 - DNA, 25 bp, Rattus norvegicus
aatacctacctgtgggtcccagaag

SEQ ID NO: 56063 - DNA, 25 bp, Rattus norvegicus
aatacctacgtgaacccatggtggg

SEQ ID NO: 56064 - DNA, 25 bp, Rattus norvegicus
aatacctacgtgtacccatggtggg

SEQ ID NO: 56065 - DNA, 25 bp, Rattus norvegicus
aatacctagttgctgccatctccac

SEQ ID NO: 56066 - DNA, 25 bp, Rattus norvegicus
aatacctagttggtgccatctccac

SEQ ID NO: 56067 - DNA, 25 bp, Rattus norvegicus
aatacctatcctaatgagagctgaa

SEQ ID NO: 56068 - DNA, 25 bp, Rattus norvegicus
aatacctatccttatgagagctgaa

SEQ ID NO: 56069 - DNA, 25 bp, Rattus norvegicus
aatacctatcttcttttctcttaat

SEQ ID NO: 56070 - DNA, 25 bp, Rattus norvegicus
aatacctatcttgttttctcttaat

SEQ ID NO: 56071 - DNA, 25 bp, Rattus norvegicus
aatacctatgcgacagcgattcaca

SEQ ID NO: 56072 - DNA, 25 bp, Rattus norvegicus
aatacctatgcgtcagcgattcaca

SEQ ID NO: 56073 - DNA, 25 bp, Rattus norvegicus
aatacctcacggatataacactgga

SEQ ID NO: 56074 - DNA, 25 bp, Rattus norvegicus
aatacctcacggttataacactgga

SEQ ID NO: 56075 - DNA, 25 bp, Rattus norvegicus
aatacctcacttcactatgctgggc

SEQ ID NO: 56076 - DNA, 25 bp, Rattus norvegicus
aatacctcacttgactatgctgggc

SEQ ID NO: 56077 - DNA, 25 bp, Rattus norvegicus
aatacctcaggcaatttactgttca

SEQ ID NO: 56078 - DNA, 25 bp, Rattus norvegicus
aatacctcaggctatttactgttca

SEQ ID NO: 56079 - DNA, 25 bp, Rattus norvegicus
aatacctcagtgcaggacttcagaa

SEQ ID NO: 56080 - DNA, 25 bp, Rattus norvegicus
aatacctcagtggaggacttcagaa

SEQ ID NO: 56081 - DNA, 25 bp, Rattus norvegicus
aatacctcatgtatcacctagccat

SEQ ID NO: 56082 - DNA, 25 bp, Rattus norvegicus
aatacctcatgtttcacctagccat

SEQ ID NO: 56083 - DNA, 25 bp, Rattus norvegicus
aatacctcctacaaacctgaagcgt

SEQ ID NO: 56084 - DNA, 25 bp, Rattus norvegicus
aatacctcctactaacctgaagcgt

SEQ ID NO: 56085 - DNA, 25 bp, Rattus norvegicus
aatacctcgatgagctggcgcccta

SEQ ID NO: 56086 - DNA, 25 bp, Rattus norvegicus
aatacctcgatgtgctggcgcccta

SEQ ID NO: 56087 - DNA, 25 bp, Rattus norvegicus
aatacctcggatctgtgaagctctc

SEQ ID NO: 56088 - DNA, 25 bp, Rattus norvegicus
aatacctcggatgtgtgaagctctc

SEQ ID NO: 56089 - DNA, 25 bp, Rattus norvegicus
aatacctctcacctgtggtgttgaa

SEQ ID NO: 56090 - DNA, 25 bp, Rattus norvegicus
aatacctctcacgtgtggtgttgaa

SEQ ID NO: 56091 - DNA, 25 bp, Rattus norvegicus
aatacctctcttaacatgggcactg

SEQ ID NO: 56092 - DNA, 25 bp, Rattus norvegicus
aatacctctctttacatgggcactg

SEQ ID NO: 56093 - DNA, 25 bp, Rattus norvegicus
aatacctctgccacaagggcaagat

SEQ ID NO: 56094 - DNA, 25 bp, Rattus norvegicus
aatacctctgcctcaagggcaagat

SEQ ID NO: 56095 - DNA, 25 bp, Rattus norvegicus
aatacctctgtgcttcggagtcttt

SEQ ID NO: 56096 - DNA, 25 bp, Rattus norvegicus
aatacctctgtggttcggagtcttt

SEQ ID NO: 56097 - DNA, 25 bp, Rattus norvegicus
aatacctcttaaattcctctattag

SEQ ID NO: 56098 - DNA, 25 bp, Rattus norvegicus
aatacctcttaatttcctctattag

SEQ ID NO: 56099 - DNA, 25 bp, Rattus norvegicus
aatacctgccaaacacagctgttag

SEQ ID NO: 56100 - DNA, 25 bp, Rattus norvegicus
aatacctgccaatcacagctgttag

SEQ ID NO: 56101 - DNA, 25 bp, Rattus norvegicus
aatacctgctttctcaagtggcgta

SEQ ID NO: 56102 - DNA, 25 bp, Rattus norvegicus
aatacctgctttgtcaagtggcgta

SEQ ID NO: 56103 - DNA, 25 bp, Rattus norvegicus
aatacctggtgtacagttccagaaa

SEQ ID NO: 56104 - DNA, 25 bp, Rattus norvegicus
aatacctggtgttcagttccagaaa

SEQ ID NO: 56105 - DNA, 25 bp, Rattus norvegicus
aatacctgtgcccatgagattcatt

SEQ ID NO: 56106 - DNA, 25 bp, Rattus norvegicus
aatacctgtgccgatgagattcatt

SEQ ID NO: 56107 - DNA, 25 bp, Rattus norvegicus
aatacctgtgtcatgcactcaatca

SEQ ID NO: 56108 - DNA, 25 bp, Rattus norvegicus
aatacctgtgtcttgcactcaatca

SEQ ID NO: 56109 - DNA, 25 bp, Rattus norvegicus
aatacctgtgtgatcacttgctatt

SEQ ID NO: 56110 - DNA, 25 bp, Rattus norvegicus
aatacctgtgtgttcacttgctatt

SEQ ID NO: 56111 - DNA, 25 bp, Rattus norvegicus
aatacctgttggctaccaggcgaca

SEQ ID NO: 56112 - DNA, 25 bp, Rattus norvegicus
aatacctgttgggtaccaggcgaca

SEQ ID NO: 56113 - DNA, 25 bp, Rattus norvegicus
aataccttagtgaacccatttccat

SEQ ID NO: 56114 - DNA, 25 bp, Rattus norvegicus
aataccttagtgtacccatttccat

SEQ ID NO: 56115 - DNA, 25 bp, Rattus norvegicus
aataccttatcacaagactcagtag

SEQ ID NO: 56116 - DNA, 25 bp, Rattus norvegicus
aataccttatcagaagactcagtag

SEQ ID NO: 56117 - DNA, 25 bp, Rattus norvegicus
aataccttccttcggtagtcactgt

SEQ ID NO: 56118 - DNA, 25 bp, Rattus norvegicus
aataccttccttctcaaggcacaga

SEQ ID NO: 56119 - DNA, 25 bp, Rattus norvegicus
aataccttccttgggtagtcactgt

SEQ ID NO: 56120 - DNA, 25 bp, Rattus norvegicus
aataccttccttgtcaaggcacaga

SEQ ID NO: 56121 - DNA, 25 bp, Rattus norvegicus
aataccttggaaaacatattcttgg

SEQ ID NO: 56122 - DNA, 25 bp, Rattus norvegicus
aataccttggaatacatattcttgg

SEQ ID NO: 56123 - DNA, 25 bp, Rattus norvegicus
aataccttgtatacacccagaagca

SEQ ID NO: 56124 - DNA, 25 bp, Rattus norvegicus
aataccttgtattcacccagaagca

SEQ ID NO: 56125 - DNA, 25 bp, Rattus norvegicus
aataccttgtcactagcatcgtcat

SEQ ID NO: 56126 - DNA, 25 bp, Rattus norvegicus
aataccttgtcagtagcatcgtcat

SEQ ID NO: 56127 - DNA, 25 bp, Rattus norvegicus
aatacctttatcatactggcattga

SEQ ID NO: 56128 - DNA, 25 bp, Rattus norvegicus
aatacctttatcttactggcattga

SEQ ID NO: 56129 - DNA, 25 bp, Rattus norvegicus
aatacctttctcaatatctctcaac

SEQ ID NO: 56130 - DNA, 25 bp, Rattus norvegicus
aatacctttctcagggcaggagctc

SEQ ID NO: 56131 - DNA, 25 bp, Rattus norvegicus
aatacctttctctatatctctcaac

SEQ ID NO: 56132 - DNA, 25 bp, Rattus norvegicus
aatacctttctctgggcaggagctc

SEQ ID NO: 56133 - DNA, 25 bp, Rattus norvegicus
aatacctttgctcacacctttttgt

SEQ ID NO: 56134 - DNA, 25 bp, Rattus norvegicus
aatacctttgctgacacctttttgt

SEQ ID NO: 56135 - DNA, 25 bp, Rattus norvegicus
aatacctttggacagagagctggac

SEQ ID NO: 56136 - DNA, 25 bp, Rattus norvegicus
aatacctttggagagagagctggac

SEQ ID NO: 56137 - DNA, 25 bp, Rattus norvegicus
aataccttttctacctgacttacat

SEQ ID NO: 56138 - DNA, 25 bp, Rattus norvegicus
aataccttttcttcctgacttacat

SEQ ID NO: 56139 - DNA, 25 bp, Rattus norvegicus
aataccttttgtcagcgacctgttc

SEQ ID NO: 56140 - DNA, 25 bp, Rattus norvegicus
aataccttttgtgagcgacctgttc

SEQ ID NO: 56141 - DNA, 25 bp, Rattus norvegicus
aatacctttttcctgagctgcattc

SEQ ID NO: 56142 - DNA, 25 bp, Rattus norvegicus
aatacctttttcgtgagctgcattc

SEQ ID NO: 56143 - DNA, 25 bp, Rattus norvegicus
aatacgaccggccagagctgcagcg

SEQ ID NO: 56144 - DNA, 25 bp, Rattus norvegicus
aatacgaccggcgagagctgcagcg

SEQ ID NO: 56145 - DNA, 25 bp, Rattus norvegicus
aatacgagaagcatggtttccaggg

SEQ ID NO: 56146 - DNA, 25 bp, Rattus norvegicus
aatacgagaagcttggtttccaggg

SEQ ID NO: 56147 - DNA, 25 bp, Rattus norvegicus
aatacgagccggctgctatttacct

SEQ ID NO: 56148 - DNA, 25 bp, Rattus norvegicus
aatacgagccgggtgctatttacct

SEQ ID NO: 56149 - DNA, 25 bp, Rattus norvegicus
aatacgagctgcaggcacataccat

SEQ ID NO: 56150 - DNA, 25 bp, Rattus norvegicus
aatacgagctgctggcacataccat

SEQ ID NO: 56151 - DNA, 25 bp, Rattus norvegicus
aatacgagtcgtctgtggcctgctg

SEQ ID NO: 56152 - DNA, 25 bp, Rattus norvegicus
aatacgagtcgtgtgtggcctgctg

SEQ ID NO: 56153 - DNA, 25 bp, Rattus norvegicus
aatacgatctcacttctctcatggt

SEQ ID NO: 56154 - DNA, 25 bp, Rattus norvegicus
aatacgatctcagttctctcatggt

SEQ ID NO: 56155 - DNA, 25 bp, Rattus norvegicus
aatacgatgcacagcttaggcgtga

SEQ ID NO: 56156 - DNA, 25 bp, Rattus norvegicus
aatacgatgcactgcttaggcgtga

SEQ ID NO: 56157 - DNA, 25 bp, Rattus norvegicus
aatacgattatgagtttccagagaa

SEQ ID NO: 56158 - DNA, 25 bp, Rattus norvegicus
aatacgattatgtgtttccagagaa

SEQ ID NO: 56159 - DNA, 25 bp, Rattus norvegicus
aatacgattcagatggttacggctc

SEQ ID NO: 56160 - DNA, 25 bp, Rattus norvegicus
aatacgattcagttggttacggctc

SEQ ID NO: 56161 - DNA, 25 bp, Rattus norvegicus
aatacgcacagcctgcttacatgtg

SEQ ID NO: 56162 - DNA, 25 bp, Rattus norvegicus
aatacgcacagcgtgcttacatgtg

SEQ ID NO: 56163 - DNA, 25 bp, Rattus norvegicus
aatacgcactggctcataggttctg

SEQ ID NO: 56164 - DNA, 25 bp, Rattus norvegicus
aatacgcactgggtcataggttctg

SEQ ID NO: 56165 - DNA, 25 bp, Rattus norvegicus
aatacgcagtggcatttgagctcat

SEQ ID NO: 56166 - DNA, 25 bp, Rattus norvegicus
aatacgcagtgggatttgagctcat

SEQ ID NO: 56167 - DNA, 25 bp, Rattus norvegicus
aatacgccagaaacgtctctgtcct

SEQ ID NO: 56168 - DNA, 25 bp, Rattus norvegicus
aatacgccagaatcgtctctgtcct

SEQ ID NO: 56169 - DNA, 25 bp, Rattus norvegicus
aatacgccagctaggacatcagtgt

SEQ ID NO: 56170 - DNA, 25 bp, Rattus norvegicus
aatacgccagcttggacatcagtgt

SEQ ID NO: 56171 - DNA, 25 bp, Rattus norvegicus
aatacgcctatgacggccgcgatta

SEQ ID NO: 56172 - DNA, 25 bp, Rattus norvegicus
aatacgcctatgtcggccgcgatta

SEQ ID NO: 56173 - DNA, 25 bp, Rattus norvegicus
aatacgcctgttatgagtgcttaat

SEQ ID NO: 56174 - DNA, 25 bp, Rattus norvegicus
aatacgcctgttttgagtgcttaat

SEQ ID NO: 56175 - DNA, 25 bp, Rattus norvegicus
aatacgcggaagaggaaaggcctct

SEQ ID NO: 56176 - DNA, 25 bp, Rattus norvegicus
aatacgcggaagtggaaaggcctct

SEQ ID NO: 56177 - DNA, 25 bp, Rattus norvegicus
aatacgcggatgacattgacatgcc

SEQ ID NO: 56178 - DNA, 25 bp, Rattus norvegicus
aatacgcggatgtcattgacatgcc

SEQ ID NO: 56179 - DNA, 25 bp, Rattus norvegicus
aatacgctgaagagtgtggcccaca

SEQ ID NO: 56180 - DNA, 25 bp, Rattus norvegicus
aatacgctgaagtgtgtggcccaca

SEQ ID NO: 56181 - DNA, 25 bp, Rattus norvegicus
aatacgctgtgcattgtgactgtca

SEQ ID NO: 56182 - DNA, 25 bp, Rattus norvegicus
aatacgctgtgctttgtgactgtca

SEQ ID NO: 56183 - DNA, 25 bp, Rattus norvegicus
aatacggaagaactgctgtggcctt

SEQ ID NO: 56184 - DNA, 25 bp, Rattus norvegicus
aatacggaagaagtgctgtggcctt

SEQ ID NO: 56185 - DNA, 25 bp, Rattus norvegicus
aatacggagcttatcctctgtttgt

SEQ ID NO: 56186 - DNA, 25 bp, Rattus norvegicus
aatacggagcttttcctctgtttgt

SEQ ID NO: 56187 - DNA, 25 bp, Rattus norvegicus
aatacggaggccagccagtgccggt

SEQ ID NO: 56188 - DNA, 25 bp, Rattus norvegicus
aatacggaggcctgccagtgccggt

SEQ ID NO: 56189 - DNA, 25 bp, Rattus norvegicus
aatacggtgaatactcccagtgtcc

SEQ ID NO: 56190 - DNA, 25 bp, Rattus norvegicus
aatacggtgaattctcccagtgtcc

SEQ ID NO: 56191 - DNA, 25 bp, Rattus norvegicus
aatacggtgacgagaccggagccgc

SEQ ID NO: 56192 - DNA, 25 bp, Rattus norvegicus
aatacggtgacgtgaccggagccgc

SEQ ID NO: 56193 - DNA, 25 bp, Rattus norvegicus
aatacggttgctcatgttgcggtga

SEQ ID NO: 56194 - DNA, 25 bp, Rattus norvegicus
aatacggttgctgatgttgcggtga

SEQ ID NO: 56195 - DNA, 25 bp, Rattus norvegicus
aatacgtcagggactattgagtggc

SEQ ID NO: 56196 - DNA, 25 bp, Rattus norvegicus
aatacgtcagggtctattgagtggc

SEQ ID NO: 56197 - DNA, 25 bp, Rattus norvegicus
aatacgtgcgctcaaggcgggaact

SEQ ID NO: 56198 - DNA, 25 bp, Rattus norvegicus
aatacgtgcgctgaaggcgggaact

SEQ ID NO: 56199 - DNA, 25 bp, Rattus norvegicus
aatacgtggaatatgactgctcaga

SEQ ID NO: 56200 - DNA, 25 bp, Rattus norvegicus
aatacgtggaatttgactgctcaga

SEQ ID NO: 56201 - DNA, 25 bp, Rattus norvegicus
aatacgtggactctgtacggaccct

SEQ ID NO: 56202 - DNA, 25 bp, Rattus norvegicus
aatacgtggactgtgtacggaccct

SEQ ID NO: 56203 - DNA, 25 bp, Rattus norvegicus
aatacgtggccaaggtcattgaccg

SEQ ID NO: 56204 - DNA, 25 bp, Rattus norvegicus
aatacgtggccatggtcattgaccg

SEQ ID NO: 56205 - DNA, 25 bp, Rattus norvegicus
aatacgtgtgatagcttgacttgag

SEQ ID NO: 56206 - DNA, 25 bp, Rattus norvegicus
aatacgtgtgattgcttgacttgag

SEQ ID NO: 56207 - DNA, 25 bp, Rattus norvegicus
aatacgtgttcaactcacttcgttc

SEQ ID NO: 56208 - DNA, 25 bp, Rattus norvegicus
aatacgtgttcatctcacttcgttc

SEQ ID NO: 56209 - DNA, 25 bp, Rattus norvegicus
aatacgtttactcagcacttgtgct

SEQ ID NO: 56210 - DNA, 25 bp, Rattus norvegicus
aatacgtttactgagcacttgtgct

SEQ ID NO: 56211 - DNA, 25 bp, Rattus norvegicus
aatactaacttgcttcctctaatta

SEQ ID NO: 56212 - DNA, 25 bp, Rattus norvegicus
aatactaacttggttcctctaatta

SEQ ID NO: 56213 - DNA, 25 bp, Rattus norvegicus
aatactacactccagttcattccat

SEQ ID NO: 56214 - DNA, 25 bp, Rattus norvegicus
aatactacactcgagttcattccat

SEQ ID NO: 56215 - DNA, 25 bp, Rattus norvegicus
aatactacagacaattattgctcta

SEQ ID NO: 56216 - DNA, 25 bp, Rattus norvegicus
aatactacagactattattgctcta

SEQ ID NO: 56217 - DNA, 25 bp, Rattus norvegicus
aatactaccaccagcctataatcag

SEQ ID NO: 56218 - DNA, 25 bp, Rattus norvegicus
aatactaccacctgcctataatcag

SEQ ID NO: 56219 - DNA, 25 bp, Rattus norvegicus
aatactacgtggaacagttggctgt

SEQ ID NO: 56220 - DNA, 25 bp, Rattus norvegicus
aatactacgtggtacagttggctgt

SEQ ID NO: 56221 - DNA, 25 bp, Rattus norvegicus
aatactagcaggagaatttctccga

SEQ ID NO: 56222 - DNA, 25 bp, Rattus norvegicus
aatactagcaggtgaatttctccga

SEQ ID NO: 56223 - DNA, 25 bp, Rattus norvegicus
aatactatatgcatcgtgacggtca

SEQ ID NO: 56224 - DNA, 25 bp, Rattus norvegicus
aatactatatgcttcgtgacggtca

SEQ ID NO: 56225 - DNA, 25 bp, Rattus norvegicus
aatactatccttactcagatctgct

SEQ ID NO: 56226 - DNA, 25 bp, Rattus norvegicus
aatactatcctttctcagatctgct

SEQ ID NO: 56227 - DNA, 25 bp, Rattus norvegicus
aatactatcttgcatgggctggaga

SEQ ID NO: 56228 - DNA, 25 bp, Rattus norvegicus
aatactatcttggatgggctggaga

SEQ ID NO: 56229 - DNA, 25 bp, Rattus norvegicus
aatactatgttcacactcgtgacta

SEQ ID NO: 56230 - DNA, 25 bp, Rattus norvegicus
aatactatgttctcactcgtgacta

SEQ ID NO: 56231 - DNA, 25 bp, Rattus norvegicus
aatactattcggatgtcatttcatg

SEQ ID NO: 56232 - DNA, 25 bp, Rattus norvegicus
aatactattcggttgtcatttcatg

SEQ ID NO: 56233 - DNA, 25 bp, Rattus norvegicus
aatactattctgatgtctgggtggg

SEQ ID NO: 56234 - DNA, 25 bp, Rattus norvegicus
aatactattctgttgtctgggtggg

SEQ ID NO: 56235 - DNA, 25 bp, Rattus norvegicus
aatactattgggaaaacgtgctaag

SEQ ID NO: 56236 - DNA, 25 bp, Rattus norvegicus
aatactattgggtaaacgtgctaag

SEQ ID NO: 56237 - DNA, 25 bp, Rattus norvegicus
aatactcaagcaccattcaaagcgt

SEQ ID NO: 56238 - DNA, 25 bp, Rattus norvegicus
aatactcaagcagcattcaaagcgt

SEQ ID NO: 56239 - DNA, 25 bp, Rattus norvegicus
aatactcacatcatcatcagctgga

SEQ ID NO: 56240 - DNA, 25 bp, Rattus norvegicus
aatactcacatcttcatcagctgga

SEQ ID NO: 56241 - DNA, 25 bp, Rattus norvegicus
aatactcacctcatacaactcttag

SEQ ID NO: 56242 - DNA, 25 bp, Rattus norvegicus
aatactcacctcttacaactcttag

SEQ ID NO: 56243 - DNA, 25 bp, Rattus norvegicus
aatactcacctgacatcacacagtt

SEQ ID NO: 56244 - DNA, 25 bp, Rattus norvegicus
aatactcacctgtcatcacacagtt

SEQ ID NO: 56245 - DNA, 25 bp, Rattus norvegicus
aatactcacgctctagttcgtctct

SEQ ID NO: 56246 - DNA, 25 bp, Rattus norvegicus
aatactcacgctgtagttcgtctct

SEQ ID NO: 56247 - DNA, 25 bp, Rattus norvegicus
aatactcacgtactttccttgttct

SEQ ID NO: 56248 - DNA, 25 bp, Rattus norvegicus
aatactcacgtagtttccttgttct

SEQ ID NO: 56249 - DNA, 25 bp, Rattus norvegicus
aatactcagctacttgccatctggc

SEQ ID NO: 56250 - DNA, 25 bp, Rattus norvegicus
aatactcagctagttgccatctggc

SEQ ID NO: 56251 - DNA, 25 bp, Rattus norvegicus
aatactcaggacatgcactttcacg

SEQ ID NO: 56252 - DNA, 25 bp, Rattus norvegicus
aatactcaggacttgcactttcacg

SEQ ID NO: 56253 - DNA, 25 bp, Rattus norvegicus
aatactcatggcattttatttctgt

SEQ ID NO: 56254 - DNA, 25 bp, Rattus norvegicus
aatactcatggctttttatttctgt

SEQ ID NO: 56255 - DNA, 25 bp, Rattus norvegicus
aatactccagagatgagggacccga

SEQ ID NO: 56256 - DNA, 25 bp, Rattus norvegicus
aatactccagagttgagggacccga

SEQ ID NO: 56257 - DNA, 25 bp, Rattus norvegicus
aatactccattcacttcggacaaag

SEQ ID NO: 56258 - DNA, 25 bp, Rattus norvegicus
aatactccattctcttcggacaaag

SEQ ID NO: 56259 - DNA, 25 bp, Rattus norvegicus
aatactcctgttatacgttgctgca

SEQ ID NO: 56260 - DNA, 25 bp, Rattus norvegicus
aatactcctgttttacgttgctgca

SEQ ID NO: 56261 - DNA, 25 bp, Rattus norvegicus
aatactcgcgtgcaagctctgtaaa

SEQ ID NO: 56262 - DNA, 25 bp, Rattus norvegicus
aatactcgcgtggaagctctgtaaa

SEQ ID NO: 56263 - DNA, 25 bp, Rattus norvegicus
aatactctaaataacatcccctcag

SEQ ID NO: 56264 - DNA, 25 bp, Rattus norvegicus
aatactctaaattacatcccctcag

SEQ ID NO: 56265 - DNA, 25 bp, Rattus norvegicus
aatactctaatacccttgagtgacc

SEQ ID NO: 56266 - DNA, 25 bp, Rattus norvegicus
aatactctaatagccttgagtgacc

SEQ ID NO: 56267 - DNA, 25 bp, Rattus norvegicus
aatactctcggaagggaagccagaa

SEQ ID NO: 56268 - DNA, 25 bp, Rattus norvegicus
aatactctcggatgggaagccagaa

SEQ ID NO: 56269 - DNA, 25 bp, Rattus norvegicus
aatactctctccaacagtcaagtct

SEQ ID NO: 56270 - DNA, 25 bp, Rattus norvegicus
aatactctctcctacagtcaagtct

SEQ ID NO: 56271 - DNA, 25 bp, Rattus norvegicus
aatactctctgacgctttagcaatg

SEQ ID NO: 56272 - DNA, 25 bp, Rattus norvegicus
aatactctctgaggctttagcaatg

SEQ ID NO: 56273 - DNA, 25 bp, Rattus norvegicus
aatactctgattacttgccgttttg

SEQ ID NO: 56274 - DNA, 25 bp, Rattus norvegicus
aatactctgatttcttgccgttttg

SEQ ID NO: 56275 - DNA, 25 bp, Rattus norvegicus
aatactctgctactctgctgaactc

SEQ ID NO: 56276 - DNA, 25 bp, Rattus norvegicus
aatactctgctagtctgctgaactc

SEQ ID NO: 56277 - DNA, 25 bp, Rattus norvegicus
aatactctgggtatacctatgagca

SEQ ID NO: 56278 - DNA, 25 bp, Rattus norvegicus
aatactctgggtttacctatgagca

SEQ ID NO: 56279 - DNA, 25 bp, Rattus norvegicus
aatactctgtagacagtgcctacgt

SEQ ID NO: 56280 - DNA, 25 bp, Rattus norvegicus
aatactctgtagtcagtgcctacgt

SEQ ID NO: 56281 - DNA, 25 bp, Rattus norvegicus
aatactctgtgtcttccttggtcaa

SEQ ID NO: 56282 - DNA, 25 bp, Rattus norvegicus
aatactctgtgtgttccttggtcaa

SEQ ID NO: 56283 - DNA, 25 bp, Rattus norvegicus
aatactcttaagactgatggccaca

SEQ ID NO: 56284 - DNA, 25 bp, Rattus norvegicus
aatactcttaagtctgatggccaca

SEQ ID NO: 56285 - DNA, 25 bp, Rattus norvegicus
aatactgaactcattctggtgtgtg

SEQ ID NO: 56286 - DNA, 25 bp, Rattus norvegicus
aatactgaactctttctggtgtgtg

SEQ ID NO: 56287 - DNA, 25 bp, Rattus norvegicus
aatactgactccaaaagttgccctc

SEQ ID NO: 56288 - DNA, 25 bp, Rattus norvegicus
aatactgactccatactgcagtctg

SEQ ID NO: 56289 - DNA, 25 bp, Rattus norvegicus
aatactgactcctaaagttgccctc

SEQ ID NO: 56290 - DNA, 25 bp, Rattus norvegicus
aatactgactccttactgcagtctg

SEQ ID NO: 56291 - DNA, 25 bp, Rattus norvegicus
aatactgactggctgagctgatgct

SEQ ID NO: 56292 - DNA, 25 bp, Rattus norvegicus
aatactgactgggtgagctgatgct

SEQ ID NO: 56293 - DNA, 25 bp, Rattus norvegicus
aatactgagccaccttggcttgtgc

SEQ ID NO: 56294 - DNA, 25 bp, Rattus norvegicus
aatactgagccagcttggcttgtgc

SEQ ID NO: 56295 - DNA, 25 bp, Rattus norvegicus
aatactgagcccatagtcatgaact

SEQ ID NO: 56296 - DNA, 25 bp, Rattus norvegicus
aatactgagcccttagtcatgaact

SEQ ID NO: 56297 - DNA, 25 bp, Rattus norvegicus
aatactgatggcacaaaccaccctt

SEQ ID NO: 56298 - DNA, 25 bp, Rattus norvegicus
aatactgatggctcaaaccaccctt

SEQ ID NO: 56299 - DNA, 25 bp, Rattus norvegicus
aatactgcaaggcacaccccactgg

SEQ ID NO: 56300 - DNA, 25 bp, Rattus norvegicus
aatactgcaagggacaccccactgg

SEQ ID NO: 56301 - DNA, 25 bp, Rattus norvegicus
aatactgcagagatgctttccagat

SEQ ID NO: 56302 - DNA, 25 bp, Rattus norvegicus
aatactgcagagttgctttccagat

SEQ ID NO: 56303 - DNA, 25 bp, Rattus norvegicus
aatactgccagaagctgatgttcag

SEQ ID NO: 56304 - DNA, 25 bp, Rattus norvegicus
aatactgccagatgctgatgttcag

SEQ ID NO: 56305 - DNA, 25 bp, Rattus norvegicus
aatactgccattatgttcatttgag

SEQ ID NO: 56306 - DNA, 25 bp, Rattus norvegicus
aatactgccattttgttcatttgag

SEQ ID NO: 56307 - DNA, 25 bp, Rattus norvegicus
aatactgccgggagaaagccactca

SEQ ID NO: 56308 - DNA, 25 bp, Rattus norvegicus
aatactgccgggtgaaagccactca

SEQ ID NO: 56309 - DNA, 25 bp, Rattus norvegicus
aatactgcctttcgacccaacctga

SEQ ID NO: 56310 - DNA, 25 bp, Rattus norvegicus
aatactgcctttggacccaacctga

SEQ ID NO: 56311 - DNA, 25 bp, Rattus norvegicus
aatactgctcagcttaacgacattt

SEQ ID NO: 56312 - DNA, 25 bp, Rattus norvegicus
aatactgctcaggttaacgacattt

SEQ ID NO: 56313 - DNA, 25 bp, Rattus norvegicus
aatactgctgctcacagctagcctt

SEQ ID NO: 56314 - DNA, 25 bp, Rattus norvegicus
aatactgctgctgacagctagcctt

SEQ ID NO: 56315 - DNA, 25 bp, Rattus norvegicus
aatactgctgttagtggctcttttg

SEQ ID NO: 56316 - DNA, 25 bp, Rattus norvegicus
aatactgctgtttgtggctcttttg

SEQ ID NO: 56317 - DNA, 25 bp, Rattus norvegicus
aatactgctttgctactagcccatg

SEQ ID NO: 56318 - DNA, 25 bp, Rattus norvegicus
aatactgctttggtactagcccatg

SEQ ID NO: 56319 - DNA, 25 bp, Rattus norvegicus
aatactggagaactgtcgatgacac

SEQ ID NO: 56320 - DNA, 25 bp, Rattus norvegicus
aatactggagaagtgtcgatgacac

SEQ ID NO: 56321 - DNA, 25 bp, Rattus norvegicus
aatactggagctcaggtggccttca

SEQ ID NO: 56322 - DNA, 25 bp, Rattus norvegicus
aatactggagctgaggtggccttca

SEQ ID NO: 56323 - DNA, 25 bp, Rattus norvegicus
aatactggcagacaaatggatacaa

SEQ ID NO: 56324 - DNA, 25 bp, Rattus norvegicus
aatactggcagagaaatggatacaa

SEQ ID NO: 56325 - DNA, 25 bp, Rattus norvegicus
aatactggccgtattcagcagctga

SEQ ID NO: 56326 - DNA, 25 bp, Rattus norvegicus
aatactggccgttttcagcagctga

SEQ ID NO: 56327 - DNA, 25 bp, Rattus norvegicus
aatactggcgatctggaagcaaaca

SEQ ID NO: 56328 - DNA, 25 bp, Rattus norvegicus
aatactggcgatgtggaagcaaaca

SEQ ID NO: 56329 - DNA, 25 bp, Rattus norvegicus
aatactggctttcgcaggtttgaga

SEQ ID NO: 56330 - DNA, 25 bp, Rattus norvegicus
aatactggctttggcaggtttgaga

SEQ ID NO: 56331 - DNA, 25 bp, Rattus norvegicus
aatactgggctcagggtttctccta

SEQ ID NO: 56332 - DNA, 25 bp, Rattus norvegicus
aatactgggctctgggtttctccta

SEQ ID NO: 56333 - DNA, 25 bp, Rattus norvegicus
aatactgggtgacatgggttcccac

SEQ ID NO: 56334 - DNA, 25 bp, Rattus norvegicus
aatactgggtgagatgggttcccac

SEQ ID NO: 56335 - DNA, 25 bp, Rattus norvegicus
aatactgggtttctgaagccaagcc

SEQ ID NO: 56336 - DNA, 25 bp, Rattus norvegicus
aatactgggtttgtgaagccaagcc

SEQ ID NO: 56337 - DNA, 25 bp, Rattus norvegicus
aatactggtgatcggtgacctgtga

SEQ ID NO: 56338 - DNA, 25 bp, Rattus norvegicus
aatactggtgatgggtgacctgtga

SEQ ID NO: 56339 - DNA, 25 bp, Rattus norvegicus
aatactggttggagtcttcatcatg

SEQ ID NO: 56340 - DNA, 25 bp, Rattus norvegicus
aatactggttggtgtcttcatcatg

SEQ ID NO: 56341 - DNA, 25 bp, Rattus norvegicus
aatactggtttgacgttcaccgagt

SEQ ID NO: 56342 - DNA, 25 bp, Rattus norvegicus
aatactggtttgtcgttcaccgagt

SEQ ID NO: 56343 - DNA, 25 bp, Rattus norvegicus
aatactggttttctactctgtgttc

SEQ ID NO: 56344 - DNA, 25 bp, Rattus norvegicus
aatactggttttgtactctgtgttc

SEQ ID NO: 56345 - DNA, 25 bp, Rattus norvegicus
aatactgtaactacagctgtgagga

SEQ ID NO: 56346 - DNA, 25 bp, Rattus norvegicus
aatactgtaacttcagctgtgagga

SEQ ID NO: 56347 - DNA, 25 bp, Rattus norvegicus
aatactgtactgaacctgtcccaaa

SEQ ID NO: 56348 - DNA, 25 bp, Rattus norvegicus
aatactgtactgtacctgtcccaaa

SEQ ID NO: 56349 - DNA, 25 bp, Rattus norvegicus
aatactgtatgtagcctggtgccaa

SEQ ID NO: 56350 - DNA, 25 bp, Rattus norvegicus
aatactgtatgttgcctggtgccaa

SEQ ID NO: 56351 - DNA, 25 bp, Rattus norvegicus
aatactgtcaccactaaggccgcat

SEQ ID NO: 56352 - DNA, 25 bp, Rattus norvegicus
aatactgtcacctctaaggccgcat

SEQ ID NO: 56353 - DNA, 25 bp, Rattus norvegicus
aatactgtcaggctatgctgggttt

SEQ ID NO: 56354 - DNA, 25 bp, Rattus norvegicus
aatactgtcagggtatgctgggttt

SEQ ID NO: 56355 - DNA, 25 bp, Rattus norvegicus
aatactgtccttatgttggatctct

SEQ ID NO: 56356 - DNA, 25 bp, Rattus norvegicus
aatactgtccttttgttggatctct

SEQ ID NO: 56357 - DNA, 25 bp, Rattus norvegicus
aatactgtctttagtctgggtcaag

SEQ ID NO: 56358 - DNA, 25 bp, Rattus norvegicus
aatactgtcttttgtctgggtcaag

SEQ ID NO: 56359 - DNA, 25 bp, Rattus norvegicus
aatactgtgaccatttgtccttctt

SEQ ID NO: 56360 - DNA, 25 bp, Rattus norvegicus
aatactgtgaccttttgtccttctt

SEQ ID NO: 56361 - DNA, 25 bp, Rattus norvegicus
aatactgtgagactggcggcgccaa

SEQ ID NO: 56362 - DNA, 25 bp, Rattus norvegicus
aatactgtgagagtggcggcgccaa

SEQ ID NO: 56363 - DNA, 25 bp, Rattus norvegicus
aatactgtgcccattatatcctgta

SEQ ID NO: 56364 - DNA, 25 bp, Rattus norvegicus
aatactgtgccctttatatcctgta

SEQ ID NO: 56365 - DNA, 25 bp, Rattus norvegicus
aatactgtggcaagagatatctcga

SEQ ID NO: 56366 - DNA, 25 bp, Rattus norvegicus
aatactgtggcatgagatatctcga

SEQ ID NO: 56367 - DNA, 25 bp, Rattus norvegicus
aatactgtgttcatattttaccaac

SEQ ID NO: 56368 - DNA, 25 bp, Rattus norvegicus
aatactgtgttcttattttaccaac

SEQ ID NO: 56369 - DNA, 25 bp, Rattus norvegicus
aatactgtgtttcccttctatgtgt

SEQ ID NO: 56370 - DNA, 25 bp, Rattus norvegicus
aatactgtgtttctttagcttggtt

SEQ ID NO: 56371 - DNA, 25 bp, Rattus norvegicus
aatactgtgtttgccttctatgtgt

SEQ ID NO: 56372 - DNA, 25 bp, Rattus norvegicus
aatactgtgtttgtttagcttggtt

SEQ ID NO: 56373 - DNA, 25 bp, Rattus norvegicus
aatactgttaaaataccaccatact

SEQ ID NO: 56374 - DNA, 25 bp, Rattus norvegicus
aatactgttaaattaccaccatact

SEQ ID NO: 56375 - DNA, 25 bp, Rattus norvegicus
aatactgttacaccaagagaccatt

SEQ ID NO: 56376 - DNA, 25 bp, Rattus norvegicus
aatactgttacagcaagagaccatt

SEQ ID NO: 56377 - DNA, 25 bp, Rattus norvegicus
aatactgttattcaggccagcccat

SEQ ID NO: 56378 - DNA, 25 bp, Rattus norvegicus
aatactgttattgaggccagcccat

SEQ ID NO: 56379 - DNA, 25 bp, Rattus norvegicus
aatactgttcaacaacactatggtt

SEQ ID NO: 56380 - DNA, 25 bp, Rattus norvegicus
aatactgttcaagaacactatggtt

SEQ ID NO: 56381 - DNA, 25 bp, Rattus norvegicus
aatactgttcatatttctggcctgt

SEQ ID NO: 56382 - DNA, 25 bp, Rattus norvegicus
aatactgttcatttttctggcctgt

SEQ ID NO: 56383 - DNA, 25 bp, Rattus norvegicus
aatactgttctcagtgccttaggac

SEQ ID NO: 56384 - DNA, 25 bp, Rattus norvegicus
aatactgttctctgtgccttaggac

SEQ ID NO: 56385 - DNA, 25 bp, Rattus norvegicus
aatactgttgtcagtgttgagatcg

SEQ ID NO: 56386 - DNA, 25 bp, Rattus norvegicus
aatactgttgtctgtgttgagatcg

SEQ ID NO: 56387 - DNA, 25 bp, Rattus norvegicus
aatactgttgtgctcttggtgctta

SEQ ID NO: 56388 - DNA, 25 bp, Rattus norvegicus
aatactgttgtggtcttggtgctta

SEQ ID NO: 56389 - DNA, 25 bp, Rattus norvegicus
aatactgtttacatttagcccatag

SEQ ID NO: 56390 - DNA, 25 bp, Rattus norvegicus
aatactgtttacttttagcccatag

SEQ ID NO: 56391 - DNA, 25 bp, Rattus norvegicus
aatactgtttgtcagccttgatgcc

SEQ ID NO: 56392 - DNA, 25 bp, Rattus norvegicus
aatactgtttgtgagccttgatgcc

SEQ ID NO: 56393 - DNA, 25 bp, Rattus norvegicus
aatactgttttcattagctacttca

SEQ ID NO: 56394 - DNA, 25 bp, Rattus norvegicus
aatactgttttctttagctacttca

SEQ ID NO: 56395 - DNA, 25 bp, Rattus norvegicus
aatacttactatccaattggtttta

SEQ ID NO: 56396 - DNA, 25 bp, Rattus norvegicus
aatacttactatgcaattggtttta

SEQ ID NO: 56397 - DNA, 25 bp, Rattus norvegicus
aatacttagctgctactgactgaat

SEQ ID NO: 56398 - DNA, 25 bp, Rattus norvegicus
aatacttagctggtactgactgaat

SEQ ID NO: 56399 - DNA, 25 bp, Rattus norvegicus
aatacttaggagacaggctaccttt

SEQ ID NO: 56400 - DNA, 25 bp, Rattus norvegicus
aatacttaggagtcaggctaccttt

SEQ ID NO: 56401 - DNA, 25 bp, Rattus norvegicus
aatacttagtccatcctgcttgtaa

SEQ ID NO: 56402 - DNA, 25 bp, Rattus norvegicus
aatacttagtccttcctgcttgtaa

SEQ ID NO: 56403 - DNA, 25 bp, Rattus norvegicus
aatacttatttcactagcactttgg

SEQ ID NO: 56404 - DNA, 25 bp, Rattus norvegicus
aatacttatttctctagcactttgg

SEQ ID NO: 56405 - DNA, 25 bp, Rattus norvegicus
aatacttcccagctgatgagattca

SEQ ID NO: 56406 - DNA, 25 bp, Rattus norvegicus
aatacttcccaggtgatgagattca

SEQ ID NO: 56407 - DNA, 25 bp, Rattus norvegicus
aatacttccccgaatgtgccttggc

SEQ ID NO: 56408 - DNA, 25 bp, Rattus norvegicus
aatacttccccgtatgtgccttggc

SEQ ID NO: 56409 - DNA, 25 bp, Rattus norvegicus
aatacttcccgactatgctctggag

SEQ ID NO: 56410 - DNA, 25 bp, Rattus norvegicus
aatacttcccgagtatgctctggag

SEQ ID NO: 56411 - DNA, 25 bp, Rattus norvegicus
aatacttcggttatgtggccttcag

SEQ ID NO: 56412 - DNA, 25 bp, Rattus norvegicus
aatacttcggttttgtggccttcag

SEQ ID NO: 56413 - DNA, 25 bp, Rattus norvegicus
aatacttctacccatctgttcatag

SEQ ID NO: 56414 - DNA, 25 bp, Rattus norvegicus
aatacttctaccgatctgttcatag

SEQ ID NO: 56415 - DNA, 25 bp, Rattus norvegicus
aatacttctcaactcactcactttc

SEQ ID NO: 56416 - DNA, 25 bp, Rattus norvegicus
aatacttctcaagtcactcactttc

SEQ ID NO: 56417 - DNA, 25 bp, Rattus norvegicus
aatacttgaactctgtgtctgctgc

SEQ ID NO: 56418 - DNA, 25 bp, Rattus norvegicus
aatacttgaactgtgtgtctgctgc

SEQ ID NO: 56419 - DNA, 25 bp, Rattus norvegicus
aatacttgaagtagagcgcacccct

SEQ ID NO: 56420 - DNA, 25 bp, Rattus norvegicus
aatacttgaagttgagcgcacccct

SEQ ID NO: 56421 - DNA, 25 bp, Rattus norvegicus
aatacttgaccgattgtgcctagat

SEQ ID NO: 56422 - DNA, 25 bp, Rattus norvegicus
aatacttgaccgtttgtgcctagat

SEQ ID NO: 56423 - DNA, 25 bp, Rattus norvegicus
aatacttgcactatcttacctctgt

SEQ ID NO: 56424 - DNA, 25 bp, Rattus norvegicus
aatacttgcactttcttacctctgt

SEQ ID NO: 56425 - DNA, 25 bp, Rattus norvegicus
aatacttgcatgagtcttaacccaa

SEQ ID NO: 56426 - DNA, 25 bp, Rattus norvegicus
aatacttgcatgtgtcttaacccaa

SEQ ID NO: 56427 - DNA, 25 bp, Rattus norvegicus
aatacttgccacaatacttgctcaa

SEQ ID NO: 56428 - DNA, 25 bp, Rattus norvegicus
aatacttgccactatacttgctcaa

SEQ ID NO: 56429 - DNA, 25 bp, Rattus norvegicus
aatacttgctggaggacctgtgtcc

SEQ ID NO: 56430 - DNA, 25 bp, Rattus norvegicus
aatacttgctggtggacctgtgtcc

SEQ ID NO: 56431 - DNA, 25 bp, Rattus norvegicus
aatacttggatacaggctgccgcct

SEQ ID NO: 56432 - DNA, 25 bp, Rattus norvegicus
aatacttggatagaggctgccgcct

SEQ ID NO: 56433 - DNA, 25 bp, Rattus norvegicus
aatacttggcacatggcttgctttt

SEQ ID NO: 56434 - DNA, 25 bp, Rattus norvegicus
aatacttggcacttggcttgctttt

SEQ ID NO: 56435 - DNA, 25 bp, Rattus norvegicus
aatacttggctcagatacatcttga

SEQ ID NO: 56436 - DNA, 25 bp, Rattus norvegicus
aatacttggctctgatacatcttga

SEQ ID NO: 56437 - DNA, 25 bp, Rattus norvegicus
aatacttggcttactccgtgtggat

SEQ ID NO: 56438 - DNA, 25 bp, Rattus norvegicus
aatacttggctttctccgtgtggat

SEQ ID NO: 56439 - DNA, 25 bp, Rattus norvegicus
aatacttgtcagctctatatccaga

SEQ ID NO: 56440 - DNA, 25 bp, Rattus norvegicus
aatacttgtcaggtctatatccaga

SEQ ID NO: 56441 - DNA, 25 bp, Rattus norvegicus
aatactttatctacctgtcaatctg

SEQ ID NO: 56442 - DNA, 25 bp, Rattus norvegicus
aatactttatcttcctgtcaatctg

SEQ ID NO: 56443 - DNA, 25 bp, Rattus norvegicus
aatactttccgcattggtgtggact

SEQ ID NO: 56444 - DNA, 25 bp, Rattus norvegicus
aatactttccgctttggtgtggact

SEQ ID NO: 56445 - DNA, 25 bp, Rattus norvegicus
aatactttcgcactaactgatggac

SEQ ID NO: 56446 - DNA, 25 bp, Rattus norvegicus
aatactttcgcagtaactgatggac

SEQ ID NO: 56447 - DNA, 25 bp, Rattus norvegicus
aatactttcgccactgtaaccaatg

SEQ ID NO: 56448 - DNA, 25 bp, Rattus norvegicus
aatactttcgcctctgtaaccaatg

SEQ ID NO: 56449 - DNA, 25 bp, Rattus norvegicus
aatactttcggtctgtttctgcatc

SEQ ID NO: 56450 - DNA, 25 bp, Rattus norvegicus
aatactttcggtgtgtttctgcatc

SEQ ID NO: 56451 - DNA, 25 bp, Rattus norvegicus
aatactttctaaaggccagagggta

SEQ ID NO: 56452 - DNA, 25 bp, Rattus norvegicus
aatactttctaatggccagagggta

SEQ ID NO: 56453 - DNA, 25 bp, Rattus norvegicus
aatactttcttgcagccgtgtagct

SEQ ID NO: 56454 - DNA, 25 bp, Rattus norvegicus
aatactttcttggagccgtgtagct

SEQ ID NO: 56455 - DNA, 25 bp, Rattus norvegicus
aatactttgaagacgtcagccccga

SEQ ID NO: 56456 - DNA, 25 bp, Rattus norvegicus
aatactttgaagatggcctaactcc

SEQ ID NO: 56457 - DNA, 25 bp, Rattus norvegicus
aatactttgaagtcgtcagccccga

SEQ ID NO: 56458 - DNA, 25 bp, Rattus norvegicus
aatactttgaagttggcctaactcc

SEQ ID NO: 56459 - DNA, 25 bp, Rattus norvegicus
aatactttgcagcttggctttgtac

SEQ ID NO: 56460 - DNA, 25 bp, Rattus norvegicus
aatactttgcaggttggctttgtac

SEQ ID NO: 56461 - DNA, 25 bp, Rattus norvegicus
aatactttggatagtctcccaggcc

SEQ ID NO: 56462 - DNA, 25 bp, Rattus norvegicus
aatactttggattgtctcccaggcc

SEQ ID NO: 56463 - DNA, 25 bp, Rattus norvegicus
aatactttggccctgatccagctga

SEQ ID NO: 56464 - DNA, 25 bp, Rattus norvegicus
aatactttggccgtgatccagctga

SEQ ID NO: 56465 - DNA, 25 bp, Rattus norvegicus
aatactttgtccagacatttcacaa

SEQ ID NO: 56466 - DNA, 25 bp, Rattus norvegicus
aatactttgtcctgacatttcacaa

SEQ ID NO: 56467 - DNA, 25 bp, Rattus norvegicus
aatactttgttgactctgttctgag

SEQ ID NO: 56468 - DNA, 25 bp, Rattus norvegicus
aatactttgttgtctctgttctgag

SEQ ID NO: 56469 - DNA, 25 bp, Rattus norvegicus
aatacttttcctagcacagtgccag

SEQ ID NO: 56470 - DNA, 25 bp, Rattus norvegicus
aatacttttccttgcacagtgccag

SEQ ID NO: 56471 - DNA, 25 bp, Rattus norvegicus
aatacttttctcctgtgactcaaca

SEQ ID NO: 56472 - DNA, 25 bp, Rattus norvegicus
aatacttttctcgtgtgactcaaca

SEQ ID NO: 56473 - DNA, 25 bp, Rattus norvegicus
aatagaaaactcaacgctctaccca

SEQ ID NO: 56474 - DNA, 25 bp, Rattus norvegicus
aatagaaaactctacgctctaccca

SEQ ID NO: 56475 - DNA, 25 bp, Rattus norvegicus
aatagaaagaccacccatgctcatg

SEQ ID NO: 56476 - DNA, 25 bp, Rattus norvegicus
aatagaaagacctcccatgctcatg

SEQ ID NO: 56477 - DNA, 25 bp, Rattus norvegicus
aatagaaaggagaggtgctaggcaa

SEQ ID NO: 56478 - DNA, 25 bp, Rattus norvegicus
aatagaaaggagtggtgctaggcaa

SEQ ID NO: 56479 - DNA, 25 bp, Rattus norvegicus
aatagaacagctagcagtgagattt

SEQ ID NO: 56480 - DNA, 25 bp, Rattus norvegicus
aatagaacagcttgcagtgagattt

SEQ ID NO: 56481 - DNA, 25 bp, Rattus norvegicus
aatagaacctgaatttctgcgtcct

SEQ ID NO: 56482 - DNA, 25 bp, Rattus norvegicus
aatagaacctgattttctgcgtcct

SEQ ID NO: 56483 - DNA, 25 bp, Rattus norvegicus
aatagaactcagcacgatccatcgg

SEQ ID NO: 56484 - DNA, 25 bp, Rattus norvegicus
aatagaactcaggacgatccatcgg

SEQ ID NO: 56485 - DNA, 25 bp, Rattus norvegicus
aatagaagcaccagccgccctgatt

SEQ ID NO: 56486 - DNA, 25 bp, Rattus norvegicus
aatagaagcacctgccgccctgatt

SEQ ID NO: 56487 - DNA, 25 bp, Rattus norvegicus
aatagaagccttagtcagtccctcc

SEQ ID NO: 56488 - DNA, 25 bp, Rattus norvegicus
aatagaagcctttgtcagtccctcc

SEQ ID NO: 56489 - DNA, 25 bp, Rattus norvegicus
aatagaatactaagccatgttggct

SEQ ID NO: 56490 - DNA, 25 bp, Rattus norvegicus
aatagaatactatgccatgttggct

SEQ ID NO: 56491 - DNA, 25 bp, Rattus norvegicus
aatagaatactcagccctattcggg

SEQ ID NO: 56492 - DNA, 25 bp, Rattus norvegicus
aatagaatactctgccctattcggg

SEQ ID NO: 56493 - DNA, 25 bp, Rattus norvegicus
aatagaatcacaagccttcaaggct

SEQ ID NO: 56494 - DNA, 25 bp, Rattus norvegicus
aatagaatcacatgccttcaaggct

SEQ ID NO: 56495 - DNA, 25 bp, Rattus norvegicus
aatagaatccaactccagggctcac

SEQ ID NO: 56496 - DNA, 25 bp, Rattus norvegicus
aatagaatccaagtccagggctcac

SEQ ID NO: 56497 - DNA, 25 bp, Rattus norvegicus
aatagaatccgcaagtgtttccgct

SEQ ID NO: 56498 - DNA, 25 bp, Rattus norvegicus
aatagaatccgcatgacggctccgt

SEQ ID NO: 56499 - DNA, 25 bp, Rattus norvegicus
aatagaatccgctagtgtttccgct

SEQ ID NO: 56500 - DNA, 25 bp, Rattus norvegicus
aatagaatccgcttgacggctccgt

SEQ ID NO: 56501 - DNA, 25 bp, Rattus norvegicus
aatagaatctgtcccgagaaagccc

SEQ ID NO: 56502 - DNA, 25 bp, Rattus norvegicus
aatagaatctgtgccgagaaagccc

SEQ ID NO: 56503 - DNA, 25 bp, Rattus norvegicus
aatagaatgttacgtcctctccctg

SEQ ID NO: 56504 - DNA, 25 bp, Rattus norvegicus
aatagaatgttaggtcctctccctg

SEQ ID NO: 56505 - DNA, 25 bp, Rattus norvegicus
aatagacaatgtatcgctttaaaga

SEQ ID NO: 56506 - DNA, 25 bp, Rattus norvegicus
aatagacaatgtttcgctttaaaga

SEQ ID NO: 56507 - DNA, 25 bp, Rattus norvegicus
aatagacactcaataaccactcaca

SEQ ID NO: 56508 - DNA, 25 bp, Rattus norvegicus
aatagacactcattaaccactcaca

SEQ ID NO: 56509 - DNA, 25 bp, Rattus norvegicus
aatagacatctcactgggaccgcag

SEQ ID NO: 56510 - DNA, 25 bp, Rattus norvegicus
aatagacatctctctgggaccgcag

SEQ ID NO: 56511 - DNA, 25 bp, Rattus norvegicus
aatagacatgtaagattcagtttat

SEQ ID NO: 56512 - DNA, 25 bp, Rattus norvegicus
aatagacatgtatgattcagtttat

SEQ ID NO: 56513 - DNA, 25 bp, Rattus norvegicus
aatagaccactaatttttgtgtgtg

SEQ ID NO: 56514 - DNA, 25 bp, Rattus norvegicus
aatagaccactattttttgtgtgtg

SEQ ID NO: 56515 - DNA, 25 bp, Rattus norvegicus
aatagacccattagccttttgccca

SEQ ID NO: 56516 - DNA, 25 bp, Rattus norvegicus
aatagacccattatctgaacctcag

SEQ ID NO: 56517 - DNA, 25 bp, Rattus norvegicus
aatagacccatttgccttttgccca

SEQ ID NO: 56518 - DNA, 25 bp, Rattus norvegicus
aatagacccattttctgaacctcag

SEQ ID NO: 56519 - DNA, 25 bp, Rattus norvegicus
aatagactcccacaagtggttctct

SEQ ID NO: 56520 - DNA, 25 bp, Rattus norvegicus
aatagactcccagaagtggttctct

SEQ ID NO: 56521 - DNA, 25 bp, Rattus norvegicus
aatagactctagctgggccaatacc

SEQ ID NO: 56522 - DNA, 25 bp, Rattus norvegicus
aatagactctaggtgggccaatacc

SEQ ID NO: 56523 - DNA, 25 bp, Rattus norvegicus
aatagactctgtcgaacctctcatc

SEQ ID NO: 56524 - DNA, 25 bp, Rattus norvegicus
aatagactctgtggaacctctcatc

SEQ ID NO: 56525 - DNA, 25 bp, Rattus norvegicus
aatagacttgcacgccaatcttcaa

SEQ ID NO: 56526 - DNA, 25 bp, Rattus norvegicus
aatagacttgcaggccaatcttcaa

SEQ ID NO: 56527 - DNA, 25 bp, Rattus norvegicus
aatagagaatcccaagagaatgctt

SEQ ID NO: 56528 - DNA, 25 bp, Rattus norvegicus
aatagagaatccgaagagaatgctt

SEQ ID NO: 56529 - DNA, 25 bp, Rattus norvegicus
aatagagacctcatcctggatgctg

SEQ ID NO: 56530 - DNA, 25 bp, Rattus norvegicus
aatagagacctcttcctggatgctg

SEQ ID NO: 56531 - DNA, 25 bp, Rattus norvegicus
aatagagagctcactgctgctgagg

SEQ ID NO: 56532 - DNA, 25 bp, Rattus norvegicus
aatagagagctctctgctgctgagg

SEQ ID NO: 56533 - DNA, 25 bp, Rattus norvegicus
aatagagatcttagcacccacatgg

SEQ ID NO: 56534 - DNA, 25 bp, Rattus norvegicus
aatagagatctttgcacccacatgg

SEQ ID NO: 56535 - DNA, 25 bp, Rattus norvegicus
aatagagcagtacgcctgccttggc

SEQ ID NO: 56536 - DNA, 25 bp, Rattus norvegicus
aatagagcagtaggcctgccttggc

SEQ ID NO: 56537 - DNA, 25 bp, Rattus norvegicus
aatagagctccactcccaactaagc

SEQ ID NO: 56538 - DNA, 25 bp, Rattus norvegicus
aatagagctccagtcccaactaagc

SEQ ID NO: 56539 - DNA, 25 bp, Rattus norvegicus
aatagagctgcgcttttgtgccggt

SEQ ID NO: 56540 - DNA, 25 bp, Rattus norvegicus
aatagagctgcggttttgtgccggt

SEQ ID NO: 56541 - DNA, 25 bp, Rattus norvegicus
aatagaggccttaagtcccagcgtt

SEQ ID NO: 56542 - DNA, 25 bp, Rattus norvegicus
aatagaggcctttagtcccagcgtt

SEQ ID NO: 56543 - DNA, 25 bp, Rattus norvegicus
aatagaggtcctccagcttggctat

SEQ ID NO: 56544 - DNA, 25 bp, Rattus norvegicus
aatagaggtcctgcagcttggctat

SEQ ID NO: 56545 - DNA, 25 bp, Rattus norvegicus
aatagaggtggccatcaggtcccct

SEQ ID NO: 56546 - DNA, 25 bp, Rattus norvegicus
aatagaggtggcgatcaggtcccct

SEQ ID NO: 56547 - DNA, 25 bp, Rattus norvegicus
aatagagtccagagcaccattcaaa

SEQ ID NO: 56548 - DNA, 25 bp, Rattus norvegicus
aatagagtccagtgcaccattcaaa

SEQ ID NO: 56549 - DNA, 25 bp, Rattus norvegicus
aatagagtctatacgttacagtttg

SEQ ID NO: 56550 - DNA, 25 bp, Rattus norvegicus
aatagagtctattcgttacagtttg

SEQ ID NO: 56551 - DNA, 25 bp, Rattus norvegicus
aatagagtgacacccttcccatggt

SEQ ID NO: 56552 - DNA, 25 bp, Rattus norvegicus
aatagagtgacagccttcccatggt

SEQ ID NO: 56553 - DNA, 25 bp, Rattus norvegicus
aatagagtggccacattggttccca

SEQ ID NO: 56554 - DNA, 25 bp, Rattus norvegicus
aatagagtggcctcattggttccca

SEQ ID NO: 56555 - DNA, 25 bp, Rattus norvegicus
aatagagttcagctttctctcccag

SEQ ID NO: 56556 - DNA, 25 bp, Rattus norvegicus
aatagagttcaggtttctctcccag

SEQ ID NO: 56557 - DNA, 25 bp, Rattus norvegicus
aatagagttcccacacaggatgctt

SEQ ID NO: 56558 - DNA, 25 bp, Rattus norvegicus
aatagagttccctcacaggatgctt

SEQ ID NO: 56559 - DNA, 25 bp, Rattus norvegicus
aatagagttttccatgagcctccac

SEQ ID NO: 56560 - DNA, 25 bp, Rattus norvegicus
aatagagttttcgatgagcctccac

SEQ ID NO: 56561 - DNA, 25 bp, Rattus norvegicus
aatagatacctcctagtggtccaca

SEQ ID NO: 56562 - DNA, 25 bp, Rattus norvegicus
aatagatacctcgtagtggtccaca

SEQ ID NO: 56563 - DNA, 25 bp, Rattus norvegicus
aatagatcacatcccggatctgcca

SEQ ID NO: 56564 - DNA, 25 bp, Rattus norvegicus
aatagatcacatgccggatctgcca

SEQ ID NO: 56565 - DNA, 25 bp, Rattus norvegicus
aatagatccaccagcttattttaag

SEQ ID NO: 56566 - DNA, 25 bp, Rattus norvegicus
aatagatccacctgcttattttaag

SEQ ID NO: 56567 - DNA, 25 bp, Rattus norvegicus
aatagatcggcactatcggtccata

SEQ ID NO: 56568 - DNA, 25 bp, Rattus norvegicus
aatagatcggcagtatcggtccata

SEQ ID NO: 56569 - DNA, 25 bp, Rattus norvegicus
aatagatggcaacgcggtcgattcc

SEQ ID NO: 56570 - DNA, 25 bp, Rattus norvegicus
aatagatggcaaggcggtcgattcc

SEQ ID NO: 56571 - DNA, 25 bp, Rattus norvegicus
aatagatgggcacattagactcggt

SEQ ID NO: 56572 - DNA, 25 bp, Rattus norvegicus
aatagatgggcagattagactcggt

SEQ ID NO: 56573 - DNA, 25 bp, Rattus norvegicus
aatagattggtactctctacctcag

SEQ ID NO: 56574 - DNA, 25 bp, Rattus norvegicus
aatagattggtagtctctacctcag

SEQ ID NO: 56575 - DNA, 25 bp, Rattus norvegicus
aatagatttcgcaggttcctatcca

SEQ ID NO: 56576 - DNA, 25 bp, Rattus norvegicus
aatagatttcgctggttcctatcca

SEQ ID NO: 56577 - DNA, 25 bp, Rattus norvegicus
aatagatttgttacagggtgacctg

SEQ ID NO: 56578 - DNA, 25 bp, Rattus norvegicus
aatagatttgtttcagggtgacctg

SEQ ID NO: 56579 - DNA, 25 bp, Rattus norvegicus
aatagcaaagccatcagtcaagata

SEQ ID NO: 56580 - DNA, 25 bp, Rattus norvegicus
aatagcaaagccttcagtcaagata

SEQ ID NO: 56581 - DNA, 25 bp, Rattus norvegicus
aatagcaaatttctcagcacttgga

SEQ ID NO: 56582 - DNA, 25 bp, Rattus norvegicus
aatagcaaatttgtcagcacttgga

SEQ ID NO: 56583 - DNA, 25 bp, Rattus norvegicus
aatagcaagcaacgagcattctcag

SEQ ID NO: 56584 - DNA, 25 bp, Rattus norvegicus
aatagcaagcaaggagcattctcag

SEQ ID NO: 56585 - DNA, 25 bp, Rattus norvegicus
aatagcacagcgactgggagtggca

SEQ ID NO: 56586 - DNA, 25 bp, Rattus norvegicus
aatagcacagcgtctgggagtggca

SEQ ID NO: 56587 - DNA, 25 bp, Rattus norvegicus
aatagcacagtgaggcctgtcttca

SEQ ID NO: 56588 - DNA, 25 bp, Rattus norvegicus
aatagcacagtgtggcctgtcttca

SEQ ID NO: 56589 - DNA, 25 bp, Rattus norvegicus
aatagcacatatagtacctcacaca

SEQ ID NO: 56590 - DNA, 25 bp, Rattus norvegicus
aatagcacatattgtacctcacaca

SEQ ID NO: 56591 - DNA, 25 bp, Rattus norvegicus
aatagcacctgtctccaacaacatt

SEQ ID NO: 56592 - DNA, 25 bp, Rattus norvegicus
aatagcacctgtgtccaacaacatt

SEQ ID NO: 56593 - DNA, 25 bp, Rattus norvegicus
aatagcactgtcactgtccgtgagg

SEQ ID NO: 56594 - DNA, 25 bp, Rattus norvegicus
aatagcactgtcctcggtggacctg

SEQ ID NO: 56595 - DNA, 25 bp, Rattus norvegicus
aatagcactgtcgtcggtggacctg

SEQ ID NO: 56596 - DNA, 25 bp, Rattus norvegicus
aatagcactgtctctgtccgtgagg

SEQ ID NO: 56597 - DNA, 25 bp, Rattus norvegicus
aatagcacttggctctggttttgca

SEQ ID NO: 56598 - DNA, 25 bp, Rattus norvegicus
aatagcacttgggtctggttttgca

SEQ ID NO: 56599 - DNA, 25 bp, Rattus norvegicus
aatagcacttgtccaacatctccca

SEQ ID NO: 56600 - DNA, 25 bp, Rattus norvegicus
aatagcacttgtgcaacatctccca

SEQ ID NO: 56601 - DNA, 25 bp, Rattus norvegicus
aatagcagaggccaggtgacccctt

SEQ ID NO: 56602 - DNA, 25 bp, Rattus norvegicus
aatagcagaggcgaggtgacccctt

SEQ ID NO: 56603 - DNA, 25 bp, Rattus norvegicus
aatagcagagtccatgcgccgggta

SEQ ID NO: 56604 - DNA, 25 bp, Rattus norvegicus
aatagcagagtcgatgcgccgggta

SEQ ID NO: 56605 - DNA, 25 bp, Rattus norvegicus
aatagcagcagcatcctcctcgttg

SEQ ID NO: 56606 - DNA, 25 bp, Rattus norvegicus
aatagcagcagcttcctcctcgttg

SEQ ID NO: 56607 - DNA, 25 bp, Rattus norvegicus
aatagcagcatcaaattccccaggg

SEQ ID NO: 56608 - DNA, 25 bp, Rattus norvegicus
aatagcagcatctaattccccaggg

SEQ ID NO: 56609 - DNA, 25 bp, Rattus norvegicus
aatagcagccaaaggacacctccgg

SEQ ID NO: 56610 - DNA, 25 bp, Rattus norvegicus
aatagcagccaatggacacctccgg

SEQ ID NO: 56611 - DNA, 25 bp, Rattus norvegicus
aatagcagtcctatagtagagttac

SEQ ID NO: 56612 - DNA, 25 bp, Rattus norvegicus
aatagcagtcctttagtagagttac

SEQ ID NO: 56613 - DNA, 25 bp, Rattus norvegicus
aatagcataggaaaccccaggttag

SEQ ID NO: 56614 - DNA, 25 bp, Rattus norvegicus
aatagcataggataccccaggttag

SEQ ID NO: 56615 - DNA, 25 bp, Rattus norvegicus
aatagcatctaactcctgctctggc

SEQ ID NO: 56616 - DNA, 25 bp, Rattus norvegicus
aatagcatctaagtcctgctctggc

SEQ ID NO: 56617 - DNA, 25 bp, Rattus norvegicus
aatagcatctaccaaacagccgacc

SEQ ID NO: 56618 - DNA, 25 bp, Rattus norvegicus
aatagcatctaccatatcccttcag

SEQ ID NO: 56619 - DNA, 25 bp, Rattus norvegicus
aatagcatctacgaaacagccgacc

SEQ ID NO: 56620 - DNA, 25 bp, Rattus norvegicus
aatagcatctacgatatcccttcag

SEQ ID NO: 56621 - DNA, 25 bp, Rattus norvegicus
aatagcatctttctctctggacgag

SEQ ID NO: 56622 - DNA, 25 bp, Rattus norvegicus
aatagcatctttgtctctggacgag

SEQ ID NO: 56623 - DNA, 25 bp, Rattus norvegicus
aatagcattcctattacatcttctg

SEQ ID NO: 56624 - DNA, 25 bp, Rattus norvegicus
aatagcattccttttacatcttctg

SEQ ID NO: 56625 - DNA, 25 bp, Rattus norvegicus
aatagcattcggagtatttgcacta

SEQ ID NO: 56626 - DNA, 25 bp, Rattus norvegicus
aatagcattcggtgtatttgcacta

SEQ ID NO: 56627 - DNA, 25 bp, Rattus norvegicus
aatagcattctaaccagactcagcc

SEQ ID NO: 56628 - DNA, 25 bp, Rattus norvegicus
aatagcattctatccagactcagcc

SEQ ID NO: 56629 - DNA, 25 bp, Rattus norvegicus
aatagcattgtaacgccccatatat

SEQ ID NO: 56630 - DNA, 25 bp, Rattus norvegicus
aatagcattgtatcgccccatatat

SEQ ID NO: 56631 - DNA, 25 bp, Rattus norvegicus
aatagcatttcacattcccagtaag

SEQ ID NO: 56632 - DNA, 25 bp, Rattus norvegicus
aatagcatttcagattcccagtaag

SEQ ID NO: 56633 - DNA, 25 bp, Rattus norvegicus
aatagccaagctccctcaatgtgta

SEQ ID NO: 56634 - DNA, 25 bp, Rattus norvegicus
aatagccaagctgcctcaatgtgta

SEQ ID NO: 56635 - DNA, 25 bp, Rattus norvegicus
aatagccaatgtacattcccttggg

SEQ ID NO: 56636 - DNA, 25 bp, Rattus norvegicus
aatagccaatgttcattcccttggg

SEQ ID NO: 56637 - DNA, 25 bp, Rattus norvegicus
aatagccacaatatcttgtaccctg

SEQ ID NO: 56638 - DNA, 25 bp, Rattus norvegicus
aatagccacaatttcttgtaccctg

SEQ ID NO: 56639 - DNA, 25 bp, Rattus norvegicus
aatagccaccttcattttcttcctt

SEQ ID NO: 56640 - DNA, 25 bp, Rattus norvegicus
aatagccaccttgattttcttcctt

SEQ ID NO: 56641 - DNA, 25 bp, Rattus norvegicus
aatagccagcacctattagcagcca

SEQ ID NO: 56642 - DNA, 25 bp, Rattus norvegicus
aatagccagcacgtattagcagcca

SEQ ID NO: 56643 - DNA, 25 bp, Rattus norvegicus
aatagccagccacatttctcaatgc

SEQ ID NO: 56644 - DNA, 25 bp, Rattus norvegicus
aatagccagccagatttctcaatgc

SEQ ID NO: 56645 - DNA, 25 bp, Rattus norvegicus
aatagccaggagcttgcagaccaag

SEQ ID NO: 56646 - DNA, 25 bp, Rattus norvegicus
aatagccaggaggttgcagaccaag

SEQ ID NO: 56647 - DNA, 25 bp, Rattus norvegicus
aatagccagtatccagtcacttaga

SEQ ID NO: 56648 - DNA, 25 bp, Rattus norvegicus
aatagccagtatgcagtcacttaga

SEQ ID NO: 56649 - DNA, 25 bp, Rattus norvegicus
aatagccatgctattagggaatagg

SEQ ID NO: 56650 - DNA, 25 bp, Rattus norvegicus
aatagccatgcttttagggaatagg

SEQ ID NO: 56651 - DNA, 25 bp, Rattus norvegicus
aatagccatggaagacaggttatca

SEQ ID NO: 56652 - DNA, 25 bp, Rattus norvegicus
aatagccatggatgacaggttatca

SEQ ID NO: 56653 - DNA, 25 bp, Rattus norvegicus
aatagccatgttatctttctgtaaa

SEQ ID NO: 56654 - DNA, 25 bp, Rattus norvegicus
aatagccatgttttctttctgtaaa

SEQ ID NO: 56655 - DNA, 25 bp, Rattus norvegicus
aatagccattctccttctctaagaa

SEQ ID NO: 56656 - DNA, 25 bp, Rattus norvegicus
aatagccattctgcttctctaagaa

SEQ ID NO: 56657 - DNA, 25 bp, Rattus norvegicus
aatagcccaacactgtccagcagcg

SEQ ID NO: 56658 - DNA, 25 bp, Rattus norvegicus
aatagcccaacagtgtccagcagcg

SEQ ID NO: 56659 - DNA, 25 bp, Rattus norvegicus
aatagcccatttccttgaagctgcc

SEQ ID NO: 56660 - DNA, 25 bp, Rattus norvegicus
aatagcccatttgcttgaagctgcc

SEQ ID NO: 56661 - DNA, 25 bp, Rattus norvegicus
aatagccccactagttgttcaacag

SEQ ID NO: 56662 - DNA, 25 bp, Rattus norvegicus
aatagccccacttgttgttcaacag

SEQ ID NO: 56663 - DNA, 25 bp, Rattus norvegicus
aatagccctggaccaacacatgagt

SEQ ID NO: 56664 - DNA, 25 bp, Rattus norvegicus
aatagccctggagcaacacatgagt

SEQ ID NO: 56665 - DNA, 25 bp, Rattus norvegicus
aatagccctggcaaggctgatgctt

SEQ ID NO: 56666 - DNA, 25 bp, Rattus norvegicus
aatagccctggctaggctgatgctt

SEQ ID NO: 56667 - DNA, 25 bp, Rattus norvegicus
aatagccctgtgagctgtattttaa

SEQ ID NO: 56668 - DNA, 25 bp, Rattus norvegicus
aatagccctgtgtgctgtattttaa

SEQ ID NO: 56669 - DNA, 25 bp, Rattus norvegicus
aatagcctctcaattaagtcctgca

SEQ ID NO: 56670 - DNA, 25 bp, Rattus norvegicus
aatagcctctcatttaagtcctgca

SEQ ID NO: 56671 - DNA, 25 bp, Rattus norvegicus
aatagcctgagtcctttgtcaccat

SEQ ID NO: 56672 - DNA, 25 bp, Rattus norvegicus
aatagcctgagtgctttgtcaccat

SEQ ID NO: 56673 - DNA, 25 bp, Rattus norvegicus
aatagcctgcgcatcaggccatttt

SEQ ID NO: 56674 - DNA, 25 bp, Rattus norvegicus
aatagcctgcgcttcaggccatttt

SEQ ID NO: 56675 - DNA, 25 bp, Rattus norvegicus
aatagccttaacattccgtactctg

SEQ ID NO: 56676 - DNA, 25 bp, Rattus norvegicus
aatagccttaactttccgtactctg

SEQ ID NO: 56677 - DNA, 25 bp, Rattus norvegicus
aatagccttggtagcaagtccagtt

SEQ ID NO: 56678 - DNA, 25 bp, Rattus norvegicus
aatagccttggttgcaagtccagtt

SEQ ID NO: 56679 - DNA, 25 bp, Rattus norvegicus
aatagcgacggtcgcttgatggtcc

SEQ ID NO: 56680 - DNA, 25 bp, Rattus norvegicus
aatagcgacggtggcttgatggtcc

SEQ ID NO: 56681 - DNA, 25 bp, Rattus norvegicus
aatagcgatggcaacatcatcccca

SEQ ID NO: 56682 - DNA, 25 bp, Rattus norvegicus
aatagcgatggctacatcatcccca

SEQ ID NO: 56683 - DNA, 25 bp, Rattus norvegicus
aatagcgctaggaaccgattaacga

SEQ ID NO: 56684 - DNA, 25 bp, Rattus norvegicus
aatagcgctaggtaccgattaacga

SEQ ID NO: 56685 - DNA, 25 bp, Rattus norvegicus
aatagcggaaacctgtacattggat

SEQ ID NO: 56686 - DNA, 25 bp, Rattus norvegicus
aatagcggaaacgtgtacattggat

SEQ ID NO: 56687 - DNA, 25 bp, Rattus norvegicus
aatagcggcctccaatctggtgacg

SEQ ID NO: 56688 - DNA, 25 bp, Rattus norvegicus
aatagcggcctcgaatctggtgacg

SEQ ID NO: 56689 - DNA, 25 bp, Rattus norvegicus
aatagcggctgaccgaaacccgtcg

SEQ ID NO: 56690 - DNA, 25 bp, Rattus norvegicus
aatagcggctgagcgaaacccgtcg

SEQ ID NO: 56691 - DNA, 25 bp, Rattus norvegicus
aatagcgggctactctcaggaaaca

SEQ ID NO: 56692 - DNA, 25 bp, Rattus norvegicus
aatagcgggctagtctcaggaaaca

SEQ ID NO: 56693 - DNA, 25 bp, Rattus norvegicus
aatagcgtcaatatcgtcttttctt

SEQ ID NO: 56694 - DNA, 25 bp, Rattus norvegicus
aatagcgtcaatttcgtcttttctt

SEQ ID NO: 56695 - DNA, 25 bp, Rattus norvegicus
aatagctaacgaacctggcgcaagg

SEQ ID NO: 56696 - DNA, 25 bp, Rattus norvegicus
aatagctaacgatcctggcgcaagg

SEQ ID NO: 56697 - DNA, 25 bp, Rattus norvegicus
aatagctacagcatccatgatgtgt

SEQ ID NO: 56698 - DNA, 25 bp, Rattus norvegicus
aatagctacagcttccatgatgtgt

SEQ ID NO: 56699 - DNA, 25 bp, Rattus norvegicus
aatagctacgacattctcactgagg

SEQ ID NO: 56700 - DNA, 25 bp, Rattus norvegicus
aatagctacgactttctcactgagg

SEQ ID NO: 56701 - DNA, 25 bp, Rattus norvegicus
aatagctactctctctgtgaactgt

SEQ ID NO: 56702 - DNA, 25 bp, Rattus norvegicus
aatagctactctgtctgtgaactgt

SEQ ID NO: 56703 - DNA, 25 bp, Rattus norvegicus
aatagctagactcttgtccctttcc

SEQ ID NO: 56704 - DNA, 25 bp, Rattus norvegicus
aatagctagactgttgtccctttcc

SEQ ID NO: 56705 - DNA, 25 bp, Rattus norvegicus
aatagctagcacagcttctgcaact

SEQ ID NO: 56706 - DNA, 25 bp, Rattus norvegicus
aatagctagcactgcttctgcaact

SEQ ID NO: 56707 - DNA, 25 bp, Rattus norvegicus
aatagctagctactccctaactgga

SEQ ID NO: 56708 - DNA, 25 bp, Rattus norvegicus
aatagctagctagtccctaactgga

SEQ ID NO: 56709 - DNA, 25 bp, Rattus norvegicus
aatagctagtttctccagacctgtt

SEQ ID NO: 56710 - DNA, 25 bp, Rattus norvegicus
aatagctagtttgtccagacctgtt

SEQ ID NO: 56711 - DNA, 25 bp, Rattus norvegicus
aatagctataaaacaccctgtgtgc

SEQ ID NO: 56712 - DNA, 25 bp, Rattus norvegicus
aatagctataaatcaccctgtgtgc

SEQ ID NO: 56713 - DNA, 25 bp, Rattus norvegicus
aatagctcaaagcacctgaacctga

SEQ ID NO: 56714 - DNA, 25 bp, Rattus norvegicus
aatagctcaaaggacctgaacctga

SEQ ID NO: 56715 - DNA, 25 bp, Rattus norvegicus
aatagctcaggaatgactccttggt

SEQ ID NO: 56716 - DNA, 25 bp, Rattus norvegicus
aatagctcaggattgactccttggt

SEQ ID NO: 56717 - DNA, 25 bp, Rattus norvegicus
aatagctcatggcaaggaccacccg

SEQ ID NO: 56718 - DNA, 25 bp, Rattus norvegicus
aatagctcatgggaaggaccacccg

SEQ ID NO: 56719 - DNA, 25 bp, Rattus norvegicus
aatagctccgcgctaatccttaatc

SEQ ID NO: 56720 - DNA, 25 bp, Rattus norvegicus
aatagctccgcggtaatccttaatc

SEQ ID NO: 56721 - DNA, 25 bp, Rattus norvegicus
aatagctcgactcttggacaacccc

SEQ ID NO: 56722 - DNA, 25 bp, Rattus norvegicus
aatagctcgactgttggacaacccc

SEQ ID NO: 56723 - DNA, 25 bp, Rattus norvegicus
aatagctgaaggatgtccctactgc

SEQ ID NO: 56724 - DNA, 25 bp, Rattus norvegicus
aatagctgaaggttgtccctactgc

SEQ ID NO: 56725 - DNA, 25 bp, Rattus norvegicus
aatagctgacccagttgatctgcgc

SEQ ID NO: 56726 - DNA, 25 bp, Rattus norvegicus
aatagctgaccctgttgatctgcgc

SEQ ID NO: 56727 - DNA, 25 bp, Rattus norvegicus
aatagctgatagctgcgggtcccct

SEQ ID NO: 56728 - DNA, 25 bp, Rattus norvegicus
aatagctgataggtgcgggtcccct

SEQ ID NO: 56729 - DNA, 25 bp, Rattus norvegicus
aatagctggaggactctgcgctgtt

SEQ ID NO: 56730 - DNA, 25 bp, Rattus norvegicus
aatagctggaggtctctgcgctgtt

SEQ ID NO: 56731 - DNA, 25 bp, Rattus norvegicus
aatagctgggacaatcgagctccgt

SEQ ID NO: 56732 - DNA, 25 bp, Rattus norvegicus
aatagctgggactatcgagctccgt

SEQ ID NO: 56733 - DNA, 25 bp, Rattus norvegicus
aatagctgtcagagtgcacctaaag

SEQ ID NO: 56734 - DNA, 25 bp, Rattus norvegicus
aatagctgtcagatcgcacggatac

SEQ ID NO: 56735 - DNA, 25 bp, Rattus norvegicus
aatagctgtcagtgtgcacctaaag

SEQ ID NO: 56736 - DNA, 25 bp, Rattus norvegicus
aatagctgtcagttcgcacggatac

SEQ ID NO: 56737 - DNA, 25 bp, Rattus norvegicus
aatagctgtgtcaccgatgttgact

SEQ ID NO: 56738 - DNA, 25 bp, Rattus norvegicus
aatagctgtgtctccgatgttgact

SEQ ID NO: 56739 - DNA, 25 bp, Rattus norvegicus
aatagctgtttccaggctgccgggt

SEQ ID NO: 56740 - DNA, 25 bp, Rattus norvegicus
aatagctgtttcgaggctgccgggt

SEQ ID NO: 56741 - DNA, 25 bp, Rattus norvegicus
aatagcttacaccacggttacgctc

SEQ ID NO: 56742 - DNA, 25 bp, Rattus norvegicus
aatagcttacacgacggttacgctc

SEQ ID NO: 56743 - DNA, 25 bp, Rattus norvegicus
aatagcttagagaccgccaagggcc

SEQ ID NO: 56744 - DNA, 25 bp, Rattus norvegicus
aatagcttagagtccgccaagggcc

SEQ ID NO: 56745 - DNA, 25 bp, Rattus norvegicus
aatagcttagtcagccagtgccaca

SEQ ID NO: 56746 - DNA, 25 bp, Rattus norvegicus
aatagcttagtctgccagtgccaca

SEQ ID NO: 56747 - DNA, 25 bp, Rattus norvegicus
aatagcttatgtatgtgacccatcc

SEQ ID NO: 56748 - DNA, 25 bp, Rattus norvegicus
aatagcttatgtttgtgacccatcc

SEQ ID NO: 56749 - DNA, 25 bp, Rattus norvegicus
aatagcttcatgctcctccaaagag

SEQ ID NO: 56750 - DNA, 25 bp, Rattus norvegicus
aatagcttcatggtcctccaaagag

SEQ ID NO: 56751 - DNA, 25 bp, Rattus norvegicus
aatagcttccagaatttggtgacaa

SEQ ID NO: 56752 - DNA, 25 bp, Rattus norvegicus
aatagcttccagtatttggtgacaa

SEQ ID NO: 56753 - DNA, 25 bp, Rattus norvegicus
aatagcttcctaatcatctaaatac

SEQ ID NO: 56754 - DNA, 25 bp, Rattus norvegicus
aatagcttcctattcatctaaatac

SEQ ID NO: 56755 - DNA, 25 bp, Rattus norvegicus
aatagcttctttacctgcaatcaac

SEQ ID NO: 56756 - DNA, 25 bp, Rattus norvegicus
aatagcttcttttcctgcaatcaac

SEQ ID NO: 56757 - DNA, 25 bp, Rattus norvegicus
aatagcttggctatgtcagcaataa

SEQ ID NO: 56758 - DNA, 25 bp, Rattus norvegicus
aatagcttggctttgtcagcaataa

SEQ ID NO: 56759 - DNA, 25 bp, Rattus norvegicus
aatagcttgtcacggcaacttccag

SEQ ID NO: 56760 - DNA, 25 bp, Rattus norvegicus
aatagcttgtcagggcaacttccag

SEQ ID NO: 56761 - DNA, 25 bp, Rattus norvegicus
aatagcttgtgcacagacacctctg

SEQ ID NO: 56762 - DNA, 25 bp, Rattus norvegicus
aatagcttgtgctcagacacctctg

SEQ ID NO: 56763 - DNA, 25 bp, Rattus norvegicus
aatagctttctcaagcgtgaagggt

SEQ ID NO: 56764 - DNA, 25 bp, Rattus norvegicus
aatagctttctctagcgtgaagggt

SEQ ID NO: 56765 - DNA, 25 bp, Rattus norvegicus
aatagctttcttagtttggttgctt

SEQ ID NO: 56766 - DNA, 25 bp, Rattus norvegicus
aatagctttctttgtttggttgctt

SEQ ID NO: 56767 - DNA, 25 bp, Rattus norvegicus
aataggaaacctccagccagtcctt

SEQ ID NO: 56768 - DNA, 25 bp, Rattus norvegicus
aataggaaacctgcagccagtcctt

SEQ ID NO: 56769 - DNA, 25 bp, Rattus norvegicus
aataggaagctcctttctagcccct

SEQ ID NO: 56770 - DNA, 25 bp, Rattus norvegicus
aataggaagctcgtttctagcccct

SEQ ID NO: 56771 - DNA, 25 bp, Rattus norvegicus
aataggaaggcccacctttctgaag

SEQ ID NO: 56772 - DNA, 25 bp, Rattus norvegicus
aataggaaggccgacctttctgaag

SEQ ID NO: 56773 - DNA, 25 bp, Rattus norvegicus
aataggaatcctccttctctgaggg

SEQ ID NO: 56774 - DNA, 25 bp, Rattus norvegicus
aataggaatcctgcttctctgaggg

SEQ ID NO: 56775 - DNA, 25 bp, Rattus norvegicus
aataggaatgatatacactgtgtac

SEQ ID NO: 56776 - DNA, 25 bp, Rattus norvegicus
aataggaatgatttacactgtgtac

SEQ ID NO: 56777 - DNA, 25 bp, Rattus norvegicus
aataggaattttcacccctgtgctt

SEQ ID NO: 56778 - DNA, 25 bp, Rattus norvegicus
aataggaattttgacccctgtgctt

SEQ ID NO: 56779 - DNA, 25 bp, Rattus norvegicus
aataggaccagcacttcgaacacag

SEQ ID NO: 56780 - DNA, 25 bp, Rattus norvegicus
aataggaccagctcttcgaacacag

SEQ ID NO: 56781 - DNA, 25 bp, Rattus norvegicus
aataggaccagtcttacactcgctg

SEQ ID NO: 56782 - DNA, 25 bp, Rattus norvegicus
aataggaccagtgttacactcgctg

SEQ ID NO: 56783 - DNA, 25 bp, Rattus norvegicus
aataggactcggactgcgtctgatg

SEQ ID NO: 56784 - DNA, 25 bp, Rattus norvegicus
aataggactcggtctgcgtctgatg

SEQ ID NO: 56785 - DNA, 25 bp, Rattus norvegicus
aataggactgctccctcagaatgct

SEQ ID NO: 56786 - DNA, 25 bp, Rattus norvegicus
aataggactgctgcctcagaatgct

SEQ ID NO: 56787 - DNA, 25 bp, Rattus norvegicus
aataggagaccaccactccagatac

SEQ ID NO: 56788 - DNA, 25 bp, Rattus norvegicus
aataggagaccagcactccagatac

SEQ ID NO: 56789 - DNA, 25 bp, Rattus norvegicus
aataggagacgccagcaccttgcaa

SEQ ID NO: 56790 - DNA, 25 bp, Rattus norvegicus
aataggagacgcgagcaccttgcaa

SEQ ID NO: 56791 - DNA, 25 bp, Rattus norvegicus
aataggaggcgcaagtcaccggtat

SEQ ID NO: 56792 - DNA, 25 bp, Rattus norvegicus
aataggaggcgctagtcaccggtat

SEQ ID NO: 56793 - DNA, 25 bp, Rattus norvegicus
aataggatgcagagtgtgcgcaagc

SEQ ID NO: 56794 - DNA, 25 bp, Rattus norvegicus
aataggatgcagtgtgtgcgcaagc

SEQ ID NO: 56795 - DNA, 25 bp, Rattus norvegicus
aataggcaacctcgagcacggtcct

SEQ ID NO: 56796 - DNA, 25 bp, Rattus norvegicus
aataggcaacctggagcacggtcct

SEQ ID NO: 56797 - DNA, 25 bp, Rattus norvegicus
aataggcaatttcagtttcactccc

SEQ ID NO: 56798 - DNA, 25 bp, Rattus norvegicus
aataggcaatttgagtttcactccc

SEQ ID NO: 56799 - DNA, 25 bp, Rattus norvegicus
aataggcacatcaacacaataggaa

SEQ ID NO: 56800 - DNA, 25 bp, Rattus norvegicus
aataggcacatctacacaataggaa

SEQ ID NO: 56801 - DNA, 25 bp, Rattus norvegicus
aataggcacgacattgcgaagtgtt

SEQ ID NO: 56802 - DNA, 25 bp, Rattus norvegicus
aataggcacgactttgcgaagtgtt

SEQ ID NO: 56803 - DNA, 25 bp, Rattus norvegicus
aataggcagcgaccaatgcctggtc

SEQ ID NO: 56804 - DNA, 25 bp, Rattus norvegicus
aataggcagcgagcaatgcctggtc

SEQ ID NO: 56805 - DNA, 25 bp, Rattus norvegicus
aataggcatggtcttgctgacctct

SEQ ID NO: 56806 - DNA, 25 bp, Rattus norvegicus
aataggcatggtgttgctgacctct

SEQ ID NO: 56807 - DNA, 25 bp, Rattus norvegicus
aataggcatgtgagactcttgtaaa

SEQ ID NO: 56808 - DNA, 25 bp, Rattus norvegicus
aataggcatgtgtgactcttgtaaa

SEQ ID NO: 56809 - DNA, 25 bp, Rattus norvegicus
aataggcattaacctgctgctgtaa

SEQ ID NO: 56810 - DNA, 25 bp, Rattus norvegicus
aataggcattaagctgctgctgtaa

SEQ ID NO: 56811 - DNA, 25 bp, Rattus norvegicus
aataggcattcccatctcaagatgg

SEQ ID NO: 56812 - DNA, 25 bp, Rattus norvegicus
aataggcattccgatctcaagatgg

SEQ ID NO: 56813 - DNA, 25 bp, Rattus norvegicus
aataggcatttaattttgtctgata

SEQ ID NO: 56814 - DNA, 25 bp, Rattus norvegicus
aataggcatttatttttgtctgata

SEQ ID NO: 56815 - DNA, 25 bp, Rattus norvegicus
aataggcctgagatgtacgtgtgca

SEQ ID NO: 56816 - DNA, 25 bp, Rattus norvegicus
aataggcctgagttgtacgtgtgca

SEQ ID NO: 56817 - DNA, 25 bp, Rattus norvegicus
aataggctagacatctgcacgtccc

SEQ ID NO: 56818 - DNA, 25 bp, Rattus norvegicus
aataggctagacttctgcacgtccc

SEQ ID NO: 56819 - DNA, 25 bp, Rattus norvegicus
aataggctagataggatgtccagca

SEQ ID NO: 56820 - DNA, 25 bp, Rattus norvegicus
aataggctagatatccagtgacgac

SEQ ID NO: 56821 - DNA, 25 bp, Rattus norvegicus
aataggctagattggatgtccagca

SEQ ID NO: 56822 - DNA, 25 bp, Rattus norvegicus
aataggctagatttccagtgacgac

SEQ ID NO: 56823 - DNA, 25 bp, Rattus norvegicus
aataggctccagagtatccgggaaa

SEQ ID NO: 56824 - DNA, 25 bp, Rattus norvegicus
aataggctccagtgtatccgggaaa

SEQ ID NO: 56825 - DNA, 25 bp, Rattus norvegicus
aataggctcttcatttggtggtgtc

SEQ ID NO: 56826 - DNA, 25 bp, Rattus norvegicus
aataggctcttcttttggtggtgtc

SEQ ID NO: 56827 - DNA, 25 bp, Rattus norvegicus
aataggctgtttaagcacagctgaa

SEQ ID NO: 56828 - DNA, 25 bp, Rattus norvegicus
aataggctgttttagcacagctgaa

SEQ ID NO: 56829 - DNA, 25 bp, Rattus norvegicus
aataggcttgtgacctggctccctg

SEQ ID NO: 56830 - DNA, 25 bp, Rattus norvegicus
aataggcttgtgtcctggctccctg

SEQ ID NO: 56831 - DNA, 25 bp, Rattus norvegicus
aatagggaacccagcagaggctctc

SEQ ID NO: 56832 - DNA, 25 bp, Rattus norvegicus
aatagggaaccctgcagaggctctc

SEQ ID NO: 56833 - DNA, 25 bp, Rattus norvegicus
aatagggacgcaccgaagtctcttt

SEQ ID NO: 56834 - DNA, 25 bp, Rattus norvegicus
aatagggacgcagcgaagtctcttt

SEQ ID NO: 56835 - DNA, 25 bp, Rattus norvegicus
aatagggactgtcaggctctgctct

SEQ ID NO: 56836 - DNA, 25 bp, Rattus norvegicus
aatagggactgtgaggctctgctct

SEQ ID NO: 56837 - DNA, 25 bp, Rattus norvegicus
aatagggcagcaccagacgaggtca

SEQ ID NO: 56838 - DNA, 25 bp, Rattus norvegicus
aatagggcagcagcagacgaggtca

SEQ ID NO: 56839 - DNA, 25 bp, Rattus norvegicus
aatagggcattgaatgttaataaac

SEQ ID NO: 56840 - DNA, 25 bp, Rattus norvegicus
aatagggcattgtatgttaataaac

SEQ ID NO: 56841 - DNA, 25 bp, Rattus norvegicus
aatagggccagtaggatgactcaga

SEQ ID NO: 56842 - DNA, 25 bp, Rattus norvegicus
aatagggccagttggatgactcaga

SEQ ID NO: 56843 - DNA, 25 bp, Rattus norvegicus
aatagggcctgaagcttcaaagcaa

SEQ ID NO: 56844 - DNA, 25 bp, Rattus norvegicus
aatagggcctgatgcttcaaagcaa

SEQ ID NO: 56845 - DNA, 25 bp, Rattus norvegicus
aatagggccttgctggctcagctgc

SEQ ID NO: 56846 - DNA, 25 bp, Rattus norvegicus
aatagggccttggtggctcagctgc

SEQ ID NO: 56847 - DNA, 25 bp, Rattus norvegicus
aatagggcctttcacgggtagatat

SEQ ID NO: 56848 - DNA, 25 bp, Rattus norvegicus
aatagggcctttctgtttccctcag

SEQ ID NO: 56849 - DNA, 25 bp, Rattus norvegicus
aatagggcctttgacgggtagatat

SEQ ID NO: 56850 - DNA, 25 bp, Rattus norvegicus
aatagggcctttgtgtttccctcag

SEQ ID NO: 56851 - DNA, 25 bp, Rattus norvegicus
aatagggcttgtccaggtcttagag

SEQ ID NO: 56852 - DNA, 25 bp, Rattus norvegicus
aatagggcttgtgcaggtcttagag

SEQ ID NO: 56853 - DNA, 25 bp, Rattus norvegicus
aatagggtccagaatctgtttgccc

SEQ ID NO: 56854 - DNA, 25 bp, Rattus norvegicus
aatagggtccagtatctgtttgccc

SEQ ID NO: 56855 - DNA, 25 bp, Rattus norvegicus
aataggtaatgcctctgccaccacc

SEQ ID NO: 56856 - DNA, 25 bp, Rattus norvegicus
aataggtaatgcgtctgccaccacc

SEQ ID NO: 56857 - DNA, 25 bp, Rattus norvegicus
aataggtagcttacagggctgagac

SEQ ID NO: 56858 - DNA, 25 bp, Rattus norvegicus
aataggtagctttcagggctgagac

SEQ ID NO: 56859 - DNA, 25 bp, Rattus norvegicus
aataggtcaccaagctcgaaagaat

SEQ ID NO: 56860 - DNA, 25 bp, Rattus norvegicus
aataggtcaccatgctcgaaagaat

SEQ ID NO: 56861 - DNA, 25 bp, Rattus norvegicus
aataggtcatttctgcgagcaggat

SEQ ID NO: 56862 - DNA, 25 bp, Rattus norvegicus
aataggtcatttgtgcgagcaggat

SEQ ID NO: 56863 - DNA, 25 bp, Rattus norvegicus
aataggtccagtaccaggtcttcca

SEQ ID NO: 56864 - DNA, 25 bp, Rattus norvegicus
aataggtccagttccaggtcttcca

SEQ ID NO: 56865 - DNA, 25 bp, Rattus norvegicus
aataggtcctttcaagccaatgcaa

SEQ ID NO: 56866 - DNA, 25 bp, Rattus norvegicus
aataggtcctttgaagccaatgcaa

SEQ ID NO: 56867 - DNA, 25 bp, Rattus norvegicus
aataggtctaccacagagtgccttg

SEQ ID NO: 56868 - DNA, 25 bp, Rattus norvegicus
aataggtctacctcagagtgccttg

SEQ ID NO: 56869 - DNA, 25 bp, Rattus norvegicus
aataggtctcacatgaattgcgaaa

SEQ ID NO: 56870 - DNA, 25 bp, Rattus norvegicus
aataggtctcacttgaattgcgaaa

SEQ ID NO: 56871 - DNA, 25 bp, Rattus norvegicus
aataggtctctaccccttcatgacg

SEQ ID NO: 56872 - DNA, 25 bp, Rattus norvegicus
aataggtctctagcccttcatgacg

SEQ ID NO: 56873 - DNA, 25 bp, Rattus norvegicus
aataggtctgtgctacctcttgacc

SEQ ID NO: 56874 - DNA, 25 bp, Rattus norvegicus
aataggtctgtggtacctcttgacc

SEQ ID NO: 56875 - DNA, 25 bp, Rattus norvegicus
aataggtgccctacctgaaacatgg

SEQ ID NO: 56876 - DNA, 25 bp, Rattus norvegicus
aataggtgcccttcctgaaacatgg

SEQ ID NO: 56877 - DNA, 25 bp, Rattus norvegicus
aataggtgtactaggactctccaca

SEQ ID NO: 56878 - DNA, 25 bp, Rattus norvegicus
aataggtgtacttggactctccaca

SEQ ID NO: 56879 - DNA, 25 bp, Rattus norvegicus
aataggtgtcggaagcccggccact

SEQ ID NO: 56880 - DNA, 25 bp, Rattus norvegicus
aataggtgtcggtagcccggccact

SEQ ID NO: 56881 - DNA, 25 bp, Rattus norvegicus
aataggttaaagagggcgtgtcaga

SEQ ID NO: 56882 - DNA, 25 bp, Rattus norvegicus
aataggttaaagtgggcgtgtcaga

SEQ ID NO: 56883 - DNA, 25 bp, Rattus norvegicus
aataggttaggaagccgaaggccaa

SEQ ID NO: 56884 - DNA, 25 bp, Rattus norvegicus
aataggttaggatgccgaaggccaa

SEQ ID NO: 56885 - DNA, 25 bp, Rattus norvegicus
aataggttcctgactttggtgtgtc

SEQ ID NO: 56886 - DNA, 25 bp, Rattus norvegicus
aataggttcctgtctttggtgtgtc

SEQ ID NO: 56887 - DNA, 25 bp, Rattus norvegicus
aataggttctccaagagccgtccag

SEQ ID NO: 56888 - DNA, 25 bp, Rattus norvegicus
aataggttctcctagagccgtccag

SEQ ID NO: 56889 - DNA, 25 bp, Rattus norvegicus
aataggttctctccttagcacagga

SEQ ID NO: 56890 - DNA, 25 bp, Rattus norvegicus
aataggttctctgcttagcacagga

SEQ ID NO: 56891 - DNA, 25 bp, Rattus norvegicus
aataggttgttcctggagcctgaat

SEQ ID NO: 56892 - DNA, 25 bp, Rattus norvegicus
aataggttgttcgtggagcctgaat

SEQ ID NO: 56893 - DNA, 25 bp, Rattus norvegicus
aataggtttaccatacaccagcctc

SEQ ID NO: 56894 - DNA, 25 bp, Rattus norvegicus
aataggtttaccttacaccagcctc

SEQ ID NO: 56895 - DNA, 25 bp, Rattus norvegicus
aataggtttataagtagctcagtga

SEQ ID NO: 56896 - DNA, 25 bp, Rattus norvegicus
aataggtttatatgtagctcagtga

SEQ ID NO: 56897 - DNA, 25 bp, Rattus norvegicus
aataggtttcctaggattccatcag

SEQ ID NO: 56898 - DNA, 25 bp, Rattus norvegicus
aataggtttccttggattccatcag

SEQ ID NO: 56899 - DNA, 25 bp, Rattus norvegicus
aatagtaactctcgccatagcttaa

SEQ ID NO: 56900 - DNA, 25 bp, Rattus norvegicus
aatagtaactctggccatagcttaa

SEQ ID NO: 56901 - DNA, 25 bp, Rattus norvegicus
aatagtactcgacattcgtcatatt

SEQ ID NO: 56902 - DNA, 25 bp, Rattus norvegicus
aatagtactcgagattcgtcatatt

SEQ ID NO: 56903 - DNA, 25 bp, Rattus norvegicus
aatagtaggtctcatctctgttcgt

SEQ ID NO: 56904 - DNA, 25 bp, Rattus norvegicus
aatagtaggtctgatctctgttcgt

SEQ ID NO: 56905 - DNA, 25 bp, Rattus norvegicus
aatagtatctgaagtgtgggcacca

SEQ ID NO: 56906 - DNA, 25 bp, Rattus norvegicus
aatagtatctgatgtgtgggcacca

SEQ ID NO: 56907 - DNA, 25 bp, Rattus norvegicus
aatagtcaagttacacagaatcggt

SEQ ID NO: 56908 - DNA, 25 bp, Rattus norvegicus
aatagtcaagtttcacagaatcggt

SEQ ID NO: 56909 - DNA, 25 bp, Rattus norvegicus
aatagtcaccccaaagagccttaag

SEQ ID NO: 56910 - DNA, 25 bp, Rattus norvegicus
aatagtcacccctaagagccttaag

SEQ ID NO: 56911 - DNA, 25 bp, Rattus norvegicus
aatagtcacgaaccccatgcagaaa

SEQ ID NO: 56912 - DNA, 25 bp, Rattus norvegicus
aatagtcacgaagcccatgcagaaa

SEQ ID NO: 56913 - DNA, 25 bp, Rattus norvegicus
aatagtcagccaatttgtacgtgtg

SEQ ID NO: 56914 - DNA, 25 bp, Rattus norvegicus
aatagtcagccattttgtacgtgtg

SEQ ID NO: 56915 - DNA, 25 bp, Rattus norvegicus
aatagtcatacaatccatcagggcc

SEQ ID NO: 56916 - DNA, 25 bp, Rattus norvegicus
aatagtcatacattccatcagggcc

SEQ ID NO: 56917 - DNA, 25 bp, Rattus norvegicus
aatagtccaggcctgactctgtggg

SEQ ID NO: 56918 - DNA, 25 bp, Rattus norvegicus
aatagtccaggcgtgactctgtggg

SEQ ID NO: 56919 - DNA, 25 bp, Rattus norvegicus
aatagtccagttactccaggagccc

SEQ ID NO: 56920 - DNA, 25 bp, Rattus norvegicus
aatagtccagtttctccaggagccc

SEQ ID NO: 56921 - DNA, 25 bp, Rattus norvegicus
aatagtccatttcgtagtcaccagc

SEQ ID NO: 56922 - DNA, 25 bp, Rattus norvegicus
aatagtccatttggtagtcaccagc

SEQ ID NO: 56923 - DNA, 25 bp, Rattus norvegicus
aatagtcccaagaggatcctgtaac

SEQ ID NO: 56924 - DNA, 25 bp, Rattus norvegicus
aatagtcccaagtggatcctgtaac

SEQ ID NO: 56925 - DNA, 25 bp, Rattus norvegicus
aatagtccggacaccagaattctct

SEQ ID NO: 56926 - DNA, 25 bp, Rattus norvegicus
aatagtccggactccagaattctct

SEQ ID NO: 56927 - DNA, 25 bp, Rattus norvegicus
aatagtccgtgcatcttatttcctc

SEQ ID NO: 56928 - DNA, 25 bp, Rattus norvegicus
aatagtccgtgcttcttatttcctc

SEQ ID NO: 56929 - DNA, 25 bp, Rattus norvegicus
aatagtccttgcacagttgcttgcc

SEQ ID NO: 56930 - DNA, 25 bp, Rattus norvegicus
aatagtccttgctcagttgcttgcc

SEQ ID NO: 56931 - DNA, 25 bp, Rattus norvegicus
aatagtctcaagattgcatcaggga

SEQ ID NO: 56932 - DNA, 25 bp, Rattus norvegicus
aatagtctcaagtttgcatcaggga

SEQ ID NO: 56933 - DNA, 25 bp, Rattus norvegicus
aatagtctcgtcactttgatggtgt

SEQ ID NO: 56934 - DNA, 25 bp, Rattus norvegicus
aatagtctcgtctctttgatggtgt

SEQ ID NO: 56935 - DNA, 25 bp, Rattus norvegicus
aatagtctctttcccaggcagcgaa

SEQ ID NO: 56936 - DNA, 25 bp, Rattus norvegicus
aatagtctctttgccaggcagcgaa

SEQ ID NO: 56937 - DNA, 25 bp, Rattus norvegicus
aatagtctgggcaatcccatcctat

SEQ ID NO: 56938 - DNA, 25 bp, Rattus norvegicus
aatagtctgggctatcccatcctat

SEQ ID NO: 56939 - DNA, 25 bp, Rattus norvegicus
aatagtctgtctagagtccttgtac

SEQ ID NO: 56940 - DNA, 25 bp, Rattus norvegicus
aatagtctgtcttgagtccttgtac

SEQ ID NO: 56941 - DNA, 25 bp, Rattus norvegicus
aatagtctgtgccttgccttggagg

SEQ ID NO: 56942 - DNA, 25 bp, Rattus norvegicus
aatagtctgtgcgttgccttggagg

SEQ ID NO: 56943 - DNA, 25 bp, Rattus norvegicus
aatagtcttagtaatactcaacaga

SEQ ID NO: 56944 - DNA, 25 bp, Rattus norvegicus
aatagtcttagttatactcaacaga

SEQ ID NO: 56945 - DNA, 25 bp, Rattus norvegicus
aatagtcttcttacagtttcttaca

SEQ ID NO: 56946 - DNA, 25 bp, Rattus norvegicus
aatagtcttctttcagtttcttaca

SEQ ID NO: 56947 - DNA, 25 bp, Rattus norvegicus
aatagtcttggtctggcggtttcat

SEQ ID NO: 56948 - DNA, 25 bp, Rattus norvegicus
aatagtcttggtgtggcggtttcat

SEQ ID NO: 56949 - DNA, 25 bp, Rattus norvegicus
aatagtgaagttcgcctcagttgct

SEQ ID NO: 56950 - DNA, 25 bp, Rattus norvegicus
aatagtgaagttggcctcagttgct

SEQ ID NO: 56951 - DNA, 25 bp, Rattus norvegicus
aatagtgacaacctggtgctgcgcc

SEQ ID NO: 56952 - DNA, 25 bp, Rattus norvegicus
aatagtgacaacgtggtgctgcgcc

SEQ ID NO: 56953 - DNA, 25 bp, Rattus norvegicus
aatagtgacgtaccctttgtactga

SEQ ID NO: 56954 - DNA, 25 bp, Rattus norvegicus
aatagtgacgtagcctttgtactga

SEQ ID NO: 56955 - DNA, 25 bp, Rattus norvegicus
aatagtgaggcaactcatcaagccc

SEQ ID NO: 56956 - DNA, 25 bp, Rattus norvegicus
aatagtgaggcatctcatcaagccc

SEQ ID NO: 56957 - DNA, 25 bp, Rattus norvegicus
aatagtgataccatccggacctgag

SEQ ID NO: 56958 - DNA, 25 bp, Rattus norvegicus
aatagtgataccttccggacctgag

SEQ ID NO: 56959 - DNA, 25 bp, Rattus norvegicus
aatagtgatgtcctcaagcgtcaaa

SEQ ID NO: 56960 - DNA, 25 bp, Rattus norvegicus
aatagtgatgtcgtcaagcgtcaaa

SEQ ID NO: 56961 - DNA, 25 bp, Rattus norvegicus
aatagtgcacatcttctaactgcta

SEQ ID NO: 56962 - DNA, 25 bp, Rattus norvegicus
aatagtgcacatgttctaactgcta

SEQ ID NO: 56963 - DNA, 25 bp, Rattus norvegicus
aatagtgcagttccattctggccgt

SEQ ID NO: 56964 - DNA, 25 bp, Rattus norvegicus
aatagtgcagttgcattctggccgt

SEQ ID NO: 56965 - DNA, 25 bp, Rattus norvegicus
aatagtgcatgtatccttccgttat

SEQ ID NO: 56966 - DNA, 25 bp, Rattus norvegicus
aatagtgcatgtttccttccgttat

SEQ ID NO: 56967 - DNA, 25 bp, Rattus norvegicus
aatagtgcccttatcctgctgagat

SEQ ID NO: 56968 - DNA, 25 bp, Rattus norvegicus
aatagtgcccttcgatctctgaagt

SEQ ID NO: 56969 - DNA, 25 bp, Rattus norvegicus
aatagtgcccttggatctctgaagt

SEQ ID NO: 56970 - DNA, 25 bp, Rattus norvegicus
aatagtgcccttttcctgctgagat

SEQ ID NO: 56971 - DNA, 25 bp, Rattus norvegicus
aatagtgctgatacaaaggctggaa

SEQ ID NO: 56972 - DNA, 25 bp, Rattus norvegicus
aatagtgctgattcaaaggctggaa

SEQ ID NO: 56973 - DNA, 25 bp, Rattus norvegicus
aatagtgctgctatacctggcatgt

SEQ ID NO: 56974 - DNA, 25 bp, Rattus norvegicus
aatagtgctgctttacctggcatgt

SEQ ID NO: 56975 - DNA, 25 bp, Rattus norvegicus
aatagtgctggtaacctcctgggtc

SEQ ID NO: 56976 - DNA, 25 bp, Rattus norvegicus
aatagtgctggttacctcctgggtc

SEQ ID NO: 56977 - DNA, 25 bp, Rattus norvegicus
aatagtgctgttacctattggactg

SEQ ID NO: 56978 - DNA, 25 bp, Rattus norvegicus
aatagtgctgtttcctattggactg

SEQ ID NO: 56979 - DNA, 25 bp, Rattus norvegicus
aatagtggagcacttgtcggacagt

SEQ ID NO: 56980 - DNA, 25 bp, Rattus norvegicus
aatagtggagcagttgtcggacagt

SEQ ID NO: 56981 - DNA, 25 bp, Rattus norvegicus
aatagtgggactccctatccttgct

SEQ ID NO: 56982 - DNA, 25 bp, Rattus norvegicus
aatagtgggactgcctatccttgct

SEQ ID NO: 56983 - DNA, 25 bp, Rattus norvegicus
aatagtggtagcagtgccttccttt

SEQ ID NO: 56984 - DNA, 25 bp, Rattus norvegicus
aatagtggtagctgtgccttccttt

SEQ ID NO: 56985 - DNA, 25 bp, Rattus norvegicus
aatagtggttcaattggccctcaac

SEQ ID NO: 56986 - DNA, 25 bp, Rattus norvegicus
aatagtggttcatttggccctcaac

SEQ ID NO: 56987 - DNA, 25 bp, Rattus norvegicus
aatagtgtacttcccatttgagcct

SEQ ID NO: 56988 - DNA, 25 bp, Rattus norvegicus
aatagtgtacttgccatttgagcct

SEQ ID NO: 56989 - DNA, 25 bp, Rattus norvegicus
aatagtgtcagtattctgtgtaaag

SEQ ID NO: 56990 - DNA, 25 bp, Rattus norvegicus
aatagtgtcagttttctgtgtaaag

SEQ ID NO: 56991 - DNA, 25 bp, Rattus norvegicus
aatagtgtccataagcttctttgtc

SEQ ID NO: 56992 - DNA, 25 bp, Rattus norvegicus
aatagtgtccattagcttctttgtc

SEQ ID NO: 56993 - DNA, 25 bp, Rattus norvegicus
aatagtgtctatagctgctttgaat

SEQ ID NO: 56994 - DNA, 25 bp, Rattus norvegicus
aatagtgtctattgctgctttgaat

SEQ ID NO: 56995 - DNA, 25 bp, Rattus norvegicus
aatagtgtgttcaaggctgtcctgg

SEQ ID NO: 56996 - DNA, 25 bp, Rattus norvegicus
aatagtgtgttctaggctgtcctgg

SEQ ID NO: 56997 - DNA, 25 bp, Rattus norvegicus
aatagtgttctcactgtggcagttc

SEQ ID NO: 56998 - DNA, 25 bp, Rattus norvegicus
aatagtgttctctctgtggcagttc

SEQ ID NO: 56999 - DNA, 25 bp, Rattus norvegicus
aatagtgttttgagtgttgattaaa

SEQ ID NO: 57000 - DNA, 25 bp, Rattus norvegicus
aatagtgttttgtgtgttgattaaa

SEQ ID NO: 57001 - DNA, 25 bp, Rattus norvegicus
aatagtgtttttcgcatcggcaatt

SEQ ID NO: 57002 - DNA, 25 bp, Rattus norvegicus
aatagtgtttttggcatcggcaatt

SEQ ID NO: 57003 - DNA, 25 bp, Rattus norvegicus
aatagttactacagggtttgcatca

SEQ ID NO: 57004 - DNA, 25 bp, Rattus norvegicus
aatagttactactgggtttgcatca

SEQ ID NO: 57005 - DNA, 25 bp, Rattus norvegicus
aatagttcagcaaggcaccactggc

SEQ ID NO: 57006 - DNA, 25 bp, Rattus norvegicus
aatagttcagcatggcaccactggc

SEQ ID NO: 57007 - DNA, 25 bp, Rattus norvegicus
aatagttcatttactttccacctga

SEQ ID NO: 57008 - DNA, 25 bp, Rattus norvegicus
aatagttcattttctttccacctga

SEQ ID NO: 57009 - DNA, 25 bp, Rattus norvegicus
aatagttcgcaaacctccaatggcc

SEQ ID NO: 57010 - DNA, 25 bp, Rattus norvegicus
aatagttcgcaatcctccaatggcc

SEQ ID NO: 57011 - DNA, 25 bp, Rattus norvegicus
aatagttcgtccatcattttacact

SEQ ID NO: 57012 - DNA, 25 bp, Rattus norvegicus
aatagttcgtccttcattttacact

SEQ ID NO: 57013 - DNA, 25 bp, Rattus norvegicus
aatagttctccacctctgacacact

SEQ ID NO: 57014 - DNA, 25 bp, Rattus norvegicus
aatagttctccagctctgacacact

SEQ ID NO: 57015 - DNA, 25 bp, Rattus norvegicus
aatagttctgtgatcaccctcttgg

SEQ ID NO: 57016 - DNA, 25 bp, Rattus norvegicus
aatagttctgtgcatgtatatccat

SEQ ID NO: 57017 - DNA, 25 bp, Rattus norvegicus
aatagttctgtggatgtatatccat

SEQ ID NO: 57018 - DNA, 25 bp, Rattus norvegicus
aatagttctgtgttcaccctcttgg

SEQ ID NO: 57019 - DNA, 25 bp, Rattus norvegicus
aatagttgaccaatcttccatgttt

SEQ ID NO: 57020 - DNA, 25 bp, Rattus norvegicus
aatagttgaccattcttccatgttt

SEQ ID NO: 57021 - DNA, 25 bp, Rattus norvegicus
aatagttgcggtagtttctggagac

SEQ ID NO: 57022 - DNA, 25 bp, Rattus norvegicus
aatagttgcggttgtttctggagac

SEQ ID NO: 57023 - DNA, 25 bp, Rattus norvegicus
aatagttggcctagatgagtgggca

SEQ ID NO: 57024 - DNA, 25 bp, Rattus norvegicus
aatagttggccttgatgagtgggca

SEQ ID NO: 57025 - DNA, 25 bp, Rattus norvegicus
aatagtttagctactgcctgatact

SEQ ID NO: 57026 - DNA, 25 bp, Rattus norvegicus
aatagtttagcttctgcctgatact

SEQ ID NO: 57027 - DNA, 25 bp, Rattus norvegicus
aatagtttataactcagcctgttta

SEQ ID NO: 57028 - DNA, 25 bp, Rattus norvegicus
aatagtttataagtcagcctgttta

SEQ ID NO: 57029 - DNA, 25 bp, Rattus norvegicus
aatagtttccacattgcttgaggca

SEQ ID NO: 57030 - DNA, 25 bp, Rattus norvegicus
aatagtttccactttgcttgaggca

SEQ ID NO: 57031 - DNA, 25 bp, Rattus norvegicus
aatagtttcctgcttccaatgttct

SEQ ID NO: 57032 - DNA, 25 bp, Rattus norvegicus
aatagtttcctggttccaatgttct

SEQ ID NO: 57033 - DNA, 25 bp, Rattus norvegicus
aatagtttcttcatactctgcatat

SEQ ID NO: 57034 - DNA, 25 bp, Rattus norvegicus
aatagtttcttcttactctgcatat

SEQ ID NO: 57035 - DNA, 25 bp, Rattus norvegicus
aatagtttctttagctttactgcct

SEQ ID NO: 57036 - DNA, 25 bp, Rattus norvegicus
aatagtttcttttgctttactgcct

SEQ ID NO: 57037 - DNA, 25 bp, Rattus norvegicus
aatagtttgcaacccaatgctttag

SEQ ID NO: 57038 - DNA, 25 bp, Rattus norvegicus
aatagtttgcaagccaatgctttag

SEQ ID NO: 57039 - DNA, 25 bp, Rattus norvegicus
aatagtttgcctagttcagttgtat

SEQ ID NO: 57040 - DNA, 25 bp, Rattus norvegicus
aatagtttgccttgttcagttgtat

SEQ ID NO: 57041 - DNA, 25 bp, Rattus norvegicus
aatagtttgcggctctctagcagcc

SEQ ID NO: 57042 - DNA, 25 bp, Rattus norvegicus
aatagtttgcgggtctctagcagcc

SEQ ID NO: 57043 - DNA, 25 bp, Rattus norvegicus
aatagtttgtaccagtttcatgaag

SEQ ID NO: 57044 - DNA, 25 bp, Rattus norvegicus
aatagtttgtacgagtttcatgaag

SEQ ID NO: 57045 - DNA, 25 bp, Rattus norvegicus
aatagtttttccagtactgctgacg

SEQ ID NO: 57046 - DNA, 25 bp, Rattus norvegicus
aatagtttttcctgtactgctgacg

SEQ ID NO: 57047 - DNA, 25 bp, Rattus norvegicus
aatagtttttctcgtggactgtgca

SEQ ID NO: 57048 - DNA, 25 bp, Rattus norvegicus
aatagtttttctggtggactgtgca

SEQ ID NO: 57049 - DNA, 25 bp, Rattus norvegicus
aatataaaaccacatctcccgcatc

SEQ ID NO: 57050 - DNA, 25 bp, Rattus norvegicus
aatataaaaccagatctcccgcatc

SEQ ID NO: 57051 - DNA, 25 bp, Rattus norvegicus
aatataaagccacggctggtggtat

SEQ ID NO: 57052 - DNA, 25 bp, Rattus norvegicus
aatataaagccagggctggtggtat

SEQ ID NO: 57053 - DNA, 25 bp, Rattus norvegicus
aatataacaatgctggttcctggag

SEQ ID NO: 57054 - DNA, 25 bp, Rattus norvegicus
aatataacaatggtggttcctggag

SEQ ID NO: 57055 - DNA, 25 bp, Rattus norvegicus
aatataacgtggctcaaatggacat

SEQ ID NO: 57056 - DNA, 25 bp, Rattus norvegicus
aatataacgtgggtcaaatggacat

SEQ ID NO: 57057 - DNA, 25 bp, Rattus norvegicus
aatataactcgcaatgcttctcctt

SEQ ID NO: 57058 - DNA, 25 bp, Rattus norvegicus
aatataactcgctatgcttctcctt

SEQ ID NO: 57059 - DNA, 25 bp, Rattus norvegicus
aatataagatcgcttgcctcctgat

SEQ ID NO: 57060 - DNA, 25 bp, Rattus norvegicus
aatataagatcggttgcctcctgat

SEQ ID NO: 57061 - DNA, 25 bp, Rattus norvegicus
aatataatgttacccacccgttagc

SEQ ID NO: 57062 - DNA, 25 bp, Rattus norvegicus
aatataatgttagccacccgttagc

SEQ ID NO: 57063 - DNA, 25 bp, Rattus norvegicus
aatataattatcaacttttcaaggt

SEQ ID NO: 57064 - DNA, 25 bp, Rattus norvegicus
aatataattatctacttttcaaggt

SEQ ID NO: 57065 - DNA, 25 bp, Rattus norvegicus
aatataattcagatccttggcaagt

SEQ ID NO: 57066 - DNA, 25 bp, Rattus norvegicus
aatataattcagttccttggcaagt

SEQ ID NO: 57067 - DNA, 25 bp, Rattus norvegicus
aatatacaaagcatctattcagctc

SEQ ID NO: 57068 - DNA, 25 bp, Rattus norvegicus
aatatacaaagcttctattcagctc

SEQ ID NO: 57069 - DNA, 25 bp, Rattus norvegicus
aatatacaggcccaagtttccctct

SEQ ID NO: 57070 - DNA, 25 bp, Rattus norvegicus
aatatacaggccgaagtttccctct

SEQ ID NO: 57071 - DNA, 25 bp, Rattus norvegicus
aatataccacatatgacatcccgag

SEQ ID NO: 57072 - DNA, 25 bp, Rattus norvegicus
aatataccacatttgacatcccgag

SEQ ID NO: 57073 - DNA, 25 bp, Rattus norvegicus
aatataccagttagtctttccgtct

SEQ ID NO: 57074 - DNA, 25 bp, Rattus norvegicus
aatataccagtttgtctttccgtct

SEQ ID NO: 57075 - DNA, 25 bp, Rattus norvegicus
aatatacctataccactgttacaag

SEQ ID NO: 57076 - DNA, 25 bp, Rattus norvegicus
aatatacctatagcactgttacaag

SEQ ID NO: 57077 - DNA, 25 bp, Rattus norvegicus
aatatacgccttcctggtgattttg

SEQ ID NO: 57078 - DNA, 25 bp, Rattus norvegicus
aatatacgccttgctggtgattttg

SEQ ID NO: 57079 - DNA, 25 bp, Rattus norvegicus
aatatacgtcggaggtgttgagcag

SEQ ID NO: 57080 - DNA, 25 bp, Rattus norvegicus
aatatacgtcggtggtgttgagcag

SEQ ID NO: 57081 - DNA, 25 bp, Rattus norvegicus
aatatacgttctctaagattcaatt

SEQ ID NO: 57082 - DNA, 25 bp, Rattus norvegicus
aatatacgttctgtaagattcaatt

SEQ ID NO: 57083 - DNA, 25 bp, Rattus norvegicus
aatatactcaccattacagaccctt

SEQ ID NO: 57084 - DNA, 25 bp, Rattus norvegicus
aatatactcacctttacagaccctt

SEQ ID NO: 57085 - DNA, 25 bp, Rattus norvegicus
aatatactcccaaactaaacccaag

SEQ ID NO: 57086 - DNA, 25 bp, Rattus norvegicus
aatatactcccatactaaacccaag

SEQ ID NO: 57087 - DNA, 25 bp, Rattus norvegicus
aatatactcggtaggagcgtctcct

SEQ ID NO: 57088 - DNA, 25 bp, Rattus norvegicus
aatatactcggttggagcgtctcct

SEQ ID NO: 57089 - DNA, 25 bp, Rattus norvegicus
aatatactctgaacatgctgtcccc

SEQ ID NO: 57090 - DNA, 25 bp, Rattus norvegicus
aatatactctgatcatgctgtcccc

SEQ ID NO: 57091 - DNA, 25 bp, Rattus norvegicus
aatatactgcatcttgggtgaggtt

SEQ ID NO: 57092 - DNA, 25 bp, Rattus norvegicus
aatatactgcatgttgggtgaggtt

SEQ ID NO: 57093 - DNA, 25 bp, Rattus norvegicus
aatatacttataacacagccccacc

SEQ ID NO: 57094 - DNA, 25 bp, Rattus norvegicus
aatatacttatatcacagccccacc

SEQ ID NO: 57095 - DNA, 25 bp, Rattus norvegicus
aatatacttctgattttagggctta

SEQ ID NO: 57096 - DNA, 25 bp, Rattus norvegicus
aatatacttctgtttttagggctta

SEQ ID NO: 57097 - DNA, 25 bp, Rattus norvegicus
aatatactttcgatccatggtgtgc

SEQ ID NO: 57098 - DNA, 25 bp, Rattus norvegicus
aatatactttcgttccatggtgtgc

SEQ ID NO: 57099 - DNA, 25 bp, Rattus norvegicus
aatatagacaaaatggctccccagc

SEQ ID NO: 57100 - DNA, 25 bp, Rattus norvegicus
aatatagacaaattggctccccagc

SEQ ID NO: 57101 - DNA, 25 bp, Rattus norvegicus
aatatagagcagacattcttcctgg

SEQ ID NO: 57102 - DNA, 25 bp, Rattus norvegicus
aatatagagcagtcattcttcctgg

SEQ ID NO: 57103 - DNA, 25 bp, Rattus norvegicus
aatatagaggctaaccccttgctca

SEQ ID NO: 57104 - DNA, 25 bp, Rattus norvegicus
aatatagaggcttaccccttgctca

SEQ ID NO: 57105 - DNA, 25 bp, Rattus norvegicus
aatatagcacttatcaattctctct

SEQ ID NO: 57106 - DNA, 25 bp, Rattus norvegicus
aatatagcacttttcaattctctct

SEQ ID NO: 57107 - DNA, 25 bp, Rattus norvegicus
aatatagcatgtcgtctggcccacc

SEQ ID NO: 57108 - DNA, 25 bp, Rattus norvegicus
aatatagcatgtggtctggcccacc

SEQ ID NO: 57109 - DNA, 25 bp, Rattus norvegicus
aatatagctttccactctgttgtct

SEQ ID NO: 57110 - DNA, 25 bp, Rattus norvegicus
aatatagctttcgactctgttgtct

SEQ ID NO: 57111 - DNA, 25 bp, Rattus norvegicus
aatatagcttttatgccctttctct

SEQ ID NO: 57112 - DNA, 25 bp, Rattus norvegicus
aatatagcttttttgccctttctct

SEQ ID NO: 57113 - DNA, 25 bp, Rattus norvegicus
aatataggcctcatctcttgtttac

SEQ ID NO: 57114 - DNA, 25 bp, Rattus norvegicus
aatataggcctcttctcttgtttac

SEQ ID NO: 57115 - DNA, 25 bp, Rattus norvegicus
aatatagttcagactccgatcccca

SEQ ID NO: 57116 - DNA, 25 bp, Rattus norvegicus
aatatagttcagtctccgatcccca

SEQ ID NO: 57117 - DNA, 25 bp, Rattus norvegicus
aatatagtttttcccttcctgatag

SEQ ID NO: 57118 - DNA, 25 bp, Rattus norvegicus
aatatagtttttgccttcctgatag

SEQ ID NO: 57119 - DNA, 25 bp, Rattus norvegicus
aatatataccccagagcacagtgtg

SEQ ID NO: 57120 - DNA, 25 bp, Rattus norvegicus
aatatatacccctgagcacagtgtg

SEQ ID NO: 57121 - DNA, 25 bp, Rattus norvegicus
aatatatatatgacgcgcatcactt

SEQ ID NO: 57122 - DNA, 25 bp, Rattus norvegicus
aatatatatatgtcgcgcatcactt

SEQ ID NO: 57123 - DNA, 25 bp, Rattus norvegicus
aatatatatcttacatttctgcttt

SEQ ID NO: 57124 - DNA, 25 bp, Rattus norvegicus
aatatatatctttcatttctgcttt

SEQ ID NO: 57125 - DNA, 25 bp, Rattus norvegicus
aatatatcagctatatctccccact

SEQ ID NO: 57126 - DNA, 25 bp, Rattus norvegicus
aatatatcagctttatctccccact

SEQ ID NO: 57127 - DNA, 25 bp, Rattus norvegicus
aatatatcctacaaccgtggctcag

SEQ ID NO: 57128 - DNA, 25 bp, Rattus norvegicus
aatatatcctactaccgtggctcag

SEQ ID NO: 57129 - DNA, 25 bp, Rattus norvegicus
aatatatcgttgctcttggttcagg

SEQ ID NO: 57130 - DNA, 25 bp, Rattus norvegicus
aatatatcgttggtcttggttcagg

SEQ ID NO: 57131 - DNA, 25 bp, Rattus norvegicus
aatatatctattactacttagaagg

SEQ ID NO: 57132 - DNA, 25 bp, Rattus norvegicus
aatatatctatttctacttagaagg

SEQ ID NO: 57133 - DNA, 25 bp, Rattus norvegicus
aatatatgacgtatccagggaccag

SEQ ID NO: 57134 - DNA, 25 bp, Rattus norvegicus
aatatatgacgtttccagggaccag

SEQ ID NO: 57135 - DNA, 25 bp, Rattus norvegicus
aatatatgatacctgtgccctgtgc

SEQ ID NO: 57136 - DNA, 25 bp, Rattus norvegicus
aatatatgatacgtgtgccctgtgc

SEQ ID NO: 57137 - DNA, 25 bp, Rattus norvegicus
aatatatgatgcctgttagtaacac

SEQ ID NO: 57138 - DNA, 25 bp, Rattus norvegicus
aatatatgatgcgtgttagtaacac

SEQ ID NO: 57139 - DNA, 25 bp, Rattus norvegicus
aatatatgtcttattcctatccaaa

SEQ ID NO: 57140 - DNA, 25 bp, Rattus norvegicus
aatatatgtctttttcctatccaaa

SEQ ID NO: 57141 - DNA, 25 bp, Rattus norvegicus
aatatatgttgtattccgcaccgtg

SEQ ID NO: 57142 - DNA, 25 bp, Rattus norvegicus
aatatatgttgttttccgcaccgtg

SEQ ID NO: 57143 - DNA, 25 bp, Rattus norvegicus
aatatattccatactgatgccaccc

SEQ ID NO: 57144 - DNA, 25 bp, Rattus norvegicus
aatatattccattctgatgccaccc

SEQ ID NO: 57145 - DNA, 25 bp, Rattus norvegicus
aatatattccgcacctgatcgaggg

SEQ ID NO: 57146 - DNA, 25 bp, Rattus norvegicus
aatatattccgctcctgatcgaggg

SEQ ID NO: 57147 - DNA, 25 bp, Rattus norvegicus
aatatattccttagcactgtgaccc

SEQ ID NO: 57148 - DNA, 25 bp, Rattus norvegicus
aatatattcctttgcactgtgaccc

SEQ ID NO: 57149 - DNA, 25 bp, Rattus norvegicus
aatatattctaaaaccatttgtgta

SEQ ID NO: 57150 - DNA, 25 bp, Rattus norvegicus
aatatattctaataccatttgtgta

SEQ ID NO: 57151 - DNA, 25 bp, Rattus norvegicus
aatatattctccataattccccatc

SEQ ID NO: 57152 - DNA, 25 bp, Rattus norvegicus
aatatattctccttaattccccatc

SEQ ID NO: 57153 - DNA, 25 bp, Rattus norvegicus
aatatatttcataccttcctggcga

SEQ ID NO: 57154 - DNA, 25 bp, Rattus norvegicus
aatatatttcattccttcctggcga

SEQ ID NO: 57155 - DNA, 25 bp, Rattus norvegicus
aatatcaaaaagaagctcccacatg

SEQ ID NO: 57156 - DNA, 25 bp, Rattus norvegicus
aatatcaaaaagtagctcccacatg

SEQ ID NO: 57157 - DNA, 25 bp, Rattus norvegicus
aatatcaaacacctcccgggcggag

SEQ ID NO: 57158 - DNA, 25 bp, Rattus norvegicus
aatatcaaacacgtcccgggcggag

SEQ ID NO: 57159 - DNA, 25 bp, Rattus norvegicus
aatatcaatcacacttctcttctgg

SEQ ID NO: 57160 - DNA, 25 bp, Rattus norvegicus
aatatcaatcactcttctcttctgg

SEQ ID NO: 57161 - DNA, 25 bp, Rattus norvegicus
aatatcaccatcctaggacaagcag

SEQ ID NO: 57162 - DNA, 25 bp, Rattus norvegicus
aatatcaccatcgtaggacaagcag

SEQ ID NO: 57163 - DNA, 25 bp, Rattus norvegicus
aatatcaccttccttcacagtcctg

SEQ ID NO: 57164 - DNA, 25 bp, Rattus norvegicus
aatatcaccttcgttcacagtcctg

SEQ ID NO: 57165 - DNA, 25 bp, Rattus norvegicus
aatatcactaggagcagaccccggg

SEQ ID NO: 57166 - DNA, 25 bp, Rattus norvegicus
aatatcactaggtgcagaccccggg

SEQ ID NO: 57167 - DNA, 25 bp, Rattus norvegicus
aatatcactgcccaaattacccatt

SEQ ID NO: 57168 - DNA, 25 bp, Rattus norvegicus
aatatcactgccgaaattacccatt

SEQ ID NO: 57169 - DNA, 25 bp, Rattus norvegicus
aatatcagagtcaggctttcattac

SEQ ID NO: 57170 - DNA, 25 bp, Rattus norvegicus
aatatcagagtctggctttcattac

SEQ ID NO: 57171 - DNA, 25 bp, Rattus norvegicus
aatatcagatgaagtgtgacacact

SEQ ID NO: 57172 - DNA, 25 bp, Rattus norvegicus
aatatcagatgatgtgtgacacact

SEQ ID NO: 57173 - DNA, 25 bp, Rattus norvegicus
aatatcaggacgctggcttccaata

SEQ ID NO: 57174 - DNA, 25 bp, Rattus norvegicus
aatatcaggacggtggcttccaata

SEQ ID NO: 57175 - DNA, 25 bp, Rattus norvegicus
aatatcataataccgctttcccttt

SEQ ID NO: 57176 - DNA, 25 bp, Rattus norvegicus
aatatcataatagcgctttcccttt

SEQ ID NO: 57177 - DNA, 25 bp, Rattus norvegicus
aatatcatagtaattgtgctgaaga

SEQ ID NO: 57178 - DNA, 25 bp, Rattus norvegicus
aatatcatagtatttgtgctgaaga

SEQ ID NO: 57179 - DNA, 25 bp, Rattus norvegicus
aatatcatcagcagttcaggccgac

SEQ ID NO: 57180 - DNA, 25 bp, Rattus norvegicus
aatatcatcagctgttcaggccgac

SEQ ID NO: 57181 - DNA, 25 bp, Rattus norvegicus
aatatcatcctgacatttggtttgc

SEQ ID NO: 57182 - DNA, 25 bp, Rattus norvegicus
aatatcatcctgtcatttggtttgc

SEQ ID NO: 57183 - DNA, 25 bp, Rattus norvegicus
aatatcatcggactgctggctatca

SEQ ID NO: 57184 - DNA, 25 bp, Rattus norvegicus
aatatcatcggagtgctggctatca

SEQ ID NO: 57185 - DNA, 25 bp, Rattus norvegicus
aatatcatgacacctctgatctctg

SEQ ID NO: 57186 - DNA, 25 bp, Rattus norvegicus
aatatcatgacagctctgatctctg

SEQ ID NO: 57187 - DNA, 25 bp, Rattus norvegicus
aatatcatgctacacaggtcctctc

SEQ ID NO: 57188 - DNA, 25 bp, Rattus norvegicus
aatatcatgctagacaggtcctctc

SEQ ID NO: 57189 - DNA, 25 bp, Rattus norvegicus
aatatcattcttaccatggctaaat

SEQ ID NO: 57190 - DNA, 25 bp, Rattus norvegicus
aatatcattctttccatggctaaat

SEQ ID NO: 57191 - DNA, 25 bp, Rattus norvegicus
aatatcatttagacttagcctctat

SEQ ID NO: 57192 - DNA, 25 bp, Rattus norvegicus
aatatcatttagtcttagcctctat

SEQ ID NO: 57193 - DNA, 25 bp, Rattus norvegicus
aatatcatttggcttcccattgctc

SEQ ID NO: 57194 - DNA, 25 bp, Rattus norvegicus
aatatcatttgggttcccattgctc

SEQ ID NO: 57195 - DNA, 25 bp, Rattus norvegicus
aatatccaactcactccagagacag

SEQ ID NO: 57196 - DNA, 25 bp, Rattus norvegicus
aatatccaactctctccagagacag

SEQ ID NO: 57197 - DNA, 25 bp, Rattus norvegicus
aatatccaagtcagtccaaagccat

SEQ ID NO: 57198 - DNA, 25 bp, Rattus norvegicus
aatatccaagtctgtccaaagccat

SEQ ID NO: 57199 - DNA, 25 bp, Rattus norvegicus
aatatccaatttcaccttaggccaa

SEQ ID NO: 57200 - DNA, 25 bp, Rattus norvegicus
aatatccaatttgaccttaggccaa

SEQ ID NO: 57201 - DNA, 25 bp, Rattus norvegicus
aatatccacattacataggcacatg

SEQ ID NO: 57202 - DNA, 25 bp, Rattus norvegicus
aatatccacatttcataggcacatg

SEQ ID NO: 57203 - DNA, 25 bp, Rattus norvegicus
aatatccaccagacagtgagtgagc

SEQ ID NO: 57204 - DNA, 25 bp, Rattus norvegicus
aatatccaccagtcagtgagtgagc

SEQ ID NO: 57205 - DNA, 25 bp, Rattus norvegicus
aatatccacttaacaacgaatgcat

SEQ ID NO: 57206 - DNA, 25 bp, Rattus norvegicus
aatatccacttatcaacgaatgcat

SEQ ID NO: 57207 - DNA, 25 bp, Rattus norvegicus
aatatccagattactccaagaacat

SEQ ID NO: 57208 - DNA, 25 bp, Rattus norvegicus
aatatccagatttctccaagaacat

SEQ ID NO: 57209 - DNA, 25 bp, Rattus norvegicus
aatatccagccaccttaaacccata

SEQ ID NO: 57210 - DNA, 25 bp, Rattus norvegicus
aatatccagccagcttaaacccata

SEQ ID NO: 57211 - DNA, 25 bp, Rattus norvegicus
aatatccatcagctaatttgggtgg

SEQ ID NO: 57212 - DNA, 25 bp, Rattus norvegicus
aatatccatcaggtaatttgggtgg

SEQ ID NO: 57213 - DNA, 25 bp, Rattus norvegicus
aatatccatcatcccatacgacttc

SEQ ID NO: 57214 - DNA, 25 bp, Rattus norvegicus
aatatccatcatgccatacgacttc

SEQ ID NO: 57215 - DNA, 25 bp, Rattus norvegicus
aatatccatctcatggttgggtaca

SEQ ID NO: 57216 - DNA, 25 bp, Rattus norvegicus
aatatccatctcttggttgggtaca

SEQ ID NO: 57217 - DNA, 25 bp, Rattus norvegicus
aatatccatgctacttgtcaagtgt

SEQ ID NO: 57218 - DNA, 25 bp, Rattus norvegicus
aatatccatgcttcttgtcaagtgt

SEQ ID NO: 57219 - DNA, 25 bp, Rattus norvegicus
aatatcccagatccagtcagccttg

SEQ ID NO: 57220 - DNA, 25 bp, Rattus norvegicus
aatatcccagatgcagtcagccttg

SEQ ID NO: 57221 - DNA, 25 bp, Rattus norvegicus
aatatcccatagacatctgcaattg

SEQ ID NO: 57222 - DNA, 25 bp, Rattus norvegicus
aatatcccatagtcatctgcaattg

SEQ ID NO: 57223 - DNA, 25 bp, Rattus norvegicus
aatatcccatgtagttacctctctg

SEQ ID NO: 57224 - DNA, 25 bp, Rattus norvegicus
aatatcccatgttgttacctctctg

SEQ ID NO: 57225 - DNA, 25 bp, Rattus norvegicus
aatatcccctacagtcaatattagg

SEQ ID NO: 57226 - DNA, 25 bp, Rattus norvegicus
aatatcccctactgtcaatattagg

SEQ ID NO: 57227 - DNA, 25 bp, Rattus norvegicus
aatatccctgagagacggttccatt

SEQ ID NO: 57228 - DNA, 25 bp, Rattus norvegicus
aatatccctgagatctcccaagagg

SEQ ID NO: 57229 - DNA, 25 bp, Rattus norvegicus
aatatccctgagtgacggttccatt

SEQ ID NO: 57230 - DNA, 25 bp, Rattus norvegicus
aatatccctgagttctcccaagagg

SEQ ID NO: 57231 - DNA, 25 bp, Rattus norvegicus
aatatccgtggtatctacttctcct

SEQ ID NO: 57232 - DNA, 25 bp, Rattus norvegicus
aatatccgtggtttctacttctcct

SEQ ID NO: 57233 - DNA, 25 bp, Rattus norvegicus
aatatcctcacaagttatccgtcaa

SEQ ID NO: 57234 - DNA, 25 bp, Rattus norvegicus
aatatcctcacatgttatccgtcaa

SEQ ID NO: 57235 - DNA, 25 bp, Rattus norvegicus
aatatcctcatcaggcttcttttgg

SEQ ID NO: 57236 - DNA, 25 bp, Rattus norvegicus
aatatcctcatctggcttcttttgg

SEQ ID NO: 57237 - DNA, 25 bp, Rattus norvegicus
aatatcctctgcatcctatgttctg

SEQ ID NO: 57238 - DNA, 25 bp, Rattus norvegicus
aatatcctctgcttcctatgttctg

SEQ ID NO: 57239 - DNA, 25 bp, Rattus norvegicus
aatatcctcttgatcatgttttagt

SEQ ID NO: 57240 - DNA, 25 bp, Rattus norvegicus
aatatcctcttgttcatgttttagt

SEQ ID NO: 57241 - DNA, 25 bp, Rattus norvegicus
aatatcctgctgctcaacctgctga

SEQ ID NO: 57242 - DNA, 25 bp, Rattus norvegicus
aatatcctgctggtcaacctgctga

SEQ ID NO: 57243 - DNA, 25 bp, Rattus norvegicus
aatatcctgggacagctgctggtgt

SEQ ID NO: 57244 - DNA, 25 bp, Rattus norvegicus
aatatcctgggagagctgctggtgt

SEQ ID NO: 57245 - DNA, 25 bp, Rattus norvegicus
aatatccttgcgctttccttcgcac

SEQ ID NO: 57246 - DNA, 25 bp, Rattus norvegicus
aatatccttgcggtttccttcgcac

SEQ ID NO: 57247 - DNA, 25 bp, Rattus norvegicus
aatatccttttgctgatgtcagaaa

SEQ ID NO: 57248 - DNA, 25 bp, Rattus norvegicus
aatatccttttggtgatgtcagaaa

SEQ ID NO: 57249 - DNA, 25 bp, Rattus norvegicus
aatatcgcctaaagggccctggaag

SEQ ID NO: 57250 - DNA, 25 bp, Rattus norvegicus
aatatcgcctaatgggccctggaag

SEQ ID NO: 57251 - DNA, 25 bp, Rattus norvegicus
aatatcgcctctaaactttgtttgg

SEQ ID NO: 57252 - DNA, 25 bp, Rattus norvegicus
aatatcgcctcttaactttgtttgg

SEQ ID NO: 57253 - DNA, 25 bp, Rattus norvegicus
aatatcggtgcccactgctgcagag

SEQ ID NO: 57254 - DNA, 25 bp, Rattus norvegicus
aatatcggtgccgactgctgcagag

SEQ ID NO: 57255 - DNA, 25 bp, Rattus norvegicus
aatatcgtgattcatcccctggagc

SEQ ID NO: 57256 - DNA, 25 bp, Rattus norvegicus
aatatcgtgattgatcccctggagc

SEQ ID NO: 57257 - DNA, 25 bp, Rattus norvegicus
aatatcgtgttaccctcatgtttct

SEQ ID NO: 57258 - DNA, 25 bp, Rattus norvegicus
aatatcgtgttagcctcatgtttct

SEQ ID NO: 57259 - DNA, 25 bp, Rattus norvegicus
aatatctaatcccttttctttgagt

SEQ ID NO: 57260 - DNA, 25 bp, Rattus norvegicus
aatatctaatccgttttctttgagt

SEQ ID NO: 57261 - DNA, 25 bp, Rattus norvegicus
aatatctagaataccagactgggct

SEQ ID NO: 57262 - DNA, 25 bp, Rattus norvegicus
aatatctagaattccagactgggct

SEQ ID NO: 57263 - DNA, 25 bp, Rattus norvegicus
aatatctagcctcgactcaaatttt

SEQ ID NO: 57264 - DNA, 25 bp, Rattus norvegicus
aatatctagcctggactcaaatttt

SEQ ID NO: 57265 - DNA, 25 bp, Rattus norvegicus
aatatctatagccaccgttagccct

SEQ ID NO: 57266 - DNA, 25 bp, Rattus norvegicus
aatatctatagcgaccgttagccct

SEQ ID NO: 57267 - DNA, 25 bp, Rattus norvegicus
aatatctatgagatcagggccagac

SEQ ID NO: 57268 - DNA, 25 bp, Rattus norvegicus
aatatctatgagttcagggccagac

SEQ ID NO: 57269 - DNA, 25 bp, Rattus norvegicus
aatatctcagatcttcctctccaaa

SEQ ID NO: 57270 - DNA, 25 bp, Rattus norvegicus
aatatctcagatgttcctctccaaa

SEQ ID NO: 57271 - DNA, 25 bp, Rattus norvegicus
aatatctctattcactctggcactc

SEQ ID NO: 57272 - DNA, 25 bp, Rattus norvegicus
aatatctctattgactctggcactc

SEQ ID NO: 57273 - DNA, 25 bp, Rattus norvegicus
aatatctgaggtctcgctgctagtc

SEQ ID NO: 57274 - DNA, 25 bp, Rattus norvegicus
aatatctgaggtgtcgctgctagtc

SEQ ID NO: 57275 - DNA, 25 bp, Rattus norvegicus
aatatctgctataggaacccactgg

SEQ ID NO: 57276 - DNA, 25 bp, Rattus norvegicus
aatatctgctattggaacccactgg

SEQ ID NO: 57277 - DNA, 25 bp, Rattus norvegicus
aatatctggcaaatgactcgcccca

SEQ ID NO: 57278 - DNA, 25 bp, Rattus norvegicus
aatatctggcaattgactcgcccca

SEQ ID NO: 57279 - DNA, 25 bp, Rattus norvegicus
aatatctgggcaaatacctactgga

SEQ ID NO: 57280 - DNA, 25 bp, Rattus norvegicus
aatatctgggcatatacctactgga

SEQ ID NO: 57281 - DNA, 25 bp, Rattus norvegicus
aatatctgtctcaccttatcagagg

SEQ ID NO: 57282 - DNA, 25 bp, Rattus norvegicus
aatatctgtctctccttatcagagg

SEQ ID NO: 57283 - DNA, 25 bp, Rattus norvegicus
aatatctgtggcctgcaaggcccat

SEQ ID NO: 57284 - DNA, 25 bp, Rattus norvegicus
aatatctgtggcgtgcaaggcccat

SEQ ID NO: 57285 - DNA, 25 bp, Rattus norvegicus
aatatctgtgtcctttcatgagtga

SEQ ID NO: 57286 - DNA, 25 bp, Rattus norvegicus
aatatctgtgtcgtttcatgagtga

SEQ ID NO: 57287 - DNA, 25 bp, Rattus norvegicus
aatatctgtgttctttcctctcgga

SEQ ID NO: 57288 - DNA, 25 bp, Rattus norvegicus
aatatctgtgttgtttcctctcgga

SEQ ID NO: 57289 - DNA, 25 bp, Rattus norvegicus
aatatctgttcaagtgccaggccac

SEQ ID NO: 57290 - DNA, 25 bp, Rattus norvegicus
aatatctgttcatgtgccaggccac

SEQ ID NO: 57291 - DNA, 25 bp, Rattus norvegicus
aatatctgttccagtcatggcagct

SEQ ID NO: 57292 - DNA, 25 bp, Rattus norvegicus
aatatctgttcctgtcatggcagct

SEQ ID NO: 57293 - DNA, 25 bp, Rattus norvegicus
aatatctgttctcaggtgtcaccag

SEQ ID NO: 57294 - DNA, 25 bp, Rattus norvegicus
aatatctgttctgaggtgtcaccag

SEQ ID NO: 57295 - DNA, 25 bp, Rattus norvegicus
aatatcttactgagtgggccaagct

SEQ ID NO: 57296 - DNA, 25 bp, Rattus norvegicus
aatatcttactgtgtgggccaagct

SEQ ID NO: 57297 - DNA, 25 bp, Rattus norvegicus
aatatcttctttctagctctggact

SEQ ID NO: 57298 - DNA, 25 bp, Rattus norvegicus
aatatcttctttgtagctctggact

SEQ ID NO: 57299 - DNA, 25 bp, Rattus norvegicus
aatatcttgagtatgatcctgcccc

SEQ ID NO: 57300 - DNA, 25 bp, Rattus norvegicus
aatatcttgagtttgatcctgcccc

SEQ ID NO: 57301 - DNA, 25 bp, Rattus norvegicus
aatatcttgatgcactcttttataa

SEQ ID NO: 57302 - DNA, 25 bp, Rattus norvegicus
aatatcttgatggactcttttataa

SEQ ID NO: 57303 - DNA, 25 bp, Rattus norvegicus
aatatcttgtgtagtcctttgtctt

SEQ ID NO: 57304 - DNA, 25 bp, Rattus norvegicus
aatatcttgtgttgtcctttgtctt

SEQ ID NO: 57305 - DNA, 25 bp, Rattus norvegicus
aatatctttacaacacgcacagtgc

SEQ ID NO: 57306 - DNA, 25 bp, Rattus norvegicus
aatatctttacatcacgcacagtgc

SEQ ID NO: 57307 - DNA, 25 bp, Rattus norvegicus
aatatgaaacatccagaccctcctt

SEQ ID NO: 57308 - DNA, 25 bp, Rattus norvegicus
aatatgaaacatgcagaccctcctt

SEQ ID NO: 57309 - DNA, 25 bp, Rattus norvegicus
aatatgaaatctagtgggccagggt

SEQ ID NO: 57310 - DNA, 25 bp, Rattus norvegicus
aatatgaaatcttgtgggccagggt

SEQ ID NO: 57311 - DNA, 25 bp, Rattus norvegicus
aatatgaaggtgagcctgtgtccct

SEQ ID NO: 57312 - DNA, 25 bp, Rattus norvegicus
aatatgaaggtgtgcctgtgtccct

SEQ ID NO: 57313 - DNA, 25 bp, Rattus norvegicus
aatatgacaactccctcaagattgt

SEQ ID NO: 57314 - DNA, 25 bp, Rattus norvegicus
aatatgacaactgcctcaagattgt

SEQ ID NO: 57315 - DNA, 25 bp, Rattus norvegicus
aatatgacaccgcatgttttagcaa

SEQ ID NO: 57316 - DNA, 25 bp, Rattus norvegicus
aatatgacaccggatgttttagcaa

SEQ ID NO: 57317 - DNA, 25 bp, Rattus norvegicus
aatatgaccccaagcatggtggctc

SEQ ID NO: 57318 - DNA, 25 bp, Rattus norvegicus
aatatgaccccatgcatggtggctc

SEQ ID NO: 57319 - DNA, 25 bp, Rattus norvegicus
aatatgacctcaaagatggcctcag

SEQ ID NO: 57320 - DNA, 25 bp, Rattus norvegicus
aatatgacctcaatctcacttcaga

SEQ ID NO: 57321 - DNA, 25 bp, Rattus norvegicus
aatatgacctcatagatggcctcag

SEQ ID NO: 57322 - DNA, 25 bp, Rattus norvegicus
aatatgacctcattctcacttcaga

SEQ ID NO: 57323 - DNA, 25 bp, Rattus norvegicus
aatatgacgactcctatgcccaaga

SEQ ID NO: 57324 - DNA, 25 bp, Rattus norvegicus
aatatgacgactgctatgcccaaga

SEQ ID NO: 57325 - DNA, 25 bp, Rattus norvegicus
aatatgacgttcacaccaagtcctc

SEQ ID NO: 57326 - DNA, 25 bp, Rattus norvegicus
aatatgacgttctcaccaagtcctc

SEQ ID NO: 57327 - DNA, 25 bp, Rattus norvegicus
aatatgagaccaactcctgcagcaa

SEQ ID NO: 57328 - DNA, 25 bp, Rattus norvegicus
aatatgagaccatctcctgcagcaa

SEQ ID NO: 57329 - DNA, 25 bp, Rattus norvegicus
aatatgagatccatttctgaagtgg

SEQ ID NO: 57330 - DNA, 25 bp, Rattus norvegicus
aatatgagatccttttctgaagtgg

SEQ ID NO: 57331 - DNA, 25 bp, Rattus norvegicus
aatatgagccttagttgctttcaaa

SEQ ID NO: 57332 - DNA, 25 bp, Rattus norvegicus
aatatgagcctttgttgctttcaaa

SEQ ID NO: 57333 - DNA, 25 bp, Rattus norvegicus
aatatgaggagaatacgcccctgct

SEQ ID NO: 57334 - DNA, 25 bp, Rattus norvegicus
aatatgaggagattacgcccctgct

SEQ ID NO: 57335 - DNA, 25 bp, Rattus norvegicus
aatatgaggccaccttcaatcccaa

SEQ ID NO: 57336 - DNA, 25 bp, Rattus norvegicus
aatatgaggccagcttcaatcccaa

SEQ ID NO: 57337 - DNA, 25 bp, Rattus norvegicus
aatatgagtaatccgtgtgcccaag

SEQ ID NO: 57338 - DNA, 25 bp, Rattus norvegicus
aatatgagtaatgcgtgtgcccaag

SEQ ID NO: 57339 - DNA, 25 bp, Rattus norvegicus
aatatgagtcttctttctgtaacct

SEQ ID NO: 57340 - DNA, 25 bp, Rattus norvegicus
aatatgagtcttgtttctgtaacct

SEQ ID NO: 57341 - DNA, 25 bp, Rattus norvegicus
aatatgatcaagagcaccatccccg

SEQ ID NO: 57342 - DNA, 25 bp, Rattus norvegicus
aatatgatcaagtgcaccatccccg

SEQ ID NO: 57343 - DNA, 25 bp, Rattus norvegicus
aatatgatctggatccatcctgtct

SEQ ID NO: 57344 - DNA, 25 bp, Rattus norvegicus
aatatgatctggttccatcctgtct

SEQ ID NO: 57345 - DNA, 25 bp, Rattus norvegicus
aatatgatctgtctcttgggtcctt

SEQ ID NO: 57346 - DNA, 25 bp, Rattus norvegicus
aatatgatctgtgtcttgggtcctt

SEQ ID NO: 57347 - DNA, 25 bp, Rattus norvegicus
aatatgatggctcagaaccacccct

SEQ ID NO: 57348 - DNA, 25 bp, Rattus norvegicus
aatatgatggctgagaaccacccct

SEQ ID NO: 57349 - DNA, 25 bp, Rattus norvegicus
aatatgatttgtcccggaaacctcc

SEQ ID NO: 57350 - DNA, 25 bp, Rattus norvegicus
aatatgatttgtgccggaaacctcc

SEQ ID NO: 57351 - DNA, 25 bp, Rattus norvegicus
aatatgcactacagaacacatcagt

SEQ ID NO: 57352 - DNA, 25 bp, Rattus norvegicus
aatatgcactactgaacacatcagt

SEQ ID NO: 57353 - DNA, 25 bp, Rattus norvegicus
aatatgcactttacaccactgccaa

SEQ ID NO: 57354 - DNA, 25 bp, Rattus norvegicus
aatatgcacttttcaccactgccaa

SEQ ID NO: 57355 - DNA, 25 bp, Rattus norvegicus
aatatgcagcttactctgttctgtc

SEQ ID NO: 57356 - DNA, 25 bp, Rattus norvegicus
aatatgcagctttctctgttctgtc

SEQ ID NO: 57357 - DNA, 25 bp, Rattus norvegicus
aatatgcaggctatatgttttgttg

SEQ ID NO: 57358 - DNA, 25 bp, Rattus norvegicus
aatatgcaggctttatgttttgttg

SEQ ID NO: 57359 - DNA, 25 bp, Rattus norvegicus
aatatgcaggttcctgttgggccag

SEQ ID NO: 57360 - DNA, 25 bp, Rattus norvegicus
aatatgcaggttgctgttgggccag

SEQ ID NO: 57361 - DNA, 25 bp, Rattus norvegicus
aatatgcatcgtcatcctcttgaga

SEQ ID NO: 57362 - DNA, 25 bp, Rattus norvegicus
aatatgcatcgtgatcctcttgaga

SEQ ID NO: 57363 - DNA, 25 bp, Rattus norvegicus
aatatgcattgaagctttgcctgca

SEQ ID NO: 57364 - DNA, 25 bp, Rattus norvegicus
aatatgcattgatgctttgcctgca

SEQ ID NO: 57365 - DNA, 25 bp, Rattus norvegicus
aatatgcccaggaggaaccatccag

SEQ ID NO: 57366 - DNA, 25 bp, Rattus norvegicus
aatatgcccaggtggaaccatccag

SEQ ID NO: 57367 - DNA, 25 bp, Rattus norvegicus
aatatgccctgtctttcagactctc

SEQ ID NO: 57368 - DNA, 25 bp, Rattus norvegicus
aatatgccctgtgtttcagactctc

SEQ ID NO: 57369 - DNA, 25 bp, Rattus norvegicus
aatatgccgctgacaactttgtgtc

SEQ ID NO: 57370 - DNA, 25 bp, Rattus norvegicus
aatatgccgctgtcaactttgtgtc

SEQ ID NO: 57371 - DNA, 25 bp, Rattus norvegicus
aatatgcctcacacttcacaatagg

SEQ ID NO: 57372 - DNA, 25 bp, Rattus norvegicus
aatatgcctcactcttcacaatagg

SEQ ID NO: 57373 - DNA, 25 bp, Rattus norvegicus
aatatgcctggtcttgtgacttgga

SEQ ID NO: 57374 - DNA, 25 bp, Rattus norvegicus
aatatgcctggtgttgtgacttgga

SEQ ID NO: 57375 - DNA, 25 bp, Rattus norvegicus
aatatgcctgttatgcttgtagcag

SEQ ID NO: 57376 - DNA, 25 bp, Rattus norvegicus
aatatgcctgttttgcttgtagcag

SEQ ID NO: 57377 - DNA, 25 bp, Rattus norvegicus
aatatgccttcccttacctgggtag

SEQ ID NO: 57378 - DNA, 25 bp, Rattus norvegicus
aatatgccttccgttacctgggtag

SEQ ID NO: 57379 - DNA, 25 bp, Rattus norvegicus
aatatgcgagctctcttcttctttg

SEQ ID NO: 57380 - DNA, 25 bp, Rattus norvegicus
aatatgcgagctgtcttcttctttg

SEQ ID NO: 57381 - DNA, 25 bp, Rattus norvegicus
aatatgctacctccaaaggcagctt

SEQ ID NO: 57382 - DNA, 25 bp, Rattus norvegicus
aatatgctacctgcaaaggcagctt

SEQ ID NO: 57383 - DNA, 25 bp, Rattus norvegicus
aatatgctagcaagatccccaacac

SEQ ID NO: 57384 - DNA, 25 bp, Rattus norvegicus
aatatgctagcatgatccccaacac

SEQ ID NO: 57385 - DNA, 25 bp, Rattus norvegicus
aatatgctatgactgcaccctttta

SEQ ID NO: 57386 - DNA, 25 bp, Rattus norvegicus
aatatgctatgagtgcaccctttta

SEQ ID NO: 57387 - DNA, 25 bp, Rattus norvegicus
aatatgctcactcttcgttttatgg

SEQ ID NO: 57388 - DNA, 25 bp, Rattus norvegicus
aatatgctcactgttcgttttatgg

SEQ ID NO: 57389 - DNA, 25 bp, Rattus norvegicus
aatatgctcagtcgtctgctgggat

SEQ ID NO: 57390 - DNA, 25 bp, Rattus norvegicus
aatatgctcagtggtctgctgggat

SEQ ID NO: 57391 - DNA, 25 bp, Rattus norvegicus
aatatgctctctagttgctctactg

SEQ ID NO: 57392 - DNA, 25 bp, Rattus norvegicus
aatatgctctcttgttgctctactg

SEQ ID NO: 57393 - DNA, 25 bp, Rattus norvegicus
aatatgctctgtcttctcaggcgga

SEQ ID NO: 57394 - DNA, 25 bp, Rattus norvegicus
aatatgctctgtgttctcaggcgga

SEQ ID NO: 57395 - DNA, 25 bp, Rattus norvegicus
aatatgctgcttagagattctcttt

SEQ ID NO: 57396 - DNA, 25 bp, Rattus norvegicus
aatatgctgctttgagattctcttt

SEQ ID NO: 57397 - DNA, 25 bp, Rattus norvegicus
aatatgcttctcaccgtagagccgg

SEQ ID NO: 57398 - DNA, 25 bp, Rattus norvegicus
aatatgcttctctccgtagagccgg

SEQ ID NO: 57399 - DNA, 25 bp, Rattus norvegicus
aatatgctttctcttctgtttcctt

SEQ ID NO: 57400 - DNA, 25 bp, Rattus norvegicus
aatatgctttctgttctgtttcctt

SEQ ID NO: 57401 - DNA, 25 bp, Rattus norvegicus
aatatgcttttaacacagttgtttt

SEQ ID NO: 57402 - DNA, 25 bp, Rattus norvegicus
aatatgcttttatcacagttgtttt

SEQ ID NO: 57403 - DNA, 25 bp, Rattus norvegicus
aatatggaacaacgctcccctcctg

SEQ ID NO: 57404 - DNA, 25 bp, Rattus norvegicus
aatatggaacaaggctcccctcctg

SEQ ID NO: 57405 - DNA, 25 bp, Rattus norvegicus
aatatggacctaatcgtcaaatcag

SEQ ID NO: 57406 - DNA, 25 bp, Rattus norvegicus
aatatggacctattcgtcaaatcag

SEQ ID NO: 57407 - DNA, 25 bp, Rattus norvegicus
aatatggacctgatgggctgcccta

SEQ ID NO: 57408 - DNA, 25 bp, Rattus norvegicus
aatatggacctgttgggctgcccta

SEQ ID NO: 57409 - DNA, 25 bp, Rattus norvegicus
aatatggactggcacttaagcaaca

SEQ ID NO: 57410 - DNA, 25 bp, Rattus norvegicus
aatatggactgggacttaagcaaca

SEQ ID NO: 57411 - DNA, 25 bp, Rattus norvegicus
aatatggagaccagcttcagccagt

SEQ ID NO: 57412 - DNA, 25 bp, Rattus norvegicus
aatatggagacctgcttcagccagt

SEQ ID NO: 57413 - DNA, 25 bp, Rattus norvegicus
aatatggagctcagtgggtttctaa

SEQ ID NO: 57414 - DNA, 25 bp, Rattus norvegicus
aatatggagctctgtgggtttctaa

SEQ ID NO: 57415 - DNA, 25 bp, Rattus norvegicus
aatatggagtggaccgaccctctta

SEQ ID NO: 57416 - DNA, 25 bp, Rattus norvegicus
aatatggagtggtccgaccctctta

SEQ ID NO: 57417 - DNA, 25 bp, Rattus norvegicus
aatatggagtttcttttggtcgatc

SEQ ID NO: 57418 - DNA, 25 bp, Rattus norvegicus
aatatggagtttgttttggtcgatc

SEQ ID NO: 57419 - DNA, 25 bp, Rattus norvegicus
aatatggattcgagcttctcactgg

SEQ ID NO: 57420 - DNA, 25 bp, Rattus norvegicus
aatatggattcgtgcttctcactgg

SEQ ID NO: 57421 - DNA, 25 bp, Rattus norvegicus
aatatggcgtccagtgttgaccttc

SEQ ID NO: 57422 - DNA, 25 bp, Rattus norvegicus
aatatggcgtcctgtgttgaccttc

SEQ ID NO: 57423 - DNA, 25 bp, Rattus norvegicus
aatatggcgtctcgcttgcttgaaa

SEQ ID NO: 57424 - DNA, 25 bp, Rattus norvegicus
aatatggcgtctggcttgcttgaaa

SEQ ID NO: 57425 - DNA, 25 bp, Rattus norvegicus
aatatggctcaaagctgggctgctg

SEQ ID NO: 57426 - DNA, 25 bp, Rattus norvegicus
aatatggctcaatgctgggctgctg

SEQ ID NO: 57427 - DNA, 25 bp, Rattus norvegicus
aatatggctgcccaactttctgttc

SEQ ID NO: 57428 - DNA, 25 bp, Rattus norvegicus
aatatggctgccgaactttctgttc

SEQ ID NO: 57429 - DNA, 25 bp, Rattus norvegicus
aatatggcttaccactctgcctgaa

SEQ ID NO: 57430 - DNA, 25 bp, Rattus norvegicus
aatatggcttacgactctgcctgaa

SEQ ID NO: 57431 - DNA, 25 bp, Rattus norvegicus
aatatgggcatcattgcgtcacacg

SEQ ID NO: 57432 - DNA, 25 bp, Rattus norvegicus
aatatgggcatctttgcgtcacacg

SEQ ID NO: 57433 - DNA, 25 bp, Rattus norvegicus
aatatggtacatctcctcacggagg

SEQ ID NO: 57434 - DNA, 25 bp, Rattus norvegicus
aatatggtacatgtcctcacggagg

SEQ ID NO: 57435 - DNA, 25 bp, Rattus norvegicus
aatatggtccccaattcagacacta

SEQ ID NO: 57436 - DNA, 25 bp, Rattus norvegicus
aatatggtcccctattcagacacta

SEQ ID NO: 57437 - DNA, 25 bp, Rattus norvegicus
aatatggtcctgaggccaaagccag

SEQ ID NO: 57438 - DNA, 25 bp, Rattus norvegicus
aatatggtcctgtggccaaagccag

SEQ ID NO: 57439 - DNA, 25 bp, Rattus norvegicus
aatatggtcttccattggccagcca

SEQ ID NO: 57440 - DNA, 25 bp, Rattus norvegicus
aatatggtcttcgattggccagcca

SEQ ID NO: 57441 - DNA, 25 bp, Rattus norvegicus
aatatggtggttccgtcaacgctgc

SEQ ID NO: 57442 - DNA, 25 bp, Rattus norvegicus
aatatggtggttgcgtcaacgctgc

SEQ ID NO: 57443 - DNA, 25 bp, Rattus norvegicus
aatatggtgtcaagttactgtggct

SEQ ID NO: 57444 - DNA, 25 bp, Rattus norvegicus
aatatggtgtcatgttactgtggct

SEQ ID NO: 57445 - DNA, 25 bp, Rattus norvegicus
aatatggttgctcgttttcctgtca

SEQ ID NO: 57446 - DNA, 25 bp, Rattus norvegicus
aatatggttgctggttttcctgtca

SEQ ID NO: 57447 - DNA, 25 bp, Rattus norvegicus
aatatggtttctcagtgtccaaact

SEQ ID NO: 57448 - DNA, 25 bp, Rattus norvegicus
aatatggtttctgagtgtccaaact

SEQ ID NO: 57449 - DNA, 25 bp, Rattus norvegicus
aatatggttttgattgttgcgtggt

SEQ ID NO: 57450 - DNA, 25 bp, Rattus norvegicus
aatatggttttgtttgttgcgtggt

SEQ ID NO: 57451 - DNA, 25 bp, Rattus norvegicus
aatatgtaaggtacaccccaggaag

SEQ ID NO: 57452 - DNA, 25 bp, Rattus norvegicus
aatatgtaaggttcaccccaggaag

SEQ ID NO: 57453 - DNA, 25 bp, Rattus norvegicus
aatatgtacacaaacgtcagcatgt

SEQ ID NO: 57454 - DNA, 25 bp, Rattus norvegicus
aatatgtacacatacgtcagcatgt

SEQ ID NO: 57455 - DNA, 25 bp, Rattus norvegicus
aatatgtaccaaacacaccagtaat

SEQ ID NO: 57456 - DNA, 25 bp, Rattus norvegicus
aatatgtaccaatcacaccagtaat

SEQ ID NO: 57457 - DNA, 25 bp, Rattus norvegicus
aatatgtatcagaccctgggttcct

SEQ ID NO: 57458 - DNA, 25 bp, Rattus norvegicus
aatatgtatcagtccctgggttcct

SEQ ID NO: 57459 - DNA, 25 bp, Rattus norvegicus
aatatgtatccaatctcagctgaat

SEQ ID NO: 57460 - DNA, 25 bp, Rattus norvegicus
aatatgtatccattctcagctgaat

SEQ ID NO: 57461 - DNA, 25 bp, Rattus norvegicus
aatatgtcattcagggtgttaactc

SEQ ID NO: 57462 - DNA, 25 bp, Rattus norvegicus
aatatgtcattctgggtgttaactc

SEQ ID NO: 57463 - DNA, 25 bp, Rattus norvegicus
aatatgtccaaaaagccagctccaa

SEQ ID NO: 57464 - DNA, 25 bp, Rattus norvegicus
aatatgtccaaatagccagctccaa

SEQ ID NO: 57465 - DNA, 25 bp, Rattus norvegicus
aatatgtcccagagcaactgtccat

SEQ ID NO: 57466 - DNA, 25 bp, Rattus norvegicus
aatatgtcccagtgcaactgtccat

SEQ ID NO: 57467 - DNA, 25 bp, Rattus norvegicus
aatatgtcctgacgacctgcctggt

SEQ ID NO: 57468 - DNA, 25 bp, Rattus norvegicus
aatatgtcctgaggacctgcctggt

SEQ ID NO: 57469 - DNA, 25 bp, Rattus norvegicus
aatatgtcggcgcacttggctcgta

SEQ ID NO: 57470 - DNA, 25 bp, Rattus norvegicus
aatatgtcggcggacttggctcgta

SEQ ID NO: 57471 - DNA, 25 bp, Rattus norvegicus
aatatgtctccacacttccctcaga

SEQ ID NO: 57472 - DNA, 25 bp, Rattus norvegicus
aatatgtctccagacttccctcaga

SEQ ID NO: 57473 - DNA, 25 bp, Rattus norvegicus
aatatgtctgtaaatctatctgata

SEQ ID NO: 57474 - DNA, 25 bp, Rattus norvegicus
aatatgtctgtatatctatctgata

SEQ ID NO: 57475 - DNA, 25 bp, Rattus norvegicus
aatatgtgcctgctgctcaaggtgg

SEQ ID NO: 57476 - DNA, 25 bp, Rattus norvegicus
aatatgtgcctggtgctcaaggtgg

SEQ ID NO: 57477 - DNA, 25 bp, Rattus norvegicus
aatatgtggattctgccttctccta

SEQ ID NO: 57478 - DNA, 25 bp, Rattus norvegicus
aatatgtggattgtgccttctccta

SEQ ID NO: 57479 - DNA, 25 bp, Rattus norvegicus
aatatgtgtcgtcgcagatctctgt

SEQ ID NO: 57480 - DNA, 25 bp, Rattus norvegicus
aatatgtgtcgtggcagatctctgt

SEQ ID NO: 57481 - DNA, 25 bp, Rattus norvegicus
aatatgtgtggcactttctctggtt

SEQ ID NO: 57482 - DNA, 25 bp, Rattus norvegicus
aatatgtgtggcctaggtctccgga

SEQ ID NO: 57483 - DNA, 25 bp, Rattus norvegicus
aatatgtgtggcgtaggtctccgga

SEQ ID NO: 57484 - DNA, 25 bp, Rattus norvegicus
aatatgtgtggctctttctctggtt

SEQ ID NO: 57485 - DNA, 25 bp, Rattus norvegicus
aatatgtgttttaatctccctgtca

SEQ ID NO: 57486 - DNA, 25 bp, Rattus norvegicus
aatatgtgtttttatctccctgtca

SEQ ID NO: 57487 - DNA, 25 bp, Rattus norvegicus
aatatgttactcaaccgtgggcttg

SEQ ID NO: 57488 - DNA, 25 bp, Rattus norvegicus
aatatgttactctaccgtgggcttg

SEQ ID NO: 57489 - DNA, 25 bp, Rattus norvegicus
aatatgttccatcaacagattccta

SEQ ID NO: 57490 - DNA, 25 bp, Rattus norvegicus
aatatgttccatgaacagattccta

SEQ ID NO: 57491 - DNA, 25 bp, Rattus norvegicus
aatatgttcctgattccaacctcat

SEQ ID NO: 57492 - DNA, 25 bp, Rattus norvegicus
aatatgttcctgtttccaacctcat

SEQ ID NO: 57493 - DNA, 25 bp, Rattus norvegicus
aatatgttcttgatttctcagatag

SEQ ID NO: 57494 - DNA, 25 bp, Rattus norvegicus
aatatgttcttgttttctcagatag

SEQ ID NO: 57495 - DNA, 25 bp, Rattus norvegicus
aatatgttgctgcagtccgggactt

SEQ ID NO: 57496 - DNA, 25 bp, Rattus norvegicus
aatatgttgctggagtccgggactt

SEQ ID NO: 57497 - DNA, 25 bp, Rattus norvegicus
aatatgttggctccctgcattctga

SEQ ID NO: 57498 - DNA, 25 bp, Rattus norvegicus
aatatgttggctgcctgcattctga

SEQ ID NO: 57499 - DNA, 25 bp, Rattus norvegicus
aatatgttgtcacgcgtccccttgc

SEQ ID NO: 57500 - DNA, 25 bp, Rattus norvegicus
aatatgttgtcaggcgtccccttgc

SEQ ID NO: 57501 - DNA, 25 bp, Rattus norvegicus
aatatgttgttccttcattggttgt

SEQ ID NO: 57502 - DNA, 25 bp, Rattus norvegicus
aatatgttgttcgttcattggttgt

SEQ ID NO: 57503 - DNA, 25 bp, Rattus norvegicus
aatatgtttacccagcctgctttgc

SEQ ID NO: 57504 - DNA, 25 bp, Rattus norvegicus
aatatgtttaccgagcctgctttgc

SEQ ID NO: 57505 - DNA, 25 bp, Rattus norvegicus
aatatgtttttaaggaagccctcta

SEQ ID NO: 57506 - DNA, 25 bp, Rattus norvegicus
aatatgtttttatggaagccctcta

SEQ ID NO: 57507 - DNA, 25 bp, Rattus norvegicus
aatattaaagaacctgtgtgccgca

SEQ ID NO: 57508 - DNA, 25 bp, Rattus norvegicus
aatattaaagaagctgtgtgccgca

SEQ ID NO: 57509 - DNA, 25 bp, Rattus norvegicus
aatattaacctcagcttcaatgtac

SEQ ID NO: 57510 - DNA, 25 bp, Rattus norvegicus
aatattaacctctgcttcaatgtac

SEQ ID NO: 57511 - DNA, 25 bp, Rattus norvegicus
aatattacaaatatctgggctagtg

SEQ ID NO: 57512 - DNA, 25 bp, Rattus norvegicus
aatattacaaatttctgggctagtg

SEQ ID NO: 57513 - DNA, 25 bp, Rattus norvegicus
aatattaccaacacatatctggaca

SEQ ID NO: 57514 - DNA, 25 bp, Rattus norvegicus
aatattaccaactcatatctggaca

SEQ ID NO: 57515 - DNA, 25 bp, Rattus norvegicus
aatattaccctcattcactgttaat

SEQ ID NO: 57516 - DNA, 25 bp, Rattus norvegicus
aatattaccctctttcactgttaat

SEQ ID NO: 57517 - DNA, 25 bp, Rattus norvegicus
aatattaccgttctctttgaccagt

SEQ ID NO: 57518 - DNA, 25 bp, Rattus norvegicus
aatattaccgttgtctttgaccagt

SEQ ID NO: 57519 - DNA, 25 bp, Rattus norvegicus
aatattacgagcaaggaccttgggt

SEQ ID NO: 57520 - DNA, 25 bp, Rattus norvegicus
aatattacgagctaggaccttgggt

SEQ ID NO: 57521 - DNA, 25 bp, Rattus norvegicus
aatattactgacagttcactttttt

SEQ ID NO: 57522 - DNA, 25 bp, Rattus norvegicus
aatattactgactgttcactttttt

SEQ ID NO: 57523 - DNA, 25 bp, Rattus norvegicus
aatattacttgaagtctccctctgt

SEQ ID NO: 57524 - DNA, 25 bp, Rattus norvegicus
aatattacttgatgtctccctctgt

SEQ ID NO: 57525 - DNA, 25 bp, Rattus norvegicus
aatattagcacacagggccgttccc

SEQ ID NO: 57526 - DNA, 25 bp, Rattus norvegicus
aatattagcacagagggccgttccc

SEQ ID NO: 57527 - DNA, 25 bp, Rattus norvegicus
aatattatactcaggccacactcag

SEQ ID NO: 57528 - DNA, 25 bp, Rattus norvegicus
aatattatactctggccacactcag

SEQ ID NO: 57529 - DNA, 25 bp, Rattus norvegicus
aatattatgtgcattgtgattcgtg

SEQ ID NO: 57530 - DNA, 25 bp, Rattus norvegicus
aatattatgtgctttgtgattcgtg

SEQ ID NO: 57531 - DNA, 25 bp, Rattus norvegicus
aatattatttatccccatccgttcg

SEQ ID NO: 57532 - DNA, 25 bp, Rattus norvegicus
aatattatttatgcccatccgttcg

SEQ ID NO: 57533 - DNA, 25 bp, Rattus norvegicus
aatattcacatcagccttgtcaagc

SEQ ID NO: 57534 - DNA, 25 bp, Rattus norvegicus
aatattcacatctgccttgtcaagc

SEQ ID NO: 57535 - DNA, 25 bp, Rattus norvegicus
aatattcactggctatgtccctgtg

SEQ ID NO: 57536 - DNA, 25 bp, Rattus norvegicus
aatattcactgggtatgtccctgtg

SEQ ID NO: 57537 - DNA, 25 bp, Rattus norvegicus
aatattcacttcactgtctgtgcca

SEQ ID NO: 57538 - DNA, 25 bp, Rattus norvegicus
aatattcacttctctgtctgtgcca

SEQ ID NO: 57539 - DNA, 25 bp, Rattus norvegicus
aatattcactttaacaaacatacat

SEQ ID NO: 57540 - DNA, 25 bp, Rattus norvegicus
aatattcacttttacaaacatacat

SEQ ID NO: 57541 - DNA, 25 bp, Rattus norvegicus
aatattcagcaaacccacacatttt

SEQ ID NO: 57542 - DNA, 25 bp, Rattus norvegicus
aatattcagcaatcccacacatttt

SEQ ID NO: 57543 - DNA, 25 bp, Rattus norvegicus
aatattcaggccaggatcaccagac

SEQ ID NO: 57544 - DNA, 25 bp, Rattus norvegicus
aatattcaggcctggatcaccagac

SEQ ID NO: 57545 - DNA, 25 bp, Rattus norvegicus
aatattcagggcaagtgctccgcct

SEQ ID NO: 57546 - DNA, 25 bp, Rattus norvegicus
aatattcagggctagtgctccgcct

SEQ ID NO: 57547 - DNA, 25 bp, Rattus norvegicus
aatattcagggtcctgggcacgcag

SEQ ID NO: 57548 - DNA, 25 bp, Rattus norvegicus
aatattcagggtgctgggcacgcag

SEQ ID NO: 57549 - DNA, 25 bp, Rattus norvegicus
aatattcagttaatgctttccctaa

SEQ ID NO: 57550 - DNA, 25 bp, Rattus norvegicus
aatattcagttattgctttccctaa

SEQ ID NO: 57551 - DNA, 25 bp, Rattus norvegicus
aatattcatgggaagtgtttatcaa

SEQ ID NO: 57552 - DNA, 25 bp, Rattus norvegicus
aatattcatgggtagtgtttatcaa

SEQ ID NO: 57553 - DNA, 25 bp, Rattus norvegicus
aatattcatgtaacttaagttaagg

SEQ ID NO: 57554 - DNA, 25 bp, Rattus norvegicus
aatattcatgtatcttaagttaagg

SEQ ID NO: 57555 - DNA, 25 bp, Rattus norvegicus
aatattcatgttagttactggtgca

SEQ ID NO: 57556 - DNA, 25 bp, Rattus norvegicus
aatattcatgtttgttactggtgca

SEQ ID NO: 57557 - DNA, 25 bp, Rattus norvegicus
aatattccagtgagctaaatgcccc

SEQ ID NO: 57558 - DNA, 25 bp, Rattus norvegicus
aatattccagtgtgctaaatgcccc

SEQ ID NO: 57559 - DNA, 25 bp, Rattus norvegicus
aatattccatcaatcttgtgccacc

SEQ ID NO: 57560 - DNA, 25 bp, Rattus norvegicus
aatattccatcattcttgtgccacc

SEQ ID NO: 57561 - DNA, 25 bp, Rattus norvegicus
aatattctccatcagccaaaggact

SEQ ID NO: 57562 - DNA, 25 bp, Rattus norvegicus
aatattctccatgagccaaaggact

SEQ ID NO: 57563 - DNA, 25 bp, Rattus norvegicus
aatattctcttcatctggcacaaca

SEQ ID NO: 57564 - DNA, 25 bp, Rattus norvegicus
aatattctcttcttctggcacaaca

SEQ ID NO: 57565 - DNA, 25 bp, Rattus norvegicus
aatattctgaacctgttgtgacaag

SEQ ID NO: 57566 - DNA, 25 bp, Rattus norvegicus
aatattctgaacgtgttgtgacaag

SEQ ID NO: 57567 - DNA, 25 bp, Rattus norvegicus
aatattctggctctttctggtagga

SEQ ID NO: 57568 - DNA, 25 bp, Rattus norvegicus
aatattctggctgtttctggtagga

SEQ ID NO: 57569 - DNA, 25 bp, Rattus norvegicus
aatattctggtactctgctccaata

SEQ ID NO: 57570 - DNA, 25 bp, Rattus norvegicus
aatattctggtagtctgctccaata

SEQ ID NO: 57571 - DNA, 25 bp, Rattus norvegicus
aatattctgtctagacaccgtgaag

SEQ ID NO: 57572 - DNA, 25 bp, Rattus norvegicus
aatattctgtcttgacaccgtgaag

SEQ ID NO: 57573 - DNA, 25 bp, Rattus norvegicus
aatattctgtgaactaaaccctgga

SEQ ID NO: 57574 - DNA, 25 bp, Rattus norvegicus
aatattctgtgatctaaaccctgga

SEQ ID NO: 57575 - DNA, 25 bp, Rattus norvegicus
aatattcttctcatgccctgtttgg

SEQ ID NO: 57576 - DNA, 25 bp, Rattus norvegicus
aatattcttctcttgccctgtttgg

SEQ ID NO: 57577 - DNA, 25 bp, Rattus norvegicus
aatattgaatttacccgccccaatg

SEQ ID NO: 57578 - DNA, 25 bp, Rattus norvegicus
aatattgaattttcccgccccaatg

SEQ ID NO: 57579 - DNA, 25 bp, Rattus norvegicus
aatattgactagataggcatcttgt

SEQ ID NO: 57580 - DNA, 25 bp, Rattus norvegicus
aatattgactagttaggcatcttgt

SEQ ID NO: 57581 - DNA, 25 bp, Rattus norvegicus
aatattgactcacctacacacgtta

SEQ ID NO: 57582 - DNA, 25 bp, Rattus norvegicus
aatattgactcagctacacacgtta

SEQ ID NO: 57583 - DNA, 25 bp, Rattus norvegicus
aatattgcacaaagttgcccgctcc

SEQ ID NO: 57584 - DNA, 25 bp, Rattus norvegicus
aatattgcacaatgttgcccgctcc

SEQ ID NO: 57585 - DNA, 25 bp, Rattus norvegicus
aatattgccactagcattgccctga

SEQ ID NO: 57586 - DNA, 25 bp, Rattus norvegicus
aatattgccacttgcattgccctga

SEQ ID NO: 57587 - DNA, 25 bp, Rattus norvegicus
aatattgcccagagctgagactcat

SEQ ID NO: 57588 - DNA, 25 bp, Rattus norvegicus
aatattgcccagtgctgagactcat

SEQ ID NO: 57589 - DNA, 25 bp, Rattus norvegicus
aatattgcccataatcacggaggac

SEQ ID NO: 57590 - DNA, 25 bp, Rattus norvegicus
aatattgcccattatcacggaggac

SEQ ID NO: 57591 - DNA, 25 bp, Rattus norvegicus
aatattgccttgacttctgagctct

SEQ ID NO: 57592 - DNA, 25 bp, Rattus norvegicus
aatattgccttgtcttctgagctct

SEQ ID NO: 57593 - DNA, 25 bp, Rattus norvegicus
aatattgctaagagttcgtcagtgt

SEQ ID NO: 57594 - DNA, 25 bp, Rattus norvegicus
aatattgctaagtgttcgtcagtgt

SEQ ID NO: 57595 - DNA, 25 bp, Rattus norvegicus
aatattgctgctagttcttctgttt

SEQ ID NO: 57596 - DNA, 25 bp, Rattus norvegicus
aatattgctgcttgttcttctgttt

SEQ ID NO: 57597 - DNA, 25 bp, Rattus norvegicus
aatattgcttttatcagacacttag

SEQ ID NO: 57598 - DNA, 25 bp, Rattus norvegicus
aatattgcttttttcagacacttag

SEQ ID NO: 57599 - DNA, 25 bp, Rattus norvegicus
aatattggacttcgctaatgtgctc

SEQ ID NO: 57600 - DNA, 25 bp, Rattus norvegicus
aatattggacttggctaatgtgctc

SEQ ID NO: 57601 - DNA, 25 bp, Rattus norvegicus
aatattggagcacccagctctgctt

SEQ ID NO: 57602 - DNA, 25 bp, Rattus norvegicus
aatattggagcagccagctctgctt

SEQ ID NO: 57603 - DNA, 25 bp, Rattus norvegicus
aatattggcccaacagagcctttgg

SEQ ID NO: 57604 - DNA, 25 bp, Rattus norvegicus
aatattggcccatcagagcctttgg

SEQ ID NO: 57605 - DNA, 25 bp, Rattus norvegicus
aatattgggaacaacttgttgaact

SEQ ID NO: 57606 - DNA, 25 bp, Rattus norvegicus
aatattgggaactacttgttgaact

SEQ ID NO: 57607 - DNA, 25 bp, Rattus norvegicus
aatattgggcacagtcccctgatgt

SEQ ID NO: 57608 - DNA, 25 bp, Rattus norvegicus
aatattgggcactgtcccctgatgt

SEQ ID NO: 57609 - DNA, 25 bp, Rattus norvegicus
aatattggtggtactcctgttgcag

SEQ ID NO: 57610 - DNA, 25 bp, Rattus norvegicus
aatattggtggttctcctgttgcag

SEQ ID NO: 57611 - DNA, 25 bp, Rattus norvegicus
aatattggttttaccgcttgctgtc

SEQ ID NO: 57612 - DNA, 25 bp, Rattus norvegicus
aatattggtttttccgcttgctgtc

SEQ ID NO: 57613 - DNA, 25 bp, Rattus norvegicus
aatattgtacctagttcagcctacc

SEQ ID NO: 57614 - DNA, 25 bp, Rattus norvegicus
aatattgtaccttgttcagcctacc

SEQ ID NO: 57615 - DNA, 25 bp, Rattus norvegicus
aatattgtcactaggcagcatttcc

SEQ ID NO: 57616 - DNA, 25 bp, Rattus norvegicus
aatattgtcacttggcagcatttcc

SEQ ID NO: 57617 - DNA, 25 bp, Rattus norvegicus
aatattgtccctcacatattgtccc

SEQ ID NO: 57618 - DNA, 25 bp, Rattus norvegicus
aatattgtccctgacatattgtccc

SEQ ID NO: 57619 - DNA, 25 bp, Rattus norvegicus
aatattgtctacactgttccctgca

SEQ ID NO: 57620 - DNA, 25 bp, Rattus norvegicus
aatattgtctactctgttccctgca

SEQ ID NO: 57621 - DNA, 25 bp, Rattus norvegicus
aatattgtctggctgtcatctgcgg

SEQ ID NO: 57622 - DNA, 25 bp, Rattus norvegicus
aatattgtctgggtgtcatctgcgg

SEQ ID NO: 57623 - DNA, 25 bp, Rattus norvegicus
aatattgtcttcaacatggccgccg

SEQ ID NO: 57624 - DNA, 25 bp, Rattus norvegicus
aatattgtcttctacatggccgccg

SEQ ID NO: 57625 - DNA, 25 bp, Rattus norvegicus
aatattgtctttacacagacgctaa

SEQ ID NO: 57626 - DNA, 25 bp, Rattus norvegicus
aatattgtctttagaaacttcccag

SEQ ID NO: 57627 - DNA, 25 bp, Rattus norvegicus
aatattgtcttttcacagacgctaa

SEQ ID NO: 57628 - DNA, 25 bp, Rattus norvegicus
aatattgtcttttgaaacttcccag

SEQ ID NO: 57629 - DNA, 25 bp, Rattus norvegicus
aatattgtgactagtctccgtgcgc

SEQ ID NO: 57630 - DNA, 25 bp, Rattus norvegicus
aatattgtgacttgtctccgtgcgc

SEQ ID NO: 57631 - DNA, 25 bp, Rattus norvegicus
aatattgtggtcctgcacagccaag

SEQ ID NO: 57632 - DNA, 25 bp, Rattus norvegicus
aatattgtggtcgtgcacagccaag

SEQ ID NO: 57633 - DNA, 25 bp, Rattus norvegicus
aatattgtgttgaatctgtgtgtgt

SEQ ID NO: 57634 - DNA, 25 bp, Rattus norvegicus
aatattgtgttgtatctgtgtgtgt

SEQ ID NO: 57635 - DNA, 25 bp, Rattus norvegicus
aatattgttgtcacagccagacctc

SEQ ID NO: 57636 - DNA, 25 bp, Rattus norvegicus
aatattgttgtctcagccagacctc

SEQ ID NO: 57637 - DNA, 25 bp, Rattus norvegicus
aatattgtttgtcctctctggttca

SEQ ID NO: 57638 - DNA, 25 bp, Rattus norvegicus
aatattgtttgtgctctctggttca

SEQ ID NO: 57639 - DNA, 25 bp, Rattus norvegicus
aatatttaagccatcttcttgatct

SEQ ID NO: 57640 - DNA, 25 bp, Rattus norvegicus
aatatttaagccttcttcttgatct

SEQ ID NO: 57641 - DNA, 25 bp, Rattus norvegicus
aatatttacattatagccagacttt

SEQ ID NO: 57642 - DNA, 25 bp, Rattus norvegicus
aatatttacattttagccagacttt

SEQ ID NO: 57643 - DNA, 25 bp, Rattus norvegicus
aatatttactcaaatgtcccatgga

SEQ ID NO: 57644 - DNA, 25 bp, Rattus norvegicus
aatatttactcatatgtcccatgga

SEQ ID NO: 57645 - DNA, 25 bp, Rattus norvegicus
aatatttagattattgtgggaggag

SEQ ID NO: 57646 - DNA, 25 bp, Rattus norvegicus
aatatttagatttttgtgggaggag

SEQ ID NO: 57647 - DNA, 25 bp, Rattus norvegicus
aatatttagtgcataagaacactgg

SEQ ID NO: 57648 - DNA, 25 bp, Rattus norvegicus
aatatttagtgcttaagaacactgg

SEQ ID NO: 57649 - DNA, 25 bp, Rattus norvegicus
aatatttatattcgagtctcagtac

SEQ ID NO: 57650 - DNA, 25 bp, Rattus norvegicus
aatatttatattggagtctcagtac

SEQ ID NO: 57651 - DNA, 25 bp, Rattus norvegicus
aatatttatgacagactctccatgt

SEQ ID NO: 57652 - DNA, 25 bp, Rattus norvegicus
aatatttatgactgactctccatgt

SEQ ID NO: 57653 - DNA, 25 bp, Rattus norvegicus
aatatttattccagtgtttctgcca

SEQ ID NO: 57654 - DNA, 25 bp, Rattus norvegicus
aatatttattcctgtgtttctgcca

SEQ ID NO: 57655 - DNA, 25 bp, Rattus norvegicus
aatatttcaatccacatttcaaggg

SEQ ID NO: 57656 - DNA, 25 bp, Rattus norvegicus
aatatttcaatcgacatttcaaggg

SEQ ID NO: 57657 - DNA, 25 bp, Rattus norvegicus
aatatttcacatcttcaacgcacaa

SEQ ID NO: 57658 - DNA, 25 bp, Rattus norvegicus
aatatttcacatgttcaacgcacaa

SEQ ID NO: 57659 - DNA, 25 bp, Rattus norvegicus
aatatttcagtcattgtgggccata

SEQ ID NO: 57660 - DNA, 25 bp, Rattus norvegicus
aatatttcagtctttgtgggccata

SEQ ID NO: 57661 - DNA, 25 bp, Rattus norvegicus
aatatttcatggacttactcccctc

SEQ ID NO: 57662 - DNA, 25 bp, Rattus norvegicus
aatatttcatggtcttactcccctc

SEQ ID NO: 57663 - DNA, 25 bp, Rattus norvegicus
aatatttcccgcatatcaggctttg

SEQ ID NO: 57664 - DNA, 25 bp, Rattus norvegicus
aatatttcccgcttatcaggctttg

SEQ ID NO: 57665 - DNA, 25 bp, Rattus norvegicus
aatatttccctgctggacacagcct

SEQ ID NO: 57666 - DNA, 25 bp, Rattus norvegicus
aatatttccctggtggacacagcct

SEQ ID NO: 57667 - DNA, 25 bp, Rattus norvegicus
aatatttcctctccctctaacagga

SEQ ID NO: 57668 - DNA, 25 bp, Rattus norvegicus
aatatttcctctgcctctaacagga

SEQ ID NO: 57669 - DNA, 25 bp, Rattus norvegicus
aatatttcctgtacctttgtcagac

SEQ ID NO: 57670 - DNA, 25 bp, Rattus norvegicus
aatatttcctgttcctttgtcagac

SEQ ID NO: 57671 - DNA, 25 bp, Rattus norvegicus
aatatttcgcttctggaggctctga

SEQ ID NO: 57672 - DNA, 25 bp, Rattus norvegicus
aatatttcgcttgtggaggctctga

SEQ ID NO: 57673 - DNA, 25 bp, Rattus norvegicus
aatatttctattatcctcaagctag

SEQ ID NO: 57674 - DNA, 25 bp, Rattus norvegicus
aatatttctattttcctcaagctag

SEQ ID NO: 57675 - DNA, 25 bp, Rattus norvegicus
aatatttctccaagacaagctgtca

SEQ ID NO: 57676 - DNA, 25 bp, Rattus norvegicus
aatatttctccatgacaagctgtca

SEQ ID NO: 57677 - DNA, 25 bp, Rattus norvegicus
aatatttctcttctactgtagttaa

SEQ ID NO: 57678 - DNA, 25 bp, Rattus norvegicus
aatatttctcttgtactgtagttaa

SEQ ID NO: 57679 - DNA, 25 bp, Rattus norvegicus
aatatttctgaacgccatcacagtg

SEQ ID NO: 57680 - DNA, 25 bp, Rattus norvegicus
aatatttctgaaggccatcacagtg

SEQ ID NO: 57681 - DNA, 25 bp, Rattus norvegicus
aatatttctgtaaagccatgttcac

SEQ ID NO: 57682 - DNA, 25 bp, Rattus norvegicus
aatatttctgtatagccatgttcac

SEQ ID NO: 57683 - DNA, 25 bp, Rattus norvegicus
aatatttcttacatgattcagctga

SEQ ID NO: 57684 - DNA, 25 bp, Rattus norvegicus
aatatttcttacttgattcagctga

SEQ ID NO: 57685 - DNA, 25 bp, Rattus norvegicus
aatatttcttgcattgtccaggcag

SEQ ID NO: 57686 - DNA, 25 bp, Rattus norvegicus
aatatttcttgctttgtccaggcag

SEQ ID NO: 57687 - DNA, 25 bp, Rattus norvegicus
aatatttgacctctcttctgtgaag

SEQ ID NO: 57688 - DNA, 25 bp, Rattus norvegicus
aatatttgacctgtcttctgtgaag

SEQ ID NO: 57689 - DNA, 25 bp, Rattus norvegicus
aatatttgatcgactgtgtacacag

SEQ ID NO: 57690 - DNA, 25 bp, Rattus norvegicus
aatatttgatcgtctgtgtacacag

SEQ ID NO: 57691 - DNA, 25 bp, Rattus norvegicus
aatatttgcattactattgcttttg

SEQ ID NO: 57692 - DNA, 25 bp, Rattus norvegicus
aatatttgcatttctattgcttttg

SEQ ID NO: 57693 - DNA, 25 bp, Rattus norvegicus
aatatttgcctccttatcctgtaaa

SEQ ID NO: 57694 - DNA, 25 bp, Rattus norvegicus
aatatttgcctcgttatcctgtaaa

SEQ ID NO: 57695 - DNA, 25 bp, Rattus norvegicus
aatatttgctcccatactttctctg

SEQ ID NO: 57696 - DNA, 25 bp, Rattus norvegicus
aatatttgctccgatactttctctg

SEQ ID NO: 57697 - DNA, 25 bp, Rattus norvegicus
aatatttgcttgatgtatccttcac

SEQ ID NO: 57698 - DNA, 25 bp, Rattus norvegicus
aatatttgcttgttgtatccttcac

SEQ ID NO: 57699 - DNA, 25 bp, Rattus norvegicus
aatatttggcctatcattctttaaa

SEQ ID NO: 57700 - DNA, 25 bp, Rattus norvegicus
aatatttggcctttcattctttaaa

SEQ ID NO: 57701 - DNA, 25 bp, Rattus norvegicus
aatatttggcttacgttgtctcaag

SEQ ID NO: 57702 - DNA, 25 bp, Rattus norvegicus
aatatttggctttcgttgtctcaag

SEQ ID NO: 57703 - DNA, 25 bp, Rattus norvegicus
aatatttgtgttcccagtacctcag

SEQ ID NO: 57704 - DNA, 25 bp, Rattus norvegicus
aatatttgtgttgccagtacctcag

SEQ ID NO: 57705 - DNA, 25 bp, Rattus norvegicus
aatatttgttgtcttctttagagag

SEQ ID NO: 57706 - DNA, 25 bp, Rattus norvegicus
aatatttgttgtgttctttagagag

SEQ ID NO: 57707 - DNA, 25 bp, Rattus norvegicus
aatattttacccatgcttgcagtgg

SEQ ID NO: 57708 - DNA, 25 bp, Rattus norvegicus
aatattttacccttgcttgcagtgg

SEQ ID NO: 57709 - DNA, 25 bp, Rattus norvegicus
aatattttaggcatgcccttgctaa

SEQ ID NO: 57710 - DNA, 25 bp, Rattus norvegicus
aatattttaggcttgcccttgctaa

SEQ ID NO: 57711 - DNA, 25 bp, Rattus norvegicus
aatattttctagaagtgtgtcttat

SEQ ID NO: 57712 - DNA, 25 bp, Rattus norvegicus
aatattttctagcagttctattgta

SEQ ID NO: 57713 - DNA, 25 bp, Rattus norvegicus
aatattttctaggagttctattgta

SEQ ID NO: 57714 - DNA, 25 bp, Rattus norvegicus
aatattttctagtagtgtgtcttat

SEQ ID NO: 57715 - DNA, 25 bp, Rattus norvegicus
aatattttctctaccatcaccaagt

SEQ ID NO: 57716 - DNA, 25 bp, Rattus norvegicus
aatattttctcttccatcaccaagt

SEQ ID NO: 57717 - DNA, 25 bp, Rattus norvegicus
aatattttctgtccaagcttttaaa

SEQ ID NO: 57718 - DNA, 25 bp, Rattus norvegicus
aatattttctgtgcaagcttttaaa

SEQ ID NO: 57719 - DNA, 25 bp, Rattus norvegicus
aatattttgcctacctcaactggat

SEQ ID NO: 57720 - DNA, 25 bp, Rattus norvegicus
aatattttgccttcctcaactggat

SEQ ID NO: 57721 - DNA, 25 bp, Rattus norvegicus
aatattttgcggacaagccttgcca

SEQ ID NO: 57722 - DNA, 25 bp, Rattus norvegicus
aatattttgcggtcaagccttgcca

SEQ ID NO: 57723 - DNA, 25 bp, Rattus norvegicus
aatattttgcttacatcatcaggaa

SEQ ID NO: 57724 - DNA, 25 bp, Rattus norvegicus
aatattttgctttcatcatcaggaa

SEQ ID NO: 57725 - DNA, 25 bp, Rattus norvegicus
aatatttttataagtctgcagccta

SEQ ID NO: 57726 - DNA, 25 bp, Rattus norvegicus
aatatttttatatgtctgcagccta

SEQ ID NO: 57727 - DNA, 25 bp, Rattus norvegicus
aatatttttatcactcttgggagag

SEQ ID NO: 57728 - DNA, 25 bp, Rattus norvegicus
aatatttttatctctcttgggagag

SEQ ID NO: 57729 - DNA, 25 bp, Rattus norvegicus
aatatttttgctatccatggagtgt

SEQ ID NO: 57730 - DNA, 25 bp, Rattus norvegicus
aatatttttgctttccatggagtgt

SEQ ID NO: 57731 - DNA, 25 bp, Rattus norvegicus
aatattttttgtccgctgtgtagaa

SEQ ID NO: 57732 - DNA, 25 bp, Rattus norvegicus
aatattttttgtgcgctgtgtagaa

SEQ ID NO: 57733 - DNA, 25 bp, Rattus norvegicus
aatcaaaacttacttcgcacctacg

SEQ ID NO: 57734 - DNA, 25 bp, Rattus norvegicus
aatcaaaacttagttcgcacctacg

SEQ ID NO: 57735 - DNA, 25 bp, Rattus norvegicus
aatcaaaagattcgcctgaaggcta

SEQ ID NO: 57736 - DNA, 25 bp, Rattus norvegicus
aatcaaaagattggcctgaaggcta

SEQ ID NO: 57737 - DNA, 25 bp, Rattus norvegicus
aatcaaaatgatctacacctgggca

SEQ ID NO: 57738 - DNA, 25 bp, Rattus norvegicus
aatcaaaatgatgtacacctgggca

SEQ ID NO: 57739 - DNA, 25 bp, Rattus norvegicus
aatcaaaccaccctactgaacagag

SEQ ID NO: 57740 - DNA, 25 bp, Rattus norvegicus
aatcaaaccaccgtactgaacagag

SEQ ID NO: 57741 - DNA, 25 bp, Rattus norvegicus
aatcaaacgatgctctcttttcctg

SEQ ID NO: 57742 - DNA, 25 bp, Rattus norvegicus
aatcaaacgatggtctcttttcctg

SEQ ID NO: 57743 - DNA, 25 bp, Rattus norvegicus
aatcaaacgccacctgtgacttcac

SEQ ID NO: 57744 - DNA, 25 bp, Rattus norvegicus
aatcaaacgccagctgtgacttcac

SEQ ID NO: 57745 - DNA, 25 bp, Rattus norvegicus
aatcaaagatctccttccttctcag

SEQ ID NO: 57746 - DNA, 25 bp, Rattus norvegicus
aatcaaagatctgcttccttctcag

SEQ ID NO: 57747 - DNA, 25 bp, Rattus norvegicus
aatcaaagctgaatctcttacaact

SEQ ID NO: 57748 - DNA, 25 bp, Rattus norvegicus
aatcaaagctgattctcttacaact

SEQ ID NO: 57749 - DNA, 25 bp, Rattus norvegicus
aatcaaaggatgactgcgcgccagc

SEQ ID NO: 57750 - DNA, 25 bp, Rattus norvegicus
aatcaaaggatgtctgcgcgccagc

SEQ ID NO: 57751 - DNA, 25 bp, Rattus norvegicus
aatcaaaggcttagcttccacccaa

SEQ ID NO: 57752 - DNA, 25 bp, Rattus norvegicus
aatcaaaggctttgcttccacccaa

SEQ ID NO: 57753 - DNA, 25 bp, Rattus norvegicus
aatcaaagggatcctctgaggctag

SEQ ID NO: 57754 - DNA, 25 bp, Rattus norvegicus
aatcaaagggatgctctgaggctag

SEQ ID NO: 57755 - DNA, 25 bp, Rattus norvegicus
aatcaaagggccctcaggcgactgg

SEQ ID NO: 57756 - DNA, 25 bp, Rattus norvegicus
aatcaaagggccgtcaggcgactgg

SEQ ID NO: 57757 - DNA, 25 bp, Rattus norvegicus
aatcaaagtcaccataggccggcgt

SEQ ID NO: 57758 - DNA, 25 bp, Rattus norvegicus
aatcaaagtcacgataggccggcgt

SEQ ID NO: 57759 - DNA, 25 bp, Rattus norvegicus
aatcaaataaataactctgggacta

SEQ ID NO: 57760 - DNA, 25 bp, Rattus norvegicus
aatcaaataaattactctgggacta

SEQ ID NO: 57761 - DNA, 25 bp, Rattus norvegicus
aatcaaatcccaatctacctctcag

SEQ ID NO: 57762 - DNA, 25 bp, Rattus norvegicus
aatcaaatcccaatgtcacctaact

SEQ ID NO: 57763 - DNA, 25 bp, Rattus norvegicus
aatcaaatcccattctacctctcag

SEQ ID NO: 57764 - DNA, 25 bp, Rattus norvegicus
aatcaaatcccattgtcacctaact

SEQ ID NO: 57765 - DNA, 25 bp, Rattus norvegicus
aatcaaatccctaagcatccaggct

SEQ ID NO: 57766 - DNA, 25 bp, Rattus norvegicus
aatcaaatcccttagcatccaggct

SEQ ID NO: 57767 - DNA, 25 bp, Rattus norvegicus
aatcaaatctgcctcgggtgttttc

SEQ ID NO: 57768 - DNA, 25 bp, Rattus norvegicus
aatcaaatctgcgtcgggtgttttc

SEQ ID NO: 57769 - DNA, 25 bp, Rattus norvegicus
aatcaaatgcttctcctgctaggaa

SEQ ID NO: 57770 - DNA, 25 bp, Rattus norvegicus
aatcaaatgcttgtcctgctaggaa

SEQ ID NO: 57771 - DNA, 25 bp, Rattus norvegicus
aatcaaattcacctccctgggagtg

SEQ ID NO: 57772 - DNA, 25 bp, Rattus norvegicus
aatcaaattcacgtccctgggagtg

SEQ ID NO: 57773 - DNA, 25 bp, Rattus norvegicus
aatcaaattgatagtccgtgcccgc

SEQ ID NO: 57774 - DNA, 25 bp, Rattus norvegicus
aatcaaattgattgtccgtgcccgc

SEQ ID NO: 57775 - DNA, 25 bp, Rattus norvegicus
aatcaacaaagcaagccaggtgtgg

SEQ ID NO: 57776 - DNA, 25 bp, Rattus norvegicus
aatcaacaaagctagccaggtgtgg

SEQ ID NO: 57777 - DNA, 25 bp, Rattus norvegicus
aatcaacactcgaaaggccttcaga

SEQ ID NO: 57778 - DNA, 25 bp, Rattus norvegicus
aatcaacactcgtaaggccttcaga

SEQ ID NO: 57779 - DNA, 25 bp, Rattus norvegicus
aatcaacatgcgcagaggcctcggg

SEQ ID NO: 57780 - DNA, 25 bp, Rattus norvegicus
aatcaacatgcggagaggcctcggg

SEQ ID NO: 57781 - DNA, 25 bp, Rattus norvegicus
aatcaacccagtcagtgtgtgttag

SEQ ID NO: 57782 - DNA, 25 bp, Rattus norvegicus
aatcaacccagtgagtgtgtgttag

SEQ ID NO: 57783 - DNA, 25 bp, Rattus norvegicus
aatcaacctcatagctttcttcttt

SEQ ID NO: 57784 - DNA, 25 bp, Rattus norvegicus
aatcaacctcattgctttcttcttt

SEQ ID NO: 57785 - DNA, 25 bp, Rattus norvegicus
aatcaaccttttctcaagcagcagc

SEQ ID NO: 57786 - DNA, 25 bp, Rattus norvegicus
aatcaaccttttgtcaagcagcagc

SEQ ID NO: 57787 - DNA, 25 bp, Rattus norvegicus
aatcaacggatccatcagtctggcc

SEQ ID NO: 57788 - DNA, 25 bp, Rattus norvegicus
aatcaacggatcgatcagtctggcc

SEQ ID NO: 57789 - DNA, 25 bp, Rattus norvegicus
aatcaactctgcagactgaactcac

SEQ ID NO: 57790 - DNA, 25 bp, Rattus norvegicus
aatcaactctgctgactgaactcac

SEQ ID NO: 57791 - DNA, 25 bp, Rattus norvegicus
aatcaactcttcatgtactctgtgt

SEQ ID NO: 57792 - DNA, 25 bp, Rattus norvegicus
aatcaactcttcttgtactctgtgt

SEQ ID NO: 57793 - DNA, 25 bp, Rattus norvegicus
aatcaactgcccagacgaactgttt

SEQ ID NO: 57794 - DNA, 25 bp, Rattus norvegicus
aatcaactgccctgacgaactgttt

SEQ ID NO: 57795 - DNA, 25 bp, Rattus norvegicus
aatcaactggctcacttgttcaagg

SEQ ID NO: 57796 - DNA, 25 bp, Rattus norvegicus
aatcaactggctgacttgttcaagg

SEQ ID NO: 57797 - DNA, 25 bp, Rattus norvegicus
aatcaacttgtgatttgcctgtagt

SEQ ID NO: 57798 - DNA, 25 bp, Rattus norvegicus
aatcaacttgtgttttgcctgtagt

SEQ ID NO: 57799 - DNA, 25 bp, Rattus norvegicus
aatcaagaaggccagaccctccggt

SEQ ID NO: 57800 - DNA, 25 bp, Rattus norvegicus
aatcaagaaggcgagaccctccggt

SEQ ID NO: 57801 - DNA, 25 bp, Rattus norvegicus
aatcaagaattgctcccagaaaatg

SEQ ID NO: 57802 - DNA, 25 bp, Rattus norvegicus
aatcaagaattggtcccagaaaatg

SEQ ID NO: 57803 - DNA, 25 bp, Rattus norvegicus
aatcaagagctgctggtcatccaga

SEQ ID NO: 57804 - DNA, 25 bp, Rattus norvegicus
aatcaagagctggtggtcatccaga

SEQ ID NO: 57805 - DNA, 25 bp, Rattus norvegicus
aatcaagagttcactgatgacattg

SEQ ID NO: 57806 - DNA, 25 bp, Rattus norvegicus
aatcaagagttctctgatgacattg

SEQ ID NO: 57807 - DNA, 25 bp, Rattus norvegicus
aatcaagcagcaccaatactaccac

SEQ ID NO: 57808 - DNA, 25 bp, Rattus norvegicus
aatcaagcagcaccacggtgaggca

SEQ ID NO: 57809 - DNA, 25 bp, Rattus norvegicus
aatcaagcagcagcaatactaccac

SEQ ID NO: 57810 - DNA, 25 bp, Rattus norvegicus
aatcaagcagcagcacggtgaggca

SEQ ID NO: 57811 - DNA, 25 bp, Rattus norvegicus
aatcaagcaggtacttccttctcag

SEQ ID NO: 57812 - DNA, 25 bp, Rattus norvegicus
aatcaagcaggttcttccttctcag

SEQ ID NO: 57813 - DNA, 25 bp, Rattus norvegicus
aatcaagcatggcagggcacatctg

SEQ ID NO: 57814 - DNA, 25 bp, Rattus norvegicus
aatcaagcatgggagggcacatctg

SEQ ID NO: 57815 - DNA, 25 bp, Rattus norvegicus
aatcaagcattaaggtgttcctctt

SEQ ID NO: 57816 - DNA, 25 bp, Rattus norvegicus
aatcaagcattatggtgttcctctt

SEQ ID NO: 57817 - DNA, 25 bp, Rattus norvegicus
aatcaagccggaagacgtctgtcat

SEQ ID NO: 57818 - DNA, 25 bp, Rattus norvegicus
aatcaagccggatgacgtctgtcat

SEQ ID NO: 57819 - DNA, 25 bp, Rattus norvegicus
aatcaagctgacatttcatccacca

SEQ ID NO: 57820 - DNA, 25 bp, Rattus norvegicus
aatcaagctgacttttcatccacca

SEQ ID NO: 57821 - DNA, 25 bp, Rattus norvegicus
aatcaagcttggctcctattctaaa

SEQ ID NO: 57822 - DNA, 25 bp, Rattus norvegicus
aatcaagcttgggtcctattctaaa

SEQ ID NO: 57823 - DNA, 25 bp, Rattus norvegicus
aatcaaggaggcaacggatctgttg

SEQ ID NO: 57824 - DNA, 25 bp, Rattus norvegicus
aatcaaggaggctacggatctgttg

SEQ ID NO: 57825 - DNA, 25 bp, Rattus norvegicus
aatcaaggagttagcagccggctac

SEQ ID NO: 57826 - DNA, 25 bp, Rattus norvegicus
aatcaaggagtttgcagccggctac

SEQ ID NO: 57827 - DNA, 25 bp, Rattus norvegicus
aatcaaggcatgaatttcaagcaag

SEQ ID NO: 57828 - DNA, 25 bp, Rattus norvegicus
aatcaaggcatgtatttcaagcaag

SEQ ID NO: 57829 - DNA, 25 bp, Rattus norvegicus
aatcaagggcctactagacccattc

SEQ ID NO: 57830 - DNA, 25 bp, Rattus norvegicus
aatcaagggccttctagacccattc

SEQ ID NO: 57831 - DNA, 25 bp, Rattus norvegicus
aatcaagggcttcaggtgtccccat

SEQ ID NO: 57832 - DNA, 25 bp, Rattus norvegicus
aatcaagggcttgaggtgtccccat

SEQ ID NO: 57833 - DNA, 25 bp, Rattus norvegicus
aatcaaggtcttccagcagaggtaa

SEQ ID NO: 57834 - DNA, 25 bp, Rattus norvegicus
aatcaaggtcttgcagcagaggtaa

SEQ ID NO: 57835 - DNA, 25 bp, Rattus norvegicus
aatcaaggttctacagtgtcacaag

SEQ ID NO: 57836 - DNA, 25 bp, Rattus norvegicus
aatcaaggttcttcagtgtcacaag

SEQ ID NO: 57837 - DNA, 25 bp, Rattus norvegicus
aatcaagtacaaacgctaacgcccc

SEQ ID NO: 57838 - DNA, 25 bp, Rattus norvegicus
aatcaagtacaatcgctaacgcccc

SEQ ID NO: 57839 - DNA, 25 bp, Rattus norvegicus
aatcaagtcattctcagtttcctgc

SEQ ID NO: 57840 - DNA, 25 bp, Rattus norvegicus
aatcaagtcattgtcagtttcctgc

SEQ ID NO: 57841 - DNA, 25 bp, Rattus norvegicus
aatcaagtccctatttgtttgcaga

SEQ ID NO: 57842 - DNA, 25 bp, Rattus norvegicus
aatcaagtccctttttgtttgcaga

SEQ ID NO: 57843 - DNA, 25 bp, Rattus norvegicus
aatcaagtctttagctgagagcctg

SEQ ID NO: 57844 - DNA, 25 bp, Rattus norvegicus
aatcaagtcttttgctgagagcctg

SEQ ID NO: 57845 - DNA, 25 bp, Rattus norvegicus
aatcaagtgatacctcatgccgttg

SEQ ID NO: 57846 - DNA, 25 bp, Rattus norvegicus
aatcaagtgatagctcatgccgttg

SEQ ID NO: 57847 - DNA, 25 bp, Rattus norvegicus
aatcaagtgattactgactttactg

SEQ ID NO: 57848 - DNA, 25 bp, Rattus norvegicus
aatcaagtgatttctgactttactg

SEQ ID NO: 57849 - DNA, 25 bp, Rattus norvegicus
aatcaagtgcaacttctgccgccga

SEQ ID NO: 57850 - DNA, 25 bp, Rattus norvegicus
aatcaagtgcaagttctgccgccga

SEQ ID NO: 57851 - DNA, 25 bp, Rattus norvegicus
aatcaagtgcttctcatgtttcaga

SEQ ID NO: 57852 - DNA, 25 bp, Rattus norvegicus
aatcaagtgcttgtcatgtttcaga

SEQ ID NO: 57853 - DNA, 25 bp, Rattus norvegicus
aatcaagtgttcattctgctctctg

SEQ ID NO: 57854 - DNA, 25 bp, Rattus norvegicus
aatcaagtgttctttctgctctctg

SEQ ID NO: 57855 - DNA, 25 bp, Rattus norvegicus
aatcaagttcgtacttccaggtatt

SEQ ID NO: 57856 - DNA, 25 bp, Rattus norvegicus
aatcaagttcgttcttccaggtatt

SEQ ID NO: 57857 - DNA, 25 bp, Rattus norvegicus
aatcaagttctgattctgtcctctc

SEQ ID NO: 57858 - DNA, 25 bp, Rattus norvegicus
aatcaagttctgtttctgtcctctc

SEQ ID NO: 57859 - DNA, 25 bp, Rattus norvegicus
aatcaagttcttagttcccacagtg

SEQ ID NO: 57860 - DNA, 25 bp, Rattus norvegicus
aatcaagttcttcagtacctcagtt

SEQ ID NO: 57861 - DNA, 25 bp, Rattus norvegicus
aatcaagttcttgagtacctcagtt

SEQ ID NO: 57862 - DNA, 25 bp, Rattus norvegicus
aatcaagttctttgttcccacagtg

SEQ ID NO: 57863 - DNA, 25 bp, Rattus norvegicus
aatcaatacataccactcctctgtg

SEQ ID NO: 57864 - DNA, 25 bp, Rattus norvegicus
aatcaatacatagcactcctctgtg

SEQ ID NO: 57865 - DNA, 25 bp, Rattus norvegicus
aatcaatagctcagcttcacctcag

SEQ ID NO: 57866 - DNA, 25 bp, Rattus norvegicus
aatcaatagctctgcttcacctcag

SEQ ID NO: 57867 - DNA, 25 bp, Rattus norvegicus
aatcaatcaaacagcactgaagctg

SEQ ID NO: 57868 - DNA, 25 bp, Rattus norvegicus
aatcaatcaaactgcactgaagctg

SEQ ID NO: 57869 - DNA, 25 bp, Rattus norvegicus
aatcaatccctgcttgtagacaagt

SEQ ID NO: 57870 - DNA, 25 bp, Rattus norvegicus
aatcaatccctggttgtagacaagt

SEQ ID NO: 57871 - DNA, 25 bp, Rattus norvegicus
aatcaatctcataccttcataaagt

SEQ ID NO: 57872 - DNA, 25 bp, Rattus norvegicus
aatcaatctcattccttcataaagt

SEQ ID NO: 57873 - DNA, 25 bp, Rattus norvegicus
aatcaatgacttatccaaccaggga

SEQ ID NO: 57874 - DNA, 25 bp, Rattus norvegicus
aatcaatgacttttccaaccaggga

SEQ ID NO: 57875 - DNA, 25 bp, Rattus norvegicus
aatcaatggctcatttgtgcttttg

SEQ ID NO: 57876 - DNA, 25 bp, Rattus norvegicus
aatcaatggctcttttgtgcttttg

SEQ ID NO: 57877 - DNA, 25 bp, Rattus norvegicus
aatcaatggtgcaagagttggctca

SEQ ID NO: 57878 - DNA, 25 bp, Rattus norvegicus
aatcaatggtgctagagttggctca

SEQ ID NO: 57879 - DNA, 25 bp, Rattus norvegicus
aatcaatgtaccattaggcctccta

SEQ ID NO: 57880 - DNA, 25 bp, Rattus norvegicus
aatcaatgtacctttaggcctccta

SEQ ID NO: 57881 - DNA, 25 bp, Rattus norvegicus
aatcaatgtcatctctgacgcctgg

SEQ ID NO: 57882 - DNA, 25 bp, Rattus norvegicus
aatcaatgtcatgtctgacgcctgg

SEQ ID NO: 57883 - DNA, 25 bp, Rattus norvegicus
aatcaatgtgttctccttggtgata

SEQ ID NO: 57884 - DNA, 25 bp, Rattus norvegicus
aatcaatgtgttgtccttggtgata

SEQ ID NO: 57885 - DNA, 25 bp, Rattus norvegicus
aatcaattaggtatgggtgcagtcc

SEQ ID NO: 57886 - DNA, 25 bp, Rattus norvegicus
aatcaattaggtttgggtgcagtcc

SEQ ID NO: 57887 - DNA, 25 bp, Rattus norvegicus
aatcaattgtttacagcctctgaag

SEQ ID NO: 57888 - DNA, 25 bp, Rattus norvegicus
aatcaattgttttcagcctctgaag

SEQ ID NO: 57889 - DNA, 25 bp, Rattus norvegicus
aatcacaacctaaagcagatattgc

SEQ ID NO: 57890 - DNA, 25 bp, Rattus norvegicus
aatcacaacctatagcagatattgc

SEQ ID NO: 57891 - DNA, 25 bp, Rattus norvegicus
aatcacacaaatccaagacccactg

SEQ ID NO: 57892 - DNA, 25 bp, Rattus norvegicus
aatcacacaaatgcaagacccactg

SEQ ID NO: 57893 - DNA, 25 bp, Rattus norvegicus
aatcacacactgctcatttttaact

SEQ ID NO: 57894 - DNA, 25 bp, Rattus norvegicus
aatcacacactggtcatttttaact

SEQ ID NO: 57895 - DNA, 25 bp, Rattus norvegicus
aatcacaccagtactagttcttcac

SEQ ID NO: 57896 - DNA, 25 bp, Rattus norvegicus
aatcacaccagttctagttcttcac

SEQ ID NO: 57897 - DNA, 25 bp, Rattus norvegicus
aatcacacccttctagtgcttcgcg

SEQ ID NO: 57898 - DNA, 25 bp, Rattus norvegicus
aatcacacccttgtagtgcttcgcg

SEQ ID NO: 57899 - DNA, 25 bp, Rattus norvegicus
aatcacactcagagacttcaccgag

SEQ ID NO: 57900 - DNA, 25 bp, Rattus norvegicus
aatcacactcagtgacttcaccgag

SEQ ID NO: 57901 - DNA, 25 bp, Rattus norvegicus
aatcacactgaaatctccccaggag

SEQ ID NO: 57902 - DNA, 25 bp, Rattus norvegicus
aatcacactgaattctccccaggag

SEQ ID NO: 57903 - DNA, 25 bp, Rattus norvegicus
aatcacagatgacaatgttgtacct

SEQ ID NO: 57904 - DNA, 25 bp, Rattus norvegicus
aatcacagatgagaatgttgtacct

SEQ ID NO: 57905 - DNA, 25 bp, Rattus norvegicus
aatcacagcacaaggcaggcacagg

SEQ ID NO: 57906 - DNA, 25 bp, Rattus norvegicus
aatcacagcacatggcaggcacagg

SEQ ID NO: 57907 - DNA, 25 bp, Rattus norvegicus
aatcacaggcctagttcttggttac

SEQ ID NO: 57908 - DNA, 25 bp, Rattus norvegicus
aatcacaggccttgttcttggttac

SEQ ID NO: 57909 - DNA, 25 bp, Rattus norvegicus
aatcacagtcctcacagtggccagg

SEQ ID NO: 57910 - DNA, 25 bp, Rattus norvegicus
aatcacagtcctgacagtggccagg

SEQ ID NO: 57911 - DNA, 25 bp, Rattus norvegicus
aatcacataactaacctagggcaag

SEQ ID NO: 57912 - DNA, 25 bp, Rattus norvegicus
aatcacataacttacctagggcaag

SEQ ID NO: 57913 - DNA, 25 bp, Rattus norvegicus
aatcacatatctcgccttgctgggt

SEQ ID NO: 57914 - DNA, 25 bp, Rattus norvegicus
aatcacatatctggccttgctgggt

SEQ ID NO: 57915 - DNA, 25 bp, Rattus norvegicus
aatcacatcccaccgattgggcagc

SEQ ID NO: 57916 - DNA, 25 bp, Rattus norvegicus
aatcacatcccagcgattgggcagc

SEQ ID NO: 57917 - DNA, 25 bp, Rattus norvegicus
aatcacatcgtacagttgggcacaa

SEQ ID NO: 57918 - DNA, 25 bp, Rattus norvegicus
aatcacatcgtagagttgggcacaa

SEQ ID NO: 57919 - DNA, 25 bp, Rattus norvegicus
aatcacatctccattcaaaaccatc

SEQ ID NO: 57920 - DNA, 25 bp, Rattus norvegicus
aatcacatctcctttcaaaaccatc

SEQ ID NO: 57921 - DNA, 25 bp, Rattus norvegicus
aatcacatctgcatctctaccaagg

SEQ ID NO: 57922 - DNA, 25 bp, Rattus norvegicus
aatcacatctgcttctctaccaagg

SEQ ID NO: 57923 - DNA, 25 bp, Rattus norvegicus
aatcacatctgtaaatctttttatc

SEQ ID NO: 57924 - DNA, 25 bp, Rattus norvegicus
aatcacatctgttaatctttttatc

SEQ ID NO: 57925 - DNA, 25 bp, Rattus norvegicus
aatcacatgtacacctgagagctgc

SEQ ID NO: 57926 - DNA, 25 bp, Rattus norvegicus
aatcacatgtactcctgagagctgc

SEQ ID NO: 57927 - DNA, 25 bp, Rattus norvegicus
aatcacatgtttaaagactcctttt

SEQ ID NO: 57928 - DNA, 25 bp, Rattus norvegicus
aatcacatgttttaagactcctttt

SEQ ID NO: 57929 - DNA, 25 bp, Rattus norvegicus
aatcacattacaattgtcaggaaac

SEQ ID NO: 57930 - DNA, 25 bp, Rattus norvegicus
aatcacattacatttgtcaggaaac

SEQ ID NO: 57931 - DNA, 25 bp, Rattus norvegicus
aatcaccaactgaattttgtatcta

SEQ ID NO: 57932 - DNA, 25 bp, Rattus norvegicus
aatcaccaactgtattttgtatcta

SEQ ID NO: 57933 - DNA, 25 bp, Rattus norvegicus
aatcaccaccaaatgagggcacata

SEQ ID NO: 57934 - DNA, 25 bp, Rattus norvegicus
aatcaccaccaattgagggcacata

SEQ ID NO: 57935 - DNA, 25 bp, Rattus norvegicus
aatcaccaggaaatctctctcaaga

SEQ ID NO: 57936 - DNA, 25 bp, Rattus norvegicus
aatcaccaggaattctctctcaaga

SEQ ID NO: 57937 - DNA, 25 bp, Rattus norvegicus
aatcaccaggcacttgcacgtgtag

SEQ ID NO: 57938 - DNA, 25 bp, Rattus norvegicus
aatcaccaggcagttgcacgtgtag

SEQ ID NO: 57939 - DNA, 25 bp, Rattus norvegicus
aatcaccatctaaggacgacccagt

SEQ ID NO: 57940 - DNA, 25 bp, Rattus norvegicus
aatcaccatctatggacgacccagt

SEQ ID NO: 57941 - DNA, 25 bp, Rattus norvegicus
aatcacccaatgcacaccctgtgtt

SEQ ID NO: 57942 - DNA, 25 bp, Rattus norvegicus
aatcacccaatggacaccctgtgtt

SEQ ID NO: 57943 - DNA, 25 bp, Rattus norvegicus
aatcacccacaaatttatcttgcgt

SEQ ID NO: 57944 - DNA, 25 bp, Rattus norvegicus
aatcacccacaattttatcttgcgt

SEQ ID NO: 57945 - DNA, 25 bp, Rattus norvegicus
aatcaccccaagatagctatcatca

SEQ ID NO: 57946 - DNA, 25 bp, Rattus norvegicus
aatcaccccaagttagctatcatca

SEQ ID NO: 57947 - DNA, 25 bp, Rattus norvegicus
aatcacccctacacaatctatcgat

SEQ ID NO: 57948 - DNA, 25 bp, Rattus norvegicus
aatcacccctactcaatctatcgat

SEQ ID NO: 57949 - DNA, 25 bp, Rattus norvegicus
aatcaccctgtacctagtgtgggaa

SEQ ID NO: 57950 - DNA, 25 bp, Rattus norvegicus
aatcaccctgtagctagtgtgggaa

SEQ ID NO: 57951 - DNA, 25 bp, Rattus norvegicus
aatcaccctgttaatctcagttggt

SEQ ID NO: 57952 - DNA, 25 bp, Rattus norvegicus
aatcaccctgtttatctcagttggt

SEQ ID NO: 57953 - DNA, 25 bp, Rattus norvegicus
aatcaccgacctcaagatgctggag

SEQ ID NO: 57954 - DNA, 25 bp, Rattus norvegicus
aatcaccgacctgaagatgctggag

SEQ ID NO: 57955 - DNA, 25 bp, Rattus norvegicus
aatcaccgagatcgataaacctttt

SEQ ID NO: 57956 - DNA, 25 bp, Rattus norvegicus
aatcaccgagatggataaacctttt

SEQ ID NO: 57957 - DNA, 25 bp, Rattus norvegicus
aatcaccggaacagtttgcctggat

SEQ ID NO: 57958 - DNA, 25 bp, Rattus norvegicus
aatcaccggaactgtttgcctggat

SEQ ID NO: 57959 - DNA, 25 bp, Rattus norvegicus
aatcacctacttcaacattgtatgc

SEQ ID NO: 57960 - DNA, 25 bp, Rattus norvegicus
aatcacctacttgaacattgtatgc

SEQ ID NO: 57961 - DNA, 25 bp, Rattus norvegicus
aatcacctattcacttctcaagcat

SEQ ID NO: 57962 - DNA, 25 bp, Rattus norvegicus
aatcacctattctcttctcaagcat

SEQ ID NO: 57963 - DNA, 25 bp, Rattus norvegicus
aatcacctgaaaagagggagcttca

SEQ ID NO: 57964 - DNA, 25 bp, Rattus norvegicus
aatcacctgaaatgagggagcttca

SEQ ID NO: 57965 - DNA, 25 bp, Rattus norvegicus
aatcacctgaatatgcatagtcatt

SEQ ID NO: 57966 - DNA, 25 bp, Rattus norvegicus
aatcacctgaatttgcatagtcatt

SEQ ID NO: 57967 - DNA, 25 bp, Rattus norvegicus
aatcacctgcttaatgtccactttt

SEQ ID NO: 57968 - DNA, 25 bp, Rattus norvegicus
aatcacctgctttatgtccactttt

SEQ ID NO: 57969 - DNA, 25 bp, Rattus norvegicus
aatcacctggacatcatctgggcaa

SEQ ID NO: 57970 - DNA, 25 bp, Rattus norvegicus
aatcacctggacttcatctgggcaa

SEQ ID NO: 57971 - DNA, 25 bp, Rattus norvegicus
aatcacctggtcatgaagatcaaca

SEQ ID NO: 57972 - DNA, 25 bp, Rattus norvegicus
aatcacctggtcttgaagatcaaca

SEQ ID NO: 57973 - DNA, 25 bp, Rattus norvegicus
aatcacctgtcgaggctggtggtca

SEQ ID NO: 57974 - DNA, 25 bp, Rattus norvegicus
aatcacctgtcgtggctggtggtca

SEQ ID NO: 57975 - DNA, 25 bp, Rattus norvegicus
aatcacgatcttcatttttcaggga

SEQ ID NO: 57976 - DNA, 25 bp, Rattus norvegicus
aatcacgatcttgatttttcaggga

SEQ ID NO: 57977 - DNA, 25 bp, Rattus norvegicus
aatcacgctcggacctactcaaggc

SEQ ID NO: 57978 - DNA, 25 bp, Rattus norvegicus
aatcacgctcggtcctactcaaggc

SEQ ID NO: 57979 - DNA, 25 bp, Rattus norvegicus
aatcacggaataattaaagctgcat

SEQ ID NO: 57980 - DNA, 25 bp, Rattus norvegicus
aatcacggaatatttaaagctgcat

SEQ ID NO: 57981 - DNA, 25 bp, Rattus norvegicus
aatcacggcggcacttgtgccttgc

SEQ ID NO: 57982 - DNA, 25 bp, Rattus norvegicus
aatcacggcggctcttgtgccttgc

SEQ ID NO: 57983 - DNA, 25 bp, Rattus norvegicus
aatcacgggcagagtccaaacgcat

SEQ ID NO: 57984 - DNA, 25 bp, Rattus norvegicus
aatcacgggcagtgtccaaacgcat

SEQ ID NO: 57985 - DNA, 25 bp, Rattus norvegicus
aatcacgtacgcaaaatgccgagga

SEQ ID NO: 57986 - DNA, 25 bp, Rattus norvegicus
aatcacgtacgctaaatgccgagga

SEQ ID NO: 57987 - DNA, 25 bp, Rattus norvegicus
aatcacgtaggaagttgtaaactca

SEQ ID NO: 57988 - DNA, 25 bp, Rattus norvegicus
aatcacgtaggatgttgtaaactca

SEQ ID NO: 57989 - DNA, 25 bp, Rattus norvegicus
aatcacgtggtgatcagggtagtaa

SEQ ID NO: 57990 - DNA, 25 bp, Rattus norvegicus
aatcacgtggtgttcagggtagtaa

SEQ ID NO: 57991 - DNA, 25 bp, Rattus norvegicus
aatcacgttaatcttgttttttgca

SEQ ID NO: 57992 - DNA, 25 bp, Rattus norvegicus
aatcacgttaatgttgttttttgca

SEQ ID NO: 57993 - DNA, 25 bp, Rattus norvegicus
aatcactacactatgtttccccgta

SEQ ID NO: 57994 - DNA, 25 bp, Rattus norvegicus
aatcactacactttgtttccccgta

SEQ ID NO: 57995 - DNA, 25 bp, Rattus norvegicus
aatcactacatgaccttgagagctt

SEQ ID NO: 57996 - DNA, 25 bp, Rattus norvegicus
aatcactacatgtccttgagagctt

SEQ ID NO: 57997 - DNA, 25 bp, Rattus norvegicus
aatcactaccagactagactagccc

SEQ ID NO: 57998 - DNA, 25 bp, Rattus norvegicus
aatcactaccagtctagactagccc

SEQ ID NO: 57999 - DNA, 25 bp, Rattus norvegicus
aatcactactgtcttgtgctgcata

SEQ ID NO: 58000 - DNA, 25 bp, Rattus norvegicus
aatcactactgtgttgtgctgcata

SEQ ID NO: 58001 - DNA, 25 bp, Rattus norvegicus
aatcactacttaaccagctttggct

SEQ ID NO: 58002 - DNA, 25 bp, Rattus norvegicus
aatcactacttatccagctttggct

SEQ ID NO: 58003 - DNA, 25 bp, Rattus norvegicus
aatcactagtgaattcgcggccgcc

SEQ ID NO: 58004 - DNA, 25 bp, Rattus norvegicus
aatcactagtgatttcgcggccgcc

SEQ ID NO: 58005 - DNA, 25 bp, Rattus norvegicus
aatcactattagatcttctggcgcc

SEQ ID NO: 58006 - DNA, 25 bp, Rattus norvegicus
aatcactattagttcttctggcgcc

SEQ ID NO: 58007 - DNA, 25 bp, Rattus norvegicus
aatcactccaaaaggcagagccctg

SEQ ID NO: 58008 - DNA, 25 bp, Rattus norvegicus
aatcactccaaatggcagagccctg

SEQ ID NO: 58009 - DNA, 25 bp, Rattus norvegicus
aatcactcccagagtcaggagtcct

SEQ ID NO: 58010 - DNA, 25 bp, Rattus norvegicus
aatcactcccagtgtcaggagtcct

SEQ ID NO: 58011 - DNA, 25 bp, Rattus norvegicus
aatcactccctcactcaagtagtaa

SEQ ID NO: 58012 - DNA, 25 bp, Rattus norvegicus
aatcactccctctctcaagtagtaa

SEQ ID NO: 58013 - DNA, 25 bp, Rattus norvegicus
aatcactcctgaccagcaccgaggg

SEQ ID NO: 58014 - DNA, 25 bp, Rattus norvegicus
aatcactcctgagcagcaccgaggg

SEQ ID NO: 58015 - DNA, 25 bp, Rattus norvegicus
aatcactcggataattcaggacaaa

SEQ ID NO: 58016 - DNA, 25 bp, Rattus norvegicus
aatcactcggattattcaggacaaa

SEQ ID NO: 58017 - DNA, 25 bp, Rattus norvegicus
aatcactctcaacagatccttgcag

SEQ ID NO: 58018 - DNA, 25 bp, Rattus norvegicus
aatcactctcaagagatccttgcag

SEQ ID NO: 58019 - DNA, 25 bp, Rattus norvegicus
aatcactctgtcacgaagctggtag

SEQ ID NO: 58020 - DNA, 25 bp, Rattus norvegicus
aatcactctgtctcgaagctggtag

SEQ ID NO: 58021 - DNA, 25 bp, Rattus norvegicus
aatcactcttgtaacttctgttgct

SEQ ID NO: 58022 - DNA, 25 bp, Rattus norvegicus
aatcactcttgttacttctgttgct

SEQ ID NO: 58023 - DNA, 25 bp, Rattus norvegicus
aatcactgacccagaagttgcctgg

SEQ ID NO: 58024 - DNA, 25 bp, Rattus norvegicus
aatcactgaccctgaagttgcctgg

SEQ ID NO: 58025 - DNA, 25 bp, Rattus norvegicus
aatcactgcgacagcgctgggaggc

SEQ ID NO: 58026 - DNA, 25 bp, Rattus norvegicus
aatcactgcgactgcgctgggaggc

SEQ ID NO: 58027 - DNA, 25 bp, Rattus norvegicus
aatcactgcggacaaggacctcaga

SEQ ID NO: 58028 - DNA, 25 bp, Rattus norvegicus
aatcactgcggagaaggacctcaga

SEQ ID NO: 58029 - DNA, 25 bp, Rattus norvegicus
aatcactgctttatatactactgag

SEQ ID NO: 58030 - DNA, 25 bp, Rattus norvegicus
aatcactgctttttatactactgag

SEQ ID NO: 58031 - DNA, 25 bp, Rattus norvegicus
aatcactggctccaaacctggaagt

SEQ ID NO: 58032 - DNA, 25 bp, Rattus norvegicus
aatcactggctcgaaacctggaagt

SEQ ID NO: 58033 - DNA, 25 bp, Rattus norvegicus
aatcactggctgacttttcacaagg

SEQ ID NO: 58034 - DNA, 25 bp, Rattus norvegicus
aatcactggctgtcttttcacaagg

SEQ ID NO: 58035 - DNA, 25 bp, Rattus norvegicus
aatcactggcttcatgttagaggtc

SEQ ID NO: 58036 - DNA, 25 bp, Rattus norvegicus
aatcactggcttgatgttagaggtc

SEQ ID NO: 58037 - DNA, 25 bp, Rattus norvegicus
aatcactgtctgagggttattccat

SEQ ID NO: 58038 - DNA, 25 bp, Rattus norvegicus
aatcactgtctgtgggttattccat

SEQ ID NO: 58039 - DNA, 25 bp, Rattus norvegicus
aatcactgtgaacccaatggctctt

SEQ ID NO: 58040 - DNA, 25 bp, Rattus norvegicus
aatcactgtgaagccaatggctctt

SEQ ID NO: 58041 - DNA, 25 bp, Rattus norvegicus
aatcactgtgccagatgtgggctgc

SEQ ID NO: 58042 - DNA, 25 bp, Rattus norvegicus
aatcactgtgcctgatgtgggctgc

SEQ ID NO: 58043 - DNA, 25 bp, Rattus norvegicus
aatcactgtggtcctcttgaactga

SEQ ID NO: 58044 - DNA, 25 bp, Rattus norvegicus
aatcactgtggtgctcttgaactga

SEQ ID NO: 58045 - DNA, 25 bp, Rattus norvegicus
aatcactgttgaatcccgtggtact

SEQ ID NO: 58046 - DNA, 25 bp, Rattus norvegicus
aatcactgttgattcccgtggtact

SEQ ID NO: 58047 - DNA, 25 bp, Rattus norvegicus
aatcactgttggctattacatagag

SEQ ID NO: 58048 - DNA, 25 bp, Rattus norvegicus
aatcactgttgggtattacatagag

SEQ ID NO: 58049 - DNA, 25 bp, Rattus norvegicus
aatcactgttttacaagttcttgta

SEQ ID NO: 58050 - DNA, 25 bp, Rattus norvegicus
aatcactgtttttcaagttcttgta

SEQ ID NO: 58051 - DNA, 25 bp, Rattus norvegicus
aatcacttaaagatgttcctgcggg

SEQ ID NO: 58052 - DNA, 25 bp, Rattus norvegicus
aatcacttaaagttgttcctgcggg

SEQ ID NO: 58053 - DNA, 25 bp, Rattus norvegicus
aatcacttaagtccagtccccaaga

SEQ ID NO: 58054 - DNA, 25 bp, Rattus norvegicus
aatcacttaagtgcagtccccaaga

SEQ ID NO: 58055 - DNA, 25 bp, Rattus norvegicus
aatcacttattcaaccctattccac

SEQ ID NO: 58056 - DNA, 25 bp, Rattus norvegicus
aatcacttattctaccctattccac

SEQ ID NO: 58057 - DNA, 25 bp, Rattus norvegicus
aatcacttccagaccagggagtctg

SEQ ID NO: 58058 - DNA, 25 bp, Rattus norvegicus
aatcacttccagtccagggagtctg

SEQ ID NO: 58059 - DNA, 25 bp, Rattus norvegicus
aatcacttctgcaagagcccatttt

SEQ ID NO: 58060 - DNA, 25 bp, Rattus norvegicus
aatcacttctgctagagcccatttt

SEQ ID NO: 58061 - DNA, 25 bp, Rattus norvegicus
aatcacttgaagacactctggaaat

SEQ ID NO: 58062 - DNA, 25 bp, Rattus norvegicus
aatcacttgaagtcactctggaaat

SEQ ID NO: 58063 - DNA, 25 bp, Rattus norvegicus
aatcacttgccaatcatgagcctca

SEQ ID NO: 58064 - DNA, 25 bp, Rattus norvegicus
aatcacttgccattcatgagcctca

SEQ ID NO: 58065 - DNA, 25 bp, Rattus norvegicus
aatcacttgggacttatgcacacat

SEQ ID NO: 58066 - DNA, 25 bp, Rattus norvegicus
aatcacttgggagttatgcacacat

SEQ ID NO: 58067 - DNA, 25 bp, Rattus norvegicus
aatcactttactctccaaggacttc

SEQ ID NO: 58068 - DNA, 25 bp, Rattus norvegicus
aatcactttactgtccaaggacttc

SEQ ID NO: 58069 - DNA, 25 bp, Rattus norvegicus
aatcactttataaccctttagagtc

SEQ ID NO: 58070 - DNA, 25 bp, Rattus norvegicus
aatcactttatatccctttagagtc

SEQ ID NO: 58071 - DNA, 25 bp, Rattus norvegicus
aatcactttgaacccaggagtctga

SEQ ID NO: 58072 - DNA, 25 bp, Rattus norvegicus
aatcactttgaagccaggagtctga

SEQ ID NO: 58073 - DNA, 25 bp, Rattus norvegicus
aatcactttgccctggcggaagttg

SEQ ID NO: 58074 - DNA, 25 bp, Rattus norvegicus
aatcactttgccgtggcggaagttg

SEQ ID NO: 58075 - DNA, 25 bp, Rattus norvegicus
aatcactttgttccgtggtgggaca

SEQ ID NO: 58076 - DNA, 25 bp, Rattus norvegicus
aatcactttgttgcgtggtgggaca

SEQ ID NO: 58077 - DNA, 25 bp, Rattus norvegicus
aatcacttttttcctcttccagtat

SEQ ID NO: 58078 - DNA, 25 bp, Rattus norvegicus
aatcacttttttgctcttccagtat

SEQ ID NO: 58079 - DNA, 25 bp, Rattus norvegicus
aatcagaaacctccgttgtggcaga

SEQ ID NO: 58080 - DNA, 25 bp, Rattus norvegicus
aatcagaaacctgcgttgtggcaga

SEQ ID NO: 58081 - DNA, 25 bp, Rattus norvegicus
aatcagaaagtccaccctaaccagg

SEQ ID NO: 58082 - DNA, 25 bp, Rattus norvegicus
aatcagaaagtcgaccctaaccagg

SEQ ID NO: 58083 - DNA, 25 bp, Rattus norvegicus
aatcagaacctgcaagagggtgcct

SEQ ID NO: 58084 - DNA, 25 bp, Rattus norvegicus
aatcagaacctggaagagggtgcct

SEQ ID NO: 58085 - DNA, 25 bp, Rattus norvegicus
aatcagaagcacaggcctttctaca

SEQ ID NO: 58086 - DNA, 25 bp, Rattus norvegicus
aatcagaagcactggcctttctaca

SEQ ID NO: 58087 - DNA, 25 bp, Rattus norvegicus
aatcagaagcagactttctttcctt

SEQ ID NO: 58088 - DNA, 25 bp, Rattus norvegicus
aatcagaagcagtctttctttcctt

SEQ ID NO: 58089 - DNA, 25 bp, Rattus norvegicus
aatcagaagcggctgttcctccgtg

SEQ ID NO: 58090 - DNA, 25 bp, Rattus norvegicus
aatcagaagcgggtgttcctccgtg

SEQ ID NO: 58091 - DNA, 25 bp, Rattus norvegicus
aatcagaagtgcagctgtctcccag

SEQ ID NO: 58092 - DNA, 25 bp, Rattus norvegicus
aatcagaagtgctgctgtctcccag

SEQ ID NO: 58093 - DNA, 25 bp, Rattus norvegicus
aatcagaattccatcatggtttgaa

SEQ ID NO: 58094 - DNA, 25 bp, Rattus norvegicus
aatcagaattccttcatggtttgaa

SEQ ID NO: 58095 - DNA, 25 bp, Rattus norvegicus
aatcagacagtactagccagggaat

SEQ ID NO: 58096 - DNA, 25 bp, Rattus norvegicus
aatcagacagtagtagccagggaat

SEQ ID NO: 58097 - DNA, 25 bp, Rattus norvegicus
aatcagaccccaatgaagctcaaca

SEQ ID NO: 58098 - DNA, 25 bp, Rattus norvegicus
aatcagaccccattgaagctcaaca

SEQ ID NO: 58099 - DNA, 25 bp, Rattus norvegicus
aatcagacggtgaacttgtccttca

SEQ ID NO: 58100 - DNA, 25 bp, Rattus norvegicus
aatcagacggtgtacttgtccttca

SEQ ID NO: 58101 - DNA, 25 bp, Rattus norvegicus
aatcagactgcgatcattcacactc

SEQ ID NO: 58102 - DNA, 25 bp, Rattus norvegicus
aatcagactgcgttcattcacactc

SEQ ID NO: 58103 - DNA, 25 bp, Rattus norvegicus
aatcagagacacctggtttcaccct

SEQ ID NO: 58104 - DNA, 25 bp, Rattus norvegicus
aatcagagacacgtggtttcaccct

SEQ ID NO: 58105 - DNA, 25 bp, Rattus norvegicus
aatcagagagcacggacaccattat

SEQ ID NO: 58106 - DNA, 25 bp, Rattus norvegicus
aatcagagagcagggacaccattat

SEQ ID NO: 58107 - DNA, 25 bp, Rattus norvegicus
aatcagagccctagcaaaattggtt

SEQ ID NO: 58108 - DNA, 25 bp, Rattus norvegicus
aatcagagcccttgcaaaattggtt

SEQ ID NO: 58109 - DNA, 25 bp, Rattus norvegicus
aatcagagctcacgctgctgttctg

SEQ ID NO: 58110 - DNA, 25 bp, Rattus norvegicus
aatcagagctcaggctgctgttctg

SEQ ID NO: 58111 - DNA, 25 bp, Rattus norvegicus
aatcagaggagacacttaatttttt

SEQ ID NO: 58112 - DNA, 25 bp, Rattus norvegicus
aatcagaggagagacttaatttttt

SEQ ID NO: 58113 - DNA, 25 bp, Rattus norvegicus
aatcagaggtgcagtgtggccaccc

SEQ ID NO: 58114 - DNA, 25 bp, Rattus norvegicus
aatcagaggtgctgtgtggccaccc

SEQ ID NO: 58115 - DNA, 25 bp, Rattus norvegicus
aatcagagtctcagtttctccgtct

SEQ ID NO: 58116 - DNA, 25 bp, Rattus norvegicus
aatcagagtctctgtttctccgtct

SEQ ID NO: 58117 - DNA, 25 bp, Rattus norvegicus
aatcagatctgtctcccttttagct

SEQ ID NO: 58118 - DNA, 25 bp, Rattus norvegicus
aatcagatctgtgtcccttttagct

SEQ ID NO: 58119 - DNA, 25 bp, Rattus norvegicus
aatcagatggtccatctcatcccaa

SEQ ID NO: 58120 - DNA, 25 bp, Rattus norvegicus
aatcagatggtcgatctcatcccaa

SEQ ID NO: 58121 - DNA, 25 bp, Rattus norvegicus
aatcagatgtctacctgaggcgcac

SEQ ID NO: 58122 - DNA, 25 bp, Rattus norvegicus
aatcagatgtcttcctgaggcgcac

SEQ ID NO: 58123 - DNA, 25 bp, Rattus norvegicus
aatcagattgatcatcctcctcata

SEQ ID NO: 58124 - DNA, 25 bp, Rattus norvegicus
aatcagattgatgatcctcctcata

SEQ ID NO: 58125 - DNA, 25 bp, Rattus norvegicus
aatcagatttggctgcattgtaaca

SEQ ID NO: 58126 - DNA, 25 bp, Rattus norvegicus
aatcagatttgggtgcattgtaaca

SEQ ID NO: 58127 - DNA, 25 bp, Rattus norvegicus
aatcagcaccgaccctcgctttgag

SEQ ID NO: 58128 - DNA, 25 bp, Rattus norvegicus
aatcagcaccgagcctcgctttgag

SEQ ID NO: 58129 - DNA, 25 bp, Rattus norvegicus
aatcagcactgcattgccttgggat

SEQ ID NO: 58130 - DNA, 25 bp, Rattus norvegicus
aatcagcactgctttgccttgggat

SEQ ID NO: 58131 - DNA, 25 bp, Rattus norvegicus
aatcagcagcacagcaatcacgtct

SEQ ID NO: 58132 - DNA, 25 bp, Rattus norvegicus
aatcagcagcactgcaatcacgtct

SEQ ID NO: 58133 - DNA, 25 bp, Rattus norvegicus
aatcagcaggccaaaatccgcaatt

SEQ ID NO: 58134 - DNA, 25 bp, Rattus norvegicus
aatcagcaggcctaaatccgcaatt

SEQ ID NO: 58135 - DNA, 25 bp, Rattus norvegicus
aatcagcaggtaagccccagtggga

SEQ ID NO: 58136 - DNA, 25 bp, Rattus norvegicus
aatcagcaggtatgccccagtggga

SEQ ID NO: 58137 - DNA, 25 bp, Rattus norvegicus
aatcagcatcgcagtccattagcat

SEQ ID NO: 58138 - DNA, 25 bp, Rattus norvegicus
aatcagcatcgctgtccattagcat

SEQ ID NO: 58139 - DNA, 25 bp, Rattus norvegicus
aatcagcatgtactctcaggacgcc

SEQ ID NO: 58140 - DNA, 25 bp, Rattus norvegicus
aatcagcatgtagtctcaggacgcc

SEQ ID NO: 58141 - DNA, 25 bp, Rattus norvegicus
aatcagccaaaactcacacagtcag

SEQ ID NO: 58142 - DNA, 25 bp, Rattus norvegicus
aatcagccaaaagtcacacagtcag

SEQ ID NO: 58143 - DNA, 25 bp, Rattus norvegicus
aatcagccaatgacttatgcaaaac

SEQ ID NO: 58144 - DNA, 25 bp, Rattus norvegicus
aatcagccaatgtcttatgcaaaac

SEQ ID NO: 58145 - DNA, 25 bp, Rattus norvegicus
aatcagccagttcttctccggtgag

SEQ ID NO: 58146 - DNA, 25 bp, Rattus norvegicus
aatcagccagttgttctccggtgag

SEQ ID NO: 58147 - DNA, 25 bp, Rattus norvegicus
aatcagccatttaagacaattccct

SEQ ID NO: 58148 - DNA, 25 bp, Rattus norvegicus
aatcagccattttagacaattccct

SEQ ID NO: 58149 - DNA, 25 bp, Rattus norvegicus
aatcagcccgccaatgtgctgcaga

SEQ ID NO: 58150 - DNA, 25 bp, Rattus norvegicus
aatcagcccgcctatgtgctgcaga

SEQ ID NO: 58151 - DNA, 25 bp, Rattus norvegicus
aatcagcccttcagctctgaggttg

SEQ ID NO: 58152 - DNA, 25 bp, Rattus norvegicus
aatcagcccttctgctctgaggttg

SEQ ID NO: 58153 - DNA, 25 bp, Rattus norvegicus
aatcagcctcagcagtctgtatgga

SEQ ID NO: 58154 - DNA, 25 bp, Rattus norvegicus
aatcagcctcaggagtctgtatgga

SEQ ID NO: 58155 - DNA, 25 bp, Rattus norvegicus
aatcagcctctgatccgcagtgatc

SEQ ID NO: 58156 - DNA, 25 bp, Rattus norvegicus
aatcagcctctgttccgcagtgatc

SEQ ID NO: 58157 - DNA, 25 bp, Rattus norvegicus
aatcagcctgtcaggatgaagccat

SEQ ID NO: 58158 - DNA, 25 bp, Rattus norvegicus
aatcagcctgtctggatgaagccat

SEQ ID NO: 58159 - DNA, 25 bp, Rattus norvegicus
aatcagccttacagttctaatacgg

SEQ ID NO: 58160 - DNA, 25 bp, Rattus norvegicus
aatcagccttactgttctaatacgg

SEQ ID NO: 58161 - DNA, 25 bp, Rattus norvegicus
aatcagcgtctaccatcgggaggga

SEQ ID NO: 58162 - DNA, 25 bp, Rattus norvegicus
aatcagcgtctagcatcgggaggga

SEQ ID NO: 58163 - DNA, 25 bp, Rattus norvegicus
aatcagctcatcatgctgtgcactc

SEQ ID NO: 58164 - DNA, 25 bp, Rattus norvegicus
aatcagctcatcttgctgtgcactc

SEQ ID NO: 58165 - DNA, 25 bp, Rattus norvegicus
aatcagctcatgcagtacgaccagt

SEQ ID NO: 58166 - DNA, 25 bp, Rattus norvegicus
aatcagctcatggagtacgaccagt

SEQ ID NO: 58167 - DNA, 25 bp, Rattus norvegicus
aatcagctccggaacggtgcctgca

SEQ ID NO: 58168 - DNA, 25 bp, Rattus norvegicus
aatcagctccggtacggtgcctgca

SEQ ID NO: 58169 - DNA, 25 bp, Rattus norvegicus
aatcagctcttgctctcaatacaac

SEQ ID NO: 58170 - DNA, 25 bp, Rattus norvegicus
aatcagctcttggtctcaatacaac

SEQ ID NO: 58171 - DNA, 25 bp, Rattus norvegicus
aatcagctgcggctgtaccaggaga

SEQ ID NO: 58172 - DNA, 25 bp, Rattus norvegicus
aatcagctgcgggtgtaccaggaga

SEQ ID NO: 58173 - DNA, 25 bp, Rattus norvegicus
aatcagctggcacacaacaaacaat

SEQ ID NO: 58174 - DNA, 25 bp, Rattus norvegicus
aatcagctggcagacaacaaacaat

SEQ ID NO: 58175 - DNA, 25 bp, Rattus norvegicus
aatcagctggtgatttacctgccag

SEQ ID NO: 58176 - DNA, 25 bp, Rattus norvegicus
aatcagctggtgttttacctgccag

SEQ ID NO: 58177 - DNA, 25 bp, Rattus norvegicus
aatcagcttaatatccaacaaggag

SEQ ID NO: 58178 - DNA, 25 bp, Rattus norvegicus
aatcagcttaatttccaacaaggag

SEQ ID NO: 58179 - DNA, 25 bp, Rattus norvegicus
aatcagcttatcacaaccatcacaa

SEQ ID NO: 58180 - DNA, 25 bp, Rattus norvegicus
aatcagcttatctcaaccatcacaa

SEQ ID NO: 58181 - DNA, 25 bp, Rattus norvegicus
aatcagcttcagagtgcttatgttt

SEQ ID NO: 58182 - DNA, 25 bp, Rattus norvegicus
aatcagcttcagtgtgcttatgttt

SEQ ID NO: 58183 - DNA, 25 bp, Rattus norvegicus
aatcagcttctccatttaatcttgc

SEQ ID NO: 58184 - DNA, 25 bp, Rattus norvegicus
aatcagcttctcgatttaatcttgc

SEQ ID NO: 58185 - DNA, 25 bp, Rattus norvegicus
aatcagcttgaacacactactggag

SEQ ID NO: 58186 - DNA, 25 bp, Rattus norvegicus
aatcagcttgaagacactactggag

SEQ ID NO: 58187 - DNA, 25 bp, Rattus norvegicus
aatcagcttgttagtgcttccagag

SEQ ID NO: 58188 - DNA, 25 bp, Rattus norvegicus
aatcagcttgtttgtgcttccagag

SEQ ID NO: 58189 - DNA, 25 bp, Rattus norvegicus
aatcaggaacagaccgttgcgagca

SEQ ID NO: 58190 - DNA, 25 bp, Rattus norvegicus
aatcaggaacagtccgttgcgagca

SEQ ID NO: 58191 - DNA, 25 bp, Rattus norvegicus
aatcaggaagctcctgcgaacgcct

SEQ ID NO: 58192 - DNA, 25 bp, Rattus norvegicus
aatcaggaagctgctgcgaacgcct

SEQ ID NO: 58193 - DNA, 25 bp, Rattus norvegicus
aatcaggagccaaaccagaggtcaa

SEQ ID NO: 58194 - DNA, 25 bp, Rattus norvegicus
aatcaggagccataccagaggtcaa

SEQ ID NO: 58195 - DNA, 25 bp, Rattus norvegicus
aatcaggagggcaagccgctgcctg

SEQ ID NO: 58196 - DNA, 25 bp, Rattus norvegicus
aatcaggagggctagccgctgcctg

SEQ ID NO: 58197 - DNA, 25 bp, Rattus norvegicus
aatcaggaggtgagttctccccaat

SEQ ID NO: 58198 - DNA, 25 bp, Rattus norvegicus
aatcaggaggtgtgttctccccaat

SEQ ID NO: 58199 - DNA, 25 bp, Rattus norvegicus
aatcaggatcgcacccagagacaaa

SEQ ID NO: 58200 - DNA, 25 bp, Rattus norvegicus
aatcaggatcgctcccagagacaaa

SEQ ID NO: 58201 - DNA, 25 bp, Rattus norvegicus
aatcaggcagtcagggttgtcaatc

SEQ ID NO: 58202 - DNA, 25 bp, Rattus norvegicus
aatcaggcagtctgggttgtcaatc

SEQ ID NO: 58203 - DNA, 25 bp, Rattus norvegicus
aatcaggccctaccatagtcgtgtg

SEQ ID NO: 58204 - DNA, 25 bp, Rattus norvegicus
aatcaggccctagcatagtcgtgtg

SEQ ID NO: 58205 - DNA, 25 bp, Rattus norvegicus
aatcaggcggacagtgttcacttct

SEQ ID NO: 58206 - DNA, 25 bp, Rattus norvegicus
aatcaggcggactgtgttcacttct

SEQ ID NO: 58207 - DNA, 25 bp, Rattus norvegicus
aatcaggctgagacatttgaggcta

SEQ ID NO: 58208 - DNA, 25 bp, Rattus norvegicus
aatcaggctgagtcatttgaggcta

SEQ ID NO: 58209 - DNA, 25 bp, Rattus norvegicus
aatcagggaagacgctgctcttggc

SEQ ID NO: 58210 - DNA, 25 bp, Rattus norvegicus
aatcagggaagaggctgctcttggc

SEQ ID NO: 58211 - DNA, 25 bp, Rattus norvegicus
aatcagggatgtatgtaatttgcca

SEQ ID NO: 58212 - DNA, 25 bp, Rattus norvegicus
aatcagggatgtttgtaatttgcca

SEQ ID NO: 58213 - DNA, 25 bp, Rattus norvegicus
aatcagggcagtaactaggcgtgaa

SEQ ID NO: 58214 - DNA, 25 bp, Rattus norvegicus
aatcagggcagttactaggcgtgaa

SEQ ID NO: 58215 - DNA, 25 bp, Rattus norvegicus
aatcagggctgaccctgccatgacc

SEQ ID NO: 58216 - DNA, 25 bp, Rattus norvegicus
aatcagggctgacttcttactgtct

SEQ ID NO: 58217 - DNA, 25 bp, Rattus norvegicus
aatcagggctgagcctgccatgacc

SEQ ID NO: 58218 - DNA, 25 bp, Rattus norvegicus
aatcagggctgagttcttactgtct

SEQ ID NO: 58219 - DNA, 25 bp, Rattus norvegicus
aatcagggtttaatcatgtcctaat

SEQ ID NO: 58220 - DNA, 25 bp, Rattus norvegicus
aatcagggtttattcatgtcctaat

SEQ ID NO: 58221 - DNA, 25 bp, Rattus norvegicus
aatcaggtacatactcaagtcaaaa

SEQ ID NO: 58222 - DNA, 25 bp, Rattus norvegicus
aatcaggtacattctcaagtcaaaa

SEQ ID NO: 58223 - DNA, 25 bp, Rattus norvegicus
aatcaggtattcctggttgttttat

SEQ ID NO: 58224 - DNA, 25 bp, Rattus norvegicus
aatcaggtattcgtggttgttttat

SEQ ID NO: 58225 - DNA, 25 bp, Rattus norvegicus
aatcaggtgtttcttccacgaacct

SEQ ID NO: 58226 - DNA, 25 bp, Rattus norvegicus
aatcaggtgtttgttccacgaacct

SEQ ID NO: 58227 - DNA, 25 bp, Rattus norvegicus
aatcaggttattagcattgctccca

SEQ ID NO: 58228 - DNA, 25 bp, Rattus norvegicus
aatcaggttatttgcattgctccca

SEQ ID NO: 58229 - DNA, 25 bp, Rattus norvegicus
aatcaggttcacctgctgtgtggca

SEQ ID NO: 58230 - DNA, 25 bp, Rattus norvegicus
aatcaggttcacgtgctgtgtggca

SEQ ID NO: 58231 - DNA, 25 bp, Rattus norvegicus
aatcaggttctgctcacttggacat

SEQ ID NO: 58232 - DNA, 25 bp, Rattus norvegicus
aatcaggttctggtcacttggacat

SEQ ID NO: 58233 - DNA, 25 bp, Rattus norvegicus
aatcaggttttcacttacactgcca

SEQ ID NO: 58234 - DNA, 25 bp, Rattus norvegicus
aatcaggttttctcttacactgcca

SEQ ID NO: 58235 - DNA, 25 bp, Rattus norvegicus
aatcaggtttttcttgtcagccctc

SEQ ID NO: 58236 - DNA, 25 bp, Rattus norvegicus
aatcaggtttttgttgtcagccctc

SEQ ID NO: 58237 - DNA, 25 bp, Rattus norvegicus
aatcagtaaaccagtctttgcagac

SEQ ID NO: 58238 - DNA, 25 bp, Rattus norvegicus
aatcagtaaacctgtctttgcagac

SEQ ID NO: 58239 - DNA, 25 bp, Rattus norvegicus
aatcagtaacccatcagttagcctc

SEQ ID NO: 58240 - DNA, 25 bp, Rattus norvegicus
aatcagtaacccttcagttagcctc

SEQ ID NO: 58241 - DNA, 25 bp, Rattus norvegicus
aatcagtaatggcagtgacgtggct

SEQ ID NO: 58242 - DNA, 25 bp, Rattus norvegicus
aatcagtaatgggagtgacgtggct

SEQ ID NO: 58243 - DNA, 25 bp, Rattus norvegicus
aatcagtagcatcacagcgcccaat

SEQ ID NO: 58244 - DNA, 25 bp, Rattus norvegicus
aatcagtagcatgacagcgcccaat

SEQ ID NO: 58245 - DNA, 25 bp, Rattus norvegicus
aatcagtagctcatggtcattctct

SEQ ID NO: 58246 - DNA, 25 bp, Rattus norvegicus
aatcagtagctcttggtcattctct

SEQ ID NO: 58247 - DNA, 25 bp, Rattus norvegicus
aatcagtaggcgcagcttaacccca

SEQ ID NO: 58248 - DNA, 25 bp, Rattus norvegicus
aatcagtaggcggagcttaacccca

SEQ ID NO: 58249 - DNA, 25 bp, Rattus norvegicus
aatcagtagtccaaaatccattcat

SEQ ID NO: 58250 - DNA, 25 bp, Rattus norvegicus
aatcagtagtcctaaatccattcat

SEQ ID NO: 58251 - DNA, 25 bp, Rattus norvegicus
aatcagtatgccacaatttagatag

SEQ ID NO: 58252 - DNA, 25 bp, Rattus norvegicus
aatcagtatgcctcaatttagatag

SEQ ID NO: 58253 - DNA, 25 bp, Rattus norvegicus
aatcagtcgattcagaggagcccat

SEQ ID NO: 58254 - DNA, 25 bp, Rattus norvegicus
aatcagtcgattgagaggagcccat

SEQ ID NO: 58255 - DNA, 25 bp, Rattus norvegicus
aatcagtctatgctctacttcgtcc

SEQ ID NO: 58256 - DNA, 25 bp, Rattus norvegicus
aatcagtctatggtctacttcgtcc

SEQ ID NO: 58257 - DNA, 25 bp, Rattus norvegicus
aatcagtctgagctgtctgacacag

SEQ ID NO: 58258 - DNA, 25 bp, Rattus norvegicus
aatcagtctgaggtgtctgacacag

SEQ ID NO: 58259 - DNA, 25 bp, Rattus norvegicus
aatcagtcttgtagcccagtgccct

SEQ ID NO: 58260 - DNA, 25 bp, Rattus norvegicus
aatcagtcttgttgcccagtgccct

SEQ ID NO: 58261 - DNA, 25 bp, Rattus norvegicus
aatcagtgagtcagtggcctgtgcc

SEQ ID NO: 58262 - DNA, 25 bp, Rattus norvegicus
aatcagtgagtctgtggcctgtgcc

SEQ ID NO: 58263 - DNA, 25 bp, Rattus norvegicus
aatcagtgattgaacccacataggt

SEQ ID NO: 58264 - DNA, 25 bp, Rattus norvegicus
aatcagtgattgtacccacataggt

SEQ ID NO: 58265 - DNA, 25 bp, Rattus norvegicus
aatcagtgccgcatcgtgacgggcc

SEQ ID NO: 58266 - DNA, 25 bp, Rattus norvegicus
aatcagtgccgcttcgtgacgggcc

SEQ ID NO: 58267 - DNA, 25 bp, Rattus norvegicus
aatcagtgcctaattctcctgggaa

SEQ ID NO: 58268 - DNA, 25 bp, Rattus norvegicus
aatcagtgcctatttctcctgggaa

SEQ ID NO: 58269 - DNA, 25 bp, Rattus norvegicus
aatcagtgtacaagagaggccacat

SEQ ID NO: 58270 - DNA, 25 bp, Rattus norvegicus
aatcagtgtacatgagaggccacat

SEQ ID NO: 58271 - DNA, 25 bp, Rattus norvegicus
aatcagtgtcagatagcttcatgtg

SEQ ID NO: 58272 - DNA, 25 bp, Rattus norvegicus
aatcagtgtcagttagcttcatgtg

SEQ ID NO: 58273 - DNA, 25 bp, Rattus norvegicus
aatcagtgtttcctctgggttccaa

SEQ ID NO: 58274 - DNA, 25 bp, Rattus norvegicus
aatcagtgtttcgtctgggttccaa

SEQ ID NO: 58275 - DNA, 25 bp, Rattus norvegicus
aatcagttaggaactcaacctcctc

SEQ ID NO: 58276 - DNA, 25 bp, Rattus norvegicus
aatcagttaggatctcaacctcctc

SEQ ID NO: 58277 - DNA, 25 bp, Rattus norvegicus
aatcagttatccaatctcggatccc

SEQ ID NO: 58278 - DNA, 25 bp, Rattus norvegicus
aatcagttatcctatctcggatccc

SEQ ID NO: 58279 - DNA, 25 bp, Rattus norvegicus
aatcagttcaggaccatcgggcaca

SEQ ID NO: 58280 - DNA, 25 bp, Rattus norvegicus
aatcagttcaggtccatcgggcaca

SEQ ID NO: 58281 - DNA, 25 bp, Rattus norvegicus
aatcagttctgcatccagttcactt

SEQ ID NO: 58282 - DNA, 25 bp, Rattus norvegicus
aatcagttctgcttccagttcactt

SEQ ID NO: 58283 - DNA, 25 bp, Rattus norvegicus
aatcagttgcttcgctctggttggg

SEQ ID NO: 58284 - DNA, 25 bp, Rattus norvegicus
aatcagttgcttcttcgtacggagt

SEQ ID NO: 58285 - DNA, 25 bp, Rattus norvegicus
aatcagttgcttggctctggttggg

SEQ ID NO: 58286 - DNA, 25 bp, Rattus norvegicus
aatcagttgcttgttcgtacggagt

SEQ ID NO: 58287 - DNA, 25 bp, Rattus norvegicus
aatcagttgtccatgtatggtgagt

SEQ ID NO: 58288 - DNA, 25 bp, Rattus norvegicus
aatcagttgtccttgtatggtgagt

SEQ ID NO: 58289 - DNA, 25 bp, Rattus norvegicus
aatcagtttagccatttcccaagtc

SEQ ID NO: 58290 - DNA, 25 bp, Rattus norvegicus
aatcagtttagcgatttcccaagtc

SEQ ID NO: 58291 - DNA, 25 bp, Rattus norvegicus
aatcagtttcagctttgcaggcagc

SEQ ID NO: 58292 - DNA, 25 bp, Rattus norvegicus
aatcagtttcaggtttgcaggcagc

SEQ ID NO: 58293 - DNA, 25 bp, Rattus norvegicus
aatcagtttccgagtgctccacctc

SEQ ID NO: 58294 - DNA, 25 bp, Rattus norvegicus
aatcagtttccgtgtgctccacctc

SEQ ID NO: 58295 - DNA, 25 bp, Rattus norvegicus
aatcagtttcctcgagtctgtcgga

SEQ ID NO: 58296 - DNA, 25 bp, Rattus norvegicus
aatcagtttcctggagtctgtcgga

SEQ ID NO: 58297 - DNA, 25 bp, Rattus norvegicus
aatcagttttacatcccagttcagc

SEQ ID NO: 58298 - DNA, 25 bp, Rattus norvegicus
aatcagttttacttcccagttcagc

SEQ ID NO: 58299 - DNA, 25 bp, Rattus norvegicus
aatcagttttccaatgcagttgcct

SEQ ID NO: 58300 - DNA, 25 bp, Rattus norvegicus
aatcagttttcctatgcagttgcct

SEQ ID NO: 58301 - DNA, 25 bp, Rattus norvegicus
aatcagttttttctatggcaataaa

SEQ ID NO: 58302 - DNA, 25 bp, Rattus norvegicus
aatcagttttttgtatggcaataaa

SEQ ID NO: 58303 - DNA, 25 bp, Rattus norvegicus
aatcataaaaagaggactgcagaga

SEQ ID NO: 58304 - DNA, 25 bp, Rattus norvegicus
aatcataaaaagtggactgcagaga

SEQ ID NO: 58305 - DNA, 25 bp, Rattus norvegicus
aatcataattccagtgctgtctacc

SEQ ID NO: 58306 - DNA, 25 bp, Rattus norvegicus
aatcataattcctgtgctgtctacc

SEQ ID NO: 58307 - DNA, 25 bp, Rattus norvegicus
aatcatacagctcgttcatgccttc

SEQ ID NO: 58308 - DNA, 25 bp, Rattus norvegicus
aatcatacagctggttcatgccttc

SEQ ID NO: 58309 - DNA, 25 bp, Rattus norvegicus
aatcatacctgacacactgccagtc

SEQ ID NO: 58310 - DNA, 25 bp, Rattus norvegicus
aatcatacctgagacactgccagtc

SEQ ID NO: 58311 - DNA, 25 bp, Rattus norvegicus
aatcatactttcaggcttacttttg

SEQ ID NO: 58312 - DNA, 25 bp, Rattus norvegicus
aatcatactttctggcttacttttg

SEQ ID NO: 58313 - DNA, 25 bp, Rattus norvegicus
aatcatagaaggctggttgcgacca

SEQ ID NO: 58314 - DNA, 25 bp, Rattus norvegicus
aatcatagaagggtggttgcgacca

SEQ ID NO: 58315 - DNA, 25 bp, Rattus norvegicus
aatcatagcagtccatttctacccg

SEQ ID NO: 58316 - DNA, 25 bp, Rattus norvegicus
aatcatagcagtgcatttctacccg

SEQ ID NO: 58317 - DNA, 25 bp, Rattus norvegicus
aatcatatgcccaaatgccttaagt

SEQ ID NO: 58318 - DNA, 25 bp, Rattus norvegicus
aatcatatgccctaatgccttaagt

SEQ ID NO: 58319 - DNA, 25 bp, Rattus norvegicus
aatcatatgtccagagccaaagctc

SEQ ID NO: 58320 - DNA, 25 bp, Rattus norvegicus
aatcatatgtcctgagccaaagctc

SEQ ID NO: 58321 - DNA, 25 bp, Rattus norvegicus
aatcatattggccttctctttgtga

SEQ ID NO: 58322 - DNA, 25 bp, Rattus norvegicus
aatcatattggcgttctctttgtga

SEQ ID NO: 58323 - DNA, 25 bp, Rattus norvegicus
aatcatcaagacaatgtccgcccca

SEQ ID NO: 58324 - DNA, 25 bp, Rattus norvegicus
aatcatcaagactatgtccgcccca

SEQ ID NO: 58325 - DNA, 25 bp, Rattus norvegicus
aatcatcacaggagttggttagcag

SEQ ID NO: 58326 - DNA, 25 bp, Rattus norvegicus
aatcatcacaggtgttggttagcag

SEQ ID NO: 58327 - DNA, 25 bp, Rattus norvegicus
aatcatcaccggagaggacaggccc

SEQ ID NO: 58328 - DNA, 25 bp, Rattus norvegicus
aatcatcaccggtgaggacaggccc

SEQ ID NO: 58329 - DNA, 25 bp, Rattus norvegicus
aatcatcattaaaattaggatcaga

SEQ ID NO: 58330 - DNA, 25 bp, Rattus norvegicus
aatcatcattaatattaggatcaga

SEQ ID NO: 58331 - DNA, 25 bp, Rattus norvegicus
aatcatccagagatgtgacctccac

SEQ ID NO: 58332 - DNA, 25 bp, Rattus norvegicus
aatcatccagagttgtgacctccac

SEQ ID NO: 58333 - DNA, 25 bp, Rattus norvegicus
aatcatccatgtactggacgtggca

SEQ ID NO: 58334 - DNA, 25 bp, Rattus norvegicus
aatcatccatgttctggacgtggca

SEQ ID NO: 58335 - DNA, 25 bp, Rattus norvegicus
aatcatcccacgcaatgcctgagga

SEQ ID NO: 58336 - DNA, 25 bp, Rattus norvegicus
aatcatcccacggaatgcctgagga

SEQ ID NO: 58337 - DNA, 25 bp, Rattus norvegicus
aatcatcccagactgctctatggag

SEQ ID NO: 58338 - DNA, 25 bp, Rattus norvegicus
aatcatcccagagtgctctatggag

SEQ ID NO: 58339 - DNA, 25 bp, Rattus norvegicus
aatcatcccgacacttgtctttttg

SEQ ID NO: 58340 - DNA, 25 bp, Rattus norvegicus
aatcatcccgactcttgtctttttg

SEQ ID NO: 58341 - DNA, 25 bp, Rattus norvegicus
aatcatccggatcgtgtgttacgat

SEQ ID NO: 58342 - DNA, 25 bp, Rattus norvegicus
aatcatccggatggtgtgttacgat

SEQ ID NO: 58343 - DNA, 25 bp, Rattus norvegicus
aatcatcctaggcttgggcagtctt

SEQ ID NO: 58344 - DNA, 25 bp, Rattus norvegicus
aatcatcctagggttgggcagtctt

SEQ ID NO: 58345 - DNA, 25 bp, Rattus norvegicus
aatcatcctcggctttggcctgtgg

SEQ ID NO: 58346 - DNA, 25 bp, Rattus norvegicus
aatcatcctcgggtttggcctgtgg

SEQ ID NO: 58347 - DNA, 25 bp, Rattus norvegicus
aatcatcctgatcaattgctctggg

SEQ ID NO: 58348 - DNA, 25 bp, Rattus norvegicus
aatcatcctgatgaattgctctggg

SEQ ID NO: 58349 - DNA, 25 bp, Rattus norvegicus
aatcatcctgtgacatacctggtgt

SEQ ID NO: 58350 - DNA, 25 bp, Rattus norvegicus
aatcatcctgtgtcatacctggtgt

SEQ ID NO: 58351 - DNA, 25 bp, Rattus norvegicus
aatcatccttaaattttgacgcaag

SEQ ID NO: 58352 - DNA, 25 bp, Rattus norvegicus
aatcatccttaatttttgacgcaag

SEQ ID NO: 58353 - DNA, 25 bp, Rattus norvegicus
aatcatccttccaggtagctgccat

SEQ ID NO: 58354 - DNA, 25 bp, Rattus norvegicus
aatcatccttcctggtagctgccat

SEQ ID NO: 58355 - DNA, 25 bp, Rattus norvegicus
aatcatcgccatcgaccgccggtgg

SEQ ID NO: 58356 - DNA, 25 bp, Rattus norvegicus
aatcatcgccatggaccgccggtgg

SEQ ID NO: 58357 - DNA, 25 bp, Rattus norvegicus
aatcatcgttacactggaaaccaga

SEQ ID NO: 58358 - DNA, 25 bp, Rattus norvegicus
aatcatcgttactctggaaaccaga

SEQ ID NO: 58359 - DNA, 25 bp, Rattus norvegicus
aatcatcgttatacttaatagtcaa

SEQ ID NO: 58360 - DNA, 25 bp, Rattus norvegicus
aatcatcgttattcttaatagtcaa

SEQ ID NO: 58361 - DNA, 25 bp, Rattus norvegicus
aatcatctcctcatagaaaatgtga

SEQ ID NO: 58362 - DNA, 25 bp, Rattus norvegicus
aatcatctcctcttagaaaatgtga

SEQ ID NO: 58363 - DNA, 25 bp, Rattus norvegicus
aatcatctgcagagacacactacca

SEQ ID NO: 58364 - DNA, 25 bp, Rattus norvegicus
aatcatctgcagtgacacactacca

SEQ ID NO: 58365 - DNA, 25 bp, Rattus norvegicus
aatcatctgtgaacttggtgccctc

SEQ ID NO: 58366 - DNA, 25 bp, Rattus norvegicus
aatcatctgtgatcttggtgccctc

SEQ ID NO: 58367 - DNA, 25 bp, Rattus norvegicus
aatcatcttaccctagtctgtcagg

SEQ ID NO: 58368 - DNA, 25 bp, Rattus norvegicus
aatcatcttaccgtagtctgtcagg

SEQ ID NO: 58369 - DNA, 25 bp, Rattus norvegicus
aatcatcttgagctgttgcctccac

SEQ ID NO: 58370 - DNA, 25 bp, Rattus norvegicus
aatcatcttgaggtgttgcctccac

SEQ ID NO: 58371 - DNA, 25 bp, Rattus norvegicus
aatcatcttggaattgtgtcccatt

SEQ ID NO: 58372 - DNA, 25 bp, Rattus norvegicus
aatcatcttggatttgtgtcccatt

SEQ ID NO: 58373 - DNA, 25 bp, Rattus norvegicus
aatcatgactcacccacacgtttgg

SEQ ID NO: 58374 - DNA, 25 bp, Rattus norvegicus
aatcatgactcagccacacgtttgg

SEQ ID NO: 58375 - DNA, 25 bp, Rattus norvegicus
aatcatgactgtccctctgcaggga

SEQ ID NO: 58376 - DNA, 25 bp, Rattus norvegicus
aatcatgactgtgcctctgcaggga

SEQ ID NO: 58377 - DNA, 25 bp, Rattus norvegicus
aatcatgaggctatctcctgtatag

SEQ ID NO: 58378 - DNA, 25 bp, Rattus norvegicus
aatcatgaggctttctcctgtatag

SEQ ID NO: 58379 - DNA, 25 bp, Rattus norvegicus
aatcatgagtacctgggttcaatcc

SEQ ID NO: 58380 - DNA, 25 bp, Rattus norvegicus
aatcatgagtacgtgggttcaatcc

SEQ ID NO: 58381 - DNA, 25 bp, Rattus norvegicus
aatcatgatcatccttctgaagcta

SEQ ID NO: 58382 - DNA, 25 bp, Rattus norvegicus
aatcatgatcatgcttctgaagcta

SEQ ID NO: 58383 - DNA, 25 bp, Rattus norvegicus
aatcatgatttcctgtcacctgaac

SEQ ID NO: 58384 - DNA, 25 bp, Rattus norvegicus
aatcatgatttcgtgtcacctgaac

SEQ ID NO: 58385 - DNA, 25 bp, Rattus norvegicus
aatcatgcaaagatcttttgccaca

SEQ ID NO: 58386 - DNA, 25 bp, Rattus norvegicus
aatcatgcaaagttcttttgccaca

SEQ ID NO: 58387 - DNA, 25 bp, Rattus norvegicus
aatcatgcacacatgtacatacgta

SEQ ID NO: 58388 - DNA, 25 bp, Rattus norvegicus
aatcatgcacacttgtacatacgta

SEQ ID NO: 58389 - DNA, 25 bp, Rattus norvegicus
aatcatgcagtgactgtgttgatga

SEQ ID NO: 58390 - DNA, 25 bp, Rattus norvegicus
aatcatgcagtgtctgtgttgatga

SEQ ID NO: 58391 - DNA, 25 bp, Rattus norvegicus
aatcatgccatgattctctgtagag

SEQ ID NO: 58392 - DNA, 25 bp, Rattus norvegicus
aatcatgccatgtttctctgtagag

SEQ ID NO: 58393 - DNA, 25 bp, Rattus norvegicus
aatcatgcgagtccccaaaggatac

SEQ ID NO: 58394 - DNA, 25 bp, Rattus norvegicus
aatcatgcgagtgcccaaaggatac

SEQ ID NO: 58395 - DNA, 25 bp, Rattus norvegicus
aatcatgcgcggatatagggccgag

SEQ ID NO: 58396 - DNA, 25 bp, Rattus norvegicus
aatcatgcgcggttatagggccgag

SEQ ID NO: 58397 - DNA, 25 bp, Rattus norvegicus
aatcatgctatgaccttggctttga

SEQ ID NO: 58398 - DNA, 25 bp, Rattus norvegicus
aatcatgctatgtccttggctttga

SEQ ID NO: 58399 - DNA, 25 bp, Rattus norvegicus
aatcatgctgaactgtagagcttct

SEQ ID NO: 58400 - DNA, 25 bp, Rattus norvegicus
aatcatgctgaagtgtagagcttct

SEQ ID NO: 58401 - DNA, 25 bp, Rattus norvegicus
aatcatgctgtcaaaggacatctag

SEQ ID NO: 58402 - DNA, 25 bp, Rattus norvegicus
aatcatgctgtctaaggacatctag

SEQ ID NO: 58403 - DNA, 25 bp, Rattus norvegicus
aatcatgcttccatatcagtgatag

SEQ ID NO: 58404 - DNA, 25 bp, Rattus norvegicus
aatcatgcttccttatcagtgatag

SEQ ID NO: 58405 - DNA, 25 bp, Rattus norvegicus
aatcatgcttgcaagaagcccagag

SEQ ID NO: 58406 - DNA, 25 bp, Rattus norvegicus
aatcatgcttgctagaagcccagag

SEQ ID NO: 58407 - DNA, 25 bp, Rattus norvegicus
aatcatggaaacagggactttgccc

SEQ ID NO: 58408 - DNA, 25 bp, Rattus norvegicus
aatcatggaaactgggactttgccc

SEQ ID NO: 58409 - DNA, 25 bp, Rattus norvegicus
aatcatggaccgcaacacctgcaat

SEQ ID NO: 58410 - DNA, 25 bp, Rattus norvegicus
aatcatggaccggaacacctgcaat

SEQ ID NO: 58411 - DNA, 25 bp, Rattus norvegicus
aatcatggactcaggcttcttgctg

SEQ ID NO: 58412 - DNA, 25 bp, Rattus norvegicus
aatcatggactctggcttcttgctg

SEQ ID NO: 58413 - DNA, 25 bp, Rattus norvegicus
aatcatggaggacctggccacctgc

SEQ ID NO: 58414 - DNA, 25 bp, Rattus norvegicus
aatcatggaggagctggccacctgc

SEQ ID NO: 58415 - DNA, 25 bp, Rattus norvegicus
aatcatggcatcatcgtactctaat

SEQ ID NO: 58416 - DNA, 25 bp, Rattus norvegicus
aatcatggcatcttcgtactctaat

SEQ ID NO: 58417 - DNA, 25 bp, Rattus norvegicus
aatcatggcattatctgctcctttc

SEQ ID NO: 58418 - DNA, 25 bp, Rattus norvegicus
aatcatggcattttctgctcctttc

SEQ ID NO: 58419 - DNA, 25 bp, Rattus norvegicus
aatcatggcggaagctgtgtgctgt

SEQ ID NO: 58420 - DNA, 25 bp, Rattus norvegicus
aatcatggcggatgctgtgtgctgt

SEQ ID NO: 58421 - DNA, 25 bp, Rattus norvegicus
aatcatggctgtcttctggacttaa

SEQ ID NO: 58422 - DNA, 25 bp, Rattus norvegicus
aatcatggctgtgttctggacttaa

SEQ ID NO: 58423 - DNA, 25 bp, Rattus norvegicus
aatcatggctttctaatcacccagc

SEQ ID NO: 58424 - DNA, 25 bp, Rattus norvegicus
aatcatggctttgtaatcacccagc

SEQ ID NO: 58425 - DNA, 25 bp, Rattus norvegicus
aatcatggtcccaggccgtaagcat

SEQ ID NO: 58426 - DNA, 25 bp, Rattus norvegicus
aatcatggtccctggccgtaagcat

SEQ ID NO: 58427 - DNA, 25 bp, Rattus norvegicus
aatcatggtgacaaaggtcccattt

SEQ ID NO: 58428 - DNA, 25 bp, Rattus norvegicus
aatcatggtgactaaggtcccattt

SEQ ID NO: 58429 - DNA, 25 bp, Rattus norvegicus
aatcatggtgtgcttcccagggaca

SEQ ID NO: 58430 - DNA, 25 bp, Rattus norvegicus
aatcatggtgtggttcccagggaca

SEQ ID NO: 58431 - DNA, 25 bp, Rattus norvegicus
aatcatggttttctgtctgtctttg

SEQ ID NO: 58432 - DNA, 25 bp, Rattus norvegicus
aatcatggttttgtgtctgtctttg

SEQ ID NO: 58433 - DNA, 25 bp, Rattus norvegicus
aatcatgtaaccaattatcatggat

SEQ ID NO: 58434 - DNA, 25 bp, Rattus norvegicus
aatcatgtaacctattatcatggat

SEQ ID NO: 58435 - DNA, 25 bp, Rattus norvegicus
aatcatgtcatcaacctgtaccgtt

SEQ ID NO: 58436 - DNA, 25 bp, Rattus norvegicus
aatcatgtcatctacctgtaccgtt

SEQ ID NO: 58437 - DNA, 25 bp, Rattus norvegicus
aatcatgtctaaacatgctgaactg

SEQ ID NO: 58438 - DNA, 25 bp, Rattus norvegicus
aatcatgtctaatcatgctgaactg

SEQ ID NO: 58439 - DNA, 25 bp, Rattus norvegicus
aatcatgtctatccacatcgtggcg

SEQ ID NO: 58440 - DNA, 25 bp, Rattus norvegicus
aatcatgtctatgcacatcgtggcg

SEQ ID NO: 58441 - DNA, 25 bp, Rattus norvegicus
aatcatgtctccctacatagtctag

SEQ ID NO: 58442 - DNA, 25 bp, Rattus norvegicus
aatcatgtctccgtacatagtctag

SEQ ID NO: 58443 - DNA, 25 bp, Rattus norvegicus
aatcatgtctctcaaactgtgtcaa

SEQ ID NO: 58444 - DNA, 25 bp, Rattus norvegicus
aatcatgtctctgaaactgtgtcaa

SEQ ID NO: 58445 - DNA, 25 bp, Rattus norvegicus
aatcatgtgacaacctgttttcagt

SEQ ID NO: 58446 - DNA, 25 bp, Rattus norvegicus
aatcatgtgacatcctgttttcagt

SEQ ID NO: 58447 - DNA, 25 bp, Rattus norvegicus
aatcatgtgctaccacgtccagcaa

SEQ ID NO: 58448 - DNA, 25 bp, Rattus norvegicus
aatcatgtgctagcacgtccagcaa

SEQ ID NO: 58449 - DNA, 25 bp, Rattus norvegicus
aatcatgtgctgagggcctccagag

SEQ ID NO: 58450 - DNA, 25 bp, Rattus norvegicus
aatcatgtgctgtgggcctccagag

SEQ ID NO: 58451 - DNA, 25 bp, Rattus norvegicus
aatcatgtggttcgtgggactcttc

SEQ ID NO: 58452 - DNA, 25 bp, Rattus norvegicus
aatcatgtggttggtgggactcttc

SEQ ID NO: 58453 - DNA, 25 bp, Rattus norvegicus
aatcatgttcacatgtaaccttatg

SEQ ID NO: 58454 - DNA, 25 bp, Rattus norvegicus
aatcatgttcacttgtaaccttatg

SEQ ID NO: 58455 - DNA, 25 bp, Rattus norvegicus
aatcatgttgctacatgtgctgctc

SEQ ID NO: 58456 - DNA, 25 bp, Rattus norvegicus
aatcatgttgcttcatgtgctgctc

SEQ ID NO: 58457 - DNA, 25 bp, Rattus norvegicus
aatcattacaaaacgtctctcccca

SEQ ID NO: 58458 - DNA, 25 bp, Rattus norvegicus
aatcattacaaatcgtctctcccca

SEQ ID NO: 58459 - DNA, 25 bp, Rattus norvegicus
aatcattacggcagcttctgtttgt

SEQ ID NO: 58460 - DNA, 25 bp, Rattus norvegicus
aatcattacggctgcttctgtttgt

SEQ ID NO: 58461 - DNA, 25 bp, Rattus norvegicus
aatcattatctaattctttgggctg

SEQ ID NO: 58462 - DNA, 25 bp, Rattus norvegicus
aatcattatctatttctttgggctg

SEQ ID NO: 58463 - DNA, 25 bp, Rattus norvegicus
aatcattcaaggcagagataatcta

SEQ ID NO: 58464 - DNA, 25 bp, Rattus norvegicus
aatcattcaagggagagataatcta

SEQ ID NO: 58465 - DNA, 25 bp, Rattus norvegicus
aatcattcatttctgaggcattcaa

SEQ ID NO: 58466 - DNA, 25 bp, Rattus norvegicus
aatcattcatttgtgaggcattcaa

SEQ ID NO: 58467 - DNA, 25 bp, Rattus norvegicus
aatcattcctggacacgggtgttga

SEQ ID NO: 58468 - DNA, 25 bp, Rattus norvegicus
aatcattcctggtcacgggtgttga

SEQ ID NO: 58469 - DNA, 25 bp, Rattus norvegicus
aatcattcgtctacgttgctgttac

SEQ ID NO: 58470 - DNA, 25 bp, Rattus norvegicus
aatcattcgtcttcgttgctgttac

SEQ ID NO: 58471 - DNA, 25 bp, Rattus norvegicus
aatcattctaggacggtgttctcac

SEQ ID NO: 58472 - DNA, 25 bp, Rattus norvegicus
aatcattctaggtcggtgttctcac

SEQ ID NO: 58473 - DNA, 25 bp, Rattus norvegicus
aatcattctctacgcgttggttggt

SEQ ID NO: 58474 - DNA, 25 bp, Rattus norvegicus
aatcattctctaggcgttggttggt

SEQ ID NO: 58475 - DNA, 25 bp, Rattus norvegicus
aatcattctgaacgcttagctcaag

SEQ ID NO: 58476 - DNA, 25 bp, Rattus norvegicus
aatcattctgaaggcttagctcaag

SEQ ID NO: 58477 - DNA, 25 bp, Rattus norvegicus
aatcattctgtgagctttggcccca

SEQ ID NO: 58478 - DNA, 25 bp, Rattus norvegicus
aatcattctgtgaggtgctgcccaa

SEQ ID NO: 58479 - DNA, 25 bp, Rattus norvegicus
aatcattctgtgtgctttggcccca

SEQ ID NO: 58480 - DNA, 25 bp, Rattus norvegicus
aatcattctgtgtggtgctgcccaa

SEQ ID NO: 58481 - DNA, 25 bp, Rattus norvegicus
aatcattctttcctacagttctttg

SEQ ID NO: 58482 - DNA, 25 bp, Rattus norvegicus
aatcattctttcgtacagttctttg

SEQ ID NO: 58483 - DNA, 25 bp, Rattus norvegicus
aatcattgaccccattccttggtgt

SEQ ID NO: 58484 - DNA, 25 bp, Rattus norvegicus
aatcattgacccgattccttggtgt

SEQ ID NO: 58485 - DNA, 25 bp, Rattus norvegicus
aatcattgcattacatcctcaaggg

SEQ ID NO: 58486 - DNA, 25 bp, Rattus norvegicus
aatcattgcatttcatcctcaaggg

SEQ ID NO: 58487 - DNA, 25 bp, Rattus norvegicus
aatcattgcctgaggagagcttgtc

SEQ ID NO: 58488 - DNA, 25 bp, Rattus norvegicus
aatcattgcctgtggagagcttgtc

SEQ ID NO: 58489 - DNA, 25 bp, Rattus norvegicus
aatcattgctagattattttcagtt

SEQ ID NO: 58490 - DNA, 25 bp, Rattus norvegicus
aatcattgctagtttattttcagtt

SEQ ID NO: 58491 - DNA, 25 bp, Rattus norvegicus
aatcattgctgtaaggttttccata

SEQ ID NO: 58492 - DNA, 25 bp, Rattus norvegicus
aatcattgctgtcaccatccaaggg

SEQ ID NO: 58493 - DNA, 25 bp, Rattus norvegicus
aatcattgctgtgaccatccaaggg

SEQ ID NO: 58494 - DNA, 25 bp, Rattus norvegicus
aatcattgctgttaggttttccata

SEQ ID NO: 58495 - DNA, 25 bp, Rattus norvegicus
aatcattgttatactggctctcctg

SEQ ID NO: 58496 - DNA, 25 bp, Rattus norvegicus
aatcattgttattctggctctcctg

SEQ ID NO: 58497 - DNA, 25 bp, Rattus norvegicus
aatcattgttgtatcgtagtcctaa

SEQ ID NO: 58498 - DNA, 25 bp, Rattus norvegicus
aatcattgttgtttcgtagtcctaa

SEQ ID NO: 58499 - DNA, 25 bp, Rattus norvegicus
aatcatttaaccctctacatgccct

SEQ ID NO: 58500 - DNA, 25 bp, Rattus norvegicus
aatcatttaaccgtctacatgccct

SEQ ID NO: 58501 - DNA, 25 bp, Rattus norvegicus
aatcatttacggagtgtgcgtgccc

SEQ ID NO: 58502 - DNA, 25 bp, Rattus norvegicus
aatcatttacggtgtgtgcgtgccc

SEQ ID NO: 58503 - DNA, 25 bp, Rattus norvegicus
aatcatttatgcagcctacttctct

SEQ ID NO: 58504 - DNA, 25 bp, Rattus norvegicus
aatcatttatgctgcctacttctct

SEQ ID NO: 58505 - DNA, 25 bp, Rattus norvegicus
aatcatttatggcatcgcagtcaac

SEQ ID NO: 58506 - DNA, 25 bp, Rattus norvegicus
aatcatttatgggatcgcagtcaac

SEQ ID NO: 58507 - DNA, 25 bp, Rattus norvegicus
aatcatttccgtaatcctgaggcag

SEQ ID NO: 58508 - DNA, 25 bp, Rattus norvegicus
aatcatttccgttatcctgaggcag

SEQ ID NO: 58509 - DNA, 25 bp, Rattus norvegicus
aatcatttctccagtttaccagcca

SEQ ID NO: 58510 - DNA, 25 bp, Rattus norvegicus
aatcatttctcctgtttaccagcca

SEQ ID NO: 58511 - DNA, 25 bp, Rattus norvegicus
aatcatttctgaagtcctggagtgg

SEQ ID NO: 58512 - DNA, 25 bp, Rattus norvegicus
aatcatttctgatgtcctggagtgg

SEQ ID NO: 58513 - DNA, 25 bp, Rattus norvegicus
aatcatttcttcagacttgatcccc

SEQ ID NO: 58514 - DNA, 25 bp, Rattus norvegicus
aatcatttcttcagtttctccaacc

SEQ ID NO: 58515 - DNA, 25 bp, Rattus norvegicus
aatcatttcttctgacttgatcccc

SEQ ID NO: 58516 - DNA, 25 bp, Rattus norvegicus
aatcatttcttctgtttctccaacc

SEQ ID NO: 58517 - DNA, 25 bp, Rattus norvegicus
aatcatttgatgattcccacttctc

SEQ ID NO: 58518 - DNA, 25 bp, Rattus norvegicus
aatcatttgatgtttcccacttctc

SEQ ID NO: 58519 - DNA, 25 bp, Rattus norvegicus
aatcatttgctcatacctttaccag

SEQ ID NO: 58520 - DNA, 25 bp, Rattus norvegicus
aatcatttgctcttacctttaccag

SEQ ID NO: 58521 - DNA, 25 bp, Rattus norvegicus
aatcatttgcttcctttggtgtaaa

SEQ ID NO: 58522 - DNA, 25 bp, Rattus norvegicus
aatcatttgcttgctttggtgtaaa

SEQ ID NO: 58523 - DNA, 25 bp, Rattus norvegicus
aatcatttgttccactttccatgta

SEQ ID NO: 58524 - DNA, 25 bp, Rattus norvegicus
aatcatttgttcgactttccatgta

SEQ ID NO: 58525 - DNA, 25 bp, Rattus norvegicus
aatcattttggtattcagggtcctt

SEQ ID NO: 58526 - DNA, 25 bp, Rattus norvegicus
aatcattttggttttcagggtcctt

SEQ ID NO: 58527 - DNA, 25 bp, Rattus norvegicus
aatcatttttcaagtgccatttgtg

SEQ ID NO: 58528 - DNA, 25 bp, Rattus norvegicus
aatcatttttcatgtgccatttgtg

SEQ ID NO: 58529 - DNA, 25 bp, Rattus norvegicus
aatcatttttgtccttcagtttgta

SEQ ID NO: 58530 - DNA, 25 bp, Rattus norvegicus
aatcatttttgtctttactgaccat

SEQ ID NO: 58531 - DNA, 25 bp, Rattus norvegicus
aatcatttttgtgcttcagtttgta

SEQ ID NO: 58532 - DNA, 25 bp, Rattus norvegicus
aatcatttttgtgtttactgaccat

SEQ ID NO: 58533 - DNA, 25 bp, Rattus norvegicus
aatccaaactgcagtctctaagact

SEQ ID NO: 58534 - DNA, 25 bp, Rattus norvegicus
aatccaaactgctgtctctaagact

SEQ ID NO: 58535 - DNA, 25 bp, Rattus norvegicus
aatccaaagactagagtgcccctcc

SEQ ID NO: 58536 - DNA, 25 bp, Rattus norvegicus
aatccaaagacttgagtgcccctcc

SEQ ID NO: 58537 - DNA, 25 bp, Rattus norvegicus
aatccaaagccgacgaaccacgcgg

SEQ ID NO: 58538 - DNA, 25 bp, Rattus norvegicus
aatccaaagccgtcgaaccacgcgg

SEQ ID NO: 58539 - DNA, 25 bp, Rattus norvegicus
aatccaaagtcacaaaattcacgtt

SEQ ID NO: 58540 - DNA, 25 bp, Rattus norvegicus
aatccaaagtcagaaaattcacgtt

SEQ ID NO: 58541 - DNA, 25 bp, Rattus norvegicus
aatccaaagtgtccagcagcattct

SEQ ID NO: 58542 - DNA, 25 bp, Rattus norvegicus
aatccaaagtgtgcagcagcattct

SEQ ID NO: 58543 - DNA, 25 bp, Rattus norvegicus
aatccaaatcctagctttccatcag

SEQ ID NO: 58544 - DNA, 25 bp, Rattus norvegicus
aatccaaatccttgctttccatcag

SEQ ID NO: 58545 - DNA, 25 bp, Rattus norvegicus
aatccaaatttcagagttcttccaa

SEQ ID NO: 58546 - DNA, 25 bp, Rattus norvegicus
aatccaaatttctgagttcttccaa

SEQ ID NO: 58547 - DNA, 25 bp, Rattus norvegicus
aatccaacagggacagctacagcgc

SEQ ID NO: 58548 - DNA, 25 bp, Rattus norvegicus
aatccaacagggtcagctacagcgc

SEQ ID NO: 58549 - DNA, 25 bp, Rattus norvegicus
aatccaacgcagcttctcagaaaga

SEQ ID NO: 58550 - DNA, 25 bp, Rattus norvegicus
aatccaacgcaggttctcagaaaga

SEQ ID NO: 58551 - DNA, 25 bp, Rattus norvegicus
aatccaacggctatgcagggcagac

SEQ ID NO: 58552 - DNA, 25 bp, Rattus norvegicus
aatccaacggctttgcagggcagac

SEQ ID NO: 58553 - DNA, 25 bp, Rattus norvegicus
aatccaactcctagttttcagtaat

SEQ ID NO: 58554 - DNA, 25 bp, Rattus norvegicus
aatccaactccttgttttcagtaat

SEQ ID NO: 58555 - DNA, 25 bp, Rattus norvegicus
aatccaagaagccttgtgcctcagc

SEQ ID NO: 58556 - DNA, 25 bp, Rattus norvegicus
aatccaagaagcgttgtgcctcagc

SEQ ID NO: 58557 - DNA, 25 bp, Rattus norvegicus
aatccaagagttcctggccgatctg

SEQ ID NO: 58558 - DNA, 25 bp, Rattus norvegicus
aatccaagagttgctggccgatctg

SEQ ID NO: 58559 - DNA, 25 bp, Rattus norvegicus
aatccaagcatacctcgaggccttg

SEQ ID NO: 58560 - DNA, 25 bp, Rattus norvegicus
aatccaagcatagctcgaggccttg

SEQ ID NO: 58561 - DNA, 25 bp, Rattus norvegicus
aatccaaggattcaacacctgccag

SEQ ID NO: 58562 - DNA, 25 bp, Rattus norvegicus
aatccaaggattgaacacctgccag

SEQ ID NO: 58563 - DNA, 25 bp, Rattus norvegicus
aatccaaggcctatgagccctggga

SEQ ID NO: 58564 - DNA, 25 bp, Rattus norvegicus
aatccaaggcctttgagccctggga

SEQ ID NO: 58565 - DNA, 25 bp, Rattus norvegicus
aatccaaggtggatgccgtgtagta

SEQ ID NO: 58566 - DNA, 25 bp, Rattus norvegicus
aatccaaggtggttgccgtgtagta

SEQ ID NO: 58567 - DNA, 25 bp, Rattus norvegicus
aatccaagtcatatgcctacctaac

SEQ ID NO: 58568 - DNA, 25 bp, Rattus norvegicus
aatccaagtcatttgcctacctaac

SEQ ID NO: 58569 - DNA, 25 bp, Rattus norvegicus
aatccaagtcttcaggaggtgaaca

SEQ ID NO: 58570 - DNA, 25 bp, Rattus norvegicus
aatccaagtcttgaggaggtgaaca

SEQ ID NO: 58571 - DNA, 25 bp, Rattus norvegicus
aatccaagtgcaacacaagtctgtg

SEQ ID NO: 58572 - DNA, 25 bp, Rattus norvegicus
aatccaagtgcatcacaagtctgtg

SEQ ID NO: 58573 - DNA, 25 bp, Rattus norvegicus
aatccaatccagatgatcgctgctg

SEQ ID NO: 58574 - DNA, 25 bp, Rattus norvegicus
aatccaatccagttgatcgctgctg

SEQ ID NO: 58575 - DNA, 25 bp, Rattus norvegicus
aatccaatgaggagcttgaaaattc

SEQ ID NO: 58576 - DNA, 25 bp, Rattus norvegicus
aatccaatgaggtgcttgaaaattc

SEQ ID NO: 58577 - DNA, 25 bp, Rattus norvegicus
aatccaatgtagacgtgatccgcca

SEQ ID NO: 58578 - DNA, 25 bp, Rattus norvegicus
aatccaatgtagtcgtgatccgcca

SEQ ID NO: 58579 - DNA, 25 bp, Rattus norvegicus
aatccaatgtccacgatcagcagag

SEQ ID NO: 58580 - DNA, 25 bp, Rattus norvegicus
aatccaatgtcctcgatcagcagag

SEQ ID NO: 58581 - DNA, 25 bp, Rattus norvegicus
aatccacaaagcatcttgaagcccc

SEQ ID NO: 58582 - DNA, 25 bp, Rattus norvegicus
aatccacaaagcttcttgaagcccc

SEQ ID NO: 58583 - DNA, 25 bp, Rattus norvegicus
aatccacaacatctacagctccttt

SEQ ID NO: 58584 - DNA, 25 bp, Rattus norvegicus
aatccacaacatgtacagctccttt

SEQ ID NO: 58585 - DNA, 25 bp, Rattus norvegicus
aatccacaatatagagagccagcaa

SEQ ID NO: 58586 - DNA, 25 bp, Rattus norvegicus
aatccacaatattgagagccagcaa

SEQ ID NO: 58587 - DNA, 25 bp, Rattus norvegicus
aatccacacaatacatcatccacat

SEQ ID NO: 58588 - DNA, 25 bp, Rattus norvegicus
aatccacacaattcatcatccacat

SEQ ID NO: 58589 - DNA, 25 bp, Rattus norvegicus
aatccacacctaagcatgtacactc

SEQ ID NO: 58590 - DNA, 25 bp, Rattus norvegicus
aatccacacctatgcatgtacactc

SEQ ID NO: 58591 - DNA, 25 bp, Rattus norvegicus
aatccacagttgcagaccaattgca

SEQ ID NO: 58592 - DNA, 25 bp, Rattus norvegicus
aatccacagttggagaccaattgca

SEQ ID NO: 58593 - DNA, 25 bp, Rattus norvegicus
aatccaccagagcacttgtgcctgt

SEQ ID NO: 58594 - DNA, 25 bp, Rattus norvegicus
aatccaccagaggacttgtgcctgt

SEQ ID NO: 58595 - DNA, 25 bp, Rattus norvegicus
aatccacctctgacgattgtgcgga

SEQ ID NO: 58596 - DNA, 25 bp, Rattus norvegicus
aatccacctctgtcgattgtgcgga

SEQ ID NO: 58597 - DNA, 25 bp, Rattus norvegicus
aatccacctgagaggacctttccag

SEQ ID NO: 58598 - DNA, 25 bp, Rattus norvegicus
aatccacctgagtggacctttccag

SEQ ID NO: 58599 - DNA, 25 bp, Rattus norvegicus
aatccacgaggcatactacttgatg

SEQ ID NO: 58600 - DNA, 25 bp, Rattus norvegicus
aatccacgaggcttactacttgatg

SEQ ID NO: 58601 - DNA, 25 bp, Rattus norvegicus
aatccacgcgggacgcctgtagagg

SEQ ID NO: 58602 - DNA, 25 bp, Rattus norvegicus
aatccacgcgggtcgcctgtagagg

SEQ ID NO: 58603 - DNA, 25 bp, Rattus norvegicus
aatccacgttcacagaggccttaca

SEQ ID NO: 58604 - DNA, 25 bp, Rattus norvegicus
aatccacgttcagagaggccttaca

SEQ ID NO: 58605 - DNA, 25 bp, Rattus norvegicus
aatccactctgtatgctgaggctat

SEQ ID NO: 58606 - DNA, 25 bp, Rattus norvegicus
aatccactctgtttgctgaggctat

SEQ ID NO: 58607 - DNA, 25 bp, Rattus norvegicus
aatccactctttctcaacatgacag

SEQ ID NO: 58608 - DNA, 25 bp, Rattus norvegicus
aatccactctttgtcaacatgacag

SEQ ID NO: 58609 - DNA, 25 bp, Rattus norvegicus
aatccactgaccatgatctttgcaa

SEQ ID NO: 58610 - DNA, 25 bp, Rattus norvegicus
aatccactgaccttgatctttgcaa

SEQ ID NO: 58611 - DNA, 25 bp, Rattus norvegicus
aatccactggataaggcctgaatta

SEQ ID NO: 58612 - DNA, 25 bp, Rattus norvegicus
aatccactggattaggcctgaatta

SEQ ID NO: 58613 - DNA, 25 bp, Rattus norvegicus
aatccactttctagaatcatgtcag

SEQ ID NO: 58614 - DNA, 25 bp, Rattus norvegicus
aatccactttcttgaatcatgtcag

SEQ ID NO: 58615 - DNA, 25 bp, Rattus norvegicus
aatccagaaaggagtatcagatcag

SEQ ID NO: 58616 - DNA, 25 bp, Rattus norvegicus
aatccagaaaggtgtatcagatcag

SEQ ID NO: 58617 - DNA, 25 bp, Rattus norvegicus
aatccagaactgaccctgcacagat

SEQ ID NO: 58618 - DNA, 25 bp, Rattus norvegicus
aatccagaactgtccctgcacagat

SEQ ID NO: 58619 - DNA, 25 bp, Rattus norvegicus
aatccagaagacagggcgaggctcc

SEQ ID NO: 58620 - DNA, 25 bp, Rattus norvegicus
aatccagaagactgggcgaggctcc

SEQ ID NO: 58621 - DNA, 25 bp, Rattus norvegicus
aatccagaatgtacctatttccctg

SEQ ID NO: 58622 - DNA, 25 bp, Rattus norvegicus
aatccagaatgttcctatttccctg

SEQ ID NO: 58623 - DNA, 25 bp, Rattus norvegicus
aatccagacccactttggttttcag

SEQ ID NO: 58624 - DNA, 25 bp, Rattus norvegicus
aatccagacccagtttggttttcag

SEQ ID NO: 58625 - DNA, 25 bp, Rattus norvegicus
aatccagacgttctcaaacgctgct

SEQ ID NO: 58626 - DNA, 25 bp, Rattus norvegicus
aatccagacgttgtcaaacgctgct

SEQ ID NO: 58627 - DNA, 25 bp, Rattus norvegicus
aatccagagagcaaacaaagggttt

SEQ ID NO: 58628 - DNA, 25 bp, Rattus norvegicus
aatccagagagctaacaaagggttt

SEQ ID NO: 58629 - DNA, 25 bp, Rattus norvegicus
aatccagagcaaaatttagttcagc

SEQ ID NO: 58630 - DNA, 25 bp, Rattus norvegicus
aatccagagcaatatttagttcagc

SEQ ID NO: 58631 - DNA, 25 bp, Rattus norvegicus
aatccagaggttcgcatcttcgtca

SEQ ID NO: 58632 - DNA, 25 bp, Rattus norvegicus
aatccagaggttggcatcttcgtca

SEQ ID NO: 58633 - DNA, 25 bp, Rattus norvegicus
aatccagatcagcttagggtcgggc

SEQ ID NO: 58634 - DNA, 25 bp, Rattus norvegicus
aatccagatcaggttagggtcgggc

SEQ ID NO: 58635 - DNA, 25 bp, Rattus norvegicus
aatccagatgcacctgaaggacatt

SEQ ID NO: 58636 - DNA, 25 bp, Rattus norvegicus
aatccagatgcagctgaaggacatt

SEQ ID NO: 58637 - DNA, 25 bp, Rattus norvegicus
aatccagcagtacatggtgaccctg

SEQ ID NO: 58638 - DNA, 25 bp, Rattus norvegicus
aatccagcagtagatggtgaccctg

SEQ ID NO: 58639 - DNA, 25 bp, Rattus norvegicus
aatccagcatttccaagaccaagct

SEQ ID NO: 58640 - DNA, 25 bp, Rattus norvegicus
aatccagcatttcggaaaccaatgc

SEQ ID NO: 58641 - DNA, 25 bp, Rattus norvegicus
aatccagcatttgcaagaccaagct

SEQ ID NO: 58642 - DNA, 25 bp, Rattus norvegicus
aatccagcatttgggaaaccaatgc

SEQ ID NO: 58643 - DNA, 25 bp, Rattus norvegicus
aatccagccaataatttttatacag

SEQ ID NO: 58644 - DNA, 25 bp, Rattus norvegicus
aatccagccaattatttttatacag

SEQ ID NO: 58645 - DNA, 25 bp, Rattus norvegicus
aatccagcgaccagagggatgcgcc

SEQ ID NO: 58646 - DNA, 25 bp, Rattus norvegicus
aatccagcgacctgagggatgcgcc

SEQ ID NO: 58647 - DNA, 25 bp, Rattus norvegicus
aatccagctcttaaaaaagccttag

SEQ ID NO: 58648 - DNA, 25 bp, Rattus norvegicus
aatccagctcttcctcagagtagtg

SEQ ID NO: 58649 - DNA, 25 bp, Rattus norvegicus
aatccagctcttgctcagagtagtg

SEQ ID NO: 58650 - DNA, 25 bp, Rattus norvegicus
aatccagctctttaaaaagccttag

SEQ ID NO: 58651 - DNA, 25 bp, Rattus norvegicus
aatccagctttcctgaagccagaac

SEQ ID NO: 58652 - DNA, 25 bp, Rattus norvegicus
aatccagctttcgtgaagccagaac

SEQ ID NO: 58653 - DNA, 25 bp, Rattus norvegicus
aatccaggacctagcacatgagagt

SEQ ID NO: 58654 - DNA, 25 bp, Rattus norvegicus
aatccaggaccttgcacatgagagt

SEQ ID NO: 58655 - DNA, 25 bp, Rattus norvegicus
aatccaggagatccaatggcctttc

SEQ ID NO: 58656 - DNA, 25 bp, Rattus norvegicus
aatccaggagatgcaatggcctttc

SEQ ID NO: 58657 - DNA, 25 bp, Rattus norvegicus
aatccaggagtcaaaccactgctct

SEQ ID NO: 58658 - DNA, 25 bp, Rattus norvegicus
aatccaggagtctaaccactgctct

SEQ ID NO: 58659 - DNA, 25 bp, Rattus norvegicus
aatccaggatctagggtggcaccca

SEQ ID NO: 58660 - DNA, 25 bp, Rattus norvegicus
aatccaggatcttgggtggcaccca

SEQ ID NO: 58661 - DNA, 25 bp, Rattus norvegicus
aatccaggcaagactaggaatccaa

SEQ ID NO: 58662 - DNA, 25 bp, Rattus norvegicus
aatccaggcaagtctaggaatccaa

SEQ ID NO: 58663 - DNA, 25 bp, Rattus norvegicus
aatccaggcagcatcgagccttaga

SEQ ID NO: 58664 - DNA, 25 bp, Rattus norvegicus
aatccaggcagcttcgagccttaga

SEQ ID NO: 58665 - DNA, 25 bp, Rattus norvegicus
aatccaggcaggattagggtcaaga

SEQ ID NO: 58666 - DNA, 25 bp, Rattus norvegicus
aatccaggcaggtttagggtcaaga

SEQ ID NO: 58667 - DNA, 25 bp, Rattus norvegicus
aatccaggctaaagaaacccagcgc

SEQ ID NO: 58668 - DNA, 25 bp, Rattus norvegicus
aatccaggctaatgaaacccagcgc

SEQ ID NO: 58669 - DNA, 25 bp, Rattus norvegicus
aatccagggaatcctcagggatcga

SEQ ID NO: 58670 - DNA, 25 bp, Rattus norvegicus
aatccagggaatgctcagggatcga

SEQ ID NO: 58671 - DNA, 25 bp, Rattus norvegicus
aatccagggacactagagaggctaa

SEQ ID NO: 58672 - DNA, 25 bp, Rattus norvegicus
aatccagggacagtagagaggctaa

SEQ ID NO: 58673 - DNA, 25 bp, Rattus norvegicus
aatccagggatccaatcagatgcag

SEQ ID NO: 58674 - DNA, 25 bp, Rattus norvegicus
aatccagggatcgaatcagatgcag

SEQ ID NO: 58675 - DNA, 25 bp, Rattus norvegicus
aatccagggccacggcctgcttggc

SEQ ID NO: 58676 - DNA, 25 bp, Rattus norvegicus
aatccagggccagggcctgcttggc

SEQ ID NO: 58677 - DNA, 25 bp, Rattus norvegicus
aatccaggtattaacgaattagtgt

SEQ ID NO: 58678 - DNA, 25 bp, Rattus norvegicus
aatccaggtatttacgaattagtgt

SEQ ID NO: 58679 - DNA, 25 bp, Rattus norvegicus
aatccaggttttccatctgtagagc

SEQ ID NO: 58680 - DNA, 25 bp, Rattus norvegicus
aatccaggttttgcatctgtagagc

SEQ ID NO: 58681 - DNA, 25 bp, Rattus norvegicus
aatccagtcaacatcctatacccag

SEQ ID NO: 58682 - DNA, 25 bp, Rattus norvegicus
aatccagtcaacttcctatacccag

SEQ ID NO: 58683 - DNA, 25 bp, Rattus norvegicus
aatccagtctcaccgttttatacga

SEQ ID NO: 58684 - DNA, 25 bp, Rattus norvegicus
aatccagtctcagcgttttatacga

SEQ ID NO: 58685 - DNA, 25 bp, Rattus norvegicus
aatccagtctggctcctttacaagc

SEQ ID NO: 58686 - DNA, 25 bp, Rattus norvegicus
aatccagtctgggtcctttacaagc

SEQ ID NO: 58687 - DNA, 25 bp, Rattus norvegicus
aatccagtgcagattcgttgagtgt

SEQ ID NO: 58688 - DNA, 25 bp, Rattus norvegicus
aatccagtgcagtttcgttgagtgt

SEQ ID NO: 58689 - DNA, 25 bp, Rattus norvegicus
aatccagtgcctaatgccagaacag

SEQ ID NO: 58690 - DNA, 25 bp, Rattus norvegicus
aatccagtgccttatgccagaacag

SEQ ID NO: 58691 - DNA, 25 bp, Rattus norvegicus
aatccagtgctcatcgtgtattacc

SEQ ID NO: 58692 - DNA, 25 bp, Rattus norvegicus
aatccagtgctcttcgtgtattacc

SEQ ID NO: 58693 - DNA, 25 bp, Rattus norvegicus
aatccagtgctgagtaagcagaaac

SEQ ID NO: 58694 - DNA, 25 bp, Rattus norvegicus
aatccagtgctgctgggcattggca

SEQ ID NO: 58695 - DNA, 25 bp, Rattus norvegicus
aatccagtgctggtgggcattggca

SEQ ID NO: 58696 - DNA, 25 bp, Rattus norvegicus
aatccagtgctgtgtaagcagaaac

SEQ ID NO: 58697 - DNA, 25 bp, Rattus norvegicus
aatccagtgggaagctcaagcacct

SEQ ID NO: 58698 - DNA, 25 bp, Rattus norvegicus
aatccagtgggatgctcaagcacct

SEQ ID NO: 58699 - DNA, 25 bp, Rattus norvegicus
aatccagtgtcaatgtgtcttccag

SEQ ID NO: 58700 - DNA, 25 bp, Rattus norvegicus
aatccagtgtcattgtgtcttccag

SEQ ID NO: 58701 - DNA, 25 bp, Rattus norvegicus
aatccagtgtgaaattttgctccta

SEQ ID NO: 58702 - DNA, 25 bp, Rattus norvegicus
aatccagtgtgatattttgctccta

SEQ ID NO: 58703 - DNA, 25 bp, Rattus norvegicus
aatccagttctgacgtttgcttagt

SEQ ID NO: 58704 - DNA, 25 bp, Rattus norvegicus
aatccagttctgtcgtttgcttagt

SEQ ID NO: 58705 - DNA, 25 bp, Rattus norvegicus
aatccagttggcacatggagtcctt

SEQ ID NO: 58706 - DNA, 25 bp, Rattus norvegicus
aatccagttggctcatggagtcctt

SEQ ID NO: 58707 - DNA, 25 bp, Rattus norvegicus
aatccagttgtcaccagggctgtga

SEQ ID NO: 58708 - DNA, 25 bp, Rattus norvegicus
aatccagttgtctccagggctgtga

SEQ ID NO: 58709 - DNA, 25 bp, Rattus norvegicus
aatccagttgttaccaagtgtaggc

SEQ ID NO: 58710 - DNA, 25 bp, Rattus norvegicus
aatccagttgtttccaagtgtaggc

SEQ ID NO: 58711 - DNA, 25 bp, Rattus norvegicus
aatccagtttagagctttcaagtca

SEQ ID NO: 58712 - DNA, 25 bp, Rattus norvegicus
aatccagtttagtgctttcaagtca

SEQ ID NO: 58713 - DNA, 25 bp, Rattus norvegicus
aatccagtttctaagcactcatatg

SEQ ID NO: 58714 - DNA, 25 bp, Rattus norvegicus
aatccagtttcttagcactcatatg

SEQ ID NO: 58715 - DNA, 25 bp, Rattus norvegicus
aatccagttttgagacatcatcttg

SEQ ID NO: 58716 - DNA, 25 bp, Rattus norvegicus
aatccagttttgtgacatcatcttg

SEQ ID NO: 58717 - DNA, 25 bp, Rattus norvegicus
aatccataaatgcattgtgtctgag

SEQ ID NO: 58718 - DNA, 25 bp, Rattus norvegicus
aatccataaatggattgtgtctgag

SEQ ID NO: 58719 - DNA, 25 bp, Rattus norvegicus
aatccatagcgtattctcttacagg

SEQ ID NO: 58720 - DNA, 25 bp, Rattus norvegicus
aatccatagcgttttctcttacagg

SEQ ID NO: 58721 - DNA, 25 bp, Rattus norvegicus
aatccatagcttctttcttccagtt

SEQ ID NO: 58722 - DNA, 25 bp, Rattus norvegicus
aatccatagcttgtttcttccagtt

SEQ ID NO: 58723 - DNA, 25 bp, Rattus norvegicus
aatccatatgtgaacatgtgtgtat

SEQ ID NO: 58724 - DNA, 25 bp, Rattus norvegicus
aatccatatgtgtacatgtgtgtat

SEQ ID NO: 58725 - DNA, 25 bp, Rattus norvegicus
aatccatattgtacactagacccat

SEQ ID NO: 58726 - DNA, 25 bp, Rattus norvegicus
aatccatattgttcactagacccat

SEQ ID NO: 58727 - DNA, 25 bp, Rattus norvegicus
aatccatcagatacattcctgtctc

SEQ ID NO: 58728 - DNA, 25 bp, Rattus norvegicus
aatccatcagattcattcctgtctc

SEQ ID NO: 58729 - DNA, 25 bp, Rattus norvegicus
aatccatcaggcacgggaagcgatc

SEQ ID NO: 58730 - DNA, 25 bp, Rattus norvegicus
aatccatcaggctcgggaagcgatc

SEQ ID NO: 58731 - DNA, 25 bp, Rattus norvegicus
aatccatccaatcttcctggtctaa

SEQ ID NO: 58732 - DNA, 25 bp, Rattus norvegicus
aatccatccaatgttcctggtctaa

SEQ ID NO: 58733 - DNA, 25 bp, Rattus norvegicus
aatccatccctaagagcgatcatcc

SEQ ID NO: 58734 - DNA, 25 bp, Rattus norvegicus
aatccatccctatgagcgatcatcc

SEQ ID NO: 58735 - DNA, 25 bp, Rattus norvegicus
aatccatcggttattacagctttaa

SEQ ID NO: 58736 - DNA, 25 bp, Rattus norvegicus
aatccatcggtttttacagctttaa

SEQ ID NO: 58737 - DNA, 25 bp, Rattus norvegicus
aatccatctggaaagctgcggctgc

SEQ ID NO: 58738 - DNA, 25 bp, Rattus norvegicus
aatccatctggatagctgcggctgc

SEQ ID NO: 58739 - DNA, 25 bp, Rattus norvegicus
aatccatcttcacctgactgaatgt

SEQ ID NO: 58740 - DNA, 25 bp, Rattus norvegicus
aatccatcttcagctgactgaatgt

SEQ ID NO: 58741 - DNA, 25 bp, Rattus norvegicus
aatccatgacatcaactattgcatt

SEQ ID NO: 58742 - DNA, 25 bp, Rattus norvegicus
aatccatgacatgaactattgcatt

SEQ ID NO: 58743 - DNA, 25 bp, Rattus norvegicus
aatccatgagaaactgaggcttcag

SEQ ID NO: 58744 - DNA, 25 bp, Rattus norvegicus
aatccatgagaatctgaggcttcag

SEQ ID NO: 58745 - DNA, 25 bp, Rattus norvegicus
aatccatgatgacaggaggcaacat

SEQ ID NO: 58746 - DNA, 25 bp, Rattus norvegicus
aatccatgatgagaggaggcaacat

SEQ ID NO: 58747 - DNA, 25 bp, Rattus norvegicus
aatccatgattacctgcttctacag

SEQ ID NO: 58748 - DNA, 25 bp, Rattus norvegicus
aatccatgattagctgcttctacag

SEQ ID NO: 58749 - DNA, 25 bp, Rattus norvegicus
aatccatgattcaatcgcgtcgctg

SEQ ID NO: 58750 - DNA, 25 bp, Rattus norvegicus
aatccatgattctatcgcgtcgctg

SEQ ID NO: 58751 - DNA, 25 bp, Rattus norvegicus
aatccatggattcattcctttgagt

SEQ ID NO: 58752 - DNA, 25 bp, Rattus norvegicus
aatccatggattgattcctttgagt

SEQ ID NO: 58753 - DNA, 25 bp, Rattus norvegicus
aatccatggcctagtgtctcagcag

SEQ ID NO: 58754 - DNA, 25 bp, Rattus norvegicus
aatccatggccttgtgtctcagcag

SEQ ID NO: 58755 - DNA, 25 bp, Rattus norvegicus
aatccatgtgcgatctcagttctta

SEQ ID NO: 58756 - DNA, 25 bp, Rattus norvegicus
aatccatgtgcgttctcagttctta

SEQ ID NO: 58757 - DNA, 25 bp, Rattus norvegicus
aatccatgtggtcctttgctttgag

SEQ ID NO: 58758 - DNA, 25 bp, Rattus norvegicus
aatccatgtggtgctttgctttgag

SEQ ID NO: 58759 - DNA, 25 bp, Rattus norvegicus
aatccatgtgtcctccaaacagaaa

SEQ ID NO: 58760 - DNA, 25 bp, Rattus norvegicus
aatccatgtgtcgtccaaacagaaa

SEQ ID NO: 58761 - DNA, 25 bp, Rattus norvegicus
aatccatgttaactcttcacacaag

SEQ ID NO: 58762 - DNA, 25 bp, Rattus norvegicus
aatccatgttaagtcttcacacaag

SEQ ID NO: 58763 - DNA, 25 bp, Rattus norvegicus
aatccattagccatcaaatttagaa

SEQ ID NO: 58764 - DNA, 25 bp, Rattus norvegicus
aatccattagccttcaaatttagaa

SEQ ID NO: 58765 - DNA, 25 bp, Rattus norvegicus
aatccattagcgattctgaagtcct

SEQ ID NO: 58766 - DNA, 25 bp, Rattus norvegicus
aatccattagcgtttctgaagtcct

SEQ ID NO: 58767 - DNA, 25 bp, Rattus norvegicus
aatccattccctccatgagtcacag

SEQ ID NO: 58768 - DNA, 25 bp, Rattus norvegicus
aatccattccctgcatgagtcacag

SEQ ID NO: 58769 - DNA, 25 bp, Rattus norvegicus
aatccattctacatctattacttga

SEQ ID NO: 58770 - DNA, 25 bp, Rattus norvegicus
aatccattctacttctattacttga

SEQ ID NO: 58771 - DNA, 25 bp, Rattus norvegicus
aatccattctgaagagacccgggta

SEQ ID NO: 58772 - DNA, 25 bp, Rattus norvegicus
aatccattctgatgagacccgggta

SEQ ID NO: 58773 - DNA, 25 bp, Rattus norvegicus
aatccattctgcatgtcttctatag

SEQ ID NO: 58774 - DNA, 25 bp, Rattus norvegicus
aatccattctgcttgtcttctatag

SEQ ID NO: 58775 - DNA, 25 bp, Rattus norvegicus
aatccattgttgcagaagactcttg

SEQ ID NO: 58776 - DNA, 25 bp, Rattus norvegicus
aatccattgttggagaagactcttg

SEQ ID NO: 58777 - DNA, 25 bp, Rattus norvegicus
aatccatttataatcctttgcagtc

SEQ ID NO: 58778 - DNA, 25 bp, Rattus norvegicus
aatccatttatattcctttgcagtc

SEQ ID NO: 58779 - DNA, 25 bp, Rattus norvegicus
aatccatttattctaccatcctttg

SEQ ID NO: 58780 - DNA, 25 bp, Rattus norvegicus
aatccatttattgtaccatcctttg

SEQ ID NO: 58781 - DNA, 25 bp, Rattus norvegicus
aatccatttcatctatcagcactgc

SEQ ID NO: 58782 - DNA, 25 bp, Rattus norvegicus
aatccatttcatctgagggtacaaa

SEQ ID NO: 58783 - DNA, 25 bp, Rattus norvegicus
aatccatttcatctgcttgctaatg

SEQ ID NO: 58784 - DNA, 25 bp, Rattus norvegicus
aatccatttcatgtatcagcactgc

SEQ ID NO: 58785 - DNA, 25 bp, Rattus norvegicus
aatccatttcatgtgagggtacaaa

SEQ ID NO: 58786 - DNA, 25 bp, Rattus norvegicus
aatccatttcatgtgcttgctaatg

SEQ ID NO: 58787 - DNA, 25 bp, Rattus norvegicus
aatccatttggccagagtttcccag

SEQ ID NO: 58788 - DNA, 25 bp, Rattus norvegicus
aatccatttggcgagagtttcccag

SEQ ID NO: 58789 - DNA, 25 bp, Rattus norvegicus
aatccatttgggatggtggtgtaca

SEQ ID NO: 58790 - DNA, 25 bp, Rattus norvegicus
aatccatttgggttggtggtgtaca

SEQ ID NO: 58791 - DNA, 25 bp, Rattus norvegicus
aatccatttgtaatttcccaatcat

SEQ ID NO: 58792 - DNA, 25 bp, Rattus norvegicus
aatccatttgtattttcccaatcat

SEQ ID NO: 58793 - DNA, 25 bp, Rattus norvegicus
aatcccaaagatccagcactcaaag

SEQ ID NO: 58794 - DNA, 25 bp, Rattus norvegicus
aatcccaaagatgcagcactcaaag

SEQ ID NO: 58795 - DNA, 25 bp, Rattus norvegicus
aatcccaacttccagacgctgaagt

SEQ ID NO: 58796 - DNA, 25 bp, Rattus norvegicus
aatcccaacttcgagacgctgaagt

SEQ ID NO: 58797 - DNA, 25 bp, Rattus norvegicus
aatcccaagaatcgagggtatttgt

SEQ ID NO: 58798 - DNA, 25 bp, Rattus norvegicus
aatcccaagaatggagggtatttgt

SEQ ID NO: 58799 - DNA, 25 bp, Rattus norvegicus
aatcccaagagtcagctcggttctt

SEQ ID NO: 58800 - DNA, 25 bp, Rattus norvegicus
aatcccaagagtgagctcggttctt

SEQ ID NO: 58801 - DNA, 25 bp, Rattus norvegicus
aatcccaatagtcaataggcagaga

SEQ ID NO: 58802 - DNA, 25 bp, Rattus norvegicus
aatcccaatagtgaataggcagaga

SEQ ID NO: 58803 - DNA, 25 bp, Rattus norvegicus
aatcccaattgtcgccattttagtt

SEQ ID NO: 58804 - DNA, 25 bp, Rattus norvegicus
aatcccaattgtggccattttagtt

SEQ ID NO: 58805 - DNA, 25 bp, Rattus norvegicus
aatcccacgattatccggcagtgta

SEQ ID NO: 58806 - DNA, 25 bp, Rattus norvegicus
aatcccacgattttccggcagtgta

SEQ ID NO: 58807 - DNA, 25 bp, Rattus norvegicus
aatcccactgtgcaggtgctactgt

SEQ ID NO: 58808 - DNA, 25 bp, Rattus norvegicus
aatcccactgtggaggtgctactgt

SEQ ID NO: 58809 - DNA, 25 bp, Rattus norvegicus
aatcccagaaggaatcagtgacttg

SEQ ID NO: 58810 - DNA, 25 bp, Rattus norvegicus
aatcccagaaggtatcagtgacttg

SEQ ID NO: 58811 - DNA, 25 bp, Rattus norvegicus
aatcccagagtcacaaggttccaca

SEQ ID NO: 58812 - DNA, 25 bp, Rattus norvegicus
aatcccagagtcatctgccattgtg

SEQ ID NO: 58813 - DNA, 25 bp, Rattus norvegicus
aatcccagagtctcaaggttccaca

SEQ ID NO: 58814 - DNA, 25 bp, Rattus norvegicus
aatcccagagtcttctgccattgtg

SEQ ID NO: 58815 - DNA, 25 bp, Rattus norvegicus
aatcccagcaataccaggggccata

SEQ ID NO: 58816 - DNA, 25 bp, Rattus norvegicus
aatcccagcaattccaggggccata

SEQ ID NO: 58817 - DNA, 25 bp, Rattus norvegicus
aatcccagcagtcggcagattgagg

SEQ ID NO: 58818 - DNA, 25 bp, Rattus norvegicus
aatcccagcagtgggcagattgagg

SEQ ID NO: 58819 - DNA, 25 bp, Rattus norvegicus
aatcccagcatgcagaattcagaga

SEQ ID NO: 58820 - DNA, 25 bp, Rattus norvegicus
aatcccagcatggagaattcagaga

SEQ ID NO: 58821 - DNA, 25 bp, Rattus norvegicus
aatcccagcattctgccaaagccaa

SEQ ID NO: 58822 - DNA, 25 bp, Rattus norvegicus
aatcccagcattgtgccaaagccaa

SEQ ID NO: 58823 - DNA, 25 bp, Rattus norvegicus
aatcccagcctcctggaggtgtaga

SEQ ID NO: 58824 - DNA, 25 bp, Rattus norvegicus
aatcccagcctcgtggaggtgtaga

SEQ ID NO: 58825 - DNA, 25 bp, Rattus norvegicus
aatcccagcgccaaagacatcaaga

SEQ ID NO: 58826 - DNA, 25 bp, Rattus norvegicus
aatcccagcgcctaagacatcaaga

SEQ ID NO: 58827 - DNA, 25 bp, Rattus norvegicus
aatcccagctccacagaagactgag

SEQ ID NO: 58828 - DNA, 25 bp, Rattus norvegicus
aatcccagctcctcagaagactgag

SEQ ID NO: 58829 - DNA, 25 bp, Rattus norvegicus
aatcccaggaaccactagcagtagt

SEQ ID NO: 58830 - DNA, 25 bp, Rattus norvegicus
aatcccaggaacgactagcagtagt

SEQ ID NO: 58831 - DNA, 25 bp, Rattus norvegicus
aatcccaggagaatgctcggtggac

SEQ ID NO: 58832 - DNA, 25 bp, Rattus norvegicus
aatcccaggagattgctcggtggac

SEQ ID NO: 58833 - DNA, 25 bp, Rattus norvegicus
aatcccaggcttaaggatgctctag

SEQ ID NO: 58834 - DNA, 25 bp, Rattus norvegicus
aatcccaggctttaggatgctctag

SEQ ID NO: 58835 - DNA, 25 bp, Rattus norvegicus
aatcccagtaaccaggagcctcctg

SEQ ID NO: 58836 - DNA, 25 bp, Rattus norvegicus
aatcccagtaacgaggagcctcctg

SEQ ID NO: 58837 - DNA, 25 bp, Rattus norvegicus
aatcccagtattcagaagccagttc

SEQ ID NO: 58838 - DNA, 25 bp, Rattus norvegicus
aatcccagtattgagaagccagttc

SEQ ID NO: 58839 - DNA, 25 bp, Rattus norvegicus
aatcccagtgggatcttgttccctg

SEQ ID NO: 58840 - DNA, 25 bp, Rattus norvegicus
aatcccagtgggttcttgttccctg

SEQ ID NO: 58841 - DNA, 25 bp, Rattus norvegicus
aatcccatatcaagttgctcctggt

SEQ ID NO: 58842 - DNA, 25 bp, Rattus norvegicus
aatcccatatcatgttgctcctggt

SEQ ID NO: 58843 - DNA, 25 bp, Rattus norvegicus
aatcccatcatcagtggtggcatcc

SEQ ID NO: 58844 - DNA, 25 bp, Rattus norvegicus
aatcccatcatctgtggtggcatcc

SEQ ID NO: 58845 - DNA, 25 bp, Rattus norvegicus
aatcccatccccagatggattcttc

SEQ ID NO: 58846 - DNA, 25 bp, Rattus norvegicus
aatcccatcccctgatggattcttc

SEQ ID NO: 58847 - DNA, 25 bp, Rattus norvegicus
aatcccatcgctaacgtcatggaga

SEQ ID NO: 58848 - DNA, 25 bp, Rattus norvegicus
aatcccatcgcttacgtcatggaga

SEQ ID NO: 58849 - DNA, 25 bp, Rattus norvegicus
aatcccatctgacttacggttctga

SEQ ID NO: 58850 - DNA, 25 bp, Rattus norvegicus
aatcccatctgagttacggttctga

SEQ ID NO: 58851 - DNA, 25 bp, Rattus norvegicus
aatcccatggcaccagtggactgtg

SEQ ID NO: 58852 - DNA, 25 bp, Rattus norvegicus
aatcccatggcagcagtggactgtg

SEQ ID NO: 58853 - DNA, 25 bp, Rattus norvegicus
aatcccattccaaccatattataca

SEQ ID NO: 58854 - DNA, 25 bp, Rattus norvegicus
aatcccattccatccatattataca

SEQ ID NO: 58855 - DNA, 25 bp, Rattus norvegicus
aatcccattctcaattccatcagaa

SEQ ID NO: 58856 - DNA, 25 bp, Rattus norvegicus
aatcccattctctattccatcagaa

SEQ ID NO: 58857 - DNA, 25 bp, Rattus norvegicus
aatcccatttacatgctacattgcg

SEQ ID NO: 58858 - DNA, 25 bp, Rattus norvegicus
aatcccatttacttgctacattgcg

SEQ ID NO: 58859 - DNA, 25 bp, Rattus norvegicus
aatcccatttgtattttattttctg

SEQ ID NO: 58860 - DNA, 25 bp, Rattus norvegicus
aatcccatttgttttttattttctg

SEQ ID NO: 58861 - DNA, 25 bp, Rattus norvegicus
aatcccattttcaagagtcgcggtg

SEQ ID NO: 58862 - DNA, 25 bp, Rattus norvegicus
aatcccattttctagagtcgcggtg

SEQ ID NO: 58863 - DNA, 25 bp, Rattus norvegicus
aatccccaaaacactctcctggtgt

SEQ ID NO: 58864 - DNA, 25 bp, Rattus norvegicus
aatccccaaaactctctcctggtgt

SEQ ID NO: 58865 - DNA, 25 bp, Rattus norvegicus
aatccccaaaggacacagagcgcgt

SEQ ID NO: 58866 - DNA, 25 bp, Rattus norvegicus
aatccccaaaggtcacagagcgcgt

SEQ ID NO: 58867 - DNA, 25 bp, Rattus norvegicus
aatccccaacttagaccaaagcctg

SEQ ID NO: 58868 - DNA, 25 bp, Rattus norvegicus
aatccccaactttgaccaaagcctg

SEQ ID NO: 58869 - DNA, 25 bp, Rattus norvegicus
aatccccaagagctttgagtctgag

SEQ ID NO: 58870 - DNA, 25 bp, Rattus norvegicus
aatccccaagaggtttgagtctgag

SEQ ID NO: 58871 - DNA, 25 bp, Rattus norvegicus
aatccccaagctctgtgactcaact

SEQ ID NO: 58872 - DNA, 25 bp, Rattus norvegicus
aatccccaagctgtgtgactcaact

SEQ ID NO: 58873 - DNA, 25 bp, Rattus norvegicus
aatccccactgtctttgtgcatgtg

SEQ ID NO: 58874 - DNA, 25 bp, Rattus norvegicus
aatccccactgtgtttgtgcatgtg

SEQ ID NO: 58875 - DNA, 25 bp, Rattus norvegicus
aatccccagagcattgcacacactg

SEQ ID NO: 58876 - DNA, 25 bp, Rattus norvegicus
aatccccagagctttgcacacactg

SEQ ID NO: 58877 - DNA, 25 bp, Rattus norvegicus
aatccccagtgtaacatggtgatgc

SEQ ID NO: 58878 - DNA, 25 bp, Rattus norvegicus
aatccccagtgttacatggtgatgc

SEQ ID NO: 58879 - DNA, 25 bp, Rattus norvegicus
aatccccagtttcctaatagcctgg

SEQ ID NO: 58880 - DNA, 25 bp, Rattus norvegicus
aatccccagtttgctaatagcctgg

SEQ ID NO: 58881 - DNA, 25 bp, Rattus norvegicus
aatccccattatagtgtcagttcct

SEQ ID NO: 58882 - DNA, 25 bp, Rattus norvegicus
aatccccattattgtgtcagttcct

SEQ ID NO: 58883 - DNA, 25 bp, Rattus norvegicus
aatccccgaggtctctgggtgcaca

SEQ ID NO: 58884 - DNA, 25 bp, Rattus norvegicus
aatccccgaggtgtctgggtgcaca

SEQ ID NO: 58885 - DNA, 25 bp, Rattus norvegicus
aatccccgtggaacgtagttgtgga

SEQ ID NO: 58886 - DNA, 25 bp, Rattus norvegicus
aatccccgtggatcgtagttgtgga

SEQ ID NO: 58887 - DNA, 25 bp, Rattus norvegicus
aatccccgtgtgacgagagggctct

SEQ ID NO: 58888 - DNA, 25 bp, Rattus norvegicus
aatccccgtgtgtcgagagggctct

SEQ ID NO: 58889 - DNA, 25 bp, Rattus norvegicus
aatcccctacgacgagagggctgcg

SEQ ID NO: 58890 - DNA, 25 bp, Rattus norvegicus
aatcccctacgaggagagggctgcg

SEQ ID NO: 58891 - DNA, 25 bp, Rattus norvegicus
aatcccctattcagtctgccttaag

SEQ ID NO: 58892 - DNA, 25 bp, Rattus norvegicus
aatcccctattctgtctgccttaag

SEQ ID NO: 58893 - DNA, 25 bp, Rattus norvegicus
aatcccctggataaacatctacgcc

SEQ ID NO: 58894 - DNA, 25 bp, Rattus norvegicus
aatcccctggattaacatctacgcc

SEQ ID NO: 58895 - DNA, 25 bp, Rattus norvegicus
aatcccctgggccttgagagagaac

SEQ ID NO: 58896 - DNA, 25 bp, Rattus norvegicus
aatcccctgggcgttgagagagaac

SEQ ID NO: 58897 - DNA, 25 bp, Rattus norvegicus
aatcccctgtagctctttggtcaga

SEQ ID NO: 58898 - DNA, 25 bp, Rattus norvegicus
aatcccctgtaggtctttggtcaga

SEQ ID NO: 58899 - DNA, 25 bp, Rattus norvegicus
aatcccctttagctcctttaatcat

SEQ ID NO: 58900 - DNA, 25 bp, Rattus norvegicus
aatcccctttaggtcctttaatcat

SEQ ID NO: 58901 - DNA, 25 bp, Rattus norvegicus
aatcccgactaaatcatttcttaag

SEQ ID NO: 58902 - DNA, 25 bp, Rattus norvegicus
aatcccgactaattcatttcttaag

SEQ ID NO: 58903 - DNA, 25 bp, Rattus norvegicus
aatcccgcaatgcaggccaggagtc

SEQ ID NO: 58904 - DNA, 25 bp, Rattus norvegicus
aatcccgcaatggaggccaggagtc

SEQ ID NO: 58905 - DNA, 25 bp, Rattus norvegicus
aatcccgccttcaggactatggaca

SEQ ID NO: 58906 - DNA, 25 bp, Rattus norvegicus
aatcccgccttctggactatggaca

SEQ ID NO: 58907 - DNA, 25 bp, Rattus norvegicus
aatcccggagggaggctgtctctgc

SEQ ID NO: 58908 - DNA, 25 bp, Rattus norvegicus
aatcccggagggtggctgtctctgc

SEQ ID NO: 58909 - DNA, 25 bp, Rattus norvegicus
aatcccggagtcactgaggcgcttt

SEQ ID NO: 58910 - DNA, 25 bp, Rattus norvegicus
aatcccggagtctctgaggcgcttt

SEQ ID NO: 58911 - DNA, 25 bp, Rattus norvegicus
aatcccgggcctctatgtgtgtgtt

SEQ ID NO: 58912 - DNA, 25 bp, Rattus norvegicus
aatcccgggcctgtatgtgtgtgtt

SEQ ID NO: 58913 - DNA, 25 bp, Rattus norvegicus
aatcccgtagcgagtcgaagcggat

SEQ ID NO: 58914 - DNA, 25 bp, Rattus norvegicus
aatcccgtagcgtgtcgaagcggat

SEQ ID NO: 58915 - DNA, 25 bp, Rattus norvegicus
aatcccgtcagtacgactatgctgt

SEQ ID NO: 58916 - DNA, 25 bp, Rattus norvegicus
aatcccgtcagttcgactatgctgt

SEQ ID NO: 58917 - DNA, 25 bp, Rattus norvegicus
aatcccgtctggctgagattcacga

SEQ ID NO: 58918 - DNA, 25 bp, Rattus norvegicus
aatcccgtctgggtgagattcacga

SEQ ID NO: 58919 - DNA, 25 bp, Rattus norvegicus
aatcccgtgaccaggtggttgagta

SEQ ID NO: 58920 - DNA, 25 bp, Rattus norvegicus
aatcccgtgacctggtggttgagta

SEQ ID NO: 58921 - DNA, 25 bp, Rattus norvegicus
aatcccgtgcctactagtagatgct

SEQ ID NO: 58922 - DNA, 25 bp, Rattus norvegicus
aatcccgtgccttctagtagatgct

SEQ ID NO: 58923 - DNA, 25 bp, Rattus norvegicus
aatccctaactgatctttcaactgt

SEQ ID NO: 58924 - DNA, 25 bp, Rattus norvegicus
aatccctaactgttctttcaactgt

SEQ ID NO: 58925 - DNA, 25 bp, Rattus norvegicus
aatccctaagccaaatgacagttct

SEQ ID NO: 58926 - DNA, 25 bp, Rattus norvegicus
aatccctaagcctaatgacagttct

SEQ ID NO: 58927 - DNA, 25 bp, Rattus norvegicus
aatccctacataaactgtttcttgt

SEQ ID NO: 58928 - DNA, 25 bp, Rattus norvegicus
aatccctacatatactgtttcttgt

SEQ ID NO: 58929 - DNA, 25 bp, Rattus norvegicus
aatccctagacactattgccatctc

SEQ ID NO: 58930 - DNA, 25 bp, Rattus norvegicus
aatccctagacagtattgccatctc

SEQ ID NO: 58931 - DNA, 25 bp, Rattus norvegicus
aatccctatagcagtggccaacgtc

SEQ ID NO: 58932 - DNA, 25 bp, Rattus norvegicus
aatccctatagctgtggccaacgtc

SEQ ID NO: 58933 - DNA, 25 bp, Rattus norvegicus
aatccctcaatgcacatttccagaa

SEQ ID NO: 58934 - DNA, 25 bp, Rattus norvegicus
aatccctcaatggacatttccagaa

SEQ ID NO: 58935 - DNA, 25 bp, Rattus norvegicus
aatccctcacagcagattccatggt

SEQ ID NO: 58936 - DNA, 25 bp, Rattus norvegicus
aatccctcacaggagattccatggt

SEQ ID NO: 58937 - DNA, 25 bp, Rattus norvegicus
aatccctcccacaagtgtcttgagt

SEQ ID NO: 58938 - DNA, 25 bp, Rattus norvegicus
aatccctcccactagtgtcttgagt

SEQ ID NO: 58939 - DNA, 25 bp, Rattus norvegicus
aatccctccccgagtagaatgtatt

SEQ ID NO: 58940 - DNA, 25 bp, Rattus norvegicus
aatccctccccgtgtagaatgtatt

SEQ ID NO: 58941 - DNA, 25 bp, Rattus norvegicus
aatccctccgtgagcatgaacttct

SEQ ID NO: 58942 - DNA, 25 bp, Rattus norvegicus
aatccctccgtgtgcatgaacttct

SEQ ID NO: 58943 - DNA, 25 bp, Rattus norvegicus
aatccctctaccaaatttttcactg

SEQ ID NO: 58944 - DNA, 25 bp, Rattus norvegicus
aatccctctacctaatttttcactg

SEQ ID NO: 58945 - DNA, 25 bp, Rattus norvegicus
aatccctctattagagtcttctata

SEQ ID NO: 58946 - DNA, 25 bp, Rattus norvegicus
aatccctctatttgagtcttctata

SEQ ID NO: 58947 - DNA, 25 bp, Rattus norvegicus
aatccctgccgcagactgtataaga

SEQ ID NO: 58948 - DNA, 25 bp, Rattus norvegicus
aatccctgccgctgactgtataaga

SEQ ID NO: 58949 - DNA, 25 bp, Rattus norvegicus
aatccctgccttagtgttgagtttg

SEQ ID NO: 58950 - DNA, 25 bp, Rattus norvegicus
aatccctgcctttgtgttgagtttg

SEQ ID NO: 58951 - DNA, 25 bp, Rattus norvegicus
aatccctgggaactgtgtcgctgca

SEQ ID NO: 58952 - DNA, 25 bp, Rattus norvegicus
aatccctgggaagtgtgtcgctgca

SEQ ID NO: 58953 - DNA, 25 bp, Rattus norvegicus
aatccctgggcgcatggctaaaatg

SEQ ID NO: 58954 - DNA, 25 bp, Rattus norvegicus
aatccctgggcggatggctaaaatg

SEQ ID NO: 58955 - DNA, 25 bp, Rattus norvegicus
aatccctgggtaatcttgtgttcta

SEQ ID NO: 58956 - DNA, 25 bp, Rattus norvegicus
aatccctgggtattcttgtgttcta

SEQ ID NO: 58957 - DNA, 25 bp, Rattus norvegicus
aatccctggtgcaacacgcaaaatg

SEQ ID NO: 58958 - DNA, 25 bp, Rattus norvegicus
aatccctggtgctacacgcaaaatg

SEQ ID NO: 58959 - DNA, 25 bp, Rattus norvegicus
aatccctggtggcaaaatccttcag

SEQ ID NO: 58960 - DNA, 25 bp, Rattus norvegicus
aatccctggtgggaaaatccttcag

SEQ ID NO: 58961 - DNA, 25 bp, Rattus norvegicus
aatccctgtagaaagactgccatac

SEQ ID NO: 58962 - DNA, 25 bp, Rattus norvegicus
aatccctgtagatagactgccatac

SEQ ID NO: 58963 - DNA, 25 bp, Rattus norvegicus
aatccctgtatgaacgaagcagtaa

SEQ ID NO: 58964 - DNA, 25 bp, Rattus norvegicus
aatccctgtatgtacgaagcagtaa

SEQ ID NO: 58965 - DNA, 25 bp, Rattus norvegicus
aatccctgtcccaattgtgcaatct

SEQ ID NO: 58966 - DNA, 25 bp, Rattus norvegicus
aatccctgtccctattgtgcaatct

SEQ ID NO: 58967 - DNA, 25 bp, Rattus norvegicus
aatccctgtgcaattttgtgatgtg

SEQ ID NO: 58968 - DNA, 25 bp, Rattus norvegicus
aatccctgtgcatttttgtgatgtg

SEQ ID NO: 58969 - DNA, 25 bp, Rattus norvegicus
aatccctgttgtatggctaagactt

SEQ ID NO: 58970 - DNA, 25 bp, Rattus norvegicus
aatccctgttgtttggctaagactt

SEQ ID NO: 58971 - DNA, 25 bp, Rattus norvegicus
aatccctgtttgcaatgagcctttg

SEQ ID NO: 58972 - DNA, 25 bp, Rattus norvegicus
aatccctgtttggaatgagcctttg

SEQ ID NO: 58973 - DNA, 25 bp, Rattus norvegicus
aatcccttaacaaggccaagcgggt

SEQ ID NO: 58974 - DNA, 25 bp, Rattus norvegicus
aatcccttaacatggccaagcgggt

SEQ ID NO: 58975 - DNA, 25 bp, Rattus norvegicus
aatcccttcatgatgcacactcttt

SEQ ID NO: 58976 - DNA, 25 bp, Rattus norvegicus
aatcccttcatgttgcacactcttt

SEQ ID NO: 58977 - DNA, 25 bp, Rattus norvegicus
aatcccttcctcctttgactgaatg

SEQ ID NO: 58978 - DNA, 25 bp, Rattus norvegicus
aatcccttcctcgtttgactgaatg

SEQ ID NO: 58979 - DNA, 25 bp, Rattus norvegicus
aatcccttcctgaattgtttcgttg

SEQ ID NO: 58980 - DNA, 25 bp, Rattus norvegicus
aatcccttcctgtattgtttcgttg

SEQ ID NO: 58981 - DNA, 25 bp, Rattus norvegicus
aatcccttcgaaagttaacaagtat

SEQ ID NO: 58982 - DNA, 25 bp, Rattus norvegicus
aatcccttcgaatgttaacaagtat

SEQ ID NO: 58983 - DNA, 25 bp, Rattus norvegicus
aatcccttgcggaagttagcgtaca

SEQ ID NO: 58984 - DNA, 25 bp, Rattus norvegicus
aatcccttgcggtagttagcgtaca

SEQ ID NO: 58985 - DNA, 25 bp, Rattus norvegicus
aatcccttgctgcttaattctgctg

SEQ ID NO: 58986 - DNA, 25 bp, Rattus norvegicus
aatcccttgctggttaattctgctg

SEQ ID NO: 58987 - DNA, 25 bp, Rattus norvegicus
aatcccttgcttaagttgctgaaag

SEQ ID NO: 58988 - DNA, 25 bp, Rattus norvegicus
aatcccttgctttagttgctgaaag

SEQ ID NO: 58989 - DNA, 25 bp, Rattus norvegicus
aatcccttggagagttgagtcccac

SEQ ID NO: 58990 - DNA, 25 bp, Rattus norvegicus
aatcccttggagtgttgagtcccac

SEQ ID NO: 58991 - DNA, 25 bp, Rattus norvegicus
aatcccttgggcaccattggtgata

SEQ ID NO: 58992 - DNA, 25 bp, Rattus norvegicus
aatcccttgggctccattggtgata

SEQ ID NO: 58993 - DNA, 25 bp, Rattus norvegicus
aatcccttggtgaaaaccctgctag

SEQ ID NO: 58994 - DNA, 25 bp, Rattus norvegicus
aatcccttggtgtaaaccctgctag

SEQ ID NO: 58995 - DNA, 25 bp, Rattus norvegicus
aatccctttatccactggtccatct

SEQ ID NO: 58996 - DNA, 25 bp, Rattus norvegicus
aatccctttatcgactggtccatct

SEQ ID NO: 58997 - DNA, 25 bp, Rattus norvegicus
aatccctttcatccctttattcctt

SEQ ID NO: 58998 - DNA, 25 bp, Rattus norvegicus
aatccctttcatgcctttattcctt

SEQ ID NO: 58999 - DNA, 25 bp, Rattus norvegicus
aatccctttctcaattattttgctg

SEQ ID NO: 59000 - DNA, 25 bp, Rattus norvegicus
aatccctttctctattattttgctg

SEQ ID NO: 59001 - DNA, 25 bp, Rattus norvegicus
aatccctttgaaagctcagagcctt

SEQ ID NO: 59002 - DNA, 25 bp, Rattus norvegicus
aatccctttgaatgctcagagcctt

SEQ ID NO: 59003 - DNA, 25 bp, Rattus norvegicus
aatccgaaacctcaggctgggaact

SEQ ID NO: 59004 - DNA, 25 bp, Rattus norvegicus
aatccgaaacctgaggctgggaact

SEQ ID NO: 59005 - DNA, 25 bp, Rattus norvegicus
aatccgaaacgcatggtcctggtga

SEQ ID NO: 59006 - DNA, 25 bp, Rattus norvegicus
aatccgaaacgcttggtcctggtga

SEQ ID NO: 59007 - DNA, 25 bp, Rattus norvegicus
aatccgaatggaaaactacttgtat

SEQ ID NO: 59008 - DNA, 25 bp, Rattus norvegicus
aatccgaatggataactacttgtat

SEQ ID NO: 59009 - DNA, 25 bp, Rattus norvegicus
aatccgacctaaatggtgaatccca

SEQ ID NO: 59010 - DNA, 25 bp, Rattus norvegicus
aatccgacctaattggtgaatccca

SEQ ID NO: 59011 - DNA, 25 bp, Rattus norvegicus
aatccgacgctgactcaatgacttt

SEQ ID NO: 59012 - DNA, 25 bp, Rattus norvegicus
aatccgacgctgtctcaatgacttt

SEQ ID NO: 59013 - DNA, 25 bp, Rattus norvegicus
aatccgacggtactctcttcgacag

SEQ ID NO: 59014 - DNA, 25 bp, Rattus norvegicus
aatccgacggtagtctcttcgacag

SEQ ID NO: 59015 - DNA, 25 bp, Rattus norvegicus
aatccgagagacacatctttggtga

SEQ ID NO: 59016 - DNA, 25 bp, Rattus norvegicus
aatccgagagactcatctttggtga

SEQ ID NO: 59017 - DNA, 25 bp, Rattus norvegicus
aatccgagcgatcggctttgtgcat

SEQ ID NO: 59018 - DNA, 25 bp, Rattus norvegicus
aatccgagcgatgggctttgtgcat

SEQ ID NO: 59019 - DNA, 25 bp, Rattus norvegicus
aatccgagggcgaccgcgagaagat

SEQ ID NO: 59020 - DNA, 25 bp, Rattus norvegicus
aatccgagggcgtccgcgagaagat

SEQ ID NO: 59021 - DNA, 25 bp, Rattus norvegicus
aatccgatgttccaggtcgtcattg

SEQ ID NO: 59022 - DNA, 25 bp, Rattus norvegicus
aatccgatgttcgaggtcgtcattg

SEQ ID NO: 59023 - DNA, 25 bp, Rattus norvegicus
aatccgatttttagagacaagtgcc

SEQ ID NO: 59024 - DNA, 25 bp, Rattus norvegicus
aatccgattttttgagacaagtgcc

SEQ ID NO: 59025 - DNA, 25 bp, Rattus norvegicus
aatccgcaccttcggctcaggaagg

SEQ ID NO: 59026 - DNA, 25 bp, Rattus norvegicus
aatccgcaccttgggctcaggaagg

SEQ ID NO: 59027 - DNA, 25 bp, Rattus norvegicus
aatccgcatggtcactggaccctaa

SEQ ID NO: 59028 - DNA, 25 bp, Rattus norvegicus
aatccgcatggtgactggaccctaa

SEQ ID NO: 59029 - DNA, 25 bp, Rattus norvegicus
aatccgccagctcgatgagcgctac

SEQ ID NO: 59030 - DNA, 25 bp, Rattus norvegicus
aatccgccagctggatgagcgctac

SEQ ID NO: 59031 - DNA, 25 bp, Rattus norvegicus
aatccgccggcgagagctcttggag

SEQ ID NO: 59032 - DNA, 25 bp, Rattus norvegicus
aatccgccggcgtgagctcttggag

SEQ ID NO: 59033 - DNA, 25 bp, Rattus norvegicus
aatccgcctaatacttgttctgtag

SEQ ID NO: 59034 - DNA, 25 bp, Rattus norvegicus
aatccgcctaattcttgttctgtag

SEQ ID NO: 59035 - DNA, 25 bp, Rattus norvegicus
aatccgcgaggacagagttctccac

SEQ ID NO: 59036 - DNA, 25 bp, Rattus norvegicus
aatccgcgaggagagagttctccac

SEQ ID NO: 59037 - DNA, 25 bp, Rattus norvegicus
aatccgcggcctaactttgatttcg

SEQ ID NO: 59038 - DNA, 25 bp, Rattus norvegicus
aatccgcggccttactttgatttcg

SEQ ID NO: 59039 - DNA, 25 bp, Rattus norvegicus
aatccgcggctacggagctggttac

SEQ ID NO: 59040 - DNA, 25 bp, Rattus norvegicus
aatccgcggctagggagctggttac

SEQ ID NO: 59041 - DNA, 25 bp, Rattus norvegicus
aatccgctcagcaggactctaagat

SEQ ID NO: 59042 - DNA, 25 bp, Rattus norvegicus
aatccgctcagctggactctaagat

SEQ ID NO: 59043 - DNA, 25 bp, Rattus norvegicus
aatccggaactcatataacttgctg

SEQ ID NO: 59044 - DNA, 25 bp, Rattus norvegicus
aatccggaactcttataacttgctg

SEQ ID NO: 59045 - DNA, 25 bp, Rattus norvegicus
aatccggaatgccatgctatgccct

SEQ ID NO: 59046 - DNA, 25 bp, Rattus norvegicus
aatccggaatgcgatgctatgccct

SEQ ID NO: 59047 - DNA, 25 bp, Rattus norvegicus
aatccggacgcaattcaagtttaat

SEQ ID NO: 59048 - DNA, 25 bp, Rattus norvegicus
aatccggacgcatttcaagtttaat

SEQ ID NO: 59049 - DNA, 25 bp, Rattus norvegicus
aatccggagaaacctgacctaccag

SEQ ID NO: 59050 - DNA, 25 bp, Rattus norvegicus
aatccggagaaagctgacctaccag

SEQ ID NO: 59051 - DNA, 25 bp, Rattus norvegicus
aatccggagaagaaccagtgcacaa

SEQ ID NO: 59052 - DNA, 25 bp, Rattus norvegicus
aatccggagaagtaccagtgcacaa

SEQ ID NO: 59053 - DNA, 25 bp, Rattus norvegicus
aatccgggacagaatggctgcatga

SEQ ID NO: 59054 - DNA, 25 bp, Rattus norvegicus
aatccgggacagtatggctgcatga

SEQ ID NO: 59055 - DNA, 25 bp, Rattus norvegicus
aatccggtcctccagggagaatcct

SEQ ID NO: 59056 - DNA, 25 bp, Rattus norvegicus
aatccggtcctcgagggagaatcct

SEQ ID NO: 59057 - DNA, 25 bp, Rattus norvegicus
aatccggtgaagactctcatttgcg

SEQ ID NO: 59058 - DNA, 25 bp, Rattus norvegicus
aatccggtgaagtctctcatttgcg

SEQ ID NO: 59059 - DNA, 25 bp, Rattus norvegicus
aatccgtaagttacatctccagcat

SEQ ID NO: 59060 - DNA, 25 bp, Rattus norvegicus
aatccgtaagtttcatctccagcat

SEQ ID NO: 59061 - DNA, 25 bp, Rattus norvegicus
aatccgtacaatctgatctctgaag

SEQ ID NO: 59062 - DNA, 25 bp, Rattus norvegicus
aatccgtacaatgtgatctctgaag

SEQ ID NO: 59063 - DNA, 25 bp, Rattus norvegicus
aatccgtatgtaccaccatccgttt

SEQ ID NO: 59064 - DNA, 25 bp, Rattus norvegicus
aatccgtatgtagcaccatccgttt

SEQ ID NO: 59065 - DNA, 25 bp, Rattus norvegicus
aatccgtcaaaaaagccttcgtggc

SEQ ID NO: 59066 - DNA, 25 bp, Rattus norvegicus
aatccgtcaaaatagccttcgtggc

SEQ ID NO: 59067 - DNA, 25 bp, Rattus norvegicus
aatccgtcaagtagtcatggccagt

SEQ ID NO: 59068 - DNA, 25 bp, Rattus norvegicus
aatccgtcaagttgtcatggccagt

SEQ ID NO: 59069 - DNA, 25 bp, Rattus norvegicus
aatccgtcactacaagcgccaagtt

SEQ ID NO: 59070 - DNA, 25 bp, Rattus norvegicus
aatccgtcactagaagcgccaagtt

SEQ ID NO: 59071 - DNA, 25 bp, Rattus norvegicus
aatccgtcgctcaatattatcactg

SEQ ID NO: 59072 - DNA, 25 bp, Rattus norvegicus
aatccgtcgctctatattatcactg

SEQ ID NO: 59073 - DNA, 25 bp, Rattus norvegicus
aatccgtgctgtcttagtctttgct

SEQ ID NO: 59074 - DNA, 25 bp, Rattus norvegicus
aatccgtgctgtgttagtctttgct

SEQ ID NO: 59075 - DNA, 25 bp, Rattus norvegicus
aatccgtggccaaggtcgtcagccg

SEQ ID NO: 59076 - DNA, 25 bp, Rattus norvegicus
aatccgtggccatggtcgtcagccg

SEQ ID NO: 59077 - DNA, 25 bp, Rattus norvegicus
aatccgtgtggacgtctacgcatgc

SEQ ID NO: 59078 - DNA, 25 bp, Rattus norvegicus
aatccgtgtggaggtctacgcatgc

SEQ ID NO: 59079 - DNA, 25 bp, Rattus norvegicus
aatccgtgtgtgattaaaccgtgca

SEQ ID NO: 59080 - DNA, 25 bp, Rattus norvegicus
aatccgtgtgtgtttaaaccgtgca

SEQ ID NO: 59081 - DNA, 25 bp, Rattus norvegicus
aatccgtgttccctgtgcagatgat

SEQ ID NO: 59082 - DNA, 25 bp, Rattus norvegicus
aatccgtgttccgtgtgcagatgat

SEQ ID NO: 59083 - DNA, 25 bp, Rattus norvegicus
aatccgttctccaaaatacatcctt

SEQ ID NO: 59084 - DNA, 25 bp, Rattus norvegicus
aatccgttctcctaaatacatcctt

SEQ ID NO: 59085 - DNA, 25 bp, Rattus norvegicus
aatccgttcttgaactgtttcctca

SEQ ID NO: 59086 - DNA, 25 bp, Rattus norvegicus
aatccgttcttgtactgtttcctca

SEQ ID NO: 59087 - DNA, 25 bp, Rattus norvegicus
aatccgttgtccatgttgctccttg

SEQ ID NO: 59088 - DNA, 25 bp, Rattus norvegicus
aatccgttgtccttgttgctccttg

SEQ ID NO: 59089 - DNA, 25 bp, Rattus norvegicus
aatccgttgtgtagttcctcggtga

SEQ ID NO: 59090 - DNA, 25 bp, Rattus norvegicus
aatccgttgtgttgttcctcggtga

SEQ ID NO: 59091 - DNA, 25 bp, Rattus norvegicus
aatcctaaaaatactggcaccagcc

SEQ ID NO: 59092 - DNA, 25 bp, Rattus norvegicus
aatcctaaaaattctggcaccagcc

SEQ ID NO: 59093 - DNA, 25 bp, Rattus norvegicus
aatcctaacataacccactggtact

SEQ ID NO: 59094 - DNA, 25 bp, Rattus norvegicus
aatcctaacatatcccactggtact

SEQ ID NO: 59095 - DNA, 25 bp, Rattus norvegicus
aatcctaaccgtcagagagtgccag

SEQ ID NO: 59096 - DNA, 25 bp, Rattus norvegicus
aatcctaaccgtgagagagtgccag

SEQ ID NO: 59097 - DNA, 25 bp, Rattus norvegicus
aatcctaacctgcaaatgcttttat

SEQ ID NO: 59098 - DNA, 25 bp, Rattus norvegicus
aatcctaacctggaaatgcttttat

SEQ ID NO: 59099 - DNA, 25 bp, Rattus norvegicus
aatcctaagatgacagttatccaga

SEQ ID NO: 59100 - DNA, 25 bp, Rattus norvegicus
aatcctaagatgtcagttatccaga

SEQ ID NO: 59101 - DNA, 25 bp, Rattus norvegicus
aatcctaagggcaatttctaagaca

SEQ ID NO: 59102 - DNA, 25 bp, Rattus norvegicus
aatcctaagggctatttctaagaca

SEQ ID NO: 59103 - DNA, 25 bp, Rattus norvegicus
aatcctacacctcaacacatttaga

SEQ ID NO: 59104 - DNA, 25 bp, Rattus norvegicus
aatcctacacctgaacacatttaga

SEQ ID NO: 59105 - DNA, 25 bp, Rattus norvegicus
aatcctactgccacctgttaagaac

SEQ ID NO: 59106 - DNA, 25 bp, Rattus norvegicus
aatcctactgcctcctgttaagaac

SEQ ID NO: 59107 - DNA, 25 bp, Rattus norvegicus
aatcctagaacccaagctgctgcag

SEQ ID NO: 59108 - DNA, 25 bp, Rattus norvegicus
aatcctagaaccgaagctgctgcag

SEQ ID NO: 59109 - DNA, 25 bp, Rattus norvegicus
aatcctagagaaattccaggcttaa

SEQ ID NO: 59110 - DNA, 25 bp, Rattus norvegicus
aatcctagagaatttccaggcttaa

SEQ ID NO: 59111 - DNA, 25 bp, Rattus norvegicus
aatcctagcactccaggacctgggc

SEQ ID NO: 59112 - DNA, 25 bp, Rattus norvegicus
aatcctagcactgcaggacctgggc

SEQ ID NO: 59113 - DNA, 25 bp, Rattus norvegicus
aatcctagcagtaaagttctccaca

SEQ ID NO: 59114 - DNA, 25 bp, Rattus norvegicus
aatcctagcagttaagttctccaca

SEQ ID NO: 59115 - DNA, 25 bp, Rattus norvegicus
aatcctaggccaaatgtctgtggac

SEQ ID NO: 59116 - DNA, 25 bp, Rattus norvegicus
aatcctaggccatatgtctgtggac

SEQ ID NO: 59117 - DNA, 25 bp, Rattus norvegicus
aatcctaggcccataagctataaga

SEQ ID NO: 59118 - DNA, 25 bp, Rattus norvegicus
aatcctaggcccttaagctataaga

SEQ ID NO: 59119 - DNA, 25 bp, Rattus norvegicus
aatcctaggtatcgccaccaggtga

SEQ ID NO: 59120 - DNA, 25 bp, Rattus norvegicus
aatcctaggtatggccaccaggtga

SEQ ID NO: 59121 - DNA, 25 bp, Rattus norvegicus
aatcctagtactctgctctagcttg

SEQ ID NO: 59122 - DNA, 25 bp, Rattus norvegicus
aatcctagtactgtgctctagcttg

SEQ ID NO: 59123 - DNA, 25 bp, Rattus norvegicus
aatcctagtctaaaagcctattgta

SEQ ID NO: 59124 - DNA, 25 bp, Rattus norvegicus
aatcctagtctataagcctattgta

SEQ ID NO: 59125 - DNA, 25 bp, Rattus norvegicus
aatcctagttcaaatcagttagcct

SEQ ID NO: 59126 - DNA, 25 bp, Rattus norvegicus
aatcctagttcatatcagttagcct

SEQ ID NO: 59127 - DNA, 25 bp, Rattus norvegicus
aatcctagttttacaattcttcatc

SEQ ID NO: 59128 - DNA, 25 bp, Rattus norvegicus
aatcctagtttttcaattcttcatc

SEQ ID NO: 59129 - DNA, 25 bp, Rattus norvegicus
aatcctataactcgtgatcctgccc

SEQ ID NO: 59130 - DNA, 25 bp, Rattus norvegicus
aatcctataactggtgatcctgccc

SEQ ID NO: 59131 - DNA, 25 bp, Rattus norvegicus
aatcctatgggaagtgtcacccaca

SEQ ID NO: 59132 - DNA, 25 bp, Rattus norvegicus
aatcctatgggatgtgtcacccaca

SEQ ID NO: 59133 - DNA, 25 bp, Rattus norvegicus
aatcctatttacaagagtgccgtga

SEQ ID NO: 59134 - DNA, 25 bp, Rattus norvegicus
aatcctatttactagagtgccgtga

SEQ ID NO: 59135 - DNA, 25 bp, Rattus norvegicus
aatcctatttctcgctttctctttt

SEQ ID NO: 59136 - DNA, 25 bp, Rattus norvegicus
aatcctatttctggctttctctttt

SEQ ID NO: 59137 - DNA, 25 bp, Rattus norvegicus
aatcctcaaataactactccctggt

SEQ ID NO: 59138 - DNA, 25 bp, Rattus norvegicus
aatcctcaaatatctactccctggt

SEQ ID NO: 59139 - DNA, 25 bp, Rattus norvegicus
aatcctcaatgccaaagtcacagtg

SEQ ID NO: 59140 - DNA, 25 bp, Rattus norvegicus
aatcctcaatgcgaaagtcacagtg

SEQ ID NO: 59141 - DNA, 25 bp, Rattus norvegicus
aatcctcacaggatttgctttccaa

SEQ ID NO: 59142 - DNA, 25 bp, Rattus norvegicus
aatcctcacaggttttgctttccaa

SEQ ID NO: 59143 - DNA, 25 bp, Rattus norvegicus
aatcctcaccaaaggtagcttgctt

SEQ ID NO: 59144 - DNA, 25 bp, Rattus norvegicus
aatcctcaccaatggtagcttgctt

SEQ ID NO: 59145 - DNA, 25 bp, Rattus norvegicus
aatcctcactccatactgtggatat

SEQ ID NO: 59146 - DNA, 25 bp, Rattus norvegicus
aatcctcactccttactgtggatat

SEQ ID NO: 59147 - DNA, 25 bp, Rattus norvegicus
aatcctcagtgtaaaatgtcttgtg

SEQ ID NO: 59148 - DNA, 25 bp, Rattus norvegicus
aatcctcagtgttaaatgtcttgtg

SEQ ID NO: 59149 - DNA, 25 bp, Rattus norvegicus
aatcctcattgacttttggactctg

SEQ ID NO: 59150 - DNA, 25 bp, Rattus norvegicus
aatcctcattgagttttggactctg

SEQ ID NO: 59151 - DNA, 25 bp, Rattus norvegicus
aatcctcattgtatcttcagtcact

SEQ ID NO: 59152 - DNA, 25 bp, Rattus norvegicus
aatcctcattgtttcttcagtcact

SEQ ID NO: 59153 - DNA, 25 bp, Rattus norvegicus
aatcctccaagcatctctttacagt

SEQ ID NO: 59154 - DNA, 25 bp, Rattus norvegicus
aatcctccaagcttctctttacagt

SEQ ID NO: 59155 - DNA, 25 bp, Rattus norvegicus
aatcctccaatgactaacttccttt

SEQ ID NO: 59156 - DNA, 25 bp, Rattus norvegicus
aatcctccaatgtctaacttccttt

SEQ ID NO: 59157 - DNA, 25 bp, Rattus norvegicus
aatcctccaggaccaacttctgaac

SEQ ID NO: 59158 - DNA, 25 bp, Rattus norvegicus
aatcctccaggagcaacttctgaac

SEQ ID NO: 59159 - DNA, 25 bp, Rattus norvegicus
aatcctccatttccaagcattgtgt

SEQ ID NO: 59160 - DNA, 25 bp, Rattus norvegicus
aatcctccatttgcaagcattgtgt

SEQ ID NO: 59161 - DNA, 25 bp, Rattus norvegicus
aatcctccctctagattgcactggg

SEQ ID NO: 59162 - DNA, 25 bp, Rattus norvegicus
aatcctccctcttgattgcactggg

SEQ ID NO: 59163 - DNA, 25 bp, Rattus norvegicus
aatcctccctgtctctggagcaaaa

SEQ ID NO: 59164 - DNA, 25 bp, Rattus norvegicus
aatcctccctgtgtctggagcaaaa

SEQ ID NO: 59165 - DNA, 25 bp, Rattus norvegicus
aatcctcctcttcaagtcaggctag

SEQ ID NO: 59166 - DNA, 25 bp, Rattus norvegicus
aatcctcctcttgaagtcaggctag

SEQ ID NO: 59167 - DNA, 25 bp, Rattus norvegicus
aatcctcctgtaaattgcctttttg

SEQ ID NO: 59168 - DNA, 25 bp, Rattus norvegicus
aatcctcctgtatattgcctttttg

SEQ ID NO: 59169 - DNA, 25 bp, Rattus norvegicus
aatcctcctgtcacttgtttgggag

SEQ ID NO: 59170 - DNA, 25 bp, Rattus norvegicus
aatcctcctgtctcttgtttgggag

SEQ ID NO: 59171 - DNA, 25 bp, Rattus norvegicus
aatcctccttgaaagtttgcgggca

SEQ ID NO: 59172 - DNA, 25 bp, Rattus norvegicus
aatcctccttgatagtttgcgggca

SEQ ID NO: 59173 - DNA, 25 bp, Rattus norvegicus
aatcctcgctttatgtggccttata

SEQ ID NO: 59174 - DNA, 25 bp, Rattus norvegicus
aatcctcgctttttgtggccttata

SEQ ID NO: 59175 - DNA, 25 bp, Rattus norvegicus
aatcctctaaaaactgtgtgatcca

SEQ ID NO: 59176 - DNA, 25 bp, Rattus norvegicus
aatcctctaaaatctgtgtgatcca

SEQ ID NO: 59177 - DNA, 25 bp, Rattus norvegicus
aatcctctactaacactgacagcat

SEQ ID NO: 59178 - DNA, 25 bp, Rattus norvegicus
aatcctctactatcactgacagcat

SEQ ID NO: 59179 - DNA, 25 bp, Rattus norvegicus
aatcctctatgtccgagtagcttac

SEQ ID NO: 59180 - DNA, 25 bp, Rattus norvegicus
aatcctctatgtctggtgactgctt

SEQ ID NO: 59181 - DNA, 25 bp, Rattus norvegicus
aatcctctatgtgcgagtagcttac

SEQ ID NO: 59182 - DNA, 25 bp, Rattus norvegicus
aatcctctatgtgtggtgactgctt

SEQ ID NO: 59183 - DNA, 25 bp, Rattus norvegicus
aatcctctccacaaagtagtctttt

SEQ ID NO: 59184 - DNA, 25 bp, Rattus norvegicus
aatcctctccactaagtagtctttt

SEQ ID NO: 59185 - DNA, 25 bp, Rattus norvegicus
aatcctctctgactgtttaatgcca

SEQ ID NO: 59186 - DNA, 25 bp, Rattus norvegicus
aatcctctctgagtgtttaatgcca

SEQ ID NO: 59187 - DNA, 25 bp, Rattus norvegicus
aatcctctgataaatgttggcccaa

SEQ ID NO: 59188 - DNA, 25 bp, Rattus norvegicus
aatcctctgatatatgttggcccaa

SEQ ID NO: 59189 - DNA, 25 bp, Rattus norvegicus
aatcctctgcctacaaaagaaacaa

SEQ ID NO: 59190 - DNA, 25 bp, Rattus norvegicus
aatcctctgccttcaaaagaaacaa

SEQ ID NO: 59191 - DNA, 25 bp, Rattus norvegicus
aatcctctggcaaatcaagtagtgg

SEQ ID NO: 59192 - DNA, 25 bp, Rattus norvegicus
aatcctctggcatatcaagtagtgg

SEQ ID NO: 59193 - DNA, 25 bp, Rattus norvegicus
aatcctctgtggctcgtgtatttat

SEQ ID NO: 59194 - DNA, 25 bp, Rattus norvegicus
aatcctctgtgggtcgtgtatttat

SEQ ID NO: 59195 - DNA, 25 bp, Rattus norvegicus
aatcctcttatcaactgtcggagtc

SEQ ID NO: 59196 - DNA, 25 bp, Rattus norvegicus
aatcctcttatctactgtcggagtc

SEQ ID NO: 59197 - DNA, 25 bp, Rattus norvegicus
aatcctcttcatcacgggagacgag

SEQ ID NO: 59198 - DNA, 25 bp, Rattus norvegicus
aatcctcttcatgacgggagacgag

SEQ ID NO: 59199 - DNA, 25 bp, Rattus norvegicus
aatcctctttagctggacagtctgg

SEQ ID NO: 59200 - DNA, 25 bp, Rattus norvegicus
aatcctctttaggtggacagtctgg

SEQ ID NO: 59201 - DNA, 25 bp, Rattus norvegicus
aatcctgaaatgactcaccgactgg

SEQ ID NO: 59202 - DNA, 25 bp, Rattus norvegicus
aatcctgaaatgtctcaccgactgg

SEQ ID NO: 59203 - DNA, 25 bp, Rattus norvegicus
aatcctgaactgcaagtgcctgctt

SEQ ID NO: 59204 - DNA, 25 bp, Rattus norvegicus
aatcctgaactggaagtgcctgctt

SEQ ID NO: 59205 - DNA, 25 bp, Rattus norvegicus
aatcctgaagacctcgcagagagag

SEQ ID NO: 59206 - DNA, 25 bp, Rattus norvegicus
aatcctgaagacgtcgcagagagag

SEQ ID NO: 59207 - DNA, 25 bp, Rattus norvegicus
aatcctgaagctaggtatgtctcac

SEQ ID NO: 59208 - DNA, 25 bp, Rattus norvegicus
aatcctgaagcttggtatgtctcac

SEQ ID NO: 59209 - DNA, 25 bp, Rattus norvegicus
aatcctgaatagcaagaccccatgt

SEQ ID NO: 59210 - DNA, 25 bp, Rattus norvegicus
aatcctgaataggaagaccccatgt

SEQ ID NO: 59211 - DNA, 25 bp, Rattus norvegicus
aatcctgacagcatgtagctttctg

SEQ ID NO: 59212 - DNA, 25 bp, Rattus norvegicus
aatcctgacagcttgtagctttctg

SEQ ID NO: 59213 - DNA, 25 bp, Rattus norvegicus
aatcctgacaggagatctgttgtct

SEQ ID NO: 59214 - DNA, 25 bp, Rattus norvegicus
aatcctgacaggtgatctgttgtct

SEQ ID NO: 59215 - DNA, 25 bp, Rattus norvegicus
aatcctgacataaccggtatttccg

SEQ ID NO: 59216 - DNA, 25 bp, Rattus norvegicus
aatcctgacatatccggtatttccg

SEQ ID NO: 59217 - DNA, 25 bp, Rattus norvegicus
aatcctgacatcctgagttcaatcc

SEQ ID NO: 59218 - DNA, 25 bp, Rattus norvegicus
aatcctgacatcgtgagttcaatcc

SEQ ID NO: 59219 - DNA, 25 bp, Rattus norvegicus
aatcctgaccacatacctacaagag

SEQ ID NO: 59220 - DNA, 25 bp, Rattus norvegicus
aatcctgaccacttacctacaagag

SEQ ID NO: 59221 - DNA, 25 bp, Rattus norvegicus
aatcctgactggctcctagggaagg

SEQ ID NO: 59222 - DNA, 25 bp, Rattus norvegicus
aatcctgactgggtcctagggaagg

SEQ ID NO: 59223 - DNA, 25 bp, Rattus norvegicus
aatcctgagcacagtaccatgggct

SEQ ID NO: 59224 - DNA, 25 bp, Rattus norvegicus
aatcctgagcactgtaccatgggct

SEQ ID NO: 59225 - DNA, 25 bp, Rattus norvegicus
aatcctgagctcaacgaagcggccg

SEQ ID NO: 59226 - DNA, 25 bp, Rattus norvegicus
aatcctgagctctacgaagcggccg

SEQ ID NO: 59227 - DNA, 25 bp, Rattus norvegicus
aatcctgagggtcaaataacttggc

SEQ ID NO: 59228 - DNA, 25 bp, Rattus norvegicus
aatcctgagggtcagagttccacat

SEQ ID NO: 59229 - DNA, 25 bp, Rattus norvegicus
aatcctgagggtcctgttggaccac

SEQ ID NO: 59230 - DNA, 25 bp, Rattus norvegicus
aatcctgagggtgaaataacttggc

SEQ ID NO: 59231 - DNA, 25 bp, Rattus norvegicus
aatcctgagggtgagagttccacat

SEQ ID NO: 59232 - DNA, 25 bp, Rattus norvegicus
aatcctgagggtgctgttggaccac

SEQ ID NO: 59233 - DNA, 25 bp, Rattus norvegicus
aatcctgatgatagtttgaacagcc

SEQ ID NO: 59234 - DNA, 25 bp, Rattus norvegicus
aatcctgatgattgtttgaacagcc

SEQ ID NO: 59235 - DNA, 25 bp, Rattus norvegicus
aatcctgcaaacacttcaccagttt

SEQ ID NO: 59236 - DNA, 25 bp, Rattus norvegicus
aatcctgcaaactcttcaccagttt

SEQ ID NO: 59237 - DNA, 25 bp, Rattus norvegicus
aatcctgcaacgaggaggtcagcct

SEQ ID NO: 59238 - DNA, 25 bp, Rattus norvegicus
aatcctgcaacgtggaggtcagcct

SEQ ID NO: 59239 - DNA, 25 bp, Rattus norvegicus
aatcctgcacacaagctgggcagtg

SEQ ID NO: 59240 - DNA, 25 bp, Rattus norvegicus
aatcctgcacactagctgggcagtg

SEQ ID NO: 59241 - DNA, 25 bp, Rattus norvegicus
aatcctgcacatcactcttgttggc

SEQ ID NO: 59242 - DNA, 25 bp, Rattus norvegicus
aatcctgcacatgactcttgttggc

SEQ ID NO: 59243 - DNA, 25 bp, Rattus norvegicus
aatcctgcagctaatggtcttgtag

SEQ ID NO: 59244 - DNA, 25 bp, Rattus norvegicus
aatcctgcagcttatggtcttgtag

SEQ ID NO: 59245 - DNA, 25 bp, Rattus norvegicus
aatcctgcagtaaatttaacttgaa

SEQ ID NO: 59246 - DNA, 25 bp, Rattus norvegicus
aatcctgcagtatatttaacttgaa

SEQ ID NO: 59247 - DNA, 25 bp, Rattus norvegicus
aatcctgccaacagacctttggaga

SEQ ID NO: 59248 - DNA, 25 bp, Rattus norvegicus
aatcctgccaactgacctttggaga

SEQ ID NO: 59249 - DNA, 25 bp, Rattus norvegicus
aatcctgccctcattggtgctagat

SEQ ID NO: 59250 - DNA, 25 bp, Rattus norvegicus
aatcctgccctctttggtgctagat

SEQ ID NO: 59251 - DNA, 25 bp, Rattus norvegicus
aatcctgcctggaacacgggccgcg

SEQ ID NO: 59252 - DNA, 25 bp, Rattus norvegicus
aatcctgcctggtacacgggccgcg

SEQ ID NO: 59253 - DNA, 25 bp, Rattus norvegicus
aatcctgccttcctcttgcacaagt

SEQ ID NO: 59254 - DNA, 25 bp, Rattus norvegicus
aatcctgccttcgtcttgcacaagt

SEQ ID NO: 59255 - DNA, 25 bp, Rattus norvegicus
aatcctgcgcggacagtgccaacag

SEQ ID NO: 59256 - DNA, 25 bp, Rattus norvegicus
aatcctgcgcggtcagtgccaacag

SEQ ID NO: 59257 - DNA, 25 bp, Rattus norvegicus
aatcctgcgcgtctctggagacaag

SEQ ID NO: 59258 - DNA, 25 bp, Rattus norvegicus
aatcctgcgcgtgtctggagacaag

SEQ ID NO: 59259 - DNA, 25 bp, Rattus norvegicus
aatcctgcgtatcttgaatttcctg

SEQ ID NO: 59260 - DNA, 25 bp, Rattus norvegicus
aatcctgcgtatgttgaatttcctg

SEQ ID NO: 59261 - DNA, 25 bp, Rattus norvegicus
aatcctgctgctctactacctattg

SEQ ID NO: 59262 - DNA, 25 bp, Rattus norvegicus
aatcctgctgctgtactacctattg

SEQ ID NO: 59263 - DNA, 25 bp, Rattus norvegicus
aatcctgctgttaatgtgtggtaca

SEQ ID NO: 59264 - DNA, 25 bp, Rattus norvegicus
aatcctgctgttatctagcttttga

SEQ ID NO: 59265 - DNA, 25 bp, Rattus norvegicus
aatcctgctgtttatgtgtggtaca

SEQ ID NO: 59266 - DNA, 25 bp, Rattus norvegicus
aatcctgctgttttctagcttttga

SEQ ID NO: 59267 - DNA, 25 bp, Rattus norvegicus
aatcctgcttgaatgcactgttctt

SEQ ID NO: 59268 - DNA, 25 bp, Rattus norvegicus
aatcctgcttgattgcactgttctt

SEQ ID NO: 59269 - DNA, 25 bp, Rattus norvegicus
aatcctgctttgagagtatttgtaa

SEQ ID NO: 59270 - DNA, 25 bp, Rattus norvegicus
aatcctgctttgtgagtatttgtaa

SEQ ID NO: 59271 - DNA, 25 bp, Rattus norvegicus
aatcctggacctccatcatgagtgg

SEQ ID NO: 59272 - DNA, 25 bp, Rattus norvegicus
aatcctggacctgcatcatgagtgg

SEQ ID NO: 59273 - DNA, 25 bp, Rattus norvegicus
aatcctggagtcagtgtgaccttcg

SEQ ID NO: 59274 - DNA, 25 bp, Rattus norvegicus
aatcctggagtctgtgtgaccttcg

SEQ ID NO: 59275 - DNA, 25 bp, Rattus norvegicus
aatcctggagtgacctgggagaacc

SEQ ID NO: 59276 - DNA, 25 bp, Rattus norvegicus
aatcctggagtgtcctgggagaacc

SEQ ID NO: 59277 - DNA, 25 bp, Rattus norvegicus
aatcctggcaaaatcatgtttcatg

SEQ ID NO: 59278 - DNA, 25 bp, Rattus norvegicus
aatcctggcaaattcatgtttcatg

SEQ ID NO: 59279 - DNA, 25 bp, Rattus norvegicus
aatcctggcatcacagacatgataa

SEQ ID NO: 59280 - DNA, 25 bp, Rattus norvegicus
aatcctggcatctcagacatgataa

SEQ ID NO: 59281 - DNA, 25 bp, Rattus norvegicus
aatcctggctatatcaagctccgaa

SEQ ID NO: 59282 - DNA, 25 bp, Rattus norvegicus
aatcctggctatttcaagctccgaa

SEQ ID NO: 59283 - DNA, 25 bp, Rattus norvegicus
aatcctggctgcatatctgcacttt

SEQ ID NO: 59284 - DNA, 25 bp, Rattus norvegicus
aatcctggctgcttatctgcacttt

SEQ ID NO: 59285 - DNA, 25 bp, Rattus norvegicus
aatcctgggacactgggtatcctaa

SEQ ID NO: 59286 - DNA, 25 bp, Rattus norvegicus
aatcctgggacagtgggtatcctaa

SEQ ID NO: 59287 - DNA, 25 bp, Rattus norvegicus
aatcctgggtgtagaattactatac

SEQ ID NO: 59288 - DNA, 25 bp, Rattus norvegicus
aatcctgggtgttgaattactatac

SEQ ID NO: 59289 - DNA, 25 bp, Rattus norvegicus
aatcctggtaaaacagacctagtgg

SEQ ID NO: 59290 - DNA, 25 bp, Rattus norvegicus
aatcctggtaaatcagacctagtgg

SEQ ID NO: 59291 - DNA, 25 bp, Rattus norvegicus
aatcctggtttgctgcaagtctgtc

SEQ ID NO: 59292 - DNA, 25 bp, Rattus norvegicus
aatcctggtttggtgcaagtctgtc

SEQ ID NO: 59293 - DNA, 25 bp, Rattus norvegicus
aatcctgtaagtcggaactgccctc

SEQ ID NO: 59294 - DNA, 25 bp, Rattus norvegicus
aatcctgtaagtgggaactgccctc

SEQ ID NO: 59295 - DNA, 25 bp, Rattus norvegicus
aatcctgtacaaatgcatcacgggt

SEQ ID NO: 59296 - DNA, 25 bp, Rattus norvegicus
aatcctgtacaattgcatcacgggt

SEQ ID NO: 59297 - DNA, 25 bp, Rattus norvegicus
aatcctgtctaaatctttgtctctc

SEQ ID NO: 59298 - DNA, 25 bp, Rattus norvegicus
aatcctgtctaattctttgtctctc

SEQ ID NO: 59299 - DNA, 25 bp, Rattus norvegicus
aatcctgtgacaatgagcgtgactt

SEQ ID NO: 59300 - DNA, 25 bp, Rattus norvegicus
aatcctgtgacattgagcgtgactt

SEQ ID NO: 59301 - DNA, 25 bp, Rattus norvegicus
aatcctgtgagtcttgagttctcca

SEQ ID NO: 59302 - DNA, 25 bp, Rattus norvegicus
aatcctgtgagtgttgagttctcca

SEQ ID NO: 59303 - DNA, 25 bp, Rattus norvegicus
aatcctgtgatcaataccaccttca

SEQ ID NO: 59304 - DNA, 25 bp, Rattus norvegicus
aatcctgtgatctataccaccttca

SEQ ID NO: 59305 - DNA, 25 bp, Rattus norvegicus
aatcctgtgctcaggccgggaccac

SEQ ID NO: 59306 - DNA, 25 bp, Rattus norvegicus
aatcctgtgctcagggaggttccct

SEQ ID NO: 59307 - DNA, 25 bp, Rattus norvegicus
aatcctgtgctctggccgggaccac

SEQ ID NO: 59308 - DNA, 25 bp, Rattus norvegicus
aatcctgtgctctgggaggttccct

SEQ ID NO: 59309 - DNA, 25 bp, Rattus norvegicus
aatcctgtgcttacaaggcagtctg

SEQ ID NO: 59310 - DNA, 25 bp, Rattus norvegicus
aatcctgtgctttcaaggcagtctg

SEQ ID NO: 59311 - DNA, 25 bp, Rattus norvegicus
aatcctgtggctatggtgcgagagt

SEQ ID NO: 59312 - DNA, 25 bp, Rattus norvegicus
aatcctgtggctttggtgcgagagt

SEQ ID NO: 59313 - DNA, 25 bp, Rattus norvegicus
aatcctgtgggaatgccagtaggcc

SEQ ID NO: 59314 - DNA, 25 bp, Rattus norvegicus
aatcctgtgggattgccagtaggcc

SEQ ID NO: 59315 - DNA, 25 bp, Rattus norvegicus
aatcctgtgtatagctctgtgtgcc

SEQ ID NO: 59316 - DNA, 25 bp, Rattus norvegicus
aatcctgtgtattgctctgtgtgcc

SEQ ID NO: 59317 - DNA, 25 bp, Rattus norvegicus
aatcctgttgctacatcagagtgta

SEQ ID NO: 59318 - DNA, 25 bp, Rattus norvegicus
aatcctgttgcttcatcagagtgta

SEQ ID NO: 59319 - DNA, 25 bp, Rattus norvegicus
aatcctgttggcctctcaccatgat

SEQ ID NO: 59320 - DNA, 25 bp, Rattus norvegicus
aatcctgttggcgtctcaccatgat

SEQ ID NO: 59321 - DNA, 25 bp, Rattus norvegicus
aatcctgttgtaattttgtcctggc

SEQ ID NO: 59322 - DNA, 25 bp, Rattus norvegicus
aatcctgttgtatttttgtcctggc

SEQ ID NO: 59323 - DNA, 25 bp, Rattus norvegicus
aatccttaacatccagaacctcatt

SEQ ID NO: 59324 - DNA, 25 bp, Rattus norvegicus
aatccttaacatgcagaacctcatt

SEQ ID NO: 59325 - DNA, 25 bp, Rattus norvegicus
aatccttaatctagagcgggtgacc

SEQ ID NO: 59326 - DNA, 25 bp, Rattus norvegicus
aatccttaatcttgagcgggtgacc

SEQ ID NO: 59327 - DNA, 25 bp, Rattus norvegicus
aatccttaatgcatttgggtctgta

SEQ ID NO: 59328 - DNA, 25 bp, Rattus norvegicus
aatccttaatgcttttgggtctgta

SEQ ID NO: 59329 - DNA, 25 bp, Rattus norvegicus
aatccttacaaaattcttctcctgc

SEQ ID NO: 59330 - DNA, 25 bp, Rattus norvegicus
aatccttacaaatttcttctcctgc

SEQ ID NO: 59331 - DNA, 25 bp, Rattus norvegicus
aatccttacacacgcagttcccggg

SEQ ID NO: 59332 - DNA, 25 bp, Rattus norvegicus
aatccttacacaggcagttcccggg

SEQ ID NO: 59333 - DNA, 25 bp, Rattus norvegicus
aatccttaccgtaggtcatgccata

SEQ ID NO: 59334 - DNA, 25 bp, Rattus norvegicus
aatccttaccgttggtcatgccata

SEQ ID NO: 59335 - DNA, 25 bp, Rattus norvegicus
aatccttagagcctgttgttggtgt

SEQ ID NO: 59336 - DNA, 25 bp, Rattus norvegicus
aatccttagagcgtgttgttggtgt

SEQ ID NO: 59337 - DNA, 25 bp, Rattus norvegicus
aatccttagcctcgttgttggctgc

SEQ ID NO: 59338 - DNA, 25 bp, Rattus norvegicus
aatccttagcctggttgttggctgc

SEQ ID NO: 59339 - DNA, 25 bp, Rattus norvegicus
aatccttagttgacacagcatttat

SEQ ID NO: 59340 - DNA, 25 bp, Rattus norvegicus
aatccttagttgtcacagcatttat

SEQ ID NO: 59341 - DNA, 25 bp, Rattus norvegicus
aatccttataccaatgagccatgtt

SEQ ID NO: 59342 - DNA, 25 bp, Rattus norvegicus
aatccttatacctatgagccatgtt

SEQ ID NO: 59343 - DNA, 25 bp, Rattus norvegicus
aatccttatactcacccatctttaa

SEQ ID NO: 59344 - DNA, 25 bp, Rattus norvegicus
aatccttatactgacccatctttaa

SEQ ID NO: 59345 - DNA, 25 bp, Rattus norvegicus
aatccttcaacaagtttgactcccc

SEQ ID NO: 59346 - DNA, 25 bp, Rattus norvegicus
aatccttcaacatgtttgactcccc

SEQ ID NO: 59347 - DNA, 25 bp, Rattus norvegicus
aatccttcaatcacttgtatggcaa

SEQ ID NO: 59348 - DNA, 25 bp, Rattus norvegicus
aatccttcaatctcttgtatggcaa

SEQ ID NO: 59349 - DNA, 25 bp, Rattus norvegicus
aatccttcacgccacttactttagg

SEQ ID NO: 59350 - DNA, 25 bp, Rattus norvegicus
aatccttcacgcgacttactttagg

SEQ ID NO: 59351 - DNA, 25 bp, Rattus norvegicus
aatccttcagacatttgtgctccta

SEQ ID NO: 59352 - DNA, 25 bp, Rattus norvegicus
aatccttcagacttttgtgctccta

SEQ ID NO: 59353 - DNA, 25 bp, Rattus norvegicus
aatccttcagggatgacatccggaa

SEQ ID NO: 59354 - DNA, 25 bp, Rattus norvegicus
aatccttcagggttgacatccggaa

SEQ ID NO: 59355 - DNA, 25 bp, Rattus norvegicus
aatccttccacaaactgtctaccaa

SEQ ID NO: 59356 - DNA, 25 bp, Rattus norvegicus
aatccttccacatactgtctaccaa

SEQ ID NO: 59357 - DNA, 25 bp, Rattus norvegicus
aatccttccagcagctatatgcaat

SEQ ID NO: 59358 - DNA, 25 bp, Rattus norvegicus
aatccttccagctgctatatgcaat

SEQ ID NO: 59359 - DNA, 25 bp, Rattus norvegicus
aatccttccctgagcatcgtcaagg

SEQ ID NO: 59360 - DNA, 25 bp, Rattus norvegicus
aatccttccctgtgcatcgtcaagg

SEQ ID NO: 59361 - DNA, 25 bp, Rattus norvegicus
aatccttccgagacccagaacattt

SEQ ID NO: 59362 - DNA, 25 bp, Rattus norvegicus
aatccttccgagtcccagaacattt

SEQ ID NO: 59363 - DNA, 25 bp, Rattus norvegicus
aatccttcgatgaccaagccggatg

SEQ ID NO: 59364 - DNA, 25 bp, Rattus norvegicus
aatccttcgatgtccaagccggatg

SEQ ID NO: 59365 - DNA, 25 bp, Rattus norvegicus
aatccttctgaaccgcatcatcaag

SEQ ID NO: 59366 - DNA, 25 bp, Rattus norvegicus
aatccttctgaagcgcatcatcaag

SEQ ID NO: 59367 - DNA, 25 bp, Rattus norvegicus
aatccttctgtgagtcagtgggcgc

SEQ ID NO: 59368 - DNA, 25 bp, Rattus norvegicus
aatccttctgtgtgtcagtgggcgc

SEQ ID NO: 59369 - DNA, 25 bp, Rattus norvegicus
aatccttgaaagactagcattaaat

SEQ ID NO: 59370 - DNA, 25 bp, Rattus norvegicus
aatccttgaaagtctagcattaaat

SEQ ID NO: 59371 - DNA, 25 bp, Rattus norvegicus
aatccttgatggcagagaattcatg

SEQ ID NO: 59372 - DNA, 25 bp, Rattus norvegicus
aatccttgatgggagagaattcatg

SEQ ID NO: 59373 - DNA, 25 bp, Rattus norvegicus
aatccttgatgtcccctgaacagac

SEQ ID NO: 59374 - DNA, 25 bp, Rattus norvegicus
aatccttgatgtgccctgaacagac

SEQ ID NO: 59375 - DNA, 25 bp, Rattus norvegicus
aatccttggagcctacaaaccagct

SEQ ID NO: 59376 - DNA, 25 bp, Rattus norvegicus
aatccttggagcgtacaaaccagct

SEQ ID NO: 59377 - DNA, 25 bp, Rattus norvegicus
aatccttggatcaggtgggacctta

SEQ ID NO: 59378 - DNA, 25 bp, Rattus norvegicus
aatccttggatctggtgggacctta

SEQ ID NO: 59379 - DNA, 25 bp, Rattus norvegicus
aatccttggcagagtggatctccag

SEQ ID NO: 59380 - DNA, 25 bp, Rattus norvegicus
aatccttggcagtgtggatctccag

SEQ ID NO: 59381 - DNA, 25 bp, Rattus norvegicus
aatccttggcccattagtgtggaca

SEQ ID NO: 59382 - DNA, 25 bp, Rattus norvegicus
aatccttggccctttagtgtggaca

SEQ ID NO: 59383 - DNA, 25 bp, Rattus norvegicus
aatccttgggacaggtgacagacca

SEQ ID NO: 59384 - DNA, 25 bp, Rattus norvegicus
aatccttgggactggtgacagacca

SEQ ID NO: 59385 - DNA, 25 bp, Rattus norvegicus
aatccttggtaaccccactgttatt

SEQ ID NO: 59386 - DNA, 25 bp, Rattus norvegicus
aatccttggtaagcccactgttatt

SEQ ID NO: 59387 - DNA, 25 bp, Rattus norvegicus
aatccttgtctcaagtctggtgcac

SEQ ID NO: 59388 - DNA, 25 bp, Rattus norvegicus
aatccttgtctctagtctggtgcac

SEQ ID NO: 59389 - DNA, 25 bp, Rattus norvegicus
aatccttgtgcaaatgtgtcataat

SEQ ID NO: 59390 - DNA, 25 bp, Rattus norvegicus
aatccttgtgcatatgtgtcataat

SEQ ID NO: 59391 - DNA, 25 bp, Rattus norvegicus
aatccttgtgggaactggctatagc

SEQ ID NO: 59392 - DNA, 25 bp, Rattus norvegicus
aatccttgtgggagcctgactctta

SEQ ID NO: 59393 - DNA, 25 bp, Rattus norvegicus
aatccttgtgggtactggctatagc

SEQ ID NO: 59394 - DNA, 25 bp, Rattus norvegicus
aatccttgtgggtgcctgactctta

SEQ ID NO: 59395 - DNA, 25 bp, Rattus norvegicus
aatccttgtgtgaagccttgggttc

SEQ ID NO: 59396 - DNA, 25 bp, Rattus norvegicus
aatccttgtgtgtagccttgggttc

SEQ ID NO: 59397 - DNA, 25 bp, Rattus norvegicus
aatccttgttagactactgacttaa

SEQ ID NO: 59398 - DNA, 25 bp, Rattus norvegicus
aatccttgttagtctactgacttaa

SEQ ID NO: 59399 - DNA, 25 bp, Rattus norvegicus
aatccttgttgacgtgtggacatca

SEQ ID NO: 59400 - DNA, 25 bp, Rattus norvegicus
aatccttgttgaggtgtggacatca

SEQ ID NO: 59401 - DNA, 25 bp, Rattus norvegicus
aatcctttactcctgtctgctgaag

SEQ ID NO: 59402 - DNA, 25 bp, Rattus norvegicus
aatcctttactcgtgtctgctgaag

SEQ ID NO: 59403 - DNA, 25 bp, Rattus norvegicus
aatcctttagtcagtgagtactcac

SEQ ID NO: 59404 - DNA, 25 bp, Rattus norvegicus
aatcctttagtctgtgagtactcac

SEQ ID NO: 59405 - DNA, 25 bp, Rattus norvegicus
aatcctttagtgattacttcctgca

SEQ ID NO: 59406 - DNA, 25 bp, Rattus norvegicus
aatcctttagtgtttacttcctgca

SEQ ID NO: 59407 - DNA, 25 bp, Rattus norvegicus
aatcctttgatcaggtatctagcaa

SEQ ID NO: 59408 - DNA, 25 bp, Rattus norvegicus
aatcctttgatctggtatctagcaa

SEQ ID NO: 59409 - DNA, 25 bp, Rattus norvegicus
aatcctttgcacatttctgtttcca

SEQ ID NO: 59410 - DNA, 25 bp, Rattus norvegicus
aatcctttgcacttttctgtttcca

SEQ ID NO: 59411 - DNA, 25 bp, Rattus norvegicus
aatcctttgcagagaatgatcccaa

SEQ ID NO: 59412 - DNA, 25 bp, Rattus norvegicus
aatcctttgcagtgaatgatcccaa

SEQ ID NO: 59413 - DNA, 25 bp, Rattus norvegicus
aatcctttgctgattcagtctgtct

SEQ ID NO: 59414 - DNA, 25 bp, Rattus norvegicus
aatcctttgctgtttcagtctgtct

SEQ ID NO: 59415 - DNA, 25 bp, Rattus norvegicus
aatcctttgggtattgcaagagcaa

SEQ ID NO: 59416 - DNA, 25 bp, Rattus norvegicus
aatcctttgggttttgcaagagcaa

SEQ ID NO: 59417 - DNA, 25 bp, Rattus norvegicus
aatcctttgtaaacccggatgttgg

SEQ ID NO: 59418 - DNA, 25 bp, Rattus norvegicus
aatcctttgtaatcccggatgttgg

SEQ ID NO: 59419 - DNA, 25 bp, Rattus norvegicus
aatccttttatgactggtgcaccaa

SEQ ID NO: 59420 - DNA, 25 bp, Rattus norvegicus
aatccttttatgagccaagatgtct

SEQ ID NO: 59421 - DNA, 25 bp, Rattus norvegicus
aatccttttatgtctggtgcaccaa

SEQ ID NO: 59422 - DNA, 25 bp, Rattus norvegicus
aatccttttatgtgccaagatgtct

SEQ ID NO: 59423 - DNA, 25 bp, Rattus norvegicus
aatccttttctgaggaggtgctggc

SEQ ID NO: 59424 - DNA, 25 bp, Rattus norvegicus
aatccttttctgtggaggtgctggc

SEQ ID NO: 59425 - DNA, 25 bp, Rattus norvegicus
aatccttttgtaatttgacttgtag

SEQ ID NO: 59426 - DNA, 25 bp, Rattus norvegicus
aatccttttgtattttgacttgtag

SEQ ID NO: 59427 - DNA, 25 bp, Rattus norvegicus
aatcctttttgtcgagaactctgca

SEQ ID NO: 59428 - DNA, 25 bp, Rattus norvegicus
aatcctttttgtggagaactctgca

SEQ ID NO: 59429 - DNA, 25 bp, Rattus norvegicus
aatcgaacccctaaactcaatgctg

SEQ ID NO: 59430 - DNA, 25 bp, Rattus norvegicus
aatcgaaccccttaactcaatgctg

SEQ ID NO: 59431 - DNA, 25 bp, Rattus norvegicus
aatcgaactcgcattggccaaggaa

SEQ ID NO: 59432 - DNA, 25 bp, Rattus norvegicus
aatcgaactcgctttggccaaggaa

SEQ ID NO: 59433 - DNA, 25 bp, Rattus norvegicus
aatcgaactgttacttccagggcat

SEQ ID NO: 59434 - DNA, 25 bp, Rattus norvegicus
aatcgaactgtttcttccagggcat

SEQ ID NO: 59435 - DNA, 25 bp, Rattus norvegicus
aatcgaagcaccctccatgatagtg

SEQ ID NO: 59436 - DNA, 25 bp, Rattus norvegicus
aatcgaagcaccgtccatgatagtg

SEQ ID NO: 59437 - DNA, 25 bp, Rattus norvegicus
aatcgaagtgtgcactgggttccct

SEQ ID NO: 59438 - DNA, 25 bp, Rattus norvegicus
aatcgaagtgtggactgggttccct

SEQ ID NO: 59439 - DNA, 25 bp, Rattus norvegicus
aatcgaattctcatgtagctctttt

SEQ ID NO: 59440 - DNA, 25 bp, Rattus norvegicus
aatcgaattctcttgtagctctttt

SEQ ID NO: 59441 - DNA, 25 bp, Rattus norvegicus
aatcgaattcttctcagcctttatc

SEQ ID NO: 59442 - DNA, 25 bp, Rattus norvegicus
aatcgaattcttgtcagcctttatc

SEQ ID NO: 59443 - DNA, 25 bp, Rattus norvegicus
aatcgacaaaacattgcaaaagcaa

SEQ ID NO: 59444 - DNA, 25 bp, Rattus norvegicus
aatcgacaaaactttgcaaaagcaa

SEQ ID NO: 59445 - DNA, 25 bp, Rattus norvegicus
aatcgacaagttccattacggcacg

SEQ ID NO: 59446 - DNA, 25 bp, Rattus norvegicus
aatcgacaagttgcattacggcacg

SEQ ID NO: 59447 - DNA, 25 bp, Rattus norvegicus
aatcgacattccattgttggttaca

SEQ ID NO: 59448 - DNA, 25 bp, Rattus norvegicus
aatcgacattcctttgttggttaca

SEQ ID NO: 59449 - DNA, 25 bp, Rattus norvegicus
aatcgaccaggtagctgcagctttg

SEQ ID NO: 59450 - DNA, 25 bp, Rattus norvegicus
aatcgaccaggttgctgcagctttg

SEQ ID NO: 59451 - DNA, 25 bp, Rattus norvegicus
aatcgaccgtcccatgtgattctcc

SEQ ID NO: 59452 - DNA, 25 bp, Rattus norvegicus
aatcgaccgtccgatgtgattctcc

SEQ ID NO: 59453 - DNA, 25 bp, Rattus norvegicus
aatcgacgagagacttatggtcaaa

SEQ ID NO: 59454 - DNA, 25 bp, Rattus norvegicus
aatcgacgagagtcttatggtcaaa

SEQ ID NO: 59455 - DNA, 25 bp, Rattus norvegicus
aatcgactagtgctctaatggctga

SEQ ID NO: 59456 - DNA, 25 bp, Rattus norvegicus
aatcgactagtggtctaatggctga

SEQ ID NO: 59457 - DNA, 25 bp, Rattus norvegicus
aatcgactgatgcatttttcctgga

SEQ ID NO: 59458 - DNA, 25 bp, Rattus norvegicus
aatcgactgatggatttttcctgga

SEQ ID NO: 59459 - DNA, 25 bp, Rattus norvegicus
aatcgacttattccctaccgcttgt

SEQ ID NO: 59460 - DNA, 25 bp, Rattus norvegicus
aatcgacttattgcctaccgcttgt

SEQ ID NO: 59461 - DNA, 25 bp, Rattus norvegicus
aatcgagaaacgacagtcttgtgaa

SEQ ID NO: 59462 - DNA, 25 bp, Rattus norvegicus
aatcgagaaacgtcagtcttgtgaa

SEQ ID NO: 59463 - DNA, 25 bp, Rattus norvegicus
aatcgagaggttcatttttaatgcc

SEQ ID NO: 59464 - DNA, 25 bp, Rattus norvegicus
aatcgagaggttgatttttaatgcc

SEQ ID NO: 59465 - DNA, 25 bp, Rattus norvegicus
aatcgagatgacacaggagcacagc

SEQ ID NO: 59466 - DNA, 25 bp, Rattus norvegicus
aatcgagatgactcaggagcacagc

SEQ ID NO: 59467 - DNA, 25 bp, Rattus norvegicus
aatcgagcgcctcaccagggaggta

SEQ ID NO: 59468 - DNA, 25 bp, Rattus norvegicus
aatcgagcgcctgaccagggaggta

SEQ ID NO: 59469 - DNA, 25 bp, Rattus norvegicus
aatcgagctggaaatgtgacttggt

SEQ ID NO: 59470 - DNA, 25 bp, Rattus norvegicus
aatcgagctggatatgtgacttggt

SEQ ID NO: 59471 - DNA, 25 bp, Rattus norvegicus
aatcgagtaactatccatgtgcttt

SEQ ID NO: 59472 - DNA, 25 bp, Rattus norvegicus
aatcgagtaactcgactcttccctg

SEQ ID NO: 59473 - DNA, 25 bp, Rattus norvegicus
aatcgagtaactggactcttccctg

SEQ ID NO: 59474 - DNA, 25 bp, Rattus norvegicus
aatcgagtaactttccatgtgcttt

SEQ ID NO: 59475 - DNA, 25 bp, Rattus norvegicus
aatcgatagtcaacatgccaagagt

SEQ ID NO: 59476 - DNA, 25 bp, Rattus norvegicus
aatcgatagtcatcatgccaagagt

SEQ ID NO: 59477 - DNA, 25 bp, Rattus norvegicus
aatcgatcataaatcggcgcgattt

SEQ ID NO: 59478 - DNA, 25 bp, Rattus norvegicus
aatcgatcataattcggcgcgattt

SEQ ID NO: 59479 - DNA, 25 bp, Rattus norvegicus
aatcgatgtctcaggttaaggccgc

SEQ ID NO: 59480 - DNA, 25 bp, Rattus norvegicus
aatcgatgtctctggttaaggccgc

SEQ ID NO: 59481 - DNA, 25 bp, Rattus norvegicus
aatcgatgtggcagcccgtggactg

SEQ ID NO: 59482 - DNA, 25 bp, Rattus norvegicus
aatcgatgtggctgcccgtggactg

SEQ ID NO: 59483 - DNA, 25 bp, Rattus norvegicus
aatcgatgttacatctgttgttctt

SEQ ID NO: 59484 - DNA, 25 bp, Rattus norvegicus
aatcgatgttacttctgttgttctt

SEQ ID NO: 59485 - DNA, 25 bp, Rattus norvegicus
aatcgattcattcgctgtctcttgt

SEQ ID NO: 59486 - DNA, 25 bp, Rattus norvegicus
aatcgattcattggctgtctcttgt

SEQ ID NO: 59487 - DNA, 25 bp, Rattus norvegicus
aatcgattctgtactttggaaactc

SEQ ID NO: 59488 - DNA, 25 bp, Rattus norvegicus
aatcgattctgttctttggaaactc

SEQ ID NO: 59489 - DNA, 25 bp, Rattus norvegicus
aatcgattctttcccgcagcagtgg

SEQ ID NO: 59490 - DNA, 25 bp, Rattus norvegicus
aatcgattctttgccgcagcagtgg

SEQ ID NO: 59491 - DNA, 25 bp, Rattus norvegicus
aatcgatttcttaccattgtgacaa

SEQ ID NO: 59492 - DNA, 25 bp, Rattus norvegicus
aatcgatttctttccattgtgacaa

SEQ ID NO: 59493 - DNA, 25 bp, Rattus norvegicus
aatcgcacaaggcaagggtcagaaa

SEQ ID NO: 59494 - DNA, 25 bp, Rattus norvegicus
aatcgcacaagggaagggtcagaaa

SEQ ID NO: 59495 - DNA, 25 bp, Rattus norvegicus
aatcgcacaatgaactgtaacccaa

SEQ ID NO: 59496 - DNA, 25 bp, Rattus norvegicus
aatcgcacaatgtactgtaacccaa

SEQ ID NO: 59497 - DNA, 25 bp, Rattus norvegicus
aatcgcaccaagaaatggatccagg

SEQ ID NO: 59498 - DNA, 25 bp, Rattus norvegicus
aatcgcaccaagtaatggatccagg

SEQ ID NO: 59499 - DNA, 25 bp, Rattus norvegicus
aatcgcaccgtgagtcttgtatctg

SEQ ID NO: 59500 - DNA, 25 bp, Rattus norvegicus
aatcgcaccgtgtgtcttgtatctg

SEQ ID NO: 59501 - DNA, 25 bp, Rattus norvegicus
aatcgcagcactcaagagatggtct

SEQ ID NO: 59502 - DNA, 25 bp, Rattus norvegicus
aatcgcagcactgaagagatggtct

SEQ ID NO: 59503 - DNA, 25 bp, Rattus norvegicus
aatcgcatcagaaactgggcattgt

SEQ ID NO: 59504 - DNA, 25 bp, Rattus norvegicus
aatcgcatcagatactgggcattgt

SEQ ID NO: 59505 - DNA, 25 bp, Rattus norvegicus
aatcgcatccatcttgtcttgttgt

SEQ ID NO: 59506 - DNA, 25 bp, Rattus norvegicus
aatcgcatccatgttgtcttgttgt

SEQ ID NO: 59507 - DNA, 25 bp, Rattus norvegicus
aatcgccactggactaggtgttcta

SEQ ID NO: 59508 - DNA, 25 bp, Rattus norvegicus
aatcgccactggtctaggtgttcta

SEQ ID NO: 59509 - DNA, 25 bp, Rattus norvegicus
aatcgcccaggtacctagaggtggt

SEQ ID NO: 59510 - DNA, 25 bp, Rattus norvegicus
aatcgcccaggttcctagaggtggt

SEQ ID NO: 59511 - DNA, 25 bp, Rattus norvegicus
aatcgcccggatacatgtgctggtt

SEQ ID NO: 59512 - DNA, 25 bp, Rattus norvegicus
aatcgcccggattcatgtgctggtt

SEQ ID NO: 59513 - DNA, 25 bp, Rattus norvegicus
aatcgccctggcatggagatgaaat

SEQ ID NO: 59514 - DNA, 25 bp, Rattus norvegicus
aatcgccctggcttggagatgaaat

SEQ ID NO: 59515 - DNA, 25 bp, Rattus norvegicus
aatcgccgaggacattgccaaagct

SEQ ID NO: 59516 - DNA, 25 bp, Rattus norvegicus
aatcgccgaggagattgccaaagct

SEQ ID NO: 59517 - DNA, 25 bp, Rattus norvegicus
aatcgccgtgggagaatcgtgaatc

SEQ ID NO: 59518 - DNA, 25 bp, Rattus norvegicus
aatcgccgtgggtgaatcgtgaatc

SEQ ID NO: 59519 - DNA, 25 bp, Rattus norvegicus
aatcgcctatttcatttttcattgg

SEQ ID NO: 59520 - DNA, 25 bp, Rattus norvegicus
aatcgcctatttgatttttcattgg

SEQ ID NO: 59521 - DNA, 25 bp, Rattus norvegicus
aatcgcctgcttcatcttggttttt

SEQ ID NO: 59522 - DNA, 25 bp, Rattus norvegicus
aatcgcctgcttgatcttggttttt

SEQ ID NO: 59523 - DNA, 25 bp, Rattus norvegicus
aatcgcctgtggaaatgtcacggac

SEQ ID NO: 59524 - DNA, 25 bp, Rattus norvegicus
aatcgcctgtggtaatgtcacggac

SEQ ID NO: 59525 - DNA, 25 bp, Rattus norvegicus
aatcgccttttgcatattctttcac

SEQ ID NO: 59526 - DNA, 25 bp, Rattus norvegicus
aatcgccttttggatattctttcac

SEQ ID NO: 59527 - DNA, 25 bp, Rattus norvegicus
aatcgcgccgggaccatggagaagc

SEQ ID NO: 59528 - DNA, 25 bp, Rattus norvegicus
aatcgcgccgggtccatggagaagc

SEQ ID NO: 59529 - DNA, 25 bp, Rattus norvegicus
aatcgcgctgttccaattctttgta

SEQ ID NO: 59530 - DNA, 25 bp, Rattus norvegicus
aatcgcgctgttgcaattctttgta

SEQ ID NO: 59531 - DNA, 25 bp, Rattus norvegicus
aatcgcgcttctagaagacctatgt

SEQ ID NO: 59532 - DNA, 25 bp, Rattus norvegicus
aatcgcgcttcttgaagacctatgt

SEQ ID NO: 59533 - DNA, 25 bp, Rattus norvegicus
aatcgcgggtttcctgtgtgacaat

SEQ ID NO: 59534 - DNA, 25 bp, Rattus norvegicus
aatcgcgggtttgctgtgtgacaat

SEQ ID NO: 59535 - DNA, 25 bp, Rattus norvegicus
aatcgcgtactcacagccttagcaa

SEQ ID NO: 59536 - DNA, 25 bp, Rattus norvegicus
aatcgcgtactctcagccttagcaa

SEQ ID NO: 59537 - DNA, 25 bp, Rattus norvegicus
aatcgcgtctcgaccaggagctaaa

SEQ ID NO: 59538 - DNA, 25 bp, Rattus norvegicus
aatcgcgtctcgtccaggagctaaa

SEQ ID NO: 59539 - DNA, 25 bp, Rattus norvegicus
aatcgctaacaactgctccgaatca

SEQ ID NO: 59540 - DNA, 25 bp, Rattus norvegicus
aatcgctaacaagtgctccgaatca

SEQ ID NO: 59541 - DNA, 25 bp, Rattus norvegicus
aatcgctacctgactcggcggcggc

SEQ ID NO: 59542 - DNA, 25 bp, Rattus norvegicus
aatcgctacctgtctcggcggcggc

SEQ ID NO: 59543 - DNA, 25 bp, Rattus norvegicus
aatcgctactatctgtccaagggcc

SEQ ID NO: 59544 - DNA, 25 bp, Rattus norvegicus
aatcgctactatgtgtccaagggcc

SEQ ID NO: 59545 - DNA, 25 bp, Rattus norvegicus
aatcgctatgttcctttctctataa

SEQ ID NO: 59546 - DNA, 25 bp, Rattus norvegicus
aatcgctatgttgctttctctataa

SEQ ID NO: 59547 - DNA, 25 bp, Rattus norvegicus
aatcgctcagggattctcagtgtcc

SEQ ID NO: 59548 - DNA, 25 bp, Rattus norvegicus
aatcgctcagggtttctcagtgtcc

SEQ ID NO: 59549 - DNA, 25 bp, Rattus norvegicus
aatcgctccagcactgcagtatggg

SEQ ID NO: 59550 - DNA, 25 bp, Rattus norvegicus
aatcgctccagctctgcagtatggg

SEQ ID NO: 59551 - DNA, 25 bp, Rattus norvegicus
aatcgctccatcagattggcttatg

SEQ ID NO: 59552 - DNA, 25 bp, Rattus norvegicus
aatcgctccatctgattggcttatg

SEQ ID NO: 59553 - DNA, 25 bp, Rattus norvegicus
aatcgctcctggcaggcagttgatt

SEQ ID NO: 59554 - DNA, 25 bp, Rattus norvegicus
aatcgctcctgggaggcagttgatt

SEQ ID NO: 59555 - DNA, 25 bp, Rattus norvegicus
aatcgctgcagaagggcgacaaccg

SEQ ID NO: 59556 - DNA, 25 bp, Rattus norvegicus
aatcgctgcagatgggcgacaaccg

SEQ ID NO: 59557 - DNA, 25 bp, Rattus norvegicus
aatcgctgcgagctcattctaatag

SEQ ID NO: 59558 - DNA, 25 bp, Rattus norvegicus
aatcgctgcgaggtcattctaatag

SEQ ID NO: 59559 - DNA, 25 bp, Rattus norvegicus
aatcgctgcgtcaggtttgtttctg

SEQ ID NO: 59560 - DNA, 25 bp, Rattus norvegicus
aatcgctgcgtctggtttgtttctg

SEQ ID NO: 59561 - DNA, 25 bp, Rattus norvegicus
aatcgcttagacagaaacgtgtgta

SEQ ID NO: 59562 - DNA, 25 bp, Rattus norvegicus
aatcgcttagactgaaacgtgtgta

SEQ ID NO: 59563 - DNA, 25 bp, Rattus norvegicus
aatcgcttagctctggaagtgtcta

SEQ ID NO: 59564 - DNA, 25 bp, Rattus norvegicus
aatcgcttagctgtggaagtgtcta

SEQ ID NO: 59565 - DNA, 25 bp, Rattus norvegicus
aatcgcttcctccttgggttgagga

SEQ ID NO: 59566 - DNA, 25 bp, Rattus norvegicus
aatcgcttcctcgttgggttgagga

SEQ ID NO: 59567 - DNA, 25 bp, Rattus norvegicus
aatcgctttattactctgttaccac

SEQ ID NO: 59568 - DNA, 25 bp, Rattus norvegicus
aatcgctttatttctctgttaccac

SEQ ID NO: 59569 - DNA, 25 bp, Rattus norvegicus
aatcgctttgatcttgaactttaca

SEQ ID NO: 59570 - DNA, 25 bp, Rattus norvegicus
aatcgctttgatgttgaactttaca

SEQ ID NO: 59571 - DNA, 25 bp, Rattus norvegicus
aatcggaacacaatcagctgctggg

SEQ ID NO: 59572 - DNA, 25 bp, Rattus norvegicus
aatcggaacacattcagctgctggg

SEQ ID NO: 59573 - DNA, 25 bp, Rattus norvegicus
aatcggaagtttcaggtcatccttg

SEQ ID NO: 59574 - DNA, 25 bp, Rattus norvegicus
aatcggaagtttgaggtcatccttg

SEQ ID NO: 59575 - DNA, 25 bp, Rattus norvegicus
aatcggacagggagctttgttcttc

SEQ ID NO: 59576 - DNA, 25 bp, Rattus norvegicus
aatcggacagggtgctttgttcttc

SEQ ID NO: 59577 - DNA, 25 bp, Rattus norvegicus
aatcggaccattactatctgtctat

SEQ ID NO: 59578 - DNA, 25 bp, Rattus norvegicus
aatcggaccatttctatctgtctat

SEQ ID NO: 59579 - DNA, 25 bp, Rattus norvegicus
aatcggactctacaataatgcctgt

SEQ ID NO: 59580 - DNA, 25 bp, Rattus norvegicus
aatcggactctagaataatgcctgt

SEQ ID NO: 59581 - DNA, 25 bp, Rattus norvegicus
aatcggatatgtctaccgactccct

SEQ ID NO: 59582 - DNA, 25 bp, Rattus norvegicus
aatcggatatgtgtaccgactccct

SEQ ID NO: 59583 - DNA, 25 bp, Rattus norvegicus
aatcggattcccattccatatcttt

SEQ ID NO: 59584 - DNA, 25 bp, Rattus norvegicus
aatcggattccctttccatatcttt

SEQ ID NO: 59585 - DNA, 25 bp, Rattus norvegicus
aatcggcacaatatgttgtatgtat

SEQ ID NO: 59586 - DNA, 25 bp, Rattus norvegicus
aatcggcacaatttgttgtatgtat

SEQ ID NO: 59587 - DNA, 25 bp, Rattus norvegicus
aatcggcactttcttcaagtgggac

SEQ ID NO: 59588 - DNA, 25 bp, Rattus norvegicus
aatcggcactttgttcaagtgggac

SEQ ID NO: 59589 - DNA, 25 bp, Rattus norvegicus
aatcggcatagcctgttttcacaac

SEQ ID NO: 59590 - DNA, 25 bp, Rattus norvegicus
aatcggcatagcgtgttttcacaac

SEQ ID NO: 59591 - DNA, 25 bp, Rattus norvegicus
aatcggccatcacagaaactccagt

SEQ ID NO: 59592 - DNA, 25 bp, Rattus norvegicus
aatcggccatcagagaaactccagt

SEQ ID NO: 59593 - DNA, 25 bp, Rattus norvegicus
aatcggcggctaaggagcgtcctca

SEQ ID NO: 59594 - DNA, 25 bp, Rattus norvegicus
aatcggcggctatggagcgtcctca

SEQ ID NO: 59595 - DNA, 25 bp, Rattus norvegicus
aatcggcgtctgaccaggagctgat

SEQ ID NO: 59596 - DNA, 25 bp, Rattus norvegicus
aatcggcgtctgtccaggagctgat

SEQ ID NO: 59597 - DNA, 25 bp, Rattus norvegicus
aatcggctccaaccaaaacgtccag

SEQ ID NO: 59598 - DNA, 25 bp, Rattus norvegicus
aatcggctccaagcaaaacgtccag

SEQ ID NO: 59599 - DNA, 25 bp, Rattus norvegicus
aatcggctgcagactgatggccaag

SEQ ID NO: 59600 - DNA, 25 bp, Rattus norvegicus
aatcggctgcagtctgatggccaag

SEQ ID NO: 59601 - DNA, 25 bp, Rattus norvegicus
aatcggctgctgaatcaaggccctg

SEQ ID NO: 59602 - DNA, 25 bp, Rattus norvegicus
aatcggctgctgtatcaaggccctg

SEQ ID NO: 59603 - DNA, 25 bp, Rattus norvegicus
aatcggcttcagcaatggaactgca

SEQ ID NO: 59604 - DNA, 25 bp, Rattus norvegicus
aatcggcttcaggaatggaactgca

SEQ ID NO: 59605 - DNA, 25 bp, Rattus norvegicus
aatcgggaaggaacacgttgctttg

SEQ ID NO: 59606 - DNA, 25 bp, Rattus norvegicus
aatcgggaaggatcacgttgctttg

SEQ ID NO: 59607 - DNA, 25 bp, Rattus norvegicus
aatcgggaccatattgcttcagtgt

SEQ ID NO: 59608 - DNA, 25 bp, Rattus norvegicus
aatcgggaccattttgcttcagtgt

SEQ ID NO: 59609 - DNA, 25 bp, Rattus norvegicus
aatcgggatccacattcctacgtgg

SEQ ID NO: 59610 - DNA, 25 bp, Rattus norvegicus
aatcgggatccagattcctacgtgg

SEQ ID NO: 59611 - DNA, 25 bp, Rattus norvegicus
aatcgggtgtggcatacacctgtaa

SEQ ID NO: 59612 - DNA, 25 bp, Rattus norvegicus
aatcgggtgtgggatacacctgtaa

SEQ ID NO: 59613 - DNA, 25 bp, Rattus norvegicus
aatcgggtttggcttcactcttgca

SEQ ID NO: 59614 - DNA, 25 bp, Rattus norvegicus
aatcgggtttgggttcactcttgca

SEQ ID NO: 59615 - DNA, 25 bp, Rattus norvegicus
aatcggtatggaatccctgtgtggc

SEQ ID NO: 59616 - DNA, 25 bp, Rattus norvegicus
aatcggtatggattccctgtgtggc

SEQ ID NO: 59617 - DNA, 25 bp, Rattus norvegicus
aatcggtcagataggttctatatgg

SEQ ID NO: 59618 - DNA, 25 bp, Rattus norvegicus
aatcggtcagattggttctatatgg

SEQ ID NO: 59619 - DNA, 25 bp, Rattus norvegicus
aatcggtctgcaaaccatgtggaat

SEQ ID NO: 59620 - DNA, 25 bp, Rattus norvegicus
aatcggtctgcataccatgtggaat

SEQ ID NO: 59621 - DNA, 25 bp, Rattus norvegicus
aatcggtggcaacatatctctgtaa

SEQ ID NO: 59622 - DNA, 25 bp, Rattus norvegicus
aatcggtggcaagatatctctgtaa

SEQ ID NO: 59623 - DNA, 25 bp, Rattus norvegicus
aatcggtgtgaaactttcctgcagc

SEQ ID NO: 59624 - DNA, 25 bp, Rattus norvegicus
aatcggtgtgaatctttcctgcagc

SEQ ID NO: 59625 - DNA, 25 bp, Rattus norvegicus
aatcggtgtgtcaagctaggagtct

SEQ ID NO: 59626 - DNA, 25 bp, Rattus norvegicus
aatcggtgtgtcatgacatctcgcc

SEQ ID NO: 59627 - DNA, 25 bp, Rattus norvegicus
aatcggtgtgtctagctaggagtct

SEQ ID NO: 59628 - DNA, 25 bp, Rattus norvegicus
aatcggtgtgtcttgacatctcgcc

SEQ ID NO: 59629 - DNA, 25 bp, Rattus norvegicus
aatcggttcctacagtgcctgcatc

SEQ ID NO: 59630 - DNA, 25 bp, Rattus norvegicus
aatcggttcctagagtgcctgcatc

SEQ ID NO: 59631 - DNA, 25 bp, Rattus norvegicus
aatcggttgtttagtttgctcctat

SEQ ID NO: 59632 - DNA, 25 bp, Rattus norvegicus
aatcggttgttttgtttgctcctat

SEQ ID NO: 59633 - DNA, 25 bp, Rattus norvegicus
aatcggttttttcttgtcaatgtgt

SEQ ID NO: 59634 - DNA, 25 bp, Rattus norvegicus
aatcggttttttgttgtcaatgtgt

SEQ ID NO: 59635 - DNA, 25 bp, Rattus norvegicus
aatcgtacatacaatgggccgtgag

SEQ ID NO: 59636 - DNA, 25 bp, Rattus norvegicus
aatcgtacatactatgggccgtgag

SEQ ID NO: 59637 - DNA, 25 bp, Rattus norvegicus
aatcgtacctatatctttctagtga

SEQ ID NO: 59638 - DNA, 25 bp, Rattus norvegicus
aatcgtacctatttctttctagtga

SEQ ID NO: 59639 - DNA, 25 bp, Rattus norvegicus
aatcgtactctaaaaaggcaggtgg

SEQ ID NO: 59640 - DNA, 25 bp, Rattus norvegicus
aatcgtactctataaaggcaggtgg

SEQ ID NO: 59641 - DNA, 25 bp, Rattus norvegicus
aatcgtactggaaggctcttggcat

SEQ ID NO: 59642 - DNA, 25 bp, Rattus norvegicus
aatcgtactggatggctcttggcat

SEQ ID NO: 59643 - DNA, 25 bp, Rattus norvegicus
aatcgtatagacatcccagtgctgg

SEQ ID NO: 59644 - DNA, 25 bp, Rattus norvegicus
aatcgtatagacttcccagtgctgg

SEQ ID NO: 59645 - DNA, 25 bp, Rattus norvegicus
aatcgtatctgtaattctgtccctg

SEQ ID NO: 59646 - DNA, 25 bp, Rattus norvegicus
aatcgtatctgttattctgtccctg

SEQ ID NO: 59647 - DNA, 25 bp, Rattus norvegicus
aatcgtatgatcaagacatgcctta

SEQ ID NO: 59648 - DNA, 25 bp, Rattus norvegicus
aatcgtatgatctagacatgcctta

SEQ ID NO: 59649 - DNA, 25 bp, Rattus norvegicus
aatcgtatgttgacattctctggct

SEQ ID NO: 59650 - DNA, 25 bp, Rattus norvegicus
aatcgtatgttgtcattctctggct

SEQ ID NO: 59651 - DNA, 25 bp, Rattus norvegicus
aatcgtcatgaaaccaaatctttgg

SEQ ID NO: 59652 - DNA, 25 bp, Rattus norvegicus
aatcgtcatgaatccaaatctttgg

SEQ ID NO: 59653 - DNA, 25 bp, Rattus norvegicus
aatcgtccagataagctccaagcag

SEQ ID NO: 59654 - DNA, 25 bp, Rattus norvegicus
aatcgtccagattagctccaagcag

SEQ ID NO: 59655 - DNA, 25 bp, Rattus norvegicus
aatcgtccctagcaaaaccacagag

SEQ ID NO: 59656 - DNA, 25 bp, Rattus norvegicus
aatcgtccctaggaaaaccacagag

SEQ ID NO: 59657 - DNA, 25 bp, Rattus norvegicus
aatcgtccgattccaggaggttgcc

SEQ ID NO: 59658 - DNA, 25 bp, Rattus norvegicus
aatcgtccgattgcaggaggttgcc

SEQ ID NO: 59659 - DNA, 25 bp, Rattus norvegicus
aatcgtccgctcattgtgaatggtc

SEQ ID NO: 59660 - DNA, 25 bp, Rattus norvegicus
aatcgtccgctctttgtgaatggtc

SEQ ID NO: 59661 - DNA, 25 bp, Rattus norvegicus
aatcgtcctagaccattttaatgtt

SEQ ID NO: 59662 - DNA, 25 bp, Rattus norvegicus
aatcgtcctagagcattttaatgtt

SEQ ID NO: 59663 - DNA, 25 bp, Rattus norvegicus
aatcgtcctgatatgttatgggttt

SEQ ID NO: 59664 - DNA, 25 bp, Rattus norvegicus
aatcgtcctgatttgttatgggttt

SEQ ID NO: 59665 - DNA, 25 bp, Rattus norvegicus
aatcgtctcctgctagttgttatta

SEQ ID NO: 59666 - DNA, 25 bp, Rattus norvegicus
aatcgtctcctggtagttgttatta

SEQ ID NO: 59667 - DNA, 25 bp, Rattus norvegicus
aatcgtctgatgctctgtgtggaag

SEQ ID NO: 59668 - DNA, 25 bp, Rattus norvegicus
aatcgtctgatggtctgtgtggaag

SEQ ID NO: 59669 - DNA, 25 bp, Rattus norvegicus
aatcgtctgcttcctgcttaacaag

SEQ ID NO: 59670 - DNA, 25 bp, Rattus norvegicus
aatcgtctgcttgctgcttaacaag

SEQ ID NO: 59671 - DNA, 25 bp, Rattus norvegicus
aatcgtctggctagagagaacgtca

SEQ ID NO: 59672 - DNA, 25 bp, Rattus norvegicus
aatcgtctggcttgagagaacgtca

SEQ ID NO: 59673 - DNA, 25 bp, Rattus norvegicus
aatcgtcttatactctcatttctgc

SEQ ID NO: 59674 - DNA, 25 bp, Rattus norvegicus
aatcgtcttatagtctcatttctgc

SEQ ID NO: 59675 - DNA, 25 bp, Rattus norvegicus
aatcgtgacaaacagcttcccagtg

SEQ ID NO: 59676 - DNA, 25 bp, Rattus norvegicus
aatcgtgacaaagagcttcccagtg

SEQ ID NO: 59677 - DNA, 25 bp, Rattus norvegicus
aatcgtgacgacattggaactgtat

SEQ ID NO: 59678 - DNA, 25 bp, Rattus norvegicus
aatcgtgacgactttggaactgtat

SEQ ID NO: 59679 - DNA, 25 bp, Rattus norvegicus
aatcgtgacgatatcctacacacac

SEQ ID NO: 59680 - DNA, 25 bp, Rattus norvegicus
aatcgtgacgatttcctacacacac

SEQ ID NO: 59681 - DNA, 25 bp, Rattus norvegicus
aatcgtgagaggacgtgctgcccag

SEQ ID NO: 59682 - DNA, 25 bp, Rattus norvegicus
aatcgtgagaggtcgtgctgcccag

SEQ ID NO: 59683 - DNA, 25 bp, Rattus norvegicus
aatcgtgatgatatccagtcagcat

SEQ ID NO: 59684 - DNA, 25 bp, Rattus norvegicus
aatcgtgatgatttccagtcagcat

SEQ ID NO: 59685 - DNA, 25 bp, Rattus norvegicus
aatcgtgcatatatagtagcgcttg

SEQ ID NO: 59686 - DNA, 25 bp, Rattus norvegicus
aatcgtgcatatttagtagcgcttg

SEQ ID NO: 59687 - DNA, 25 bp, Rattus norvegicus
aatcgtgccattcccattttccttg

SEQ ID NO: 59688 - DNA, 25 bp, Rattus norvegicus
aatcgtgccattgccattttccttg

SEQ ID NO: 59689 - DNA, 25 bp, Rattus norvegicus
aatcgtgccccaacatacagaagtg

SEQ ID NO: 59690 - DNA, 25 bp, Rattus norvegicus
aatcgtgccccatcatacagaagtg

SEQ ID NO: 59691 - DNA, 25 bp, Rattus norvegicus
aatcgtgctattaaaatcttttcta

SEQ ID NO: 59692 - DNA, 25 bp, Rattus norvegicus
aatcgtgctatttaaatcttttcta

SEQ ID NO: 59693 - DNA, 25 bp, Rattus norvegicus
aatcgtggccttcatgtgtattcta

SEQ ID NO: 59694 - DNA, 25 bp, Rattus norvegicus
aatcgtggccttgatgtgtattcta

SEQ ID NO: 59695 - DNA, 25 bp, Rattus norvegicus
aatcgtgggtgaaatgacgttgccg

SEQ ID NO: 59696 - DNA, 25 bp, Rattus norvegicus
aatcgtgggtgatatgacgttgccg

SEQ ID NO: 59697 - DNA, 25 bp, Rattus norvegicus
aatcgtggtcccatggctgaagatc

SEQ ID NO: 59698 - DNA, 25 bp, Rattus norvegicus
aatcgtggtcccttggctgaagatc

SEQ ID NO: 59699 - DNA, 25 bp, Rattus norvegicus
aatcgtggtcctcttgacaagtgga

SEQ ID NO: 59700 - DNA, 25 bp, Rattus norvegicus
aatcgtggtcctgttgacaagtgga

SEQ ID NO: 59701 - DNA, 25 bp, Rattus norvegicus
aatcgtggtctgagcttcatacctg

SEQ ID NO: 59702 - DNA, 25 bp, Rattus norvegicus
aatcgtggtctgtgcttcatacctg

SEQ ID NO: 59703 - DNA, 25 bp, Rattus norvegicus
aatcgtgtactcctgtgtctgccta

SEQ ID NO: 59704 - DNA, 25 bp, Rattus norvegicus
aatcgtgtactcgtgtgtctgccta

SEQ ID NO: 59705 - DNA, 25 bp, Rattus norvegicus
aatcgtgtagcgctcagtcaccttg

SEQ ID NO: 59706 - DNA, 25 bp, Rattus norvegicus
aatcgtgtagcggtcagtcaccttg

SEQ ID NO: 59707 - DNA, 25 bp, Rattus norvegicus
aatcgtgtccatagatgtgggtcca

SEQ ID NO: 59708 - DNA, 25 bp, Rattus norvegicus
aatcgtgtccattgatgtgggtcca

SEQ ID NO: 59709 - DNA, 25 bp, Rattus norvegicus
aatcgtgtgaagagtctgtctccca

SEQ ID NO: 59710 - DNA, 25 bp, Rattus norvegicus
aatcgtgtgaagtgtctgtctccca

SEQ ID NO: 59711 - DNA, 25 bp, Rattus norvegicus
aatcgtgttcccacctgaaaatggt

SEQ ID NO: 59712 - DNA, 25 bp, Rattus norvegicus
aatcgtgttccctcctgaaaatggt

SEQ ID NO: 59713 - DNA, 25 bp, Rattus norvegicus
aatcgtgtttgtcatccagagtcag

SEQ ID NO: 59714 - DNA, 25 bp, Rattus norvegicus
aatcgtgtttgtgatccagagtcag

SEQ ID NO: 59715 - DNA, 25 bp, Rattus norvegicus
aatcgttcaaatacttcttcgcctg

SEQ ID NO: 59716 - DNA, 25 bp, Rattus norvegicus
aatcgttcaaattcttcttcgcctg

SEQ ID NO: 59717 - DNA, 25 bp, Rattus norvegicus
aatcgttcgataagctgtgcccact

SEQ ID NO: 59718 - DNA, 25 bp, Rattus norvegicus
aatcgttcgatatgctgtgcccact

SEQ ID NO: 59719 - DNA, 25 bp, Rattus norvegicus
aatcgttcgggaaaggcctctgttg

SEQ ID NO: 59720 - DNA, 25 bp, Rattus norvegicus
aatcgttcgggataggcctctgttg

SEQ ID NO: 59721 - DNA, 25 bp, Rattus norvegicus
aatcgttgccacagatcagtcctga

SEQ ID NO: 59722 - DNA, 25 bp, Rattus norvegicus
aatcgttgccactgatcagtcctga

SEQ ID NO: 59723 - DNA, 25 bp, Rattus norvegicus
aatcgtttactgatgtgatgttaag

SEQ ID NO: 59724 - DNA, 25 bp, Rattus norvegicus
aatcgtttactgttgtgatgttaag

SEQ ID NO: 59725 - DNA, 25 bp, Rattus norvegicus
aatcgtttcatcattcggcgtgcga

SEQ ID NO: 59726 - DNA, 25 bp, Rattus norvegicus
aatcgtttcatctttcggcgtgcga

SEQ ID NO: 59727 - DNA, 25 bp, Rattus norvegicus
aatcgttttcttatctcatgttcag

SEQ ID NO: 59728 - DNA, 25 bp, Rattus norvegicus
aatcgttttcttttctcatgttcag

SEQ ID NO: 59729 - DNA, 25 bp, Rattus norvegicus
aatcgtttttaaacctttgcctatg

SEQ ID NO: 59730 - DNA, 25 bp, Rattus norvegicus
aatcgtttttaatcctttgcctatg

SEQ ID NO: 59731 - DNA, 25 bp, Rattus norvegicus
aatctaaagacgcacctggtgcggc

SEQ ID NO: 59732 - DNA, 25 bp, Rattus norvegicus
aatctaaagacggacctggtgcggc

SEQ ID NO: 59733 - DNA, 25 bp, Rattus norvegicus
aatctaaaggatacagccctgcctt

SEQ ID NO: 59734 - DNA, 25 bp, Rattus norvegicus
aatctaaaggattcagccctgcctt

SEQ ID NO: 59735 - DNA, 25 bp, Rattus norvegicus
aatctaagaaggactgtgccgccgc

SEQ ID NO: 59736 - DNA, 25 bp, Rattus norvegicus
aatctaagaaggtctgtgccgccgc

SEQ ID NO: 59737 - DNA, 25 bp, Rattus norvegicus
aatctaagcctgcatcctacatgat

SEQ ID NO: 59738 - DNA, 25 bp, Rattus norvegicus
aatctaagcctggatcctacatgat

SEQ ID NO: 59739 - DNA, 25 bp, Rattus norvegicus
aatctaagcgtaaacacccgcatcg

SEQ ID NO: 59740 - DNA, 25 bp, Rattus norvegicus
aatctaagcgtatacacccgcatcg

SEQ ID NO: 59741 - DNA, 25 bp, Rattus norvegicus
aatctaaggcataccagttgtctgg

SEQ ID NO: 59742 - DNA, 25 bp, Rattus norvegicus
aatctaaggcattccagttgtctgg

SEQ ID NO: 59743 - DNA, 25 bp, Rattus norvegicus
aatctaagttatactcaccagccag

SEQ ID NO: 59744 - DNA, 25 bp, Rattus norvegicus
aatctaagttattctcaccagccag

SEQ ID NO: 59745 - DNA, 25 bp, Rattus norvegicus
aatctaatcgtcaagtgttatacac

SEQ ID NO: 59746 - DNA, 25 bp, Rattus norvegicus
aatctaatcgtctagtgttatacac

SEQ ID NO: 59747 - DNA, 25 bp, Rattus norvegicus
aatctaatgcccatcaactggagag

SEQ ID NO: 59748 - DNA, 25 bp, Rattus norvegicus
aatctaatgcccttcaactggagag

SEQ ID NO: 59749 - DNA, 25 bp, Rattus norvegicus
aatctaatgctccttttaaatgaca

SEQ ID NO: 59750 - DNA, 25 bp, Rattus norvegicus
aatctaatgctcgttttaaatgaca

SEQ ID NO: 59751 - DNA, 25 bp, Rattus norvegicus
aatctaatgtctctgtgtgctgtgc

SEQ ID NO: 59752 - DNA, 25 bp, Rattus norvegicus
aatctaatgtctgtgtgtgctgtgc

SEQ ID NO: 59753 - DNA, 25 bp, Rattus norvegicus
aatctaatgtgtatctgcagcccga

SEQ ID NO: 59754 - DNA, 25 bp, Rattus norvegicus
aatctaatgtgtttctgcagcccga

SEQ ID NO: 59755 - DNA, 25 bp, Rattus norvegicus
aatctaatttcaaagcgggccgctc

SEQ ID NO: 59756 - DNA, 25 bp, Rattus norvegicus
aatctaatttcatagcgggccgctc

SEQ ID NO: 59757 - DNA, 25 bp, Rattus norvegicus
aatctacacttcatagggtcaggac

SEQ ID NO: 59758 - DNA, 25 bp, Rattus norvegicus
aatctacacttcttagggtcaggac

SEQ ID NO: 59759 - DNA, 25 bp, Rattus norvegicus
aatctacagatcaccaaatgtgaca

SEQ ID NO: 59760 - DNA, 25 bp, Rattus norvegicus
aatctacagatctccaaatgtgaca

SEQ ID NO: 59761 - DNA, 25 bp, Rattus norvegicus
aatctacagcttattgtgtcctgcg

SEQ ID NO: 59762 - DNA, 25 bp, Rattus norvegicus
aatctacagctttttgtgtcctgcg

SEQ ID NO: 59763 - DNA, 25 bp, Rattus norvegicus
aatctacagtgtctaaattgcctta

SEQ ID NO: 59764 - DNA, 25 bp, Rattus norvegicus
aatctacagtgtgtaaattgcctta

SEQ ID NO: 59765 - DNA, 25 bp, Rattus norvegicus
aatctacatcacaagactccacgtt

SEQ ID NO: 59766 - DNA, 25 bp, Rattus norvegicus
aatctacatcactagactccacgtt

SEQ ID NO: 59767 - DNA, 25 bp, Rattus norvegicus
aatctacatcttctacttgagcctc

SEQ ID NO: 59768 - DNA, 25 bp, Rattus norvegicus
aatctacatcttgtacttgagcctc

SEQ ID NO: 59769 - DNA, 25 bp, Rattus norvegicus
aatctacattcaaggcttgggcctg

SEQ ID NO: 59770 - DNA, 25 bp, Rattus norvegicus
aatctacattcatggcttgggcctg

SEQ ID NO: 59771 - DNA, 25 bp, Rattus norvegicus
aatctaccaaggagcttcgagacat

SEQ ID NO: 59772 - DNA, 25 bp, Rattus norvegicus
aatctaccaaggtgcttcgagacat

SEQ ID NO: 59773 - DNA, 25 bp, Rattus norvegicus
aatctaccacctcaacaacattgtt

SEQ ID NO: 59774 - DNA, 25 bp, Rattus norvegicus
aatctaccacctgaacaacattgtt

SEQ ID NO: 59775 - DNA, 25 bp, Rattus norvegicus
aatctaccagtaacccattttgtgt

SEQ ID NO: 59776 - DNA, 25 bp, Rattus norvegicus
aatctaccagtatcccattttgtgt

SEQ ID NO: 59777 - DNA, 25 bp, Rattus norvegicus
aatctaccagtgcattctctcaagg

SEQ ID NO: 59778 - DNA, 25 bp, Rattus norvegicus
aatctaccagtgctttatcctctga

SEQ ID NO: 59779 - DNA, 25 bp, Rattus norvegicus
aatctaccagtggattctctcaagg

SEQ ID NO: 59780 - DNA, 25 bp, Rattus norvegicus
aatctaccagtggtttatcctctga

SEQ ID NO: 59781 - DNA, 25 bp, Rattus norvegicus
aatctaccatcacttcgtagttacc

SEQ ID NO: 59782 - DNA, 25 bp, Rattus norvegicus
aatctaccatcagttcgtagttacc

SEQ ID NO: 59783 - DNA, 25 bp, Rattus norvegicus
aatctacccctaagtcatccaggaa

SEQ ID NO: 59784 - DNA, 25 bp, Rattus norvegicus
aatctacccctatgtcatccaggaa

SEQ ID NO: 59785 - DNA, 25 bp, Rattus norvegicus
aatctacctcgtcccagagtctgag

SEQ ID NO: 59786 - DNA, 25 bp, Rattus norvegicus
aatctacctcgtgccagagtctgag

SEQ ID NO: 59787 - DNA, 25 bp, Rattus norvegicus
aatctacgccttctcaaagagctta

SEQ ID NO: 59788 - DNA, 25 bp, Rattus norvegicus
aatctacgccttgtcaaagagctta

SEQ ID NO: 59789 - DNA, 25 bp, Rattus norvegicus
aatctactcatccatgctgtacagg

SEQ ID NO: 59790 - DNA, 25 bp, Rattus norvegicus
aatctactcatcgatgctgtacagg

SEQ ID NO: 59791 - DNA, 25 bp, Rattus norvegicus
aatctactccttattggctgcttga

SEQ ID NO: 59792 - DNA, 25 bp, Rattus norvegicus
aatctactcctttttggctgcttga

SEQ ID NO: 59793 - DNA, 25 bp, Rattus norvegicus
aatctactctccaagggtgagggca

SEQ ID NO: 59794 - DNA, 25 bp, Rattus norvegicus
aatctactctcctagggtgagggca

SEQ ID NO: 59795 - DNA, 25 bp, Rattus norvegicus
aatctactgactccagctttacagc

SEQ ID NO: 59796 - DNA, 25 bp, Rattus norvegicus
aatctactgactgcagctttacagc

SEQ ID NO: 59797 - DNA, 25 bp, Rattus norvegicus
aatctactgcagcagtcagaaacac

SEQ ID NO: 59798 - DNA, 25 bp, Rattus norvegicus
aatctactgcaggagtcagaaacac

SEQ ID NO: 59799 - DNA, 25 bp, Rattus norvegicus
aatctactgcccattcacagaactg

SEQ ID NO: 59800 - DNA, 25 bp, Rattus norvegicus
aatctactgccctttcacagaactg

SEQ ID NO: 59801 - DNA, 25 bp, Rattus norvegicus
aatctactggagatgtgtgtgccaa

SEQ ID NO: 59802 - DNA, 25 bp, Rattus norvegicus
aatctactggagttgtgtgtgccaa

SEQ ID NO: 59803 - DNA, 25 bp, Rattus norvegicus
aatctacttcagctacaggtcccag

SEQ ID NO: 59804 - DNA, 25 bp, Rattus norvegicus
aatctacttcaggtacaggtcccag

SEQ ID NO: 59805 - DNA, 25 bp, Rattus norvegicus
aatctacttgatctacagttcaaca

SEQ ID NO: 59806 - DNA, 25 bp, Rattus norvegicus
aatctacttgatgtacagttcaaca

SEQ ID NO: 59807 - DNA, 25 bp, Rattus norvegicus
aatctacttgggattgagtctgaac

SEQ ID NO: 59808 - DNA, 25 bp, Rattus norvegicus
aatctacttgggtttgagtctgaac

SEQ ID NO: 59809 - DNA, 25 bp, Rattus norvegicus
aatctacttttcaatttaggaagca

SEQ ID NO: 59810 - DNA, 25 bp, Rattus norvegicus
aatctacttttctatttaggaagca

SEQ ID NO: 59811 - DNA, 25 bp, Rattus norvegicus
aatctagaagccctctgtaccaaga

SEQ ID NO: 59812 - DNA, 25 bp, Rattus norvegicus
aatctagaagccgtctgtaccaaga

SEQ ID NO: 59813 - DNA, 25 bp, Rattus norvegicus
aatctagaccaaagcctcatttcac

SEQ ID NO: 59814 - DNA, 25 bp, Rattus norvegicus
aatctagaccaatgcctcatttcac

SEQ ID NO: 59815 - DNA, 25 bp, Rattus norvegicus
aatctagagctgctttgtctctgcc

SEQ ID NO: 59816 - DNA, 25 bp, Rattus norvegicus
aatctagagctggtttgtctctgcc

SEQ ID NO: 59817 - DNA, 25 bp, Rattus norvegicus
aatctagaggtgattcaaggagcat

SEQ ID NO: 59818 - DNA, 25 bp, Rattus norvegicus
aatctagaggtgtttcaaggagcat

SEQ ID NO: 59819 - DNA, 25 bp, Rattus norvegicus
aatctagcaaggctctttcactgct

SEQ ID NO: 59820 - DNA, 25 bp, Rattus norvegicus
aatctagcaagggtctttcactgct

SEQ ID NO: 59821 - DNA, 25 bp, Rattus norvegicus
aatctagcaccaagctgttgggaaa

SEQ ID NO: 59822 - DNA, 25 bp, Rattus norvegicus
aatctagcaccatgctgttgggaaa

SEQ ID NO: 59823 - DNA, 25 bp, Rattus norvegicus
aatctagcgctaatctgaggctcaa

SEQ ID NO: 59824 - DNA, 25 bp, Rattus norvegicus
aatctagcgctattctgaggctcaa

SEQ ID NO: 59825 - DNA, 25 bp, Rattus norvegicus
aatctaggcctaccatgttacaact

SEQ ID NO: 59826 - DNA, 25 bp, Rattus norvegicus
aatctaggcctagcatgttacaact

SEQ ID NO: 59827 - DNA, 25 bp, Rattus norvegicus
aatctaggtttcacagctgcctgtc

SEQ ID NO: 59828 - DNA, 25 bp, Rattus norvegicus
aatctaggtttctcagctgcctgtc

SEQ ID NO: 59829 - DNA, 25 bp, Rattus norvegicus
aatctagtaatcatcagctcctgag

SEQ ID NO: 59830 - DNA, 25 bp, Rattus norvegicus
aatctagtaatcttcagctcctgag

SEQ ID NO: 59831 - DNA, 25 bp, Rattus norvegicus
aatctagtgatgctctcctgtctgc

SEQ ID NO: 59832 - DNA, 25 bp, Rattus norvegicus
aatctagtgatggtctcctgtctgc

SEQ ID NO: 59833 - DNA, 25 bp, Rattus norvegicus
aatctagtgccgatgtgcagttctg

SEQ ID NO: 59834 - DNA, 25 bp, Rattus norvegicus
aatctagtgccgttgtgcagttctg

SEQ ID NO: 59835 - DNA, 25 bp, Rattus norvegicus
aatctagtgcttactgggtgtctcc

SEQ ID NO: 59836 - DNA, 25 bp, Rattus norvegicus
aatctagtgctttctgggtgtctcc

SEQ ID NO: 59837 - DNA, 25 bp, Rattus norvegicus
aatctatacactccatgctgggata

SEQ ID NO: 59838 - DNA, 25 bp, Rattus norvegicus
aatctatacactgcatgctgggata

SEQ ID NO: 59839 - DNA, 25 bp, Rattus norvegicus
aatctataggctctggttttccata

SEQ ID NO: 59840 - DNA, 25 bp, Rattus norvegicus
aatctataggctgtggttttccata

SEQ ID NO: 59841 - DNA, 25 bp, Rattus norvegicus
aatctatatacacctgagccctgag

SEQ ID NO: 59842 - DNA, 25 bp, Rattus norvegicus
aatctatatacagctgagccctgag

SEQ ID NO: 59843 - DNA, 25 bp, Rattus norvegicus
aatctatcagggagctgggcacgca

SEQ ID NO: 59844 - DNA, 25 bp, Rattus norvegicus
aatctatcagggtgctgggcacgca

SEQ ID NO: 59845 - DNA, 25 bp, Rattus norvegicus
aatctatctgatacccacttgggat

SEQ ID NO: 59846 - DNA, 25 bp, Rattus norvegicus
aatctatctgattcccacttgggat

SEQ ID NO: 59847 - DNA, 25 bp, Rattus norvegicus
aatctatgcttcattctcacaaatg

SEQ ID NO: 59848 - DNA, 25 bp, Rattus norvegicus
aatctatgcttctttctcacaaatg

SEQ ID NO: 59849 - DNA, 25 bp, Rattus norvegicus
aatctatggcgtctcacacacatga

SEQ ID NO: 59850 - DNA, 25 bp, Rattus norvegicus
aatctatggcgtgtcacacacatga

SEQ ID NO: 59851 - DNA, 25 bp, Rattus norvegicus
aatctattcaagatcctggcttgga

SEQ ID NO: 59852 - DNA, 25 bp, Rattus norvegicus
aatctattcaagttcctggcttgga

SEQ ID NO: 59853 - DNA, 25 bp, Rattus norvegicus
aatctattccctcaaatgtaccaaa

SEQ ID NO: 59854 - DNA, 25 bp, Rattus norvegicus
aatctattccctgaaatgtaccaaa

SEQ ID NO: 59855 - DNA, 25 bp, Rattus norvegicus
aatctatttactctagtcttccaaa

SEQ ID NO: 59856 - DNA, 25 bp, Rattus norvegicus
aatctatttactgtagtcttccaaa

SEQ ID NO: 59857 - DNA, 25 bp, Rattus norvegicus
aatctatttatcattgttactgctt

SEQ ID NO: 59858 - DNA, 25 bp, Rattus norvegicus
aatctatttatctttgttactgctt

SEQ ID NO: 59859 - DNA, 25 bp, Rattus norvegicus
aatctatttctgaacagtcagtcat

SEQ ID NO: 59860 - DNA, 25 bp, Rattus norvegicus
aatctatttctgtacagtcagtcat

SEQ ID NO: 59861 - DNA, 25 bp, Rattus norvegicus
aatctattttgaaatgcctttccat

SEQ ID NO: 59862 - DNA, 25 bp, Rattus norvegicus
aatctattttgacccactttaggga

SEQ ID NO: 59863 - DNA, 25 bp, Rattus norvegicus
aatctattttgagccactttaggga

SEQ ID NO: 59864 - DNA, 25 bp, Rattus norvegicus
aatctattttgatatgcctttccat

SEQ ID NO: 59865 - DNA, 25 bp, Rattus norvegicus
aatctatttttaagtggcccttgag

SEQ ID NO: 59866 - DNA, 25 bp, Rattus norvegicus
aatctatttttatgtggcccttgag

SEQ ID NO: 59867 - DNA, 25 bp, Rattus norvegicus
aatctatttttgacttccgatctac

SEQ ID NO: 59868 - DNA, 25 bp, Rattus norvegicus
aatctatttttgtcttccgatctac

SEQ ID NO: 59869 - DNA, 25 bp, Rattus norvegicus
aatctcaaattactcttgctaggag

SEQ ID NO: 59870 - DNA, 25 bp, Rattus norvegicus
aatctcaaattagtcttgctaggag

SEQ ID NO: 59871 - DNA, 25 bp, Rattus norvegicus
aatctcaaattcaacctcatttccc

SEQ ID NO: 59872 - DNA, 25 bp, Rattus norvegicus
aatctcaaattctacctcatttccc

SEQ ID NO: 59873 - DNA, 25 bp, Rattus norvegicus
aatctcaagctgacaggctgggcag

SEQ ID NO: 59874 - DNA, 25 bp, Rattus norvegicus
aatctcaagctgtcaggctgggcag

SEQ ID NO: 59875 - DNA, 25 bp, Rattus norvegicus
aatctcaagggtattctgatatcag

SEQ ID NO: 59876 - DNA, 25 bp, Rattus norvegicus
aatctcaagggttttctgatatcag

SEQ ID NO: 59877 - DNA, 25 bp, Rattus norvegicus
aatctcaagtcgacgctggacaaat

SEQ ID NO: 59878 - DNA, 25 bp, Rattus norvegicus
aatctcaagtcgtcgctggacaaat

SEQ ID NO: 59879 - DNA, 25 bp, Rattus norvegicus
aatctcaattcacactcccaaggaa

SEQ ID NO: 59880 - DNA, 25 bp, Rattus norvegicus
aatctcaattcagactcccaaggaa

SEQ ID NO: 59881 - DNA, 25 bp, Rattus norvegicus
aatctcaatttacttgtcaaagtag

SEQ ID NO: 59882 - DNA, 25 bp, Rattus norvegicus
aatctcaatttagttgtcaaagtag

SEQ ID NO: 59883 - DNA, 25 bp, Rattus norvegicus
aatctcaattttactttcaaagcac

SEQ ID NO: 59884 - DNA, 25 bp, Rattus norvegicus
aatctcaatttttctttcaaagcac

SEQ ID NO: 59885 - DNA, 25 bp, Rattus norvegicus
aatctcacagccatatccttatctt

SEQ ID NO: 59886 - DNA, 25 bp, Rattus norvegicus
aatctcacagccttatccttatctt

SEQ ID NO: 59887 - DNA, 25 bp, Rattus norvegicus
aatctcaccccgcaaggacaaaata

SEQ ID NO: 59888 - DNA, 25 bp, Rattus norvegicus
aatctcaccccggaaggacaaaata

SEQ ID NO: 59889 - DNA, 25 bp, Rattus norvegicus
aatctcaccgctaaccttgggaata

SEQ ID NO: 59890 - DNA, 25 bp, Rattus norvegicus
aatctcaccgcttaccttgggaata

SEQ ID NO: 59891 - DNA, 25 bp, Rattus norvegicus
aatctcacggatccagagcagctgt

SEQ ID NO: 59892 - DNA, 25 bp, Rattus norvegicus
aatctcacggatgcagagcagctgt

SEQ ID NO: 59893 - DNA, 25 bp, Rattus norvegicus
aatctcacggtaatgcaagggccag

SEQ ID NO: 59894 - DNA, 25 bp, Rattus norvegicus
aatctcacggtattgcaagggccag

SEQ ID NO: 59895 - DNA, 25 bp, Rattus norvegicus
aatctcactgttcgtaggtcttgcc

SEQ ID NO: 59896 - DNA, 25 bp, Rattus norvegicus
aatctcactgttggtaggtcttgcc

SEQ ID NO: 59897 - DNA, 25 bp, Rattus norvegicus
aatctcacttctacctgtattaatg

SEQ ID NO: 59898 - DNA, 25 bp, Rattus norvegicus
aatctcacttcttcctgtattaatg

SEQ ID NO: 59899 - DNA, 25 bp, Rattus norvegicus
aatctcagagtacagtccaggcctt

SEQ ID NO: 59900 - DNA, 25 bp, Rattus norvegicus
aatctcagagtagagtccaggcctt

SEQ ID NO: 59901 - DNA, 25 bp, Rattus norvegicus
aatctcagagtgatcctgctgactg

SEQ ID NO: 59902 - DNA, 25 bp, Rattus norvegicus
aatctcagagtgttcctgctgactg

SEQ ID NO: 59903 - DNA, 25 bp, Rattus norvegicus
aatctcagattgaccgttctaggcg

SEQ ID NO: 59904 - DNA, 25 bp, Rattus norvegicus
aatctcagattgtccgttctaggcg

SEQ ID NO: 59905 - DNA, 25 bp, Rattus norvegicus
aatctcagcctgagctatgcgcaaa

SEQ ID NO: 59906 - DNA, 25 bp, Rattus norvegicus
aatctcagcctgtgctatgcgcaaa

SEQ ID NO: 59907 - DNA, 25 bp, Rattus norvegicus
aatctcagccttactgtacctaata

SEQ ID NO: 59908 - DNA, 25 bp, Rattus norvegicus
aatctcagcctttctgtacctaata

SEQ ID NO: 59909 - DNA, 25 bp, Rattus norvegicus
aatctcagcggtccgggatcaccga

SEQ ID NO: 59910 - DNA, 25 bp, Rattus norvegicus
aatctcagcggtgcgggatcaccga

SEQ ID NO: 59911 - DNA, 25 bp, Rattus norvegicus
aatctcagctcaactatcgctttat

SEQ ID NO: 59912 - DNA, 25 bp, Rattus norvegicus
aatctcagctcacttgtgtggtcgt

SEQ ID NO: 59913 - DNA, 25 bp, Rattus norvegicus
aatctcagctcagttgtgtggtcgt

SEQ ID NO: 59914 - DNA, 25 bp, Rattus norvegicus
aatctcagctcatctatcgctttat

SEQ ID NO: 59915 - DNA, 25 bp, Rattus norvegicus
aatctcagcttaaaatcgtacaacg

SEQ ID NO: 59916 - DNA, 25 bp, Rattus norvegicus
aatctcagcttataatcgtacaacg

SEQ ID NO: 59917 - DNA, 25 bp, Rattus norvegicus
aatctcaggcttcacgttgcaatga

SEQ ID NO: 59918 - DNA, 25 bp, Rattus norvegicus
aatctcaggcttgacgttgcaatga

SEQ ID NO: 59919 - DNA, 25 bp, Rattus norvegicus
aatctcagggctacaaccagtggca

SEQ ID NO: 59920 - DNA, 25 bp, Rattus norvegicus
aatctcagggcttcaaccagtggca

SEQ ID NO: 59921 - DNA, 25 bp, Rattus norvegicus
aatctcagggttcggattctaacta

SEQ ID NO: 59922 - DNA, 25 bp, Rattus norvegicus
aatctcagggttgggattctaacta

SEQ ID NO: 59923 - DNA, 25 bp, Rattus norvegicus
aatctcagtctgcaccgaaggtcac

SEQ ID NO: 59924 - DNA, 25 bp, Rattus norvegicus
aatctcagtctggaccgaaggtcac

SEQ ID NO: 59925 - DNA, 25 bp, Rattus norvegicus
aatctcagtgatatttggcaagcca

SEQ ID NO: 59926 - DNA, 25 bp, Rattus norvegicus
aatctcagtgatttttggcaagcca

SEQ ID NO: 59927 - DNA, 25 bp, Rattus norvegicus
aatctcagtggaatttcatctgaag

SEQ ID NO: 59928 - DNA, 25 bp, Rattus norvegicus
aatctcagtggattttcatctgaag

SEQ ID NO: 59929 - DNA, 25 bp, Rattus norvegicus
aatctcagtgtaaagtgatgctttt

SEQ ID NO: 59930 - DNA, 25 bp, Rattus norvegicus
aatctcagtgtatagtgatgctttt

SEQ ID NO: 59931 - DNA, 25 bp, Rattus norvegicus
aatctcagttctcaatcatggcacc

SEQ ID NO: 59932 - DNA, 25 bp, Rattus norvegicus
aatctcagttctgaatcatggcacc

SEQ ID NO: 59933 - DNA, 25 bp, Rattus norvegicus
aatctcatactcattttgtctttgg

SEQ ID NO: 59934 - DNA, 25 bp, Rattus norvegicus
aatctcatactctttttgtctttgg

SEQ ID NO: 59935 - DNA, 25 bp, Rattus norvegicus
aatctcatagtcctttgcaggccaa

SEQ ID NO: 59936 - DNA, 25 bp, Rattus norvegicus
aatctcatagtcgtttgcaggccaa

SEQ ID NO: 59937 - DNA, 25 bp, Rattus norvegicus
aatctcatcaaaacttaacgtcttt

SEQ ID NO: 59938 - DNA, 25 bp, Rattus norvegicus
aatctcatcaaatcttaacgtcttt

SEQ ID NO: 59939 - DNA, 25 bp, Rattus norvegicus
aatctcatcactcatgctctcaata

SEQ ID NO: 59940 - DNA, 25 bp, Rattus norvegicus
aatctcatcactgatgctctcaata

SEQ ID NO: 59941 - DNA, 25 bp, Rattus norvegicus
aatctcatcagtattaatgcctgct

SEQ ID NO: 59942 - DNA, 25 bp, Rattus norvegicus
aatctcatcagttttaatgcctgct

SEQ ID NO: 59943 - DNA, 25 bp, Rattus norvegicus
aatctcatccctatacggctgtgaa

SEQ ID NO: 59944 - DNA, 25 bp, Rattus norvegicus
aatctcatccctttacggctgtgaa

SEQ ID NO: 59945 - DNA, 25 bp, Rattus norvegicus
aatctcatgctacacttgagccaca

SEQ ID NO: 59946 - DNA, 25 bp, Rattus norvegicus
aatctcatgctagacttgagccaca

SEQ ID NO: 59947 - DNA, 25 bp, Rattus norvegicus
aatctcattacccaaaagtctcctg

SEQ ID NO: 59948 - DNA, 25 bp, Rattus norvegicus
aatctcattaccgaaaagtctcctg

SEQ ID NO: 59949 - DNA, 25 bp, Rattus norvegicus
aatctcattactccgcatgcttgtg

SEQ ID NO: 59950 - DNA, 25 bp, Rattus norvegicus
aatctcattactgcgcatgcttgtg

SEQ ID NO: 59951 - DNA, 25 bp, Rattus norvegicus
aatctcatttatatggccaccatcg

SEQ ID NO: 59952 - DNA, 25 bp, Rattus norvegicus
aatctcatttatttggccaccatcg

SEQ ID NO: 59953 - DNA, 25 bp, Rattus norvegicus
aatctccaaattccctagtactgac

SEQ ID NO: 59954 - DNA, 25 bp, Rattus norvegicus
aatctccaaattgcctagtactgac

SEQ ID NO: 59955 - DNA, 25 bp, Rattus norvegicus
aatctccacattcccttgattttcc

SEQ ID NO: 59956 - DNA, 25 bp, Rattus norvegicus
aatctccacattgccttgattttcc

SEQ ID NO: 59957 - DNA, 25 bp, Rattus norvegicus
aatctccaccgtcctgtatactgtt

SEQ ID NO: 59958 - DNA, 25 bp, Rattus norvegicus
aatctccaccgtgctgtatactgtt

SEQ ID NO: 59959 - DNA, 25 bp, Rattus norvegicus
aatctccaggccactgatttagttt

SEQ ID NO: 59960 - DNA, 25 bp, Rattus norvegicus
aatctccaggcctctgatttagttt

SEQ ID NO: 59961 - DNA, 25 bp, Rattus norvegicus
aatctccaggctacatatatgaact

SEQ ID NO: 59962 - DNA, 25 bp, Rattus norvegicus
aatctccaggcttcatatatgaact

SEQ ID NO: 59963 - DNA, 25 bp, Rattus norvegicus
aatctccagggtagcagtattttcc

SEQ ID NO: 59964 - DNA, 25 bp, Rattus norvegicus
aatctccagggttgcagtattttcc

SEQ ID NO: 59965 - DNA, 25 bp, Rattus norvegicus
aatctccatcatctatgccaagcct

SEQ ID NO: 59966 - DNA, 25 bp, Rattus norvegicus
aatctccatcatgtatgccaagcct

SEQ ID NO: 59967 - DNA, 25 bp, Rattus norvegicus
aatctccatttcacgttctgtcaga

SEQ ID NO: 59968 - DNA, 25 bp, Rattus norvegicus
aatctccatttctcgttctgtcaga

SEQ ID NO: 59969 - DNA, 25 bp, Rattus norvegicus
aatctcccacatcaggtctattgca

SEQ ID NO: 59970 - DNA, 25 bp, Rattus norvegicus
aatctcccacatgaggtctattgca

SEQ ID NO: 59971 - DNA, 25 bp, Rattus norvegicus
aatctcccagacatcgtgagcacag

SEQ ID NO: 59972 - DNA, 25 bp, Rattus norvegicus
aatctcccagacttcgtgagcacag

SEQ ID NO: 59973 - DNA, 25 bp, Rattus norvegicus
aatctcccggaaagctttacataag

SEQ ID NO: 59974 - DNA, 25 bp, Rattus norvegicus
aatctcccggaatgctttacataag

SEQ ID NO: 59975 - DNA, 25 bp, Rattus norvegicus
aatctcccgtcacctgcattaggaa

SEQ ID NO: 59976 - DNA, 25 bp, Rattus norvegicus
aatctcccgtcagctgcattaggaa

SEQ ID NO: 59977 - DNA, 25 bp, Rattus norvegicus
aatctccctctgagcaaagtcttga

SEQ ID NO: 59978 - DNA, 25 bp, Rattus norvegicus
aatctccctctgtgcaaagtcttga

SEQ ID NO: 59979 - DNA, 25 bp, Rattus norvegicus
aatctccctgtgagttgcaagcaga

SEQ ID NO: 59980 - DNA, 25 bp, Rattus norvegicus
aatctccctgtgtgttgcaagcaga

SEQ ID NO: 59981 - DNA, 25 bp, Rattus norvegicus
aatctcccttgccactggtttgcaa

SEQ ID NO: 59982 - DNA, 25 bp, Rattus norvegicus
aatctcccttgcgactggtttgcaa

SEQ ID NO: 59983 - DNA, 25 bp, Rattus norvegicus
aatctccgcctgactctggatggaa

SEQ ID NO: 59984 - DNA, 25 bp, Rattus norvegicus
aatctccgcctgtctctggatggaa

SEQ ID NO: 59985 - DNA, 25 bp, Rattus norvegicus
aatctcctaaacaaacaggctatgg

SEQ ID NO: 59986 - DNA, 25 bp, Rattus norvegicus
aatctcctaaactaacaggctatgg

SEQ ID NO: 59987 - DNA, 25 bp, Rattus norvegicus
aatctcctaggaacacacactgatt

SEQ ID NO: 59988 - DNA, 25 bp, Rattus norvegicus
aatctcctaggatcacacactgatt

SEQ ID NO: 59989 - DNA, 25 bp, Rattus norvegicus
aatctcctctggctctctgtagaag

SEQ ID NO: 59990 - DNA, 25 bp, Rattus norvegicus
aatctcctctgggtctctgtagaag

SEQ ID NO: 59991 - DNA, 25 bp, Rattus norvegicus
aatctcctctgtagccaagcaccag

SEQ ID NO: 59992 - DNA, 25 bp, Rattus norvegicus
aatctcctctgttgccaagcaccag

SEQ ID NO: 59993 - DNA, 25 bp, Rattus norvegicus
aatctcctgagccaagtgatacccc

SEQ ID NO: 59994 - DNA, 25 bp, Rattus norvegicus
aatctcctgagcgaagtgatacccc

SEQ ID NO: 59995 - DNA, 25 bp, Rattus norvegicus
aatctcctgcggctgaaggtggaca

SEQ ID NO: 59996 - DNA, 25 bp, Rattus norvegicus
aatctcctgcgggtgaaggtggaca

SEQ ID NO: 59997 - DNA, 25 bp, Rattus norvegicus
aatctcctggacaccggaggactga

SEQ ID NO: 59998 - DNA, 25 bp, Rattus norvegicus
aatctcctggactccggaggactga

SEQ ID NO: 59999 - DNA, 25 bp, Rattus norvegicus
aatctcctgttcataaacggttcca

SEQ ID NO: 60000 - DNA, 25 bp, Rattus norvegicus
aatctcctgttcttaaacggttcca

SEQ ID NO: 60001 - DNA, 25 bp, Rattus norvegicus
aatctccttattattctggataatg

SEQ ID NO: 60002 - DNA, 25 bp, Rattus norvegicus
aatctccttatttttctggataatg

SEQ ID NO: 60003 - DNA, 25 bp, Rattus norvegicus
aatctccttcaacaggactcacagg

SEQ ID NO: 60004 - DNA, 25 bp, Rattus norvegicus
aatctccttcaagaggactcacagg

SEQ ID NO: 60005 - DNA, 25 bp, Rattus norvegicus
aatctcctttatatatcacctcgtc

SEQ ID NO: 60006 - DNA, 25 bp, Rattus norvegicus
aatctcctttatttatcacctcgtc

SEQ ID NO: 60007 - DNA, 25 bp, Rattus norvegicus
aatctcgaaaacatagcaccacctc

SEQ ID NO: 60008 - DNA, 25 bp, Rattus norvegicus
aatctcgaaaacttagcaccacctc

SEQ ID NO: 60009 - DNA, 25 bp, Rattus norvegicus
aatctcgagctcatgcctttatttt

SEQ ID NO: 60010 - DNA, 25 bp, Rattus norvegicus
aatctcgagctcttgcctttatttt

SEQ ID NO: 60011 - DNA, 25 bp, Rattus norvegicus
aatctcgatcacatcctcggatatt

SEQ ID NO: 60012 - DNA, 25 bp, Rattus norvegicus
aatctcgatcacttcctcggatatt

SEQ ID NO: 60013 - DNA, 25 bp, Rattus norvegicus
aatctcgatcttcccgagcatcagt

SEQ ID NO: 60014 - DNA, 25 bp, Rattus norvegicus
aatctcgatcttgccgagcatcagt

SEQ ID NO: 60015 - DNA, 25 bp, Rattus norvegicus
aatctcgccgccatttttgtgatga

SEQ ID NO: 60016 - DNA, 25 bp, Rattus norvegicus
aatctcgccgccttttttgtgatga

SEQ ID NO: 60017 - DNA, 25 bp, Rattus norvegicus
aatctcggcagcctggtggcctaag

SEQ ID NO: 60018 - DNA, 25 bp, Rattus norvegicus
aatctcggcagcgtggtggcctaag

SEQ ID NO: 60019 - DNA, 25 bp, Rattus norvegicus
aatctcgggtggctctgatgcacat

SEQ ID NO: 60020 - DNA, 25 bp, Rattus norvegicus
aatctcgggtgggtctgatgcacat

SEQ ID NO: 60021 - DNA, 25 bp, Rattus norvegicus
aatctcggtctaagaagtctatggg

SEQ ID NO: 60022 - DNA, 25 bp, Rattus norvegicus
aatctcggtctatgaagtctatggg

SEQ ID NO: 60023 - DNA, 25 bp, Rattus norvegicus
aatctcgtaagtctgaagccctgaa

SEQ ID NO: 60024 - DNA, 25 bp, Rattus norvegicus
aatctcgtaagtgtgaagccctgaa

SEQ ID NO: 60025 - DNA, 25 bp, Rattus norvegicus
aatctcgtcagaagtgatgaatgca

SEQ ID NO: 60026 - DNA, 25 bp, Rattus norvegicus
aatctcgtcagatgtgatgaatgca

SEQ ID NO: 60027 - DNA, 25 bp, Rattus norvegicus
aatctcgtgtggcactacagccaca

SEQ ID NO: 60028 - DNA, 25 bp, Rattus norvegicus
aatctcgtgtgggactacagccaca

SEQ ID NO: 60029 - DNA, 25 bp, Rattus norvegicus
aatctcgtttgcctccgtcgccgga

SEQ ID NO: 60030 - DNA, 25 bp, Rattus norvegicus
aatctcgtttgcgtccgtcgccgga

SEQ ID NO: 60031 - DNA, 25 bp, Rattus norvegicus
aatctctaattgacagtacagcagc

SEQ ID NO: 60032 - DNA, 25 bp, Rattus norvegicus
aatctctaattgtcagtacagcagc

SEQ ID NO: 60033 - DNA, 25 bp, Rattus norvegicus
aatctctacaagagcctgttcccta

SEQ ID NO: 60034 - DNA, 25 bp, Rattus norvegicus
aatctctacaagctattcacggtgg

SEQ ID NO: 60035 - DNA, 25 bp, Rattus norvegicus
aatctctacaaggtattcacggtgg

SEQ ID NO: 60036 - DNA, 25 bp, Rattus norvegicus
aatctctacaagtgcctgttcccta

SEQ ID NO: 60037 - DNA, 25 bp, Rattus norvegicus
aatctctacatcctggctggacatg

SEQ ID NO: 60038 - DNA, 25 bp, Rattus norvegicus
aatctctacatcgtggctggacatg

SEQ ID NO: 60039 - DNA, 25 bp, Rattus norvegicus
aatctctaccttctaaatcttgctg

SEQ ID NO: 60040 - DNA, 25 bp, Rattus norvegicus
aatctctaccttgtaaatcttgctg

SEQ ID NO: 60041 - DNA, 25 bp, Rattus norvegicus
aatctctagtctaaacaaagcctga

SEQ ID NO: 60042 - DNA, 25 bp, Rattus norvegicus
aatctctagtcttaacaaagcctga

SEQ ID NO: 60043 - DNA, 25 bp, Rattus norvegicus
aatctctagttcaaggcaggcctgt

SEQ ID NO: 60044 - DNA, 25 bp, Rattus norvegicus
aatctctagttctaggcaggcctgt

SEQ ID NO: 60045 - DNA, 25 bp, Rattus norvegicus
aatctctatcacattggttttatca

SEQ ID NO: 60046 - DNA, 25 bp, Rattus norvegicus
aatctctatcactttggttttatca

SEQ ID NO: 60047 - DNA, 25 bp, Rattus norvegicus
aatctctatggaccctatgttccca

SEQ ID NO: 60048 - DNA, 25 bp, Rattus norvegicus
aatctctatggagcctatgttccca

SEQ ID NO: 60049 - DNA, 25 bp, Rattus norvegicus
aatctctccacaacactaagttctt

SEQ ID NO: 60050 - DNA, 25 bp, Rattus norvegicus
aatctctccacatcactaagttctt

SEQ ID NO: 60051 - DNA, 25 bp, Rattus norvegicus
aatctctcggaccacggacccttag

SEQ ID NO: 60052 - DNA, 25 bp, Rattus norvegicus
aatctctcggacgacggacccttag

SEQ ID NO: 60053 - DNA, 25 bp, Rattus norvegicus
aatctctctcaaaatcctgttagcg

SEQ ID NO: 60054 - DNA, 25 bp, Rattus norvegicus
aatctctctcaatatcctgttagcg

SEQ ID NO: 60055 - DNA, 25 bp, Rattus norvegicus
aatctctctcagagcagtgggatga

SEQ ID NO: 60056 - DNA, 25 bp, Rattus norvegicus
aatctctctcagtgcagtgggatga

SEQ ID NO: 60057 - DNA, 25 bp, Rattus norvegicus
aatctctctccccaaggcataggat

SEQ ID NO: 60058 - DNA, 25 bp, Rattus norvegicus
aatctctctcccgaaggcataggat

SEQ ID NO: 60059 - DNA, 25 bp, Rattus norvegicus
aatctctctgatactatcttatcca

SEQ ID NO: 60060 - DNA, 25 bp, Rattus norvegicus
aatctctctgattctatcttatcca

SEQ ID NO: 60061 - DNA, 25 bp, Rattus norvegicus
aatctctctgttcaaagtagcatca

SEQ ID NO: 60062 - DNA, 25 bp, Rattus norvegicus
aatctctctgttgaaagtagcatca

SEQ ID NO: 60063 - DNA, 25 bp, Rattus norvegicus
aatctctgaagaacatgtagcctca

SEQ ID NO: 60064 - DNA, 25 bp, Rattus norvegicus
aatctctgaagatcatgtagcctca

SEQ ID NO: 60065 - DNA, 25 bp, Rattus norvegicus
aatctctgacatcctacttcaagtg

SEQ ID NO: 60066 - DNA, 25 bp, Rattus norvegicus
aatctctgacatgctacttcaagtg

SEQ ID NO: 60067 - DNA, 25 bp, Rattus norvegicus
aatctctgctggctgaaatctctca

SEQ ID NO: 60068 - DNA, 25 bp, Rattus norvegicus
aatctctgctgggtgaaatctctca

SEQ ID NO: 60069 - DNA, 25 bp, Rattus norvegicus
aatctctgggatacacgcggtagtc

SEQ ID NO: 60070 - DNA, 25 bp, Rattus norvegicus
aatctctgggatcggcagggccttt

SEQ ID NO: 60071 - DNA, 25 bp, Rattus norvegicus
aatctctgggatgggcagggccttt

SEQ ID NO: 60072 - DNA, 25 bp, Rattus norvegicus
aatctctgggattcacgcggtagtc

SEQ ID NO: 60073 - DNA, 25 bp, Rattus norvegicus
aatctctggtccactagtctttgag

SEQ ID NO: 60074 - DNA, 25 bp, Rattus norvegicus
aatctctggtcctctagtctttgag

SEQ ID NO: 60075 - DNA, 25 bp, Rattus norvegicus
aatctctggtctctgggtttgtctc

SEQ ID NO: 60076 - DNA, 25 bp, Rattus norvegicus
aatctctggtctgtgggtttgtctc

SEQ ID NO: 60077 - DNA, 25 bp, Rattus norvegicus
aatctctgtcacatgatagggctgg

SEQ ID NO: 60078 - DNA, 25 bp, Rattus norvegicus
aatctctgtcacttgatagggctgg

SEQ ID NO: 60079 - DNA, 25 bp, Rattus norvegicus
aatctcttcaacacccaagacatat

SEQ ID NO: 60080 - DNA, 25 bp, Rattus norvegicus
aatctcttcaactcccaagacatat

SEQ ID NO: 60081 - DNA, 25 bp, Rattus norvegicus
aatctcttccgtcgtcaggaggacc

SEQ ID NO: 60082 - DNA, 25 bp, Rattus norvegicus
aatctcttccgtggtcaggaggacc

SEQ ID NO: 60083 - DNA, 25 bp, Rattus norvegicus
aatctcttcgtgcctagtctgtgac

SEQ ID NO: 60084 - DNA, 25 bp, Rattus norvegicus
aatctcttcgtggctagtctgtgac

SEQ ID NO: 60085 - DNA, 25 bp, Rattus norvegicus
aatctcttctcccaaggtcattaat

SEQ ID NO: 60086 - DNA, 25 bp, Rattus norvegicus
aatctcttctccgaaggtcattaat

SEQ ID NO: 60087 - DNA, 25 bp, Rattus norvegicus
aatctcttctctacatattgctgtc

SEQ ID NO: 60088 - DNA, 25 bp, Rattus norvegicus
aatctcttctctcaggataacccaa

SEQ ID NO: 60089 - DNA, 25 bp, Rattus norvegicus
aatctcttctctgaggataacccaa

SEQ ID NO: 60090 - DNA, 25 bp, Rattus norvegicus
aatctcttctcttcatattgctgtc

SEQ ID NO: 60091 - DNA, 25 bp, Rattus norvegicus
aatctcttgaaacctgtgtccttgc

SEQ ID NO: 60092 - DNA, 25 bp, Rattus norvegicus
aatctcttgaaagctgtgtccttgc

SEQ ID NO: 60093 - DNA, 25 bp, Rattus norvegicus
aatctcttgagtatgagggtagcct

SEQ ID NO: 60094 - DNA, 25 bp, Rattus norvegicus
aatctcttgagtttgagggtagcct

SEQ ID NO: 60095 - DNA, 25 bp, Rattus norvegicus
aatctcttgcttcacttgaggaaac

SEQ ID NO: 60096 - DNA, 25 bp, Rattus norvegicus
aatctcttgcttgacttgaggaaac

SEQ ID NO: 60097 - DNA, 25 bp, Rattus norvegicus
aatctcttgggcaaatgcggtaggc

SEQ ID NO: 60098 - DNA, 25 bp, Rattus norvegicus
aatctcttgggctaatgcggtaggc

SEQ ID NO: 60099 - DNA, 25 bp, Rattus norvegicus
aatctcttgtgtaacccatgtcagg

SEQ ID NO: 60100 - DNA, 25 bp, Rattus norvegicus
aatctcttgtgttacccatgtcagg

SEQ ID NO: 60101 - DNA, 25 bp, Rattus norvegicus
aatctgaaatgtagaccctggtcac

SEQ ID NO: 60102 - DNA, 25 bp, Rattus norvegicus
aatctgaaatgttgaccctggtcac

SEQ ID NO: 60103 - DNA, 25 bp, Rattus norvegicus
aatctgaacctgctgagcgtctgtt

SEQ ID NO: 60104 - DNA, 25 bp, Rattus norvegicus
aatctgaacctggtgagcgtctgtt

SEQ ID NO: 60105 - DNA, 25 bp, Rattus norvegicus
aatctgaaggagaatccaaccagga

SEQ ID NO: 60106 - DNA, 25 bp, Rattus norvegicus
aatctgaaggagtatccaaccagga

SEQ ID NO: 60107 - DNA, 25 bp, Rattus norvegicus
aatctgacaaggcagatttctacag

SEQ ID NO: 60108 - DNA, 25 bp, Rattus norvegicus
aatctgacaagggagatttctacag

SEQ ID NO: 60109 - DNA, 25 bp, Rattus norvegicus
aatctgacagttccactgagcgggc

SEQ ID NO: 60110 - DNA, 25 bp, Rattus norvegicus
aatctgacagttgcactgagcgggc

SEQ ID NO: 60111 - DNA, 25 bp, Rattus norvegicus
aatctgaccgtcctcctctaaatgt

SEQ ID NO: 60112 - DNA, 25 bp, Rattus norvegicus
aatctgaccgtcgtcctctaaatgt

SEQ ID NO: 60113 - DNA, 25 bp, Rattus norvegicus
aatctgacttagcaactccaggccc

SEQ ID NO: 60114 - DNA, 25 bp, Rattus norvegicus
aatctgacttaggaactccaggccc

SEQ ID NO: 60115 - DNA, 25 bp, Rattus norvegicus
aatctgactttcaatatccccaatc

SEQ ID NO: 60116 - DNA, 25 bp, Rattus norvegicus
aatctgactttctatatccccaatc

SEQ ID NO: 60117 - DNA, 25 bp, Rattus norvegicus
aatctgagacagcagcatcgtgagt

SEQ ID NO: 60118 - DNA, 25 bp, Rattus norvegicus
aatctgagacaggagcatcgtgagt

SEQ ID NO: 60119 - DNA, 25 bp, Rattus norvegicus
aatctgagacctactgcctgaggga

SEQ ID NO: 60120 - DNA, 25 bp, Rattus norvegicus
aatctgagaccttctgcctgaggga

SEQ ID NO: 60121 - DNA, 25 bp, Rattus norvegicus
aatctgagaggtacctttgtgtggt

SEQ ID NO: 60122 - DNA, 25 bp, Rattus norvegicus
aatctgagaggttcctttgtgtggt

SEQ ID NO: 60123 - DNA, 25 bp, Rattus norvegicus
aatctgagcagaccttcgctggtgc

SEQ ID NO: 60124 - DNA, 25 bp, Rattus norvegicus
aatctgagcagagcttcgctggtgc

SEQ ID NO: 60125 - DNA, 25 bp, Rattus norvegicus
aatctgagccagagtttgggacctg

SEQ ID NO: 60126 - DNA, 25 bp, Rattus norvegicus
aatctgagccagtgtttgggacctg

SEQ ID NO: 60127 - DNA, 25 bp, Rattus norvegicus
aatctgaggacactgccaaggctgt

SEQ ID NO: 60128 - DNA, 25 bp, Rattus norvegicus
aatctgaggacagtgccaaggctgt

SEQ ID NO: 60129 - DNA, 25 bp, Rattus norvegicus
aatctgaggcacattgacataggtc

SEQ ID NO: 60130 - DNA, 25 bp, Rattus norvegicus
aatctgaggcactttgacataggtc

SEQ ID NO: 60131 - DNA, 25 bp, Rattus norvegicus
aatctgaggtccaaggtttacaaga

SEQ ID NO: 60132 - DNA, 25 bp, Rattus norvegicus
aatctgaggtcctaggtttacaaga

SEQ ID NO: 60133 - DNA, 25 bp, Rattus norvegicus
aatctgagtctacttattaacaccc

SEQ ID NO: 60134 - DNA, 25 bp, Rattus norvegicus
aatctgagtctagttattaacaccc

SEQ ID NO: 60135 - DNA, 25 bp, Rattus norvegicus
aatctgagtcttcagcctgggttgt

SEQ ID NO: 60136 - DNA, 25 bp, Rattus norvegicus
aatctgagtcttgagcctgggttgt

SEQ ID NO: 60137 - DNA, 25 bp, Rattus norvegicus
aatctgagtgttcaggtctccttta

SEQ ID NO: 60138 - DNA, 25 bp, Rattus norvegicus
aatctgagtgttgaggtctccttta

SEQ ID NO: 60139 - DNA, 25 bp, Rattus norvegicus
aatctgatagctagtggccactcta

SEQ ID NO: 60140 - DNA, 25 bp, Rattus norvegicus
aatctgatagcttgtggccactcta

SEQ ID NO: 60141 - DNA, 25 bp, Rattus norvegicus
aatctgatatgactgctatcctcag

SEQ ID NO: 60142 - DNA, 25 bp, Rattus norvegicus
aatctgatatgagtgctatcctcag

SEQ ID NO: 60143 - DNA, 25 bp, Rattus norvegicus
aatctgatcccactaagtctttctg

SEQ ID NO: 60144 - DNA, 25 bp, Rattus norvegicus
aatctgatcccagtaagtctttctg

SEQ ID NO: 60145 - DNA, 25 bp, Rattus norvegicus
aatctgatctttcctgtcgggatat

SEQ ID NO: 60146 - DNA, 25 bp, Rattus norvegicus
aatctgatctttgctgtcgggatat

SEQ ID NO: 60147 - DNA, 25 bp, Rattus norvegicus
aatctgatgctgcttctgtaatgtg

SEQ ID NO: 60148 - DNA, 25 bp, Rattus norvegicus
aatctgatgctggttctgtaatgtg

SEQ ID NO: 60149 - DNA, 25 bp, Rattus norvegicus
aatctgatgtgactcctgcttagct

SEQ ID NO: 60150 - DNA, 25 bp, Rattus norvegicus
aatctgatgtgagtcctgcttagct

SEQ ID NO: 60151 - DNA, 25 bp, Rattus norvegicus
aatctgattaacagttcttccctgc

SEQ ID NO: 60152 - DNA, 25 bp, Rattus norvegicus
aatctgattaactgttcttccctgc

SEQ ID NO: 60153 - DNA, 25 bp, Rattus norvegicus
aatctgattcagaagcttgcacatt

SEQ ID NO: 60154 - DNA, 25 bp, Rattus norvegicus
aatctgattcagtagcttgcacatt

SEQ ID NO: 60155 - DNA, 25 bp, Rattus norvegicus
aatctgatttcaccaaccgagttga

SEQ ID NO: 60156 - DNA, 25 bp, Rattus norvegicus
aatctgatttcagcaaccgagttga

SEQ ID NO: 60157 - DNA, 25 bp, Rattus norvegicus
aatctgcacgccatccttaaaatag

SEQ ID NO: 60158 - DNA, 25 bp, Rattus norvegicus
aatctgcacgcccagggcattttaa

SEQ ID NO: 60159 - DNA, 25 bp, Rattus norvegicus
aatctgcacgccgagggcattttaa

SEQ ID NO: 60160 - DNA, 25 bp, Rattus norvegicus
aatctgcacgccttccttaaaatag

SEQ ID NO: 60161 - DNA, 25 bp, Rattus norvegicus
aatctgcagaacctgcagtcgctgc

SEQ ID NO: 60162 - DNA, 25 bp, Rattus norvegicus
aatctgcagaacgtgcagtcgctgc

SEQ ID NO: 60163 - DNA, 25 bp, Rattus norvegicus
aatctgcagattcgctcgatctcat

SEQ ID NO: 60164 - DNA, 25 bp, Rattus norvegicus
aatctgcagattggctcgatctcat

SEQ ID NO: 60165 - DNA, 25 bp, Rattus norvegicus
aatctgcagttcaattgcaccccat

SEQ ID NO: 60166 - DNA, 25 bp, Rattus norvegicus
aatctgcagttctattgcaccccat

SEQ ID NO: 60167 - DNA, 25 bp, Rattus norvegicus
aatctgcatcaccttaaaactgtgc

SEQ ID NO: 60168 - DNA, 25 bp, Rattus norvegicus
aatctgcatcacgttaaaactgtgc

SEQ ID NO: 60169 - DNA, 25 bp, Rattus norvegicus
aatctgcatccactaatcattttag

SEQ ID NO: 60170 - DNA, 25 bp, Rattus norvegicus
aatctgcatccagtaatcattttag

SEQ ID NO: 60171 - DNA, 25 bp, Rattus norvegicus
aatctgcatctcacaacttggaatc

SEQ ID NO: 60172 - DNA, 25 bp, Rattus norvegicus
aatctgcatctctcaacttggaatc

SEQ ID NO: 60173 - DNA, 25 bp, Rattus norvegicus
aatctgcatgcgaagtgtttaactc

SEQ ID NO: 60174 - DNA, 25 bp, Rattus norvegicus
aatctgcatgcgtagtgtttaactc

SEQ ID NO: 60175 - DNA, 25 bp, Rattus norvegicus
aatctgcattccaaaggtttcttcc

SEQ ID NO: 60176 - DNA, 25 bp, Rattus norvegicus
aatctgcattcctaaggtttcttcc

SEQ ID NO: 60177 - DNA, 25 bp, Rattus norvegicus
aatctgcattggctttccctaatat

SEQ ID NO: 60178 - DNA, 25 bp, Rattus norvegicus
aatctgcattgggtttccctaatat

SEQ ID NO: 60179 - DNA, 25 bp, Rattus norvegicus
aatctgcatttcagggcacagttcc

SEQ ID NO: 60180 - DNA, 25 bp, Rattus norvegicus
aatctgcatttctgggcacagttcc

SEQ ID NO: 60181 - DNA, 25 bp, Rattus norvegicus
aatctgccacgactgattccagcaa

SEQ ID NO: 60182 - DNA, 25 bp, Rattus norvegicus
aatctgccacgagtgattccagcaa

SEQ ID NO: 60183 - DNA, 25 bp, Rattus norvegicus
aatctgcctcaaaggaaatgctagt

SEQ ID NO: 60184 - DNA, 25 bp, Rattus norvegicus
aatctgcctcaatggaaatgctagt

SEQ ID NO: 60185 - DNA, 25 bp, Rattus norvegicus
aatctgcctcgaaaagatgctccct

SEQ ID NO: 60186 - DNA, 25 bp, Rattus norvegicus
aatctgcctcgataagatgctccct

SEQ ID NO: 60187 - DNA, 25 bp, Rattus norvegicus
aatctgccttggacatactcagaaa

SEQ ID NO: 60188 - DNA, 25 bp, Rattus norvegicus
aatctgccttggtcatactcagaaa

SEQ ID NO: 60189 - DNA, 25 bp, Rattus norvegicus
aatctgcgcaacacaagtgttctcc

SEQ ID NO: 60190 - DNA, 25 bp, Rattus norvegicus
aatctgcgcaactcaagtgttctcc

SEQ ID NO: 60191 - DNA, 25 bp, Rattus norvegicus
aatctgctacacagcatgggcgtgc

SEQ ID NO: 60192 - DNA, 25 bp, Rattus norvegicus
aatctgctacactgcatgggcgtgc

SEQ ID NO: 60193 - DNA, 25 bp, Rattus norvegicus
aatctgctacgtccctggatttcaa

SEQ ID NO: 60194 - DNA, 25 bp, Rattus norvegicus
aatctgctacgtgcctggatttcaa

SEQ ID NO: 60195 - DNA, 25 bp, Rattus norvegicus
aatctgctagttataatggccgacg

SEQ ID NO: 60196 - DNA, 25 bp, Rattus norvegicus
aatctgctagttatgcatgcacctg

SEQ ID NO: 60197 - DNA, 25 bp, Rattus norvegicus
aatctgctagttttaatggccgacg

SEQ ID NO: 60198 - DNA, 25 bp, Rattus norvegicus
aatctgctagttttgcatgcacctg

SEQ ID NO: 60199 - DNA, 25 bp, Rattus norvegicus
aatctgctctagcatcttgtgtgtc

SEQ ID NO: 60200 - DNA, 25 bp, Rattus norvegicus
aatctgctctaggatcttgtgtgtc

SEQ ID NO: 60201 - DNA, 25 bp, Rattus norvegicus
aatctgctgagcacatcttcatctg

SEQ ID NO: 60202 - DNA, 25 bp, Rattus norvegicus
aatctgctgagctcatcttcatctg

SEQ ID NO: 60203 - DNA, 25 bp, Rattus norvegicus
aatctgctgcccaaaaatctcatga

SEQ ID NO: 60204 - DNA, 25 bp, Rattus norvegicus
aatctgctgccctaaaatctcatga

SEQ ID NO: 60205 - DNA, 25 bp, Rattus norvegicus
aatctgctgtataccttcttagctg

SEQ ID NO: 60206 - DNA, 25 bp, Rattus norvegicus
aatctgctgtattccttcttagctg

SEQ ID NO: 60207 - DNA, 25 bp, Rattus norvegicus
aatctgctgtgtatggtgggtccca

SEQ ID NO: 60208 - DNA, 25 bp, Rattus norvegicus
aatctgctgtgtttggtgggtccca

SEQ ID NO: 60209 - DNA, 25 bp, Rattus norvegicus
aatctgcttagtatttccatgttta

SEQ ID NO: 60210 - DNA, 25 bp, Rattus norvegicus
aatctgcttagtttttccatgttta

SEQ ID NO: 60211 - DNA, 25 bp, Rattus norvegicus
aatctgcttcttaaatgtcgtcccg

SEQ ID NO: 60212 - DNA, 25 bp, Rattus norvegicus
aatctgcttctttaatgtcgtcccg

SEQ ID NO: 60213 - DNA, 25 bp, Rattus norvegicus
aatctgcttttcactccttggtgag

SEQ ID NO: 60214 - DNA, 25 bp, Rattus norvegicus
aatctgcttttctctccttggtgag

SEQ ID NO: 60215 - DNA, 25 bp, Rattus norvegicus
aatctggaaaacagtcccctctgtc

SEQ ID NO: 60216 - DNA, 25 bp, Rattus norvegicus
aatctggaaaactgtcccctctgtc

SEQ ID NO: 60217 - DNA, 25 bp, Rattus norvegicus
aatctggaaccactggactctggct

SEQ ID NO: 60218 - DNA, 25 bp, Rattus norvegicus
aatctggaaccagtggactctggct

SEQ ID NO: 60219 - DNA, 25 bp, Rattus norvegicus
aatctggacacgctgggacttgcaa

SEQ ID NO: 60220 - DNA, 25 bp, Rattus norvegicus
aatctggacacggtgggacttgcaa

SEQ ID NO: 60221 - DNA, 25 bp, Rattus norvegicus
aatctggactcaaagctacgggcac

SEQ ID NO: 60222 - DNA, 25 bp, Rattus norvegicus
aatctggactcatagctacgggcac

SEQ ID NO: 60223 - DNA, 25 bp, Rattus norvegicus
aatctggactgtcgccctggttggt

SEQ ID NO: 60224 - DNA, 25 bp, Rattus norvegicus
aatctggactgtggccctggttggt

SEQ ID NO: 60225 - DNA, 25 bp, Rattus norvegicus
aatctggagctacctgtttgccttt

SEQ ID NO: 60226 - DNA, 25 bp, Rattus norvegicus
aatctggagctagctgtttgccttt

SEQ ID NO: 60227 - DNA, 25 bp, Rattus norvegicus
aatctggaggctctcaaaggctcct

SEQ ID NO: 60228 - DNA, 25 bp, Rattus norvegicus
aatctggaggctgtcaaaggctcct

SEQ ID NO: 60229 - DNA, 25 bp, Rattus norvegicus
aatctggaggtcatgagtcaaccct

SEQ ID NO: 60230 - DNA, 25 bp, Rattus norvegicus
aatctggaggtcttgagtcaaccct

SEQ ID NO: 60231 - DNA, 25 bp, Rattus norvegicus
aatctggatgtcatgaaggaagcaa

SEQ ID NO: 60232 - DNA, 25 bp, Rattus norvegicus
aatctggatgtcttgaaggaagcaa

SEQ ID NO: 60233 - DNA, 25 bp, Rattus norvegicus
aatctggatgttacaaggacctcaa

SEQ ID NO: 60234 - DNA, 25 bp, Rattus norvegicus
aatctggatgtttcaaggacctcaa

SEQ ID NO: 60235 - DNA, 25 bp, Rattus norvegicus
aatctggcacttatttcctcatagg

SEQ ID NO: 60236 - DNA, 25 bp, Rattus norvegicus
aatctggcacttttttcctcatagg

SEQ ID NO: 60237 - DNA, 25 bp, Rattus norvegicus
aatctggcaggcactggatccgggc

SEQ ID NO: 60238 - DNA, 25 bp, Rattus norvegicus
aatctggcaggctctggatccgggc

SEQ ID NO: 60239 - DNA, 25 bp, Rattus norvegicus
aatctggccagaatagatgccttta

SEQ ID NO: 60240 - DNA, 25 bp, Rattus norvegicus
aatctggccagattagatgccttta

SEQ ID NO: 60241 - DNA, 25 bp, Rattus norvegicus
aatctggccatgagtcacctgaaac

SEQ ID NO: 60242 - DNA, 25 bp, Rattus norvegicus
aatctggccatgatgcggcctgctt

SEQ ID NO: 60243 - DNA, 25 bp, Rattus norvegicus
aatctggccatgtgtcacctgaaac

SEQ ID NO: 60244 - DNA, 25 bp, Rattus norvegicus
aatctggccatgttgcggcctgctt

SEQ ID NO: 60245 - DNA, 25 bp, Rattus norvegicus
aatctggccattaactgtacaaaat

SEQ ID NO: 60246 - DNA, 25 bp, Rattus norvegicus
aatctggccatttactgtacaaaat

SEQ ID NO: 60247 - DNA, 25 bp, Rattus norvegicus
aatctggccccaaatgaagtagctg

SEQ ID NO: 60248 - DNA, 25 bp, Rattus norvegicus
aatctggccccatatgaagtagctg

SEQ ID NO: 60249 - DNA, 25 bp, Rattus norvegicus
aatctggcctgcctgtttggacaag

SEQ ID NO: 60250 - DNA, 25 bp, Rattus norvegicus
aatctggcctgcgtgtttggacaag

SEQ ID NO: 60251 - DNA, 25 bp, Rattus norvegicus
aatctggccttaagtttacacgctc

SEQ ID NO: 60252 - DNA, 25 bp, Rattus norvegicus
aatctggccttatgtttacacgctc

SEQ ID NO: 60253 - DNA, 25 bp, Rattus norvegicus
aatctggccttgcaatgttctccca

SEQ ID NO: 60254 - DNA, 25 bp, Rattus norvegicus
aatctggccttggaatgttctccca

SEQ ID NO: 60255 - DNA, 25 bp, Rattus norvegicus
aatctggcctttccgattctcaaaa

SEQ ID NO: 60256 - DNA, 25 bp, Rattus norvegicus
aatctggcctttgcgattctcaaaa

SEQ ID NO: 60257 - DNA, 25 bp, Rattus norvegicus
aatctggctagcaagtgtttcttcc

SEQ ID NO: 60258 - DNA, 25 bp, Rattus norvegicus
aatctggctagctagtgtttcttcc

SEQ ID NO: 60259 - DNA, 25 bp, Rattus norvegicus
aatctggctcacaggtggtaggtac

SEQ ID NO: 60260 - DNA, 25 bp, Rattus norvegicus
aatctggctcactggtggtaggtac

SEQ ID NO: 60261 - DNA, 25 bp, Rattus norvegicus
aatctggctcatctgggtatccctt

SEQ ID NO: 60262 - DNA, 25 bp, Rattus norvegicus
aatctggctcatgtgggtatccctt

SEQ ID NO: 60263 - DNA, 25 bp, Rattus norvegicus
aatctgggactgctggacttactga

SEQ ID NO: 60264 - DNA, 25 bp, Rattus norvegicus
aatctgggactggtggacttactga

SEQ ID NO: 60265 - DNA, 25 bp, Rattus norvegicus
aatctgggattgacgccagggctaa

SEQ ID NO: 60266 - DNA, 25 bp, Rattus norvegicus
aatctgggattgtcgccagggctaa

SEQ ID NO: 60267 - DNA, 25 bp, Rattus norvegicus
aatctgggccctctttccagagcag

SEQ ID NO: 60268 - DNA, 25 bp, Rattus norvegicus
aatctgggccctgtttccagagcag

SEQ ID NO: 60269 - DNA, 25 bp, Rattus norvegicus
aatctgggccttctcagacttgcct

SEQ ID NO: 60270 - DNA, 25 bp, Rattus norvegicus
aatctgggccttgtcagacttgcct

SEQ ID NO: 60271 - DNA, 25 bp, Rattus norvegicus
aatctgggctcccatatacttgcat

SEQ ID NO: 60272 - DNA, 25 bp, Rattus norvegicus
aatctgggctccgatatacttgcat

SEQ ID NO: 60273 - DNA, 25 bp, Rattus norvegicus
aatctgggcttgcaaatgcctcagc

SEQ ID NO: 60274 - DNA, 25 bp, Rattus norvegicus
aatctgggcttggaaatgcctcagc

SEQ ID NO: 60275 - DNA, 25 bp, Rattus norvegicus
aatctgggtaacaaaatgcctgtac

SEQ ID NO: 60276 - DNA, 25 bp, Rattus norvegicus
aatctgggtaactaaatgcctgtac

SEQ ID NO: 60277 - DNA, 25 bp, Rattus norvegicus
aatctgggtagcagcaggcctttgt

SEQ ID NO: 60278 - DNA, 25 bp, Rattus norvegicus
aatctgggtagctgcaggcctttgt

SEQ ID NO: 60279 - DNA, 25 bp, Rattus norvegicus
aatctgggtccccaccaactggagc

SEQ ID NO: 60280 - DNA, 25 bp, Rattus norvegicus
aatctgggtcccgaccaactggagc

SEQ ID NO: 60281 - DNA, 25 bp, Rattus norvegicus
aatctgggtgatcctctgacactgt

SEQ ID NO: 60282 - DNA, 25 bp, Rattus norvegicus
aatctgggtgatgctctgacactgt

SEQ ID NO: 60283 - DNA, 25 bp, Rattus norvegicus
aatctgggtgtcagcacacgcaagt

SEQ ID NO: 60284 - DNA, 25 bp, Rattus norvegicus
aatctgggtgtctgcacacgcaagt

SEQ ID NO: 60285 - DNA, 25 bp, Rattus norvegicus
aatctgggttggagttcactgctgc

SEQ ID NO: 60286 - DNA, 25 bp, Rattus norvegicus
aatctgggttggtgttcactgctgc

SEQ ID NO: 60287 - DNA, 25 bp, Rattus norvegicus
aatctgggttttacagttctgtcga

SEQ ID NO: 60288 - DNA, 25 bp, Rattus norvegicus
aatctgggtttttcagttctgtcga

SEQ ID NO: 60289 - DNA, 25 bp, Rattus norvegicus
aatctggtactccatgtcgtagctg

SEQ ID NO: 60290 - DNA, 25 bp, Rattus norvegicus
aatctggtactcgatgtcgtagctg

SEQ ID NO: 60291 - DNA, 25 bp, Rattus norvegicus
aatctggtagcaaattcgttgttct

SEQ ID NO: 60292 - DNA, 25 bp, Rattus norvegicus
aatctggtagcatattcgttgttct

SEQ ID NO: 60293 - DNA, 25 bp, Rattus norvegicus
aatctggtatctccctataactcac

SEQ ID NO: 60294 - DNA, 25 bp, Rattus norvegicus
aatctggtatctgcctataactcac

SEQ ID NO: 60295 - DNA, 25 bp, Rattus norvegicus
aatctggtcactagtctgcccaagg

SEQ ID NO: 60296 - DNA, 25 bp, Rattus norvegicus
aatctggtcacttgtctgcccaagg

SEQ ID NO: 60297 - DNA, 25 bp, Rattus norvegicus
aatctggtccatacttacaatctag

SEQ ID NO: 60298 - DNA, 25 bp, Rattus norvegicus
aatctggtccattcttacaatctag

SEQ ID NO: 60299 - DNA, 25 bp, Rattus norvegicus
aatctggtctccctggttttctggg

SEQ ID NO: 60300 - DNA, 25 bp, Rattus norvegicus
aatctggtctccgtggttttctggg

SEQ ID NO: 60301 - DNA, 25 bp, Rattus norvegicus
aatctggtgcccatggatttcttgt

SEQ ID NO: 60302 - DNA, 25 bp, Rattus norvegicus
aatctggtgcccttggatttcttgt

SEQ ID NO: 60303 - DNA, 25 bp, Rattus norvegicus
aatctggtgcggctcaccagttcgt

SEQ ID NO: 60304 - DNA, 25 bp, Rattus norvegicus
aatctggtgcggctgcgtagaacct

SEQ ID NO: 60305 - DNA, 25 bp, Rattus norvegicus
aatctggtgcgggtcaccagttcgt

SEQ ID NO: 60306 - DNA, 25 bp, Rattus norvegicus
aatctggtgcgggtgcgtagaacct

SEQ ID NO: 60307 - DNA, 25 bp, Rattus norvegicus
aatctggtggccagcgagggtacct

SEQ ID NO: 60308 - DNA, 25 bp, Rattus norvegicus
aatctggtggcctgcgagggtacct

SEQ ID NO: 60309 - DNA, 25 bp, Rattus norvegicus
aatctggtggtcagcgttgctcagt

SEQ ID NO: 60310 - DNA, 25 bp, Rattus norvegicus
aatctggtggtctgcgttgctcagt

SEQ ID NO: 60311 - DNA, 25 bp, Rattus norvegicus
aatctggtgttgaggcatatgtgta

SEQ ID NO: 60312 - DNA, 25 bp, Rattus norvegicus
aatctggtgttgtggcatatgtgta

SEQ ID NO: 60313 - DNA, 25 bp, Rattus norvegicus
aatctggttgctatggtttgagtaa

SEQ ID NO: 60314 - DNA, 25 bp, Rattus norvegicus
aatctggttgctttggtttgagtaa

SEQ ID NO: 60315 - DNA, 25 bp, Rattus norvegicus
aatctgtaaccgactgcacgagcaa

SEQ ID NO: 60316 - DNA, 25 bp, Rattus norvegicus
aatctgtaaccgtctgcacgagcaa

SEQ ID NO: 60317 - DNA, 25 bp, Rattus norvegicus
aatctgtaagctcttgggttctccc

SEQ ID NO: 60318 - DNA, 25 bp, Rattus norvegicus
aatctgtaagctgttgggttctccc

SEQ ID NO: 60319 - DNA, 25 bp, Rattus norvegicus
aatctgtaatagacatctccggccc

SEQ ID NO: 60320 - DNA, 25 bp, Rattus norvegicus
aatctgtaatagtcatctccggccc

SEQ ID NO: 60321 - DNA, 25 bp, Rattus norvegicus
aatctgtacagaattcagcaagcag

SEQ ID NO: 60322 - DNA, 25 bp, Rattus norvegicus
aatctgtacagatttcagcaagcag

SEQ ID NO: 60323 - DNA, 25 bp, Rattus norvegicus
aatctgtactctcgtggttctgacg

SEQ ID NO: 60324 - DNA, 25 bp, Rattus norvegicus
aatctgtactctggtggttctgacg

SEQ ID NO: 60325 - DNA, 25 bp, Rattus norvegicus
aatctgtactgtacacttcgttcat

SEQ ID NO: 60326 - DNA, 25 bp, Rattus norvegicus
aatctgtactgttcacttcgttcat

SEQ ID NO: 60327 - DNA, 25 bp, Rattus norvegicus
aatctgtatatgaaggtttaggcct

SEQ ID NO: 60328 - DNA, 25 bp, Rattus norvegicus
aatctgtatatgtaggtttaggcct

SEQ ID NO: 60329 - DNA, 25 bp, Rattus norvegicus
aatctgtatggccaagctgatatgt

SEQ ID NO: 60330 - DNA, 25 bp, Rattus norvegicus
aatctgtatggcgaagctgatatgt

SEQ ID NO: 60331 - DNA, 25 bp, Rattus norvegicus
aatctgtattgaactgatttcagta

SEQ ID NO: 60332 - DNA, 25 bp, Rattus norvegicus
aatctgtattgatctgatttcagta

SEQ ID NO: 60333 - DNA, 25 bp, Rattus norvegicus
aatctgtattttaccattctatatg

SEQ ID NO: 60334 - DNA, 25 bp, Rattus norvegicus
aatctgtatttttccattctatatg

SEQ ID NO: 60335 - DNA, 25 bp, Rattus norvegicus
aatctgtcaacactctgccatttcc

SEQ ID NO: 60336 - DNA, 25 bp, Rattus norvegicus
aatctgtcaacagtctgccatttcc

SEQ ID NO: 60337 - DNA, 25 bp, Rattus norvegicus
aatctgtcacagcattcttcaattg

SEQ ID NO: 60338 - DNA, 25 bp, Rattus norvegicus
aatctgtcacaggattcttcaattg

SEQ ID NO: 60339 - DNA, 25 bp, Rattus norvegicus
aatctgtcactgaggactcaggcgc

SEQ ID NO: 60340 - DNA, 25 bp, Rattus norvegicus
aatctgtcactgtggactcaggcgc

SEQ ID NO: 60341 - DNA, 25 bp, Rattus norvegicus
aatctgtcagctacgaggcctgtgt

SEQ ID NO: 60342 - DNA, 25 bp, Rattus norvegicus
aatctgtcagcttcgaggcctgtgt

SEQ ID NO: 60343 - DNA, 25 bp, Rattus norvegicus
aatctgtcatcaaagcttcctttgc

SEQ ID NO: 60344 - DNA, 25 bp, Rattus norvegicus
aatctgtcatcatagcttcctttgc

SEQ ID NO: 60345 - DNA, 25 bp, Rattus norvegicus
aatctgtccaatcactgtgtcgcag

SEQ ID NO: 60346 - DNA, 25 bp, Rattus norvegicus
aatctgtccaatgactgtgtcgcag

SEQ ID NO: 60347 - DNA, 25 bp, Rattus norvegicus
aatctgtcccatccagatattggta

SEQ ID NO: 60348 - DNA, 25 bp, Rattus norvegicus
aatctgtcccatgcagatattggta

SEQ ID NO: 60349 - DNA, 25 bp, Rattus norvegicus
aatctgtcctcgaattagtctttgt

SEQ ID NO: 60350 - DNA, 25 bp, Rattus norvegicus
aatctgtcctcgtattagtctttgt

SEQ ID NO: 60351 - DNA, 25 bp, Rattus norvegicus
aatctgtcctgcagtattcaaactg

SEQ ID NO: 60352 - DNA, 25 bp, Rattus norvegicus
aatctgtcctgctgtattcaaactg

SEQ ID NO: 60353 - DNA, 25 bp, Rattus norvegicus
aatctgtcctgtaaacgcccacatg

SEQ ID NO: 60354 - DNA, 25 bp, Rattus norvegicus
aatctgtcctgttaacgcccacatg

SEQ ID NO: 60355 - DNA, 25 bp, Rattus norvegicus
aatctgtcgccgctgggaggtcact

SEQ ID NO: 60356 - DNA, 25 bp, Rattus norvegicus
aatctgtcgccggtgggaggtcact

SEQ ID NO: 60357 - DNA, 25 bp, Rattus norvegicus
aatctgtcgctgagcagtggcttac

SEQ ID NO: 60358 - DNA, 25 bp, Rattus norvegicus
aatctgtcgctgtgcagtggcttac

SEQ ID NO: 60359 - DNA, 25 bp, Rattus norvegicus
aatctgtctgcaagttctccaggta

SEQ ID NO: 60360 - DNA, 25 bp, Rattus norvegicus
aatctgtctgcatgttctccaggta

SEQ ID NO: 60361 - DNA, 25 bp, Rattus norvegicus
aatctgtctggacattggtttccaa

SEQ ID NO: 60362 - DNA, 25 bp, Rattus norvegicus
aatctgtctggagattggtttccaa

SEQ ID NO: 60363 - DNA, 25 bp, Rattus norvegicus
aatctgtcttggaaacccagtgact

SEQ ID NO: 60364 - DNA, 25 bp, Rattus norvegicus
aatctgtcttggtaacccagtgact

SEQ ID NO: 60365 - DNA, 25 bp, Rattus norvegicus
aatctgtcttgtatacatatatgca

SEQ ID NO: 60366 - DNA, 25 bp, Rattus norvegicus
aatctgtcttgtttacatatatgca

SEQ ID NO: 60367 - DNA, 25 bp, Rattus norvegicus
aatctgtctttcaacctacacagtg

SEQ ID NO: 60368 - DNA, 25 bp, Rattus norvegicus
aatctgtctttctacctacacagtg

SEQ ID NO: 60369 - DNA, 25 bp, Rattus norvegicus
aatctgtgacagatgaactgttcat

SEQ ID NO: 60370 - DNA, 25 bp, Rattus norvegicus
aatctgtgacagttgaactgttcat

SEQ ID NO: 60371 - DNA, 25 bp, Rattus norvegicus
aatctgtgacggattctgggatgga

SEQ ID NO: 60372 - DNA, 25 bp, Rattus norvegicus
aatctgtgacggtttctgggatgga

SEQ ID NO: 60373 - DNA, 25 bp, Rattus norvegicus
aatctgtgatgcaactgcctggcct

SEQ ID NO: 60374 - DNA, 25 bp, Rattus norvegicus
aatctgtgatgctactgcctggcct

SEQ ID NO: 60375 - DNA, 25 bp, Rattus norvegicus
aatctgtgcccactaaatggtcgtg

SEQ ID NO: 60376 - DNA, 25 bp, Rattus norvegicus
aatctgtgcccagtaaatggtcgtg

SEQ ID NO: 60377 - DNA, 25 bp, Rattus norvegicus
aatctgtggaccagcccttgaggag

SEQ ID NO: 60378 - DNA, 25 bp, Rattus norvegicus
aatctgtggacctgcccttgaggag

SEQ ID NO: 60379 - DNA, 25 bp, Rattus norvegicus
aatctgtggaggctctagcccctgt

SEQ ID NO: 60380 - DNA, 25 bp, Rattus norvegicus
aatctgtggagggtctagcccctgt

SEQ ID NO: 60381 - DNA, 25 bp, Rattus norvegicus
aatctgtggcaaagctctccttgaa

SEQ ID NO: 60382 - DNA, 25 bp, Rattus norvegicus
aatctgtggcaatgctctccttgaa

SEQ ID NO: 60383 - DNA, 25 bp, Rattus norvegicus
aatctgtggcacaggcttctagaaa

SEQ ID NO: 60384 - DNA, 25 bp, Rattus norvegicus
aatctgtggcactggcttctagaaa

SEQ ID NO: 60385 - DNA, 25 bp, Rattus norvegicus
aatctgtggcatagggagacatccc

SEQ ID NO: 60386 - DNA, 25 bp, Rattus norvegicus
aatctgtggcattgggagacatccc

SEQ ID NO: 60387 - DNA, 25 bp, Rattus norvegicus
aatctgtgtcacagcaattctgaat

SEQ ID NO: 60388 - DNA, 25 bp, Rattus norvegicus
aatctgtgtcactgcaattctgaat

SEQ ID NO: 60389 - DNA, 25 bp, Rattus norvegicus
aatctgtgtgagcttttaccccaaa

SEQ ID NO: 60390 - DNA, 25 bp, Rattus norvegicus
aatctgtgtgaggttttaccccaaa

SEQ ID NO: 60391 - DNA, 25 bp, Rattus norvegicus
aatctgtgttctaacaacctccaaa

SEQ ID NO: 60392 - DNA, 25 bp, Rattus norvegicus
aatctgtgttcttacaacctccaaa

SEQ ID NO: 60393 - DNA, 25 bp, Rattus norvegicus
aatctgttatgtatagtatccttcc

SEQ ID NO: 60394 - DNA, 25 bp, Rattus norvegicus
aatctgttatgtttagtatccttcc

SEQ ID NO: 60395 - DNA, 25 bp, Rattus norvegicus
aatctgttattcctagtctccgttt

SEQ ID NO: 60396 - DNA, 25 bp, Rattus norvegicus
aatctgttattcgtagtctccgttt

SEQ ID NO: 60397 - DNA, 25 bp, Rattus norvegicus
aatctgttccacagaagcttgtgaa

SEQ ID NO: 60398 - DNA, 25 bp, Rattus norvegicus
aatctgttccactgaagcttgtgaa

SEQ ID NO: 60399 - DNA, 25 bp, Rattus norvegicus
aatctgttggcaattctgtgtccta

SEQ ID NO: 60400 - DNA, 25 bp, Rattus norvegicus
aatctgttggcatttctgtgtccta

SEQ ID NO: 60401 - DNA, 25 bp, Rattus norvegicus
aatctgttgtgcatagacatcccta

SEQ ID NO: 60402 - DNA, 25 bp, Rattus norvegicus
aatctgttgtgcttagacatcccta

SEQ ID NO: 60403 - DNA, 25 bp, Rattus norvegicus
aatctgtttattctagctctaccat

SEQ ID NO: 60404 - DNA, 25 bp, Rattus norvegicus
aatctgtttattgtagctctaccat

SEQ ID NO: 60405 - DNA, 25 bp, Rattus norvegicus
aatctgttttccacgtatgtttcat

SEQ ID NO: 60406 - DNA, 25 bp, Rattus norvegicus
aatctgttttcctcgtatgtttcat

SEQ ID NO: 60407 - DNA, 25 bp, Rattus norvegicus
aatctgttttctacctcacttgaaa

SEQ ID NO: 60408 - DNA, 25 bp, Rattus norvegicus
aatctgttttcttcctcacttgaaa

SEQ ID NO: 60409 - DNA, 25 bp, Rattus norvegicus
aatcttaaattcagcatgggtttca

SEQ ID NO: 60410 - DNA, 25 bp, Rattus norvegicus
aatcttaaattctgcatgggtttca

SEQ ID NO: 60411 - DNA, 25 bp, Rattus norvegicus
aatcttaaggctaggttgctctctt

SEQ ID NO: 60412 - DNA, 25 bp, Rattus norvegicus
aatcttaaggcttggttgctctctt

SEQ ID NO: 60413 - DNA, 25 bp, Rattus norvegicus
aatcttaatcacagtagccccaagg

SEQ ID NO: 60414 - DNA, 25 bp, Rattus norvegicus
aatcttaatcactgtagccccaagg

SEQ ID NO: 60415 - DNA, 25 bp, Rattus norvegicus
aatcttaattgtccgggtatctgtc

SEQ ID NO: 60416 - DNA, 25 bp, Rattus norvegicus
aatcttaattgtgcgggtatctgtc

SEQ ID NO: 60417 - DNA, 25 bp, Rattus norvegicus
aatcttaccccgctctcttatgact

SEQ ID NO: 60418 - DNA, 25 bp, Rattus norvegicus
aatcttaccccggtctcttatgact

SEQ ID NO: 60419 - DNA, 25 bp, Rattus norvegicus
aatcttaccttcatgactttctacc

SEQ ID NO: 60420 - DNA, 25 bp, Rattus norvegicus
aatcttaccttcttgactttctacc

SEQ ID NO: 60421 - DNA, 25 bp, Rattus norvegicus
aatcttactgttatctggtgctgcc

SEQ ID NO: 60422 - DNA, 25 bp, Rattus norvegicus
aatcttactgttttctggtgctgcc

SEQ ID NO: 60423 - DNA, 25 bp, Rattus norvegicus
aatcttactttacccatgcaagctc

SEQ ID NO: 60424 - DNA, 25 bp, Rattus norvegicus
aatcttactttagccatgcaagctc

SEQ ID NO: 60425 - DNA, 25 bp, Rattus norvegicus
aatcttagcttcagattgcttcctg

SEQ ID NO: 60426 - DNA, 25 bp, Rattus norvegicus
aatcttagcttctgattgcttcctg

SEQ ID NO: 60427 - DNA, 25 bp, Rattus norvegicus
aatcttaggctccagtgatgagtca

SEQ ID NO: 60428 - DNA, 25 bp, Rattus norvegicus
aatcttaggctcgagtgatgagtca

SEQ ID NO: 60429 - DNA, 25 bp, Rattus norvegicus
aatcttagtcgactttccacactgc

SEQ ID NO: 60430 - DNA, 25 bp, Rattus norvegicus
aatcttagtcgagtttccacactgc

SEQ ID NO: 60431 - DNA, 25 bp, Rattus norvegicus
aatcttagtctcattcacagcgcga

SEQ ID NO: 60432 - DNA, 25 bp, Rattus norvegicus
aatcttagtctctttcacagcgcga

SEQ ID NO: 60433 - DNA, 25 bp, Rattus norvegicus
aatcttatccttccaatgagcaatg

SEQ ID NO: 60434 - DNA, 25 bp, Rattus norvegicus
aatcttatccttgcaatgagcaatg

SEQ ID NO: 60435 - DNA, 25 bp, Rattus norvegicus
aatcttatctccaccaatttcgaaa

SEQ ID NO: 60436 - DNA, 25 bp, Rattus norvegicus
aatcttatctccatcacttgtacac

SEQ ID NO: 60437 - DNA, 25 bp, Rattus norvegicus
aatcttatctcctccaatttcgaaa

SEQ ID NO: 60438 - DNA, 25 bp, Rattus norvegicus
aatcttatctccttcacttgtacac

SEQ ID NO: 60439 - DNA, 25 bp, Rattus norvegicus
aatcttatggaaactgccccatgga

SEQ ID NO: 60440 - DNA, 25 bp, Rattus norvegicus
aatcttatggaatctgccccatgga

SEQ ID NO: 60441 - DNA, 25 bp, Rattus norvegicus
aatcttatgttcatgtgtcccacag

SEQ ID NO: 60442 - DNA, 25 bp, Rattus norvegicus
aatcttatgttcttgtgtcccacag

SEQ ID NO: 60443 - DNA, 25 bp, Rattus norvegicus
aatcttattccccacaatgctaatg

SEQ ID NO: 60444 - DNA, 25 bp, Rattus norvegicus
aatcttattcccgacaatgctaatg

SEQ ID NO: 60445 - DNA, 25 bp, Rattus norvegicus
aatcttattttcactgctcaagcaa

SEQ ID NO: 60446 - DNA, 25 bp, Rattus norvegicus
aatcttattttctctgctcaagcaa

SEQ ID NO: 60447 - DNA, 25 bp, Rattus norvegicus
aatcttcaacataactttggacttt

SEQ ID NO: 60448 - DNA, 25 bp, Rattus norvegicus
aatcttcaacattactttggacttt

SEQ ID NO: 60449 - DNA, 25 bp, Rattus norvegicus
aatcttcaagagatccatcacctct

SEQ ID NO: 60450 - DNA, 25 bp, Rattus norvegicus
aatcttcaagagttccatcacctct

SEQ ID NO: 60451 - DNA, 25 bp, Rattus norvegicus
aatcttcactatactaatcccttct

SEQ ID NO: 60452 - DNA, 25 bp, Rattus norvegicus
aatcttcactattctaatcccttct

SEQ ID NO: 60453 - DNA, 25 bp, Rattus norvegicus
aatcttcactcaaagcactgactgc

SEQ ID NO: 60454 - DNA, 25 bp, Rattus norvegicus
aatcttcactcatagcactgactgc

SEQ ID NO: 60455 - DNA, 25 bp, Rattus norvegicus
aatcttcagaagatggagcagcacc

SEQ ID NO: 60456 - DNA, 25 bp, Rattus norvegicus
aatcttcagaagttggagcagcacc

SEQ ID NO: 60457 - DNA, 25 bp, Rattus norvegicus
aatcttcagactctaggttcagtga

SEQ ID NO: 60458 - DNA, 25 bp, Rattus norvegicus
aatcttcagactgtaggttcagtga

SEQ ID NO: 60459 - DNA, 25 bp, Rattus norvegicus
aatcttcagattccaaatccctcag

SEQ ID NO: 60460 - DNA, 25 bp, Rattus norvegicus
aatcttcagattgcaaatccctcag

SEQ ID NO: 60461 - DNA, 25 bp, Rattus norvegicus
aatcttcaggcgagaccaagggacc

SEQ ID NO: 60462 - DNA, 25 bp, Rattus norvegicus
aatcttcaggcgtgaccaagggacc

SEQ ID NO: 60463 - DNA, 25 bp, Rattus norvegicus
aatcttcaggtcaagttttctcaca

SEQ ID NO: 60464 - DNA, 25 bp, Rattus norvegicus
aatcttcaggtctagttttctcaca

SEQ ID NO: 60465 - DNA, 25 bp, Rattus norvegicus
aatcttcaggtgaccaaggtcgtac

SEQ ID NO: 60466 - DNA, 25 bp, Rattus norvegicus
aatcttcaggtgtccaaggtcgtac

SEQ ID NO: 60467 - DNA, 25 bp, Rattus norvegicus
aatcttcatgaaagtcccacgtcta

SEQ ID NO: 60468 - DNA, 25 bp, Rattus norvegicus
aatcttcatgaatgtcccacgtcta

SEQ ID NO: 60469 - DNA, 25 bp, Rattus norvegicus
aatcttcattgaagcctatccacat

SEQ ID NO: 60470 - DNA, 25 bp, Rattus norvegicus
aatcttcattgatgcctatccacat

SEQ ID NO: 60471 - DNA, 25 bp, Rattus norvegicus
aatcttcattttacgatagccggtc

SEQ ID NO: 60472 - DNA, 25 bp, Rattus norvegicus
aatcttcatttttcgatagccggtc

SEQ ID NO: 60473 - DNA, 25 bp, Rattus norvegicus
aatcttccaagtcgagacactgagg

SEQ ID NO: 60474 - DNA, 25 bp, Rattus norvegicus
aatcttccaagtggagacactgagg

SEQ ID NO: 60475 - DNA, 25 bp, Rattus norvegicus
aatcttccagctcggatttggccag

SEQ ID NO: 60476 - DNA, 25 bp, Rattus norvegicus
aatcttccagctgggatttggccag

SEQ ID NO: 60477 - DNA, 25 bp, Rattus norvegicus
aatcttccagtgagagcttgcctat

SEQ ID NO: 60478 - DNA, 25 bp, Rattus norvegicus
aatcttccagtgtgagcttgcctat

SEQ ID NO: 60479 - DNA, 25 bp, Rattus norvegicus
aatcttccatccagtataccctgca

SEQ ID NO: 60480 - DNA, 25 bp, Rattus norvegicus
aatcttccatcctgtataccctgca

SEQ ID NO: 60481 - DNA, 25 bp, Rattus norvegicus
aatcttccccatcgtgatctgaatg

SEQ ID NO: 60482 - DNA, 25 bp, Rattus norvegicus
aatcttccccatggtgatctgaatg

SEQ ID NO: 60483 - DNA, 25 bp, Rattus norvegicus
aatcttcccttaatgtatgctttac

SEQ ID NO: 60484 - DNA, 25 bp, Rattus norvegicus
aatcttcccttattgtatgctttac

SEQ ID NO: 60485 - DNA, 25 bp, Rattus norvegicus
aatcttccggtgaacatagggcctt

SEQ ID NO: 60486 - DNA, 25 bp, Rattus norvegicus
aatcttccggtgtacatagggcctt

SEQ ID NO: 60487 - DNA, 25 bp, Rattus norvegicus
aatcttcctgttcaccatcctggca

SEQ ID NO: 60488 - DNA, 25 bp, Rattus norvegicus
aatcttcctgttgaccatcctggca

SEQ ID NO: 60489 - DNA, 25 bp, Rattus norvegicus
aatcttcctttgacgtcttttacag

SEQ ID NO: 60490 - DNA, 25 bp, Rattus norvegicus
aatcttcctttgtcgtcttttacag

SEQ ID NO: 60491 - DNA, 25 bp, Rattus norvegicus
aatcttcgatgcagctattccaatt

SEQ ID NO: 60492 - DNA, 25 bp, Rattus norvegicus
aatcttcgatgctgctattccaatt

SEQ ID NO: 60493 - DNA, 25 bp, Rattus norvegicus
aatcttcgtaaaatgtcctgctcgc

SEQ ID NO: 60494 - DNA, 25 bp, Rattus norvegicus
aatcttcgtaaattgtcctgctcgc

SEQ ID NO: 60495 - DNA, 25 bp, Rattus norvegicus
aatcttctacagactaaggccaggg

SEQ ID NO: 60496 - DNA, 25 bp, Rattus norvegicus
aatcttctacagatgtacaccttta

SEQ ID NO: 60497 - DNA, 25 bp, Rattus norvegicus
aatcttctacagtctaaggccaggg

SEQ ID NO: 60498 - DNA, 25 bp, Rattus norvegicus
aatcttctacagttgtacaccttta

SEQ ID NO: 60499 - DNA, 25 bp, Rattus norvegicus
aatcttctagttaccacccattgga

SEQ ID NO: 60500 - DNA, 25 bp, Rattus norvegicus
aatcttctagtttccacccattgga

SEQ ID NO: 60501 - DNA, 25 bp, Rattus norvegicus
aatcttctatctaacataccacggg

SEQ ID NO: 60502 - DNA, 25 bp, Rattus norvegicus
aatcttctatcttacataccacggg

SEQ ID NO: 60503 - DNA, 25 bp, Rattus norvegicus
aatcttctcactatgtttacacgta

SEQ ID NO: 60504 - DNA, 25 bp, Rattus norvegicus
aatcttctcactttgtttacacgta

SEQ ID NO: 60505 - DNA, 25 bp, Rattus norvegicus
aatcttctcatgagtaacttggcag

SEQ ID NO: 60506 - DNA, 25 bp, Rattus norvegicus
aatcttctcatgtgtaacttggcag

SEQ ID NO: 60507 - DNA, 25 bp, Rattus norvegicus
aatcttctccacattcattggcgag

SEQ ID NO: 60508 - DNA, 25 bp, Rattus norvegicus
aatcttctccactttcattggcgag

SEQ ID NO: 60509 - DNA, 25 bp, Rattus norvegicus
aatcttctccctatgttctgaggaa

SEQ ID NO: 60510 - DNA, 25 bp, Rattus norvegicus
aatcttctccctttgttctgaggaa

SEQ ID NO: 60511 - DNA, 25 bp, Rattus norvegicus
aatcttctctagaggcagtatgcaa

SEQ ID NO: 60512 - DNA, 25 bp, Rattus norvegicus
aatcttctctagtggcagtatgcaa

SEQ ID NO: 60513 - DNA, 25 bp, Rattus norvegicus
aatcttctctctcggtgtaggtagg

SEQ ID NO: 60514 - DNA, 25 bp, Rattus norvegicus
aatcttctctctgggtgtaggtagg

SEQ ID NO: 60515 - DNA, 25 bp, Rattus norvegicus
aatcttctctgtatttgggactcca

SEQ ID NO: 60516 - DNA, 25 bp, Rattus norvegicus
aatcttctctgtttttgggactcca

SEQ ID NO: 60517 - DNA, 25 bp, Rattus norvegicus
aatcttctgcctcccgatgtgagag

SEQ ID NO: 60518 - DNA, 25 bp, Rattus norvegicus
aatcttctgcctgccgatgtgagag

SEQ ID NO: 60519 - DNA, 25 bp, Rattus norvegicus
aatcttctggatactggattccgga

SEQ ID NO: 60520 - DNA, 25 bp, Rattus norvegicus
aatcttctggattctggattccgga

SEQ ID NO: 60521 - DNA, 25 bp, Rattus norvegicus
aatcttctgtctccttgtttcctga

SEQ ID NO: 60522 - DNA, 25 bp, Rattus norvegicus
aatcttctgtctgcttgtttcctga

SEQ ID NO: 60523 - DNA, 25 bp, Rattus norvegicus
aatcttcttcagagccagacgacat

SEQ ID NO: 60524 - DNA, 25 bp, Rattus norvegicus
aatcttcttcagtgccagacgacat

SEQ ID NO: 60525 - DNA, 25 bp, Rattus norvegicus
aatcttcttgaacggctgacacggg

SEQ ID NO: 60526 - DNA, 25 bp, Rattus norvegicus
aatcttcttgaagggctgacacggg

SEQ ID NO: 60527 - DNA, 25 bp, Rattus norvegicus
aatcttctttataacacgcttgcta

SEQ ID NO: 60528 - DNA, 25 bp, Rattus norvegicus
aatcttctttattacacgcttgcta

SEQ ID NO: 60529 - DNA, 25 bp, Rattus norvegicus
aatcttctttgaccatgtgtgttgc

SEQ ID NO: 60530 - DNA, 25 bp, Rattus norvegicus
aatcttctttgagcatgtgtgttgc

SEQ ID NO: 60531 - DNA, 25 bp, Rattus norvegicus
aatcttcttttcaagactttggcat

SEQ ID NO: 60532 - DNA, 25 bp, Rattus norvegicus
aatcttcttttctagactttggcat

SEQ ID NO: 60533 - DNA, 25 bp, Rattus norvegicus
aatcttgaacttcctagtctccaga

SEQ ID NO: 60534 - DNA, 25 bp, Rattus norvegicus
aatcttgaacttgctagtctccaga

SEQ ID NO: 60535 - DNA, 25 bp, Rattus norvegicus
aatcttgaagccatgttttttgaag

SEQ ID NO: 60536 - DNA, 25 bp, Rattus norvegicus
aatcttgaagccttgttttttgaag

SEQ ID NO: 60537 - DNA, 25 bp, Rattus norvegicus
aatcttgacaacctgagttccgtcc

SEQ ID NO: 60538 - DNA, 25 bp, Rattus norvegicus
aatcttgacaacgtgagttccgtcc

SEQ ID NO: 60539 - DNA, 25 bp, Rattus norvegicus
aatcttgacagacgccgactaaggc

SEQ ID NO: 60540 - DNA, 25 bp, Rattus norvegicus
aatcttgacagaggccgactaaggc

SEQ ID NO: 60541 - DNA, 25 bp, Rattus norvegicus
aatcttgacttcctgaaggtcgccg

SEQ ID NO: 60542 - DNA, 25 bp, Rattus norvegicus
aatcttgacttcgtgaaggtcgccg

SEQ ID NO: 60543 - DNA, 25 bp, Rattus norvegicus
aatcttgagactaaggtgcggctgc

SEQ ID NO: 60544 - DNA, 25 bp, Rattus norvegicus
aatcttgagacttaggtgcggctgc

SEQ ID NO: 60545 - DNA, 25 bp, Rattus norvegicus
aatcttgagcgtctgctccttagca

SEQ ID NO: 60546 - DNA, 25 bp, Rattus norvegicus
aatcttgagcgtgtgctccttagca

SEQ ID NO: 60547 - DNA, 25 bp, Rattus norvegicus
aatcttgatatccttcagaagcaca

SEQ ID NO: 60548 - DNA, 25 bp, Rattus norvegicus
aatcttgatatcgttcagaagcaca

SEQ ID NO: 60549 - DNA, 25 bp, Rattus norvegicus
aatcttgatgcaattcttattatgg

SEQ ID NO: 60550 - DNA, 25 bp, Rattus norvegicus
aatcttgatgcatttcttattatgg

SEQ ID NO: 60551 - DNA, 25 bp, Rattus norvegicus
aatcttgcaataaccccatgagcca

SEQ ID NO: 60552 - DNA, 25 bp, Rattus norvegicus
aatcttgcaatatccccatgagcca

SEQ ID NO: 60553 - DNA, 25 bp, Rattus norvegicus
aatcttgcagacattggccagcagg

SEQ ID NO: 60554 - DNA, 25 bp, Rattus norvegicus
aatcttgcagactttggccagcagg

SEQ ID NO: 60555 - DNA, 25 bp, Rattus norvegicus
aatcttgcagagatctgcctggctg

SEQ ID NO: 60556 - DNA, 25 bp, Rattus norvegicus
aatcttgcagagttctgcctggctg

SEQ ID NO: 60557 - DNA, 25 bp, Rattus norvegicus
aatcttgcattccttctatgttgaa

SEQ ID NO: 60558 - DNA, 25 bp, Rattus norvegicus
aatcttgcattcgttctatgttgaa

SEQ ID NO: 60559 - DNA, 25 bp, Rattus norvegicus
aatcttgccaacatctctaaaactc

SEQ ID NO: 60560 - DNA, 25 bp, Rattus norvegicus
aatcttgccaacttctctaaaactc

SEQ ID NO: 60561 - DNA, 25 bp, Rattus norvegicus
aatcttgccaagcacagtacaactg

SEQ ID NO: 60562 - DNA, 25 bp, Rattus norvegicus
aatcttgccaaggacagtacaactg

SEQ ID NO: 60563 - DNA, 25 bp, Rattus norvegicus
aatcttgcccctaactcagaatgtc

SEQ ID NO: 60564 - DNA, 25 bp, Rattus norvegicus
aatcttgccccttactcagaatgtc

SEQ ID NO: 60565 - DNA, 25 bp, Rattus norvegicus
aatcttgcctagaatgtacggttca

SEQ ID NO: 60566 - DNA, 25 bp, Rattus norvegicus
aatcttgcctagtatgtacggttca

SEQ ID NO: 60567 - DNA, 25 bp, Rattus norvegicus
aatcttgcttcactagcctttgctc

SEQ ID NO: 60568 - DNA, 25 bp, Rattus norvegicus
aatcttgcttcagtagcctttgctc

SEQ ID NO: 60569 - DNA, 25 bp, Rattus norvegicus
aatcttggagctccttctgcacatt

SEQ ID NO: 60570 - DNA, 25 bp, Rattus norvegicus
aatcttggagctgcttctgcacatt

SEQ ID NO: 60571 - DNA, 25 bp, Rattus norvegicus
aatcttggataacttcattctgtaa

SEQ ID NO: 60572 - DNA, 25 bp, Rattus norvegicus
aatcttggataagttcattctgtaa

SEQ ID NO: 60573 - DNA, 25 bp, Rattus norvegicus
aatcttggattcatctgcctgtggt

SEQ ID NO: 60574 - DNA, 25 bp, Rattus norvegicus
aatcttggattcttctgcctgtggt

SEQ ID NO: 60575 - DNA, 25 bp, Rattus norvegicus
aatcttggcgcaatcggcaaagtcc

SEQ ID NO: 60576 - DNA, 25 bp, Rattus norvegicus
aatcttggcgcattcggcaaagtcc

SEQ ID NO: 60577 - DNA, 25 bp, Rattus norvegicus
aatcttggctgaagggccggcctca

SEQ ID NO: 60578 - DNA, 25 bp, Rattus norvegicus
aatcttggctgatgggccggcctca

SEQ ID NO: 60579 - DNA, 25 bp, Rattus norvegicus
aatcttgggagcaggttcttggcta

SEQ ID NO: 60580 - DNA, 25 bp, Rattus norvegicus
aatcttgggagctggttcttggcta

SEQ ID NO: 60581 - DNA, 25 bp, Rattus norvegicus
aatcttgggcttacctaagaagaag

SEQ ID NO: 60582 - DNA, 25 bp, Rattus norvegicus
aatcttgggctttcctaagaagaag

SEQ ID NO: 60583 - DNA, 25 bp, Rattus norvegicus
aatcttggtaaacagtccctcacta

SEQ ID NO: 60584 - DNA, 25 bp, Rattus norvegicus
aatcttggtaaagagtccctcacta

SEQ ID NO: 60585 - DNA, 25 bp, Rattus norvegicus
aatcttgtaatcagttgactccgtg

SEQ ID NO: 60586 - DNA, 25 bp, Rattus norvegicus
aatcttgtaatctgttgactccgtg

SEQ ID NO: 60587 - DNA, 25 bp, Rattus norvegicus
aatcttgtacaacttgcccttgagg

SEQ ID NO: 60588 - DNA, 25 bp, Rattus norvegicus
aatcttgtacaagttgcccttgagg

SEQ ID NO: 60589 - DNA, 25 bp, Rattus norvegicus
aatcttgtcagtcgcagagtcacta

SEQ ID NO: 60590 - DNA, 25 bp, Rattus norvegicus
aatcttgtcagtggcagagtcacta

SEQ ID NO: 60591 - DNA, 25 bp, Rattus norvegicus
aatcttgtcatacaagtttttccta

SEQ ID NO: 60592 - DNA, 25 bp, Rattus norvegicus
aatcttgtcatagaagtttttccta

SEQ ID NO: 60593 - DNA, 25 bp, Rattus norvegicus
aatcttgtctgtcaatggcctactc

SEQ ID NO: 60594 - DNA, 25 bp, Rattus norvegicus
aatcttgtctgtgaatggcctactc

SEQ ID NO: 60595 - DNA, 25 bp, Rattus norvegicus
aatcttgtgcctctataacttgcca

SEQ ID NO: 60596 - DNA, 25 bp, Rattus norvegicus
aatcttgtgcctgtataacttgcca

SEQ ID NO: 60597 - DNA, 25 bp, Rattus norvegicus
aatcttgtgggcaccgatgtggtga

SEQ ID NO: 60598 - DNA, 25 bp, Rattus norvegicus
aatcttgtgggctccgatgtggtga

SEQ ID NO: 60599 - DNA, 25 bp, Rattus norvegicus
aatcttgtgttaacttgcctccatc

SEQ ID NO: 60600 - DNA, 25 bp, Rattus norvegicus
aatcttgtgttatcttgcctccatc

SEQ ID NO: 60601 - DNA, 25 bp, Rattus norvegicus
aatcttgttactcctgattcttgta

SEQ ID NO: 60602 - DNA, 25 bp, Rattus norvegicus
aatcttgttactgctgattcttgta

SEQ ID NO: 60603 - DNA, 25 bp, Rattus norvegicus
aatcttgtttccaagtgctgttgtg

SEQ ID NO: 60604 - DNA, 25 bp, Rattus norvegicus
aatcttgtttcctagtgctgttgtg

SEQ ID NO: 60605 - DNA, 25 bp, Rattus norvegicus
aatcttgtttttcccatctactttg

SEQ ID NO: 60606 - DNA, 25 bp, Rattus norvegicus
aatcttgtttttgccatctactttg

SEQ ID NO: 60607 - DNA, 25 bp, Rattus norvegicus
aatctttaatggctttgcccactgc

SEQ ID NO: 60608 - DNA, 25 bp, Rattus norvegicus
aatctttaatgggtttgcccactgc

SEQ ID NO: 60609 - DNA, 25 bp, Rattus norvegicus
aatctttacaaaagctttcccagcc

SEQ ID NO: 60610 - DNA, 25 bp, Rattus norvegicus
aatctttacaaatgctttcccagcc

SEQ ID NO: 60611 - DNA, 25 bp, Rattus norvegicus
aatctttactgcactacactttcaa

SEQ ID NO: 60612 - DNA, 25 bp, Rattus norvegicus
aatctttactgctctacactttcaa

SEQ ID NO: 60613 - DNA, 25 bp, Rattus norvegicus
aatctttactggagcatgccatgtg

SEQ ID NO: 60614 - DNA, 25 bp, Rattus norvegicus
aatctttactggtgcatgccatgtg

SEQ ID NO: 60615 - DNA, 25 bp, Rattus norvegicus
aatctttatcatatgctggttccaa

SEQ ID NO: 60616 - DNA, 25 bp, Rattus norvegicus
aatctttatcatttgctggttccaa

SEQ ID NO: 60617 - DNA, 25 bp, Rattus norvegicus
aatctttattcaattttaggtaatg

SEQ ID NO: 60618 - DNA, 25 bp, Rattus norvegicus
aatctttattcatttttaggtaatg

SEQ ID NO: 60619 - DNA, 25 bp, Rattus norvegicus
aatctttcaaacagtctaggctatg

SEQ ID NO: 60620 - DNA, 25 bp, Rattus norvegicus
aatctttcaaactgtctaggctatg

SEQ ID NO: 60621 - DNA, 25 bp, Rattus norvegicus
aatctttcagagcaagtcctcaggg

SEQ ID NO: 60622 - DNA, 25 bp, Rattus norvegicus
aatctttcagaggaagtcctcaggg

SEQ ID NO: 60623 - DNA, 25 bp, Rattus norvegicus
aatctttcagcacccagatcttgga

SEQ ID NO: 60624 - DNA, 25 bp, Rattus norvegicus
aatctttcagcagccagatcttgga

SEQ ID NO: 60625 - DNA, 25 bp, Rattus norvegicus
aatctttcagcccaaagctgtccta

SEQ ID NO: 60626 - DNA, 25 bp, Rattus norvegicus
aatctttcagccgaaagctgtccta

SEQ ID NO: 60627 - DNA, 25 bp, Rattus norvegicus
aatctttcagtaagtctgtctgtct

SEQ ID NO: 60628 - DNA, 25 bp, Rattus norvegicus
aatctttcagtatgtctgtctgtct

SEQ ID NO: 60629 - DNA, 25 bp, Rattus norvegicus
aatctttcatgcaattcaacacttt

SEQ ID NO: 60630 - DNA, 25 bp, Rattus norvegicus
aatctttcatgctattcaacacttt

SEQ ID NO: 60631 - DNA, 25 bp, Rattus norvegicus
aatctttcccacaagccatttaata

SEQ ID NO: 60632 - DNA, 25 bp, Rattus norvegicus
aatctttcccactagccatttaata

SEQ ID NO: 60633 - DNA, 25 bp, Rattus norvegicus
aatctttcccttaattggctccatg

SEQ ID NO: 60634 - DNA, 25 bp, Rattus norvegicus
aatctttccctttattggctccatg

SEQ ID NO: 60635 - DNA, 25 bp, Rattus norvegicus
aatctttccgccatatttagcttga

SEQ ID NO: 60636 - DNA, 25 bp, Rattus norvegicus
aatctttccgccttatttagcttga

SEQ ID NO: 60637 - DNA, 25 bp, Rattus norvegicus
aatctttcctgtccatgtaacaact

SEQ ID NO: 60638 - DNA, 25 bp, Rattus norvegicus
aatctttcctgtgcatgtaacaact

SEQ ID NO: 60639 - DNA, 25 bp, Rattus norvegicus
aatctttcgaacaggatgggctcat

SEQ ID NO: 60640 - DNA, 25 bp, Rattus norvegicus
aatctttcgaactggatgggctcat

SEQ ID NO: 60641 - DNA, 25 bp, Rattus norvegicus
aatctttctactattgccatttgac

SEQ ID NO: 60642 - DNA, 25 bp, Rattus norvegicus
aatctttctacttttgccatttgac

SEQ ID NO: 60643 - DNA, 25 bp, Rattus norvegicus
aatctttctggcatctgtgctcaca

SEQ ID NO: 60644 - DNA, 25 bp, Rattus norvegicus
aatctttctggcttctgtgctcaca

SEQ ID NO: 60645 - DNA, 25 bp, Rattus norvegicus
aatctttctttaatcttcttccctg

SEQ ID NO: 60646 - DNA, 25 bp, Rattus norvegicus
aatctttctttattcttcttccctg

SEQ ID NO: 60647 - DNA, 25 bp, Rattus norvegicus
aatctttgaccacttgttgactgcc

SEQ ID NO: 60648 - DNA, 25 bp, Rattus norvegicus
aatctttgaccagttgttgactgcc

SEQ ID NO: 60649 - DNA, 25 bp, Rattus norvegicus
aatctttgggagagccttcccctga

SEQ ID NO: 60650 - DNA, 25 bp, Rattus norvegicus
aatctttgggagtgccttcccctga

SEQ ID NO: 60651 - DNA, 25 bp, Rattus norvegicus
aatctttgggatcgtctgttctgta

SEQ ID NO: 60652 - DNA, 25 bp, Rattus norvegicus
aatctttgggatggtctgttctgta

SEQ ID NO: 60653 - DNA, 25 bp, Rattus norvegicus
aatctttgggctatttctaaattcg

SEQ ID NO: 60654 - DNA, 25 bp, Rattus norvegicus
aatctttgggctttttctaaattcg

SEQ ID NO: 60655 - DNA, 25 bp, Rattus norvegicus
aatctttgggtgatcttgccaatga

SEQ ID NO: 60656 - DNA, 25 bp, Rattus norvegicus
aatctttgggtgttcttgccaatga

SEQ ID NO: 60657 - DNA, 25 bp, Rattus norvegicus
aatcttttaaggagatctctgctca

SEQ ID NO: 60658 - DNA, 25 bp, Rattus norvegicus
aatcttttaaggtgatctctgctca

SEQ ID NO: 60659 - DNA, 25 bp, Rattus norvegicus
aatcttttacagaggtctgcaatca

SEQ ID NO: 60660 - DNA, 25 bp, Rattus norvegicus
aatcttttacagtggtctgcaatca

SEQ ID NO: 60661 - DNA, 25 bp, Rattus norvegicus
aatcttttcatcacccaattcttgg

SEQ ID NO: 60662 - DNA, 25 bp, Rattus norvegicus
aatcttttcatctcccaattcttgg

SEQ ID NO: 60663 - DNA, 25 bp, Rattus norvegicus
aatcttttccgtacctgttggtcag

SEQ ID NO: 60664 - DNA, 25 bp, Rattus norvegicus
aatcttttccgttcctgttggtcag

SEQ ID NO: 60665 - DNA, 25 bp, Rattus norvegicus
aatcttttccttagcaatattgggt

SEQ ID NO: 60666 - DNA, 25 bp, Rattus norvegicus
aatcttttcctttgcaatattgggt

SEQ ID NO: 60667 - DNA, 25 bp, Rattus norvegicus
aatcttttctcaatcacagaccagc

SEQ ID NO: 60668 - DNA, 25 bp, Rattus norvegicus
aatcttttctcattcacagaccagc

SEQ ID NO: 60669 - DNA, 25 bp, Rattus norvegicus
aatcttttgattctcatgtagtgac

SEQ ID NO: 60670 - DNA, 25 bp, Rattus norvegicus
aatcttttgattgtcatgtagtgac

SEQ ID NO: 60671 - DNA, 25 bp, Rattus norvegicus
aatctttttgggacattctctttgt

SEQ ID NO: 60672 - DNA, 25 bp, Rattus norvegicus
aatctttttgggtcattctctttgt

SEQ ID NO: 60673 - DNA, 25 bp, Rattus norvegicus
aatcttttttctcttctgactgctt

SEQ ID NO: 60674 - DNA, 25 bp, Rattus norvegicus
aatcttttttctgttctgactgctt

SEQ ID NO: 60675 - DNA, 25 bp, Rattus norvegicus
aatcttttttggctctcaagctctg

SEQ ID NO: 60676 - DNA, 25 bp, Rattus norvegicus
aatcttttttgggtctcaagctctg

SEQ ID NO: 60677 - DNA, 25 bp, Rattus norvegicus
aatgaaaaactcaacaagggctgga

SEQ ID NO: 60678 - DNA, 25 bp, Rattus norvegicus
aatgaaaaactctacaagggctgga

SEQ ID NO: 60679 - DNA, 25 bp, Rattus norvegicus
aatgaaaacagaccgagctccccag

SEQ ID NO: 60680 - DNA, 25 bp, Rattus norvegicus
aatgaaaacagagcgagctccccag

SEQ ID NO: 60681 - DNA, 25 bp, Rattus norvegicus
aatgaaaacgagacaggcattctga

SEQ ID NO: 60682 - DNA, 25 bp, Rattus norvegicus
aatgaaaacgagtcaggcattctga

SEQ ID NO: 60683 - DNA, 25 bp, Rattus norvegicus
aatgaaaaggtcaaatctctgcttg

SEQ ID NO: 60684 - DNA, 25 bp, Rattus norvegicus
aatgaaaaggtctaatctctgcttg

SEQ ID NO: 60685 - DNA, 25 bp, Rattus norvegicus
aatgaaaatctacagctcacccttt

SEQ ID NO: 60686 - DNA, 25 bp, Rattus norvegicus
aatgaaaatctagagctcacccttt

SEQ ID NO: 60687 - DNA, 25 bp, Rattus norvegicus
aatgaaacattccactcaagggtgg

SEQ ID NO: 60688 - DNA, 25 bp, Rattus norvegicus
aatgaaacattcgactcaagggtgg

SEQ ID NO: 60689 - DNA, 25 bp, Rattus norvegicus
aatgaaaccacgcaacaggacctgt

SEQ ID NO: 60690 - DNA, 25 bp, Rattus norvegicus
aatgaaaccacggaacaggacctgt

SEQ ID NO: 60691 - DNA, 25 bp, Rattus norvegicus
aatgaaaccatgactatagctgtag

SEQ ID NO: 60692 - DNA, 25 bp, Rattus norvegicus
aatgaaaccatgtctatagctgtag

SEQ ID NO: 60693 - DNA, 25 bp, Rattus norvegicus
aatgaaactattccacagccacttt

SEQ ID NO: 60694 - DNA, 25 bp, Rattus norvegicus
aatgaaactattcccatttgcagca

SEQ ID NO: 60695 - DNA, 25 bp, Rattus norvegicus
aatgaaactattgcacagccacttt

SEQ ID NO: 60696 - DNA, 25 bp, Rattus norvegicus
aatgaaactattgccatttgcagca

SEQ ID NO: 60697 - DNA, 25 bp, Rattus norvegicus
aatgaaactgcaaatgtggtgacca

SEQ ID NO: 60698 - DNA, 25 bp, Rattus norvegicus
aatgaaactgcatatgtggtgacca

SEQ ID NO: 60699 - DNA, 25 bp, Rattus norvegicus
aatgaaagacatacccctgtgtcat

SEQ ID NO: 60700 - DNA, 25 bp, Rattus norvegicus
aatgaaagacattcccctgtgtcat

SEQ ID NO: 60701 - DNA, 25 bp, Rattus norvegicus
aatgaaagatgcctaccaccagact

SEQ ID NO: 60702 - DNA, 25 bp, Rattus norvegicus
aatgaaagatgcgtaccaccagact

SEQ ID NO: 60703 - DNA, 25 bp, Rattus norvegicus
aatgaaagcccaccctgaaagaagt

SEQ ID NO: 60704 - DNA, 25 bp, Rattus norvegicus
aatgaaagcccagcctgaaagaagt

SEQ ID NO: 60705 - DNA, 25 bp, Rattus norvegicus
aatgaaaggagcactaccagttggc

SEQ ID NO: 60706 - DNA, 25 bp, Rattus norvegicus
aatgaaaggagctctaccagttggc

SEQ ID NO: 60707 - DNA, 25 bp, Rattus norvegicus
aatgaaaggcagctcgactccagtc

SEQ ID NO: 60708 - DNA, 25 bp, Rattus norvegicus
aatgaaaggcaggtcgactccagtc

SEQ ID NO: 60709 - DNA, 25 bp, Rattus norvegicus
aatgaaaggtggctcccagtctcct

SEQ ID NO: 60710 - DNA, 25 bp, Rattus norvegicus
aatgaaaggtgggtcccagtctcct

SEQ ID NO: 60711 - DNA, 25 bp, Rattus norvegicus
aatgaaagttcacgtttccctctgt

SEQ ID NO: 60712 - DNA, 25 bp, Rattus norvegicus
aatgaaagttcaggtttccctctgt

SEQ ID NO: 60713 - DNA, 25 bp, Rattus norvegicus
aatgaaatcattctggcctcaacat

SEQ ID NO: 60714 - DNA, 25 bp, Rattus norvegicus
aatgaaatcattgtggcctcaacat

SEQ ID NO: 60715 - DNA, 25 bp, Rattus norvegicus
aatgaaatcgatcagctgctgcagg

SEQ ID NO: 60716 - DNA, 25 bp, Rattus norvegicus
aatgaaatcgatgagctgctgcagg

SEQ ID NO: 60717 - DNA, 25 bp, Rattus norvegicus
aatgaaatctcaactgcatcccttt

SEQ ID NO: 60718 - DNA, 25 bp, Rattus norvegicus
aatgaaatctcatctgcatcccttt

SEQ ID NO: 60719 - DNA, 25 bp, Rattus norvegicus
aatgaaatctccatctttcctgagc

SEQ ID NO: 60720 - DNA, 25 bp, Rattus norvegicus
aatgaaatctccttctttcctgagc

SEQ ID NO: 60721 - DNA, 25 bp, Rattus norvegicus
aatgaaatgcctacgctgcgactgc

SEQ ID NO: 60722 - DNA, 25 bp, Rattus norvegicus
aatgaaatgccttcgctgcgactgc

SEQ ID NO: 60723 - DNA, 25 bp, Rattus norvegicus
aatgaaattcgccaatctgctcttt

SEQ ID NO: 60724 - DNA, 25 bp, Rattus norvegicus
aatgaaattcgcgaatctgctcttt

SEQ ID NO: 60725 - DNA, 25 bp, Rattus norvegicus
aatgaaattctcaagcctgctttcc

SEQ ID NO: 60726 - DNA, 25 bp, Rattus norvegicus
aatgaaattctctagcctgctttcc

SEQ ID NO: 60727 - DNA, 25 bp, Rattus norvegicus
aatgaaattctgaggcatcctggaa

SEQ ID NO: 60728 - DNA, 25 bp, Rattus norvegicus
aatgaaattctgtggcatcctggaa

SEQ ID NO: 60729 - DNA, 25 bp, Rattus norvegicus
aatgaaattgctcgtctgcctgttt

SEQ ID NO: 60730 - DNA, 25 bp, Rattus norvegicus
aatgaaattgctggtctgcctgttt

SEQ ID NO: 60731 - DNA, 25 bp, Rattus norvegicus
aatgaaattgtcctggtgctccaac

SEQ ID NO: 60732 - DNA, 25 bp, Rattus norvegicus
aatgaaattgtcgtggtgctccaac

SEQ ID NO: 60733 - DNA, 25 bp, Rattus norvegicus
aatgaaatttaaagtcctcttttgg

SEQ ID NO: 60734 - DNA, 25 bp, Rattus norvegicus
aatgaaatttaatgtcctcttttgg

SEQ ID NO: 60735 - DNA, 25 bp, Rattus norvegicus
aatgaacaagtcagctacctcttcg

SEQ ID NO: 60736 - DNA, 25 bp, Rattus norvegicus
aatgaacaagtctgctacctcttcg

SEQ ID NO: 60737 - DNA, 25 bp, Rattus norvegicus
aatgaacacaccagtgccacagcag

SEQ ID NO: 60738 - DNA, 25 bp, Rattus norvegicus
aatgaacacacctgtgccacagcag

SEQ ID NO: 60739 - DNA, 25 bp, Rattus norvegicus
aatgaacacccactagtccggaagg

SEQ ID NO: 60740 - DNA, 25 bp, Rattus norvegicus
aatgaacacccagtagtccggaagg

SEQ ID NO: 60741 - DNA, 25 bp, Rattus norvegicus
aatgaacagcgtcgccatggactct

SEQ ID NO: 60742 - DNA, 25 bp, Rattus norvegicus
aatgaacagcgtggccatggactct

SEQ ID NO: 60743 - DNA, 25 bp, Rattus norvegicus
aatgaacagcttcccttgaacatgc

SEQ ID NO: 60744 - DNA, 25 bp, Rattus norvegicus
aatgaacagcttgccttgaacatgc

SEQ ID NO: 60745 - DNA, 25 bp, Rattus norvegicus
aatgaacagttcatgaagactcgaa

SEQ ID NO: 60746 - DNA, 25 bp, Rattus norvegicus
aatgaacagttcctgctgcagcgac

SEQ ID NO: 60747 - DNA, 25 bp, Rattus norvegicus
aatgaacagttcgtgctgcagcgac

SEQ ID NO: 60748 - DNA, 25 bp, Rattus norvegicus
aatgaacagttcttgaagactcgaa

SEQ ID NO: 60749 - DNA, 25 bp, Rattus norvegicus
aatgaacatgctattacccctgaat

SEQ ID NO: 60750 - DNA, 25 bp, Rattus norvegicus
aatgaacatgcttttacccctgaat

SEQ ID NO: 60751 - DNA, 25 bp, Rattus norvegicus
aatgaacatttcactacccctgtga

SEQ ID NO: 60752 - DNA, 25 bp, Rattus norvegicus
aatgaacatttctctacccctgtga

SEQ ID NO: 60753 - DNA, 25 bp, Rattus norvegicus
aatgaaccacgaagcccactaaatt

SEQ ID NO: 60754 - DNA, 25 bp, Rattus norvegicus
aatgaaccacgatgcccactaaatt

SEQ ID NO: 60755 - DNA, 25 bp, Rattus norvegicus
aatgaaccagacctcccaggcacta

SEQ ID NO: 60756 - DNA, 25 bp, Rattus norvegicus
aatgaaccagacgtcccaggcacta

SEQ ID NO: 60757 - DNA, 25 bp, Rattus norvegicus
aatgaaccatcaatacaggtccagg

SEQ ID NO: 60758 - DNA, 25 bp, Rattus norvegicus
aatgaaccatcattacaggtccagg

SEQ ID NO: 60759 - DNA, 25 bp, Rattus norvegicus
aatgaaccattcaactcctgctgtg

SEQ ID NO: 60760 - DNA, 25 bp, Rattus norvegicus
aatgaaccattctactcctgctgtg

SEQ ID NO: 60761 - DNA, 25 bp, Rattus norvegicus
aatgaacccagaagtggcaccctca

SEQ ID NO: 60762 - DNA, 25 bp, Rattus norvegicus
aatgaacccagatgtggcaccctca

SEQ ID NO: 60763 - DNA, 25 bp, Rattus norvegicus
aatgaacctgtcagctattcaagat

SEQ ID NO: 60764 - DNA, 25 bp, Rattus norvegicus
aatgaacctgtctgctattcaagat

SEQ ID NO: 60765 - DNA, 25 bp, Rattus norvegicus
aatgaacgaagcagaccctcggagt

SEQ ID NO: 60766 - DNA, 25 bp, Rattus norvegicus
aatgaacgaagctgaccctcggagt

SEQ ID NO: 60767 - DNA, 25 bp, Rattus norvegicus
aatgaacgcatgcactcgagcctta

SEQ ID NO: 60768 - DNA, 25 bp, Rattus norvegicus
aatgaacgcatggactcgagcctta

SEQ ID NO: 60769 - DNA, 25 bp, Rattus norvegicus
aatgaactacgtccgtcacatgctg

SEQ ID NO: 60770 - DNA, 25 bp, Rattus norvegicus
aatgaactacgtgcgtcacatgctg

SEQ ID NO: 60771 - DNA, 25 bp, Rattus norvegicus
aatgaactatgtcttggctctctct

SEQ ID NO: 60772 - DNA, 25 bp, Rattus norvegicus
aatgaactatgtgttggctctctct

SEQ ID NO: 60773 - DNA, 25 bp, Rattus norvegicus
aatgaactcaccaagctcaacgtct

SEQ ID NO: 60774 - DNA, 25 bp, Rattus norvegicus
aatgaactcacctagctcaacgtct

SEQ ID NO: 60775 - DNA, 25 bp, Rattus norvegicus
aatgaactcagtaccttggaaacgt

SEQ ID NO: 60776 - DNA, 25 bp, Rattus norvegicus
aatgaactcagttccttggaaacgt

SEQ ID NO: 60777 - DNA, 25 bp, Rattus norvegicus
aatgaactcctaattttgatagtaa

SEQ ID NO: 60778 - DNA, 25 bp, Rattus norvegicus
aatgaactcctatttttgatagtaa

SEQ ID NO: 60779 - DNA, 25 bp, Rattus norvegicus
aatgaactctggcatttgagcacac

SEQ ID NO: 60780 - DNA, 25 bp, Rattus norvegicus
aatgaactctgggatttgagcacac

SEQ ID NO: 60781 - DNA, 25 bp, Rattus norvegicus
aatgaactgaagctgaaacaaagct

SEQ ID NO: 60782 - DNA, 25 bp, Rattus norvegicus
aatgaactgaagctggccgtggccc

SEQ ID NO: 60783 - DNA, 25 bp, Rattus norvegicus
aatgaactgaaggtgaaacaaagct

SEQ ID NO: 60784 - DNA, 25 bp, Rattus norvegicus
aatgaactgaaggtggccgtggccc

SEQ ID NO: 60785 - DNA, 25 bp, Rattus norvegicus
aatgaactgatcacaggcctgtcct

SEQ ID NO: 60786 - DNA, 25 bp, Rattus norvegicus
aatgaactgatctcaggcctgtcct

SEQ ID NO: 60787 - DNA, 25 bp, Rattus norvegicus
aatgaacttggaagacttgcccctc

SEQ ID NO: 60788 - DNA, 25 bp, Rattus norvegicus
aatgaacttggatgacttgcccctc

SEQ ID NO: 60789 - DNA, 25 bp, Rattus norvegicus
aatgaagaacttcctccagctgcag

SEQ ID NO: 60790 - DNA, 25 bp, Rattus norvegicus
aatgaagaacttgctccagctgcag

SEQ ID NO: 60791 - DNA, 25 bp, Rattus norvegicus
aatgaagaatcccttccctgtgcat

SEQ ID NO: 60792 - DNA, 25 bp, Rattus norvegicus
aatgaagaatccgttccctgtgcat

SEQ ID NO: 60793 - DNA, 25 bp, Rattus norvegicus
aatgaagaatttccccaggctcagc

SEQ ID NO: 60794 - DNA, 25 bp, Rattus norvegicus
aatgaagaatttgcccaggctcagc

SEQ ID NO: 60795 - DNA, 25 bp, Rattus norvegicus
aatgaagacacactgcctcgattac

SEQ ID NO: 60796 - DNA, 25 bp, Rattus norvegicus
aatgaagacacagtgcctcgattac

SEQ ID NO: 60797 - DNA, 25 bp, Rattus norvegicus
aatgaagaccctccaaagcgaccca

SEQ ID NO: 60798 - DNA, 25 bp, Rattus norvegicus
aatgaagaccctgcaaagcgaccca

SEQ ID NO: 60799 - DNA, 25 bp, Rattus norvegicus
aatgaagacgacagctgctctttcc

SEQ ID NO: 60800 - DNA, 25 bp, Rattus norvegicus
aatgaagacgactgctgctctttcc

SEQ ID NO: 60801 - DNA, 25 bp, Rattus norvegicus
aatgaagacgttaccatcatcccac

SEQ ID NO: 60802 - DNA, 25 bp, Rattus norvegicus
aatgaagacgtttccatcatcccac

SEQ ID NO: 60803 - DNA, 25 bp, Rattus norvegicus
aatgaagagatgacgggcctccctg

SEQ ID NO: 60804 - DNA, 25 bp, Rattus norvegicus
aatgaagagatgtcgggcctccctg

SEQ ID NO: 60805 - DNA, 25 bp, Rattus norvegicus
aatgaagaggccatggcccctgact

SEQ ID NO: 60806 - DNA, 25 bp, Rattus norvegicus
aatgaagaggccttggcccctgact

SEQ ID NO: 60807 - DNA, 25 bp, Rattus norvegicus
aatgaagagtccacggtcttccctt

SEQ ID NO: 60808 - DNA, 25 bp, Rattus norvegicus
aatgaagagtcctcggtcttccctt

SEQ ID NO: 60809 - DNA, 25 bp, Rattus norvegicus
aatgaagatcacctgcttggcatga

SEQ ID NO: 60810 - DNA, 25 bp, Rattus norvegicus
aatgaagatcacgtgcttggcatga

SEQ ID NO: 60811 - DNA, 25 bp, Rattus norvegicus
aatgaagatctcatttgccaagaag

SEQ ID NO: 60812 - DNA, 25 bp, Rattus norvegicus
aatgaagatctcttttgccaagaag

SEQ ID NO: 60813 - DNA, 25 bp, Rattus norvegicus
aatgaagcaagaactgtcccacagg

SEQ ID NO: 60814 - DNA, 25 bp, Rattus norvegicus
aatgaagcaagatctgtcccacagg

SEQ ID NO: 60815 - DNA, 25 bp, Rattus norvegicus
aatgaagcagcacacctcgtggcac

SEQ ID NO: 60816 - DNA, 25 bp, Rattus norvegicus
aatgaagcagcagacctcgtggcac

SEQ ID NO: 60817 - DNA, 25 bp, Rattus norvegicus
aatgaagcagcccatcatggcggat

SEQ ID NO: 60818 - DNA, 25 bp, Rattus norvegicus
aatgaagcagccgatcatggcggat

SEQ ID NO: 60819 - DNA, 25 bp, Rattus norvegicus
aatgaagcagctatggctttcccgc

SEQ ID NO: 60820 - DNA, 25 bp, Rattus norvegicus
aatgaagcagctttggctttcccgc

SEQ ID NO: 60821 - DNA, 25 bp, Rattus norvegicus
aatgaagcatacagccactgcccgt

SEQ ID NO: 60822 - DNA, 25 bp, Rattus norvegicus
aatgaagcatactgccactgcccgt

SEQ ID NO: 60823 - DNA, 25 bp, Rattus norvegicus
aatgaagcattcattgggtcccagc

SEQ ID NO: 60824 - DNA, 25 bp, Rattus norvegicus
aatgaagcattctttgggtcccagc

SEQ ID NO: 60825 - DNA, 25 bp, Rattus norvegicus
aatgaagccatgactcagatcaggg

SEQ ID NO: 60826 - DNA, 25 bp, Rattus norvegicus
aatgaagccatgtctcagatcaggg

SEQ ID NO: 60827 - DNA, 25 bp, Rattus norvegicus
aatgaagccctgatactcatcaaat

SEQ ID NO: 60828 - DNA, 25 bp, Rattus norvegicus
aatgaagccctgttactcatcaaat

SEQ ID NO: 60829 - DNA, 25 bp, Rattus norvegicus
aatgaagccgatattccaccacctg

SEQ ID NO: 60830 - DNA, 25 bp, Rattus norvegicus
aatgaagccgattttccaccacctg

SEQ ID NO: 60831 - DNA, 25 bp, Rattus norvegicus
aatgaagccgctaggattctgggat

SEQ ID NO: 60832 - DNA, 25 bp, Rattus norvegicus
aatgaagccgcttggattctgggat

SEQ ID NO: 60833 - DNA, 25 bp, Rattus norvegicus
aatgaagccggtctcctctgtggta

SEQ ID NO: 60834 - DNA, 25 bp, Rattus norvegicus
aatgaagccggtgtcctctgtggta

SEQ ID NO: 60835 - DNA, 25 bp, Rattus norvegicus
aatgaagcctacacggcagacttga

SEQ ID NO: 60836 - DNA, 25 bp, Rattus norvegicus
aatgaagcctactcggcagacttga

SEQ ID NO: 60837 - DNA, 25 bp, Rattus norvegicus
aatgaagcctagatcagtccacggc

SEQ ID NO: 60838 - DNA, 25 bp, Rattus norvegicus
aatgaagcctagcagctcttccaaa

SEQ ID NO: 60839 - DNA, 25 bp, Rattus norvegicus
aatgaagcctaggagctcttccaaa

SEQ ID NO: 60840 - DNA, 25 bp, Rattus norvegicus
aatgaagcctagttcagtccacggc

SEQ ID NO: 60841 - DNA, 25 bp, Rattus norvegicus
aatgaagcctgacaagacacctcct

SEQ ID NO: 60842 - DNA, 25 bp, Rattus norvegicus
aatgaagcctgagaagacacctcct

SEQ ID NO: 60843 - DNA, 25 bp, Rattus norvegicus
aatgaagccttcatgcgtgtgctga

SEQ ID NO: 60844 - DNA, 25 bp, Rattus norvegicus
aatgaagccttcttgcgtgtgctga

SEQ ID NO: 60845 - DNA, 25 bp, Rattus norvegicus
aatgaagctcgtcgtggtttctctt

SEQ ID NO: 60846 - DNA, 25 bp, Rattus norvegicus
aatgaagctcgtggtggtttctctt

SEQ ID NO: 60847 - DNA, 25 bp, Rattus norvegicus
aatgaagctgctcagatcctgcggt

SEQ ID NO: 60848 - DNA, 25 bp, Rattus norvegicus
aatgaagctgctgagatcctgcggt

SEQ ID NO: 60849 - DNA, 25 bp, Rattus norvegicus
aatgaagctgttaccatgtacagga

SEQ ID NO: 60850 - DNA, 25 bp, Rattus norvegicus
aatgaagctgtttccatgtacagga

SEQ ID NO: 60851 - DNA, 25 bp, Rattus norvegicus
aatgaagcttccagcctagcttgga

SEQ ID NO: 60852 - DNA, 25 bp, Rattus norvegicus
aatgaagcttcctgcctagcttgga

SEQ ID NO: 60853 - DNA, 25 bp, Rattus norvegicus
aatgaaggaagacggctcatgcctg

SEQ ID NO: 60854 - DNA, 25 bp, Rattus norvegicus
aatgaaggaagagggctcatgcctg

SEQ ID NO: 60855 - DNA, 25 bp, Rattus norvegicus
aatgaaggacagctctcctgttggg

SEQ ID NO: 60856 - DNA, 25 bp, Rattus norvegicus
aatgaaggacaggtctcctgttggg

SEQ ID NO: 60857 - DNA, 25 bp, Rattus norvegicus
aatgaaggagaaccttcctccctga

SEQ ID NO: 60858 - DNA, 25 bp, Rattus norvegicus
aatgaaggagaagcttcctccctga

SEQ ID NO: 60859 - DNA, 25 bp, Rattus norvegicus
aatgaagggtctcctcgtggacaga

SEQ ID NO: 60860 - DNA, 25 bp, Rattus norvegicus
aatgaagggtctgctcgtggacaga

SEQ ID NO: 60861 - DNA, 25 bp, Rattus norvegicus
aatgaaggtcaacccattgcccttt

SEQ ID NO: 60862 - DNA, 25 bp, Rattus norvegicus
aatgaaggtcaagccattgcccttt

SEQ ID NO: 60863 - DNA, 25 bp, Rattus norvegicus
aatgaagtacccactggtgccgctg

SEQ ID NO: 60864 - DNA, 25 bp, Rattus norvegicus
aatgaagtaccctctggtgccgctg

SEQ ID NO: 60865 - DNA, 25 bp, Rattus norvegicus
aatgaagtagccaccgtttcatcct

SEQ ID NO: 60866 - DNA, 25 bp, Rattus norvegicus
aatgaagtagccatgctttctccct

SEQ ID NO: 60867 - DNA, 25 bp, Rattus norvegicus
aatgaagtagcctccgtttcatcct

SEQ ID NO: 60868 - DNA, 25 bp, Rattus norvegicus
aatgaagtagccttgctttctccct

SEQ ID NO: 60869 - DNA, 25 bp, Rattus norvegicus
aatgaagtagtgctcctggacgccc

SEQ ID NO: 60870 - DNA, 25 bp, Rattus norvegicus
aatgaagtagtggtcctggacgccc

SEQ ID NO: 60871 - DNA, 25 bp, Rattus norvegicus
aatgaagtcaccacggactatcata

SEQ ID NO: 60872 - DNA, 25 bp, Rattus norvegicus
aatgaagtcacctcggactatcata

SEQ ID NO: 60873 - DNA, 25 bp, Rattus norvegicus
aatgaagtcatccacctttctgatg

SEQ ID NO: 60874 - DNA, 25 bp, Rattus norvegicus
aatgaagtcatcgacctttctgatg

SEQ ID NO: 60875 - DNA, 25 bp, Rattus norvegicus
aatgaagtgcgtagtcagtgttgcg

SEQ ID NO: 60876 - DNA, 25 bp, Rattus norvegicus
aatgaagtgcgttgtcagtgttgcg

SEQ ID NO: 60877 - DNA, 25 bp, Rattus norvegicus
aatgaagtgctgagttccactccag

SEQ ID NO: 60878 - DNA, 25 bp, Rattus norvegicus
aatgaagtgctgtgttccactccag

SEQ ID NO: 60879 - DNA, 25 bp, Rattus norvegicus
aatgaagtgtgcagttctctgccta

SEQ ID NO: 60880 - DNA, 25 bp, Rattus norvegicus
aatgaagtgtgctgttctctgccta

SEQ ID NO: 60881 - DNA, 25 bp, Rattus norvegicus
aatgaagttcagcacacgggacaga

SEQ ID NO: 60882 - DNA, 25 bp, Rattus norvegicus
aatgaagttcaggacacgggacaga

SEQ ID NO: 60883 - DNA, 25 bp, Rattus norvegicus
aatgaagttcccactcattaaccct

SEQ ID NO: 60884 - DNA, 25 bp, Rattus norvegicus
aatgaagttccctctcattaaccct

SEQ ID NO: 60885 - DNA, 25 bp, Rattus norvegicus
aatgaagttggaaccgggaagagtc

SEQ ID NO: 60886 - DNA, 25 bp, Rattus norvegicus
aatgaagttggatccgggaagagtc

SEQ ID NO: 60887 - DNA, 25 bp, Rattus norvegicus
aatgaagtttgcaggccgtccagag

SEQ ID NO: 60888 - DNA, 25 bp, Rattus norvegicus
aatgaagtttgctggccgtccagag

SEQ ID NO: 60889 - DNA, 25 bp, Rattus norvegicus
aatgaagtttgtaccacacagcact

SEQ ID NO: 60890 - DNA, 25 bp, Rattus norvegicus
aatgaagtttgttccacacagcact

SEQ ID NO: 60891 - DNA, 25 bp, Rattus norvegicus
aatgaataacctacctgtgagctgt

SEQ ID NO: 60892 - DNA, 25 bp, Rattus norvegicus
aatgaataacctccagcaaagtctg

SEQ ID NO: 60893 - DNA, 25 bp, Rattus norvegicus
aatgaataacctgcagcaaagtctg

SEQ ID NO: 60894 - DNA, 25 bp, Rattus norvegicus
aatgaataaccttcctgtgagctgt

SEQ ID NO: 60895 - DNA, 25 bp, Rattus norvegicus
aatgaatagcttaggacactttaaa

SEQ ID NO: 60896 - DNA, 25 bp, Rattus norvegicus
aatgaatagctttggacactttaaa

SEQ ID NO: 60897 - DNA, 25 bp, Rattus norvegicus
aatgaatatttcctccaaacctcac

SEQ ID NO: 60898 - DNA, 25 bp, Rattus norvegicus
aatgaatatttcgtccaaacctcac

SEQ ID NO: 60899 - DNA, 25 bp, Rattus norvegicus
aatgaatcaattccctttgagggtg

SEQ ID NO: 60900 - DNA, 25 bp, Rattus norvegicus
aatgaatcaattgcctttgagggtg

SEQ ID NO: 60901 - DNA, 25 bp, Rattus norvegicus
aatgaatcacaacactgcctcctac

SEQ ID NO: 60902 - DNA, 25 bp, Rattus norvegicus
aatgaatcacaagactgcctcctac

SEQ ID NO: 60903 - DNA, 25 bp, Rattus norvegicus
aatgaatcattcacccatgttgggt

SEQ ID NO: 60904 - DNA, 25 bp, Rattus norvegicus
aatgaatcattctcccatgttgggt

SEQ ID NO: 60905 - DNA, 25 bp, Rattus norvegicus
aatgaatccactcccactggtatta

SEQ ID NO: 60906 - DNA, 25 bp, Rattus norvegicus
aatgaatccactcctccgtaagatg

SEQ ID NO: 60907 - DNA, 25 bp, Rattus norvegicus
aatgaatccactgccactggtatta

SEQ ID NO: 60908 - DNA, 25 bp, Rattus norvegicus
aatgaatccactgctccgtaagatg

SEQ ID NO: 60909 - DNA, 25 bp, Rattus norvegicus
aatgaatcctgtaggagttaatcaa

SEQ ID NO: 60910 - DNA, 25 bp, Rattus norvegicus
aatgaatcctgttggagttaatcaa

SEQ ID NO: 60911 - DNA, 25 bp, Rattus norvegicus
aatgaatctctgaatgtatgttgaa

SEQ ID NO: 60912 - DNA, 25 bp, Rattus norvegicus
aatgaatctctgtatgtatgttgaa

SEQ ID NO: 60913 - DNA, 25 bp, Rattus norvegicus
aatgaatgacgaagcttttccccat

SEQ ID NO: 60914 - DNA, 25 bp, Rattus norvegicus
aatgaatgacgatgcttttccccat

SEQ ID NO: 60915 - DNA, 25 bp, Rattus norvegicus
aatgaatgcattagggctagaggac

SEQ ID NO: 60916 - DNA, 25 bp, Rattus norvegicus
aatgaatgcatttgggctagaggac

SEQ ID NO: 60917 - DNA, 25 bp, Rattus norvegicus
aatgaatgccctaacttgttgaaat

SEQ ID NO: 60918 - DNA, 25 bp, Rattus norvegicus
aatgaatgcccttacttgttgaaat

SEQ ID NO: 60919 - DNA, 25 bp, Rattus norvegicus
aatgaatgctgcagttcgctctact

SEQ ID NO: 60920 - DNA, 25 bp, Rattus norvegicus
aatgaatgctgctgttcgctctact

SEQ ID NO: 60921 - DNA, 25 bp, Rattus norvegicus
aatgaatggatgactctgagccctt

SEQ ID NO: 60922 - DNA, 25 bp, Rattus norvegicus
aatgaatggatgtctctgagccctt

SEQ ID NO: 60923 - DNA, 25 bp, Rattus norvegicus
aatgaatgggcacaaccggcccctt

SEQ ID NO: 60924 - DNA, 25 bp, Rattus norvegicus
aatgaatgggcagaaccggcccctt

SEQ ID NO: 60925 - DNA, 25 bp, Rattus norvegicus
aatgaatgggtcagctcactgtagc

SEQ ID NO: 60926 - DNA, 25 bp, Rattus norvegicus
aatgaatgggtctgctcactgtagc

SEQ ID NO: 60927 - DNA, 25 bp, Rattus norvegicus
aatgaatgtgataacgctttttcac

SEQ ID NO: 60928 - DNA, 25 bp, Rattus norvegicus
aatgaatgtgattacgctttttcac

SEQ ID NO: 60929 - DNA, 25 bp, Rattus norvegicus
aatgaatgttctcgcagatgctctc

SEQ ID NO: 60930 - DNA, 25 bp, Rattus norvegicus
aatgaatgttctggcagatgctctc

SEQ ID NO: 60931 - DNA, 25 bp, Rattus norvegicus
aatgaattaaacaatgacgccagtc

SEQ ID NO: 60932 - DNA, 25 bp, Rattus norvegicus
aatgaattaaactatgacgccagtc

SEQ ID NO: 60933 - DNA, 25 bp, Rattus norvegicus
aatgaattcaccacatccgatcaat

SEQ ID NO: 60934 - DNA, 25 bp, Rattus norvegicus
aatgaattcacctcatccgatcaat

SEQ ID NO: 60935 - DNA, 25 bp, Rattus norvegicus
aatgaattcatgactgctgtgctaa

SEQ ID NO: 60936 - DNA, 25 bp, Rattus norvegicus
aatgaattcatgtctgctgtgctaa

SEQ ID NO: 60937 - DNA, 25 bp, Rattus norvegicus
aatgaattccgccacgaggcgtgca

SEQ ID NO: 60938 - DNA, 25 bp, Rattus norvegicus
aatgaattccgcgacgaggcgtgca

SEQ ID NO: 60939 - DNA, 25 bp, Rattus norvegicus
aatgaattctgactcacttcctaga

SEQ ID NO: 60940 - DNA, 25 bp, Rattus norvegicus
aatgaattctgagtcacttcctaga

SEQ ID NO: 60941 - DNA, 25 bp, Rattus norvegicus
aatgaattctgtcagtcacaccgcc

SEQ ID NO: 60942 - DNA, 25 bp, Rattus norvegicus
aatgaattctgtgagtcacaccgcc

SEQ ID NO: 60943 - DNA, 25 bp, Rattus norvegicus
aatgaattctttcagggctgcccag

SEQ ID NO: 60944 - DNA, 25 bp, Rattus norvegicus
aatgaattctttgagggctgcccag

SEQ ID NO: 60945 - DNA, 25 bp, Rattus norvegicus
aatgaattggctagtttagcgcccc

SEQ ID NO: 60946 - DNA, 25 bp, Rattus norvegicus
aatgaattggcttgtttagcgcccc

SEQ ID NO: 60947 - DNA, 25 bp, Rattus norvegicus
aatgaattggtcctggtggctcaca

SEQ ID NO: 60948 - DNA, 25 bp, Rattus norvegicus
aatgaattggtcgtggtggctcaca

SEQ ID NO: 60949 - DNA, 25 bp, Rattus norvegicus
aatgaatttacacttacactcacag

SEQ ID NO: 60950 - DNA, 25 bp, Rattus norvegicus
aatgaatttacagttacactcacag

SEQ ID NO: 60951 - DNA, 25 bp, Rattus norvegicus
aatgacaaagtcctgcctgataaga

SEQ ID NO: 60952 - DNA, 25 bp, Rattus norvegicus
aatgacaaagtcgtgcctgataaga

SEQ ID NO: 60953 - DNA, 25 bp, Rattus norvegicus
aatgacaaggaacacggcccagctg

SEQ ID NO: 60954 - DNA, 25 bp, Rattus norvegicus
aatgacaaggaagacggcccagctg

SEQ ID NO: 60955 - DNA, 25 bp, Rattus norvegicus
aatgacaagtacaaccatgaccagt

SEQ ID NO: 60956 - DNA, 25 bp, Rattus norvegicus
aatgacaagtactaccatgaccagt

SEQ ID NO: 60957 - DNA, 25 bp, Rattus norvegicus
aatgacaatctgctgtctgcctttc

SEQ ID NO: 60958 - DNA, 25 bp, Rattus norvegicus
aatgacaatctggtgtctgcctttc

SEQ ID NO: 60959 - DNA, 25 bp, Rattus norvegicus
aatgacaatgacactcctgtctcag

SEQ ID NO: 60960 - DNA, 25 bp, Rattus norvegicus
aatgacaatgactctcctgtctcag

SEQ ID NO: 60961 - DNA, 25 bp, Rattus norvegicus
aatgacaattgcaacaactgggagc

SEQ ID NO: 60962 - DNA, 25 bp, Rattus norvegicus
aatgacaattgctacaactgggagc

SEQ ID NO: 60963 - DNA, 25 bp, Rattus norvegicus
aatgacacagccagcaacacagttc

SEQ ID NO: 60964 - DNA, 25 bp, Rattus norvegicus
aatgacacagcctgcaacacagttc

SEQ ID NO: 60965 - DNA, 25 bp, Rattus norvegicus
aatgacacagctatgcagtttgcac

SEQ ID NO: 60966 - DNA, 25 bp, Rattus norvegicus
aatgacacagctttgcagtttgcac

SEQ ID NO: 60967 - DNA, 25 bp, Rattus norvegicus
aatgacaccactatcgttctgggaa

SEQ ID NO: 60968 - DNA, 25 bp, Rattus norvegicus
aatgacaccactttcgttctgggaa

SEQ ID NO: 60969 - DNA, 25 bp, Rattus norvegicus
aatgacaccttcaactcactgggtc

SEQ ID NO: 60970 - DNA, 25 bp, Rattus norvegicus
aatgacaccttctactcactgggtc

SEQ ID NO: 60971 - DNA, 25 bp, Rattus norvegicus
aatgacactatcaactccgagttta

SEQ ID NO: 60972 - DNA, 25 bp, Rattus norvegicus
aatgacactatctactccgagttta

SEQ ID NO: 60973 - DNA, 25 bp, Rattus norvegicus
aatgacactgccaaaggtggcctcc

SEQ ID NO: 60974 - DNA, 25 bp, Rattus norvegicus
aatgacactgcctaaggtggcctcc

SEQ ID NO: 60975 - DNA, 25 bp, Rattus norvegicus
aatgacacttcgcttcattggcccg

SEQ ID NO: 60976 - DNA, 25 bp, Rattus norvegicus
aatgacacttcggttcattggcccg

SEQ ID NO: 60977 - DNA, 25 bp, Rattus norvegicus
aatgacactttaacctgactctttc

SEQ ID NO: 60978 - DNA, 25 bp, Rattus norvegicus
aatgacactttatcctgactctttc

SEQ ID NO: 60979 - DNA, 25 bp, Rattus norvegicus
aatgacagatgtcacccaggaactc

SEQ ID NO: 60980 - DNA, 25 bp, Rattus norvegicus
aatgacagatgtcccttagctttcc

SEQ ID NO: 60981 - DNA, 25 bp, Rattus norvegicus
aatgacagatgtgacccaggaactc

SEQ ID NO: 60982 - DNA, 25 bp, Rattus norvegicus
aatgacagatgtgccttagctttcc

SEQ ID NO: 60983 - DNA, 25 bp, Rattus norvegicus
aatgacagcgagacccaaagccggg

SEQ ID NO: 60984 - DNA, 25 bp, Rattus norvegicus
aatgacagcgagtcccaaagccggg

SEQ ID NO: 60985 - DNA, 25 bp, Rattus norvegicus
aatgacagttcccttggccttgagc

SEQ ID NO: 60986 - DNA, 25 bp, Rattus norvegicus
aatgacagttccgttggccttgagc

SEQ ID NO: 60987 - DNA, 25 bp, Rattus norvegicus
aatgacagttctcacgcactctgga

SEQ ID NO: 60988 - DNA, 25 bp, Rattus norvegicus
aatgacagttctgacgcactctgga

SEQ ID NO: 60989 - DNA, 25 bp, Rattus norvegicus
aatgacatcatcaatctccttctct

SEQ ID NO: 60990 - DNA, 25 bp, Rattus norvegicus
aatgacatcatctatctccttctct

SEQ ID NO: 60991 - DNA, 25 bp, Rattus norvegicus
aatgacatcatgctcctgaagttgg

SEQ ID NO: 60992 - DNA, 25 bp, Rattus norvegicus
aatgacatcatggtcctgaagttgg

SEQ ID NO: 60993 - DNA, 25 bp, Rattus norvegicus
aatgacatctctccgtggttttact

SEQ ID NO: 60994 - DNA, 25 bp, Rattus norvegicus
aatgacatctctgcgtggttttact

SEQ ID NO: 60995 - DNA, 25 bp, Rattus norvegicus
aatgacatctgcctacacatttggc

SEQ ID NO: 60996 - DNA, 25 bp, Rattus norvegicus
aatgacatctgcgtacacatttggc

SEQ ID NO: 60997 - DNA, 25 bp, Rattus norvegicus
aatgacatgagcaacctgggtccat

SEQ ID NO: 60998 - DNA, 25 bp, Rattus norvegicus
aatgacatgagctacctgggtccat

SEQ ID NO: 60999 - DNA, 25 bp, Rattus norvegicus
aatgacatgcccatctacgaagctg

SEQ ID NO: 61000 - DNA, 25 bp, Rattus norvegicus
aatgacatgcccttctacgaagctg

SEQ ID NO: 61001 - DNA, 25 bp, Rattus norvegicus
aatgacatggcgctcctgaggacag

SEQ ID NO: 61002 - DNA, 25 bp, Rattus norvegicus
aatgacatggcggtcctgaggacag

SEQ ID NO: 61003 - DNA, 25 bp, Rattus norvegicus
aatgacatgtgtagtcccagttcct

SEQ ID NO: 61004 - DNA, 25 bp, Rattus norvegicus
aatgacatgtgttgtcccagttcct

SEQ ID NO: 61005 - DNA, 25 bp, Rattus norvegicus
aatgacattaccaccttctaccttg

SEQ ID NO: 61006 - DNA, 25 bp, Rattus norvegicus
aatgacattacctccttctaccttg

SEQ ID NO: 61007 - DNA, 25 bp, Rattus norvegicus
aatgacattcaaactgccagccagc

SEQ ID NO: 61008 - DNA, 25 bp, Rattus norvegicus
aatgacattcaatctgccagccagc

SEQ ID NO: 61009 - DNA, 25 bp, Rattus norvegicus
aatgacattcacattccagctattc

SEQ ID NO: 61010 - DNA, 25 bp, Rattus norvegicus
aatgacattcactttccagctattc

SEQ ID NO: 61011 - DNA, 25 bp, Rattus norvegicus
aatgacatttccaaggagcggcctc

SEQ ID NO: 61012 - DNA, 25 bp, Rattus norvegicus
aatgacatttcctaggagcggcctc

SEQ ID NO: 61013 - DNA, 25 bp, Rattus norvegicus
aatgacatttggaaattccttgaca

SEQ ID NO: 61014 - DNA, 25 bp, Rattus norvegicus
aatgacatttggtaattccttgaca

SEQ ID NO: 61015 - DNA, 25 bp, Rattus norvegicus
aatgacattttcctcctgatgcaca

SEQ ID NO: 61016 - DNA, 25 bp, Rattus norvegicus
aatgacattttcgtcctgatgcaca

SEQ ID NO: 61017 - DNA, 25 bp, Rattus norvegicus
aatgacattttgactcctgtggaca

SEQ ID NO: 61018 - DNA, 25 bp, Rattus norvegicus
aatgacattttgtctcctgtggaca

SEQ ID NO: 61019 - DNA, 25 bp, Rattus norvegicus
aatgaccaacatcaagggagactta

SEQ ID NO: 61020 - DNA, 25 bp, Rattus norvegicus
aatgaccaacatgaagggagactta

SEQ ID NO: 61021 - DNA, 25 bp, Rattus norvegicus
aatgaccaccgaaggatgctgtgcc

SEQ ID NO: 61022 - DNA, 25 bp, Rattus norvegicus
aatgaccaccgatggatgctgtgcc

SEQ ID NO: 61023 - DNA, 25 bp, Rattus norvegicus
aatgaccactacaggttccacaatc

SEQ ID NO: 61024 - DNA, 25 bp, Rattus norvegicus
aatgaccactactggttccacaatc

SEQ ID NO: 61025 - DNA, 25 bp, Rattus norvegicus
aatgaccagattctccttaatgccc

SEQ ID NO: 61026 - DNA, 25 bp, Rattus norvegicus
aatgaccagattgtccttaatgccc

SEQ ID NO: 61027 - DNA, 25 bp, Rattus norvegicus
aatgaccagcctattactgctttca

SEQ ID NO: 61028 - DNA, 25 bp, Rattus norvegicus
aatgaccagccttttactgctttca

SEQ ID NO: 61029 - DNA, 25 bp, Rattus norvegicus
aatgaccatggacttcccacacagt

SEQ ID NO: 61030 - DNA, 25 bp, Rattus norvegicus
aatgaccatggagttcccacacagt

SEQ ID NO: 61031 - DNA, 25 bp, Rattus norvegicus
aatgaccatggtacacttgaagttg

SEQ ID NO: 61032 - DNA, 25 bp, Rattus norvegicus
aatgaccatggttcacttgaagttg

SEQ ID NO: 61033 - DNA, 25 bp, Rattus norvegicus
aatgacccacatcccgttgagtaac

SEQ ID NO: 61034 - DNA, 25 bp, Rattus norvegicus
aatgacccacatgccgttgagtaac

SEQ ID NO: 61035 - DNA, 25 bp, Rattus norvegicus
aatgacccctacagggcactggaca

SEQ ID NO: 61036 - DNA, 25 bp, Rattus norvegicus
aatgacccctactgggcactggaca

SEQ ID NO: 61037 - DNA, 25 bp, Rattus norvegicus
aatgacccctttaagagttgccaga

SEQ ID NO: 61038 - DNA, 25 bp, Rattus norvegicus
aatgaccccttttagagttgccaga

SEQ ID NO: 61039 - DNA, 25 bp, Rattus norvegicus
aatgacccggaacctcggcaggagc

SEQ ID NO: 61040 - DNA, 25 bp, Rattus norvegicus
aatgacccggaagctcggcaggagc

SEQ ID NO: 61041 - DNA, 25 bp, Rattus norvegicus
aatgaccctcagcaacgtgtggata

SEQ ID NO: 61042 - DNA, 25 bp, Rattus norvegicus
aatgaccctcaggaacgtgtggata

SEQ ID NO: 61043 - DNA, 25 bp, Rattus norvegicus
aatgaccctggcaggctggcactgc

SEQ ID NO: 61044 - DNA, 25 bp, Rattus norvegicus
aatgaccctggctggctggcactgc

SEQ ID NO: 61045 - DNA, 25 bp, Rattus norvegicus
aatgaccgagaaccctttggcagga

SEQ ID NO: 61046 - DNA, 25 bp, Rattus norvegicus
aatgaccgagaagcctttggcagga

SEQ ID NO: 61047 - DNA, 25 bp, Rattus norvegicus
aatgaccgaggactccaggctgcag

SEQ ID NO: 61048 - DNA, 25 bp, Rattus norvegicus
aatgaccgaggagtccaggctgcag

SEQ ID NO: 61049 - DNA, 25 bp, Rattus norvegicus
aatgaccgaggtaccgatttctgct

SEQ ID NO: 61050 - DNA, 25 bp, Rattus norvegicus
aatgaccgaggttccgatttctgct

SEQ ID NO: 61051 - DNA, 25 bp, Rattus norvegicus
aatgaccggaataagacatctgagg

SEQ ID NO: 61052 - DNA, 25 bp, Rattus norvegicus
aatgaccggaattagacatctgagg

SEQ ID NO: 61053 - DNA, 25 bp, Rattus norvegicus
aatgaccgtggtccctggaatctgg

SEQ ID NO: 61054 - DNA, 25 bp, Rattus norvegicus
aatgaccgtggtgcctggaatctgg

SEQ ID NO: 61055 - DNA, 25 bp, Rattus norvegicus
aatgaccgtgtccatgctgttgagt

SEQ ID NO: 61056 - DNA, 25 bp, Rattus norvegicus
aatgaccgtgtcgatgctgttgagt

SEQ ID NO: 61057 - DNA, 25 bp, Rattus norvegicus
aatgaccgttgcaatcacgaaccac

SEQ ID NO: 61058 - DNA, 25 bp, Rattus norvegicus
aatgaccgttgctatcacgaaccac

SEQ ID NO: 61059 - DNA, 25 bp, Rattus norvegicus
aatgacctcagtctccagtgtgtct

SEQ ID NO: 61060 - DNA, 25 bp, Rattus norvegicus
aatgacctcagtgtccagtgtgtct

SEQ ID NO: 61061 - DNA, 25 bp, Rattus norvegicus
aatgacctcggtcggtaaggcagaa

SEQ ID NO: 61062 - DNA, 25 bp, Rattus norvegicus
aatgacctcggtgggtaaggcagaa

SEQ ID NO: 61063 - DNA, 25 bp, Rattus norvegicus
aatgacctgcccatggaattgtgct

SEQ ID NO: 61064 - DNA, 25 bp, Rattus norvegicus
aatgacctgcccttggaattgtgct

SEQ ID NO: 61065 - DNA, 25 bp, Rattus norvegicus
aatgacctggagcatgtcttctgga

SEQ ID NO: 61066 - DNA, 25 bp, Rattus norvegicus
aatgacctggaggatgtcttctgga

SEQ ID NO: 61067 - DNA, 25 bp, Rattus norvegicus
aatgacctgggtaaatgctcttaat

SEQ ID NO: 61068 - DNA, 25 bp, Rattus norvegicus
aatgacctgggttaatgctcttaat

SEQ ID NO: 61069 - DNA, 25 bp, Rattus norvegicus
aatgacctggttagttatgctgaaa

SEQ ID NO: 61070 - DNA, 25 bp, Rattus norvegicus
aatgacctggtttgttatgctgaaa

SEQ ID NO: 61071 - DNA, 25 bp, Rattus norvegicus
aatgacctgtctatctacaacatga

SEQ ID NO: 61072 - DNA, 25 bp, Rattus norvegicus
aatgacctgtctttctacaacatga

SEQ ID NO: 61073 - DNA, 25 bp, Rattus norvegicus
aatgaccttcagactgctgatccca

SEQ ID NO: 61074 - DNA, 25 bp, Rattus norvegicus
aatgaccttcagtctgctgatccca

SEQ ID NO: 61075 - DNA, 25 bp, Rattus norvegicus
aatgaccttgtcatctcagagactg

SEQ ID NO: 61076 - DNA, 25 bp, Rattus norvegicus
aatgaccttgtcttctcagagactg

SEQ ID NO: 61077 - DNA, 25 bp, Rattus norvegicus
aatgacctttgaacctgatccggct

SEQ ID NO: 61078 - DNA, 25 bp, Rattus norvegicus
aatgacctttgatcctgatccggct

SEQ ID NO: 61079 - DNA, 25 bp, Rattus norvegicus
aatgacctttggattctcttgccaa

SEQ ID NO: 61080 - DNA, 25 bp, Rattus norvegicus
aatgacctttggtttctcttgccaa

SEQ ID NO: 61081 - DNA, 25 bp, Rattus norvegicus
aatgacctttgtactgttgttataa

SEQ ID NO: 61082 - DNA, 25 bp, Rattus norvegicus
aatgacctttgttctgttgttataa

SEQ ID NO: 61083 - DNA, 25 bp, Rattus norvegicus
aatgaccttttcacagcttgaagct

SEQ ID NO: 61084 - DNA, 25 bp, Rattus norvegicus
aatgaccttttctcagcttgaagct

SEQ ID NO: 61085 - DNA, 25 bp, Rattus norvegicus
aatgacctttttctatttggcgtgg

SEQ ID NO: 61086 - DNA, 25 bp, Rattus norvegicus
aatgacctttttgtatttggcgtgg

SEQ ID NO: 61087 - DNA, 25 bp, Rattus norvegicus
aatgacgatggtctcttccgaatcc

SEQ ID NO: 61088 - DNA, 25 bp, Rattus norvegicus
aatgacgatggtgtcttccgaatcc

SEQ ID NO: 61089 - DNA, 25 bp, Rattus norvegicus
aatgacgccatacacaccaggagtg

SEQ ID NO: 61090 - DNA, 25 bp, Rattus norvegicus
aatgacgccatagacaccaggagtg

SEQ ID NO: 61091 - DNA, 25 bp, Rattus norvegicus
aatgacggcagactgttcaacttct

SEQ ID NO: 61092 - DNA, 25 bp, Rattus norvegicus
aatgacggcagagtgttcaacttct

SEQ ID NO: 61093 - DNA, 25 bp, Rattus norvegicus
aatgacggcatgatcagacaagcag

SEQ ID NO: 61094 - DNA, 25 bp, Rattus norvegicus
aatgacggcatgttcagacaagcag

SEQ ID NO: 61095 - DNA, 25 bp, Rattus norvegicus
aatgacggtgtcagtgagtatgttt

SEQ ID NO: 61096 - DNA, 25 bp, Rattus norvegicus
aatgacggtgtctgtgagtatgttt

SEQ ID NO: 61097 - DNA, 25 bp, Rattus norvegicus
aatgacggttcccaagagcggccat

SEQ ID NO: 61098 - DNA, 25 bp, Rattus norvegicus
aatgacggttccgaagagcggccat

SEQ ID NO: 61099 - DNA, 25 bp, Rattus norvegicus
aatgacgtagcacttggaacaaaac

SEQ ID NO: 61100 - DNA, 25 bp, Rattus norvegicus
aatgacgtagcagttggaacaaaac

SEQ ID NO: 61101 - DNA, 25 bp, Rattus norvegicus
aatgacgtcacacggacagccagaa

SEQ ID NO: 61102 - DNA, 25 bp, Rattus norvegicus
aatgacgtcacagggacagccagaa

SEQ ID NO: 61103 - DNA, 25 bp, Rattus norvegicus
aatgacgtcactaaccacagtttca

SEQ ID NO: 61104 - DNA, 25 bp, Rattus norvegicus
aatgacgtcacttaccacagtttca

SEQ ID NO: 61105 - DNA, 25 bp, Rattus norvegicus
aatgacgtcatgaggcttttgcagt

SEQ ID NO: 61106 - DNA, 25 bp, Rattus norvegicus
aatgacgtcatgtggcttttgcagt

SEQ ID NO: 61107 - DNA, 25 bp, Rattus norvegicus
aatgacgtctgaatgccatgggcca

SEQ ID NO: 61108 - DNA, 25 bp, Rattus norvegicus
aatgacgtctgattgccatgggcca

SEQ ID NO: 61109 - DNA, 25 bp, Rattus norvegicus
aatgacgtgcatatctttgaacagt

SEQ ID NO: 61110 - DNA, 25 bp, Rattus norvegicus
aatgacgtgcatttctttgaacagt

SEQ ID NO: 61111 - DNA, 25 bp, Rattus norvegicus
aatgacgtgtaccaacccgggcttg

SEQ ID NO: 61112 - DNA, 25 bp, Rattus norvegicus
aatgacgtgtacgaacccgggcttg

SEQ ID NO: 61113 - DNA, 25 bp, Rattus norvegicus
aatgacgttattcctacttcccaat

SEQ ID NO: 61114 - DNA, 25 bp, Rattus norvegicus
aatgacgttattgctacttcccaat

SEQ ID NO: 61115 - DNA, 25 bp, Rattus norvegicus
aatgacgttgctacagagtgcaggt

SEQ ID NO: 61116 - DNA, 25 bp, Rattus norvegicus
aatgacgttgcttcagagtgcaggt

SEQ ID NO: 61117 - DNA, 25 bp, Rattus norvegicus
aatgacgttgggatgcttcctgggc

SEQ ID NO: 61118 - DNA, 25 bp, Rattus norvegicus
aatgacgttgggttgcttcctgggc

SEQ ID NO: 61119 - DNA, 25 bp, Rattus norvegicus
aatgactaacggactgaagcccctc

SEQ ID NO: 61120 - DNA, 25 bp, Rattus norvegicus
aatgactaacggtctgaagcccctc

SEQ ID NO: 61121 - DNA, 25 bp, Rattus norvegicus
aatgactactatcggagtctgtatc

SEQ ID NO: 61122 - DNA, 25 bp, Rattus norvegicus
aatgactactatgggagtctgtatc

SEQ ID NO: 61123 - DNA, 25 bp, Rattus norvegicus
aatgactactgcatccagacagcct

SEQ ID NO: 61124 - DNA, 25 bp, Rattus norvegicus
aatgactactgcttccagacagcct

SEQ ID NO: 61125 - DNA, 25 bp, Rattus norvegicus
aatgactacttgcttttatccccag

SEQ ID NO: 61126 - DNA, 25 bp, Rattus norvegicus
aatgactacttggttttatccccag

SEQ ID NO: 61127 - DNA, 25 bp, Rattus norvegicus
aatgactagattcggttcaaaccca

SEQ ID NO: 61128 - DNA, 25 bp, Rattus norvegicus
aatgactagattgggttcaaaccca

SEQ ID NO: 61129 - DNA, 25 bp, Rattus norvegicus
aatgactaggctagcaggaattctg

SEQ ID NO: 61130 - DNA, 25 bp, Rattus norvegicus
aatgactaggcttgcaggaattctg

SEQ ID NO: 61131 - DNA, 25 bp, Rattus norvegicus
aatgactaggtcaccgaattattga

SEQ ID NO: 61132 - DNA, 25 bp, Rattus norvegicus
aatgactaggtctccgaattattga

SEQ ID NO: 61133 - DNA, 25 bp, Rattus norvegicus
aatgactatccaacaggttgtcttc

SEQ ID NO: 61134 - DNA, 25 bp, Rattus norvegicus
aatgactatccatcaggttgtcttc

SEQ ID NO: 61135 - DNA, 25 bp, Rattus norvegicus
aatgactatgtgagagttccctccc

SEQ ID NO: 61136 - DNA, 25 bp, Rattus norvegicus
aatgactatgtgtgagttccctccc

SEQ ID NO: 61137 - DNA, 25 bp, Rattus norvegicus
aatgactattgtctaactcccctct

SEQ ID NO: 61138 - DNA, 25 bp, Rattus norvegicus
aatgactattgtgtaactcccctct

SEQ ID NO: 61139 - DNA, 25 bp, Rattus norvegicus
aatgactcaacactgatccaggcgc

SEQ ID NO: 61140 - DNA, 25 bp, Rattus norvegicus
aatgactcaacagtgatccaggcgc

SEQ ID NO: 61141 - DNA, 25 bp, Rattus norvegicus
aatgactcagttaaccagggcttag

SEQ ID NO: 61142 - DNA, 25 bp, Rattus norvegicus
aatgactcagtttaccagggcttag

SEQ ID NO: 61143 - DNA, 25 bp, Rattus norvegicus
aatgactcattcattgctaatgctc

SEQ ID NO: 61144 - DNA, 25 bp, Rattus norvegicus
aatgactcattctttgctaatgctc

SEQ ID NO: 61145 - DNA, 25 bp, Rattus norvegicus
aatgactccagcctgtttgtctctg

SEQ ID NO: 61146 - DNA, 25 bp, Rattus norvegicus
aatgactccagcgtgtttgtctctg

SEQ ID NO: 61147 - DNA, 25 bp, Rattus norvegicus
aatgactccctacgcatgctttttt

SEQ ID NO: 61148 - DNA, 25 bp, Rattus norvegicus
aatgactccctaggcatgctttttt

SEQ ID NO: 61149 - DNA, 25 bp, Rattus norvegicus
aatgactccggtctgggtgtcccag

SEQ ID NO: 61150 - DNA, 25 bp, Rattus norvegicus
aatgactccggtgtgggtgtcccag

SEQ ID NO: 61151 - DNA, 25 bp, Rattus norvegicus
aatgactcctagatcgtgttttggg

SEQ ID NO: 61152 - DNA, 25 bp, Rattus norvegicus
aatgactcctagttcgtgttttggg

SEQ ID NO: 61153 - DNA, 25 bp, Rattus norvegicus
aatgactcctgaaggttgacccctg

SEQ ID NO: 61154 - DNA, 25 bp, Rattus norvegicus
aatgactcctgatggttgacccctg

SEQ ID NO: 61155 - DNA, 25 bp, Rattus norvegicus
aatgactcgggtaaaactccaggat

SEQ ID NO: 61156 - DNA, 25 bp, Rattus norvegicus
aatgactcgggttaaactccaggat

SEQ ID NO: 61157 - DNA, 25 bp, Rattus norvegicus
aatgactctagtaattcctgcctga

SEQ ID NO: 61158 - DNA, 25 bp, Rattus norvegicus
aatgactctagttattcctgcctga

SEQ ID NO: 61159 - DNA, 25 bp, Rattus norvegicus
aatgactctgagctagctgccactg

SEQ ID NO: 61160 - DNA, 25 bp, Rattus norvegicus
aatgactctgaggtagctgccactg

SEQ ID NO: 61161 - DNA, 25 bp, Rattus norvegicus
aatgactgaactacacacttaaggt

SEQ ID NO: 61162 - DNA, 25 bp, Rattus norvegicus
aatgactgaacttcacacttaaggt

SEQ ID NO: 61163 - DNA, 25 bp, Rattus norvegicus
aatgactgagctctccttggcaggc

SEQ ID NO: 61164 - DNA, 25 bp, Rattus norvegicus
aatgactgagctgtccttggcaggc

SEQ ID NO: 61165 - DNA, 25 bp, Rattus norvegicus
aatgactgaggcatatgactgggaa

SEQ ID NO: 61166 - DNA, 25 bp, Rattus norvegicus
aatgactgaggcttatgactgggaa

SEQ ID NO: 61167 - DNA, 25 bp, Rattus norvegicus
aatgactgattgaccctcccgggta

SEQ ID NO: 61168 - DNA, 25 bp, Rattus norvegicus
aatgactgattgtccctcccgggta

SEQ ID NO: 61169 - DNA, 25 bp, Rattus norvegicus
aatgactgcatcagctacaagcctg

SEQ ID NO: 61170 - DNA, 25 bp, Rattus norvegicus
aatgactgcatctgctacaagcctg

SEQ ID NO: 61171 - DNA, 25 bp, Rattus norvegicus
aatgactgccagctgcttggagaga

SEQ ID NO: 61172 - DNA, 25 bp, Rattus norvegicus
aatgactgccaggtgcttggagaga

SEQ ID NO: 61173 - DNA, 25 bp, Rattus norvegicus
aatgactgccatctgactttatttc

SEQ ID NO: 61174 - DNA, 25 bp, Rattus norvegicus
aatgactgccatgtgactttatttc

SEQ ID NO: 61175 - DNA, 25 bp, Rattus norvegicus
aatgactgccccatcattcgggtct

SEQ ID NO: 61176 - DNA, 25 bp, Rattus norvegicus
aatgactgccccttcattcgggtct

SEQ ID NO: 61177 - DNA, 25 bp, Rattus norvegicus
aatgactgcctgctgacttgtgact

SEQ ID NO: 61178 - DNA, 25 bp, Rattus norvegicus
aatgactgcctggtgacttgtgact

SEQ ID NO: 61179 - DNA, 25 bp, Rattus norvegicus
aatgactgcgggagtgaccacattt

SEQ ID NO: 61180 - DNA, 25 bp, Rattus norvegicus
aatgactgcgggtgtgaccacattt

SEQ ID NO: 61181 - DNA, 25 bp, Rattus norvegicus
aatgactgcgtgagctgggctggga

SEQ ID NO: 61182 - DNA, 25 bp, Rattus norvegicus
aatgactgcgtgtgctgggctggga

SEQ ID NO: 61183 - DNA, 25 bp, Rattus norvegicus
aatgactgctagcacatccatctac

SEQ ID NO: 61184 - DNA, 25 bp, Rattus norvegicus
aatgactgctaggacatccatctac

SEQ ID NO: 61185 - DNA, 25 bp, Rattus norvegicus
aatgactgctgcattgctgggttgc

SEQ ID NO: 61186 - DNA, 25 bp, Rattus norvegicus
aatgactgctgctttgctgggttgc

SEQ ID NO: 61187 - DNA, 25 bp, Rattus norvegicus
aatgactgtcatagtgtccctgcct

SEQ ID NO: 61188 - DNA, 25 bp, Rattus norvegicus
aatgactgtcattgtgtccctgcct

SEQ ID NO: 61189 - DNA, 25 bp, Rattus norvegicus
aatgactgtgcgcttcctacgggag

SEQ ID NO: 61190 - DNA, 25 bp, Rattus norvegicus
aatgactgtgcggttcctacgggag

SEQ ID NO: 61191 - DNA, 25 bp, Rattus norvegicus
aatgactgtgtcctgtcacggtctc

SEQ ID NO: 61192 - DNA, 25 bp, Rattus norvegicus
aatgactgtgtcgtgtcacggtctc

SEQ ID NO: 61193 - DNA, 25 bp, Rattus norvegicus
aatgactgttacacatctcttccct

SEQ ID NO: 61194 - DNA, 25 bp, Rattus norvegicus
aatgactgttactcatctcttccct

SEQ ID NO: 61195 - DNA, 25 bp, Rattus norvegicus
aatgactgttgcctttctatattgg

SEQ ID NO: 61196 - DNA, 25 bp, Rattus norvegicus
aatgactgttgcgtttctatattgg

SEQ ID NO: 61197 - DNA, 25 bp, Rattus norvegicus
aatgactgtttgatggcctccctgc

SEQ ID NO: 61198 - DNA, 25 bp, Rattus norvegicus
aatgactgtttgctcatctatgaca

SEQ ID NO: 61199 - DNA, 25 bp, Rattus norvegicus
aatgactgtttggtcatctatgaca

SEQ ID NO: 61200 - DNA, 25 bp, Rattus norvegicus
aatgactgtttgttggcctccctgc

SEQ ID NO: 61201 - DNA, 25 bp, Rattus norvegicus
aatgacttaagtcccttcctgacac

SEQ ID NO: 61202 - DNA, 25 bp, Rattus norvegicus
aatgacttaagtgccttcctgacac

SEQ ID NO: 61203 - DNA, 25 bp, Rattus norvegicus
aatgacttcaccacacagcgagcca

SEQ ID NO: 61204 - DNA, 25 bp, Rattus norvegicus
aatgacttcacctcacagcgagcca

SEQ ID NO: 61205 - DNA, 25 bp, Rattus norvegicus
aatgacttcactaactttttagatg

SEQ ID NO: 61206 - DNA, 25 bp, Rattus norvegicus
aatgacttcacttactttttagatg

SEQ ID NO: 61207 - DNA, 25 bp, Rattus norvegicus
aatgacttcataactgtccctacag

SEQ ID NO: 61208 - DNA, 25 bp, Rattus norvegicus
aatgacttcatatctgtccctacag

SEQ ID NO: 61209 - DNA, 25 bp, Rattus norvegicus
aatgacttctttcctgatgggctga

SEQ ID NO: 61210 - DNA, 25 bp, Rattus norvegicus
aatgacttctttgctgatgggctga

SEQ ID NO: 61211 - DNA, 25 bp, Rattus norvegicus
aatgacttgcagagccttaggctca

SEQ ID NO: 61212 - DNA, 25 bp, Rattus norvegicus
aatgacttgcagtgccttaggctca

SEQ ID NO: 61213 - DNA, 25 bp, Rattus norvegicus
aatgactttaacaatctgaacaacg

SEQ ID NO: 61214 - DNA, 25 bp, Rattus norvegicus
aatgactttaactatctgaacaacg

SEQ ID NO: 61215 - DNA, 25 bp, Rattus norvegicus
aatgactttgctcgcaggcagcgaa

SEQ ID NO: 61216 - DNA, 25 bp, Rattus norvegicus
aatgactttgctggcaggcagcgaa

SEQ ID NO: 61217 - DNA, 25 bp, Rattus norvegicus
aatgactttggcacacaggcccata

SEQ ID NO: 61218 - DNA, 25 bp, Rattus norvegicus
aatgactttggctcacaggcccata

SEQ ID NO: 61219 - DNA, 25 bp, Rattus norvegicus
aatgactttgtcaccctcaaacgtg

SEQ ID NO: 61220 - DNA, 25 bp, Rattus norvegicus
aatgactttgtctccctcaaacgtg

SEQ ID NO: 61221 - DNA, 25 bp, Rattus norvegicus
aatgacttttatcatcacctgcctg

SEQ ID NO: 61222 - DNA, 25 bp, Rattus norvegicus
aatgacttttatgatcacctgcctg

SEQ ID NO: 61223 - DNA, 25 bp, Rattus norvegicus
aatgagaaacaaatgcggcagcttt

SEQ ID NO: 61224 - DNA, 25 bp, Rattus norvegicus
aatgagaaacaattgcggcagcttt

SEQ ID NO: 61225 - DNA, 25 bp, Rattus norvegicus
aatgagaaacagaacccaggcttat

SEQ ID NO: 61226 - DNA, 25 bp, Rattus norvegicus
aatgagaaacagtacccaggcttat

SEQ ID NO: 61227 - DNA, 25 bp, Rattus norvegicus
aatgagaaagtgaacggactccaag

SEQ ID NO: 61228 - DNA, 25 bp, Rattus norvegicus
aatgagaaagtgtacggactccaag

SEQ ID NO: 61229 - DNA, 25 bp, Rattus norvegicus
aatgagaacctcctagcctgggtga

SEQ ID NO: 61230 - DNA, 25 bp, Rattus norvegicus
aatgagaacctcgtagcctgggtga

SEQ ID NO: 61231 - DNA, 25 bp, Rattus norvegicus
aatgagaactcacctacaattttag

SEQ ID NO: 61232 - DNA, 25 bp, Rattus norvegicus
aatgagaactcagctacaattttag

SEQ ID NO: 61233 - DNA, 25 bp, Rattus norvegicus
aatgagaagaccactagctcctttc

SEQ ID NO: 61234 - DNA, 25 bp, Rattus norvegicus
aatgagaagacctctagctcctttc

SEQ ID NO: 61235 - DNA, 25 bp, Rattus norvegicus
aatgagaagcttatgtgactgatgt

SEQ ID NO: 61236 - DNA, 25 bp, Rattus norvegicus
aatgagaagcttttgtgactgatgt

SEQ ID NO: 61237 - DNA, 25 bp, Rattus norvegicus
aatgagaaggcacctgttcacgaca

SEQ ID NO: 61238 - DNA, 25 bp, Rattus norvegicus
aatgagaaggcagctgttcacgaca

SEQ ID NO: 61239 - DNA, 25 bp, Rattus norvegicus
aatgagaattaaattcaggagcccc

SEQ ID NO: 61240 - DNA, 25 bp, Rattus norvegicus
aatgagaattaatttcaggagcccc

SEQ ID NO: 61241 - DNA, 25 bp, Rattus norvegicus
aatgagacagacaatcccagcactc

SEQ ID NO: 61242 - DNA, 25 bp, Rattus norvegicus
aatgagacagactatcccagcactc

SEQ ID NO: 61243 - DNA, 25 bp, Rattus norvegicus
aatgagacaggacatcaggccatgg

SEQ ID NO: 61244 - DNA, 25 bp, Rattus norvegicus
aatgagacaggagatcaggccatgg

SEQ ID NO: 61245 - DNA, 25 bp, Rattus norvegicus
aatgagacatctacattccttccca

SEQ ID NO: 61246 - DNA, 25 bp, Rattus norvegicus
aatgagacatcttcattccttccca

SEQ ID NO: 61247 - DNA, 25 bp, Rattus norvegicus
aatgagacccagagcagtgtcctcc

SEQ ID NO: 61248 - DNA, 25 bp, Rattus norvegicus
aatgagacccagtgcagtgtcctcc

SEQ ID NO: 61249 - DNA, 25 bp, Rattus norvegicus
aatgagactcttcacgaacggccag

SEQ ID NO: 61250 - DNA, 25 bp, Rattus norvegicus
aatgagactcttgacgaacggccag

SEQ ID NO: 61251 - DNA, 25 bp, Rattus norvegicus
aatgagactgggagatctggaccga

SEQ ID NO: 61252 - DNA, 25 bp, Rattus norvegicus
aatgagactgggtgatctggaccga

SEQ ID NO: 61253 - DNA, 25 bp, Rattus norvegicus
aatgagagactcaattgcctcgtga

SEQ ID NO: 61254 - DNA, 25 bp, Rattus norvegicus
aatgagagactctattgcctcgtga

SEQ ID NO: 61255 - DNA, 25 bp, Rattus norvegicus
aatgagagcaaaccgcgcgtgcgtt

SEQ ID NO: 61256 - DNA, 25 bp, Rattus norvegicus
aatgagagcaaagcgcgcgtgcgtt

SEQ ID NO: 61257 - DNA, 25 bp, Rattus norvegicus
aatgagatcctgaacgttcgcacca

SEQ ID NO: 61258 - DNA, 25 bp, Rattus norvegicus
aatgagatcctgtacgttcgcacca

SEQ ID NO: 61259 - DNA, 25 bp, Rattus norvegicus
aatgagatcgagacacgccacaaag

SEQ ID NO: 61260 - DNA, 25 bp, Rattus norvegicus
aatgagatcgagtcacgccacaaag

SEQ ID NO: 61261 - DNA, 25 bp, Rattus norvegicus
aatgagatgcagcttctctccaagg

SEQ ID NO: 61262 - DNA, 25 bp, Rattus norvegicus
aatgagatgcaggttctctccaagg

SEQ ID NO: 61263 - DNA, 25 bp, Rattus norvegicus
aatgagatgtccaccatgggtctcc

SEQ ID NO: 61264 - DNA, 25 bp, Rattus norvegicus
aatgagatgtcctccatgggtctcc

SEQ ID NO: 61265 - DNA, 25 bp, Rattus norvegicus
aatgagatgtgacccagccaagccc

SEQ ID NO: 61266 - DNA, 25 bp, Rattus norvegicus
aatgagatgtgagccagccaagccc

SEQ ID NO: 61267 - DNA, 25 bp, Rattus norvegicus
aatgagattgtgaacctgagggcca

SEQ ID NO: 61268 - DNA, 25 bp, Rattus norvegicus
aatgagattgtgtacctgagggcca

SEQ ID NO: 61269 - DNA, 25 bp, Rattus norvegicus
aatgagcaaactcgcctttgggtgc

SEQ ID NO: 61270 - DNA, 25 bp, Rattus norvegicus
aatgagcaaactggcctttgggtgc

SEQ ID NO: 61271 - DNA, 25 bp, Rattus norvegicus
aatgagcaagaactccctggaggag

SEQ ID NO: 61272 - DNA, 25 bp, Rattus norvegicus
aatgagcaagaagtccctggaggag

SEQ ID NO: 61273 - DNA, 25 bp, Rattus norvegicus
aatgagcaagttatatttccacaaa

SEQ ID NO: 61274 - DNA, 25 bp, Rattus norvegicus
aatgagcaagttttatttccacaaa

SEQ ID NO: 61275 - DNA, 25 bp, Rattus norvegicus
aatgagcacatactatgcactggaa

SEQ ID NO: 61276 - DNA, 25 bp, Rattus norvegicus
aatgagcacatagtatgcactggaa

SEQ ID NO: 61277 - DNA, 25 bp, Rattus norvegicus
aatgagcaccgaaagaacccgtatc

SEQ ID NO: 61278 - DNA, 25 bp, Rattus norvegicus
aatgagcaccgatagaacccgtatc

SEQ ID NO: 61279 - DNA, 25 bp, Rattus norvegicus
aatgagcaggctcggacccactgga

SEQ ID NO: 61280 - DNA, 25 bp, Rattus norvegicus
aatgagcaggctgggacccactgga

SEQ ID NO: 61281 - DNA, 25 bp, Rattus norvegicus
aatgagcatcctacttggtgggtga

SEQ ID NO: 61282 - DNA, 25 bp, Rattus norvegicus
aatgagcatccttcttggtgggtga

SEQ ID NO: 61283 - DNA, 25 bp, Rattus norvegicus
aatgagcatcgtcctgctgaagcaa

SEQ ID NO: 61284 - DNA, 25 bp, Rattus norvegicus
aatgagcatcgtgctgctgaagcaa

SEQ ID NO: 61285 - DNA, 25 bp, Rattus norvegicus
aatgagcattgtaccatccccttgg

SEQ ID NO: 61286 - DNA, 25 bp, Rattus norvegicus
aatgagcattgttccatccccttgg

SEQ ID NO: 61287 - DNA, 25 bp, Rattus norvegicus
aatgagccaggcctacaggtaattg

SEQ ID NO: 61288 - DNA, 25 bp, Rattus norvegicus
aatgagccaggcgtacaggtaattg

SEQ ID NO: 61289 - DNA, 25 bp, Rattus norvegicus
aatgagccatggatgcagtcctgga

SEQ ID NO: 61290 - DNA, 25 bp, Rattus norvegicus
aatgagccatggttgcagtcctgga

SEQ ID NO: 61291 - DNA, 25 bp, Rattus norvegicus
aatgagccattaccctttgtaaaga

SEQ ID NO: 61292 - DNA, 25 bp, Rattus norvegicus
aatgagccattagcctttgtaaaga

SEQ ID NO: 61293 - DNA, 25 bp, Rattus norvegicus
aatgagccctttcttcttatgttgg

SEQ ID NO: 61294 - DNA, 25 bp, Rattus norvegicus
aatgagccctttgttcttatgttgg

SEQ ID NO: 61295 - DNA, 25 bp, Rattus norvegicus
aatgagcctattactttctaaaaag

SEQ ID NO: 61296 - DNA, 25 bp, Rattus norvegicus
aatgagcctatttctttctaaaaag

SEQ ID NO: 61297 - DNA, 25 bp, Rattus norvegicus
aatgagcctcgtcatctgtgattac

SEQ ID NO: 61298 - DNA, 25 bp, Rattus norvegicus
aatgagcctcgtgatctgtgattac

SEQ ID NO: 61299 - DNA, 25 bp, Rattus norvegicus
aatgagcctgcacagtacttgtcta

SEQ ID NO: 61300 - DNA, 25 bp, Rattus norvegicus
aatgagcctgcagagtacttgtcta

SEQ ID NO: 61301 - DNA, 25 bp, Rattus norvegicus
aatgagcgcaggactccccagagga

SEQ ID NO: 61302 - DNA, 25 bp, Rattus norvegicus
aatgagcgcaggtctccccagagga

SEQ ID NO: 61303 - DNA, 25 bp, Rattus norvegicus
aatgagctacacagccagtccttgt

SEQ ID NO: 61304 - DNA, 25 bp, Rattus norvegicus
aatgagctacactgccagtccttgt

SEQ ID NO: 61305 - DNA, 25 bp, Rattus norvegicus
aatgagctacttagtggcctaggaa

SEQ ID NO: 61306 - DNA, 25 bp, Rattus norvegicus
aatgagctactttgtggcctaggaa

SEQ ID NO: 61307 - DNA, 25 bp, Rattus norvegicus
aatgagctcaagcactcagcgggct

SEQ ID NO: 61308 - DNA, 25 bp, Rattus norvegicus
aatgagctcaaggactcagcgggct

SEQ ID NO: 61309 - DNA, 25 bp, Rattus norvegicus
aatgagctcaggcacagagctagca

SEQ ID NO: 61310 - DNA, 25 bp, Rattus norvegicus
aatgagctcagggacagagctagca

SEQ ID NO: 61311 - DNA, 25 bp, Rattus norvegicus
aatgagctcctgaggcagcagatcg

SEQ ID NO: 61312 - DNA, 25 bp, Rattus norvegicus
aatgagctcctgtggcagcagatcg

SEQ ID NO: 61313 - DNA, 25 bp, Rattus norvegicus
aatgagctccttacttaacttctga

SEQ ID NO: 61314 - DNA, 25 bp, Rattus norvegicus
aatgagctcctttcttaacttctga

SEQ ID NO: 61315 - DNA, 25 bp, Rattus norvegicus
aatgagctcgaaaatccggagcaaa

SEQ ID NO: 61316 - DNA, 25 bp, Rattus norvegicus
aatgagctcgaatatccggagcaaa

SEQ ID NO: 61317 - DNA, 25 bp, Rattus norvegicus
aatgagctcgcgcatgtgatttttt

SEQ ID NO: 61318 - DNA, 25 bp, Rattus norvegicus
aatgagctcgcggatgtgatttttt

SEQ ID NO: 61319 - DNA, 25 bp, Rattus norvegicus
aatgagctcgtgcagtaggtgctat

SEQ ID NO: 61320 - DNA, 25 bp, Rattus norvegicus
aatgagctcgtggagtaggtgctat

SEQ ID NO: 61321 - DNA, 25 bp, Rattus norvegicus
aatgagctgataactgtccgtaggt

SEQ ID NO: 61322 - DNA, 25 bp, Rattus norvegicus
aatgagctgatatctgtccgtaggt

SEQ ID NO: 61323 - DNA, 25 bp, Rattus norvegicus
aatgagctgatcaccctggagctga

SEQ ID NO: 61324 - DNA, 25 bp, Rattus norvegicus
aatgagctgatctccctggagctga

SEQ ID NO: 61325 - DNA, 25 bp, Rattus norvegicus
aatgagctgcctatatgcctgtggg

SEQ ID NO: 61326 - DNA, 25 bp, Rattus norvegicus
aatgagctgcctttatgcctgtggg

SEQ ID NO: 61327 - DNA, 25 bp, Rattus norvegicus
aatgagctgcgtcttctgtcgagac

SEQ ID NO: 61328 - DNA, 25 bp, Rattus norvegicus
aatgagctgcgtgttctgtcgagac

SEQ ID NO: 61329 - DNA, 25 bp, Rattus norvegicus
aatgagctgctgaccaaataccagt

SEQ ID NO: 61330 - DNA, 25 bp, Rattus norvegicus
aatgagctgctgctttcattggcca

SEQ ID NO: 61331 - DNA, 25 bp, Rattus norvegicus
aatgagctgctggtttcattggcca

SEQ ID NO: 61332 - DNA, 25 bp, Rattus norvegicus
aatgagctgctgtccaaataccagt

SEQ ID NO: 61333 - DNA, 25 bp, Rattus norvegicus
aatgagctggatcgcattcctctga

SEQ ID NO: 61334 - DNA, 25 bp, Rattus norvegicus
aatgagctggatggcattcctctga

SEQ ID NO: 61335 - DNA, 25 bp, Rattus norvegicus
aatgagcttattcgtcacgggagac

SEQ ID NO: 61336 - DNA, 25 bp, Rattus norvegicus
aatgagcttattggtcacgggagac

SEQ ID NO: 61337 - DNA, 25 bp, Rattus norvegicus
aatgagctttacagtttggttggat

SEQ ID NO: 61338 - DNA, 25 bp, Rattus norvegicus
aatgagctttactgtttggttggat

SEQ ID NO: 61339 - DNA, 25 bp, Rattus norvegicus
aatgagctttttactggcacgacaa

SEQ ID NO: 61340 - DNA, 25 bp, Rattus norvegicus
aatgagcttttttctggcacgacaa

SEQ ID NO: 61341 - DNA, 25 bp, Rattus norvegicus
aatgaggaaatccatctcccctgca

SEQ ID NO: 61342 - DNA, 25 bp, Rattus norvegicus
aatgaggaaatcgatctcccctgca

SEQ ID NO: 61343 - DNA, 25 bp, Rattus norvegicus
aatgaggacgcaaccgtggcacaca

SEQ ID NO: 61344 - DNA, 25 bp, Rattus norvegicus
aatgaggacgcatccgtggcacaca

SEQ ID NO: 61345 - DNA, 25 bp, Rattus norvegicus
aatgaggacgtgaccatcttctgcc

SEQ ID NO: 61346 - DNA, 25 bp, Rattus norvegicus
aatgaggacgtgtccatcttctgcc

SEQ ID NO: 61347 - DNA, 25 bp, Rattus norvegicus
aatgaggactggaccctgtggaccg

SEQ ID NO: 61348 - DNA, 25 bp, Rattus norvegicus
aatgaggactggtccctgtggaccg

SEQ ID NO: 61349 - DNA, 25 bp, Rattus norvegicus
aatgaggagagtccttcttcgcccc

SEQ ID NO: 61350 - DNA, 25 bp, Rattus norvegicus
aatgaggagagtgcttcttcgcccc

SEQ ID NO: 61351 - DNA, 25 bp, Rattus norvegicus
aatgaggaggaaccctctccctctc

SEQ ID NO: 61352 - DNA, 25 bp, Rattus norvegicus
aatgaggaggaagcctctccctctc

SEQ ID NO: 61353 - DNA, 25 bp, Rattus norvegicus
aatgaggaggacctctgcccaatct

SEQ ID NO: 61354 - DNA, 25 bp, Rattus norvegicus
aatgaggaggacgtctgcccaatct

SEQ ID NO: 61355 - DNA, 25 bp, Rattus norvegicus
aatgaggatccacgtctgtctaccc

SEQ ID NO: 61356 - DNA, 25 bp, Rattus norvegicus
aatgaggatccaggtctgtctaccc

SEQ ID NO: 61357 - DNA, 25 bp, Rattus norvegicus
aatgaggatggtaccattcctgcca

SEQ ID NO: 61358 - DNA, 25 bp, Rattus norvegicus
aatgaggatggttccattcctgcca

SEQ ID NO: 61359 - DNA, 25 bp, Rattus norvegicus
aatgaggatttactccacgtgctca

SEQ ID NO: 61360 - DNA, 25 bp, Rattus norvegicus
aatgaggatttagtccacgtgctca

SEQ ID NO: 61361 - DNA, 25 bp, Rattus norvegicus
aatgaggcaagtactcttccctgct

SEQ ID NO: 61362 - DNA, 25 bp, Rattus norvegicus
aatgaggcaagttctcttccctgct

SEQ ID NO: 61363 - DNA, 25 bp, Rattus norvegicus
aatgaggcactgctgttaacactta

SEQ ID NO: 61364 - DNA, 25 bp, Rattus norvegicus
aatgaggcactggtgttaacactta

SEQ ID NO: 61365 - DNA, 25 bp, Rattus norvegicus
aatgaggccttactgctgtagtgta

SEQ ID NO: 61366 - DNA, 25 bp, Rattus norvegicus
aatgaggccttagtgctgtagtgta

SEQ ID NO: 61367 - DNA, 25 bp, Rattus norvegicus
aatgaggctcctcgattgtctatcc

SEQ ID NO: 61368 - DNA, 25 bp, Rattus norvegicus
aatgaggctcctggattgtctatcc

SEQ ID NO: 61369 - DNA, 25 bp, Rattus norvegicus
aatgaggctgaccttgagctcgtga

SEQ ID NO: 61370 - DNA, 25 bp, Rattus norvegicus
aatgaggctgacgttgagctcgtga

SEQ ID NO: 61371 - DNA, 25 bp, Rattus norvegicus
aatgaggctggcctgaccttcacat

SEQ ID NO: 61372 - DNA, 25 bp, Rattus norvegicus
aatgaggctggcgtgaccttcacat

SEQ ID NO: 61373 - DNA, 25 bp, Rattus norvegicus
aatgaggctttaagttggcccctcc

SEQ ID NO: 61374 - DNA, 25 bp, Rattus norvegicus
aatgaggctttatgttggcccctcc

SEQ ID NO: 61375 - DNA, 25 bp, Rattus norvegicus
aatgagggacacacacgggacacgc

SEQ ID NO: 61376 - DNA, 25 bp, Rattus norvegicus
aatgagggacactcacgggacacgc

SEQ ID NO: 61377 - DNA, 25 bp, Rattus norvegicus
aatgagggagcgcatctctccaggc

SEQ ID NO: 61378 - DNA, 25 bp, Rattus norvegicus
aatgagggagcggatctctccaggc

SEQ ID NO: 61379 - DNA, 25 bp, Rattus norvegicus
aatgagggagtcagggcaccaccat

SEQ ID NO: 61380 - DNA, 25 bp, Rattus norvegicus
aatgagggagtctgggcaccaccat

SEQ ID NO: 61381 - DNA, 25 bp, Rattus norvegicus
aatgagggatgtagtctttgccaaa

SEQ ID NO: 61382 - DNA, 25 bp, Rattus norvegicus
aatgagggatgttgtctttgccaaa

SEQ ID NO: 61383 - DNA, 25 bp, Rattus norvegicus
aatgagggccttacgggtctcccag

SEQ ID NO: 61384 - DNA, 25 bp, Rattus norvegicus
aatgagggcctttcgggtctcccag

SEQ ID NO: 61385 - DNA, 25 bp, Rattus norvegicus
aatgagggcgggaacctctttgaat

SEQ ID NO: 61386 - DNA, 25 bp, Rattus norvegicus
aatgagggcgggtacctctttgaat

SEQ ID NO: 61387 - DNA, 25 bp, Rattus norvegicus
aatgaggtcattcctactgtcttcc

SEQ ID NO: 61388 - DNA, 25 bp, Rattus norvegicus
aatgaggtcattgctactgtcttcc

SEQ ID NO: 61389 - DNA, 25 bp, Rattus norvegicus
aatgaggtcctaagacccagtctgt

SEQ ID NO: 61390 - DNA, 25 bp, Rattus norvegicus
aatgaggtcctatgacccagtctgt

SEQ ID NO: 61391 - DNA, 25 bp, Rattus norvegicus
aatgaggtccttagttttttatatg

SEQ ID NO: 61392 - DNA, 25 bp, Rattus norvegicus
aatgaggtcctttgttttttatatg

SEQ ID NO: 61393 - DNA, 25 bp, Rattus norvegicus
aatgaggtcgagactgctcctctgg

SEQ ID NO: 61394 - DNA, 25 bp, Rattus norvegicus
aatgaggtcgagtctgctcctctgg

SEQ ID NO: 61395 - DNA, 25 bp, Rattus norvegicus
aatgaggtcgatactgggattcagt

SEQ ID NO: 61396 - DNA, 25 bp, Rattus norvegicus
aatgaggtcgattctgggattcagt

SEQ ID NO: 61397 - DNA, 25 bp, Rattus norvegicus
aatgaggtggatcatcgccaaggaa

SEQ ID NO: 61398 - DNA, 25 bp, Rattus norvegicus
aatgaggtggatgatcgccaaggaa

SEQ ID NO: 61399 - DNA, 25 bp, Rattus norvegicus
aatgaggtttgcagcatcttctgag

SEQ ID NO: 61400 - DNA, 25 bp, Rattus norvegicus
aatgaggtttgctgcatcttctgag

SEQ ID NO: 61401 - DNA, 25 bp, Rattus norvegicus
aatgagtaaggcacgtcgggctgaa

SEQ ID NO: 61402 - DNA, 25 bp, Rattus norvegicus
aatgagtaaggctcgtcgggctgaa

SEQ ID NO: 61403 - DNA, 25 bp, Rattus norvegicus
aatgagtacactcgtcatcgtcctg

SEQ ID NO: 61404 - DNA, 25 bp, Rattus norvegicus
aatgagtacactggtcatcgtcctg

SEQ ID NO: 61405 - DNA, 25 bp, Rattus norvegicus
aatgagtatataacccttttgcaga

SEQ ID NO: 61406 - DNA, 25 bp, Rattus norvegicus
aatgagtatatatcccttttgcaga

SEQ ID NO: 61407 - DNA, 25 bp, Rattus norvegicus
aatgagtccgacagttccctgtaat

SEQ ID NO: 61408 - DNA, 25 bp, Rattus norvegicus
aatgagtccgactgttccctgtaat

SEQ ID NO: 61409 - DNA, 25 bp, Rattus norvegicus
aatgagtcctcaccagcctgggaag

SEQ ID NO: 61410 - DNA, 25 bp, Rattus norvegicus
aatgagtcctcagcagcctgggaag

SEQ ID NO: 61411 - DNA, 25 bp, Rattus norvegicus
aatgagtcgactctgagtgtctccc

SEQ ID NO: 61412 - DNA, 25 bp, Rattus norvegicus
aatgagtcgactgtgagtgtctccc

SEQ ID NO: 61413 - DNA, 25 bp, Rattus norvegicus
aatgagtctcatctactgttcctca

SEQ ID NO: 61414 - DNA, 25 bp, Rattus norvegicus
aatgagtctcatgtactgttcctca

SEQ ID NO: 61415 - DNA, 25 bp, Rattus norvegicus
aatgagtctcccatcaagtcttttg

SEQ ID NO: 61416 - DNA, 25 bp, Rattus norvegicus
aatgagtctcccttcaagtcttttg

SEQ ID NO: 61417 - DNA, 25 bp, Rattus norvegicus
aatgagtctctcaggtgactgggaa

SEQ ID NO: 61418 - DNA, 25 bp, Rattus norvegicus
aatgagtctctctggtgactgggaa

SEQ ID NO: 61419 - DNA, 25 bp, Rattus norvegicus
aatgagtgaactctgctcttcggtg

SEQ ID NO: 61420 - DNA, 25 bp, Rattus norvegicus
aatgagtgaactgtgctcttcggtg

SEQ ID NO: 61421 - DNA, 25 bp, Rattus norvegicus
aatgagtgacttaccttctgtttgt

SEQ ID NO: 61422 - DNA, 25 bp, Rattus norvegicus
aatgagtgactttccttctgtttgt

SEQ ID NO: 61423 - DNA, 25 bp, Rattus norvegicus
aatgagtgatcacgcaattcggtca

SEQ ID NO: 61424 - DNA, 25 bp, Rattus norvegicus
aatgagtgatcaggcaattcggtca

SEQ ID NO: 61425 - DNA, 25 bp, Rattus norvegicus
aatgagtgatttctttgccctactg

SEQ ID NO: 61426 - DNA, 25 bp, Rattus norvegicus
aatgagtgatttgtttgccctactg

SEQ ID NO: 61427 - DNA, 25 bp, Rattus norvegicus
aatgagtgcagtccgcatgtgcttc

SEQ ID NO: 61428 - DNA, 25 bp, Rattus norvegicus
aatgagtgcagtgcgcatgtgcttc

SEQ ID NO: 61429 - DNA, 25 bp, Rattus norvegicus
aatgagtgcatgctcttcctcagga

SEQ ID NO: 61430 - DNA, 25 bp, Rattus norvegicus
aatgagtgcatggtcttcctcagga

SEQ ID NO: 61431 - DNA, 25 bp, Rattus norvegicus
aatgagtgccatagggagtctccct

SEQ ID NO: 61432 - DNA, 25 bp, Rattus norvegicus
aatgagtgccattgggagtctccct

SEQ ID NO: 61433 - DNA, 25 bp, Rattus norvegicus
aatgagtgccctcagtgagctgact

SEQ ID NO: 61434 - DNA, 25 bp, Rattus norvegicus
aatgagtgccctgagtgagctgact

SEQ ID NO: 61435 - DNA, 25 bp, Rattus norvegicus
aatgagtgccttcataatgtcctga

SEQ ID NO: 61436 - DNA, 25 bp, Rattus norvegicus
aatgagtgccttgataatgtcctga

SEQ ID NO: 61437 - DNA, 25 bp, Rattus norvegicus
aatgagtggcagagacaccgtctcc

SEQ ID NO: 61438 - DNA, 25 bp, Rattus norvegicus
aatgagtggcagtgacaccgtctcc

SEQ ID NO: 61439 - DNA, 25 bp, Rattus norvegicus
aatgagtggcttcggcccaacaagt

SEQ ID NO: 61440 - DNA, 25 bp, Rattus norvegicus
aatgagtggcttgggcccaacaagt

SEQ ID NO: 61441 - DNA, 25 bp, Rattus norvegicus
aatgagtgggcacctccatgttcgc

SEQ ID NO: 61442 - DNA, 25 bp, Rattus norvegicus
aatgagtgggcagctccatgttcgc

SEQ ID NO: 61443 - DNA, 25 bp, Rattus norvegicus
aatgagtgggttaccacacctgtgg

SEQ ID NO: 61444 - DNA, 25 bp, Rattus norvegicus
aatgagtgggtttccacacctgtgg

SEQ ID NO: 61445 - DNA, 25 bp, Rattus norvegicus
aatgagttagaacagccgagcaaac

SEQ ID NO: 61446 - DNA, 25 bp, Rattus norvegicus
aatgagttagaagagccgagcaaac

SEQ ID NO: 61447 - DNA, 25 bp, Rattus norvegicus
aatgagttccagagtccaggtgatt

SEQ ID NO: 61448 - DNA, 25 bp, Rattus norvegicus
aatgagttccagtgtccaggtgatt

SEQ ID NO: 61449 - DNA, 25 bp, Rattus norvegicus
aatgagttcccgcttgtgctgaaaa

SEQ ID NO: 61450 - DNA, 25 bp, Rattus norvegicus
aatgagttcccggttgtgctgaaaa

SEQ ID NO: 61451 - DNA, 25 bp, Rattus norvegicus
aatgagttgtacacataccaatttg

SEQ ID NO: 61452 - DNA, 25 bp, Rattus norvegicus
aatgagttgtactcataccaatttg

SEQ ID NO: 61453 - DNA, 25 bp, Rattus norvegicus
aatgagtttactcgtgatcgttgcc

SEQ ID NO: 61454 - DNA, 25 bp, Rattus norvegicus
aatgagtttactggtgatcgttgcc

SEQ ID NO: 61455 - DNA, 25 bp, Rattus norvegicus
aatgagtttcttactcaggagttcc

SEQ ID NO: 61456 - DNA, 25 bp, Rattus norvegicus
aatgagtttctttctcaggagttcc

SEQ ID NO: 61457 - DNA, 25 bp, Rattus norvegicus
aatgagtttgctatcgtgcaataaa

SEQ ID NO: 61458 - DNA, 25 bp, Rattus norvegicus
aatgagtttgctatctctgccaatt

SEQ ID NO: 61459 - DNA, 25 bp, Rattus norvegicus
aatgagtttgctttcgtgcaataaa

SEQ ID NO: 61460 - DNA, 25 bp, Rattus norvegicus
aatgagtttgctttctctgccaatt

SEQ ID NO: 61461 - DNA, 25 bp, Rattus norvegicus
aatgataacctgataccctgcaaag

SEQ ID NO: 61462 - DNA, 25 bp, Rattus norvegicus
aatgataacctgttaccctgcaaag

SEQ ID NO: 61463 - DNA, 25 bp, Rattus norvegicus
aatgataactttcccaaaaggtcaa

SEQ ID NO: 61464 - DNA, 25 bp, Rattus norvegicus
aatgataactttgccaaaaggtcaa

SEQ ID NO: 61465 - DNA, 25 bp, Rattus norvegicus
aatgataatctcaacgggaccagca

SEQ ID NO: 61466 - DNA, 25 bp, Rattus norvegicus
aatgataatctctacgggaccagca

SEQ ID NO: 61467 - DNA, 25 bp, Rattus norvegicus
aatgatacacacacacccggaaaac

SEQ ID NO: 61468 - DNA, 25 bp, Rattus norvegicus
aatgatacacactcacccggaaaac

SEQ ID NO: 61469 - DNA, 25 bp, Rattus norvegicus
aatgataccatgaagtttgaatgat

SEQ ID NO: 61470 - DNA, 25 bp, Rattus norvegicus
aatgataccatgtagtttgaatgat

SEQ ID NO: 61471 - DNA, 25 bp, Rattus norvegicus
aatgataggcccatggtctgtgcat

SEQ ID NO: 61472 - DNA, 25 bp, Rattus norvegicus
aatgataggcccttggtctgtgcat

SEQ ID NO: 61473 - DNA, 25 bp, Rattus norvegicus
aatgatatatgtctaacagatcggg

SEQ ID NO: 61474 - DNA, 25 bp, Rattus norvegicus
aatgatatatgtgtaacagatcggg

SEQ ID NO: 61475 - DNA, 25 bp, Rattus norvegicus
aatgatatccaaaccgaccaacttc

SEQ ID NO: 61476 - DNA, 25 bp, Rattus norvegicus
aatgatatccaatccgaccaacttc

SEQ ID NO: 61477 - DNA, 25 bp, Rattus norvegicus
aatgatatcctcatagctctggacc

SEQ ID NO: 61478 - DNA, 25 bp, Rattus norvegicus
aatgatatcctcttagctctggacc

SEQ ID NO: 61479 - DNA, 25 bp, Rattus norvegicus
aatgatatctgacgatcccctgcta

SEQ ID NO: 61480 - DNA, 25 bp, Rattus norvegicus
aatgatatctgaggatcccctgcta

SEQ ID NO: 61481 - DNA, 25 bp, Rattus norvegicus
aatgatattttcactttgcctacgc

SEQ ID NO: 61482 - DNA, 25 bp, Rattus norvegicus
aatgatattttctctttgcctacgc

SEQ ID NO: 61483 - DNA, 25 bp, Rattus norvegicus
aatgatcaagatctcgcctggcggt

SEQ ID NO: 61484 - DNA, 25 bp, Rattus norvegicus
aatgatcaagatgtcgcctggcggt

SEQ ID NO: 61485 - DNA, 25 bp, Rattus norvegicus
aatgatcaatggcagtctgccccgg

SEQ ID NO: 61486 - DNA, 25 bp, Rattus norvegicus
aatgatcaatgggagtctgccccgg

SEQ ID NO: 61487 - DNA, 25 bp, Rattus norvegicus
aatgatcacctaattaccaccttct

SEQ ID NO: 61488 - DNA, 25 bp, Rattus norvegicus
aatgatcacctatttaccaccttct

SEQ ID NO: 61489 - DNA, 25 bp, Rattus norvegicus
aatgatcacgtcagtcatttcccga

SEQ ID NO: 61490 - DNA, 25 bp, Rattus norvegicus
aatgatcacgtctgtcatttcccga

SEQ ID NO: 61491 - DNA, 25 bp, Rattus norvegicus
aatgatcactaacacgctggactgt

SEQ ID NO: 61492 - DNA, 25 bp, Rattus norvegicus
aatgatcactaagacgctggactgt

SEQ ID NO: 61493 - DNA, 25 bp, Rattus norvegicus
aatgatcactctagacagtcacgtc

SEQ ID NO: 61494 - DNA, 25 bp, Rattus norvegicus
aatgatcactcttgacagtcacgtc

SEQ ID NO: 61495 - DNA, 25 bp, Rattus norvegicus
aatgatccatgtatcctaaagagac

SEQ ID NO: 61496 - DNA, 25 bp, Rattus norvegicus
aatgatccatgtttcctaaagagac

SEQ ID NO: 61497 - DNA, 25 bp, Rattus norvegicus
aatgatccattcacctgtagacagg

SEQ ID NO: 61498 - DNA, 25 bp, Rattus norvegicus
aatgatccattctcctgtagacagg

SEQ ID NO: 61499 - DNA, 25 bp, Rattus norvegicus
aatgatcccaagcttggcctcagca

SEQ ID NO: 61500 - DNA, 25 bp, Rattus norvegicus
aatgatcccaaggttggcctcagca

SEQ ID NO: 61501 - DNA, 25 bp, Rattus norvegicus
aatgatccctctcgtctttttctgg

SEQ ID NO: 61502 - DNA, 25 bp, Rattus norvegicus
aatgatccctctggtctttttctgg

SEQ ID NO: 61503 - DNA, 25 bp, Rattus norvegicus
aatgatcccttgagattgttttgta

SEQ ID NO: 61504 - DNA, 25 bp, Rattus norvegicus
aatgatcccttgtgattgttttgta

SEQ ID NO: 61505 - DNA, 25 bp, Rattus norvegicus
aatgatccgccacatagagtttatc

SEQ ID NO: 61506 - DNA, 25 bp, Rattus norvegicus
aatgatccgccagatagagtttatc

SEQ ID NO: 61507 - DNA, 25 bp, Rattus norvegicus
aatgatccggaaatgatggtgcaca

SEQ ID NO: 61508 - DNA, 25 bp, Rattus norvegicus
aatgatccggaattgatggtgcaca

SEQ ID NO: 61509 - DNA, 25 bp, Rattus norvegicus
aatgatcctctgctggcctctgttt

SEQ ID NO: 61510 - DNA, 25 bp, Rattus norvegicus
aatgatcctctggtggcctctgttt

SEQ ID NO: 61511 - DNA, 25 bp, Rattus norvegicus
aatgatcctgtactctcccactagt

SEQ ID NO: 61512 - DNA, 25 bp, Rattus norvegicus
aatgatcctgtagtctcccactagt

SEQ ID NO: 61513 - DNA, 25 bp, Rattus norvegicus
aatgatccttgtacaatgcatgtct

SEQ ID NO: 61514 - DNA, 25 bp, Rattus norvegicus
aatgatccttgttcaatgcatgtct

SEQ ID NO: 61515 - DNA, 25 bp, Rattus norvegicus
aatgatcgcagacacatccagcggt

SEQ ID NO: 61516 - DNA, 25 bp, Rattus norvegicus
aatgatcgcagagacatccagcggt

SEQ ID NO: 61517 - DNA, 25 bp, Rattus norvegicus
aatgatcgtcaaagagtcactcagc

SEQ ID NO: 61518 - DNA, 25 bp, Rattus norvegicus
aatgatcgtcaatgagtcactcagc

SEQ ID NO: 61519 - DNA, 25 bp, Rattus norvegicus
aatgatctactacctgttgcttatg

SEQ ID NO: 61520 - DNA, 25 bp, Rattus norvegicus
aatgatctactagctgttgcttatg

SEQ ID NO: 61521 - DNA, 25 bp, Rattus norvegicus
aatgatctcaataccttttggtggc

SEQ ID NO: 61522 - DNA, 25 bp, Rattus norvegicus
aatgatctcaattccttttggtggc

SEQ ID NO: 61523 - DNA, 25 bp, Rattus norvegicus
aatgatctcccacagcattgtggac

SEQ ID NO: 61524 - DNA, 25 bp, Rattus norvegicus
aatgatctcccagagcattgtggac

SEQ ID NO: 61525 - DNA, 25 bp, Rattus norvegicus
aatgatctccctaaattacaccctg

SEQ ID NO: 61526 - DNA, 25 bp, Rattus norvegicus
aatgatctcccttaattacaccctg

SEQ ID NO: 61527 - DNA, 25 bp, Rattus norvegicus
aatgatctctggaggccataaccct

SEQ ID NO: 61528 - DNA, 25 bp, Rattus norvegicus
aatgatctctggtggccataaccct

SEQ ID NO: 61529 - DNA, 25 bp, Rattus norvegicus
aatgatctgcatctactaggactca

SEQ ID NO: 61530 - DNA, 25 bp, Rattus norvegicus
aatgatctgcatgtactaggactca

SEQ ID NO: 61531 - DNA, 25 bp, Rattus norvegicus
aatgatctggaaacgcactgagaga

SEQ ID NO: 61532 - DNA, 25 bp, Rattus norvegicus
aatgatctggaatcgcactgagaga

SEQ ID NO: 61533 - DNA, 25 bp, Rattus norvegicus
aatgatctgtctaggcatgcttcta

SEQ ID NO: 61534 - DNA, 25 bp, Rattus norvegicus
aatgatctgtcttggcatgcttcta

SEQ ID NO: 61535 - DNA, 25 bp, Rattus norvegicus
aatgatcttactcaattcaacagga

SEQ ID NO: 61536 - DNA, 25 bp, Rattus norvegicus
aatgatcttactgaattcaacagga

SEQ ID NO: 61537 - DNA, 25 bp, Rattus norvegicus
aatgatcttcgccttttttgttagc

SEQ ID NO: 61538 - DNA, 25 bp, Rattus norvegicus
aatgatcttcgcgttttttgttagc

SEQ ID NO: 61539 - DNA, 25 bp, Rattus norvegicus
aatgatctttctcttgggtgttcaa

SEQ ID NO: 61540 - DNA, 25 bp, Rattus norvegicus
aatgatctttctgttgggtgttcaa

SEQ ID NO: 61541 - DNA, 25 bp, Rattus norvegicus
aatgatctttgtaccttacttgccc

SEQ ID NO: 61542 - DNA, 25 bp, Rattus norvegicus
aatgatctttgttccttacttgccc

SEQ ID NO: 61543 - DNA, 25 bp, Rattus norvegicus
aatgatgaaaacacagaactctgaa

SEQ ID NO: 61544 - DNA, 25 bp, Rattus norvegicus
aatgatgaaaactcagaactctgaa

SEQ ID NO: 61545 - DNA, 25 bp, Rattus norvegicus
aatgatgaaggcctttgggcagcta

SEQ ID NO: 61546 - DNA, 25 bp, Rattus norvegicus
aatgatgaaggcgtttgggcagcta

SEQ ID NO: 61547 - DNA, 25 bp, Rattus norvegicus
aatgatgaataactagccagaatga

SEQ ID NO: 61548 - DNA, 25 bp, Rattus norvegicus
aatgatgaataagtagccagaatga

SEQ ID NO: 61549 - DNA, 25 bp, Rattus norvegicus
aatgatgacaccacgaagacctttg

SEQ ID NO: 61550 - DNA, 25 bp, Rattus norvegicus
aatgatgacacctcgaagacctttg

SEQ ID NO: 61551 - DNA, 25 bp, Rattus norvegicus
aatgatgacccgaacttccaggatt

SEQ ID NO: 61552 - DNA, 25 bp, Rattus norvegicus
aatgatgacccgtacttccaggatt

SEQ ID NO: 61553 - DNA, 25 bp, Rattus norvegicus
aatgatgacgttagccagaggccct

SEQ ID NO: 61554 - DNA, 25 bp, Rattus norvegicus
aatgatgacgtttgccagaggccct

SEQ ID NO: 61555 - DNA, 25 bp, Rattus norvegicus
aatgatgactgcagagatctcacct

SEQ ID NO: 61556 - DNA, 25 bp, Rattus norvegicus
aatgatgactgctgagatctcacct

SEQ ID NO: 61557 - DNA, 25 bp, Rattus norvegicus
aatgatgagaagatccccatgcagt

SEQ ID NO: 61558 - DNA, 25 bp, Rattus norvegicus
aatgatgagaagttccccatgcagt

SEQ ID NO: 61559 - DNA, 25 bp, Rattus norvegicus
aatgatgaggttcgttatccccgct

SEQ ID NO: 61560 - DNA, 25 bp, Rattus norvegicus
aatgatgaggttggttatccccgct

SEQ ID NO: 61561 - DNA, 25 bp, Rattus norvegicus
aatgatgcagagacctccccggcag

SEQ ID NO: 61562 - DNA, 25 bp, Rattus norvegicus
aatgatgcagagtcctccccggcag

SEQ ID NO: 61563 - DNA, 25 bp, Rattus norvegicus
aatgatgcagctccagagcactgat

SEQ ID NO: 61564 - DNA, 25 bp, Rattus norvegicus
aatgatgcagctgcagagcactgat

SEQ ID NO: 61565 - DNA, 25 bp, Rattus norvegicus
aatgatgcaggcatccatctcaaca

SEQ ID NO: 61566 - DNA, 25 bp, Rattus norvegicus
aatgatgcaggcttccatctcaaca

SEQ ID NO: 61567 - DNA, 25 bp, Rattus norvegicus
aatgatgccaagctttgcctgtgac

SEQ ID NO: 61568 - DNA, 25 bp, Rattus norvegicus
aatgatgccaaggtttgcctgtgac

SEQ ID NO: 61569 - DNA, 25 bp, Rattus norvegicus
aatgatgccctacagcactgcaaaa

SEQ ID NO: 61570 - DNA, 25 bp, Rattus norvegicus
aatgatgccctagagcactgcaaaa

SEQ ID NO: 61571 - DNA, 25 bp, Rattus norvegicus
aatgatgcctccaccatggagtcat

SEQ ID NO: 61572 - DNA, 25 bp, Rattus norvegicus
aatgatgcctcctccatggagtcat

SEQ ID NO: 61573 - DNA, 25 bp, Rattus norvegicus
aatgatgcgctgaagcctgtcacac

SEQ ID NO: 61574 - DNA, 25 bp, Rattus norvegicus
aatgatgcgctgtagcctgtcacac

SEQ ID NO: 61575 - DNA, 25 bp, Rattus norvegicus
aatgatgcggctccaggcctactgt

SEQ ID NO: 61576 - DNA, 25 bp, Rattus norvegicus
aatgatgcggctgcaggcctactgt

SEQ ID NO: 61577 - DNA, 25 bp, Rattus norvegicus
aatgatgctccaacttctctgtcac

SEQ ID NO: 61578 - DNA, 25 bp, Rattus norvegicus
aatgatgctccatcttctctgtcac

SEQ ID NO: 61579 - DNA, 25 bp, Rattus norvegicus
aatgatgctggtcccattgtgctga

SEQ ID NO: 61580 - DNA, 25 bp, Rattus norvegicus
aatgatgctggtgccattgtgctga

SEQ ID NO: 61581 - DNA, 25 bp, Rattus norvegicus
aatgatgctttcactgtccaagtga

SEQ ID NO: 61582 - DNA, 25 bp, Rattus norvegicus
aatgatgctttctctgtccaagtga

SEQ ID NO: 61583 - DNA, 25 bp, Rattus norvegicus
aatgatggaagaactgcacagcctg

SEQ ID NO: 61584 - DNA, 25 bp, Rattus norvegicus
aatgatggaagatctgcacagcctg

SEQ ID NO: 61585 - DNA, 25 bp, Rattus norvegicus
aatgatggaattccttggcccacag

SEQ ID NO: 61586 - DNA, 25 bp, Rattus norvegicus
aatgatggaattgcttggcccacag

SEQ ID NO: 61587 - DNA, 25 bp, Rattus norvegicus
aatgatggacgtcccgtcagtgtcc

SEQ ID NO: 61588 - DNA, 25 bp, Rattus norvegicus
aatgatggacgtgccgtcagtgtcc

SEQ ID NO: 61589 - DNA, 25 bp, Rattus norvegicus
aatgatggagccctgtaccacaaca

SEQ ID NO: 61590 - DNA, 25 bp, Rattus norvegicus
aatgatggagccgtgtaccacaaca

SEQ ID NO: 61591 - DNA, 25 bp, Rattus norvegicus
aatgatggcctcatgatttggtggt

SEQ ID NO: 61592 - DNA, 25 bp, Rattus norvegicus
aatgatggcctcttgatttggtggt

SEQ ID NO: 61593 - DNA, 25 bp, Rattus norvegicus
aatgatggccttcgattgtctgacc

SEQ ID NO: 61594 - DNA, 25 bp, Rattus norvegicus
aatgatggccttggattgtctgacc

SEQ ID NO: 61595 - DNA, 25 bp, Rattus norvegicus
aatgatgggctcctcctaatgagaa

SEQ ID NO: 61596 - DNA, 25 bp, Rattus norvegicus
aatgatgggctcgtcctaatgagaa

SEQ ID NO: 61597 - DNA, 25 bp, Rattus norvegicus
aatgatggttcaactccacgggcat

SEQ ID NO: 61598 - DNA, 25 bp, Rattus norvegicus
aatgatggttcatctccacgggcat

SEQ ID NO: 61599 - DNA, 25 bp, Rattus norvegicus
aatgatgtaaaacctccagccctgg

SEQ ID NO: 61600 - DNA, 25 bp, Rattus norvegicus
aatgatgtaaaagctccagccctgg

SEQ ID NO: 61601 - DNA, 25 bp, Rattus norvegicus
aatgatgtattgagctgtggaagta

SEQ ID NO: 61602 - DNA, 25 bp, Rattus norvegicus
aatgatgtattgtgctgtggaagta

SEQ ID NO: 61603 - DNA, 25 bp, Rattus norvegicus
aatgatgtcattaggccagcaacaa

SEQ ID NO: 61604 - DNA, 25 bp, Rattus norvegicus
aatgatgtcatttggccagcaacaa

SEQ ID NO: 61605 - DNA, 25 bp, Rattus norvegicus
aatgatgtccaaatctacttccggg

SEQ ID NO: 61606 - DNA, 25 bp, Rattus norvegicus
aatgatgtccaattctacttccggg

SEQ ID NO: 61607 - DNA, 25 bp, Rattus norvegicus
aatgatgtcctcagtgctgctatgc

SEQ ID NO: 61608 - DNA, 25 bp, Rattus norvegicus
aatgatgtcctctgtgctgctatgc

SEQ ID NO: 61609 - DNA, 25 bp, Rattus norvegicus
aatgatgtctgcagctttcccaatg

SEQ ID NO: 61610 - DNA, 25 bp, Rattus norvegicus
aatgatgtctgctgctttcccaatg

SEQ ID NO: 61611 - DNA, 25 bp, Rattus norvegicus
aatgatgtctgtcttttctctttcc

SEQ ID NO: 61612 - DNA, 25 bp, Rattus norvegicus
aatgatgtctgtgttttctctttcc

SEQ ID NO: 61613 - DNA, 25 bp, Rattus norvegicus
aatgatgtctttacaattgactttt

SEQ ID NO: 61614 - DNA, 25 bp, Rattus norvegicus
aatgatgtctttacttgtcttcctt

SEQ ID NO: 61615 - DNA, 25 bp, Rattus norvegicus
aatgatgtcttttcaattgactttt

SEQ ID NO: 61616 - DNA, 25 bp, Rattus norvegicus
aatgatgtcttttcttgtcttcctt

SEQ ID NO: 61617 - DNA, 25 bp, Rattus norvegicus
aatgatgtgactatgggattcttcg

SEQ ID NO: 61618 - DNA, 25 bp, Rattus norvegicus
aatgatgtgactttgggattcttcg

SEQ ID NO: 61619 - DNA, 25 bp, Rattus norvegicus
aatgatgtgaggcagtctacagcag

SEQ ID NO: 61620 - DNA, 25 bp, Rattus norvegicus
aatgatgtgagggagtctacagcag

SEQ ID NO: 61621 - DNA, 25 bp, Rattus norvegicus
aatgatgtgcttagggttgcctcgc

SEQ ID NO: 61622 - DNA, 25 bp, Rattus norvegicus
aatgatgtgctttgggttgcctcgc

SEQ ID NO: 61623 - DNA, 25 bp, Rattus norvegicus
aatgatgtgtccatctcttgatcca

SEQ ID NO: 61624 - DNA, 25 bp, Rattus norvegicus
aatgatgtgtccttctcttgatcca

SEQ ID NO: 61625 - DNA, 25 bp, Rattus norvegicus
aatgatgtgtctagctgtgctggtc

SEQ ID NO: 61626 - DNA, 25 bp, Rattus norvegicus
aatgatgtgtcttgctgtgctggtc

SEQ ID NO: 61627 - DNA, 25 bp, Rattus norvegicus
aatgatgttcgacctatccgtagca

SEQ ID NO: 61628 - DNA, 25 bp, Rattus norvegicus
aatgatgttcgagctatccgtagca

SEQ ID NO: 61629 - DNA, 25 bp, Rattus norvegicus
aatgatgttcttcgtgtttttctat

SEQ ID NO: 61630 - DNA, 25 bp, Rattus norvegicus
aatgatgttcttggtgtttttctat

SEQ ID NO: 61631 - DNA, 25 bp, Rattus norvegicus
aatgatgtttaccagtctttcccac

SEQ ID NO: 61632 - DNA, 25 bp, Rattus norvegicus
aatgatgtttacgagtctttcccac

SEQ ID NO: 61633 - DNA, 25 bp, Rattus norvegicus
aatgatgtttctaaatgctggttac

SEQ ID NO: 61634 - DNA, 25 bp, Rattus norvegicus
aatgatgtttcttaatgctggttac

SEQ ID NO: 61635 - DNA, 25 bp, Rattus norvegicus
aatgatgtttgtcctgttctccctt

SEQ ID NO: 61636 - DNA, 25 bp, Rattus norvegicus
aatgatgtttgtgctgttctccctt

SEQ ID NO: 61637 - DNA, 25 bp, Rattus norvegicus
aatgattaccagagactcggatgac

SEQ ID NO: 61638 - DNA, 25 bp, Rattus norvegicus
aatgattaccagtgactcggatgac

SEQ ID NO: 61639 - DNA, 25 bp, Rattus norvegicus
aatgattactctcccgaagctagcg

SEQ ID NO: 61640 - DNA, 25 bp, Rattus norvegicus
aatgattactctgccgaagctagcg

SEQ ID NO: 61641 - DNA, 25 bp, Rattus norvegicus
aatgattagcagcatgtcttccact

SEQ ID NO: 61642 - DNA, 25 bp, Rattus norvegicus
aatgattagcaggatgtcttccact

SEQ ID NO: 61643 - DNA, 25 bp, Rattus norvegicus
aatgattattttcgccccatcgcag

SEQ ID NO: 61644 - DNA, 25 bp, Rattus norvegicus
aatgattattttggccccatcgcag

SEQ ID NO: 61645 - DNA, 25 bp, Rattus norvegicus
aatgattcaaaaagccactggcctg

SEQ ID NO: 61646 - DNA, 25 bp, Rattus norvegicus
aatgattcaaaactgcttggcttct

SEQ ID NO: 61647 - DNA, 25 bp, Rattus norvegicus
aatgattcaaaagtgcttggcttct

SEQ ID NO: 61648 - DNA, 25 bp, Rattus norvegicus
aatgattcaaaatgccactggcctg

SEQ ID NO: 61649 - DNA, 25 bp, Rattus norvegicus
aatgattcacatcctctcaagttag

SEQ ID NO: 61650 - DNA, 25 bp, Rattus norvegicus
aatgattcacatgctctcaagttag

SEQ ID NO: 61651 - DNA, 25 bp, Rattus norvegicus
aatgattcaccacgcactggcatga

SEQ ID NO: 61652 - DNA, 25 bp, Rattus norvegicus
aatgattcaccaggcactggcatga

SEQ ID NO: 61653 - DNA, 25 bp, Rattus norvegicus
aatgattcagataccacgtggcttt

SEQ ID NO: 61654 - DNA, 25 bp, Rattus norvegicus
aatgattcagattccacgtggcttt

SEQ ID NO: 61655 - DNA, 25 bp, Rattus norvegicus
aatgattcaggaacagaagggctcc

SEQ ID NO: 61656 - DNA, 25 bp, Rattus norvegicus
aatgattcaggatcagaagggctcc

SEQ ID NO: 61657 - DNA, 25 bp, Rattus norvegicus
aatgattccttccatctttgtatga

SEQ ID NO: 61658 - DNA, 25 bp, Rattus norvegicus
aatgattccttcgatctttgtatga

SEQ ID NO: 61659 - DNA, 25 bp, Rattus norvegicus
aatgattccttgatatctggacaga

SEQ ID NO: 61660 - DNA, 25 bp, Rattus norvegicus
aatgattccttgttatctggacaga

SEQ ID NO: 61661 - DNA, 25 bp, Rattus norvegicus
aatgattctccacggcagtatagcc

SEQ ID NO: 61662 - DNA, 25 bp, Rattus norvegicus
aatgattctccagggcagtatagcc

SEQ ID NO: 61663 - DNA, 25 bp, Rattus norvegicus
aatgattctgagcacttggtcccag

SEQ ID NO: 61664 - DNA, 25 bp, Rattus norvegicus
aatgattctgaggacttggtcccag

SEQ ID NO: 61665 - DNA, 25 bp, Rattus norvegicus
aatgattcttttctgttgtccctaa

SEQ ID NO: 61666 - DNA, 25 bp, Rattus norvegicus
aatgattcttttgtgttgtccctaa

SEQ ID NO: 61667 - DNA, 25 bp, Rattus norvegicus
aatgattggctactagctcgctctc

SEQ ID NO: 61668 - DNA, 25 bp, Rattus norvegicus
aatgattggctagtagctcgctctc

SEQ ID NO: 61669 - DNA, 25 bp, Rattus norvegicus
aatgattggcttactagcttcccag

SEQ ID NO: 61670 - DNA, 25 bp, Rattus norvegicus
aatgattggctttctagcttcccag

SEQ ID NO: 61671 - DNA, 25 bp, Rattus norvegicus
aatgattggtgtcctttctgtggcc

SEQ ID NO: 61672 - DNA, 25 bp, Rattus norvegicus
aatgattggtgtgctttctgtggcc

SEQ ID NO: 61673 - DNA, 25 bp, Rattus norvegicus
aatgattggttgcttgctgttcccg

SEQ ID NO: 61674 - DNA, 25 bp, Rattus norvegicus
aatgattggttggttgctgttcccg

SEQ ID NO: 61675 - DNA, 25 bp, Rattus norvegicus
aatgattgttccctctgccaggaaa

SEQ ID NO: 61676 - DNA, 25 bp, Rattus norvegicus
aatgattgttccgtctgccaggaaa

SEQ ID NO: 61677 - DNA, 25 bp, Rattus norvegicus
aatgatttatcaaccagatacctgg

SEQ ID NO: 61678 - DNA, 25 bp, Rattus norvegicus
aatgatttatcatccagatacctgg

SEQ ID NO: 61679 - DNA, 25 bp, Rattus norvegicus
aatgatttcagtaagtccacctgta

SEQ ID NO: 61680 - DNA, 25 bp, Rattus norvegicus
aatgatttcagttagtccacctgta

SEQ ID NO: 61681 - DNA, 25 bp, Rattus norvegicus
aatgatttctctactaagagttgcc

SEQ ID NO: 61682 - DNA, 25 bp, Rattus norvegicus
aatgatttctcttctaagagttgcc

SEQ ID NO: 61683 - DNA, 25 bp, Rattus norvegicus
aatgatttgcatcaagcccttaggc

SEQ ID NO: 61684 - DNA, 25 bp, Rattus norvegicus
aatgatttgcatgaagcccttaggc

SEQ ID NO: 61685 - DNA, 25 bp, Rattus norvegicus
aatgatttggacagagccttggctc

SEQ ID NO: 61686 - DNA, 25 bp, Rattus norvegicus
aatgatttggactgagccttggctc

SEQ ID NO: 61687 - DNA, 25 bp, Rattus norvegicus
aatgatttggcacttagcgcccact

SEQ ID NO: 61688 - DNA, 25 bp, Rattus norvegicus
aatgatttggcagttagcgcccact

SEQ ID NO: 61689 - DNA, 25 bp, Rattus norvegicus
aatgatttgtatccctggctctgct

SEQ ID NO: 61690 - DNA, 25 bp, Rattus norvegicus
aatgatttgtatgcctggctctgct

SEQ ID NO: 61691 - DNA, 25 bp, Rattus norvegicus
aatgattttccaacaactccctcgt

SEQ ID NO: 61692 - DNA, 25 bp, Rattus norvegicus
aatgattttccatcaactccctcgt

SEQ ID NO: 61693 - DNA, 25 bp, Rattus norvegicus
aatgatttttagcagtagacccata

SEQ ID NO: 61694 - DNA, 25 bp, Rattus norvegicus
aatgatttttaggagtagacccata

SEQ ID NO: 61695 - DNA, 25 bp, Rattus norvegicus
aatgatttttctccccaatggaagg

SEQ ID NO: 61696 - DNA, 25 bp, Rattus norvegicus
aatgatttttctgcccaatggaagg

SEQ ID NO: 61697 - DNA, 25 bp, Rattus norvegicus
aatgattttttgcttggctttcaag

SEQ ID NO: 61698 - DNA, 25 bp, Rattus norvegicus
aatgattttttggttggctttcaag

SEQ ID NO: 61699 - DNA, 25 bp, Rattus norvegicus
aatgcaaaaagcaccctatacctgc

SEQ ID NO: 61700 - DNA, 25 bp, Rattus norvegicus
aatgcaaaaagctccctatacctgc

SEQ ID NO: 61701 - DNA, 25 bp, Rattus norvegicus
aatgcaaaacctccagcttaatctg

SEQ ID NO: 61702 - DNA, 25 bp, Rattus norvegicus
aatgcaaaacctgcagcttaatctg

SEQ ID NO: 61703 - DNA, 25 bp, Rattus norvegicus
aatgcaaaaggtccatgcgctccga

SEQ ID NO: 61704 - DNA, 25 bp, Rattus norvegicus
aatgcaaaaggtgcatgcgctccga

SEQ ID NO: 61705 - DNA, 25 bp, Rattus norvegicus
aatgcaaacaatccaaatgcacctc

SEQ ID NO: 61706 - DNA, 25 bp, Rattus norvegicus
aatgcaaacaatgcaaatgcacctc

SEQ ID NO: 61707 - DNA, 25 bp, Rattus norvegicus
aatgcaaacgccacgtgactgacct

SEQ ID NO: 61708 - DNA, 25 bp, Rattus norvegicus
aatgcaaacgcctcgtgactgacct

SEQ ID NO: 61709 - DNA, 25 bp, Rattus norvegicus
aatgcaaactctacgattcactcct

SEQ ID NO: 61710 - DNA, 25 bp, Rattus norvegicus
aatgcaaactctatcgatgttggga

SEQ ID NO: 61711 - DNA, 25 bp, Rattus norvegicus
aatgcaaactcttcgattcactcct

SEQ ID NO: 61712 - DNA, 25 bp, Rattus norvegicus
aatgcaaactctttcgatgttggga

SEQ ID NO: 61713 - DNA, 25 bp, Rattus norvegicus
aatgcaaagactctggcaaattttt

SEQ ID NO: 61714 - DNA, 25 bp, Rattus norvegicus
aatgcaaagactgtggcaaattttt

SEQ ID NO: 61715 - DNA, 25 bp, Rattus norvegicus
aatgcaaagcccctgttttggactt

SEQ ID NO: 61716 - DNA, 25 bp, Rattus norvegicus
aatgcaaagcccgtgttttggactt

SEQ ID NO: 61717 - DNA, 25 bp, Rattus norvegicus
aatgcaaatattatcaccctcctgc

SEQ ID NO: 61718 - DNA, 25 bp, Rattus norvegicus
aatgcaaatattttcaccctcctgc

SEQ ID NO: 61719 - DNA, 25 bp, Rattus norvegicus
aatgcaaattacaacgctcacgcca

SEQ ID NO: 61720 - DNA, 25 bp, Rattus norvegicus
aatgcaaattactacgctcacgcca

SEQ ID NO: 61721 - DNA, 25 bp, Rattus norvegicus
aatgcaaattcaacgtcgggctctc

SEQ ID NO: 61722 - DNA, 25 bp, Rattus norvegicus
aatgcaaattcatcgtcgggctctc

SEQ ID NO: 61723 - DNA, 25 bp, Rattus norvegicus
aatgcaacactgctcttacggactc

SEQ ID NO: 61724 - DNA, 25 bp, Rattus norvegicus
aatgcaacactggtcttacggactc

SEQ ID NO: 61725 - DNA, 25 bp, Rattus norvegicus
aatgcaacatgtcagccgtgtgtgt

SEQ ID NO: 61726 - DNA, 25 bp, Rattus norvegicus
aatgcaacatgtgagccgtgtgtgt

SEQ ID NO: 61727 - DNA, 25 bp, Rattus norvegicus
aatgcaactccccatgaccttagat

SEQ ID NO: 61728 - DNA, 25 bp, Rattus norvegicus
aatgcaactcccgatgaccttagat

SEQ ID NO: 61729 - DNA, 25 bp, Rattus norvegicus
aatgcaactgagaggttcttccggg

SEQ ID NO: 61730 - DNA, 25 bp, Rattus norvegicus
aatgcaactgagtggttcttccggg

SEQ ID NO: 61731 - DNA, 25 bp, Rattus norvegicus
aatgcaactgtgacaatggctgggc

SEQ ID NO: 61732 - DNA, 25 bp, Rattus norvegicus
aatgcaactgtgtcaatggctgggc

SEQ ID NO: 61733 - DNA, 25 bp, Rattus norvegicus
aatgcaactgttaaaatgcttttaa

SEQ ID NO: 61734 - DNA, 25 bp, Rattus norvegicus
aatgcaactgtttaaatgcttttaa

SEQ ID NO: 61735 - DNA, 25 bp, Rattus norvegicus
aatgcaacttggagtcttgcgttag

SEQ ID NO: 61736 - DNA, 25 bp, Rattus norvegicus
aatgcaacttggtgtcttgcgttag

SEQ ID NO: 61737 - DNA, 25 bp, Rattus norvegicus
aatgcaagactaccgacttcgtgaa

SEQ ID NO: 61738 - DNA, 25 bp, Rattus norvegicus
aatgcaagactagcgacttcgtgaa

SEQ ID NO: 61739 - DNA, 25 bp, Rattus norvegicus
aatgcaagagcaaacccagttctct

SEQ ID NO: 61740 - DNA, 25 bp, Rattus norvegicus
aatgcaagagcatacccagttctct

SEQ ID NO: 61741 - DNA, 25 bp, Rattus norvegicus
aatgcaagcacaacagtttcctggg

SEQ ID NO: 61742 - DNA, 25 bp, Rattus norvegicus
aatgcaagcacatcagtttcctggg

SEQ ID NO: 61743 - DNA, 25 bp, Rattus norvegicus
aatgcaagcaccctgacctaggaag

SEQ ID NO: 61744 - DNA, 25 bp, Rattus norvegicus
aatgcaagcaccgtgacctaggaag

SEQ ID NO: 61745 - DNA, 25 bp, Rattus norvegicus
aatgcaagcagtaccaagaccagtg

SEQ ID NO: 61746 - DNA, 25 bp, Rattus norvegicus
aatgcaagcagttccaagaccagtg

SEQ ID NO: 61747 - DNA, 25 bp, Rattus norvegicus
aatgcaaggcaaccgtccagacagc

SEQ ID NO: 61748 - DNA, 25 bp, Rattus norvegicus
aatgcaaggcaagcgtccagacagc

SEQ ID NO: 61749 - DNA, 25 bp, Rattus norvegicus
aatgcaaggcctcaggcatgagccc

SEQ ID NO: 61750 - DNA, 25 bp, Rattus norvegicus
aatgcaaggcctgaggcatgagccc

SEQ ID NO: 61751 - DNA, 25 bp, Rattus norvegicus
aatgcaagtaggcagccagcccgtc

SEQ ID NO: 61752 - DNA, 25 bp, Rattus norvegicus
aatgcaagtagggagccagcccgtc

SEQ ID NO: 61753 - DNA, 25 bp, Rattus norvegicus
aatgcaagtcaccaacaacagcctg

SEQ ID NO: 61754 - DNA, 25 bp, Rattus norvegicus
aatgcaagtcaccagctagcagaca

SEQ ID NO: 61755 - DNA, 25 bp, Rattus norvegicus
aatgcaagtcacgaacaacagcctg

SEQ ID NO: 61756 - DNA, 25 bp, Rattus norvegicus
aatgcaagtcacgagctagcagaca

SEQ ID NO: 61757 - DNA, 25 bp, Rattus norvegicus
aatgcaagtcatcattaacagctac

SEQ ID NO: 61758 - DNA, 25 bp, Rattus norvegicus
aatgcaagtcatgattaacagctac

SEQ ID NO: 61759 - DNA, 25 bp, Rattus norvegicus
aatgcaagtttaccccatatcctct

SEQ ID NO: 61760 - DNA, 25 bp, Rattus norvegicus
aatgcaagtttagcccatatcctct

SEQ ID NO: 61761 - DNA, 25 bp, Rattus norvegicus
aatgcaagtttcagcttagagagta

SEQ ID NO: 61762 - DNA, 25 bp, Rattus norvegicus
aatgcaagtttctgcttagagagta

SEQ ID NO: 61763 - DNA, 25 bp, Rattus norvegicus
aatgcaatagccagtgtctgtgcct

SEQ ID NO: 61764 - DNA, 25 bp, Rattus norvegicus
aatgcaatagcctgtgtctgtgcct

SEQ ID NO: 61765 - DNA, 25 bp, Rattus norvegicus
aatgcaatgactcctattccttttc

SEQ ID NO: 61766 - DNA, 25 bp, Rattus norvegicus
aatgcaatgactgctattccttttc

SEQ ID NO: 61767 - DNA, 25 bp, Rattus norvegicus
aatgcaatgcctcactatgtagtcc

SEQ ID NO: 61768 - DNA, 25 bp, Rattus norvegicus
aatgcaatgcctgactatgtagtcc

SEQ ID NO: 61769 - DNA, 25 bp, Rattus norvegicus
aatgcaatgtttccctagtgagcaa

SEQ ID NO: 61770 - DNA, 25 bp, Rattus norvegicus
aatgcaatgtttgcctagtgagcaa

SEQ ID NO: 61771 - DNA, 25 bp, Rattus norvegicus
aatgcaattagaatttcccctgttc

SEQ ID NO: 61772 - DNA, 25 bp, Rattus norvegicus
aatgcaattagattttcccctgttc

SEQ ID NO: 61773 - DNA, 25 bp, Rattus norvegicus
aatgcaattgctctctcagcagcat

SEQ ID NO: 61774 - DNA, 25 bp, Rattus norvegicus
aatgcaattgctgtctcagcagcat

SEQ ID NO: 61775 - DNA, 25 bp, Rattus norvegicus
aatgcaattgttcgtttccctgtcc

SEQ ID NO: 61776 - DNA, 25 bp, Rattus norvegicus
aatgcaattgttggtttccctgtcc

SEQ ID NO: 61777 - DNA, 25 bp, Rattus norvegicus
aatgcacacgtgatgctgttacact

SEQ ID NO: 61778 - DNA, 25 bp, Rattus norvegicus
aatgcacacgtgttgctgttacact

SEQ ID NO: 61779 - DNA, 25 bp, Rattus norvegicus
aatgcacacgttcaatcccagcatt

SEQ ID NO: 61780 - DNA, 25 bp, Rattus norvegicus
aatgcacacgttgaatcccagcatt

SEQ ID NO: 61781 - DNA, 25 bp, Rattus norvegicus
aatgcacagcacacgtgttgaggct

SEQ ID NO: 61782 - DNA, 25 bp, Rattus norvegicus
aatgcacagcactcgtgttgaggct

SEQ ID NO: 61783 - DNA, 25 bp, Rattus norvegicus
aatgcacaggaaactcagcctcagg

SEQ ID NO: 61784 - DNA, 25 bp, Rattus norvegicus
aatgcacaggaatctcagcctcagg

SEQ ID NO: 61785 - DNA, 25 bp, Rattus norvegicus
aatgcacaggctcggctggatacct

SEQ ID NO: 61786 - DNA, 25 bp, Rattus norvegicus
aatgcacaggctgggctggatacct

SEQ ID NO: 61787 - DNA, 25 bp, Rattus norvegicus
aatgcacagtccctgaagctgcgtg

SEQ ID NO: 61788 - DNA, 25 bp, Rattus norvegicus
aatgcacagtccgtgaagctgcgtg

SEQ ID NO: 61789 - DNA, 25 bp, Rattus norvegicus
aatgcacatcccattttgcctatag

SEQ ID NO: 61790 - DNA, 25 bp, Rattus norvegicus
aatgcacatccctttttgcctatag

SEQ ID NO: 61791 - DNA, 25 bp, Rattus norvegicus
aatgcacatgctaacattggctaag

SEQ ID NO: 61792 - DNA, 25 bp, Rattus norvegicus
aatgcacatgcttacattggctaag

SEQ ID NO: 61793 - DNA, 25 bp, Rattus norvegicus
aatgcacattgtagacatgctaagc

SEQ ID NO: 61794 - DNA, 25 bp, Rattus norvegicus
aatgcacattgttgacatgctaagc

SEQ ID NO: 61795 - DNA, 25 bp, Rattus norvegicus
aatgcaccaccaagaggctccacaa

SEQ ID NO: 61796 - DNA, 25 bp, Rattus norvegicus
aatgcaccaccatgaggctccacaa

SEQ ID NO: 61797 - DNA, 25 bp, Rattus norvegicus
aatgcaccatctcacattcggagga

SEQ ID NO: 61798 - DNA, 25 bp, Rattus norvegicus
aatgcaccatctgacattcggagga

SEQ ID NO: 61799 - DNA, 25 bp, Rattus norvegicus
aatgcaccccaacaggcactgagta

SEQ ID NO: 61800 - DNA, 25 bp, Rattus norvegicus
aatgcaccccaagaggcactgagta

SEQ ID NO: 61801 - DNA, 25 bp, Rattus norvegicus
aatgcacccgagagacaagcctggt

SEQ ID NO: 61802 - DNA, 25 bp, Rattus norvegicus
aatgcacccgagtgacaagcctggt

SEQ ID NO: 61803 - DNA, 25 bp, Rattus norvegicus
aatgcaccgcatcaagatactttat

SEQ ID NO: 61804 - DNA, 25 bp, Rattus norvegicus
aatgcaccgcatgaagatactttat

SEQ ID NO: 61805 - DNA, 25 bp, Rattus norvegicus
aatgcaccgctcatgccgtaggtca

SEQ ID NO: 61806 - DNA, 25 bp, Rattus norvegicus
aatgcaccgctcttgccgtaggtca

SEQ ID NO: 61807 - DNA, 25 bp, Rattus norvegicus
aatgcacctgttctcatctgtaacc

SEQ ID NO: 61808 - DNA, 25 bp, Rattus norvegicus
aatgcacctgttgtcatctgtaacc

SEQ ID NO: 61809 - DNA, 25 bp, Rattus norvegicus
aatgcacctttgaatggcgagagtc

SEQ ID NO: 61810 - DNA, 25 bp, Rattus norvegicus
aatgcacctttgtatggcgagagtc

SEQ ID NO: 61811 - DNA, 25 bp, Rattus norvegicus
aatgcacgactgatactcgatatga

SEQ ID NO: 61812 - DNA, 25 bp, Rattus norvegicus
aatgcacgactgttactcgatatga

SEQ ID NO: 61813 - DNA, 25 bp, Rattus norvegicus
aatgcacgcctgacggctaaagtgg

SEQ ID NO: 61814 - DNA, 25 bp, Rattus norvegicus
aatgcacgcctgtcggctaaagtgg

SEQ ID NO: 61815 - DNA, 25 bp, Rattus norvegicus
aatgcacggtgcatgtctggtgtct

SEQ ID NO: 61816 - DNA, 25 bp, Rattus norvegicus
aatgcacggtgcttgtctggtgtct

SEQ ID NO: 61817 - DNA, 25 bp, Rattus norvegicus
aatgcacgtggtagcttcgaggagc

SEQ ID NO: 61818 - DNA, 25 bp, Rattus norvegicus
aatgcacgtggttgcttcgaggagc

SEQ ID NO: 61819 - DNA, 25 bp, Rattus norvegicus
aatgcactatggagtgtgtccacca

SEQ ID NO: 61820 - DNA, 25 bp, Rattus norvegicus
aatgcactatggtgtgtgtccacca

SEQ ID NO: 61821 - DNA, 25 bp, Rattus norvegicus
aatgcactcaaccagggtgtcttca

SEQ ID NO: 61822 - DNA, 25 bp, Rattus norvegicus
aatgcactcaacgagggtgtcttca

SEQ ID NO: 61823 - DNA, 25 bp, Rattus norvegicus
aatgcactctttacacgttttgttg

SEQ ID NO: 61824 - DNA, 25 bp, Rattus norvegicus
aatgcactcttttcacgttttgttg

SEQ ID NO: 61825 - DNA, 25 bp, Rattus norvegicus
aatgcactgaccagctccattcctt

SEQ ID NO: 61826 - DNA, 25 bp, Rattus norvegicus
aatgcactgacctgctccattcctt

SEQ ID NO: 61827 - DNA, 25 bp, Rattus norvegicus
aatgcactgacgcaaacttttgtaa

SEQ ID NO: 61828 - DNA, 25 bp, Rattus norvegicus
aatgcactgacggaaacttttgtaa

SEQ ID NO: 61829 - DNA, 25 bp, Rattus norvegicus
aatgcactgaggaacttcgcctgtc

SEQ ID NO: 61830 - DNA, 25 bp, Rattus norvegicus
aatgcactgaggtacttcgcctgtc

SEQ ID NO: 61831 - DNA, 25 bp, Rattus norvegicus
aatgcactgcatctatgtattctga

SEQ ID NO: 61832 - DNA, 25 bp, Rattus norvegicus
aatgcactgcatgtatgtattctga

SEQ ID NO: 61833 - DNA, 25 bp, Rattus norvegicus
aatgcactggacaaactcttgttta

SEQ ID NO: 61834 - DNA, 25 bp, Rattus norvegicus
aatgcactggactaactcttgttta

SEQ ID NO: 61835 - DNA, 25 bp, Rattus norvegicus
aatgcactggttctgttatggtata

SEQ ID NO: 61836 - DNA, 25 bp, Rattus norvegicus
aatgcactggttgtgttatggtata

SEQ ID NO: 61837 - DNA, 25 bp, Rattus norvegicus
aatgcactgtatatcctgcgatact

SEQ ID NO: 61838 - DNA, 25 bp, Rattus norvegicus
aatgcactgtatttcctgcgatact

SEQ ID NO: 61839 - DNA, 25 bp, Rattus norvegicus
aatgcactgtgaagtggcaccaact

SEQ ID NO: 61840 - DNA, 25 bp, Rattus norvegicus
aatgcactgtgatgtggcaccaact

SEQ ID NO: 61841 - DNA, 25 bp, Rattus norvegicus
aatgcactgtttaactgtgtaggaa

SEQ ID NO: 61842 - DNA, 25 bp, Rattus norvegicus
aatgcactgttttactgtgtaggaa

SEQ ID NO: 61843 - DNA, 25 bp, Rattus norvegicus
aatgcacttcaacatagcgaccctt

SEQ ID NO: 61844 - DNA, 25 bp, Rattus norvegicus
aatgcacttcaagatagcgaccctt

SEQ ID NO: 61845 - DNA, 25 bp, Rattus norvegicus
aatgcacttccaaacaagctagctg

SEQ ID NO: 61846 - DNA, 25 bp, Rattus norvegicus
aatgcacttccatacaagctagctg

SEQ ID NO: 61847 - DNA, 25 bp, Rattus norvegicus
aatgcacttgcacacgggtcacaaa

SEQ ID NO: 61848 - DNA, 25 bp, Rattus norvegicus
aatgcacttgcagacgggtcacaaa

SEQ ID NO: 61849 - DNA, 25 bp, Rattus norvegicus
aatgcactttgacgtttggagagaa

SEQ ID NO: 61850 - DNA, 25 bp, Rattus norvegicus
aatgcactttgaggtttggagagaa

SEQ ID NO: 61851 - DNA, 25 bp, Rattus norvegicus
aatgcacttttaatgacttcacagt

SEQ ID NO: 61852 - DNA, 25 bp, Rattus norvegicus
aatgcacttttattgacttcacagt

SEQ ID NO: 61853 - DNA, 25 bp, Rattus norvegicus
aatgcactttttcccaagctccggg

SEQ ID NO: 61854 - DNA, 25 bp, Rattus norvegicus
aatgcactttttgccaagctccggg

SEQ ID NO: 61855 - DNA, 25 bp, Rattus norvegicus
aatgcagaagatcccctataggctt

SEQ ID NO: 61856 - DNA, 25 bp, Rattus norvegicus
aatgcagaagatgccctataggctt

SEQ ID NO: 61857 - DNA, 25 bp, Rattus norvegicus
aatgcagaagcaatgacccagagct

SEQ ID NO: 61858 - DNA, 25 bp, Rattus norvegicus
aatgcagaagcattgacccagagct

SEQ ID NO: 61859 - DNA, 25 bp, Rattus norvegicus
aatgcagaatacacacggctgcctg

SEQ ID NO: 61860 - DNA, 25 bp, Rattus norvegicus
aatgcagaatactcacggctgcctg

SEQ ID NO: 61861 - DNA, 25 bp, Rattus norvegicus
aatgcagaatgcctgccttcatctc

SEQ ID NO: 61862 - DNA, 25 bp, Rattus norvegicus
aatgcagaatgcgtgccttcatctc

SEQ ID NO: 61863 - DNA, 25 bp, Rattus norvegicus
aatgcagaatgtcgctttcctcttc

SEQ ID NO: 61864 - DNA, 25 bp, Rattus norvegicus
aatgcagaatgtggctttcctcttc

SEQ ID NO: 61865 - DNA, 25 bp, Rattus norvegicus
aatgcagacccacttgccttacagg

SEQ ID NO: 61866 - DNA, 25 bp, Rattus norvegicus
aatgcagacccagttgccttacagg

SEQ ID NO: 61867 - DNA, 25 bp, Rattus norvegicus
aatgcagacgctcagcttgctgttc

SEQ ID NO: 61868 - DNA, 25 bp, Rattus norvegicus
aatgcagacgctgagcttgctgttc

SEQ ID NO: 61869 - DNA, 25 bp, Rattus norvegicus
aatgcagacgtgaagtcattcagga

SEQ ID NO: 61870 - DNA, 25 bp, Rattus norvegicus
aatgcagacgtgtagtcattcagga

SEQ ID NO: 61871 - DNA, 25 bp, Rattus norvegicus
aatgcagacttgagtgtgggttggg

SEQ ID NO: 61872 - DNA, 25 bp, Rattus norvegicus
aatgcagacttgtgtgtgggttggg

SEQ ID NO: 61873 - DNA, 25 bp, Rattus norvegicus
aatgcagagatgcagtccctgctgc

SEQ ID NO: 61874 - DNA, 25 bp, Rattus norvegicus
aatgcagagatggagtccctgctgc

SEQ ID NO: 61875 - DNA, 25 bp, Rattus norvegicus
aatgcagagcacagcagcttttcct

SEQ ID NO: 61876 - DNA, 25 bp, Rattus norvegicus
aatgcagagcactgcagcttttcct

SEQ ID NO: 61877 - DNA, 25 bp, Rattus norvegicus
aatgcagagcctactccgcatgtgt

SEQ ID NO: 61878 - DNA, 25 bp, Rattus norvegicus
aatgcagagccttctccgcatgtgt

SEQ ID NO: 61879 - DNA, 25 bp, Rattus norvegicus
aatgcagagtgccagtcaccgtggt

SEQ ID NO: 61880 - DNA, 25 bp, Rattus norvegicus
aatgcagagtgcgagtcaccgtggt

SEQ ID NO: 61881 - DNA, 25 bp, Rattus norvegicus
aatgcagatcacctgacagccaagt

SEQ ID NO: 61882 - DNA, 25 bp, Rattus norvegicus
aatgcagatcacgtgacagccaagt

SEQ ID NO: 61883 - DNA, 25 bp, Rattus norvegicus
aatgcagatcgtcagcccttcggat

SEQ ID NO: 61884 - DNA, 25 bp, Rattus norvegicus
aatgcagatcgtgagcccttcggat

SEQ ID NO: 61885 - DNA, 25 bp, Rattus norvegicus
aatgcagattttactcaaccccaaa

SEQ ID NO: 61886 - DNA, 25 bp, Rattus norvegicus
aatgcagatttttctcaaccccaaa

SEQ ID NO: 61887 - DNA, 25 bp, Rattus norvegicus
aatgcagcaaatctcttcagcctct

SEQ ID NO: 61888 - DNA, 25 bp, Rattus norvegicus
aatgcagcaaatgtcttcagcctct

SEQ ID NO: 61889 - DNA, 25 bp, Rattus norvegicus
aatgcagcacagaggtgtcttcctg

SEQ ID NO: 61890 - DNA, 25 bp, Rattus norvegicus
aatgcagcacagtggtgtcttcctg

SEQ ID NO: 61891 - DNA, 25 bp, Rattus norvegicus
aatgcagcactcaaggcaaccgcta

SEQ ID NO: 61892 - DNA, 25 bp, Rattus norvegicus
aatgcagcactctaggcaaccgcta

SEQ ID NO: 61893 - DNA, 25 bp, Rattus norvegicus
aatgcagcagcaccctaccagggag

SEQ ID NO: 61894 - DNA, 25 bp, Rattus norvegicus
aatgcagcagcagcctaccagggag

SEQ ID NO: 61895 - DNA, 25 bp, Rattus norvegicus
aatgcagcaggaagctgtacctgtg

SEQ ID NO: 61896 - DNA, 25 bp, Rattus norvegicus
aatgcagcaggaattgtataaccac

SEQ ID NO: 61897 - DNA, 25 bp, Rattus norvegicus
aatgcagcaggatgctgtacctgtg

SEQ ID NO: 61898 - DNA, 25 bp, Rattus norvegicus
aatgcagcaggatttgtataaccac

SEQ ID NO: 61899 - DNA, 25 bp, Rattus norvegicus
aatgcagcatatctcccagaggcgg

SEQ ID NO: 61900 - DNA, 25 bp, Rattus norvegicus
aatgcagcatatgtcccagaggcgg

SEQ ID NO: 61901 - DNA, 25 bp, Rattus norvegicus
aatgcagcatcgaaggtctttcatg

SEQ ID NO: 61902 - DNA, 25 bp, Rattus norvegicus
aatgcagcatcgtaggtctttcatg

SEQ ID NO: 61903 - DNA, 25 bp, Rattus norvegicus
aatgcagcatgaagttctgggttac

SEQ ID NO: 61904 - DNA, 25 bp, Rattus norvegicus
aatgcagcatgatgttctgggttac

SEQ ID NO: 61905 - DNA, 25 bp, Rattus norvegicus
aatgcagcatgcagtgttcggctca

SEQ ID NO: 61906 - DNA, 25 bp, Rattus norvegicus
aatgcagcatgctgtgttcggctca

SEQ ID NO: 61907 - DNA, 25 bp, Rattus norvegicus
aatgcagcccatacacattggtacc

SEQ ID NO: 61908 - DNA, 25 bp, Rattus norvegicus
aatgcagcccattcacattggtacc

SEQ ID NO: 61909 - DNA, 25 bp, Rattus norvegicus
aatgcagccccacctgttaaaacaa

SEQ ID NO: 61910 - DNA, 25 bp, Rattus norvegicus
aatgcagccccagctgttaaaacaa

SEQ ID NO: 61911 - DNA, 25 bp, Rattus norvegicus
aatgcagccgagaggaatcccaagt

SEQ ID NO: 61912 - DNA, 25 bp, Rattus norvegicus
aatgcagccgagtggaatcccaagt

SEQ ID NO: 61913 - DNA, 25 bp, Rattus norvegicus
aatgcagcctgtattactccaagag

SEQ ID NO: 61914 - DNA, 25 bp, Rattus norvegicus
aatgcagcctgttttactccaagag

SEQ ID NO: 61915 - DNA, 25 bp, Rattus norvegicus
aatgcagcgaagattctgcccatca

SEQ ID NO: 61916 - DNA, 25 bp, Rattus norvegicus
aatgcagcgaagtttctgcccatca

SEQ ID NO: 61917 - DNA, 25 bp, Rattus norvegicus
aatgcagcgcagaatcctccgctta

SEQ ID NO: 61918 - DNA, 25 bp, Rattus norvegicus
aatgcagcgcagtatcctccgctta

SEQ ID NO: 61919 - DNA, 25 bp, Rattus norvegicus
aatgcagcggctagaatttgatgta

SEQ ID NO: 61920 - DNA, 25 bp, Rattus norvegicus
aatgcagcggcttgaatttgatgta

SEQ ID NO: 61921 - DNA, 25 bp, Rattus norvegicus
aatgcagctatcaatgtccatttgg

SEQ ID NO: 61922 - DNA, 25 bp, Rattus norvegicus
aatgcagctatcattgggtcacttc

SEQ ID NO: 61923 - DNA, 25 bp, Rattus norvegicus
aatgcagctatctatgtccatttgg

SEQ ID NO: 61924 - DNA, 25 bp, Rattus norvegicus
aatgcagctatctttgggtcacttc

SEQ ID NO: 61925 - DNA, 25 bp, Rattus norvegicus
aatgcagctcccaggtcagttagag

SEQ ID NO: 61926 - DNA, 25 bp, Rattus norvegicus
aatgcagctccctggtcagttagag

SEQ ID NO: 61927 - DNA, 25 bp, Rattus norvegicus
aatgcagctgaacacctgttacgta

SEQ ID NO: 61928 - DNA, 25 bp, Rattus norvegicus
aatgcagctgaagacctgttacgta

SEQ ID NO: 61929 - DNA, 25 bp, Rattus norvegicus
aatgcagctgctcatgaggctgaaa

SEQ ID NO: 61930 - DNA, 25 bp, Rattus norvegicus
aatgcagctgctctgtagcatgctt

SEQ ID NO: 61931 - DNA, 25 bp, Rattus norvegicus
aatgcagctgctgatgaggctgaaa

SEQ ID NO: 61932 - DNA, 25 bp, Rattus norvegicus
aatgcagctgctgtgtagcatgctt

SEQ ID NO: 61933 - DNA, 25 bp, Rattus norvegicus
aatgcagcttccacttgggcaaaca

SEQ ID NO: 61934 - DNA, 25 bp, Rattus norvegicus
aatgcagcttcctcttgggcaaaca

SEQ ID NO: 61935 - DNA, 25 bp, Rattus norvegicus
aatgcagctttaaggcttctctttg

SEQ ID NO: 61936 - DNA, 25 bp, Rattus norvegicus
aatgcagctttatggcttctctttg

SEQ ID NO: 61937 - DNA, 25 bp, Rattus norvegicus
aatgcaggacatcggtgttccagct

SEQ ID NO: 61938 - DNA, 25 bp, Rattus norvegicus
aatgcaggacatgggtgttccagct

SEQ ID NO: 61939 - DNA, 25 bp, Rattus norvegicus
aatgcaggaggcaggtccaggataa

SEQ ID NO: 61940 - DNA, 25 bp, Rattus norvegicus
aatgcaggaggctggtccaggataa

SEQ ID NO: 61941 - DNA, 25 bp, Rattus norvegicus
aatgcaggatccaagggtttgagac

SEQ ID NO: 61942 - DNA, 25 bp, Rattus norvegicus
aatgcaggatccacttgattctttc

SEQ ID NO: 61943 - DNA, 25 bp, Rattus norvegicus
aatgcaggatcctagggtttgagac

SEQ ID NO: 61944 - DNA, 25 bp, Rattus norvegicus
aatgcaggatcctcttgattctttc

SEQ ID NO: 61945 - DNA, 25 bp, Rattus norvegicus
aatgcaggcagtcttctttgtgatt

SEQ ID NO: 61946 - DNA, 25 bp, Rattus norvegicus
aatgcaggcagtgttctttgtgatt

SEQ ID NO: 61947 - DNA, 25 bp, Rattus norvegicus
aatgcaggccctagtgagactcgga

SEQ ID NO: 61948 - DNA, 25 bp, Rattus norvegicus
aatgcaggcccttgtgagactcgga

SEQ ID NO: 61949 - DNA, 25 bp, Rattus norvegicus
aatgcaggcctaatctggagacgac

SEQ ID NO: 61950 - DNA, 25 bp, Rattus norvegicus
aatgcaggcctattctggagacgac

SEQ ID NO: 61951 - DNA, 25 bp, Rattus norvegicus
aatgcaggctacattgctctgtgta

SEQ ID NO: 61952 - DNA, 25 bp, Rattus norvegicus
aatgcaggctactttgctctgtgta

SEQ ID NO: 61953 - DNA, 25 bp, Rattus norvegicus
aatgcaggctccagttgttttccgt

SEQ ID NO: 61954 - DNA, 25 bp, Rattus norvegicus
aatgcaggctcctgttgttttccgt

SEQ ID NO: 61955 - DNA, 25 bp, Rattus norvegicus
aatgcaggctgccattgtttcccac

SEQ ID NO: 61956 - DNA, 25 bp, Rattus norvegicus
aatgcaggctgcgattgtttcccac

SEQ ID NO: 61957 - DNA, 25 bp, Rattus norvegicus
aatgcagggcacattgtcttgtaca

SEQ ID NO: 61958 - DNA, 25 bp, Rattus norvegicus
aatgcagggcactttgtcttgtaca

SEQ ID NO: 61959 - DNA, 25 bp, Rattus norvegicus
aatgcagggcctaccaaaattcccg

SEQ ID NO: 61960 - DNA, 25 bp, Rattus norvegicus
aatgcagggccttccaaaattcccg

SEQ ID NO: 61961 - DNA, 25 bp, Rattus norvegicus
aatgcagggcttattagcctctcca

SEQ ID NO: 61962 - DNA, 25 bp, Rattus norvegicus
aatgcagggctttttagcctctcca

SEQ ID NO: 61963 - DNA, 25 bp, Rattus norvegicus
aatgcaggtgctatgtcattcccaa

SEQ ID NO: 61964 - DNA, 25 bp, Rattus norvegicus
aatgcaggtgctttgtcattcccaa

SEQ ID NO: 61965 - DNA, 25 bp, Rattus norvegicus
aatgcaggtgtgctgactctgaagc

SEQ ID NO: 61966 - DNA, 25 bp, Rattus norvegicus
aatgcaggtgtggtgactctgaagc

SEQ ID NO: 61967 - DNA, 25 bp, Rattus norvegicus
aatgcaggtttcatagcagctccaa

SEQ ID NO: 61968 - DNA, 25 bp, Rattus norvegicus
aatgcaggtttcttagcagctccaa

SEQ ID NO: 61969 - DNA, 25 bp, Rattus norvegicus
aatgcagtagaaacgtcagtgtgac

SEQ ID NO: 61970 - DNA, 25 bp, Rattus norvegicus
aatgcagtagaatcgtcagtgtgac

SEQ ID NO: 61971 - DNA, 25 bp, Rattus norvegicus
aatgcagtcaaccaaggcacctaca

SEQ ID NO: 61972 - DNA, 25 bp, Rattus norvegicus
aatgcagtcaacgaaggcacctaca

SEQ ID NO: 61973 - DNA, 25 bp, Rattus norvegicus
aatgcagtcactcgtacagcccagg

SEQ ID NO: 61974 - DNA, 25 bp, Rattus norvegicus
aatgcagtcactggtacagcccagg

SEQ ID NO: 61975 - DNA, 25 bp, Rattus norvegicus
aatgcagtcagcaccatcaaggcaa

SEQ ID NO: 61976 - DNA, 25 bp, Rattus norvegicus
aatgcagtcagcaggtttgctagga

SEQ ID NO: 61977 - DNA, 25 bp, Rattus norvegicus
aatgcagtcagctccatcaaggcaa

SEQ ID NO: 61978 - DNA, 25 bp, Rattus norvegicus
aatgcagtcagctggtttgctagga

SEQ ID NO: 61979 - DNA, 25 bp, Rattus norvegicus
aatgcagtcaggctcttttgctcct

SEQ ID NO: 61980 - DNA, 25 bp, Rattus norvegicus
aatgcagtcagggtcttttgctcct

SEQ ID NO: 61981 - DNA, 25 bp, Rattus norvegicus
aatgcagtcatgagaactacctata

SEQ ID NO: 61982 - DNA, 25 bp, Rattus norvegicus
aatgcagtcatgtgaactacctata

SEQ ID NO: 61983 - DNA, 25 bp, Rattus norvegicus
aatgcagtccagaggcgctggtgac

SEQ ID NO: 61984 - DNA, 25 bp, Rattus norvegicus
aatgcagtccagtggcgctggtgac

SEQ ID NO: 61985 - DNA, 25 bp, Rattus norvegicus
aatgcagtcgtgcaaccagctggaa

SEQ ID NO: 61986 - DNA, 25 bp, Rattus norvegicus
aatgcagtcgtggaaccagctggaa

SEQ ID NO: 61987 - DNA, 25 bp, Rattus norvegicus
aatgcagtctccagaatcttcccgt

SEQ ID NO: 61988 - DNA, 25 bp, Rattus norvegicus
aatgcagtctcctgaatcttcccgt

SEQ ID NO: 61989 - DNA, 25 bp, Rattus norvegicus
aatgcagtctctcactcttttacct

SEQ ID NO: 61990 - DNA, 25 bp, Rattus norvegicus
aatgcagtctctgactcttttacct

SEQ ID NO: 61991 - DNA, 25 bp, Rattus norvegicus
aatgcagtctgtccagagttgcttt

SEQ ID NO: 61992 - DNA, 25 bp, Rattus norvegicus
aatgcagtctgtgcagagttgcttt

SEQ ID NO: 61993 - DNA, 25 bp, Rattus norvegicus
aatgcagtcttaataaaccagggaa

SEQ ID NO: 61994 - DNA, 25 bp, Rattus norvegicus
aatgcagtcttattaaaccagggaa

SEQ ID NO: 61995 - DNA, 25 bp, Rattus norvegicus
aatgcagtgaacactgacctctgga

SEQ ID NO: 61996 - DNA, 25 bp, Rattus norvegicus
aatgcagtgaactctgacctctgga

SEQ ID NO: 61997 - DNA, 25 bp, Rattus norvegicus
aatgcagtgaatctcaccacccgac

SEQ ID NO: 61998 - DNA, 25 bp, Rattus norvegicus
aatgcagtgaatgtcaccacccgac

SEQ ID NO: 61999 - DNA, 25 bp, Rattus norvegicus
aatgcagtgagaaccatctgtacct

SEQ ID NO: 62000 - DNA, 25 bp, Rattus norvegicus
aatgcagtgagaccaggacctgaga

SEQ ID NO: 62001 - DNA, 25 bp, Rattus norvegicus
aatgcagtgagagcaggacctgaga

SEQ ID NO: 62002 - DNA, 25 bp, Rattus norvegicus
aatgcagtgagatccatctgtacct

SEQ ID NO: 62003 - DNA, 25 bp, Rattus norvegicus
aatgcagtgaggatcctgtgtggcc

SEQ ID NO: 62004 - DNA, 25 bp, Rattus norvegicus
aatgcagtgaggttcctgtgtggcc

SEQ ID NO: 62005 - DNA, 25 bp, Rattus norvegicus
aatgcagtgctgagtacatactgta

SEQ ID NO: 62006 - DNA, 25 bp, Rattus norvegicus
aatgcagtgctgtgtacatactgta

SEQ ID NO: 62007 - DNA, 25 bp, Rattus norvegicus
aatgcagtggacacacacgcagttt

SEQ ID NO: 62008 - DNA, 25 bp, Rattus norvegicus
aatgcagtggactcacacgcagttt

SEQ ID NO: 62009 - DNA, 25 bp, Rattus norvegicus
aatgcagttaccaaggtaggactca

SEQ ID NO: 62010 - DNA, 25 bp, Rattus norvegicus
aatgcagttacctaggtaggactca

SEQ ID NO: 62011 - DNA, 25 bp, Rattus norvegicus
aatgcagttgtaaatcgaatctaaa

SEQ ID NO: 62012 - DNA, 25 bp, Rattus norvegicus
aatgcagttgtatatcgaatctaaa

SEQ ID NO: 62013 - DNA, 25 bp, Rattus norvegicus
aatgcagttgtcatcttcttggtga

SEQ ID NO: 62014 - DNA, 25 bp, Rattus norvegicus
aatgcagttgtcttcttcttggtga

SEQ ID NO: 62015 - DNA, 25 bp, Rattus norvegicus
aatgcagtttccctgtgttttgtct

SEQ ID NO: 62016 - DNA, 25 bp, Rattus norvegicus
aatgcagtttccgtgtgttttgtct

SEQ ID NO: 62017 - DNA, 25 bp, Rattus norvegicus
aatgcagtttgcactttcaccacag

SEQ ID NO: 62018 - DNA, 25 bp, Rattus norvegicus
aatgcagtttgcatagaacctattt

SEQ ID NO: 62019 - DNA, 25 bp, Rattus norvegicus
aatgcagtttgctctttcaccacag

SEQ ID NO: 62020 - DNA, 25 bp, Rattus norvegicus
aatgcagtttgcttagaacctattt

SEQ ID NO: 62021 - DNA, 25 bp, Rattus norvegicus
aatgcagtttgtctgtgtacggaaa

SEQ ID NO: 62022 - DNA, 25 bp, Rattus norvegicus
aatgcagtttgtgtgtgtacggaaa

SEQ ID NO: 62023 - DNA, 25 bp, Rattus norvegicus
aatgcagtttttccacttaacagtg

SEQ ID NO: 62024 - DNA, 25 bp, Rattus norvegicus
aatgcagtttttgcacttaacagtg

SEQ ID NO: 62025 - DNA, 25 bp, Rattus norvegicus
aatgcataacgaagcctcctgggag

SEQ ID NO: 62026 - DNA, 25 bp, Rattus norvegicus
aatgcataacgatgcctcctgggag

SEQ ID NO: 62027 - DNA, 25 bp, Rattus norvegicus
aatgcataatccaaagttggccgaa

SEQ ID NO: 62028 - DNA, 25 bp, Rattus norvegicus
aatgcataatcctaagttggccgaa

SEQ ID NO: 62029 - DNA, 25 bp, Rattus norvegicus
aatgcatacaatcctggcaccgctc

SEQ ID NO: 62030 - DNA, 25 bp, Rattus norvegicus
aatgcatacaatgctggcaccgctc

SEQ ID NO: 62031 - DNA, 25 bp, Rattus norvegicus
aatgcatacaggaggtcctctcagc

SEQ ID NO: 62032 - DNA, 25 bp, Rattus norvegicus
aatgcatacaggtggtcctctcagc

SEQ ID NO: 62033 - DNA, 25 bp, Rattus norvegicus
aatgcataccatacatttatctatg

SEQ ID NO: 62034 - DNA, 25 bp, Rattus norvegicus
aatgcataccattcatttatctatg

SEQ ID NO: 62035 - DNA, 25 bp, Rattus norvegicus
aatgcatacctgaaaatgtctttta

SEQ ID NO: 62036 - DNA, 25 bp, Rattus norvegicus
aatgcatacctgtaaatgtctttta

SEQ ID NO: 62037 - DNA, 25 bp, Rattus norvegicus
aatgcatactccacatagctaacag

SEQ ID NO: 62038 - DNA, 25 bp, Rattus norvegicus
aatgcatactcctcatagctaacag

SEQ ID NO: 62039 - DNA, 25 bp, Rattus norvegicus
aatgcatactctctgttgtttgttt

SEQ ID NO: 62040 - DNA, 25 bp, Rattus norvegicus
aatgcatactctgtgttgtttgttt

SEQ ID NO: 62041 - DNA, 25 bp, Rattus norvegicus
aatgcatatagaccctccttcttct

SEQ ID NO: 62042 - DNA, 25 bp, Rattus norvegicus
aatgcatatagagcctccttcttct

SEQ ID NO: 62043 - DNA, 25 bp, Rattus norvegicus
aatgcatatattcttgtgcctcata

SEQ ID NO: 62044 - DNA, 25 bp, Rattus norvegicus
aatgcatatattgttgtgcctcata

SEQ ID NO: 62045 - DNA, 25 bp, Rattus norvegicus
aatgcatatcacagttgtttcatca

SEQ ID NO: 62046 - DNA, 25 bp, Rattus norvegicus
aatgcatatcactgttgtttcatca

SEQ ID NO: 62047 - DNA, 25 bp, Rattus norvegicus
aatgcatattggacctctgtaccca

SEQ ID NO: 62048 - DNA, 25 bp, Rattus norvegicus
aatgcatattggtcctctgtaccca

SEQ ID NO: 62049 - DNA, 25 bp, Rattus norvegicus
aatgcatccaacaatcaagtcgcta

SEQ ID NO: 62050 - DNA, 25 bp, Rattus norvegicus
aatgcatccaactatcaagtcgcta

SEQ ID NO: 62051 - DNA, 25 bp, Rattus norvegicus
aatgcatcccatcagtttgactggt

SEQ ID NO: 62052 - DNA, 25 bp, Rattus norvegicus
aatgcatcccatgagtttgactggt

SEQ ID NO: 62053 - DNA, 25 bp, Rattus norvegicus
aatgcatccctaccagcggtgagtg

SEQ ID NO: 62054 - DNA, 25 bp, Rattus norvegicus
aatgcatccctagcagcggtgagtg

SEQ ID NO: 62055 - DNA, 25 bp, Rattus norvegicus
aatgcatccgatctgggccaccacg

SEQ ID NO: 62056 - DNA, 25 bp, Rattus norvegicus
aatgcatccgatgtgggccaccacg

SEQ ID NO: 62057 - DNA, 25 bp, Rattus norvegicus
aatgcatcctcaatgtcctggaaac

SEQ ID NO: 62058 - DNA, 25 bp, Rattus norvegicus
aatgcatcctcattgtcctggaaac

SEQ ID NO: 62059 - DNA, 25 bp, Rattus norvegicus
aatgcatcctttcccacatcaggac

SEQ ID NO: 62060 - DNA, 25 bp, Rattus norvegicus
aatgcatcctttgccacatcaggac

SEQ ID NO: 62061 - DNA, 25 bp, Rattus norvegicus
aatgcatcgagactcctgcgggtga

SEQ ID NO: 62062 - DNA, 25 bp, Rattus norvegicus
aatgcatcgagagtcctgcgggtga

SEQ ID NO: 62063 - DNA, 25 bp, Rattus norvegicus
aatgcatcgcatactttactggtgc

SEQ ID NO: 62064 - DNA, 25 bp, Rattus norvegicus
aatgcatcgcattctttactggtgc

SEQ ID NO: 62065 - DNA, 25 bp, Rattus norvegicus
aatgcatctactcactacgacctgt

SEQ ID NO: 62066 - DNA, 25 bp, Rattus norvegicus
aatgcatctactgactacgacctgt

SEQ ID NO: 62067 - DNA, 25 bp, Rattus norvegicus
aatgcatctccaaatttccttgaca

SEQ ID NO: 62068 - DNA, 25 bp, Rattus norvegicus
aatgcatctccatatttccttgaca

SEQ ID NO: 62069 - DNA, 25 bp, Rattus norvegicus
aatgcatctccccagagtattttgt

SEQ ID NO: 62070 - DNA, 25 bp, Rattus norvegicus
aatgcatctcccgagagtattttgt

SEQ ID NO: 62071 - DNA, 25 bp, Rattus norvegicus
aatgcatctgataagctatggccac

SEQ ID NO: 62072 - DNA, 25 bp, Rattus norvegicus
aatgcatctgattagctatggccac

SEQ ID NO: 62073 - DNA, 25 bp, Rattus norvegicus
aatgcatcttagagaacggtttcaa

SEQ ID NO: 62074 - DNA, 25 bp, Rattus norvegicus
aatgcatcttagtgaacggtttcaa

SEQ ID NO: 62075 - DNA, 25 bp, Rattus norvegicus
aatgcatgacagattcggagccaca

SEQ ID NO: 62076 - DNA, 25 bp, Rattus norvegicus
aatgcatgacagtttcggagccaca

SEQ ID NO: 62077 - DNA, 25 bp, Rattus norvegicus
aatgcatgacatccagccagagcta

SEQ ID NO: 62078 - DNA, 25 bp, Rattus norvegicus
aatgcatgacatgcagccagagcta

SEQ ID NO: 62079 - DNA, 25 bp, Rattus norvegicus
aatgcatgagacagaggccatccca

SEQ ID NO: 62080 - DNA, 25 bp, Rattus norvegicus
aatgcatgagactgaggccatccca

SEQ ID NO: 62081 - DNA, 25 bp, Rattus norvegicus
aatgcatgagggagtcctttgaggt

SEQ ID NO: 62082 - DNA, 25 bp, Rattus norvegicus
aatgcatgagggtgtcctttgaggt

SEQ ID NO: 62083 - DNA, 25 bp, Rattus norvegicus
aatgcatgcagcacactgacttcat

SEQ ID NO: 62084 - DNA, 25 bp, Rattus norvegicus
aatgcatgcagctcactgacttcat

SEQ ID NO: 62085 - DNA, 25 bp, Rattus norvegicus
aatgcatgcatgcatcttccctcgt

SEQ ID NO: 62086 - DNA, 25 bp, Rattus norvegicus
aatgcatgcatggatcttccctcgt

SEQ ID NO: 62087 - DNA, 25 bp, Rattus norvegicus
aatgcatgccaccaccaggctggat

SEQ ID NO: 62088 - DNA, 25 bp, Rattus norvegicus
aatgcatgccacgaccaggctggat

SEQ ID NO: 62089 - DNA, 25 bp, Rattus norvegicus
aatgcatgccctaacgtgacagcag

SEQ ID NO: 62090 - DNA, 25 bp, Rattus norvegicus
aatgcatgcccttacgtgacagcag

SEQ ID NO: 62091 - DNA, 25 bp, Rattus norvegicus
aatgcatgcctgagatttgattaga

SEQ ID NO: 62092 - DNA, 25 bp, Rattus norvegicus
aatgcatgcctgtgatttgattaga

SEQ ID NO: 62093 - DNA, 25 bp, Rattus norvegicus
aatgcatgctaaacttctttctttg

SEQ ID NO: 62094 - DNA, 25 bp, Rattus norvegicus
aatgcatgctaatcttctttctttg

SEQ ID NO: 62095 - DNA, 25 bp, Rattus norvegicus
aatgcatgctcaaagcctaacctca

SEQ ID NO: 62096 - DNA, 25 bp, Rattus norvegicus
aatgcatgctcatagcctaacctca

SEQ ID NO: 62097 - DNA, 25 bp, Rattus norvegicus
aatgcatggcctatgtagcccagga

SEQ ID NO: 62098 - DNA, 25 bp, Rattus norvegicus
aatgcatggcctttgtagcccagga

SEQ ID NO: 62099 - DNA, 25 bp, Rattus norvegicus
aatgcatggcttcgtggcctgcaat

SEQ ID NO: 62100 - DNA, 25 bp, Rattus norvegicus
aatgcatggcttggtggcctgcaat

SEQ ID NO: 62101 - DNA, 25 bp, Rattus norvegicus
aatgcatgggcaacagaggattctg

SEQ ID NO: 62102 - DNA, 25 bp, Rattus norvegicus
aatgcatgggcatcagaggattctg

SEQ ID NO: 62103 - DNA, 25 bp, Rattus norvegicus
aatgcatggtatccacgtcacttgg

SEQ ID NO: 62104 - DNA, 25 bp, Rattus norvegicus
aatgcatggtatgcacgtcacttgg

SEQ ID NO: 62105 - DNA, 25 bp, Rattus norvegicus
aatgcatgtccgaggttgggtgcac

SEQ ID NO: 62106 - DNA, 25 bp, Rattus norvegicus
aatgcatgtccgtggttgggtgcac

SEQ ID NO: 62107 - DNA, 25 bp, Rattus norvegicus
aatgcatgtttgattgtctcctggc

SEQ ID NO: 62108 - DNA, 25 bp, Rattus norvegicus
aatgcatgtttgtttgtctcctggc

SEQ ID NO: 62109 - DNA, 25 bp, Rattus norvegicus
aatgcatgttttacagtactccaga

SEQ ID NO: 62110 - DNA, 25 bp, Rattus norvegicus
aatgcatgtttttcagtactccaga

SEQ ID NO: 62111 - DNA, 25 bp, Rattus norvegicus
aatgcattatgtcgtcttattctag

SEQ ID NO: 62112 - DNA, 25 bp, Rattus norvegicus
aatgcattatgtggtcttattctag

SEQ ID NO: 62113 - DNA, 25 bp, Rattus norvegicus
aatgcattcactctattcctctttc

SEQ ID NO: 62114 - DNA, 25 bp, Rattus norvegicus
aatgcattcactgtattcctctttc

SEQ ID NO: 62115 - DNA, 25 bp, Rattus norvegicus
aatgcattcagacctgtagcaggct

SEQ ID NO: 62116 - DNA, 25 bp, Rattus norvegicus
aatgcattcagagctgtagcaggct

SEQ ID NO: 62117 - DNA, 25 bp, Rattus norvegicus
aatgcattcatcactacttcttcag

SEQ ID NO: 62118 - DNA, 25 bp, Rattus norvegicus
aatgcattcatcatgtttgtttttc

SEQ ID NO: 62119 - DNA, 25 bp, Rattus norvegicus
aatgcattcatctctacttcttcag

SEQ ID NO: 62120 - DNA, 25 bp, Rattus norvegicus
aatgcattcatcttgtttgtttttc

SEQ ID NO: 62121 - DNA, 25 bp, Rattus norvegicus
aatgcattcctaagctataattcta

SEQ ID NO: 62122 - DNA, 25 bp, Rattus norvegicus
aatgcattcctatgctataattcta

SEQ ID NO: 62123 - DNA, 25 bp, Rattus norvegicus
aatgcattctgcaggaaagccacca

SEQ ID NO: 62124 - DNA, 25 bp, Rattus norvegicus
aatgcattctgctggaaagccacca

SEQ ID NO: 62125 - DNA, 25 bp, Rattus norvegicus
aatgcattctttaattcacttccaa

SEQ ID NO: 62126 - DNA, 25 bp, Rattus norvegicus
aatgcattcttttattcacttccaa

SEQ ID NO: 62127 - DNA, 25 bp, Rattus norvegicus
aatgcattgaagcagcaggaccctg

SEQ ID NO: 62128 - DNA, 25 bp, Rattus norvegicus
aatgcattgaaggagcaggaccctg

SEQ ID NO: 62129 - DNA, 25 bp, Rattus norvegicus
aatgcattgaatcgagtccccttga

SEQ ID NO: 62130 - DNA, 25 bp, Rattus norvegicus
aatgcattgaatggagtccccttga

SEQ ID NO: 62131 - DNA, 25 bp, Rattus norvegicus
aatgcattgccaaccgaatctcaat

SEQ ID NO: 62132 - DNA, 25 bp, Rattus norvegicus
aatgcattgccatccgaatctcaat

SEQ ID NO: 62133 - DNA, 25 bp, Rattus norvegicus
aatgcattggttactcctgggtcct

SEQ ID NO: 62134 - DNA, 25 bp, Rattus norvegicus
aatgcattggtttctcctgggtcct

SEQ ID NO: 62135 - DNA, 25 bp, Rattus norvegicus
aatgcattgtgtaatggctctgctg

SEQ ID NO: 62136 - DNA, 25 bp, Rattus norvegicus
aatgcattgtgttatggctctgctg

SEQ ID NO: 62137 - DNA, 25 bp, Rattus norvegicus
aatgcatttaatagctacaaaggac

SEQ ID NO: 62138 - DNA, 25 bp, Rattus norvegicus
aatgcatttaattgctacaaaggac

SEQ ID NO: 62139 - DNA, 25 bp, Rattus norvegicus
aatgcatttaccatctcgatgactc

SEQ ID NO: 62140 - DNA, 25 bp, Rattus norvegicus
aatgcatttaccttctcgatgactc

SEQ ID NO: 62141 - DNA, 25 bp, Rattus norvegicus
aatgcatttagaccgattgctgatt

SEQ ID NO: 62142 - DNA, 25 bp, Rattus norvegicus
aatgcatttagagcgattgctgatt

SEQ ID NO: 62143 - DNA, 25 bp, Rattus norvegicus
aatgcatttatgacatcgttggtac

SEQ ID NO: 62144 - DNA, 25 bp, Rattus norvegicus
aatgcatttatgtcatcgttggtac

SEQ ID NO: 62145 - DNA, 25 bp, Rattus norvegicus
aatgcatttctactccacttggtga

SEQ ID NO: 62146 - DNA, 25 bp, Rattus norvegicus
aatgcatttctagtccacttggtga

SEQ ID NO: 62147 - DNA, 25 bp, Rattus norvegicus
aatgcatttggacggtcactctacc

SEQ ID NO: 62148 - DNA, 25 bp, Rattus norvegicus
aatgcatttggactgctgaccatgt

SEQ ID NO: 62149 - DNA, 25 bp, Rattus norvegicus
aatgcatttggagggtcactctacc

SEQ ID NO: 62150 - DNA, 25 bp, Rattus norvegicus
aatgcatttggagtgctgaccatgt

SEQ ID NO: 62151 - DNA, 25 bp, Rattus norvegicus
aatgcattttcacgttcttgtggta

SEQ ID NO: 62152 - DNA, 25 bp, Rattus norvegicus
aatgcattttcaggttcttgtggta

SEQ ID NO: 62153 - DNA, 25 bp, Rattus norvegicus
aatgcattttctaagggtgcctgtc

SEQ ID NO: 62154 - DNA, 25 bp, Rattus norvegicus
aatgcattttcttagggtgcctgtc

SEQ ID NO: 62155 - DNA, 25 bp, Rattus norvegicus
aatgcatttttaaccttaaacctag

SEQ ID NO: 62156 - DNA, 25 bp, Rattus norvegicus
aatgcatttttatccttaaacctag

SEQ ID NO: 62157 - DNA, 25 bp, Rattus norvegicus
aatgcatttttcatcctgttcagtg

SEQ ID NO: 62158 - DNA, 25 bp, Rattus norvegicus
aatgcatttttcatgggcttttgga

SEQ ID NO: 62159 - DNA, 25 bp, Rattus norvegicus
aatgcatttttcttcctgttcagtg

SEQ ID NO: 62160 - DNA, 25 bp, Rattus norvegicus
aatgcatttttcttgggcttttgga

SEQ ID NO: 62161 - DNA, 25 bp, Rattus norvegicus
aatgccaaagtcatcttccactaac

SEQ ID NO: 62162 - DNA, 25 bp, Rattus norvegicus
aatgccaaagtcttcttccactaac

SEQ ID NO: 62163 - DNA, 25 bp, Rattus norvegicus
aatgccaactttccattccatggga

SEQ ID NO: 62164 - DNA, 25 bp, Rattus norvegicus
aatgccaactttgcattccatggga

SEQ ID NO: 62165 - DNA, 25 bp, Rattus norvegicus
aatgccaagacactgttgccatccc

SEQ ID NO: 62166 - DNA, 25 bp, Rattus norvegicus
aatgccaagacagtgttgccatccc

SEQ ID NO: 62167 - DNA, 25 bp, Rattus norvegicus
aatgccaagcccaatgcccaggaag

SEQ ID NO: 62168 - DNA, 25 bp, Rattus norvegicus
aatgccaagccctatgcccaggaag

SEQ ID NO: 62169 - DNA, 25 bp, Rattus norvegicus
aatgccaaggctcttcctgccctta

SEQ ID NO: 62170 - DNA, 25 bp, Rattus norvegicus
aatgccaaggctgttcctgccctta

SEQ ID NO: 62171 - DNA, 25 bp, Rattus norvegicus
aatgccaagtggaacatcactgact

SEQ ID NO: 62172 - DNA, 25 bp, Rattus norvegicus
aatgccaagtggtacatcactgact

SEQ ID NO: 62173 - DNA, 25 bp, Rattus norvegicus
aatgccaattttaactgtcaccgag

SEQ ID NO: 62174 - DNA, 25 bp, Rattus norvegicus
aatgccaatttttactgtcaccgag

SEQ ID NO: 62175 - DNA, 25 bp, Rattus norvegicus
aatgccacactgaatgtttctaaca

SEQ ID NO: 62176 - DNA, 25 bp, Rattus norvegicus
aatgccacactgctgactaatgcgg

SEQ ID NO: 62177 - DNA, 25 bp, Rattus norvegicus
aatgccacactggtgactaatgcgg

SEQ ID NO: 62178 - DNA, 25 bp, Rattus norvegicus
aatgccacactgtatgtttctaaca

SEQ ID NO: 62179 - DNA, 25 bp, Rattus norvegicus
aatgccacagagctgctttcgggct

SEQ ID NO: 62180 - DNA, 25 bp, Rattus norvegicus
aatgccacagaggtgctttcgggct

SEQ ID NO: 62181 - DNA, 25 bp, Rattus norvegicus
aatgccacagatacccttttaaact

SEQ ID NO: 62182 - DNA, 25 bp, Rattus norvegicus
aatgccacagattcccttttaaact

SEQ ID NO: 62183 - DNA, 25 bp, Rattus norvegicus
aatgccacagccctgtcagatgagt

SEQ ID NO: 62184 - DNA, 25 bp, Rattus norvegicus
aatgccacagccgtgtcagatgagt

SEQ ID NO: 62185 - DNA, 25 bp, Rattus norvegicus
aatgccacatctaccaaaagcagag

SEQ ID NO: 62186 - DNA, 25 bp, Rattus norvegicus
aatgccacatcttccaaaagcagag

SEQ ID NO: 62187 - DNA, 25 bp, Rattus norvegicus
aatgccacccctcgaaggagatgat

SEQ ID NO: 62188 - DNA, 25 bp, Rattus norvegicus
aatgccacccctggaaggagatgat

SEQ ID NO: 62189 - DNA, 25 bp, Rattus norvegicus
aatgccaccgagagcaatgcttcct

SEQ ID NO: 62190 - DNA, 25 bp, Rattus norvegicus
aatgccaccgagtgcaatgcttcct

SEQ ID NO: 62191 - DNA, 25 bp, Rattus norvegicus
aatgccaccgtgcttcctggaaaat

SEQ ID NO: 62192 - DNA, 25 bp, Rattus norvegicus
aatgccaccgtggttcctggaaaat

SEQ ID NO: 62193 - DNA, 25 bp, Rattus norvegicus
aatgccacctatcctgttcatgtgt

SEQ ID NO: 62194 - DNA, 25 bp, Rattus norvegicus
aatgccacctatgctgttcatgtgt

SEQ ID NO: 62195 - DNA, 25 bp, Rattus norvegicus
aatgccacctcaccaaagacagatg

SEQ ID NO: 62196 - DNA, 25 bp, Rattus norvegicus
aatgccacctcagcaaagacagatg

SEQ ID NO: 62197 - DNA, 25 bp, Rattus norvegicus
aatgccacctgcctctgagaatttc

SEQ ID NO: 62198 - DNA, 25 bp, Rattus norvegicus
aatgccacctgcgtctgagaatttc

SEQ ID NO: 62199 - DNA, 25 bp, Rattus norvegicus
aatgccacctttactgtgctttttg

SEQ ID NO: 62200 - DNA, 25 bp, Rattus norvegicus
aatgccaccttttctgtgctttttg

SEQ ID NO: 62201 - DNA, 25 bp, Rattus norvegicus
aatgccacgcccaggaggctgagga

SEQ ID NO: 62202 - DNA, 25 bp, Rattus norvegicus
aatgccacgccctggaggctgagga

SEQ ID NO: 62203 - DNA, 25 bp, Rattus norvegicus
aatgccactaatacttgcagtaaag

SEQ ID NO: 62204 - DNA, 25 bp, Rattus norvegicus
aatgccactaattcttgcagtaaag

SEQ ID NO: 62205 - DNA, 25 bp, Rattus norvegicus
aatgccactagcatctttgtatcag

SEQ ID NO: 62206 - DNA, 25 bp, Rattus norvegicus
aatgccactagcttctttgtatcag

SEQ ID NO: 62207 - DNA, 25 bp, Rattus norvegicus
aatgccactagtacctgcagtgtct

SEQ ID NO: 62208 - DNA, 25 bp, Rattus norvegicus
aatgccactagttcctgcagtgtct

SEQ ID NO: 62209 - DNA, 25 bp, Rattus norvegicus
aatgccactggccagtgtgacttcc

SEQ ID NO: 62210 - DNA, 25 bp, Rattus norvegicus
aatgccactggcgagtgtgacttcc

SEQ ID NO: 62211 - DNA, 25 bp, Rattus norvegicus
aatgccactgtcacctgctcctgag

SEQ ID NO: 62212 - DNA, 25 bp, Rattus norvegicus
aatgccactgtctcctgctcctgag

SEQ ID NO: 62213 - DNA, 25 bp, Rattus norvegicus
aatgccactgtgattcctcatcaat

SEQ ID NO: 62214 - DNA, 25 bp, Rattus norvegicus
aatgccactgtgtttcctcatcaat

SEQ ID NO: 62215 - DNA, 25 bp, Rattus norvegicus
aatgccactgttactcattgatgga

SEQ ID NO: 62216 - DNA, 25 bp, Rattus norvegicus
aatgccactgtttctcattgatgga

SEQ ID NO: 62217 - DNA, 25 bp, Rattus norvegicus
aatgccagaactcattgatgccctc

SEQ ID NO: 62218 - DNA, 25 bp, Rattus norvegicus
aatgccagaactgattgatgccctc

SEQ ID NO: 62219 - DNA, 25 bp, Rattus norvegicus
aatgccagaagtaagcctcacgtgc

SEQ ID NO: 62220 - DNA, 25 bp, Rattus norvegicus
aatgccagaagttagcctcacgtgc

SEQ ID NO: 62221 - DNA, 25 bp, Rattus norvegicus
aatgccagaattacaaccaggcggc

SEQ ID NO: 62222 - DNA, 25 bp, Rattus norvegicus
aatgccagaatttcaaccaggcggc

SEQ ID NO: 62223 - DNA, 25 bp, Rattus norvegicus
aatgccagagctcggaatatagttg

SEQ ID NO: 62224 - DNA, 25 bp, Rattus norvegicus
aatgccagagctgggaatatagttg

SEQ ID NO: 62225 - DNA, 25 bp, Rattus norvegicus
aatgccagccacaaattcacttact

SEQ ID NO: 62226 - DNA, 25 bp, Rattus norvegicus
aatgccagccactaattcacttact

SEQ ID NO: 62227 - DNA, 25 bp, Rattus norvegicus
aatgccagcgcgaatctgaccaggt

SEQ ID NO: 62228 - DNA, 25 bp, Rattus norvegicus
aatgccagcgcgtatctgaccaggt

SEQ ID NO: 62229 - DNA, 25 bp, Rattus norvegicus
aatgccagctaaacccttagtcaga

SEQ ID NO: 62230 - DNA, 25 bp, Rattus norvegicus
aatgccagctaatcccttagtcaga

SEQ ID NO: 62231 - DNA, 25 bp, Rattus norvegicus
aatgccagctttctgttctgaaacg

SEQ ID NO: 62232 - DNA, 25 bp, Rattus norvegicus
aatgccagctttgtgttctgaaacg

SEQ ID NO: 62233 - DNA, 25 bp, Rattus norvegicus
aatgccaggcacacgcgtgatgtat

SEQ ID NO: 62234 - DNA, 25 bp, Rattus norvegicus
aatgccaggcactcgcgtgatgtat

SEQ ID NO: 62235 - DNA, 25 bp, Rattus norvegicus
aatgccaggtatccctccaggaggg

SEQ ID NO: 62236 - DNA, 25 bp, Rattus norvegicus
aatgccaggtatgcctccaggaggg

SEQ ID NO: 62237 - DNA, 25 bp, Rattus norvegicus
aatgccagtagtcaccaaggacagt

SEQ ID NO: 62238 - DNA, 25 bp, Rattus norvegicus
aatgccagtagtgaccaaggacagt

SEQ ID NO: 62239 - DNA, 25 bp, Rattus norvegicus
aatgccagtccgagtatgaccaggt

SEQ ID NO: 62240 - DNA, 25 bp, Rattus norvegicus
aatgccagtccgtgtatgaccaggt

SEQ ID NO: 62241 - DNA, 25 bp, Rattus norvegicus
aatgccagttaaatgccttggaaaa

SEQ ID NO: 62242 - DNA, 25 bp, Rattus norvegicus
aatgccagttaattgccttggaaaa

SEQ ID NO: 62243 - DNA, 25 bp, Rattus norvegicus
aatgccagttcacgctttgggcgat

SEQ ID NO: 62244 - DNA, 25 bp, Rattus norvegicus
aatgccagttcaggctttgggcgat

SEQ ID NO: 62245 - DNA, 25 bp, Rattus norvegicus
aatgccagttgtacagaaccccaaa

SEQ ID NO: 62246 - DNA, 25 bp, Rattus norvegicus
aatgccagttgttcagaaccccaaa

SEQ ID NO: 62247 - DNA, 25 bp, Rattus norvegicus
aatgccagtttcagactcaactcca

SEQ ID NO: 62248 - DNA, 25 bp, Rattus norvegicus
aatgccagtttcaggtctctcttga

SEQ ID NO: 62249 - DNA, 25 bp, Rattus norvegicus
aatgccagtttctgactcaactcca

SEQ ID NO: 62250 - DNA, 25 bp, Rattus norvegicus
aatgccagtttctggtctctcttga

SEQ ID NO: 62251 - DNA, 25 bp, Rattus norvegicus
aatgccataaatcatttcagtatat

SEQ ID NO: 62252 - DNA, 25 bp, Rattus norvegicus
aatgccataaatgatttcagtatat

SEQ ID NO: 62253 - DNA, 25 bp, Rattus norvegicus
aatgccatagctagtttttcttgaa

SEQ ID NO: 62254 - DNA, 25 bp, Rattus norvegicus
aatgccatagcttgtttttcttgaa

SEQ ID NO: 62255 - DNA, 25 bp, Rattus norvegicus
aatgccatcctaagaccatgtgtga

SEQ ID NO: 62256 - DNA, 25 bp, Rattus norvegicus
aatgccatcctactgcagcagatta

SEQ ID NO: 62257 - DNA, 25 bp, Rattus norvegicus
aatgccatcctagtgcagcagatta

SEQ ID NO: 62258 - DNA, 25 bp, Rattus norvegicus
aatgccatcctatgaccatgtgtga

SEQ ID NO: 62259 - DNA, 25 bp, Rattus norvegicus
aatgccatcgccatcctgaccgtag

SEQ ID NO: 62260 - DNA, 25 bp, Rattus norvegicus
aatgccatcgccttcctgaccgtag

SEQ ID NO: 62261 - DNA, 25 bp, Rattus norvegicus
aatgccatcgttccctggaatgctg

SEQ ID NO: 62262 - DNA, 25 bp, Rattus norvegicus
aatgccatcgttgcctggaatgctg

SEQ ID NO: 62263 - DNA, 25 bp, Rattus norvegicus
aatgccatctacagccttgtgacct

SEQ ID NO: 62264 - DNA, 25 bp, Rattus norvegicus
aatgccatctactgccttgtgacct

SEQ ID NO: 62265 - DNA, 25 bp, Rattus norvegicus
aatgccatgaatatctccacacagg

SEQ ID NO: 62266 - DNA, 25 bp, Rattus norvegicus
aatgccatgaatttctccacacagg

SEQ ID NO: 62267 - DNA, 25 bp, Rattus norvegicus
aatgccatgaccaggtgtagcggaa

SEQ ID NO: 62268 - DNA, 25 bp, Rattus norvegicus
aatgccatgacctggtgtagcggaa

SEQ ID NO: 62269 - DNA, 25 bp, Rattus norvegicus
aatgccatgcttcccattagtgaca

SEQ ID NO: 62270 - DNA, 25 bp, Rattus norvegicus
aatgccatgcttgccattagtgaca

SEQ ID NO: 62271 - DNA, 25 bp, Rattus norvegicus
aatgccatggccatgtgcccagggt

SEQ ID NO: 62272 - DNA, 25 bp, Rattus norvegicus
aatgccatggccttgtgcccagggt

SEQ ID NO: 62273 - DNA, 25 bp, Rattus norvegicus
aatgccatgggacagcacagtgctc

SEQ ID NO: 62274 - DNA, 25 bp, Rattus norvegicus
aatgccatgggagagcacagtgctc

SEQ ID NO: 62275 - DNA, 25 bp, Rattus norvegicus
aatgccatgtttcacttcagcgaga

SEQ ID NO: 62276 - DNA, 25 bp, Rattus norvegicus
aatgccatgtttgacttcagcgaga

SEQ ID NO: 62277 - DNA, 25 bp, Rattus norvegicus
aatgccattcagaagtccatggtca

SEQ ID NO: 62278 - DNA, 25 bp, Rattus norvegicus
aatgccattcagtagtccatggtca

SEQ ID NO: 62279 - DNA, 25 bp, Rattus norvegicus
aatgccattgtaatctcgagactgt

SEQ ID NO: 62280 - DNA, 25 bp, Rattus norvegicus
aatgccattgtattctcgagactgt

SEQ ID NO: 62281 - DNA, 25 bp, Rattus norvegicus
aatgccatttggaggtgcctaataa

SEQ ID NO: 62282 - DNA, 25 bp, Rattus norvegicus
aatgccatttggtggtgcctaataa

SEQ ID NO: 62283 - DNA, 25 bp, Rattus norvegicus
aatgccattttcatgatgacggact

SEQ ID NO: 62284 - DNA, 25 bp, Rattus norvegicus
aatgccattttcttgatgacggact

SEQ ID NO: 62285 - DNA, 25 bp, Rattus norvegicus
aatgcccaacacagagttacttcgg

SEQ ID NO: 62286 - DNA, 25 bp, Rattus norvegicus
aatgcccaacactgagttacttcgg

SEQ ID NO: 62287 - DNA, 25 bp, Rattus norvegicus
aatgcccaccctctgtaactgagtg

SEQ ID NO: 62288 - DNA, 25 bp, Rattus norvegicus
aatgcccaccctgtgtaactgagtg

SEQ ID NO: 62289 - DNA, 25 bp, Rattus norvegicus
aatgcccacctgatttgaaagatgt

SEQ ID NO: 62290 - DNA, 25 bp, Rattus norvegicus
aatgcccacctgttttgaaagatgt

SEQ ID NO: 62291 - DNA, 25 bp, Rattus norvegicus
aatgcccacgcacacggacgaggag

SEQ ID NO: 62292 - DNA, 25 bp, Rattus norvegicus
aatgcccacgcagacggacgaggag

SEQ ID NO: 62293 - DNA, 25 bp, Rattus norvegicus
aatgcccacgtgatttctgggccct

SEQ ID NO: 62294 - DNA, 25 bp, Rattus norvegicus
aatgcccacgtgttttctgggccct

SEQ ID NO: 62295 - DNA, 25 bp, Rattus norvegicus
aatgcccactttatggataactctg

SEQ ID NO: 62296 - DNA, 25 bp, Rattus norvegicus
aatgcccactttttggataactctg

SEQ ID NO: 62297 - DNA, 25 bp, Rattus norvegicus
aatgcccagaagatcctcagactag

SEQ ID NO: 62298 - DNA, 25 bp, Rattus norvegicus
aatgcccagaagttcctcagactag

SEQ ID NO: 62299 - DNA, 25 bp, Rattus norvegicus
aatgcccaggttctttaccacggtg

SEQ ID NO: 62300 - DNA, 25 bp, Rattus norvegicus
aatgcccaggttgtttaccacggtg

SEQ ID NO: 62301 - DNA, 25 bp, Rattus norvegicus
aatgcccagtgaactcaagctgtag

SEQ ID NO: 62302 - DNA, 25 bp, Rattus norvegicus
aatgcccagtgatctcaagctgtag

SEQ ID NO: 62303 - DNA, 25 bp, Rattus norvegicus
aatgcccagtgtcttatactgcaaa

SEQ ID NO: 62304 - DNA, 25 bp, Rattus norvegicus
aatgcccagtgtgttatactgcaaa

SEQ ID NO: 62305 - DNA, 25 bp, Rattus norvegicus
aatgcccagtttagtgtttcaggga

SEQ ID NO: 62306 - DNA, 25 bp, Rattus norvegicus
aatgcccagttttgtgtttcaggga

SEQ ID NO: 62307 - DNA, 25 bp, Rattus norvegicus
aatgcccatagaaagaacttctctg

SEQ ID NO: 62308 - DNA, 25 bp, Rattus norvegicus
aatgcccatagatagaacttctctg

SEQ ID NO: 62309 - DNA, 25 bp, Rattus norvegicus
aatgcccatagtacactggtgacat

SEQ ID NO: 62310 - DNA, 25 bp, Rattus norvegicus
aatgcccatagttcactggtgacat

SEQ ID NO: 62311 - DNA, 25 bp, Rattus norvegicus
aatgcccatgccaaggtttgtgcgg

SEQ ID NO: 62312 - DNA, 25 bp, Rattus norvegicus
aatgcccatgcctaggtttgtgcgg

SEQ ID NO: 62313 - DNA, 25 bp, Rattus norvegicus
aatgccccaaacattcttgtgagga

SEQ ID NO: 62314 - DNA, 25 bp, Rattus norvegicus
aatgccccaaactttcttgtgagga

SEQ ID NO: 62315 - DNA, 25 bp, Rattus norvegicus
aatgccccgggcatctgggttactg

SEQ ID NO: 62316 - DNA, 25 bp, Rattus norvegicus
aatgccccgggcttctgggttactg

SEQ ID NO: 62317 - DNA, 25 bp, Rattus norvegicus
aatgcccctatcaaccagttagcaa

SEQ ID NO: 62318 - DNA, 25 bp, Rattus norvegicus
aatgcccctatctaccagttagcaa

SEQ ID NO: 62319 - DNA, 25 bp, Rattus norvegicus
aatgccccttgcagggtttggactg

SEQ ID NO: 62320 - DNA, 25 bp, Rattus norvegicus
aatgccccttgctgggtttggactg

SEQ ID NO: 62321 - DNA, 25 bp, Rattus norvegicus
aatgcccgcatactagtgtgattaa

SEQ ID NO: 62322 - DNA, 25 bp, Rattus norvegicus
aatgcccgcatagtagtgtgattaa

SEQ ID NO: 62323 - DNA, 25 bp, Rattus norvegicus
aatgcccgccagacgattaatgatc

SEQ ID NO: 62324 - DNA, 25 bp, Rattus norvegicus
aatgcccgccagtcgattaatgatc

SEQ ID NO: 62325 - DNA, 25 bp, Rattus norvegicus
aatgcccgctcaaagtctcttatgg

SEQ ID NO: 62326 - DNA, 25 bp, Rattus norvegicus
aatgcccgctcatagtctcttatgg

SEQ ID NO: 62327 - DNA, 25 bp, Rattus norvegicus
aatgcccgggacaagctgtggcaga

SEQ ID NO: 62328 - DNA, 25 bp, Rattus norvegicus
aatgcccgggactagctgtggcaga

SEQ ID NO: 62329 - DNA, 25 bp, Rattus norvegicus
aatgccctaacgagtaactagcaga

SEQ ID NO: 62330 - DNA, 25 bp, Rattus norvegicus
aatgccctaacgtgtaactagcaga

SEQ ID NO: 62331 - DNA, 25 bp, Rattus norvegicus
aatgccctaactctgtttggacagt

SEQ ID NO: 62332 - DNA, 25 bp, Rattus norvegicus
aatgccctaactgtgtttggacagt

SEQ ID NO: 62333 - DNA, 25 bp, Rattus norvegicus
aatgccctaccacagaagaccaaag

SEQ ID NO: 62334 - DNA, 25 bp, Rattus norvegicus
aatgccctaccagagaagaccaaag

SEQ ID NO: 62335 - DNA, 25 bp, Rattus norvegicus
aatgccctagcactatctaattgaa

SEQ ID NO: 62336 - DNA, 25 bp, Rattus norvegicus
aatgccctagcagtatctaattgaa

SEQ ID NO: 62337 - DNA, 25 bp, Rattus norvegicus
aatgccctcctcatggaacgtgatg

SEQ ID NO: 62338 - DNA, 25 bp, Rattus norvegicus
aatgccctcctcttggaacgtgatg

SEQ ID NO: 62339 - DNA, 25 bp, Rattus norvegicus
aatgccctccttctggctctaagag

SEQ ID NO: 62340 - DNA, 25 bp, Rattus norvegicus
aatgccctccttgtggctctaagag

SEQ ID NO: 62341 - DNA, 25 bp, Rattus norvegicus
aatgccctctcacccatgaaggcgt

SEQ ID NO: 62342 - DNA, 25 bp, Rattus norvegicus
aatgccctctcagccatgaaggcgt

SEQ ID NO: 62343 - DNA, 25 bp, Rattus norvegicus
aatgccctgcggataaacactggtt

SEQ ID NO: 62344 - DNA, 25 bp, Rattus norvegicus
aatgccctgcggttaaacactggtt

SEQ ID NO: 62345 - DNA, 25 bp, Rattus norvegicus
aatgccctgctcatgatgactgtgg

SEQ ID NO: 62346 - DNA, 25 bp, Rattus norvegicus
aatgccctgctcttgatgactgtgg

SEQ ID NO: 62347 - DNA, 25 bp, Rattus norvegicus
aatgccctgctgagtaagcggttgt

SEQ ID NO: 62348 - DNA, 25 bp, Rattus norvegicus
aatgccctgctgtgtaagcggttgt

SEQ ID NO: 62349 - DNA, 25 bp, Rattus norvegicus
aatgccctggagcaacgtttctcgc

SEQ ID NO: 62350 - DNA, 25 bp, Rattus norvegicus
aatgccctggaggaacgtttctcgc

SEQ ID NO: 62351 - DNA, 25 bp, Rattus norvegicus
aatgccctgggtcgtcgcagccttt

SEQ ID NO: 62352 - DNA, 25 bp, Rattus norvegicus
aatgccctgggtggtcgcagccttt

SEQ ID NO: 62353 - DNA, 25 bp, Rattus norvegicus
aatgccctggttacagaatgctacc

SEQ ID NO: 62354 - DNA, 25 bp, Rattus norvegicus
aatgccctggtttcagaatgctacc

SEQ ID NO: 62355 - DNA, 25 bp, Rattus norvegicus
aatgcccttacaagaatctaagcaa

SEQ ID NO: 62356 - DNA, 25 bp, Rattus norvegicus
aatgcccttacacaagtcttgcaga

SEQ ID NO: 62357 - DNA, 25 bp, Rattus norvegicus
aatgcccttacagaagtcttgcaga

SEQ ID NO: 62358 - DNA, 25 bp, Rattus norvegicus
aatgcccttacatgaatctaagcaa

SEQ ID NO: 62359 - DNA, 25 bp, Rattus norvegicus
aatgcccttagaacactgtcctact

SEQ ID NO: 62360 - DNA, 25 bp, Rattus norvegicus
aatgcccttagatcactgtcctact

SEQ ID NO: 62361 - DNA, 25 bp, Rattus norvegicus
aatgcccttcgcatggcgaagcagg

SEQ ID NO: 62362 - DNA, 25 bp, Rattus norvegicus
aatgcccttcgcttggcgaagcagg

SEQ ID NO: 62363 - DNA, 25 bp, Rattus norvegicus
aatgcccttctgagaagctccagga

SEQ ID NO: 62364 - DNA, 25 bp, Rattus norvegicus
aatgcccttctgtgaagctccagga

SEQ ID NO: 62365 - DNA, 25 bp, Rattus norvegicus
aatgccctttatatggttcggatga

SEQ ID NO: 62366 - DNA, 25 bp, Rattus norvegicus
aatgccctttatttggttcggatga

SEQ ID NO: 62367 - DNA, 25 bp, Rattus norvegicus
aatgccgacctgaaagactgagaga

SEQ ID NO: 62368 - DNA, 25 bp, Rattus norvegicus
aatgccgacctgctgccagtgaaaa

SEQ ID NO: 62369 - DNA, 25 bp, Rattus norvegicus
aatgccgacctggtgccagtgaaaa

SEQ ID NO: 62370 - DNA, 25 bp, Rattus norvegicus
aatgccgacctgtaagactgagaga

SEQ ID NO: 62371 - DNA, 25 bp, Rattus norvegicus
aatgccgactgtcttagttacgaca

SEQ ID NO: 62372 - DNA, 25 bp, Rattus norvegicus
aatgccgactgtgttagttacgaca

SEQ ID NO: 62373 - DNA, 25 bp, Rattus norvegicus
aatgccgatggtagctgaaagtctt

SEQ ID NO: 62374 - DNA, 25 bp, Rattus norvegicus
aatgccgatggttgctgaaagtctt

SEQ ID NO: 62375 - DNA, 25 bp, Rattus norvegicus
aatgccgatgtcaggttagtatgtc

SEQ ID NO: 62376 - DNA, 25 bp, Rattus norvegicus
aatgccgatgtctggttagtatgtc

SEQ ID NO: 62377 - DNA, 25 bp, Rattus norvegicus
aatgccgcatgtatcaattgtaata

SEQ ID NO: 62378 - DNA, 25 bp, Rattus norvegicus
aatgccgcatgtttcaattgtaata

SEQ ID NO: 62379 - DNA, 25 bp, Rattus norvegicus
aatgccgccctgcagaaagttgttc

SEQ ID NO: 62380 - DNA, 25 bp, Rattus norvegicus
aatgccgccctggagaaagttgttc

SEQ ID NO: 62381 - DNA, 25 bp, Rattus norvegicus
aatgccgcctgaataagtactgtgc

SEQ ID NO: 62382 - DNA, 25 bp, Rattus norvegicus
aatgccgcctgattaagtactgtgc

SEQ ID NO: 62383 - DNA, 25 bp, Rattus norvegicus
aatgccgcgtatagcttgtggataa

SEQ ID NO: 62384 - DNA, 25 bp, Rattus norvegicus
aatgccgcgtattgcttgtggataa

SEQ ID NO: 62385 - DNA, 25 bp, Rattus norvegicus
aatgccgctactatgctgtggatgc

SEQ ID NO: 62386 - DNA, 25 bp, Rattus norvegicus
aatgccgctactttgctgtggatgc

SEQ ID NO: 62387 - DNA, 25 bp, Rattus norvegicus
aatgccggatgccagatctaatgcg

SEQ ID NO: 62388 - DNA, 25 bp, Rattus norvegicus
aatgccggatgcgagatctaatgcg

SEQ ID NO: 62389 - DNA, 25 bp, Rattus norvegicus
aatgccgggaagaagtctgcccacc

SEQ ID NO: 62390 - DNA, 25 bp, Rattus norvegicus
aatgccgggaagtagtctgcccacc

SEQ ID NO: 62391 - DNA, 25 bp, Rattus norvegicus
aatgccgggcagacaccatgtaagt

SEQ ID NO: 62392 - DNA, 25 bp, Rattus norvegicus
aatgccgggcagtcaccatgtaagt

SEQ ID NO: 62393 - DNA, 25 bp, Rattus norvegicus
aatgccgggcccaagtccatggagg

SEQ ID NO: 62394 - DNA, 25 bp, Rattus norvegicus
aatgccgggccctagtccatggagg

SEQ ID NO: 62395 - DNA, 25 bp, Rattus norvegicus
aatgccggtggaatatgatgactta

SEQ ID NO: 62396 - DNA, 25 bp, Rattus norvegicus
aatgccggtggattatgatgactta

SEQ ID NO: 62397 - DNA, 25 bp, Rattus norvegicus
aatgccgtcatgagatccagctgga

SEQ ID NO: 62398 - DNA, 25 bp, Rattus norvegicus
aatgccgtcatgtgatccagctgga

SEQ ID NO: 62399 - DNA, 25 bp, Rattus norvegicus
aatgccgtggctaggtgcttctccg

SEQ ID NO: 62400 - DNA, 25 bp, Rattus norvegicus
aatgccgtggcttggtgcttctccg

SEQ ID NO: 62401 - DNA, 25 bp, Rattus norvegicus
aatgccgtgtggcttcatgtgaagt

SEQ ID NO: 62402 - DNA, 25 bp, Rattus norvegicus
aatgccgtgtgggttcatgtgaagt

SEQ ID NO: 62403 - DNA, 25 bp, Rattus norvegicus
aatgccgttgagcttgatttatgtc

SEQ ID NO: 62404 - DNA, 25 bp, Rattus norvegicus
aatgccgttgaggttgatttatgtc

SEQ ID NO: 62405 - DNA, 25 bp, Rattus norvegicus
aatgcctaactcaacttaaggaaag

SEQ ID NO: 62406 - DNA, 25 bp, Rattus norvegicus
aatgcctaactctacttaaggaaag

SEQ ID NO: 62407 - DNA, 25 bp, Rattus norvegicus
aatgcctaatttctgtctttgttct

SEQ ID NO: 62408 - DNA, 25 bp, Rattus norvegicus
aatgcctaatttgtgtctttgttct

SEQ ID NO: 62409 - DNA, 25 bp, Rattus norvegicus
aatgcctacacccagtgacctagaa

SEQ ID NO: 62410 - DNA, 25 bp, Rattus norvegicus
aatgcctacaccgagtgacctagaa

SEQ ID NO: 62411 - DNA, 25 bp, Rattus norvegicus
aatgcctacgacattgttccatgat

SEQ ID NO: 62412 - DNA, 25 bp, Rattus norvegicus
aatgcctacgactttgttccatgat

SEQ ID NO: 62413 - DNA, 25 bp, Rattus norvegicus
aatgcctactaacttcaacagacag

SEQ ID NO: 62414 - DNA, 25 bp, Rattus norvegicus
aatgcctactaagttcaacagacag

SEQ ID NO: 62415 - DNA, 25 bp, Rattus norvegicus
aatgcctagccgatttcaaactaca

SEQ ID NO: 62416 - DNA, 25 bp, Rattus norvegicus
aatgcctagccgttttcaaactaca

SEQ ID NO: 62417 - DNA, 25 bp, Rattus norvegicus
aatgcctaggccagctgtagtatcc

SEQ ID NO: 62418 - DNA, 25 bp, Rattus norvegicus
aatgcctaggcctgctgtagtatcc

SEQ ID NO: 62419 - DNA, 25 bp, Rattus norvegicus
aatgcctagtgccttctatttacag

SEQ ID NO: 62420 - DNA, 25 bp, Rattus norvegicus
aatgcctagtgcgttctatttacag

SEQ ID NO: 62421 - DNA, 25 bp, Rattus norvegicus
aatgcctatcatcctaatgtttgac

SEQ ID NO: 62422 - DNA, 25 bp, Rattus norvegicus
aatgcctatcatgctaatgtttgac

SEQ ID NO: 62423 - DNA, 25 bp, Rattus norvegicus
aatgcctattcccagttgtgacaat

SEQ ID NO: 62424 - DNA, 25 bp, Rattus norvegicus
aatgcctattccgagttgtgacaat

SEQ ID NO: 62425 - DNA, 25 bp, Rattus norvegicus
aatgcctcaaagaaagcctatctgc

SEQ ID NO: 62426 - DNA, 25 bp, Rattus norvegicus
aatgcctcaaagaacaatccactgt

SEQ ID NO: 62427 - DNA, 25 bp, Rattus norvegicus
aatgcctcaaagtaagcctatctgc

SEQ ID NO: 62428 - DNA, 25 bp, Rattus norvegicus
aatgcctcaaagtacaatccactgt

SEQ ID NO: 62429 - DNA, 25 bp, Rattus norvegicus
aatgcctcacatagctgcactggag

SEQ ID NO: 62430 - DNA, 25 bp, Rattus norvegicus
aatgcctcacattgctgcactggag

SEQ ID NO: 62431 - DNA, 25 bp, Rattus norvegicus
aatgcctcagagctgtaactcatga

SEQ ID NO: 62432 - DNA, 25 bp, Rattus norvegicus
aatgcctcagaggtgtaactcatga

SEQ ID NO: 62433 - DNA, 25 bp, Rattus norvegicus
aatgcctcagcaagcacgtcagaat

SEQ ID NO: 62434 - DNA, 25 bp, Rattus norvegicus
aatgcctcagcatgcacgtcagaat

SEQ ID NO: 62435 - DNA, 25 bp, Rattus norvegicus
aatgcctccagcagtcactaggtag

SEQ ID NO: 62436 - DNA, 25 bp, Rattus norvegicus
aatgcctccagctgtcactaggtag

SEQ ID NO: 62437 - DNA, 25 bp, Rattus norvegicus
aatgcctcccagagaaaccaataac

SEQ ID NO: 62438 - DNA, 25 bp, Rattus norvegicus
aatgcctcccagtgaaaccaataac

SEQ ID NO: 62439 - DNA, 25 bp, Rattus norvegicus
aatgcctccctcactgttatggact

SEQ ID NO: 62440 - DNA, 25 bp, Rattus norvegicus
aatgcctccctctctgttatggact

SEQ ID NO: 62441 - DNA, 25 bp, Rattus norvegicus
aatgcctcctttcctctaagggatg

SEQ ID NO: 62442 - DNA, 25 bp, Rattus norvegicus
aatgcctcctttgctctaagggatg

SEQ ID NO: 62443 - DNA, 25 bp, Rattus norvegicus
aatgcctcggcactgggaaaatcct

SEQ ID NO: 62444 - DNA, 25 bp, Rattus norvegicus
aatgcctcggcagtgggaaaatcct

SEQ ID NO: 62445 - DNA, 25 bp, Rattus norvegicus
aatgcctctagtcatcttggtggta

SEQ ID NO: 62446 - DNA, 25 bp, Rattus norvegicus
aatgcctctagtgatcttggtggta

SEQ ID NO: 62447 - DNA, 25 bp, Rattus norvegicus
aatgcctctcaacctgcagatttat

SEQ ID NO: 62448 - DNA, 25 bp, Rattus norvegicus
aatgcctctcaagctgcagatttat

SEQ ID NO: 62449 - DNA, 25 bp, Rattus norvegicus
aatgcctctgcaatctgaagggaca

SEQ ID NO: 62450 - DNA, 25 bp, Rattus norvegicus
aatgcctctgcattctgaagggaca

SEQ ID NO: 62451 - DNA, 25 bp, Rattus norvegicus
aatgcctctgtaaagattggtgtca

SEQ ID NO: 62452 - DNA, 25 bp, Rattus norvegicus
aatgcctctgtatagattggtgtca

SEQ ID NO: 62453 - DNA, 25 bp, Rattus norvegicus
aatgcctcttatcatggtgcccctt

SEQ ID NO: 62454 - DNA, 25 bp, Rattus norvegicus
aatgcctcttatgatggtgcccctt

SEQ ID NO: 62455 - DNA, 25 bp, Rattus norvegicus
aatgcctcttgcatctgttttctag

SEQ ID NO: 62456 - DNA, 25 bp, Rattus norvegicus
aatgcctcttgcttctgttttctag

SEQ ID NO: 62457 - DNA, 25 bp, Rattus norvegicus
aatgcctcttggattgcaaaacttt

SEQ ID NO: 62458 - DNA, 25 bp, Rattus norvegicus
aatgcctcttggtttgcaaaacttt

SEQ ID NO: 62459 - DNA, 25 bp, Rattus norvegicus
aatgcctgcataagatccagttgta

SEQ ID NO: 62460 - DNA, 25 bp, Rattus norvegicus
aatgcctgcatatgatccagttgta

SEQ ID NO: 62461 - DNA, 25 bp, Rattus norvegicus
aatgcctgcctgcaaattccaggtg

SEQ ID NO: 62462 - DNA, 25 bp, Rattus norvegicus
aatgcctgcctggaaattccaggtg

SEQ ID NO: 62463 - DNA, 25 bp, Rattus norvegicus
aatgcctgctacatggaggagatga

SEQ ID NO: 62464 - DNA, 25 bp, Rattus norvegicus
aatgcctgctacttggaggagatga

SEQ ID NO: 62465 - DNA, 25 bp, Rattus norvegicus
aatgcctgctcgattatatagaaaa

SEQ ID NO: 62466 - DNA, 25 bp, Rattus norvegicus
aatgcctgctcgtttatatagaaaa

SEQ ID NO: 62467 - DNA, 25 bp, Rattus norvegicus
aatgcctgctttctagtggatcatc

SEQ ID NO: 62468 - DNA, 25 bp, Rattus norvegicus
aatgcctgctttgtagtggatcatc

SEQ ID NO: 62469 - DNA, 25 bp, Rattus norvegicus
aatgcctggagacggctcttgctaa

SEQ ID NO: 62470 - DNA, 25 bp, Rattus norvegicus
aatgcctggagagggctcttgctaa

SEQ ID NO: 62471 - DNA, 25 bp, Rattus norvegicus
aatgcctggcacacggcacagcgta

SEQ ID NO: 62472 - DNA, 25 bp, Rattus norvegicus
aatgcctggcacactggtaaatgat

SEQ ID NO: 62473 - DNA, 25 bp, Rattus norvegicus
aatgcctggcactcggcacagcgta

SEQ ID NO: 62474 - DNA, 25 bp, Rattus norvegicus
aatgcctggcactctggtaaatgat

SEQ ID NO: 62475 - DNA, 25 bp, Rattus norvegicus
aatgcctggcctcgtagctccgctt

SEQ ID NO: 62476 - DNA, 25 bp, Rattus norvegicus
aatgcctggcctggtagctccgctt

SEQ ID NO: 62477 - DNA, 25 bp, Rattus norvegicus
aatgcctgggagatttgtttcctgc

SEQ ID NO: 62478 - DNA, 25 bp, Rattus norvegicus
aatgcctgggagttttgtttcctgc

SEQ ID NO: 62479 - DNA, 25 bp, Rattus norvegicus
aatgcctgggcaagtgtatcagaag

SEQ ID NO: 62480 - DNA, 25 bp, Rattus norvegicus
aatgcctgggcatgtgtatcagaag

SEQ ID NO: 62481 - DNA, 25 bp, Rattus norvegicus
aatgcctgtaccctgtttgacagtt

SEQ ID NO: 62482 - DNA, 25 bp, Rattus norvegicus
aatgcctgtaccgtgtttgacagtt

SEQ ID NO: 62483 - DNA, 25 bp, Rattus norvegicus
aatgcctgtactctgaaagcctgcc

SEQ ID NO: 62484 - DNA, 25 bp, Rattus norvegicus
aatgcctgtactgtgaaagcctgcc

SEQ ID NO: 62485 - DNA, 25 bp, Rattus norvegicus
aatgcctgtcagctatgtctgtaag

SEQ ID NO: 62486 - DNA, 25 bp, Rattus norvegicus
aatgcctgtcaggtatgtctgtaag

SEQ ID NO: 62487 - DNA, 25 bp, Rattus norvegicus
aatgcctgtgacaagcccattggac

SEQ ID NO: 62488 - DNA, 25 bp, Rattus norvegicus
aatgcctgtgactagcccattggac

SEQ ID NO: 62489 - DNA, 25 bp, Rattus norvegicus
aatgcctgtgagacttaccagtgca

SEQ ID NO: 62490 - DNA, 25 bp, Rattus norvegicus
aatgcctgtgagtcttaccagtgca

SEQ ID NO: 62491 - DNA, 25 bp, Rattus norvegicus
aatgcctgtggcattaccaacctgg

SEQ ID NO: 62492 - DNA, 25 bp, Rattus norvegicus
aatgcctgtggctttaccaacctgg

SEQ ID NO: 62493 - DNA, 25 bp, Rattus norvegicus
aatgcctgtgtcagaactactgtaa

SEQ ID NO: 62494 - DNA, 25 bp, Rattus norvegicus
aatgcctgtgtctgaactactgtaa

SEQ ID NO: 62495 - DNA, 25 bp, Rattus norvegicus
aatgccttacgtacattcctttctc

SEQ ID NO: 62496 - DNA, 25 bp, Rattus norvegicus
aatgccttacgttcattcctttctc

SEQ ID NO: 62497 - DNA, 25 bp, Rattus norvegicus
aatgccttagcaacagtgacctttg

SEQ ID NO: 62498 - DNA, 25 bp, Rattus norvegicus
aatgccttagcacccttcgtgagac

SEQ ID NO: 62499 - DNA, 25 bp, Rattus norvegicus
aatgccttagcagccttcgtgagac

SEQ ID NO: 62500 - DNA, 25 bp, Rattus norvegicus
aatgccttagcatcagtgacctttg

SEQ ID NO: 62501 - DNA, 25 bp, Rattus norvegicus
aatgccttagccagtttctagactc

SEQ ID NO: 62502 - DNA, 25 bp, Rattus norvegicus
aatgccttagcctgtttctagactc

SEQ ID NO: 62503 - DNA, 25 bp, Rattus norvegicus
aatgccttcaatatccctttttctg

SEQ ID NO: 62504 - DNA, 25 bp, Rattus norvegicus
aatgccttcaatttccctttttctg

SEQ ID NO: 62505 - DNA, 25 bp, Rattus norvegicus
aatgccttcatactgatgtgcaccc

SEQ ID NO: 62506 - DNA, 25 bp, Rattus norvegicus
aatgccttcatagtgatgtgcaccc

SEQ ID NO: 62507 - DNA, 25 bp, Rattus norvegicus
aatgccttcatgacctcagtagcaa

SEQ ID NO: 62508 - DNA, 25 bp, Rattus norvegicus
aatgccttcatgtcctcagtagcaa

SEQ ID NO: 62509 - DNA, 25 bp, Rattus norvegicus
aatgccttccagaaggtaaccgaca

SEQ ID NO: 62510 - DNA, 25 bp, Rattus norvegicus
aatgccttccagtaggtaaccgaca

SEQ ID NO: 62511 - DNA, 25 bp, Rattus norvegicus
aatgccttccatcactgcaaacgac

SEQ ID NO: 62512 - DNA, 25 bp, Rattus norvegicus
aatgccttccatgactgcaaacgac

SEQ ID NO: 62513 - DNA, 25 bp, Rattus norvegicus
aatgccttctacagagatcatggac

SEQ ID NO: 62514 - DNA, 25 bp, Rattus norvegicus
aatgccttctactgagatcatggac

SEQ ID NO: 62515 - DNA, 25 bp, Rattus norvegicus
aatgccttctgccttgtaatttaat

SEQ ID NO: 62516 - DNA, 25 bp, Rattus norvegicus
aatgccttctgcgttgtaatttaat

SEQ ID NO: 62517 - DNA, 25 bp, Rattus norvegicus
aatgccttgaggaacgtcttagaaa

SEQ ID NO: 62518 - DNA, 25 bp, Rattus norvegicus
aatgccttgaggtacgtcttagaaa

SEQ ID NO: 62519 - DNA, 25 bp, Rattus norvegicus
aatgccttgagtcgagtctccatct

SEQ ID NO: 62520 - DNA, 25 bp, Rattus norvegicus
aatgccttgagtggagtctccatct

SEQ ID NO: 62521 - DNA, 25 bp, Rattus norvegicus
aatgccttgggtacgatcttgagag

SEQ ID NO: 62522 - DNA, 25 bp, Rattus norvegicus
aatgccttgggttcgatcttgagag

SEQ ID NO: 62523 - DNA, 25 bp, Rattus norvegicus
aatgccttgtttagctcactgtcaa

SEQ ID NO: 62524 - DNA, 25 bp, Rattus norvegicus
aatgccttgtttctgactgccgcac

SEQ ID NO: 62525 - DNA, 25 bp, Rattus norvegicus
aatgccttgtttgtgactgccgcac

SEQ ID NO: 62526 - DNA, 25 bp, Rattus norvegicus
aatgccttgttttgctcactgtcaa

SEQ ID NO: 62527 - DNA, 25 bp, Rattus norvegicus
aatgcctttaatacaagtagtctgc

SEQ ID NO: 62528 - DNA, 25 bp, Rattus norvegicus
aatgcctttaattcaagtagtctgc

SEQ ID NO: 62529 - DNA, 25 bp, Rattus norvegicus
aatgcctttcacacgttgtagactc

SEQ ID NO: 62530 - DNA, 25 bp, Rattus norvegicus
aatgcctttcactcgttgtagactc

SEQ ID NO: 62531 - DNA, 25 bp, Rattus norvegicus
aatgcctttgcgatttaatggatga

SEQ ID NO: 62532 - DNA, 25 bp, Rattus norvegicus
aatgcctttgcgttttaatggatga

SEQ ID NO: 62533 - DNA, 25 bp, Rattus norvegicus
aatgccttttatcatgcagccggtg

SEQ ID NO: 62534 - DNA, 25 bp, Rattus norvegicus
aatgccttttatgatgcagccggtg

SEQ ID NO: 62535 - DNA, 25 bp, Rattus norvegicus
aatgccttttctcttacccagaagt

SEQ ID NO: 62536 - DNA, 25 bp, Rattus norvegicus
aatgccttttctgttacccagaagt

SEQ ID NO: 62537 - DNA, 25 bp, Rattus norvegicus
aatgcgaaaaccagctccgagtgca

SEQ ID NO: 62538 - DNA, 25 bp, Rattus norvegicus
aatgcgaaaacctgctccgagtgca

SEQ ID NO: 62539 - DNA, 25 bp, Rattus norvegicus
aatgcgaacttaatggctcttagga

SEQ ID NO: 62540 - DNA, 25 bp, Rattus norvegicus
aatgcgaacttattggctcttagga

SEQ ID NO: 62541 - DNA, 25 bp, Rattus norvegicus
aatgcgaagcacctctttgcagaac

SEQ ID NO: 62542 - DNA, 25 bp, Rattus norvegicus
aatgcgaagcacgtctttgcagaac

SEQ ID NO: 62543 - DNA, 25 bp, Rattus norvegicus
aatgcgaatgcaaacatcatgtctg

SEQ ID NO: 62544 - DNA, 25 bp, Rattus norvegicus
aatgcgaatgcatacatcatgtctg

SEQ ID NO: 62545 - DNA, 25 bp, Rattus norvegicus
aatgcgacacatatcaaactaggta

SEQ ID NO: 62546 - DNA, 25 bp, Rattus norvegicus
aatgcgacacatttcaaactaggta

SEQ ID NO: 62547 - DNA, 25 bp, Rattus norvegicus
aatgcgacacttagtattgctggca

SEQ ID NO: 62548 - DNA, 25 bp, Rattus norvegicus
aatgcgacactttgtattgctggca

SEQ ID NO: 62549 - DNA, 25 bp, Rattus norvegicus
aatgcgacatagacagctgtgctca

SEQ ID NO: 62550 - DNA, 25 bp, Rattus norvegicus
aatgcgacatagtcagctgtgctca

SEQ ID NO: 62551 - DNA, 25 bp, Rattus norvegicus
aatgcgacccgcaggttgtggaaga

SEQ ID NO: 62552 - DNA, 25 bp, Rattus norvegicus
aatgcgacccgctggttgtggaaga

SEQ ID NO: 62553 - DNA, 25 bp, Rattus norvegicus
aatgcgactagactgccttgagctt

SEQ ID NO: 62554 - DNA, 25 bp, Rattus norvegicus
aatgcgactagagtgccttgagctt

SEQ ID NO: 62555 - DNA, 25 bp, Rattus norvegicus
aatgcgactcgtaatgggtgttatc

SEQ ID NO: 62556 - DNA, 25 bp, Rattus norvegicus
aatgcgactcgttatgggtgttatc

SEQ ID NO: 62557 - DNA, 25 bp, Rattus norvegicus
aatgcgactctacaaatccctggga

SEQ ID NO: 62558 - DNA, 25 bp, Rattus norvegicus
aatgcgactctagaaatccctggga

SEQ ID NO: 62559 - DNA, 25 bp, Rattus norvegicus
aatgcgagagctatgaacactagac

SEQ ID NO: 62560 - DNA, 25 bp, Rattus norvegicus
aatgcgagagctttgaacactagac

SEQ ID NO: 62561 - DNA, 25 bp, Rattus norvegicus
aatgcgagaggcagccctgaacaac

SEQ ID NO: 62562 - DNA, 25 bp, Rattus norvegicus
aatgcgagaggctgccctgaacaac

SEQ ID NO: 62563 - DNA, 25 bp, Rattus norvegicus
aatgcgagccggctgttccagtgtc

SEQ ID NO: 62564 - DNA, 25 bp, Rattus norvegicus
aatgcgagccgggtgttccagtgtc

SEQ ID NO: 62565 - DNA, 25 bp, Rattus norvegicus
aatgcgcacactcatgaagttcttc

SEQ ID NO: 62566 - DNA, 25 bp, Rattus norvegicus
aatgcgcacactgatgaagttcttc

SEQ ID NO: 62567 - DNA, 25 bp, Rattus norvegicus
aatgcgcagaaactttcgcttccag

SEQ ID NO: 62568 - DNA, 25 bp, Rattus norvegicus
aatgcgcagaaagtttcgcttccag

SEQ ID NO: 62569 - DNA, 25 bp, Rattus norvegicus
aatgcgcagatcagcttggtccagt

SEQ ID NO: 62570 - DNA, 25 bp, Rattus norvegicus
aatgcgcagatctgcttggtccagt

SEQ ID NO: 62571 - DNA, 25 bp, Rattus norvegicus
aatgcgcagtgtcgaaagcccgtga

SEQ ID NO: 62572 - DNA, 25 bp, Rattus norvegicus
aatgcgcagtgtggaaagcccgtga

SEQ ID NO: 62573 - DNA, 25 bp, Rattus norvegicus
aatgcgccagctccggctaggtcta

SEQ ID NO: 62574 - DNA, 25 bp, Rattus norvegicus
aatgcgccagctgcggctaggtcta

SEQ ID NO: 62575 - DNA, 25 bp, Rattus norvegicus
aatgcgccttccagtgtcgtggtga

SEQ ID NO: 62576 - DNA, 25 bp, Rattus norvegicus
aatgcgccttcctgtgtcgtggtga

SEQ ID NO: 62577 - DNA, 25 bp, Rattus norvegicus
aatgcgcgctgtctcaacactgatg

SEQ ID NO: 62578 - DNA, 25 bp, Rattus norvegicus
aatgcgcgctgtgtcaacactgatg

SEQ ID NO: 62579 - DNA, 25 bp, Rattus norvegicus
aatgcgcggagtagagcatcctcct

SEQ ID NO: 62580 - DNA, 25 bp, Rattus norvegicus
aatgcgcggagttgagcatcctcct

SEQ ID NO: 62581 - DNA, 25 bp, Rattus norvegicus
aatgcgctgagaagtgtacctttta

SEQ ID NO: 62582 - DNA, 25 bp, Rattus norvegicus
aatgcgctgagatgtgtacctttta

SEQ ID NO: 62583 - DNA, 25 bp, Rattus norvegicus
aatgcgctggctccccgaggaaaaa

SEQ ID NO: 62584 - DNA, 25 bp, Rattus norvegicus
aatgcgctggctgcccgaggaaaaa

SEQ ID NO: 62585 - DNA, 25 bp, Rattus norvegicus
aatgcggacagtaacgggccagaca

SEQ ID NO: 62586 - DNA, 25 bp, Rattus norvegicus
aatgcggacagttacgggccagaca

SEQ ID NO: 62587 - DNA, 25 bp, Rattus norvegicus
aatgcggaccacattttgtgccact

SEQ ID NO: 62588 - DNA, 25 bp, Rattus norvegicus
aatgcggaccactttttgtgccact

SEQ ID NO: 62589 - DNA, 25 bp, Rattus norvegicus
aatgcggagactaagagcctttata

SEQ ID NO: 62590 - DNA, 25 bp, Rattus norvegicus
aatgcggagacttagagcctttata

SEQ ID NO: 62591 - DNA, 25 bp, Rattus norvegicus
aatgcggatcaacttaccctcccag

SEQ ID NO: 62592 - DNA, 25 bp, Rattus norvegicus
aatgcggatcaagttaccctcccag

SEQ ID NO: 62593 - DNA, 25 bp, Rattus norvegicus
aatgcggatgcccttcccaagagtc

SEQ ID NO: 62594 - DNA, 25 bp, Rattus norvegicus
aatgcggatgccgttcccaagagtc

SEQ ID NO: 62595 - DNA, 25 bp, Rattus norvegicus
aatgcggatgtaccagcagtgacca

SEQ ID NO: 62596 - DNA, 25 bp, Rattus norvegicus
aatgcggatgtagcagcagtgacca

SEQ ID NO: 62597 - DNA, 25 bp, Rattus norvegicus
aatgcggattccatacgatgtatgt

SEQ ID NO: 62598 - DNA, 25 bp, Rattus norvegicus
aatgcggattccttacgatgtatgt

SEQ ID NO: 62599 - DNA, 25 bp, Rattus norvegicus
aatgcggattcgagtggtgcaagca

SEQ ID NO: 62600 - DNA, 25 bp, Rattus norvegicus
aatgcggattcgtgtggtgcaagca

SEQ ID NO: 62601 - DNA, 25 bp, Rattus norvegicus
aatgcggcatatatttgtgtggaga

SEQ ID NO: 62602 - DNA, 25 bp, Rattus norvegicus
aatgcggcatatttttgtgtggaga

SEQ ID NO: 62603 - DNA, 25 bp, Rattus norvegicus
aatgcggccctgctcagaacaagaa

SEQ ID NO: 62604 - DNA, 25 bp, Rattus norvegicus
aatgcggccctggtcagaacaagaa

SEQ ID NO: 62605 - DNA, 25 bp, Rattus norvegicus
aatgcggcgaagacaagcttcctcc

SEQ ID NO: 62606 - DNA, 25 bp, Rattus norvegicus
aatgcggcgaagtcaagcttcctcc

SEQ ID NO: 62607 - DNA, 25 bp, Rattus norvegicus
aatgcggctgctatcggagcagagt

SEQ ID NO: 62608 - DNA, 25 bp, Rattus norvegicus
aatgcggctgctttcggagcagagt

SEQ ID NO: 62609 - DNA, 25 bp, Rattus norvegicus
aatgcggctgtcattaagtgaagac

SEQ ID NO: 62610 - DNA, 25 bp, Rattus norvegicus
aatgcggctgtctttaagtgaagac

SEQ ID NO: 62611 - DNA, 25 bp, Rattus norvegicus
aatgcgggcctgatgttgcttagct

SEQ ID NO: 62612 - DNA, 25 bp, Rattus norvegicus
aatgcgggcctgttgttgcttagct

SEQ ID NO: 62613 - DNA, 25 bp, Rattus norvegicus
aatgcgggctccagggctgtgcact

SEQ ID NO: 62614 - DNA, 25 bp, Rattus norvegicus
aatgcgggctcctgggctgtgcact

SEQ ID NO: 62615 - DNA, 25 bp, Rattus norvegicus
aatgcgggtgacaagggttcggaag

SEQ ID NO: 62616 - DNA, 25 bp, Rattus norvegicus
aatgcgggtgactagggttcggaag

SEQ ID NO: 62617 - DNA, 25 bp, Rattus norvegicus
aatgcgggtgcgatctgtctgtctc

SEQ ID NO: 62618 - DNA, 25 bp, Rattus norvegicus
aatgcgggtgcgttctgtctgtctc

SEQ ID NO: 62619 - DNA, 25 bp, Rattus norvegicus
aatgcggtgaacctgttcctgggcc

SEQ ID NO: 62620 - DNA, 25 bp, Rattus norvegicus
aatgcggtgaacgtgttcctgggcc

SEQ ID NO: 62621 - DNA, 25 bp, Rattus norvegicus
aatgcggtggccagttcacggatca

SEQ ID NO: 62622 - DNA, 25 bp, Rattus norvegicus
aatgcggtggcctgttcacggatca

SEQ ID NO: 62623 - DNA, 25 bp, Rattus norvegicus
aatgcgtaagcacaacacccctgac

SEQ ID NO: 62624 - DNA, 25 bp, Rattus norvegicus
aatgcgtaagcagaacacccctgac

SEQ ID NO: 62625 - DNA, 25 bp, Rattus norvegicus
aatgcgtatttcatgaagccggaac

SEQ ID NO: 62626 - DNA, 25 bp, Rattus norvegicus
aatgcgtatttcttgaagccggaac

SEQ ID NO: 62627 - DNA, 25 bp, Rattus norvegicus
aatgcgtccaccaagaccctaagat

SEQ ID NO: 62628 - DNA, 25 bp, Rattus norvegicus
aatgcgtccacctagaccctaagat

SEQ ID NO: 62629 - DNA, 25 bp, Rattus norvegicus
aatgcgtccataacagggtcaactg

SEQ ID NO: 62630 - DNA, 25 bp, Rattus norvegicus
aatgcgtccatatcagggtcaactg

SEQ ID NO: 62631 - DNA, 25 bp, Rattus norvegicus
aatgcgtctacgacaatgaacccag

SEQ ID NO: 62632 - DNA, 25 bp, Rattus norvegicus
aatgcgtctacgtcaatgaacccag

SEQ ID NO: 62633 - DNA, 25 bp, Rattus norvegicus
aatgcgtctcagcttctatatctgt

SEQ ID NO: 62634 - DNA, 25 bp, Rattus norvegicus
aatgcgtctcaggttctatatctgt

SEQ ID NO: 62635 - DNA, 25 bp, Rattus norvegicus
aatgcgtctgcaattgctatgaaga

SEQ ID NO: 62636 - DNA, 25 bp, Rattus norvegicus
aatgcgtctgcatttgctatgaaga

SEQ ID NO: 62637 - DNA, 25 bp, Rattus norvegicus
aatgcgtgactgcacttagctgtga

SEQ ID NO: 62638 - DNA, 25 bp, Rattus norvegicus
aatgcgtgactggacttagctgtga

SEQ ID NO: 62639 - DNA, 25 bp, Rattus norvegicus
aatgcgtgagtgctggtatgccaac

SEQ ID NO: 62640 - DNA, 25 bp, Rattus norvegicus
aatgcgtgagtggtggtatgccaac

SEQ ID NO: 62641 - DNA, 25 bp, Rattus norvegicus
aatgcgtgcataccacttttgttct

SEQ ID NO: 62642 - DNA, 25 bp, Rattus norvegicus
aatgcgtgcatagcacttttgttct

SEQ ID NO: 62643 - DNA, 25 bp, Rattus norvegicus
aatgcgtgctatatccagcagtgct

SEQ ID NO: 62644 - DNA, 25 bp, Rattus norvegicus
aatgcgtgctatttccagcagtgct

SEQ ID NO: 62645 - DNA, 25 bp, Rattus norvegicus
aatgcgttcgcaagctgtgacacag

SEQ ID NO: 62646 - DNA, 25 bp, Rattus norvegicus
aatgcgttcgcatgctgtgacacag

SEQ ID NO: 62647 - DNA, 25 bp, Rattus norvegicus
aatgcgtttctaactgggcactaaa

SEQ ID NO: 62648 - DNA, 25 bp, Rattus norvegicus
aatgcgtttctatctgggcactaaa

SEQ ID NO: 62649 - DNA, 25 bp, Rattus norvegicus
aatgctaacgcactccttggacaaa

SEQ ID NO: 62650 - DNA, 25 bp, Rattus norvegicus
aatgctaacgcagtccttggacaaa

SEQ ID NO: 62651 - DNA, 25 bp, Rattus norvegicus
aatgctaactacatcagtcctcaca

SEQ ID NO: 62652 - DNA, 25 bp, Rattus norvegicus
aatgctaactacatctctagtaaat

SEQ ID NO: 62653 - DNA, 25 bp, Rattus norvegicus
aatgctaactacttcagtcctcaca

SEQ ID NO: 62654 - DNA, 25 bp, Rattus norvegicus
aatgctaactacttctctagtaaat

SEQ ID NO: 62655 - DNA, 25 bp, Rattus norvegicus
aatgctaagagaatcctttcctaga

SEQ ID NO: 62656 - DNA, 25 bp, Rattus norvegicus
aatgctaagagattcctttcctaga

SEQ ID NO: 62657 - DNA, 25 bp, Rattus norvegicus
aatgctaagcccagaggagtactca

SEQ ID NO: 62658 - DNA, 25 bp, Rattus norvegicus
aatgctaagccctgaggagtactca

SEQ ID NO: 62659 - DNA, 25 bp, Rattus norvegicus
aatgctaagcctcagttcctagtta

SEQ ID NO: 62660 - DNA, 25 bp, Rattus norvegicus
aatgctaagcctgagttcctagtta

SEQ ID NO: 62661 - DNA, 25 bp, Rattus norvegicus
aatgctaaggaactgtatgtctgta

SEQ ID NO: 62662 - DNA, 25 bp, Rattus norvegicus
aatgctaaggaagtgtatgtctgta

SEQ ID NO: 62663 - DNA, 25 bp, Rattus norvegicus
aatgctaatcatatcccatggaaga

SEQ ID NO: 62664 - DNA, 25 bp, Rattus norvegicus
aatgctaatcatttcccatggaaga

SEQ ID NO: 62665 - DNA, 25 bp, Rattus norvegicus
aatgctaatgccacccattaaagga

SEQ ID NO: 62666 - DNA, 25 bp, Rattus norvegicus
aatgctaatgcctcccattaaagga

SEQ ID NO: 62667 - DNA, 25 bp, Rattus norvegicus
aatgctacacatccgtctagttcaa

SEQ ID NO: 62668 - DNA, 25 bp, Rattus norvegicus
aatgctacacatgcgtctagttcaa

SEQ ID NO: 62669 - DNA, 25 bp, Rattus norvegicus
aatgctacagcgcaagaaggaggaa

SEQ ID NO: 62670 - DNA, 25 bp, Rattus norvegicus
aatgctacagcggaagaaggaggaa

SEQ ID NO: 62671 - DNA, 25 bp, Rattus norvegicus
aatgctacatagaaggatactgact

SEQ ID NO: 62672 - DNA, 25 bp, Rattus norvegicus
aatgctacatagtaggatactgact

SEQ ID NO: 62673 - DNA, 25 bp, Rattus norvegicus
aatgctacatttctctttcaacgga

SEQ ID NO: 62674 - DNA, 25 bp, Rattus norvegicus
aatgctacatttgtctttcaacgga

SEQ ID NO: 62675 - DNA, 25 bp, Rattus norvegicus
aatgctaccagtcttcctctaggaa

SEQ ID NO: 62676 - DNA, 25 bp, Rattus norvegicus
aatgctaccagtgttcctctaggaa

SEQ ID NO: 62677 - DNA, 25 bp, Rattus norvegicus
aatgctaccctgatgctttgtgaat

SEQ ID NO: 62678 - DNA, 25 bp, Rattus norvegicus
aatgctaccctgcttttgctggtgt

SEQ ID NO: 62679 - DNA, 25 bp, Rattus norvegicus
aatgctaccctggttttgctggtgt

SEQ ID NO: 62680 - DNA, 25 bp, Rattus norvegicus
aatgctaccctgttgctttgtgaat

SEQ ID NO: 62681 - DNA, 25 bp, Rattus norvegicus
aatgctacgagcaaaggaaccaaca

SEQ ID NO: 62682 - DNA, 25 bp, Rattus norvegicus
aatgctacgagctaaggaaccaaca

SEQ ID NO: 62683 - DNA, 25 bp, Rattus norvegicus
aatgctactaacaagctgacagtca

SEQ ID NO: 62684 - DNA, 25 bp, Rattus norvegicus
aatgctactaactagctgacagtca

SEQ ID NO: 62685 - DNA, 25 bp, Rattus norvegicus
aatgctactcacaggattttgcaga

SEQ ID NO: 62686 - DNA, 25 bp, Rattus norvegicus
aatgctactcactggattttgcaga

SEQ ID NO: 62687 - DNA, 25 bp, Rattus norvegicus
aatgctactcccactaaaacaacga

SEQ ID NO: 62688 - DNA, 25 bp, Rattus norvegicus
aatgctactccctctaaaacaacga

SEQ ID NO: 62689 - DNA, 25 bp, Rattus norvegicus
aatgctactggcactcgagttacag

SEQ ID NO: 62690 - DNA, 25 bp, Rattus norvegicus
aatgctactggctctcgagttacag

SEQ ID NO: 62691 - DNA, 25 bp, Rattus norvegicus
aatgctactgtccaagcgcaaagtc

SEQ ID NO: 62692 - DNA, 25 bp, Rattus norvegicus
aatgctactgtcgaagcgcaaagtc

SEQ ID NO: 62693 - DNA, 25 bp, Rattus norvegicus
aatgctagaaacctgatgagtggcc

SEQ ID NO: 62694 - DNA, 25 bp, Rattus norvegicus
aatgctagaaacgtgatgagtggcc

SEQ ID NO: 62695 - DNA, 25 bp, Rattus norvegicus
aatgctagagaacctgagcctttaa

SEQ ID NO: 62696 - DNA, 25 bp, Rattus norvegicus
aatgctagagaagctgagcctttaa

SEQ ID NO: 62697 - DNA, 25 bp, Rattus norvegicus
aatgctagccaactcgtggagctgc

SEQ ID NO: 62698 - DNA, 25 bp, Rattus norvegicus
aatgctagccaagtcgtggagctgc

SEQ ID NO: 62699 - DNA, 25 bp, Rattus norvegicus
aatgctaggactatgccctgggata

SEQ ID NO: 62700 - DNA, 25 bp, Rattus norvegicus
aatgctaggactttgccctgggata

SEQ ID NO: 62701 - DNA, 25 bp, Rattus norvegicus
aatgctagtgtgatgctcacttcat

SEQ ID NO: 62702 - DNA, 25 bp, Rattus norvegicus
aatgctagtgtgttgctcacttcat

SEQ ID NO: 62703 - DNA, 25 bp, Rattus norvegicus
aatgctatacccagtgcctcagttt

SEQ ID NO: 62704 - DNA, 25 bp, Rattus norvegicus
aatgctataccctgtgcctcagttt

SEQ ID NO: 62705 - DNA, 25 bp, Rattus norvegicus
aatgctatcatcattcacctgaagt

SEQ ID NO: 62706 - DNA, 25 bp, Rattus norvegicus
aatgctatcatctttcacctgaagt

SEQ ID NO: 62707 - DNA, 25 bp, Rattus norvegicus
aatgctatccctagttaccttataa

SEQ ID NO: 62708 - DNA, 25 bp, Rattus norvegicus
aatgctatcccttgttaccttataa

SEQ ID NO: 62709 - DNA, 25 bp, Rattus norvegicus
aatgctatcgagatgtctgtagaac

SEQ ID NO: 62710 - DNA, 25 bp, Rattus norvegicus
aatgctatcgagttgtctgtagaac

SEQ ID NO: 62711 - DNA, 25 bp, Rattus norvegicus
aatgctatctatcatgtgtctcaca

SEQ ID NO: 62712 - DNA, 25 bp, Rattus norvegicus
aatgctatctatgatgtgtctcaca

SEQ ID NO: 62713 - DNA, 25 bp, Rattus norvegicus
aatgctatctctatcttaatcttaa

SEQ ID NO: 62714 - DNA, 25 bp, Rattus norvegicus
aatgctatctctttcttaatcttaa

SEQ ID NO: 62715 - DNA, 25 bp, Rattus norvegicus
aatgctatgcaacggacgtggagaa

SEQ ID NO: 62716 - DNA, 25 bp, Rattus norvegicus
aatgctatgcaagggacgtggagaa

SEQ ID NO: 62717 - DNA, 25 bp, Rattus norvegicus
aatgctatgcacagaggatacacaa

SEQ ID NO: 62718 - DNA, 25 bp, Rattus norvegicus
aatgctatgcactgaggatacacaa

SEQ ID NO: 62719 - DNA, 25 bp, Rattus norvegicus
aatgctatgctgcttcttttacctt

SEQ ID NO: 62720 - DNA, 25 bp, Rattus norvegicus
aatgctatgctggttcttttacctt

SEQ ID NO: 62721 - DNA, 25 bp, Rattus norvegicus
aatgctatgcttatgcaagcgcaag

SEQ ID NO: 62722 - DNA, 25 bp, Rattus norvegicus
aatgctatgcttttgcaagcgcaag

SEQ ID NO: 62723 - DNA, 25 bp, Rattus norvegicus
aatgctattgacagaatgcccacca

SEQ ID NO: 62724 - DNA, 25 bp, Rattus norvegicus
aatgctattgacaggattctgaact

SEQ ID NO: 62725 - DNA, 25 bp, Rattus norvegicus
aatgctattgactgaatgcccacca

SEQ ID NO: 62726 - DNA, 25 bp, Rattus norvegicus
aatgctattgactggattctgaact

SEQ ID NO: 62727 - DNA, 25 bp, Rattus norvegicus
aatgctatttgtcctattacccttc

SEQ ID NO: 62728 - DNA, 25 bp, Rattus norvegicus
aatgctatttgtgctattacccttc

SEQ ID NO: 62729 - DNA, 25 bp, Rattus norvegicus
aatgctcaactgacttggcttagcc

SEQ ID NO: 62730 - DNA, 25 bp, Rattus norvegicus
aatgctcaactgtcttggcttagcc

SEQ ID NO: 62731 - DNA, 25 bp, Rattus norvegicus
aatgctcaagagatctaattccatc

SEQ ID NO: 62732 - DNA, 25 bp, Rattus norvegicus
aatgctcaagagttctaattccatc

SEQ ID NO: 62733 - DNA, 25 bp, Rattus norvegicus
aatgctcacatcagagggcgtcctg

SEQ ID NO: 62734 - DNA, 25 bp, Rattus norvegicus
aatgctcacatctgagggcgtcctg

SEQ ID NO: 62735 - DNA, 25 bp, Rattus norvegicus
aatgctcacattatctagtccacaa

SEQ ID NO: 62736 - DNA, 25 bp, Rattus norvegicus
aatgctcacattttctagtccacaa

SEQ ID NO: 62737 - DNA, 25 bp, Rattus norvegicus
aatgctcagaatcgttgctctttag

SEQ ID NO: 62738 - DNA, 25 bp, Rattus norvegicus
aatgctcagaatggttgctctttag

SEQ ID NO: 62739 - DNA, 25 bp, Rattus norvegicus
aatgctcagacgaagaccttttcct

SEQ ID NO: 62740 - DNA, 25 bp, Rattus norvegicus
aatgctcagacgtagaccttttcct

SEQ ID NO: 62741 - DNA, 25 bp, Rattus norvegicus
aatgctcagattaggcttatttccc

SEQ ID NO: 62742 - DNA, 25 bp, Rattus norvegicus
aatgctcagatttggcttatttccc

SEQ ID NO: 62743 - DNA, 25 bp, Rattus norvegicus
aatgctcagcagaggcaacttgaac

SEQ ID NO: 62744 - DNA, 25 bp, Rattus norvegicus
aatgctcagcagtggcaacttgaac

SEQ ID NO: 62745 - DNA, 25 bp, Rattus norvegicus
aatgctcagcgtacatgttgttgga

SEQ ID NO: 62746 - DNA, 25 bp, Rattus norvegicus
aatgctcagcgttcatgttgttgga

SEQ ID NO: 62747 - DNA, 25 bp, Rattus norvegicus
aatgctcaggagcaatcttggctat

SEQ ID NO: 62748 - DNA, 25 bp, Rattus norvegicus
aatgctcaggaggaatcttggctat

SEQ ID NO: 62749 - DNA, 25 bp, Rattus norvegicus
aatgctcaggttctcatgggtgtta

SEQ ID NO: 62750 - DNA, 25 bp, Rattus norvegicus
aatgctcaggttgtcatgggtgtta

SEQ ID NO: 62751 - DNA, 25 bp, Rattus norvegicus
aatgctcagtaaattagctcttgct

SEQ ID NO: 62752 - DNA, 25 bp, Rattus norvegicus
aatgctcagtaatttagctcttgct

SEQ ID NO: 62753 - DNA, 25 bp, Rattus norvegicus
aatgctcataccagcagtgttgact

SEQ ID NO: 62754 - DNA, 25 bp, Rattus norvegicus
aatgctcatacctgcagtgttgact

SEQ ID NO: 62755 - DNA, 25 bp, Rattus norvegicus
aatgctcatctgcaaccagtttggt

SEQ ID NO: 62756 - DNA, 25 bp, Rattus norvegicus
aatgctcatctggaaccagtttggt

SEQ ID NO: 62757 - DNA, 25 bp, Rattus norvegicus
aatgctccaaatatgtctcctttag

SEQ ID NO: 62758 - DNA, 25 bp, Rattus norvegicus
aatgctccaaatttgtctcctttag

SEQ ID NO: 62759 - DNA, 25 bp, Rattus norvegicus
aatgctccacagaacttgaaagata

SEQ ID NO: 62760 - DNA, 25 bp, Rattus norvegicus
aatgctccacagtacttgaaagata

SEQ ID NO: 62761 - DNA, 25 bp, Rattus norvegicus
aatgctcccaggaagccgggcagat

SEQ ID NO: 62762 - DNA, 25 bp, Rattus norvegicus
aatgctcccaggtagccgggcagat

SEQ ID NO: 62763 - DNA, 25 bp, Rattus norvegicus
aatgctcccagtatattttctcaaa

SEQ ID NO: 62764 - DNA, 25 bp, Rattus norvegicus
aatgctcccagtttattttctcaaa

SEQ ID NO: 62765 - DNA, 25 bp, Rattus norvegicus
aatgctcccataaggccaggctgca

SEQ ID NO: 62766 - DNA, 25 bp, Rattus norvegicus
aatgctcccatatggccaggctgca

SEQ ID NO: 62767 - DNA, 25 bp, Rattus norvegicus
aatgctcccatccaggtggtccaaa

SEQ ID NO: 62768 - DNA, 25 bp, Rattus norvegicus
aatgctcccatcgaggtggtccaaa

SEQ ID NO: 62769 - DNA, 25 bp, Rattus norvegicus
aatgctcccattaactgctttaagg

SEQ ID NO: 62770 - DNA, 25 bp, Rattus norvegicus
aatgctcccatttactgctttaagg

SEQ ID NO: 62771 - DNA, 25 bp, Rattus norvegicus
aatgctcccctgcaggtgactgagg

SEQ ID NO: 62772 - DNA, 25 bp, Rattus norvegicus
aatgctcccctggaggtgactgagg

SEQ ID NO: 62773 - DNA, 25 bp, Rattus norvegicus
aatgctccgccaaagggagtggctc

SEQ ID NO: 62774 - DNA, 25 bp, Rattus norvegicus
aatgctccgccatagggagtggctc

SEQ ID NO: 62775 - DNA, 25 bp, Rattus norvegicus
aatgctccggacacagcctgtgtga

SEQ ID NO: 62776 - DNA, 25 bp, Rattus norvegicus
aatgctccggactcagcctgtgtga

SEQ ID NO: 62777 - DNA, 25 bp, Rattus norvegicus
aatgctccggagattgacgcgtcca

SEQ ID NO: 62778 - DNA, 25 bp, Rattus norvegicus
aatgctccggagtttgacgcgtcca

SEQ ID NO: 62779 - DNA, 25 bp, Rattus norvegicus
aatgctcctgagcactgtgtggctt

SEQ ID NO: 62780 - DNA, 25 bp, Rattus norvegicus
aatgctcctgaggactgtgtggctt

SEQ ID NO: 62781 - DNA, 25 bp, Rattus norvegicus
aatgctcctggaatgtcctgctgaa

SEQ ID NO: 62782 - DNA, 25 bp, Rattus norvegicus
aatgctcctggattgtcctgctgaa

SEQ ID NO: 62783 - DNA, 25 bp, Rattus norvegicus
aatgctccttaaactgataccctga

SEQ ID NO: 62784 - DNA, 25 bp, Rattus norvegicus
aatgctccttaatctgataccctga

SEQ ID NO: 62785 - DNA, 25 bp, Rattus norvegicus
aatgctccttatattggctctgtgg

SEQ ID NO: 62786 - DNA, 25 bp, Rattus norvegicus
aatgctccttattttggctctgtgg

SEQ ID NO: 62787 - DNA, 25 bp, Rattus norvegicus
aatgctccttgcagtttcctgatga

SEQ ID NO: 62788 - DNA, 25 bp, Rattus norvegicus
aatgctccttgctgtttcctgatga

SEQ ID NO: 62789 - DNA, 25 bp, Rattus norvegicus
aatgctcctttaatgcctgtttatg

SEQ ID NO: 62790 - DNA, 25 bp, Rattus norvegicus
aatgctcctttattgcctgtttatg

SEQ ID NO: 62791 - DNA, 25 bp, Rattus norvegicus
aatgctcgaccccaattacaccatg

SEQ ID NO: 62792 - DNA, 25 bp, Rattus norvegicus
aatgctcgacccgaattacaccatg

SEQ ID NO: 62793 - DNA, 25 bp, Rattus norvegicus
aatgctcgctggctcgaggctcgca

SEQ ID NO: 62794 - DNA, 25 bp, Rattus norvegicus
aatgctcgctgggtcgaggctcgca

SEQ ID NO: 62795 - DNA, 25 bp, Rattus norvegicus
aatgctctaaagaccacactggctt

SEQ ID NO: 62796 - DNA, 25 bp, Rattus norvegicus
aatgctctaaagtccacactggctt

SEQ ID NO: 62797 - DNA, 25 bp, Rattus norvegicus
aatgctctacctactactctaagtt

SEQ ID NO: 62798 - DNA, 25 bp, Rattus norvegicus
aatgctctaccttctactctaagtt

SEQ ID NO: 62799 - DNA, 25 bp, Rattus norvegicus
aatgctctcagcctttgaatcaaag

SEQ ID NO: 62800 - DNA, 25 bp, Rattus norvegicus
aatgctctcagcgtttgaatcaaag

SEQ ID NO: 62801 - DNA, 25 bp, Rattus norvegicus
aatgctctccttctttaaccaaggg

SEQ ID NO: 62802 - DNA, 25 bp, Rattus norvegicus
aatgctctccttgtttaaccaaggg

SEQ ID NO: 62803 - DNA, 25 bp, Rattus norvegicus
aatgctctcggacattactgggctt

SEQ ID NO: 62804 - DNA, 25 bp, Rattus norvegicus
aatgctctcggagattactgggctt

SEQ ID NO: 62805 - DNA, 25 bp, Rattus norvegicus
aatgctctgaacagctccaagcaat

SEQ ID NO: 62806 - DNA, 25 bp, Rattus norvegicus
aatgctctgaactgctccaagcaat

SEQ ID NO: 62807 - DNA, 25 bp, Rattus norvegicus
aatgctctgcatactactttggaga

SEQ ID NO: 62808 - DNA, 25 bp, Rattus norvegicus
aatgctctgcattctactttggaga

SEQ ID NO: 62809 - DNA, 25 bp, Rattus norvegicus
aatgctctggaaaccgtcaatgctg

SEQ ID NO: 62810 - DNA, 25 bp, Rattus norvegicus
aatgctctggaatccgtcaatgctg

SEQ ID NO: 62811 - DNA, 25 bp, Rattus norvegicus
aatgctctggcactgtattttgaat

SEQ ID NO: 62812 - DNA, 25 bp, Rattus norvegicus
aatgctctggcagtgtattttgaat

SEQ ID NO: 62813 - DNA, 25 bp, Rattus norvegicus
aatgctctgggcacacaaactttgt

SEQ ID NO: 62814 - DNA, 25 bp, Rattus norvegicus
aatgctctgggctcacaaactttgt

SEQ ID NO: 62815 - DNA, 25 bp, Rattus norvegicus
aatgctctgtgcaggagtccgttca

SEQ ID NO: 62816 - DNA, 25 bp, Rattus norvegicus
aatgctctgtgctggagtccgttca

SEQ ID NO: 62817 - DNA, 25 bp, Rattus norvegicus
aatgctctgttcatactctttgttt

SEQ ID NO: 62818 - DNA, 25 bp, Rattus norvegicus
aatgctctgttcatcaaggtatgct

SEQ ID NO: 62819 - DNA, 25 bp, Rattus norvegicus
aatgctctgttcttactctttgttt

SEQ ID NO: 62820 - DNA, 25 bp, Rattus norvegicus
aatgctctgttcttcaaggtatgct

SEQ ID NO: 62821 - DNA, 25 bp, Rattus norvegicus
aatgctcttatcattgccagcacag

SEQ ID NO: 62822 - DNA, 25 bp, Rattus norvegicus
aatgctcttatctttgccagcacag

SEQ ID NO: 62823 - DNA, 25 bp, Rattus norvegicus
aatgctcttcaaattttactgtcaa

SEQ ID NO: 62824 - DNA, 25 bp, Rattus norvegicus
aatgctcttcaatttttactgtcaa

SEQ ID NO: 62825 - DNA, 25 bp, Rattus norvegicus
aatgctcttcctcggtagatctgga

SEQ ID NO: 62826 - DNA, 25 bp, Rattus norvegicus
aatgctcttcctgggtagatctgga

SEQ ID NO: 62827 - DNA, 25 bp, Rattus norvegicus
aatgctcttcgccaggaaacggcaa

SEQ ID NO: 62828 - DNA, 25 bp, Rattus norvegicus
aatgctcttcgcgaggaaacggcaa

SEQ ID NO: 62829 - DNA, 25 bp, Rattus norvegicus
aatgctcttcttaacgcacaccagg

SEQ ID NO: 62830 - DNA, 25 bp, Rattus norvegicus
aatgctcttctttacgcacaccagg

SEQ ID NO: 62831 - DNA, 25 bp, Rattus norvegicus
aatgctctttctcttgacttcccat

SEQ ID NO: 62832 - DNA, 25 bp, Rattus norvegicus
aatgctctttctgttgacttcccat

SEQ ID NO: 62833 - DNA, 25 bp, Rattus norvegicus
aatgctctttgactgcactgtgggt

SEQ ID NO: 62834 - DNA, 25 bp, Rattus norvegicus
aatgctctttgagtgcactgtgggt

SEQ ID NO: 62835 - DNA, 25 bp, Rattus norvegicus
aatgctctttgcctgcagtctatat

SEQ ID NO: 62836 - DNA, 25 bp, Rattus norvegicus
aatgctctttgcgtgcagtctatat

SEQ ID NO: 62837 - DNA, 25 bp, Rattus norvegicus
aatgctctttggcttgatgccgaag

SEQ ID NO: 62838 - DNA, 25 bp, Rattus norvegicus
aatgctctttgggttgatgccgaag

SEQ ID NO: 62839 - DNA, 25 bp, Rattus norvegicus
aatgctcttttgactgtttccttag

SEQ ID NO: 62840 - DNA, 25 bp, Rattus norvegicus
aatgctcttttgtctgtttccttag

SEQ ID NO: 62841 - DNA, 25 bp, Rattus norvegicus
aatgctgaaaatcgcttctgtgatt

SEQ ID NO: 62842 - DNA, 25 bp, Rattus norvegicus
aatgctgaaaatggcttctgtgatt

SEQ ID NO: 62843 - DNA, 25 bp, Rattus norvegicus
aatgctgaagcccagtttaccacag

SEQ ID NO: 62844 - DNA, 25 bp, Rattus norvegicus
aatgctgaagccgagtttaccacag

SEQ ID NO: 62845 - DNA, 25 bp, Rattus norvegicus
aatgctgaagctactggactttggc

SEQ ID NO: 62846 - DNA, 25 bp, Rattus norvegicus
aatgctgaagcttctggactttggc

SEQ ID NO: 62847 - DNA, 25 bp, Rattus norvegicus
aatgctgaagtccaggtttcccaca

SEQ ID NO: 62848 - DNA, 25 bp, Rattus norvegicus
aatgctgaagtcgaggtttcccaca

SEQ ID NO: 62849 - DNA, 25 bp, Rattus norvegicus
aatgctgaattgaaccctcttggag

SEQ ID NO: 62850 - DNA, 25 bp, Rattus norvegicus
aatgctgaattgtaccctcttggag

SEQ ID NO: 62851 - DNA, 25 bp, Rattus norvegicus
aatgctgaccagctgtcatccggta

SEQ ID NO: 62852 - DNA, 25 bp, Rattus norvegicus
aatgctgaccaggtgtcatccggta

SEQ ID NO: 62853 - DNA, 25 bp, Rattus norvegicus
aatgctgaccctacctagatgtgaa

SEQ ID NO: 62854 - DNA, 25 bp, Rattus norvegicus
aatgctgacccttcctagatgtgaa

SEQ ID NO: 62855 - DNA, 25 bp, Rattus norvegicus
aatgctgacctcatacgaagtgccg

SEQ ID NO: 62856 - DNA, 25 bp, Rattus norvegicus
aatgctgacctcttacgaagtgccg

SEQ ID NO: 62857 - DNA, 25 bp, Rattus norvegicus
aatgctgactatctcctacaggccc

SEQ ID NO: 62858 - DNA, 25 bp, Rattus norvegicus
aatgctgactatgtcctacaggccc

SEQ ID NO: 62859 - DNA, 25 bp, Rattus norvegicus
aatgctgagcataggaggtctctct

SEQ ID NO: 62860 - DNA, 25 bp, Rattus norvegicus
aatgctgagcattggaggtctctct

SEQ ID NO: 62861 - DNA, 25 bp, Rattus norvegicus
aatgctgagcctccgaggcctgaca

SEQ ID NO: 62862 - DNA, 25 bp, Rattus norvegicus
aatgctgagcctgcgaggcctgaca

SEQ ID NO: 62863 - DNA, 25 bp, Rattus norvegicus
aatgctgaggacacgcctgaccaga

SEQ ID NO: 62864 - DNA, 25 bp, Rattus norvegicus
aatgctgaggactcgcctgaccaga

SEQ ID NO: 62865 - DNA, 25 bp, Rattus norvegicus
aatgctgaggtgcaccctaacgtgc

SEQ ID NO: 62866 - DNA, 25 bp, Rattus norvegicus
aatgctgaggtggaccctaacgtgc

SEQ ID NO: 62867 - DNA, 25 bp, Rattus norvegicus
aatgctgagttcatccccatgcctg

SEQ ID NO: 62868 - DNA, 25 bp, Rattus norvegicus
aatgctgagttcttccccatgcctg

SEQ ID NO: 62869 - DNA, 25 bp, Rattus norvegicus
aatgctgatctccaactgtaccaaa

SEQ ID NO: 62870 - DNA, 25 bp, Rattus norvegicus
aatgctgatctcgaactgtaccaaa

SEQ ID NO: 62871 - DNA, 25 bp, Rattus norvegicus
aatgctgatgtcacctgcattgctg

SEQ ID NO: 62872 - DNA, 25 bp, Rattus norvegicus
aatgctgatgtctcctgcattgctg

SEQ ID NO: 62873 - DNA, 25 bp, Rattus norvegicus
aatgctgatgtgactctaatgttgt

SEQ ID NO: 62874 - DNA, 25 bp, Rattus norvegicus
aatgctgatgtgtctctaatgttgt

SEQ ID NO: 62875 - DNA, 25 bp, Rattus norvegicus
aatgctgatgttacaaaccgtgaca

SEQ ID NO: 62876 - DNA, 25 bp, Rattus norvegicus
aatgctgatgtttcaaaccgtgaca

SEQ ID NO: 62877 - DNA, 25 bp, Rattus norvegicus
aatgctgattcactctgatgttaat

SEQ ID NO: 62878 - DNA, 25 bp, Rattus norvegicus
aatgctgattcagtctgatgttaat

SEQ ID NO: 62879 - DNA, 25 bp, Rattus norvegicus
aatgctgattctagggatctaccct

SEQ ID NO: 62880 - DNA, 25 bp, Rattus norvegicus
aatgctgattcttgggatctaccct

SEQ ID NO: 62881 - DNA, 25 bp, Rattus norvegicus
aatgctgatttaacggactgataca

SEQ ID NO: 62882 - DNA, 25 bp, Rattus norvegicus
aatgctgatttatcggactgataca

SEQ ID NO: 62883 - DNA, 25 bp, Rattus norvegicus
aatgctgattttagactgccctcgg

SEQ ID NO: 62884 - DNA, 25 bp, Rattus norvegicus
aatgctgatttttgactgccctcgg

SEQ ID NO: 62885 - DNA, 25 bp, Rattus norvegicus
aatgctgcacacacctgtgtttgaa

SEQ ID NO: 62886 - DNA, 25 bp, Rattus norvegicus
aatgctgcacactcctgtgtttgaa

SEQ ID NO: 62887 - DNA, 25 bp, Rattus norvegicus
aatgctgcactaacagatgccacac

SEQ ID NO: 62888 - DNA, 25 bp, Rattus norvegicus
aatgctgcactatcagatgccacac

SEQ ID NO: 62889 - DNA, 25 bp, Rattus norvegicus
aatgctgcatgcattcagtgttttg

SEQ ID NO: 62890 - DNA, 25 bp, Rattus norvegicus
aatgctgcatgctttcagtgttttg

SEQ ID NO: 62891 - DNA, 25 bp, Rattus norvegicus
aatgctgcatggcttctgaaggctg

SEQ ID NO: 62892 - DNA, 25 bp, Rattus norvegicus
aatgctgcatgggttctgaaggctg

SEQ ID NO: 62893 - DNA, 25 bp, Rattus norvegicus
aatgctgccaaaccgcaaacagccg

SEQ ID NO: 62894 - DNA, 25 bp, Rattus norvegicus
aatgctgccaaagcgcaaacagccg

SEQ ID NO: 62895 - DNA, 25 bp, Rattus norvegicus
aatgctgccactccacagattgtgt

SEQ ID NO: 62896 - DNA, 25 bp, Rattus norvegicus
aatgctgccactgcacagattgtgt

SEQ ID NO: 62897 - DNA, 25 bp, Rattus norvegicus
aatgctgccattctctgcaactttg

SEQ ID NO: 62898 - DNA, 25 bp, Rattus norvegicus
aatgctgccattgtctgcaactttg

SEQ ID NO: 62899 - DNA, 25 bp, Rattus norvegicus
aatgctgcccaaacctgggacctat

SEQ ID NO: 62900 - DNA, 25 bp, Rattus norvegicus
aatgctgcccaatcctgggacctat

SEQ ID NO: 62901 - DNA, 25 bp, Rattus norvegicus
aatgctgccccgataactgggtgga

SEQ ID NO: 62902 - DNA, 25 bp, Rattus norvegicus
aatgctgccccgttaactgggtgga

SEQ ID NO: 62903 - DNA, 25 bp, Rattus norvegicus
aatgctgccgaaatggctgtgggaa

SEQ ID NO: 62904 - DNA, 25 bp, Rattus norvegicus
aatgctgccgaattggctgtgggaa

SEQ ID NO: 62905 - DNA, 25 bp, Rattus norvegicus
aatgctgccgaccaatcagagtctc

SEQ ID NO: 62906 - DNA, 25 bp, Rattus norvegicus
aatgctgccgacgaatcagagtctc

SEQ ID NO: 62907 - DNA, 25 bp, Rattus norvegicus
aatgctgccgagaatgacgtcatca

SEQ ID NO: 62908 - DNA, 25 bp, Rattus norvegicus
aatgctgccgagactggtgtacaac

SEQ ID NO: 62909 - DNA, 25 bp, Rattus norvegicus
aatgctgccgagtatgacgtcatca

SEQ ID NO: 62910 - DNA, 25 bp, Rattus norvegicus
aatgctgccgagtctggtgtacaac

SEQ ID NO: 62911 - DNA, 25 bp, Rattus norvegicus
aatgctgccgcccaatgtcatagac

SEQ ID NO: 62912 - DNA, 25 bp, Rattus norvegicus
aatgctgccgccgaatgtcatagac

SEQ ID NO: 62913 - DNA, 25 bp, Rattus norvegicus
aatgctgccgctctggcaggcacaa

SEQ ID NO: 62914 - DNA, 25 bp, Rattus norvegicus
aatgctgccgctgtggcaggcacaa

SEQ ID NO: 62915 - DNA, 25 bp, Rattus norvegicus
aatgctgccggaagcatagcgtgcg

SEQ ID NO: 62916 - DNA, 25 bp, Rattus norvegicus
aatgctgccggatgcatagcgtgcg

SEQ ID NO: 62917 - DNA, 25 bp, Rattus norvegicus
aatgctgccgtgctcttgccttgat

SEQ ID NO: 62918 - DNA, 25 bp, Rattus norvegicus
aatgctgccgtggtcttgccttgat

SEQ ID NO: 62919 - DNA, 25 bp, Rattus norvegicus
aatgctgcgttcacctagtgttaag

SEQ ID NO: 62920 - DNA, 25 bp, Rattus norvegicus
aatgctgcgttctcctagtgttaag

SEQ ID NO: 62921 - DNA, 25 bp, Rattus norvegicus
aatgctgctaatatatttccttttt

SEQ ID NO: 62922 - DNA, 25 bp, Rattus norvegicus
aatgctgctaatttatttccttttt

SEQ ID NO: 62923 - DNA, 25 bp, Rattus norvegicus
aatgctgctacacagctgctggatt

SEQ ID NO: 62924 - DNA, 25 bp, Rattus norvegicus
aatgctgctacagagctgctggatt

SEQ ID NO: 62925 - DNA, 25 bp, Rattus norvegicus
aatgctgctattcattagctgcaaa

SEQ ID NO: 62926 - DNA, 25 bp, Rattus norvegicus
aatgctgctattgattagctgcaaa

SEQ ID NO: 62927 - DNA, 25 bp, Rattus norvegicus
aatgctgctctcagagtgaacctta

SEQ ID NO: 62928 - DNA, 25 bp, Rattus norvegicus
aatgctgctctctgagtgaacctta

SEQ ID NO: 62929 - DNA, 25 bp, Rattus norvegicus
aatgctgctctgcttgatgagggaa

SEQ ID NO: 62930 - DNA, 25 bp, Rattus norvegicus
aatgctgctctggttgatgagggaa

SEQ ID NO: 62931 - DNA, 25 bp, Rattus norvegicus
aatgctgcttctctttgatgttttc

SEQ ID NO: 62932 - DNA, 25 bp, Rattus norvegicus
aatgctgcttctgtttgatgttttc

SEQ ID NO: 62933 - DNA, 25 bp, Rattus norvegicus
aatgctgctttgaccaggtgtccaa

SEQ ID NO: 62934 - DNA, 25 bp, Rattus norvegicus
aatgctgctttgatttctgtcttgt

SEQ ID NO: 62935 - DNA, 25 bp, Rattus norvegicus
aatgctgctttgtccaggtgtccaa

SEQ ID NO: 62936 - DNA, 25 bp, Rattus norvegicus
aatgctgctttgttttctgtcttgt

SEQ ID NO: 62937 - DNA, 25 bp, Rattus norvegicus
aatgctggaacaattctcctctaca

SEQ ID NO: 62938 - DNA, 25 bp, Rattus norvegicus
aatgctggaacatttctcctctaca

SEQ ID NO: 62939 - DNA, 25 bp, Rattus norvegicus
aatgctggacctaggtgctaggctt

SEQ ID NO: 62940 - DNA, 25 bp, Rattus norvegicus
aatgctggaccttggtgctaggctt

SEQ ID NO: 62941 - DNA, 25 bp, Rattus norvegicus
aatgctggactgacagccacaccag

SEQ ID NO: 62942 - DNA, 25 bp, Rattus norvegicus
aatgctggactgtcagccacaccag

SEQ ID NO: 62943 - DNA, 25 bp, Rattus norvegicus
aatgctggcaacctgtgcaacctca

SEQ ID NO: 62944 - DNA, 25 bp, Rattus norvegicus
aatgctggcaacgtgtgcaacctca

SEQ ID NO: 62945 - DNA, 25 bp, Rattus norvegicus
aatgctggcactaccaagggctgga

SEQ ID NO: 62946 - DNA, 25 bp, Rattus norvegicus
aatgctggcacttccaagggctgga

SEQ ID NO: 62947 - DNA, 25 bp, Rattus norvegicus
aatgctggcagcacacattcactgt

SEQ ID NO: 62948 - DNA, 25 bp, Rattus norvegicus
aatgctggcagctcacattcactgt

SEQ ID NO: 62949 - DNA, 25 bp, Rattus norvegicus
aatgctggcccacatctttcgatct

SEQ ID NO: 62950 - DNA, 25 bp, Rattus norvegicus
aatgctggcccagatctttcgatct

SEQ ID NO: 62951 - DNA, 25 bp, Rattus norvegicus
aatgctggctacactattgacttcc

SEQ ID NO: 62952 - DNA, 25 bp, Rattus norvegicus
aatgctggctactctattgacttcc

SEQ ID NO: 62953 - DNA, 25 bp, Rattus norvegicus
aatgctggctgacgtacggtcacga

SEQ ID NO: 62954 - DNA, 25 bp, Rattus norvegicus
aatgctggctgacttttttgccaca

SEQ ID NO: 62955 - DNA, 25 bp, Rattus norvegicus
aatgctggctgaggtacggtcacga

SEQ ID NO: 62956 - DNA, 25 bp, Rattus norvegicus
aatgctggctgagttttttgccaca

SEQ ID NO: 62957 - DNA, 25 bp, Rattus norvegicus
aatgctggcttcactgcagaggacc

SEQ ID NO: 62958 - DNA, 25 bp, Rattus norvegicus
aatgctggcttctctgcagaggacc

SEQ ID NO: 62959 - DNA, 25 bp, Rattus norvegicus
aatgctgggagtacaggatgagcct

SEQ ID NO: 62960 - DNA, 25 bp, Rattus norvegicus
aatgctgggagttcaggatgagcct

SEQ ID NO: 62961 - DNA, 25 bp, Rattus norvegicus
aatgctgggatacacaggcctggcc

SEQ ID NO: 62962 - DNA, 25 bp, Rattus norvegicus
aatgctgggatagacaggcctggcc

SEQ ID NO: 62963 - DNA, 25 bp, Rattus norvegicus
aatgctgggtaacgtgtccgtgctc

SEQ ID NO: 62964 - DNA, 25 bp, Rattus norvegicus
aatgctgggtaaggtgtccgtgctc

SEQ ID NO: 62965 - DNA, 25 bp, Rattus norvegicus
aatgctgggtctaacaagctcctag

SEQ ID NO: 62966 - DNA, 25 bp, Rattus norvegicus
aatgctgggtcttacaagctcctag

SEQ ID NO: 62967 - DNA, 25 bp, Rattus norvegicus
aatgctgggtgcatgaggcacctgc

SEQ ID NO: 62968 - DNA, 25 bp, Rattus norvegicus
aatgctgggtgcttgaggcacctgc

SEQ ID NO: 62969 - DNA, 25 bp, Rattus norvegicus
aatgctggtccaaatggagccccgg

SEQ ID NO: 62970 - DNA, 25 bp, Rattus norvegicus
aatgctggtccatatggagccccgg

SEQ ID NO: 62971 - DNA, 25 bp, Rattus norvegicus
aatgctggtggaagtccagtccttc

SEQ ID NO: 62972 - DNA, 25 bp, Rattus norvegicus
aatgctggtggatgtccagtccttc

SEQ ID NO: 62973 - DNA, 25 bp, Rattus norvegicus
aatgctggtggtaaaagtgcttgtc

SEQ ID NO: 62974 - DNA, 25 bp, Rattus norvegicus
aatgctggtggttaaagtgcttgtc

SEQ ID NO: 62975 - DNA, 25 bp, Rattus norvegicus
aatgctggtttgaggtatctttttt

SEQ ID NO: 62976 - DNA, 25 bp, Rattus norvegicus
aatgctggtttgtggtatctttttt

SEQ ID NO: 62977 - DNA, 25 bp, Rattus norvegicus
aatgctggttttatgtttgaggata

SEQ ID NO: 62978 - DNA, 25 bp, Rattus norvegicus
aatgctggttttcctgactttttgt

SEQ ID NO: 62979 - DNA, 25 bp, Rattus norvegicus
aatgctggttttgctgactttttgt

SEQ ID NO: 62980 - DNA, 25 bp, Rattus norvegicus
aatgctggttttttgtttgaggata

SEQ ID NO: 62981 - DNA, 25 bp, Rattus norvegicus
aatgctgtaaacactgcactgcagt

SEQ ID NO: 62982 - DNA, 25 bp, Rattus norvegicus
aatgctgtaaactctgcactgcagt

SEQ ID NO: 62983 - DNA, 25 bp, Rattus norvegicus
aatgctgtaattctcccagtgcggg

SEQ ID NO: 62984 - DNA, 25 bp, Rattus norvegicus
aatgctgtaattgtcccagtgcggg

SEQ ID NO: 62985 - DNA, 25 bp, Rattus norvegicus
aatgctgtacacacaagtgggctca

SEQ ID NO: 62986 - DNA, 25 bp, Rattus norvegicus
aatgctgtacactcaagtgggctca

SEQ ID NO: 62987 - DNA, 25 bp, Rattus norvegicus
aatgctgtacagaactagctgcaca

SEQ ID NO: 62988 - DNA, 25 bp, Rattus norvegicus
aatgctgtacagtactagctgcaca

SEQ ID NO: 62989 - DNA, 25 bp, Rattus norvegicus
aatgctgtacctagtgtttcacatg

SEQ ID NO: 62990 - DNA, 25 bp, Rattus norvegicus
aatgctgtaccttgtgtttcacatg

SEQ ID NO: 62991 - DNA, 25 bp, Rattus norvegicus
aatgctgtagctcgttttgtgtctg

SEQ ID NO: 62992 - DNA, 25 bp, Rattus norvegicus
aatgctgtagctggttttgtgtctg

SEQ ID NO: 62993 - DNA, 25 bp, Rattus norvegicus
aatgctgtatagcttcccgttggac

SEQ ID NO: 62994 - DNA, 25 bp, Rattus norvegicus
aatgctgtataggttcccgttggac

SEQ ID NO: 62995 - DNA, 25 bp, Rattus norvegicus
aatgctgtatctcgtgctttatcta

SEQ ID NO: 62996 - DNA, 25 bp, Rattus norvegicus
aatgctgtatctggtgctttatcta

SEQ ID NO: 62997 - DNA, 25 bp, Rattus norvegicus
aatgctgtcagtcggcaacagcctc

SEQ ID NO: 62998 - DNA, 25 bp, Rattus norvegicus
aatgctgtcagtgggcaacagcctc

SEQ ID NO: 62999 - DNA, 25 bp, Rattus norvegicus
aatgctgtctcaaaaggcaaggttg

SEQ ID NO: 63000 - DNA, 25 bp, Rattus norvegicus
aatgctgtctcataaggcaaggttg

SEQ ID NO: 63001 - DNA, 25 bp, Rattus norvegicus
aatgctgtctccacaatggaagtag

SEQ ID NO: 63002 - DNA, 25 bp, Rattus norvegicus
aatgctgtctcctcaatggaagtag

SEQ ID NO: 63003 - DNA, 25 bp, Rattus norvegicus
aatgctgtctgactgagcggtagcc

SEQ ID NO: 63004 - DNA, 25 bp, Rattus norvegicus
aatgctgtctgagtgagcggtagcc

SEQ ID NO: 63005 - DNA, 25 bp, Rattus norvegicus
aatgctgtctgcctggtgctgtttc

SEQ ID NO: 63006 - DNA, 25 bp, Rattus norvegicus
aatgctgtctgcgtggtgctgtttc

SEQ ID NO: 63007 - DNA, 25 bp, Rattus norvegicus
aatgctgtgaatctgttttcctcag

SEQ ID NO: 63008 - DNA, 25 bp, Rattus norvegicus
aatgctgtgaatgtgttttcctcag

SEQ ID NO: 63009 - DNA, 25 bp, Rattus norvegicus
aatgctgtgagtaccaggcgagcca

SEQ ID NO: 63010 - DNA, 25 bp, Rattus norvegicus
aatgctgtgagttccaggcgagcca

SEQ ID NO: 63011 - DNA, 25 bp, Rattus norvegicus
aatgctgtgatgacatgcctacggc

SEQ ID NO: 63012 - DNA, 25 bp, Rattus norvegicus
aatgctgtgatgtcatgcctacggc

SEQ ID NO: 63013 - DNA, 25 bp, Rattus norvegicus
aatgctgtgccgagctgtagaacca

SEQ ID NO: 63014 - DNA, 25 bp, Rattus norvegicus
aatgctgtgccgtgctgtagaacca

SEQ ID NO: 63015 - DNA, 25 bp, Rattus norvegicus
aatgctgtgctaaagggtgctccaa

SEQ ID NO: 63016 - DNA, 25 bp, Rattus norvegicus
aatgctgtgctatagggtgctccaa

SEQ ID NO: 63017 - DNA, 25 bp, Rattus norvegicus
aatgctgtggtcatgctggcaggct

SEQ ID NO: 63018 - DNA, 25 bp, Rattus norvegicus
aatgctgtggtcttgctggcaggct

SEQ ID NO: 63019 - DNA, 25 bp, Rattus norvegicus
aatgctgtgtagaaatttcctctga

SEQ ID NO: 63020 - DNA, 25 bp, Rattus norvegicus
aatgctgtgtagacactctgagcaa

SEQ ID NO: 63021 - DNA, 25 bp, Rattus norvegicus
aatgctgtgtagtaatttcctctga

SEQ ID NO: 63022 - DNA, 25 bp, Rattus norvegicus
aatgctgtgtagtcactctgagcaa

SEQ ID NO: 63023 - DNA, 25 bp, Rattus norvegicus
aatgctgtgttcacacatgcataga

SEQ ID NO: 63024 - DNA, 25 bp, Rattus norvegicus
aatgctgtgttccaggctaacgcca

SEQ ID NO: 63025 - DNA, 25 bp, Rattus norvegicus
aatgctgtgttcgaggctaacgcca

SEQ ID NO: 63026 - DNA, 25 bp, Rattus norvegicus
aatgctgtgttctcacatgcataga

SEQ ID NO: 63027 - DNA, 25 bp, Rattus norvegicus
aatgctgttctaataactggctggt

SEQ ID NO: 63028 - DNA, 25 bp, Rattus norvegicus
aatgctgttctattaactggctggt

SEQ ID NO: 63029 - DNA, 25 bp, Rattus norvegicus
aatgctgttctcaggaaaatatttt

SEQ ID NO: 63030 - DNA, 25 bp, Rattus norvegicus
aatgctgttctctggaaaatatttt

SEQ ID NO: 63031 - DNA, 25 bp, Rattus norvegicus
aatgctgttcttcaggtcttgggtc

SEQ ID NO: 63032 - DNA, 25 bp, Rattus norvegicus
aatgctgttcttgaggtcttgggtc

SEQ ID NO: 63033 - DNA, 25 bp, Rattus norvegicus
aatgctgttggacttcacgtcccca

SEQ ID NO: 63034 - DNA, 25 bp, Rattus norvegicus
aatgctgttggagttcacgtcccca

SEQ ID NO: 63035 - DNA, 25 bp, Rattus norvegicus
aatgctgtttacaatctactgtgac

SEQ ID NO: 63036 - DNA, 25 bp, Rattus norvegicus
aatgctgtttactatctactgtgac

SEQ ID NO: 63037 - DNA, 25 bp, Rattus norvegicus
aatgctgtttcactggttatgcggc

SEQ ID NO: 63038 - DNA, 25 bp, Rattus norvegicus
aatgctgtttcagtggttatgcggc

SEQ ID NO: 63039 - DNA, 25 bp, Rattus norvegicus
aatgctgtttctaagttcaagtcac

SEQ ID NO: 63040 - DNA, 25 bp, Rattus norvegicus
aatgctgtttctcaatgattctgct

SEQ ID NO: 63041 - DNA, 25 bp, Rattus norvegicus
aatgctgtttctgaatgattctgct

SEQ ID NO: 63042 - DNA, 25 bp, Rattus norvegicus
aatgctgtttcttagttcaagtcac

SEQ ID NO: 63043 - DNA, 25 bp, Rattus norvegicus
aatgctgttttgattacttcctgtc

SEQ ID NO: 63044 - DNA, 25 bp, Rattus norvegicus
aatgctgttttgtttacttcctgtc

SEQ ID NO: 63045 - DNA, 25 bp, Rattus norvegicus
aatgcttaaagcactcaattgggtt

SEQ ID NO: 63046 - DNA, 25 bp, Rattus norvegicus
aatgcttaaagctctcaattgggtt

SEQ ID NO: 63047 - DNA, 25 bp, Rattus norvegicus
aatgcttaaatcatccttagggagg

SEQ ID NO: 63048 - DNA, 25 bp, Rattus norvegicus
aatgcttaaatcttccttagggagg

SEQ ID NO: 63049 - DNA, 25 bp, Rattus norvegicus
aatgcttaattgacctaacttgtaa

SEQ ID NO: 63050 - DNA, 25 bp, Rattus norvegicus
aatgcttaattgtcctaacttgtaa

SEQ ID NO: 63051 - DNA, 25 bp, Rattus norvegicus
aatgcttacagcatttggctcgcca

SEQ ID NO: 63052 - DNA, 25 bp, Rattus norvegicus
aatgcttacagcttttggctcgcca

SEQ ID NO: 63053 - DNA, 25 bp, Rattus norvegicus
aatgcttagaatacctcgtcctcat

SEQ ID NO: 63054 - DNA, 25 bp, Rattus norvegicus
aatgcttagaattcctcgtcctcat

SEQ ID NO: 63055 - DNA, 25 bp, Rattus norvegicus
aatgcttaggacactgcagatgcta

SEQ ID NO: 63056 - DNA, 25 bp, Rattus norvegicus
aatgcttaggactctgcagatgcta

SEQ ID NO: 63057 - DNA, 25 bp, Rattus norvegicus
aatgcttaggtaatggtcacactta

SEQ ID NO: 63058 - DNA, 25 bp, Rattus norvegicus
aatgcttaggtattggtcacactta

SEQ ID NO: 63059 - DNA, 25 bp, Rattus norvegicus
aatgcttatgctattctactttgtt

SEQ ID NO: 63060 - DNA, 25 bp, Rattus norvegicus
aatgcttatgcttttctactttgtt

SEQ ID NO: 63061 - DNA, 25 bp, Rattus norvegicus
aatgcttatggccatctctttgtat

SEQ ID NO: 63062 - DNA, 25 bp, Rattus norvegicus
aatgcttatggcgatctctttgtat

SEQ ID NO: 63063 - DNA, 25 bp, Rattus norvegicus
aatgcttattaaacccaggagatac

SEQ ID NO: 63064 - DNA, 25 bp, Rattus norvegicus
aatgcttattaatcccaggagatac

SEQ ID NO: 63065 - DNA, 25 bp, Rattus norvegicus
aatgcttcaccacacgcggttataa

SEQ ID NO: 63066 - DNA, 25 bp, Rattus norvegicus
aatgcttcaccagacgcggttataa

SEQ ID NO: 63067 - DNA, 25 bp, Rattus norvegicus
aatgcttcagaacctaccagtcaaa

SEQ ID NO: 63068 - DNA, 25 bp, Rattus norvegicus
aatgcttcagaagctaccagtcaaa

SEQ ID NO: 63069 - DNA, 25 bp, Rattus norvegicus
aatgcttcagatcaccttctaggca

SEQ ID NO: 63070 - DNA, 25 bp, Rattus norvegicus
aatgcttcagatgaccttctaggca

SEQ ID NO: 63071 - DNA, 25 bp, Rattus norvegicus
aatgcttccaacatcgaatacggtt

SEQ ID NO: 63072 - DNA, 25 bp, Rattus norvegicus
aatgcttccaacttcgaatacggtt

SEQ ID NO: 63073 - DNA, 25 bp, Rattus norvegicus
aatgcttccatccaaaacgactttt

SEQ ID NO: 63074 - DNA, 25 bp, Rattus norvegicus
aatgcttccatcgaaaacgactttt

SEQ ID NO: 63075 - DNA, 25 bp, Rattus norvegicus
aatgcttccgtacacagattcctag

SEQ ID NO: 63076 - DNA, 25 bp, Rattus norvegicus
aatgcttccgtagacagattcctag

SEQ ID NO: 63077 - DNA, 25 bp, Rattus norvegicus
aatgcttcctaacgcaggtgtgcaa

SEQ ID NO: 63078 - DNA, 25 bp, Rattus norvegicus
aatgcttcctaaggcaggtgtgcaa

SEQ ID NO: 63079 - DNA, 25 bp, Rattus norvegicus
aatgcttcctacatggatcctggag

SEQ ID NO: 63080 - DNA, 25 bp, Rattus norvegicus
aatgcttcctacttggatcctggag

SEQ ID NO: 63081 - DNA, 25 bp, Rattus norvegicus
aatgcttcctccattcccttatgtg

SEQ ID NO: 63082 - DNA, 25 bp, Rattus norvegicus
aatgcttcctcctttcccttatgtg

SEQ ID NO: 63083 - DNA, 25 bp, Rattus norvegicus
aatgcttcctgtaagagccatagat

SEQ ID NO: 63084 - DNA, 25 bp, Rattus norvegicus
aatgcttcctgtaggctgttggcct

SEQ ID NO: 63085 - DNA, 25 bp, Rattus norvegicus
aatgcttcctgttagagccatagat

SEQ ID NO: 63086 - DNA, 25 bp, Rattus norvegicus
aatgcttcctgttggctgttggcct

SEQ ID NO: 63087 - DNA, 25 bp, Rattus norvegicus
aatgcttccttaagtgctgacagcc

SEQ ID NO: 63088 - DNA, 25 bp, Rattus norvegicus
aatgcttccttatgtgctgacagcc

SEQ ID NO: 63089 - DNA, 25 bp, Rattus norvegicus
aatgcttccttcaccggcgaacact

SEQ ID NO: 63090 - DNA, 25 bp, Rattus norvegicus
aatgcttccttctccggcgaacact

SEQ ID NO: 63091 - DNA, 25 bp, Rattus norvegicus
aatgcttctattacaaccttgatgg

SEQ ID NO: 63092 - DNA, 25 bp, Rattus norvegicus
aatgcttctatttcaaccttgatgg

SEQ ID NO: 63093 - DNA, 25 bp, Rattus norvegicus
aatgcttctccaatctactgacagc

SEQ ID NO: 63094 - DNA, 25 bp, Rattus norvegicus
aatgcttctccattctactgacagc

SEQ ID NO: 63095 - DNA, 25 bp, Rattus norvegicus
aatgcttctctaccacctatatgtc

SEQ ID NO: 63096 - DNA, 25 bp, Rattus norvegicus
aatgcttctctagcacctatatgtc

SEQ ID NO: 63097 - DNA, 25 bp, Rattus norvegicus
aatgcttctctcacctcagtaggga

SEQ ID NO: 63098 - DNA, 25 bp, Rattus norvegicus
aatgcttctctctcctcagtaggga

SEQ ID NO: 63099 - DNA, 25 bp, Rattus norvegicus
aatgcttctgtgatcacactgctga

SEQ ID NO: 63100 - DNA, 25 bp, Rattus norvegicus
aatgcttctgtgatctttgttggta

SEQ ID NO: 63101 - DNA, 25 bp, Rattus norvegicus
aatgcttctgtgttcacactgctga

SEQ ID NO: 63102 - DNA, 25 bp, Rattus norvegicus
aatgcttctgtgttctttgttggta

SEQ ID NO: 63103 - DNA, 25 bp, Rattus norvegicus
aatgcttcttacatgggacactgtc

SEQ ID NO: 63104 - DNA, 25 bp, Rattus norvegicus
aatgcttcttacttgggacactgtc

SEQ ID NO: 63105 - DNA, 25 bp, Rattus norvegicus
aatgcttcttccatagtacttgcaa

SEQ ID NO: 63106 - DNA, 25 bp, Rattus norvegicus
aatgcttcttccttagtacttgcaa

SEQ ID NO: 63107 - DNA, 25 bp, Rattus norvegicus
aatgcttcttctacttcaacgtctt

SEQ ID NO: 63108 - DNA, 25 bp, Rattus norvegicus
aatgcttcttctatcagactggcct

SEQ ID NO: 63109 - DNA, 25 bp, Rattus norvegicus
aatgcttcttcttcttcaacgtctt

SEQ ID NO: 63110 - DNA, 25 bp, Rattus norvegicus
aatgcttcttctttcagactggcct

SEQ ID NO: 63111 - DNA, 25 bp, Rattus norvegicus
aatgcttctttgactttgtgcaaac

SEQ ID NO: 63112 - DNA, 25 bp, Rattus norvegicus
aatgcttctttgtctttgtgcaaac

SEQ ID NO: 63113 - DNA, 25 bp, Rattus norvegicus
aatgcttgaactcgctctgtgtgtg

SEQ ID NO: 63114 - DNA, 25 bp, Rattus norvegicus
aatgcttgaactggctctgtgtgtg

SEQ ID NO: 63115 - DNA, 25 bp, Rattus norvegicus
aatgcttgaaggattgttaccctaa

SEQ ID NO: 63116 - DNA, 25 bp, Rattus norvegicus
aatgcttgaaggtttgttaccctaa

SEQ ID NO: 63117 - DNA, 25 bp, Rattus norvegicus
aatgcttgactgctcaactaccttg

SEQ ID NO: 63118 - DNA, 25 bp, Rattus norvegicus
aatgcttgactggtcaactaccttg

SEQ ID NO: 63119 - DNA, 25 bp, Rattus norvegicus
aatgcttgagttccttgcacaggct

SEQ ID NO: 63120 - DNA, 25 bp, Rattus norvegicus
aatgcttgagttgcttgcacaggct

SEQ ID NO: 63121 - DNA, 25 bp, Rattus norvegicus
aatgcttgcagtctttctaaggagc

SEQ ID NO: 63122 - DNA, 25 bp, Rattus norvegicus
aatgcttgcagtgtttctaaggagc

SEQ ID NO: 63123 - DNA, 25 bp, Rattus norvegicus
aatgcttgcattatcttctctctgg

SEQ ID NO: 63124 - DNA, 25 bp, Rattus norvegicus
aatgcttgcattttcttctctctgg

SEQ ID NO: 63125 - DNA, 25 bp, Rattus norvegicus
aatgcttgccagaagaaccccagga

SEQ ID NO: 63126 - DNA, 25 bp, Rattus norvegicus
aatgcttgccagtagaaccccagga

SEQ ID NO: 63127 - DNA, 25 bp, Rattus norvegicus
aatgcttgcctgaaaattagtctta

SEQ ID NO: 63128 - DNA, 25 bp, Rattus norvegicus
aatgcttgcctgtaaattagtctta

SEQ ID NO: 63129 - DNA, 25 bp, Rattus norvegicus
aatgcttggaatacctgtcatccgg

SEQ ID NO: 63130 - DNA, 25 bp, Rattus norvegicus
aatgcttggaattcctgtcatccgg

SEQ ID NO: 63131 - DNA, 25 bp, Rattus norvegicus
aatgcttggatcactcttcttgcta

SEQ ID NO: 63132 - DNA, 25 bp, Rattus norvegicus
aatgcttggatctctcttcttgcta

SEQ ID NO: 63133 - DNA, 25 bp, Rattus norvegicus
aatgcttgggcaccttttctggtaa

SEQ ID NO: 63134 - DNA, 25 bp, Rattus norvegicus
aatgcttgggcagcttttctggtaa

SEQ ID NO: 63135 - DNA, 25 bp, Rattus norvegicus
aatgcttggtacatgagaagatcct

SEQ ID NO: 63136 - DNA, 25 bp, Rattus norvegicus
aatgcttggtacttgagaagatcct

SEQ ID NO: 63137 - DNA, 25 bp, Rattus norvegicus
aatgcttggtgcagcaccttgttta

SEQ ID NO: 63138 - DNA, 25 bp, Rattus norvegicus
aatgcttggtgctgcaccttgttta

SEQ ID NO: 63139 - DNA, 25 bp, Rattus norvegicus
aatgcttggtttcccttcatgccat

SEQ ID NO: 63140 - DNA, 25 bp, Rattus norvegicus
aatgcttggtttgccttcatgccat

SEQ ID NO: 63141 - DNA, 25 bp, Rattus norvegicus
aatgcttgtagcacaggcctggaaa

SEQ ID NO: 63142 - DNA, 25 bp, Rattus norvegicus
aatgcttgtagcactggttctatgg

SEQ ID NO: 63143 - DNA, 25 bp, Rattus norvegicus
aatgcttgtagcatcctactccaag

SEQ ID NO: 63144 - DNA, 25 bp, Rattus norvegicus
aatgcttgtagctcaggcctggaaa

SEQ ID NO: 63145 - DNA, 25 bp, Rattus norvegicus
aatgcttgtagctctggttctatgg

SEQ ID NO: 63146 - DNA, 25 bp, Rattus norvegicus
aatgcttgtagcttcctactccaag

SEQ ID NO: 63147 - DNA, 25 bp, Rattus norvegicus
aatgcttgtatgcacttgtatgtaa

SEQ ID NO: 63148 - DNA, 25 bp, Rattus norvegicus
aatgcttgtatggacttgtatgtaa

SEQ ID NO: 63149 - DNA, 25 bp, Rattus norvegicus
aatgcttgtattatggctttcccac

SEQ ID NO: 63150 - DNA, 25 bp, Rattus norvegicus
aatgcttgtattttggctttcccac

SEQ ID NO: 63151 - DNA, 25 bp, Rattus norvegicus
aatgcttgtcgtcatcacctgtcaa

SEQ ID NO: 63152 - DNA, 25 bp, Rattus norvegicus
aatgcttgtcgtgatcacctgtcaa

SEQ ID NO: 63153 - DNA, 25 bp, Rattus norvegicus
aatgcttgtcttaatgcacagccaa

SEQ ID NO: 63154 - DNA, 25 bp, Rattus norvegicus
aatgcttgtctttatgcacagccaa

SEQ ID NO: 63155 - DNA, 25 bp, Rattus norvegicus
aatgcttgtgtgacttggatatccc

SEQ ID NO: 63156 - DNA, 25 bp, Rattus norvegicus
aatgcttgtgtgctacttctgttcc

SEQ ID NO: 63157 - DNA, 25 bp, Rattus norvegicus
aatgcttgtgtggtacttctgttcc

SEQ ID NO: 63158 - DNA, 25 bp, Rattus norvegicus
aatgcttgtgtgtcttggatatccc

SEQ ID NO: 63159 - DNA, 25 bp, Rattus norvegicus
aatgcttgttctccatccaccatga

SEQ ID NO: 63160 - DNA, 25 bp, Rattus norvegicus
aatgcttgttctgcatccaccatga

SEQ ID NO: 63161 - DNA, 25 bp, Rattus norvegicus
aatgcttgttttctggttggtggcc

SEQ ID NO: 63162 - DNA, 25 bp, Rattus norvegicus
aatgcttgttttgtggttggtggcc

SEQ ID NO: 63163 - DNA, 25 bp, Rattus norvegicus
aatgctttacaactggatcttatgc

SEQ ID NO: 63164 - DNA, 25 bp, Rattus norvegicus
aatgctttacaagtggatcttatgc

SEQ ID NO: 63165 - DNA, 25 bp, Rattus norvegicus
aatgctttagaactacctggcccct

SEQ ID NO: 63166 - DNA, 25 bp, Rattus norvegicus
aatgctttagaagtacctggcccct

SEQ ID NO: 63167 - DNA, 25 bp, Rattus norvegicus
aatgctttagagactgttcacagag

SEQ ID NO: 63168 - DNA, 25 bp, Rattus norvegicus
aatgctttagagtctgttcacagag

SEQ ID NO: 63169 - DNA, 25 bp, Rattus norvegicus
aatgctttagctatatgtgggaata

SEQ ID NO: 63170 - DNA, 25 bp, Rattus norvegicus
aatgctttagctctaactccgcttc

SEQ ID NO: 63171 - DNA, 25 bp, Rattus norvegicus
aatgctttagctgtaactccgcttc

SEQ ID NO: 63172 - DNA, 25 bp, Rattus norvegicus
aatgctttagctttatgtgggaata

SEQ ID NO: 63173 - DNA, 25 bp, Rattus norvegicus
aatgctttagttaggactgcctcag

SEQ ID NO: 63174 - DNA, 25 bp, Rattus norvegicus
aatgctttagtttggactgcctcag

SEQ ID NO: 63175 - DNA, 25 bp, Rattus norvegicus
aatgctttatccatttgtgcaaagg

SEQ ID NO: 63176 - DNA, 25 bp, Rattus norvegicus
aatgctttatcccttttagcctaag

SEQ ID NO: 63177 - DNA, 25 bp, Rattus norvegicus
aatgctttatccgttttagcctaag

SEQ ID NO: 63178 - DNA, 25 bp, Rattus norvegicus
aatgctttatccttttgtgcaaagg

SEQ ID NO: 63179 - DNA, 25 bp, Rattus norvegicus
aatgctttatttacagatgctgggt

SEQ ID NO: 63180 - DNA, 25 bp, Rattus norvegicus
aatgctttattttcagatgctgggt

SEQ ID NO: 63181 - DNA, 25 bp, Rattus norvegicus
aatgctttcaaaatgccctttctag

SEQ ID NO: 63182 - DNA, 25 bp, Rattus norvegicus
aatgctttcaaattgccctttctag

SEQ ID NO: 63183 - DNA, 25 bp, Rattus norvegicus
aatgctttcaacagtggctggctca

SEQ ID NO: 63184 - DNA, 25 bp, Rattus norvegicus
aatgctttcaactgtggctggctca

SEQ ID NO: 63185 - DNA, 25 bp, Rattus norvegicus
aatgctttccaactgggatcccgct

SEQ ID NO: 63186 - DNA, 25 bp, Rattus norvegicus
aatgctttccaagtgggatcccgct

SEQ ID NO: 63187 - DNA, 25 bp, Rattus norvegicus
aatgctttcgtgatctttgtgcaag

SEQ ID NO: 63188 - DNA, 25 bp, Rattus norvegicus
aatgctttcgtgttctttgtgcaag

SEQ ID NO: 63189 - DNA, 25 bp, Rattus norvegicus
aatgctttcttaatgtgactgtgat

SEQ ID NO: 63190 - DNA, 25 bp, Rattus norvegicus
aatgctttcttattgtgactgtgat

SEQ ID NO: 63191 - DNA, 25 bp, Rattus norvegicus
aatgctttcttccacggcaggaatt

SEQ ID NO: 63192 - DNA, 25 bp, Rattus norvegicus
aatgctttcttcgacggcaggaatt

SEQ ID NO: 63193 - DNA, 25 bp, Rattus norvegicus
aatgctttcttgagccatacaggtg

SEQ ID NO: 63194 - DNA, 25 bp, Rattus norvegicus
aatgctttcttgagtctcaactctt

SEQ ID NO: 63195 - DNA, 25 bp, Rattus norvegicus
aatgctttcttgtgccatacaggtg

SEQ ID NO: 63196 - DNA, 25 bp, Rattus norvegicus
aatgctttcttgtgtctcaactctt

SEQ ID NO: 63197 - DNA, 25 bp, Rattus norvegicus
aatgctttgagtcaccactgttttt

SEQ ID NO: 63198 - DNA, 25 bp, Rattus norvegicus
aatgctttgagtgaccactgttttt

SEQ ID NO: 63199 - DNA, 25 bp, Rattus norvegicus
aatgctttgcatagtgttgtcctaa

SEQ ID NO: 63200 - DNA, 25 bp, Rattus norvegicus
aatgctttgcattgtgttgtcctaa

SEQ ID NO: 63201 - DNA, 25 bp, Rattus norvegicus
aatgctttgcctcgtcctgtgtact

SEQ ID NO: 63202 - DNA, 25 bp, Rattus norvegicus
aatgctttgcctggtcctgtgtact

SEQ ID NO: 63203 - DNA, 25 bp, Rattus norvegicus
aatgctttggaaactcaccctgtgt

SEQ ID NO: 63204 - DNA, 25 bp, Rattus norvegicus
aatgctttggaaatttcattctgaa

SEQ ID NO: 63205 - DNA, 25 bp, Rattus norvegicus
aatgctttggaatctcaccctgtgt

SEQ ID NO: 63206 - DNA, 25 bp, Rattus norvegicus
aatgctttggaattttcattctgaa

SEQ ID NO: 63207 - DNA, 25 bp, Rattus norvegicus
aatgctttggctccttcatatctgc

SEQ ID NO: 63208 - DNA, 25 bp, Rattus norvegicus
aatgctttggctgcttcatatctgc

SEQ ID NO: 63209 - DNA, 25 bp, Rattus norvegicus
aatgctttgtgaagacgctgcggtt

SEQ ID NO: 63210 - DNA, 25 bp, Rattus norvegicus
aatgctttgtgatgacgctgcggtt

SEQ ID NO: 63211 - DNA, 25 bp, Rattus norvegicus
aatgcttttaccctttgccccagtg

SEQ ID NO: 63212 - DNA, 25 bp, Rattus norvegicus
aatgcttttaccgtttgccccagtg

SEQ ID NO: 63213 - DNA, 25 bp, Rattus norvegicus
aatgcttttatacagctctctgcta

SEQ ID NO: 63214 - DNA, 25 bp, Rattus norvegicus
aatgcttttatagagctctctgcta

SEQ ID NO: 63215 - DNA, 25 bp, Rattus norvegicus
aatgcttttctaacagggttgtgct

SEQ ID NO: 63216 - DNA, 25 bp, Rattus norvegicus
aatgcttttctatcagggttgtgct

SEQ ID NO: 63217 - DNA, 25 bp, Rattus norvegicus
aatgcttttctcagccatatacgcc

SEQ ID NO: 63218 - DNA, 25 bp, Rattus norvegicus
aatgcttttctctgccatatacgcc

SEQ ID NO: 63219 - DNA, 25 bp, Rattus norvegicus
aatgcttttgacaggtgccacatac

SEQ ID NO: 63220 - DNA, 25 bp, Rattus norvegicus
aatgcttttgactggtgccacatac

SEQ ID NO: 63221 - DNA, 25 bp, Rattus norvegicus
aatgcttttgccagacagtacagac

SEQ ID NO: 63222 - DNA, 25 bp, Rattus norvegicus
aatgcttttgcctgacagtacagac

SEQ ID NO: 63223 - DNA, 25 bp, Rattus norvegicus
aatgcttttgtaaatccgaatggaa

SEQ ID NO: 63224 - DNA, 25 bp, Rattus norvegicus
aatgcttttgtatatccgaatggaa

SEQ ID NO: 63225 - DNA, 25 bp, Rattus norvegicus
aatgcttttgttatgaggatatcgg

SEQ ID NO: 63226 - DNA, 25 bp, Rattus norvegicus
aatgcttttgttttgaggatatcgg

SEQ ID NO: 63227 - DNA, 25 bp, Rattus norvegicus
aatgctttttcactgcctaaaattt

SEQ ID NO: 63228 - DNA, 25 bp, Rattus norvegicus
aatgctttttcagtgcctaaaattt

SEQ ID NO: 63229 - DNA, 25 bp, Rattus norvegicus
aatgctttttgtcgcgaacctaatt

SEQ ID NO: 63230 - DNA, 25 bp, Rattus norvegicus
aatgctttttgtggcgaacctaatt

SEQ ID NO: 63231 - DNA, 25 bp, Rattus norvegicus
aatggaaaaatccacccagcttcct

SEQ ID NO: 63232 - DNA, 25 bp, Rattus norvegicus
aatggaaaaatcgacccagcttcct

SEQ ID NO: 63233 - DNA, 25 bp, Rattus norvegicus
aatggaaacaccaggtctgtgccct

SEQ ID NO: 63234 - DNA, 25 bp, Rattus norvegicus
aatggaaacacctggtctgtgccct

SEQ ID NO: 63235 - DNA, 25 bp, Rattus norvegicus
aatggaaacccacaagatctcttcg

SEQ ID NO: 63236 - DNA, 25 bp, Rattus norvegicus
aatggaaacccagaagatctcttcg

SEQ ID NO: 63237 - DNA, 25 bp, Rattus norvegicus
aatggaaactaacgccttccttgca

SEQ ID NO: 63238 - DNA, 25 bp, Rattus norvegicus
aatggaaactaaggccttccttgca

SEQ ID NO: 63239 - DNA, 25 bp, Rattus norvegicus
aatggaaacttcatgagggaggaca

SEQ ID NO: 63240 - DNA, 25 bp, Rattus norvegicus
aatggaaacttcttgagggaggaca

SEQ ID NO: 63241 - DNA, 25 bp, Rattus norvegicus
aatggaaatgaccagcggctgttac

SEQ ID NO: 63242 - DNA, 25 bp, Rattus norvegicus
aatggaaatgacgagcggctgttac

SEQ ID NO: 63243 - DNA, 25 bp, Rattus norvegicus
aatggaacatttaggtcagaatttc

SEQ ID NO: 63244 - DNA, 25 bp, Rattus norvegicus
aatggaacatttctgccttggcaac

SEQ ID NO: 63245 - DNA, 25 bp, Rattus norvegicus
aatggaacatttgtgccttggcaac

SEQ ID NO: 63246 - DNA, 25 bp, Rattus norvegicus
aatggaacattttggtcagaatttc

SEQ ID NO: 63247 - DNA, 25 bp, Rattus norvegicus
aatggaacccaaatcctgtgtttag

SEQ ID NO: 63248 - DNA, 25 bp, Rattus norvegicus
aatggaacccaattcctgtgtttag

SEQ ID NO: 63249 - DNA, 25 bp, Rattus norvegicus
aatggaaccgttagctctgagactg

SEQ ID NO: 63250 - DNA, 25 bp, Rattus norvegicus
aatggaaccgtttgctctgagactg

SEQ ID NO: 63251 - DNA, 25 bp, Rattus norvegicus
aatggaacgctccttacatgacgct

SEQ ID NO: 63252 - DNA, 25 bp, Rattus norvegicus
aatggaacgctcgttacatgacgct

SEQ ID NO: 63253 - DNA, 25 bp, Rattus norvegicus
aatggaacggccattgtaccctgca

SEQ ID NO: 63254 - DNA, 25 bp, Rattus norvegicus
aatggaacggcctttgtaccctgca

SEQ ID NO: 63255 - DNA, 25 bp, Rattus norvegicus
aatggaagaaagctcccggccctct

SEQ ID NO: 63256 - DNA, 25 bp, Rattus norvegicus
aatggaagaaaggtcccggccctct

SEQ ID NO: 63257 - DNA, 25 bp, Rattus norvegicus
aatggaagaaatcagtgccctgctg

SEQ ID NO: 63258 - DNA, 25 bp, Rattus norvegicus
aatggaagaaatgagtgccctgctg

SEQ ID NO: 63259 - DNA, 25 bp, Rattus norvegicus
aatggaagacccagtgctgcactta

SEQ ID NO: 63260 - DNA, 25 bp, Rattus norvegicus
aatggaagaccctgtgctgcactta

SEQ ID NO: 63261 - DNA, 25 bp, Rattus norvegicus
aatggaagaccgcttctcccctggt

SEQ ID NO: 63262 - DNA, 25 bp, Rattus norvegicus
aatggaagaccggttctcccctggt

SEQ ID NO: 63263 - DNA, 25 bp, Rattus norvegicus
aatggaagactgcagccgtggataa

SEQ ID NO: 63264 - DNA, 25 bp, Rattus norvegicus
aatggaagactggagccgtggataa

SEQ ID NO: 63265 - DNA, 25 bp, Rattus norvegicus
aatggaagcactatctctgctgctt

SEQ ID NO: 63266 - DNA, 25 bp, Rattus norvegicus
aatggaagcactttctctgctgctt

SEQ ID NO: 63267 - DNA, 25 bp, Rattus norvegicus
aatggaagcctaagacgactacgaa

SEQ ID NO: 63268 - DNA, 25 bp, Rattus norvegicus
aatggaagcctatgacgactacgaa

SEQ ID NO: 63269 - DNA, 25 bp, Rattus norvegicus
aatggaagcctgatgaggagctgca

SEQ ID NO: 63270 - DNA, 25 bp, Rattus norvegicus
aatggaagcctgttgaggagctgca

SEQ ID NO: 63271 - DNA, 25 bp, Rattus norvegicus
aatggaagccttactacatctgcag

SEQ ID NO: 63272 - DNA, 25 bp, Rattus norvegicus
aatggaagccttcgaaaatcgccta

SEQ ID NO: 63273 - DNA, 25 bp, Rattus norvegicus
aatggaagccttggaaaatcgccta

SEQ ID NO: 63274 - DNA, 25 bp, Rattus norvegicus
aatggaagcctttctacatctgcag

SEQ ID NO: 63275 - DNA, 25 bp, Rattus norvegicus
aatggaagcgctctcaggcatatgc

SEQ ID NO: 63276 - DNA, 25 bp, Rattus norvegicus
aatggaagcgctgtcaggcatatgc

SEQ ID NO: 63277 - DNA, 25 bp, Rattus norvegicus
aatggaaggcagacccttataataa

SEQ ID NO: 63278 - DNA, 25 bp, Rattus norvegicus
aatggaaggcagtcccttataataa

SEQ ID NO: 63279 - DNA, 25 bp, Rattus norvegicus
aatggaaggctcaacctcagctaca

SEQ ID NO: 63280 - DNA, 25 bp, Rattus norvegicus
aatggaaggctctacctcagctaca

SEQ ID NO: 63281 - DNA, 25 bp, Rattus norvegicus
aatggaagtgatattcccatgctca

SEQ ID NO: 63282 - DNA, 25 bp, Rattus norvegicus
aatggaagtgattttcccatgctca

SEQ ID NO: 63283 - DNA, 25 bp, Rattus norvegicus
aatggaatatccactatcaccctga

SEQ ID NO: 63284 - DNA, 25 bp, Rattus norvegicus
aatggaatatcctctatcaccctga

SEQ ID NO: 63285 - DNA, 25 bp, Rattus norvegicus
aatggaatattcatcctgccctgct

SEQ ID NO: 63286 - DNA, 25 bp, Rattus norvegicus
aatggaatattcttcctgccctgct

SEQ ID NO: 63287 - DNA, 25 bp, Rattus norvegicus
aatggaatcccgcaggtttctcttg

SEQ ID NO: 63288 - DNA, 25 bp, Rattus norvegicus
aatggaatcccggaggtttctcttg

SEQ ID NO: 63289 - DNA, 25 bp, Rattus norvegicus
aatggaatccttacccacttgggag

SEQ ID NO: 63290 - DNA, 25 bp, Rattus norvegicus
aatggaatcctttcccacttgggag

SEQ ID NO: 63291 - DNA, 25 bp, Rattus norvegicus
aatggaatggccaagtctctccagc

SEQ ID NO: 63292 - DNA, 25 bp, Rattus norvegicus
aatggaatggcctagtctctccagc

SEQ ID NO: 63293 - DNA, 25 bp, Rattus norvegicus
aatggaatgtcaccgtgtcagcaga

SEQ ID NO: 63294 - DNA, 25 bp, Rattus norvegicus
aatggaatgtcagcgtgtcagcaga

SEQ ID NO: 63295 - DNA, 25 bp, Rattus norvegicus
aatggacaaatcaaggagcctgact

SEQ ID NO: 63296 - DNA, 25 bp, Rattus norvegicus
aatggacaaatctaggagcctgact

SEQ ID NO: 63297 - DNA, 25 bp, Rattus norvegicus
aatggacacaggactgatctctggc

SEQ ID NO: 63298 - DNA, 25 bp, Rattus norvegicus
aatggacacaggtctgatctctggc

SEQ ID NO: 63299 - DNA, 25 bp, Rattus norvegicus
aatggacacatgagcagtgttgacg

SEQ ID NO: 63300 - DNA, 25 bp, Rattus norvegicus
aatggacacatgtgcagtgttgacg

SEQ ID NO: 63301 - DNA, 25 bp, Rattus norvegicus
aatggacaccagagtttggcttttc

SEQ ID NO: 63302 - DNA, 25 bp, Rattus norvegicus
aatggacaccagtgtttggcttttc

SEQ ID NO: 63303 - DNA, 25 bp, Rattus norvegicus
aatggacacttcatttctgaaaata

SEQ ID NO: 63304 - DNA, 25 bp, Rattus norvegicus
aatggacacttcttttctgaaaata

SEQ ID NO: 63305 - DNA, 25 bp, Rattus norvegicus
aatggacagcaaaggcactgccggc

SEQ ID NO: 63306 - DNA, 25 bp, Rattus norvegicus
aatggacagcaatggcactgccggc

SEQ ID NO: 63307 - DNA, 25 bp, Rattus norvegicus
aatggacagcacacttgttgactct

SEQ ID NO: 63308 - DNA, 25 bp, Rattus norvegicus
aatggacagcactcttgttgactct

SEQ ID NO: 63309 - DNA, 25 bp, Rattus norvegicus
aatggacagccacgatacccacaat

SEQ ID NO: 63310 - DNA, 25 bp, Rattus norvegicus
aatggacagccaggatacccacaat

SEQ ID NO: 63311 - DNA, 25 bp, Rattus norvegicus
aatggacagctcagggcctacagga

SEQ ID NO: 63312 - DNA, 25 bp, Rattus norvegicus
aatggacagctctgggcctacagga

SEQ ID NO: 63313 - DNA, 25 bp, Rattus norvegicus
aatggacagcttctttctacattgt

SEQ ID NO: 63314 - DNA, 25 bp, Rattus norvegicus
aatggacagcttgtttctacattgt

SEQ ID NO: 63315 - DNA, 25 bp, Rattus norvegicus
aatggacaggagaatcctcgttccc

SEQ ID NO: 63316 - DNA, 25 bp, Rattus norvegicus
aatggacaggagtatcctcgttccc

SEQ ID NO: 63317 - DNA, 25 bp, Rattus norvegicus
aatggacatctaaacttgccgtcaa

SEQ ID NO: 63318 - DNA, 25 bp, Rattus norvegicus
aatggacatctatacttgccgtcaa

SEQ ID NO: 63319 - DNA, 25 bp, Rattus norvegicus
aatggacatgctaggatctggatca

SEQ ID NO: 63320 - DNA, 25 bp, Rattus norvegicus
aatggacatgcttggatctggatca

SEQ ID NO: 63321 - DNA, 25 bp, Rattus norvegicus
aatggacattcgcatggtcttctgt

SEQ ID NO: 63322 - DNA, 25 bp, Rattus norvegicus
aatggacattcggatggtcttctgt

SEQ ID NO: 63323 - DNA, 25 bp, Rattus norvegicus
aatggaccaaagagtcatccaacac

SEQ ID NO: 63324 - DNA, 25 bp, Rattus norvegicus
aatggaccaaagtgtcatccaacac

SEQ ID NO: 63325 - DNA, 25 bp, Rattus norvegicus
aatggaccacctatcttatgccttg

SEQ ID NO: 63326 - DNA, 25 bp, Rattus norvegicus
aatggaccacctttcttatgccttg

SEQ ID NO: 63327 - DNA, 25 bp, Rattus norvegicus
aatggaccagaaccagtggccaaga

SEQ ID NO: 63328 - DNA, 25 bp, Rattus norvegicus
aatggaccagaagcagtggccaaga

SEQ ID NO: 63329 - DNA, 25 bp, Rattus norvegicus
aatggacccacgacagtcatgtctt

SEQ ID NO: 63330 - DNA, 25 bp, Rattus norvegicus
aatggacccacgtcagtcatgtctt

SEQ ID NO: 63331 - DNA, 25 bp, Rattus norvegicus
aatggacccgtgcatttgctgatac

SEQ ID NO: 63332 - DNA, 25 bp, Rattus norvegicus
aatggacccgtggatttgctgatac

SEQ ID NO: 63333 - DNA, 25 bp, Rattus norvegicus
aatggaccctgcatttcaaaaggaa

SEQ ID NO: 63334 - DNA, 25 bp, Rattus norvegicus
aatggaccctgcttttcaaaaggaa

SEQ ID NO: 63335 - DNA, 25 bp, Rattus norvegicus
aatggaccgcctacacttgcacaga

SEQ ID NO: 63336 - DNA, 25 bp, Rattus norvegicus
aatggaccgccttcacttgcacaga

SEQ ID NO: 63337 - DNA, 25 bp, Rattus norvegicus
aatggacctaccataggacctgcca

SEQ ID NO: 63338 - DNA, 25 bp, Rattus norvegicus
aatggacctaccttaggacctgcca

SEQ ID NO: 63339 - DNA, 25 bp, Rattus norvegicus
aatggacctgtgcagtctggctcaa

SEQ ID NO: 63340 - DNA, 25 bp, Rattus norvegicus
aatggacctgtggagtctggctcaa

SEQ ID NO: 63341 - DNA, 25 bp, Rattus norvegicus
aatggacctttcattgcactgtgtg

SEQ ID NO: 63342 - DNA, 25 bp, Rattus norvegicus
aatggacctttctttgcactgtgtg

SEQ ID NO: 63343 - DNA, 25 bp, Rattus norvegicus
aatggacctttgaatatgagtgtgt

SEQ ID NO: 63344 - DNA, 25 bp, Rattus norvegicus
aatggacctttgtatatgagtgtgt

SEQ ID NO: 63345 - DNA, 25 bp, Rattus norvegicus
aatggacgaatgaccaccagctgct

SEQ ID NO: 63346 - DNA, 25 bp, Rattus norvegicus
aatggacgaatgtccaccagctgct

SEQ ID NO: 63347 - DNA, 25 bp, Rattus norvegicus
aatggacgggtgcatccagcactga

SEQ ID NO: 63348 - DNA, 25 bp, Rattus norvegicus
aatggacgggtggatccagcactga

SEQ ID NO: 63349 - DNA, 25 bp, Rattus norvegicus
aatggacgtgctattgactgtgact

SEQ ID NO: 63350 - DNA, 25 bp, Rattus norvegicus
aatggacgtgcttttgactgtgact

SEQ ID NO: 63351 - DNA, 25 bp, Rattus norvegicus
aatggacgtttgagccacgtgcggc

SEQ ID NO: 63352 - DNA, 25 bp, Rattus norvegicus
aatggacgtttgtgccacgtgcggc

SEQ ID NO: 63353 - DNA, 25 bp, Rattus norvegicus
aatggactagcaacaaacctcactt

SEQ ID NO: 63354 - DNA, 25 bp, Rattus norvegicus
aatggactagcatcaaacctcactt

SEQ ID NO: 63355 - DNA, 25 bp, Rattus norvegicus
aatggactcagtctggcccttagca

SEQ ID NO: 63356 - DNA, 25 bp, Rattus norvegicus
aatggactcagtgtggcccttagca

SEQ ID NO: 63357 - DNA, 25 bp, Rattus norvegicus
aatggactcattcaacaatcaactg

SEQ ID NO: 63358 - DNA, 25 bp, Rattus norvegicus
aatggactcattgaacaatcaactg

SEQ ID NO: 63359 - DNA, 25 bp, Rattus norvegicus
aatggactccaacatggtgccggtc

SEQ ID NO: 63360 - DNA, 25 bp, Rattus norvegicus
aatggactccaagatggtgccggtc

SEQ ID NO: 63361 - DNA, 25 bp, Rattus norvegicus
aatggactcctcagattgtgtttaa

SEQ ID NO: 63362 - DNA, 25 bp, Rattus norvegicus
aatggactcctctgattgtgtttaa

SEQ ID NO: 63363 - DNA, 25 bp, Rattus norvegicus
aatggactcgatacttcagggtgcc

SEQ ID NO: 63364 - DNA, 25 bp, Rattus norvegicus
aatggactcgattcttcagggtgcc

SEQ ID NO: 63365 - DNA, 25 bp, Rattus norvegicus
aatggactctggcacgatggttcga

SEQ ID NO: 63366 - DNA, 25 bp, Rattus norvegicus
aatggactctgggacgatggttcga

SEQ ID NO: 63367 - DNA, 25 bp, Rattus norvegicus
aatggactcttgctgtgaacccaat

SEQ ID NO: 63368 - DNA, 25 bp, Rattus norvegicus
aatggactcttggtgtgaacccaat

SEQ ID NO: 63369 - DNA, 25 bp, Rattus norvegicus
aatggactgactaccagttgggcac

SEQ ID NO: 63370 - DNA, 25 bp, Rattus norvegicus
aatggactgacttccagttgggcac

SEQ ID NO: 63371 - DNA, 25 bp, Rattus norvegicus
aatggactgcacactgaatggaaca

SEQ ID NO: 63372 - DNA, 25 bp, Rattus norvegicus
aatggactgcactctgaatggaaca

SEQ ID NO: 63373 - DNA, 25 bp, Rattus norvegicus
aatggactgcatatatcccaaacag

SEQ ID NO: 63374 - DNA, 25 bp, Rattus norvegicus
aatggactgcatttatcccaaacag

SEQ ID NO: 63375 - DNA, 25 bp, Rattus norvegicus
aatggactggagctgttagtacata

SEQ ID NO: 63376 - DNA, 25 bp, Rattus norvegicus
aatggactggaggtgttagtacata

SEQ ID NO: 63377 - DNA, 25 bp, Rattus norvegicus
aatggactgttcagatctataagcc

SEQ ID NO: 63378 - DNA, 25 bp, Rattus norvegicus
aatggactgttctgatctataagcc

SEQ ID NO: 63379 - DNA, 25 bp, Rattus norvegicus
aatggacttctacgcttagggagcg

SEQ ID NO: 63380 - DNA, 25 bp, Rattus norvegicus
aatggacttctaggcttagggagcg

SEQ ID NO: 63381 - DNA, 25 bp, Rattus norvegicus
aatggacttgggactcagcagtttt

SEQ ID NO: 63382 - DNA, 25 bp, Rattus norvegicus
aatggacttgggtctcagcagtttt

SEQ ID NO: 63383 - DNA, 25 bp, Rattus norvegicus
aatggagaacagaccttccctggga

SEQ ID NO: 63384 - DNA, 25 bp, Rattus norvegicus
aatggagaacagtccttccctggga

SEQ ID NO: 63385 - DNA, 25 bp, Rattus norvegicus
aatggagaactgacttgggcctact

SEQ ID NO: 63386 - DNA, 25 bp, Rattus norvegicus
aatggagaactgtcttgggcctact

SEQ ID NO: 63387 - DNA, 25 bp, Rattus norvegicus
aatggagaaggacatccaggcacac

SEQ ID NO: 63388 - DNA, 25 bp, Rattus norvegicus
aatggagaaggagatccaggcacac

SEQ ID NO: 63389 - DNA, 25 bp, Rattus norvegicus
aatggagaaggcctcggctgtcttt

SEQ ID NO: 63390 - DNA, 25 bp, Rattus norvegicus
aatggagaaggcgtcggctgtcttt

SEQ ID NO: 63391 - DNA, 25 bp, Rattus norvegicus
aatggagacaatagcacacgaggaa

SEQ ID NO: 63392 - DNA, 25 bp, Rattus norvegicus
aatggagacaattgcacacgaggaa

SEQ ID NO: 63393 - DNA, 25 bp, Rattus norvegicus
aatggagacagacactcgctcatct

SEQ ID NO: 63394 - DNA, 25 bp, Rattus norvegicus
aatggagacagagactcgctcatct

SEQ ID NO: 63395 - DNA, 25 bp, Rattus norvegicus
aatggagacccaacctttatagtct

SEQ ID NO: 63396 - DNA, 25 bp, Rattus norvegicus
aatggagacccaatgtcactgggaa

SEQ ID NO: 63397 - DNA, 25 bp, Rattus norvegicus
aatggagacccatcctttatagtct

SEQ ID NO: 63398 - DNA, 25 bp, Rattus norvegicus
aatggagacccattgtcactgggaa

SEQ ID NO: 63399 - DNA, 25 bp, Rattus norvegicus
aatggagacctgctttgggattttt

SEQ ID NO: 63400 - DNA, 25 bp, Rattus norvegicus
aatggagacctggtttgggattttt

SEQ ID NO: 63401 - DNA, 25 bp, Rattus norvegicus
aatggagactgcctactggtgcgct

SEQ ID NO: 63402 - DNA, 25 bp, Rattus norvegicus
aatggagactgcgtactggtgcgct

SEQ ID NO: 63403 - DNA, 25 bp, Rattus norvegicus
aatggagatactcctgagcccgcac

SEQ ID NO: 63404 - DNA, 25 bp, Rattus norvegicus
aatggagatactgctgagcccgcac

SEQ ID NO: 63405 - DNA, 25 bp, Rattus norvegicus
aatggagatgctcaacgccttcagc

SEQ ID NO: 63406 - DNA, 25 bp, Rattus norvegicus
aatggagatgctgaacgccttcagc

SEQ ID NO: 63407 - DNA, 25 bp, Rattus norvegicus
aatggagcaccgagttacatcagcg

SEQ ID NO: 63408 - DNA, 25 bp, Rattus norvegicus
aatggagcaccgtgttacatcagcg

SEQ ID NO: 63409 - DNA, 25 bp, Rattus norvegicus
aatggagccaacaaatgggcctggg

SEQ ID NO: 63410 - DNA, 25 bp, Rattus norvegicus
aatggagccaactaatgggcctggg

SEQ ID NO: 63411 - DNA, 25 bp, Rattus norvegicus
aatggagccatgatagcacaagctg

SEQ ID NO: 63412 - DNA, 25 bp, Rattus norvegicus
aatggagccatgttagcacaagctg

SEQ ID NO: 63413 - DNA, 25 bp, Rattus norvegicus
aatggagccccaagggattcgaggt

SEQ ID NO: 63414 - DNA, 25 bp, Rattus norvegicus
aatggagccccatgggattcgaggt

SEQ ID NO: 63415 - DNA, 25 bp, Rattus norvegicus
aatggagcccgtcgcacattttggc

SEQ ID NO: 63416 - DNA, 25 bp, Rattus norvegicus
aatggagcccgtggcacattttggc

SEQ ID NO: 63417 - DNA, 25 bp, Rattus norvegicus
aatggagccgggaatgggccaccca

SEQ ID NO: 63418 - DNA, 25 bp, Rattus norvegicus
aatggagccgggtatgggccaccca

SEQ ID NO: 63419 - DNA, 25 bp, Rattus norvegicus
aatggagccggtatgcatctgggat

SEQ ID NO: 63420 - DNA, 25 bp, Rattus norvegicus
aatggagccggtttgcatctgggat

SEQ ID NO: 63421 - DNA, 25 bp, Rattus norvegicus
aatggagccgtcaaattcttgtgaa

SEQ ID NO: 63422 - DNA, 25 bp, Rattus norvegicus
aatggagccgtctaattcttgtgaa

SEQ ID NO: 63423 - DNA, 25 bp, Rattus norvegicus
aatggagcctccataccataagtgc

SEQ ID NO: 63424 - DNA, 25 bp, Rattus norvegicus
aatggagcctccttaccataagtgc

SEQ ID NO: 63425 - DNA, 25 bp, Rattus norvegicus
aatggagctctaacatacacagatg

SEQ ID NO: 63426 - DNA, 25 bp, Rattus norvegicus
aatggagctctatcatacacagatg

SEQ ID NO: 63427 - DNA, 25 bp, Rattus norvegicus
aatggagctctcatccactggcgtg

SEQ ID NO: 63428 - DNA, 25 bp, Rattus norvegicus
aatggagctctcttccactggcgtg

SEQ ID NO: 63429 - DNA, 25 bp, Rattus norvegicus
aatggagctgctcttggcctcagtg

SEQ ID NO: 63430 - DNA, 25 bp, Rattus norvegicus
aatggagctgctgttggcctcagtg

SEQ ID NO: 63431 - DNA, 25 bp, Rattus norvegicus
aatggagcttctcgtgtgctacgaa

SEQ ID NO: 63432 - DNA, 25 bp, Rattus norvegicus
aatggagcttctggtgtgctacgaa

SEQ ID NO: 63433 - DNA, 25 bp, Rattus norvegicus
aatggaggacatacttcgatgcttc

SEQ ID NO: 63434 - DNA, 25 bp, Rattus norvegicus
aatggaggacattcttcgatgcttc

SEQ ID NO: 63435 - DNA, 25 bp, Rattus norvegicus
aatggaggacgtagtttcccagcgg

SEQ ID NO: 63436 - DNA, 25 bp, Rattus norvegicus
aatggaggacgttgtttcccagcgg

SEQ ID NO: 63437 - DNA, 25 bp, Rattus norvegicus
aatggaggacttcgcgccacaggct

SEQ ID NO: 63438 - DNA, 25 bp, Rattus norvegicus
aatggaggacttggcgccacaggct

SEQ ID NO: 63439 - DNA, 25 bp, Rattus norvegicus
aatggaggaggcaggccccttgctc

SEQ ID NO: 63440 - DNA, 25 bp, Rattus norvegicus
aatggaggaggctggccccttgctc

SEQ ID NO: 63441 - DNA, 25 bp, Rattus norvegicus
aatggaggcatcatctgttcactta

SEQ ID NO: 63442 - DNA, 25 bp, Rattus norvegicus
aatggaggcatcttctgttcactta

SEQ ID NO: 63443 - DNA, 25 bp, Rattus norvegicus
aatggaggccaaagcaagcacctgc

SEQ ID NO: 63444 - DNA, 25 bp, Rattus norvegicus
aatggaggccaatgcaagcacctgc

SEQ ID NO: 63445 - DNA, 25 bp, Rattus norvegicus
aatggaggctggatgatttttaaac

SEQ ID NO: 63446 - DNA, 25 bp, Rattus norvegicus
aatggaggctggttgatttttaaac

SEQ ID NO: 63447 - DNA, 25 bp, Rattus norvegicus
aatggagggacgactctcctctggt

SEQ ID NO: 63448 - DNA, 25 bp, Rattus norvegicus
aatggagggacgtctctcctctggt

SEQ ID NO: 63449 - DNA, 25 bp, Rattus norvegicus
aatggaggtccactggccactctgt

SEQ ID NO: 63450 - DNA, 25 bp, Rattus norvegicus
aatggaggtccagtggccactctgt

SEQ ID NO: 63451 - DNA, 25 bp, Rattus norvegicus
aatggaggtcggctttgccatttct

SEQ ID NO: 63452 - DNA, 25 bp, Rattus norvegicus
aatggaggtcgggtttgccatttct

SEQ ID NO: 63453 - DNA, 25 bp, Rattus norvegicus
aatggaggtctcatcatgatggatg

SEQ ID NO: 63454 - DNA, 25 bp, Rattus norvegicus
aatggaggtctcttcatgatggatg

SEQ ID NO: 63455 - DNA, 25 bp, Rattus norvegicus
aatggaggtgtcagccccacaggga

SEQ ID NO: 63456 - DNA, 25 bp, Rattus norvegicus
aatggaggtgtctgccccacaggga

SEQ ID NO: 63457 - DNA, 25 bp, Rattus norvegicus
aatggagtaccacttcctctgtcag

SEQ ID NO: 63458 - DNA, 25 bp, Rattus norvegicus
aatggagtaccagttcctctgtcag

SEQ ID NO: 63459 - DNA, 25 bp, Rattus norvegicus
aatggagtcacccacacaagcactg

SEQ ID NO: 63460 - DNA, 25 bp, Rattus norvegicus
aatggagtcaccgacacaagcactg

SEQ ID NO: 63461 - DNA, 25 bp, Rattus norvegicus
aatggagtcatcatggccagagctt

SEQ ID NO: 63462 - DNA, 25 bp, Rattus norvegicus
aatggagtcatcttggccagagctt

SEQ ID NO: 63463 - DNA, 25 bp, Rattus norvegicus
aatggagtccaaacaaaggtctatt

SEQ ID NO: 63464 - DNA, 25 bp, Rattus norvegicus
aatggagtccaatcaaaggtctatt

SEQ ID NO: 63465 - DNA, 25 bp, Rattus norvegicus
aatggagtccagacccaaccaagat

SEQ ID NO: 63466 - DNA, 25 bp, Rattus norvegicus
aatggagtccagtcccaaccaagat

SEQ ID NO: 63467 - DNA, 25 bp, Rattus norvegicus
aatggagtccatcgcttatcaatct

SEQ ID NO: 63468 - DNA, 25 bp, Rattus norvegicus
aatggagtccatggcttatcaatct

SEQ ID NO: 63469 - DNA, 25 bp, Rattus norvegicus
aatggagtcccgctttgagaaaatg

SEQ ID NO: 63470 - DNA, 25 bp, Rattus norvegicus
aatggagtcccggtttgagaaaatg

SEQ ID NO: 63471 - DNA, 25 bp, Rattus norvegicus
aatggagtccgcattctcccatcac

SEQ ID NO: 63472 - DNA, 25 bp, Rattus norvegicus
aatggagtccgctttctcccatcac

SEQ ID NO: 63473 - DNA, 25 bp, Rattus norvegicus
aatggagtcctgaaacactgccagc

SEQ ID NO: 63474 - DNA, 25 bp, Rattus norvegicus
aatggagtcctgcttctggacccca

SEQ ID NO: 63475 - DNA, 25 bp, Rattus norvegicus
aatggagtcctggttctggacccca

SEQ ID NO: 63476 - DNA, 25 bp, Rattus norvegicus
aatggagtcctgtaacactgccagc

SEQ ID NO: 63477 - DNA, 25 bp, Rattus norvegicus
aatggagtcggtcctttattacaaa

SEQ ID NO: 63478 - DNA, 25 bp, Rattus norvegicus
aatggagtcggtgctttattacaaa

SEQ ID NO: 63479 - DNA, 25 bp, Rattus norvegicus
aatggagtcgttccccaagccgtag

SEQ ID NO: 63480 - DNA, 25 bp, Rattus norvegicus
aatggagtcgttgcccaagccgtag

SEQ ID NO: 63481 - DNA, 25 bp, Rattus norvegicus
aatggagtctctcccttgggattag

SEQ ID NO: 63482 - DNA, 25 bp, Rattus norvegicus
aatggagtctctgccttgggattag

SEQ ID NO: 63483 - DNA, 25 bp, Rattus norvegicus
aatggagtcttgacttttccttcct

SEQ ID NO: 63484 - DNA, 25 bp, Rattus norvegicus
aatggagtcttgctattttccactc

SEQ ID NO: 63485 - DNA, 25 bp, Rattus norvegicus
aatggagtcttggtattttccactc

SEQ ID NO: 63486 - DNA, 25 bp, Rattus norvegicus
aatggagtcttgtcttttccttcct

SEQ ID NO: 63487 - DNA, 25 bp, Rattus norvegicus
aatggagtgagtatgccacagccct

SEQ ID NO: 63488 - DNA, 25 bp, Rattus norvegicus
aatggagtgagtttgccacagccct

SEQ ID NO: 63489 - DNA, 25 bp, Rattus norvegicus
aatggagtgctcatctcagtcttct

SEQ ID NO: 63490 - DNA, 25 bp, Rattus norvegicus
aatggagtgctcttctcagtcttct

SEQ ID NO: 63491 - DNA, 25 bp, Rattus norvegicus
aatggagtggccatcttggcttggc

SEQ ID NO: 63492 - DNA, 25 bp, Rattus norvegicus
aatggagtggccttcttggcttggc

SEQ ID NO: 63493 - DNA, 25 bp, Rattus norvegicus
aatggagttcataacttccctctct

SEQ ID NO: 63494 - DNA, 25 bp, Rattus norvegicus
aatggagttcattacttccctctct

SEQ ID NO: 63495 - DNA, 25 bp, Rattus norvegicus
aatggagttcttacatctgtcccca

SEQ ID NO: 63496 - DNA, 25 bp, Rattus norvegicus
aatggagttctttcatctgtcccca

SEQ ID NO: 63497 - DNA, 25 bp, Rattus norvegicus
aatggagttgggatgcccctgagtc

SEQ ID NO: 63498 - DNA, 25 bp, Rattus norvegicus
aatggagttgggttgcccctgagtc

SEQ ID NO: 63499 - DNA, 25 bp, Rattus norvegicus
aatggagtttccagattagtctggc

SEQ ID NO: 63500 - DNA, 25 bp, Rattus norvegicus
aatggagtttcctgattagtctggc

SEQ ID NO: 63501 - DNA, 25 bp, Rattus norvegicus
aatggagtttctccacatcctttcc

SEQ ID NO: 63502 - DNA, 25 bp, Rattus norvegicus
aatggagtttctgcacatcctttcc

SEQ ID NO: 63503 - DNA, 25 bp, Rattus norvegicus
aatggatactgtccccagagtctgg

SEQ ID NO: 63504 - DNA, 25 bp, Rattus norvegicus
aatggatactgtgcccagagtctgg

SEQ ID NO: 63505 - DNA, 25 bp, Rattus norvegicus
aatggatagaccctgcagagaaagt

SEQ ID NO: 63506 - DNA, 25 bp, Rattus norvegicus
aatggatagaccgtgcagagaaagt

SEQ ID NO: 63507 - DNA, 25 bp, Rattus norvegicus
aatggatcaaggactcttaacatac

SEQ ID NO: 63508 - DNA, 25 bp, Rattus norvegicus
aatggatcaaggtctcttaacatac

SEQ ID NO: 63509 - DNA, 25 bp, Rattus norvegicus
aatggatcacgcaaagtctttaaca

SEQ ID NO: 63510 - DNA, 25 bp, Rattus norvegicus
aatggatcacgctaagtctttaaca

SEQ ID NO: 63511 - DNA, 25 bp, Rattus norvegicus
aatggatcactgctccttccgaaaa

SEQ ID NO: 63512 - DNA, 25 bp, Rattus norvegicus
aatggatcactggtccttccgaaaa

SEQ ID NO: 63513 - DNA, 25 bp, Rattus norvegicus
aatggatccaccaaatcatcccaga

SEQ ID NO: 63514 - DNA, 25 bp, Rattus norvegicus
aatggatccaccagctggaatcgga

SEQ ID NO: 63515 - DNA, 25 bp, Rattus norvegicus
aatggatccacccttcctgctcagg

SEQ ID NO: 63516 - DNA, 25 bp, Rattus norvegicus
aatggatccaccgttcctgctcagg

SEQ ID NO: 63517 - DNA, 25 bp, Rattus norvegicus
aatggatccacctaatcatcccaga

SEQ ID NO: 63518 - DNA, 25 bp, Rattus norvegicus
aatggatccacctgctggaatcgga

SEQ ID NO: 63519 - DNA, 25 bp, Rattus norvegicus
aatggatcgtggagcaactgggtca

SEQ ID NO: 63520 - DNA, 25 bp, Rattus norvegicus
aatggatcgtggtgcaactgggtca

SEQ ID NO: 63521 - DNA, 25 bp, Rattus norvegicus
aatggatctctcactaaattaaagc

SEQ ID NO: 63522 - DNA, 25 bp, Rattus norvegicus
aatggatctctctctaaattaaagc

SEQ ID NO: 63523 - DNA, 25 bp, Rattus norvegicus
aatggatctgcccagtggaagagct

SEQ ID NO: 63524 - DNA, 25 bp, Rattus norvegicus
aatggatctgccgagtggaagagct

SEQ ID NO: 63525 - DNA, 25 bp, Rattus norvegicus
aatggatgcttcagtccagacaggc

SEQ ID NO: 63526 - DNA, 25 bp, Rattus norvegicus
aatggatgcttctgtccagacaggc

SEQ ID NO: 63527 - DNA, 25 bp, Rattus norvegicus
aatggatgtcttcctgtgtggctgt

SEQ ID NO: 63528 - DNA, 25 bp, Rattus norvegicus
aatggatgtcttgctgtgtggctgt

SEQ ID NO: 63529 - DNA, 25 bp, Rattus norvegicus
aatggatgtgtcattgttctagtaa

SEQ ID NO: 63530 - DNA, 25 bp, Rattus norvegicus
aatggatgtgtctttgttctagtaa

SEQ ID NO: 63531 - DNA, 25 bp, Rattus norvegicus
aatggattactcaactggattgtga

SEQ ID NO: 63532 - DNA, 25 bp, Rattus norvegicus
aatggattactctactggattgtga

SEQ ID NO: 63533 - DNA, 25 bp, Rattus norvegicus
aatggattagacctcggctgtgcac

SEQ ID NO: 63534 - DNA, 25 bp, Rattus norvegicus
aatggattagacgtcggctgtgcac

SEQ ID NO: 63535 - DNA, 25 bp, Rattus norvegicus
aatggattcttgacctgtggttgga

SEQ ID NO: 63536 - DNA, 25 bp, Rattus norvegicus
aatggattcttgtcctgtggttgga

SEQ ID NO: 63537 - DNA, 25 bp, Rattus norvegicus
aatggatttgagaccctggagcggc

SEQ ID NO: 63538 - DNA, 25 bp, Rattus norvegicus
aatggatttgagtccctggagcggc

SEQ ID NO: 63539 - DNA, 25 bp, Rattus norvegicus
aatggatttgtaccctcccttctgt

SEQ ID NO: 63540 - DNA, 25 bp, Rattus norvegicus
aatggatttgtagcctcccttctgt

SEQ ID NO: 63541 - DNA, 25 bp, Rattus norvegicus
aatggcaaacttccccagtcactgg

SEQ ID NO: 63542 - DNA, 25 bp, Rattus norvegicus
aatggcaaacttgcccagtcactgg

SEQ ID NO: 63543 - DNA, 25 bp, Rattus norvegicus
aatggcaaatgcagctgtctttcct

SEQ ID NO: 63544 - DNA, 25 bp, Rattus norvegicus
aatggcaaatgctgctgtctttcct

SEQ ID NO: 63545 - DNA, 25 bp, Rattus norvegicus
aatggcaacaggaattcaagcagga

SEQ ID NO: 63546 - DNA, 25 bp, Rattus norvegicus
aatggcaacaggtattcaagcagga

SEQ ID NO: 63547 - DNA, 25 bp, Rattus norvegicus
aatggcaacttactctgcctactgt

SEQ ID NO: 63548 - DNA, 25 bp, Rattus norvegicus
aatggcaacttagtctgcctactgt

SEQ ID NO: 63549 - DNA, 25 bp, Rattus norvegicus
aatggcaagactccatcgcggaggt

SEQ ID NO: 63550 - DNA, 25 bp, Rattus norvegicus
aatggcaagactgcatcgcggaggt

SEQ ID NO: 63551 - DNA, 25 bp, Rattus norvegicus
aatggcaagccactagcttcccaac

SEQ ID NO: 63552 - DNA, 25 bp, Rattus norvegicus
aatggcaagccagtagcttcccaac

SEQ ID NO: 63553 - DNA, 25 bp, Rattus norvegicus
aatggcaagcctaagttcgtgaaac

SEQ ID NO: 63554 - DNA, 25 bp, Rattus norvegicus
aatggcaagccttagttcgtgaaac

SEQ ID NO: 63555 - DNA, 25 bp, Rattus norvegicus
aatggcaaggccattttcctggtct

SEQ ID NO: 63556 - DNA, 25 bp, Rattus norvegicus
aatggcaaggcctttttcctggtct

SEQ ID NO: 63557 - DNA, 25 bp, Rattus norvegicus
aatggcaatgccaattttctacaaa

SEQ ID NO: 63558 - DNA, 25 bp, Rattus norvegicus
aatggcaatgcctattttctacaaa

SEQ ID NO: 63559 - DNA, 25 bp, Rattus norvegicus
aatggcacaaccatcctgggaaggt

SEQ ID NO: 63560 - DNA, 25 bp, Rattus norvegicus
aatggcacaaccttcctgggaaggt

SEQ ID NO: 63561 - DNA, 25 bp, Rattus norvegicus
aatggcacagccaactaatcggatt

SEQ ID NO: 63562 - DNA, 25 bp, Rattus norvegicus
aatggcacagcctactaatcggatt

SEQ ID NO: 63563 - DNA, 25 bp, Rattus norvegicus
aatggcacattcattgactagggac

SEQ ID NO: 63564 - DNA, 25 bp, Rattus norvegicus
aatggcacattctttgactagggac

SEQ ID NO: 63565 - DNA, 25 bp, Rattus norvegicus
aatggcacccatcttgatttatcaa

SEQ ID NO: 63566 - DNA, 25 bp, Rattus norvegicus
aatggcacccatgttgatttatcaa

SEQ ID NO: 63567 - DNA, 25 bp, Rattus norvegicus
aatggcaccgtgaaatttctgcttg

SEQ ID NO: 63568 - DNA, 25 bp, Rattus norvegicus
aatggcaccgtgactgtccggagca

SEQ ID NO: 63569 - DNA, 25 bp, Rattus norvegicus
aatggcaccgtgtaatttctgcttg

SEQ ID NO: 63570 - DNA, 25 bp, Rattus norvegicus
aatggcaccgtgtctgtccggagca

SEQ ID NO: 63571 - DNA, 25 bp, Rattus norvegicus
aatggcacctccatagctggcttag

SEQ ID NO: 63572 - DNA, 25 bp, Rattus norvegicus
aatggcacctccttagctggcttag

SEQ ID NO: 63573 - DNA, 25 bp, Rattus norvegicus
aatggcacgtttcgagtgtgactcc

SEQ ID NO: 63574 - DNA, 25 bp, Rattus norvegicus
aatggcacgtttggagtgtgactcc

SEQ ID NO: 63575 - DNA, 25 bp, Rattus norvegicus
aatggcactaggatgcctctccata

SEQ ID NO: 63576 - DNA, 25 bp, Rattus norvegicus
aatggcactaggttgcctctccata

SEQ ID NO: 63577 - DNA, 25 bp, Rattus norvegicus
aatggcactatgcacctttgggact

SEQ ID NO: 63578 - DNA, 25 bp, Rattus norvegicus
aatggcactatggacctttgggact

SEQ ID NO: 63579 - DNA, 25 bp, Rattus norvegicus
aatggcactattaagaactctggtc

SEQ ID NO: 63580 - DNA, 25 bp, Rattus norvegicus
aatggcactatttagaactctggtc

SEQ ID NO: 63581 - DNA, 25 bp, Rattus norvegicus
aatggcactcatacttaaaaggacc

SEQ ID NO: 63582 - DNA, 25 bp, Rattus norvegicus
aatggcactcattcttaaaaggacc

SEQ ID NO: 63583 - DNA, 25 bp, Rattus norvegicus
aatggcactcctcgccatctggaaa

SEQ ID NO: 63584 - DNA, 25 bp, Rattus norvegicus
aatggcactcctggccatctggaaa

SEQ ID NO: 63585 - DNA, 25 bp, Rattus norvegicus
aatggcactgcaattttccaataga

SEQ ID NO: 63586 - DNA, 25 bp, Rattus norvegicus
aatggcactgcatttttccaataga

SEQ ID NO: 63587 - DNA, 25 bp, Rattus norvegicus
aatggcagaaggcaagtatgtcaga

SEQ ID NO: 63588 - DNA, 25 bp, Rattus norvegicus
aatggcagaagggaagtatgtcaga

SEQ ID NO: 63589 - DNA, 25 bp, Rattus norvegicus
aatggcagcactcttggatcaactc

SEQ ID NO: 63590 - DNA, 25 bp, Rattus norvegicus
aatggcagcactgttggatcaactc

SEQ ID NO: 63591 - DNA, 25 bp, Rattus norvegicus
aatggcagcagacgaacgagtcagc

SEQ ID NO: 63592 - DNA, 25 bp, Rattus norvegicus
aatggcagcagaggaacgagtcagc

SEQ ID NO: 63593 - DNA, 25 bp, Rattus norvegicus
aatggcagcagtcaacttggagaaa

SEQ ID NO: 63594 - DNA, 25 bp, Rattus norvegicus
aatggcagcagtgaacttggagaaa

SEQ ID NO: 63595 - DNA, 25 bp, Rattus norvegicus
aatggcagccagagtatttacctag

SEQ ID NO: 63596 - DNA, 25 bp, Rattus norvegicus
aatggcagccagtgtatttacctag

SEQ ID NO: 63597 - DNA, 25 bp, Rattus norvegicus
aatggcagccatctttcttcatagc

SEQ ID NO: 63598 - DNA, 25 bp, Rattus norvegicus
aatggcagccatgtttcttcatagc

SEQ ID NO: 63599 - DNA, 25 bp, Rattus norvegicus
aatggcagcctacatacccagctta

SEQ ID NO: 63600 - DNA, 25 bp, Rattus norvegicus
aatggcagcctagatacccagctta

SEQ ID NO: 63601 - DNA, 25 bp, Rattus norvegicus
aatggcagccttcgctgtttccaga

SEQ ID NO: 63602 - DNA, 25 bp, Rattus norvegicus
aatggcagccttggctgtttccaga

SEQ ID NO: 63603 - DNA, 25 bp, Rattus norvegicus
aatggcagctgtcctcagtctccta

SEQ ID NO: 63604 - DNA, 25 bp, Rattus norvegicus
aatggcagctgtgctcagtctccta

SEQ ID NO: 63605 - DNA, 25 bp, Rattus norvegicus
aatggcagcttaacattgtgtatct

SEQ ID NO: 63606 - DNA, 25 bp, Rattus norvegicus
aatggcagcttatcattgtgtatct

SEQ ID NO: 63607 - DNA, 25 bp, Rattus norvegicus
aatggcagcttgagatggtatcaac

SEQ ID NO: 63608 - DNA, 25 bp, Rattus norvegicus
aatggcagcttgtgatggtatcaac

SEQ ID NO: 63609 - DNA, 25 bp, Rattus norvegicus
aatggcaggaaacccctgctctgtg

SEQ ID NO: 63610 - DNA, 25 bp, Rattus norvegicus
aatggcaggaaagccctgctctgtg

SEQ ID NO: 63611 - DNA, 25 bp, Rattus norvegicus
aatggcaggatcatgaccctttttt

SEQ ID NO: 63612 - DNA, 25 bp, Rattus norvegicus
aatggcaggatcttgaccctttttt

SEQ ID NO: 63613 - DNA, 25 bp, Rattus norvegicus
aatggcaggtcccatgccggcatcc

SEQ ID NO: 63614 - DNA, 25 bp, Rattus norvegicus
aatggcaggtccgatgccggcatcc

SEQ ID NO: 63615 - DNA, 25 bp, Rattus norvegicus
aatggcagtattagtccctagaccc

SEQ ID NO: 63616 - DNA, 25 bp, Rattus norvegicus
aatggcagtatttgtccctagaccc

SEQ ID NO: 63617 - DNA, 25 bp, Rattus norvegicus
aatggcagtcaaccaacccatcata

SEQ ID NO: 63618 - DNA, 25 bp, Rattus norvegicus
aatggcagtcaagcaacccatcata

SEQ ID NO: 63619 - DNA, 25 bp, Rattus norvegicus
aatggcataaggcagctcacgacta

SEQ ID NO: 63620 - DNA, 25 bp, Rattus norvegicus
aatggcataagggagctcacgacta

SEQ ID NO: 63621 - DNA, 25 bp, Rattus norvegicus
aatggcatacctcgattcttctgga

SEQ ID NO: 63622 - DNA, 25 bp, Rattus norvegicus
aatggcatacctggattcttctgga

SEQ ID NO: 63623 - DNA, 25 bp, Rattus norvegicus
aatggcatagtgattatctgtaaca

SEQ ID NO: 63624 - DNA, 25 bp, Rattus norvegicus
aatggcatagtgtttatctgtaaca

SEQ ID NO: 63625 - DNA, 25 bp, Rattus norvegicus
aatggcatagttagctctgctccct

SEQ ID NO: 63626 - DNA, 25 bp, Rattus norvegicus
aatggcatagtttgctctgctccct

SEQ ID NO: 63627 - DNA, 25 bp, Rattus norvegicus
aatggcatccttaacttttcagttt

SEQ ID NO: 63628 - DNA, 25 bp, Rattus norvegicus
aatggcatcctttacttttcagttt

SEQ ID NO: 63629 - DNA, 25 bp, Rattus norvegicus
aatggcatcgtgacacaccattttg

SEQ ID NO: 63630 - DNA, 25 bp, Rattus norvegicus
aatggcatcgtgtcacaccattttg

SEQ ID NO: 63631 - DNA, 25 bp, Rattus norvegicus
aatggcatcttgagacttctctaag

SEQ ID NO: 63632 - DNA, 25 bp, Rattus norvegicus
aatggcatcttgtgacttctctaag

SEQ ID NO: 63633 - DNA, 25 bp, Rattus norvegicus
aatggcatctttcttaatctgtctt

SEQ ID NO: 63634 - DNA, 25 bp, Rattus norvegicus
aatggcatctttgttaatctgtctt

SEQ ID NO: 63635 - DNA, 25 bp, Rattus norvegicus
aatggcatgccacagccagtcctga

SEQ ID NO: 63636 - DNA, 25 bp, Rattus norvegicus
aatggcatgccagagccagtcctga

SEQ ID NO: 63637 - DNA, 25 bp, Rattus norvegicus
aatggcatgctgactgctctgacct

SEQ ID NO: 63638 - DNA, 25 bp, Rattus norvegicus
aatggcatgctgtctgctctgacct

SEQ ID NO: 63639 - DNA, 25 bp, Rattus norvegicus
aatggcatgttcctgtgtgtagtct

SEQ ID NO: 63640 - DNA, 25 bp, Rattus norvegicus
aatggcatgttcgtgtgtgtagtct

SEQ ID NO: 63641 - DNA, 25 bp, Rattus norvegicus
aatggcattcctagagtgactgttg

SEQ ID NO: 63642 - DNA, 25 bp, Rattus norvegicus
aatggcattccttgagtgactgttg

SEQ ID NO: 63643 - DNA, 25 bp, Rattus norvegicus
aatggcatttaacctgtaccctgga

SEQ ID NO: 63644 - DNA, 25 bp, Rattus norvegicus
aatggcatttaagctgtaccctgga

SEQ ID NO: 63645 - DNA, 25 bp, Rattus norvegicus
aatggccaatgaattcactcagcag

SEQ ID NO: 63646 - DNA, 25 bp, Rattus norvegicus
aatggccaatgatttcactcagcag

SEQ ID NO: 63647 - DNA, 25 bp, Rattus norvegicus
aatggccacaaacaccacagactga

SEQ ID NO: 63648 - DNA, 25 bp, Rattus norvegicus
aatggccacaaagaccacagactga

SEQ ID NO: 63649 - DNA, 25 bp, Rattus norvegicus
aatggccacaggcatgctctgacac

SEQ ID NO: 63650 - DNA, 25 bp, Rattus norvegicus
aatggccacagggatgctctgacac

SEQ ID NO: 63651 - DNA, 25 bp, Rattus norvegicus
aatggccacataccctcagaggagt

SEQ ID NO: 63652 - DNA, 25 bp, Rattus norvegicus
aatggccacatagcctcagaggagt

SEQ ID NO: 63653 - DNA, 25 bp, Rattus norvegicus
aatggccaccacagcatacaagaat

SEQ ID NO: 63654 - DNA, 25 bp, Rattus norvegicus
aatggccaccactgcatacaagaat

SEQ ID NO: 63655 - DNA, 25 bp, Rattus norvegicus
aatggccactgtattacaagcttgt

SEQ ID NO: 63656 - DNA, 25 bp, Rattus norvegicus
aatggccactgttttacaagcttgt

SEQ ID NO: 63657 - DNA, 25 bp, Rattus norvegicus
aatggccacttcattttactctttg

SEQ ID NO: 63658 - DNA, 25 bp, Rattus norvegicus
aatggccacttctttttactctttg

SEQ ID NO: 63659 - DNA, 25 bp, Rattus norvegicus
aatggccagagtactcatggagaga

SEQ ID NO: 63660 - DNA, 25 bp, Rattus norvegicus
aatggccagagttctcatggagaga

SEQ ID NO: 63661 - DNA, 25 bp, Rattus norvegicus
aatggccagcagatttcagctctta

SEQ ID NO: 63662 - DNA, 25 bp, Rattus norvegicus
aatggccagcagttttcagctctta

SEQ ID NO: 63663 - DNA, 25 bp, Rattus norvegicus
aatggccagctccagggtgttgttt

SEQ ID NO: 63664 - DNA, 25 bp, Rattus norvegicus
aatggccagctcgagggtgttgttt

SEQ ID NO: 63665 - DNA, 25 bp, Rattus norvegicus
aatggccagggcagagcagttagct

SEQ ID NO: 63666 - DNA, 25 bp, Rattus norvegicus
aatggccagggctgagcagttagct

SEQ ID NO: 63667 - DNA, 25 bp, Rattus norvegicus
aatggccaggtgagattttcccttc

SEQ ID NO: 63668 - DNA, 25 bp, Rattus norvegicus
aatggccaggtgtgattttcccttc

SEQ ID NO: 63669 - DNA, 25 bp, Rattus norvegicus
aatggccagtggagaaagacttgtc

SEQ ID NO: 63670 - DNA, 25 bp, Rattus norvegicus
aatggccagtggtgaaagacttgtc

SEQ ID NO: 63671 - DNA, 25 bp, Rattus norvegicus
aatggccagtttagtttttgtgtct

SEQ ID NO: 63672 - DNA, 25 bp, Rattus norvegicus
aatggccagttttgtttttgtgtct

SEQ ID NO: 63673 - DNA, 25 bp, Rattus norvegicus
aatggccatagaacctggtggcatt

SEQ ID NO: 63674 - DNA, 25 bp, Rattus norvegicus
aatggccatagatcctggtggcatt

SEQ ID NO: 63675 - DNA, 25 bp, Rattus norvegicus
aatggccatcatcctgaaactgagt

SEQ ID NO: 63676 - DNA, 25 bp, Rattus norvegicus
aatggccatcatgctgaaactgagt

SEQ ID NO: 63677 - DNA, 25 bp, Rattus norvegicus
aatggccatggcctacaataagaag

SEQ ID NO: 63678 - DNA, 25 bp, Rattus norvegicus
aatggccatggcgtacaataagaag

SEQ ID NO: 63679 - DNA, 25 bp, Rattus norvegicus
aatggccatgggactagtctgtagc

SEQ ID NO: 63680 - DNA, 25 bp, Rattus norvegicus
aatggccatgggtctagtctgtagc

SEQ ID NO: 63681 - DNA, 25 bp, Rattus norvegicus
aatggccattttatcagaacttctg

SEQ ID NO: 63682 - DNA, 25 bp, Rattus norvegicus
aatggccattttttcagaacttctg

SEQ ID NO: 63683 - DNA, 25 bp, Rattus norvegicus
aatggcccaagacgtgaacatgctt

SEQ ID NO: 63684 - DNA, 25 bp, Rattus norvegicus
aatggcccaagaggtgaacatgctt

SEQ ID NO: 63685 - DNA, 25 bp, Rattus norvegicus
aatggcccagaccttaccagaaatc

SEQ ID NO: 63686 - DNA, 25 bp, Rattus norvegicus
aatggcccagacgttaccagaaatc

SEQ ID NO: 63687 - DNA, 25 bp, Rattus norvegicus
aatggcccaggaaagtgctgctcag

SEQ ID NO: 63688 - DNA, 25 bp, Rattus norvegicus
aatggcccaggatagtgctgctcag

SEQ ID NO: 63689 - DNA, 25 bp, Rattus norvegicus
aatggcccaggcaatgtcggtacag

SEQ ID NO: 63690 - DNA, 25 bp, Rattus norvegicus
aatggcccaggctatgtcggtacag

SEQ ID NO: 63691 - DNA, 25 bp, Rattus norvegicus
aatggcccagtcctttgtgttacct

SEQ ID NO: 63692 - DNA, 25 bp, Rattus norvegicus
aatggcccagtcgtttgtgttacct

SEQ ID NO: 63693 - DNA, 25 bp, Rattus norvegicus
aatggcccagttaccatgctcaaat

SEQ ID NO: 63694 - DNA, 25 bp, Rattus norvegicus
aatggcccagtttccatgctcaaat

SEQ ID NO: 63695 - DNA, 25 bp, Rattus norvegicus
aatggcccatacatccttcagggaa

SEQ ID NO: 63696 - DNA, 25 bp, Rattus norvegicus
aatggcccatacttccttcagggaa

SEQ ID NO: 63697 - DNA, 25 bp, Rattus norvegicus
aatggcccatggcagacatttgcag

SEQ ID NO: 63698 - DNA, 25 bp, Rattus norvegicus
aatggcccatgggagacatttgcag

SEQ ID NO: 63699 - DNA, 25 bp, Rattus norvegicus
aatggcccatgtcaggcagtgtgac

SEQ ID NO: 63700 - DNA, 25 bp, Rattus norvegicus
aatggcccatgtgaggcagtgtgac

SEQ ID NO: 63701 - DNA, 25 bp, Rattus norvegicus
aatggcccatttaatgcccccatgt

SEQ ID NO: 63702 - DNA, 25 bp, Rattus norvegicus
aatggcccattttatgcccccatgt

SEQ ID NO: 63703 - DNA, 25 bp, Rattus norvegicus
aatggcccgaaactccagttctgag

SEQ ID NO: 63704 - DNA, 25 bp, Rattus norvegicus
aatggcccgaaagtccagttctgag

SEQ ID NO: 63705 - DNA, 25 bp, Rattus norvegicus
aatggccctgtacagtctgtcacac

SEQ ID NO: 63706 - DNA, 25 bp, Rattus norvegicus
aatggccctgtagagtctgtcacac

SEQ ID NO: 63707 - DNA, 25 bp, Rattus norvegicus
aatggccctgtgcacttaagtgatc

SEQ ID NO: 63708 - DNA, 25 bp, Rattus norvegicus
aatggccctgtggacttaagtgatc

SEQ ID NO: 63709 - DNA, 25 bp, Rattus norvegicus
aatggcccttcccaggaggtgatga

SEQ ID NO: 63710 - DNA, 25 bp, Rattus norvegicus
aatggcccttccgaggaggtgatga

SEQ ID NO: 63711 - DNA, 25 bp, Rattus norvegicus
aatggcccttttctgagatgcttcc

SEQ ID NO: 63712 - DNA, 25 bp, Rattus norvegicus
aatggcccttttgtgagatgcttcc

SEQ ID NO: 63713 - DNA, 25 bp, Rattus norvegicus
aatggccgagaacaaggctcgcaca

SEQ ID NO: 63714 - DNA, 25 bp, Rattus norvegicus
aatggccgagaagaaggctcgcaca

SEQ ID NO: 63715 - DNA, 25 bp, Rattus norvegicus
aatggccgatttaactacctgatcc

SEQ ID NO: 63716 - DNA, 25 bp, Rattus norvegicus
aatggccgattttactacctgatcc

SEQ ID NO: 63717 - DNA, 25 bp, Rattus norvegicus
aatggccgccttctgacatcccaaa

SEQ ID NO: 63718 - DNA, 25 bp, Rattus norvegicus
aatggccgccttgtgacatcccaaa

SEQ ID NO: 63719 - DNA, 25 bp, Rattus norvegicus
aatggccggattctgagcctagcct

SEQ ID NO: 63720 - DNA, 25 bp, Rattus norvegicus
aatggccggattgtgagcctagcct

SEQ ID NO: 63721 - DNA, 25 bp, Rattus norvegicus
aatggccgggagatggatccaccct

SEQ ID NO: 63722 - DNA, 25 bp, Rattus norvegicus
aatggccgggagttggatccaccct

SEQ ID NO: 63723 - DNA, 25 bp, Rattus norvegicus
aatggccgtttacactggagactca

SEQ ID NO: 63724 - DNA, 25 bp, Rattus norvegicus
aatggccgtttagactggagactca

SEQ ID NO: 63725 - DNA, 25 bp, Rattus norvegicus
aatggcctagcgcttaagtgttcat

SEQ ID NO: 63726 - DNA, 25 bp, Rattus norvegicus
aatggcctagcggttaagtgttcat

SEQ ID NO: 63727 - DNA, 25 bp, Rattus norvegicus
aatggcctatagaggtgttgtatca

SEQ ID NO: 63728 - DNA, 25 bp, Rattus norvegicus
aatggcctatagtggtgttgtatca

SEQ ID NO: 63729 - DNA, 25 bp, Rattus norvegicus
aatggcctcaagaacggttgtatgt

SEQ ID NO: 63730 - DNA, 25 bp, Rattus norvegicus
aatggcctcaagagcagggcgcctt

SEQ ID NO: 63731 - DNA, 25 bp, Rattus norvegicus
aatggcctcaagtacggttgtatgt

SEQ ID NO: 63732 - DNA, 25 bp, Rattus norvegicus
aatggcctcaagtgcagggcgcctt

SEQ ID NO: 63733 - DNA, 25 bp, Rattus norvegicus
aatggcctcatgattctgcctctgg

SEQ ID NO: 63734 - DNA, 25 bp, Rattus norvegicus
aatggcctcatgtttctgcctctgg

SEQ ID NO: 63735 - DNA, 25 bp, Rattus norvegicus
aatggcctcctcatagtgcatgtgg

SEQ ID NO: 63736 - DNA, 25 bp, Rattus norvegicus
aatggcctcctcttagtgcatgtgg

SEQ ID NO: 63737 - DNA, 25 bp, Rattus norvegicus
aatggcctctaaaacctgttgatgc

SEQ ID NO: 63738 - DNA, 25 bp, Rattus norvegicus
aatggcctctaatacctgttgatgc

SEQ ID NO: 63739 - DNA, 25 bp, Rattus norvegicus
aatggcctcttcataccttgctttg

SEQ ID NO: 63740 - DNA, 25 bp, Rattus norvegicus
aatggcctcttcttaccttgctttg

SEQ ID NO: 63741 - DNA, 25 bp, Rattus norvegicus
aatggcctcttgctattttgatccc

SEQ ID NO: 63742 - DNA, 25 bp, Rattus norvegicus
aatggcctcttggtattttgatccc

SEQ ID NO: 63743 - DNA, 25 bp, Rattus norvegicus
aatggcctgattcagacccacggag

SEQ ID NO: 63744 - DNA, 25 bp, Rattus norvegicus
aatggcctgattgagacccacggag

SEQ ID NO: 63745 - DNA, 25 bp, Rattus norvegicus
aatggcctgcagcagccacaactta

SEQ ID NO: 63746 - DNA, 25 bp, Rattus norvegicus
aatggcctgcaggagccacaactta

SEQ ID NO: 63747 - DNA, 25 bp, Rattus norvegicus
aatggcctgcatctttttagtctac

SEQ ID NO: 63748 - DNA, 25 bp, Rattus norvegicus
aatggcctgcatgtttttagtctac

SEQ ID NO: 63749 - DNA, 25 bp, Rattus norvegicus
aatggcctgtcgaggctgagctgta

SEQ ID NO: 63750 - DNA, 25 bp, Rattus norvegicus
aatggcctgtcgtggctgagctgta

SEQ ID NO: 63751 - DNA, 25 bp, Rattus norvegicus
aatggccttaacacactggaccacg

SEQ ID NO: 63752 - DNA, 25 bp, Rattus norvegicus
aatggccttaactcactggaccacg

SEQ ID NO: 63753 - DNA, 25 bp, Rattus norvegicus
aatggccttaggcttgtcctgttag

SEQ ID NO: 63754 - DNA, 25 bp, Rattus norvegicus
aatggccttagggttgtcctgttag

SEQ ID NO: 63755 - DNA, 25 bp, Rattus norvegicus
aatggccttccaagaaagggctgtg

SEQ ID NO: 63756 - DNA, 25 bp, Rattus norvegicus
aatggccttccatgaaagggctgtg

SEQ ID NO: 63757 - DNA, 25 bp, Rattus norvegicus
aatggcctttcacggcacctacact

SEQ ID NO: 63758 - DNA, 25 bp, Rattus norvegicus
aatggcctttcagggcacctacact

SEQ ID NO: 63759 - DNA, 25 bp, Rattus norvegicus
aatggcctttccaaagagacttacg

SEQ ID NO: 63760 - DNA, 25 bp, Rattus norvegicus
aatggcctttcctaagagacttacg

SEQ ID NO: 63761 - DNA, 25 bp, Rattus norvegicus
aatggcctttgaagaatacactaaa

SEQ ID NO: 63762 - DNA, 25 bp, Rattus norvegicus
aatggcctttgatgaatacactaaa

SEQ ID NO: 63763 - DNA, 25 bp, Rattus norvegicus
aatggcctttggacccagttgtgaa

SEQ ID NO: 63764 - DNA, 25 bp, Rattus norvegicus
aatggcctttggtcccagttgtgaa

SEQ ID NO: 63765 - DNA, 25 bp, Rattus norvegicus
aatggcgcccagagtgtggctgttt

SEQ ID NO: 63766 - DNA, 25 bp, Rattus norvegicus
aatggcgcccagtgtgtggctgttt

SEQ ID NO: 63767 - DNA, 25 bp, Rattus norvegicus
aatggcgccgtgctacacagatgct

SEQ ID NO: 63768 - DNA, 25 bp, Rattus norvegicus
aatggcgccgtggtacacagatgct

SEQ ID NO: 63769 - DNA, 25 bp, Rattus norvegicus
aatggcgccttgaccatgatagcca

SEQ ID NO: 63770 - DNA, 25 bp, Rattus norvegicus
aatggcgccttgtccatgatagcca

SEQ ID NO: 63771 - DNA, 25 bp, Rattus norvegicus
aatggcgctcctcatccaataaaag

SEQ ID NO: 63772 - DNA, 25 bp, Rattus norvegicus
aatggcgctcctgatccaataaaag

SEQ ID NO: 63773 - DNA, 25 bp, Rattus norvegicus
aatggcgcttcacaaaccgcagggc

SEQ ID NO: 63774 - DNA, 25 bp, Rattus norvegicus
aatggcgcttcagaaaccgcagggc

SEQ ID NO: 63775 - DNA, 25 bp, Rattus norvegicus
aatggcggcaaaagcccctgggtat

SEQ ID NO: 63776 - DNA, 25 bp, Rattus norvegicus
aatggcggcaaatgcccctgggtat

SEQ ID NO: 63777 - DNA, 25 bp, Rattus norvegicus
aatggcggcttacgcgcacgccgta

SEQ ID NO: 63778 - DNA, 25 bp, Rattus norvegicus
aatggcggcttaggcgcacgccgta

SEQ ID NO: 63779 - DNA, 25 bp, Rattus norvegicus
aatggcggtacaactgcagcagcag

SEQ ID NO: 63780 - DNA, 25 bp, Rattus norvegicus
aatggcggtacatctgcagcagcag

SEQ ID NO: 63781 - DNA, 25 bp, Rattus norvegicus
aatggcggtcccagtggtcttcaaa

SEQ ID NO: 63782 - DNA, 25 bp, Rattus norvegicus
aatggcggtccctgtggtcttcaaa

SEQ ID NO: 63783 - DNA, 25 bp, Rattus norvegicus
aatggcggtcttcgttggcaattac

SEQ ID NO: 63784 - DNA, 25 bp, Rattus norvegicus
aatggcggtcttggttggcaattac

SEQ ID NO: 63785 - DNA, 25 bp, Rattus norvegicus
aatggcggtggcaactaccactact

SEQ ID NO: 63786 - DNA, 25 bp, Rattus norvegicus
aatggcggtggctactaccactact

SEQ ID NO: 63787 - DNA, 25 bp, Rattus norvegicus
aatggcggttctcttaaagctgggc

SEQ ID NO: 63788 - DNA, 25 bp, Rattus norvegicus
aatggcggttctgttaaagctgggc

SEQ ID NO: 63789 - DNA, 25 bp, Rattus norvegicus
aatggcgtcatgactgattacccca

SEQ ID NO: 63790 - DNA, 25 bp, Rattus norvegicus
aatggcgtcatgtctgattacccca

SEQ ID NO: 63791 - DNA, 25 bp, Rattus norvegicus
aatggcgtcgaactcaggcacctca

SEQ ID NO: 63792 - DNA, 25 bp, Rattus norvegicus
aatggcgtcgaagtcaggcacctca

SEQ ID NO: 63793 - DNA, 25 bp, Rattus norvegicus
aatggcgtcttacatgccttcactg

SEQ ID NO: 63794 - DNA, 25 bp, Rattus norvegicus
aatggcgtcttagatgccttcactg

SEQ ID NO: 63795 - DNA, 25 bp, Rattus norvegicus
aatggcgtgtaaatgcttctacccc

SEQ ID NO: 63796 - DNA, 25 bp, Rattus norvegicus
aatggcgtgtaattgcttctacccc

SEQ ID NO: 63797 - DNA, 25 bp, Rattus norvegicus
aatggcgtgtgtaacactggcgctg

SEQ ID NO: 63798 - DNA, 25 bp, Rattus norvegicus
aatggcgtgtgttacactggcgctg

SEQ ID NO: 63799 - DNA, 25 bp, Rattus norvegicus
aatggcgttagtcttacactctgaa

SEQ ID NO: 63800 - DNA, 25 bp, Rattus norvegicus
aatggcgttagtgttacactctgaa

SEQ ID NO: 63801 - DNA, 25 bp, Rattus norvegicus
aatggcgttgccctgtataccttgg

SEQ ID NO: 63802 - DNA, 25 bp, Rattus norvegicus
aatggcgttgccgtgtataccttgg

SEQ ID NO: 63803 - DNA, 25 bp, Rattus norvegicus
aatggcgttgttcagttattaccga

SEQ ID NO: 63804 - DNA, 25 bp, Rattus norvegicus
aatggcgttgttgagttattaccga

SEQ ID NO: 63805 - DNA, 25 bp, Rattus norvegicus
aatggcgttttcaatccagcgaaag

SEQ ID NO: 63806 - DNA, 25 bp, Rattus norvegicus
aatggcgttttctatccagcgaaag

SEQ ID NO: 63807 - DNA, 25 bp, Rattus norvegicus
aatggctaaagcattttgtggcggg

SEQ ID NO: 63808 - DNA, 25 bp, Rattus norvegicus
aatggctaaagctttttgtggcggg

SEQ ID NO: 63809 - DNA, 25 bp, Rattus norvegicus
aatggctaagcaccgcggccccgtg

SEQ ID NO: 63810 - DNA, 25 bp, Rattus norvegicus
aatggctaagcagcgcggccccgtg

SEQ ID NO: 63811 - DNA, 25 bp, Rattus norvegicus
aatggctaccacagcactttgggac

SEQ ID NO: 63812 - DNA, 25 bp, Rattus norvegicus
aatggctaccactgcactttgggac

SEQ ID NO: 63813 - DNA, 25 bp, Rattus norvegicus
aatggctaccttatgaagctgctga

SEQ ID NO: 63814 - DNA, 25 bp, Rattus norvegicus
aatggctaccttttgaagctgctga

SEQ ID NO: 63815 - DNA, 25 bp, Rattus norvegicus
aatggctaggacatcgcatggaata

SEQ ID NO: 63816 - DNA, 25 bp, Rattus norvegicus
aatggctaggacttcgcatggaata

SEQ ID NO: 63817 - DNA, 25 bp, Rattus norvegicus
aatggctatattactgcatcttggg

SEQ ID NO: 63818 - DNA, 25 bp, Rattus norvegicus
aatggctatatttctgcatcttggg

SEQ ID NO: 63819 - DNA, 25 bp, Rattus norvegicus
aatggctatgaacccaccgagccag

SEQ ID NO: 63820 - DNA, 25 bp, Rattus norvegicus
aatggctatgaagccaccgagccag

SEQ ID NO: 63821 - DNA, 25 bp, Rattus norvegicus
aatggctatgcacaaaatttatcaa

SEQ ID NO: 63822 - DNA, 25 bp, Rattus norvegicus
aatggctatgcagaaaatttatcaa

SEQ ID NO: 63823 - DNA, 25 bp, Rattus norvegicus
aatggctatgctatgaagtcttatc

SEQ ID NO: 63824 - DNA, 25 bp, Rattus norvegicus
aatggctatgctctaagattaagaa

SEQ ID NO: 63825 - DNA, 25 bp, Rattus norvegicus
aatggctatgctgtaagattaagaa

SEQ ID NO: 63826 - DNA, 25 bp, Rattus norvegicus
aatggctatgctttgaagtcttatc

SEQ ID NO: 63827 - DNA, 25 bp, Rattus norvegicus
aatggctcaatccttgtggtgttgc

SEQ ID NO: 63828 - DNA, 25 bp, Rattus norvegicus
aatggctcaatcgttgtggtgttgc

SEQ ID NO: 63829 - DNA, 25 bp, Rattus norvegicus
aatggctcagtcagggactcaagct

SEQ ID NO: 63830 - DNA, 25 bp, Rattus norvegicus
aatggctcagtctgggactcaagct

SEQ ID NO: 63831 - DNA, 25 bp, Rattus norvegicus
aatggctcccacacatagcacatga

SEQ ID NO: 63832 - DNA, 25 bp, Rattus norvegicus
aatggctcccactcatagcacatga

SEQ ID NO: 63833 - DNA, 25 bp, Rattus norvegicus
aatggctccctacatgtgtgcatgt

SEQ ID NO: 63834 - DNA, 25 bp, Rattus norvegicus
aatggctccctactcaaagtgccta

SEQ ID NO: 63835 - DNA, 25 bp, Rattus norvegicus
aatggctccctagatgtgtgcatgt

SEQ ID NO: 63836 - DNA, 25 bp, Rattus norvegicus
aatggctccctagtcaaagtgccta

SEQ ID NO: 63837 - DNA, 25 bp, Rattus norvegicus
aatggctccgctaaaacttgtttca

SEQ ID NO: 63838 - DNA, 25 bp, Rattus norvegicus
aatggctccgcttaaacttgtttca

SEQ ID NO: 63839 - DNA, 25 bp, Rattus norvegicus
aatggctcctgtactctgtgtttat

SEQ ID NO: 63840 - DNA, 25 bp, Rattus norvegicus
aatggctcctgttctctgtgtttat

SEQ ID NO: 63841 - DNA, 25 bp, Rattus norvegicus
aatggctctcttattctgtaattca

SEQ ID NO: 63842 - DNA, 25 bp, Rattus norvegicus
aatggctctctttttctgtaattca

SEQ ID NO: 63843 - DNA, 25 bp, Rattus norvegicus
aatggctctgaacaacctgtgtgac

SEQ ID NO: 63844 - DNA, 25 bp, Rattus norvegicus
aatggctctgaagaacctgtgtgac

SEQ ID NO: 63845 - DNA, 25 bp, Rattus norvegicus
aatggctctgagatctgattcaaac

SEQ ID NO: 63846 - DNA, 25 bp, Rattus norvegicus
aatggctctgagttctgattcaaac

SEQ ID NO: 63847 - DNA, 25 bp, Rattus norvegicus
aatggctctgtcaagtgtaattccc

SEQ ID NO: 63848 - DNA, 25 bp, Rattus norvegicus
aatggctctgtctagtgtaattccc

SEQ ID NO: 63849 - DNA, 25 bp, Rattus norvegicus
aatggctctttgcatagaacataac

SEQ ID NO: 63850 - DNA, 25 bp, Rattus norvegicus
aatggctctttggatagaacataac

SEQ ID NO: 63851 - DNA, 25 bp, Rattus norvegicus
aatggctgacacaagagaccctggc

SEQ ID NO: 63852 - DNA, 25 bp, Rattus norvegicus
aatggctgacactagagaccctggc

SEQ ID NO: 63853 - DNA, 25 bp, Rattus norvegicus
aatggctgacgcactttttcacagt

SEQ ID NO: 63854 - DNA, 25 bp, Rattus norvegicus
aatggctgacgctctttttcacagt

SEQ ID NO: 63855 - DNA, 25 bp, Rattus norvegicus
aatggctgagcaatgtgaatgactt

SEQ ID NO: 63856 - DNA, 25 bp, Rattus norvegicus
aatggctgagcattgtgaatgactt

SEQ ID NO: 63857 - DNA, 25 bp, Rattus norvegicus
aatggctgagccaccaactgtgaaa

SEQ ID NO: 63858 - DNA, 25 bp, Rattus norvegicus
aatggctgagcctccaactgtgaaa

SEQ ID NO: 63859 - DNA, 25 bp, Rattus norvegicus
aatggctgcactcggcttgctagtc

SEQ ID NO: 63860 - DNA, 25 bp, Rattus norvegicus
aatggctgcactgggcttgctagtc

SEQ ID NO: 63861 - DNA, 25 bp, Rattus norvegicus
aatggctgcagcatcgagtactggt

SEQ ID NO: 63862 - DNA, 25 bp, Rattus norvegicus
aatggctgcagcttcgagtactggt

SEQ ID NO: 63863 - DNA, 25 bp, Rattus norvegicus
aatggctgcatgctattttcttgtt

SEQ ID NO: 63864 - DNA, 25 bp, Rattus norvegicus
aatggctgcatggtattttcttgtt

SEQ ID NO: 63865 - DNA, 25 bp, Rattus norvegicus
aatggctgccgtaagaaaacctcct

SEQ ID NO: 63866 - DNA, 25 bp, Rattus norvegicus
aatggctgccgttagaaaacctcct

SEQ ID NO: 63867 - DNA, 25 bp, Rattus norvegicus
aatggctgcttcctaccatgtagaa

SEQ ID NO: 63868 - DNA, 25 bp, Rattus norvegicus
aatggctgcttcgtaccatgtagaa

SEQ ID NO: 63869 - DNA, 25 bp, Rattus norvegicus
aatggctggccaaggacttgttctt

SEQ ID NO: 63870 - DNA, 25 bp, Rattus norvegicus
aatggctggccatggacttgttctt

SEQ ID NO: 63871 - DNA, 25 bp, Rattus norvegicus
aatggctggtcacaatggctggtct

SEQ ID NO: 63872 - DNA, 25 bp, Rattus norvegicus
aatggctggtcagaatggctggtct

SEQ ID NO: 63873 - DNA, 25 bp, Rattus norvegicus
aatggctggttgacgctcgtactgt

SEQ ID NO: 63874 - DNA, 25 bp, Rattus norvegicus
aatggctggttgtcgctcgtactgt

SEQ ID NO: 63875 - DNA, 25 bp, Rattus norvegicus
aatggctgtagcattctagctccag

SEQ ID NO: 63876 - DNA, 25 bp, Rattus norvegicus
aatggctgtagctttctagctccag

SEQ ID NO: 63877 - DNA, 25 bp, Rattus norvegicus
aatggctgtcaaagttccttggcta

SEQ ID NO: 63878 - DNA, 25 bp, Rattus norvegicus
aatggctgtcaatgttccttggcta

SEQ ID NO: 63879 - DNA, 25 bp, Rattus norvegicus
aatggctgtgcaaagtcccagtact

SEQ ID NO: 63880 - DNA, 25 bp, Rattus norvegicus
aatggctgtgcatagtcccagtact

SEQ ID NO: 63881 - DNA, 25 bp, Rattus norvegicus
aatggctgtgtcacccgggtcaagc

SEQ ID NO: 63882 - DNA, 25 bp, Rattus norvegicus
aatggctgtgtctcccgggtcaagc

SEQ ID NO: 63883 - DNA, 25 bp, Rattus norvegicus
aatggcttaaaaatctcttcactcc

SEQ ID NO: 63884 - DNA, 25 bp, Rattus norvegicus
aatggcttaaaattctcttcactcc

SEQ ID NO: 63885 - DNA, 25 bp, Rattus norvegicus
aatggcttacatcttcaggaaatac

SEQ ID NO: 63886 - DNA, 25 bp, Rattus norvegicus
aatggcttacatgttcaggaaatac

SEQ ID NO: 63887 - DNA, 25 bp, Rattus norvegicus
aatggcttatatcactatgctgtat

SEQ ID NO: 63888 - DNA, 25 bp, Rattus norvegicus
aatggcttatatgactatgctgtat

SEQ ID NO: 63889 - DNA, 25 bp, Rattus norvegicus
aatggcttcccaaagaggctggaca

SEQ ID NO: 63890 - DNA, 25 bp, Rattus norvegicus
aatggcttcccatagaggctggaca

SEQ ID NO: 63891 - DNA, 25 bp, Rattus norvegicus
aatggcttcctaatctgactgacac

SEQ ID NO: 63892 - DNA, 25 bp, Rattus norvegicus
aatggcttcctattctgactgacac

SEQ ID NO: 63893 - DNA, 25 bp, Rattus norvegicus
aatggcttccttattgtttgctaca

SEQ ID NO: 63894 - DNA, 25 bp, Rattus norvegicus
aatggcttcctttttgtttgctaca

SEQ ID NO: 63895 - DNA, 25 bp, Rattus norvegicus
aatggcttctgcatcgttttccaaa

SEQ ID NO: 63896 - DNA, 25 bp, Rattus norvegicus
aatggcttctgcttcgttttccaaa

SEQ ID NO: 63897 - DNA, 25 bp, Rattus norvegicus
aatggcttcttgctttcgaaatggc

SEQ ID NO: 63898 - DNA, 25 bp, Rattus norvegicus
aatggcttcttggtttcgaaatggc

SEQ ID NO: 63899 - DNA, 25 bp, Rattus norvegicus
aatggcttgctgacaccaacactaa

SEQ ID NO: 63900 - DNA, 25 bp, Rattus norvegicus
aatggcttgctgtcaccaacactaa

SEQ ID NO: 63901 - DNA, 25 bp, Rattus norvegicus
aatggcttggctctgataggtgtat

SEQ ID NO: 63902 - DNA, 25 bp, Rattus norvegicus
aatggcttggctcttttgcctgaca

SEQ ID NO: 63903 - DNA, 25 bp, Rattus norvegicus
aatggcttggctgtgataggtgtat

SEQ ID NO: 63904 - DNA, 25 bp, Rattus norvegicus
aatggcttggctgttttgcctgaca

SEQ ID NO: 63905 - DNA, 25 bp, Rattus norvegicus
aatggcttgtttactggattgggtc

SEQ ID NO: 63906 - DNA, 25 bp, Rattus norvegicus
aatggcttgtttcgtccttattctt

SEQ ID NO: 63907 - DNA, 25 bp, Rattus norvegicus
aatggcttgtttggtccttattctt

SEQ ID NO: 63908 - DNA, 25 bp, Rattus norvegicus
aatggcttgttttctggattgggtc

SEQ ID NO: 63909 - DNA, 25 bp, Rattus norvegicus
aatggctttactagtgacacgcccc

SEQ ID NO: 63910 - DNA, 25 bp, Rattus norvegicus
aatggctttacttgtgacacgcccc

SEQ ID NO: 63911 - DNA, 25 bp, Rattus norvegicus
aatggctttagtagctctcttggat

SEQ ID NO: 63912 - DNA, 25 bp, Rattus norvegicus
aatggctttagttgctctcttggat

SEQ ID NO: 63913 - DNA, 25 bp, Rattus norvegicus
aatggctttctgcaaacgtctggtg

SEQ ID NO: 63914 - DNA, 25 bp, Rattus norvegicus
aatggctttctggaaacgtctggtg

SEQ ID NO: 63915 - DNA, 25 bp, Rattus norvegicus
aatggctttcttctagatggcttcc

SEQ ID NO: 63916 - DNA, 25 bp, Rattus norvegicus
aatggctttcttgtagatggcttcc

SEQ ID NO: 63917 - DNA, 25 bp, Rattus norvegicus
aatggctttgttagacctgctttca

SEQ ID NO: 63918 - DNA, 25 bp, Rattus norvegicus
aatggctttgtttgacctgctttca

SEQ ID NO: 63919 - DNA, 25 bp, Rattus norvegicus
aatggcttttagcttgttttgaaat

SEQ ID NO: 63920 - DNA, 25 bp, Rattus norvegicus
aatggcttttaggttgttttgaaat

SEQ ID NO: 63921 - DNA, 25 bp, Rattus norvegicus
aatggcttttcgacacttaattgag

SEQ ID NO: 63922 - DNA, 25 bp, Rattus norvegicus
aatggcttttcgtcacttaattgag

SEQ ID NO: 63923 - DNA, 25 bp, Rattus norvegicus
aatggctttttaaactgttgcatct

SEQ ID NO: 63924 - DNA, 25 bp, Rattus norvegicus
aatggctttttatactgttgcatct

SEQ ID NO: 63925 - DNA, 25 bp, Rattus norvegicus
aatgggaagcagcacgagcctcttg

SEQ ID NO: 63926 - DNA, 25 bp, Rattus norvegicus
aatgggaagcaggacgagcctcttg

SEQ ID NO: 63927 - DNA, 25 bp, Rattus norvegicus
aatgggaagccacccctttgggtag

SEQ ID NO: 63928 - DNA, 25 bp, Rattus norvegicus
aatgggaagccagccctttgggtag

SEQ ID NO: 63929 - DNA, 25 bp, Rattus norvegicus
aatgggaagcgcctgtttgctttga

SEQ ID NO: 63930 - DNA, 25 bp, Rattus norvegicus
aatgggaagcgcgtgtttgctttga

SEQ ID NO: 63931 - DNA, 25 bp, Rattus norvegicus
aatgggaagctcatgtggatgtatc

SEQ ID NO: 63932 - DNA, 25 bp, Rattus norvegicus
aatgggaagctcttgtggatgtatc

SEQ ID NO: 63933 - DNA, 25 bp, Rattus norvegicus
aatgggaagtataccagctgaggca

SEQ ID NO: 63934 - DNA, 25 bp, Rattus norvegicus
aatgggaagtattccagctgaggca

SEQ ID NO: 63935 - DNA, 25 bp, Rattus norvegicus
aatgggaatctgaggccctcttgtg

SEQ ID NO: 63936 - DNA, 25 bp, Rattus norvegicus
aatgggaatctgtggccctcttgtg

SEQ ID NO: 63937 - DNA, 25 bp, Rattus norvegicus
aatgggaattgccagccccacgaag

SEQ ID NO: 63938 - DNA, 25 bp, Rattus norvegicus
aatgggaattgcgagccccacgaag

SEQ ID NO: 63939 - DNA, 25 bp, Rattus norvegicus
aatgggacaacaacctacacactat

SEQ ID NO: 63940 - DNA, 25 bp, Rattus norvegicus
aatgggacaacatcctacacactat

SEQ ID NO: 63941 - DNA, 25 bp, Rattus norvegicus
aatgggacaaggatgctgttctctc

SEQ ID NO: 63942 - DNA, 25 bp, Rattus norvegicus
aatgggacaaggttgctgttctctc

SEQ ID NO: 63943 - DNA, 25 bp, Rattus norvegicus
aatgggacagccatccatgttcatc

SEQ ID NO: 63944 - DNA, 25 bp, Rattus norvegicus
aatgggacagccttccatgttcatc

SEQ ID NO: 63945 - DNA, 25 bp, Rattus norvegicus
aatgggacaggtcctgcccttgtca

SEQ ID NO: 63946 - DNA, 25 bp, Rattus norvegicus
aatgggacaggtgctgcccttgtca

SEQ ID NO: 63947 - DNA, 25 bp, Rattus norvegicus
aatgggacagtcacatgacctccaa

SEQ ID NO: 63948 - DNA, 25 bp, Rattus norvegicus
aatgggacagtctcatgacctccaa

SEQ ID NO: 63949 - DNA, 25 bp, Rattus norvegicus
aatgggacagttacgttctttgata

SEQ ID NO: 63950 - DNA, 25 bp, Rattus norvegicus
aatgggacagtttcgttctttgata

SEQ ID NO: 63951 - DNA, 25 bp, Rattus norvegicus
aatgggacatcaaccaggctgtaga

SEQ ID NO: 63952 - DNA, 25 bp, Rattus norvegicus
aatgggacatcatccaggctgtaga

SEQ ID NO: 63953 - DNA, 25 bp, Rattus norvegicus
aatgggaccacaagattgcggcaac

SEQ ID NO: 63954 - DNA, 25 bp, Rattus norvegicus
aatgggaccacatgattgcggcaac

SEQ ID NO: 63955 - DNA, 25 bp, Rattus norvegicus
aatgggacccacatataatgctgac

SEQ ID NO: 63956 - DNA, 25 bp, Rattus norvegicus
aatgggacccacttataatgctgac

SEQ ID NO: 63957 - DNA, 25 bp, Rattus norvegicus
aatgggacccatcgcggaaccatcg

SEQ ID NO: 63958 - DNA, 25 bp, Rattus norvegicus
aatgggacccatggcggaaccatcg

SEQ ID NO: 63959 - DNA, 25 bp, Rattus norvegicus
aatgggaccctaaagcatatgttca

SEQ ID NO: 63960 - DNA, 25 bp, Rattus norvegicus
aatgggaccctatagcatatgttca

SEQ ID NO: 63961 - DNA, 25 bp, Rattus norvegicus
aatgggacctaaccttagcaataag

SEQ ID NO: 63962 - DNA, 25 bp, Rattus norvegicus
aatgggacctaagcttagcaataag

SEQ ID NO: 63963 - DNA, 25 bp, Rattus norvegicus
aatgggacctacaagcctgtgtgat

SEQ ID NO: 63964 - DNA, 25 bp, Rattus norvegicus
aatgggacctacagagccatgcccc

SEQ ID NO: 63965 - DNA, 25 bp, Rattus norvegicus
aatgggacctactagcctgtgtgat

SEQ ID NO: 63966 - DNA, 25 bp, Rattus norvegicus
aatgggacctactgagccatgcccc

SEQ ID NO: 63967 - DNA, 25 bp, Rattus norvegicus
aatgggacctgaaatgcctctaact

SEQ ID NO: 63968 - DNA, 25 bp, Rattus norvegicus
aatgggacctgatatgcctctaact

SEQ ID NO: 63969 - DNA, 25 bp, Rattus norvegicus
aatgggaccttaaccaagtgtgcag

SEQ ID NO: 63970 - DNA, 25 bp, Rattus norvegicus
aatgggaccttatccaagtgtgcag

SEQ ID NO: 63971 - DNA, 25 bp, Rattus norvegicus
aatgggacgatccaatcctagccga

SEQ ID NO: 63972 - DNA, 25 bp, Rattus norvegicus
aatgggacgatcgaatcctagccga

SEQ ID NO: 63973 - DNA, 25 bp, Rattus norvegicus
aatgggacgattcaggtgcctcctc

SEQ ID NO: 63974 - DNA, 25 bp, Rattus norvegicus
aatgggacgattgaggtgcctcctc

SEQ ID NO: 63975 - DNA, 25 bp, Rattus norvegicus
aatgggacggatagggtgcctgctc

SEQ ID NO: 63976 - DNA, 25 bp, Rattus norvegicus
aatgggacggattgggtgcctgctc

SEQ ID NO: 63977 - DNA, 25 bp, Rattus norvegicus
aatgggactatgatggcccttcatg

SEQ ID NO: 63978 - DNA, 25 bp, Rattus norvegicus
aatgggactatgttggcccttcatg

SEQ ID NO: 63979 - DNA, 25 bp, Rattus norvegicus
aatgggactctacacaagccgggaa

SEQ ID NO: 63980 - DNA, 25 bp, Rattus norvegicus
aatgggactctagacaagccgggaa

SEQ ID NO: 63981 - DNA, 25 bp, Rattus norvegicus
aatgggactctcatttcctctataa

SEQ ID NO: 63982 - DNA, 25 bp, Rattus norvegicus
aatgggactctcttttcctctataa

SEQ ID NO: 63983 - DNA, 25 bp, Rattus norvegicus
aatgggactgtgatgtggtatcact

SEQ ID NO: 63984 - DNA, 25 bp, Rattus norvegicus
aatgggactgtgttgtggtatcact

SEQ ID NO: 63985 - DNA, 25 bp, Rattus norvegicus
aatgggacttcgaagccgtgaaatc

SEQ ID NO: 63986 - DNA, 25 bp, Rattus norvegicus
aatgggacttcgtagccgtgaaatc

SEQ ID NO: 63987 - DNA, 25 bp, Rattus norvegicus
aatgggacttgtattggatggtgca

SEQ ID NO: 63988 - DNA, 25 bp, Rattus norvegicus
aatgggacttgttttggatggtgca

SEQ ID NO: 63989 - DNA, 25 bp, Rattus norvegicus
aatgggagagccagtcataggccaa

SEQ ID NO: 63990 - DNA, 25 bp, Rattus norvegicus
aatgggagagcctgtcataggccaa

SEQ ID NO: 63991 - DNA, 25 bp, Rattus norvegicus
aatgggagcagcacatgccaggcag

SEQ ID NO: 63992 - DNA, 25 bp, Rattus norvegicus
aatgggagcagctcatgccaggcag

SEQ ID NO: 63993 - DNA, 25 bp, Rattus norvegicus
aatgggagccacagcaaatctgagg

SEQ ID NO: 63994 - DNA, 25 bp, Rattus norvegicus
aatgggagccactgcaaatctgagg

SEQ ID NO: 63995 - DNA, 25 bp, Rattus norvegicus
aatgggagctgcatcgttttcggat

SEQ ID NO: 63996 - DNA, 25 bp, Rattus norvegicus
aatgggagctgcttcgttttcggat

SEQ ID NO: 63997 - DNA, 25 bp, Rattus norvegicus
aatgggagcttgacgagtcttcaga

SEQ ID NO: 63998 - DNA, 25 bp, Rattus norvegicus
aatgggagcttgtcgagtcttcaga

SEQ ID NO: 63999 - DNA, 25 bp, Rattus norvegicus
aatgggaggctcattgctctgctat

SEQ ID NO: 64000 - DNA, 25 bp, Rattus norvegicus
aatgggaggctctttgctctgctat

SEQ ID NO: 64001 - DNA, 25 bp, Rattus norvegicus
aatgggaggtttacatcggctgtca

SEQ ID NO: 64002 - DNA, 25 bp, Rattus norvegicus
aatgggaggttttcatcggctgtca

SEQ ID NO: 64003 - DNA, 25 bp, Rattus norvegicus
aatgggataacgatctgctggcagg

SEQ ID NO: 64004 - DNA, 25 bp, Rattus norvegicus
aatgggataacgttctgctggcagg

SEQ ID NO: 64005 - DNA, 25 bp, Rattus norvegicus
aatgggatagcacctctgagcctgg

SEQ ID NO: 64006 - DNA, 25 bp, Rattus norvegicus
aatgggatagcagctctgagcctgg

SEQ ID NO: 64007 - DNA, 25 bp, Rattus norvegicus
aatgggatcagcctggacctgcaag

SEQ ID NO: 64008 - DNA, 25 bp, Rattus norvegicus
aatgggatcagcgtggacctgcaag

SEQ ID NO: 64009 - DNA, 25 bp, Rattus norvegicus
aatgggatcctcacactttaggctc

SEQ ID NO: 64010 - DNA, 25 bp, Rattus norvegicus
aatgggatcctctcactttaggctc

SEQ ID NO: 64011 - DNA, 25 bp, Rattus norvegicus
aatgggatcgggacaaagttcgaga

SEQ ID NO: 64012 - DNA, 25 bp, Rattus norvegicus
aatgggatcgggtcaaagttcgaga

SEQ ID NO: 64013 - DNA, 25 bp, Rattus norvegicus
aatgggatggatacttttcctctct

SEQ ID NO: 64014 - DNA, 25 bp, Rattus norvegicus
aatgggatggattcttttcctctct

SEQ ID NO: 64015 - DNA, 25 bp, Rattus norvegicus
aatgggattgtgagctcaccccgtc

SEQ ID NO: 64016 - DNA, 25 bp, Rattus norvegicus
aatgggattgtgctcgagaactctg

SEQ ID NO: 64017 - DNA, 25 bp, Rattus norvegicus
aatgggattgtggtcgagaactctg

SEQ ID NO: 64018 - DNA, 25 bp, Rattus norvegicus
aatgggattgtgtgctcaccccgtc

SEQ ID NO: 64019 - DNA, 25 bp, Rattus norvegicus
aatgggatttccaacccttccagca

SEQ ID NO: 64020 - DNA, 25 bp, Rattus norvegicus
aatgggatttcctacccttccagca

SEQ ID NO: 64021 - DNA, 25 bp, Rattus norvegicus
aatgggatttctactgtcaatgagc

SEQ ID NO: 64022 - DNA, 25 bp, Rattus norvegicus
aatgggatttcttctgtcaatgagc

SEQ ID NO: 64023 - DNA, 25 bp, Rattus norvegicus
aatgggcaaattcccagacaaactg

SEQ ID NO: 64024 - DNA, 25 bp, Rattus norvegicus
aatgggcaaattgccagacaaactg

SEQ ID NO: 64025 - DNA, 25 bp, Rattus norvegicus
aatgggcaacaccagttgaatcaat

SEQ ID NO: 64026 - DNA, 25 bp, Rattus norvegicus
aatgggcaacacgagttgaatcaat

SEQ ID NO: 64027 - DNA, 25 bp, Rattus norvegicus
aatgggcaaccaactttacatgtta

SEQ ID NO: 64028 - DNA, 25 bp, Rattus norvegicus
aatgggcaaccatctttacatgtta

SEQ ID NO: 64029 - DNA, 25 bp, Rattus norvegicus
aatgggcacacaagggctccctcca

SEQ ID NO: 64030 - DNA, 25 bp, Rattus norvegicus
aatgggcacacatgggctccctcca

SEQ ID NO: 64031 - DNA, 25 bp, Rattus norvegicus
aatgggcagcataactcctaggtcc

SEQ ID NO: 64032 - DNA, 25 bp, Rattus norvegicus
aatgggcagcattactcctaggtcc

SEQ ID NO: 64033 - DNA, 25 bp, Rattus norvegicus
aatgggcagtttatggctcccgatc

SEQ ID NO: 64034 - DNA, 25 bp, Rattus norvegicus
aatgggcagtttttggctcccgatc

SEQ ID NO: 64035 - DNA, 25 bp, Rattus norvegicus
aatgggcatacaagtgcatttttaa

SEQ ID NO: 64036 - DNA, 25 bp, Rattus norvegicus
aatgggcatacatgtgcatttttaa

SEQ ID NO: 64037 - DNA, 25 bp, Rattus norvegicus
aatgggcatagcaggcttcagccac

SEQ ID NO: 64038 - DNA, 25 bp, Rattus norvegicus
aatgggcatagctggcttcagccac

SEQ ID NO: 64039 - DNA, 25 bp, Rattus norvegicus
aatgggcattccatatcagcagcag

SEQ ID NO: 64040 - DNA, 25 bp, Rattus norvegicus
aatgggcattccttatcagcagcag

SEQ ID NO: 64041 - DNA, 25 bp, Rattus norvegicus
aatgggccaaagatctaggttctgt

SEQ ID NO: 64042 - DNA, 25 bp, Rattus norvegicus
aatgggccaaagttctaggttctgt

SEQ ID NO: 64043 - DNA, 25 bp, Rattus norvegicus
aatgggccacatcacgctcaggaga

SEQ ID NO: 64044 - DNA, 25 bp, Rattus norvegicus
aatgggccacatgacgctcaggaga

SEQ ID NO: 64045 - DNA, 25 bp, Rattus norvegicus
aatgggccacctcggcaaagcgctc

SEQ ID NO: 64046 - DNA, 25 bp, Rattus norvegicus
aatgggccacctgggcaaagcgctc

SEQ ID NO: 64047 - DNA, 25 bp, Rattus norvegicus
aatgggccaggaaagttgtcacagt

SEQ ID NO: 64048 - DNA, 25 bp, Rattus norvegicus
aatgggccaggatagttgtcacagt

SEQ ID NO: 64049 - DNA, 25 bp, Rattus norvegicus
aatgggccagtaacatctcgtggtc

SEQ ID NO: 64050 - DNA, 25 bp, Rattus norvegicus
aatgggccagtacagcagtgttcag

SEQ ID NO: 64051 - DNA, 25 bp, Rattus norvegicus
aatgggccagtagagcagtgttcag

SEQ ID NO: 64052 - DNA, 25 bp, Rattus norvegicus
aatgggccagtatcatctcgtggtc

SEQ ID NO: 64053 - DNA, 25 bp, Rattus norvegicus
aatgggccatatccgcttggctgac

SEQ ID NO: 64054 - DNA, 25 bp, Rattus norvegicus
aatgggccatatgcgcttggctgac

SEQ ID NO: 64055 - DNA, 25 bp, Rattus norvegicus
aatgggccatggactagaggtcact

SEQ ID NO: 64056 - DNA, 25 bp, Rattus norvegicus
aatgggccatggtctagaggtcact

SEQ ID NO: 64057 - DNA, 25 bp, Rattus norvegicus
aatgggcccatcatagtgtgctgac

SEQ ID NO: 64058 - DNA, 25 bp, Rattus norvegicus
aatgggcccatcttagtgtgctgac

SEQ ID NO: 64059 - DNA, 25 bp, Rattus norvegicus
aatgggccctgtcctcattggcatt

SEQ ID NO: 64060 - DNA, 25 bp, Rattus norvegicus
aatgggccctgtgctcattggcatt

SEQ ID NO: 64061 - DNA, 25 bp, Rattus norvegicus
aatgggcccttgcagtggcttgaca

SEQ ID NO: 64062 - DNA, 25 bp, Rattus norvegicus
aatgggcccttggagtggcttgaca

SEQ ID NO: 64063 - DNA, 25 bp, Rattus norvegicus
aatgggcctctgcaggaaacctcaa

SEQ ID NO: 64064 - DNA, 25 bp, Rattus norvegicus
aatgggcctctggaggaaacctcaa

SEQ ID NO: 64065 - DNA, 25 bp, Rattus norvegicus
aatgggcgagcgagtcagcatctaa

SEQ ID NO: 64066 - DNA, 25 bp, Rattus norvegicus
aatgggcgagcgtgtcagcatctaa

SEQ ID NO: 64067 - DNA, 25 bp, Rattus norvegicus
aatgggcgcggccaggcgaggagag

SEQ ID NO: 64068 - DNA, 25 bp, Rattus norvegicus
aatgggcgcggcgaggcgaggagag

SEQ ID NO: 64069 - DNA, 25 bp, Rattus norvegicus
aatgggcggatcacatatcttcact

SEQ ID NO: 64070 - DNA, 25 bp, Rattus norvegicus
aatgggcggatctcatatcttcact

SEQ ID NO: 64071 - DNA, 25 bp, Rattus norvegicus
aatgggctaaggatcctacctcaca

SEQ ID NO: 64072 - DNA, 25 bp, Rattus norvegicus
aatgggctaaggttcctacctcaca

SEQ ID NO: 64073 - DNA, 25 bp, Rattus norvegicus
aatgggctacctatatatattgtgg

SEQ ID NO: 64074 - DNA, 25 bp, Rattus norvegicus
aatgggctacctttatatattgtgg

SEQ ID NO: 64075 - DNA, 25 bp, Rattus norvegicus
aatgggctaggtattatctggtctc

SEQ ID NO: 64076 - DNA, 25 bp, Rattus norvegicus
aatgggctaggttttatctggtctc

SEQ ID NO: 64077 - DNA, 25 bp, Rattus norvegicus
aatgggctcatgcagaccagcagga

SEQ ID NO: 64078 - DNA, 25 bp, Rattus norvegicus
aatgggctcatggagaccagcagga

SEQ ID NO: 64079 - DNA, 25 bp, Rattus norvegicus
aatgggctgaccaacgatgctgggc

SEQ ID NO: 64080 - DNA, 25 bp, Rattus norvegicus
aatgggctgacctacgatgctgggc

SEQ ID NO: 64081 - DNA, 25 bp, Rattus norvegicus
aatgggctgccaaacgcggaaccgc

SEQ ID NO: 64082 - DNA, 25 bp, Rattus norvegicus
aatgggctgccaacttgatttctca

SEQ ID NO: 64083 - DNA, 25 bp, Rattus norvegicus
aatgggctgccatacgcggaaccgc

SEQ ID NO: 64084 - DNA, 25 bp, Rattus norvegicus
aatgggctgccatcttgatttctca

SEQ ID NO: 64085 - DNA, 25 bp, Rattus norvegicus
aatgggcttccaagtcatcttgatc

SEQ ID NO: 64086 - DNA, 25 bp, Rattus norvegicus
aatgggcttccatgtcatcttgatc

SEQ ID NO: 64087 - DNA, 25 bp, Rattus norvegicus
aatgggcttctcaagtaggaaagtc

SEQ ID NO: 64088 - DNA, 25 bp, Rattus norvegicus
aatgggcttctccatttaccagcat

SEQ ID NO: 64089 - DNA, 25 bp, Rattus norvegicus
aatgggcttctcgatttaccagcat

SEQ ID NO: 64090 - DNA, 25 bp, Rattus norvegicus
aatgggcttctctagtaggaaagtc

SEQ ID NO: 64091 - DNA, 25 bp, Rattus norvegicus
aatgggcttggtcagcctgagtcaa

SEQ ID NO: 64092 - DNA, 25 bp, Rattus norvegicus
aatgggcttggtgagcctgagtcaa

SEQ ID NO: 64093 - DNA, 25 bp, Rattus norvegicus
aatgggctttatcaccaaggtggcc

SEQ ID NO: 64094 - DNA, 25 bp, Rattus norvegicus
aatgggctttatgaccaaggtggcc

SEQ ID NO: 64095 - DNA, 25 bp, Rattus norvegicus
aatgggtacttcctcattgagcgtg

SEQ ID NO: 64096 - DNA, 25 bp, Rattus norvegicus
aatgggtacttcgtcattgagcgtg

SEQ ID NO: 64097 - DNA, 25 bp, Rattus norvegicus
aatgggtatttcacagacctggaaa

SEQ ID NO: 64098 - DNA, 25 bp, Rattus norvegicus
aatgggtatttctcagacctggaaa

SEQ ID NO: 64099 - DNA, 25 bp, Rattus norvegicus
aatgggtcaaagctgctctgcgtcc

SEQ ID NO: 64100 - DNA, 25 bp, Rattus norvegicus
aatgggtcaaaggtgctctgcgtcc

SEQ ID NO: 64101 - DNA, 25 bp, Rattus norvegicus
aatgggtcacacatgtcttacacat

SEQ ID NO: 64102 - DNA, 25 bp, Rattus norvegicus
aatgggtcacacttgtcttacacat

SEQ ID NO: 64103 - DNA, 25 bp, Rattus norvegicus
aatgggtcactcacacagatactga

SEQ ID NO: 64104 - DNA, 25 bp, Rattus norvegicus
aatgggtcactctcacagatactga

SEQ ID NO: 64105 - DNA, 25 bp, Rattus norvegicus
aatgggtcattcaccatggcagtct

SEQ ID NO: 64106 - DNA, 25 bp, Rattus norvegicus
aatgggtcattctccatggcagtct

SEQ ID NO: 64107 - DNA, 25 bp, Rattus norvegicus
aatgggtccactcttacccagggca

SEQ ID NO: 64108 - DNA, 25 bp, Rattus norvegicus
aatgggtccactgttacccagggca

SEQ ID NO: 64109 - DNA, 25 bp, Rattus norvegicus
aatgggtccagtcagcctgtaatca

SEQ ID NO: 64110 - DNA, 25 bp, Rattus norvegicus
aatgggtccagtgagcctgtaatca

SEQ ID NO: 64111 - DNA, 25 bp, Rattus norvegicus
aatgggtccatcagggctaaggtga

SEQ ID NO: 64112 - DNA, 25 bp, Rattus norvegicus
aatgggtccatctgggctaaggtga

SEQ ID NO: 64113 - DNA, 25 bp, Rattus norvegicus
aatgggtccatgcatcattggtttt

SEQ ID NO: 64114 - DNA, 25 bp, Rattus norvegicus
aatgggtccatggatcattggtttt

SEQ ID NO: 64115 - DNA, 25 bp, Rattus norvegicus
aatgggtccccaagctgcgttcatt

SEQ ID NO: 64116 - DNA, 25 bp, Rattus norvegicus
aatgggtccccatgctgcgttcatt

SEQ ID NO: 64117 - DNA, 25 bp, Rattus norvegicus
aatgggtcggatcagtcaccttcgt

SEQ ID NO: 64118 - DNA, 25 bp, Rattus norvegicus
aatgggtcggatgagtcaccttcgt

SEQ ID NO: 64119 - DNA, 25 bp, Rattus norvegicus
aatgggtctctgcttgaaatccgaa

SEQ ID NO: 64120 - DNA, 25 bp, Rattus norvegicus
aatgggtctctggttgaaatccgaa

SEQ ID NO: 64121 - DNA, 25 bp, Rattus norvegicus
aatgggtctgatctgactgacaaga

SEQ ID NO: 64122 - DNA, 25 bp, Rattus norvegicus
aatgggtctgatgtgactgacaaga

SEQ ID NO: 64123 - DNA, 25 bp, Rattus norvegicus
aatgggtctgtgaagtagcctcttt

SEQ ID NO: 64124 - DNA, 25 bp, Rattus norvegicus
aatgggtctgtgtagtagcctcttt

SEQ ID NO: 64125 - DNA, 25 bp, Rattus norvegicus
aatgggtcttacatagccatccctc

SEQ ID NO: 64126 - DNA, 25 bp, Rattus norvegicus
aatgggtcttacttagccatccctc

SEQ ID NO: 64127 - DNA, 25 bp, Rattus norvegicus
aatgggtcttgtccgtctgatggtc

SEQ ID NO: 64128 - DNA, 25 bp, Rattus norvegicus
aatgggtcttgtgcgtctgatggtc

SEQ ID NO: 64129 - DNA, 25 bp, Rattus norvegicus
aatgggtgaactagctcttctgaaa

SEQ ID NO: 64130 - DNA, 25 bp, Rattus norvegicus
aatgggtgaactcagctcatcgact

SEQ ID NO: 64131 - DNA, 25 bp, Rattus norvegicus
aatgggtgaactgagctcatcgact

SEQ ID NO: 64132 - DNA, 25 bp, Rattus norvegicus
aatgggtgaacttgctcttctgaaa

SEQ ID NO: 64133 - DNA, 25 bp, Rattus norvegicus
aatgggtgagtgacagtctgcttcc

SEQ ID NO: 64134 - DNA, 25 bp, Rattus norvegicus
aatgggtgagtgtcagtctgcttcc

SEQ ID NO: 64135 - DNA, 25 bp, Rattus norvegicus
aatgggtgatctatccccaagtcag

SEQ ID NO: 64136 - DNA, 25 bp, Rattus norvegicus
aatgggtgatctttccccaagtcag

SEQ ID NO: 64137 - DNA, 25 bp, Rattus norvegicus
aatgggtgcaccctgacaccaggca

SEQ ID NO: 64138 - DNA, 25 bp, Rattus norvegicus
aatgggtgcaccgtgacaccaggca

SEQ ID NO: 64139 - DNA, 25 bp, Rattus norvegicus
aatgggtgtctacccaggtttgcag

SEQ ID NO: 64140 - DNA, 25 bp, Rattus norvegicus
aatgggtgtctagccaggtttgcag

SEQ ID NO: 64141 - DNA, 25 bp, Rattus norvegicus
aatgggttacatacactgtgacagt

SEQ ID NO: 64142 - DNA, 25 bp, Rattus norvegicus
aatgggttacattcactgtgacagt

SEQ ID NO: 64143 - DNA, 25 bp, Rattus norvegicus
aatgggttagtgactggtcagctgt

SEQ ID NO: 64144 - DNA, 25 bp, Rattus norvegicus
aatgggttagtgtctggtcagctgt

SEQ ID NO: 64145 - DNA, 25 bp, Rattus norvegicus
aatgggttcaccaatgttccaataa

SEQ ID NO: 64146 - DNA, 25 bp, Rattus norvegicus
aatgggttcacctatgttccaataa

SEQ ID NO: 64147 - DNA, 25 bp, Rattus norvegicus
aatgggttccagacagtgagagcct

SEQ ID NO: 64148 - DNA, 25 bp, Rattus norvegicus
aatgggttccagatctgtacctgct

SEQ ID NO: 64149 - DNA, 25 bp, Rattus norvegicus
aatgggttccagtcagtgagagcct

SEQ ID NO: 64150 - DNA, 25 bp, Rattus norvegicus
aatgggttccagttctgtacctgct

SEQ ID NO: 64151 - DNA, 25 bp, Rattus norvegicus
aatgggttccctcctctggaatgaa

SEQ ID NO: 64152 - DNA, 25 bp, Rattus norvegicus
aatgggttccctgctctggaatgaa

SEQ ID NO: 64153 - DNA, 25 bp, Rattus norvegicus
aatgggttctcaaacactcctacat

SEQ ID NO: 64154 - DNA, 25 bp, Rattus norvegicus
aatgggttctcaatcctacaggctg

SEQ ID NO: 64155 - DNA, 25 bp, Rattus norvegicus
aatgggttctcatacactcctacat

SEQ ID NO: 64156 - DNA, 25 bp, Rattus norvegicus
aatgggttctcattcctacaggctg

SEQ ID NO: 64157 - DNA, 25 bp, Rattus norvegicus
aatgggttgcgcagagttttctttc

SEQ ID NO: 64158 - DNA, 25 bp, Rattus norvegicus
aatgggttgcgctgagttttctttc

SEQ ID NO: 64159 - DNA, 25 bp, Rattus norvegicus
aatgggttgcgtctgtcagcagcta

SEQ ID NO: 64160 - DNA, 25 bp, Rattus norvegicus
aatgggttgcgtgtgtcagcagcta

SEQ ID NO: 64161 - DNA, 25 bp, Rattus norvegicus
aatgggttgggtaccacaccagcct

SEQ ID NO: 64162 - DNA, 25 bp, Rattus norvegicus
aatgggttgggttccacaccagcct

SEQ ID NO: 64163 - DNA, 25 bp, Rattus norvegicus
aatgggtttattagtactctaagat

SEQ ID NO: 64164 - DNA, 25 bp, Rattus norvegicus
aatgggtttatttgtactctaagat

SEQ ID NO: 64165 - DNA, 25 bp, Rattus norvegicus
aatgggttttccactcaggtagcca

SEQ ID NO: 64166 - DNA, 25 bp, Rattus norvegicus
aatgggttttcctctcaggtagcca

SEQ ID NO: 64167 - DNA, 25 bp, Rattus norvegicus
aatgggttttgtatgcgcgccatcc

SEQ ID NO: 64168 - DNA, 25 bp, Rattus norvegicus
aatgggttttgtttgcgcgccatcc

SEQ ID NO: 64169 - DNA, 25 bp, Rattus norvegicus
aatggtaaatccactgggctcaaaa

SEQ ID NO: 64170 - DNA, 25 bp, Rattus norvegicus
aatggtaaatcctctgggctcaaaa

SEQ ID NO: 64171 - DNA, 25 bp, Rattus norvegicus
aatggtaacaacatcgcctccgaga

SEQ ID NO: 64172 - DNA, 25 bp, Rattus norvegicus
aatggtaacaacttcgcctccgaga

SEQ ID NO: 64173 - DNA, 25 bp, Rattus norvegicus
aatggtaagtataactagctgccct

SEQ ID NO: 64174 - DNA, 25 bp, Rattus norvegicus
aatggtaagtattactagctgccct

SEQ ID NO: 64175 - DNA, 25 bp, Rattus norvegicus
aatggtaatgccctctgcagtgccc

SEQ ID NO: 64176 - DNA, 25 bp, Rattus norvegicus
aatggtaatgccgtctgcagtgccc

SEQ ID NO: 64177 - DNA, 25 bp, Rattus norvegicus
aatggtacagccatgcgatgtgcgc

SEQ ID NO: 64178 - DNA, 25 bp, Rattus norvegicus
aatggtacagccttgcgatgtgcgc

SEQ ID NO: 64179 - DNA, 25 bp, Rattus norvegicus
aatggtacatacctcaagtacaaac

SEQ ID NO: 64180 - DNA, 25 bp, Rattus norvegicus
aatggtacatacgtcaagtacaaac

SEQ ID NO: 64181 - DNA, 25 bp, Rattus norvegicus
aatggtacatttccaggccttcaca

SEQ ID NO: 64182 - DNA, 25 bp, Rattus norvegicus
aatggtacatttgcaggccttcaca

SEQ ID NO: 64183 - DNA, 25 bp, Rattus norvegicus
aatggtaccaccaacactacaggtc

SEQ ID NO: 64184 - DNA, 25 bp, Rattus norvegicus
aatggtaccacctacactacaggtc

SEQ ID NO: 64185 - DNA, 25 bp, Rattus norvegicus
aatggtaccattcacatcagcaaga

SEQ ID NO: 64186 - DNA, 25 bp, Rattus norvegicus
aatggtaccattgacatcagcaaga

SEQ ID NO: 64187 - DNA, 25 bp, Rattus norvegicus
aatggtaccctcatcataatggctt

SEQ ID NO: 64188 - DNA, 25 bp, Rattus norvegicus
aatggtaccctcattgggttggagc

SEQ ID NO: 64189 - DNA, 25 bp, Rattus norvegicus
aatggtaccctcttcataatggctt

SEQ ID NO: 64190 - DNA, 25 bp, Rattus norvegicus
aatggtaccctctttgggttggagc

SEQ ID NO: 64191 - DNA, 25 bp, Rattus norvegicus
aatggtaccgacctgagggacaaca

SEQ ID NO: 64192 - DNA, 25 bp, Rattus norvegicus
aatggtaccgacgtgagggacaaca

SEQ ID NO: 64193 - DNA, 25 bp, Rattus norvegicus
aatggtaccgtcatctttttcatga

SEQ ID NO: 64194 - DNA, 25 bp, Rattus norvegicus
aatggtaccgtcttctttttcatga

SEQ ID NO: 64195 - DNA, 25 bp, Rattus norvegicus
aatggtacctggacatgtggcccaa

SEQ ID NO: 64196 - DNA, 25 bp, Rattus norvegicus
aatggtacctggtcatgtggcccaa

SEQ ID NO: 64197 - DNA, 25 bp, Rattus norvegicus
aatggtactgtaacagctggctctg

SEQ ID NO: 64198 - DNA, 25 bp, Rattus norvegicus
aatggtactgtatcagctggctctg

SEQ ID NO: 64199 - DNA, 25 bp, Rattus norvegicus
aatggtacttctctgggaacccaca

SEQ ID NO: 64200 - DNA, 25 bp, Rattus norvegicus
aatggtacttctgtgggaacccaca

SEQ ID NO: 64201 - DNA, 25 bp, Rattus norvegicus
aatggtacttgaagccaggagccaa

SEQ ID NO: 64202 - DNA, 25 bp, Rattus norvegicus
aatggtacttgatgccaggagccaa

SEQ ID NO: 64203 - DNA, 25 bp, Rattus norvegicus
aatggtagatctcgcactgtccttc

SEQ ID NO: 64204 - DNA, 25 bp, Rattus norvegicus
aatggtagatctggcactgtccttc

SEQ ID NO: 64205 - DNA, 25 bp, Rattus norvegicus
aatggtagcattccctgtgggctaa

SEQ ID NO: 64206 - DNA, 25 bp, Rattus norvegicus
aatggtagcattgcctgtgggctaa

SEQ ID NO: 64207 - DNA, 25 bp, Rattus norvegicus
aatggtaggaacactctacggtggg

SEQ ID NO: 64208 - DNA, 25 bp, Rattus norvegicus
aatggtaggaactctctacggtggg

SEQ ID NO: 64209 - DNA, 25 bp, Rattus norvegicus
aatggtagggagatcccactgccac

SEQ ID NO: 64210 - DNA, 25 bp, Rattus norvegicus
aatggtagggagttcccactgccac

SEQ ID NO: 64211 - DNA, 25 bp, Rattus norvegicus
aatggtagtgaaacttctcccgtca

SEQ ID NO: 64212 - DNA, 25 bp, Rattus norvegicus
aatggtagtgaatcttctcccgtca

SEQ ID NO: 64213 - DNA, 25 bp, Rattus norvegicus
aatggtatagaactcacgttacact

SEQ ID NO: 64214 - DNA, 25 bp, Rattus norvegicus
aatggtatagaagtcacgttacact

SEQ ID NO: 64215 - DNA, 25 bp, Rattus norvegicus
aatggtatccatcgtggtggctgtc

SEQ ID NO: 64216 - DNA, 25 bp, Rattus norvegicus
aatggtatccatggtggtggctgtc

SEQ ID NO: 64217 - DNA, 25 bp, Rattus norvegicus
aatggtatgcctccagtctacagag

SEQ ID NO: 64218 - DNA, 25 bp, Rattus norvegicus
aatggtatgcctgcagtctacagag

SEQ ID NO: 64219 - DNA, 25 bp, Rattus norvegicus
aatggtattgttaactgtcatagga

SEQ ID NO: 64220 - DNA, 25 bp, Rattus norvegicus
aatggtattgtttactgtcatagga

SEQ ID NO: 64221 - DNA, 25 bp, Rattus norvegicus
aatggtcaatggcttgatcattaat

SEQ ID NO: 64222 - DNA, 25 bp, Rattus norvegicus
aatggtcaatgggttgatcattaat

SEQ ID NO: 64223 - DNA, 25 bp, Rattus norvegicus
aatggtcacagcaagggccagtccc

SEQ ID NO: 64224 - DNA, 25 bp, Rattus norvegicus
aatggtcacagctagggccagtccc

SEQ ID NO: 64225 - DNA, 25 bp, Rattus norvegicus
aatggtcaccacaaagctcttcaaa

SEQ ID NO: 64226 - DNA, 25 bp, Rattus norvegicus
aatggtcaccactaagctcttcaaa

SEQ ID NO: 64227 - DNA, 25 bp, Rattus norvegicus
aatggtcaggaccttctgcgactaa

SEQ ID NO: 64228 - DNA, 25 bp, Rattus norvegicus
aatggtcaggacgttctgcgactaa

SEQ ID NO: 64229 - DNA, 25 bp, Rattus norvegicus
aatggtcagggcaactgggcccagc

SEQ ID NO: 64230 - DNA, 25 bp, Rattus norvegicus
aatggtcagggctactgggcccagc

SEQ ID NO: 64231 - DNA, 25 bp, Rattus norvegicus
aatggtcatgcccttttgtactaat

SEQ ID NO: 64232 - DNA, 25 bp, Rattus norvegicus
aatggtcatgccgttttgtactaat

SEQ ID NO: 64233 - DNA, 25 bp, Rattus norvegicus
aatggtcattgcattttcatggtgc

SEQ ID NO: 64234 - DNA, 25 bp, Rattus norvegicus
aatggtcattgctttttcatggtgc

SEQ ID NO: 64235 - DNA, 25 bp, Rattus norvegicus
aatggtcccagaatttgaaacttgt

SEQ ID NO: 64236 - DNA, 25 bp, Rattus norvegicus
aatggtcccagattttgaaacttgt

SEQ ID NO: 64237 - DNA, 25 bp, Rattus norvegicus
aatggtcccctaaccctggtctgtg

SEQ ID NO: 64238 - DNA, 25 bp, Rattus norvegicus
aatggtcccctatccctggtctgtg

SEQ ID NO: 64239 - DNA, 25 bp, Rattus norvegicus
aatggtccccttagtacaagccgag

SEQ ID NO: 64240 - DNA, 25 bp, Rattus norvegicus
aatggtcccctttgtacaagccgag

SEQ ID NO: 64241 - DNA, 25 bp, Rattus norvegicus
aatggtcccgcacaaggtgatgcaa

SEQ ID NO: 64242 - DNA, 25 bp, Rattus norvegicus
aatggtcccgcagaaggtgatgcaa

SEQ ID NO: 64243 - DNA, 25 bp, Rattus norvegicus
aatggtccctagcttctatttttca

SEQ ID NO: 64244 - DNA, 25 bp, Rattus norvegicus
aatggtccctaggttctatttttca

SEQ ID NO: 64245 - DNA, 25 bp, Rattus norvegicus
aatggtccctgacttctatgttgac

SEQ ID NO: 64246 - DNA, 25 bp, Rattus norvegicus
aatggtccctgagttctatgttgac

SEQ ID NO: 64247 - DNA, 25 bp, Rattus norvegicus
aatggtcccttcagcaactacggaa

SEQ ID NO: 64248 - DNA, 25 bp, Rattus norvegicus
aatggtcccttcagcgccagaggca

SEQ ID NO: 64249 - DNA, 25 bp, Rattus norvegicus
aatggtcccttctgcaactacggaa

SEQ ID NO: 64250 - DNA, 25 bp, Rattus norvegicus
aatggtcccttctgcgccagaggca

SEQ ID NO: 64251 - DNA, 25 bp, Rattus norvegicus
aatggtcccttgataggctaccact

SEQ ID NO: 64252 - DNA, 25 bp, Rattus norvegicus
aatggtcccttgttaggctaccact

SEQ ID NO: 64253 - DNA, 25 bp, Rattus norvegicus
aatggtccgagacctcatgcaggtc

SEQ ID NO: 64254 - DNA, 25 bp, Rattus norvegicus
aatggtccgagagctcatgcaggtc

SEQ ID NO: 64255 - DNA, 25 bp, Rattus norvegicus
aatggtccgcagcactaactggtaa

SEQ ID NO: 64256 - DNA, 25 bp, Rattus norvegicus
aatggtccgcaggactaactggtaa

SEQ ID NO: 64257 - DNA, 25 bp, Rattus norvegicus
aatggtcctgtgacatttccagtgc

SEQ ID NO: 64258 - DNA, 25 bp, Rattus norvegicus
aatggtcctgtgtcatttccagtgc

SEQ ID NO: 64259 - DNA, 25 bp, Rattus norvegicus
aatggtccttcaagggtagagtcag

SEQ ID NO: 64260 - DNA, 25 bp, Rattus norvegicus
aatggtccttcatgggtagagtcag

SEQ ID NO: 64261 - DNA, 25 bp, Rattus norvegicus
aatggtccttgaagtgcttgctggc

SEQ ID NO: 64262 - DNA, 25 bp, Rattus norvegicus
aatggtccttgatgtgcttgctggc

SEQ ID NO: 64263 - DNA, 25 bp, Rattus norvegicus
aatggtcggtagctcccagttagcc

SEQ ID NO: 64264 - DNA, 25 bp, Rattus norvegicus
aatggtcggtaggtcccagttagcc

SEQ ID NO: 64265 - DNA, 25 bp, Rattus norvegicus
aatggtctagaaacattgcctttct

SEQ ID NO: 64266 - DNA, 25 bp, Rattus norvegicus
aatggtctagaatcattgcctttct

SEQ ID NO: 64267 - DNA, 25 bp, Rattus norvegicus
aatggtctatgtactccagattctc

SEQ ID NO: 64268 - DNA, 25 bp, Rattus norvegicus
aatggtctatgttctccagattctc

SEQ ID NO: 64269 - DNA, 25 bp, Rattus norvegicus
aatggtctcaataatcaagccttta

SEQ ID NO: 64270 - DNA, 25 bp, Rattus norvegicus
aatggtctcaatatctatcgtttcc

SEQ ID NO: 64271 - DNA, 25 bp, Rattus norvegicus
aatggtctcaattatcaagccttta

SEQ ID NO: 64272 - DNA, 25 bp, Rattus norvegicus
aatggtctcaatttctatcgtttcc

SEQ ID NO: 64273 - DNA, 25 bp, Rattus norvegicus
aatggtctcattccatgcgcctcag

SEQ ID NO: 64274 - DNA, 25 bp, Rattus norvegicus
aatggtctcattgcatgcgcctcag

SEQ ID NO: 64275 - DNA, 25 bp, Rattus norvegicus
aatggtctctatcgtcatctttgtt

SEQ ID NO: 64276 - DNA, 25 bp, Rattus norvegicus
aatggtctctatggtcatctttgtt

SEQ ID NO: 64277 - DNA, 25 bp, Rattus norvegicus
aatggtctgaatcccactgacctga

SEQ ID NO: 64278 - DNA, 25 bp, Rattus norvegicus
aatggtctgaatgccactgacctga

SEQ ID NO: 64279 - DNA, 25 bp, Rattus norvegicus
aatggtctggagcacaccagtaagc

SEQ ID NO: 64280 - DNA, 25 bp, Rattus norvegicus
aatggtctggaggacaccagtaagc

SEQ ID NO: 64281 - DNA, 25 bp, Rattus norvegicus
aatggtctgtcactgcctgggaagt

SEQ ID NO: 64282 - DNA, 25 bp, Rattus norvegicus
aatggtctgtcagtgcctgggaagt

SEQ ID NO: 64283 - DNA, 25 bp, Rattus norvegicus
aatggtctgtttcccatgctttgaa

SEQ ID NO: 64284 - DNA, 25 bp, Rattus norvegicus
aatggtctgtttgccatgctttgaa

SEQ ID NO: 64285 - DNA, 25 bp, Rattus norvegicus
aatggtcttaggattgtgctgggtc

SEQ ID NO: 64286 - DNA, 25 bp, Rattus norvegicus
aatggtcttaggtttgtgctgggtc

SEQ ID NO: 64287 - DNA, 25 bp, Rattus norvegicus
aatggtcttcctacttttgacataa

SEQ ID NO: 64288 - DNA, 25 bp, Rattus norvegicus
aatggtcttccttcttttgacataa

SEQ ID NO: 64289 - DNA, 25 bp, Rattus norvegicus
aatggtcttctacttgtcacttatt

SEQ ID NO: 64290 - DNA, 25 bp, Rattus norvegicus
aatggtcttctagttgtcacttatt

SEQ ID NO: 64291 - DNA, 25 bp, Rattus norvegicus
aatggtcttcttacaatatactctg

SEQ ID NO: 64292 - DNA, 25 bp, Rattus norvegicus
aatggtcttctttcaatatactctg

SEQ ID NO: 64293 - DNA, 25 bp, Rattus norvegicus
aatggtcttgtgacctttatcccac

SEQ ID NO: 64294 - DNA, 25 bp, Rattus norvegicus
aatggtcttgtgtcctttatcccac

SEQ ID NO: 64295 - DNA, 25 bp, Rattus norvegicus
aatggtcttttccagcaaggccttt

SEQ ID NO: 64296 - DNA, 25 bp, Rattus norvegicus
aatggtcttttcgagcaaggccttt

SEQ ID NO: 64297 - DNA, 25 bp, Rattus norvegicus
aatggtgaaactacccaattccctg

SEQ ID NO: 64298 - DNA, 25 bp, Rattus norvegicus
aatggtgaaacttcccaattccctg

SEQ ID NO: 64299 - DNA, 25 bp, Rattus norvegicus
aatggtgaacccagacaagatgaaa

SEQ ID NO: 64300 - DNA, 25 bp, Rattus norvegicus
aatggtgaaccctgacaagatgaaa

SEQ ID NO: 64301 - DNA, 25 bp, Rattus norvegicus
aatggtgaatttcatccttgcccta

SEQ ID NO: 64302 - DNA, 25 bp, Rattus norvegicus
aatggtgaatttgatccttgcccta

SEQ ID NO: 64303 - DNA, 25 bp, Rattus norvegicus
aatggtgacctgcttggatgtgtat

SEQ ID NO: 64304 - DNA, 25 bp, Rattus norvegicus
aatggtgacctggttggatgtgtat

SEQ ID NO: 64305 - DNA, 25 bp, Rattus norvegicus
aatggtgactgcctttgcagttctc

SEQ ID NO: 64306 - DNA, 25 bp, Rattus norvegicus
aatggtgactgcgtttgcagttctc

SEQ ID NO: 64307 - DNA, 25 bp, Rattus norvegicus
aatggtgactgtaacaatcaaccca

SEQ ID NO: 64308 - DNA, 25 bp, Rattus norvegicus
aatggtgactgttacaatcaaccca

SEQ ID NO: 64309 - DNA, 25 bp, Rattus norvegicus
aatggtgagaccaggacctccagac

SEQ ID NO: 64310 - DNA, 25 bp, Rattus norvegicus
aatggtgagacctggacctccagac

SEQ ID NO: 64311 - DNA, 25 bp, Rattus norvegicus
aatggtgagattagtgctgttctga

SEQ ID NO: 64312 - DNA, 25 bp, Rattus norvegicus
aatggtgagatttgtgctgttctga

SEQ ID NO: 64313 - DNA, 25 bp, Rattus norvegicus
aatggtgagccaactcggttttgaa

SEQ ID NO: 64314 - DNA, 25 bp, Rattus norvegicus
aatggtgagccatctcggttttgaa

SEQ ID NO: 64315 - DNA, 25 bp, Rattus norvegicus
aatggtgatgctagtgtgcctttgc

SEQ ID NO: 64316 - DNA, 25 bp, Rattus norvegicus
aatggtgatgcttgtgtgcctttgc

SEQ ID NO: 64317 - DNA, 25 bp, Rattus norvegicus
aatggtgatggcacctgtccatgaa

SEQ ID NO: 64318 - DNA, 25 bp, Rattus norvegicus
aatggtgatggctcctgtccatgaa

SEQ ID NO: 64319 - DNA, 25 bp, Rattus norvegicus
aatggtgattgacggagaccccttc

SEQ ID NO: 64320 - DNA, 25 bp, Rattus norvegicus
aatggtgattgagggagaccccttc

SEQ ID NO: 64321 - DNA, 25 bp, Rattus norvegicus
aatggtgcacatcacaacttgtgtt

SEQ ID NO: 64322 - DNA, 25 bp, Rattus norvegicus
aatggtgcacatgacaacttgtgtt

SEQ ID NO: 64323 - DNA, 25 bp, Rattus norvegicus
aatggtgcactcacagcgttagcaa

SEQ ID NO: 64324 - DNA, 25 bp, Rattus norvegicus
aatggtgcactctcagcgttagcaa

SEQ ID NO: 64325 - DNA, 25 bp, Rattus norvegicus
aatggtgccaacacaggaacttaga

SEQ ID NO: 64326 - DNA, 25 bp, Rattus norvegicus
aatggtgccaactcaggaacttaga

SEQ ID NO: 64327 - DNA, 25 bp, Rattus norvegicus
aatggtgccaggaaccacaagagta

SEQ ID NO: 64328 - DNA, 25 bp, Rattus norvegicus
aatggtgccaggtaccacaagagta

SEQ ID NO: 64329 - DNA, 25 bp, Rattus norvegicus
aatggtgccatcaacgacaccgagt

SEQ ID NO: 64330 - DNA, 25 bp, Rattus norvegicus
aatggtgccatctacgacaccgagt

SEQ ID NO: 64331 - DNA, 25 bp, Rattus norvegicus
aatggtgccatgaaacaatgacaga

SEQ ID NO: 64332 - DNA, 25 bp, Rattus norvegicus
aatggtgccatgtaacaatgacaga

SEQ ID NO: 64333 - DNA, 25 bp, Rattus norvegicus
aatggtgcccacagcagtcagtctg

SEQ ID NO: 64334 - DNA, 25 bp, Rattus norvegicus
aatggtgcccactgcagtcagtctg

SEQ ID NO: 64335 - DNA, 25 bp, Rattus norvegicus
aatggtgcccagacaggtcctaaag

SEQ ID NO: 64336 - DNA, 25 bp, Rattus norvegicus
aatggtgcccagtcaggtcctaaag

SEQ ID NO: 64337 - DNA, 25 bp, Rattus norvegicus
aatggtgccccaaatacacacgtgt

SEQ ID NO: 64338 - DNA, 25 bp, Rattus norvegicus
aatggtgccccatatacacacgtgt

SEQ ID NO: 64339 - DNA, 25 bp, Rattus norvegicus
aatggtgccctactcaggcctccct

SEQ ID NO: 64340 - DNA, 25 bp, Rattus norvegicus
aatggtgccctagtcaggcctccct

SEQ ID NO: 64341 - DNA, 25 bp, Rattus norvegicus
aatggtgcctagaaggagtcctttt

SEQ ID NO: 64342 - DNA, 25 bp, Rattus norvegicus
aatggtgcctagtaggagtcctttt

SEQ ID NO: 64343 - DNA, 25 bp, Rattus norvegicus
aatggtgccttaatcgtgcagtgga

SEQ ID NO: 64344 - DNA, 25 bp, Rattus norvegicus
aatggtgccttacttgtgatctgaa

SEQ ID NO: 64345 - DNA, 25 bp, Rattus norvegicus
aatggtgccttagttgtgatctgaa

SEQ ID NO: 64346 - DNA, 25 bp, Rattus norvegicus
aatggtgccttattcgtgcagtgga

SEQ ID NO: 64347 - DNA, 25 bp, Rattus norvegicus
aatggtgctaaaaccttggaacaca

SEQ ID NO: 64348 - DNA, 25 bp, Rattus norvegicus
aatggtgctaaatccttggaacaca

SEQ ID NO: 64349 - DNA, 25 bp, Rattus norvegicus
aatggtgctagcacgttctgaagac

SEQ ID NO: 64350 - DNA, 25 bp, Rattus norvegicus
aatggtgctagctcgttctgaagac

SEQ ID NO: 64351 - DNA, 25 bp, Rattus norvegicus
aatggtgctcacaaccactgtctgt

SEQ ID NO: 64352 - DNA, 25 bp, Rattus norvegicus
aatggtgctcactaccactgtctgt

SEQ ID NO: 64353 - DNA, 25 bp, Rattus norvegicus
aatggtgctcatatgttctttttga

SEQ ID NO: 64354 - DNA, 25 bp, Rattus norvegicus
aatggtgctcatttgttctttttga

SEQ ID NO: 64355 - DNA, 25 bp, Rattus norvegicus
aatggtgcttcactaaaccgcttac

SEQ ID NO: 64356 - DNA, 25 bp, Rattus norvegicus
aatggtgcttcagtaaaccgcttac

SEQ ID NO: 64357 - DNA, 25 bp, Rattus norvegicus
aatggtgcttctccggtgattgaaa

SEQ ID NO: 64358 - DNA, 25 bp, Rattus norvegicus
aatggtgcttctgcggtgattgaaa

SEQ ID NO: 64359 - DNA, 25 bp, Rattus norvegicus
aatggtggagttccaagctctccct

SEQ ID NO: 64360 - DNA, 25 bp, Rattus norvegicus
aatggtggagttgcaagctctccct

SEQ ID NO: 64361 - DNA, 25 bp, Rattus norvegicus
aatggtggcacccagggtcttgcat

SEQ ID NO: 64362 - DNA, 25 bp, Rattus norvegicus
aatggtggcaccgagggtcttgcat

SEQ ID NO: 64363 - DNA, 25 bp, Rattus norvegicus
aatggtggccctcatgtgacccgga

SEQ ID NO: 64364 - DNA, 25 bp, Rattus norvegicus
aatggtggccctgatgtgacccgga

SEQ ID NO: 64365 - DNA, 25 bp, Rattus norvegicus
aatggtggcctgctcaccagtaacc

SEQ ID NO: 64366 - DNA, 25 bp, Rattus norvegicus
aatggtggcctggtcaccagtaacc

SEQ ID NO: 64367 - DNA, 25 bp, Rattus norvegicus
aatggtggcggcattggcaacctgc

SEQ ID NO: 64368 - DNA, 25 bp, Rattus norvegicus
aatggtggcggctttggcaacctgc

SEQ ID NO: 64369 - DNA, 25 bp, Rattus norvegicus
aatggtggcgtgacccaggaaaact

SEQ ID NO: 64370 - DNA, 25 bp, Rattus norvegicus
aatggtggcgtgtcccaggaaaact

SEQ ID NO: 64371 - DNA, 25 bp, Rattus norvegicus
aatggtggctggaacatctattttt

SEQ ID NO: 64372 - DNA, 25 bp, Rattus norvegicus
aatggtggctggtacatctattttt

SEQ ID NO: 64373 - DNA, 25 bp, Rattus norvegicus
aatggtggcttgatttcatggtttt

SEQ ID NO: 64374 - DNA, 25 bp, Rattus norvegicus
aatggtggcttgttttcatggtttt

SEQ ID NO: 64375 - DNA, 25 bp, Rattus norvegicus
aatggtgggctcaatctactgcggt

SEQ ID NO: 64376 - DNA, 25 bp, Rattus norvegicus
aatggtgggctctatctactgcggt

SEQ ID NO: 64377 - DNA, 25 bp, Rattus norvegicus
aatggtggtggcctctacatcgagc

SEQ ID NO: 64378 - DNA, 25 bp, Rattus norvegicus
aatggtggtggcgtctacatcgagc

SEQ ID NO: 64379 - DNA, 25 bp, Rattus norvegicus
aatggtgtaaatacgccccgatttg

SEQ ID NO: 64380 - DNA, 25 bp, Rattus norvegicus
aatggtgtaaattcgccccgatttg

SEQ ID NO: 64381 - DNA, 25 bp, Rattus norvegicus
aatggtgtccacagttttttggcaa

SEQ ID NO: 64382 - DNA, 25 bp, Rattus norvegicus
aatggtgtccactgttttttggcaa

SEQ ID NO: 64383 - DNA, 25 bp, Rattus norvegicus
aatggtgtccggaggtacatcccgc

SEQ ID NO: 64384 - DNA, 25 bp, Rattus norvegicus
aatggtgtccggtggtacatcccgc

SEQ ID NO: 64385 - DNA, 25 bp, Rattus norvegicus
aatggtgtcctaaggattcttgtca

SEQ ID NO: 64386 - DNA, 25 bp, Rattus norvegicus
aatggtgtcctatggattcttgtca

SEQ ID NO: 64387 - DNA, 25 bp, Rattus norvegicus
aatggtgtctgtcaagctttgtatc

SEQ ID NO: 64388 - DNA, 25 bp, Rattus norvegicus
aatggtgtctgtgaagctttgtatc

SEQ ID NO: 64389 - DNA, 25 bp, Rattus norvegicus
aatggtgtgatgaacttcgccagcc

SEQ ID NO: 64390 - DNA, 25 bp, Rattus norvegicus
aatggtgtgatgtacttcgccagcc

SEQ ID NO: 64391 - DNA, 25 bp, Rattus norvegicus
aatggtgtgcacctgggtatttcac

SEQ ID NO: 64392 - DNA, 25 bp, Rattus norvegicus
aatggtgtgcacgtgggtatttcac

SEQ ID NO: 64393 - DNA, 25 bp, Rattus norvegicus
aatggtgtggaaactcgaatgatac

SEQ ID NO: 64394 - DNA, 25 bp, Rattus norvegicus
aatggtgtggaatctcgaatgatac

SEQ ID NO: 64395 - DNA, 25 bp, Rattus norvegicus
aatggtgtggaccacgctgccaatt

SEQ ID NO: 64396 - DNA, 25 bp, Rattus norvegicus
aatggtgtggacgacgctgccaatt

SEQ ID NO: 64397 - DNA, 25 bp, Rattus norvegicus
aatggtgtggctacagatgcagact

SEQ ID NO: 64398 - DNA, 25 bp, Rattus norvegicus
aatggtgtggcttcagatgcagact

SEQ ID NO: 64399 - DNA, 25 bp, Rattus norvegicus
aatggtgtgtgccagctgatccgaa

SEQ ID NO: 64400 - DNA, 25 bp, Rattus norvegicus
aatggtgtgtgcgagctgatccgaa

SEQ ID NO: 64401 - DNA, 25 bp, Rattus norvegicus
aatggtgtgtttctagtcagctccc

SEQ ID NO: 64402 - DNA, 25 bp, Rattus norvegicus
aatggtgtgtttgtagtcagctccc

SEQ ID NO: 64403 - DNA, 25 bp, Rattus norvegicus
aatggtgttaccagccacattgttt

SEQ ID NO: 64404 - DNA, 25 bp, Rattus norvegicus
aatggtgttacctgccacattgttt

SEQ ID NO: 64405 - DNA, 25 bp, Rattus norvegicus
aatggtgttataataattctttcat

SEQ ID NO: 64406 - DNA, 25 bp, Rattus norvegicus
aatggtgttatattaattctttcat

SEQ ID NO: 64407 - DNA, 25 bp, Rattus norvegicus
aatggtgttccaagtgcatggcctc

SEQ ID NO: 64408 - DNA, 25 bp, Rattus norvegicus
aatggtgttccatgtgcatggcctc

SEQ ID NO: 64409 - DNA, 25 bp, Rattus norvegicus
aatggtgttggcatacagggtatat

SEQ ID NO: 64410 - DNA, 25 bp, Rattus norvegicus
aatggtgttggcttacagggtatat

SEQ ID NO: 64411 - DNA, 25 bp, Rattus norvegicus
aatggtgttgtcaggtacacctggc

SEQ ID NO: 64412 - DNA, 25 bp, Rattus norvegicus
aatggtgttgtctggtacacctggc

SEQ ID NO: 64413 - DNA, 25 bp, Rattus norvegicus
aatggtgtttagctaatggtcgcaa

SEQ ID NO: 64414 - DNA, 25 bp, Rattus norvegicus
aatggtgtttaggtaatggtcgcaa

SEQ ID NO: 64415 - DNA, 25 bp, Rattus norvegicus
aatggtgtttccaatctgaccagct

SEQ ID NO: 64416 - DNA, 25 bp, Rattus norvegicus
aatggtgtttcctatctgaccagct

SEQ ID NO: 64417 - DNA, 25 bp, Rattus norvegicus
aatggttaaaaaacctcccgagctg

SEQ ID NO: 64418 - DNA, 25 bp, Rattus norvegicus
aatggttaaaaatcctcccgagctg

SEQ ID NO: 64419 - DNA, 25 bp, Rattus norvegicus
aatggttaagagaacctctaactct

SEQ ID NO: 64420 - DNA, 25 bp, Rattus norvegicus
aatggttaagagtacctctaactct

SEQ ID NO: 64421 - DNA, 25 bp, Rattus norvegicus
aatggttaagcaagggctgctcttc

SEQ ID NO: 64422 - DNA, 25 bp, Rattus norvegicus
aatggttaagcatgggctgctcttc

SEQ ID NO: 64423 - DNA, 25 bp, Rattus norvegicus
aatggttacagcaacctcagagctc

SEQ ID NO: 64424 - DNA, 25 bp, Rattus norvegicus
aatggttacagctacctcagagctc

SEQ ID NO: 64425 - DNA, 25 bp, Rattus norvegicus
aatggttaccgcagagccagggaca

SEQ ID NO: 64426 - DNA, 25 bp, Rattus norvegicus
aatggttaccgctgagccagggaca

SEQ ID NO: 64427 - DNA, 25 bp, Rattus norvegicus
aatggttacttgctttggtgtggac

SEQ ID NO: 64428 - DNA, 25 bp, Rattus norvegicus
aatggttacttggtttggtgtggac

SEQ ID NO: 64429 - DNA, 25 bp, Rattus norvegicus
aatggttagactagcctcagtgctg

SEQ ID NO: 64430 - DNA, 25 bp, Rattus norvegicus
aatggttagacttgcctcagtgctg

SEQ ID NO: 64431 - DNA, 25 bp, Rattus norvegicus
aatggttatcttacaactgttacga

SEQ ID NO: 64432 - DNA, 25 bp, Rattus norvegicus
aatggttatctttcaactgttacga

SEQ ID NO: 64433 - DNA, 25 bp, Rattus norvegicus
aatggttcaccaatccgtgtgtgtg

SEQ ID NO: 64434 - DNA, 25 bp, Rattus norvegicus
aatggttcaccattccgtgtgtgtg

SEQ ID NO: 64435 - DNA, 25 bp, Rattus norvegicus
aatggttcaggaatctgctcccaaa

SEQ ID NO: 64436 - DNA, 25 bp, Rattus norvegicus
aatggttcaggacgcgacacacaga

SEQ ID NO: 64437 - DNA, 25 bp, Rattus norvegicus
aatggttcaggaggcgacacacaga

SEQ ID NO: 64438 - DNA, 25 bp, Rattus norvegicus
aatggttcaggattctgctcccaaa

SEQ ID NO: 64439 - DNA, 25 bp, Rattus norvegicus
aatggttcattcaattgcagctccc

SEQ ID NO: 64440 - DNA, 25 bp, Rattus norvegicus
aatggttcattctattgcagctccc

SEQ ID NO: 64441 - DNA, 25 bp, Rattus norvegicus
aatggttcattgagcacaggttaac

SEQ ID NO: 64442 - DNA, 25 bp, Rattus norvegicus
aatggttcattgcataccagagcaa

SEQ ID NO: 64443 - DNA, 25 bp, Rattus norvegicus
aatggttcattggataccagagcaa

SEQ ID NO: 64444 - DNA, 25 bp, Rattus norvegicus
aatggttcattgtgcacaggttaac

SEQ ID NO: 64445 - DNA, 25 bp, Rattus norvegicus
aatggttccattctattatttgacc

SEQ ID NO: 64446 - DNA, 25 bp, Rattus norvegicus
aatggttccattgtattatttgacc

SEQ ID NO: 64447 - DNA, 25 bp, Rattus norvegicus
aatggttcccaaatcttcatcacct

SEQ ID NO: 64448 - DNA, 25 bp, Rattus norvegicus
aatggttcccaattcttcatcacct

SEQ ID NO: 64449 - DNA, 25 bp, Rattus norvegicus
aatggttcccagaggatccgcaatg

SEQ ID NO: 64450 - DNA, 25 bp, Rattus norvegicus
aatggttcccagtggatccgcaatg

SEQ ID NO: 64451 - DNA, 25 bp, Rattus norvegicus
aatggttccgttccagaatctgaga

SEQ ID NO: 64452 - DNA, 25 bp, Rattus norvegicus
aatggttccgttgcagaatctgaga

SEQ ID NO: 64453 - DNA, 25 bp, Rattus norvegicus
aatggttcggatcagtctgcagcaa

SEQ ID NO: 64454 - DNA, 25 bp, Rattus norvegicus
aatggttcggatgagtctgcagcaa

SEQ ID NO: 64455 - DNA, 25 bp, Rattus norvegicus
aatggttctgatacccattcaccca

SEQ ID NO: 64456 - DNA, 25 bp, Rattus norvegicus
aatggttctgattcccattcaccca

SEQ ID NO: 64457 - DNA, 25 bp, Rattus norvegicus
aatggttctgccagcttcaatgaca

SEQ ID NO: 64458 - DNA, 25 bp, Rattus norvegicus
aatggttctgccattatgctaacac

SEQ ID NO: 64459 - DNA, 25 bp, Rattus norvegicus
aatggttctgcctgcttcaatgaca

SEQ ID NO: 64460 - DNA, 25 bp, Rattus norvegicus
aatggttctgcctttatgctaacac

SEQ ID NO: 64461 - DNA, 25 bp, Rattus norvegicus
aatggttctgtcatgcatttctggt

SEQ ID NO: 64462 - DNA, 25 bp, Rattus norvegicus
aatggttctgtcctaggtcgtagag

SEQ ID NO: 64463 - DNA, 25 bp, Rattus norvegicus
aatggttctgtcgtaggtcgtagag

SEQ ID NO: 64464 - DNA, 25 bp, Rattus norvegicus
aatggttctgtcttgcatttctggt

SEQ ID NO: 64465 - DNA, 25 bp, Rattus norvegicus
aatggttcttgaattttgtagacaa

SEQ ID NO: 64466 - DNA, 25 bp, Rattus norvegicus
aatggttcttgatttttgtagacaa

SEQ ID NO: 64467 - DNA, 25 bp, Rattus norvegicus
aatggttcttggagtcattgttcct

SEQ ID NO: 64468 - DNA, 25 bp, Rattus norvegicus
aatggttcttggtgtcattgttcct

SEQ ID NO: 64469 - DNA, 25 bp, Rattus norvegicus
aatggttgaacaacacctagggcaa

SEQ ID NO: 64470 - DNA, 25 bp, Rattus norvegicus
aatggttgaacatcacctagggcaa

SEQ ID NO: 64471 - DNA, 25 bp, Rattus norvegicus
aatggttgaatgcttatcacccaaa

SEQ ID NO: 64472 - DNA, 25 bp, Rattus norvegicus
aatggttgaatggttatcacccaaa

SEQ ID NO: 64473 - DNA, 25 bp, Rattus norvegicus
aatggttgaccccttaatgctggtt

SEQ ID NO: 64474 - DNA, 25 bp, Rattus norvegicus
aatggttgacccgttaatgctggtt

SEQ ID NO: 64475 - DNA, 25 bp, Rattus norvegicus
aatggttgagacatccagggaactc

SEQ ID NO: 64476 - DNA, 25 bp, Rattus norvegicus
aatggttgagacttccagggaactc

SEQ ID NO: 64477 - DNA, 25 bp, Rattus norvegicus
aatggttgatctcttcagtaccgct

SEQ ID NO: 64478 - DNA, 25 bp, Rattus norvegicus
aatggttgatctgttcagtaccgct

SEQ ID NO: 64479 - DNA, 25 bp, Rattus norvegicus
aatggttgatgccagttcctgctta

SEQ ID NO: 64480 - DNA, 25 bp, Rattus norvegicus
aatggttgatgcgagttcctgctta

SEQ ID NO: 64481 - DNA, 25 bp, Rattus norvegicus
aatggttgatttctcttttcctgac

SEQ ID NO: 64482 - DNA, 25 bp, Rattus norvegicus
aatggttgatttgtcttttcctgac

SEQ ID NO: 64483 - DNA, 25 bp, Rattus norvegicus
aatggttgcaagctctgtcctgtgt

SEQ ID NO: 64484 - DNA, 25 bp, Rattus norvegicus
aatggttgcaaggtctgtcctgtgt

SEQ ID NO: 64485 - DNA, 25 bp, Rattus norvegicus
aatggttgcatgctgggtccaagca

SEQ ID NO: 64486 - DNA, 25 bp, Rattus norvegicus
aatggttgcatggtgggtccaagca

SEQ ID NO: 64487 - DNA, 25 bp, Rattus norvegicus
aatggttgccaaatgccaccgctct

SEQ ID NO: 64488 - DNA, 25 bp, Rattus norvegicus
aatggttgccaattgccaccgctct

SEQ ID NO: 64489 - DNA, 25 bp, Rattus norvegicus
aatggttgccgtatttccagacaca

SEQ ID NO: 64490 - DNA, 25 bp, Rattus norvegicus
aatggttgccgtttttccagacaca

SEQ ID NO: 64491 - DNA, 25 bp, Rattus norvegicus
aatggttgccttattcggaagccaa

SEQ ID NO: 64492 - DNA, 25 bp, Rattus norvegicus
aatggttgcctttttcggaagccaa

SEQ ID NO: 64493 - DNA, 25 bp, Rattus norvegicus
aatggttgcgatcagccagtgccct

SEQ ID NO: 64494 - DNA, 25 bp, Rattus norvegicus
aatggttgcgatgagccagtgccct

SEQ ID NO: 64495 - DNA, 25 bp, Rattus norvegicus
aatggttgcttcatggatcaggtca

SEQ ID NO: 64496 - DNA, 25 bp, Rattus norvegicus
aatggttgcttcttggatcaggtca

SEQ ID NO: 64497 - DNA, 25 bp, Rattus norvegicus
aatggttggtgtctcagcttctgtc

SEQ ID NO: 64498 - DNA, 25 bp, Rattus norvegicus
aatggttggtgtgtcagcttctgtc

SEQ ID NO: 64499 - DNA, 25 bp, Rattus norvegicus
aatggttgtaaacccgttctgtctt

SEQ ID NO: 64500 - DNA, 25 bp, Rattus norvegicus
aatggttgtaaagccgttctgtctt

SEQ ID NO: 64501 - DNA, 25 bp, Rattus norvegicus
aatggttgtatgattgcttgcgaag

SEQ ID NO: 64502 - DNA, 25 bp, Rattus norvegicus
aatggttgtatgtttgcttgcgaag

SEQ ID NO: 64503 - DNA, 25 bp, Rattus norvegicus
aatggttgtctgatggctttaggct

SEQ ID NO: 64504 - DNA, 25 bp, Rattus norvegicus
aatggttgtctgttggctttaggct

SEQ ID NO: 64505 - DNA, 25 bp, Rattus norvegicus
aatggttgtgataggtaagtggctc

SEQ ID NO: 64506 - DNA, 25 bp, Rattus norvegicus
aatggttgtgattggtaagtggctc

SEQ ID NO: 64507 - DNA, 25 bp, Rattus norvegicus
aatggttgtggcagtccacccgtga

SEQ ID NO: 64508 - DNA, 25 bp, Rattus norvegicus
aatggttgtggctgtccacccgtga

SEQ ID NO: 64509 - DNA, 25 bp, Rattus norvegicus
aatggttgttggatactgttgctct

SEQ ID NO: 64510 - DNA, 25 bp, Rattus norvegicus
aatggttgttggttactgttgctct

SEQ ID NO: 64511 - DNA, 25 bp, Rattus norvegicus
aatggtttattccagcccgagatct

SEQ ID NO: 64512 - DNA, 25 bp, Rattus norvegicus
aatggtttattcgagcccgagatct

SEQ ID NO: 64513 - DNA, 25 bp, Rattus norvegicus
aatggtttcaaaagcattcctgcct

SEQ ID NO: 64514 - DNA, 25 bp, Rattus norvegicus
aatggtttcaaatgcattcctgcct

SEQ ID NO: 64515 - DNA, 25 bp, Rattus norvegicus
aatggtttcacccttttgcagtctg

SEQ ID NO: 64516 - DNA, 25 bp, Rattus norvegicus
aatggtttcaccgttttgcagtctg

SEQ ID NO: 64517 - DNA, 25 bp, Rattus norvegicus
aatggtttcactacacctttgtgtg

SEQ ID NO: 64518 - DNA, 25 bp, Rattus norvegicus
aatggtttcacttcacctttgtgtg

SEQ ID NO: 64519 - DNA, 25 bp, Rattus norvegicus
aatggtttcatgctggttcatacaa

SEQ ID NO: 64520 - DNA, 25 bp, Rattus norvegicus
aatggtttcatggtggttcatacaa

SEQ ID NO: 64521 - DNA, 25 bp, Rattus norvegicus
aatggtttcattccaacgcactcat

SEQ ID NO: 64522 - DNA, 25 bp, Rattus norvegicus
aatggtttcattgcaacgcactcat

SEQ ID NO: 64523 - DNA, 25 bp, Rattus norvegicus
aatggtttccacagactagcccagt

SEQ ID NO: 64524 - DNA, 25 bp, Rattus norvegicus
aatggtttccactgactagcccagt

SEQ ID NO: 64525 - DNA, 25 bp, Rattus norvegicus
aatggtttccagaatgttccgtaga

SEQ ID NO: 64526 - DNA, 25 bp, Rattus norvegicus
aatggtttccagtatgttccgtaga

SEQ ID NO: 64527 - DNA, 25 bp, Rattus norvegicus
aatggtttcgttctcagctgaggca

SEQ ID NO: 64528 - DNA, 25 bp, Rattus norvegicus
aatggtttcgttgtcagctgaggca

SEQ ID NO: 64529 - DNA, 25 bp, Rattus norvegicus
aatggtttcttcagttgtagctgtg

SEQ ID NO: 64530 - DNA, 25 bp, Rattus norvegicus
aatggtttcttctgttgtagctgtg

SEQ ID NO: 64531 - DNA, 25 bp, Rattus norvegicus
aatggtttgcaacttatcctactcc

SEQ ID NO: 64532 - DNA, 25 bp, Rattus norvegicus
aatggtttgcaagttatcctactcc

SEQ ID NO: 64533 - DNA, 25 bp, Rattus norvegicus
aatggtttggccaagctttgggcac

SEQ ID NO: 64534 - DNA, 25 bp, Rattus norvegicus
aatggtttggcctagctttgggcac

SEQ ID NO: 64535 - DNA, 25 bp, Rattus norvegicus
aatggttttcataactgacttctga

SEQ ID NO: 64536 - DNA, 25 bp, Rattus norvegicus
aatggttttcattactgacttctga

SEQ ID NO: 64537 - DNA, 25 bp, Rattus norvegicus
aatggttttctcctgaagtcgaaag

SEQ ID NO: 64538 - DNA, 25 bp, Rattus norvegicus
aatggttttctcgtgaagtcgaaag

SEQ ID NO: 64539 - DNA, 25 bp, Rattus norvegicus
aatggtttttcaacgacctttatgc

SEQ ID NO: 64540 - DNA, 25 bp, Rattus norvegicus
aatggtttttcatcgacctttatgc

SEQ ID NO: 64541 - DNA, 25 bp, Rattus norvegicus
aatgtaaaactgacactctctcctt

SEQ ID NO: 64542 - DNA, 25 bp, Rattus norvegicus
aatgtaaaactgtcactctctcctt

SEQ ID NO: 64543 - DNA, 25 bp, Rattus norvegicus
aatgtaaagattcctcagtgctcaa

SEQ ID NO: 64544 - DNA, 25 bp, Rattus norvegicus
aatgtaaagattgctcagtgctcaa

SEQ ID NO: 64545 - DNA, 25 bp, Rattus norvegicus
aatgtaaatcctagtttcccttctg

SEQ ID NO: 64546 - DNA, 25 bp, Rattus norvegicus
aatgtaaatccttgtttcccttctg

SEQ ID NO: 64547 - DNA, 25 bp, Rattus norvegicus
aatgtaaatctcatgtccccattcc

SEQ ID NO: 64548 - DNA, 25 bp, Rattus norvegicus
aatgtaaatctcttgtccccattcc

SEQ ID NO: 64549 - DNA, 25 bp, Rattus norvegicus
aatgtaacacttcagatctttctga

SEQ ID NO: 64550 - DNA, 25 bp, Rattus norvegicus
aatgtaacacttgagatctttctga

SEQ ID NO: 64551 - DNA, 25 bp, Rattus norvegicus
aatgtaacatgaccacaggtgcctc

SEQ ID NO: 64552 - DNA, 25 bp, Rattus norvegicus
aatgtaacatgagcacaggtgcctc

SEQ ID NO: 64553 - DNA, 25 bp, Rattus norvegicus
aatgtaaccgatcctgacagtgtct

SEQ ID NO: 64554 - DNA, 25 bp, Rattus norvegicus
aatgtaaccgatgctgacagtgtct

SEQ ID NO: 64555 - DNA, 25 bp, Rattus norvegicus
aatgtaacgttgcatccctcacttt

SEQ ID NO: 64556 - DNA, 25 bp, Rattus norvegicus
aatgtaacgttggatccctcacttt

SEQ ID NO: 64557 - DNA, 25 bp, Rattus norvegicus
aatgtaagctgccatgtgtctgtct

SEQ ID NO: 64558 - DNA, 25 bp, Rattus norvegicus
aatgtaagctgcgatgtgtctgtct

SEQ ID NO: 64559 - DNA, 25 bp, Rattus norvegicus
aatgtaagctgtcacaaccctgtca

SEQ ID NO: 64560 - DNA, 25 bp, Rattus norvegicus
aatgtaagctgtgacaaccctgtca

SEQ ID NO: 64561 - DNA, 25 bp, Rattus norvegicus
aatgtaagcttaactttatcgaata

SEQ ID NO: 64562 - DNA, 25 bp, Rattus norvegicus
aatgtaagcttatctttatcgaata

SEQ ID NO: 64563 - DNA, 25 bp, Rattus norvegicus
aatgtaagttccagggctgctgtct

SEQ ID NO: 64564 - DNA, 25 bp, Rattus norvegicus
aatgtaagttcctgggctgctgtct

SEQ ID NO: 64565 - DNA, 25 bp, Rattus norvegicus
aatgtaatcattcctccttgttctc

SEQ ID NO: 64566 - DNA, 25 bp, Rattus norvegicus
aatgtaatcattgctccttgttctc

SEQ ID NO: 64567 - DNA, 25 bp, Rattus norvegicus
aatgtaatcttgattttacctcata

SEQ ID NO: 64568 - DNA, 25 bp, Rattus norvegicus
aatgtaatcttgtttttacctcata

SEQ ID NO: 64569 - DNA, 25 bp, Rattus norvegicus
aatgtaatgcaaatgcttgagacct

SEQ ID NO: 64570 - DNA, 25 bp, Rattus norvegicus
aatgtaatgcaattgcttgagacct

SEQ ID NO: 64571 - DNA, 25 bp, Rattus norvegicus
aatgtaatgcacattctgtttcaaa

SEQ ID NO: 64572 - DNA, 25 bp, Rattus norvegicus
aatgtaatgcactttctgtttcaaa

SEQ ID NO: 64573 - DNA, 25 bp, Rattus norvegicus
aatgtaattatgatccttcggcttt

SEQ ID NO: 64574 - DNA, 25 bp, Rattus norvegicus
aatgtaattatgttccttcggcttt

SEQ ID NO: 64575 - DNA, 25 bp, Rattus norvegicus
aatgtaattgtcactatgggatgtt

SEQ ID NO: 64576 - DNA, 25 bp, Rattus norvegicus
aatgtaattgtctctatgggatgtt

SEQ ID NO: 64577 - DNA, 25 bp, Rattus norvegicus
aatgtacacaggcagctctttggaa

SEQ ID NO: 64578 - DNA, 25 bp, Rattus norvegicus
aatgtacacagggagctctttggaa

SEQ ID NO: 64579 - DNA, 25 bp, Rattus norvegicus
aatgtacaccacctgcatcatttgg

SEQ ID NO: 64580 - DNA, 25 bp, Rattus norvegicus
aatgtacaccacgtgcatcatttgg

SEQ ID NO: 64581 - DNA, 25 bp, Rattus norvegicus
aatgtacactccaagtttggcatcc

SEQ ID NO: 64582 - DNA, 25 bp, Rattus norvegicus
aatgtacactcctagtttggcatcc

SEQ ID NO: 64583 - DNA, 25 bp, Rattus norvegicus
aatgtacagccaagaccgactactt

SEQ ID NO: 64584 - DNA, 25 bp, Rattus norvegicus
aatgtacagccatgaccgactactt

SEQ ID NO: 64585 - DNA, 25 bp, Rattus norvegicus
aatgtacagctgagtgatgtgaaat

SEQ ID NO: 64586 - DNA, 25 bp, Rattus norvegicus
aatgtacagctgtgtgatgtgaaat

SEQ ID NO: 64587 - DNA, 25 bp, Rattus norvegicus
aatgtacaggagacggtgcctctac

SEQ ID NO: 64588 - DNA, 25 bp, Rattus norvegicus
aatgtacaggagtcggtgcctctac

SEQ ID NO: 64589 - DNA, 25 bp, Rattus norvegicus
aatgtacaggatccttcaaagggtg

SEQ ID NO: 64590 - DNA, 25 bp, Rattus norvegicus
aatgtacaggatgcttcaaagggtg

SEQ ID NO: 64591 - DNA, 25 bp, Rattus norvegicus
aatgtaccacctctcctgtgggaga

SEQ ID NO: 64592 - DNA, 25 bp, Rattus norvegicus
aatgtaccacctgtcctgtgggaga

SEQ ID NO: 64593 - DNA, 25 bp, Rattus norvegicus
aatgtaccctaaattctgtgtggct

SEQ ID NO: 64594 - DNA, 25 bp, Rattus norvegicus
aatgtaccctaatttctgtgtggct

SEQ ID NO: 64595 - DNA, 25 bp, Rattus norvegicus
aatgtaccctgtcgctaagccaggc

SEQ ID NO: 64596 - DNA, 25 bp, Rattus norvegicus
aatgtaccctgtggctaagccaggc

SEQ ID NO: 64597 - DNA, 25 bp, Rattus norvegicus
aatgtacctttgagtcgtctttttg

SEQ ID NO: 64598 - DNA, 25 bp, Rattus norvegicus
aatgtacctttgtgtcgtctttttg

SEQ ID NO: 64599 - DNA, 25 bp, Rattus norvegicus
aatgtactccagcatttggctttgt

SEQ ID NO: 64600 - DNA, 25 bp, Rattus norvegicus
aatgtactccaggatttggctttgt

SEQ ID NO: 64601 - DNA, 25 bp, Rattus norvegicus
aatgtactccatcgcgatcaactct

SEQ ID NO: 64602 - DNA, 25 bp, Rattus norvegicus
aatgtactccatggcgatcaactct

SEQ ID NO: 64603 - DNA, 25 bp, Rattus norvegicus
aatgtactccgcaattctttcctgt

SEQ ID NO: 64604 - DNA, 25 bp, Rattus norvegicus
aatgtactccgctattctttcctgt

SEQ ID NO: 64605 - DNA, 25 bp, Rattus norvegicus
aatgtactcctcaactttttctgtg

SEQ ID NO: 64606 - DNA, 25 bp, Rattus norvegicus
aatgtactcctctactttttctgtg

SEQ ID NO: 64607 - DNA, 25 bp, Rattus norvegicus
aatgtactcttgatcttctagcctt

SEQ ID NO: 64608 - DNA, 25 bp, Rattus norvegicus
aatgtactcttgttcttctagcctt

SEQ ID NO: 64609 - DNA, 25 bp, Rattus norvegicus
aatgtactgtctaggttgcctgcaa

SEQ ID NO: 64610 - DNA, 25 bp, Rattus norvegicus
aatgtactgtcttggttgcctgcaa

SEQ ID NO: 64611 - DNA, 25 bp, Rattus norvegicus
aatgtacttcatatcgactccctta

SEQ ID NO: 64612 - DNA, 25 bp, Rattus norvegicus
aatgtacttcatttcgactccctta

SEQ ID NO: 64613 - DNA, 25 bp, Rattus norvegicus
aatgtacttgatatgttctcatttc

SEQ ID NO: 64614 - DNA, 25 bp, Rattus norvegicus
aatgtacttgatttgttctcatttc

SEQ ID NO: 64615 - DNA, 25 bp, Rattus norvegicus
aatgtactttacctatgctctttat

SEQ ID NO: 64616 - DNA, 25 bp, Rattus norvegicus
aatgtactttacgtatgctctttat

SEQ ID NO: 64617 - DNA, 25 bp, Rattus norvegicus
aatgtactttgaacatactccctcc

SEQ ID NO: 64618 - DNA, 25 bp, Rattus norvegicus
aatgtactttgatcatactccctcc

SEQ ID NO: 64619 - DNA, 25 bp, Rattus norvegicus
aatgtactttgcatcatttacaatg

SEQ ID NO: 64620 - DNA, 25 bp, Rattus norvegicus
aatgtactttgcatctgttttccag

SEQ ID NO: 64621 - DNA, 25 bp, Rattus norvegicus
aatgtactttgcttcatttacaatg

SEQ ID NO: 64622 - DNA, 25 bp, Rattus norvegicus
aatgtactttgcttctgttttccag

SEQ ID NO: 64623 - DNA, 25 bp, Rattus norvegicus
aatgtacttttacaatagttgttag

SEQ ID NO: 64624 - DNA, 25 bp, Rattus norvegicus
aatgtacttttagaatagttgttag

SEQ ID NO: 64625 - DNA, 25 bp, Rattus norvegicus
aatgtagaccatcggacctcaaact

SEQ ID NO: 64626 - DNA, 25 bp, Rattus norvegicus
aatgtagaccatgggacctcaaact

SEQ ID NO: 64627 - DNA, 25 bp, Rattus norvegicus
aatgtagactatcttctcatccacg

SEQ ID NO: 64628 - DNA, 25 bp, Rattus norvegicus
aatgtagactatgttctcatccacg

SEQ ID NO: 64629 - DNA, 25 bp, Rattus norvegicus
aatgtagactctcgttgcgtgcttc

SEQ ID NO: 64630 - DNA, 25 bp, Rattus norvegicus
aatgtagactctggttgcgtgcttc

SEQ ID NO: 64631 - DNA, 25 bp, Rattus norvegicus
aatgtagatcgcaccatcttttctg

SEQ ID NO: 64632 - DNA, 25 bp, Rattus norvegicus
aatgtagatcgctccatcttttctg

SEQ ID NO: 64633 - DNA, 25 bp, Rattus norvegicus
aatgtagccaagcatctgcctccac

SEQ ID NO: 64634 - DNA, 25 bp, Rattus norvegicus
aatgtagccaaggatctgcctccac

SEQ ID NO: 64635 - DNA, 25 bp, Rattus norvegicus
aatgtagccattcacctgccacaag

SEQ ID NO: 64636 - DNA, 25 bp, Rattus norvegicus
aatgtagccattgacctgccacaag

SEQ ID NO: 64637 - DNA, 25 bp, Rattus norvegicus
aatgtagctaaaagacaccgtattt

SEQ ID NO: 64638 - DNA, 25 bp, Rattus norvegicus
aatgtagctaaatgacaccgtattt

SEQ ID NO: 64639 - DNA, 25 bp, Rattus norvegicus
aatgtagctcggaggcatagggctt

SEQ ID NO: 64640 - DNA, 25 bp, Rattus norvegicus
aatgtagctcggtggcatagggctt

SEQ ID NO: 64641 - DNA, 25 bp, Rattus norvegicus
aatgtagctggacagtttccctcta

SEQ ID NO: 64642 - DNA, 25 bp, Rattus norvegicus
aatgtagctggagagtttccctcta

SEQ ID NO: 64643 - DNA, 25 bp, Rattus norvegicus
aatgtagcttggcttggtttccttt

SEQ ID NO: 64644 - DNA, 25 bp, Rattus norvegicus
aatgtagcttgggttggtttccttt

SEQ ID NO: 64645 - DNA, 25 bp, Rattus norvegicus
aatgtaggctatctgtctgtactgt

SEQ ID NO: 64646 - DNA, 25 bp, Rattus norvegicus
aatgtaggctatgtgtctgtactgt

SEQ ID NO: 64647 - DNA, 25 bp, Rattus norvegicus
aatgtaggctctacagctgtaccca

SEQ ID NO: 64648 - DNA, 25 bp, Rattus norvegicus
aatgtaggctcttcagctgtaccca

SEQ ID NO: 64649 - DNA, 25 bp, Rattus norvegicus
aatgtagggagtctcacgtctcggt

SEQ ID NO: 64650 - DNA, 25 bp, Rattus norvegicus
aatgtagggagtgtcacgtctcggt

SEQ ID NO: 64651 - DNA, 25 bp, Rattus norvegicus
aatgtaggtcctcggtgtctaccac

SEQ ID NO: 64652 - DNA, 25 bp, Rattus norvegicus
aatgtaggtcctgggtgtctaccac

SEQ ID NO: 64653 - DNA, 25 bp, Rattus norvegicus
aatgtaggttaaacagtctgtgtct

SEQ ID NO: 64654 - DNA, 25 bp, Rattus norvegicus
aatgtaggttaatcagtctgtgtct

SEQ ID NO: 64655 - DNA, 25 bp, Rattus norvegicus
aatgtaggttctcaccatttgcaaa

SEQ ID NO: 64656 - DNA, 25 bp, Rattus norvegicus
aatgtaggttctgaccatttgcaaa

SEQ ID NO: 64657 - DNA, 25 bp, Rattus norvegicus
aatgtagtccagaggtagcatattc

SEQ ID NO: 64658 - DNA, 25 bp, Rattus norvegicus
aatgtagtccagtggtagcatattc

SEQ ID NO: 64659 - DNA, 25 bp, Rattus norvegicus
aatgtagtgctcataccctgtaata

SEQ ID NO: 64660 - DNA, 25 bp, Rattus norvegicus
aatgtagtgctcttaccctgtaata

SEQ ID NO: 64661 - DNA, 25 bp, Rattus norvegicus
aatgtagtggccatggatatcccct

SEQ ID NO: 64662 - DNA, 25 bp, Rattus norvegicus
aatgtagtggccttggatatcccct

SEQ ID NO: 64663 - DNA, 25 bp, Rattus norvegicus
aatgtagtgtccagagccgagggaa

SEQ ID NO: 64664 - DNA, 25 bp, Rattus norvegicus
aatgtagtgtcctgagccgagggaa

SEQ ID NO: 64665 - DNA, 25 bp, Rattus norvegicus
aatgtagtgtgcacatcactgccac

SEQ ID NO: 64666 - DNA, 25 bp, Rattus norvegicus
aatgtagtgtgctcatcactgccac

SEQ ID NO: 64667 - DNA, 25 bp, Rattus norvegicus
aatgtagttgttaagccgtctgctc

SEQ ID NO: 64668 - DNA, 25 bp, Rattus norvegicus
aatgtagttgtttagccgtctgctc

SEQ ID NO: 64669 - DNA, 25 bp, Rattus norvegicus
aatgtagtttctcctgcttgctatc

SEQ ID NO: 64670 - DNA, 25 bp, Rattus norvegicus
aatgtagtttctgctgcttgctatc

SEQ ID NO: 64671 - DNA, 25 bp, Rattus norvegicus
aatgtataccatagtaccagtaggg

SEQ ID NO: 64672 - DNA, 25 bp, Rattus norvegicus
aatgtataccattgtaccagtaggg

SEQ ID NO: 64673 - DNA, 25 bp, Rattus norvegicus
aatgtatacccgagctttggttgcc

SEQ ID NO: 64674 - DNA, 25 bp, Rattus norvegicus
aatgtatacccgtgctttggttgcc

SEQ ID NO: 64675 - DNA, 25 bp, Rattus norvegicus
aatgtatccgttctggatctgacat

SEQ ID NO: 64676 - DNA, 25 bp, Rattus norvegicus
aatgtatccgttgtggatctgacat

SEQ ID NO: 64677 - DNA, 25 bp, Rattus norvegicus
aatgtatccttcacaggtttctgat

SEQ ID NO: 64678 - DNA, 25 bp, Rattus norvegicus
aatgtatccttctcaggtttctgat

SEQ ID NO: 64679 - DNA, 25 bp, Rattus norvegicus
aatgtatctgctatgtgtttggaaa

SEQ ID NO: 64680 - DNA, 25 bp, Rattus norvegicus
aatgtatctgctttgtgtttggaaa

SEQ ID NO: 64681 - DNA, 25 bp, Rattus norvegicus
aatgtatctgtactgcttcatcaac

SEQ ID NO: 64682 - DNA, 25 bp, Rattus norvegicus
aatgtatctgtagtgcttcatcaac

SEQ ID NO: 64683 - DNA, 25 bp, Rattus norvegicus
aatgtatctgtgactgtgcttccca

SEQ ID NO: 64684 - DNA, 25 bp, Rattus norvegicus
aatgtatctgtgtctgtgcttccca

SEQ ID NO: 64685 - DNA, 25 bp, Rattus norvegicus
aatgtatgcaccatgtcaaccaagg

SEQ ID NO: 64686 - DNA, 25 bp, Rattus norvegicus
aatgtatgcaccttgtcaaccaagg

SEQ ID NO: 64687 - DNA, 25 bp, Rattus norvegicus
aatgtatgcctgaagaatgcctcta

SEQ ID NO: 64688 - DNA, 25 bp, Rattus norvegicus
aatgtatgcctgaagctgatttttt

SEQ ID NO: 64689 - DNA, 25 bp, Rattus norvegicus
aatgtatgcctgtagaatgcctcta

SEQ ID NO: 64690 - DNA, 25 bp, Rattus norvegicus
aatgtatgcctgtagctgatttttt

SEQ ID NO: 64691 - DNA, 25 bp, Rattus norvegicus
aatgtatgctttctgtggtggtctt

SEQ ID NO: 64692 - DNA, 25 bp, Rattus norvegicus
aatgtatgctttgtgtggtggtctt

SEQ ID NO: 64693 - DNA, 25 bp, Rattus norvegicus
aatgtatgtattcgcaatgatctca

SEQ ID NO: 64694 - DNA, 25 bp, Rattus norvegicus
aatgtatgtattggcaatgatctca

SEQ ID NO: 64695 - DNA, 25 bp, Rattus norvegicus
aatgtatgtcctcatcaagcacctt

SEQ ID NO: 64696 - DNA, 25 bp, Rattus norvegicus
aatgtatgtcctgatcaagcacctt

SEQ ID NO: 64697 - DNA, 25 bp, Rattus norvegicus
aatgtatgtctgagtcgtaaatgcc

SEQ ID NO: 64698 - DNA, 25 bp, Rattus norvegicus
aatgtatgtctgtgtcgtaaatgcc

SEQ ID NO: 64699 - DNA, 25 bp, Rattus norvegicus
aatgtatgtgacattgccagcactg

SEQ ID NO: 64700 - DNA, 25 bp, Rattus norvegicus
aatgtatgtgactttgccagcactg

SEQ ID NO: 64701 - DNA, 25 bp, Rattus norvegicus
aatgtatgtgccctgttaacaccaa

SEQ ID NO: 64702 - DNA, 25 bp, Rattus norvegicus
aatgtatgtgccgtgttaacaccaa

SEQ ID NO: 64703 - DNA, 25 bp, Rattus norvegicus
aatgtatgtggtagtcgtgccgtcg

SEQ ID NO: 64704 - DNA, 25 bp, Rattus norvegicus
aatgtatgtggttgtcgtgccgtcg

SEQ ID NO: 64705 - DNA, 25 bp, Rattus norvegicus
aatgtatgttttcgtggctcctgac

SEQ ID NO: 64706 - DNA, 25 bp, Rattus norvegicus
aatgtatgttttggtggctcctgac

SEQ ID NO: 64707 - DNA, 25 bp, Rattus norvegicus
aatgtattcccgagcatatgcttgt

SEQ ID NO: 64708 - DNA, 25 bp, Rattus norvegicus
aatgtattcccgattcctctgaagc

SEQ ID NO: 64709 - DNA, 25 bp, Rattus norvegicus
aatgtattcccgtgcatatgcttgt

SEQ ID NO: 64710 - DNA, 25 bp, Rattus norvegicus
aatgtattcccgtttcctctgaagc

SEQ ID NO: 64711 - DNA, 25 bp, Rattus norvegicus
aatgtattgtctactgttcacttaa

SEQ ID NO: 64712 - DNA, 25 bp, Rattus norvegicus
aatgtattgtcttctgttcacttaa

SEQ ID NO: 64713 - DNA, 25 bp, Rattus norvegicus
aatgtatttaaacggcgcgtggctc

SEQ ID NO: 64714 - DNA, 25 bp, Rattus norvegicus
aatgtatttaaagggcgcgtggctc

SEQ ID NO: 64715 - DNA, 25 bp, Rattus norvegicus
aatgtatttataagcctagtagggt

SEQ ID NO: 64716 - DNA, 25 bp, Rattus norvegicus
aatgtatttatatgcctagtagggt

SEQ ID NO: 64717 - DNA, 25 bp, Rattus norvegicus
aatgtatttattccagaccctttct

SEQ ID NO: 64718 - DNA, 25 bp, Rattus norvegicus
aatgtatttattgcagaccctttct

SEQ ID NO: 64719 - DNA, 25 bp, Rattus norvegicus
aatgtatttctgaaccacttggcag

SEQ ID NO: 64720 - DNA, 25 bp, Rattus norvegicus
aatgtatttctgtaccacttggcag

SEQ ID NO: 64721 - DNA, 25 bp, Rattus norvegicus
aatgtatttgtgacacaccctctca

SEQ ID NO: 64722 - DNA, 25 bp, Rattus norvegicus
aatgtatttgtgtcacaccctctca

SEQ ID NO: 64723 - DNA, 25 bp, Rattus norvegicus
aatgtcaaacctagcatcagtcatg

SEQ ID NO: 64724 - DNA, 25 bp, Rattus norvegicus
aatgtcaaaccttgcatcagtcatg

SEQ ID NO: 64725 - DNA, 25 bp, Rattus norvegicus
aatgtcaacactctgcatactgcag

SEQ ID NO: 64726 - DNA, 25 bp, Rattus norvegicus
aatgtcaacactgtgcatactgcag

SEQ ID NO: 64727 - DNA, 25 bp, Rattus norvegicus
aatgtcaactcactggaggctctgc

SEQ ID NO: 64728 - DNA, 25 bp, Rattus norvegicus
aatgtcaactcagtggaggctctgc

SEQ ID NO: 64729 - DNA, 25 bp, Rattus norvegicus
aatgtcaagtacagggcgtcaagcc

SEQ ID NO: 64730 - DNA, 25 bp, Rattus norvegicus
aatgtcaagtactgggcgtcaagcc

SEQ ID NO: 64731 - DNA, 25 bp, Rattus norvegicus
aatgtcaagtttccattggccaaga

SEQ ID NO: 64732 - DNA, 25 bp, Rattus norvegicus
aatgtcaagtttgcattggccaaga

SEQ ID NO: 64733 - DNA, 25 bp, Rattus norvegicus
aatgtcaataaactgctggtaggca

SEQ ID NO: 64734 - DNA, 25 bp, Rattus norvegicus
aatgtcaataaagtgctggtaggca

SEQ ID NO: 64735 - DNA, 25 bp, Rattus norvegicus
aatgtcaatgctctcacatgctgag

SEQ ID NO: 64736 - DNA, 25 bp, Rattus norvegicus
aatgtcaatgctgtcacatgctgag

SEQ ID NO: 64737 - DNA, 25 bp, Rattus norvegicus
aatgtcacaaccagttcgttcaagc

SEQ ID NO: 64738 - DNA, 25 bp, Rattus norvegicus
aatgtcacaacctgttcgttcaagc

SEQ ID NO: 64739 - DNA, 25 bp, Rattus norvegicus
aatgtcacacaaagctgttacctgt

SEQ ID NO: 64740 - DNA, 25 bp, Rattus norvegicus
aatgtcacacaatgctgttacctgt

SEQ ID NO: 64741 - DNA, 25 bp, Rattus norvegicus
aatgtcacactcctttgctaacttc

SEQ ID NO: 64742 - DNA, 25 bp, Rattus norvegicus
aatgtcacactcgtttgctaacttc

SEQ ID NO: 64743 - DNA, 25 bp, Rattus norvegicus
aatgtcacagaaacgggcctctttt

SEQ ID NO: 64744 - DNA, 25 bp, Rattus norvegicus
aatgtcacagaatcgggcctctttt

SEQ ID NO: 64745 - DNA, 25 bp, Rattus norvegicus
aatgtcacagcacttcttgctcaat

SEQ ID NO: 64746 - DNA, 25 bp, Rattus norvegicus
aatgtcacagcagttcttgctcaat

SEQ ID NO: 64747 - DNA, 25 bp, Rattus norvegicus
aatgtcacagtgacacccattacta

SEQ ID NO: 64748 - DNA, 25 bp, Rattus norvegicus
aatgtcacagtgtcacccattacta

SEQ ID NO: 64749 - DNA, 25 bp, Rattus norvegicus
aatgtcacagttccttctgctgggc

SEQ ID NO: 64750 - DNA, 25 bp, Rattus norvegicus
aatgtcacagttgcttctgctgggc

SEQ ID NO: 64751 - DNA, 25 bp, Rattus norvegicus
aatgtcaccacccagggccagaggt

SEQ ID NO: 64752 - DNA, 25 bp, Rattus norvegicus
aatgtcaccaccgagggccagaggt

SEQ ID NO: 64753 - DNA, 25 bp, Rattus norvegicus
aatgtcacccagaagttcacctggc

SEQ ID NO: 64754 - DNA, 25 bp, Rattus norvegicus
aatgtcacccagtagttcacctggc

SEQ ID NO: 64755 - DNA, 25 bp, Rattus norvegicus
aatgtcaccctgagagctgggtaca

SEQ ID NO: 64756 - DNA, 25 bp, Rattus norvegicus
aatgtcaccctgtgagctgggtaca

SEQ ID NO: 64757 - DNA, 25 bp, Rattus norvegicus
aatgtcaccgtgaatgggcgcaaac

SEQ ID NO: 64758 - DNA, 25 bp, Rattus norvegicus
aatgtcaccgtgtatgggcgcaaac

SEQ ID NO: 64759 - DNA, 25 bp, Rattus norvegicus
aatgtcacctcacgtagctggcatg

SEQ ID NO: 64760 - DNA, 25 bp, Rattus norvegicus
aatgtcacctcaggtagctggcatg

SEQ ID NO: 64761 - DNA, 25 bp, Rattus norvegicus
aatgtcacctccactaattattcag

SEQ ID NO: 64762 - DNA, 25 bp, Rattus norvegicus
aatgtcacctcctctaattattcag

SEQ ID NO: 64763 - DNA, 25 bp, Rattus norvegicus
aatgtcacctgcaaggtcatcttgc

SEQ ID NO: 64764 - DNA, 25 bp, Rattus norvegicus
aatgtcacctgctaggtcatcttgc

SEQ ID NO: 64765 - DNA, 25 bp, Rattus norvegicus
aatgtcacctgtatgtttctcaacc

SEQ ID NO: 64766 - DNA, 25 bp, Rattus norvegicus
aatgtcacctgtttgtttctcaacc

SEQ ID NO: 64767 - DNA, 25 bp, Rattus norvegicus
aatgtcaccttaccctttgaatagg

SEQ ID NO: 64768 - DNA, 25 bp, Rattus norvegicus
aatgtcaccttagcctttgaatagg

SEQ ID NO: 64769 - DNA, 25 bp, Rattus norvegicus
aatgtcactgagaacgtcgtccgag

SEQ ID NO: 64770 - DNA, 25 bp, Rattus norvegicus
aatgtcactgagtacgtcgtccgag

SEQ ID NO: 64771 - DNA, 25 bp, Rattus norvegicus
aatgtcactggcagtcacatgcacc

SEQ ID NO: 64772 - DNA, 25 bp, Rattus norvegicus
aatgtcactggctgtcacatgcacc

SEQ ID NO: 64773 - DNA, 25 bp, Rattus norvegicus
aatgtcactggtcgtgcctggtacc

SEQ ID NO: 64774 - DNA, 25 bp, Rattus norvegicus
aatgtcactggtggtgcctggtacc

SEQ ID NO: 64775 - DNA, 25 bp, Rattus norvegicus
aatgtcactgttaccttttctatag

SEQ ID NO: 64776 - DNA, 25 bp, Rattus norvegicus
aatgtcactgtttccttttctatag

SEQ ID NO: 64777 - DNA, 25 bp, Rattus norvegicus
aatgtcacttgcaattaccagccgg

SEQ ID NO: 64778 - DNA, 25 bp, Rattus norvegicus
aatgtcacttgctattaccagccgg

SEQ ID NO: 64779 - DNA, 25 bp, Rattus norvegicus
aatgtcactttgcactttcttgcct

SEQ ID NO: 64780 - DNA, 25 bp, Rattus norvegicus
aatgtcactttggactttcttgcct

SEQ ID NO: 64781 - DNA, 25 bp, Rattus norvegicus
aatgtcagattccagtttttcctag

SEQ ID NO: 64782 - DNA, 25 bp, Rattus norvegicus
aatgtcagattcgagtttttcctag

SEQ ID NO: 64783 - DNA, 25 bp, Rattus norvegicus
aatgtcagcatacttggattccaat

SEQ ID NO: 64784 - DNA, 25 bp, Rattus norvegicus
aatgtcagcatagttggattccaat

SEQ ID NO: 64785 - DNA, 25 bp, Rattus norvegicus
aatgtcagccacaagcgtggatcag

SEQ ID NO: 64786 - DNA, 25 bp, Rattus norvegicus
aatgtcagccactagcgtggatcag

SEQ ID NO: 64787 - DNA, 25 bp, Rattus norvegicus
aatgtcagccttatgtgagctcaaa

SEQ ID NO: 64788 - DNA, 25 bp, Rattus norvegicus
aatgtcagccttttgtgagctcaaa

SEQ ID NO: 64789 - DNA, 25 bp, Rattus norvegicus
aatgtcagctgtctagtcttgtcaa

SEQ ID NO: 64790 - DNA, 25 bp, Rattus norvegicus
aatgtcagctgtgtagtcttgtcaa

SEQ ID NO: 64791 - DNA, 25 bp, Rattus norvegicus
aatgtcaggaacagctggccctgtt

SEQ ID NO: 64792 - DNA, 25 bp, Rattus norvegicus
aatgtcaggaactgctggccctgtt

SEQ ID NO: 64793 - DNA, 25 bp, Rattus norvegicus
aatgtcaggattattcttctcaaga

SEQ ID NO: 64794 - DNA, 25 bp, Rattus norvegicus
aatgtcaggatttttcttctcaaga

SEQ ID NO: 64795 - DNA, 25 bp, Rattus norvegicus
aatgtcagggtcacctgtccagaaa

SEQ ID NO: 64796 - DNA, 25 bp, Rattus norvegicus
aatgtcagggtctcctgtccagaaa

SEQ ID NO: 64797 - DNA, 25 bp, Rattus norvegicus
aatgtcagtctcaccagaccttgct

SEQ ID NO: 64798 - DNA, 25 bp, Rattus norvegicus
aatgtcagtctctccagaccttgct

SEQ ID NO: 64799 - DNA, 25 bp, Rattus norvegicus
aatgtcagtgatactcttttgaaat

SEQ ID NO: 64800 - DNA, 25 bp, Rattus norvegicus
aatgtcagtgattctcttttgaaat

SEQ ID NO: 64801 - DNA, 25 bp, Rattus norvegicus
aatgtcagtgcactgtcttgtggaa

SEQ ID NO: 64802 - DNA, 25 bp, Rattus norvegicus
aatgtcagtgcagtgtcttgtggaa

SEQ ID NO: 64803 - DNA, 25 bp, Rattus norvegicus
aatgtcagtggccactcagttcctg

SEQ ID NO: 64804 - DNA, 25 bp, Rattus norvegicus
aatgtcagtggcgactcagttcctg

SEQ ID NO: 64805 - DNA, 25 bp, Rattus norvegicus
aatgtcagtgtgaatgcctcggcca

SEQ ID NO: 64806 - DNA, 25 bp, Rattus norvegicus
aatgtcagtgtgtatgcctcggcca

SEQ ID NO: 64807 - DNA, 25 bp, Rattus norvegicus
aatgtcatacatcaatcgctctctg

SEQ ID NO: 64808 - DNA, 25 bp, Rattus norvegicus
aatgtcatacatgaatcgctctctg

SEQ ID NO: 64809 - DNA, 25 bp, Rattus norvegicus
aatgtcatcacacgcatcctcaagg

SEQ ID NO: 64810 - DNA, 25 bp, Rattus norvegicus
aatgtcatcacaggcatcctcaagg

SEQ ID NO: 64811 - DNA, 25 bp, Rattus norvegicus
aatgtcatccttagaagacttgcct

SEQ ID NO: 64812 - DNA, 25 bp, Rattus norvegicus
aatgtcatcctttgaagacttgcct

SEQ ID NO: 64813 - DNA, 25 bp, Rattus norvegicus
aatgtcatctcaagtgtttatccaa

SEQ ID NO: 64814 - DNA, 25 bp, Rattus norvegicus
aatgtcatctcatgtgtttatccaa

SEQ ID NO: 64815 - DNA, 25 bp, Rattus norvegicus
aatgtcatctgaatcgagccagccc

SEQ ID NO: 64816 - DNA, 25 bp, Rattus norvegicus
aatgtcatctgattcgagccagccc

SEQ ID NO: 64817 - DNA, 25 bp, Rattus norvegicus
aatgtcatgccaacttttttagtga

SEQ ID NO: 64818 - DNA, 25 bp, Rattus norvegicus
aatgtcatgccatcttttttagtga

SEQ ID NO: 64819 - DNA, 25 bp, Rattus norvegicus
aatgtcatggctcaatcccatctga

SEQ ID NO: 64820 - DNA, 25 bp, Rattus norvegicus
aatgtcatggctgaatcccatctga

SEQ ID NO: 64821 - DNA, 25 bp, Rattus norvegicus
aatgtcatggtaccttgaaagcaac

SEQ ID NO: 64822 - DNA, 25 bp, Rattus norvegicus
aatgtcatggtagcttgaaagcaac

SEQ ID NO: 64823 - DNA, 25 bp, Rattus norvegicus
aatgtcattcccattgacacggttg

SEQ ID NO: 64824 - DNA, 25 bp, Rattus norvegicus
aatgtcattccctttgacacggttg

SEQ ID NO: 64825 - DNA, 25 bp, Rattus norvegicus
aatgtcattgaaaagcctcctacga

SEQ ID NO: 64826 - DNA, 25 bp, Rattus norvegicus
aatgtcattgaatagcctcctacga

SEQ ID NO: 64827 - DNA, 25 bp, Rattus norvegicus
aatgtcatttgtcagcttgtcagtg

SEQ ID NO: 64828 - DNA, 25 bp, Rattus norvegicus
aatgtcatttgtgagcttgtcagtg

SEQ ID NO: 64829 - DNA, 25 bp, Rattus norvegicus
aatgtccaaaacagctaatcctggg

SEQ ID NO: 64830 - DNA, 25 bp, Rattus norvegicus
aatgtccaaaactgctaatcctggg

SEQ ID NO: 64831 - DNA, 25 bp, Rattus norvegicus
aatgtccaagaaaaaggttagcctc

SEQ ID NO: 64832 - DNA, 25 bp, Rattus norvegicus
aatgtccaagaataaggttagcctc

SEQ ID NO: 64833 - DNA, 25 bp, Rattus norvegicus
aatgtccacaatacttgcttctctc

SEQ ID NO: 64834 - DNA, 25 bp, Rattus norvegicus
aatgtccacaattcttgcttctctc

SEQ ID NO: 64835 - DNA, 25 bp, Rattus norvegicus
aatgtccacaccagtctgaccattg

SEQ ID NO: 64836 - DNA, 25 bp, Rattus norvegicus
aatgtccacacctgtctgaccattg

SEQ ID NO: 64837 - DNA, 25 bp, Rattus norvegicus
aatgtccacagacttggctcttttc

SEQ ID NO: 64838 - DNA, 25 bp, Rattus norvegicus
aatgtccacagagttggctcttttc

SEQ ID NO: 64839 - DNA, 25 bp, Rattus norvegicus
aatgtccacataacctcgtttgcct

SEQ ID NO: 64840 - DNA, 25 bp, Rattus norvegicus
aatgtccacatatcctcgtttgcct

SEQ ID NO: 64841 - DNA, 25 bp, Rattus norvegicus
aatgtccactatcactgctcaggag

SEQ ID NO: 64842 - DNA, 25 bp, Rattus norvegicus
aatgtccactatgactgctcaggag

SEQ ID NO: 64843 - DNA, 25 bp, Rattus norvegicus
aatgtccactgtcttttatacagta

SEQ ID NO: 64844 - DNA, 25 bp, Rattus norvegicus
aatgtccactgtgttttatacagta

SEQ ID NO: 64845 - DNA, 25 bp, Rattus norvegicus
aatgtccagtctcgctgtgatgctc

SEQ ID NO: 64846 - DNA, 25 bp, Rattus norvegicus
aatgtccagtctggctgtgatgctc

SEQ ID NO: 64847 - DNA, 25 bp, Rattus norvegicus
aatgtccatcctctgggttcaaaat

SEQ ID NO: 64848 - DNA, 25 bp, Rattus norvegicus
aatgtccatcctgtgggttcaaaat

SEQ ID NO: 64849 - DNA, 25 bp, Rattus norvegicus
aatgtccatgcaaacaagtactgag

SEQ ID NO: 64850 - DNA, 25 bp, Rattus norvegicus
aatgtccatgcatacaagtactgag

SEQ ID NO: 64851 - DNA, 25 bp, Rattus norvegicus
aatgtccatgttctcgtgggcagcc

SEQ ID NO: 64852 - DNA, 25 bp, Rattus norvegicus
aatgtccatgttgtcgtgggcagcc

SEQ ID NO: 64853 - DNA, 25 bp, Rattus norvegicus
aatgtccattccacaactgggtggg

SEQ ID NO: 64854 - DNA, 25 bp, Rattus norvegicus
aatgtccattcctcaactgggtggg

SEQ ID NO: 64855 - DNA, 25 bp, Rattus norvegicus
aatgtccatttgctggcatctgggt

SEQ ID NO: 64856 - DNA, 25 bp, Rattus norvegicus
aatgtccatttggtggcatctgggt

SEQ ID NO: 64857 - DNA, 25 bp, Rattus norvegicus
aatgtcccaacgaagaaattctcaa

SEQ ID NO: 64858 - DNA, 25 bp, Rattus norvegicus
aatgtcccaacgtagaaattctcaa

SEQ ID NO: 64859 - DNA, 25 bp, Rattus norvegicus
aatgtcccaagcacattcacgtttc

SEQ ID NO: 64860 - DNA, 25 bp, Rattus norvegicus
aatgtcccaagctcattcacgtttc

SEQ ID NO: 64861 - DNA, 25 bp, Rattus norvegicus
aatgtcccactgatgacacaagtat

SEQ ID NO: 64862 - DNA, 25 bp, Rattus norvegicus
aatgtcccactgttgacacaagtat

SEQ ID NO: 64863 - DNA, 25 bp, Rattus norvegicus
aatgtcccagacacgcgaatggcaa

SEQ ID NO: 64864 - DNA, 25 bp, Rattus norvegicus
aatgtcccagactcgcgaatggcaa

SEQ ID NO: 64865 - DNA, 25 bp, Rattus norvegicus
aatgtcccagccactgtatgggcca

SEQ ID NO: 64866 - DNA, 25 bp, Rattus norvegicus
aatgtcccagcctctgtatgggcca

SEQ ID NO: 64867 - DNA, 25 bp, Rattus norvegicus
aatgtcccatccaagtgtggtggct

SEQ ID NO: 64868 - DNA, 25 bp, Rattus norvegicus
aatgtcccatcctagtgtggtggct

SEQ ID NO: 64869 - DNA, 25 bp, Rattus norvegicus
aatgtccccaccatggtatgacaca

SEQ ID NO: 64870 - DNA, 25 bp, Rattus norvegicus
aatgtccccaccttggtatgacaca

SEQ ID NO: 64871 - DNA, 25 bp, Rattus norvegicus
aatgtccccattctttccagacgtt

SEQ ID NO: 64872 - DNA, 25 bp, Rattus norvegicus
aatgtccccattgtttccagacgtt

SEQ ID NO: 64873 - DNA, 25 bp, Rattus norvegicus
aatgtccccgaccagatgcaatcat

SEQ ID NO: 64874 - DNA, 25 bp, Rattus norvegicus
aatgtccccgacgagatgcaatcat

SEQ ID NO: 64875 - DNA, 25 bp, Rattus norvegicus
aatgtccccttgactcttaggaggc

SEQ ID NO: 64876 - DNA, 25 bp, Rattus norvegicus
aatgtccccttgtctcttaggaggc

SEQ ID NO: 64877 - DNA, 25 bp, Rattus norvegicus
aatgtccctaaacattcagattttt

SEQ ID NO: 64878 - DNA, 25 bp, Rattus norvegicus
aatgtccctaaagattcagattttt

SEQ ID NO: 64879 - DNA, 25 bp, Rattus norvegicus
aatgtccctcaaaggcccataaata

SEQ ID NO: 64880 - DNA, 25 bp, Rattus norvegicus
aatgtccctcaatggcccataaata

SEQ ID NO: 64881 - DNA, 25 bp, Rattus norvegicus
aatgtccctcacagggcagaggttt

SEQ ID NO: 64882 - DNA, 25 bp, Rattus norvegicus
aatgtccctcacatctagtacaata

SEQ ID NO: 64883 - DNA, 25 bp, Rattus norvegicus
aatgtccctcactgggcagaggttt

SEQ ID NO: 64884 - DNA, 25 bp, Rattus norvegicus
aatgtccctcacttctagtacaata

SEQ ID NO: 64885 - DNA, 25 bp, Rattus norvegicus
aatgtccctgacagcttcacgatta

SEQ ID NO: 64886 - DNA, 25 bp, Rattus norvegicus
aatgtccctgactgcttcacgatta

SEQ ID NO: 64887 - DNA, 25 bp, Rattus norvegicus
aatgtcccttttcagatatctcaga

SEQ ID NO: 64888 - DNA, 25 bp, Rattus norvegicus
aatgtcccttttgagatatctcaga

SEQ ID NO: 64889 - DNA, 25 bp, Rattus norvegicus
aatgtccgagtacgagtgcccctcc

SEQ ID NO: 64890 - DNA, 25 bp, Rattus norvegicus
aatgtccgagtaggagtgcccctcc

SEQ ID NO: 64891 - DNA, 25 bp, Rattus norvegicus
aatgtccgccagctgccagctaagg

SEQ ID NO: 64892 - DNA, 25 bp, Rattus norvegicus
aatgtccgccaggtgccagctaagg

SEQ ID NO: 64893 - DNA, 25 bp, Rattus norvegicus
aatgtccgcctgacctgtggagaca

SEQ ID NO: 64894 - DNA, 25 bp, Rattus norvegicus
aatgtccgcctgtcctgtggagaca

SEQ ID NO: 64895 - DNA, 25 bp, Rattus norvegicus
aatgtccgctttagcatcgctacgt

SEQ ID NO: 64896 - DNA, 25 bp, Rattus norvegicus
aatgtccgcttttgcatcgctacgt

SEQ ID NO: 64897 - DNA, 25 bp, Rattus norvegicus
aatgtcctaactactgtgctaacgc

SEQ ID NO: 64898 - DNA, 25 bp, Rattus norvegicus
aatgtcctaacttctgtgctaacgc

SEQ ID NO: 64899 - DNA, 25 bp, Rattus norvegicus
aatgtcctaatgatgctgggctact

SEQ ID NO: 64900 - DNA, 25 bp, Rattus norvegicus
aatgtcctaatgttgctgggctact

SEQ ID NO: 64901 - DNA, 25 bp, Rattus norvegicus
aatgtcctcattattctggcagtgt

SEQ ID NO: 64902 - DNA, 25 bp, Rattus norvegicus
aatgtcctcatttttctggcagtgt

SEQ ID NO: 64903 - DNA, 25 bp, Rattus norvegicus
aatgtcctccagatctaacttggtg

SEQ ID NO: 64904 - DNA, 25 bp, Rattus norvegicus
aatgtcctccagttctaacttggtg

SEQ ID NO: 64905 - DNA, 25 bp, Rattus norvegicus
aatgtcctccatctctgcagataaa

SEQ ID NO: 64906 - DNA, 25 bp, Rattus norvegicus
aatgtcctccatgtctgcagataaa

SEQ ID NO: 64907 - DNA, 25 bp, Rattus norvegicus
aatgtcctcttcatttctttgcatg

SEQ ID NO: 64908 - DNA, 25 bp, Rattus norvegicus
aatgtcctcttcttttctttgcatg

SEQ ID NO: 64909 - DNA, 25 bp, Rattus norvegicus
aatgtcctgagaactctcctggtga

SEQ ID NO: 64910 - DNA, 25 bp, Rattus norvegicus
aatgtcctgagatctctcctggtga

SEQ ID NO: 64911 - DNA, 25 bp, Rattus norvegicus
aatgtcctggtgatcatcctttaca

SEQ ID NO: 64912 - DNA, 25 bp, Rattus norvegicus
aatgtcctggtgttcatcctttaca

SEQ ID NO: 64913 - DNA, 25 bp, Rattus norvegicus
aatgtcctgttgactgtgcctttca

SEQ ID NO: 64914 - DNA, 25 bp, Rattus norvegicus
aatgtcctgttgtctgtgcctttca

SEQ ID NO: 64915 - DNA, 25 bp, Rattus norvegicus
aatgtccttaaacctacaggctaag

SEQ ID NO: 64916 - DNA, 25 bp, Rattus norvegicus
aatgtccttaaagctacaggctaag

SEQ ID NO: 64917 - DNA, 25 bp, Rattus norvegicus
aatgtccttctcctggaatgcgcac

SEQ ID NO: 64918 - DNA, 25 bp, Rattus norvegicus
aatgtccttctcgtggaatgcgcac

SEQ ID NO: 64919 - DNA, 25 bp, Rattus norvegicus
aatgtccttgacctgacttgttgag

SEQ ID NO: 64920 - DNA, 25 bp, Rattus norvegicus
aatgtccttgacgtgacttgttgag

SEQ ID NO: 64921 - DNA, 25 bp, Rattus norvegicus
aatgtccttgggatcaatgacgcct

SEQ ID NO: 64922 - DNA, 25 bp, Rattus norvegicus
aatgtccttgggttcaatgacgcct

SEQ ID NO: 64923 - DNA, 25 bp, Rattus norvegicus
aatgtcctttgaaagagaccctgcc

SEQ ID NO: 64924 - DNA, 25 bp, Rattus norvegicus
aatgtcctttgatagagaccctgcc

SEQ ID NO: 64925 - DNA, 25 bp, Rattus norvegicus
aatgtcctttggaacatgacttttg

SEQ ID NO: 64926 - DNA, 25 bp, Rattus norvegicus
aatgtcctttggtacatgacttttg

SEQ ID NO: 64927 - DNA, 25 bp, Rattus norvegicus
aatgtccttttcagagcctctattt

SEQ ID NO: 64928 - DNA, 25 bp, Rattus norvegicus
aatgtccttttctgagcctctattt

SEQ ID NO: 64929 - DNA, 25 bp, Rattus norvegicus
aatgtcgacagtattctttattaaa

SEQ ID NO: 64930 - DNA, 25 bp, Rattus norvegicus
aatgtcgacagttttctttattaaa

SEQ ID NO: 64931 - DNA, 25 bp, Rattus norvegicus
aatgtcgcacagattttatttccac

SEQ ID NO: 64932 - DNA, 25 bp, Rattus norvegicus
aatgtcgcacagtttttatttccac

SEQ ID NO: 64933 - DNA, 25 bp, Rattus norvegicus
aatgtcgcttgcatgatagctctca

SEQ ID NO: 64934 - DNA, 25 bp, Rattus norvegicus
aatgtcgcttgcttgatagctctca

SEQ ID NO: 64935 - DNA, 25 bp, Rattus norvegicus
aatgtcggacatacctttcttcaat

SEQ ID NO: 64936 - DNA, 25 bp, Rattus norvegicus
aatgtcggacattcctttcttcaat

SEQ ID NO: 64937 - DNA, 25 bp, Rattus norvegicus
aatgtcggccctctatcaaccacat

SEQ ID NO: 64938 - DNA, 25 bp, Rattus norvegicus
aatgtcggccctgtatcaaccacat

SEQ ID NO: 64939 - DNA, 25 bp, Rattus norvegicus
aatgtcggtcatactgttcagatat

SEQ ID NO: 64940 - DNA, 25 bp, Rattus norvegicus
aatgtcggtcattctgttcagatat

SEQ ID NO: 64941 - DNA, 25 bp, Rattus norvegicus
aatgtcggttccagctgttaatggg

SEQ ID NO: 64942 - DNA, 25 bp, Rattus norvegicus
aatgtcggttcctgctgttaatggg

SEQ ID NO: 64943 - DNA, 25 bp, Rattus norvegicus
aatgtcgtcagcattgtcaagtcaa

SEQ ID NO: 64944 - DNA, 25 bp, Rattus norvegicus
aatgtcgtcagctttgtcaagtcaa

SEQ ID NO: 64945 - DNA, 25 bp, Rattus norvegicus
aatgtcgtgaggcaacccacgctga

SEQ ID NO: 64946 - DNA, 25 bp, Rattus norvegicus
aatgtcgtgagggaacccacgctga

SEQ ID NO: 64947 - DNA, 25 bp, Rattus norvegicus
aatgtcgttgggaagccattctgta

SEQ ID NO: 64948 - DNA, 25 bp, Rattus norvegicus
aatgtcgttgggtagccattctgta

SEQ ID NO: 64949 - DNA, 25 bp, Rattus norvegicus
aatgtctaacatctctctgctgaaa

SEQ ID NO: 64950 - DNA, 25 bp, Rattus norvegicus
aatgtctaacatgtctctgctgaaa

SEQ ID NO: 64951 - DNA, 25 bp, Rattus norvegicus
aatgtctaattcatcttacttttga

SEQ ID NO: 64952 - DNA, 25 bp, Rattus norvegicus
aatgtctaattcttcttacttttga

SEQ ID NO: 64953 - DNA, 25 bp, Rattus norvegicus
aatgtctacatgcacactatgggaa

SEQ ID NO: 64954 - DNA, 25 bp, Rattus norvegicus
aatgtctacatggacactatgggaa

SEQ ID NO: 64955 - DNA, 25 bp, Rattus norvegicus
aatgtctaccagatgcatctagcca

SEQ ID NO: 64956 - DNA, 25 bp, Rattus norvegicus
aatgtctaccagttgcatctagcca

SEQ ID NO: 64957 - DNA, 25 bp, Rattus norvegicus
aatgtctacccacgataccactgag

SEQ ID NO: 64958 - DNA, 25 bp, Rattus norvegicus
aatgtctacccaggataccactgag

SEQ ID NO: 64959 - DNA, 25 bp, Rattus norvegicus
aatgtctaccggaatgccaccatgc

SEQ ID NO: 64960 - DNA, 25 bp, Rattus norvegicus
aatgtctaccggtatgccaccatgc

SEQ ID NO: 64961 - DNA, 25 bp, Rattus norvegicus
aatgtctactctcagaggcctctgg

SEQ ID NO: 64962 - DNA, 25 bp, Rattus norvegicus
aatgtctactctgagaggcctctgg

SEQ ID NO: 64963 - DNA, 25 bp, Rattus norvegicus
aatgtctactgacttttattcctag

SEQ ID NO: 64964 - DNA, 25 bp, Rattus norvegicus
aatgtctactgagttttattcctag

SEQ ID NO: 64965 - DNA, 25 bp, Rattus norvegicus
aatgtctagactagggcccatcgga

SEQ ID NO: 64966 - DNA, 25 bp, Rattus norvegicus
aatgtctagacttgggcccatcgga

SEQ ID NO: 64967 - DNA, 25 bp, Rattus norvegicus
aatgtctatgtcatgtttatgccaa

SEQ ID NO: 64968 - DNA, 25 bp, Rattus norvegicus
aatgtctatgtcttgtttatgccaa

SEQ ID NO: 64969 - DNA, 25 bp, Rattus norvegicus
aatgtctatgttcagttttgcccac

SEQ ID NO: 64970 - DNA, 25 bp, Rattus norvegicus
aatgtctatgttgagttttgcccac

SEQ ID NO: 64971 - DNA, 25 bp, Rattus norvegicus
aatgtctattacatcaccgccagtg

SEQ ID NO: 64972 - DNA, 25 bp, Rattus norvegicus
aatgtctattacttcaccgccagtg

SEQ ID NO: 64973 - DNA, 25 bp, Rattus norvegicus
aatgtctcagccagttgcttgcaaa

SEQ ID NO: 64974 - DNA, 25 bp, Rattus norvegicus
aatgtctcagcctgttgcttgcaaa

SEQ ID NO: 64975 - DNA, 25 bp, Rattus norvegicus
aatgtctcaggcatggctttcgttt

SEQ ID NO: 64976 - DNA, 25 bp, Rattus norvegicus
aatgtctcaggcttggctttcgttt

SEQ ID NO: 64977 - DNA, 25 bp, Rattus norvegicus
aatgtctcagtcactcaccttattg

SEQ ID NO: 64978 - DNA, 25 bp, Rattus norvegicus
aatgtctcagtctctcaccttattg

SEQ ID NO: 64979 - DNA, 25 bp, Rattus norvegicus
aatgtctccactcctgaagttgctt

SEQ ID NO: 64980 - DNA, 25 bp, Rattus norvegicus
aatgtctccactgctgaagttgctt

SEQ ID NO: 64981 - DNA, 25 bp, Rattus norvegicus
aatgtctccattctgtcctgggttg

SEQ ID NO: 64982 - DNA, 25 bp, Rattus norvegicus
aatgtctccattgtgtcctgggttg

SEQ ID NO: 64983 - DNA, 25 bp, Rattus norvegicus
aatgtctcccctagcttccgctgtt

SEQ ID NO: 64984 - DNA, 25 bp, Rattus norvegicus
aatgtctccccttgcttccgctgtt

SEQ ID NO: 64985 - DNA, 25 bp, Rattus norvegicus
aatgtctcctaaattctctcaggtc

SEQ ID NO: 64986 - DNA, 25 bp, Rattus norvegicus
aatgtctcctaatttctctcaggtc

SEQ ID NO: 64987 - DNA, 25 bp, Rattus norvegicus
aatgtctcctggacacaacgcacag

SEQ ID NO: 64988 - DNA, 25 bp, Rattus norvegicus
aatgtctcctggtcacaacgcacag

SEQ ID NO: 64989 - DNA, 25 bp, Rattus norvegicus
aatgtctcctttactggattctttg

SEQ ID NO: 64990 - DNA, 25 bp, Rattus norvegicus
aatgtctccttttctggattctttg

SEQ ID NO: 64991 - DNA, 25 bp, Rattus norvegicus
aatgtctcggccaaacacaggcgtg

SEQ ID NO: 64992 - DNA, 25 bp, Rattus norvegicus
aatgtctcggcctaacacaggcgtg

SEQ ID NO: 64993 - DNA, 25 bp, Rattus norvegicus
aatgtctcgtccattattttcaata

SEQ ID NO: 64994 - DNA, 25 bp, Rattus norvegicus
aatgtctcgtccctgtctgtggcca

SEQ ID NO: 64995 - DNA, 25 bp, Rattus norvegicus
aatgtctcgtccgtgtctgtggcca

SEQ ID NO: 64996 - DNA, 25 bp, Rattus norvegicus
aatgtctcgtcctttattttcaata

SEQ ID NO: 64997 - DNA, 25 bp, Rattus norvegicus
aatgtctctagcacgttggagtcta

SEQ ID NO: 64998 - DNA, 25 bp, Rattus norvegicus
aatgtctctagcaggttattcccca

SEQ ID NO: 64999 - DNA, 25 bp, Rattus norvegicus
aatgtctctagctcgttggagtcta

SEQ ID NO: 65000 - DNA, 25 bp, Rattus norvegicus
aatgtctctagctggttattcccca

SEQ ID NO: 65001 - DNA, 25 bp, Rattus norvegicus
aatgtctctgccattattttgtaaa

SEQ ID NO: 65002 - DNA, 25 bp, Rattus norvegicus
aatgtctctgcctttattttgtaaa

SEQ ID NO: 65003 - DNA, 25 bp, Rattus norvegicus
aatgtctctgctctagtcctcattc

SEQ ID NO: 65004 - DNA, 25 bp, Rattus norvegicus
aatgtctctgctgtagtcctcattc

SEQ ID NO: 65005 - DNA, 25 bp, Rattus norvegicus
aatgtctctggtagaactctgtgaa

SEQ ID NO: 65006 - DNA, 25 bp, Rattus norvegicus
aatgtctctggttgaactctgtgaa

SEQ ID NO: 65007 - DNA, 25 bp, Rattus norvegicus
aatgtctctgtacatctcagggcag

SEQ ID NO: 65008 - DNA, 25 bp, Rattus norvegicus
aatgtctctgtagatctcagggcag

SEQ ID NO: 65009 - DNA, 25 bp, Rattus norvegicus
aatgtctgaatccttgcattcttcc

SEQ ID NO: 65010 - DNA, 25 bp, Rattus norvegicus
aatgtctgaatcgttgcattcttcc

SEQ ID NO: 65011 - DNA, 25 bp, Rattus norvegicus
aatgtctgacatctcttatatttta

SEQ ID NO: 65012 - DNA, 25 bp, Rattus norvegicus
aatgtctgacatgtcttatatttta

SEQ ID NO: 65013 - DNA, 25 bp, Rattus norvegicus
aatgtctgatttaaatttctgtgta

SEQ ID NO: 65014 - DNA, 25 bp, Rattus norvegicus
aatgtctgattttaatttctgtgta

SEQ ID NO: 65015 - DNA, 25 bp, Rattus norvegicus
aatgtctgcagtagaaccaccctga

SEQ ID NO: 65016 - DNA, 25 bp, Rattus norvegicus
aatgtctgcagttgaaccaccctga

SEQ ID NO: 65017 - DNA, 25 bp, Rattus norvegicus
aatgtctgcatcaatgtgtgtctat

SEQ ID NO: 65018 - DNA, 25 bp, Rattus norvegicus
aatgtctgcatctatgtgtgtctat

SEQ ID NO: 65019 - DNA, 25 bp, Rattus norvegicus
aatgtctgccttcgagtttaagtca

SEQ ID NO: 65020 - DNA, 25 bp, Rattus norvegicus
aatgtctgccttggagtttaagtca

SEQ ID NO: 65021 - DNA, 25 bp, Rattus norvegicus
aatgtctggattcccagggtgtctt

SEQ ID NO: 65022 - DNA, 25 bp, Rattus norvegicus
aatgtctggattgccagggtgtctt

SEQ ID NO: 65023 - DNA, 25 bp, Rattus norvegicus
aatgtctggctacacagcattctct

SEQ ID NO: 65024 - DNA, 25 bp, Rattus norvegicus
aatgtctggctagacagcattctct

SEQ ID NO: 65025 - DNA, 25 bp, Rattus norvegicus
aatgtctggtttaaattcctgttgt

SEQ ID NO: 65026 - DNA, 25 bp, Rattus norvegicus
aatgtctggttttaattcctgttgt

SEQ ID NO: 65027 - DNA, 25 bp, Rattus norvegicus
aatgtctgtaccaggaatccttaac

SEQ ID NO: 65028 - DNA, 25 bp, Rattus norvegicus
aatgtctgtacctggaatccttaac

SEQ ID NO: 65029 - DNA, 25 bp, Rattus norvegicus
aatgtctgtactacaggatgtcaca

SEQ ID NO: 65030 - DNA, 25 bp, Rattus norvegicus
aatgtctgtacttcaggatgtcaca

SEQ ID NO: 65031 - DNA, 25 bp, Rattus norvegicus
aatgtctgtcaacaggaggcgccag

SEQ ID NO: 65032 - DNA, 25 bp, Rattus norvegicus
aatgtctgtcaagaggaggcgccag

SEQ ID NO: 65033 - DNA, 25 bp, Rattus norvegicus
aatgtctgtccacattctacctcct

SEQ ID NO: 65034 - DNA, 25 bp, Rattus norvegicus
aatgtctgtccagattctacctcct

SEQ ID NO: 65035 - DNA, 25 bp, Rattus norvegicus
aatgtctgtctcatgatcctttggc

SEQ ID NO: 65036 - DNA, 25 bp, Rattus norvegicus
aatgtctgtctcttgatcctttggc

SEQ ID NO: 65037 - DNA, 25 bp, Rattus norvegicus
aatgtctgtctgacaatcgtcacat

SEQ ID NO: 65038 - DNA, 25 bp, Rattus norvegicus
aatgtctgtctgtcaatcgtcacat

SEQ ID NO: 65039 - DNA, 25 bp, Rattus norvegicus
aatgtctgttaaatattgcctctaa

SEQ ID NO: 65040 - DNA, 25 bp, Rattus norvegicus
aatgtctgttaattattgcctctaa

SEQ ID NO: 65041 - DNA, 25 bp, Rattus norvegicus
aatgtctgttgtcatttcccttcac

SEQ ID NO: 65042 - DNA, 25 bp, Rattus norvegicus
aatgtctgttgtgatttcccttcac

SEQ ID NO: 65043 - DNA, 25 bp, Rattus norvegicus
aatgtctgtttgactctctgtgtct

SEQ ID NO: 65044 - DNA, 25 bp, Rattus norvegicus
aatgtctgtttgtctctctgtgtct

SEQ ID NO: 65045 - DNA, 25 bp, Rattus norvegicus
aatgtctgttttaccctttgaggtg

SEQ ID NO: 65046 - DNA, 25 bp, Rattus norvegicus
aatgtctgtttttccctttgaggtg

SEQ ID NO: 65047 - DNA, 25 bp, Rattus norvegicus
aatgtcttagccatgggtgtctcac

SEQ ID NO: 65048 - DNA, 25 bp, Rattus norvegicus
aatgtcttagccttgggtgtctcac

SEQ ID NO: 65049 - DNA, 25 bp, Rattus norvegicus
aatgtcttcaacaaggaggctttct

SEQ ID NO: 65050 - DNA, 25 bp, Rattus norvegicus
aatgtcttcaactaggaggctttct

SEQ ID NO: 65051 - DNA, 25 bp, Rattus norvegicus
aatgtcttccacattatggagggat

SEQ ID NO: 65052 - DNA, 25 bp, Rattus norvegicus
aatgtcttccactttatggagggat

SEQ ID NO: 65053 - DNA, 25 bp, Rattus norvegicus
aatgtcttcctaatgttctccgggt

SEQ ID NO: 65054 - DNA, 25 bp, Rattus norvegicus
aatgtcttcctattgttctccgggt

SEQ ID NO: 65055 - DNA, 25 bp, Rattus norvegicus
aatgtcttcgatacgtccagaccaa

SEQ ID NO: 65056 - DNA, 25 bp, Rattus norvegicus
aatgtcttcgattcgtccagaccaa

SEQ ID NO: 65057 - DNA, 25 bp, Rattus norvegicus
aatgtcttctctctccaatcatctg

SEQ ID NO: 65058 - DNA, 25 bp, Rattus norvegicus
aatgtcttctctgtccaatcatctg

SEQ ID NO: 65059 - DNA, 25 bp, Rattus norvegicus
aatgtcttcttaccaagggaatcac

SEQ ID NO: 65060 - DNA, 25 bp, Rattus norvegicus
aatgtcttcttagcaagggaatcac

SEQ ID NO: 65061 - DNA, 25 bp, Rattus norvegicus
aatgtcttgactctgctcagagagc

SEQ ID NO: 65062 - DNA, 25 bp, Rattus norvegicus
aatgtcttgactgtgctcagagagc

SEQ ID NO: 65063 - DNA, 25 bp, Rattus norvegicus
aatgtcttgatgaaccttctgaaga

SEQ ID NO: 65064 - DNA, 25 bp, Rattus norvegicus
aatgtcttgatgtaccttctgaaga

SEQ ID NO: 65065 - DNA, 25 bp, Rattus norvegicus
aatgtcttgcctagcaacctttagc

SEQ ID NO: 65066 - DNA, 25 bp, Rattus norvegicus
aatgtcttgccttgcaacctttagc

SEQ ID NO: 65067 - DNA, 25 bp, Rattus norvegicus
aatgtcttgctgatctttatggaga

SEQ ID NO: 65068 - DNA, 25 bp, Rattus norvegicus
aatgtcttgctgttctttatggaga

SEQ ID NO: 65069 - DNA, 25 bp, Rattus norvegicus
aatgtcttgcttaatggtgtggagg

SEQ ID NO: 65070 - DNA, 25 bp, Rattus norvegicus
aatgtcttgctttatggtgtggagg

SEQ ID NO: 65071 - DNA, 25 bp, Rattus norvegicus
aatgtcttggttatcgttgcacagg

SEQ ID NO: 65072 - DNA, 25 bp, Rattus norvegicus
aatgtcttggttttcgttgcacagg

SEQ ID NO: 65073 - DNA, 25 bp, Rattus norvegicus
aatgtcttgtctcatctctatcctg

SEQ ID NO: 65074 - DNA, 25 bp, Rattus norvegicus
aatgtcttgtctgatctctatcctg

SEQ ID NO: 65075 - DNA, 25 bp, Rattus norvegicus
aatgtctttataatcactccatgga

SEQ ID NO: 65076 - DNA, 25 bp, Rattus norvegicus
aatgtctttatattcactccatgga

SEQ ID NO: 65077 - DNA, 25 bp, Rattus norvegicus
aatgtctttgtcactctttttgttt

SEQ ID NO: 65078 - DNA, 25 bp, Rattus norvegicus
aatgtctttgtctctctttttgttt

SEQ ID NO: 65079 - DNA, 25 bp, Rattus norvegicus
aatgtgaaaaggcacctgtcccacc

SEQ ID NO: 65080 - DNA, 25 bp, Rattus norvegicus
aatgtgaaaagggacctgtcccacc

SEQ ID NO: 65081 - DNA, 25 bp, Rattus norvegicus
aatgtgaaacatagcgccctggtaa

SEQ ID NO: 65082 - DNA, 25 bp, Rattus norvegicus
aatgtgaaacattgcgccctggtaa

SEQ ID NO: 65083 - DNA, 25 bp, Rattus norvegicus
aatgtgaaacctcttgctgctgcta

SEQ ID NO: 65084 - DNA, 25 bp, Rattus norvegicus
aatgtgaaacctgttgctgctgcta

SEQ ID NO: 65085 - DNA, 25 bp, Rattus norvegicus
aatgtgaaatgtatctcccgacccg

SEQ ID NO: 65086 - DNA, 25 bp, Rattus norvegicus
aatgtgaaatgtttctcccgacccg

SEQ ID NO: 65087 - DNA, 25 bp, Rattus norvegicus
aatgtgaaattcagccaactctccc

SEQ ID NO: 65088 - DNA, 25 bp, Rattus norvegicus
aatgtgaaattctgccaactctccc

SEQ ID NO: 65089 - DNA, 25 bp, Rattus norvegicus
aatgtgaaccagagggctctgccta

SEQ ID NO: 65090 - DNA, 25 bp, Rattus norvegicus
aatgtgaaccagtgggctctgccta

SEQ ID NO: 65091 - DNA, 25 bp, Rattus norvegicus
aatgtgaacctcaaatccacggaaa

SEQ ID NO: 65092 - DNA, 25 bp, Rattus norvegicus
aatgtgaacctctaatccacggaaa

SEQ ID NO: 65093 - DNA, 25 bp, Rattus norvegicus
aatgtgaactaaagtcctactccca

SEQ ID NO: 65094 - DNA, 25 bp, Rattus norvegicus
aatgtgaactaatgtcctactccca

SEQ ID NO: 65095 - DNA, 25 bp, Rattus norvegicus
aatgtgaactggataacggctactc

SEQ ID NO: 65096 - DNA, 25 bp, Rattus norvegicus
aatgtgaactggttaacggctactc

SEQ ID NO: 65097 - DNA, 25 bp, Rattus norvegicus
aatgtgaagcctatggtcatgtccc

SEQ ID NO: 65098 - DNA, 25 bp, Rattus norvegicus
aatgtgaagcctttggtcatgtccc

SEQ ID NO: 65099 - DNA, 25 bp, Rattus norvegicus
aatgtgaagcgaagttctttgtcat

SEQ ID NO: 65100 - DNA, 25 bp, Rattus norvegicus
aatgtgaagcgatgttctttgtcat

SEQ ID NO: 65101 - DNA, 25 bp, Rattus norvegicus
aatgtgaagcttacatgcccttctc

SEQ ID NO: 65102 - DNA, 25 bp, Rattus norvegicus
aatgtgaagctttcatgcccttctc

SEQ ID NO: 65103 - DNA, 25 bp, Rattus norvegicus
aatgtgacactgaagctcctgggac

SEQ ID NO: 65104 - DNA, 25 bp, Rattus norvegicus
aatgtgacactgtagctcctgggac

SEQ ID NO: 65105 - DNA, 25 bp, Rattus norvegicus
aatgtgacaggtaactgcccagctc

SEQ ID NO: 65106 - DNA, 25 bp, Rattus norvegicus
aatgtgacaggttactgcccagctc

SEQ ID NO: 65107 - DNA, 25 bp, Rattus norvegicus
aatgtgaccaagacattctgcccct

SEQ ID NO: 65108 - DNA, 25 bp, Rattus norvegicus
aatgtgaccaagtcattctgcccct

SEQ ID NO: 65109 - DNA, 25 bp, Rattus norvegicus
aatgtgacctgactgtttcactcct

SEQ ID NO: 65110 - DNA, 25 bp, Rattus norvegicus
aatgtgacctgagtgtttcactcct

SEQ ID NO: 65111 - DNA, 25 bp, Rattus norvegicus
aatgtgacctgtaagccactctggg

SEQ ID NO: 65112 - DNA, 25 bp, Rattus norvegicus
aatgtgacctgttagccactctggg

SEQ ID NO: 65113 - DNA, 25 bp, Rattus norvegicus
aatgtgactcaaaaagatccaactg

SEQ ID NO: 65114 - DNA, 25 bp, Rattus norvegicus
aatgtgactcaataagatccaactg

SEQ ID NO: 65115 - DNA, 25 bp, Rattus norvegicus
aatgtgactggaaattgatgtgtat

SEQ ID NO: 65116 - DNA, 25 bp, Rattus norvegicus
aatgtgactggatattgatgtgtat

SEQ ID NO: 65117 - DNA, 25 bp, Rattus norvegicus
aatgtgagacatcttgctgtgacct

SEQ ID NO: 65118 - DNA, 25 bp, Rattus norvegicus
aatgtgagacatgttgctgtgacct

SEQ ID NO: 65119 - DNA, 25 bp, Rattus norvegicus
aatgtgagcagacactccatcctcc

SEQ ID NO: 65120 - DNA, 25 bp, Rattus norvegicus
aatgtgagcagagactccatcctcc

SEQ ID NO: 65121 - DNA, 25 bp, Rattus norvegicus
aatgtgagcaggaacacgctgggct

SEQ ID NO: 65122 - DNA, 25 bp, Rattus norvegicus
aatgtgagcaggtacacgctgggct

SEQ ID NO: 65123 - DNA, 25 bp, Rattus norvegicus
aatgtgagcttgactggacgctcta

SEQ ID NO: 65124 - DNA, 25 bp, Rattus norvegicus
aatgtgagcttgtctggacgctcta

SEQ ID NO: 65125 - DNA, 25 bp, Rattus norvegicus
aatgtgaggcctagtacttgttaat

SEQ ID NO: 65126 - DNA, 25 bp, Rattus norvegicus
aatgtgaggcctcgaccaccggaca

SEQ ID NO: 65127 - DNA, 25 bp, Rattus norvegicus
aatgtgaggcctggaccaccggaca

SEQ ID NO: 65128 - DNA, 25 bp, Rattus norvegicus
aatgtgaggccttgtacttgttaat

SEQ ID NO: 65129 - DNA, 25 bp, Rattus norvegicus
aatgtgagtctgcagagctaccctg

SEQ ID NO: 65130 - DNA, 25 bp, Rattus norvegicus
aatgtgagtctggagagctaccctg

SEQ ID NO: 65131 - DNA, 25 bp, Rattus norvegicus
aatgtgatacgcatcaacccacttt

SEQ ID NO: 65132 - DNA, 25 bp, Rattus norvegicus
aatgtgatacgcttcaacccacttt

SEQ ID NO: 65133 - DNA, 25 bp, Rattus norvegicus
aatgtgatcactatctttggtagtc

SEQ ID NO: 65134 - DNA, 25 bp, Rattus norvegicus
aatgtgatcactttctttggtagtc

SEQ ID NO: 65135 - DNA, 25 bp, Rattus norvegicus
aatgtgatctcccttgagtgctaga

SEQ ID NO: 65136 - DNA, 25 bp, Rattus norvegicus
aatgtgatctccgttgagtgctaga

SEQ ID NO: 65137 - DNA, 25 bp, Rattus norvegicus
aatgtgatcttcactttaggttgac

SEQ ID NO: 65138 - DNA, 25 bp, Rattus norvegicus
aatgtgatcttctctttaggttgac

SEQ ID NO: 65139 - DNA, 25 bp, Rattus norvegicus
aatgtgatgatgcatgcctttactc

SEQ ID NO: 65140 - DNA, 25 bp, Rattus norvegicus
aatgtgatgatggatgcctttactc

SEQ ID NO: 65141 - DNA, 25 bp, Rattus norvegicus
aatgtgatggttacaaagtcttgca

SEQ ID NO: 65142 - DNA, 25 bp, Rattus norvegicus
aatgtgatggtttcaaagtcttgca

SEQ ID NO: 65143 - DNA, 25 bp, Rattus norvegicus
aatgtgatgtccatttgtttgtaat

SEQ ID NO: 65144 - DNA, 25 bp, Rattus norvegicus
aatgtgatgtccttttgtttgtaat

SEQ ID NO: 65145 - DNA, 25 bp, Rattus norvegicus
aatgtgattacgatttctcttaaag

SEQ ID NO: 65146 - DNA, 25 bp, Rattus norvegicus
aatgtgattacgttttctcttaaag

SEQ ID NO: 65147 - DNA, 25 bp, Rattus norvegicus
aatgtgattcctagttttgggagac

SEQ ID NO: 65148 - DNA, 25 bp, Rattus norvegicus
aatgtgattccttgttttgggagac

SEQ ID NO: 65149 - DNA, 25 bp, Rattus norvegicus
aatgtgattgaccacttgctgtccc

SEQ ID NO: 65150 - DNA, 25 bp, Rattus norvegicus
aatgtgattgacgacttgctgtccc

SEQ ID NO: 65151 - DNA, 25 bp, Rattus norvegicus
aatgtgattgctctatgcccttagc

SEQ ID NO: 65152 - DNA, 25 bp, Rattus norvegicus
aatgtgattgctgtatgcccttagc

SEQ ID NO: 65153 - DNA, 25 bp, Rattus norvegicus
aatgtgattgttccgtggccacttc

SEQ ID NO: 65154 - DNA, 25 bp, Rattus norvegicus
aatgtgattgttgcgtggccacttc

SEQ ID NO: 65155 - DNA, 25 bp, Rattus norvegicus
aatgtgatttcacctcagggactgt

SEQ ID NO: 65156 - DNA, 25 bp, Rattus norvegicus
aatgtgatttcagctcagggactgt

SEQ ID NO: 65157 - DNA, 25 bp, Rattus norvegicus
aatgtgatttcgctgtgctaggcta

SEQ ID NO: 65158 - DNA, 25 bp, Rattus norvegicus
aatgtgatttcggtgtgctaggcta

SEQ ID NO: 65159 - DNA, 25 bp, Rattus norvegicus
aatgtgcaaagcctcggaccaattc

SEQ ID NO: 65160 - DNA, 25 bp, Rattus norvegicus
aatgtgcaaagcgtcggaccaattc

SEQ ID NO: 65161 - DNA, 25 bp, Rattus norvegicus
aatgtgcaaggtagagaagccgtac

SEQ ID NO: 65162 - DNA, 25 bp, Rattus norvegicus
aatgtgcaaggttgagaagccgtac

SEQ ID NO: 65163 - DNA, 25 bp, Rattus norvegicus
aatgtgcacagtacttgcagtgtga

SEQ ID NO: 65164 - DNA, 25 bp, Rattus norvegicus
aatgtgcacagttcttgcagtgtga

SEQ ID NO: 65165 - DNA, 25 bp, Rattus norvegicus
aatgtgcacatacccctatgcatag

SEQ ID NO: 65166 - DNA, 25 bp, Rattus norvegicus
aatgtgcacatagccctatgcatag

SEQ ID NO: 65167 - DNA, 25 bp, Rattus norvegicus
aatgtgcaccagaccaatgtggtta

SEQ ID NO: 65168 - DNA, 25 bp, Rattus norvegicus
aatgtgcaccagtccaatgtggtta

SEQ ID NO: 65169 - DNA, 25 bp, Rattus norvegicus
aatgtgcactatacgaatgagcttc

SEQ ID NO: 65170 - DNA, 25 bp, Rattus norvegicus
aatgtgcactattcgaatgagcttc

SEQ ID NO: 65171 - DNA, 25 bp, Rattus norvegicus
aatgtgcaggctctgtaaggctcac

SEQ ID NO: 65172 - DNA, 25 bp, Rattus norvegicus
aatgtgcaggctgtgtaaggctcac

SEQ ID NO: 65173 - DNA, 25 bp, Rattus norvegicus
aatgtgcatctgatagtttttcaag

SEQ ID NO: 65174 - DNA, 25 bp, Rattus norvegicus
aatgtgcatctgttagtttttcaag

SEQ ID NO: 65175 - DNA, 25 bp, Rattus norvegicus
aatgtgcatcttctgtatactttct

SEQ ID NO: 65176 - DNA, 25 bp, Rattus norvegicus
aatgtgcatcttgtgtatactttct

SEQ ID NO: 65177 - DNA, 25 bp, Rattus norvegicus
aatgtgccagtgcattgcccaaata

SEQ ID NO: 65178 - DNA, 25 bp, Rattus norvegicus
aatgtgccagtggattgcccaaata

SEQ ID NO: 65179 - DNA, 25 bp, Rattus norvegicus
aatgtgccatgccttgctgctgaga

SEQ ID NO: 65180 - DNA, 25 bp, Rattus norvegicus
aatgtgccatgcgttgctgctgaga

SEQ ID NO: 65181 - DNA, 25 bp, Rattus norvegicus
aatgtgcccagtataagtgtaagct

SEQ ID NO: 65182 - DNA, 25 bp, Rattus norvegicus
aatgtgcccagtttaagtgtaagct

SEQ ID NO: 65183 - DNA, 25 bp, Rattus norvegicus
aatgtgccctggcttccagacggaa

SEQ ID NO: 65184 - DNA, 25 bp, Rattus norvegicus
aatgtgccctgggttccagacggaa

SEQ ID NO: 65185 - DNA, 25 bp, Rattus norvegicus
aatgtgccgcttagagggtgatttc

SEQ ID NO: 65186 - DNA, 25 bp, Rattus norvegicus
aatgtgccgctttgagggtgatttc

SEQ ID NO: 65187 - DNA, 25 bp, Rattus norvegicus
aatgtgccggtcattctgaacggga

SEQ ID NO: 65188 - DNA, 25 bp, Rattus norvegicus
aatgtgccggtctttctgaacggga

SEQ ID NO: 65189 - DNA, 25 bp, Rattus norvegicus
aatgtgccgtttcggacttgctttc

SEQ ID NO: 65190 - DNA, 25 bp, Rattus norvegicus
aatgtgccgtttgggacttgctttc

SEQ ID NO: 65191 - DNA, 25 bp, Rattus norvegicus
aatgtgcctataactggtgccaccc

SEQ ID NO: 65192 - DNA, 25 bp, Rattus norvegicus
aatgtgcctatatctggtgccaccc

SEQ ID NO: 65193 - DNA, 25 bp, Rattus norvegicus
aatgtgcctctgaggaacactcctc

SEQ ID NO: 65194 - DNA, 25 bp, Rattus norvegicus
aatgtgcctctgtggaacactcctc

SEQ ID NO: 65195 - DNA, 25 bp, Rattus norvegicus
aatgtgcctgcgcacaccaagctct

SEQ ID NO: 65196 - DNA, 25 bp, Rattus norvegicus
aatgtgcctgcggacaccaagctct

SEQ ID NO: 65197 - DNA, 25 bp, Rattus norvegicus
aatgtgcctgctaactgagtgtgcc

SEQ ID NO: 65198 - DNA, 25 bp, Rattus norvegicus
aatgtgcctgcttactgagtgtgcc

SEQ ID NO: 65199 - DNA, 25 bp, Rattus norvegicus
aatgtgcctggaagccagcagctga

SEQ ID NO: 65200 - DNA, 25 bp, Rattus norvegicus
aatgtgcctggatgccagcagctga

SEQ ID NO: 65201 - DNA, 25 bp, Rattus norvegicus
aatgtgcctgtactgggcatcaccc

SEQ ID NO: 65202 - DNA, 25 bp, Rattus norvegicus
aatgtgcctgtagtgggcatcaccc

SEQ ID NO: 65203 - DNA, 25 bp, Rattus norvegicus
aatgtgcctgttatttaactcgata

SEQ ID NO: 65204 - DNA, 25 bp, Rattus norvegicus
aatgtgcctgttttttaactcgata

SEQ ID NO: 65205 - DNA, 25 bp, Rattus norvegicus
aatgtgccttgtattgctgtgctat

SEQ ID NO: 65206 - DNA, 25 bp, Rattus norvegicus
aatgtgccttgtccagaaacttctg

SEQ ID NO: 65207 - DNA, 25 bp, Rattus norvegicus
aatgtgccttgtgcagaaacttctg

SEQ ID NO: 65208 - DNA, 25 bp, Rattus norvegicus
aatgtgccttgttttgctgtgctat

SEQ ID NO: 65209 - DNA, 25 bp, Rattus norvegicus
aatgtgcgacacaggtgcctcggaa

SEQ ID NO: 65210 - DNA, 25 bp, Rattus norvegicus
aatgtgcgacactggtgcctcggaa

SEQ ID NO: 65211 - DNA, 25 bp, Rattus norvegicus
aatgtgcgcagtcccacacagtgga

SEQ ID NO: 65212 - DNA, 25 bp, Rattus norvegicus
aatgtgcgcagtgccacacagtgga

SEQ ID NO: 65213 - DNA, 25 bp, Rattus norvegicus
aatgtgcggcttaggaattgttgtc

SEQ ID NO: 65214 - DNA, 25 bp, Rattus norvegicus
aatgtgcggctttggaattgttgtc

SEQ ID NO: 65215 - DNA, 25 bp, Rattus norvegicus
aatgtgcgtgcactctttgttctcc

SEQ ID NO: 65216 - DNA, 25 bp, Rattus norvegicus
aatgtgcgtgcagtctttgttctcc

SEQ ID NO: 65217 - DNA, 25 bp, Rattus norvegicus
aatgtgctatctactgtgagcccct

SEQ ID NO: 65218 - DNA, 25 bp, Rattus norvegicus
aatgtgctatcttctgtgagcccct

SEQ ID NO: 65219 - DNA, 25 bp, Rattus norvegicus
aatgtgctccagatctgagagcgga

SEQ ID NO: 65220 - DNA, 25 bp, Rattus norvegicus
aatgtgctccagttctgagagcgga

SEQ ID NO: 65221 - DNA, 25 bp, Rattus norvegicus
aatgtgctcgatctacttgtgctta

SEQ ID NO: 65222 - DNA, 25 bp, Rattus norvegicus
aatgtgctcgatgtacttgtgctta

SEQ ID NO: 65223 - DNA, 25 bp, Rattus norvegicus
aatgtgctctacagtccagaggtca

SEQ ID NO: 65224 - DNA, 25 bp, Rattus norvegicus
aatgtgctctactgtccagaggtca

SEQ ID NO: 65225 - DNA, 25 bp, Rattus norvegicus
aatgtgctctccatggagcagggct

SEQ ID NO: 65226 - DNA, 25 bp, Rattus norvegicus
aatgtgctctccttggagcagggct

SEQ ID NO: 65227 - DNA, 25 bp, Rattus norvegicus
aatgtgctctgcattctatgagtca

SEQ ID NO: 65228 - DNA, 25 bp, Rattus norvegicus
aatgtgctctgctttctatgagtca

SEQ ID NO: 65229 - DNA, 25 bp, Rattus norvegicus
aatgtgctcttcagtatctactcaa

SEQ ID NO: 65230 - DNA, 25 bp, Rattus norvegicus
aatgtgctcttctgtatctactcaa

SEQ ID NO: 65231 - DNA, 25 bp, Rattus norvegicus
aatgtgctgcatatacttcccaata

SEQ ID NO: 65232 - DNA, 25 bp, Rattus norvegicus
aatgtgctgcatttacttcccaata

SEQ ID NO: 65233 - DNA, 25 bp, Rattus norvegicus
aatgtgctgcccagggtcgcgcgct

SEQ ID NO: 65234 - DNA, 25 bp, Rattus norvegicus
aatgtgctgccctgggtcgcgcgct

SEQ ID NO: 65235 - DNA, 25 bp, Rattus norvegicus
aatgtgctgctacctgaaggttcac

SEQ ID NO: 65236 - DNA, 25 bp, Rattus norvegicus
aatgtgctgctagctgaaggttcac

SEQ ID NO: 65237 - DNA, 25 bp, Rattus norvegicus
aatgtgctgctgctctttgtaacct

SEQ ID NO: 65238 - DNA, 25 bp, Rattus norvegicus
aatgtgctgctggtctttgtaacct

SEQ ID NO: 65239 - DNA, 25 bp, Rattus norvegicus
aatgtgctggcacatatcctctgat

SEQ ID NO: 65240 - DNA, 25 bp, Rattus norvegicus
aatgtgctggcagatatcctctgat

SEQ ID NO: 65241 - DNA, 25 bp, Rattus norvegicus
aatgtgctggcccttcgtcagattg

SEQ ID NO: 65242 - DNA, 25 bp, Rattus norvegicus
aatgtgctggccgttcgtcagattg

SEQ ID NO: 65243 - DNA, 25 bp, Rattus norvegicus
aatgtgctggcgcagattctcaagc

SEQ ID NO: 65244 - DNA, 25 bp, Rattus norvegicus
aatgtgctggcggagattctcaagc

SEQ ID NO: 65245 - DNA, 25 bp, Rattus norvegicus
aatgtgctgggcatcattccctatg

SEQ ID NO: 65246 - DNA, 25 bp, Rattus norvegicus
aatgtgctgggcattgcctcagttg

SEQ ID NO: 65247 - DNA, 25 bp, Rattus norvegicus
aatgtgctgggcttcattccctatg

SEQ ID NO: 65248 - DNA, 25 bp, Rattus norvegicus
aatgtgctgggctttgcctcagttg

SEQ ID NO: 65249 - DNA, 25 bp, Rattus norvegicus
aatgtgctgtgtcggaatattcctc

SEQ ID NO: 65250 - DNA, 25 bp, Rattus norvegicus
aatgtgctgtgtgggaatattcctc

SEQ ID NO: 65251 - DNA, 25 bp, Rattus norvegicus
aatgtgcttctgctgctgcactatt

SEQ ID NO: 65252 - DNA, 25 bp, Rattus norvegicus
aatgtgcttctggtgctgcactatt

SEQ ID NO: 65253 - DNA, 25 bp, Rattus norvegicus
aatgtgcttcttaatccttcttaat

SEQ ID NO: 65254 - DNA, 25 bp, Rattus norvegicus
aatgtgcttcttatttactgtgtgt

SEQ ID NO: 65255 - DNA, 25 bp, Rattus norvegicus
aatgtgcttctttatccttcttaat

SEQ ID NO: 65256 - DNA, 25 bp, Rattus norvegicus
aatgtgcttcttttttactgtgtgt

SEQ ID NO: 65257 - DNA, 25 bp, Rattus norvegicus
aatgtgcttgcaacagaacttctga

SEQ ID NO: 65258 - DNA, 25 bp, Rattus norvegicus
aatgtgcttgcatcagaacttctga

SEQ ID NO: 65259 - DNA, 25 bp, Rattus norvegicus
aatgtgcttttgcttgtttccactg

SEQ ID NO: 65260 - DNA, 25 bp, Rattus norvegicus
aatgtgcttttggttgtttccactg

SEQ ID NO: 65261 - DNA, 25 bp, Rattus norvegicus
aatgtggaagaaatgttggtctgta

SEQ ID NO: 65262 - DNA, 25 bp, Rattus norvegicus
aatgtggaagaattgttggtctgta

SEQ ID NO: 65263 - DNA, 25 bp, Rattus norvegicus
aatgtggacacgctacagccagggc

SEQ ID NO: 65264 - DNA, 25 bp, Rattus norvegicus
aatgtggacacggtacagccagggc

SEQ ID NO: 65265 - DNA, 25 bp, Rattus norvegicus
aatgtggaccacctgagccatcaga

SEQ ID NO: 65266 - DNA, 25 bp, Rattus norvegicus
aatgtggaccacgtgagccatcaga

SEQ ID NO: 65267 - DNA, 25 bp, Rattus norvegicus
aatgtggacctgctccctaaagagt

SEQ ID NO: 65268 - DNA, 25 bp, Rattus norvegicus
aatgtggacctggtccctaaagagt

SEQ ID NO: 65269 - DNA, 25 bp, Rattus norvegicus
aatgtggactcaccgctcctcaagt

SEQ ID NO: 65270 - DNA, 25 bp, Rattus norvegicus
aatgtggactcagcgctcctcaagt

SEQ ID NO: 65271 - DNA, 25 bp, Rattus norvegicus
aatgtggactctagactaggcccag

SEQ ID NO: 65272 - DNA, 25 bp, Rattus norvegicus
aatgtggactcttgactaggcccag

SEQ ID NO: 65273 - DNA, 25 bp, Rattus norvegicus
aatgtggagaatcctctgccagtaa

SEQ ID NO: 65274 - DNA, 25 bp, Rattus norvegicus
aatgtggagaatctgctacgcaacc

SEQ ID NO: 65275 - DNA, 25 bp, Rattus norvegicus
aatgtggagaatgctctgccagtaa

SEQ ID NO: 65276 - DNA, 25 bp, Rattus norvegicus
aatgtggagaatgtgctacgcaacc

SEQ ID NO: 65277 - DNA, 25 bp, Rattus norvegicus
aatgtggagactactgagggctacc

SEQ ID NO: 65278 - DNA, 25 bp, Rattus norvegicus
aatgtggagacttctgagggctacc

SEQ ID NO: 65279 - DNA, 25 bp, Rattus norvegicus
aatgtggagggcactgttcccctca

SEQ ID NO: 65280 - DNA, 25 bp, Rattus norvegicus
aatgtggagggctctgttcccctca

SEQ ID NO: 65281 - DNA, 25 bp, Rattus norvegicus
aatgtggaggtcactcaactctggt

SEQ ID NO: 65282 - DNA, 25 bp, Rattus norvegicus
aatgtggaggtctctcaactctggt

SEQ ID NO: 65283 - DNA, 25 bp, Rattus norvegicus
aatgtggatgatctccagcttcacc

SEQ ID NO: 65284 - DNA, 25 bp, Rattus norvegicus
aatgtggatgatgtccagcttcacc

SEQ ID NO: 65285 - DNA, 25 bp, Rattus norvegicus
aatgtggatttcctatgggtttcct

SEQ ID NO: 65286 - DNA, 25 bp, Rattus norvegicus
aatgtggatttcgtatgggtttcct

SEQ ID NO: 65287 - DNA, 25 bp, Rattus norvegicus
aatgtggcacctaatctattggatg

SEQ ID NO: 65288 - DNA, 25 bp, Rattus norvegicus
aatgtggcaccttatctattggatg

SEQ ID NO: 65289 - DNA, 25 bp, Rattus norvegicus
aatgtggcagctaaacgctcccggg

SEQ ID NO: 65290 - DNA, 25 bp, Rattus norvegicus
aatgtggcagctcgacagccaatga

SEQ ID NO: 65291 - DNA, 25 bp, Rattus norvegicus
aatgtggcagctggacagccaatga

SEQ ID NO: 65292 - DNA, 25 bp, Rattus norvegicus
aatgtggcagcttaacgctcccggg

SEQ ID NO: 65293 - DNA, 25 bp, Rattus norvegicus
aatgtggcaggcaaccaggctcagg

SEQ ID NO: 65294 - DNA, 25 bp, Rattus norvegicus
aatgtggcaggctaccaggctcagg

SEQ ID NO: 65295 - DNA, 25 bp, Rattus norvegicus
aatgtggcatcacatatcctctcac

SEQ ID NO: 65296 - DNA, 25 bp, Rattus norvegicus
aatgtggcatcagatatcctctcac

SEQ ID NO: 65297 - DNA, 25 bp, Rattus norvegicus
aatgtggccagccattccatggact

SEQ ID NO: 65298 - DNA, 25 bp, Rattus norvegicus
aatgtggccagcctctgtctgcaga

SEQ ID NO: 65299 - DNA, 25 bp, Rattus norvegicus
aatgtggccagcgattccatggact

SEQ ID NO: 65300 - DNA, 25 bp, Rattus norvegicus
aatgtggccagcgtctgtctgcaga

SEQ ID NO: 65301 - DNA, 25 bp, Rattus norvegicus
aatgtggcccatagcaaagctgtaa

SEQ ID NO: 65302 - DNA, 25 bp, Rattus norvegicus
aatgtggcccattgcaaagctgtaa

SEQ ID NO: 65303 - DNA, 25 bp, Rattus norvegicus
aatgtggccttcatgtgggatgaca

SEQ ID NO: 65304 - DNA, 25 bp, Rattus norvegicus
aatgtggccttcttgtgggatgaca

SEQ ID NO: 65305 - DNA, 25 bp, Rattus norvegicus
aatgtggcgctgctattcgacaaac

SEQ ID NO: 65306 - DNA, 25 bp, Rattus norvegicus
aatgtggcgctggtattcgacaaac

SEQ ID NO: 65307 - DNA, 25 bp, Rattus norvegicus
aatgtggctacaaataaagcttgcc

SEQ ID NO: 65308 - DNA, 25 bp, Rattus norvegicus
aatgtggctacaactgttatgctaa

SEQ ID NO: 65309 - DNA, 25 bp, Rattus norvegicus
aatgtggctacatataaagcttgcc

SEQ ID NO: 65310 - DNA, 25 bp, Rattus norvegicus
aatgtggctacatctgttatgctaa

SEQ ID NO: 65311 - DNA, 25 bp, Rattus norvegicus
aatgtggctaccctggtcatctgac

SEQ ID NO: 65312 - DNA, 25 bp, Rattus norvegicus
aatgtggctaccgtggtcatctgac

SEQ ID NO: 65313 - DNA, 25 bp, Rattus norvegicus
aatgtggctttcacagtcgtgggta

SEQ ID NO: 65314 - DNA, 25 bp, Rattus norvegicus
aatgtggctttctcagtcgtgggta

SEQ ID NO: 65315 - DNA, 25 bp, Rattus norvegicus
aatgtgggaacaccagtccacgtaa

SEQ ID NO: 65316 - DNA, 25 bp, Rattus norvegicus
aatgtgggaacagcagtccacgtaa

SEQ ID NO: 65317 - DNA, 25 bp, Rattus norvegicus
aatgtgggacgtcgtcttgtctgac

SEQ ID NO: 65318 - DNA, 25 bp, Rattus norvegicus
aatgtgggacgtggtcttgtctgac

SEQ ID NO: 65319 - DNA, 25 bp, Rattus norvegicus
aatgtgggactccatggtcttccat

SEQ ID NO: 65320 - DNA, 25 bp, Rattus norvegicus
aatgtgggactcgatggtcttccat

SEQ ID NO: 65321 - DNA, 25 bp, Rattus norvegicus
aatgtgggagtcagctggttacccc

SEQ ID NO: 65322 - DNA, 25 bp, Rattus norvegicus
aatgtgggagtctgctggttacccc

SEQ ID NO: 65323 - DNA, 25 bp, Rattus norvegicus
aatgtgggattcaattcaggccaga

SEQ ID NO: 65324 - DNA, 25 bp, Rattus norvegicus
aatgtgggattctattcaggccaga

SEQ ID NO: 65325 - DNA, 25 bp, Rattus norvegicus
aatgtgggtctgcatatgttatctc

SEQ ID NO: 65326 - DNA, 25 bp, Rattus norvegicus
aatgtgggtctggatatgttatctc

SEQ ID NO: 65327 - DNA, 25 bp, Rattus norvegicus
aatgtgggtcttaatgggttctgtc

SEQ ID NO: 65328 - DNA, 25 bp, Rattus norvegicus
aatgtgggtctttatgggttctgtc

SEQ ID NO: 65329 - DNA, 25 bp, Rattus norvegicus
aatgtgggtggcattcgatttgtgc

SEQ ID NO: 65330 - DNA, 25 bp, Rattus norvegicus
aatgtgggtggctttcgatttgtgc

SEQ ID NO: 65331 - DNA, 25 bp, Rattus norvegicus
aatgtgggtggtatgttctctttct

SEQ ID NO: 65332 - DNA, 25 bp, Rattus norvegicus
aatgtgggtggtttgttctctttct

SEQ ID NO: 65333 - DNA, 25 bp, Rattus norvegicus
aatgtggtaagcatcctggtttaga

SEQ ID NO: 65334 - DNA, 25 bp, Rattus norvegicus
aatgtggtaagcttcctggtttaga

SEQ ID NO: 65335 - DNA, 25 bp, Rattus norvegicus
aatgtggtactactatgtccttcgt

SEQ ID NO: 65336 - DNA, 25 bp, Rattus norvegicus
aatgtggtactagtatgtccttcgt

SEQ ID NO: 65337 - DNA, 25 bp, Rattus norvegicus
aatgtggtcacacccttagattttt

SEQ ID NO: 65338 - DNA, 25 bp, Rattus norvegicus
aatgtggtcacagccttagattttt

SEQ ID NO: 65339 - DNA, 25 bp, Rattus norvegicus
aatgtggtcattcaataaattctat

SEQ ID NO: 65340 - DNA, 25 bp, Rattus norvegicus
aatgtggtcattgaataaattctat

SEQ ID NO: 65341 - DNA, 25 bp, Rattus norvegicus
aatgtggtccgtacctgggaactgt

SEQ ID NO: 65342 - DNA, 25 bp, Rattus norvegicus
aatgtggtccgttcctgggaactgt

SEQ ID NO: 65343 - DNA, 25 bp, Rattus norvegicus
aatgtggtcctaccagggaggcccc

SEQ ID NO: 65344 - DNA, 25 bp, Rattus norvegicus
aatgtggtcctagcagggaggcccc

SEQ ID NO: 65345 - DNA, 25 bp, Rattus norvegicus
aatgtggtcggcagcgaggccctat

SEQ ID NO: 65346 - DNA, 25 bp, Rattus norvegicus
aatgtggtcggctgcgaggccctat

SEQ ID NO: 65347 - DNA, 25 bp, Rattus norvegicus
aatgtggtctgccaacctgtacaaa

SEQ ID NO: 65348 - DNA, 25 bp, Rattus norvegicus
aatgtggtctgcgaacctgtacaaa

SEQ ID NO: 65349 - DNA, 25 bp, Rattus norvegicus
aatgtggtgaccaattctgtcctgc

SEQ ID NO: 65350 - DNA, 25 bp, Rattus norvegicus
aatgtggtgacctattctgtcctgc

SEQ ID NO: 65351 - DNA, 25 bp, Rattus norvegicus
aatgtggtgagtacctgaccaatca

SEQ ID NO: 65352 - DNA, 25 bp, Rattus norvegicus
aatgtggtgagttcctgaccaatca

SEQ ID NO: 65353 - DNA, 25 bp, Rattus norvegicus
aatgtggtgctaatgtttctttaag

SEQ ID NO: 65354 - DNA, 25 bp, Rattus norvegicus
aatgtggtgctattgtttctttaag

SEQ ID NO: 65355 - DNA, 25 bp, Rattus norvegicus
aatgtggtgtcaccctatgcatact

SEQ ID NO: 65356 - DNA, 25 bp, Rattus norvegicus
aatgtggtgtcagcctatgcatact

SEQ ID NO: 65357 - DNA, 25 bp, Rattus norvegicus
aatgtggttactcccatgggctgga

SEQ ID NO: 65358 - DNA, 25 bp, Rattus norvegicus
aatgtggttactgccatgggctgga

SEQ ID NO: 65359 - DNA, 25 bp, Rattus norvegicus
aatgtggttatcatccttggtcacg

SEQ ID NO: 65360 - DNA, 25 bp, Rattus norvegicus
aatgtggttatcttccttggtcacg

SEQ ID NO: 65361 - DNA, 25 bp, Rattus norvegicus
aatgtggttcttatgctgctgacag

SEQ ID NO: 65362 - DNA, 25 bp, Rattus norvegicus
aatgtggttcttttgctgctgacag

SEQ ID NO: 65363 - DNA, 25 bp, Rattus norvegicus
aatgtggttgccactctgtgatgac

SEQ ID NO: 65364 - DNA, 25 bp, Rattus norvegicus
aatgtggttgcctctctgtgatgac

SEQ ID NO: 65365 - DNA, 25 bp, Rattus norvegicus
aatgtggttgtccagttcctatggc

SEQ ID NO: 65366 - DNA, 25 bp, Rattus norvegicus
aatgtggttgtcgagttcctatggc

SEQ ID NO: 65367 - DNA, 25 bp, Rattus norvegicus
aatgtggttttgagactccgacgcc

SEQ ID NO: 65368 - DNA, 25 bp, Rattus norvegicus
aatgtggttttgtgactccgacgcc

SEQ ID NO: 65369 - DNA, 25 bp, Rattus norvegicus
aatgtgtaaatactgcaacccaggc

SEQ ID NO: 65370 - DNA, 25 bp, Rattus norvegicus
aatgtgtaaatagtgcaacccaggc

SEQ ID NO: 65371 - DNA, 25 bp, Rattus norvegicus
aatgtgtaacctaattcccatccag

SEQ ID NO: 65372 - DNA, 25 bp, Rattus norvegicus
aatgtgtaaccttattcccatccag

SEQ ID NO: 65373 - DNA, 25 bp, Rattus norvegicus
aatgtgtaacttaccacgactggga

SEQ ID NO: 65374 - DNA, 25 bp, Rattus norvegicus
aatgtgtaactttccacgactggga

SEQ ID NO: 65375 - DNA, 25 bp, Rattus norvegicus
aatgtgtacacaaatcctgcttggg

SEQ ID NO: 65376 - DNA, 25 bp, Rattus norvegicus
aatgtgtacacatatcctgcttggg

SEQ ID NO: 65377 - DNA, 25 bp, Rattus norvegicus
aatgtgtacaccctggagctccaca

SEQ ID NO: 65378 - DNA, 25 bp, Rattus norvegicus
aatgtgtacaccgtggagctccaca

SEQ ID NO: 65379 - DNA, 25 bp, Rattus norvegicus
aatgtgtaccagactgaggcccatg

SEQ ID NO: 65380 - DNA, 25 bp, Rattus norvegicus
aatgtgtaccagtctgaggcccatg

SEQ ID NO: 65381 - DNA, 25 bp, Rattus norvegicus
aatgtgtactacctacaagtcctag

SEQ ID NO: 65382 - DNA, 25 bp, Rattus norvegicus
aatgtgtactacgtacaagtcctag

SEQ ID NO: 65383 - DNA, 25 bp, Rattus norvegicus
aatgtgtagcaaaggcccctatcaa

SEQ ID NO: 65384 - DNA, 25 bp, Rattus norvegicus
aatgtgtagcaatggcccctatcaa

SEQ ID NO: 65385 - DNA, 25 bp, Rattus norvegicus
aatgtgtagtaaccggccagcccga

SEQ ID NO: 65386 - DNA, 25 bp, Rattus norvegicus
aatgtgtagtaagcggccagcccga

SEQ ID NO: 65387 - DNA, 25 bp, Rattus norvegicus
aatgtgtatctaccatggtcccatc

SEQ ID NO: 65388 - DNA, 25 bp, Rattus norvegicus
aatgtgtatctagcatggtcccatc

SEQ ID NO: 65389 - DNA, 25 bp, Rattus norvegicus
aatgtgtatgtgactgcttcagtta

SEQ ID NO: 65390 - DNA, 25 bp, Rattus norvegicus
aatgtgtatgtgtctgcttcagtta

SEQ ID NO: 65391 - DNA, 25 bp, Rattus norvegicus
aatgtgtcagtaattcagggttcta

SEQ ID NO: 65392 - DNA, 25 bp, Rattus norvegicus
aatgtgtcagtatttcagggttcta

SEQ ID NO: 65393 - DNA, 25 bp, Rattus norvegicus
aatgtgtcagtgagcctttggtggc

SEQ ID NO: 65394 - DNA, 25 bp, Rattus norvegicus
aatgtgtcagtgtgcctttggtggc

SEQ ID NO: 65395 - DNA, 25 bp, Rattus norvegicus
aatgtgtcatcaaccaagaatttta

SEQ ID NO: 65396 - DNA, 25 bp, Rattus norvegicus
aatgtgtcatcatccaagaatttta

SEQ ID NO: 65397 - DNA, 25 bp, Rattus norvegicus
aatgtgtcccaactggctgttactt

SEQ ID NO: 65398 - DNA, 25 bp, Rattus norvegicus
aatgtgtcccaagtggctgttactt

SEQ ID NO: 65399 - DNA, 25 bp, Rattus norvegicus
aatgtgtcctaacagcgtcagctgc

SEQ ID NO: 65400 - DNA, 25 bp, Rattus norvegicus
aatgtgtcctaactgcggtctctgc

SEQ ID NO: 65401 - DNA, 25 bp, Rattus norvegicus
aatgtgtcctaagagcgtcagctgc

SEQ ID NO: 65402 - DNA, 25 bp, Rattus norvegicus
aatgtgtcctaagtgcggtctctgc

SEQ ID NO: 65403 - DNA, 25 bp, Rattus norvegicus
aatgtgtcctggagacatcctgtcc

SEQ ID NO: 65404 - DNA, 25 bp, Rattus norvegicus
aatgtgtcctggtgacatcctgtcc

SEQ ID NO: 65405 - DNA, 25 bp, Rattus norvegicus
aatgtgtctaggagcccaggtttct

SEQ ID NO: 65406 - DNA, 25 bp, Rattus norvegicus
aatgtgtctaggtgcccaggtttct

SEQ ID NO: 65407 - DNA, 25 bp, Rattus norvegicus
aatgtgtctcagagccaatgtcaat

SEQ ID NO: 65408 - DNA, 25 bp, Rattus norvegicus
aatgtgtctcagtgccaatgtcaat

SEQ ID NO: 65409 - DNA, 25 bp, Rattus norvegicus
aatgtgtctcatcttgccttacaaa

SEQ ID NO: 65410 - DNA, 25 bp, Rattus norvegicus
aatgtgtctcatgttgccttacaaa

SEQ ID NO: 65411 - DNA, 25 bp, Rattus norvegicus
aatgtgtctctgaatctcttcgata

SEQ ID NO: 65412 - DNA, 25 bp, Rattus norvegicus
aatgtgtctctgtatctcttcgata

SEQ ID NO: 65413 - DNA, 25 bp, Rattus norvegicus
aatgtgtctgagaagcaccactccc

SEQ ID NO: 65414 - DNA, 25 bp, Rattus norvegicus
aatgtgtctgagaatcttcatttga

SEQ ID NO: 65415 - DNA, 25 bp, Rattus norvegicus
aatgtgtctgagtagcaccactccc

SEQ ID NO: 65416 - DNA, 25 bp, Rattus norvegicus
aatgtgtctgagtatcttcatttga

SEQ ID NO: 65417 - DNA, 25 bp, Rattus norvegicus
aatgtgtctgctaccaaactcacac

SEQ ID NO: 65418 - DNA, 25 bp, Rattus norvegicus
aatgtgtctgcttccaaactcacac

SEQ ID NO: 65419 - DNA, 25 bp, Rattus norvegicus
aatgtgtctgtcagtcatctgccat

SEQ ID NO: 65420 - DNA, 25 bp, Rattus norvegicus
aatgtgtctgtctgtcatctgccat

SEQ ID NO: 65421 - DNA, 25 bp, Rattus norvegicus
aatgtgtctgtgagattattgctat

SEQ ID NO: 65422 - DNA, 25 bp, Rattus norvegicus
aatgtgtctgtgtgattattgctat

SEQ ID NO: 65423 - DNA, 25 bp, Rattus norvegicus
aatgtgtgacatctaccttatgcac

SEQ ID NO: 65424 - DNA, 25 bp, Rattus norvegicus
aatgtgtgacatgtaccttatgcac

SEQ ID NO: 65425 - DNA, 25 bp, Rattus norvegicus
aatgtgtgaggtcgtacatccctaa

SEQ ID NO: 65426 - DNA, 25 bp, Rattus norvegicus
aatgtgtgaggtggtacatccctaa

SEQ ID NO: 65427 - DNA, 25 bp, Rattus norvegicus
aatgtgtgattcagacccatggccc

SEQ ID NO: 65428 - DNA, 25 bp, Rattus norvegicus
aatgtgtgattctgacccatggccc

SEQ ID NO: 65429 - DNA, 25 bp, Rattus norvegicus
aatgtgtgcacccatcaaacctaaa

SEQ ID NO: 65430 - DNA, 25 bp, Rattus norvegicus
aatgtgtgcacccattttggtttgc

SEQ ID NO: 65431 - DNA, 25 bp, Rattus norvegicus
aatgtgtgcaccgatcaaacctaaa

SEQ ID NO: 65432 - DNA, 25 bp, Rattus norvegicus
aatgtgtgcaccgattttggtttgc

SEQ ID NO: 65433 - DNA, 25 bp, Rattus norvegicus
aatgtgtgcagaatattccgagaac

SEQ ID NO: 65434 - DNA, 25 bp, Rattus norvegicus
aatgtgtgcagattattccgagaac

SEQ ID NO: 65435 - DNA, 25 bp, Rattus norvegicus
aatgtgtgctttatagtgtttacta

SEQ ID NO: 65436 - DNA, 25 bp, Rattus norvegicus
aatgtgtgctttcggaaaattcctg

SEQ ID NO: 65437 - DNA, 25 bp, Rattus norvegicus
aatgtgtgctttgggaaaattcctg

SEQ ID NO: 65438 - DNA, 25 bp, Rattus norvegicus
aatgtgtgctttttagtgtttacta

SEQ ID NO: 65439 - DNA, 25 bp, Rattus norvegicus
aatgtgtggatcatctcagtgttct

SEQ ID NO: 65440 - DNA, 25 bp, Rattus norvegicus
aatgtgtggatcttctcagtgttct

SEQ ID NO: 65441 - DNA, 25 bp, Rattus norvegicus
aatgtgtgggatagcagcacccttt

SEQ ID NO: 65442 - DNA, 25 bp, Rattus norvegicus
aatgtgtgggattgcagcacccttt

SEQ ID NO: 65443 - DNA, 25 bp, Rattus norvegicus
aatgtgtgtataacttccttgcttt

SEQ ID NO: 65444 - DNA, 25 bp, Rattus norvegicus
aatgtgtgtatatcttccttgcttt

SEQ ID NO: 65445 - DNA, 25 bp, Rattus norvegicus
aatgtgtgtcacaggagcacaggaa

SEQ ID NO: 65446 - DNA, 25 bp, Rattus norvegicus
aatgtgtgtcactggagcacaggaa

SEQ ID NO: 65447 - DNA, 25 bp, Rattus norvegicus
aatgtgtgtctcaacatctatagaa

SEQ ID NO: 65448 - DNA, 25 bp, Rattus norvegicus
aatgtgtgtctctacatctatagaa

SEQ ID NO: 65449 - DNA, 25 bp, Rattus norvegicus
aatgtgtgtctgcaccccatatcta

SEQ ID NO: 65450 - DNA, 25 bp, Rattus norvegicus
aatgtgtgtctggaccccatatcta

SEQ ID NO: 65451 - DNA, 25 bp, Rattus norvegicus
aatgtgtgtgctactcaaactctga

SEQ ID NO: 65452 - DNA, 25 bp, Rattus norvegicus
aatgtgtgtgcttctcaaactctga

SEQ ID NO: 65453 - DNA, 25 bp, Rattus norvegicus
aatgtgtgttctatgagtccttata

SEQ ID NO: 65454 - DNA, 25 bp, Rattus norvegicus
aatgtgtgttctttgagtccttata

SEQ ID NO: 65455 - DNA, 25 bp, Rattus norvegicus
aatgtgtgttttacagcttagggac

SEQ ID NO: 65456 - DNA, 25 bp, Rattus norvegicus
aatgtgtgtttttcagcttagggac

SEQ ID NO: 65457 - DNA, 25 bp, Rattus norvegicus
aatgtgttacaaccccaaatgcccc

SEQ ID NO: 65458 - DNA, 25 bp, Rattus norvegicus
aatgtgttacaagcccaaatgcccc

SEQ ID NO: 65459 - DNA, 25 bp, Rattus norvegicus
aatgtgttacccagacaaccatcaa

SEQ ID NO: 65460 - DNA, 25 bp, Rattus norvegicus
aatgtgttaccctgacaaccatcaa

SEQ ID NO: 65461 - DNA, 25 bp, Rattus norvegicus
aatgtgttactgaccagccaagggc

SEQ ID NO: 65462 - DNA, 25 bp, Rattus norvegicus
aatgtgttactgtccagccaagggc

SEQ ID NO: 65463 - DNA, 25 bp, Rattus norvegicus
aatgtgttaggcactgtgttgatga

SEQ ID NO: 65464 - DNA, 25 bp, Rattus norvegicus
aatgtgttaggctctgtgttgatga

SEQ ID NO: 65465 - DNA, 25 bp, Rattus norvegicus
aatgtgttatctcttcgaggcttct

SEQ ID NO: 65466 - DNA, 25 bp, Rattus norvegicus
aatgtgttatctgttcgaggcttct

SEQ ID NO: 65467 - DNA, 25 bp, Rattus norvegicus
aatgtgttcctaacctttgccgtct

SEQ ID NO: 65468 - DNA, 25 bp, Rattus norvegicus
aatgtgttcctaacttctcaatgac

SEQ ID NO: 65469 - DNA, 25 bp, Rattus norvegicus
aatgtgttcctatcctttgccgtct

SEQ ID NO: 65470 - DNA, 25 bp, Rattus norvegicus
aatgtgttcctatcttctcaatgac

SEQ ID NO: 65471 - DNA, 25 bp, Rattus norvegicus
aatgtgttctacagcacaactgtta

SEQ ID NO: 65472 - DNA, 25 bp, Rattus norvegicus
aatgtgttctactgcacaactgtta

SEQ ID NO: 65473 - DNA, 25 bp, Rattus norvegicus
aatgtgttctatatacctgacatga

SEQ ID NO: 65474 - DNA, 25 bp, Rattus norvegicus
aatgtgttctatttacctgacatga

SEQ ID NO: 65475 - DNA, 25 bp, Rattus norvegicus
aatgtgttctcactgttatcagtaa

SEQ ID NO: 65476 - DNA, 25 bp, Rattus norvegicus
aatgtgttctcagtgttatcagtaa

SEQ ID NO: 65477 - DNA, 25 bp, Rattus norvegicus
aatgtgttctctaagcagcctgttt

SEQ ID NO: 65478 - DNA, 25 bp, Rattus norvegicus
aatgtgttctctactcctttggaga

SEQ ID NO: 65479 - DNA, 25 bp, Rattus norvegicus
aatgtgttctcttagcagcctgttt

SEQ ID NO: 65480 - DNA, 25 bp, Rattus norvegicus
aatgtgttctcttctcctttggaga

SEQ ID NO: 65481 - DNA, 25 bp, Rattus norvegicus
aatgtgttgcttagttcttcttttt

SEQ ID NO: 65482 - DNA, 25 bp, Rattus norvegicus
aatgtgttgctttgttcttcttttt

SEQ ID NO: 65483 - DNA, 25 bp, Rattus norvegicus
aatgtgtttcataaatctttgctaa

SEQ ID NO: 65484 - DNA, 25 bp, Rattus norvegicus
aatgtgtttcattaatctttgctaa

SEQ ID NO: 65485 - DNA, 25 bp, Rattus norvegicus
aatgtgtttcccaaacttttgatag

SEQ ID NO: 65486 - DNA, 25 bp, Rattus norvegicus
aatgtgtttccccacttaagatgag

SEQ ID NO: 65487 - DNA, 25 bp, Rattus norvegicus
aatgtgtttcccgacttaagatgag

SEQ ID NO: 65488 - DNA, 25 bp, Rattus norvegicus
aatgtgtttccctaacttttgatag

SEQ ID NO: 65489 - DNA, 25 bp, Rattus norvegicus
aatgtgtttctcagtgtgggttttt

SEQ ID NO: 65490 - DNA, 25 bp, Rattus norvegicus
aatgtgtttctctgtgtgggttttt

SEQ ID NO: 65491 - DNA, 25 bp, Rattus norvegicus
aatgtgtttctgaagcatgtcgtga

SEQ ID NO: 65492 - DNA, 25 bp, Rattus norvegicus
aatgtgtttctgtagcatgtcgtga

SEQ ID NO: 65493 - DNA, 25 bp, Rattus norvegicus
aatgtgtttcttacttgtctcctgg

SEQ ID NO: 65494 - DNA, 25 bp, Rattus norvegicus
aatgtgtttctttcttgtctcctgg

SEQ ID NO: 65495 - DNA, 25 bp, Rattus norvegicus
aatgtgtttgccaattttctgaagt

SEQ ID NO: 65496 - DNA, 25 bp, Rattus norvegicus
aatgtgtttgcctattttctgaagt

SEQ ID NO: 65497 - DNA, 25 bp, Rattus norvegicus
aatgtgttttccatgctctgttaac

SEQ ID NO: 65498 - DNA, 25 bp, Rattus norvegicus
aatgtgttttccttgctctgttaac

SEQ ID NO: 65499 - DNA, 25 bp, Rattus norvegicus
aatgttaaatctcaggctggccgtg

SEQ ID NO: 65500 - DNA, 25 bp, Rattus norvegicus
aatgttaaatctgaggctggccgtg

SEQ ID NO: 65501 - DNA, 25 bp, Rattus norvegicus
aatgttaacagcacttggaccaaaa

SEQ ID NO: 65502 - DNA, 25 bp, Rattus norvegicus
aatgttaacagctcttggaccaaaa

SEQ ID NO: 65503 - DNA, 25 bp, Rattus norvegicus
aatgttaactatatccagcctcagg

SEQ ID NO: 65504 - DNA, 25 bp, Rattus norvegicus
aatgttaactatttccagcctcagg

SEQ ID NO: 65505 - DNA, 25 bp, Rattus norvegicus
aatgttaagccactgttgcctcaca

SEQ ID NO: 65506 - DNA, 25 bp, Rattus norvegicus
aatgttaagccagtgttgcctcaca

SEQ ID NO: 65507 - DNA, 25 bp, Rattus norvegicus
aatgttaagggtatcctgctgttgc

SEQ ID NO: 65508 - DNA, 25 bp, Rattus norvegicus
aatgttaagggtttcctgctgttgc

SEQ ID NO: 65509 - DNA, 25 bp, Rattus norvegicus
aatgttaaggtgctcctttcccctg

SEQ ID NO: 65510 - DNA, 25 bp, Rattus norvegicus
aatgttaaggtggtcctttcccctg

SEQ ID NO: 65511 - DNA, 25 bp, Rattus norvegicus
aatgttaagtatatcaaaatgttgc

SEQ ID NO: 65512 - DNA, 25 bp, Rattus norvegicus
aatgttaagtatttcaaaatgttgc

SEQ ID NO: 65513 - DNA, 25 bp, Rattus norvegicus
aatgttacagacagctgcctctgac

SEQ ID NO: 65514 - DNA, 25 bp, Rattus norvegicus
aatgttacagactgctgcctctgac

SEQ ID NO: 65515 - DNA, 25 bp, Rattus norvegicus
aatgttacagttcctctttacctca

SEQ ID NO: 65516 - DNA, 25 bp, Rattus norvegicus
aatgttacagttgctctttacctca

SEQ ID NO: 65517 - DNA, 25 bp, Rattus norvegicus
aatgttaccagaagacctctctcag

SEQ ID NO: 65518 - DNA, 25 bp, Rattus norvegicus
aatgttaccagatgacctctctcag

SEQ ID NO: 65519 - DNA, 25 bp, Rattus norvegicus
aatgttaccaggacctctgcatcag

SEQ ID NO: 65520 - DNA, 25 bp, Rattus norvegicus
aatgttaccaggtcctctgcatcag

SEQ ID NO: 65521 - DNA, 25 bp, Rattus norvegicus
aatgttactggaagactttctaggt

SEQ ID NO: 65522 - DNA, 25 bp, Rattus norvegicus
aatgttactggatgactttctaggt

SEQ ID NO: 65523 - DNA, 25 bp, Rattus norvegicus
aatgttagaacaagagtcctactca

SEQ ID NO: 65524 - DNA, 25 bp, Rattus norvegicus
aatgttagaacatgagtcctactca

SEQ ID NO: 65525 - DNA, 25 bp, Rattus norvegicus
aatgttagaccccactcatgtgcac

SEQ ID NO: 65526 - DNA, 25 bp, Rattus norvegicus
aatgttagacccgactcatgtgcac

SEQ ID NO: 65527 - DNA, 25 bp, Rattus norvegicus
aatgttagacttattcatctgccaa

SEQ ID NO: 65528 - DNA, 25 bp, Rattus norvegicus
aatgttagactttttcatctgccaa

SEQ ID NO: 65529 - DNA, 25 bp, Rattus norvegicus
aatgttagcatcatccgcattgcag

SEQ ID NO: 65530 - DNA, 25 bp, Rattus norvegicus
aatgttagcatcttccgcattgcag

SEQ ID NO: 65531 - DNA, 25 bp, Rattus norvegicus
aatgttagccaccaaaggccagggt

SEQ ID NO: 65532 - DNA, 25 bp, Rattus norvegicus
aatgttagccacctgtgacttttgc

SEQ ID NO: 65533 - DNA, 25 bp, Rattus norvegicus
aatgttagccacgaaaggccagggt

SEQ ID NO: 65534 - DNA, 25 bp, Rattus norvegicus
aatgttagccacgtgtgacttttgc

SEQ ID NO: 65535 - DNA, 25 bp, Rattus norvegicus
aatgttaggctcattgtggccagtt

SEQ ID NO: 65536 - DNA, 25 bp, Rattus norvegicus
aatgttaggctctttgtggccagtt

SEQ ID NO: 65537 - DNA, 25 bp, Rattus norvegicus
aatgttagtactctctgagcccgca

SEQ ID NO: 65538 - DNA, 25 bp, Rattus norvegicus
aatgttagtactgtctgagcccgca

SEQ ID NO: 65539 - DNA, 25 bp, Rattus norvegicus
aatgttagtgtaaatccttccttcc

SEQ ID NO: 65540 - DNA, 25 bp, Rattus norvegicus
aatgttagtgtatatccttccttcc

SEQ ID NO: 65541 - DNA, 25 bp, Rattus norvegicus
aatgttagttctacaatgtctgttt

SEQ ID NO: 65542 - DNA, 25 bp, Rattus norvegicus
aatgttagttcttcaatgtctgttt

SEQ ID NO: 65543 - DNA, 25 bp, Rattus norvegicus
aatgttataattatgtgtccgtctt

SEQ ID NO: 65544 - DNA, 25 bp, Rattus norvegicus
aatgttataattttgtgtccgtctt

SEQ ID NO: 65545 - DNA, 25 bp, Rattus norvegicus
aatgttatcacactgaccatcatcc

SEQ ID NO: 65546 - DNA, 25 bp, Rattus norvegicus
aatgttatcacagtgaccatcatcc

SEQ ID NO: 65547 - DNA, 25 bp, Rattus norvegicus
aatgttatccctatgtaagcccctc

SEQ ID NO: 65548 - DNA, 25 bp, Rattus norvegicus
aatgttatccctttgtaagcccctc

SEQ ID NO: 65549 - DNA, 25 bp, Rattus norvegicus
aatgttatgagtcccatcctggtag

SEQ ID NO: 65550 - DNA, 25 bp, Rattus norvegicus
aatgttatgagtgccatcctggtag

SEQ ID NO: 65551 - DNA, 25 bp, Rattus norvegicus
aatgttattgtgaatccacggctgc

SEQ ID NO: 65552 - DNA, 25 bp, Rattus norvegicus
aatgttattgtgtatccacggctgc

SEQ ID NO: 65553 - DNA, 25 bp, Rattus norvegicus
aatgttatttgcctttatcaagaca

SEQ ID NO: 65554 - DNA, 25 bp, Rattus norvegicus
aatgttatttgcgtttatcaagaca

SEQ ID NO: 65555 - DNA, 25 bp, Rattus norvegicus
aatgttcaacaccacagcaactttc

SEQ ID NO: 65556 - DNA, 25 bp, Rattus norvegicus
aatgttcaacacgacagcaactttc

SEQ ID NO: 65557 - DNA, 25 bp, Rattus norvegicus
aatgttcacaacactgcgaaggcgg

SEQ ID NO: 65558 - DNA, 25 bp, Rattus norvegicus
aatgttcacaactctgcgaaggcgg

SEQ ID NO: 65559 - DNA, 25 bp, Rattus norvegicus
aatgttcacacgaggctatgcttca

SEQ ID NO: 65560 - DNA, 25 bp, Rattus norvegicus
aatgttcacacgtggctatgcttca

SEQ ID NO: 65561 - DNA, 25 bp, Rattus norvegicus
aatgttcaccaactaccaggcctca

SEQ ID NO: 65562 - DNA, 25 bp, Rattus norvegicus
aatgttcaccaagtaccaggcctca

SEQ ID NO: 65563 - DNA, 25 bp, Rattus norvegicus
aatgttcaccatccttgtaataaaa

SEQ ID NO: 65564 - DNA, 25 bp, Rattus norvegicus
aatgttcaccatgcttgtaataaaa

SEQ ID NO: 65565 - DNA, 25 bp, Rattus norvegicus
aatgttcacgagataccggtgtcta

SEQ ID NO: 65566 - DNA, 25 bp, Rattus norvegicus
aatgttcacgagttaccggtgtcta

SEQ ID NO: 65567 - DNA, 25 bp, Rattus norvegicus
aatgttcactcacgctttaacgcaa

SEQ ID NO: 65568 - DNA, 25 bp, Rattus norvegicus
aatgttcactcaggctttaacgcaa

SEQ ID NO: 65569 - DNA, 25 bp, Rattus norvegicus
aatgttcactgacgacctgcacaac

SEQ ID NO: 65570 - DNA, 25 bp, Rattus norvegicus
aatgttcactgaggacctgcacaac

SEQ ID NO: 65571 - DNA, 25 bp, Rattus norvegicus
aatgttcagaggagcagcccaagct

SEQ ID NO: 65572 - DNA, 25 bp, Rattus norvegicus
aatgttcagaggtgcagcccaagct

SEQ ID NO: 65573 - DNA, 25 bp, Rattus norvegicus
aatgttcagatgcagtgcccttggg

SEQ ID NO: 65574 - DNA, 25 bp, Rattus norvegicus
aatgttcagatggagtgcccttggg

SEQ ID NO: 65575 - DNA, 25 bp, Rattus norvegicus
aatgttcagctgatggtcttggtca

SEQ ID NO: 65576 - DNA, 25 bp, Rattus norvegicus
aatgttcagctgttggtcttggtca

SEQ ID NO: 65577 - DNA, 25 bp, Rattus norvegicus
aatgttcaggctattgtgagatacc

SEQ ID NO: 65578 - DNA, 25 bp, Rattus norvegicus
aatgttcaggcttttgtgagatacc

SEQ ID NO: 65579 - DNA, 25 bp, Rattus norvegicus
aatgttcagggcacgaatgtgctct

SEQ ID NO: 65580 - DNA, 25 bp, Rattus norvegicus
aatgttcagggctcgaatgtgctct

SEQ ID NO: 65581 - DNA, 25 bp, Rattus norvegicus
aatgttcaggtgctcttacagcaga

SEQ ID NO: 65582 - DNA, 25 bp, Rattus norvegicus
aatgttcaggtggtcttacagcaga

SEQ ID NO: 65583 - DNA, 25 bp, Rattus norvegicus
aatgttcatccgaagttttaactat

SEQ ID NO: 65584 - DNA, 25 bp, Rattus norvegicus
aatgttcatccgtagttttaactat

SEQ ID NO: 65585 - DNA, 25 bp, Rattus norvegicus
aatgttcattctaagacacccacca

SEQ ID NO: 65586 - DNA, 25 bp, Rattus norvegicus
aatgttcattcttagacacccacca

SEQ ID NO: 65587 - DNA, 25 bp, Rattus norvegicus
aatgttccaagtacacctgacgaaa

SEQ ID NO: 65588 - DNA, 25 bp, Rattus norvegicus
aatgttccaagttcacctgacgaaa

SEQ ID NO: 65589 - DNA, 25 bp, Rattus norvegicus
aatgttccagatcgtgactttcaat

SEQ ID NO: 65590 - DNA, 25 bp, Rattus norvegicus
aatgttccagatggtgactttcaat

SEQ ID NO: 65591 - DNA, 25 bp, Rattus norvegicus
aatgttccagctatcttctcttgtg

SEQ ID NO: 65592 - DNA, 25 bp, Rattus norvegicus
aatgttccagctttcttctcttgtg

SEQ ID NO: 65593 - DNA, 25 bp, Rattus norvegicus
aatgttccaggaatgcgctcaagca

SEQ ID NO: 65594 - DNA, 25 bp, Rattus norvegicus
aatgttccaggattgcgctcaagca

SEQ ID NO: 65595 - DNA, 25 bp, Rattus norvegicus
aatgttccagtgactgtcctgggaa

SEQ ID NO: 65596 - DNA, 25 bp, Rattus norvegicus
aatgttccagtgtctgtcctgggaa

SEQ ID NO: 65597 - DNA, 25 bp, Rattus norvegicus
aatgttcccgtgctcactctttgta

SEQ ID NO: 65598 - DNA, 25 bp, Rattus norvegicus
aatgttcccgtggtcactctttgta

SEQ ID NO: 65599 - DNA, 25 bp, Rattus norvegicus
aatgttccctcgagacccgaagcga

SEQ ID NO: 65600 - DNA, 25 bp, Rattus norvegicus
aatgttccctcgtgacccgaagcga

SEQ ID NO: 65601 - DNA, 25 bp, Rattus norvegicus
aatgttccctttcctggtcagagat

SEQ ID NO: 65602 - DNA, 25 bp, Rattus norvegicus
aatgttccctttctgatgctatgac

SEQ ID NO: 65603 - DNA, 25 bp, Rattus norvegicus
aatgttccctttgctggtcagagat

SEQ ID NO: 65604 - DNA, 25 bp, Rattus norvegicus
aatgttccctttgtgatgctatgac

SEQ ID NO: 65605 - DNA, 25 bp, Rattus norvegicus
aatgttccgggccagtgagacctgt

SEQ ID NO: 65606 - DNA, 25 bp, Rattus norvegicus
aatgttccgggcgagtgagacctgt

SEQ ID NO: 65607 - DNA, 25 bp, Rattus norvegicus
aatgttccgtctaaacaccacgagg

SEQ ID NO: 65608 - DNA, 25 bp, Rattus norvegicus
aatgttccgtcttaacaccacgagg

SEQ ID NO: 65609 - DNA, 25 bp, Rattus norvegicus
aatgttccgttcagaggagtccaaa

SEQ ID NO: 65610 - DNA, 25 bp, Rattus norvegicus
aatgttccgttctgaggagtccaaa

SEQ ID NO: 65611 - DNA, 25 bp, Rattus norvegicus
aatgttcctgggatcttccattaat

SEQ ID NO: 65612 - DNA, 25 bp, Rattus norvegicus
aatgttcctgggttcttccattaat

SEQ ID NO: 65613 - DNA, 25 bp, Rattus norvegicus
aatgttccttgtccaacagcggtcc

SEQ ID NO: 65614 - DNA, 25 bp, Rattus norvegicus
aatgttccttgtgcaacagcggtcc

SEQ ID NO: 65615 - DNA, 25 bp, Rattus norvegicus
aatgttcgaaaactcgtccctgtcg

SEQ ID NO: 65616 - DNA, 25 bp, Rattus norvegicus
aatgttcgaaaagtcgtccctgtcg

SEQ ID NO: 65617 - DNA, 25 bp, Rattus norvegicus
aatgttcgagcaagcccagattcag

SEQ ID NO: 65618 - DNA, 25 bp, Rattus norvegicus
aatgttcgagcatgcccagattcag

SEQ ID NO: 65619 - DNA, 25 bp, Rattus norvegicus
aatgttcgtggtagagcttctgccc

SEQ ID NO: 65620 - DNA, 25 bp, Rattus norvegicus
aatgttcgtggttgagcttctgccc

SEQ ID NO: 65621 - DNA, 25 bp, Rattus norvegicus
aatgttcgttatcatgtggtgcaca

SEQ ID NO: 65622 - DNA, 25 bp, Rattus norvegicus
aatgttcgttatgatgtggtgcaca

SEQ ID NO: 65623 - DNA, 25 bp, Rattus norvegicus
aatgttctaaatcttcgtgtccctc

SEQ ID NO: 65624 - DNA, 25 bp, Rattus norvegicus
aatgttctaaatgttcgtgtccctc

SEQ ID NO: 65625 - DNA, 25 bp, Rattus norvegicus
aatgttctaactaatactaataaat

SEQ ID NO: 65626 - DNA, 25 bp, Rattus norvegicus
aatgttctaacttatactaataaat

SEQ ID NO: 65627 - DNA, 25 bp, Rattus norvegicus
aatgttctagcaagccattcttgaa

SEQ ID NO: 65628 - DNA, 25 bp, Rattus norvegicus
aatgttctagcatgccattcttgaa

SEQ ID NO: 65629 - DNA, 25 bp, Rattus norvegicus
aatgttctatttaccacgtgtacaa

SEQ ID NO: 65630 - DNA, 25 bp, Rattus norvegicus
aatgttctattttccacgtgtacaa

SEQ ID NO: 65631 - DNA, 25 bp, Rattus norvegicus
aatgttctccatatgctgtacttta

SEQ ID NO: 65632 - DNA, 25 bp, Rattus norvegicus
aatgttctccatttgctgtacttta

SEQ ID NO: 65633 - DNA, 25 bp, Rattus norvegicus
aatgttctccctctactgagcataa

SEQ ID NO: 65634 - DNA, 25 bp, Rattus norvegicus
aatgttctccctgtactgagcataa

SEQ ID NO: 65635 - DNA, 25 bp, Rattus norvegicus
aatgttctccgcaacatccagctga

SEQ ID NO: 65636 - DNA, 25 bp, Rattus norvegicus
aatgttctccgctacatccagctga

SEQ ID NO: 65637 - DNA, 25 bp, Rattus norvegicus
aatgttctctagcagggctgagtct

SEQ ID NO: 65638 - DNA, 25 bp, Rattus norvegicus
aatgttctctaggagggctgagtct

SEQ ID NO: 65639 - DNA, 25 bp, Rattus norvegicus
aatgttctctgtcttaaaccttcat

SEQ ID NO: 65640 - DNA, 25 bp, Rattus norvegicus
aatgttctctgtgttaaaccttcat

SEQ ID NO: 65641 - DNA, 25 bp, Rattus norvegicus
aatgttctcttgatcttggtgccct

SEQ ID NO: 65642 - DNA, 25 bp, Rattus norvegicus
aatgttctcttgttcttggtgccct

SEQ ID NO: 65643 - DNA, 25 bp, Rattus norvegicus
aatgttctgcacatcttcaatgctc

SEQ ID NO: 65644 - DNA, 25 bp, Rattus norvegicus
aatgttctgcacttcttcaatgctc

SEQ ID NO: 65645 - DNA, 25 bp, Rattus norvegicus
aatgttctgctcattccactaattg

SEQ ID NO: 65646 - DNA, 25 bp, Rattus norvegicus
aatgttctgctctttccactaattg

SEQ ID NO: 65647 - DNA, 25 bp, Rattus norvegicus
aatgttctgggtatgtctgctgtgc

SEQ ID NO: 65648 - DNA, 25 bp, Rattus norvegicus
aatgttctgggtttgtctgctgtgc

SEQ ID NO: 65649 - DNA, 25 bp, Rattus norvegicus
aatgttctgtagctggtactgacca

SEQ ID NO: 65650 - DNA, 25 bp, Rattus norvegicus
aatgttctgtaggtggtactgacca

SEQ ID NO: 65651 - DNA, 25 bp, Rattus norvegicus
aatgttctgtggcttcaggtcacga

SEQ ID NO: 65652 - DNA, 25 bp, Rattus norvegicus
aatgttctgtgggttcaggtcacga

SEQ ID NO: 65653 - DNA, 25 bp, Rattus norvegicus
aatgttcttaacctttgacctggat

SEQ ID NO: 65654 - DNA, 25 bp, Rattus norvegicus
aatgttcttaacgtttgacctggat

SEQ ID NO: 65655 - DNA, 25 bp, Rattus norvegicus
aatgttcttcacatcaagtggttga

SEQ ID NO: 65656 - DNA, 25 bp, Rattus norvegicus
aatgttcttcacatgtttttctaat

SEQ ID NO: 65657 - DNA, 25 bp, Rattus norvegicus
aatgttcttcacttcaagtggttga

SEQ ID NO: 65658 - DNA, 25 bp, Rattus norvegicus
aatgttcttcacttgtttttctaat

SEQ ID NO: 65659 - DNA, 25 bp, Rattus norvegicus
aatgttcttgaacggcatcggctaa

SEQ ID NO: 65660 - DNA, 25 bp, Rattus norvegicus
aatgttcttgaagggcatcggctaa

SEQ ID NO: 65661 - DNA, 25 bp, Rattus norvegicus
aatgttcttgcccttcttcaatacc

SEQ ID NO: 65662 - DNA, 25 bp, Rattus norvegicus
aatgttcttgccgttcttcaatacc

SEQ ID NO: 65663 - DNA, 25 bp, Rattus norvegicus
aatgttctttccctaagtgcagtcg

SEQ ID NO: 65664 - DNA, 25 bp, Rattus norvegicus
aatgttctttccgtaagtgcagtcg

SEQ ID NO: 65665 - DNA, 25 bp, Rattus norvegicus
aatgttctttgtatgttcttttctg

SEQ ID NO: 65666 - DNA, 25 bp, Rattus norvegicus
aatgttctttgtttgttcttttctg

SEQ ID NO: 65667 - DNA, 25 bp, Rattus norvegicus
aatgttgaatttatctgggcctcca

SEQ ID NO: 65668 - DNA, 25 bp, Rattus norvegicus
aatgttgaatttttctgggcctcca

SEQ ID NO: 65669 - DNA, 25 bp, Rattus norvegicus
aatgttgacaggatccatggtgagg

SEQ ID NO: 65670 - DNA, 25 bp, Rattus norvegicus
aatgttgacaggttccatggtgagg

SEQ ID NO: 65671 - DNA, 25 bp, Rattus norvegicus
aatgttgacctactttacagctgca

SEQ ID NO: 65672 - DNA, 25 bp, Rattus norvegicus
aatgttgacctagtttacagctgca

SEQ ID NO: 65673 - DNA, 25 bp, Rattus norvegicus
aatgttgactttcttttgctcattc

SEQ ID NO: 65674 - DNA, 25 bp, Rattus norvegicus
aatgttgactttgttttgctcattc

SEQ ID NO: 65675 - DNA, 25 bp, Rattus norvegicus
aatgttgatctcagcctgatcccaa

SEQ ID NO: 65676 - DNA, 25 bp, Rattus norvegicus
aatgttgatctctgcctgatcccaa

SEQ ID NO: 65677 - DNA, 25 bp, Rattus norvegicus
aatgttgatgcccaggctgtgctga

SEQ ID NO: 65678 - DNA, 25 bp, Rattus norvegicus
aatgttgatgccgaggctgtgctga

SEQ ID NO: 65679 - DNA, 25 bp, Rattus norvegicus
aatgttgatttgatccaggctggca

SEQ ID NO: 65680 - DNA, 25 bp, Rattus norvegicus
aatgttgatttgttccaggctggca

SEQ ID NO: 65681 - DNA, 25 bp, Rattus norvegicus
aatgttgcagaaacctctcctgttg

SEQ ID NO: 65682 - DNA, 25 bp, Rattus norvegicus
aatgttgcagaatcctctcctgttg

SEQ ID NO: 65683 - DNA, 25 bp, Rattus norvegicus
aatgttgccagtcggtacctgtact

SEQ ID NO: 65684 - DNA, 25 bp, Rattus norvegicus
aatgttgccagtgggtacctgtact

SEQ ID NO: 65685 - DNA, 25 bp, Rattus norvegicus
aatgttgccatactggaccctttgc

SEQ ID NO: 65686 - DNA, 25 bp, Rattus norvegicus
aatgttgccatagtggaccctttgc

SEQ ID NO: 65687 - DNA, 25 bp, Rattus norvegicus
aatgttgccattagaactattgtgt

SEQ ID NO: 65688 - DNA, 25 bp, Rattus norvegicus
aatgttgccatttgaactattgtgt

SEQ ID NO: 65689 - DNA, 25 bp, Rattus norvegicus
aatgttgcctacagctgtgagttaa

SEQ ID NO: 65690 - DNA, 25 bp, Rattus norvegicus
aatgttgcctactgctgtgagttaa

SEQ ID NO: 65691 - DNA, 25 bp, Rattus norvegicus
aatgttgcggaccatcgacttccag

SEQ ID NO: 65692 - DNA, 25 bp, Rattus norvegicus
aatgttgcggacgatcgacttccag

SEQ ID NO: 65693 - DNA, 25 bp, Rattus norvegicus
aatgttgctagactgacctttgtat

SEQ ID NO: 65694 - DNA, 25 bp, Rattus norvegicus
aatgttgctagagtgacctttgtat

SEQ ID NO: 65695 - DNA, 25 bp, Rattus norvegicus
aatgttgctagcctctgttgtacaa

SEQ ID NO: 65696 - DNA, 25 bp, Rattus norvegicus
aatgttgctagcgtctgttgtacaa

SEQ ID NO: 65697 - DNA, 25 bp, Rattus norvegicus
aatgttgctatcactatacaagtgc

SEQ ID NO: 65698 - DNA, 25 bp, Rattus norvegicus
aatgttgctatctctatacaagtgc

SEQ ID NO: 65699 - DNA, 25 bp, Rattus norvegicus
aatgttgctgtcagacctgcctgac

SEQ ID NO: 65700 - DNA, 25 bp, Rattus norvegicus
aatgttgctgtctgacctgcctgac

SEQ ID NO: 65701 - DNA, 25 bp, Rattus norvegicus
aatgttgctgtgctccagtaatgca

SEQ ID NO: 65702 - DNA, 25 bp, Rattus norvegicus
aatgttgctgtggtccagtaatgca

SEQ ID NO: 65703 - DNA, 25 bp, Rattus norvegicus
aatgttgctttcacctggatcagct

SEQ ID NO: 65704 - DNA, 25 bp, Rattus norvegicus
aatgttgctttctcctggatcagct

SEQ ID NO: 65705 - DNA, 25 bp, Rattus norvegicus
aatgttggaaccctttctctcttgg

SEQ ID NO: 65706 - DNA, 25 bp, Rattus norvegicus
aatgttggaaccgtttctctcttgg

SEQ ID NO: 65707 - DNA, 25 bp, Rattus norvegicus
aatgttggacttagctgcattttac

SEQ ID NO: 65708 - DNA, 25 bp, Rattus norvegicus
aatgttggactttgctgcattttac

SEQ ID NO: 65709 - DNA, 25 bp, Rattus norvegicus
aatgttggagtacaccctggcctgt

SEQ ID NO: 65710 - DNA, 25 bp, Rattus norvegicus
aatgttggagtagaccctggcctgt

SEQ ID NO: 65711 - DNA, 25 bp, Rattus norvegicus
aatgttggcacgcagcgttaaccac

SEQ ID NO: 65712 - DNA, 25 bp, Rattus norvegicus
aatgttggcacggagcgttaaccac

SEQ ID NO: 65713 - DNA, 25 bp, Rattus norvegicus
aatgttggcataatcttgtttgtct

SEQ ID NO: 65714 - DNA, 25 bp, Rattus norvegicus
aatgttggcatattcttgtttgtct

SEQ ID NO: 65715 - DNA, 25 bp, Rattus norvegicus
aatgttggcctgatcttcatcttag

SEQ ID NO: 65716 - DNA, 25 bp, Rattus norvegicus
aatgttggcctgttcttcatcttag

SEQ ID NO: 65717 - DNA, 25 bp, Rattus norvegicus
aatgttggcgtgaactcttgtggtt

SEQ ID NO: 65718 - DNA, 25 bp, Rattus norvegicus
aatgttggcgtgtactcttgtggtt

SEQ ID NO: 65719 - DNA, 25 bp, Rattus norvegicus
aatgttggctatatctgcgtgaata

SEQ ID NO: 65720 - DNA, 25 bp, Rattus norvegicus
aatgttggctatttctgcgtgaata

SEQ ID NO: 65721 - DNA, 25 bp, Rattus norvegicus
aatgttggctccactagtccaagtc

SEQ ID NO: 65722 - DNA, 25 bp, Rattus norvegicus
aatgttggctcctctagtccaagtc

SEQ ID NO: 65723 - DNA, 25 bp, Rattus norvegicus
aatgttggctgtccgtgagaaccgc

SEQ ID NO: 65724 - DNA, 25 bp, Rattus norvegicus
aatgttggctgtgcgtgagaaccgc

SEQ ID NO: 65725 - DNA, 25 bp, Rattus norvegicus
aatgttggctttagagctccccatg

SEQ ID NO: 65726 - DNA, 25 bp, Rattus norvegicus
aatgttggcttttgagctccccatg

SEQ ID NO: 65727 - DNA, 25 bp, Rattus norvegicus
aatgttgggtctatctctcatcccc

SEQ ID NO: 65728 - DNA, 25 bp, Rattus norvegicus
aatgttgggtctttctctcatcccc

SEQ ID NO: 65729 - DNA, 25 bp, Rattus norvegicus
aatgttggtggtctcctttgtgtaa

SEQ ID NO: 65730 - DNA, 25 bp, Rattus norvegicus
aatgttggtggtgtcctttgtgtaa

SEQ ID NO: 65731 - DNA, 25 bp, Rattus norvegicus
aatgttggttttcctcaggtcttca

SEQ ID NO: 65732 - DNA, 25 bp, Rattus norvegicus
aatgttggttttgctcaggtcttca

SEQ ID NO: 65733 - DNA, 25 bp, Rattus norvegicus
aatgttgtagaacaaccgttcgtgt

SEQ ID NO: 65734 - DNA, 25 bp, Rattus norvegicus
aatgttgtagaagaaccgttcgtgt

SEQ ID NO: 65735 - DNA, 25 bp, Rattus norvegicus
aatgttgtaggcacagggctccagc

SEQ ID NO: 65736 - DNA, 25 bp, Rattus norvegicus
aatgttgtaggctcagggctccagc

SEQ ID NO: 65737 - DNA, 25 bp, Rattus norvegicus
aatgttgtatgaaagcccttctcca

SEQ ID NO: 65738 - DNA, 25 bp, Rattus norvegicus
aatgttgtatgatagcccttctcca

SEQ ID NO: 65739 - DNA, 25 bp, Rattus norvegicus
aatgttgtcacaaacagaagagcaa

SEQ ID NO: 65740 - DNA, 25 bp, Rattus norvegicus
aatgttgtcacatacagaagagcaa

SEQ ID NO: 65741 - DNA, 25 bp, Rattus norvegicus
aatgttgtcagtacaagctgtcata

SEQ ID NO: 65742 - DNA, 25 bp, Rattus norvegicus
aatgttgtcagttcaagctgtcata

SEQ ID NO: 65743 - DNA, 25 bp, Rattus norvegicus
aatgttgtcctactggtatttcctg

SEQ ID NO: 65744 - DNA, 25 bp, Rattus norvegicus
aatgttgtcctagtggtatttcctg

SEQ ID NO: 65745 - DNA, 25 bp, Rattus norvegicus
aatgttgtcgagcagtgggcactta

SEQ ID NO: 65746 - DNA, 25 bp, Rattus norvegicus
aatgttgtcgaggagtgggcactta

SEQ ID NO: 65747 - DNA, 25 bp, Rattus norvegicus
aatgttgtctctctggaaagcctgc

SEQ ID NO: 65748 - DNA, 25 bp, Rattus norvegicus
aatgttgtctctgtggaaagcctgc

SEQ ID NO: 65749 - DNA, 25 bp, Rattus norvegicus
aatgttgtgacaacctatgaactgg

SEQ ID NO: 65750 - DNA, 25 bp, Rattus norvegicus
aatgttgtgacatcctatgaactgg

SEQ ID NO: 65751 - DNA, 25 bp, Rattus norvegicus
aatgttgtgcatccttttgtctggt

SEQ ID NO: 65752 - DNA, 25 bp, Rattus norvegicus
aatgttgtgcatgcttttgtctggt

SEQ ID NO: 65753 - DNA, 25 bp, Rattus norvegicus
aatgttgtgctgagtgtcgtttcct

SEQ ID NO: 65754 - DNA, 25 bp, Rattus norvegicus
aatgttgtgctgtgtgtcgtttcct

SEQ ID NO: 65755 - DNA, 25 bp, Rattus norvegicus
aatgttgtggccactgttcatttgc

SEQ ID NO: 65756 - DNA, 25 bp, Rattus norvegicus
aatgttgtggcctctgttcatttgc

SEQ ID NO: 65757 - DNA, 25 bp, Rattus norvegicus
aatgttgtggttaccatctctcttc

SEQ ID NO: 65758 - DNA, 25 bp, Rattus norvegicus
aatgttgtggtttccatctctcttc

SEQ ID NO: 65759 - DNA, 25 bp, Rattus norvegicus
aatgttgttcttagctatttctgaa

SEQ ID NO: 65760 - DNA, 25 bp, Rattus norvegicus
aatgttgttctttgctatttctgaa

SEQ ID NO: 65761 - DNA, 25 bp, Rattus norvegicus
aatgttgttgtacctgtcttaccca

SEQ ID NO: 65762 - DNA, 25 bp, Rattus norvegicus
aatgttgttgtagctgtcttaccca

SEQ ID NO: 65763 - DNA, 25 bp, Rattus norvegicus
aatgttgtttgcctgtttatggatg

SEQ ID NO: 65764 - DNA, 25 bp, Rattus norvegicus
aatgttgtttgcgtgtttatggatg

SEQ ID NO: 65765 - DNA, 25 bp, Rattus norvegicus
aatgtttaatctctactcgctctca

SEQ ID NO: 65766 - DNA, 25 bp, Rattus norvegicus
aatgtttaatctgtactcgctctca

SEQ ID NO: 65767 - DNA, 25 bp, Rattus norvegicus
aatgtttaatgcattcagcctgctt

SEQ ID NO: 65768 - DNA, 25 bp, Rattus norvegicus
aatgtttaatgctttcagcctgctt

SEQ ID NO: 65769 - DNA, 25 bp, Rattus norvegicus
aatgtttacctgatgcctacctaat

SEQ ID NO: 65770 - DNA, 25 bp, Rattus norvegicus
aatgtttacctgttgcctacctaat

SEQ ID NO: 65771 - DNA, 25 bp, Rattus norvegicus
aatgtttacttaacctccaaagcac

SEQ ID NO: 65772 - DNA, 25 bp, Rattus norvegicus
aatgtttacttatcctccaaagcac

SEQ ID NO: 65773 - DNA, 25 bp, Rattus norvegicus
aatgtttactttcttccctgtctat

SEQ ID NO: 65774 - DNA, 25 bp, Rattus norvegicus
aatgtttactttgttccctgtctat

SEQ ID NO: 65775 - DNA, 25 bp, Rattus norvegicus
aatgtttagctcagtgtgtggccct

SEQ ID NO: 65776 - DNA, 25 bp, Rattus norvegicus
aatgtttagctctgtgtgtggccct

SEQ ID NO: 65777 - DNA, 25 bp, Rattus norvegicus
aatgtttataacaccaaccacagga

SEQ ID NO: 65778 - DNA, 25 bp, Rattus norvegicus
aatgtttataactccaaccacagga

SEQ ID NO: 65779 - DNA, 25 bp, Rattus norvegicus
aatgtttatatcactgtcactcatg

SEQ ID NO: 65780 - DNA, 25 bp, Rattus norvegicus
aatgtttatatctctgtcactcatg

SEQ ID NO: 65781 - DNA, 25 bp, Rattus norvegicus
aatgtttatattacttttgctgtgc

SEQ ID NO: 65782 - DNA, 25 bp, Rattus norvegicus
aatgtttatatttcttttgctgtgc

SEQ ID NO: 65783 - DNA, 25 bp, Rattus norvegicus
aatgtttatggcacctgacttgtaa

SEQ ID NO: 65784 - DNA, 25 bp, Rattus norvegicus
aatgtttatggctcctgacttgtaa

SEQ ID NO: 65785 - DNA, 25 bp, Rattus norvegicus
aatgtttcaaaacgagctgcgctct

SEQ ID NO: 65786 - DNA, 25 bp, Rattus norvegicus
aatgtttcaaaaggagctgcgctct

SEQ ID NO: 65787 - DNA, 25 bp, Rattus norvegicus
aatgtttcacacatgtgtttcctta

SEQ ID NO: 65788 - DNA, 25 bp, Rattus norvegicus
aatgtttcacacttgtgtttcctta

SEQ ID NO: 65789 - DNA, 25 bp, Rattus norvegicus
aatgtttcacctaagaagctcctcc

SEQ ID NO: 65790 - DNA, 25 bp, Rattus norvegicus
aatgtttcaccttagaagctcctcc

SEQ ID NO: 65791 - DNA, 25 bp, Rattus norvegicus
aatgtttcacttatctgatccatag

SEQ ID NO: 65792 - DNA, 25 bp, Rattus norvegicus
aatgtttcacttttctgatccatag

SEQ ID NO: 65793 - DNA, 25 bp, Rattus norvegicus
aatgtttcagacatccacctagggt

SEQ ID NO: 65794 - DNA, 25 bp, Rattus norvegicus
aatgtttcagacttccacctagggt

SEQ ID NO: 65795 - DNA, 25 bp, Rattus norvegicus
aatgtttcagtgatcacatcggtgt

SEQ ID NO: 65796 - DNA, 25 bp, Rattus norvegicus
aatgtttcagtgttcacatcggtgt

SEQ ID NO: 65797 - DNA, 25 bp, Rattus norvegicus
aatgtttcatttcccagatggacaa

SEQ ID NO: 65798 - DNA, 25 bp, Rattus norvegicus
aatgtttcatttgccagatggacaa

SEQ ID NO: 65799 - DNA, 25 bp, Rattus norvegicus
aatgtttccatgagacacggctgta

SEQ ID NO: 65800 - DNA, 25 bp, Rattus norvegicus
aatgtttccatgtgacacggctgta

SEQ ID NO: 65801 - DNA, 25 bp, Rattus norvegicus
aatgtttcccttagtgctataggaa

SEQ ID NO: 65802 - DNA, 25 bp, Rattus norvegicus
aatgtttccctttgtgctataggaa

SEQ ID NO: 65803 - DNA, 25 bp, Rattus norvegicus
aatgtttccgtgagtccttgtgtaa

SEQ ID NO: 65804 - DNA, 25 bp, Rattus norvegicus
aatgtttccgtgtgtccttgtgtaa

SEQ ID NO: 65805 - DNA, 25 bp, Rattus norvegicus
aatgtttccttcatagtaaacttag

SEQ ID NO: 65806 - DNA, 25 bp, Rattus norvegicus
aatgtttccttcttagtaaacttag

SEQ ID NO: 65807 - DNA, 25 bp, Rattus norvegicus
aatgtttcctttattggtctgtagt

SEQ ID NO: 65808 - DNA, 25 bp, Rattus norvegicus
aatgtttccttttttggtctgtagt

SEQ ID NO: 65809 - DNA, 25 bp, Rattus norvegicus
aatgtttcgggaaactctttgagtc

SEQ ID NO: 65810 - DNA, 25 bp, Rattus norvegicus
aatgtttcgggatactctttgagtc

SEQ ID NO: 65811 - DNA, 25 bp, Rattus norvegicus
aatgtttctaaaatgctgttatctg

SEQ ID NO: 65812 - DNA, 25 bp, Rattus norvegicus
aatgtttctaaattgctgttatctg

SEQ ID NO: 65813 - DNA, 25 bp, Rattus norvegicus
aatgtttctacaatggagccaatcg

SEQ ID NO: 65814 - DNA, 25 bp, Rattus norvegicus
aatgtttctacattggagccaatcg

SEQ ID NO: 65815 - DNA, 25 bp, Rattus norvegicus
aatgtttctattattggatggatgc

SEQ ID NO: 65816 - DNA, 25 bp, Rattus norvegicus
aatgtttctatttttggatggatgc

SEQ ID NO: 65817 - DNA, 25 bp, Rattus norvegicus
aatgtttctcccatcatgaggaaag

SEQ ID NO: 65818 - DNA, 25 bp, Rattus norvegicus
aatgtttctcccttcatgaggaaag

SEQ ID NO: 65819 - DNA, 25 bp, Rattus norvegicus
aatgtttctgctatctcacatcctg

SEQ ID NO: 65820 - DNA, 25 bp, Rattus norvegicus
aatgtttctgctctcactacttaga

SEQ ID NO: 65821 - DNA, 25 bp, Rattus norvegicus
aatgtttctgctgtcactacttaga

SEQ ID NO: 65822 - DNA, 25 bp, Rattus norvegicus
aatgtttctgctttctcacatcctg

SEQ ID NO: 65823 - DNA, 25 bp, Rattus norvegicus
aatgtttctgttatgtcgtggtttg

SEQ ID NO: 65824 - DNA, 25 bp, Rattus norvegicus
aatgtttctgttttgtcgtggtttg

SEQ ID NO: 65825 - DNA, 25 bp, Rattus norvegicus
aatgtttcttaacatgtcagtcacc

SEQ ID NO: 65826 - DNA, 25 bp, Rattus norvegicus
aatgtttcttaagatgtcagtcacc

SEQ ID NO: 65827 - DNA, 25 bp, Rattus norvegicus
aatgtttcttacaagttctgcactg

SEQ ID NO: 65828 - DNA, 25 bp, Rattus norvegicus
aatgtttcttactagttctgcactg

SEQ ID NO: 65829 - DNA, 25 bp, Rattus norvegicus
aatgtttcttgaacctagaggctcc

SEQ ID NO: 65830 - DNA, 25 bp, Rattus norvegicus
aatgtttcttgatcctagaggctcc

SEQ ID NO: 65831 - DNA, 25 bp, Rattus norvegicus
aatgtttcttttcccttaaatgcag

SEQ ID NO: 65832 - DNA, 25 bp, Rattus norvegicus
aatgtttcttttgccttaaatgcag

SEQ ID NO: 65833 - DNA, 25 bp, Rattus norvegicus
aatgtttgaccccagcggccaggga

SEQ ID NO: 65834 - DNA, 25 bp, Rattus norvegicus
aatgtttgacccgagcggccaggga

SEQ ID NO: 65835 - DNA, 25 bp, Rattus norvegicus
aatgtttgactgctcctgttgggtt

SEQ ID NO: 65836 - DNA, 25 bp, Rattus norvegicus
aatgtttgactggtcctgttgggtt

SEQ ID NO: 65837 - DNA, 25 bp, Rattus norvegicus
aatgtttgatgtctttgtccctttc

SEQ ID NO: 65838 - DNA, 25 bp, Rattus norvegicus
aatgtttgatgtgtttgtccctttc

SEQ ID NO: 65839 - DNA, 25 bp, Rattus norvegicus
aatgtttgcagcattgccaagcgca

SEQ ID NO: 65840 - DNA, 25 bp, Rattus norvegicus
aatgtttgcagctttgccaagcgca

SEQ ID NO: 65841 - DNA, 25 bp, Rattus norvegicus
aatgtttgccaaaaccttccaaagt

SEQ ID NO: 65842 - DNA, 25 bp, Rattus norvegicus
aatgtttgccaaattaacccctctg

SEQ ID NO: 65843 - DNA, 25 bp, Rattus norvegicus
aatgtttgccaataccttccaaagt

SEQ ID NO: 65844 - DNA, 25 bp, Rattus norvegicus
aatgtttgccaatttaacccctctg

SEQ ID NO: 65845 - DNA, 25 bp, Rattus norvegicus
aatgtttgccctaaactgtgttatg

SEQ ID NO: 65846 - DNA, 25 bp, Rattus norvegicus
aatgtttgcccttaactgtgttatg

SEQ ID NO: 65847 - DNA, 25 bp, Rattus norvegicus
aatgtttgcgagagccaggcatgct

SEQ ID NO: 65848 - DNA, 25 bp, Rattus norvegicus
aatgtttgcgagtgccaggcatgct

SEQ ID NO: 65849 - DNA, 25 bp, Rattus norvegicus
aatgtttgcgataagctttgtttta

SEQ ID NO: 65850 - DNA, 25 bp, Rattus norvegicus
aatgtttgcgattagctttgtttta

SEQ ID NO: 65851 - DNA, 25 bp, Rattus norvegicus
aatgtttggatgagtctttgctaaa

SEQ ID NO: 65852 - DNA, 25 bp, Rattus norvegicus
aatgtttggatgtgtctttgctaaa

SEQ ID NO: 65853 - DNA, 25 bp, Rattus norvegicus
aatgtttgggctcgaccctgcacat

SEQ ID NO: 65854 - DNA, 25 bp, Rattus norvegicus
aatgtttgggctggaccctgcacat

SEQ ID NO: 65855 - DNA, 25 bp, Rattus norvegicus
aatgtttgtcatacacactcggttg

SEQ ID NO: 65856 - DNA, 25 bp, Rattus norvegicus
aatgtttgtcattcacactcggttg

SEQ ID NO: 65857 - DNA, 25 bp, Rattus norvegicus
aatgtttgtctaccacttcgggcaa

SEQ ID NO: 65858 - DNA, 25 bp, Rattus norvegicus
aatgtttgtctagcacttcgggcaa

SEQ ID NO: 65859 - DNA, 25 bp, Rattus norvegicus
aatgtttgtgagctcccaagtccca

SEQ ID NO: 65860 - DNA, 25 bp, Rattus norvegicus
aatgtttgtgaggtcccaagtccca

SEQ ID NO: 65861 - DNA, 25 bp, Rattus norvegicus
aatgtttgttgtagtctccccctgc

SEQ ID NO: 65862 - DNA, 25 bp, Rattus norvegicus
aatgtttgttgttgtctccccctgc

SEQ ID NO: 65863 - DNA, 25 bp, Rattus norvegicus
aatgtttgtttaccgacccatgccc

SEQ ID NO: 65864 - DNA, 25 bp, Rattus norvegicus
aatgtttgtttagcgacccatgccc

SEQ ID NO: 65865 - DNA, 25 bp, Rattus norvegicus
aatgttttaagtacgatgccctcct

SEQ ID NO: 65866 - DNA, 25 bp, Rattus norvegicus
aatgttttaagttcgatgccctcct

SEQ ID NO: 65867 - DNA, 25 bp, Rattus norvegicus
aatgttttacttcgaatttgtcaga

SEQ ID NO: 65868 - DNA, 25 bp, Rattus norvegicus
aatgttttacttggaatttgtcaga

SEQ ID NO: 65869 - DNA, 25 bp, Rattus norvegicus
aatgttttatcgcaggctttgagct

SEQ ID NO: 65870 - DNA, 25 bp, Rattus norvegicus
aatgttttatcggaggctttgagct

SEQ ID NO: 65871 - DNA, 25 bp, Rattus norvegicus
aatgttttatgcatccttggttttg

SEQ ID NO: 65872 - DNA, 25 bp, Rattus norvegicus
aatgttttatgcttccttggttttg

SEQ ID NO: 65873 - DNA, 25 bp, Rattus norvegicus
aatgttttatttagtcctaaatgca

SEQ ID NO: 65874 - DNA, 25 bp, Rattus norvegicus
aatgttttattttgtcctaaatgca

SEQ ID NO: 65875 - DNA, 25 bp, Rattus norvegicus
aatgttttcagtactcacggaggca

SEQ ID NO: 65876 - DNA, 25 bp, Rattus norvegicus
aatgttttcagttctcacggaggca

SEQ ID NO: 65877 - DNA, 25 bp, Rattus norvegicus
aatgttttcgagcacttgatagtct

SEQ ID NO: 65878 - DNA, 25 bp, Rattus norvegicus
aatgttttcgaggacttgatagtct

SEQ ID NO: 65879 - DNA, 25 bp, Rattus norvegicus
aatgttttgaacaggcgggcactga

SEQ ID NO: 65880 - DNA, 25 bp, Rattus norvegicus
aatgttttgaactggcgggcactga

SEQ ID NO: 65881 - DNA, 25 bp, Rattus norvegicus
aatgttttgagcctccacaggacaa

SEQ ID NO: 65882 - DNA, 25 bp, Rattus norvegicus
aatgttttgagcgtccacaggacaa

SEQ ID NO: 65883 - DNA, 25 bp, Rattus norvegicus
aatgttttggcgagactgtgcctca

SEQ ID NO: 65884 - DNA, 25 bp, Rattus norvegicus
aatgttttggcgtgactgtgcctca

SEQ ID NO: 65885 - DNA, 25 bp, Rattus norvegicus
aatgttttgtctacctaccaagctt

SEQ ID NO: 65886 - DNA, 25 bp, Rattus norvegicus
aatgttttgtcttcctaccaagctt

SEQ ID NO: 65887 - DNA, 25 bp, Rattus norvegicus
aatgttttgtttagagcactgacaa

SEQ ID NO: 65888 - DNA, 25 bp, Rattus norvegicus
aatgttttgttttgagcactgacaa

SEQ ID NO: 65889 - DNA, 25 bp, Rattus norvegicus
aatgtttttaaccatatacctgcga

SEQ ID NO: 65890 - DNA, 25 bp, Rattus norvegicus
aatgtttttaacgatatacctgcga

SEQ ID NO: 65891 - DNA, 25 bp, Rattus norvegicus
aatgtttttaagacacagactgttt

SEQ ID NO: 65892 - DNA, 25 bp, Rattus norvegicus
aatgtttttaagtcacagactgttt

SEQ ID NO: 65893 - DNA, 25 bp, Rattus norvegicus
aatgtttttacaccaatgatatgaa

SEQ ID NO: 65894 - DNA, 25 bp, Rattus norvegicus
aatgtttttacagcaatgatatgaa

SEQ ID NO: 65895 - DNA, 25 bp, Rattus norvegicus
aatgtttttatgaccctctgtgtga

SEQ ID NO: 65896 - DNA, 25 bp, Rattus norvegicus
aatgtttttatgtccctctgtgtga

SEQ ID NO: 65897 - DNA, 25 bp, Rattus norvegicus
aatgtttttcgtctgttcctatatc

SEQ ID NO: 65898 - DNA, 25 bp, Rattus norvegicus
aatgtttttcgtgtgttcctatatc

SEQ ID NO: 65899 - DNA, 25 bp, Rattus norvegicus
aatgtttttctgatgtaggacttcc

SEQ ID NO: 65900 - DNA, 25 bp, Rattus norvegicus
aatgtttttctgttgtaggacttcc

SEQ ID NO: 65901 - DNA, 25 bp, Rattus norvegicus
aatgtttttcttactcaagctgcag

SEQ ID NO: 65902 - DNA, 25 bp, Rattus norvegicus
aatgtttttcttctactcttcctag

SEQ ID NO: 65903 - DNA, 25 bp, Rattus norvegicus
aatgtttttcttgtactcttcctag

SEQ ID NO: 65904 - DNA, 25 bp, Rattus norvegicus
aatgtttttctttctcaagctgcag

SEQ ID NO: 65905 - DNA, 25 bp, Rattus norvegicus
aatgtttttgttctgtagctccgtc

SEQ ID NO: 65906 - DNA, 25 bp, Rattus norvegicus
aatgtttttgttgtgtagctccgtc

SEQ ID NO: 65907 - DNA, 25 bp, Rattus norvegicus
aattaaaaccgccagatcccagaag

SEQ ID NO: 65908 - DNA, 25 bp, Rattus norvegicus
aattaaaaccgcgagatcccagaag

SEQ ID NO: 65909 - DNA, 25 bp, Rattus norvegicus
aattaaaactgcctgggccagcaag

SEQ ID NO: 65910 - DNA, 25 bp, Rattus norvegicus
aattaaaactgcgtgggccagcaag

SEQ ID NO: 65911 - DNA, 25 bp, Rattus norvegicus
aattaaaagactcccaggctcacct

SEQ ID NO: 65912 - DNA, 25 bp, Rattus norvegicus
aattaaaagactgccaggctcacct

SEQ ID NO: 65913 - DNA, 25 bp, Rattus norvegicus
aattaaaatagcacaatgtgcccag

SEQ ID NO: 65914 - DNA, 25 bp, Rattus norvegicus
aattaaaatagctcaatgtgcccag

SEQ ID NO: 65915 - DNA, 25 bp, Rattus norvegicus
aattaaaatcgcaccgttggccaca

SEQ ID NO: 65916 - DNA, 25 bp, Rattus norvegicus
aattaaaatcgctccgttggccaca

SEQ ID NO: 65917 - DNA, 25 bp, Rattus norvegicus
aattaaacctgacctcactgattag

SEQ ID NO: 65918 - DNA, 25 bp, Rattus norvegicus
aattaaacctgagctcactgattag

SEQ ID NO: 65919 - DNA, 25 bp, Rattus norvegicus
aattaaacgaagacccctggcgcag

SEQ ID NO: 65920 - DNA, 25 bp, Rattus norvegicus
aattaaacgaagtcccctggcgcag

SEQ ID NO: 65921 - DNA, 25 bp, Rattus norvegicus
aattaaagagacactcctcctcggt

SEQ ID NO: 65922 - DNA, 25 bp, Rattus norvegicus
aattaaagagactctcctcctcggt

SEQ ID NO: 65923 - DNA, 25 bp, Rattus norvegicus
aattaaaggctgagctacctctcca

SEQ ID NO: 65924 - DNA, 25 bp, Rattus norvegicus
aattaaaggctgtgctacctctcca

SEQ ID NO: 65925 - DNA, 25 bp, Rattus norvegicus
aattaaaggcttacaccatcaccac

SEQ ID NO: 65926 - DNA, 25 bp, Rattus norvegicus
aattaaaggctttcaccatcaccac

SEQ ID NO: 65927 - DNA, 25 bp, Rattus norvegicus
aattaaataactccacactcagcca

SEQ ID NO: 65928 - DNA, 25 bp, Rattus norvegicus
aattaaataactgcacactcagcca

SEQ ID NO: 65929 - DNA, 25 bp, Rattus norvegicus
aattaacagtgaccatcttccaggg

SEQ ID NO: 65930 - DNA, 25 bp, Rattus norvegicus
aattaacagtgagcatcttccaggg

SEQ ID NO: 65931 - DNA, 25 bp, Rattus norvegicus
aattaaccacgaagcaaaaacttga

SEQ ID NO: 65932 - DNA, 25 bp, Rattus norvegicus
aattaaccacgatgcaaaaacttga

SEQ ID NO: 65933 - DNA, 25 bp, Rattus norvegicus
aattaaccagctcacttaacgctca

SEQ ID NO: 65934 - DNA, 25 bp, Rattus norvegicus
aattaaccagctgacttaacgctca

SEQ ID NO: 65935 - DNA, 25 bp, Rattus norvegicus
aattaaccatggatcgtcctcgttg

SEQ ID NO: 65936 - DNA, 25 bp, Rattus norvegicus
aattaaccatggttcgtcctcgttg

SEQ ID NO: 65937 - DNA, 25 bp, Rattus norvegicus
aattaacccattacctatgctgcac

SEQ ID NO: 65938 - DNA, 25 bp, Rattus norvegicus
aattaacccatttcctatgctgcac

SEQ ID NO: 65939 - DNA, 25 bp, Rattus norvegicus
aattaacgaagcaccggcggcactg

SEQ ID NO: 65940 - DNA, 25 bp, Rattus norvegicus
aattaacgaagctccggcggcactg

SEQ ID NO: 65941 - DNA, 25 bp, Rattus norvegicus
aattaacgcgtacgcagtctacctg

SEQ ID NO: 65942 - DNA, 25 bp, Rattus norvegicus
aattaacgcgtaggcagtctacctg

SEQ ID NO: 65943 - DNA, 25 bp, Rattus norvegicus
aattaactaacaccatgtctgcccc

SEQ ID NO: 65944 - DNA, 25 bp, Rattus norvegicus
aattaactaacagcatgtctgcccc

SEQ ID NO: 65945 - DNA, 25 bp, Rattus norvegicus
aattaactcttcactcatgtgacga

SEQ ID NO: 65946 - DNA, 25 bp, Rattus norvegicus
aattaactcttctctcatgtgacga

SEQ ID NO: 65947 - DNA, 25 bp, Rattus norvegicus
aattaacttcacagtgttcctcacc

SEQ ID NO: 65948 - DNA, 25 bp, Rattus norvegicus
aattaacttcactgtgttcctcacc

SEQ ID NO: 65949 - DNA, 25 bp, Rattus norvegicus
aattaacttgtcatggatttctgcc

SEQ ID NO: 65950 - DNA, 25 bp, Rattus norvegicus
aattaacttgtcttggatttctgcc

SEQ ID NO: 65951 - DNA, 25 bp, Rattus norvegicus
aattaactttcaatcctctggaaga

SEQ ID NO: 65952 - DNA, 25 bp, Rattus norvegicus
aattaactttcattcctctggaaga

SEQ ID NO: 65953 - DNA, 25 bp, Rattus norvegicus
aattaagaagttcagctctctccca

SEQ ID NO: 65954 - DNA, 25 bp, Rattus norvegicus
aattaagaagttgagctctctccca

SEQ ID NO: 65955 - DNA, 25 bp, Rattus norvegicus
aattaagactgtacctctctgagct

SEQ ID NO: 65956 - DNA, 25 bp, Rattus norvegicus
aattaagactgttcctctctgagct

SEQ ID NO: 65957 - DNA, 25 bp, Rattus norvegicus
aattaagagtagaggctgcccttgc

SEQ ID NO: 65958 - DNA, 25 bp, Rattus norvegicus
aattaagagtagtggctgcccttgc

SEQ ID NO: 65959 - DNA, 25 bp, Rattus norvegicus
aattaagatgttcctgcctctcttc

SEQ ID NO: 65960 - DNA, 25 bp, Rattus norvegicus
aattaagatgttgctgcctctcttc

SEQ ID NO: 65961 - DNA, 25 bp, Rattus norvegicus
aattaagcaggtctcgctctccttg

SEQ ID NO: 65962 - DNA, 25 bp, Rattus norvegicus
aattaagcaggtgtcgctctccttg

SEQ ID NO: 65963 - DNA, 25 bp, Rattus norvegicus
aattaagccttcactttgtacaaat

SEQ ID NO: 65964 - DNA, 25 bp, Rattus norvegicus
aattaagccttctctttgtacaaat

SEQ ID NO: 65965 - DNA, 25 bp, Rattus norvegicus
aattaagctgaacacgcctgggaat

SEQ ID NO: 65966 - DNA, 25 bp, Rattus norvegicus
aattaagctgaagacgcctgggaat

SEQ ID NO: 65967 - DNA, 25 bp, Rattus norvegicus
aattaaggacagaacaccgcagatc

SEQ ID NO: 65968 - DNA, 25 bp, Rattus norvegicus
aattaaggacagtacaccgcagatc

SEQ ID NO: 65969 - DNA, 25 bp, Rattus norvegicus
aattaaggcagtacttgtggccagc

SEQ ID NO: 65970 - DNA, 25 bp, Rattus norvegicus
aattaaggcagttcttgtggccagc

SEQ ID NO: 65971 - DNA, 25 bp, Rattus norvegicus
aattaaggtctgaccgatgtctctc

SEQ ID NO: 65972 - DNA, 25 bp, Rattus norvegicus
aattaaggtctgtccgatgtctctc

SEQ ID NO: 65973 - DNA, 25 bp, Rattus norvegicus
aattaagtcaagcagcccctcggct

SEQ ID NO: 65974 - DNA, 25 bp, Rattus norvegicus
aattaagtcaaggagcccctcggct

SEQ ID NO: 65975 - DNA, 25 bp, Rattus norvegicus
aattaagtcacaagcttacctggac

SEQ ID NO: 65976 - DNA, 25 bp, Rattus norvegicus
aattaagtcacatgcttacctggac

SEQ ID NO: 65977 - DNA, 25 bp, Rattus norvegicus
aattaagtgggtactcctgtgccag

SEQ ID NO: 65978 - DNA, 25 bp, Rattus norvegicus
aattaagtgggttctcctgtgccag

SEQ ID NO: 65979 - DNA, 25 bp, Rattus norvegicus
aattaagtgtgtacaccccttctgt

SEQ ID NO: 65980 - DNA, 25 bp, Rattus norvegicus
aattaagtgtgttcaccccttctgt

SEQ ID NO: 65981 - DNA, 25 bp, Rattus norvegicus
aattaagttccaatgcgttggcgca

SEQ ID NO: 65982 - DNA, 25 bp, Rattus norvegicus
aattaagttccattgcgttggcgca

SEQ ID NO: 65983 - DNA, 25 bp, Rattus norvegicus
aattaatcaactccacagagcccca

SEQ ID NO: 65984 - DNA, 25 bp, Rattus norvegicus
aattaatcaactgcacagagcccca

SEQ ID NO: 65985 - DNA, 25 bp, Rattus norvegicus
aattaatccgcaacggccaagttat

SEQ ID NO: 65986 - DNA, 25 bp, Rattus norvegicus
aattaatccgcatcggccaagttat

SEQ ID NO: 65987 - DNA, 25 bp, Rattus norvegicus
aattaatcctcaaccttctgctatc

SEQ ID NO: 65988 - DNA, 25 bp, Rattus norvegicus
aattaatcctcatccttctgctatc

SEQ ID NO: 65989 - DNA, 25 bp, Rattus norvegicus
aattaatccttcaacaagtctcttg

SEQ ID NO: 65990 - DNA, 25 bp, Rattus norvegicus
aattaatccttctacaagtctcttg

SEQ ID NO: 65991 - DNA, 25 bp, Rattus norvegicus
aattaatctccaacctttttatcaa

SEQ ID NO: 65992 - DNA, 25 bp, Rattus norvegicus
aattaatctccatcctttttatcaa

SEQ ID NO: 65993 - DNA, 25 bp, Rattus norvegicus
aattaatgagacacgctcccgtgac

SEQ ID NO: 65994 - DNA, 25 bp, Rattus norvegicus
aattaatgagactcgctcccgtgac

SEQ ID NO: 65995 - DNA, 25 bp, Rattus norvegicus
aattaatggtttattctttgcaaat

SEQ ID NO: 65996 - DNA, 25 bp, Rattus norvegicus
aattaatggttttttctttgcaaat

SEQ ID NO: 65997 - DNA, 25 bp, Rattus norvegicus
aattaatgtgttcccgagttcccag

SEQ ID NO: 65998 - DNA, 25 bp, Rattus norvegicus
aattaatgtgttgccgagttcccag

SEQ ID NO: 65999 - DNA, 25 bp, Rattus norvegicus
aattaattcactagaccgcgggtgt

SEQ ID NO: 66000 - DNA, 25 bp, Rattus norvegicus
aattaattcacttgaccgcgggtgt

SEQ ID NO: 66001 - DNA, 25 bp, Rattus norvegicus
aattaattctcccactgtcttttag

SEQ ID NO: 66002 - DNA, 25 bp, Rattus norvegicus
aattaattctccgactgtcttttag

SEQ ID NO: 66003 - DNA, 25 bp, Rattus norvegicus
aattaattgataccagataccactg

SEQ ID NO: 66004 - DNA, 25 bp, Rattus norvegicus
aattaattgatagcagataccactg

SEQ ID NO: 66005 - DNA, 25 bp, Rattus norvegicus
aattaattggaaacatgccgggagt

SEQ ID NO: 66006 - DNA, 25 bp, Rattus norvegicus
aattaattggaatcatgccgggagt

SEQ ID NO: 66007 - DNA, 25 bp, Rattus norvegicus
aattaattggcccacggcatcctga

SEQ ID NO: 66008 - DNA, 25 bp, Rattus norvegicus
aattaattggccgacggcatcctga

SEQ ID NO: 66009 - DNA, 25 bp, Rattus norvegicus
aattaatttcagcactcggacgatc

SEQ ID NO: 66010 - DNA, 25 bp, Rattus norvegicus
aattaatttcaggactcggacgatc

SEQ ID NO: 66011 - DNA, 25 bp, Rattus norvegicus
aattacacaattaccagacagcatt

SEQ ID NO: 66012 - DNA, 25 bp, Rattus norvegicus
aattacacaatttccagacagcatt

SEQ ID NO: 66013 - DNA, 25 bp, Rattus norvegicus
aattacactgctcccagagaccgag

SEQ ID NO: 66014 - DNA, 25 bp, Rattus norvegicus
aattacactgctgccagagaccgag

SEQ ID NO: 66015 - DNA, 25 bp, Rattus norvegicus
aattacagaaacatcttccccatct

SEQ ID NO: 66016 - DNA, 25 bp, Rattus norvegicus
aattacagaaacttcttccccatct

SEQ ID NO: 66017 - DNA, 25 bp, Rattus norvegicus
aattacagccctctgcaagagcacg

SEQ ID NO: 66018 - DNA, 25 bp, Rattus norvegicus
aattacagccctgtgcaagagcacg

SEQ ID NO: 66019 - DNA, 25 bp, Rattus norvegicus
aattacaggctgatactctctccgg

SEQ ID NO: 66020 - DNA, 25 bp, Rattus norvegicus
aattacaggctgttactctctccgg

SEQ ID NO: 66021 - DNA, 25 bp, Rattus norvegicus
aattacagtcagaactcaacccttc

SEQ ID NO: 66022 - DNA, 25 bp, Rattus norvegicus
aattacagtcagtactcaacccttc

SEQ ID NO: 66023 - DNA, 25 bp, Rattus norvegicus
aattacatatgtaaccgctgggaat

SEQ ID NO: 66024 - DNA, 25 bp, Rattus norvegicus
aattacatatgttaccgctgggaat

SEQ ID NO: 66025 - DNA, 25 bp, Rattus norvegicus
aattacatcctaagttctcaagcgg

SEQ ID NO: 66026 - DNA, 25 bp, Rattus norvegicus
aattacatcctatgttctcaagcgg

SEQ ID NO: 66027 - DNA, 25 bp, Rattus norvegicus
aattacatctgcaaggacactggac

SEQ ID NO: 66028 - DNA, 25 bp, Rattus norvegicus
aattacatctgctaggacactggac

SEQ ID NO: 66029 - DNA, 25 bp, Rattus norvegicus
aattaccaacttcccattcataaca

SEQ ID NO: 66030 - DNA, 25 bp, Rattus norvegicus
aattaccaacttgccattcataaca

SEQ ID NO: 66031 - DNA, 25 bp, Rattus norvegicus
aattaccaagggagtcgctcagcct

SEQ ID NO: 66032 - DNA, 25 bp, Rattus norvegicus
aattaccaagggtgtcgctcagcct

SEQ ID NO: 66033 - DNA, 25 bp, Rattus norvegicus
aattaccaattcaacacattccata

SEQ ID NO: 66034 - DNA, 25 bp, Rattus norvegicus
aattaccaattctacacattccata

SEQ ID NO: 66035 - DNA, 25 bp, Rattus norvegicus
aattaccacggtacagggtggcatt

SEQ ID NO: 66036 - DNA, 25 bp, Rattus norvegicus
aattaccacggttcagggtggcatt

SEQ ID NO: 66037 - DNA, 25 bp, Rattus norvegicus
aattaccagctcatggacatccagg

SEQ ID NO: 66038 - DNA, 25 bp, Rattus norvegicus
aattaccagctcttggacatccagg

SEQ ID NO: 66039 - DNA, 25 bp, Rattus norvegicus
aattaccatgccagctttatgttta

SEQ ID NO: 66040 - DNA, 25 bp, Rattus norvegicus
aattaccatgcctgctttatgttta

SEQ ID NO: 66041 - DNA, 25 bp, Rattus norvegicus
aattacccacgtatcttggactcgt

SEQ ID NO: 66042 - DNA, 25 bp, Rattus norvegicus
aattacccacgtttcttggactcgt

SEQ ID NO: 66043 - DNA, 25 bp, Rattus norvegicus
aattacccagcaaccattatacagg

SEQ ID NO: 66044 - DNA, 25 bp, Rattus norvegicus
aattacccagcatccattatacagg

SEQ ID NO: 66045 - DNA, 25 bp, Rattus norvegicus
aattaccctctgactcgaatgaatg

SEQ ID NO: 66046 - DNA, 25 bp, Rattus norvegicus
aattaccctctgtctcgaatgaatg

SEQ ID NO: 66047 - DNA, 25 bp, Rattus norvegicus
aattaccgacgcagacgcccagaga

SEQ ID NO: 66048 - DNA, 25 bp, Rattus norvegicus
aattaccgacgctgacgcccagaga

SEQ ID NO: 66049 - DNA, 25 bp, Rattus norvegicus
aattaccgataaacacacacccata

SEQ ID NO: 66050 - DNA, 25 bp, Rattus norvegicus
aattaccgataatcacacacccata

SEQ ID NO: 66051 - DNA, 25 bp, Rattus norvegicus
aattacctcaggaatttcatgccag

SEQ ID NO: 66052 - DNA, 25 bp, Rattus norvegicus
aattacctcaggtatttcatgccag

SEQ ID NO: 66053 - DNA, 25 bp, Rattus norvegicus
aattacctcataaacgtgtttcctg

SEQ ID NO: 66054 - DNA, 25 bp, Rattus norvegicus
aattacctcatatacgtgtttcctg

SEQ ID NO: 66055 - DNA, 25 bp, Rattus norvegicus
aattacctcatcagtacaccttgta

SEQ ID NO: 66056 - DNA, 25 bp, Rattus norvegicus
aattacctcatctgtacaccttgta

SEQ ID NO: 66057 - DNA, 25 bp, Rattus norvegicus
aattacctcatgattgtgctccttg

SEQ ID NO: 66058 - DNA, 25 bp, Rattus norvegicus
aattacctcatgtttgtgctccttg

SEQ ID NO: 66059 - DNA, 25 bp, Rattus norvegicus
aattacctcccaccaattaatggaa

SEQ ID NO: 66060 - DNA, 25 bp, Rattus norvegicus
aattacctcccagcaattaatggaa

SEQ ID NO: 66061 - DNA, 25 bp, Rattus norvegicus
aattacctgcagctgagtgttggga

SEQ ID NO: 66062 - DNA, 25 bp, Rattus norvegicus
aattacctgcaggtgagtgttggga

SEQ ID NO: 66063 - DNA, 25 bp, Rattus norvegicus
aattacctgtgtcacgccgtggagc

SEQ ID NO: 66064 - DNA, 25 bp, Rattus norvegicus
aattacctgtgtgacgccgtggagc

SEQ ID NO: 66065 - DNA, 25 bp, Rattus norvegicus
aattaccttcacatcaaatgcttta

SEQ ID NO: 66066 - DNA, 25 bp, Rattus norvegicus
aattaccttcacttcaaatgcttta

SEQ ID NO: 66067 - DNA, 25 bp, Rattus norvegicus
aattaccttcataactttcctgcat

SEQ ID NO: 66068 - DNA, 25 bp, Rattus norvegicus
aattaccttcattactttcctgcat

SEQ ID NO: 66069 - DNA, 25 bp, Rattus norvegicus
aattaccttcggaactgaacgtcag

SEQ ID NO: 66070 - DNA, 25 bp, Rattus norvegicus
aattaccttcggtactgaacgtcag

SEQ ID NO: 66071 - DNA, 25 bp, Rattus norvegicus
aattaccttgtgcaagctggcaaga

SEQ ID NO: 66072 - DNA, 25 bp, Rattus norvegicus
aattaccttgtgcatatcattgtac

SEQ ID NO: 66073 - DNA, 25 bp, Rattus norvegicus
aattaccttgtggaagctggcaaga

SEQ ID NO: 66074 - DNA, 25 bp, Rattus norvegicus
aattaccttgtggatatcattgtac

SEQ ID NO: 66075 - DNA, 25 bp, Rattus norvegicus
aattacgacacacttcacatgttgg

SEQ ID NO: 66076 - DNA, 25 bp, Rattus norvegicus
aattacgacacagttcacatgttgg

SEQ ID NO: 66077 - DNA, 25 bp, Rattus norvegicus
aattacgccccgaaatgtgcagcct

SEQ ID NO: 66078 - DNA, 25 bp, Rattus norvegicus
aattacgccccgtaatgtgcagcct

SEQ ID NO: 66079 - DNA, 25 bp, Rattus norvegicus
aattacgggaagagccagcgacgtg

SEQ ID NO: 66080 - DNA, 25 bp, Rattus norvegicus
aattacgggaagtgccagcgacgtg

SEQ ID NO: 66081 - DNA, 25 bp, Rattus norvegicus
aattacgtcatgactcttttcaagg

SEQ ID NO: 66082 - DNA, 25 bp, Rattus norvegicus
aattacgtcatgtctcttttcaagg

SEQ ID NO: 66083 - DNA, 25 bp, Rattus norvegicus
aattacgttattactctctcttctc

SEQ ID NO: 66084 - DNA, 25 bp, Rattus norvegicus
aattacgttatttctctctcttctc

SEQ ID NO: 66085 - DNA, 25 bp, Rattus norvegicus
aattacgttcacaagattcctgtag

SEQ ID NO: 66086 - DNA, 25 bp, Rattus norvegicus
aattacgttcactagattcctgtag

SEQ ID NO: 66087 - DNA, 25 bp, Rattus norvegicus
aattacgttctccagttctggcatc

SEQ ID NO: 66088 - DNA, 25 bp, Rattus norvegicus
aattacgttctcgagttctggcatc

SEQ ID NO: 66089 - DNA, 25 bp, Rattus norvegicus
aattacgttcttctgacctggtggt

SEQ ID NO: 66090 - DNA, 25 bp, Rattus norvegicus
aattacgttcttgtgacctggtggt

SEQ ID NO: 66091 - DNA, 25 bp, Rattus norvegicus
aattactaacctctgtgttgtcttc

SEQ ID NO: 66092 - DNA, 25 bp, Rattus norvegicus
aattactaacctgtgtgttgtcttc

SEQ ID NO: 66093 - DNA, 25 bp, Rattus norvegicus
aattactaagagctcaggcctttct

SEQ ID NO: 66094 - DNA, 25 bp, Rattus norvegicus
aattactaagaggtcaggcctttct

SEQ ID NO: 66095 - DNA, 25 bp, Rattus norvegicus
aattactacctaatgctcttgatca

SEQ ID NO: 66096 - DNA, 25 bp, Rattus norvegicus
aattactacctattgctcttgatca

SEQ ID NO: 66097 - DNA, 25 bp, Rattus norvegicus
aattactatcatcttatgctgctgg

SEQ ID NO: 66098 - DNA, 25 bp, Rattus norvegicus
aattactatcatgttatgctgctgg

SEQ ID NO: 66099 - DNA, 25 bp, Rattus norvegicus
aattactatgtcctgtatgcctccg

SEQ ID NO: 66100 - DNA, 25 bp, Rattus norvegicus
aattactatgtcgtgtatgcctccg

SEQ ID NO: 66101 - DNA, 25 bp, Rattus norvegicus
aattactcacccaagatcatttacc

SEQ ID NO: 66102 - DNA, 25 bp, Rattus norvegicus
aattactcacccatgcaaaagcctt

SEQ ID NO: 66103 - DNA, 25 bp, Rattus norvegicus
aattactcaccctagatcatttacc

SEQ ID NO: 66104 - DNA, 25 bp, Rattus norvegicus
aattactcacccttgcaaaagcctt

SEQ ID NO: 66105 - DNA, 25 bp, Rattus norvegicus
aattactcagctctcatgtttttca

SEQ ID NO: 66106 - DNA, 25 bp, Rattus norvegicus
aattactcagctgtcatgtttttca

SEQ ID NO: 66107 - DNA, 25 bp, Rattus norvegicus
aattactcatcaacgcgaagcaagg

SEQ ID NO: 66108 - DNA, 25 bp, Rattus norvegicus
aattactcatcatcgcgaagcaagg

SEQ ID NO: 66109 - DNA, 25 bp, Rattus norvegicus
aattactccaagcaacttttccgct

SEQ ID NO: 66110 - DNA, 25 bp, Rattus norvegicus
aattactccaaggaacttttccgct

SEQ ID NO: 66111 - DNA, 25 bp, Rattus norvegicus
aattactcccatatttgcctggagg

SEQ ID NO: 66112 - DNA, 25 bp, Rattus norvegicus
aattactcccatttttgcctggagg

SEQ ID NO: 66113 - DNA, 25 bp, Rattus norvegicus
aattactctgttatcttgtttgtgt

SEQ ID NO: 66114 - DNA, 25 bp, Rattus norvegicus
aattactctgttttcttgtttgtgt

SEQ ID NO: 66115 - DNA, 25 bp, Rattus norvegicus
aattactcttttctccatgttgatg

SEQ ID NO: 66116 - DNA, 25 bp, Rattus norvegicus
aattactcttttgtccatgttgatg

SEQ ID NO: 66117 - DNA, 25 bp, Rattus norvegicus
aattactgagtcacgcctcagggca

SEQ ID NO: 66118 - DNA, 25 bp, Rattus norvegicus
aattactgagtctcgcctcagggca

SEQ ID NO: 66119 - DNA, 25 bp, Rattus norvegicus
aattactgatgccttgcgggacctc

SEQ ID NO: 66120 - DNA, 25 bp, Rattus norvegicus
aattactgatgcgttgcgggacctc

SEQ ID NO: 66121 - DNA, 25 bp, Rattus norvegicus
aattactgatgtagacgtgtcccca

SEQ ID NO: 66122 - DNA, 25 bp, Rattus norvegicus
aattactgatgttgacgtgtcccca

SEQ ID NO: 66123 - DNA, 25 bp, Rattus norvegicus
aattactgcctgagttgctctgtat

SEQ ID NO: 66124 - DNA, 25 bp, Rattus norvegicus
aattactgcctgtgttgctctgtat

SEQ ID NO: 66125 - DNA, 25 bp, Rattus norvegicus
aattactgctctctaaccctcagtc

SEQ ID NO: 66126 - DNA, 25 bp, Rattus norvegicus
aattactgctctgtaaccctcagtc

SEQ ID NO: 66127 - DNA, 25 bp, Rattus norvegicus
aattactgggtgactcagctgcact

SEQ ID NO: 66128 - DNA, 25 bp, Rattus norvegicus
aattactgggtgtctcagctgcact

SEQ ID NO: 66129 - DNA, 25 bp, Rattus norvegicus
aattactgtaccaagtctcttctgt

SEQ ID NO: 66130 - DNA, 25 bp, Rattus norvegicus
aattactgtacctagtctcttctgt

SEQ ID NO: 66131 - DNA, 25 bp, Rattus norvegicus
aattactgtcttcgcagggttttag

SEQ ID NO: 66132 - DNA, 25 bp, Rattus norvegicus
aattactgtcttggcagggttttag

SEQ ID NO: 66133 - DNA, 25 bp, Rattus norvegicus
aattactgtgtaatcatccctgata

SEQ ID NO: 66134 - DNA, 25 bp, Rattus norvegicus
aattactgtgtattcatccctgata

SEQ ID NO: 66135 - DNA, 25 bp, Rattus norvegicus
aattactgtgtcctacctttgtatc

SEQ ID NO: 66136 - DNA, 25 bp, Rattus norvegicus
aattactgtgtcgtacctttgtatc

SEQ ID NO: 66137 - DNA, 25 bp, Rattus norvegicus
aattactgttccaaggctctgtggt

SEQ ID NO: 66138 - DNA, 25 bp, Rattus norvegicus
aattactgttcctaggctctgtggt

SEQ ID NO: 66139 - DNA, 25 bp, Rattus norvegicus
aattactgtttactgcttctgcggc

SEQ ID NO: 66140 - DNA, 25 bp, Rattus norvegicus
aattactgtttagtgcttctgcggc

SEQ ID NO: 66141 - DNA, 25 bp, Rattus norvegicus
aattactgtttgctgcaattcattc

SEQ ID NO: 66142 - DNA, 25 bp, Rattus norvegicus
aattactgtttggtgcaattcattc

SEQ ID NO: 66143 - DNA, 25 bp, Rattus norvegicus
aattacttaccccagtgaatgcagt

SEQ ID NO: 66144 - DNA, 25 bp, Rattus norvegicus
aattacttacccgagtgaatgcagt

SEQ ID NO: 66145 - DNA, 25 bp, Rattus norvegicus
aattacttcattaaggtggatgtag

SEQ ID NO: 66146 - DNA, 25 bp, Rattus norvegicus
aattacttcatttaggtggatgtag

SEQ ID NO: 66147 - DNA, 25 bp, Rattus norvegicus
aattacttccatcaaatcagactgt

SEQ ID NO: 66148 - DNA, 25 bp, Rattus norvegicus
aattacttccatgaaatcagactgt

SEQ ID NO: 66149 - DNA, 25 bp, Rattus norvegicus
aattacttctgcagtagatcagtgg

SEQ ID NO: 66150 - DNA, 25 bp, Rattus norvegicus
aattacttctgctgtagatcagtgg

SEQ ID NO: 66151 - DNA, 25 bp, Rattus norvegicus
aattacttgaatcatggccacttaa

SEQ ID NO: 66152 - DNA, 25 bp, Rattus norvegicus
aattacttgaatgatggccacttaa

SEQ ID NO: 66153 - DNA, 25 bp, Rattus norvegicus
aattacttgcgtcagttcttcctac

SEQ ID NO: 66154 - DNA, 25 bp, Rattus norvegicus
aattacttgcgtgagttcttcctac

SEQ ID NO: 66155 - DNA, 25 bp, Rattus norvegicus
aattacttgtagctccctgaacgct

SEQ ID NO: 66156 - DNA, 25 bp, Rattus norvegicus
aattacttgtaggtccctgaacgct

SEQ ID NO: 66157 - DNA, 25 bp, Rattus norvegicus
aattacttgtggcttggatccagta

SEQ ID NO: 66158 - DNA, 25 bp, Rattus norvegicus
aattacttgtgggttggatccagta

SEQ ID NO: 66159 - DNA, 25 bp, Rattus norvegicus
aattactttaacacaatgggtgctt

SEQ ID NO: 66160 - DNA, 25 bp, Rattus norvegicus
aattactttaactcaatgggtgctt

SEQ ID NO: 66161 - DNA, 25 bp, Rattus norvegicus
aattagaaaactcctcttgtctact

SEQ ID NO: 66162 - DNA, 25 bp, Rattus norvegicus
aattagaaaactgctcttgtctact

SEQ ID NO: 66163 - DNA, 25 bp, Rattus norvegicus
aattagaaagtaccgagcagccccg

SEQ ID NO: 66164 - DNA, 25 bp, Rattus norvegicus
aattagaaagtagcgagcagccccg

SEQ ID NO: 66165 - DNA, 25 bp, Rattus norvegicus
aattagaacaacaggcctcaatggg

SEQ ID NO: 66166 - DNA, 25 bp, Rattus norvegicus
aattagaacaactggcctcaatggg

SEQ ID NO: 66167 - DNA, 25 bp, Rattus norvegicus
aattagaattagattccctccagga

SEQ ID NO: 66168 - DNA, 25 bp, Rattus norvegicus
aattagaattagtttccctccagga

SEQ ID NO: 66169 - DNA, 25 bp, Rattus norvegicus
aattagacaggtaagccagtgtagc

SEQ ID NO: 66170 - DNA, 25 bp, Rattus norvegicus
aattagacaggttagccagtgtagc

SEQ ID NO: 66171 - DNA, 25 bp, Rattus norvegicus
aattagactcagcaatgccgtcgtc

SEQ ID NO: 66172 - DNA, 25 bp, Rattus norvegicus
aattagactcaggaatgccgtcgtc

SEQ ID NO: 66173 - DNA, 25 bp, Rattus norvegicus
aattagactgtaaccctgacacctt

SEQ ID NO: 66174 - DNA, 25 bp, Rattus norvegicus
aattagactgtatccctgacacctt

SEQ ID NO: 66175 - DNA, 25 bp, Rattus norvegicus
aattagagtgggaaattgcccgcgt

SEQ ID NO: 66176 - DNA, 25 bp, Rattus norvegicus
aattagagtgggtaattgcccgcgt

SEQ ID NO: 66177 - DNA, 25 bp, Rattus norvegicus
aattagatacctctgtgtgccagct

SEQ ID NO: 66178 - DNA, 25 bp, Rattus norvegicus
aattagatacctgtgtgtgccagct

SEQ ID NO: 66179 - DNA, 25 bp, Rattus norvegicus
aattagatgccccacacaatgtctt

SEQ ID NO: 66180 - DNA, 25 bp, Rattus norvegicus
aattagatgcccgacacaatgtctt

SEQ ID NO: 66181 - DNA, 25 bp, Rattus norvegicus
aattagatgtgcctgccatggtgtt

SEQ ID NO: 66182 - DNA, 25 bp, Rattus norvegicus
aattagatgtgcgtgccatggtgtt

SEQ ID NO: 66183 - DNA, 25 bp, Rattus norvegicus
aattagcacctactttcagcaataa

SEQ ID NO: 66184 - DNA, 25 bp, Rattus norvegicus
aattagcacctagtttcagcaataa

SEQ ID NO: 66185 - DNA, 25 bp, Rattus norvegicus
aattagcactaaactggcactttat

SEQ ID NO: 66186 - DNA, 25 bp, Rattus norvegicus
aattagcactaatctggcactttat

SEQ ID NO: 66187 - DNA, 25 bp, Rattus norvegicus
aattagcccaagatccatggacctc

SEQ ID NO: 66188 - DNA, 25 bp, Rattus norvegicus
aattagcccaagctggctggccaga

SEQ ID NO: 66189 - DNA, 25 bp, Rattus norvegicus
aattagcccaaggtggctggccaga

SEQ ID NO: 66190 - DNA, 25 bp, Rattus norvegicus
aattagcccaagttccatggacctc

SEQ ID NO: 66191 - DNA, 25 bp, Rattus norvegicus
aattagcctagtacatccaatcctc

SEQ ID NO: 66192 - DNA, 25 bp, Rattus norvegicus
aattagcctagttcatccaatcctc

SEQ ID NO: 66193 - DNA, 25 bp, Rattus norvegicus
aattagcctggactgagccttattt

SEQ ID NO: 66194 - DNA, 25 bp, Rattus norvegicus
aattagcctggagtgagccttattt

SEQ ID NO: 66195 - DNA, 25 bp, Rattus norvegicus
aattagcctgggaagtgtagtgaga

SEQ ID NO: 66196 - DNA, 25 bp, Rattus norvegicus
aattagcctgggtagtgtagtgaga

SEQ ID NO: 66197 - DNA, 25 bp, Rattus norvegicus
aattagcctgtaattctctcaagag

SEQ ID NO: 66198 - DNA, 25 bp, Rattus norvegicus
aattagcctgtatttctctcaagag

SEQ ID NO: 66199 - DNA, 25 bp, Rattus norvegicus
aattagccttgtcaaatgtgatgca

SEQ ID NO: 66200 - DNA, 25 bp, Rattus norvegicus
aattagccttgtgaaatgtgatgca

SEQ ID NO: 66201 - DNA, 25 bp, Rattus norvegicus
aattagcgttagctctcagatgtga

SEQ ID NO: 66202 - DNA, 25 bp, Rattus norvegicus
aattagcgttaggtctcagatgtga

SEQ ID NO: 66203 - DNA, 25 bp, Rattus norvegicus
aattagctgtaactccaaggcccac

SEQ ID NO: 66204 - DNA, 25 bp, Rattus norvegicus
aattagctgtaagtccaaggcccac

SEQ ID NO: 66205 - DNA, 25 bp, Rattus norvegicus
aattagcttctaatgttcccgggct

SEQ ID NO: 66206 - DNA, 25 bp, Rattus norvegicus
aattagcttctattgttcccgggct

SEQ ID NO: 66207 - DNA, 25 bp, Rattus norvegicus
aattagctttggctcctcttggctg

SEQ ID NO: 66208 - DNA, 25 bp, Rattus norvegicus
aattagctttgggtcctcttggctg

SEQ ID NO: 66209 - DNA, 25 bp, Rattus norvegicus
aattaggagaagacgcagaatcgga

SEQ ID NO: 66210 - DNA, 25 bp, Rattus norvegicus
aattaggagaagtcgcagaatcgga

SEQ ID NO: 66211 - DNA, 25 bp, Rattus norvegicus
aattaggagaatccctgtcgccgag

SEQ ID NO: 66212 - DNA, 25 bp, Rattus norvegicus
aattaggagaatgcctgtcgccgag

SEQ ID NO: 66213 - DNA, 25 bp, Rattus norvegicus
aattaggagcatctgctgttcttcc

SEQ ID NO: 66214 - DNA, 25 bp, Rattus norvegicus
aattaggagcatgtgctgttcttcc

SEQ ID NO: 66215 - DNA, 25 bp, Rattus norvegicus
aattaggatcatcctgttagtcaca

SEQ ID NO: 66216 - DNA, 25 bp, Rattus norvegicus
aattaggatcatgctgttagtcaca

SEQ ID NO: 66217 - DNA, 25 bp, Rattus norvegicus
aattaggatgagagctgtcagtgag

SEQ ID NO: 66218 - DNA, 25 bp, Rattus norvegicus
aattaggatgagtgctgtcagtgag

SEQ ID NO: 66219 - DNA, 25 bp, Rattus norvegicus
aattaggcaagaagtcaccaggcta

SEQ ID NO: 66220 - DNA, 25 bp, Rattus norvegicus
aattaggcaagatgtcaccaggcta

SEQ ID NO: 66221 - DNA, 25 bp, Rattus norvegicus
aattaggcccagagattttattcca

SEQ ID NO: 66222 - DNA, 25 bp, Rattus norvegicus
aattaggcccagtgattttattcca

SEQ ID NO: 66223 - DNA, 25 bp, Rattus norvegicus
aattaggccctaacacattttacag

SEQ ID NO: 66224 - DNA, 25 bp, Rattus norvegicus
aattaggccctatcacattttacag

SEQ ID NO: 66225 - DNA, 25 bp, Rattus norvegicus
aattaggctactcctgattgcccca

SEQ ID NO: 66226 - DNA, 25 bp, Rattus norvegicus
aattaggctactgctgattgcccca

SEQ ID NO: 66227 - DNA, 25 bp, Rattus norvegicus
aattaggctgatatctgtcccactg

SEQ ID NO: 66228 - DNA, 25 bp, Rattus norvegicus
aattaggctgatttctgtcccactg

SEQ ID NO: 66229 - DNA, 25 bp, Rattus norvegicus
aattaggcttccatacacgggcaga

SEQ ID NO: 66230 - DNA, 25 bp, Rattus norvegicus
aattaggcttccttacacgggcaga

SEQ ID NO: 66231 - DNA, 25 bp, Rattus norvegicus
aattagggctaaaatcacttgggcg

SEQ ID NO: 66232 - DNA, 25 bp, Rattus norvegicus
aattagggctaatatcacttgggcg

SEQ ID NO: 66233 - DNA, 25 bp, Rattus norvegicus
aattagggctgcatgacacctggca

SEQ ID NO: 66234 - DNA, 25 bp, Rattus norvegicus
aattagggctgcttgacacctggca

SEQ ID NO: 66235 - DNA, 25 bp, Rattus norvegicus
aattagggtcttatctgcttttcag

SEQ ID NO: 66236 - DNA, 25 bp, Rattus norvegicus
aattagggtcttttctgcttttcag

SEQ ID NO: 66237 - DNA, 25 bp, Rattus norvegicus
aattaggtagatattgcgccctctt

SEQ ID NO: 66238 - DNA, 25 bp, Rattus norvegicus
aattaggtagattttgcgccctctt

SEQ ID NO: 66239 - DNA, 25 bp, Rattus norvegicus
aattaggtccacagtactcaattgg

SEQ ID NO: 66240 - DNA, 25 bp, Rattus norvegicus
aattaggtccactgtactcaattgg

SEQ ID NO: 66241 - DNA, 25 bp, Rattus norvegicus
aattaggtccgtagttgctctgaaa

SEQ ID NO: 66242 - DNA, 25 bp, Rattus norvegicus
aattaggtccgttgttgctctgaaa

SEQ ID NO: 66243 - DNA, 25 bp, Rattus norvegicus
aattaggttgtcatgcctctactac

SEQ ID NO: 66244 - DNA, 25 bp, Rattus norvegicus
aattaggttgtcttgcctctactac

SEQ ID NO: 66245 - DNA, 25 bp, Rattus norvegicus
aattagtacgctacctacataaggt

SEQ ID NO: 66246 - DNA, 25 bp, Rattus norvegicus
aattagtacgcttcctacataaggt

SEQ ID NO: 66247 - DNA, 25 bp, Rattus norvegicus
aattagtatttcattggctgtttga

SEQ ID NO: 66248 - DNA, 25 bp, Rattus norvegicus
aattagtatttctttggctgtttga

SEQ ID NO: 66249 - DNA, 25 bp, Rattus norvegicus
aattagtcatgtcctctttgggata

SEQ ID NO: 66250 - DNA, 25 bp, Rattus norvegicus
aattagtcatgtgctctttgggata

SEQ ID NO: 66251 - DNA, 25 bp, Rattus norvegicus
aattagtccacgataccaagccatg

SEQ ID NO: 66252 - DNA, 25 bp, Rattus norvegicus
aattagtccacgttaccaagccatg

SEQ ID NO: 66253 - DNA, 25 bp, Rattus norvegicus
aattagtctgcactggaaccaggcc

SEQ ID NO: 66254 - DNA, 25 bp, Rattus norvegicus
aattagtctgcagtggaaccaggcc

SEQ ID NO: 66255 - DNA, 25 bp, Rattus norvegicus
aattagtctggaaggcctgctggtt

SEQ ID NO: 66256 - DNA, 25 bp, Rattus norvegicus
aattagtctggatggcctgctggtt

SEQ ID NO: 66257 - DNA, 25 bp, Rattus norvegicus
aattagtctgtgagctgtgtcttgc

SEQ ID NO: 66258 - DNA, 25 bp, Rattus norvegicus
aattagtctgtgtgctgtgtcttgc

SEQ ID NO: 66259 - DNA, 25 bp, Rattus norvegicus
aattagtgactgctcctgtagcttg

SEQ ID NO: 66260 - DNA, 25 bp, Rattus norvegicus
aattagtgactggtcctgtagcttg

SEQ ID NO: 66261 - DNA, 25 bp, Rattus norvegicus
aattagtggaatcggtctccctggc

SEQ ID NO: 66262 - DNA, 25 bp, Rattus norvegicus
aattagtggaatgggtctccctggc

SEQ ID NO: 66263 - DNA, 25 bp, Rattus norvegicus
aattagtgtaatccggactcttgcc

SEQ ID NO: 66264 - DNA, 25 bp, Rattus norvegicus
aattagtgtaatgcggactcttgcc

SEQ ID NO: 66265 - DNA, 25 bp, Rattus norvegicus
aattagttacatactgatctaggaa

SEQ ID NO: 66266 - DNA, 25 bp, Rattus norvegicus
aattagttacattctgatctaggaa

SEQ ID NO: 66267 - DNA, 25 bp, Rattus norvegicus
aattagttctccacgatgctggcaa

SEQ ID NO: 66268 - DNA, 25 bp, Rattus norvegicus
aattagttctcctcgatgctggcaa

SEQ ID NO: 66269 - DNA, 25 bp, Rattus norvegicus
aattagttctctcttaccatgtggg

SEQ ID NO: 66270 - DNA, 25 bp, Rattus norvegicus
aattagttctctgttaccatgtggg

SEQ ID NO: 66271 - DNA, 25 bp, Rattus norvegicus
aattagttgttcctcaggacgccat

SEQ ID NO: 66272 - DNA, 25 bp, Rattus norvegicus
aattagttgttcgtcaggacgccat

SEQ ID NO: 66273 - DNA, 25 bp, Rattus norvegicus
aattataatgtcctctttcctgatt

SEQ ID NO: 66274 - DNA, 25 bp, Rattus norvegicus
aattataatgtcgtctttcctgatt

SEQ ID NO: 66275 - DNA, 25 bp, Rattus norvegicus
aattatacccacatgtcttgactct

SEQ ID NO: 66276 - DNA, 25 bp, Rattus norvegicus
aattatacccacttgtcttgactct

SEQ ID NO: 66277 - DNA, 25 bp, Rattus norvegicus
aattatactaccctgtctgtcctat

SEQ ID NO: 66278 - DNA, 25 bp, Rattus norvegicus
aattatactaccgtgtctgtcctat

SEQ ID NO: 66279 - DNA, 25 bp, Rattus norvegicus
aattatactctgaacctggctttcc

SEQ ID NO: 66280 - DNA, 25 bp, Rattus norvegicus
aattatactctgtacctggctttcc

SEQ ID NO: 66281 - DNA, 25 bp, Rattus norvegicus
aattatactgaaaccacccagaccg

SEQ ID NO: 66282 - DNA, 25 bp, Rattus norvegicus
aattatactgaatccacccagaccg

SEQ ID NO: 66283 - DNA, 25 bp, Rattus norvegicus
aattatagacaaccttcaatatttg

SEQ ID NO: 66284 - DNA, 25 bp, Rattus norvegicus
aattatagacaagcttcaatatttg

SEQ ID NO: 66285 - DNA, 25 bp, Rattus norvegicus
aattatagtaacaccggcctggtgc

SEQ ID NO: 66286 - DNA, 25 bp, Rattus norvegicus
aattatagtaactccggcctggtgc

SEQ ID NO: 66287 - DNA, 25 bp, Rattus norvegicus
aattatagtcttacttcaatatgtg

SEQ ID NO: 66288 - DNA, 25 bp, Rattus norvegicus
aattatagtctttcttcaatatgtg

SEQ ID NO: 66289 - DNA, 25 bp, Rattus norvegicus
aattatatctctctccattctcatt

SEQ ID NO: 66290 - DNA, 25 bp, Rattus norvegicus
aattatatctctgtccattctcatt

SEQ ID NO: 66291 - DNA, 25 bp, Rattus norvegicus
aattatattctcatgagtgggtcat

SEQ ID NO: 66292 - DNA, 25 bp, Rattus norvegicus
aattatattctcttgagtgggtcat

SEQ ID NO: 66293 - DNA, 25 bp, Rattus norvegicus
aattatattgtcatgctgagctcca

SEQ ID NO: 66294 - DNA, 25 bp, Rattus norvegicus
aattatattgtcttgctgagctcca

SEQ ID NO: 66295 - DNA, 25 bp, Rattus norvegicus
aattatcaacataactgtgctcaca

SEQ ID NO: 66296 - DNA, 25 bp, Rattus norvegicus
aattatcaacattactgtgctcaca

SEQ ID NO: 66297 - DNA, 25 bp, Rattus norvegicus
aattatcatctacagtgctttggag

SEQ ID NO: 66298 - DNA, 25 bp, Rattus norvegicus
aattatcatctagagtgctttggag

SEQ ID NO: 66299 - DNA, 25 bp, Rattus norvegicus
aattatccaagacttcatccctctc

SEQ ID NO: 66300 - DNA, 25 bp, Rattus norvegicus
aattatccaagagttcatccctctc

SEQ ID NO: 66301 - DNA, 25 bp, Rattus norvegicus
aattatccctgaccttatttagtgc

SEQ ID NO: 66302 - DNA, 25 bp, Rattus norvegicus
aattatccctgagcttatttagtgc

SEQ ID NO: 66303 - DNA, 25 bp, Rattus norvegicus
aattatcgtagcaatcttgctgtca

SEQ ID NO: 66304 - DNA, 25 bp, Rattus norvegicus
aattatcgtagctatcttgctgtca

SEQ ID NO: 66305 - DNA, 25 bp, Rattus norvegicus
aattatctagacagatctccctctg

SEQ ID NO: 66306 - DNA, 25 bp, Rattus norvegicus
aattatctagactgatctccctctg

SEQ ID NO: 66307 - DNA, 25 bp, Rattus norvegicus
aattatctgaaaactctacactata

SEQ ID NO: 66308 - DNA, 25 bp, Rattus norvegicus
aattatctgaaatctctacactata

SEQ ID NO: 66309 - DNA, 25 bp, Rattus norvegicus
aattatctgcttctgtgactcagtg

SEQ ID NO: 66310 - DNA, 25 bp, Rattus norvegicus
aattatctgcttgtgtgactcagtg

SEQ ID NO: 66311 - DNA, 25 bp, Rattus norvegicus
aattatctggatatttctcacatag

SEQ ID NO: 66312 - DNA, 25 bp, Rattus norvegicus
aattatctggatttttctcacatag

SEQ ID NO: 66313 - DNA, 25 bp, Rattus norvegicus
aattatctggccatgacggtatttg

SEQ ID NO: 66314 - DNA, 25 bp, Rattus norvegicus
aattatctggccttgacggtatttg

SEQ ID NO: 66315 - DNA, 25 bp, Rattus norvegicus
aattatctgttcaatggaccaaatg

SEQ ID NO: 66316 - DNA, 25 bp, Rattus norvegicus
aattatctgttctatggaccaaatg

SEQ ID NO: 66317 - DNA, 25 bp, Rattus norvegicus
aattatcttccaaatgttcagctga

SEQ ID NO: 66318 - DNA, 25 bp, Rattus norvegicus
aattatcttccatatgttcagctga

SEQ ID NO: 66319 - DNA, 25 bp, Rattus norvegicus
aattatctttgtccccgaggatcaa

SEQ ID NO: 66320 - DNA, 25 bp, Rattus norvegicus
aattatctttgtgcccgaggatcaa

SEQ ID NO: 66321 - DNA, 25 bp, Rattus norvegicus
aattatgaacagcacgaagactcag

SEQ ID NO: 66322 - DNA, 25 bp, Rattus norvegicus
aattatgaacaggacgaagactcag

SEQ ID NO: 66323 - DNA, 25 bp, Rattus norvegicus
aattatgacaccacactaggccaca

SEQ ID NO: 66324 - DNA, 25 bp, Rattus norvegicus
aattatgacacctcactaggccaca

SEQ ID NO: 66325 - DNA, 25 bp, Rattus norvegicus
aattatgacattattcctgggatga

SEQ ID NO: 66326 - DNA, 25 bp, Rattus norvegicus
aattatgacatttttcctgggatga

SEQ ID NO: 66327 - DNA, 25 bp, Rattus norvegicus
aattatgactgcaatgggaaaccca

SEQ ID NO: 66328 - DNA, 25 bp, Rattus norvegicus
aattatgactgctatgggaaaccca

SEQ ID NO: 66329 - DNA, 25 bp, Rattus norvegicus
aattatgagtacctgatccgcctct

SEQ ID NO: 66330 - DNA, 25 bp, Rattus norvegicus
aattatgagtacgtgatccgcctct

SEQ ID NO: 66331 - DNA, 25 bp, Rattus norvegicus
aattatgcaagtactatccctgtga

SEQ ID NO: 66332 - DNA, 25 bp, Rattus norvegicus
aattatgcaagttctatccctgtga

SEQ ID NO: 66333 - DNA, 25 bp, Rattus norvegicus
aattatgcattgaactactctttgg

SEQ ID NO: 66334 - DNA, 25 bp, Rattus norvegicus
aattatgcattgtactactctttgg

SEQ ID NO: 66335 - DNA, 25 bp, Rattus norvegicus
aattatgctagcctacgctgtatca

SEQ ID NO: 66336 - DNA, 25 bp, Rattus norvegicus
aattatgctagcgtacgctgtatca

SEQ ID NO: 66337 - DNA, 25 bp, Rattus norvegicus
aattatgctggtcacaatggtggtt

SEQ ID NO: 66338 - DNA, 25 bp, Rattus norvegicus
aattatgctggtgacaatggtggtt

SEQ ID NO: 66339 - DNA, 25 bp, Rattus norvegicus
aattatgcttagagtgcctggcctg

SEQ ID NO: 66340 - DNA, 25 bp, Rattus norvegicus
aattatgcttagtgtgcctggcctg

SEQ ID NO: 66341 - DNA, 25 bp, Rattus norvegicus
aattatggacgcaactcctcagaaa

SEQ ID NO: 66342 - DNA, 25 bp, Rattus norvegicus
aattatggacgctactcctcagaaa

SEQ ID NO: 66343 - DNA, 25 bp, Rattus norvegicus
aattatggctgactgtccatttccc

SEQ ID NO: 66344 - DNA, 25 bp, Rattus norvegicus
aattatggctgagtgtccatttccc

SEQ ID NO: 66345 - DNA, 25 bp, Rattus norvegicus
aattatggcttgagtgaaacggatt

SEQ ID NO: 66346 - DNA, 25 bp, Rattus norvegicus
aattatggcttgtgtgaaacggatt

SEQ ID NO: 66347 - DNA, 25 bp, Rattus norvegicus
aattatggctttcgagtctcccagg

SEQ ID NO: 66348 - DNA, 25 bp, Rattus norvegicus
aattatggctttggagtctcccagg

SEQ ID NO: 66349 - DNA, 25 bp, Rattus norvegicus
aattatggtcccaggagctcctaga

SEQ ID NO: 66350 - DNA, 25 bp, Rattus norvegicus
aattatggtccctggagctcctaga

SEQ ID NO: 66351 - DNA, 25 bp, Rattus norvegicus
aattatgtaattacccaactgctgg

SEQ ID NO: 66352 - DNA, 25 bp, Rattus norvegicus
aattatgtaatttcccaactgctgg

SEQ ID NO: 66353 - DNA, 25 bp, Rattus norvegicus
aattatgtcccaaacctgcgataga

SEQ ID NO: 66354 - DNA, 25 bp, Rattus norvegicus
aattatgtcccatacctgcgataga

SEQ ID NO: 66355 - DNA, 25 bp, Rattus norvegicus
aattatgtccccaaacagttccttg

SEQ ID NO: 66356 - DNA, 25 bp, Rattus norvegicus
aattatgtcccctaacagttccttg

SEQ ID NO: 66357 - DNA, 25 bp, Rattus norvegicus
aattatgtcttacctctttactggc

SEQ ID NO: 66358 - DNA, 25 bp, Rattus norvegicus
aattatgtcttagctctttactggc

SEQ ID NO: 66359 - DNA, 25 bp, Rattus norvegicus
aattatgtgcagctgactgtctcag

SEQ ID NO: 66360 - DNA, 25 bp, Rattus norvegicus
aattatgtgcaggtgactgtctcag

SEQ ID NO: 66361 - DNA, 25 bp, Rattus norvegicus
aattatgttaaacttgtgccttcac

SEQ ID NO: 66362 - DNA, 25 bp, Rattus norvegicus
aattatgttaaagttgtgccttcac

SEQ ID NO: 66363 - DNA, 25 bp, Rattus norvegicus
aattatgttcagatttgtgcctgaa

SEQ ID NO: 66364 - DNA, 25 bp, Rattus norvegicus
aattatgttcagttttgtgcctgaa

SEQ ID NO: 66365 - DNA, 25 bp, Rattus norvegicus
aattatgttcccagtctttgcaagt

SEQ ID NO: 66366 - DNA, 25 bp, Rattus norvegicus
aattatgttccctgtctttgcaagt

SEQ ID NO: 66367 - DNA, 25 bp, Rattus norvegicus
aattattaaaaaaccatctgctaag

SEQ ID NO: 66368 - DNA, 25 bp, Rattus norvegicus
aattattaaaaatccatctgctaag

SEQ ID NO: 66369 - DNA, 25 bp, Rattus norvegicus
aattattaaaggatgctcctgccct

SEQ ID NO: 66370 - DNA, 25 bp, Rattus norvegicus
aattattaaaggttgctcctgccct

SEQ ID NO: 66371 - DNA, 25 bp, Rattus norvegicus
aattattaataactcttgggctggg

SEQ ID NO: 66372 - DNA, 25 bp, Rattus norvegicus
aattattaataagtcttgggctggg

SEQ ID NO: 66373 - DNA, 25 bp, Rattus norvegicus
aattattatttcatcagtgcattta

SEQ ID NO: 66374 - DNA, 25 bp, Rattus norvegicus
aattattatttcttcagtgcattta

SEQ ID NO: 66375 - DNA, 25 bp, Rattus norvegicus
aattattccaaacgccaatccaagg

SEQ ID NO: 66376 - DNA, 25 bp, Rattus norvegicus
aattattccaaaggccaatccaagg

SEQ ID NO: 66377 - DNA, 25 bp, Rattus norvegicus
aattattccctcaaggtctcctttg

SEQ ID NO: 66378 - DNA, 25 bp, Rattus norvegicus
aattattccctctaggtctcctttg

SEQ ID NO: 66379 - DNA, 25 bp, Rattus norvegicus
aattattcccttcattttgctcctg

SEQ ID NO: 66380 - DNA, 25 bp, Rattus norvegicus
aattattcccttgattttgctcctg

SEQ ID NO: 66381 - DNA, 25 bp, Rattus norvegicus
aattattcctatatagtctcagtct

SEQ ID NO: 66382 - DNA, 25 bp, Rattus norvegicus
aattattcctatttagtctcagtct

SEQ ID NO: 66383 - DNA, 25 bp, Rattus norvegicus
aattattctaaacacctgctctcct

SEQ ID NO: 66384 - DNA, 25 bp, Rattus norvegicus
aattattctaaagacctgctctcct

SEQ ID NO: 66385 - DNA, 25 bp, Rattus norvegicus
aattattctccaaccaaaatcctcc

SEQ ID NO: 66386 - DNA, 25 bp, Rattus norvegicus
aattattctccatccaaaatcctcc

SEQ ID NO: 66387 - DNA, 25 bp, Rattus norvegicus
aattattgaggcacccatttctaaa

SEQ ID NO: 66388 - DNA, 25 bp, Rattus norvegicus
aattattgaggctcccatttctaaa

SEQ ID NO: 66389 - DNA, 25 bp, Rattus norvegicus
aattattgctccaagatttgttagc

SEQ ID NO: 66390 - DNA, 25 bp, Rattus norvegicus
aattattgctcctagatttgttagc

SEQ ID NO: 66391 - DNA, 25 bp, Rattus norvegicus
aattattggcccagatcctttggta

SEQ ID NO: 66392 - DNA, 25 bp, Rattus norvegicus
aattattggccctgatcctttggta

SEQ ID NO: 66393 - DNA, 25 bp, Rattus norvegicus
aattattggcctctcttgttatcct

SEQ ID NO: 66394 - DNA, 25 bp, Rattus norvegicus
aattattggcctgtcttgttatcct

SEQ ID NO: 66395 - DNA, 25 bp, Rattus norvegicus
aattattggtcccactggtccgaca

SEQ ID NO: 66396 - DNA, 25 bp, Rattus norvegicus
aattattggtccgactggtccgaca

SEQ ID NO: 66397 - DNA, 25 bp, Rattus norvegicus
aattattgtcttatcgttgtgtttg

SEQ ID NO: 66398 - DNA, 25 bp, Rattus norvegicus
aattattgtcttttcgttgtgtttg

SEQ ID NO: 66399 - DNA, 25 bp, Rattus norvegicus
aattattgtttaattctcgctccaa

SEQ ID NO: 66400 - DNA, 25 bp, Rattus norvegicus
aattattgtttatttctcgctccaa

SEQ ID NO: 66401 - DNA, 25 bp, Rattus norvegicus
aattatttaatacctcactcctgcc

SEQ ID NO: 66402 - DNA, 25 bp, Rattus norvegicus
aattatttaatagctcactcctgcc

SEQ ID NO: 66403 - DNA, 25 bp, Rattus norvegicus
aattatttcagaccggccgggcgga

SEQ ID NO: 66404 - DNA, 25 bp, Rattus norvegicus
aattatttcagagcggccgggcgga

SEQ ID NO: 66405 - DNA, 25 bp, Rattus norvegicus
aattatttcattatctggtttggtg

SEQ ID NO: 66406 - DNA, 25 bp, Rattus norvegicus
aattatttcattttctggtttggtg

SEQ ID NO: 66407 - DNA, 25 bp, Rattus norvegicus
aattatttccgaagtccacctgcct

SEQ ID NO: 66408 - DNA, 25 bp, Rattus norvegicus
aattatttccgatgtccacctgcct

SEQ ID NO: 66409 - DNA, 25 bp, Rattus norvegicus
aattatttctcactgtctcagcaca

SEQ ID NO: 66410 - DNA, 25 bp, Rattus norvegicus
aattatttctcagtgtctcagcaca

SEQ ID NO: 66411 - DNA, 25 bp, Rattus norvegicus
aattatttggtgaggccatcctcca

SEQ ID NO: 66412 - DNA, 25 bp, Rattus norvegicus
aattatttggtgtggccatcctcca

SEQ ID NO: 66413 - DNA, 25 bp, Rattus norvegicus
aattattttatgctctcccagctga

SEQ ID NO: 66414 - DNA, 25 bp, Rattus norvegicus
aattattttatggtctcccagctga

SEQ ID NO: 66415 - DNA, 25 bp, Rattus norvegicus
aattattttcatatgtcctgcatta

SEQ ID NO: 66416 - DNA, 25 bp, Rattus norvegicus
aattattttcatttgtcctgcatta

SEQ ID NO: 66417 - DNA, 25 bp, Rattus norvegicus
aattattttgctctagggcctgacc

SEQ ID NO: 66418 - DNA, 25 bp, Rattus norvegicus
aattattttgctgtagggcctgacc

SEQ ID NO: 66419 - DNA, 25 bp, Rattus norvegicus
aattattttgggatctgcgacatta

SEQ ID NO: 66420 - DNA, 25 bp, Rattus norvegicus
aattattttgggttctgcgacatta

SEQ ID NO: 66421 - DNA, 25 bp, Rattus norvegicus
aattcaaaaaatccaggataccctg

SEQ ID NO: 66422 - DNA, 25 bp, Rattus norvegicus
aattcaaaaaatgcaggataccctg

SEQ ID NO: 66423 - DNA, 25 bp, Rattus norvegicus
aattcaaagaatatctggggccaga

SEQ ID NO: 66424 - DNA, 25 bp, Rattus norvegicus
aattcaaagaatttctggggccaga

SEQ ID NO: 66425 - DNA, 25 bp, Rattus norvegicus
aattcaaagcatcccttggtctcaa

SEQ ID NO: 66426 - DNA, 25 bp, Rattus norvegicus
aattcaaagcatgccttggtctcaa

SEQ ID NO: 66427 - DNA, 25 bp, Rattus norvegicus
aattcaaagctcagagtgcctccat

SEQ ID NO: 66428 - DNA, 25 bp, Rattus norvegicus
aattcaaagctctgagtgcctccat

SEQ ID NO: 66429 - DNA, 25 bp, Rattus norvegicus
aattcaaagtgtctcaccctacttg

SEQ ID NO: 66430 - DNA, 25 bp, Rattus norvegicus
aattcaaagtgtgtcaccctacttg

SEQ ID NO: 66431 - DNA, 25 bp, Rattus norvegicus
aattcaaattgtacagctgccttta

SEQ ID NO: 66432 - DNA, 25 bp, Rattus norvegicus
aattcaaattgttcagctgccttta

SEQ ID NO: 66433 - DNA, 25 bp, Rattus norvegicus
aattcaaatttgaacacgaacctgc

SEQ ID NO: 66434 - DNA, 25 bp, Rattus norvegicus
aattcaaatttgtacacgaacctgc

SEQ ID NO: 66435 - DNA, 25 bp, Rattus norvegicus
aattcaacatttactaccactgcaa

SEQ ID NO: 66436 - DNA, 25 bp, Rattus norvegicus
aattcaacattttctaccactgcaa

SEQ ID NO: 66437 - DNA, 25 bp, Rattus norvegicus
aattcaaccacacccacaggatcag

SEQ ID NO: 66438 - DNA, 25 bp, Rattus norvegicus
aattcaaccacagccacaggatcag

SEQ ID NO: 66439 - DNA, 25 bp, Rattus norvegicus
aattcaaccaccctcttacgttctg

SEQ ID NO: 66440 - DNA, 25 bp, Rattus norvegicus
aattcaaccaccgtcttacgttctg

SEQ ID NO: 66441 - DNA, 25 bp, Rattus norvegicus
aattcaaccatactgatggcccggc

SEQ ID NO: 66442 - DNA, 25 bp, Rattus norvegicus
aattcaaccatagtgatggcccggc

SEQ ID NO: 66443 - DNA, 25 bp, Rattus norvegicus
aattcaaccccaagtctggccaagt

SEQ ID NO: 66444 - DNA, 25 bp, Rattus norvegicus
aattcaaccccatgtctggccaagt

SEQ ID NO: 66445 - DNA, 25 bp, Rattus norvegicus
aattcaactttgagcagctctccga

SEQ ID NO: 66446 - DNA, 25 bp, Rattus norvegicus
aattcaactttgtgcagctctccga

SEQ ID NO: 66447 - DNA, 25 bp, Rattus norvegicus
aattcaagaggcctccaaagcagga

SEQ ID NO: 66448 - DNA, 25 bp, Rattus norvegicus
aattcaagaggcgtccaaagcagga

SEQ ID NO: 66449 - DNA, 25 bp, Rattus norvegicus
aattcaagctcaccctgctatacag

SEQ ID NO: 66450 - DNA, 25 bp, Rattus norvegicus
aattcaagctcagcctgctatacag

SEQ ID NO: 66451 - DNA, 25 bp, Rattus norvegicus
aattcaagcttcactgtatcttagt

SEQ ID NO: 66452 - DNA, 25 bp, Rattus norvegicus
aattcaagcttctctgtatcttagt

SEQ ID NO: 66453 - DNA, 25 bp, Rattus norvegicus
aattcaaggttgctcattacggtta

SEQ ID NO: 66454 - DNA, 25 bp, Rattus norvegicus
aattcaaggttggtcattacggtta

SEQ ID NO: 66455 - DNA, 25 bp, Rattus norvegicus
aattcaagtgtcattcaccttgccc

SEQ ID NO: 66456 - DNA, 25 bp, Rattus norvegicus
aattcaagtgtctttcaccttgccc

SEQ ID NO: 66457 - DNA, 25 bp, Rattus norvegicus
aattcaagttttatcaggaaccaag

SEQ ID NO: 66458 - DNA, 25 bp, Rattus norvegicus
aattcaagttttttcaggaaccaag

SEQ ID NO: 66459 - DNA, 25 bp, Rattus norvegicus
aattcaatcaaacacgttgcgaaac

SEQ ID NO: 66460 - DNA, 25 bp, Rattus norvegicus
aattcaatcaaagacgttgcgaaac

SEQ ID NO: 66461 - DNA, 25 bp, Rattus norvegicus
aattcaattcagacgtgtgtgcaag

SEQ ID NO: 66462 - DNA, 25 bp, Rattus norvegicus
aattcaattcagtcgtgtgtgcaag

SEQ ID NO: 66463 - DNA, 25 bp, Rattus norvegicus
aattcacaatgtactactgcctgtc

SEQ ID NO: 66464 - DNA, 25 bp, Rattus norvegicus
aattcacaatgttctactgcctgtc

SEQ ID NO: 66465 - DNA, 25 bp, Rattus norvegicus
aattcacacattagctgactggatt

SEQ ID NO: 66466 - DNA, 25 bp, Rattus norvegicus
aattcacacatttgctgactggatt

SEQ ID NO: 66467 - DNA, 25 bp, Rattus norvegicus
aattcacaccctccacaagttttgt

SEQ ID NO: 66468 - DNA, 25 bp, Rattus norvegicus
aattcacaccctgcacaagttttgt

SEQ ID NO: 66469 - DNA, 25 bp, Rattus norvegicus
aattcacacgaaagcgccccgcgaa

SEQ ID NO: 66470 - DNA, 25 bp, Rattus norvegicus
aattcacacgaatgcgccccgcgaa

SEQ ID NO: 66471 - DNA, 25 bp, Rattus norvegicus
aattcacacgttacacagagtcctg

SEQ ID NO: 66472 - DNA, 25 bp, Rattus norvegicus
aattcacacgtttcacagagtcctg

SEQ ID NO: 66473 - DNA, 25 bp, Rattus norvegicus
aattcacactacaaggctggcacca

SEQ ID NO: 66474 - DNA, 25 bp, Rattus norvegicus
aattcacactactaggctggcacca

SEQ ID NO: 66475 - DNA, 25 bp, Rattus norvegicus
aattcacacttaatttctgggcaga

SEQ ID NO: 66476 - DNA, 25 bp, Rattus norvegicus
aattcacacttattttctgggcaga

SEQ ID NO: 66477 - DNA, 25 bp, Rattus norvegicus
aattcacagctgatcatctgccatc

SEQ ID NO: 66478 - DNA, 25 bp, Rattus norvegicus
aattcacagctgttcatctgccatc

SEQ ID NO: 66479 - DNA, 25 bp, Rattus norvegicus
aattcacagtcccttggtgtctcaa

SEQ ID NO: 66480 - DNA, 25 bp, Rattus norvegicus
aattcacagtccgttggtgtctcaa

SEQ ID NO: 66481 - DNA, 25 bp, Rattus norvegicus
aattcacagtggcttctctttatga

SEQ ID NO: 66482 - DNA, 25 bp, Rattus norvegicus
aattcacagtgggttctctttatga

SEQ ID NO: 66483 - DNA, 25 bp, Rattus norvegicus
aattcaccagcgaaagtcagcacta

SEQ ID NO: 66484 - DNA, 25 bp, Rattus norvegicus
aattcaccagcgtaagtcagcacta

SEQ ID NO: 66485 - DNA, 25 bp, Rattus norvegicus
aattcaccccagaggtgcaggctgc

SEQ ID NO: 66486 - DNA, 25 bp, Rattus norvegicus
aattcaccccagtggtgcaggctgc

SEQ ID NO: 66487 - DNA, 25 bp, Rattus norvegicus
aattcaccctcgaactgttaaatca

SEQ ID NO: 66488 - DNA, 25 bp, Rattus norvegicus
aattcaccctcgtactgttaaatca

SEQ ID NO: 66489 - DNA, 25 bp, Rattus norvegicus
aattcaccgtggattactgcgagcc

SEQ ID NO: 66490 - DNA, 25 bp, Rattus norvegicus
aattcaccgtggtttactgcgagcc

SEQ ID NO: 66491 - DNA, 25 bp, Rattus norvegicus
aattcacctagccagttcgaggcca

SEQ ID NO: 66492 - DNA, 25 bp, Rattus norvegicus
aattcacctagcgagttcgaggcca

SEQ ID NO: 66493 - DNA, 25 bp, Rattus norvegicus
aattcacctctacgataccatgcct

SEQ ID NO: 66494 - DNA, 25 bp, Rattus norvegicus
aattcacctctaggataccatgcct

SEQ ID NO: 66495 - DNA, 25 bp, Rattus norvegicus
aattcacctctgcaagtggctctgg

SEQ ID NO: 66496 - DNA, 25 bp, Rattus norvegicus
aattcacctctggaagtggctctgg

SEQ ID NO: 66497 - DNA, 25 bp, Rattus norvegicus
aattcaccttgactctttgtagagc

SEQ ID NO: 66498 - DNA, 25 bp, Rattus norvegicus
aattcaccttgagtctttgtagagc

SEQ ID NO: 66499 - DNA, 25 bp, Rattus norvegicus
aattcacgaagaaccagggtcccca

SEQ ID NO: 66500 - DNA, 25 bp, Rattus norvegicus
aattcacgaagatccagggtcccca

SEQ ID NO: 66501 - DNA, 25 bp, Rattus norvegicus
aattcactccagacaacaggttcag

SEQ ID NO: 66502 - DNA, 25 bp, Rattus norvegicus
aattcactccagtcaacaggttcag

SEQ ID NO: 66503 - DNA, 25 bp, Rattus norvegicus
aattcactcgggatttctcatcaga

SEQ ID NO: 66504 - DNA, 25 bp, Rattus norvegicus
aattcactcgggttttctcatcaga

SEQ ID NO: 66505 - DNA, 25 bp, Rattus norvegicus
aattcactctaccttgttttccaag

SEQ ID NO: 66506 - DNA, 25 bp, Rattus norvegicus
aattcactctacgttgttttccaag

SEQ ID NO: 66507 - DNA, 25 bp, Rattus norvegicus
aattcactctccaaggaagtcacta

SEQ ID NO: 66508 - DNA, 25 bp, Rattus norvegicus
aattcactctcctaggaagtcacta

SEQ ID NO: 66509 - DNA, 25 bp, Rattus norvegicus
aattcactctgaaggcaatccacag

SEQ ID NO: 66510 - DNA, 25 bp, Rattus norvegicus
aattcactctgatggcaatccacag

SEQ ID NO: 66511 - DNA, 25 bp, Rattus norvegicus
aattcactctgcatcttgttaacat

SEQ ID NO: 66512 - DNA, 25 bp, Rattus norvegicus
aattcactctgcttcttgttaacat

SEQ ID NO: 66513 - DNA, 25 bp, Rattus norvegicus
aattcactcttcaagcagggcatga

SEQ ID NO: 66514 - DNA, 25 bp, Rattus norvegicus
aattcactcttctagcagggcatga

SEQ ID NO: 66515 - DNA, 25 bp, Rattus norvegicus
aattcactggaactggctgtcctgt

SEQ ID NO: 66516 - DNA, 25 bp, Rattus norvegicus
aattcactggaagtggctgtcctgt

SEQ ID NO: 66517 - DNA, 25 bp, Rattus norvegicus
aattcactgttcattgagtcctcag

SEQ ID NO: 66518 - DNA, 25 bp, Rattus norvegicus
aattcactgttctttgagtcctcag

SEQ ID NO: 66519 - DNA, 25 bp, Rattus norvegicus
aattcactgttgaatgcctgtcccg

SEQ ID NO: 66520 - DNA, 25 bp, Rattus norvegicus
aattcactgttgtatgcctgtcccg

SEQ ID NO: 66521 - DNA, 25 bp, Rattus norvegicus
aattcacttgtaatgtctggattca

SEQ ID NO: 66522 - DNA, 25 bp, Rattus norvegicus
aattcacttgtattgtctggattca

SEQ ID NO: 66523 - DNA, 25 bp, Rattus norvegicus
aattcactttatatgcccttccaaa

SEQ ID NO: 66524 - DNA, 25 bp, Rattus norvegicus
aattcactttatttgcccttccaaa

SEQ ID NO: 66525 - DNA, 25 bp, Rattus norvegicus
aattcagaacctcactactgtatag

SEQ ID NO: 66526 - DNA, 25 bp, Rattus norvegicus
aattcagaacctgactactgtatag

SEQ ID NO: 66527 - DNA, 25 bp, Rattus norvegicus
aattcagagcgcatctgtctgggcc

SEQ ID NO: 66528 - DNA, 25 bp, Rattus norvegicus
aattcagagcgcttctgtctgggcc

SEQ ID NO: 66529 - DNA, 25 bp, Rattus norvegicus
aattcagagctgattcccaggaggc

SEQ ID NO: 66530 - DNA, 25 bp, Rattus norvegicus
aattcagagctgctgaggtctgctg

SEQ ID NO: 66531 - DNA, 25 bp, Rattus norvegicus
aattcagagctggtgaggtctgctg

SEQ ID NO: 66532 - DNA, 25 bp, Rattus norvegicus
aattcagagctgtttcccaggaggc

SEQ ID NO: 66533 - DNA, 25 bp, Rattus norvegicus
aattcagaggctctgctggcttttc

SEQ ID NO: 66534 - DNA, 25 bp, Rattus norvegicus
aattcagaggctgtgctggcttttc

SEQ ID NO: 66535 - DNA, 25 bp, Rattus norvegicus
aattcagagtaaacattcccaccct

SEQ ID NO: 66536 - DNA, 25 bp, Rattus norvegicus
aattcagagtaatcattcccaccct

SEQ ID NO: 66537 - DNA, 25 bp, Rattus norvegicus
aattcagatatgactctggtaccaa

SEQ ID NO: 66538 - DNA, 25 bp, Rattus norvegicus
aattcagatatgtctctggtaccaa

SEQ ID NO: 66539 - DNA, 25 bp, Rattus norvegicus
aattcagatgtgacatagttccaga

SEQ ID NO: 66540 - DNA, 25 bp, Rattus norvegicus
aattcagatgtgtcatagttccaga

SEQ ID NO: 66541 - DNA, 25 bp, Rattus norvegicus
aattcagcaaaacttcatccaaggg

SEQ ID NO: 66542 - DNA, 25 bp, Rattus norvegicus
aattcagcaaaagttcatccaaggg

SEQ ID NO: 66543 - DNA, 25 bp, Rattus norvegicus
aattcagcagctactaaggctctcc

SEQ ID NO: 66544 - DNA, 25 bp, Rattus norvegicus
aattcagcagcttctaaggctctcc

SEQ ID NO: 66545 - DNA, 25 bp, Rattus norvegicus
aattcagcatgaaccctgtgagcag

SEQ ID NO: 66546 - DNA, 25 bp, Rattus norvegicus
aattcagcatgatccctgtgagcag

SEQ ID NO: 66547 - DNA, 25 bp, Rattus norvegicus
aattcagccataaactcacctatta

SEQ ID NO: 66548 - DNA, 25 bp, Rattus norvegicus
aattcagccatatactcacctatta

SEQ ID NO: 66549 - DNA, 25 bp, Rattus norvegicus
aattcagccctgacacctttattta

SEQ ID NO: 66550 - DNA, 25 bp, Rattus norvegicus
aattcagccctgtcacctttattta

SEQ ID NO: 66551 - DNA, 25 bp, Rattus norvegicus
aattcagccgtgattcattaagtgc

SEQ ID NO: 66552 - DNA, 25 bp, Rattus norvegicus
aattcagccgtgtttcattaagtgc

SEQ ID NO: 66553 - DNA, 25 bp, Rattus norvegicus
aattcagcctggactatatcgtgag

SEQ ID NO: 66554 - DNA, 25 bp, Rattus norvegicus
aattcagcctggatctattacaata

SEQ ID NO: 66555 - DNA, 25 bp, Rattus norvegicus
aattcagcctggtctatatcgtgag

SEQ ID NO: 66556 - DNA, 25 bp, Rattus norvegicus
aattcagcctggttctattacaata

SEQ ID NO: 66557 - DNA, 25 bp, Rattus norvegicus
aattcagctagactggcaggccggc

SEQ ID NO: 66558 - DNA, 25 bp, Rattus norvegicus
aattcagctagagtggcaggccggc

SEQ ID NO: 66559 - DNA, 25 bp, Rattus norvegicus
aattcagctcatccttatgtttcca

SEQ ID NO: 66560 - DNA, 25 bp, Rattus norvegicus
aattcagctcatgcttatgtttcca

SEQ ID NO: 66561 - DNA, 25 bp, Rattus norvegicus
aattcagctctcatctgattgccac

SEQ ID NO: 66562 - DNA, 25 bp, Rattus norvegicus
aattcagctctcttctgattgccac

SEQ ID NO: 66563 - DNA, 25 bp, Rattus norvegicus
aattcagctgctacctacaatgtaa

SEQ ID NO: 66564 - DNA, 25 bp, Rattus norvegicus
aattcagctgcttcctacaatgtaa

SEQ ID NO: 66565 - DNA, 25 bp, Rattus norvegicus
aattcagcttctactctgcctacag

SEQ ID NO: 66566 - DNA, 25 bp, Rattus norvegicus
aattcagcttcttctctgcctacag

SEQ ID NO: 66567 - DNA, 25 bp, Rattus norvegicus
aattcaggacagatgcaatggtgga

SEQ ID NO: 66568 - DNA, 25 bp, Rattus norvegicus
aattcaggacagttgcaatggtgga

SEQ ID NO: 66569 - DNA, 25 bp, Rattus norvegicus
aattcaggactgatgtgacctacca

SEQ ID NO: 66570 - DNA, 25 bp, Rattus norvegicus
aattcaggactgttgtgacctacca

SEQ ID NO: 66571 - DNA, 25 bp, Rattus norvegicus
aattcaggaggtcaggtgcctatag

SEQ ID NO: 66572 - DNA, 25 bp, Rattus norvegicus
aattcaggaggtgaggtgcctatag

SEQ ID NO: 66573 - DNA, 25 bp, Rattus norvegicus
aattcaggcaacacttcgtcttcat

SEQ ID NO: 66574 - DNA, 25 bp, Rattus norvegicus
aattcaggcaactcttcgtcttcat

SEQ ID NO: 66575 - DNA, 25 bp, Rattus norvegicus
aattcaggcccgaattagtcataga

SEQ ID NO: 66576 - DNA, 25 bp, Rattus norvegicus
aattcaggcccgtattagtcataga

SEQ ID NO: 66577 - DNA, 25 bp, Rattus norvegicus
aattcaggccctagatgtttccaca

SEQ ID NO: 66578 - DNA, 25 bp, Rattus norvegicus
aattcaggcccttgatgtttccaca

SEQ ID NO: 66579 - DNA, 25 bp, Rattus norvegicus
aattcagggacgcaaccaccagctg

SEQ ID NO: 66580 - DNA, 25 bp, Rattus norvegicus
aattcagggacggaaccaccagctg

SEQ ID NO: 66581 - DNA, 25 bp, Rattus norvegicus
aattcagggactccagtctcaccag

SEQ ID NO: 66582 - DNA, 25 bp, Rattus norvegicus
aattcagggactgcagtctcaccag

SEQ ID NO: 66583 - DNA, 25 bp, Rattus norvegicus
aattcagggatcatgcattctttaa

SEQ ID NO: 66584 - DNA, 25 bp, Rattus norvegicus
aattcagggatcttgcattctttaa

SEQ ID NO: 66585 - DNA, 25 bp, Rattus norvegicus
aattcagggctcagtccacacataa

SEQ ID NO: 66586 - DNA, 25 bp, Rattus norvegicus
aattcagggctctgtccacacataa

SEQ ID NO: 66587 - DNA, 25 bp, Rattus norvegicus
aattcaggtggaactttcctggaca

SEQ ID NO: 66588 - DNA, 25 bp, Rattus norvegicus
aattcaggtggatctttcctggaca

SEQ ID NO: 66589 - DNA, 25 bp, Rattus norvegicus
aattcaggttttactggcactgctg

SEQ ID NO: 66590 - DNA, 25 bp, Rattus norvegicus
aattcaggtttttctggcactgctg

SEQ ID NO: 66591 - DNA, 25 bp, Rattus norvegicus
aattcagtaacaaaggcaacacctt

SEQ ID NO: 66592 - DNA, 25 bp, Rattus norvegicus
aattcagtaacataggcaacacctt

SEQ ID NO: 66593 - DNA, 25 bp, Rattus norvegicus
aattcagtacggagcaaactcagag

SEQ ID NO: 66594 - DNA, 25 bp, Rattus norvegicus
aattcagtacggtgcaaactcagag

SEQ ID NO: 66595 - DNA, 25 bp, Rattus norvegicus
aattcagtcattctcctcaattgag

SEQ ID NO: 66596 - DNA, 25 bp, Rattus norvegicus
aattcagtcattgtcctcaattgag

SEQ ID NO: 66597 - DNA, 25 bp, Rattus norvegicus
aattcagtccccaggaaccacgtgg

SEQ ID NO: 66598 - DNA, 25 bp, Rattus norvegicus
aattcagtcccctggaaccacgtgg

SEQ ID NO: 66599 - DNA, 25 bp, Rattus norvegicus
aattcagtccctacttattcttatc

SEQ ID NO: 66600 - DNA, 25 bp, Rattus norvegicus
aattcagtcccttcttattcttatc

SEQ ID NO: 66601 - DNA, 25 bp, Rattus norvegicus
aattcagtcctaatctacatgtgtt

SEQ ID NO: 66602 - DNA, 25 bp, Rattus norvegicus
aattcagtcctattctacatgtgtt

SEQ ID NO: 66603 - DNA, 25 bp, Rattus norvegicus
aattcagtctctagagggctttctt

SEQ ID NO: 66604 - DNA, 25 bp, Rattus norvegicus
aattcagtctcttgagggctttctt

SEQ ID NO: 66605 - DNA, 25 bp, Rattus norvegicus
aattcagtctgtatctgcttaaaag

SEQ ID NO: 66606 - DNA, 25 bp, Rattus norvegicus
aattcagtctgtattctccctaaat

SEQ ID NO: 66607 - DNA, 25 bp, Rattus norvegicus
aattcagtctgtctgtcttcgggaa

SEQ ID NO: 66608 - DNA, 25 bp, Rattus norvegicus
aattcagtctgtgtgtcttcgggaa

SEQ ID NO: 66609 - DNA, 25 bp, Rattus norvegicus
aattcagtctgtttctgcttaaaag

SEQ ID NO: 66610 - DNA, 25 bp, Rattus norvegicus
aattcagtctgttttctccctaaat

SEQ ID NO: 66611 - DNA, 25 bp, Rattus norvegicus
aattcagtctttcactagcagcctt

SEQ ID NO: 66612 - DNA, 25 bp, Rattus norvegicus
aattcagtctttgactagcagcctt

SEQ ID NO: 66613 - DNA, 25 bp, Rattus norvegicus
aattcagtgccgcagctcactgctt

SEQ ID NO: 66614 - DNA, 25 bp, Rattus norvegicus
aattcagtgccggagctcactgctt

SEQ ID NO: 66615 - DNA, 25 bp, Rattus norvegicus
aattcagtgggtctttatttcttca

SEQ ID NO: 66616 - DNA, 25 bp, Rattus norvegicus
aattcagtgggtgtttatttcttca

SEQ ID NO: 66617 - DNA, 25 bp, Rattus norvegicus
aattcagtgtggctcaaattgcccc

SEQ ID NO: 66618 - DNA, 25 bp, Rattus norvegicus
aattcagtgtggcttttcaatgcat

SEQ ID NO: 66619 - DNA, 25 bp, Rattus norvegicus
aattcagtgtgggtcaaattgcccc

SEQ ID NO: 66620 - DNA, 25 bp, Rattus norvegicus
aattcagtgtgggttttcaatgcat

SEQ ID NO: 66621 - DNA, 25 bp, Rattus norvegicus
aattcagtgttcagtgtctattcac

SEQ ID NO: 66622 - DNA, 25 bp, Rattus norvegicus
aattcagtgttctgtgtctattcac

SEQ ID NO: 66623 - DNA, 25 bp, Rattus norvegicus
aattcagttcatactctttttgcat

SEQ ID NO: 66624 - DNA, 25 bp, Rattus norvegicus
aattcagttcattctctttttgcat

SEQ ID NO: 66625 - DNA, 25 bp, Rattus norvegicus
aattcagttctacttttcagtcctt

SEQ ID NO: 66626 - DNA, 25 bp, Rattus norvegicus
aattcagttctagttttcagtcctt

SEQ ID NO: 66627 - DNA, 25 bp, Rattus norvegicus
aattcagttgctacccttcctgaaa

SEQ ID NO: 66628 - DNA, 25 bp, Rattus norvegicus
aattcagttgcttcccttcctgaaa

SEQ ID NO: 66629 - DNA, 25 bp, Rattus norvegicus
aattcagtttccctcaagacacagt

SEQ ID NO: 66630 - DNA, 25 bp, Rattus norvegicus
aattcagtttccgtcaagacacagt

SEQ ID NO: 66631 - DNA, 25 bp, Rattus norvegicus
aattcagtttgtatccattcgtgcc

SEQ ID NO: 66632 - DNA, 25 bp, Rattus norvegicus
aattcagtttgtcaggttggatggt

SEQ ID NO: 66633 - DNA, 25 bp, Rattus norvegicus
aattcagtttgtgaggttggatggt

SEQ ID NO: 66634 - DNA, 25 bp, Rattus norvegicus
aattcagtttgtttccattcgtgcc

SEQ ID NO: 66635 - DNA, 25 bp, Rattus norvegicus
aattcatacagaatttggaaaggga

SEQ ID NO: 66636 - DNA, 25 bp, Rattus norvegicus
aattcatacagattttggaaaggga

SEQ ID NO: 66637 - DNA, 25 bp, Rattus norvegicus
aattcatacccgagatagccccaaa

SEQ ID NO: 66638 - DNA, 25 bp, Rattus norvegicus
aattcatacccgtgatagccccaaa

SEQ ID NO: 66639 - DNA, 25 bp, Rattus norvegicus
aattcatagcaccaaattgcctcaa

SEQ ID NO: 66640 - DNA, 25 bp, Rattus norvegicus
aattcatagcacgaaattgcctcaa

SEQ ID NO: 66641 - DNA, 25 bp, Rattus norvegicus
aattcatcacctatctgcagaggct

SEQ ID NO: 66642 - DNA, 25 bp, Rattus norvegicus
aattcatcacctttctgcagaggct

SEQ ID NO: 66643 - DNA, 25 bp, Rattus norvegicus
aattcatcagatctggcagggttat

SEQ ID NO: 66644 - DNA, 25 bp, Rattus norvegicus
aattcatcagatgtggcagggttat

SEQ ID NO: 66645 - DNA, 25 bp, Rattus norvegicus
aattcatcagcgatggcaattccat

SEQ ID NO: 66646 - DNA, 25 bp, Rattus norvegicus
aattcatcagcgttggcaattccat

SEQ ID NO: 66647 - DNA, 25 bp, Rattus norvegicus
aattcatcaggaccaggtgggccag

SEQ ID NO: 66648 - DNA, 25 bp, Rattus norvegicus
aattcatcaggagcaggtgggccag

SEQ ID NO: 66649 - DNA, 25 bp, Rattus norvegicus
aattcatcatgtactgttgtcctat

SEQ ID NO: 66650 - DNA, 25 bp, Rattus norvegicus
aattcatcatgttctgttgtcctat

SEQ ID NO: 66651 - DNA, 25 bp, Rattus norvegicus
aattcatccatactacaccatcatc

SEQ ID NO: 66652 - DNA, 25 bp, Rattus norvegicus
aattcatccatagtacaccatcatc

SEQ ID NO: 66653 - DNA, 25 bp, Rattus norvegicus
aattcatccttcagacgaatttttt

SEQ ID NO: 66654 - DNA, 25 bp, Rattus norvegicus
aattcatccttctgacgaatttttt

SEQ ID NO: 66655 - DNA, 25 bp, Rattus norvegicus
aattcatctaccaggccaattgctt

SEQ ID NO: 66656 - DNA, 25 bp, Rattus norvegicus
aattcatctacctggccaattgctt

SEQ ID NO: 66657 - DNA, 25 bp, Rattus norvegicus
aattcatctagtagctgttcccctg

SEQ ID NO: 66658 - DNA, 25 bp, Rattus norvegicus
aattcatctagttgctgttcccctg

SEQ ID NO: 66659 - DNA, 25 bp, Rattus norvegicus
aattcatctctgagccttcagttgg

SEQ ID NO: 66660 - DNA, 25 bp, Rattus norvegicus
aattcatctctgtgccttcagttgg

SEQ ID NO: 66661 - DNA, 25 bp, Rattus norvegicus
aattcatctcttcaggattgggtca

SEQ ID NO: 66662 - DNA, 25 bp, Rattus norvegicus
aattcatctcttgaggattgggtca

SEQ ID NO: 66663 - DNA, 25 bp, Rattus norvegicus
aattcatctgcaaggattcccacac

SEQ ID NO: 66664 - DNA, 25 bp, Rattus norvegicus
aattcatctgcatggattcccacac

SEQ ID NO: 66665 - DNA, 25 bp, Rattus norvegicus
aattcatgctctatatatctccaag

SEQ ID NO: 66666 - DNA, 25 bp, Rattus norvegicus
aattcatgctctttatatctccaag

SEQ ID NO: 66667 - DNA, 25 bp, Rattus norvegicus
aattcatgctttactgttcgtgagt

SEQ ID NO: 66668 - DNA, 25 bp, Rattus norvegicus
aattcatgcttttctgttcgtgagt

SEQ ID NO: 66669 - DNA, 25 bp, Rattus norvegicus
aattcatggcgcatttcctgcagct

SEQ ID NO: 66670 - DNA, 25 bp, Rattus norvegicus
aattcatggcgcttttcctgcagct

SEQ ID NO: 66671 - DNA, 25 bp, Rattus norvegicus
aattcatgggatatttgacttcagt

SEQ ID NO: 66672 - DNA, 25 bp, Rattus norvegicus
aattcatgggatttttgacttcagt

SEQ ID NO: 66673 - DNA, 25 bp, Rattus norvegicus
aattcatggtgtagggacagctgga

SEQ ID NO: 66674 - DNA, 25 bp, Rattus norvegicus
aattcatggtgttgggacagctgga

SEQ ID NO: 66675 - DNA, 25 bp, Rattus norvegicus
aattcatgtaccatctttctttgga

SEQ ID NO: 66676 - DNA, 25 bp, Rattus norvegicus
aattcatgtaccttctttctttgga

SEQ ID NO: 66677 - DNA, 25 bp, Rattus norvegicus
aattcattaaggcagcttgtcctaa

SEQ ID NO: 66678 - DNA, 25 bp, Rattus norvegicus
aattcattaagggagcttgtcctaa

SEQ ID NO: 66679 - DNA, 25 bp, Rattus norvegicus
aattcattatcccaggatctcctgc

SEQ ID NO: 66680 - DNA, 25 bp, Rattus norvegicus
aattcattatccgaggatctcctgc

SEQ ID NO: 66681 - DNA, 25 bp, Rattus norvegicus
aattcattctgaagacaagacctat

SEQ ID NO: 66682 - DNA, 25 bp, Rattus norvegicus
aattcattctgactttctcgtctca

SEQ ID NO: 66683 - DNA, 25 bp, Rattus norvegicus
aattcattctgagtttctcgtctca

SEQ ID NO: 66684 - DNA, 25 bp, Rattus norvegicus
aattcattctgatgacaagacctat

SEQ ID NO: 66685 - DNA, 25 bp, Rattus norvegicus
aattcattgcaccttacagcttggc

SEQ ID NO: 66686 - DNA, 25 bp, Rattus norvegicus
aattcattgcacgttacagcttggc

SEQ ID NO: 66687 - DNA, 25 bp, Rattus norvegicus
aattcattgtggcatccggcttata

SEQ ID NO: 66688 - DNA, 25 bp, Rattus norvegicus
aattcattgtgggatccggcttata

SEQ ID NO: 66689 - DNA, 25 bp, Rattus norvegicus
aattcatttcacactcaccgtgggc

SEQ ID NO: 66690 - DNA, 25 bp, Rattus norvegicus
aattcatttcactctcaccgtgggc

SEQ ID NO: 66691 - DNA, 25 bp, Rattus norvegicus
aattcatttcctagtctcgctgaaa

SEQ ID NO: 66692 - DNA, 25 bp, Rattus norvegicus
aattcatttccttgtctcgctgaaa

SEQ ID NO: 66693 - DNA, 25 bp, Rattus norvegicus
aattcatttgaactgactggctaaa

SEQ ID NO: 66694 - DNA, 25 bp, Rattus norvegicus
aattcatttgaagtgactggctaaa

SEQ ID NO: 66695 - DNA, 25 bp, Rattus norvegicus
aattcattttgcatattgtgcatgc

SEQ ID NO: 66696 - DNA, 25 bp, Rattus norvegicus
aattcattttgcttattgtgcatgc

SEQ ID NO: 66697 - DNA, 25 bp, Rattus norvegicus
aattcatttttgcttctttctcaat

SEQ ID NO: 66698 - DNA, 25 bp, Rattus norvegicus
aattcatttttggttctttctcaat

SEQ ID NO: 66699 - DNA, 25 bp, Rattus norvegicus
aattccaaaaagatgctttctatac

SEQ ID NO: 66700 - DNA, 25 bp, Rattus norvegicus
aattccaaaaagttgctttctatac

SEQ ID NO: 66701 - DNA, 25 bp, Rattus norvegicus
aattccaaattcctgtgtgtacccg

SEQ ID NO: 66702 - DNA, 25 bp, Rattus norvegicus
aattccaaattcgtgtgtgtacccg

SEQ ID NO: 66703 - DNA, 25 bp, Rattus norvegicus
aattccaacagcacttactcttcct

SEQ ID NO: 66704 - DNA, 25 bp, Rattus norvegicus
aattccaacagctcttactcttcct

SEQ ID NO: 66705 - DNA, 25 bp, Rattus norvegicus
aattccaacatgatttcttcagccc

SEQ ID NO: 66706 - DNA, 25 bp, Rattus norvegicus
aattccaacatgttttcttcagccc

SEQ ID NO: 66707 - DNA, 25 bp, Rattus norvegicus
aattccaacctgataccctagtttg

SEQ ID NO: 66708 - DNA, 25 bp, Rattus norvegicus
aattccaacctgttaccctagtttg

SEQ ID NO: 66709 - DNA, 25 bp, Rattus norvegicus
aattccaactctcggcttcatttgt

SEQ ID NO: 66710 - DNA, 25 bp, Rattus norvegicus
aattccaactctgggcttcatttgt

SEQ ID NO: 66711 - DNA, 25 bp, Rattus norvegicus
aattccaacttcaaactcttcttca

SEQ ID NO: 66712 - DNA, 25 bp, Rattus norvegicus
aattccaacttctaactcttcttca

SEQ ID NO: 66713 - DNA, 25 bp, Rattus norvegicus
aattccaagacactttctccccagg

SEQ ID NO: 66714 - DNA, 25 bp, Rattus norvegicus
aattccaagacagtttctccccagg

SEQ ID NO: 66715 - DNA, 25 bp, Rattus norvegicus
aattccaagtggcatgtaccttccc

SEQ ID NO: 66716 - DNA, 25 bp, Rattus norvegicus
aattccaagtgggatgtaccttccc

SEQ ID NO: 66717 - DNA, 25 bp, Rattus norvegicus
aattccaattggctgggcaggacaa

SEQ ID NO: 66718 - DNA, 25 bp, Rattus norvegicus
aattccaattgggtgggcaggacaa

SEQ ID NO: 66719 - DNA, 25 bp, Rattus norvegicus
aattccacacaaagtttcttaagag

SEQ ID NO: 66720 - DNA, 25 bp, Rattus norvegicus
aattccacacaatgtttcttaagag

SEQ ID NO: 66721 - DNA, 25 bp, Rattus norvegicus
aattccacatgcaggtatttgtacc

SEQ ID NO: 66722 - DNA, 25 bp, Rattus norvegicus
aattccacatgctggtatttgtacc

SEQ ID NO: 66723 - DNA, 25 bp, Rattus norvegicus
aattccaccagtcccttcatataag

SEQ ID NO: 66724 - DNA, 25 bp, Rattus norvegicus
aattccaccagtgccttcatataag

SEQ ID NO: 66725 - DNA, 25 bp, Rattus norvegicus
aattccacccacagcagtgaacggt

SEQ ID NO: 66726 - DNA, 25 bp, Rattus norvegicus
aattccacccactgcagtgaacggt

SEQ ID NO: 66727 - DNA, 25 bp, Rattus norvegicus
aattccaccctgaagttagctgtca

SEQ ID NO: 66728 - DNA, 25 bp, Rattus norvegicus
aattccaccctgtagttagctgtca

SEQ ID NO: 66729 - DNA, 25 bp, Rattus norvegicus
aattccaccgttcctgtgagtgcct

SEQ ID NO: 66730 - DNA, 25 bp, Rattus norvegicus
aattccaccgttgctgtgagtgcct

SEQ ID NO: 66731 - DNA, 25 bp, Rattus norvegicus
aattccactcaaccacgtgtctgtg

SEQ ID NO: 66732 - DNA, 25 bp, Rattus norvegicus
aattccactcaagcacgtgtctgtg

SEQ ID NO: 66733 - DNA, 25 bp, Rattus norvegicus
aattccactcatattaacatagatt

SEQ ID NO: 66734 - DNA, 25 bp, Rattus norvegicus
aattccactcatattcctttatcgg

SEQ ID NO: 66735 - DNA, 25 bp, Rattus norvegicus
aattccactcattttaacatagatt

SEQ ID NO: 66736 - DNA, 25 bp, Rattus norvegicus
aattccactcattttcctttatcgg

SEQ ID NO: 66737 - DNA, 25 bp, Rattus norvegicus
aattccactgccatatttattacaa

SEQ ID NO: 66738 - DNA, 25 bp, Rattus norvegicus
aattccactgccttatttattacaa

SEQ ID NO: 66739 - DNA, 25 bp, Rattus norvegicus
aattccactgtcacatgtcttcaat

SEQ ID NO: 66740 - DNA, 25 bp, Rattus norvegicus
aattccactgtctcatgtcttcaat

SEQ ID NO: 66741 - DNA, 25 bp, Rattus norvegicus
aattccacttacaatatcctgcttc

SEQ ID NO: 66742 - DNA, 25 bp, Rattus norvegicus
aattccacttactatatcctgcttc

SEQ ID NO: 66743 - DNA, 25 bp, Rattus norvegicus
aattccactttcaagtatatgtcta

SEQ ID NO: 66744 - DNA, 25 bp, Rattus norvegicus
aattccactttctagtatatgtcta

SEQ ID NO: 66745 - DNA, 25 bp, Rattus norvegicus
aattccactttgctcaccatagagg

SEQ ID NO: 66746 - DNA, 25 bp, Rattus norvegicus
aattccactttggtcaccatagagg

SEQ ID NO: 66747 - DNA, 25 bp, Rattus norvegicus
aattccagaaccaggcactccttta

SEQ ID NO: 66748 - DNA, 25 bp, Rattus norvegicus
aattccagaaccatcttgcttgtga

SEQ ID NO: 66749 - DNA, 25 bp, Rattus norvegicus
aattccagaacctggcactccttta

SEQ ID NO: 66750 - DNA, 25 bp, Rattus norvegicus
aattccagaaccttcttgcttgtga

SEQ ID NO: 66751 - DNA, 25 bp, Rattus norvegicus
aattccagaactactctctccatga

SEQ ID NO: 66752 - DNA, 25 bp, Rattus norvegicus
aattccagaacttctctctccatga

SEQ ID NO: 66753 - DNA, 25 bp, Rattus norvegicus
aattccagacgtcctaattagccgg

SEQ ID NO: 66754 - DNA, 25 bp, Rattus norvegicus
aattccagacgtgctaattagccgg

SEQ ID NO: 66755 - DNA, 25 bp, Rattus norvegicus
aattccagagaaatcaatgcccttc

SEQ ID NO: 66756 - DNA, 25 bp, Rattus norvegicus
aattccagagaattcaatgcccttc

SEQ ID NO: 66757 - DNA, 25 bp, Rattus norvegicus
aattccagattgaagccatccatag

SEQ ID NO: 66758 - DNA, 25 bp, Rattus norvegicus
aattccagattgtagccatccatag

SEQ ID NO: 66759 - DNA, 25 bp, Rattus norvegicus
aattccagatttctgccctacgggt

SEQ ID NO: 66760 - DNA, 25 bp, Rattus norvegicus
aattccagatttgtgccctacgggt

SEQ ID NO: 66761 - DNA, 25 bp, Rattus norvegicus
aattccagcaagcacctcattcagt

SEQ ID NO: 66762 - DNA, 25 bp, Rattus norvegicus
aattccagcaaggacctcattcagt

SEQ ID NO: 66763 - DNA, 25 bp, Rattus norvegicus
aattccagcatccacttggtaactt

SEQ ID NO: 66764 - DNA, 25 bp, Rattus norvegicus
aattccagcatcgacttggtaactt

SEQ ID NO: 66765 - DNA, 25 bp, Rattus norvegicus
aattccagctagctctgagtatgct

SEQ ID NO: 66766 - DNA, 25 bp, Rattus norvegicus
aattccagctaggtctgagtatgct

SEQ ID NO: 66767 - DNA, 25 bp, Rattus norvegicus
aattccaggagcagttcccggacat

SEQ ID NO: 66768 - DNA, 25 bp, Rattus norvegicus
aattccaggagctgttcccggacat

SEQ ID NO: 66769 - DNA, 25 bp, Rattus norvegicus
aattccaggcaaacttgtaccccag

SEQ ID NO: 66770 - DNA, 25 bp, Rattus norvegicus
aattccaggcaatcttgtaccccag

SEQ ID NO: 66771 - DNA, 25 bp, Rattus norvegicus
aattccaggccccaggcattgagtg

SEQ ID NO: 66772 - DNA, 25 bp, Rattus norvegicus
aattccaggcccgaggcattgagtg

SEQ ID NO: 66773 - DNA, 25 bp, Rattus norvegicus
aattccaggctgagaagaccccaac

SEQ ID NO: 66774 - DNA, 25 bp, Rattus norvegicus
aattccaggctgtgaagaccccaac

SEQ ID NO: 66775 - DNA, 25 bp, Rattus norvegicus
aattccaggtcacccggtttacatg

SEQ ID NO: 66776 - DNA, 25 bp, Rattus norvegicus
aattccaggtcagccggtttacatg

SEQ ID NO: 66777 - DNA, 25 bp, Rattus norvegicus
aattccaggttacccaagactgcgt

SEQ ID NO: 66778 - DNA, 25 bp, Rattus norvegicus
aattccaggttagccaagactgcgt

SEQ ID NO: 66779 - DNA, 25 bp, Rattus norvegicus
aattccagtaccactgaagggtcag

SEQ ID NO: 66780 - DNA, 25 bp, Rattus norvegicus
aattccagtacctctgaagggtcag

SEQ ID NO: 66781 - DNA, 25 bp, Rattus norvegicus
aattccagtcttcttcagctccaaa

SEQ ID NO: 66782 - DNA, 25 bp, Rattus norvegicus
aattccagtcttgttcagctccaaa

SEQ ID NO: 66783 - DNA, 25 bp, Rattus norvegicus
aattccagtgccatcattcacattt

SEQ ID NO: 66784 - DNA, 25 bp, Rattus norvegicus
aattccagtgccttcattcacattt

SEQ ID NO: 66785 - DNA, 25 bp, Rattus norvegicus
aattccatatgacggtctccacaga

SEQ ID NO: 66786 - DNA, 25 bp, Rattus norvegicus
aattccatatgagggtctccacaga

SEQ ID NO: 66787 - DNA, 25 bp, Rattus norvegicus
aattccatcacaatcggatttcttg

SEQ ID NO: 66788 - DNA, 25 bp, Rattus norvegicus
aattccatcacattcggatttcttg

SEQ ID NO: 66789 - DNA, 25 bp, Rattus norvegicus
aattccatcatcaaccctgtcatat

SEQ ID NO: 66790 - DNA, 25 bp, Rattus norvegicus
aattccatcatctaccctgtcatat

SEQ ID NO: 66791 - DNA, 25 bp, Rattus norvegicus
aattccatccatagctgcctgtttt

SEQ ID NO: 66792 - DNA, 25 bp, Rattus norvegicus
aattccatccatattgcctcaaatg

SEQ ID NO: 66793 - DNA, 25 bp, Rattus norvegicus
aattccatccattgctgcctgtttt

SEQ ID NO: 66794 - DNA, 25 bp, Rattus norvegicus
aattccatccattttgcctcaaatg

SEQ ID NO: 66795 - DNA, 25 bp, Rattus norvegicus
aattccatcccaactgtttggatcc

SEQ ID NO: 66796 - DNA, 25 bp, Rattus norvegicus
aattccatcccatctgtttggatcc

SEQ ID NO: 66797 - DNA, 25 bp, Rattus norvegicus
aattccatcttaacttgtacatcca

SEQ ID NO: 66798 - DNA, 25 bp, Rattus norvegicus
aattccatcttatcttgtacatcca

SEQ ID NO: 66799 - DNA, 25 bp, Rattus norvegicus
aattccatcttcctaaacccaatga

SEQ ID NO: 66800 - DNA, 25 bp, Rattus norvegicus
aattccatcttcgtaaacccaatga

SEQ ID NO: 66801 - DNA, 25 bp, Rattus norvegicus
aattccatgagcagaggctccagcc

SEQ ID NO: 66802 - DNA, 25 bp, Rattus norvegicus
aattccatgagctgaggctccagcc

SEQ ID NO: 66803 - DNA, 25 bp, Rattus norvegicus
aattccatgcctaacttgctccagg

SEQ ID NO: 66804 - DNA, 25 bp, Rattus norvegicus
aattccatgccttacttgctccagg

SEQ ID NO: 66805 - DNA, 25 bp, Rattus norvegicus
aattccatgctaatttggccagaat

SEQ ID NO: 66806 - DNA, 25 bp, Rattus norvegicus
aattccatgctattttggccagaat

SEQ ID NO: 66807 - DNA, 25 bp, Rattus norvegicus
aattccatgggcaccatatgatagg

SEQ ID NO: 66808 - DNA, 25 bp, Rattus norvegicus
aattccatgggctccatatgatagg

SEQ ID NO: 66809 - DNA, 25 bp, Rattus norvegicus
aattccatggtcacaagaactccga

SEQ ID NO: 66810 - DNA, 25 bp, Rattus norvegicus
aattccatggtctcaagaactccga

SEQ ID NO: 66811 - DNA, 25 bp, Rattus norvegicus
aattccatgtctagtctttaggtag

SEQ ID NO: 66812 - DNA, 25 bp, Rattus norvegicus
aattccatgtcttgtctttaggtag

SEQ ID NO: 66813 - DNA, 25 bp, Rattus norvegicus
aattccattcccaagttcatacaac

SEQ ID NO: 66814 - DNA, 25 bp, Rattus norvegicus
aattccattccctagttcatacaac

SEQ ID NO: 66815 - DNA, 25 bp, Rattus norvegicus
aattccattgaaatgggcattggcc

SEQ ID NO: 66816 - DNA, 25 bp, Rattus norvegicus
aattccattgaattgggcattggcc

SEQ ID NO: 66817 - DNA, 25 bp, Rattus norvegicus
aattccattggccaagcgctttggg

SEQ ID NO: 66818 - DNA, 25 bp, Rattus norvegicus
aattccattggcgaagcgctttggg

SEQ ID NO: 66819 - DNA, 25 bp, Rattus norvegicus
aattccatttctaagggttctactg

SEQ ID NO: 66820 - DNA, 25 bp, Rattus norvegicus
aattccatttcttagggttctactg

SEQ ID NO: 66821 - DNA, 25 bp, Rattus norvegicus
aattccatttggagctatcaagcta

SEQ ID NO: 66822 - DNA, 25 bp, Rattus norvegicus
aattccatttggtgctatcaagcta

SEQ ID NO: 66823 - DNA, 25 bp, Rattus norvegicus
aattccattttgagcatatgtacta

SEQ ID NO: 66824 - DNA, 25 bp, Rattus norvegicus
aattccattttgtgcatatgtacta

SEQ ID NO: 66825 - DNA, 25 bp, Rattus norvegicus
aattcccaaggcctaggtcacaatg

SEQ ID NO: 66826 - DNA, 25 bp, Rattus norvegicus
aattcccaaggcgtaggtcacaatg

SEQ ID NO: 66827 - DNA, 25 bp, Rattus norvegicus
aattcccaatagaagccaggctaga

SEQ ID NO: 66828 - DNA, 25 bp, Rattus norvegicus
aattcccaatagtagccaggctaga

SEQ ID NO: 66829 - DNA, 25 bp, Rattus norvegicus
aattcccaatgaccacatggccatt

SEQ ID NO: 66830 - DNA, 25 bp, Rattus norvegicus
aattcccaatgagcacatggccatt

SEQ ID NO: 66831 - DNA, 25 bp, Rattus norvegicus
aattcccacctgaatttgctggcgc

SEQ ID NO: 66832 - DNA, 25 bp, Rattus norvegicus
aattcccacctgtatttgctggcgc

SEQ ID NO: 66833 - DNA, 25 bp, Rattus norvegicus
aattcccactttccagagcggcgat

SEQ ID NO: 66834 - DNA, 25 bp, Rattus norvegicus
aattcccactttgcagagcggcgat

SEQ ID NO: 66835 - DNA, 25 bp, Rattus norvegicus
aattcccagacaaactgcaagaggt

SEQ ID NO: 66836 - DNA, 25 bp, Rattus norvegicus
aattcccagacatactgcaagaggt

SEQ ID NO: 66837 - DNA, 25 bp, Rattus norvegicus
aattcccagagtcaaccagccaatt

SEQ ID NO: 66838 - DNA, 25 bp, Rattus norvegicus
aattcccagagtgaaccagccaatt

SEQ ID NO: 66839 - DNA, 25 bp, Rattus norvegicus
aattcccagcaaactgagtagccct

SEQ ID NO: 66840 - DNA, 25 bp, Rattus norvegicus
aattcccagcaatctgagtagccct

SEQ ID NO: 66841 - DNA, 25 bp, Rattus norvegicus
aattcccagggccagcctggctgct

SEQ ID NO: 66842 - DNA, 25 bp, Rattus norvegicus
aattcccagggcgagcctggctgct

SEQ ID NO: 66843 - DNA, 25 bp, Rattus norvegicus
aattcccagttcatgcttcagtttg

SEQ ID NO: 66844 - DNA, 25 bp, Rattus norvegicus
aattcccagttcttgcttcagtttg

SEQ ID NO: 66845 - DNA, 25 bp, Rattus norvegicus
aattcccatacaccattggctagct

SEQ ID NO: 66846 - DNA, 25 bp, Rattus norvegicus
aattcccatacagcattggctagct

SEQ ID NO: 66847 - DNA, 25 bp, Rattus norvegicus
aattcccataggactgagtaggtat

SEQ ID NO: 66848 - DNA, 25 bp, Rattus norvegicus
aattcccataggtctgagtaggtat

SEQ ID NO: 66849 - DNA, 25 bp, Rattus norvegicus
aattcccatttaacaagtccttctc

SEQ ID NO: 66850 - DNA, 25 bp, Rattus norvegicus
aattcccatttatcaagtccttctc

SEQ ID NO: 66851 - DNA, 25 bp, Rattus norvegicus
aattccccaacgagtctgtggaagc

SEQ ID NO: 66852 - DNA, 25 bp, Rattus norvegicus
aattccccaacgtgtctgtggaagc

SEQ ID NO: 66853 - DNA, 25 bp, Rattus norvegicus
aattccccattaagatctgtcactg

SEQ ID NO: 66854 - DNA, 25 bp, Rattus norvegicus
aattccccattatgatctgtcactg

SEQ ID NO: 66855 - DNA, 25 bp, Rattus norvegicus
aattccccggaacgaatgtctacag

SEQ ID NO: 66856 - DNA, 25 bp, Rattus norvegicus
aattccccggaaggaatgtctacag

SEQ ID NO: 66857 - DNA, 25 bp, Rattus norvegicus
aattcccctggcatagtcttgggag

SEQ ID NO: 66858 - DNA, 25 bp, Rattus norvegicus
aattcccctggcttagtcttgggag

SEQ ID NO: 66859 - DNA, 25 bp, Rattus norvegicus
aattccccttctccagctgaactgt

SEQ ID NO: 66860 - DNA, 25 bp, Rattus norvegicus
aattccccttctgcagctgaactgt

SEQ ID NO: 66861 - DNA, 25 bp, Rattus norvegicus
aattcccgaaccaatgggcgttgca

SEQ ID NO: 66862 - DNA, 25 bp, Rattus norvegicus
aattcccgaacctatgggcgttgca

SEQ ID NO: 66863 - DNA, 25 bp, Rattus norvegicus
aattccctaggtactgccatgccaa

SEQ ID NO: 66864 - DNA, 25 bp, Rattus norvegicus
aattccctaggttctgccatgccaa

SEQ ID NO: 66865 - DNA, 25 bp, Rattus norvegicus
aattccctcctgagactcgttagca

SEQ ID NO: 66866 - DNA, 25 bp, Rattus norvegicus
aattccctcctgtgactcgttagca

SEQ ID NO: 66867 - DNA, 25 bp, Rattus norvegicus
aattccctgcaacctattcaactgg

SEQ ID NO: 66868 - DNA, 25 bp, Rattus norvegicus
aattccctgcaagctattcaactgg

SEQ ID NO: 66869 - DNA, 25 bp, Rattus norvegicus
aattccctggagagtttcttcagct

SEQ ID NO: 66870 - DNA, 25 bp, Rattus norvegicus
aattccctggagtgtttcttcagct

SEQ ID NO: 66871 - DNA, 25 bp, Rattus norvegicus
aattccctggtaactatcagacaga

SEQ ID NO: 66872 - DNA, 25 bp, Rattus norvegicus
aattccctggtatctatcagacaga

SEQ ID NO: 66873 - DNA, 25 bp, Rattus norvegicus
aattccctggttcggttgcagacct

SEQ ID NO: 66874 - DNA, 25 bp, Rattus norvegicus
aattccctggttgggttgcagacct

SEQ ID NO: 66875 - DNA, 25 bp, Rattus norvegicus
aattcccttaaaactatctcgcttg

SEQ ID NO: 66876 - DNA, 25 bp, Rattus norvegicus
aattcccttaaatctatctcgcttg

SEQ ID NO: 66877 - DNA, 25 bp, Rattus norvegicus
aattcccttcttcgacttctgtatg

SEQ ID NO: 66878 - DNA, 25 bp, Rattus norvegicus
aattcccttcttcgattttgccagg

SEQ ID NO: 66879 - DNA, 25 bp, Rattus norvegicus
aattcccttcttggacttctgtatg

SEQ ID NO: 66880 - DNA, 25 bp, Rattus norvegicus
aattcccttcttggattttgccagg

SEQ ID NO: 66881 - DNA, 25 bp, Rattus norvegicus
aattccctttatactttcagtggtg

SEQ ID NO: 66882 - DNA, 25 bp, Rattus norvegicus
aattccctttattctttcagtggtg

SEQ ID NO: 66883 - DNA, 25 bp, Rattus norvegicus
aattccgacttactaactccagagc

SEQ ID NO: 66884 - DNA, 25 bp, Rattus norvegicus
aattccgacttagtaactccagagc

SEQ ID NO: 66885 - DNA, 25 bp, Rattus norvegicus
aattccgagggcagggtgttcttca

SEQ ID NO: 66886 - DNA, 25 bp, Rattus norvegicus
aattccgagggctgggtgttcttca

SEQ ID NO: 66887 - DNA, 25 bp, Rattus norvegicus
aattccgaggttcagtgctgctgtt

SEQ ID NO: 66888 - DNA, 25 bp, Rattus norvegicus
aattccgaggttgagtgctgctgtt

SEQ ID NO: 66889 - DNA, 25 bp, Rattus norvegicus
aattccgcgcaaacatttctccagt

SEQ ID NO: 66890 - DNA, 25 bp, Rattus norvegicus
aattccgcgcaatcatttctccagt

SEQ ID NO: 66891 - DNA, 25 bp, Rattus norvegicus
aattccgctgtccaccacaatggaa

SEQ ID NO: 66892 - DNA, 25 bp, Rattus norvegicus
aattccgctgtcgaccacaatggaa

SEQ ID NO: 66893 - DNA, 25 bp, Rattus norvegicus
aattccggatcgaagattcccagcc

SEQ ID NO: 66894 - DNA, 25 bp, Rattus norvegicus
aattccggatcgtagattcccagcc

SEQ ID NO: 66895 - DNA, 25 bp, Rattus norvegicus
aattccggcccgaggacgctgacta

SEQ ID NO: 66896 - DNA, 25 bp, Rattus norvegicus
aattccggcccgtggacgctgacta

SEQ ID NO: 66897 - DNA, 25 bp, Rattus norvegicus
aattccggctagaataaaggttgct

SEQ ID NO: 66898 - DNA, 25 bp, Rattus norvegicus
aattccggctagtataaaggttgct

SEQ ID NO: 66899 - DNA, 25 bp, Rattus norvegicus
aattccggctggctaaagagctggt

SEQ ID NO: 66900 - DNA, 25 bp, Rattus norvegicus
aattccggctgggtaaagagctggt

SEQ ID NO: 66901 - DNA, 25 bp, Rattus norvegicus
aattccgtgattattatatcctgca

SEQ ID NO: 66902 - DNA, 25 bp, Rattus norvegicus
aattccgtgatttttatatcctgca

SEQ ID NO: 66903 - DNA, 25 bp, Rattus norvegicus
aattccgtgcctccagataattcat

SEQ ID NO: 66904 - DNA, 25 bp, Rattus norvegicus
aattccgtgcctgcagataattcat

SEQ ID NO: 66905 - DNA, 25 bp, Rattus norvegicus
aattccgttaatatctgtcgccaag

SEQ ID NO: 66906 - DNA, 25 bp, Rattus norvegicus
aattccgttaatttctgtcgccaag

SEQ ID NO: 66907 - DNA, 25 bp, Rattus norvegicus
aattccgttgacatgttggctgcca

SEQ ID NO: 66908 - DNA, 25 bp, Rattus norvegicus
aattccgttgacttgttggctgcca

SEQ ID NO: 66909 - DNA, 25 bp, Rattus norvegicus
aattcctaacgaagcctttgcagcc

SEQ ID NO: 66910 - DNA, 25 bp, Rattus norvegicus
aattcctaacgatgcctttgcagcc

SEQ ID NO: 66911 - DNA, 25 bp, Rattus norvegicus
aattcctaagctcgcgagtccttat

SEQ ID NO: 66912 - DNA, 25 bp, Rattus norvegicus
aattcctaagctggcgagtccttat

SEQ ID NO: 66913 - DNA, 25 bp, Rattus norvegicus
aattcctaaggacgatacccctgag

SEQ ID NO: 66914 - DNA, 25 bp, Rattus norvegicus
aattcctaaggaggatacccctgag

SEQ ID NO: 66915 - DNA, 25 bp, Rattus norvegicus
aattcctaattcaagacccacacta

SEQ ID NO: 66916 - DNA, 25 bp, Rattus norvegicus
aattcctaattctagacccacacta

SEQ ID NO: 66917 - DNA, 25 bp, Rattus norvegicus
aattcctacacaaatttgcctgcca

SEQ ID NO: 66918 - DNA, 25 bp, Rattus norvegicus
aattcctacacatatttgcctgcca

SEQ ID NO: 66919 - DNA, 25 bp, Rattus norvegicus
aattcctaccaaagtccaccagagg

SEQ ID NO: 66920 - DNA, 25 bp, Rattus norvegicus
aattcctaccaatgtccaccagagg

SEQ ID NO: 66921 - DNA, 25 bp, Rattus norvegicus
aattcctactatatgaaatgccttg

SEQ ID NO: 66922 - DNA, 25 bp, Rattus norvegicus
aattcctactatttgaaatgccttg

SEQ ID NO: 66923 - DNA, 25 bp, Rattus norvegicus
aattcctacttaatacgcacgatgc

SEQ ID NO: 66924 - DNA, 25 bp, Rattus norvegicus
aattcctacttattacgcacgatgc

SEQ ID NO: 66925 - DNA, 25 bp, Rattus norvegicus
aattcctagataccacatcttctgc

SEQ ID NO: 66926 - DNA, 25 bp, Rattus norvegicus
aattcctagatagcacatcttctgc

SEQ ID NO: 66927 - DNA, 25 bp, Rattus norvegicus
aattcctagcttatctctagttatg

SEQ ID NO: 66928 - DNA, 25 bp, Rattus norvegicus
aattcctagcttttctctagttatg

SEQ ID NO: 66929 - DNA, 25 bp, Rattus norvegicus
aattcctaggctctgatgtcgaaga

SEQ ID NO: 66930 - DNA, 25 bp, Rattus norvegicus
aattcctaggctgtgatgtcgaaga

SEQ ID NO: 66931 - DNA, 25 bp, Rattus norvegicus
aattcctagggaaaccaggttgcag

SEQ ID NO: 66932 - DNA, 25 bp, Rattus norvegicus
aattcctagggataccaggttgcag

SEQ ID NO: 66933 - DNA, 25 bp, Rattus norvegicus
aattcctcaccacatacaggcagtg

SEQ ID NO: 66934 - DNA, 25 bp, Rattus norvegicus
aattcctcaccagatacaggcagtg

SEQ ID NO: 66935 - DNA, 25 bp, Rattus norvegicus
aattcctcagtcagtatcctcatga

SEQ ID NO: 66936 - DNA, 25 bp, Rattus norvegicus
aattcctcagtctgtatcctcatga

SEQ ID NO: 66937 - DNA, 25 bp, Rattus norvegicus
aattcctccactcctgtcttagaag

SEQ ID NO: 66938 - DNA, 25 bp, Rattus norvegicus
aattcctccactgctgtcttagaag

SEQ ID NO: 66939 - DNA, 25 bp, Rattus norvegicus
aattcctcctggcattttcattgtg

SEQ ID NO: 66940 - DNA, 25 bp, Rattus norvegicus
aattcctcctgggattttcattgtg

SEQ ID NO: 66941 - DNA, 25 bp, Rattus norvegicus
aattcctcctttccccaataaaatg

SEQ ID NO: 66942 - DNA, 25 bp, Rattus norvegicus
aattcctcctttgcccaataaaatg

SEQ ID NO: 66943 - DNA, 25 bp, Rattus norvegicus
aattcctcggcgctgtacttctggc

SEQ ID NO: 66944 - DNA, 25 bp, Rattus norvegicus
aattcctcggcggtgtacttctggc

SEQ ID NO: 66945 - DNA, 25 bp, Rattus norvegicus
aattcctcgtgcagcaggtgctctg

SEQ ID NO: 66946 - DNA, 25 bp, Rattus norvegicus
aattcctcgtgctgcaggtgctctg

SEQ ID NO: 66947 - DNA, 25 bp, Rattus norvegicus
aattcctctagaacagttttgtctg

SEQ ID NO: 66948 - DNA, 25 bp, Rattus norvegicus
aattcctctagatcagttttgtctg

SEQ ID NO: 66949 - DNA, 25 bp, Rattus norvegicus
aattcctctgaaatgcacactttaa

SEQ ID NO: 66950 - DNA, 25 bp, Rattus norvegicus
aattcctctgaattgcacactttaa

SEQ ID NO: 66951 - DNA, 25 bp, Rattus norvegicus
aattcctgaaacacagcatgactgt

SEQ ID NO: 66952 - DNA, 25 bp, Rattus norvegicus
aattcctgaaactcagcatgactgt

SEQ ID NO: 66953 - DNA, 25 bp, Rattus norvegicus
aattcctgaactctaggtcaccact

SEQ ID NO: 66954 - DNA, 25 bp, Rattus norvegicus
aattcctgaactgtaggtcaccact

SEQ ID NO: 66955 - DNA, 25 bp, Rattus norvegicus
aattcctgagaccttagtttgcttc

SEQ ID NO: 66956 - DNA, 25 bp, Rattus norvegicus
aattcctgagacgttagtttgcttc

SEQ ID NO: 66957 - DNA, 25 bp, Rattus norvegicus
aattcctgagagagtcctatatttg

SEQ ID NO: 66958 - DNA, 25 bp, Rattus norvegicus
aattcctgagagtgtcctatatttg

SEQ ID NO: 66959 - DNA, 25 bp, Rattus norvegicus
aattcctgagtccagtgctaacgct

SEQ ID NO: 66960 - DNA, 25 bp, Rattus norvegicus
aattcctgagtcgagtgctaacgct

SEQ ID NO: 66961 - DNA, 25 bp, Rattus norvegicus
aattcctgagttcataaagtctcaa

SEQ ID NO: 66962 - DNA, 25 bp, Rattus norvegicus
aattcctgagttgataaagtctcaa

SEQ ID NO: 66963 - DNA, 25 bp, Rattus norvegicus
aattcctgatccaccagtcactacc

SEQ ID NO: 66964 - DNA, 25 bp, Rattus norvegicus
aattcctgatcctccagtcactacc

SEQ ID NO: 66965 - DNA, 25 bp, Rattus norvegicus
aattcctgatgtcggcaggtcctgc

SEQ ID NO: 66966 - DNA, 25 bp, Rattus norvegicus
aattcctgatgtgggcaggtcctgc

SEQ ID NO: 66967 - DNA, 25 bp, Rattus norvegicus
aattcctgccaaacacaggctctta

SEQ ID NO: 66968 - DNA, 25 bp, Rattus norvegicus
aattcctgccaatcacaggctctta

SEQ ID NO: 66969 - DNA, 25 bp, Rattus norvegicus
aattcctgccgcatcggtaagaata

SEQ ID NO: 66970 - DNA, 25 bp, Rattus norvegicus
aattcctgccgcttcggtaagaata

SEQ ID NO: 66971 - DNA, 25 bp, Rattus norvegicus
aattcctgcgctcacagcagaacgt

SEQ ID NO: 66972 - DNA, 25 bp, Rattus norvegicus
aattcctgcgctgacagcagaacgt

SEQ ID NO: 66973 - DNA, 25 bp, Rattus norvegicus
aattcctgcgtgagtgcaggctcaa

SEQ ID NO: 66974 - DNA, 25 bp, Rattus norvegicus
aattcctgcgtgtgtgcaggctcaa

SEQ ID NO: 66975 - DNA, 25 bp, Rattus norvegicus
aattcctggatcacgggatctaggc

SEQ ID NO: 66976 - DNA, 25 bp, Rattus norvegicus
aattcctggatctcgggatctaggc

SEQ ID NO: 66977 - DNA, 25 bp, Rattus norvegicus
aattcctggatgctcatttggaggt

SEQ ID NO: 66978 - DNA, 25 bp, Rattus norvegicus
aattcctggatggtcatttggaggt

SEQ ID NO: 66979 - DNA, 25 bp, Rattus norvegicus
aattcctgggaaacttgggttgatg

SEQ ID NO: 66980 - DNA, 25 bp, Rattus norvegicus
aattcctgggaatcttgggttgatg

SEQ ID NO: 66981 - DNA, 25 bp, Rattus norvegicus
aattcctgggctcgtagattgcggc

SEQ ID NO: 66982 - DNA, 25 bp, Rattus norvegicus
aattcctgggctggtagattgcggc

SEQ ID NO: 66983 - DNA, 25 bp, Rattus norvegicus
aattccttaaatcctagtgagtcag

SEQ ID NO: 66984 - DNA, 25 bp, Rattus norvegicus
aattccttaaatgctagtgagtcag

SEQ ID NO: 66985 - DNA, 25 bp, Rattus norvegicus
aattccttcatgatggtgatcttct

SEQ ID NO: 66986 - DNA, 25 bp, Rattus norvegicus
aattccttcatgttggtgatcttct

SEQ ID NO: 66987 - DNA, 25 bp, Rattus norvegicus
aattccttcctcagctgttgtataa

SEQ ID NO: 66988 - DNA, 25 bp, Rattus norvegicus
aattccttcctctgctgttgtataa

SEQ ID NO: 66989 - DNA, 25 bp, Rattus norvegicus
aattccttcctgcacaagctttctt

SEQ ID NO: 66990 - DNA, 25 bp, Rattus norvegicus
aattccttcctggacaagctttctt

SEQ ID NO: 66991 - DNA, 25 bp, Rattus norvegicus
aattccttctgtaaagcccatgttc

SEQ ID NO: 66992 - DNA, 25 bp, Rattus norvegicus
aattccttctgtagaaaggtgacag

SEQ ID NO: 66993 - DNA, 25 bp, Rattus norvegicus
aattccttctgttaagcccatgttc

SEQ ID NO: 66994 - DNA, 25 bp, Rattus norvegicus
aattccttctgttgaaaggtgacag

SEQ ID NO: 66995 - DNA, 25 bp, Rattus norvegicus
aattccttcttgcatgttctccatc

SEQ ID NO: 66996 - DNA, 25 bp, Rattus norvegicus
aattccttcttggatgttctccatc

SEQ ID NO: 66997 - DNA, 25 bp, Rattus norvegicus
aattccttgatcatagatgtgtcca

SEQ ID NO: 66998 - DNA, 25 bp, Rattus norvegicus
aattccttgatcttagatgtgtcca

SEQ ID NO: 66999 - DNA, 25 bp, Rattus norvegicus
aattccttggaaatcgtcatcttca

SEQ ID NO: 67000 - DNA, 25 bp, Rattus norvegicus
aattccttggaattcgtcatcttca

SEQ ID NO: 67001 - DNA, 25 bp, Rattus norvegicus
aattccttgtgtatctattgagtta

SEQ ID NO: 67002 - DNA, 25 bp, Rattus norvegicus
aattccttgtgtttctattgagtta

SEQ ID NO: 67003 - DNA, 25 bp, Rattus norvegicus
aattcctttcctagagtcactgggt

SEQ ID NO: 67004 - DNA, 25 bp, Rattus norvegicus
aattcctttccttgagtcactgggt

SEQ ID NO: 67005 - DNA, 25 bp, Rattus norvegicus
aattcctttgaaacggtcaccagca

SEQ ID NO: 67006 - DNA, 25 bp, Rattus norvegicus
aattcctttgaatcggtcaccagca

SEQ ID NO: 67007 - DNA, 25 bp, Rattus norvegicus
aattcctttgtcaaatgtgtagtga

SEQ ID NO: 67008 - DNA, 25 bp, Rattus norvegicus
aattcctttgtctaatgtgtagtga

SEQ ID NO: 67009 - DNA, 25 bp, Rattus norvegicus
aattcgaaagtcacgtcatgcccag

SEQ ID NO: 67010 - DNA, 25 bp, Rattus norvegicus
aattcgaaagtctcgtcatgcccag

SEQ ID NO: 67011 - DNA, 25 bp, Rattus norvegicus
aattcgaagattacacacagcccat

SEQ ID NO: 67012 - DNA, 25 bp, Rattus norvegicus
aattcgaagatttcacacagcccat

SEQ ID NO: 67013 - DNA, 25 bp, Rattus norvegicus
aattcgacacagatgggcatggtat

SEQ ID NO: 67014 - DNA, 25 bp, Rattus norvegicus
aattcgacacagttgggcatggtat

SEQ ID NO: 67015 - DNA, 25 bp, Rattus norvegicus
aattcgactgaaagtgccactcgcc

SEQ ID NO: 67016 - DNA, 25 bp, Rattus norvegicus
aattcgactgaatgtgccactcgcc

SEQ ID NO: 67017 - DNA, 25 bp, Rattus norvegicus
aattcgacttgtagctagtgatggc

SEQ ID NO: 67018 - DNA, 25 bp, Rattus norvegicus
aattcgacttgttgctagtgatggc

SEQ ID NO: 67019 - DNA, 25 bp, Rattus norvegicus
aattcgagactccagtggacgacct

SEQ ID NO: 67020 - DNA, 25 bp, Rattus norvegicus
aattcgagactcgagtggacgacct

SEQ ID NO: 67021 - DNA, 25 bp, Rattus norvegicus
aattcgagcagcatgtcttgcaggc

SEQ ID NO: 67022 - DNA, 25 bp, Rattus norvegicus
aattcgagcagcttgtcttgcaggc

SEQ ID NO: 67023 - DNA, 25 bp, Rattus norvegicus
aattcgaggcttacatgccattgaa

SEQ ID NO: 67024 - DNA, 25 bp, Rattus norvegicus
aattcgaggctttcatgccattgaa

SEQ ID NO: 67025 - DNA, 25 bp, Rattus norvegicus
aattcgaggtcaacctgactaccta

SEQ ID NO: 67026 - DNA, 25 bp, Rattus norvegicus
aattcgaggtcatcctgactaccta

SEQ ID NO: 67027 - DNA, 25 bp, Rattus norvegicus
aattcgatgcgtccaaacccaggaa

SEQ ID NO: 67028 - DNA, 25 bp, Rattus norvegicus
aattcgatgcgtgcaaacccaggaa

SEQ ID NO: 67029 - DNA, 25 bp, Rattus norvegicus
aattcgattgccacactagggacaa

SEQ ID NO: 67030 - DNA, 25 bp, Rattus norvegicus
aattcgattgcctcactagggacaa

SEQ ID NO: 67031 - DNA, 25 bp, Rattus norvegicus
aattcgcagttgcttctgtgttgtt

SEQ ID NO: 67032 - DNA, 25 bp, Rattus norvegicus
aattcgcagttggttctgtgttgtt

SEQ ID NO: 67033 - DNA, 25 bp, Rattus norvegicus
aattcgcataagcttctggttggta

SEQ ID NO: 67034 - DNA, 25 bp, Rattus norvegicus
aattcgcataaggttctggttggta

SEQ ID NO: 67035 - DNA, 25 bp, Rattus norvegicus
aattcgccatgtacctctactgctt

SEQ ID NO: 67036 - DNA, 25 bp, Rattus norvegicus
aattcgccatgttcctctactgctt

SEQ ID NO: 67037 - DNA, 25 bp, Rattus norvegicus
aattcgcctgcgctgaccgaggctt

SEQ ID NO: 67038 - DNA, 25 bp, Rattus norvegicus
aattcgcctgcggtgaccgaggctt

SEQ ID NO: 67039 - DNA, 25 bp, Rattus norvegicus
aattcgcctgtaatgggactgtgat

SEQ ID NO: 67040 - DNA, 25 bp, Rattus norvegicus
aattcgcctgtattgggactgtgat

SEQ ID NO: 67041 - DNA, 25 bp, Rattus norvegicus
aattcgcctgttcatggagctggtg

SEQ ID NO: 67042 - DNA, 25 bp, Rattus norvegicus
aattcgcctgttgatggagctggtg

SEQ ID NO: 67043 - DNA, 25 bp, Rattus norvegicus
aattcgcggaagacagctttccacc

SEQ ID NO: 67044 - DNA, 25 bp, Rattus norvegicus
aattcgcggaagtcagctttccacc

SEQ ID NO: 67045 - DNA, 25 bp, Rattus norvegicus
aattcgctgaaaccttatcttttta

SEQ ID NO: 67046 - DNA, 25 bp, Rattus norvegicus
aattcgctgaaagcttatcttttta

SEQ ID NO: 67047 - DNA, 25 bp, Rattus norvegicus
aattcgcttgtgctagtggtctgct

SEQ ID NO: 67048 - DNA, 25 bp, Rattus norvegicus
aattcgcttgtggtagtggtctgct

SEQ ID NO: 67049 - DNA, 25 bp, Rattus norvegicus
aattcggatcagacggttgttggcg

SEQ ID NO: 67050 - DNA, 25 bp, Rattus norvegicus
aattcggatcagtcggttgttggcg

SEQ ID NO: 67051 - DNA, 25 bp, Rattus norvegicus
aattcggatgctcgataatcgcaaa

SEQ ID NO: 67052 - DNA, 25 bp, Rattus norvegicus
aattcggatgctggataatcgcaaa

SEQ ID NO: 67053 - DNA, 25 bp, Rattus norvegicus
aattcggcaagacctgcctgacaga

SEQ ID NO: 67054 - DNA, 25 bp, Rattus norvegicus
aattcggcaagagctgcctgacaga

SEQ ID NO: 67055 - DNA, 25 bp, Rattus norvegicus
aattcggcacgaccacaggcgcctg

SEQ ID NO: 67056 - DNA, 25 bp, Rattus norvegicus
aattcggcacgagcacaggcgcctg

SEQ ID NO: 67057 - DNA, 25 bp, Rattus norvegicus
aattcggcttttccttactggccat

SEQ ID NO: 67058 - DNA, 25 bp, Rattus norvegicus
aattcggcttttgcttactggccat

SEQ ID NO: 67059 - DNA, 25 bp, Rattus norvegicus
aattcgggactgctggtgcaatgct

SEQ ID NO: 67060 - DNA, 25 bp, Rattus norvegicus
aattcgggactggtggtgcaatgct

SEQ ID NO: 67061 - DNA, 25 bp, Rattus norvegicus
aattcgggatgcaccttcaagcagc

SEQ ID NO: 67062 - DNA, 25 bp, Rattus norvegicus
aattcgggatgctccttcaagcagc

SEQ ID NO: 67063 - DNA, 25 bp, Rattus norvegicus
aattcgggatgtcataaaggtgcac

SEQ ID NO: 67064 - DNA, 25 bp, Rattus norvegicus
aattcgggatgtgataaaggtgcac

SEQ ID NO: 67065 - DNA, 25 bp, Rattus norvegicus
aattcggtccccagcggctgagggt

SEQ ID NO: 67066 - DNA, 25 bp, Rattus norvegicus
aattcggtcccctgcggctgagggt

SEQ ID NO: 67067 - DNA, 25 bp, Rattus norvegicus
aattcggtcctgagcgcatgtatat

SEQ ID NO: 67068 - DNA, 25 bp, Rattus norvegicus
aattcggtcctgtgcgcatgtatat

SEQ ID NO: 67069 - DNA, 25 bp, Rattus norvegicus
aattcggtctggctagtatttgcaa

SEQ ID NO: 67070 - DNA, 25 bp, Rattus norvegicus
aattcggtctgggtagtatttgcaa

SEQ ID NO: 67071 - DNA, 25 bp, Rattus norvegicus
aattcggtgcacacagactgacctg

SEQ ID NO: 67072 - DNA, 25 bp, Rattus norvegicus
aattcggtgcactcagactgacctg

SEQ ID NO: 67073 - DNA, 25 bp, Rattus norvegicus
aattcggtgcccactgaagcctggt

SEQ ID NO: 67074 - DNA, 25 bp, Rattus norvegicus
aattcggtgccctctgaagcctggt

SEQ ID NO: 67075 - DNA, 25 bp, Rattus norvegicus
aattcggttcccagcagaggccagc

SEQ ID NO: 67076 - DNA, 25 bp, Rattus norvegicus
aattcggttccctgcagaggccagc

SEQ ID NO: 67077 - DNA, 25 bp, Rattus norvegicus
aattcggttctcagaggcctcaaat

SEQ ID NO: 67078 - DNA, 25 bp, Rattus norvegicus
aattcggttctctgaggcctcaaat

SEQ ID NO: 67079 - DNA, 25 bp, Rattus norvegicus
aattcgtagcagcttaattctgttg

SEQ ID NO: 67080 - DNA, 25 bp, Rattus norvegicus
aattcgtagcaggttaattctgttg

SEQ ID NO: 67081 - DNA, 25 bp, Rattus norvegicus
aattcgtcatcacgctgcacaggct

SEQ ID NO: 67082 - DNA, 25 bp, Rattus norvegicus
aattcgtcatcaggctgcacaggct

SEQ ID NO: 67083 - DNA, 25 bp, Rattus norvegicus
aattcgtcatctacagtgtcatctg

SEQ ID NO: 67084 - DNA, 25 bp, Rattus norvegicus
aattcgtcatcttcagtgtcatctg

SEQ ID NO: 67085 - DNA, 25 bp, Rattus norvegicus
aattcgtcttttatatctcagtaca

SEQ ID NO: 67086 - DNA, 25 bp, Rattus norvegicus
aattcgtcttttttatctcagtaca

SEQ ID NO: 67087 - DNA, 25 bp, Rattus norvegicus
aattcgtgagtccggtactacattc

SEQ ID NO: 67088 - DNA, 25 bp, Rattus norvegicus
aattcgtgagtcgggtactacattc

SEQ ID NO: 67089 - DNA, 25 bp, Rattus norvegicus
aattcgtggattacatttccttctc

SEQ ID NO: 67090 - DNA, 25 bp, Rattus norvegicus
aattcgtggatttcatttccttctc

SEQ ID NO: 67091 - DNA, 25 bp, Rattus norvegicus
aattcgtggcggagattctgatgta

SEQ ID NO: 67092 - DNA, 25 bp, Rattus norvegicus
aattcgtggcggtgattctgatgta

SEQ ID NO: 67093 - DNA, 25 bp, Rattus norvegicus
aattcgtgggagattgggcctcact

SEQ ID NO: 67094 - DNA, 25 bp, Rattus norvegicus
aattcgtgggagtttgggcctcact

SEQ ID NO: 67095 - DNA, 25 bp, Rattus norvegicus
aattcgtgtttgatgccgtgacaga

SEQ ID NO: 67096 - DNA, 25 bp, Rattus norvegicus
aattcgtgtttgttgccgtgacaga

SEQ ID NO: 67097 - DNA, 25 bp, Rattus norvegicus
aattcgttgatcatcgctgtatgac

SEQ ID NO: 67098 - DNA, 25 bp, Rattus norvegicus
aattcgttgatcttcgctgtatgac

SEQ ID NO: 67099 - DNA, 25 bp, Rattus norvegicus
aattcgttgctgagtccacaagact

SEQ ID NO: 67100 - DNA, 25 bp, Rattus norvegicus
aattcgttgctgtgtccacaagact

SEQ ID NO: 67101 - DNA, 25 bp, Rattus norvegicus
aattcgttgtgtcaccctgaagatg

SEQ ID NO: 67102 - DNA, 25 bp, Rattus norvegicus
aattcgttgtgtgaccctgaagatg

SEQ ID NO: 67103 - DNA, 25 bp, Rattus norvegicus
aattcgtttctactttcacacacag

SEQ ID NO: 67104 - DNA, 25 bp, Rattus norvegicus
aattcgtttctagtttcacacacag

SEQ ID NO: 67105 - DNA, 25 bp, Rattus norvegicus
aattctaaaactcctttggccgcta

SEQ ID NO: 67106 - DNA, 25 bp, Rattus norvegicus
aattctaaaactgctttggccgcta

SEQ ID NO: 67107 - DNA, 25 bp, Rattus norvegicus
aattctaaatctagcatgtttgcca

SEQ ID NO: 67108 - DNA, 25 bp, Rattus norvegicus
aattctaaatcttgcatgtttgcca

SEQ ID NO: 67109 - DNA, 25 bp, Rattus norvegicus
aattctaacttgcatcacttttctt

SEQ ID NO: 67110 - DNA, 25 bp, Rattus norvegicus
aattctaacttggatcacttttctt

SEQ ID NO: 67111 - DNA, 25 bp, Rattus norvegicus
aattctaagacaatgtgcccaccca

SEQ ID NO: 67112 - DNA, 25 bp, Rattus norvegicus
aattctaagacattgtgcccaccca

SEQ ID NO: 67113 - DNA, 25 bp, Rattus norvegicus
aattctaatcgcaccattgtgatgt

SEQ ID NO: 67114 - DNA, 25 bp, Rattus norvegicus
aattctaatcgctccattgtgatgt

SEQ ID NO: 67115 - DNA, 25 bp, Rattus norvegicus
aattctacatgaagccagattcaaa

SEQ ID NO: 67116 - DNA, 25 bp, Rattus norvegicus
aattctacatgatgccagattcaaa

SEQ ID NO: 67117 - DNA, 25 bp, Rattus norvegicus
aattctacatttaggtgcataagca

SEQ ID NO: 67118 - DNA, 25 bp, Rattus norvegicus
aattctacattttggtgcataagca

SEQ ID NO: 67119 - DNA, 25 bp, Rattus norvegicus
aattctaccctgaatttcatcgacg

SEQ ID NO: 67120 - DNA, 25 bp, Rattus norvegicus
aattctaccctgtatttcatcgacg

SEQ ID NO: 67121 - DNA, 25 bp, Rattus norvegicus
aattctacccttatgagcgtgtggc

SEQ ID NO: 67122 - DNA, 25 bp, Rattus norvegicus
aattctacccttttgagcgtgtggc

SEQ ID NO: 67123 - DNA, 25 bp, Rattus norvegicus
aattctaccttgaaccctatctgaa

SEQ ID NO: 67124 - DNA, 25 bp, Rattus norvegicus
aattctaccttgtaccctatctgaa

SEQ ID NO: 67125 - DNA, 25 bp, Rattus norvegicus
aattctactctaaactgttaagttg

SEQ ID NO: 67126 - DNA, 25 bp, Rattus norvegicus
aattctactctatactgttaagttg

SEQ ID NO: 67127 - DNA, 25 bp, Rattus norvegicus
aattctactgccacacataattgcc

SEQ ID NO: 67128 - DNA, 25 bp, Rattus norvegicus
aattctactgcctcacataattgcc

SEQ ID NO: 67129 - DNA, 25 bp, Rattus norvegicus
aattctactgctagatctgtctgtg

SEQ ID NO: 67130 - DNA, 25 bp, Rattus norvegicus
aattctactgcttgatctgtctgtg

SEQ ID NO: 67131 - DNA, 25 bp, Rattus norvegicus
aattctactgtaagtgtgtgtggca

SEQ ID NO: 67132 - DNA, 25 bp, Rattus norvegicus
aattctactgtatgtgtgtgtggca

SEQ ID NO: 67133 - DNA, 25 bp, Rattus norvegicus
aattctacttatctttacatctcta

SEQ ID NO: 67134 - DNA, 25 bp, Rattus norvegicus
aattctacttatgtttacatctcta

SEQ ID NO: 67135 - DNA, 25 bp, Rattus norvegicus
aattctagaaatcctgccgggccat

SEQ ID NO: 67136 - DNA, 25 bp, Rattus norvegicus
aattctagaaatgctgccgggccat

SEQ ID NO: 67137 - DNA, 25 bp, Rattus norvegicus
aattctagaagtatagggccagcta

SEQ ID NO: 67138 - DNA, 25 bp, Rattus norvegicus
aattctagaagtttagggccagcta

SEQ ID NO: 67139 - DNA, 25 bp, Rattus norvegicus
aattctagagtaaacccacctggct

SEQ ID NO: 67140 - DNA, 25 bp, Rattus norvegicus
aattctagagtatacccacctggct

SEQ ID NO: 67141 - DNA, 25 bp, Rattus norvegicus
aattctagcaaacagccggctgaaa

SEQ ID NO: 67142 - DNA, 25 bp, Rattus norvegicus
aattctagcaaagagccggctgaaa

SEQ ID NO: 67143 - DNA, 25 bp, Rattus norvegicus
aattctagccttacatgattgccca

SEQ ID NO: 67144 - DNA, 25 bp, Rattus norvegicus
aattctagcctttcatgattgccca

SEQ ID NO: 67145 - DNA, 25 bp, Rattus norvegicus
aattctaggacacattctgggagcc

SEQ ID NO: 67146 - DNA, 25 bp, Rattus norvegicus
aattctaggacagattctgggagcc

SEQ ID NO: 67147 - DNA, 25 bp, Rattus norvegicus
aattctagttatattcgacgtgtga

SEQ ID NO: 67148 - DNA, 25 bp, Rattus norvegicus
aattctagttattttcgacgtgtga

SEQ ID NO: 67149 - DNA, 25 bp, Rattus norvegicus
aattctataacaacacccgttctgc

SEQ ID NO: 67150 - DNA, 25 bp, Rattus norvegicus
aattctataacatcacccgttctgc

SEQ ID NO: 67151 - DNA, 25 bp, Rattus norvegicus
aattctatagctcagtttattcaag

SEQ ID NO: 67152 - DNA, 25 bp, Rattus norvegicus
aattctatagctgagtttattcaag

SEQ ID NO: 67153 - DNA, 25 bp, Rattus norvegicus
aattctatatgtatgtgcctgctat

SEQ ID NO: 67154 - DNA, 25 bp, Rattus norvegicus
aattctatatgtttgtgcctgctat

SEQ ID NO: 67155 - DNA, 25 bp, Rattus norvegicus
aattctatcgggatatcctttcact

SEQ ID NO: 67156 - DNA, 25 bp, Rattus norvegicus
aattctatcgggttatcctttcact

SEQ ID NO: 67157 - DNA, 25 bp, Rattus norvegicus
aattctatcttactatagtgcgatg

SEQ ID NO: 67158 - DNA, 25 bp, Rattus norvegicus
aattctatcttagtatagtgcgatg

SEQ ID NO: 67159 - DNA, 25 bp, Rattus norvegicus
aattctattaacacctgcctgttgt

SEQ ID NO: 67160 - DNA, 25 bp, Rattus norvegicus
aattctattaactcctgcctgttgt

SEQ ID NO: 67161 - DNA, 25 bp, Rattus norvegicus
aattctatttctaggatatttcctt

SEQ ID NO: 67162 - DNA, 25 bp, Rattus norvegicus
aattctatttcttggatatttcctt

SEQ ID NO: 67163 - DNA, 25 bp, Rattus norvegicus
aattctcaaaacacaatggacaggc

SEQ ID NO: 67164 - DNA, 25 bp, Rattus norvegicus
aattctcaaaactcaatggacaggc

SEQ ID NO: 67165 - DNA, 25 bp, Rattus norvegicus
aattctcaaagtactgcactgccag

SEQ ID NO: 67166 - DNA, 25 bp, Rattus norvegicus
aattctcaaagttctgcactgccag

SEQ ID NO: 67167 - DNA, 25 bp, Rattus norvegicus
aattctcacagcagtttttataaga

SEQ ID NO: 67168 - DNA, 25 bp, Rattus norvegicus
aattctcacagctgtttttataaga

SEQ ID NO: 67169 - DNA, 25 bp, Rattus norvegicus
aattctcacagtatcttggagacca

SEQ ID NO: 67170 - DNA, 25 bp, Rattus norvegicus
aattctcacagtttcttggagacca

SEQ ID NO: 67171 - DNA, 25 bp, Rattus norvegicus
aattctcacttcctctgtcttctgt

SEQ ID NO: 67172 - DNA, 25 bp, Rattus norvegicus
aattctcacttcgtctgtcttctgt

SEQ ID NO: 67173 - DNA, 25 bp, Rattus norvegicus
aattctcagcaaagatgtctgttgg

SEQ ID NO: 67174 - DNA, 25 bp, Rattus norvegicus
aattctcagcaatgatgtctgttgg

SEQ ID NO: 67175 - DNA, 25 bp, Rattus norvegicus
aattctcaggagactggcgctatct

SEQ ID NO: 67176 - DNA, 25 bp, Rattus norvegicus
aattctcaggagtctggcgctatct

SEQ ID NO: 67177 - DNA, 25 bp, Rattus norvegicus
aattctcagtcaacacgtgacttgg

SEQ ID NO: 67178 - DNA, 25 bp, Rattus norvegicus
aattctcagtcatcacgtgacttgg

SEQ ID NO: 67179 - DNA, 25 bp, Rattus norvegicus
aattctcagttacattcacttgcaa

SEQ ID NO: 67180 - DNA, 25 bp, Rattus norvegicus
aattctcagttagattcacttgcaa

SEQ ID NO: 67181 - DNA, 25 bp, Rattus norvegicus
aattctcagtttcttatcctgggcc

SEQ ID NO: 67182 - DNA, 25 bp, Rattus norvegicus
aattctcagtttgttatcctgggcc

SEQ ID NO: 67183 - DNA, 25 bp, Rattus norvegicus
aattctcatcccagaagttcacgca

SEQ ID NO: 67184 - DNA, 25 bp, Rattus norvegicus
aattctcatccctgaagttcacgca

SEQ ID NO: 67185 - DNA, 25 bp, Rattus norvegicus
aattctcatcctaaagcaacttcgc

SEQ ID NO: 67186 - DNA, 25 bp, Rattus norvegicus
aattctcatccttaagcaacttcgc

SEQ ID NO: 67187 - DNA, 25 bp, Rattus norvegicus
aattctcatgctaaccctgttagca

SEQ ID NO: 67188 - DNA, 25 bp, Rattus norvegicus
aattctcatgcttaccctgttagca

SEQ ID NO: 67189 - DNA, 25 bp, Rattus norvegicus
aattctcatgttctgtgcattgcca

SEQ ID NO: 67190 - DNA, 25 bp, Rattus norvegicus
aattctcatgttgtgtgcattgcca

SEQ ID NO: 67191 - DNA, 25 bp, Rattus norvegicus
aattctccaaaactgtgtccgtcta

SEQ ID NO: 67192 - DNA, 25 bp, Rattus norvegicus
aattctccaaaagtgtgtccgtcta

SEQ ID NO: 67193 - DNA, 25 bp, Rattus norvegicus
aattctccaactcgaggcctttggc

SEQ ID NO: 67194 - DNA, 25 bp, Rattus norvegicus
aattctccaactggaggcctttggc

SEQ ID NO: 67195 - DNA, 25 bp, Rattus norvegicus
aattctccaaggatcgtttcctagg

SEQ ID NO: 67196 - DNA, 25 bp, Rattus norvegicus
aattctccaaggttcgtttcctagg

SEQ ID NO: 67197 - DNA, 25 bp, Rattus norvegicus
aattctccagatattgccaaacatt

SEQ ID NO: 67198 - DNA, 25 bp, Rattus norvegicus
aattctccagattttgccaaacatt

SEQ ID NO: 67199 - DNA, 25 bp, Rattus norvegicus
aattctccaggactttgcccggagt

SEQ ID NO: 67200 - DNA, 25 bp, Rattus norvegicus
aattctccaggagtttgcccggagt

SEQ ID NO: 67201 - DNA, 25 bp, Rattus norvegicus
aattctccctacataatggagttgg

SEQ ID NO: 67202 - DNA, 25 bp, Rattus norvegicus
aattctccctacttaatggagttgg

SEQ ID NO: 67203 - DNA, 25 bp, Rattus norvegicus
aattctcccttccatctttattgat

SEQ ID NO: 67204 - DNA, 25 bp, Rattus norvegicus
aattctcccttcgatctttattgat

SEQ ID NO: 67205 - DNA, 25 bp, Rattus norvegicus
aattctccggtgatgatagccctaa

SEQ ID NO: 67206 - DNA, 25 bp, Rattus norvegicus
aattctccggtgttgatagccctaa

SEQ ID NO: 67207 - DNA, 25 bp, Rattus norvegicus
aattctccgtgcacctaaagctttg

SEQ ID NO: 67208 - DNA, 25 bp, Rattus norvegicus
aattctccgtgctcctaaagctttg

SEQ ID NO: 67209 - DNA, 25 bp, Rattus norvegicus
aattctcctcacagcatctttataa

SEQ ID NO: 67210 - DNA, 25 bp, Rattus norvegicus
aattctcctcactgcatctttataa

SEQ ID NO: 67211 - DNA, 25 bp, Rattus norvegicus
aattctcctttaatcatgctgcggc

SEQ ID NO: 67212 - DNA, 25 bp, Rattus norvegicus
aattctcctttattcatgctgcggc

SEQ ID NO: 67213 - DNA, 25 bp, Rattus norvegicus
aattctcgaattatactctgttatg

SEQ ID NO: 67214 - DNA, 25 bp, Rattus norvegicus
aattctcgaattttactctgttatg

SEQ ID NO: 67215 - DNA, 25 bp, Rattus norvegicus
aattctcgctccaatgctttgctta

SEQ ID NO: 67216 - DNA, 25 bp, Rattus norvegicus
aattctcgctcctatgctttgctta

SEQ ID NO: 67217 - DNA, 25 bp, Rattus norvegicus
aattctcgtggacatactccccatc

SEQ ID NO: 67218 - DNA, 25 bp, Rattus norvegicus
aattctcgtggagatactccccatc

SEQ ID NO: 67219 - DNA, 25 bp, Rattus norvegicus
aattctctacaactgcttggtcccc

SEQ ID NO: 67220 - DNA, 25 bp, Rattus norvegicus
aattctctacaagtgcttggtcccc

SEQ ID NO: 67221 - DNA, 25 bp, Rattus norvegicus
aattctctaccaactgttacaggct

SEQ ID NO: 67222 - DNA, 25 bp, Rattus norvegicus
aattctctaccatctgttacaggct

SEQ ID NO: 67223 - DNA, 25 bp, Rattus norvegicus
aattctctatggagccaaggctgcc

SEQ ID NO: 67224 - DNA, 25 bp, Rattus norvegicus
aattctctatggtgccaaggctgcc

SEQ ID NO: 67225 - DNA, 25 bp, Rattus norvegicus
aattctctcagaaccatttctatgt

SEQ ID NO: 67226 - DNA, 25 bp, Rattus norvegicus
aattctctcagatccatttctatgt

SEQ ID NO: 67227 - DNA, 25 bp, Rattus norvegicus
aattctctcatcatttgtaggtctg

SEQ ID NO: 67228 - DNA, 25 bp, Rattus norvegicus
aattctctcatcttttgtaggtctg

SEQ ID NO: 67229 - DNA, 25 bp, Rattus norvegicus
aattctctcattcgttcttcccaag

SEQ ID NO: 67230 - DNA, 25 bp, Rattus norvegicus
aattctctcattggttcttcccaag

SEQ ID NO: 67231 - DNA, 25 bp, Rattus norvegicus
aattctctccctctatcttactata

SEQ ID NO: 67232 - DNA, 25 bp, Rattus norvegicus
aattctctccctgtatcttactata

SEQ ID NO: 67233 - DNA, 25 bp, Rattus norvegicus
aattctctctttctgtgtctaggac

SEQ ID NO: 67234 - DNA, 25 bp, Rattus norvegicus
aattctctctttgtgtgtctaggac

SEQ ID NO: 67235 - DNA, 25 bp, Rattus norvegicus
aattctctggaaatgtcactctgga

SEQ ID NO: 67236 - DNA, 25 bp, Rattus norvegicus
aattctctggaattgtcactctgga

SEQ ID NO: 67237 - DNA, 25 bp, Rattus norvegicus
aattctctgtgaacgtggagcacgt

SEQ ID NO: 67238 - DNA, 25 bp, Rattus norvegicus
aattctctgtgatcgtggagcacgt

SEQ ID NO: 67239 - DNA, 25 bp, Rattus norvegicus
aattctcttaacagctgatccacct

SEQ ID NO: 67240 - DNA, 25 bp, Rattus norvegicus
aattctcttaactgctgatccacct

SEQ ID NO: 67241 - DNA, 25 bp, Rattus norvegicus
aattctcttcaaacaagctgagggc

SEQ ID NO: 67242 - DNA, 25 bp, Rattus norvegicus
aattctcttcaatcaagctgagggc

SEQ ID NO: 67243 - DNA, 25 bp, Rattus norvegicus
aattctcttcatcgagtcgggctct

SEQ ID NO: 67244 - DNA, 25 bp, Rattus norvegicus
aattctcttcatggagtcgggctct

SEQ ID NO: 67245 - DNA, 25 bp, Rattus norvegicus
aattctcttcccagtagcatttgca

SEQ ID NO: 67246 - DNA, 25 bp, Rattus norvegicus
aattctcttccctgtagcatttgca

SEQ ID NO: 67247 - DNA, 25 bp, Rattus norvegicus
aattctcttctacccatggactatg

SEQ ID NO: 67248 - DNA, 25 bp, Rattus norvegicus
aattctcttctaccctgtgagtttc

SEQ ID NO: 67249 - DNA, 25 bp, Rattus norvegicus
aattctcttctagccatggactatg

SEQ ID NO: 67250 - DNA, 25 bp, Rattus norvegicus
aattctcttctagcctgtgagtttc

SEQ ID NO: 67251 - DNA, 25 bp, Rattus norvegicus
aattctctttatatgccactagttt

SEQ ID NO: 67252 - DNA, 25 bp, Rattus norvegicus
aattctctttatttgccactagttt

SEQ ID NO: 67253 - DNA, 25 bp, Rattus norvegicus
aattctgaaagcatactgggatagt

SEQ ID NO: 67254 - DNA, 25 bp, Rattus norvegicus
aattctgaaagcttactgggatagt

SEQ ID NO: 67255 - DNA, 25 bp, Rattus norvegicus
aattctgaaatacctccttgctcct

SEQ ID NO: 67256 - DNA, 25 bp, Rattus norvegicus
aattctgaaatagctccttgctcct

SEQ ID NO: 67257 - DNA, 25 bp, Rattus norvegicus
aattctgaacgccaagggctcttat

SEQ ID NO: 67258 - DNA, 25 bp, Rattus norvegicus
aattctgaacgcgaagggctcttat

SEQ ID NO: 67259 - DNA, 25 bp, Rattus norvegicus
aattctgaaggtcctgtccccttta

SEQ ID NO: 67260 - DNA, 25 bp, Rattus norvegicus
aattctgaaggtgctgtccccttta

SEQ ID NO: 67261 - DNA, 25 bp, Rattus norvegicus
aattctgaatggactgccttcctgc

SEQ ID NO: 67262 - DNA, 25 bp, Rattus norvegicus
aattctgaatggtctgccttcctgc

SEQ ID NO: 67263 - DNA, 25 bp, Rattus norvegicus
aattctgaccgtcaattgtgaggtc

SEQ ID NO: 67264 - DNA, 25 bp, Rattus norvegicus
aattctgaccgtgaattgtgaggtc

SEQ ID NO: 67265 - DNA, 25 bp, Rattus norvegicus
aattctgaccttcagtcttgttctg

SEQ ID NO: 67266 - DNA, 25 bp, Rattus norvegicus
aattctgaccttgagtcttgttctg

SEQ ID NO: 67267 - DNA, 25 bp, Rattus norvegicus
aattctgacttacggcaaactgttc

SEQ ID NO: 67268 - DNA, 25 bp, Rattus norvegicus
aattctgacttagggcaaactgttc

SEQ ID NO: 67269 - DNA, 25 bp, Rattus norvegicus
aattctgagactatgcaccccacca

SEQ ID NO: 67270 - DNA, 25 bp, Rattus norvegicus
aattctgagactttgcaccccacca

SEQ ID NO: 67271 - DNA, 25 bp, Rattus norvegicus
aattctgagcatcactgctgcctca

SEQ ID NO: 67272 - DNA, 25 bp, Rattus norvegicus
aattctgagcatgactgctgcctca

SEQ ID NO: 67273 - DNA, 25 bp, Rattus norvegicus
aattctgagcttaattaatcctgag

SEQ ID NO: 67274 - DNA, 25 bp, Rattus norvegicus
aattctgagctttattaatcctgag

SEQ ID NO: 67275 - DNA, 25 bp, Rattus norvegicus
aattctgagtccagcttccctcatg

SEQ ID NO: 67276 - DNA, 25 bp, Rattus norvegicus
aattctgagtcctgcttccctcatg

SEQ ID NO: 67277 - DNA, 25 bp, Rattus norvegicus
aattctgagtttactacaggaccag

SEQ ID NO: 67278 - DNA, 25 bp, Rattus norvegicus
aattctgagttttctacaggaccag

SEQ ID NO: 67279 - DNA, 25 bp, Rattus norvegicus
aattctgatggcatccgaggacagc

SEQ ID NO: 67280 - DNA, 25 bp, Rattus norvegicus
aattctgatggcttccgaggacagc

SEQ ID NO: 67281 - DNA, 25 bp, Rattus norvegicus
aattctgatgtccatttctggcgct

SEQ ID NO: 67282 - DNA, 25 bp, Rattus norvegicus
aattctgatgtcgatttctggcgct

SEQ ID NO: 67283 - DNA, 25 bp, Rattus norvegicus
aattctgattcaagtggcctccttg

SEQ ID NO: 67284 - DNA, 25 bp, Rattus norvegicus
aattctgattcatgtggcctccttg

SEQ ID NO: 67285 - DNA, 25 bp, Rattus norvegicus
aattctgcaactctgttcagtgcca

SEQ ID NO: 67286 - DNA, 25 bp, Rattus norvegicus
aattctgcaactgtgttcagtgcca

SEQ ID NO: 67287 - DNA, 25 bp, Rattus norvegicus
aattctgcaaggctcctttcggtag

SEQ ID NO: 67288 - DNA, 25 bp, Rattus norvegicus
aattctgcaagggtcctttcggtag

SEQ ID NO: 67289 - DNA, 25 bp, Rattus norvegicus
aattctgcacaccttagccgatttc

SEQ ID NO: 67290 - DNA, 25 bp, Rattus norvegicus
aattctgcacacgttagccgatttc

SEQ ID NO: 67291 - DNA, 25 bp, Rattus norvegicus
aattctgcagatagaccctttttaa

SEQ ID NO: 67292 - DNA, 25 bp, Rattus norvegicus
aattctgcagattgaccctttttaa

SEQ ID NO: 67293 - DNA, 25 bp, Rattus norvegicus
aattctgcagcaatttcaaaacctc

SEQ ID NO: 67294 - DNA, 25 bp, Rattus norvegicus
aattctgcagcattttcaaaacctc

SEQ ID NO: 67295 - DNA, 25 bp, Rattus norvegicus
aattctgcagttagtaattgcccac

SEQ ID NO: 67296 - DNA, 25 bp, Rattus norvegicus
aattctgcagtttgtaattgcccac

SEQ ID NO: 67297 - DNA, 25 bp, Rattus norvegicus
aattctgccaccagaatactgtatg

SEQ ID NO: 67298 - DNA, 25 bp, Rattus norvegicus
aattctgccaccagggtctctgaaa

SEQ ID NO: 67299 - DNA, 25 bp, Rattus norvegicus
aattctgccacctgaatactgtatg

SEQ ID NO: 67300 - DNA, 25 bp, Rattus norvegicus
aattctgccacctgggtctctgaaa

SEQ ID NO: 67301 - DNA, 25 bp, Rattus norvegicus
aattctgccatcacagatcctttga

SEQ ID NO: 67302 - DNA, 25 bp, Rattus norvegicus
aattctgccatctcagatcctttga

SEQ ID NO: 67303 - DNA, 25 bp, Rattus norvegicus
aattctgccccgaaggatgaactgg

SEQ ID NO: 67304 - DNA, 25 bp, Rattus norvegicus
aattctgccccgtaggatgaactgg

SEQ ID NO: 67305 - DNA, 25 bp, Rattus norvegicus
aattctgcctctaaaattcctgtct

SEQ ID NO: 67306 - DNA, 25 bp, Rattus norvegicus
aattctgcctcttaaattcctgtct

SEQ ID NO: 67307 - DNA, 25 bp, Rattus norvegicus
aattctgcctggatcagatacctct

SEQ ID NO: 67308 - DNA, 25 bp, Rattus norvegicus
aattctgcctggttcagatacctct

SEQ ID NO: 67309 - DNA, 25 bp, Rattus norvegicus
aattctgctaaaattcctgcactgt

SEQ ID NO: 67310 - DNA, 25 bp, Rattus norvegicus
aattctgctaaatttcctgcactgt

SEQ ID NO: 67311 - DNA, 25 bp, Rattus norvegicus
aattctgctcaactgcagcacacag

SEQ ID NO: 67312 - DNA, 25 bp, Rattus norvegicus
aattctgctcaagtgcagcacacag

SEQ ID NO: 67313 - DNA, 25 bp, Rattus norvegicus
aattctgctcctagctttgcagaga

SEQ ID NO: 67314 - DNA, 25 bp, Rattus norvegicus
aattctgctccttgctttgcagaga

SEQ ID NO: 67315 - DNA, 25 bp, Rattus norvegicus
aattctgctcttacgtggttcatga

SEQ ID NO: 67316 - DNA, 25 bp, Rattus norvegicus
aattctgctcttcgtcatgtgaaca

SEQ ID NO: 67317 - DNA, 25 bp, Rattus norvegicus
aattctgctcttggtcatgtgaaca

SEQ ID NO: 67318 - DNA, 25 bp, Rattus norvegicus
aattctgctctttcgtggttcatga

SEQ ID NO: 67319 - DNA, 25 bp, Rattus norvegicus
aattctgcttctcagctttagtcag

SEQ ID NO: 67320 - DNA, 25 bp, Rattus norvegicus
aattctgcttctgagctttagtcag

SEQ ID NO: 67321 - DNA, 25 bp, Rattus norvegicus
aattctggacagagcaagtgtagta

SEQ ID NO: 67322 - DNA, 25 bp, Rattus norvegicus
aattctggacagtgcaagtgtagta

SEQ ID NO: 67323 - DNA, 25 bp, Rattus norvegicus
aattctggaggcctgtctttcccat

SEQ ID NO: 67324 - DNA, 25 bp, Rattus norvegicus
aattctggaggcgtgtctttcccat

SEQ ID NO: 67325 - DNA, 25 bp, Rattus norvegicus
aattctggattcactctcatgtttt

SEQ ID NO: 67326 - DNA, 25 bp, Rattus norvegicus
aattctggattctctctcatgtttt

SEQ ID NO: 67327 - DNA, 25 bp, Rattus norvegicus
aattctggccaaacttaggcaaacc

SEQ ID NO: 67328 - DNA, 25 bp, Rattus norvegicus
aattctggccaatcttaggcaaacc

SEQ ID NO: 67329 - DNA, 25 bp, Rattus norvegicus
aattctggccatacctgaagtgctg

SEQ ID NO: 67330 - DNA, 25 bp, Rattus norvegicus
aattctggccattcctgaagtgctg

SEQ ID NO: 67331 - DNA, 25 bp, Rattus norvegicus
aattctggctgtatgctgagtactg

SEQ ID NO: 67332 - DNA, 25 bp, Rattus norvegicus
aattctggctgtttgctgagtactg

SEQ ID NO: 67333 - DNA, 25 bp, Rattus norvegicus
aattctggctttatatccaaatgag

SEQ ID NO: 67334 - DNA, 25 bp, Rattus norvegicus
aattctggctttcagtgacatcctg

SEQ ID NO: 67335 - DNA, 25 bp, Rattus norvegicus
aattctggctttgagtgacatcctg

SEQ ID NO: 67336 - DNA, 25 bp, Rattus norvegicus
aattctggctttttatccaaatgag

SEQ ID NO: 67337 - DNA, 25 bp, Rattus norvegicus
aattctgggagtagcagctacgcca

SEQ ID NO: 67338 - DNA, 25 bp, Rattus norvegicus
aattctgggagttgcagctacgcca

SEQ ID NO: 67339 - DNA, 25 bp, Rattus norvegicus
aattctgggccaccactatccttgc

SEQ ID NO: 67340 - DNA, 25 bp, Rattus norvegicus
aattctgggccagcactatccttgc

SEQ ID NO: 67341 - DNA, 25 bp, Rattus norvegicus
aattctgggtggatatgtctgatca

SEQ ID NO: 67342 - DNA, 25 bp, Rattus norvegicus
aattctgggtggttatgtctgatca

SEQ ID NO: 67343 - DNA, 25 bp, Rattus norvegicus
aattctgggtgtctgtctccaggcc

SEQ ID NO: 67344 - DNA, 25 bp, Rattus norvegicus
aattctgggtgtgtgtctccaggcc

SEQ ID NO: 67345 - DNA, 25 bp, Rattus norvegicus
aattctggtcagatcgttttctcct

SEQ ID NO: 67346 - DNA, 25 bp, Rattus norvegicus
aattctggtcagttcgttttctcct

SEQ ID NO: 67347 - DNA, 25 bp, Rattus norvegicus
aattctggtggtcatttgtcgttgt

SEQ ID NO: 67348 - DNA, 25 bp, Rattus norvegicus
aattctggtggtgatttgtcgttgt

SEQ ID NO: 67349 - DNA, 25 bp, Rattus norvegicus
aattctggttctagttccctgccta

SEQ ID NO: 67350 - DNA, 25 bp, Rattus norvegicus
aattctggttcttgttccctgccta

SEQ ID NO: 67351 - DNA, 25 bp, Rattus norvegicus
aattctggttggatttcttcattca

SEQ ID NO: 67352 - DNA, 25 bp, Rattus norvegicus
aattctggttggttttcttcattca

SEQ ID NO: 67353 - DNA, 25 bp, Rattus norvegicus
aattctgtaactatgcttagcctcc

SEQ ID NO: 67354 - DNA, 25 bp, Rattus norvegicus
aattctgtaactttgcttagcctcc

SEQ ID NO: 67355 - DNA, 25 bp, Rattus norvegicus
aattctgtacatagaaacaaaccaa

SEQ ID NO: 67356 - DNA, 25 bp, Rattus norvegicus
aattctgtacatagagcctggccgc

SEQ ID NO: 67357 - DNA, 25 bp, Rattus norvegicus
aattctgtacattgaaacaaaccaa

SEQ ID NO: 67358 - DNA, 25 bp, Rattus norvegicus
aattctgtacattgagcctggccgc

SEQ ID NO: 67359 - DNA, 25 bp, Rattus norvegicus
aattctgtactgaggtttttccaat

SEQ ID NO: 67360 - DNA, 25 bp, Rattus norvegicus
aattctgtactgtggtttttccaat

SEQ ID NO: 67361 - DNA, 25 bp, Rattus norvegicus
aattctgtatatatggtcttatgct

SEQ ID NO: 67362 - DNA, 25 bp, Rattus norvegicus
aattctgtatatttggtcttatgct

SEQ ID NO: 67363 - DNA, 25 bp, Rattus norvegicus
aattctgtattcataactatcctgt

SEQ ID NO: 67364 - DNA, 25 bp, Rattus norvegicus
aattctgtattcttaactatcctgt

SEQ ID NO: 67365 - DNA, 25 bp, Rattus norvegicus
aattctgtcacaataagttctggga

SEQ ID NO: 67366 - DNA, 25 bp, Rattus norvegicus
aattctgtcacattaagttctggga

SEQ ID NO: 67367 - DNA, 25 bp, Rattus norvegicus
aattctgtcagactttccctttggg

SEQ ID NO: 67368 - DNA, 25 bp, Rattus norvegicus
aattctgtcagagtttccctttggg

SEQ ID NO: 67369 - DNA, 25 bp, Rattus norvegicus
aattctgtcattaaaaatccacctt

SEQ ID NO: 67370 - DNA, 25 bp, Rattus norvegicus
aattctgtcatttaaaatccacctt

SEQ ID NO: 67371 - DNA, 25 bp, Rattus norvegicus
aattctgtcggtacctgtgtgtctg

SEQ ID NO: 67372 - DNA, 25 bp, Rattus norvegicus
aattctgtcggttcctgtgtgtctg

SEQ ID NO: 67373 - DNA, 25 bp, Rattus norvegicus
aattctgtcgttatagcacacgcta

SEQ ID NO: 67374 - DNA, 25 bp, Rattus norvegicus
aattctgtcgttttagcacacgcta

SEQ ID NO: 67375 - DNA, 25 bp, Rattus norvegicus
aattctgtcttgctgtatcttctat

SEQ ID NO: 67376 - DNA, 25 bp, Rattus norvegicus
aattctgtcttggtgtatcttctat

SEQ ID NO: 67377 - DNA, 25 bp, Rattus norvegicus
aattctgtgaatactgctccctgcg

SEQ ID NO: 67378 - DNA, 25 bp, Rattus norvegicus
aattctgtgaattctgctccctgcg

SEQ ID NO: 67379 - DNA, 25 bp, Rattus norvegicus
aattctgtgatgactgatgagctgt

SEQ ID NO: 67380 - DNA, 25 bp, Rattus norvegicus
aattctgtgatgtctgatgagctgt

SEQ ID NO: 67381 - DNA, 25 bp, Rattus norvegicus
aattctgtgcagatctgttcctcct

SEQ ID NO: 67382 - DNA, 25 bp, Rattus norvegicus
aattctgtgcagttctgttcctcct

SEQ ID NO: 67383 - DNA, 25 bp, Rattus norvegicus
aattctgtggctcgagtagataccc

SEQ ID NO: 67384 - DNA, 25 bp, Rattus norvegicus
aattctgtggctggagtagataccc

SEQ ID NO: 67385 - DNA, 25 bp, Rattus norvegicus
aattctgtggtacccagaggcacct

SEQ ID NO: 67386 - DNA, 25 bp, Rattus norvegicus
aattctgtggtagccagaggcacct

SEQ ID NO: 67387 - DNA, 25 bp, Rattus norvegicus
aattctgtgtatcttgctgtgactc

SEQ ID NO: 67388 - DNA, 25 bp, Rattus norvegicus
aattctgtgtatgttgctgtgactc

SEQ ID NO: 67389 - DNA, 25 bp, Rattus norvegicus
aattctgtgtgtatttgctgtagca

SEQ ID NO: 67390 - DNA, 25 bp, Rattus norvegicus
aattctgtgtgtttttgctgtagca

SEQ ID NO: 67391 - DNA, 25 bp, Rattus norvegicus
aattctgttccacttactcagagga

SEQ ID NO: 67392 - DNA, 25 bp, Rattus norvegicus
aattctgttccagttactcagagga

SEQ ID NO: 67393 - DNA, 25 bp, Rattus norvegicus
aattctgttcccaaaagtcactgac

SEQ ID NO: 67394 - DNA, 25 bp, Rattus norvegicus
aattctgttccctaaagtcactgac

SEQ ID NO: 67395 - DNA, 25 bp, Rattus norvegicus
aattctgttctgcttacaaattcac

SEQ ID NO: 67396 - DNA, 25 bp, Rattus norvegicus
aattctgttctggttacaaattcac

SEQ ID NO: 67397 - DNA, 25 bp, Rattus norvegicus
aattctgttgacagtggttgctggc

SEQ ID NO: 67398 - DNA, 25 bp, Rattus norvegicus
aattctgttgactgtggttgctggc

SEQ ID NO: 67399 - DNA, 25 bp, Rattus norvegicus
aattctgttgccattactggttctt

SEQ ID NO: 67400 - DNA, 25 bp, Rattus norvegicus
aattctgttgcctttactggttctt

SEQ ID NO: 67401 - DNA, 25 bp, Rattus norvegicus
aattctgtttccaaggcaaatactg

SEQ ID NO: 67402 - DNA, 25 bp, Rattus norvegicus
aattctgtttccagacattctagct

SEQ ID NO: 67403 - DNA, 25 bp, Rattus norvegicus
aattctgtttcctaggcaaatactg

SEQ ID NO: 67404 - DNA, 25 bp, Rattus norvegicus
aattctgtttcctgacattctagct

SEQ ID NO: 67405 - DNA, 25 bp, Rattus norvegicus
aattctgtttgtaatgcacttatca

SEQ ID NO: 67406 - DNA, 25 bp, Rattus norvegicus
aattctgtttgttatgcacttatca

SEQ ID NO: 67407 - DNA, 25 bp, Rattus norvegicus
aattctgttttaagagcctttccct

SEQ ID NO: 67408 - DNA, 25 bp, Rattus norvegicus
aattctgttttatgagcctttccct

SEQ ID NO: 67409 - DNA, 25 bp, Rattus norvegicus
aattcttaagaaacgctgggctgtg

SEQ ID NO: 67410 - DNA, 25 bp, Rattus norvegicus
aattcttaagaatcgctgggctgtg

SEQ ID NO: 67411 - DNA, 25 bp, Rattus norvegicus
aattcttacacaccttttcctactt

SEQ ID NO: 67412 - DNA, 25 bp, Rattus norvegicus
aattcttacacagcttttcctactt

SEQ ID NO: 67413 - DNA, 25 bp, Rattus norvegicus
aattcttaccaaaccaagtctcctg

SEQ ID NO: 67414 - DNA, 25 bp, Rattus norvegicus
aattcttaccaatccaagtctcctg

SEQ ID NO: 67415 - DNA, 25 bp, Rattus norvegicus
aattcttacgtgactttgcgaaatc

SEQ ID NO: 67416 - DNA, 25 bp, Rattus norvegicus
aattcttacgtgtctttgcgaaatc

SEQ ID NO: 67417 - DNA, 25 bp, Rattus norvegicus
aattcttagaagattgcaccaatca

SEQ ID NO: 67418 - DNA, 25 bp, Rattus norvegicus
aattcttagaagtttgcaccaatca

SEQ ID NO: 67419 - DNA, 25 bp, Rattus norvegicus
aattcttagcatcattttgtccttg

SEQ ID NO: 67420 - DNA, 25 bp, Rattus norvegicus
aattcttagcatgattttgtccttg

SEQ ID NO: 67421 - DNA, 25 bp, Rattus norvegicus
aattcttagttccttctctgccata

SEQ ID NO: 67422 - DNA, 25 bp, Rattus norvegicus
aattcttagttcgttctctgccata

SEQ ID NO: 67423 - DNA, 25 bp, Rattus norvegicus
aattcttataccatgttctctgctt

SEQ ID NO: 67424 - DNA, 25 bp, Rattus norvegicus
aattcttataccttgttctctgctt

SEQ ID NO: 67425 - DNA, 25 bp, Rattus norvegicus
aattcttcaaagagcaacatgcagg

SEQ ID NO: 67426 - DNA, 25 bp, Rattus norvegicus
aattcttcaaagtgcaacatgcagg

SEQ ID NO: 67427 - DNA, 25 bp, Rattus norvegicus
aattcttcacgaatttccagtttat

SEQ ID NO: 67428 - DNA, 25 bp, Rattus norvegicus
aattcttcacgattttccagtttat

SEQ ID NO: 67429 - DNA, 25 bp, Rattus norvegicus
aattcttcacttctcttgcaaggca

SEQ ID NO: 67430 - DNA, 25 bp, Rattus norvegicus
aattcttcacttgtcttgcaaggca

SEQ ID NO: 67431 - DNA, 25 bp, Rattus norvegicus
aattcttcaggcaccagggatgcat

SEQ ID NO: 67432 - DNA, 25 bp, Rattus norvegicus
aattcttcaggctccagggatgcat

SEQ ID NO: 67433 - DNA, 25 bp, Rattus norvegicus
aattcttcagtcagcattcccggcg

SEQ ID NO: 67434 - DNA, 25 bp, Rattus norvegicus
aattcttcagtctgcattcccggcg

SEQ ID NO: 67435 - DNA, 25 bp, Rattus norvegicus
aattcttcatgaacacattttgtgt

SEQ ID NO: 67436 - DNA, 25 bp, Rattus norvegicus
aattcttcatgatcacattttgtgt

SEQ ID NO: 67437 - DNA, 25 bp, Rattus norvegicus
aattcttccaagaattcgcctccgg

SEQ ID NO: 67438 - DNA, 25 bp, Rattus norvegicus
aattcttccaagtattcgcctccgg

SEQ ID NO: 67439 - DNA, 25 bp, Rattus norvegicus
aattcttccattcatgtctctctaa

SEQ ID NO: 67440 - DNA, 25 bp, Rattus norvegicus
aattcttccattgatgtctctctaa

SEQ ID NO: 67441 - DNA, 25 bp, Rattus norvegicus
aattcttcccgcacagttactaact

SEQ ID NO: 67442 - DNA, 25 bp, Rattus norvegicus
aattcttcccgctcagttactaact

SEQ ID NO: 67443 - DNA, 25 bp, Rattus norvegicus
aattcttccctgcatgacataaaga

SEQ ID NO: 67444 - DNA, 25 bp, Rattus norvegicus
aattcttccctggatgacataaaga

SEQ ID NO: 67445 - DNA, 25 bp, Rattus norvegicus
aattcttcgaaaaagcagcttccat

SEQ ID NO: 67446 - DNA, 25 bp, Rattus norvegicus
aattcttcgaaatagcagcttccat

SEQ ID NO: 67447 - DNA, 25 bp, Rattus norvegicus
aattcttctaatacatgaccctaat

SEQ ID NO: 67448 - DNA, 25 bp, Rattus norvegicus
aattcttctaattcatgaccctaat

SEQ ID NO: 67449 - DNA, 25 bp, Rattus norvegicus
aattcttctgaccttgattttccta

SEQ ID NO: 67450 - DNA, 25 bp, Rattus norvegicus
aattcttctgacgttgattttccta

SEQ ID NO: 67451 - DNA, 25 bp, Rattus norvegicus
aattcttctgtcactcgctaagata

SEQ ID NO: 67452 - DNA, 25 bp, Rattus norvegicus
aattcttctgtctctcgctaagata

SEQ ID NO: 67453 - DNA, 25 bp, Rattus norvegicus
aattcttcttttcttaggctgtgct

SEQ ID NO: 67454 - DNA, 25 bp, Rattus norvegicus
aattcttcttttgttaggctgtgct

SEQ ID NO: 67455 - DNA, 25 bp, Rattus norvegicus
aattcttgaactcttgggtcctcat

SEQ ID NO: 67456 - DNA, 25 bp, Rattus norvegicus
aattcttgaactgttgggtcctcat

SEQ ID NO: 67457 - DNA, 25 bp, Rattus norvegicus
aattcttgaaggcactgtggtttat

SEQ ID NO: 67458 - DNA, 25 bp, Rattus norvegicus
aattcttgaagggactgtggtttat

SEQ ID NO: 67459 - DNA, 25 bp, Rattus norvegicus
aattcttgctgtcttgttttcgagt

SEQ ID NO: 67460 - DNA, 25 bp, Rattus norvegicus
aattcttgctgtgttgttttcgagt

SEQ ID NO: 67461 - DNA, 25 bp, Rattus norvegicus
aattcttggaggagctgcttaccac

SEQ ID NO: 67462 - DNA, 25 bp, Rattus norvegicus
aattcttggaggtgctgcttaccac

SEQ ID NO: 67463 - DNA, 25 bp, Rattus norvegicus
aattcttggcgcagttgtaatctct

SEQ ID NO: 67464 - DNA, 25 bp, Rattus norvegicus
aattcttggcgctgttgtaatctct

SEQ ID NO: 67465 - DNA, 25 bp, Rattus norvegicus
aattcttggtctactccaaagagac

SEQ ID NO: 67466 - DNA, 25 bp, Rattus norvegicus
aattcttggtcttctccaaagagac

SEQ ID NO: 67467 - DNA, 25 bp, Rattus norvegicus
aattcttgtcgcattggtctgccgc

SEQ ID NO: 67468 - DNA, 25 bp, Rattus norvegicus
aattcttgtcgctttggtctgccgc

SEQ ID NO: 67469 - DNA, 25 bp, Rattus norvegicus
aattcttgtctccatactttctctt

SEQ ID NO: 67470 - DNA, 25 bp, Rattus norvegicus
aattcttgtctcgatactttctctt

SEQ ID NO: 67471 - DNA, 25 bp, Rattus norvegicus
aattcttgtggtcactttctgtgtt

SEQ ID NO: 67472 - DNA, 25 bp, Rattus norvegicus
aattcttgtggtgactttctgtgtt

SEQ ID NO: 67473 - DNA, 25 bp, Rattus norvegicus
aattcttgtttcatgcttgtaaatg

SEQ ID NO: 67474 - DNA, 25 bp, Rattus norvegicus
aattcttgtttcatggtgagctggt

SEQ ID NO: 67475 - DNA, 25 bp, Rattus norvegicus
aattcttgtttcttgcttgtaaatg

SEQ ID NO: 67476 - DNA, 25 bp, Rattus norvegicus
aattcttgtttcttggtgagctggt

SEQ ID NO: 67477 - DNA, 25 bp, Rattus norvegicus
aattctttactgctggttttccatt

SEQ ID NO: 67478 - DNA, 25 bp, Rattus norvegicus
aattctttactggtggttttccatt

SEQ ID NO: 67479 - DNA, 25 bp, Rattus norvegicus
aattctttagttcccatacacagtg

SEQ ID NO: 67480 - DNA, 25 bp, Rattus norvegicus
aattctttagttgccatacacagtg

SEQ ID NO: 67481 - DNA, 25 bp, Rattus norvegicus
aattctttctttcccaacttgacat

SEQ ID NO: 67482 - DNA, 25 bp, Rattus norvegicus
aattctttctttgccaacttgacat

SEQ ID NO: 67483 - DNA, 25 bp, Rattus norvegicus
aattctttgatcactcttgaaaatg

SEQ ID NO: 67484 - DNA, 25 bp, Rattus norvegicus
aattctttgatctctcttgaaaatg

SEQ ID NO: 67485 - DNA, 25 bp, Rattus norvegicus
aattctttgcacaggatctcacagg

SEQ ID NO: 67486 - DNA, 25 bp, Rattus norvegicus
aattctttgcactggatctcacagg

SEQ ID NO: 67487 - DNA, 25 bp, Rattus norvegicus
aattctttgcagactatgggctagt

SEQ ID NO: 67488 - DNA, 25 bp, Rattus norvegicus
aattctttgcagtctatgggctagt

SEQ ID NO: 67489 - DNA, 25 bp, Rattus norvegicus
aattctttgtagagatacctttgta

SEQ ID NO: 67490 - DNA, 25 bp, Rattus norvegicus
aattctttgtagtgatacctttgta

SEQ ID NO: 67491 - DNA, 25 bp, Rattus norvegicus
aattctttgtgcatccaggtttttt

SEQ ID NO: 67492 - DNA, 25 bp, Rattus norvegicus
aattctttgtgcttccaggtttttt

SEQ ID NO: 67493 - DNA, 25 bp, Rattus norvegicus
aattcttttagaccattatgtataa

SEQ ID NO: 67494 - DNA, 25 bp, Rattus norvegicus
aattcttttagagcattatgtataa

SEQ ID NO: 67495 - DNA, 25 bp, Rattus norvegicus
aattcttttcttcagttgtccttag

SEQ ID NO: 67496 - DNA, 25 bp, Rattus norvegicus
aattcttttcttgagttgtccttag

SEQ ID NO: 67497 - DNA, 25 bp, Rattus norvegicus
aattcttttgcacaaagctgaccta

SEQ ID NO: 67498 - DNA, 25 bp, Rattus norvegicus
aattcttttgcagaaagctgaccta

SEQ ID NO: 67499 - DNA, 25 bp, Rattus norvegicus
aattcttttgctacatttcacttga

SEQ ID NO: 67500 - DNA, 25 bp, Rattus norvegicus
aattcttttgcttcatttcacttga

SEQ ID NO: 67501 - DNA, 25 bp, Rattus norvegicus
aattctttttctcgctgttcatcta

SEQ ID NO: 67502 - DNA, 25 bp, Rattus norvegicus
aattctttttctggctgttcatcta

SEQ ID NO: 67503 - DNA, 25 bp, Rattus norvegicus
aattgaaacaccagcccagtggcag

SEQ ID NO: 67504 - DNA, 25 bp, Rattus norvegicus
aattgaaacacctgcccagtggcag

SEQ ID NO: 67505 - DNA, 25 bp, Rattus norvegicus
aattgaaaccttcaggctgtatttt

SEQ ID NO: 67506 - DNA, 25 bp, Rattus norvegicus
aattgaaaccttgaggctgtatttt

SEQ ID NO: 67507 - DNA, 25 bp, Rattus norvegicus
aattgaaagctccagatgcctattg

SEQ ID NO: 67508 - DNA, 25 bp, Rattus norvegicus
aattgaaagctcgagatgcctattg

SEQ ID NO: 67509 - DNA, 25 bp, Rattus norvegicus
aattgaaatactctgctgtagcaag

SEQ ID NO: 67510 - DNA, 25 bp, Rattus norvegicus
aattgaaatactgtgctgtagcaag

SEQ ID NO: 67511 - DNA, 25 bp, Rattus norvegicus
aattgaaatatacccgacgtgccca

SEQ ID NO: 67512 - DNA, 25 bp, Rattus norvegicus
aattgaaatatagccgacgtgccca

SEQ ID NO: 67513 - DNA, 25 bp, Rattus norvegicus
aattgaaatcacaagcctgcttccc

SEQ ID NO: 67514 - DNA, 25 bp, Rattus norvegicus
aattgaaatcactagcctgcttccc

SEQ ID NO: 67515 - DNA, 25 bp, Rattus norvegicus
aattgaaccgccagaacgttgctgt

SEQ ID NO: 67516 - DNA, 25 bp, Rattus norvegicus
aattgaaccgcctgaacgttgctgt

SEQ ID NO: 67517 - DNA, 25 bp, Rattus norvegicus
aattgaaccttgagcccagtctctt

SEQ ID NO: 67518 - DNA, 25 bp, Rattus norvegicus
aattgaaccttgtgcccagtctctt

SEQ ID NO: 67519 - DNA, 25 bp, Rattus norvegicus
aattgaacgaacactaacacttagg

SEQ ID NO: 67520 - DNA, 25 bp, Rattus norvegicus
aattgaacgaactctaacacttagg

SEQ ID NO: 67521 - DNA, 25 bp, Rattus norvegicus
aattgaactcatcacttcttggaag

SEQ ID NO: 67522 - DNA, 25 bp, Rattus norvegicus
aattgaactcatgacttcttggaag

SEQ ID NO: 67523 - DNA, 25 bp, Rattus norvegicus
aattgaacttggagctcctgcatgc

SEQ ID NO: 67524 - DNA, 25 bp, Rattus norvegicus
aattgaacttggtgctcctgcatgc

SEQ ID NO: 67525 - DNA, 25 bp, Rattus norvegicus
aattgaagcctactctccagaggga

SEQ ID NO: 67526 - DNA, 25 bp, Rattus norvegicus
aattgaagcctagtctccagaggga

SEQ ID NO: 67527 - DNA, 25 bp, Rattus norvegicus
aattgaagctacctgtggcaccatc

SEQ ID NO: 67528 - DNA, 25 bp, Rattus norvegicus
aattgaagctacgtgtggcaccatc

SEQ ID NO: 67529 - DNA, 25 bp, Rattus norvegicus
aattgaagctctcggccatgctctc

SEQ ID NO: 67530 - DNA, 25 bp, Rattus norvegicus
aattgaagctctgggccatgctctc

SEQ ID NO: 67531 - DNA, 25 bp, Rattus norvegicus
aattgaagctgcactacgtcctaga

SEQ ID NO: 67532 - DNA, 25 bp, Rattus norvegicus
aattgaagctgctctacgtcctaga

SEQ ID NO: 67533 - DNA, 25 bp, Rattus norvegicus
aattgaagcttaagccaccctttga

SEQ ID NO: 67534 - DNA, 25 bp, Rattus norvegicus
aattgaagcttatgccaccctttga

SEQ ID NO: 67535 - DNA, 25 bp, Rattus norvegicus
aattgaatactgatcttgcaaagga

SEQ ID NO: 67536 - DNA, 25 bp, Rattus norvegicus
aattgaatactgttcttgcaaagga

SEQ ID NO: 67537 - DNA, 25 bp, Rattus norvegicus
aattgaatagtcctttacccctgca

SEQ ID NO: 67538 - DNA, 25 bp, Rattus norvegicus
aattgaatagtcgtttacccctgca

SEQ ID NO: 67539 - DNA, 25 bp, Rattus norvegicus
aattgaatatcaatctagcccccac

SEQ ID NO: 67540 - DNA, 25 bp, Rattus norvegicus
aattgaatatcattctagcccccac

SEQ ID NO: 67541 - DNA, 25 bp, Rattus norvegicus
aattgaatcacacgctgctcgacta

SEQ ID NO: 67542 - DNA, 25 bp, Rattus norvegicus
aattgaatcacaggctgctcgacta

SEQ ID NO: 67543 - DNA, 25 bp, Rattus norvegicus
aattgaatccagctcctcgccgaga

SEQ ID NO: 67544 - DNA, 25 bp, Rattus norvegicus
aattgaatccaggtcctcgccgaga

SEQ ID NO: 67545 - DNA, 25 bp, Rattus norvegicus
aattgaatggcaaaacgaccttcct

SEQ ID NO: 67546 - DNA, 25 bp, Rattus norvegicus
aattgaatggcataacgaccttcct

SEQ ID NO: 67547 - DNA, 25 bp, Rattus norvegicus
aattgaattacccttcctgatgttt

SEQ ID NO: 67548 - DNA, 25 bp, Rattus norvegicus
aattgaattaccgttcctgatgttt

SEQ ID NO: 67549 - DNA, 25 bp, Rattus norvegicus
aattgacaaaatcccagctacctgg

SEQ ID NO: 67550 - DNA, 25 bp, Rattus norvegicus
aattgacaaaatgccagctacctgg

SEQ ID NO: 67551 - DNA, 25 bp, Rattus norvegicus
aattgacagttgcttggaggctctt

SEQ ID NO: 67552 - DNA, 25 bp, Rattus norvegicus
aattgacagttggttggaggctctt

SEQ ID NO: 67553 - DNA, 25 bp, Rattus norvegicus
aattgacatcatacacccataacag

SEQ ID NO: 67554 - DNA, 25 bp, Rattus norvegicus
aattgacatcattcacccataacag

SEQ ID NO: 67555 - DNA, 25 bp, Rattus norvegicus
aattgacatgtccagttcccttttg

SEQ ID NO: 67556 - DNA, 25 bp, Rattus norvegicus
aattgacatgtcgagttcccttttg

SEQ ID NO: 67557 - DNA, 25 bp, Rattus norvegicus
aattgacattttaacagtgctgatt

SEQ ID NO: 67558 - DNA, 25 bp, Rattus norvegicus
aattgacatttttacagtgctgatt

SEQ ID NO: 67559 - DNA, 25 bp, Rattus norvegicus
aattgacccaaactctagatctttc

SEQ ID NO: 67560 - DNA, 25 bp, Rattus norvegicus
aattgacccaaagtctagatctttc

SEQ ID NO: 67561 - DNA, 25 bp, Rattus norvegicus
aattgacctatgcaggccctaattg

SEQ ID NO: 67562 - DNA, 25 bp, Rattus norvegicus
aattgacctatggaggccctaattg

SEQ ID NO: 67563 - DNA, 25 bp, Rattus norvegicus
aattgacctgctcggattcctaaga

SEQ ID NO: 67564 - DNA, 25 bp, Rattus norvegicus
aattgacctgctgggattcctaaga

SEQ ID NO: 67565 - DNA, 25 bp, Rattus norvegicus
aattgacgcaatctccctggagtgt

SEQ ID NO: 67566 - DNA, 25 bp, Rattus norvegicus
aattgacgcaatgtccctggagtgt

SEQ ID NO: 67567 - DNA, 25 bp, Rattus norvegicus
aattgacgtaccatcactagcttag

SEQ ID NO: 67568 - DNA, 25 bp, Rattus norvegicus
aattgacgtaccttcactagcttag

SEQ ID NO: 67569 - DNA, 25 bp, Rattus norvegicus
aattgactaattcccctgctgttta

SEQ ID NO: 67570 - DNA, 25 bp, Rattus norvegicus
aattgactaattgccctgctgttta

SEQ ID NO: 67571 - DNA, 25 bp, Rattus norvegicus
aattgactcaatcctgtgtgttctc

SEQ ID NO: 67572 - DNA, 25 bp, Rattus norvegicus
aattgactcaatgctgtgtgttctc

SEQ ID NO: 67573 - DNA, 25 bp, Rattus norvegicus
aattgactcagtccacgtttggcat

SEQ ID NO: 67574 - DNA, 25 bp, Rattus norvegicus
aattgactcagtgcacgtttggcat

SEQ ID NO: 67575 - DNA, 25 bp, Rattus norvegicus
aattgactcctgaaaattgtcctct

SEQ ID NO: 67576 - DNA, 25 bp, Rattus norvegicus
aattgactcctgtaaattgtcctct

SEQ ID NO: 67577 - DNA, 25 bp, Rattus norvegicus
aattgactcgtgacagtagtgcaca

SEQ ID NO: 67578 - DNA, 25 bp, Rattus norvegicus
aattgactcgtgtcagtagtgcaca

SEQ ID NO: 67579 - DNA, 25 bp, Rattus norvegicus
aattgactgcttccatttcatacaa

SEQ ID NO: 67580 - DNA, 25 bp, Rattus norvegicus
aattgactgcttgcatttcatacaa

SEQ ID NO: 67581 - DNA, 25 bp, Rattus norvegicus
aattgacttcaaattcctctactag

SEQ ID NO: 67582 - DNA, 25 bp, Rattus norvegicus
aattgacttcaatttcctctactag

SEQ ID NO: 67583 - DNA, 25 bp, Rattus norvegicus
aattgacttgtcagggtcccaaagc

SEQ ID NO: 67584 - DNA, 25 bp, Rattus norvegicus
aattgacttgtctgggtcccaaagc

SEQ ID NO: 67585 - DNA, 25 bp, Rattus norvegicus
aattgacttttacatctgcattctg

SEQ ID NO: 67586 - DNA, 25 bp, Rattus norvegicus
aattgacttttagatctgcattctg

SEQ ID NO: 67587 - DNA, 25 bp, Rattus norvegicus
aattgagactacagcccaagcctgc

SEQ ID NO: 67588 - DNA, 25 bp, Rattus norvegicus
aattgagactactgcccaagcctgc

SEQ ID NO: 67589 - DNA, 25 bp, Rattus norvegicus
aattgagagccactgaccatgcgtc

SEQ ID NO: 67590 - DNA, 25 bp, Rattus norvegicus
aattgagagccagtgaccatgcgtc

SEQ ID NO: 67591 - DNA, 25 bp, Rattus norvegicus
aattgagagctcactacctgcctgg

SEQ ID NO: 67592 - DNA, 25 bp, Rattus norvegicus
aattgagagctcatggtttctgccc

SEQ ID NO: 67593 - DNA, 25 bp, Rattus norvegicus
aattgagagctctctacctgcctgg

SEQ ID NO: 67594 - DNA, 25 bp, Rattus norvegicus
aattgagagctcttggtttctgccc

SEQ ID NO: 67595 - DNA, 25 bp, Rattus norvegicus
aattgagagcttctggtgctgtcca

SEQ ID NO: 67596 - DNA, 25 bp, Rattus norvegicus
aattgagagcttgtggtgctgtcca

SEQ ID NO: 67597 - DNA, 25 bp, Rattus norvegicus
aattgagatcaacttcccagcagag

SEQ ID NO: 67598 - DNA, 25 bp, Rattus norvegicus
aattgagatcaagttcccagcagag

SEQ ID NO: 67599 - DNA, 25 bp, Rattus norvegicus
aattgagcatcccaaaccaagcagg

SEQ ID NO: 67600 - DNA, 25 bp, Rattus norvegicus
aattgagcatccgaaaccaagcagg

SEQ ID NO: 67601 - DNA, 25 bp, Rattus norvegicus
aattgagcatgcacttgaaaaccac

SEQ ID NO: 67602 - DNA, 25 bp, Rattus norvegicus
aattgagcatgctcttgaaaaccac

SEQ ID NO: 67603 - DNA, 25 bp, Rattus norvegicus
aattgagccaggagttcttctcttc

SEQ ID NO: 67604 - DNA, 25 bp, Rattus norvegicus
aattgagccaggtgttcttctcttc

SEQ ID NO: 67605 - DNA, 25 bp, Rattus norvegicus
aattgagcctaaatgatctgcagtt

SEQ ID NO: 67606 - DNA, 25 bp, Rattus norvegicus
aattgagcctaattgatctgcagtt

SEQ ID NO: 67607 - DNA, 25 bp, Rattus norvegicus
aattgagcctttccagtgctaggat

SEQ ID NO: 67608 - DNA, 25 bp, Rattus norvegicus
aattgagcctttgcagtgctaggat

SEQ ID NO: 67609 - DNA, 25 bp, Rattus norvegicus
aattgagcgagaactcaggctgagc

SEQ ID NO: 67610 - DNA, 25 bp, Rattus norvegicus
aattgagcgagatctcaggctgagc

SEQ ID NO: 67611 - DNA, 25 bp, Rattus norvegicus
aattgagggcagatactctcttccc

SEQ ID NO: 67612 - DNA, 25 bp, Rattus norvegicus
aattgagggcagttactctcttccc

SEQ ID NO: 67613 - DNA, 25 bp, Rattus norvegicus
aattgagggcccactgtttgccaga

SEQ ID NO: 67614 - DNA, 25 bp, Rattus norvegicus
aattgagggccctctgtttgccaga

SEQ ID NO: 67615 - DNA, 25 bp, Rattus norvegicus
aattgaggtatcctcagctagcccc

SEQ ID NO: 67616 - DNA, 25 bp, Rattus norvegicus
aattgaggtatcgtcagctagcccc

SEQ ID NO: 67617 - DNA, 25 bp, Rattus norvegicus
aattgagtccctctgctaggaattc

SEQ ID NO: 67618 - DNA, 25 bp, Rattus norvegicus
aattgagtccctgtgctaggaattc

SEQ ID NO: 67619 - DNA, 25 bp, Rattus norvegicus
aattgagtctgcctgtatgtgtatg

SEQ ID NO: 67620 - DNA, 25 bp, Rattus norvegicus
aattgagtctgcctttggccaggac

SEQ ID NO: 67621 - DNA, 25 bp, Rattus norvegicus
aattgagtctgcgtgtatgtgtatg

SEQ ID NO: 67622 - DNA, 25 bp, Rattus norvegicus
aattgagtctgcgtttggccaggac

SEQ ID NO: 67623 - DNA, 25 bp, Rattus norvegicus
aattgagtcttacagcagccattaa

SEQ ID NO: 67624 - DNA, 25 bp, Rattus norvegicus
aattgagtcttagagcagccattaa

SEQ ID NO: 67625 - DNA, 25 bp, Rattus norvegicus
aattgagtcttgagtcagggtcttt

SEQ ID NO: 67626 - DNA, 25 bp, Rattus norvegicus
aattgagtcttgtgtcagggtcttt

SEQ ID NO: 67627 - DNA, 25 bp, Rattus norvegicus
aattgagtggctacctctcagtggc

SEQ ID NO: 67628 - DNA, 25 bp, Rattus norvegicus
aattgagtggcttcctctcagtggc

SEQ ID NO: 67629 - DNA, 25 bp, Rattus norvegicus
aattgagttgttcaattgtggcaaa

SEQ ID NO: 67630 - DNA, 25 bp, Rattus norvegicus
aattgagttgttgaattgtggcaaa

SEQ ID NO: 67631 - DNA, 25 bp, Rattus norvegicus
aattgagtttatatgctgcccttcc

SEQ ID NO: 67632 - DNA, 25 bp, Rattus norvegicus
aattgagtttatttgctgcccttcc

SEQ ID NO: 67633 - DNA, 25 bp, Rattus norvegicus
aattgataacataggcagcccattc

SEQ ID NO: 67634 - DNA, 25 bp, Rattus norvegicus
aattgataacattggcagcccattc

SEQ ID NO: 67635 - DNA, 25 bp, Rattus norvegicus
aattgataattgactccttcgctgt

SEQ ID NO: 67636 - DNA, 25 bp, Rattus norvegicus
aattgataattgtctccttcgctgt

SEQ ID NO: 67637 - DNA, 25 bp, Rattus norvegicus
aattgatacgttcctttcccttgag

SEQ ID NO: 67638 - DNA, 25 bp, Rattus norvegicus
aattgatacgttgctttcccttgag

SEQ ID NO: 67639 - DNA, 25 bp, Rattus norvegicus
aattgatacttgacttctttcgctc

SEQ ID NO: 67640 - DNA, 25 bp, Rattus norvegicus
aattgatacttgtcttctttcgctc

SEQ ID NO: 67641 - DNA, 25 bp, Rattus norvegicus
aattgatatcgcatttgctccactc

SEQ ID NO: 67642 - DNA, 25 bp, Rattus norvegicus
aattgatatcgcttttgctccactc

SEQ ID NO: 67643 - DNA, 25 bp, Rattus norvegicus
aattgatcagtgcagcccatcgccg

SEQ ID NO: 67644 - DNA, 25 bp, Rattus norvegicus
aattgatcagtggagcccatcgccg

SEQ ID NO: 67645 - DNA, 25 bp, Rattus norvegicus
aattgatctcctcggaaactcctta

SEQ ID NO: 67646 - DNA, 25 bp, Rattus norvegicus
aattgatctcctgggaaactcctta

SEQ ID NO: 67647 - DNA, 25 bp, Rattus norvegicus
aattgatctgacattgaatggctaa

SEQ ID NO: 67648 - DNA, 25 bp, Rattus norvegicus
aattgatctgactttgaatggctaa

SEQ ID NO: 67649 - DNA, 25 bp, Rattus norvegicus
aattgatgatccatttctcttggtt

SEQ ID NO: 67650 - DNA, 25 bp, Rattus norvegicus
aattgatgatccttttctcttggtt

SEQ ID NO: 67651 - DNA, 25 bp, Rattus norvegicus
aattgatgcaggaaccacctcggtg

SEQ ID NO: 67652 - DNA, 25 bp, Rattus norvegicus
aattgatgcaggtaccacctcggtg

SEQ ID NO: 67653 - DNA, 25 bp, Rattus norvegicus
aattgatgcagtaaaactttgttac

SEQ ID NO: 67654 - DNA, 25 bp, Rattus norvegicus
aattgatgcagttaaactttgttac

SEQ ID NO: 67655 - DNA, 25 bp, Rattus norvegicus
aattgatgtgacaaggcgagcctgg

SEQ ID NO: 67656 - DNA, 25 bp, Rattus norvegicus
aattgatgtgactaggcgagcctgg

SEQ ID NO: 67657 - DNA, 25 bp, Rattus norvegicus
aattgattagcccttgcttttataa

SEQ ID NO: 67658 - DNA, 25 bp, Rattus norvegicus
aattgattagccgttgcttttataa

SEQ ID NO: 67659 - DNA, 25 bp, Rattus norvegicus
aattgattatctagtggccctcata

SEQ ID NO: 67660 - DNA, 25 bp, Rattus norvegicus
aattgattatcttgtggccctcata

SEQ ID NO: 67661 - DNA, 25 bp, Rattus norvegicus
aattgattccgcaatatacctttta

SEQ ID NO: 67662 - DNA, 25 bp, Rattus norvegicus
aattgattccgctatatacctttta

SEQ ID NO: 67663 - DNA, 25 bp, Rattus norvegicus
aattgattgattagcctcttagaag

SEQ ID NO: 67664 - DNA, 25 bp, Rattus norvegicus
aattgattgatttgcctcttagaag

SEQ ID NO: 67665 - DNA, 25 bp, Rattus norvegicus
aattgattgtcaatggctttttcca

SEQ ID NO: 67666 - DNA, 25 bp, Rattus norvegicus
aattgattgtcattggctttttcca

SEQ ID NO: 67667 - DNA, 25 bp, Rattus norvegicus
aattgcaaacatcgccagatcccag

SEQ ID NO: 67668 - DNA, 25 bp, Rattus norvegicus
aattgcaaacatggccagatcccag

SEQ ID NO: 67669 - DNA, 25 bp, Rattus norvegicus
aattgcaaataaaggccccttcaca

SEQ ID NO: 67670 - DNA, 25 bp, Rattus norvegicus
aattgcaaataatggccccttcaca

SEQ ID NO: 67671 - DNA, 25 bp, Rattus norvegicus
aattgcaaatttaccactgttatga

SEQ ID NO: 67672 - DNA, 25 bp, Rattus norvegicus
aattgcaaattttccactgttatga

SEQ ID NO: 67673 - DNA, 25 bp, Rattus norvegicus
aattgcaagctgcacaggcttcccc

SEQ ID NO: 67674 - DNA, 25 bp, Rattus norvegicus
aattgcaagctggacaggcttcccc

SEQ ID NO: 67675 - DNA, 25 bp, Rattus norvegicus
aattgcaatcgtattttcttttgta

SEQ ID NO: 67676 - DNA, 25 bp, Rattus norvegicus
aattgcaatcgttttttcttttgta

SEQ ID NO: 67677 - DNA, 25 bp, Rattus norvegicus
aattgcaatcttatccctggttttt

SEQ ID NO: 67678 - DNA, 25 bp, Rattus norvegicus
aattgcaatcttttccctggttttt

SEQ ID NO: 67679 - DNA, 25 bp, Rattus norvegicus
aattgcaatgtgaaagtgtttcttc

SEQ ID NO: 67680 - DNA, 25 bp, Rattus norvegicus
aattgcaatgtgtaagtgtttcttc

SEQ ID NO: 67681 - DNA, 25 bp, Rattus norvegicus
aattgcacagcaacttagtataggt

SEQ ID NO: 67682 - DNA, 25 bp, Rattus norvegicus
aattgcacagcatcttagtataggt

SEQ ID NO: 67683 - DNA, 25 bp, Rattus norvegicus
aattgcaccccaaaaacaacaggag

SEQ ID NO: 67684 - DNA, 25 bp, Rattus norvegicus
aattgcaccccataaacaacaggag

SEQ ID NO: 67685 - DNA, 25 bp, Rattus norvegicus
aattgcacctgtagttggccaccgg

SEQ ID NO: 67686 - DNA, 25 bp, Rattus norvegicus
aattgcacctgttgttggccaccgg

SEQ ID NO: 67687 - DNA, 25 bp, Rattus norvegicus
aattgcactacacttgttctggctg

SEQ ID NO: 67688 - DNA, 25 bp, Rattus norvegicus
aattgcactacagttgttctggctg

SEQ ID NO: 67689 - DNA, 25 bp, Rattus norvegicus
aattgcactgaactctataaacgta

SEQ ID NO: 67690 - DNA, 25 bp, Rattus norvegicus
aattgcactgaagtctataaacgta

SEQ ID NO: 67691 - DNA, 25 bp, Rattus norvegicus
aattgcactggtaatgggacacgcc

SEQ ID NO: 67692 - DNA, 25 bp, Rattus norvegicus
aattgcactggttatgggacacgcc

SEQ ID NO: 67693 - DNA, 25 bp, Rattus norvegicus
aattgcacttggaaagccagcctag

SEQ ID NO: 67694 - DNA, 25 bp, Rattus norvegicus
aattgcacttggtaagccagcctag

SEQ ID NO: 67695 - DNA, 25 bp, Rattus norvegicus
aattgcagaagcatcccaccattaa

SEQ ID NO: 67696 - DNA, 25 bp, Rattus norvegicus
aattgcagaagcttcccaccattaa

SEQ ID NO: 67697 - DNA, 25 bp, Rattus norvegicus
aattgcagacaaaccgtccagcctt

SEQ ID NO: 67698 - DNA, 25 bp, Rattus norvegicus
aattgcagacaatccgtccagcctt

SEQ ID NO: 67699 - DNA, 25 bp, Rattus norvegicus
aattgcagacccctgaattccaggt

SEQ ID NO: 67700 - DNA, 25 bp, Rattus norvegicus
aattgcagacccgtgaattccaggt

SEQ ID NO: 67701 - DNA, 25 bp, Rattus norvegicus
aattgcagcaccatgttctggtcca

SEQ ID NO: 67702 - DNA, 25 bp, Rattus norvegicus
aattgcagcaccttgttctggtcca

SEQ ID NO: 67703 - DNA, 25 bp, Rattus norvegicus
aattgcagcactcatccagccagaa

SEQ ID NO: 67704 - DNA, 25 bp, Rattus norvegicus
aattgcagcactgatccagccagaa

SEQ ID NO: 67705 - DNA, 25 bp, Rattus norvegicus
aattgcagctctctgctgtttgtta

SEQ ID NO: 67706 - DNA, 25 bp, Rattus norvegicus
aattgcagctctgtgctgtttgtta

SEQ ID NO: 67707 - DNA, 25 bp, Rattus norvegicus
aattgcagcttcaagcggcctgtgg

SEQ ID NO: 67708 - DNA, 25 bp, Rattus norvegicus
aattgcagcttctagcggcctgtgg

SEQ ID NO: 67709 - DNA, 25 bp, Rattus norvegicus
aattgcagggcacgtccagtttctc

SEQ ID NO: 67710 - DNA, 25 bp, Rattus norvegicus
aattgcagggcaggtccagtttctc

SEQ ID NO: 67711 - DNA, 25 bp, Rattus norvegicus
aattgcaggtacatgctggcttgcc

SEQ ID NO: 67712 - DNA, 25 bp, Rattus norvegicus
aattgcaggtacttgctggcttgcc

SEQ ID NO: 67713 - DNA, 25 bp, Rattus norvegicus
aattgcaggtgcactggtataagac

SEQ ID NO: 67714 - DNA, 25 bp, Rattus norvegicus
aattgcaggtgctctggtataagac

SEQ ID NO: 67715 - DNA, 25 bp, Rattus norvegicus
aattgcagtcaaagccttatggcct

SEQ ID NO: 67716 - DNA, 25 bp, Rattus norvegicus
aattgcagtcaatgccttatggcct

SEQ ID NO: 67717 - DNA, 25 bp, Rattus norvegicus
aattgcagtcctacagcattgtctg

SEQ ID NO: 67718 - DNA, 25 bp, Rattus norvegicus
aattgcagtccttcagcattgtctg

SEQ ID NO: 67719 - DNA, 25 bp, Rattus norvegicus
aattgcagtgtacagagtcgtgttt

SEQ ID NO: 67720 - DNA, 25 bp, Rattus norvegicus
aattgcagtgtagagagtcgtgttt

SEQ ID NO: 67721 - DNA, 25 bp, Rattus norvegicus
aattgcatacacaccaaccattact

SEQ ID NO: 67722 - DNA, 25 bp, Rattus norvegicus
aattgcatacactccaaccattact

SEQ ID NO: 67723 - DNA, 25 bp, Rattus norvegicus
aattgcatcacaaggattctgcctc

SEQ ID NO: 67724 - DNA, 25 bp, Rattus norvegicus
aattgcatcacatggattctgcctc

SEQ ID NO: 67725 - DNA, 25 bp, Rattus norvegicus
aattgcatctaaaggactctgttga

SEQ ID NO: 67726 - DNA, 25 bp, Rattus norvegicus
aattgcatctaatggactctgttga

SEQ ID NO: 67727 - DNA, 25 bp, Rattus norvegicus
aattgcatcttgctctggaggcctg

SEQ ID NO: 67728 - DNA, 25 bp, Rattus norvegicus
aattgcatcttggtctggaggcctg

SEQ ID NO: 67729 - DNA, 25 bp, Rattus norvegicus
aattgcatctttccagcttggcaga

SEQ ID NO: 67730 - DNA, 25 bp, Rattus norvegicus
aattgcatctttgcagcttggcaga

SEQ ID NO: 67731 - DNA, 25 bp, Rattus norvegicus
aattgcatgcacattccaccggtca

SEQ ID NO: 67732 - DNA, 25 bp, Rattus norvegicus
aattgcatgcactttccaccggtca

SEQ ID NO: 67733 - DNA, 25 bp, Rattus norvegicus
aattgcatgtatcgccatgcacttc

SEQ ID NO: 67734 - DNA, 25 bp, Rattus norvegicus
aattgcatgtatggccatgcacttc

SEQ ID NO: 67735 - DNA, 25 bp, Rattus norvegicus
aattgcatgtgtcagcgcacccagt

SEQ ID NO: 67736 - DNA, 25 bp, Rattus norvegicus
aattgcatgtgtgagcgcacccagt

SEQ ID NO: 67737 - DNA, 25 bp, Rattus norvegicus
aattgcattctgattgcctcaaata

SEQ ID NO: 67738 - DNA, 25 bp, Rattus norvegicus
aattgcattctgtttgcctcaaata

SEQ ID NO: 67739 - DNA, 25 bp, Rattus norvegicus
aattgcattttacggccagcaaggt

SEQ ID NO: 67740 - DNA, 25 bp, Rattus norvegicus
aattgcattttagggccagcaaggt

SEQ ID NO: 67741 - DNA, 25 bp, Rattus norvegicus
aattgccaaaacacaatgcctccag

SEQ ID NO: 67742 - DNA, 25 bp, Rattus norvegicus
aattgccaaaactcaatgcctccag

SEQ ID NO: 67743 - DNA, 25 bp, Rattus norvegicus
aattgccaacaacacccatagccgt

SEQ ID NO: 67744 - DNA, 25 bp, Rattus norvegicus
aattgccaacaagacccatagccgt

SEQ ID NO: 67745 - DNA, 25 bp, Rattus norvegicus
aattgccaagatcttgagactctct

SEQ ID NO: 67746 - DNA, 25 bp, Rattus norvegicus
aattgccaagatgttgagactctct

SEQ ID NO: 67747 - DNA, 25 bp, Rattus norvegicus
aattgccaagccacatatattcacc

SEQ ID NO: 67748 - DNA, 25 bp, Rattus norvegicus
aattgccaagcctcatatattcacc

SEQ ID NO: 67749 - DNA, 25 bp, Rattus norvegicus
aattgccaagctaggagtgacctaa

SEQ ID NO: 67750 - DNA, 25 bp, Rattus norvegicus
aattgccaagcttggagtgacctaa

SEQ ID NO: 67751 - DNA, 25 bp, Rattus norvegicus
aattgccaagtgagtttctagcccc

SEQ ID NO: 67752 - DNA, 25 bp, Rattus norvegicus
aattgccaagtgtgtttctagcccc

SEQ ID NO: 67753 - DNA, 25 bp, Rattus norvegicus
aattgccacagcctaagtattgaca

SEQ ID NO: 67754 - DNA, 25 bp, Rattus norvegicus
aattgccacagcgtaagtattgaca

SEQ ID NO: 67755 - DNA, 25 bp, Rattus norvegicus
aattgccacagtagggccattgggt

SEQ ID NO: 67756 - DNA, 25 bp, Rattus norvegicus
aattgccacagttgggccattgggt

SEQ ID NO: 67757 - DNA, 25 bp, Rattus norvegicus
aattgccatatcatgccacgacaat

SEQ ID NO: 67758 - DNA, 25 bp, Rattus norvegicus
aattgccatatcttgccacgacaat

SEQ ID NO: 67759 - DNA, 25 bp, Rattus norvegicus
aattgccatattccacatgtcttaa

SEQ ID NO: 67760 - DNA, 25 bp, Rattus norvegicus
aattgccatattgcacatgtcttaa

SEQ ID NO: 67761 - DNA, 25 bp, Rattus norvegicus
aattgccattatagtttcgtgaagc

SEQ ID NO: 67762 - DNA, 25 bp, Rattus norvegicus
aattgccattattgtttcgtgaagc

SEQ ID NO: 67763 - DNA, 25 bp, Rattus norvegicus
aattgcccagaaattcccaagcagt

SEQ ID NO: 67764 - DNA, 25 bp, Rattus norvegicus
aattgcccagaatttcccaagcagt

SEQ ID NO: 67765 - DNA, 25 bp, Rattus norvegicus
aattgcccaggactcgttaacgttg

SEQ ID NO: 67766 - DNA, 25 bp, Rattus norvegicus
aattgcccaggagtcgttaacgttg

SEQ ID NO: 67767 - DNA, 25 bp, Rattus norvegicus
aattgcccataactctaactcctgg

SEQ ID NO: 67768 - DNA, 25 bp, Rattus norvegicus
aattgcccataagtctaactcctgg

SEQ ID NO: 67769 - DNA, 25 bp, Rattus norvegicus
aattgcccattgctacaaggctcgg

SEQ ID NO: 67770 - DNA, 25 bp, Rattus norvegicus
aattgcccattggtacaaggctcgg

SEQ ID NO: 67771 - DNA, 25 bp, Rattus norvegicus
aattgccccaaaattgcctggccca

SEQ ID NO: 67772 - DNA, 25 bp, Rattus norvegicus
aattgccccaaatttgcctggccca

SEQ ID NO: 67773 - DNA, 25 bp, Rattus norvegicus
aattgccccaagcatctgctacatt

SEQ ID NO: 67774 - DNA, 25 bp, Rattus norvegicus
aattgccccaaggatctgctacatt

SEQ ID NO: 67775 - DNA, 25 bp, Rattus norvegicus
aattgccccggtacaagatagaaga

SEQ ID NO: 67776 - DNA, 25 bp, Rattus norvegicus
aattgccccggttcaagatagaaga

SEQ ID NO: 67777 - DNA, 25 bp, Rattus norvegicus
aattgcccggtgattgttcaatgtc

SEQ ID NO: 67778 - DNA, 25 bp, Rattus norvegicus
aattgcccggtgtttgttcaatgtc

SEQ ID NO: 67779 - DNA, 25 bp, Rattus norvegicus
aattgccctataatattctatgctc

SEQ ID NO: 67780 - DNA, 25 bp, Rattus norvegicus
aattgccctatattattctatgctc

SEQ ID NO: 67781 - DNA, 25 bp, Rattus norvegicus
aattgccctgaactctggctatgga

SEQ ID NO: 67782 - DNA, 25 bp, Rattus norvegicus
aattgccctgaagtctggctatgga

SEQ ID NO: 67783 - DNA, 25 bp, Rattus norvegicus
aattgccctgtcctcaggtgcagtg

SEQ ID NO: 67784 - DNA, 25 bp, Rattus norvegicus
aattgccctgtcgtcaggtgcagtg

SEQ ID NO: 67785 - DNA, 25 bp, Rattus norvegicus
aattgccgcctgattgttacgatgc

SEQ ID NO: 67786 - DNA, 25 bp, Rattus norvegicus
aattgccgcctgtttgttacgatgc

SEQ ID NO: 67787 - DNA, 25 bp, Rattus norvegicus
aattgccgcgcaccagggctgcagc

SEQ ID NO: 67788 - DNA, 25 bp, Rattus norvegicus
aattgccgcgcagcagggctgcagc

SEQ ID NO: 67789 - DNA, 25 bp, Rattus norvegicus
aattgcctacctatgtcctaagact

SEQ ID NO: 67790 - DNA, 25 bp, Rattus norvegicus
aattgcctacctttgtcctaagact

SEQ ID NO: 67791 - DNA, 25 bp, Rattus norvegicus
aattgcctatgtctattctgctttg

SEQ ID NO: 67792 - DNA, 25 bp, Rattus norvegicus
aattgcctatgtgtattctgctttg

SEQ ID NO: 67793 - DNA, 25 bp, Rattus norvegicus
aattgcctcaagacaagtgcttctg

SEQ ID NO: 67794 - DNA, 25 bp, Rattus norvegicus
aattgcctcaagtcaagtgcttctg

SEQ ID NO: 67795 - DNA, 25 bp, Rattus norvegicus
aattgcctcatgagatgttttatac

SEQ ID NO: 67796 - DNA, 25 bp, Rattus norvegicus
aattgcctcatgtgatgttttatac

SEQ ID NO: 67797 - DNA, 25 bp, Rattus norvegicus
aattgcctcattatggaaaattgtg

SEQ ID NO: 67798 - DNA, 25 bp, Rattus norvegicus
aattgcctcattttggaaaattgtg

SEQ ID NO: 67799 - DNA, 25 bp, Rattus norvegicus
aattgcctccaaatgctcatggtgc

SEQ ID NO: 67800 - DNA, 25 bp, Rattus norvegicus
aattgcctccaattgctcatggtgc

SEQ ID NO: 67801 - DNA, 25 bp, Rattus norvegicus
aattgcctcgatatattttgtgtaa

SEQ ID NO: 67802 - DNA, 25 bp, Rattus norvegicus
aattgcctcgatttattttgtgtaa

SEQ ID NO: 67803 - DNA, 25 bp, Rattus norvegicus
aattgcctggagctttgctctcagc

SEQ ID NO: 67804 - DNA, 25 bp, Rattus norvegicus
aattgcctggaggtttgctctcagc

SEQ ID NO: 67805 - DNA, 25 bp, Rattus norvegicus
aattgccttataaatattggttggt

SEQ ID NO: 67806 - DNA, 25 bp, Rattus norvegicus
aattgccttataccttgatcttatg

SEQ ID NO: 67807 - DNA, 25 bp, Rattus norvegicus
aattgccttatagcttgatcttatg

SEQ ID NO: 67808 - DNA, 25 bp, Rattus norvegicus
aattgccttatatatattggttggt

SEQ ID NO: 67809 - DNA, 25 bp, Rattus norvegicus
aattgccttattccagagccttcta

SEQ ID NO: 67810 - DNA, 25 bp, Rattus norvegicus
aattgccttattgcagagccttcta

SEQ ID NO: 67811 - DNA, 25 bp, Rattus norvegicus
aattgccttcaacggcactgttctg

SEQ ID NO: 67812 - DNA, 25 bp, Rattus norvegicus
aattgccttcaagggcactgttctg

SEQ ID NO: 67813 - DNA, 25 bp, Rattus norvegicus
aattgccttctactgctgtagcgag

SEQ ID NO: 67814 - DNA, 25 bp, Rattus norvegicus
aattgccttctagtgctgtagcgag

SEQ ID NO: 67815 - DNA, 25 bp, Rattus norvegicus
aattgccttgaactctctgctcttt

SEQ ID NO: 67816 - DNA, 25 bp, Rattus norvegicus
aattgccttgaagtctctgctcttt

SEQ ID NO: 67817 - DNA, 25 bp, Rattus norvegicus
aattgccttgatatttcctagttgc

SEQ ID NO: 67818 - DNA, 25 bp, Rattus norvegicus
aattgccttgatttttcctagttgc

SEQ ID NO: 67819 - DNA, 25 bp, Rattus norvegicus
aattgccttgcacacatttcggtac

SEQ ID NO: 67820 - DNA, 25 bp, Rattus norvegicus
aattgccttgcagacatttcggtac

SEQ ID NO: 67821 - DNA, 25 bp, Rattus norvegicus
aattgccttgccctggcattttgac

SEQ ID NO: 67822 - DNA, 25 bp, Rattus norvegicus
aattgccttgccgtggcattttgac

SEQ ID NO: 67823 - DNA, 25 bp, Rattus norvegicus
aattgcctttgtcctgtttggtaat

SEQ ID NO: 67824 - DNA, 25 bp, Rattus norvegicus
aattgcctttgtctgatgggaccac

SEQ ID NO: 67825 - DNA, 25 bp, Rattus norvegicus
aattgcctttgtgctgtttggtaat

SEQ ID NO: 67826 - DNA, 25 bp, Rattus norvegicus
aattgcctttgtgtgatgggaccac

SEQ ID NO: 67827 - DNA, 25 bp, Rattus norvegicus
aattgccttttgaggtctggatcca

SEQ ID NO: 67828 - DNA, 25 bp, Rattus norvegicus
aattgccttttgtggtctggatcca

SEQ ID NO: 67829 - DNA, 25 bp, Rattus norvegicus
aattgcgaagcaagccttacagaat

SEQ ID NO: 67830 - DNA, 25 bp, Rattus norvegicus
aattgcgaagcatgccttacagaat

SEQ ID NO: 67831 - DNA, 25 bp, Rattus norvegicus
aattgcgctgctatggagaatgtct

SEQ ID NO: 67832 - DNA, 25 bp, Rattus norvegicus
aattgcgctgctttggagaatgtct

SEQ ID NO: 67833 - DNA, 25 bp, Rattus norvegicus
aattgcggagcccttatgatggaat

SEQ ID NO: 67834 - DNA, 25 bp, Rattus norvegicus
aattgcggagccgttatgatggaat

SEQ ID NO: 67835 - DNA, 25 bp, Rattus norvegicus
aattgcggtgtccatacttgtgtta

SEQ ID NO: 67836 - DNA, 25 bp, Rattus norvegicus
aattgcggtgtcgatacttgtgtta

SEQ ID NO: 67837 - DNA, 25 bp, Rattus norvegicus
aattgcggttttctgactgtgggtc

SEQ ID NO: 67838 - DNA, 25 bp, Rattus norvegicus
aattgcggttttgtgactgtgggtc

SEQ ID NO: 67839 - DNA, 25 bp, Rattus norvegicus
aattgcgttctactgactttggcga

SEQ ID NO: 67840 - DNA, 25 bp, Rattus norvegicus
aattgcgttctagtgactttggcga

SEQ ID NO: 67841 - DNA, 25 bp, Rattus norvegicus
aattgctaaataaagctggtccata

SEQ ID NO: 67842 - DNA, 25 bp, Rattus norvegicus
aattgctaaatatagctggtccata

SEQ ID NO: 67843 - DNA, 25 bp, Rattus norvegicus
aattgctacagccactaggttggat

SEQ ID NO: 67844 - DNA, 25 bp, Rattus norvegicus
aattgctacagcgactaggttggat

SEQ ID NO: 67845 - DNA, 25 bp, Rattus norvegicus
aattgctactgaacacagccagcga

SEQ ID NO: 67846 - DNA, 25 bp, Rattus norvegicus
aattgctactgatcacagccagcga

SEQ ID NO: 67847 - DNA, 25 bp, Rattus norvegicus
aattgctactgtattataggctaaa

SEQ ID NO: 67848 - DNA, 25 bp, Rattus norvegicus
aattgctactgttttataggctaaa

SEQ ID NO: 67849 - DNA, 25 bp, Rattus norvegicus
aattgctacttcaccctgctattat

SEQ ID NO: 67850 - DNA, 25 bp, Rattus norvegicus
aattgctacttctccctgctattat

SEQ ID NO: 67851 - DNA, 25 bp, Rattus norvegicus
aattgctatcagagggtctcggatc

SEQ ID NO: 67852 - DNA, 25 bp, Rattus norvegicus
aattgctatcagtgggtctcggatc

SEQ ID NO: 67853 - DNA, 25 bp, Rattus norvegicus
aattgctattgacttggctctctta

SEQ ID NO: 67854 - DNA, 25 bp, Rattus norvegicus
aattgctattgagttggctctctta

SEQ ID NO: 67855 - DNA, 25 bp, Rattus norvegicus
aattgctatttcattattgtacgag

SEQ ID NO: 67856 - DNA, 25 bp, Rattus norvegicus
aattgctatttctttattgtacgag

SEQ ID NO: 67857 - DNA, 25 bp, Rattus norvegicus
aattgctcaaacctggttctccaac

SEQ ID NO: 67858 - DNA, 25 bp, Rattus norvegicus
aattgctcaaacgtggttctccaac

SEQ ID NO: 67859 - DNA, 25 bp, Rattus norvegicus
aattgctcactcacctgtgaacaga

SEQ ID NO: 67860 - DNA, 25 bp, Rattus norvegicus
aattgctcactctcctgtgaacaga

SEQ ID NO: 67861 - DNA, 25 bp, Rattus norvegicus
aattgctcaggacaagtggctcaga

SEQ ID NO: 67862 - DNA, 25 bp, Rattus norvegicus
aattgctcaggagaagtggctcaga

SEQ ID NO: 67863 - DNA, 25 bp, Rattus norvegicus
aattgctcagtcactgggatgctga

SEQ ID NO: 67864 - DNA, 25 bp, Rattus norvegicus
aattgctcagtctctgggatgctga

SEQ ID NO: 67865 - DNA, 25 bp, Rattus norvegicus
aattgctccttcagcgaaggtgtga

SEQ ID NO: 67866 - DNA, 25 bp, Rattus norvegicus
aattgctccttctgcgaaggtgtga

SEQ ID NO: 67867 - DNA, 25 bp, Rattus norvegicus
aattgctctatcacactgcgttgta

SEQ ID NO: 67868 - DNA, 25 bp, Rattus norvegicus
aattgctctatctcactgcgttgta

SEQ ID NO: 67869 - DNA, 25 bp, Rattus norvegicus
aattgctctggaacgctactaggac

SEQ ID NO: 67870 - DNA, 25 bp, Rattus norvegicus
aattgctctggatcgctactaggac

SEQ ID NO: 67871 - DNA, 25 bp, Rattus norvegicus
aattgctctggtcggaagttcggaa

SEQ ID NO: 67872 - DNA, 25 bp, Rattus norvegicus
aattgctctggtgggaagttcggaa

SEQ ID NO: 67873 - DNA, 25 bp, Rattus norvegicus
aattgctctgtactgatgtcttgtt

SEQ ID NO: 67874 - DNA, 25 bp, Rattus norvegicus
aattgctctgtagtgatgtcttgtt

SEQ ID NO: 67875 - DNA, 25 bp, Rattus norvegicus
aattgctcttccctttctagtttag

SEQ ID NO: 67876 - DNA, 25 bp, Rattus norvegicus
aattgctcttccgtttctagtttag

SEQ ID NO: 67877 - DNA, 25 bp, Rattus norvegicus
aattgctctttcaggcagcatggtg

SEQ ID NO: 67878 - DNA, 25 bp, Rattus norvegicus
aattgctctttctggcagcatggtg

SEQ ID NO: 67879 - DNA, 25 bp, Rattus norvegicus
aattgctgaagtcctgagcctttgt

SEQ ID NO: 67880 - DNA, 25 bp, Rattus norvegicus
aattgctgaagtgctgagcctttgt

SEQ ID NO: 67881 - DNA, 25 bp, Rattus norvegicus
aattgctgacagacatggaggcctc

SEQ ID NO: 67882 - DNA, 25 bp, Rattus norvegicus
aattgctgacagagccaaggccaag

SEQ ID NO: 67883 - DNA, 25 bp, Rattus norvegicus
aattgctgacagtcatggaggcctc

SEQ ID NO: 67884 - DNA, 25 bp, Rattus norvegicus
aattgctgacagtgccaaggccaag

SEQ ID NO: 67885 - DNA, 25 bp, Rattus norvegicus
aattgctgaccaatatgactgtacc

SEQ ID NO: 67886 - DNA, 25 bp, Rattus norvegicus
aattgctgaccattatgactgtacc

SEQ ID NO: 67887 - DNA, 25 bp, Rattus norvegicus
aattgctgaccgagcagctcatgat

SEQ ID NO: 67888 - DNA, 25 bp, Rattus norvegicus
aattgctgaccgtgcagctcatgat

SEQ ID NO: 67889 - DNA, 25 bp, Rattus norvegicus
aattgctgacttaggcccgaccagg

SEQ ID NO: 67890 - DNA, 25 bp, Rattus norvegicus
aattgctgactttggcccgaccagg

SEQ ID NO: 67891 - DNA, 25 bp, Rattus norvegicus
aattgctgagtaatcccgatctcgc

SEQ ID NO: 67892 - DNA, 25 bp, Rattus norvegicus
aattgctgagtattcccgatctcgc

SEQ ID NO: 67893 - DNA, 25 bp, Rattus norvegicus
aattgctgagtgacctatttccggc

SEQ ID NO: 67894 - DNA, 25 bp, Rattus norvegicus
aattgctgagtgtcctatttccggc

SEQ ID NO: 67895 - DNA, 25 bp, Rattus norvegicus
aattgctgcccactctgttctctta

SEQ ID NO: 67896 - DNA, 25 bp, Rattus norvegicus
aattgctgcccagtctgttctctta

SEQ ID NO: 67897 - DNA, 25 bp, Rattus norvegicus
aattgctgcccgagaggtgcctatt

SEQ ID NO: 67898 - DNA, 25 bp, Rattus norvegicus
aattgctgcccgtgaggtgcctatt

SEQ ID NO: 67899 - DNA, 25 bp, Rattus norvegicus
aattgctgcctcaatctagtcccat

SEQ ID NO: 67900 - DNA, 25 bp, Rattus norvegicus
aattgctgcctctatctagtcccat

SEQ ID NO: 67901 - DNA, 25 bp, Rattus norvegicus
aattgctggaccacagttgtcacat

SEQ ID NO: 67902 - DNA, 25 bp, Rattus norvegicus
aattgctggacctcagttgtcacat

SEQ ID NO: 67903 - DNA, 25 bp, Rattus norvegicus
aattgctgggagcatcttctgccct

SEQ ID NO: 67904 - DNA, 25 bp, Rattus norvegicus
aattgctgggaggatcttctgccct

SEQ ID NO: 67905 - DNA, 25 bp, Rattus norvegicus
aattgctgggatcctatttggttgt

SEQ ID NO: 67906 - DNA, 25 bp, Rattus norvegicus
aattgctgggatgctatttggttgt

SEQ ID NO: 67907 - DNA, 25 bp, Rattus norvegicus
aattgctgggttcaggactcggcta

SEQ ID NO: 67908 - DNA, 25 bp, Rattus norvegicus
aattgctgggttgaggactcggcta

SEQ ID NO: 67909 - DNA, 25 bp, Rattus norvegicus
aattgctgtagcacaaaccttttca

SEQ ID NO: 67910 - DNA, 25 bp, Rattus norvegicus
aattgctgtagctcaaaccttttca

SEQ ID NO: 67911 - DNA, 25 bp, Rattus norvegicus
aattgctgtcctacaggccagtgct

SEQ ID NO: 67912 - DNA, 25 bp, Rattus norvegicus
aattgctgtccttcaggccagtgct

SEQ ID NO: 67913 - DNA, 25 bp, Rattus norvegicus
aattgctgtgaaaggcattttcagt

SEQ ID NO: 67914 - DNA, 25 bp, Rattus norvegicus
aattgctgtgaatggcattttcagt

SEQ ID NO: 67915 - DNA, 25 bp, Rattus norvegicus
aattgctgtgcaaccacagccacat

SEQ ID NO: 67916 - DNA, 25 bp, Rattus norvegicus
aattgctgtgcatccacagccacat

SEQ ID NO: 67917 - DNA, 25 bp, Rattus norvegicus
aattgcttaatcacactctgacttg

SEQ ID NO: 67918 - DNA, 25 bp, Rattus norvegicus
aattgcttaatctcactctgacttg

SEQ ID NO: 67919 - DNA, 25 bp, Rattus norvegicus
aattgcttacatacttactacccgg

SEQ ID NO: 67920 - DNA, 25 bp, Rattus norvegicus
aattgcttacattcttactacccgg

SEQ ID NO: 67921 - DNA, 25 bp, Rattus norvegicus
aattgcttatgcatgtgtaacactg

SEQ ID NO: 67922 - DNA, 25 bp, Rattus norvegicus
aattgcttatgcttgtgtaacactg

SEQ ID NO: 67923 - DNA, 25 bp, Rattus norvegicus
aattgcttatttacacctgtttaga

SEQ ID NO: 67924 - DNA, 25 bp, Rattus norvegicus
aattgcttattttcacctgtttaga

SEQ ID NO: 67925 - DNA, 25 bp, Rattus norvegicus
aattgcttcacaagcttgagtctcc

SEQ ID NO: 67926 - DNA, 25 bp, Rattus norvegicus
aattgcttcacatgcttgagtctcc

SEQ ID NO: 67927 - DNA, 25 bp, Rattus norvegicus
aattgcttctgcctgatgatgccac

SEQ ID NO: 67928 - DNA, 25 bp, Rattus norvegicus
aattgcttctgcgtgatgatgccac

SEQ ID NO: 67929 - DNA, 25 bp, Rattus norvegicus
aattgcttgcgacacattgacggga

SEQ ID NO: 67930 - DNA, 25 bp, Rattus norvegicus
aattgcttgcgagacattgacggga

SEQ ID NO: 67931 - DNA, 25 bp, Rattus norvegicus
aattgcttgcttcagatgagtcccc

SEQ ID NO: 67932 - DNA, 25 bp, Rattus norvegicus
aattgcttgcttctttcgagactgc

SEQ ID NO: 67933 - DNA, 25 bp, Rattus norvegicus
aattgcttgcttgagatgagtcccc

SEQ ID NO: 67934 - DNA, 25 bp, Rattus norvegicus
aattgcttgcttgtttcgagactgc

SEQ ID NO: 67935 - DNA, 25 bp, Rattus norvegicus
aattgcttgggcacctgaaggcaaa

SEQ ID NO: 67936 - DNA, 25 bp, Rattus norvegicus
aattgcttgggctcctgaaggcaaa

SEQ ID NO: 67937 - DNA, 25 bp, Rattus norvegicus
aattgcttgtcaacttttccctttt

SEQ ID NO: 67938 - DNA, 25 bp, Rattus norvegicus
aattgcttgtcatcttttccctttt

SEQ ID NO: 67939 - DNA, 25 bp, Rattus norvegicus
aattgctttcagatttggagtttaa

SEQ ID NO: 67940 - DNA, 25 bp, Rattus norvegicus
aattgctttcagttttggagtttaa

SEQ ID NO: 67941 - DNA, 25 bp, Rattus norvegicus
aattgctttcttccctaattaccta

SEQ ID NO: 67942 - DNA, 25 bp, Rattus norvegicus
aattgctttcttgcctaattaccta

SEQ ID NO: 67943 - DNA, 25 bp, Rattus norvegicus
aattgctttgaaacctggagctgga

SEQ ID NO: 67944 - DNA, 25 bp, Rattus norvegicus
aattgctttgaatcctggagctgga

SEQ ID NO: 67945 - DNA, 25 bp, Rattus norvegicus
aattgcttttatattgctgtaccag

SEQ ID NO: 67946 - DNA, 25 bp, Rattus norvegicus
aattgcttttattttgctgtaccag

SEQ ID NO: 67947 - DNA, 25 bp, Rattus norvegicus
aattgcttttccctgcaaggatgca

SEQ ID NO: 67948 - DNA, 25 bp, Rattus norvegicus
aattgcttttccgtgcaaggatgca

SEQ ID NO: 67949 - DNA, 25 bp, Rattus norvegicus
aattgcttttgcctttttcatgaat

SEQ ID NO: 67950 - DNA, 25 bp, Rattus norvegicus
aattgcttttgcgtttttcatgaat

SEQ ID NO: 67951 - DNA, 25 bp, Rattus norvegicus
aattggaaatgaaccctctgtgaga

SEQ ID NO: 67952 - DNA, 25 bp, Rattus norvegicus
aattggaaatgatccctctgtgaga

SEQ ID NO: 67953 - DNA, 25 bp, Rattus norvegicus
aattggacacaccagctacttcaga

SEQ ID NO: 67954 - DNA, 25 bp, Rattus norvegicus
aattggacacacgagctacttcaga

SEQ ID NO: 67955 - DNA, 25 bp, Rattus norvegicus
aattggacagtccttgaaagattta

SEQ ID NO: 67956 - DNA, 25 bp, Rattus norvegicus
aattggacagtcgttgaaagattta

SEQ ID NO: 67957 - DNA, 25 bp, Rattus norvegicus
aattggaccctgcagtacaccttga

SEQ ID NO: 67958 - DNA, 25 bp, Rattus norvegicus
aattggaccctggagtacaccttga

SEQ ID NO: 67959 - DNA, 25 bp, Rattus norvegicus
aattggacggtgaggaactgcccct

SEQ ID NO: 67960 - DNA, 25 bp, Rattus norvegicus
aattggacggtgtggaactgcccct

SEQ ID NO: 67961 - DNA, 25 bp, Rattus norvegicus
aattggactccacgcaggcttacga

SEQ ID NO: 67962 - DNA, 25 bp, Rattus norvegicus
aattggactccaggcaggcttacga

SEQ ID NO: 67963 - DNA, 25 bp, Rattus norvegicus
aattggacttttctgttgtttctgc

SEQ ID NO: 67964 - DNA, 25 bp, Rattus norvegicus
aattggacttttgtgttgtttctgc

SEQ ID NO: 67965 - DNA, 25 bp, Rattus norvegicus
aattggagaccccagaggctccgtt

SEQ ID NO: 67966 - DNA, 25 bp, Rattus norvegicus
aattggagacccgagaggctccgtt

SEQ ID NO: 67967 - DNA, 25 bp, Rattus norvegicus
aattggagactgctggccacatcat

SEQ ID NO: 67968 - DNA, 25 bp, Rattus norvegicus
aattggagactggtggccacatcat

SEQ ID NO: 67969 - DNA, 25 bp, Rattus norvegicus
aattggagccacagacttgtctttt

SEQ ID NO: 67970 - DNA, 25 bp, Rattus norvegicus
aattggagccactgacttgtctttt

SEQ ID NO: 67971 - DNA, 25 bp, Rattus norvegicus
aattggagccagagatggaatttga

SEQ ID NO: 67972 - DNA, 25 bp, Rattus norvegicus
aattggagccagagcctagaggacc

SEQ ID NO: 67973 - DNA, 25 bp, Rattus norvegicus
aattggagccagtgatggaatttga

SEQ ID NO: 67974 - DNA, 25 bp, Rattus norvegicus
aattggagccagtgcctagaggacc

SEQ ID NO: 67975 - DNA, 25 bp, Rattus norvegicus
aattggaggcaaccactccgggtca

SEQ ID NO: 67976 - DNA, 25 bp, Rattus norvegicus
aattggaggcaagcactccgggtca

SEQ ID NO: 67977 - DNA, 25 bp, Rattus norvegicus
aattggaggcatagcagccaccagc

SEQ ID NO: 67978 - DNA, 25 bp, Rattus norvegicus
aattggaggcattgcagccaccagc

SEQ ID NO: 67979 - DNA, 25 bp, Rattus norvegicus
aattggagtaccagggaccctctgc

SEQ ID NO: 67980 - DNA, 25 bp, Rattus norvegicus
aattggagtacctgggaccctctgc

SEQ ID NO: 67981 - DNA, 25 bp, Rattus norvegicus
aattggatagcacccatgttcatgc

SEQ ID NO: 67982 - DNA, 25 bp, Rattus norvegicus
aattggatagcagccatgttcatgc

SEQ ID NO: 67983 - DNA, 25 bp, Rattus norvegicus
aattggatcaaacccgtgtctctac

SEQ ID NO: 67984 - DNA, 25 bp, Rattus norvegicus
aattggatcaaagccgtgtctctac

SEQ ID NO: 67985 - DNA, 25 bp, Rattus norvegicus
aattggatgcttactctcttctcgg

SEQ ID NO: 67986 - DNA, 25 bp, Rattus norvegicus
aattggatgctttctctcttctcgg

SEQ ID NO: 67987 - DNA, 25 bp, Rattus norvegicus
aattggatgtagatgtccacggtca

SEQ ID NO: 67988 - DNA, 25 bp, Rattus norvegicus
aattggatgtagttgtccacggtca

SEQ ID NO: 67989 - DNA, 25 bp, Rattus norvegicus
aattggattgtaatctctggcatat

SEQ ID NO: 67990 - DNA, 25 bp, Rattus norvegicus
aattggattgtattctctggcatat

SEQ ID NO: 67991 - DNA, 25 bp, Rattus norvegicus
aattggatttctcacttctttaaca

SEQ ID NO: 67992 - DNA, 25 bp, Rattus norvegicus
aattggatttctgacttctttaaca

SEQ ID NO: 67993 - DNA, 25 bp, Rattus norvegicus
aattggcaacacaattcagccctcc

SEQ ID NO: 67994 - DNA, 25 bp, Rattus norvegicus
aattggcaacactattcagccctcc

SEQ ID NO: 67995 - DNA, 25 bp, Rattus norvegicus
aattggcaccacacttgtacattat

SEQ ID NO: 67996 - DNA, 25 bp, Rattus norvegicus
aattggcaccactcttgtacattat

SEQ ID NO: 67997 - DNA, 25 bp, Rattus norvegicus
aattggcagaaaaggtcctctcccg

SEQ ID NO: 67998 - DNA, 25 bp, Rattus norvegicus
aattggcagaaatggtcctctcccg

SEQ ID NO: 67999 - DNA, 25 bp, Rattus norvegicus
aattggcagagcattttcccttcgg

SEQ ID NO: 68000 - DNA, 25 bp, Rattus norvegicus
aattggcagagctttttcccttcgg

SEQ ID NO: 68001 - DNA, 25 bp, Rattus norvegicus
aattggcagtgtctgtctgagtaaa

SEQ ID NO: 68002 - DNA, 25 bp, Rattus norvegicus
aattggcagtgtgtgtctgagtaaa

SEQ ID NO: 68003 - DNA, 25 bp, Rattus norvegicus
aattggcatggacccgactatgttt

SEQ ID NO: 68004 - DNA, 25 bp, Rattus norvegicus
aattggcatggagccgactatgttt

SEQ ID NO: 68005 - DNA, 25 bp, Rattus norvegicus
aattggccaattcatggatctttca

SEQ ID NO: 68006 - DNA, 25 bp, Rattus norvegicus
aattggccaattgatggatctttca

SEQ ID NO: 68007 - DNA, 25 bp, Rattus norvegicus
aattggcccatgcttgatagatcaa

SEQ ID NO: 68008 - DNA, 25 bp, Rattus norvegicus
aattggcccatggttgatagatcaa

SEQ ID NO: 68009 - DNA, 25 bp, Rattus norvegicus
aattggccggctcattctgaaggaa

SEQ ID NO: 68010 - DNA, 25 bp, Rattus norvegicus
aattggccggctgattctgaaggaa

SEQ ID NO: 68011 - DNA, 25 bp, Rattus norvegicus
aattggcctcagaggtgttggaacc

SEQ ID NO: 68012 - DNA, 25 bp, Rattus norvegicus
aattggcctcagtggtgttggaacc

SEQ ID NO: 68013 - DNA, 25 bp, Rattus norvegicus
aattggcctggcaagatgcacccac

SEQ ID NO: 68014 - DNA, 25 bp, Rattus norvegicus
aattggcctggctagatgcacccac

SEQ ID NO: 68015 - DNA, 25 bp, Rattus norvegicus
aattggcgagaacaagccatacacc

SEQ ID NO: 68016 - DNA, 25 bp, Rattus norvegicus
aattggcgagaagaagccatacacc

SEQ ID NO: 68017 - DNA, 25 bp, Rattus norvegicus
aattggcgcataattttacacttgc

SEQ ID NO: 68018 - DNA, 25 bp, Rattus norvegicus
aattggcgcatatttttacacttgc

SEQ ID NO: 68019 - DNA, 25 bp, Rattus norvegicus
aattggcgtaacagtttcatcttta

SEQ ID NO: 68020 - DNA, 25 bp, Rattus norvegicus
aattggcgtaactgtttcatcttta

SEQ ID NO: 68021 - DNA, 25 bp, Rattus norvegicus
aattggctacctcccctttgtagag

SEQ ID NO: 68022 - DNA, 25 bp, Rattus norvegicus
aattggctacctgccctttgtagag

SEQ ID NO: 68023 - DNA, 25 bp, Rattus norvegicus
aattggctacttagtgatgctggct

SEQ ID NO: 68024 - DNA, 25 bp, Rattus norvegicus
aattggctactttgtgatgctggct

SEQ ID NO: 68025 - DNA, 25 bp, Rattus norvegicus
aattggctagcccattccttggagc

SEQ ID NO: 68026 - DNA, 25 bp, Rattus norvegicus
aattggctagccgattccttggagc

SEQ ID NO: 68027 - DNA, 25 bp, Rattus norvegicus
aattggctcatgacgttggcagaga

SEQ ID NO: 68028 - DNA, 25 bp, Rattus norvegicus
aattggctcatgtcgttggcagaga

SEQ ID NO: 68029 - DNA, 25 bp, Rattus norvegicus
aattggctcctaagcgcaaggctgt

SEQ ID NO: 68030 - DNA, 25 bp, Rattus norvegicus
aattggctcctatgcgcaaggctgt

SEQ ID NO: 68031 - DNA, 25 bp, Rattus norvegicus
aattggctctgaaaaccctgtttgt

SEQ ID NO: 68032 - DNA, 25 bp, Rattus norvegicus
aattggctctgataaccctgtttgt

SEQ ID NO: 68033 - DNA, 25 bp, Rattus norvegicus
aattggctgactcctctaggagctt

SEQ ID NO: 68034 - DNA, 25 bp, Rattus norvegicus
aattggctgactgctctaggagctt

SEQ ID NO: 68035 - DNA, 25 bp, Rattus norvegicus
aattggctgataattacccattgta

SEQ ID NO: 68036 - DNA, 25 bp, Rattus norvegicus
aattggctgatatttacccattgta

SEQ ID NO: 68037 - DNA, 25 bp, Rattus norvegicus
aattggctgcagaggctttcatgga

SEQ ID NO: 68038 - DNA, 25 bp, Rattus norvegicus
aattggctgcagtggctttcatgga

SEQ ID NO: 68039 - DNA, 25 bp, Rattus norvegicus
aattggctgcctctatgttccctta

SEQ ID NO: 68040 - DNA, 25 bp, Rattus norvegicus
aattggctgcctgtatgttccctta

SEQ ID NO: 68041 - DNA, 25 bp, Rattus norvegicus
aattggctggcgcttcataaggata

SEQ ID NO: 68042 - DNA, 25 bp, Rattus norvegicus
aattggctggcggttcataaggata

SEQ ID NO: 68043 - DNA, 25 bp, Rattus norvegicus
aattggctgtacacgaggcctgtga

SEQ ID NO: 68044 - DNA, 25 bp, Rattus norvegicus
aattggctgtactcgaggcctgtga

SEQ ID NO: 68045 - DNA, 25 bp, Rattus norvegicus
aattggcttaggctacactcagacc

SEQ ID NO: 68046 - DNA, 25 bp, Rattus norvegicus
aattggcttagggtacactcagacc

SEQ ID NO: 68047 - DNA, 25 bp, Rattus norvegicus
aattggcttcagagccctcatagct

SEQ ID NO: 68048 - DNA, 25 bp, Rattus norvegicus
aattggcttcagtgccctcatagct

SEQ ID NO: 68049 - DNA, 25 bp, Rattus norvegicus
aattggcttctgcttttcatcactg

SEQ ID NO: 68050 - DNA, 25 bp, Rattus norvegicus
aattggcttctggttttcatcactg

SEQ ID NO: 68051 - DNA, 25 bp, Rattus norvegicus
aattggcttgtaacacttgggcaaa

SEQ ID NO: 68052 - DNA, 25 bp, Rattus norvegicus
aattggcttgtatcacttgggcaaa

SEQ ID NO: 68053 - DNA, 25 bp, Rattus norvegicus
aattgggaacaaaccgcagcgcgtg

SEQ ID NO: 68054 - DNA, 25 bp, Rattus norvegicus
aattgggaacaatccgcagcgcgtg

SEQ ID NO: 68055 - DNA, 25 bp, Rattus norvegicus
aattgggacattatctccagcccta

SEQ ID NO: 68056 - DNA, 25 bp, Rattus norvegicus
aattgggacattttctccagcccta

SEQ ID NO: 68057 - DNA, 25 bp, Rattus norvegicus
aattgggacctaaatgaagctttca

SEQ ID NO: 68058 - DNA, 25 bp, Rattus norvegicus
aattgggacctatatgaagctttca

SEQ ID NO: 68059 - DNA, 25 bp, Rattus norvegicus
aattgggagcagacttcctgttgat

SEQ ID NO: 68060 - DNA, 25 bp, Rattus norvegicus
aattgggagcagtcttcctgttgat

SEQ ID NO: 68061 - DNA, 25 bp, Rattus norvegicus
aattgggagtacatgctaagcctag

SEQ ID NO: 68062 - DNA, 25 bp, Rattus norvegicus
aattgggagtacttgctaagcctag

SEQ ID NO: 68063 - DNA, 25 bp, Rattus norvegicus
aattgggatcctatctacttactgc

SEQ ID NO: 68064 - DNA, 25 bp, Rattus norvegicus
aattgggatcctttctacttactgc

SEQ ID NO: 68065 - DNA, 25 bp, Rattus norvegicus
aattgggatctgaatctggtgtgtc

SEQ ID NO: 68066 - DNA, 25 bp, Rattus norvegicus
aattgggatctgtatctggtgtgtc

SEQ ID NO: 68067 - DNA, 25 bp, Rattus norvegicus
aattgggcagacctcagggacctca

SEQ ID NO: 68068 - DNA, 25 bp, Rattus norvegicus
aattgggcagacgtcagggacctca

SEQ ID NO: 68069 - DNA, 25 bp, Rattus norvegicus
aattgggcagcaccagaaattccct

SEQ ID NO: 68070 - DNA, 25 bp, Rattus norvegicus
aattgggcagcagcagaaattccct

SEQ ID NO: 68071 - DNA, 25 bp, Rattus norvegicus
aattgggcatacatgtcgtacacat

SEQ ID NO: 68072 - DNA, 25 bp, Rattus norvegicus
aattgggcatacttgtcgtacacat

SEQ ID NO: 68073 - DNA, 25 bp, Rattus norvegicus
aattgggcatccaggcctgtgtgga

SEQ ID NO: 68074 - DNA, 25 bp, Rattus norvegicus
aattgggcatcctggcctgtgtgga

SEQ ID NO: 68075 - DNA, 25 bp, Rattus norvegicus
aattgggccagtatgtttcatgtaa

SEQ ID NO: 68076 - DNA, 25 bp, Rattus norvegicus
aattgggccagtttgtttcatgtaa

SEQ ID NO: 68077 - DNA, 25 bp, Rattus norvegicus
aattgggcctctactgtgatgattc

SEQ ID NO: 68078 - DNA, 25 bp, Rattus norvegicus
aattgggcctcttctgtgatgattc

SEQ ID NO: 68079 - DNA, 25 bp, Rattus norvegicus
aattgggctcccatgtatgacacat

SEQ ID NO: 68080 - DNA, 25 bp, Rattus norvegicus
aattgggctccccagtttctggctg

SEQ ID NO: 68081 - DNA, 25 bp, Rattus norvegicus
aattgggctcccgagtttctggctg

SEQ ID NO: 68082 - DNA, 25 bp, Rattus norvegicus
aattgggctcccttgtatgacacat

SEQ ID NO: 68083 - DNA, 25 bp, Rattus norvegicus
aattgggctcttccatctctcaggt

SEQ ID NO: 68084 - DNA, 25 bp, Rattus norvegicus
aattgggctcttgcatctctcaggt

SEQ ID NO: 68085 - DNA, 25 bp, Rattus norvegicus
aattgggcttttcgtattcataggg

SEQ ID NO: 68086 - DNA, 25 bp, Rattus norvegicus
aattgggcttttggtattcataggg

SEQ ID NO: 68087 - DNA, 25 bp, Rattus norvegicus
aattgggtcaggaagctcacagtct

SEQ ID NO: 68088 - DNA, 25 bp, Rattus norvegicus
aattgggtcaggtagctcacagtct

SEQ ID NO: 68089 - DNA, 25 bp, Rattus norvegicus
aattgggtcgcaattcttctagaaa

SEQ ID NO: 68090 - DNA, 25 bp, Rattus norvegicus
aattgggtcgcatttcttctagaaa

SEQ ID NO: 68091 - DNA, 25 bp, Rattus norvegicus
aattgggtctgcagcacaggtgtct

SEQ ID NO: 68092 - DNA, 25 bp, Rattus norvegicus
aattgggtctgctgcacaggtgtct

SEQ ID NO: 68093 - DNA, 25 bp, Rattus norvegicus
aattgggtgcatcacactgtggcct

SEQ ID NO: 68094 - DNA, 25 bp, Rattus norvegicus
aattgggtgcatgacactgtggcct

SEQ ID NO: 68095 - DNA, 25 bp, Rattus norvegicus
aattgggtgtacaggtgtgtcacat

SEQ ID NO: 68096 - DNA, 25 bp, Rattus norvegicus
aattgggtgtactggtgtgtcacat

SEQ ID NO: 68097 - DNA, 25 bp, Rattus norvegicus
aattgggtgtctagggtcattttat

SEQ ID NO: 68098 - DNA, 25 bp, Rattus norvegicus
aattgggtgtcttgggtcattttat

SEQ ID NO: 68099 - DNA, 25 bp, Rattus norvegicus
aattgggtgtttcacctgctgttgg

SEQ ID NO: 68100 - DNA, 25 bp, Rattus norvegicus
aattgggtgtttgacctgctgttgg

SEQ ID NO: 68101 - DNA, 25 bp, Rattus norvegicus
aattgggttcagaggcggctacacg

SEQ ID NO: 68102 - DNA, 25 bp, Rattus norvegicus
aattgggttcagtggcggctacacg

SEQ ID NO: 68103 - DNA, 25 bp, Rattus norvegicus
aattggtacactatattgacacagg

SEQ ID NO: 68104 - DNA, 25 bp, Rattus norvegicus
aattggtacactttattgacacagg

SEQ ID NO: 68105 - DNA, 25 bp, Rattus norvegicus
aattggtatgccaacccttggacca

SEQ ID NO: 68106 - DNA, 25 bp, Rattus norvegicus
aattggtatgcctacccttggacca

SEQ ID NO: 68107 - DNA, 25 bp, Rattus norvegicus
aattggtcacaacgctaatctgcag

SEQ ID NO: 68108 - DNA, 25 bp, Rattus norvegicus
aattggtcacaaggctaatctgcag

SEQ ID NO: 68109 - DNA, 25 bp, Rattus norvegicus
aattggtcagtgatcatgctgttca

SEQ ID NO: 68110 - DNA, 25 bp, Rattus norvegicus
aattggtcagtgttcatgctgttca

SEQ ID NO: 68111 - DNA, 25 bp, Rattus norvegicus
aattggtcatgtctacttacttctg

SEQ ID NO: 68112 - DNA, 25 bp, Rattus norvegicus
aattggtcatgtgtacttacttctg

SEQ ID NO: 68113 - DNA, 25 bp, Rattus norvegicus
aattggtccttaccattgcctagcc

SEQ ID NO: 68114 - DNA, 25 bp, Rattus norvegicus
aattggtccttagcattgcctagcc

SEQ ID NO: 68115 - DNA, 25 bp, Rattus norvegicus
aattggtctggtctacttgccttga

SEQ ID NO: 68116 - DNA, 25 bp, Rattus norvegicus
aattggtctggtgtacttgccttga

SEQ ID NO: 68117 - DNA, 25 bp, Rattus norvegicus
aattggtgctataggtatttcctct

SEQ ID NO: 68118 - DNA, 25 bp, Rattus norvegicus
aattggtgctattggtatttcctct

SEQ ID NO: 68119 - DNA, 25 bp, Rattus norvegicus
aattggtgctctctcatgttgctgc

SEQ ID NO: 68120 - DNA, 25 bp, Rattus norvegicus
aattggtgctctgtcatgttgctgc

SEQ ID NO: 68121 - DNA, 25 bp, Rattus norvegicus
aattggtgggatctgaagctgcttt

SEQ ID NO: 68122 - DNA, 25 bp, Rattus norvegicus
aattggtgggatgtgaagctgcttt

SEQ ID NO: 68123 - DNA, 25 bp, Rattus norvegicus
aattggtgggcaacaaccctactgc

SEQ ID NO: 68124 - DNA, 25 bp, Rattus norvegicus
aattggtgggcatcaaccctactgc

SEQ ID NO: 68125 - DNA, 25 bp, Rattus norvegicus
aattggtgtcatattcttgatgtca

SEQ ID NO: 68126 - DNA, 25 bp, Rattus norvegicus
aattggtgtcattttcttgatgtca

SEQ ID NO: 68127 - DNA, 25 bp, Rattus norvegicus
aattggtgttgaagagcccagcaca

SEQ ID NO: 68128 - DNA, 25 bp, Rattus norvegicus
aattggtgttgatgagcccagcaca

SEQ ID NO: 68129 - DNA, 25 bp, Rattus norvegicus
aattggttaattaccgggctgctgt

SEQ ID NO: 68130 - DNA, 25 bp, Rattus norvegicus
aattggttaatttccgggctgctgt

SEQ ID NO: 68131 - DNA, 25 bp, Rattus norvegicus
aattggttattcctgtttcctccag

SEQ ID NO: 68132 - DNA, 25 bp, Rattus norvegicus
aattggttattcgtgtttcctccag

SEQ ID NO: 68133 - DNA, 25 bp, Rattus norvegicus
aattggttcatcctccatacgttcc

SEQ ID NO: 68134 - DNA, 25 bp, Rattus norvegicus
aattggttcatcgtccatacgttcc

SEQ ID NO: 68135 - DNA, 25 bp, Rattus norvegicus
aattggttccctaattgatgtcaac

SEQ ID NO: 68136 - DNA, 25 bp, Rattus norvegicus
aattggttcccttattgatgtcaac

SEQ ID NO: 68137 - DNA, 25 bp, Rattus norvegicus
aattggttccttatgtctacagtac

SEQ ID NO: 68138 - DNA, 25 bp, Rattus norvegicus
aattggttccttttgtctacagtac

SEQ ID NO: 68139 - DNA, 25 bp, Rattus norvegicus
aattggttctctcatgtattccctc

SEQ ID NO: 68140 - DNA, 25 bp, Rattus norvegicus
aattggttctctgatgtattccctc

SEQ ID NO: 68141 - DNA, 25 bp, Rattus norvegicus
aattggttcttgctcttttgcagaa

SEQ ID NO: 68142 - DNA, 25 bp, Rattus norvegicus
aattggttcttggtcttttgcagaa

SEQ ID NO: 68143 - DNA, 25 bp, Rattus norvegicus
aattggttggttatgctctccagat

SEQ ID NO: 68144 - DNA, 25 bp, Rattus norvegicus
aattggttggttttgctctccagat

SEQ ID NO: 68145 - DNA, 25 bp, Rattus norvegicus
aattggtttactatcacatccctca

SEQ ID NO: 68146 - DNA, 25 bp, Rattus norvegicus
aattggtttactttcacatccctca

SEQ ID NO: 68147 - DNA, 25 bp, Rattus norvegicus
aattggtttagtaggatggctccga

SEQ ID NO: 68148 - DNA, 25 bp, Rattus norvegicus
aattggtttagttggatggctccga

SEQ ID NO: 68149 - DNA, 25 bp, Rattus norvegicus
aattggtttccacgaggctgcgtcc

SEQ ID NO: 68150 - DNA, 25 bp, Rattus norvegicus
aattggtttccaggaggctgcgtcc

SEQ ID NO: 68151 - DNA, 25 bp, Rattus norvegicus
aattggtttcccatcgaactgcttc

SEQ ID NO: 68152 - DNA, 25 bp, Rattus norvegicus
aattggtttcccttcgaactgcttc

SEQ ID NO: 68153 - DNA, 25 bp, Rattus norvegicus
aattggtttgttacagtctttagtg

SEQ ID NO: 68154 - DNA, 25 bp, Rattus norvegicus
aattggtttgtttcagtctttagtg

SEQ ID NO: 68155 - DNA, 25 bp, Rattus norvegicus
aattgtaacaatactgatgccttca

SEQ ID NO: 68156 - DNA, 25 bp, Rattus norvegicus
aattgtaacaattctgatgccttca

SEQ ID NO: 68157 - DNA, 25 bp, Rattus norvegicus
aattgtaactccatcaaaaccctga

SEQ ID NO: 68158 - DNA, 25 bp, Rattus norvegicus
aattgtaactccttcaaaaccctga

SEQ ID NO: 68159 - DNA, 25 bp, Rattus norvegicus
aattgtaagtagacctgcttcccgc

SEQ ID NO: 68160 - DNA, 25 bp, Rattus norvegicus
aattgtaagtagtcctgcttcccgc

SEQ ID NO: 68161 - DNA, 25 bp, Rattus norvegicus
aattgtaagttgcatgcggctgctg

SEQ ID NO: 68162 - DNA, 25 bp, Rattus norvegicus
aattgtaagttggatgcggctgctg

SEQ ID NO: 68163 - DNA, 25 bp, Rattus norvegicus
aattgtaatgagatccagggccaaa

SEQ ID NO: 68164 - DNA, 25 bp, Rattus norvegicus
aattgtaatgagttccagggccaaa

SEQ ID NO: 68165 - DNA, 25 bp, Rattus norvegicus
aattgtaatgttaccctttgtgcta

SEQ ID NO: 68166 - DNA, 25 bp, Rattus norvegicus
aattgtaatgtttccctttgtgcta

SEQ ID NO: 68167 - DNA, 25 bp, Rattus norvegicus
aattgtacatatcccttacatccct

SEQ ID NO: 68168 - DNA, 25 bp, Rattus norvegicus
aattgtacatatgccttacatccct

SEQ ID NO: 68169 - DNA, 25 bp, Rattus norvegicus
aattgtacgattctttctgtgccat

SEQ ID NO: 68170 - DNA, 25 bp, Rattus norvegicus
aattgtacgattgtttctgtgccat

SEQ ID NO: 68171 - DNA, 25 bp, Rattus norvegicus
aattgtacgcttacgcattgaaggt

SEQ ID NO: 68172 - DNA, 25 bp, Rattus norvegicus
aattgtacgctttcgcattgaaggt

SEQ ID NO: 68173 - DNA, 25 bp, Rattus norvegicus
aattgtagaataagcaccccgtgta

SEQ ID NO: 68174 - DNA, 25 bp, Rattus norvegicus
aattgtagaatatgcaccccgtgta

SEQ ID NO: 68175 - DNA, 25 bp, Rattus norvegicus
aattgtagatctctagtccccttgt

SEQ ID NO: 68176 - DNA, 25 bp, Rattus norvegicus
aattgtagatctgtagtccccttgt

SEQ ID NO: 68177 - DNA, 25 bp, Rattus norvegicus
aattgtagatggcttttcagtttaa

SEQ ID NO: 68178 - DNA, 25 bp, Rattus norvegicus
aattgtagatgggttttcagtttaa

SEQ ID NO: 68179 - DNA, 25 bp, Rattus norvegicus
aattgtaggaccaagctcccagtgt

SEQ ID NO: 68180 - DNA, 25 bp, Rattus norvegicus
aattgtaggacctagctcccagtgt

SEQ ID NO: 68181 - DNA, 25 bp, Rattus norvegicus
aattgtaggcttcttccttcttgtc

SEQ ID NO: 68182 - DNA, 25 bp, Rattus norvegicus
aattgtaggcttgttccttcttgtc

SEQ ID NO: 68183 - DNA, 25 bp, Rattus norvegicus
aattgtagtgcgctgttcttagaag

SEQ ID NO: 68184 - DNA, 25 bp, Rattus norvegicus
aattgtagtgcggtgttcttagaag

SEQ ID NO: 68185 - DNA, 25 bp, Rattus norvegicus
aattgtagttctacagactggtctc

SEQ ID NO: 68186 - DNA, 25 bp, Rattus norvegicus
aattgtagttcttcagactggtctc

SEQ ID NO: 68187 - DNA, 25 bp, Rattus norvegicus
aattgtatcaagctctcatgccaaa

SEQ ID NO: 68188 - DNA, 25 bp, Rattus norvegicus
aattgtatcaaggtctcatgccaaa

SEQ ID NO: 68189 - DNA, 25 bp, Rattus norvegicus
aattgtatcatgaagttgggcagcc

SEQ ID NO: 68190 - DNA, 25 bp, Rattus norvegicus
aattgtatcatgtagttgggcagcc

SEQ ID NO: 68191 - DNA, 25 bp, Rattus norvegicus
aattgtatgcctacctaaacctgtt

SEQ ID NO: 68192 - DNA, 25 bp, Rattus norvegicus
aattgtatgccttcctaaacctgtt

SEQ ID NO: 68193 - DNA, 25 bp, Rattus norvegicus
aattgtatgtttctgagtgatccac

SEQ ID NO: 68194 - DNA, 25 bp, Rattus norvegicus
aattgtatgtttgtgagtgatccac

SEQ ID NO: 68195 - DNA, 25 bp, Rattus norvegicus
aattgtatttcaagtgcctgaggag

SEQ ID NO: 68196 - DNA, 25 bp, Rattus norvegicus
aattgtatttcatgtgcctgaggag

SEQ ID NO: 68197 - DNA, 25 bp, Rattus norvegicus
aattgtcaaactacatttctcctgt

SEQ ID NO: 68198 - DNA, 25 bp, Rattus norvegicus
aattgtcaaacttcatttctcctgt

SEQ ID NO: 68199 - DNA, 25 bp, Rattus norvegicus
aattgtcaaatgacctgttcctagt

SEQ ID NO: 68200 - DNA, 25 bp, Rattus norvegicus
aattgtcaaatgtcctgttcctagt

SEQ ID NO: 68201 - DNA, 25 bp, Rattus norvegicus
aattgtcaccatcagaggcctaggg

SEQ ID NO: 68202 - DNA, 25 bp, Rattus norvegicus
aattgtcaccatgagaggcctaggg

SEQ ID NO: 68203 - DNA, 25 bp, Rattus norvegicus
aattgtcacctacattaagccttaa

SEQ ID NO: 68204 - DNA, 25 bp, Rattus norvegicus
aattgtcacctagattaagccttaa

SEQ ID NO: 68205 - DNA, 25 bp, Rattus norvegicus
aattgtcacgtacgtggagccttca

SEQ ID NO: 68206 - DNA, 25 bp, Rattus norvegicus
aattgtcacgtaggtggagccttca

SEQ ID NO: 68207 - DNA, 25 bp, Rattus norvegicus
aattgtcactatagggctgggcaga

SEQ ID NO: 68208 - DNA, 25 bp, Rattus norvegicus
aattgtcactatccaaagggctcag

SEQ ID NO: 68209 - DNA, 25 bp, Rattus norvegicus
aattgtcactatgcaaagggctcag

SEQ ID NO: 68210 - DNA, 25 bp, Rattus norvegicus
aattgtcactattgggctgggcaga

SEQ ID NO: 68211 - DNA, 25 bp, Rattus norvegicus
aattgtcactctacaccatttgtat

SEQ ID NO: 68212 - DNA, 25 bp, Rattus norvegicus
aattgtcactcttcaccatttgtat

SEQ ID NO: 68213 - DNA, 25 bp, Rattus norvegicus
aattgtcactgtccaggtctacgag

SEQ ID NO: 68214 - DNA, 25 bp, Rattus norvegicus
aattgtcactgtgcaggtctacgag

SEQ ID NO: 68215 - DNA, 25 bp, Rattus norvegicus
aattgtcagaatagctcaggagaag

SEQ ID NO: 68216 - DNA, 25 bp, Rattus norvegicus
aattgtcagaattgctcaggagaag

SEQ ID NO: 68217 - DNA, 25 bp, Rattus norvegicus
aattgtcaggagaggcgagatcgaa

SEQ ID NO: 68218 - DNA, 25 bp, Rattus norvegicus
aattgtcaggagtggcgagatcgaa

SEQ ID NO: 68219 - DNA, 25 bp, Rattus norvegicus
aattgtcagtgtagcttggcaggtg

SEQ ID NO: 68220 - DNA, 25 bp, Rattus norvegicus
aattgtcagtgttgcttggcaggtg

SEQ ID NO: 68221 - DNA, 25 bp, Rattus norvegicus
aattgtcataacagttcctctcagg

SEQ ID NO: 68222 - DNA, 25 bp, Rattus norvegicus
aattgtcataactgttcctctcagg

SEQ ID NO: 68223 - DNA, 25 bp, Rattus norvegicus
aattgtcatcccaaaggtctgagta

SEQ ID NO: 68224 - DNA, 25 bp, Rattus norvegicus
aattgtcatccctaaggtctgagta

SEQ ID NO: 68225 - DNA, 25 bp, Rattus norvegicus
aattgtcatctccaagacttcttgc

SEQ ID NO: 68226 - DNA, 25 bp, Rattus norvegicus
aattgtcatctcgaagacttcttgc

SEQ ID NO: 68227 - DNA, 25 bp, Rattus norvegicus
aattgtcatggcacagttaggctct

SEQ ID NO: 68228 - DNA, 25 bp, Rattus norvegicus
aattgtcatggctcagttaggctct

SEQ ID NO: 68229 - DNA, 25 bp, Rattus norvegicus
aattgtcattctactattgctaaag

SEQ ID NO: 68230 - DNA, 25 bp, Rattus norvegicus
aattgtcattcttctattgctaaag

SEQ ID NO: 68231 - DNA, 25 bp, Rattus norvegicus
aattgtccacacatgacttgttagg

SEQ ID NO: 68232 - DNA, 25 bp, Rattus norvegicus
aattgtccacacttgacttgttagg

SEQ ID NO: 68233 - DNA, 25 bp, Rattus norvegicus
aattgtccaggcaacgtgacttata

SEQ ID NO: 68234 - DNA, 25 bp, Rattus norvegicus
aattgtccaggctacgtgacttata

SEQ ID NO: 68235 - DNA, 25 bp, Rattus norvegicus
aattgtccatccaaactgggctgca

SEQ ID NO: 68236 - DNA, 25 bp, Rattus norvegicus
aattgtccatcctaactgggctgca

SEQ ID NO: 68237 - DNA, 25 bp, Rattus norvegicus
aattgtccatggattgggttgctgt

SEQ ID NO: 68238 - DNA, 25 bp, Rattus norvegicus
aattgtccatggtttgggttgctgt

SEQ ID NO: 68239 - DNA, 25 bp, Rattus norvegicus
aattgtccattgcaggaaggcccag

SEQ ID NO: 68240 - DNA, 25 bp, Rattus norvegicus
aattgtccattggaggaaggcccag

SEQ ID NO: 68241 - DNA, 25 bp, Rattus norvegicus
aattgtcccacgctttcagtgctgt

SEQ ID NO: 68242 - DNA, 25 bp, Rattus norvegicus
aattgtcccacggtttcagtgctgt

SEQ ID NO: 68243 - DNA, 25 bp, Rattus norvegicus
aattgtcccctgatgcgagaaaagc

SEQ ID NO: 68244 - DNA, 25 bp, Rattus norvegicus
aattgtcccctgttgcgagaaaagc

SEQ ID NO: 68245 - DNA, 25 bp, Rattus norvegicus
aattgtcccttgacttcctgttggg

SEQ ID NO: 68246 - DNA, 25 bp, Rattus norvegicus
aattgtcccttgtcttcctgttggg

SEQ ID NO: 68247 - DNA, 25 bp, Rattus norvegicus
aattgtccgccaatctcattgagac

SEQ ID NO: 68248 - DNA, 25 bp, Rattus norvegicus
aattgtccgccattctcattgagac

SEQ ID NO: 68249 - DNA, 25 bp, Rattus norvegicus
aattgtccgtacctcaagaatcctg

SEQ ID NO: 68250 - DNA, 25 bp, Rattus norvegicus
aattgtccgtacgtcaagaatcctg

SEQ ID NO: 68251 - DNA, 25 bp, Rattus norvegicus
aattgtcctgatactattttgtaaa

SEQ ID NO: 68252 - DNA, 25 bp, Rattus norvegicus
aattgtcctgattctattttgtaaa

SEQ ID NO: 68253 - DNA, 25 bp, Rattus norvegicus
aattgtcctgggatctgggatgcaa

SEQ ID NO: 68254 - DNA, 25 bp, Rattus norvegicus
aattgtcctgggttctgggatgcaa

SEQ ID NO: 68255 - DNA, 25 bp, Rattus norvegicus
aattgtccttgtattcctgagctaa

SEQ ID NO: 68256 - DNA, 25 bp, Rattus norvegicus
aattgtccttgttttcctgagctaa

SEQ ID NO: 68257 - DNA, 25 bp, Rattus norvegicus
aattgtccttttctcacattactgc

SEQ ID NO: 68258 - DNA, 25 bp, Rattus norvegicus
aattgtccttttgtcacattactgc

SEQ ID NO: 68259 - DNA, 25 bp, Rattus norvegicus
aattgtcgagcgagtttttcagtca

SEQ ID NO: 68260 - DNA, 25 bp, Rattus norvegicus
aattgtcgagcgtgtttttcagtca

SEQ ID NO: 68261 - DNA, 25 bp, Rattus norvegicus
aattgtcgttctagcccagagttac

SEQ ID NO: 68262 - DNA, 25 bp, Rattus norvegicus
aattgtcgttcttgcccagagttac

SEQ ID NO: 68263 - DNA, 25 bp, Rattus norvegicus
aattgtctaagtcgcttcaccgcac

SEQ ID NO: 68264 - DNA, 25 bp, Rattus norvegicus
aattgtctaagtggcttcaccgcac

SEQ ID NO: 68265 - DNA, 25 bp, Rattus norvegicus
aattgtctaccaagcatttctctta

SEQ ID NO: 68266 - DNA, 25 bp, Rattus norvegicus
aattgtctaccatgcatttctctta

SEQ ID NO: 68267 - DNA, 25 bp, Rattus norvegicus
aattgtctatacaggcttctgaggc

SEQ ID NO: 68268 - DNA, 25 bp, Rattus norvegicus
aattgtctatactggcttctgaggc

SEQ ID NO: 68269 - DNA, 25 bp, Rattus norvegicus
aattgtctcatgctctatttataca

SEQ ID NO: 68270 - DNA, 25 bp, Rattus norvegicus
aattgtctcatggtctatttataca

SEQ ID NO: 68271 - DNA, 25 bp, Rattus norvegicus
aattgtctggaccatctggaggctt

SEQ ID NO: 68272 - DNA, 25 bp, Rattus norvegicus
aattgtctggacgatctggaggctt

SEQ ID NO: 68273 - DNA, 25 bp, Rattus norvegicus
aattgtctggccaagctgtgcactg

SEQ ID NO: 68274 - DNA, 25 bp, Rattus norvegicus
aattgtctggcctagctgtgcactg

SEQ ID NO: 68275 - DNA, 25 bp, Rattus norvegicus
aattgtctgttaacggccaagccgc

SEQ ID NO: 68276 - DNA, 25 bp, Rattus norvegicus
aattgtctgttatcggccaagccgc

SEQ ID NO: 68277 - DNA, 25 bp, Rattus norvegicus
aattgtctgttcacccgctcttggg

SEQ ID NO: 68278 - DNA, 25 bp, Rattus norvegicus
aattgtctgttctcccgctcttggg

SEQ ID NO: 68279 - DNA, 25 bp, Rattus norvegicus
aattgtcttactattcagattagag

SEQ ID NO: 68280 - DNA, 25 bp, Rattus norvegicus
aattgtcttacttttcagattagag

SEQ ID NO: 68281 - DNA, 25 bp, Rattus norvegicus
aattgtcttcatagttccttcataa

SEQ ID NO: 68282 - DNA, 25 bp, Rattus norvegicus
aattgtcttcattgttccttcataa

SEQ ID NO: 68283 - DNA, 25 bp, Rattus norvegicus
aattgtcttccaagtctagcttaag

SEQ ID NO: 68284 - DNA, 25 bp, Rattus norvegicus
aattgtcttccatgtctagcttaag

SEQ ID NO: 68285 - DNA, 25 bp, Rattus norvegicus
aattgtcttttgaactgtatgttac

SEQ ID NO: 68286 - DNA, 25 bp, Rattus norvegicus
aattgtcttttgtactgtatgttac

SEQ ID NO: 68287 - DNA, 25 bp, Rattus norvegicus
aattgtgaacatatcagccggcctc

SEQ ID NO: 68288 - DNA, 25 bp, Rattus norvegicus
aattgtgaacatttcagccggcctc

SEQ ID NO: 68289 - DNA, 25 bp, Rattus norvegicus
aattgtgaattgagtgtccgtccgt

SEQ ID NO: 68290 - DNA, 25 bp, Rattus norvegicus
aattgtgaattgtgtgtccgtccgt

SEQ ID NO: 68291 - DNA, 25 bp, Rattus norvegicus
aattgtgaccataccaacctgtgca

SEQ ID NO: 68292 - DNA, 25 bp, Rattus norvegicus
aattgtgaccatcaagctagctgat

SEQ ID NO: 68293 - DNA, 25 bp, Rattus norvegicus
aattgtgaccatgaagctagctgat

SEQ ID NO: 68294 - DNA, 25 bp, Rattus norvegicus
aattgtgaccattccaacctgtgca

SEQ ID NO: 68295 - DNA, 25 bp, Rattus norvegicus
aattgtgacctcagaatgacccctg

SEQ ID NO: 68296 - DNA, 25 bp, Rattus norvegicus
aattgtgacctcctgtcaacttggt

SEQ ID NO: 68297 - DNA, 25 bp, Rattus norvegicus
aattgtgacctcgtgtcaacttggt

SEQ ID NO: 68298 - DNA, 25 bp, Rattus norvegicus
aattgtgacctctgaatgacccctg

SEQ ID NO: 68299 - DNA, 25 bp, Rattus norvegicus
aattgtgacggactacaaaccataa

SEQ ID NO: 68300 - DNA, 25 bp, Rattus norvegicus
aattgtgacggagtacaaaccataa

SEQ ID NO: 68301 - DNA, 25 bp, Rattus norvegicus
aattgtgactagctggagaaagcct

SEQ ID NO: 68302 - DNA, 25 bp, Rattus norvegicus
aattgtgactaggtggagaaagcct

SEQ ID NO: 68303 - DNA, 25 bp, Rattus norvegicus
aattgtgacttcatcatgggccctg

SEQ ID NO: 68304 - DNA, 25 bp, Rattus norvegicus
aattgtgacttcttcatgggccctg

SEQ ID NO: 68305 - DNA, 25 bp, Rattus norvegicus
aattgtgcagaacaggtttcaacct

SEQ ID NO: 68306 - DNA, 25 bp, Rattus norvegicus
aattgtgcagaagaggtttcaacct

SEQ ID NO: 68307 - DNA, 25 bp, Rattus norvegicus
aattgtgcagcaaatttctatcaaa

SEQ ID NO: 68308 - DNA, 25 bp, Rattus norvegicus
aattgtgcagcatatttctatcaaa

SEQ ID NO: 68309 - DNA, 25 bp, Rattus norvegicus
aattgtgcagtcagggcaaccacag

SEQ ID NO: 68310 - DNA, 25 bp, Rattus norvegicus
aattgtgcagtctgggcaaccacag

SEQ ID NO: 68311 - DNA, 25 bp, Rattus norvegicus
aattgtgcatggcttgggcattcaa

SEQ ID NO: 68312 - DNA, 25 bp, Rattus norvegicus
aattgtgcatgggttgggcattcaa

SEQ ID NO: 68313 - DNA, 25 bp, Rattus norvegicus
aattgtgccagcaagatgtgccccg

SEQ ID NO: 68314 - DNA, 25 bp, Rattus norvegicus
aattgtgccagcaatctgtcaacag

SEQ ID NO: 68315 - DNA, 25 bp, Rattus norvegicus
aattgtgccagctagatgtgccccg

SEQ ID NO: 68316 - DNA, 25 bp, Rattus norvegicus
aattgtgccagctatctgtcaacag

SEQ ID NO: 68317 - DNA, 25 bp, Rattus norvegicus
aattgtgcccacatgcagctctata

SEQ ID NO: 68318 - DNA, 25 bp, Rattus norvegicus
aattgtgcccacttgcagctctata

SEQ ID NO: 68319 - DNA, 25 bp, Rattus norvegicus
aattgtgccctactttgcattctca

SEQ ID NO: 68320 - DNA, 25 bp, Rattus norvegicus
aattgtgccctagtttgcattctca

SEQ ID NO: 68321 - DNA, 25 bp, Rattus norvegicus
aattgtgcctaaccgctctatcaat

SEQ ID NO: 68322 - DNA, 25 bp, Rattus norvegicus
aattgtgcctaagcgctctatcaat

SEQ ID NO: 68323 - DNA, 25 bp, Rattus norvegicus
aattgtgcctttatgtactggtaag

SEQ ID NO: 68324 - DNA, 25 bp, Rattus norvegicus
aattgtgcctttttgtactggtaag

SEQ ID NO: 68325 - DNA, 25 bp, Rattus norvegicus
aattgtgctgctagttggtatttaa

SEQ ID NO: 68326 - DNA, 25 bp, Rattus norvegicus
aattgtgctgcttgttggtatttaa

SEQ ID NO: 68327 - DNA, 25 bp, Rattus norvegicus
aattgtgcttatcttcataatggaa

SEQ ID NO: 68328 - DNA, 25 bp, Rattus norvegicus
aattgtgcttatgttcataatggaa

SEQ ID NO: 68329 - DNA, 25 bp, Rattus norvegicus
aattgtggacctcgcactggccctg

SEQ ID NO: 68330 - DNA, 25 bp, Rattus norvegicus
aattgtggacctggcactggccctg

SEQ ID NO: 68331 - DNA, 25 bp, Rattus norvegicus
aattgtggactcatgcttcaactca

SEQ ID NO: 68332 - DNA, 25 bp, Rattus norvegicus
aattgtggactcttgcttcaactca

SEQ ID NO: 68333 - DNA, 25 bp, Rattus norvegicus
aattgtggatttcggcatttctcta

SEQ ID NO: 68334 - DNA, 25 bp, Rattus norvegicus
aattgtggatttgggcatttctcta

SEQ ID NO: 68335 - DNA, 25 bp, Rattus norvegicus
aattgtggcacaagatggctccgct

SEQ ID NO: 68336 - DNA, 25 bp, Rattus norvegicus
aattgtggcacatgatggctccgct

SEQ ID NO: 68337 - DNA, 25 bp, Rattus norvegicus
aattgtggccaaacttgctgctttc

SEQ ID NO: 68338 - DNA, 25 bp, Rattus norvegicus
aattgtggccaatcttgctgctttc

SEQ ID NO: 68339 - DNA, 25 bp, Rattus norvegicus
aattgtggccttagttataataact

SEQ ID NO: 68340 - DNA, 25 bp, Rattus norvegicus
aattgtggcctttgttataataact

SEQ ID NO: 68341 - DNA, 25 bp, Rattus norvegicus
aattgtggctaactggcatcattca

SEQ ID NO: 68342 - DNA, 25 bp, Rattus norvegicus
aattgtggctaagtggcatcattca

SEQ ID NO: 68343 - DNA, 25 bp, Rattus norvegicus
aattgtggctcaaaagatctgcaga

SEQ ID NO: 68344 - DNA, 25 bp, Rattus norvegicus
aattgtggctcataagatctgcaga

SEQ ID NO: 68345 - DNA, 25 bp, Rattus norvegicus
aattgtgggagtcggatttgccttt

SEQ ID NO: 68346 - DNA, 25 bp, Rattus norvegicus
aattgtgggagtgggatttgccttt

SEQ ID NO: 68347 - DNA, 25 bp, Rattus norvegicus
aattgtgggtatatggcctgagcat

SEQ ID NO: 68348 - DNA, 25 bp, Rattus norvegicus
aattgtgggtatttggcctgagcat

SEQ ID NO: 68349 - DNA, 25 bp, Rattus norvegicus
aattgtgggtccagcacttcagggc

SEQ ID NO: 68350 - DNA, 25 bp, Rattus norvegicus
aattgtgggtccctcccagggtgca

SEQ ID NO: 68351 - DNA, 25 bp, Rattus norvegicus
aattgtgggtccgtcccagggtgca

SEQ ID NO: 68352 - DNA, 25 bp, Rattus norvegicus
aattgtgggtcctgcacttcagggc

SEQ ID NO: 68353 - DNA, 25 bp, Rattus norvegicus
aattgtgggtgcacagctgttccca

SEQ ID NO: 68354 - DNA, 25 bp, Rattus norvegicus
aattgtgggtgctcagctgttccca

SEQ ID NO: 68355 - DNA, 25 bp, Rattus norvegicus
aattgtgggttcattgtgcatttcc

SEQ ID NO: 68356 - DNA, 25 bp, Rattus norvegicus
aattgtgggttctttgtgcatttcc

SEQ ID NO: 68357 - DNA, 25 bp, Rattus norvegicus
aattgtggttttacattccatggga

SEQ ID NO: 68358 - DNA, 25 bp, Rattus norvegicus
aattgtggtttttcattccatggga

SEQ ID NO: 68359 - DNA, 25 bp, Rattus norvegicus
aattgtgtaatcagctccttccttt

SEQ ID NO: 68360 - DNA, 25 bp, Rattus norvegicus
aattgtgtaatctgctccttccttt

SEQ ID NO: 68361 - DNA, 25 bp, Rattus norvegicus
aattgtgtacccattttattctgct

SEQ ID NO: 68362 - DNA, 25 bp, Rattus norvegicus
aattgtgtaccctttttattctgct

SEQ ID NO: 68363 - DNA, 25 bp, Rattus norvegicus
aattgtgtccaaagcagcatacgtg

SEQ ID NO: 68364 - DNA, 25 bp, Rattus norvegicus
aattgtgtccaatgcagcatacgtg

SEQ ID NO: 68365 - DNA, 25 bp, Rattus norvegicus
aattgtgtcccactgtacatagctg

SEQ ID NO: 68366 - DNA, 25 bp, Rattus norvegicus
aattgtgtcccagtgtacatagctg

SEQ ID NO: 68367 - DNA, 25 bp, Rattus norvegicus
aattgtgtcctaataaaccttctga

SEQ ID NO: 68368 - DNA, 25 bp, Rattus norvegicus
aattgtgtcctattaaaccttctga

SEQ ID NO: 68369 - DNA, 25 bp, Rattus norvegicus
aattgtgtcgccagcaagcttttga

SEQ ID NO: 68370 - DNA, 25 bp, Rattus norvegicus
aattgtgtcgcctgcaagcttttga

SEQ ID NO: 68371 - DNA, 25 bp, Rattus norvegicus
aattgtgtgaatacatgagaccctg

SEQ ID NO: 68372 - DNA, 25 bp, Rattus norvegicus
aattgtgtgaattcatgagaccctg

SEQ ID NO: 68373 - DNA, 25 bp, Rattus norvegicus
aattgtgtgctgctaaaaatcttac

SEQ ID NO: 68374 - DNA, 25 bp, Rattus norvegicus
aattgtgtgctggtaaaaatcttac

SEQ ID NO: 68375 - DNA, 25 bp, Rattus norvegicus
aattgtgtggctaatcagctgtcta

SEQ ID NO: 68376 - DNA, 25 bp, Rattus norvegicus
aattgtgtggcttatcagctgtcta

SEQ ID NO: 68377 - DNA, 25 bp, Rattus norvegicus
aattgtgtgtatcatacctgtgtaa

SEQ ID NO: 68378 - DNA, 25 bp, Rattus norvegicus
aattgtgtgtatgatacctgtgtaa

SEQ ID NO: 68379 - DNA, 25 bp, Rattus norvegicus
aattgtgtgtttctgggtgagctta

SEQ ID NO: 68380 - DNA, 25 bp, Rattus norvegicus
aattgtgtgtttgtgggtgagctta

SEQ ID NO: 68381 - DNA, 25 bp, Rattus norvegicus
aattgtgttctgctaatccgtggcc

SEQ ID NO: 68382 - DNA, 25 bp, Rattus norvegicus
aattgtgttctggtaatccgtggcc

SEQ ID NO: 68383 - DNA, 25 bp, Rattus norvegicus
aattgtgttcttctgttttgtgtag

SEQ ID NO: 68384 - DNA, 25 bp, Rattus norvegicus
aattgtgttcttgtgttttgtgtag

SEQ ID NO: 68385 - DNA, 25 bp, Rattus norvegicus
aattgtgttgatcttttccttagga

SEQ ID NO: 68386 - DNA, 25 bp, Rattus norvegicus
aattgtgttgatgttttccttagga

SEQ ID NO: 68387 - DNA, 25 bp, Rattus norvegicus
aattgtgttgttatgccattactat

SEQ ID NO: 68388 - DNA, 25 bp, Rattus norvegicus
aattgtgttgttttgccattactat

SEQ ID NO: 68389 - DNA, 25 bp, Rattus norvegicus
aattgtgtttacaattgctgatcag

SEQ ID NO: 68390 - DNA, 25 bp, Rattus norvegicus
aattgtgtttactattgctgatcag

SEQ ID NO: 68391 - DNA, 25 bp, Rattus norvegicus
aattgtgtttctagagcagctctcg

SEQ ID NO: 68392 - DNA, 25 bp, Rattus norvegicus
aattgtgtttcttgagcagctctcg

SEQ ID NO: 68393 - DNA, 25 bp, Rattus norvegicus
aattgtgtttgaactctcctattcc

SEQ ID NO: 68394 - DNA, 25 bp, Rattus norvegicus
aattgtgtttgatctctcctattcc

SEQ ID NO: 68395 - DNA, 25 bp, Rattus norvegicus
aattgtgtttggaccgacgctgttt

SEQ ID NO: 68396 - DNA, 25 bp, Rattus norvegicus
aattgtgtttggtccgacgctgttt

SEQ ID NO: 68397 - DNA, 25 bp, Rattus norvegicus
aattgtgttttgattggctctggtc

SEQ ID NO: 68398 - DNA, 25 bp, Rattus norvegicus
aattgtgttttgtttggctctggtc

SEQ ID NO: 68399 - DNA, 25 bp, Rattus norvegicus
aattgttaatatacacgccgcagga

SEQ ID NO: 68400 - DNA, 25 bp, Rattus norvegicus
aattgttaatattcacgccgcagga

SEQ ID NO: 68401 - DNA, 25 bp, Rattus norvegicus
aattgttacaatctcttcctggaaa

SEQ ID NO: 68402 - DNA, 25 bp, Rattus norvegicus
aattgttacaatgtcttcctggaaa

SEQ ID NO: 68403 - DNA, 25 bp, Rattus norvegicus
aattgttacatgcttctttgaagct

SEQ ID NO: 68404 - DNA, 25 bp, Rattus norvegicus
aattgttacatggttctttgaagct

SEQ ID NO: 68405 - DNA, 25 bp, Rattus norvegicus
aattgttacattccgctggaacctg

SEQ ID NO: 68406 - DNA, 25 bp, Rattus norvegicus
aattgttacattgcgctggaacctg

SEQ ID NO: 68407 - DNA, 25 bp, Rattus norvegicus
aattgttacctgagtgcaagctcca

SEQ ID NO: 68408 - DNA, 25 bp, Rattus norvegicus
aattgttacctgcttttgctgcaac

SEQ ID NO: 68409 - DNA, 25 bp, Rattus norvegicus
aattgttacctggttttgctgcaac

SEQ ID NO: 68410 - DNA, 25 bp, Rattus norvegicus
aattgttacctgtgtgcaagctcca

SEQ ID NO: 68411 - DNA, 25 bp, Rattus norvegicus
aattgttacgggaggccaccaagat

SEQ ID NO: 68412 - DNA, 25 bp, Rattus norvegicus
aattgttacgggtggccaccaagat

SEQ ID NO: 68413 - DNA, 25 bp, Rattus norvegicus
aattgttaggctccaccaaaggctg

SEQ ID NO: 68414 - DNA, 25 bp, Rattus norvegicus
aattgttaggctgcaccaaaggctg

SEQ ID NO: 68415 - DNA, 25 bp, Rattus norvegicus
aattgttatgccaacagccattgaa

SEQ ID NO: 68416 - DNA, 25 bp, Rattus norvegicus
aattgttatgcctacagccattgaa

SEQ ID NO: 68417 - DNA, 25 bp, Rattus norvegicus
aattgttatttcacattgtacctga

SEQ ID NO: 68418 - DNA, 25 bp, Rattus norvegicus
aattgttatttctcattgtacctga

SEQ ID NO: 68419 - DNA, 25 bp, Rattus norvegicus
aattgttcaacaacctttgtagtag

SEQ ID NO: 68420 - DNA, 25 bp, Rattus norvegicus
aattgttcaacatcctttgtagtag

SEQ ID NO: 68421 - DNA, 25 bp, Rattus norvegicus
aattgttcaccaaccgagcgtgttc

SEQ ID NO: 68422 - DNA, 25 bp, Rattus norvegicus
aattgttcaccatccgagcgtgttc

SEQ ID NO: 68423 - DNA, 25 bp, Rattus norvegicus
aattgttcagaaccctgctcaggag

SEQ ID NO: 68424 - DNA, 25 bp, Rattus norvegicus
aattgttcagaagcctgctcaggag

SEQ ID NO: 68425 - DNA, 25 bp, Rattus norvegicus
aattgttccctgagttacattagct

SEQ ID NO: 68426 - DNA, 25 bp, Rattus norvegicus
aattgttccctgtgttacattagct

SEQ ID NO: 68427 - DNA, 25 bp, Rattus norvegicus
aattgttcctatccagcttatttta

SEQ ID NO: 68428 - DNA, 25 bp, Rattus norvegicus
aattgttcctatcttctgctgtggc

SEQ ID NO: 68429 - DNA, 25 bp, Rattus norvegicus
aattgttcctatgcagcttatttta

SEQ ID NO: 68430 - DNA, 25 bp, Rattus norvegicus
aattgttcctatgttctgctgtggc

SEQ ID NO: 68431 - DNA, 25 bp, Rattus norvegicus
aattgttcctttatgttctgtatca

SEQ ID NO: 68432 - DNA, 25 bp, Rattus norvegicus
aattgttcctttttgttctgtatca

SEQ ID NO: 68433 - DNA, 25 bp, Rattus norvegicus
aattgttctataaaggcatccgccc

SEQ ID NO: 68434 - DNA, 25 bp, Rattus norvegicus
aattgttctatataggcatccgccc

SEQ ID NO: 68435 - DNA, 25 bp, Rattus norvegicus
aattgttctattacttccagggttg

SEQ ID NO: 68436 - DNA, 25 bp, Rattus norvegicus
aattgttctattatcctttctatgg

SEQ ID NO: 68437 - DNA, 25 bp, Rattus norvegicus
aattgttctattctggtttgctaaa

SEQ ID NO: 68438 - DNA, 25 bp, Rattus norvegicus
aattgttctattgtggtttgctaaa

SEQ ID NO: 68439 - DNA, 25 bp, Rattus norvegicus
aattgttctatttcttccagggttg

SEQ ID NO: 68440 - DNA, 25 bp, Rattus norvegicus
aattgttctattttcctttctatgg

SEQ ID NO: 68441 - DNA, 25 bp, Rattus norvegicus
aattgttgatgaacggtgctctgaa

SEQ ID NO: 68442 - DNA, 25 bp, Rattus norvegicus
aattgttgatgatcggtgctctgaa

SEQ ID NO: 68443 - DNA, 25 bp, Rattus norvegicus
aattgttggccgagtattgtcagca

SEQ ID NO: 68444 - DNA, 25 bp, Rattus norvegicus
aattgttggccgtgtattgtcagca

SEQ ID NO: 68445 - DNA, 25 bp, Rattus norvegicus
aattgttggttacttcacctccagg

SEQ ID NO: 68446 - DNA, 25 bp, Rattus norvegicus
aattgttggttagttcacctccagg

SEQ ID NO: 68447 - DNA, 25 bp, Rattus norvegicus
aattgttgtccacacagcagcctaa

SEQ ID NO: 68448 - DNA, 25 bp, Rattus norvegicus
aattgttgtccagacagcagcctaa

SEQ ID NO: 68449 - DNA, 25 bp, Rattus norvegicus
aattgttgttaaacgctttgcaaga

SEQ ID NO: 68450 - DNA, 25 bp, Rattus norvegicus
aattgttgttaatcgctttgcaaga

SEQ ID NO: 68451 - DNA, 25 bp, Rattus norvegicus
aattgttgtttgcaagcatcttctc

SEQ ID NO: 68452 - DNA, 25 bp, Rattus norvegicus
aattgttgtttggaagcatcttctc

SEQ ID NO: 68453 - DNA, 25 bp, Rattus norvegicus
aattgtttactccagtgtcgctaac

SEQ ID NO: 68454 - DNA, 25 bp, Rattus norvegicus
aattgtttactcgagtgtcgctaac

SEQ ID NO: 68455 - DNA, 25 bp, Rattus norvegicus
aattgtttacttatgtgtcttagaa

SEQ ID NO: 68456 - DNA, 25 bp, Rattus norvegicus
aattgtttacttctgaccatggcgt

SEQ ID NO: 68457 - DNA, 25 bp, Rattus norvegicus
aattgtttacttgtgaccatggcgt

SEQ ID NO: 68458 - DNA, 25 bp, Rattus norvegicus
aattgtttacttttgtgtcttagaa

SEQ ID NO: 68459 - DNA, 25 bp, Rattus norvegicus
aattgtttagcacaactaggttcaa

SEQ ID NO: 68460 - DNA, 25 bp, Rattus norvegicus
aattgtttagcagaactaggttcaa

SEQ ID NO: 68461 - DNA, 25 bp, Rattus norvegicus
aattgtttcactacctgattcctag

SEQ ID NO: 68462 - DNA, 25 bp, Rattus norvegicus
aattgtttcacttcctgattcctag

SEQ ID NO: 68463 - DNA, 25 bp, Rattus norvegicus
aattgtttccttctctagtcttata

SEQ ID NO: 68464 - DNA, 25 bp, Rattus norvegicus
aattgtttccttgtctagtcttata

SEQ ID NO: 68465 - DNA, 25 bp, Rattus norvegicus
aattgtttctcaagcttccatctct

SEQ ID NO: 68466 - DNA, 25 bp, Rattus norvegicus
aattgtttctcatgcttccatctct

SEQ ID NO: 68467 - DNA, 25 bp, Rattus norvegicus
aattgtttgataaattgagccaggg

SEQ ID NO: 68468 - DNA, 25 bp, Rattus norvegicus
aattgtttgatatattgagccaggg

SEQ ID NO: 68469 - DNA, 25 bp, Rattus norvegicus
aattgtttgctgctgagtctcaggt

SEQ ID NO: 68470 - DNA, 25 bp, Rattus norvegicus
aattgtttgctggtgagtctcaggt

SEQ ID NO: 68471 - DNA, 25 bp, Rattus norvegicus
aattgtttgtacaactgagcccaca

SEQ ID NO: 68472 - DNA, 25 bp, Rattus norvegicus
aattgtttgtactactgagcccaca

SEQ ID NO: 68473 - DNA, 25 bp, Rattus norvegicus
aattgttttacacaagaggtcctat

SEQ ID NO: 68474 - DNA, 25 bp, Rattus norvegicus
aattgttttacagaagaggtcctat

SEQ ID NO: 68475 - DNA, 25 bp, Rattus norvegicus
aattgttttcagacatgcctctgtt

SEQ ID NO: 68476 - DNA, 25 bp, Rattus norvegicus
aattgttttcagtcatgcctctgtt

SEQ ID NO: 68477 - DNA, 25 bp, Rattus norvegicus
aattgttttcctaagtgctctgtgt

SEQ ID NO: 68478 - DNA, 25 bp, Rattus norvegicus
aattgttttccttagtgctctgtgt

SEQ ID NO: 68479 - DNA, 25 bp, Rattus norvegicus
aattgtttttgactctcagcctcac

SEQ ID NO: 68480 - DNA, 25 bp, Rattus norvegicus
aattgtttttgagtctcagcctcac

SEQ ID NO: 68481 - DNA, 25 bp, Rattus norvegicus
aattgtttttgcatctgaggaccga

SEQ ID NO: 68482 - DNA, 25 bp, Rattus norvegicus
aattgtttttgcttctgaggaccga

SEQ ID NO: 68483 - DNA, 25 bp, Rattus norvegicus
aatttaaacctgctgacctgcacac

SEQ ID NO: 68484 - DNA, 25 bp, Rattus norvegicus
aatttaaacctggtgacctgcacac

SEQ ID NO: 68485 - DNA, 25 bp, Rattus norvegicus
aatttaactccaccatctcactgtg

SEQ ID NO: 68486 - DNA, 25 bp, Rattus norvegicus
aatttaactccagcatctcactgtg

SEQ ID NO: 68487 - DNA, 25 bp, Rattus norvegicus
aatttaaggcttccagatccctggc

SEQ ID NO: 68488 - DNA, 25 bp, Rattus norvegicus
aatttaaggcttgcagatccctggc

SEQ ID NO: 68489 - DNA, 25 bp, Rattus norvegicus
aatttaatctttctacaccttccat

SEQ ID NO: 68490 - DNA, 25 bp, Rattus norvegicus
aatttaatctttgtacaccttccat

SEQ ID NO: 68491 - DNA, 25 bp, Rattus norvegicus
aatttaatgcccctgtctcgaggat

SEQ ID NO: 68492 - DNA, 25 bp, Rattus norvegicus
aatttaatgcccgtgtctcgaggat

SEQ ID NO: 68493 - DNA, 25 bp, Rattus norvegicus
aatttaattttcagaggtcctcatt

SEQ ID NO: 68494 - DNA, 25 bp, Rattus norvegicus
aatttaattttctgaggtcctcatt

SEQ ID NO: 68495 - DNA, 25 bp, Rattus norvegicus
aatttacacagcaagatttggaaga

SEQ ID NO: 68496 - DNA, 25 bp, Rattus norvegicus
aatttacacagctagatttggaaga

SEQ ID NO: 68497 - DNA, 25 bp, Rattus norvegicus
aatttacactccatagtctctgctt

SEQ ID NO: 68498 - DNA, 25 bp, Rattus norvegicus
aatttacactccttagtctctgctt

SEQ ID NO: 68499 - DNA, 25 bp, Rattus norvegicus
aatttacactctcgccatgcctggt

SEQ ID NO: 68500 - DNA, 25 bp, Rattus norvegicus
aatttacactctggccatgcctggt

SEQ ID NO: 68501 - DNA, 25 bp, Rattus norvegicus
aatttacatgtacggccaccaggcc

SEQ ID NO: 68502 - DNA, 25 bp, Rattus norvegicus
aatttacatgtagggccaccaggcc

SEQ ID NO: 68503 - DNA, 25 bp, Rattus norvegicus
aatttaccagagcagcgggccagtt

SEQ ID NO: 68504 - DNA, 25 bp, Rattus norvegicus
aatttaccagaggagcgggccagtt

SEQ ID NO: 68505 - DNA, 25 bp, Rattus norvegicus
aatttaccagggatggcttctcaga

SEQ ID NO: 68506 - DNA, 25 bp, Rattus norvegicus
aatttaccagggttggcttctcaga

SEQ ID NO: 68507 - DNA, 25 bp, Rattus norvegicus
aatttaccatagagttgctgagaaa

SEQ ID NO: 68508 - DNA, 25 bp, Rattus norvegicus
aatttaccatagtgttgctgagaaa

SEQ ID NO: 68509 - DNA, 25 bp, Rattus norvegicus
aatttacccattctgcttagctttg

SEQ ID NO: 68510 - DNA, 25 bp, Rattus norvegicus
aatttacccattgtgcttagctttg

SEQ ID NO: 68511 - DNA, 25 bp, Rattus norvegicus
aatttacctccaattaggctgaact

SEQ ID NO: 68512 - DNA, 25 bp, Rattus norvegicus
aatttacctccatttaggctgaact

SEQ ID NO: 68513 - DNA, 25 bp, Rattus norvegicus
aatttacgctgtcctattttactac

SEQ ID NO: 68514 - DNA, 25 bp, Rattus norvegicus
aatttacgctgtgctattttactac

SEQ ID NO: 68515 - DNA, 25 bp, Rattus norvegicus
aatttactcacaatcacacgcgatt

SEQ ID NO: 68516 - DNA, 25 bp, Rattus norvegicus
aatttactcacattcacacgcgatt

SEQ ID NO: 68517 - DNA, 25 bp, Rattus norvegicus
aatttactgcttattctgcgctact

SEQ ID NO: 68518 - DNA, 25 bp, Rattus norvegicus
aatttactgctttttctgcgctact

SEQ ID NO: 68519 - DNA, 25 bp, Rattus norvegicus
aatttactgtgcaggagactctaaa

SEQ ID NO: 68520 - DNA, 25 bp, Rattus norvegicus
aatttactgtgctggagactctaaa

SEQ ID NO: 68521 - DNA, 25 bp, Rattus norvegicus
aatttacttggccaagtccagcacc

SEQ ID NO: 68522 - DNA, 25 bp, Rattus norvegicus
aatttacttggcgaagtccagcacc

SEQ ID NO: 68523 - DNA, 25 bp, Rattus norvegicus
aatttacttgtaatcgccctttcat

SEQ ID NO: 68524 - DNA, 25 bp, Rattus norvegicus
aatttacttgtattcgccctttcat

SEQ ID NO: 68525 - DNA, 25 bp, Rattus norvegicus
aatttagacaataattctgccagca

SEQ ID NO: 68526 - DNA, 25 bp, Rattus norvegicus
aatttagacaattattctgccagca

SEQ ID NO: 68527 - DNA, 25 bp, Rattus norvegicus
aatttagaccaaaaccttgccctca

SEQ ID NO: 68528 - DNA, 25 bp, Rattus norvegicus
aatttagaccaataccttgccctca

SEQ ID NO: 68529 - DNA, 25 bp, Rattus norvegicus
aatttagcactgatgtctgctctta

SEQ ID NO: 68530 - DNA, 25 bp, Rattus norvegicus
aatttagcactgttgtctgctctta

SEQ ID NO: 68531 - DNA, 25 bp, Rattus norvegicus
aatttagccgcactttgtccagcaa

SEQ ID NO: 68532 - DNA, 25 bp, Rattus norvegicus
aatttagccgcagtttgtccagcaa

SEQ ID NO: 68533 - DNA, 25 bp, Rattus norvegicus
aatttagcctgtatgggtctgtgga

SEQ ID NO: 68534 - DNA, 25 bp, Rattus norvegicus
aatttagcctgtttgggtctgtgga

SEQ ID NO: 68535 - DNA, 25 bp, Rattus norvegicus
aatttagctccgagctgtgcaccta

SEQ ID NO: 68536 - DNA, 25 bp, Rattus norvegicus
aatttagctccgtgctgtgcaccta

SEQ ID NO: 68537 - DNA, 25 bp, Rattus norvegicus
aatttagcttccatgtaactcccag

SEQ ID NO: 68538 - DNA, 25 bp, Rattus norvegicus
aatttagcttccttgtaactcccag

SEQ ID NO: 68539 - DNA, 25 bp, Rattus norvegicus
aatttagctttgagtgcctacctgg

SEQ ID NO: 68540 - DNA, 25 bp, Rattus norvegicus
aatttagctttgtgtgcctacctgg

SEQ ID NO: 68541 - DNA, 25 bp, Rattus norvegicus
aatttaggacctcttcactgtgaaa

SEQ ID NO: 68542 - DNA, 25 bp, Rattus norvegicus
aatttaggacctgttcactgtgaaa

SEQ ID NO: 68543 - DNA, 25 bp, Rattus norvegicus
aatttaggcgacctggccctttcat

SEQ ID NO: 68544 - DNA, 25 bp, Rattus norvegicus
aatttaggcgacgtggccctttcat

SEQ ID NO: 68545 - DNA, 25 bp, Rattus norvegicus
aatttaggctatcgcctttctctcc

SEQ ID NO: 68546 - DNA, 25 bp, Rattus norvegicus
aatttaggctatggcctttctctcc

SEQ ID NO: 68547 - DNA, 25 bp, Rattus norvegicus
aatttagggccccatacatgctagg

SEQ ID NO: 68548 - DNA, 25 bp, Rattus norvegicus
aatttagggcccgatacatgctagg

SEQ ID NO: 68549 - DNA, 25 bp, Rattus norvegicus
aatttaggtgccagcatcctgcgct

SEQ ID NO: 68550 - DNA, 25 bp, Rattus norvegicus
aatttaggtgcctgcatcctgcgct

SEQ ID NO: 68551 - DNA, 25 bp, Rattus norvegicus
aatttagtacatcttctcgcacctt

SEQ ID NO: 68552 - DNA, 25 bp, Rattus norvegicus
aatttagtacatgttctcgcacctt

SEQ ID NO: 68553 - DNA, 25 bp, Rattus norvegicus
aatttagtcaatccaggagtgtcct

SEQ ID NO: 68554 - DNA, 25 bp, Rattus norvegicus
aatttagtcaatgcaggagtgtcct

SEQ ID NO: 68555 - DNA, 25 bp, Rattus norvegicus
aatttagtcctgagcataccgtggt

SEQ ID NO: 68556 - DNA, 25 bp, Rattus norvegicus
aatttagtcctgtgcataccgtggt

SEQ ID NO: 68557 - DNA, 25 bp, Rattus norvegicus
aatttagtcttgagtgtctttggat

SEQ ID NO: 68558 - DNA, 25 bp, Rattus norvegicus
aatttagtcttgtgtgtctttggat

SEQ ID NO: 68559 - DNA, 25 bp, Rattus norvegicus
aatttagttcctccagcttgattta

SEQ ID NO: 68560 - DNA, 25 bp, Rattus norvegicus
aatttagttcctgcagcttgattta

SEQ ID NO: 68561 - DNA, 25 bp, Rattus norvegicus
aatttagttggtagcgtcctcacct

SEQ ID NO: 68562 - DNA, 25 bp, Rattus norvegicus
aatttagttggttgcgtcctcacct

SEQ ID NO: 68563 - DNA, 25 bp, Rattus norvegicus
aatttataatctactgcctcagttt

SEQ ID NO: 68564 - DNA, 25 bp, Rattus norvegicus
aatttataatcttctgcctcagttt

SEQ ID NO: 68565 - DNA, 25 bp, Rattus norvegicus
aatttatagcaacctcactcactac

SEQ ID NO: 68566 - DNA, 25 bp, Rattus norvegicus
aatttatagcaagctcactcactac

SEQ ID NO: 68567 - DNA, 25 bp, Rattus norvegicus
aatttatatcacacgcacacactgg

SEQ ID NO: 68568 - DNA, 25 bp, Rattus norvegicus
aatttatatcactcgcacacactgg

SEQ ID NO: 68569 - DNA, 25 bp, Rattus norvegicus
aatttatattttaacctggcatgca

SEQ ID NO: 68570 - DNA, 25 bp, Rattus norvegicus
aatttatatttttacctggcatgca

SEQ ID NO: 68571 - DNA, 25 bp, Rattus norvegicus
aatttatcaagcagaactgtctcta

SEQ ID NO: 68572 - DNA, 25 bp, Rattus norvegicus
aatttatcaagctgaactgtctcta

SEQ ID NO: 68573 - DNA, 25 bp, Rattus norvegicus
aatttatcccaaattccaccatctt

SEQ ID NO: 68574 - DNA, 25 bp, Rattus norvegicus
aatttatcccaatttccaccatctt

SEQ ID NO: 68575 - DNA, 25 bp, Rattus norvegicus
aatttatcgagcaagctggcccagc

SEQ ID NO: 68576 - DNA, 25 bp, Rattus norvegicus
aatttatcgagctagctggcccagc

SEQ ID NO: 68577 - DNA, 25 bp, Rattus norvegicus
aatttatcttcgaacttcattccgt

SEQ ID NO: 68578 - DNA, 25 bp, Rattus norvegicus
aatttatcttcgtacttcattccgt

SEQ ID NO: 68579 - DNA, 25 bp, Rattus norvegicus
aatttatggtttctgcgtgctttat

SEQ ID NO: 68580 - DNA, 25 bp, Rattus norvegicus
aatttatggtttgtgcgtgctttat

SEQ ID NO: 68581 - DNA, 25 bp, Rattus norvegicus
aatttatgtctaactacttctagga

SEQ ID NO: 68582 - DNA, 25 bp, Rattus norvegicus
aatttatgtctatctacttctagga

SEQ ID NO: 68583 - DNA, 25 bp, Rattus norvegicus
aatttatgttctctggagggtggca

SEQ ID NO: 68584 - DNA, 25 bp, Rattus norvegicus
aatttatgttctgtggagggtggca

SEQ ID NO: 68585 - DNA, 25 bp, Rattus norvegicus
aatttattagcgctgctctgcaccc

SEQ ID NO: 68586 - DNA, 25 bp, Rattus norvegicus
aatttattagcggtgctctgcaccc

SEQ ID NO: 68587 - DNA, 25 bp, Rattus norvegicus
aatttattcatcattctcatttgtg

SEQ ID NO: 68588 - DNA, 25 bp, Rattus norvegicus
aatttattcatctttctcatttgtg

SEQ ID NO: 68589 - DNA, 25 bp, Rattus norvegicus
aatttattccatattgcttgttttg

SEQ ID NO: 68590 - DNA, 25 bp, Rattus norvegicus
aatttattccattttgcttgttttg

SEQ ID NO: 68591 - DNA, 25 bp, Rattus norvegicus
aatttattccgtcagcacctttgaa

SEQ ID NO: 68592 - DNA, 25 bp, Rattus norvegicus
aatttattccgtgagcacctttgaa

SEQ ID NO: 68593 - DNA, 25 bp, Rattus norvegicus
aatttattctaactactctgggatt

SEQ ID NO: 68594 - DNA, 25 bp, Rattus norvegicus
aatttattctaagtactctgggatt

SEQ ID NO: 68595 - DNA, 25 bp, Rattus norvegicus
aatttattctgtacttcctcgtgga

SEQ ID NO: 68596 - DNA, 25 bp, Rattus norvegicus
aatttattctgttcttcctcgtgga

SEQ ID NO: 68597 - DNA, 25 bp, Rattus norvegicus
aatttattgattaccctgtctctcc

SEQ ID NO: 68598 - DNA, 25 bp, Rattus norvegicus
aatttattgatttccctgtctctcc

SEQ ID NO: 68599 - DNA, 25 bp, Rattus norvegicus
aatttattggttcctgatacactga

SEQ ID NO: 68600 - DNA, 25 bp, Rattus norvegicus
aatttattggttgctgatacactga

SEQ ID NO: 68601 - DNA, 25 bp, Rattus norvegicus
aatttattttgcatctgtggtcgta

SEQ ID NO: 68602 - DNA, 25 bp, Rattus norvegicus
aatttattttgcttctgtggtcgta

SEQ ID NO: 68603 - DNA, 25 bp, Rattus norvegicus
aatttcaaaatgctacattcccaag

SEQ ID NO: 68604 - DNA, 25 bp, Rattus norvegicus
aatttcaaaatggtacattcccaag

SEQ ID NO: 68605 - DNA, 25 bp, Rattus norvegicus
aatttcaaggctcggcatgtggcta

SEQ ID NO: 68606 - DNA, 25 bp, Rattus norvegicus
aatttcaaggctgggcatgtggcta

SEQ ID NO: 68607 - DNA, 25 bp, Rattus norvegicus
aatttcaagtgaatcctcctcgtag

SEQ ID NO: 68608 - DNA, 25 bp, Rattus norvegicus
aatttcaagtgattcctcctcgtag

SEQ ID NO: 68609 - DNA, 25 bp, Rattus norvegicus
aatttcaagtgtcatagagcccggg

SEQ ID NO: 68610 - DNA, 25 bp, Rattus norvegicus
aatttcaagtgtgatagagcccggg

SEQ ID NO: 68611 - DNA, 25 bp, Rattus norvegicus
aatttcaatttaagccaccactccc

SEQ ID NO: 68612 - DNA, 25 bp, Rattus norvegicus
aatttcaatttatgccaccactccc

SEQ ID NO: 68613 - DNA, 25 bp, Rattus norvegicus
aatttcacacacaggcttcaggaac

SEQ ID NO: 68614 - DNA, 25 bp, Rattus norvegicus
aatttcacacactggcttcaggaac

SEQ ID NO: 68615 - DNA, 25 bp, Rattus norvegicus
aatttcacactgaaaagccctgaga

SEQ ID NO: 68616 - DNA, 25 bp, Rattus norvegicus
aatttcacactgtaaagccctgaga

SEQ ID NO: 68617 - DNA, 25 bp, Rattus norvegicus
aatttcacagagctggcagtggccg

SEQ ID NO: 68618 - DNA, 25 bp, Rattus norvegicus
aatttcacagaggtggcagtggccg

SEQ ID NO: 68619 - DNA, 25 bp, Rattus norvegicus
aatttcacagttaagatgtccccaa

SEQ ID NO: 68620 - DNA, 25 bp, Rattus norvegicus
aatttcacagtttagatgtccccaa

SEQ ID NO: 68621 - DNA, 25 bp, Rattus norvegicus
aatttcaccatcaaaatcgccgact

SEQ ID NO: 68622 - DNA, 25 bp, Rattus norvegicus
aatttcaccatctaaatcgccgact

SEQ ID NO: 68623 - DNA, 25 bp, Rattus norvegicus
aatttcactgcacggcttccacgat

SEQ ID NO: 68624 - DNA, 25 bp, Rattus norvegicus
aatttcactgcagggcttccacgat

SEQ ID NO: 68625 - DNA, 25 bp, Rattus norvegicus
aatttcagaaataaccaccgctcct

SEQ ID NO: 68626 - DNA, 25 bp, Rattus norvegicus
aatttcagaaattaccaccgctcct

SEQ ID NO: 68627 - DNA, 25 bp, Rattus norvegicus
aatttcagaattacagacctgactg

SEQ ID NO: 68628 - DNA, 25 bp, Rattus norvegicus
aatttcagaatttcagacctgactg

SEQ ID NO: 68629 - DNA, 25 bp, Rattus norvegicus
aatttcagagttccccttgtatcat

SEQ ID NO: 68630 - DNA, 25 bp, Rattus norvegicus
aatttcagagttgcccttgtatcat

SEQ ID NO: 68631 - DNA, 25 bp, Rattus norvegicus
aatttcagcgcacaggagagaccta

SEQ ID NO: 68632 - DNA, 25 bp, Rattus norvegicus
aatttcagcgcagaggagagaccta

SEQ ID NO: 68633 - DNA, 25 bp, Rattus norvegicus
aatttcagctaccattcaccttttg

SEQ ID NO: 68634 - DNA, 25 bp, Rattus norvegicus
aatttcagctacgattcaccttttg

SEQ ID NO: 68635 - DNA, 25 bp, Rattus norvegicus
aatttcaggtcacctaggattgcac

SEQ ID NO: 68636 - DNA, 25 bp, Rattus norvegicus
aatttcaggtcacgcagggtttcag

SEQ ID NO: 68637 - DNA, 25 bp, Rattus norvegicus
aatttcaggtcagctaggattgcac

SEQ ID NO: 68638 - DNA, 25 bp, Rattus norvegicus
aatttcaggtcaggcagggtttcag

SEQ ID NO: 68639 - DNA, 25 bp, Rattus norvegicus
aatttcagtcttcctgattcttccc

SEQ ID NO: 68640 - DNA, 25 bp, Rattus norvegicus
aatttcagtcttgctgattcttccc

SEQ ID NO: 68641 - DNA, 25 bp, Rattus norvegicus
aatttcagtgccaccgctgttgcag

SEQ ID NO: 68642 - DNA, 25 bp, Rattus norvegicus
aatttcagtgcctccgctgttgcag

SEQ ID NO: 68643 - DNA, 25 bp, Rattus norvegicus
aatttcataatcatgtttctccagt

SEQ ID NO: 68644 - DNA, 25 bp, Rattus norvegicus
aatttcataatcttgtttctccagt

SEQ ID NO: 68645 - DNA, 25 bp, Rattus norvegicus
aatttcatagctaacatttgttcat

SEQ ID NO: 68646 - DNA, 25 bp, Rattus norvegicus
aatttcatagcttacatttgttcat

SEQ ID NO: 68647 - DNA, 25 bp, Rattus norvegicus
aatttcatcactccaagactttttg

SEQ ID NO: 68648 - DNA, 25 bp, Rattus norvegicus
aatttcatcactgcaagactttttg

SEQ ID NO: 68649 - DNA, 25 bp, Rattus norvegicus
aatttcatcatgactggtctctgag

SEQ ID NO: 68650 - DNA, 25 bp, Rattus norvegicus
aatttcatcatgtctggtctctgag

SEQ ID NO: 68651 - DNA, 25 bp, Rattus norvegicus
aatttcatccttattatttgggtct

SEQ ID NO: 68652 - DNA, 25 bp, Rattus norvegicus
aatttcatcctttttatttgggtct

SEQ ID NO: 68653 - DNA, 25 bp, Rattus norvegicus
aatttcatctaactgtcatccttca

SEQ ID NO: 68654 - DNA, 25 bp, Rattus norvegicus
aatttcatctaagtgtcatccttca

SEQ ID NO: 68655 - DNA, 25 bp, Rattus norvegicus
aatttcatctggattctgctgctgg

SEQ ID NO: 68656 - DNA, 25 bp, Rattus norvegicus
aatttcatctggtttctgctgctgg

SEQ ID NO: 68657 - DNA, 25 bp, Rattus norvegicus
aatttcatcttcatatccttctctc

SEQ ID NO: 68658 - DNA, 25 bp, Rattus norvegicus
aatttcatcttcttatccttctctc

SEQ ID NO: 68659 - DNA, 25 bp, Rattus norvegicus
aatttcatgcccactaacatctcta

SEQ ID NO: 68660 - DNA, 25 bp, Rattus norvegicus
aatttcatgccctctaacatctcta

SEQ ID NO: 68661 - DNA, 25 bp, Rattus norvegicus
aatttcatggccagcaaaccgagcg

SEQ ID NO: 68662 - DNA, 25 bp, Rattus norvegicus
aatttcatggccaggagtgaagtga

SEQ ID NO: 68663 - DNA, 25 bp, Rattus norvegicus
aatttcatggcctgcaaaccgagcg

SEQ ID NO: 68664 - DNA, 25 bp, Rattus norvegicus
aatttcatggcctggagtgaagtga

SEQ ID NO: 68665 - DNA, 25 bp, Rattus norvegicus
aatttcatgggcaatctccttctca

SEQ ID NO: 68666 - DNA, 25 bp, Rattus norvegicus
aatttcatgggctatctccttctca

SEQ ID NO: 68667 - DNA, 25 bp, Rattus norvegicus
aatttcatgtatcaagccccgccag

SEQ ID NO: 68668 - DNA, 25 bp, Rattus norvegicus
aatttcatgtatgaagccccgccag

SEQ ID NO: 68669 - DNA, 25 bp, Rattus norvegicus
aatttcattacaaggcttgccgtac

SEQ ID NO: 68670 - DNA, 25 bp, Rattus norvegicus
aatttcattacatggcttgccgtac

SEQ ID NO: 68671 - DNA, 25 bp, Rattus norvegicus
aatttcattgatctatgccgtgctt

SEQ ID NO: 68672 - DNA, 25 bp, Rattus norvegicus
aatttcattgatgtatgccgtgctt

SEQ ID NO: 68673 - DNA, 25 bp, Rattus norvegicus
aatttccaaccaatagccgtgctaa

SEQ ID NO: 68674 - DNA, 25 bp, Rattus norvegicus
aatttccaaccattagccgtgctaa

SEQ ID NO: 68675 - DNA, 25 bp, Rattus norvegicus
aatttccaagcaactacaccagcac

SEQ ID NO: 68676 - DNA, 25 bp, Rattus norvegicus
aatttccaagcatctacaccagcac

SEQ ID NO: 68677 - DNA, 25 bp, Rattus norvegicus
aatttccagcccaccagaactgggt

SEQ ID NO: 68678 - DNA, 25 bp, Rattus norvegicus
aatttccagccctccagaactgggt

SEQ ID NO: 68679 - DNA, 25 bp, Rattus norvegicus
aatttccaggatccggtgccaaaag

SEQ ID NO: 68680 - DNA, 25 bp, Rattus norvegicus
aatttccaggatgcggtgccaaaag

SEQ ID NO: 68681 - DNA, 25 bp, Rattus norvegicus
aatttccaggccatggtggtgttgt

SEQ ID NO: 68682 - DNA, 25 bp, Rattus norvegicus
aatttccaggccttggtggtgttgt

SEQ ID NO: 68683 - DNA, 25 bp, Rattus norvegicus
aatttccatacacagatgcgagcac

SEQ ID NO: 68684 - DNA, 25 bp, Rattus norvegicus
aatttccatacagagatgcgagcac

SEQ ID NO: 68685 - DNA, 25 bp, Rattus norvegicus
aatttccatcatacgctctttcaag

SEQ ID NO: 68686 - DNA, 25 bp, Rattus norvegicus
aatttccatcattcgctctttcaag

SEQ ID NO: 68687 - DNA, 25 bp, Rattus norvegicus
aatttcccaattatgtatgcacaca

SEQ ID NO: 68688 - DNA, 25 bp, Rattus norvegicus
aatttcccaattttgtatgcacaca

SEQ ID NO: 68689 - DNA, 25 bp, Rattus norvegicus
aatttcccagacagtggccggacgt

SEQ ID NO: 68690 - DNA, 25 bp, Rattus norvegicus
aatttcccagactgtggccggacgt

SEQ ID NO: 68691 - DNA, 25 bp, Rattus norvegicus
aatttcccagagcttgttgagctca

SEQ ID NO: 68692 - DNA, 25 bp, Rattus norvegicus
aatttcccagaggttgttgagctca

SEQ ID NO: 68693 - DNA, 25 bp, Rattus norvegicus
aatttcccagttagcctgagtcagg

SEQ ID NO: 68694 - DNA, 25 bp, Rattus norvegicus
aatttcccagtttgcctgagtcagg

SEQ ID NO: 68695 - DNA, 25 bp, Rattus norvegicus
aatttcccataaagctctcatctga

SEQ ID NO: 68696 - DNA, 25 bp, Rattus norvegicus
aatttcccataatgctctcatctga

SEQ ID NO: 68697 - DNA, 25 bp, Rattus norvegicus
aatttccctaaccttaatgcctatg

SEQ ID NO: 68698 - DNA, 25 bp, Rattus norvegicus
aatttccctaacgttaatgcctatg

SEQ ID NO: 68699 - DNA, 25 bp, Rattus norvegicus
aatttccctaccattcagcttgttt

SEQ ID NO: 68700 - DNA, 25 bp, Rattus norvegicus
aatttccctacctttcagcttgttt

SEQ ID NO: 68701 - DNA, 25 bp, Rattus norvegicus
aatttccctgctaccagaattatct

SEQ ID NO: 68702 - DNA, 25 bp, Rattus norvegicus
aatttccctgcttccagaattatct

SEQ ID NO: 68703 - DNA, 25 bp, Rattus norvegicus
aatttcccttctcctgatactaaca

SEQ ID NO: 68704 - DNA, 25 bp, Rattus norvegicus
aatttcccttctgctgatactaaca

SEQ ID NO: 68705 - DNA, 25 bp, Rattus norvegicus
aatttcccttgactcatatcttgta

SEQ ID NO: 68706 - DNA, 25 bp, Rattus norvegicus
aatttcccttgagtcatatcttgta

SEQ ID NO: 68707 - DNA, 25 bp, Rattus norvegicus
aatttccgatcaatctttcagacat

SEQ ID NO: 68708 - DNA, 25 bp, Rattus norvegicus
aatttccgatcattctttcagacat

SEQ ID NO: 68709 - DNA, 25 bp, Rattus norvegicus
aatttccggtctacgtgacatacca

SEQ ID NO: 68710 - DNA, 25 bp, Rattus norvegicus
aatttccggtcttcgtgacatacca

SEQ ID NO: 68711 - DNA, 25 bp, Rattus norvegicus
aatttccgttcacagcatgcatgca

SEQ ID NO: 68712 - DNA, 25 bp, Rattus norvegicus
aatttccgttcagagcatgcatgca

SEQ ID NO: 68713 - DNA, 25 bp, Rattus norvegicus
aatttcctaatcagaaatgcttgaa

SEQ ID NO: 68714 - DNA, 25 bp, Rattus norvegicus
aatttcctaatctgaaatgcttgaa

SEQ ID NO: 68715 - DNA, 25 bp, Rattus norvegicus
aatttcctactacctagcagactga

SEQ ID NO: 68716 - DNA, 25 bp, Rattus norvegicus
aatttcctactagctagcagactga

SEQ ID NO: 68717 - DNA, 25 bp, Rattus norvegicus
aatttcctattcagatgagactttg

SEQ ID NO: 68718 - DNA, 25 bp, Rattus norvegicus
aatttcctattctgatgagactttg

SEQ ID NO: 68719 - DNA, 25 bp, Rattus norvegicus
aatttcctatttccttgctctgctt

SEQ ID NO: 68720 - DNA, 25 bp, Rattus norvegicus
aatttcctatttgcttgctctgctt

SEQ ID NO: 68721 - DNA, 25 bp, Rattus norvegicus
aatttcctcaacactgaaacctcga

SEQ ID NO: 68722 - DNA, 25 bp, Rattus norvegicus
aatttcctcaactctgaaacctcga

SEQ ID NO: 68723 - DNA, 25 bp, Rattus norvegicus
aatttcctccagaaactagtgagcg

SEQ ID NO: 68724 - DNA, 25 bp, Rattus norvegicus
aatttcctccagtaactagtgagcg

SEQ ID NO: 68725 - DNA, 25 bp, Rattus norvegicus
aatttcctccgtccagaattctgaa

SEQ ID NO: 68726 - DNA, 25 bp, Rattus norvegicus
aatttcctccgtgcagaattctgaa

SEQ ID NO: 68727 - DNA, 25 bp, Rattus norvegicus
aatttcctctttcatgcatttggtt

SEQ ID NO: 68728 - DNA, 25 bp, Rattus norvegicus
aatttcctctttgatgcatttggtt

SEQ ID NO: 68729 - DNA, 25 bp, Rattus norvegicus
aatttcctgatgctcttacaacctg

SEQ ID NO: 68730 - DNA, 25 bp, Rattus norvegicus
aatttcctgatggtcttacaacctg

SEQ ID NO: 68731 - DNA, 25 bp, Rattus norvegicus
aatttcctgcttccttttcattctc

SEQ ID NO: 68732 - DNA, 25 bp, Rattus norvegicus
aatttcctgcttgcttttcattctc

SEQ ID NO: 68733 - DNA, 25 bp, Rattus norvegicus
aatttcctggttcatttctatccca

SEQ ID NO: 68734 - DNA, 25 bp, Rattus norvegicus
aatttcctggttgatttctatccca

SEQ ID NO: 68735 - DNA, 25 bp, Rattus norvegicus
aatttcctgttactgttctttgatc

SEQ ID NO: 68736 - DNA, 25 bp, Rattus norvegicus
aatttcctgttagtgttctttgatc

SEQ ID NO: 68737 - DNA, 25 bp, Rattus norvegicus
aatttccttacaaactttattccag

SEQ ID NO: 68738 - DNA, 25 bp, Rattus norvegicus
aatttccttacatactttattccag

SEQ ID NO: 68739 - DNA, 25 bp, Rattus norvegicus
aatttccttatcctgaggctctgta

SEQ ID NO: 68740 - DNA, 25 bp, Rattus norvegicus
aatttccttatcgtgaggctctgta

SEQ ID NO: 68741 - DNA, 25 bp, Rattus norvegicus
aatttccttccaatatgtgtgtgtg

SEQ ID NO: 68742 - DNA, 25 bp, Rattus norvegicus
aatttccttccattatgtgtgtgtg

SEQ ID NO: 68743 - DNA, 25 bp, Rattus norvegicus
aatttccttcctcagttcttgactt

SEQ ID NO: 68744 - DNA, 25 bp, Rattus norvegicus
aatttccttcctgagttcttgactt

SEQ ID NO: 68745 - DNA, 25 bp, Rattus norvegicus
aatttccttcgtcgtctcattatat

SEQ ID NO: 68746 - DNA, 25 bp, Rattus norvegicus
aatttccttcgtggtctcattatat

SEQ ID NO: 68747 - DNA, 25 bp, Rattus norvegicus
aatttcctttgtcgtttgatgcaga

SEQ ID NO: 68748 - DNA, 25 bp, Rattus norvegicus
aatttcctttgtggtttgatgcaga

SEQ ID NO: 68749 - DNA, 25 bp, Rattus norvegicus
aatttcgacgagccgttacatattc

SEQ ID NO: 68750 - DNA, 25 bp, Rattus norvegicus
aatttcgacgaggcgttacatattc

SEQ ID NO: 68751 - DNA, 25 bp, Rattus norvegicus
aatttcgagattacggacctgcacc

SEQ ID NO: 68752 - DNA, 25 bp, Rattus norvegicus
aatttcgagatttcggacctgcacc

SEQ ID NO: 68753 - DNA, 25 bp, Rattus norvegicus
aatttcgaggagaacctgcgtgcgc

SEQ ID NO: 68754 - DNA, 25 bp, Rattus norvegicus
aatttcgaggagtacctgcgtgcgc

SEQ ID NO: 68755 - DNA, 25 bp, Rattus norvegicus
aatttcgccgtaaaacatcagcata

SEQ ID NO: 68756 - DNA, 25 bp, Rattus norvegicus
aatttcgccgtataacatcagcata

SEQ ID NO: 68757 - DNA, 25 bp, Rattus norvegicus
aatttctaaaggacactcagggtgg

SEQ ID NO: 68758 - DNA, 25 bp, Rattus norvegicus
aatttctaaaggtcactcagggtgg

SEQ ID NO: 68759 - DNA, 25 bp, Rattus norvegicus
aatttctaacagatgcctgtcatag

SEQ ID NO: 68760 - DNA, 25 bp, Rattus norvegicus
aatttctaacagttgcctgtcatag

SEQ ID NO: 68761 - DNA, 25 bp, Rattus norvegicus
aatttctaattgatctgttcctgtg

SEQ ID NO: 68762 - DNA, 25 bp, Rattus norvegicus
aatttctaattgttctgttcctgtg

SEQ ID NO: 68763 - DNA, 25 bp, Rattus norvegicus
aatttctacaccacaacctttgcaa

SEQ ID NO: 68764 - DNA, 25 bp, Rattus norvegicus
aatttctacacctcaacctttgcaa

SEQ ID NO: 68765 - DNA, 25 bp, Rattus norvegicus
aatttctacctcagcatcagtttga

SEQ ID NO: 68766 - DNA, 25 bp, Rattus norvegicus
aatttctacctccatagactggcca

SEQ ID NO: 68767 - DNA, 25 bp, Rattus norvegicus
aatttctacctcgatagactggcca

SEQ ID NO: 68768 - DNA, 25 bp, Rattus norvegicus
aatttctacctctgcatcagtttga

SEQ ID NO: 68769 - DNA, 25 bp, Rattus norvegicus
aatttctactttctcctcaatttag

SEQ ID NO: 68770 - DNA, 25 bp, Rattus norvegicus
aatttctactttgtcctcaatttag

SEQ ID NO: 68771 - DNA, 25 bp, Rattus norvegicus
aatttctagcaactctggtggccta

SEQ ID NO: 68772 - DNA, 25 bp, Rattus norvegicus
aatttctagcaagtctggtggccta

SEQ ID NO: 68773 - DNA, 25 bp, Rattus norvegicus
aatttctagcttccctcttaggctt

SEQ ID NO: 68774 - DNA, 25 bp, Rattus norvegicus
aatttctagcttgcctcttaggctt

SEQ ID NO: 68775 - DNA, 25 bp, Rattus norvegicus
aatttctaggaaactgcttgataac

SEQ ID NO: 68776 - DNA, 25 bp, Rattus norvegicus
aatttctaggaatctgcttgataac

SEQ ID NO: 68777 - DNA, 25 bp, Rattus norvegicus
aatttctagtgcaccccttaggcct

SEQ ID NO: 68778 - DNA, 25 bp, Rattus norvegicus
aatttctagtgctccccttaggcct

SEQ ID NO: 68779 - DNA, 25 bp, Rattus norvegicus
aatttctatatcattgtccctcctc

SEQ ID NO: 68780 - DNA, 25 bp, Rattus norvegicus
aatttctatatctttgtccctcctc

SEQ ID NO: 68781 - DNA, 25 bp, Rattus norvegicus
aatttctatctgcagaacccctgag

SEQ ID NO: 68782 - DNA, 25 bp, Rattus norvegicus
aatttctatctggagaacccctgag

SEQ ID NO: 68783 - DNA, 25 bp, Rattus norvegicus
aatttctattgtatggccctagctg

SEQ ID NO: 68784 - DNA, 25 bp, Rattus norvegicus
aatttctattgtttggccctagctg

SEQ ID NO: 68785 - DNA, 25 bp, Rattus norvegicus
aatttctatttaatccctcatggag

SEQ ID NO: 68786 - DNA, 25 bp, Rattus norvegicus
aatttctatttattccctcatggag

SEQ ID NO: 68787 - DNA, 25 bp, Rattus norvegicus
aatttctcagatctcattctctggg

SEQ ID NO: 68788 - DNA, 25 bp, Rattus norvegicus
aatttctcagatgtcattctctggg

SEQ ID NO: 68789 - DNA, 25 bp, Rattus norvegicus
aatttctcatggatcattgatgctg

SEQ ID NO: 68790 - DNA, 25 bp, Rattus norvegicus
aatttctcatggttcattgatgctg

SEQ ID NO: 68791 - DNA, 25 bp, Rattus norvegicus
aatttctcatgtagttcctgtgtgg

SEQ ID NO: 68792 - DNA, 25 bp, Rattus norvegicus
aatttctcatgttgttcctgtgtgg

SEQ ID NO: 68793 - DNA, 25 bp, Rattus norvegicus
aatttctccctgacccagtatataa

SEQ ID NO: 68794 - DNA, 25 bp, Rattus norvegicus
aatttctccctgtcccagtatataa

SEQ ID NO: 68795 - DNA, 25 bp, Rattus norvegicus
aatttctcgaacctttgattgacgg

SEQ ID NO: 68796 - DNA, 25 bp, Rattus norvegicus
aatttctcgaacgtttgattgacgg

SEQ ID NO: 68797 - DNA, 25 bp, Rattus norvegicus
aatttctcggttacattctaggact

SEQ ID NO: 68798 - DNA, 25 bp, Rattus norvegicus
aatttctcggtttcattctaggact

SEQ ID NO: 68799 - DNA, 25 bp, Rattus norvegicus
aatttctctaaacctgaagtgccaa

SEQ ID NO: 68800 - DNA, 25 bp, Rattus norvegicus
aatttctctaaagctgaagtgccaa

SEQ ID NO: 68801 - DNA, 25 bp, Rattus norvegicus
aatttctctagtaatgtgtctcaca

SEQ ID NO: 68802 - DNA, 25 bp, Rattus norvegicus
aatttctctagttatgtgtctcaca

SEQ ID NO: 68803 - DNA, 25 bp, Rattus norvegicus
aatttctctgcgctgtatcgttagc

SEQ ID NO: 68804 - DNA, 25 bp, Rattus norvegicus
aatttctctgcggtgtatcgttagc

SEQ ID NO: 68805 - DNA, 25 bp, Rattus norvegicus
aatttctctgtacatcttccccata

SEQ ID NO: 68806 - DNA, 25 bp, Rattus norvegicus
aatttctctgtagatcttccccata

SEQ ID NO: 68807 - DNA, 25 bp, Rattus norvegicus
aatttctcttaactgctgtgtcctt

SEQ ID NO: 68808 - DNA, 25 bp, Rattus norvegicus
aatttctcttaagtgctgtgtcctt

SEQ ID NO: 68809 - DNA, 25 bp, Rattus norvegicus
aatttctcttcacgtgagctttgag

SEQ ID NO: 68810 - DNA, 25 bp, Rattus norvegicus
aatttctcttcactgcaaaggccca

SEQ ID NO: 68811 - DNA, 25 bp, Rattus norvegicus
aatttctcttcaggtgagctttgag

SEQ ID NO: 68812 - DNA, 25 bp, Rattus norvegicus
aatttctcttcagtgcaaaggccca

SEQ ID NO: 68813 - DNA, 25 bp, Rattus norvegicus
aatttctcttccagtctgatgtctg

SEQ ID NO: 68814 - DNA, 25 bp, Rattus norvegicus
aatttctcttcctgtctgatgtctg

SEQ ID NO: 68815 - DNA, 25 bp, Rattus norvegicus
aatttctgaaatctatgctcaacaa

SEQ ID NO: 68816 - DNA, 25 bp, Rattus norvegicus
aatttctgaaatgtatgctcaacaa

SEQ ID NO: 68817 - DNA, 25 bp, Rattus norvegicus
aatttctgcctaaccacatctagat

SEQ ID NO: 68818 - DNA, 25 bp, Rattus norvegicus
aatttctgcctatccacatctagat

SEQ ID NO: 68819 - DNA, 25 bp, Rattus norvegicus
aatttctgctgcactaagtaacccc

SEQ ID NO: 68820 - DNA, 25 bp, Rattus norvegicus
aatttctgctgctctaagtaacccc

SEQ ID NO: 68821 - DNA, 25 bp, Rattus norvegicus
aatttctgctgtaggctgttaataa

SEQ ID NO: 68822 - DNA, 25 bp, Rattus norvegicus
aatttctgctgttggctgttaataa

SEQ ID NO: 68823 - DNA, 25 bp, Rattus norvegicus
aatttctggaacaccaggactccgc

SEQ ID NO: 68824 - DNA, 25 bp, Rattus norvegicus
aatttctggaactccaggactccgc

SEQ ID NO: 68825 - DNA, 25 bp, Rattus norvegicus
aatttctggactcactgacttcatc

SEQ ID NO: 68826 - DNA, 25 bp, Rattus norvegicus
aatttctggactgactgacttcatc

SEQ ID NO: 68827 - DNA, 25 bp, Rattus norvegicus
aatttctggcacacggaaggctggg

SEQ ID NO: 68828 - DNA, 25 bp, Rattus norvegicus
aatttctggcactcggaaggctggg

SEQ ID NO: 68829 - DNA, 25 bp, Rattus norvegicus
aatttctggcagagtagccggtgct

SEQ ID NO: 68830 - DNA, 25 bp, Rattus norvegicus
aatttctggcagtgtagccggtgct

SEQ ID NO: 68831 - DNA, 25 bp, Rattus norvegicus
aatttctgggccaggtattacttca

SEQ ID NO: 68832 - DNA, 25 bp, Rattus norvegicus
aatttctgggcctggtattacttca

SEQ ID NO: 68833 - DNA, 25 bp, Rattus norvegicus
aatttctgggttcttctggatggcc

SEQ ID NO: 68834 - DNA, 25 bp, Rattus norvegicus
aatttctgggttgttctggatggcc

SEQ ID NO: 68835 - DNA, 25 bp, Rattus norvegicus
aatttctggtccctaacttgtgaag

SEQ ID NO: 68836 - DNA, 25 bp, Rattus norvegicus
aatttctggtccgtaacttgtgaag

SEQ ID NO: 68837 - DNA, 25 bp, Rattus norvegicus
aatttctgtcatacttccgagcatc

SEQ ID NO: 68838 - DNA, 25 bp, Rattus norvegicus
aatttctgtcatcctcaattccacc

SEQ ID NO: 68839 - DNA, 25 bp, Rattus norvegicus
aatttctgtcatgctcaattccacc

SEQ ID NO: 68840 - DNA, 25 bp, Rattus norvegicus
aatttctgtcattcttccgagcatc

SEQ ID NO: 68841 - DNA, 25 bp, Rattus norvegicus
aatttctgtccaattatagccgtaa

SEQ ID NO: 68842 - DNA, 25 bp, Rattus norvegicus
aatttctgtccatttatagccgtaa

SEQ ID NO: 68843 - DNA, 25 bp, Rattus norvegicus
aatttctgtgggattgttactctga

SEQ ID NO: 68844 - DNA, 25 bp, Rattus norvegicus
aatttctgtgggtttgttactctga

SEQ ID NO: 68845 - DNA, 25 bp, Rattus norvegicus
aatttctgtgtgacccagggagcac

SEQ ID NO: 68846 - DNA, 25 bp, Rattus norvegicus
aatttctgtgtgtcccagggagcac

SEQ ID NO: 68847 - DNA, 25 bp, Rattus norvegicus
aatttctgttaaaagctgttctcgt

SEQ ID NO: 68848 - DNA, 25 bp, Rattus norvegicus
aatttctgttaatagctgttctcgt

SEQ ID NO: 68849 - DNA, 25 bp, Rattus norvegicus
aatttcttaagaattgtctacccag

SEQ ID NO: 68850 - DNA, 25 bp, Rattus norvegicus
aatttcttaagacgtgcattgggta

SEQ ID NO: 68851 - DNA, 25 bp, Rattus norvegicus
aatttcttaagaggtgcattgggta

SEQ ID NO: 68852 - DNA, 25 bp, Rattus norvegicus
aatttcttaagatttgtctacccag

SEQ ID NO: 68853 - DNA, 25 bp, Rattus norvegicus
aatttcttaccaattcatgctgatt

SEQ ID NO: 68854 - DNA, 25 bp, Rattus norvegicus
aatttcttaccatttcatgctgatt

SEQ ID NO: 68855 - DNA, 25 bp, Rattus norvegicus
aatttcttactgattctgctttctt

SEQ ID NO: 68856 - DNA, 25 bp, Rattus norvegicus
aatttcttactgtttctgctttctt

SEQ ID NO: 68857 - DNA, 25 bp, Rattus norvegicus
aatttcttgaagagtgtggcccctt

SEQ ID NO: 68858 - DNA, 25 bp, Rattus norvegicus
aatttcttgaagtgtgtggcccctt

SEQ ID NO: 68859 - DNA, 25 bp, Rattus norvegicus
aatttcttgacaagcacgtgcgatt

SEQ ID NO: 68860 - DNA, 25 bp, Rattus norvegicus
aatttcttgacatgcacgtgcgatt

SEQ ID NO: 68861 - DNA, 25 bp, Rattus norvegicus
aatttcttgcctccctagttattta

SEQ ID NO: 68862 - DNA, 25 bp, Rattus norvegicus
aatttcttgcctgcctagttattta

SEQ ID NO: 68863 - DNA, 25 bp, Rattus norvegicus
aatttcttgcttaggtgtttcctag

SEQ ID NO: 68864 - DNA, 25 bp, Rattus norvegicus
aatttcttgctttggtgtttcctag

SEQ ID NO: 68865 - DNA, 25 bp, Rattus norvegicus
aatttcttgggcaccatttgggcta

SEQ ID NO: 68866 - DNA, 25 bp, Rattus norvegicus
aatttcttgggctccatttgggcta

SEQ ID NO: 68867 - DNA, 25 bp, Rattus norvegicus
aatttctttacaacaagttcagtca

SEQ ID NO: 68868 - DNA, 25 bp, Rattus norvegicus
aatttctttacatcaagttcagtca

SEQ ID NO: 68869 - DNA, 25 bp, Rattus norvegicus
aatttctttcatactgttttctgac

SEQ ID NO: 68870 - DNA, 25 bp, Rattus norvegicus
aatttctttcattctgttttctgac

SEQ ID NO: 68871 - DNA, 25 bp, Rattus norvegicus
aatttctttctcatgctccaggata

SEQ ID NO: 68872 - DNA, 25 bp, Rattus norvegicus
aatttctttctcttgctccaggata

SEQ ID NO: 68873 - DNA, 25 bp, Rattus norvegicus
aatttctttgaactctgctctggcc

SEQ ID NO: 68874 - DNA, 25 bp, Rattus norvegicus
aatttctttgaagtctgctctggcc

SEQ ID NO: 68875 - DNA, 25 bp, Rattus norvegicus
aatttctttgagacagtgcctccca

SEQ ID NO: 68876 - DNA, 25 bp, Rattus norvegicus
aatttctttgagtcagtgcctccca

SEQ ID NO: 68877 - DNA, 25 bp, Rattus norvegicus
aatttcttttgacctcttttgatag

SEQ ID NO: 68878 - DNA, 25 bp, Rattus norvegicus
aatttcttttgagctcttttgatag

SEQ ID NO: 68879 - DNA, 25 bp, Rattus norvegicus
aatttgaacttcaggaccatgacaa

SEQ ID NO: 68880 - DNA, 25 bp, Rattus norvegicus
aatttgaacttctggaccatgacaa

SEQ ID NO: 68881 - DNA, 25 bp, Rattus norvegicus
aatttgaagcttcctcctttccaga

SEQ ID NO: 68882 - DNA, 25 bp, Rattus norvegicus
aatttgaagcttgctcctttccaga

SEQ ID NO: 68883 - DNA, 25 bp, Rattus norvegicus
aatttgaaggtgctttgtcctccgc

SEQ ID NO: 68884 - DNA, 25 bp, Rattus norvegicus
aatttgaaggtggtttgtcctccgc

SEQ ID NO: 68885 - DNA, 25 bp, Rattus norvegicus
aatttgaaggttacagttctctctc

SEQ ID NO: 68886 - DNA, 25 bp, Rattus norvegicus
aatttgaaggtttcagttctctctc

SEQ ID NO: 68887 - DNA, 25 bp, Rattus norvegicus
aatttgaagtctagcgttgtggaga

SEQ ID NO: 68888 - DNA, 25 bp, Rattus norvegicus
aatttgaagtcttgcgttgtggaga

SEQ ID NO: 68889 - DNA, 25 bp, Rattus norvegicus
aatttgaagtttatctcagtccata

SEQ ID NO: 68890 - DNA, 25 bp, Rattus norvegicus
aatttgaagtttttctcagtccata

SEQ ID NO: 68891 - DNA, 25 bp, Rattus norvegicus
aatttgaatctgagcctccaagaaa

SEQ ID NO: 68892 - DNA, 25 bp, Rattus norvegicus
aatttgaatctgtgcctccaagaaa

SEQ ID NO: 68893 - DNA, 25 bp, Rattus norvegicus
aatttgacagccctgtagttcccta

SEQ ID NO: 68894 - DNA, 25 bp, Rattus norvegicus
aatttgacagccgtgtagttcccta

SEQ ID NO: 68895 - DNA, 25 bp, Rattus norvegicus
aatttgagagcactcctacttccct

SEQ ID NO: 68896 - DNA, 25 bp, Rattus norvegicus
aatttgagagcagtcctacttccct

SEQ ID NO: 68897 - DNA, 25 bp, Rattus norvegicus
aatttgagagctagacggacccctg

SEQ ID NO: 68898 - DNA, 25 bp, Rattus norvegicus
aatttgagagcttgacggacccctg

SEQ ID NO: 68899 - DNA, 25 bp, Rattus norvegicus
aatttgagcctgacactgaacctcc

SEQ ID NO: 68900 - DNA, 25 bp, Rattus norvegicus
aatttgagcctgtcactgaacctcc

SEQ ID NO: 68901 - DNA, 25 bp, Rattus norvegicus
aatttgagctacagcatgggtcacc

SEQ ID NO: 68902 - DNA, 25 bp, Rattus norvegicus
aatttgagctactgcatgggtcacc

SEQ ID NO: 68903 - DNA, 25 bp, Rattus norvegicus
aatttgagcttgatccctagggccg

SEQ ID NO: 68904 - DNA, 25 bp, Rattus norvegicus
aatttgagcttgttccctagggccg

SEQ ID NO: 68905 - DNA, 25 bp, Rattus norvegicus
aatttgaggcatacctgcctcagct

SEQ ID NO: 68906 - DNA, 25 bp, Rattus norvegicus
aatttgaggcattcctgcctcagct

SEQ ID NO: 68907 - DNA, 25 bp, Rattus norvegicus
aatttgagtctcatgcctcaggcat

SEQ ID NO: 68908 - DNA, 25 bp, Rattus norvegicus
aatttgagtctcttgcctcaggcat

SEQ ID NO: 68909 - DNA, 25 bp, Rattus norvegicus
aatttgatatccactgctagctgca

SEQ ID NO: 68910 - DNA, 25 bp, Rattus norvegicus
aatttgatatcctctgctagctgca

SEQ ID NO: 68911 - DNA, 25 bp, Rattus norvegicus
aatttgatctgtccttcggttttct

SEQ ID NO: 68912 - DNA, 25 bp, Rattus norvegicus
aatttgatctgtgcttcggttttct

SEQ ID NO: 68913 - DNA, 25 bp, Rattus norvegicus
aatttgatctttacagcctttctcc

SEQ ID NO: 68914 - DNA, 25 bp, Rattus norvegicus
aatttgatcttttcagcctttctcc

SEQ ID NO: 68915 - DNA, 25 bp, Rattus norvegicus
aatttgatggctcactctttgttct

SEQ ID NO: 68916 - DNA, 25 bp, Rattus norvegicus
aatttgatggctgactctttgttct

SEQ ID NO: 68917 - DNA, 25 bp, Rattus norvegicus
aatttgatttcaccccgagttccta

SEQ ID NO: 68918 - DNA, 25 bp, Rattus norvegicus
aatttgatttcagcccgagttccta

SEQ ID NO: 68919 - DNA, 25 bp, Rattus norvegicus
aatttgatttgtccgcggcttctaa

SEQ ID NO: 68920 - DNA, 25 bp, Rattus norvegicus
aatttgatttgtgcgcggcttctaa

SEQ ID NO: 68921 - DNA, 25 bp, Rattus norvegicus
aatttgattttaaacgctccctgaa

SEQ ID NO: 68922 - DNA, 25 bp, Rattus norvegicus
aatttgattttatacgctccctgaa

SEQ ID NO: 68923 - DNA, 25 bp, Rattus norvegicus
aatttgatttttctcttggctgttc

SEQ ID NO: 68924 - DNA, 25 bp, Rattus norvegicus
aatttgatttttgtcttggctgttc

SEQ ID NO: 68925 - DNA, 25 bp, Rattus norvegicus
aatttgcaaacaagcccagcttgaa

SEQ ID NO: 68926 - DNA, 25 bp, Rattus norvegicus
aatttgcaaacatgcccagcttgaa

SEQ ID NO: 68927 - DNA, 25 bp, Rattus norvegicus
aatttgcaaccccagggacatgcac

SEQ ID NO: 68928 - DNA, 25 bp, Rattus norvegicus
aatttgcaacccgagggacatgcac

SEQ ID NO: 68929 - DNA, 25 bp, Rattus norvegicus
aatttgcactgtactgataatgggt

SEQ ID NO: 68930 - DNA, 25 bp, Rattus norvegicus
aatttgcactgttctgataatgggt

SEQ ID NO: 68931 - DNA, 25 bp, Rattus norvegicus
aatttgcacttacacagcacctttc

SEQ ID NO: 68932 - DNA, 25 bp, Rattus norvegicus
aatttgcacttagacagcacctttc

SEQ ID NO: 68933 - DNA, 25 bp, Rattus norvegicus
aatttgcagtcaccctggtctaaat

SEQ ID NO: 68934 - DNA, 25 bp, Rattus norvegicus
aatttgcagtcagcctggtctaaat

SEQ ID NO: 68935 - DNA, 25 bp, Rattus norvegicus
aatttgcagttgatctactttacta

SEQ ID NO: 68936 - DNA, 25 bp, Rattus norvegicus
aatttgcagttgttctactttacta

SEQ ID NO: 68937 - DNA, 25 bp, Rattus norvegicus
aatttgcatatgagtatcattatac

SEQ ID NO: 68938 - DNA, 25 bp, Rattus norvegicus
aatttgcatatgtgtatcattatac

SEQ ID NO: 68939 - DNA, 25 bp, Rattus norvegicus
aatttgcatgttctactttgattgt

SEQ ID NO: 68940 - DNA, 25 bp, Rattus norvegicus
aatttgcatgttgtactttgattgt

SEQ ID NO: 68941 - DNA, 25 bp, Rattus norvegicus
aatttgcattctaactttcttggga

SEQ ID NO: 68942 - DNA, 25 bp, Rattus norvegicus
aatttgcattcttactttcttggga

SEQ ID NO: 68943 - DNA, 25 bp, Rattus norvegicus
aatttgccacttatcctcggagatt

SEQ ID NO: 68944 - DNA, 25 bp, Rattus norvegicus
aatttgccacttttcctcggagatt

SEQ ID NO: 68945 - DNA, 25 bp, Rattus norvegicus
aatttgccagtgcttccaagtcggg

SEQ ID NO: 68946 - DNA, 25 bp, Rattus norvegicus
aatttgccagtggttccaagtcggg

SEQ ID NO: 68947 - DNA, 25 bp, Rattus norvegicus
aatttgcccgcgcaggtgtgtgacc

SEQ ID NO: 68948 - DNA, 25 bp, Rattus norvegicus
aatttgcccgcggaggtgtgtgacc

SEQ ID NO: 68949 - DNA, 25 bp, Rattus norvegicus
aatttgcctcaaacacttttataaa

SEQ ID NO: 68950 - DNA, 25 bp, Rattus norvegicus
aatttgcctcaatcacttttataaa

SEQ ID NO: 68951 - DNA, 25 bp, Rattus norvegicus
aatttgcgtctgacaccaagtgcat

SEQ ID NO: 68952 - DNA, 25 bp, Rattus norvegicus
aatttgcgtctgtcaccaagtgcat

SEQ ID NO: 68953 - DNA, 25 bp, Rattus norvegicus
aatttgctagtgagcctctggacct

SEQ ID NO: 68954 - DNA, 25 bp, Rattus norvegicus
aatttgctagtgtgcctctggacct

SEQ ID NO: 68955 - DNA, 25 bp, Rattus norvegicus
aatttgctatgtcacactttctcgg

SEQ ID NO: 68956 - DNA, 25 bp, Rattus norvegicus
aatttgctatgtgacactttctcgg

SEQ ID NO: 68957 - DNA, 25 bp, Rattus norvegicus
aatttgctcctgcttgtggtgtaga

SEQ ID NO: 68958 - DNA, 25 bp, Rattus norvegicus
aatttgctcctggttgtggtgtaga

SEQ ID NO: 68959 - DNA, 25 bp, Rattus norvegicus
aatttgctccttacaccaagtggtt

SEQ ID NO: 68960 - DNA, 25 bp, Rattus norvegicus
aatttgctcctttcaccaagtggtt

SEQ ID NO: 68961 - DNA, 25 bp, Rattus norvegicus
aatttgctctatattacccacgctt

SEQ ID NO: 68962 - DNA, 25 bp, Rattus norvegicus
aatttgctctattttacccacgctt

SEQ ID NO: 68963 - DNA, 25 bp, Rattus norvegicus
aatttgctctccctgtttgaacttt

SEQ ID NO: 68964 - DNA, 25 bp, Rattus norvegicus
aatttgctctccgtgtttgaacttt

SEQ ID NO: 68965 - DNA, 25 bp, Rattus norvegicus
aatttgctgatcatcaaagtgctga

SEQ ID NO: 68966 - DNA, 25 bp, Rattus norvegicus
aatttgctgatcttcaaagtgctga

SEQ ID NO: 68967 - DNA, 25 bp, Rattus norvegicus
aatttgctgccacatcgtacggctg

SEQ ID NO: 68968 - DNA, 25 bp, Rattus norvegicus
aatttgctgccagatcgtacggctg

SEQ ID NO: 68969 - DNA, 25 bp, Rattus norvegicus
aatttgctggagacaccagaccctg

SEQ ID NO: 68970 - DNA, 25 bp, Rattus norvegicus
aatttgctggagtcaccagaccctg

SEQ ID NO: 68971 - DNA, 25 bp, Rattus norvegicus
aatttgctggcacatgcccgcctgg

SEQ ID NO: 68972 - DNA, 25 bp, Rattus norvegicus
aatttgctggcagatgcccgcctgg

SEQ ID NO: 68973 - DNA, 25 bp, Rattus norvegicus
aatttgctggctactcgtatactaa

SEQ ID NO: 68974 - DNA, 25 bp, Rattus norvegicus
aatttgctggcttctcgtatactaa

SEQ ID NO: 68975 - DNA, 25 bp, Rattus norvegicus
aatttgctgtagagttagctcccca

SEQ ID NO: 68976 - DNA, 25 bp, Rattus norvegicus
aatttgctgtagtgttagctcccca

SEQ ID NO: 68977 - DNA, 25 bp, Rattus norvegicus
aatttgctgtggagatcggcctggc

SEQ ID NO: 68978 - DNA, 25 bp, Rattus norvegicus
aatttgctgtggtgatcggcctggc

SEQ ID NO: 68979 - DNA, 25 bp, Rattus norvegicus
aatttgcttcctaaggtgctgcttc

SEQ ID NO: 68980 - DNA, 25 bp, Rattus norvegicus
aatttgcttccttaggtgctgcttc

SEQ ID NO: 68981 - DNA, 25 bp, Rattus norvegicus
aatttgcttgtgattaaccttcttg

SEQ ID NO: 68982 - DNA, 25 bp, Rattus norvegicus
aatttgcttgtgtttaaccttcttg

SEQ ID NO: 68983 - DNA, 25 bp, Rattus norvegicus
aatttgctttcacaacttactgatg

SEQ ID NO: 68984 - DNA, 25 bp, Rattus norvegicus
aatttgctttcagaacttactgatg

SEQ ID NO: 68985 - DNA, 25 bp, Rattus norvegicus
aatttgcttttgactgctgagataa

SEQ ID NO: 68986 - DNA, 25 bp, Rattus norvegicus
aatttgcttttgtctgctgagataa

SEQ ID NO: 68987 - DNA, 25 bp, Rattus norvegicus
aatttggacaaaagagcctctggct

SEQ ID NO: 68988 - DNA, 25 bp, Rattus norvegicus
aatttggacaaatgagcctctggct

SEQ ID NO: 68989 - DNA, 25 bp, Rattus norvegicus
aatttggaccagagcacagccagca

SEQ ID NO: 68990 - DNA, 25 bp, Rattus norvegicus
aatttggaccagtgcacagccagca

SEQ ID NO: 68991 - DNA, 25 bp, Rattus norvegicus
aatttggagccaattccatgggtgt

SEQ ID NO: 68992 - DNA, 25 bp, Rattus norvegicus
aatttggagccatttccatgggtgt

SEQ ID NO: 68993 - DNA, 25 bp, Rattus norvegicus
aatttggaggtgatccctgcaggtc

SEQ ID NO: 68994 - DNA, 25 bp, Rattus norvegicus
aatttggaggtgttccctgcaggtc

SEQ ID NO: 68995 - DNA, 25 bp, Rattus norvegicus
aatttggatcacatggcatgctaga

SEQ ID NO: 68996 - DNA, 25 bp, Rattus norvegicus
aatttggatcacttggcatgctaga

SEQ ID NO: 68997 - DNA, 25 bp, Rattus norvegicus
aatttggatccgcaagcaagggtcc

SEQ ID NO: 68998 - DNA, 25 bp, Rattus norvegicus
aatttggatccggaagcaagggtcc

SEQ ID NO: 68999 - DNA, 25 bp, Rattus norvegicus
aatttggatgctatctactggtctg

SEQ ID NO: 69000 - DNA, 25 bp, Rattus norvegicus
aatttggatgctttctactggtctg

SEQ ID NO: 69001 - DNA, 25 bp, Rattus norvegicus
aatttggcaggcatgcagtttatgc

SEQ ID NO: 69002 - DNA, 25 bp, Rattus norvegicus
aatttggcaggcttgcagtttatgc

SEQ ID NO: 69003 - DNA, 25 bp, Rattus norvegicus
aatttggccatgctcgcttccagac

SEQ ID NO: 69004 - DNA, 25 bp, Rattus norvegicus
aatttggccatggtcgcttccagac

SEQ ID NO: 69005 - DNA, 25 bp, Rattus norvegicus
aatttggcggagacatcagcctctc

SEQ ID NO: 69006 - DNA, 25 bp, Rattus norvegicus
aatttggcggagtcatcagcctctc

SEQ ID NO: 69007 - DNA, 25 bp, Rattus norvegicus
aatttggcttttcatgggccgctca

SEQ ID NO: 69008 - DNA, 25 bp, Rattus norvegicus
aatttggcttttgatgggccgctca

SEQ ID NO: 69009 - DNA, 25 bp, Rattus norvegicus
aatttgggcagtatgggctcttgtc

SEQ ID NO: 69010 - DNA, 25 bp, Rattus norvegicus
aatttgggcagtttgggctcttgtc

SEQ ID NO: 69011 - DNA, 25 bp, Rattus norvegicus
aatttgggcatcatgcttactcttt

SEQ ID NO: 69012 - DNA, 25 bp, Rattus norvegicus
aatttgggcatcttgcttactcttt

SEQ ID NO: 69013 - DNA, 25 bp, Rattus norvegicus
aatttgggccctcccaacaggcaga

SEQ ID NO: 69014 - DNA, 25 bp, Rattus norvegicus
aatttgggccctgccaacaggcaga

SEQ ID NO: 69015 - DNA, 25 bp, Rattus norvegicus
aatttgggcctcatgtgataatcac

SEQ ID NO: 69016 - DNA, 25 bp, Rattus norvegicus
aatttgggcctcttgtgataatcac

SEQ ID NO: 69017 - DNA, 25 bp, Rattus norvegicus
aatttgggtagtcttataggtcata

SEQ ID NO: 69018 - DNA, 25 bp, Rattus norvegicus
aatttgggtagtgttataggtcata

SEQ ID NO: 69019 - DNA, 25 bp, Rattus norvegicus
aatttggtcacgagtttgttctaat

SEQ ID NO: 69020 - DNA, 25 bp, Rattus norvegicus
aatttggtcacgtgtttgttctaat

SEQ ID NO: 69021 - DNA, 25 bp, Rattus norvegicus
aatttggtctatacgtacatgtctg

SEQ ID NO: 69022 - DNA, 25 bp, Rattus norvegicus
aatttggtctattcgtacatgtctg

SEQ ID NO: 69023 - DNA, 25 bp, Rattus norvegicus
aatttggttcttataataggctcat

SEQ ID NO: 69024 - DNA, 25 bp, Rattus norvegicus
aatttggttcttttaataggctcat

SEQ ID NO: 69025 - DNA, 25 bp, Rattus norvegicus
aatttggtttcacccaactcaacag

SEQ ID NO: 69026 - DNA, 25 bp, Rattus norvegicus
aatttggtttcagccaactcaacag

SEQ ID NO: 69027 - DNA, 25 bp, Rattus norvegicus
aatttggtttgtctttgtcactggc

SEQ ID NO: 69028 - DNA, 25 bp, Rattus norvegicus
aatttggtttgtgtttgtcactggc

SEQ ID NO: 69029 - DNA, 25 bp, Rattus norvegicus
aatttgtaaagtactggtgcgggca

SEQ ID NO: 69030 - DNA, 25 bp, Rattus norvegicus
aatttgtaaagttctggtgcgggca

SEQ ID NO: 69031 - DNA, 25 bp, Rattus norvegicus
aatttgtaaatcatgcgagtgccca

SEQ ID NO: 69032 - DNA, 25 bp, Rattus norvegicus
aatttgtaaatcttgcgagtgccca

SEQ ID NO: 69033 - DNA, 25 bp, Rattus norvegicus
aatttgtacattatgccgtctggtc

SEQ ID NO: 69034 - DNA, 25 bp, Rattus norvegicus
aatttgtacattttgccgtctggtc

SEQ ID NO: 69035 - DNA, 25 bp, Rattus norvegicus
aatttgtactatccagactgcgggc

SEQ ID NO: 69036 - DNA, 25 bp, Rattus norvegicus
aatttgtactatgcagactgcgggc

SEQ ID NO: 69037 - DNA, 25 bp, Rattus norvegicus
aatttgtactccctcgccattagat

SEQ ID NO: 69038 - DNA, 25 bp, Rattus norvegicus
aatttgtactccgtcgccattagat

SEQ ID NO: 69039 - DNA, 25 bp, Rattus norvegicus
aatttgtacttcataccttgctggc

SEQ ID NO: 69040 - DNA, 25 bp, Rattus norvegicus
aatttgtacttcttaccttgctggc

SEQ ID NO: 69041 - DNA, 25 bp, Rattus norvegicus
aatttgtactttccccaatcatcct

SEQ ID NO: 69042 - DNA, 25 bp, Rattus norvegicus
aatttgtactttgcccaatcatcct

SEQ ID NO: 69043 - DNA, 25 bp, Rattus norvegicus
aatttgtagggcacgcgctgctgaa

SEQ ID NO: 69044 - DNA, 25 bp, Rattus norvegicus
aatttgtagggctcgcgctgctgaa

SEQ ID NO: 69045 - DNA, 25 bp, Rattus norvegicus
aatttgtatgaaactgactgcatga

SEQ ID NO: 69046 - DNA, 25 bp, Rattus norvegicus
aatttgtatgaatctgactgcatga

SEQ ID NO: 69047 - DNA, 25 bp, Rattus norvegicus
aatttgtcacatacggtggcttcta

SEQ ID NO: 69048 - DNA, 25 bp, Rattus norvegicus
aatttgtcacattcggtggcttcta

SEQ ID NO: 69049 - DNA, 25 bp, Rattus norvegicus
aatttgtcactgcactgtctctggg

SEQ ID NO: 69050 - DNA, 25 bp, Rattus norvegicus
aatttgtcactggactgtctctggg

SEQ ID NO: 69051 - DNA, 25 bp, Rattus norvegicus
aatttgtcacttctattctttacag

SEQ ID NO: 69052 - DNA, 25 bp, Rattus norvegicus
aatttgtcacttgtattctttacag

SEQ ID NO: 69053 - DNA, 25 bp, Rattus norvegicus
aatttgtccactagagcctttaact

SEQ ID NO: 69054 - DNA, 25 bp, Rattus norvegicus
aatttgtccacttgagcctttaact

SEQ ID NO: 69055 - DNA, 25 bp, Rattus norvegicus
aatttgtccataatgttcactgtca

SEQ ID NO: 69056 - DNA, 25 bp, Rattus norvegicus
aatttgtccatattgttcactgtca

SEQ ID NO: 69057 - DNA, 25 bp, Rattus norvegicus
aatttgtcccctctcagtgtctgag

SEQ ID NO: 69058 - DNA, 25 bp, Rattus norvegicus
aatttgtcccctgtcagtgtctgag

SEQ ID NO: 69059 - DNA, 25 bp, Rattus norvegicus
aatttgtccttgcacagctgtgttt

SEQ ID NO: 69060 - DNA, 25 bp, Rattus norvegicus
aatttgtccttggacagctgtgttt

SEQ ID NO: 69061 - DNA, 25 bp, Rattus norvegicus
aatttgtctcacagttttcttctgt

SEQ ID NO: 69062 - DNA, 25 bp, Rattus norvegicus
aatttgtctcactgttttcttctgt

SEQ ID NO: 69063 - DNA, 25 bp, Rattus norvegicus
aatttgtctctacctgacataggct

SEQ ID NO: 69064 - DNA, 25 bp, Rattus norvegicus
aatttgtctctagctgacataggct

SEQ ID NO: 69065 - DNA, 25 bp, Rattus norvegicus
aatttgtctggtacaattttggcca

SEQ ID NO: 69066 - DNA, 25 bp, Rattus norvegicus
aatttgtctggttcaattttggcca

SEQ ID NO: 69067 - DNA, 25 bp, Rattus norvegicus
aatttgtcttcacgcttcgtggctc

SEQ ID NO: 69068 - DNA, 25 bp, Rattus norvegicus
aatttgtcttcaggcttcgtggctc

SEQ ID NO: 69069 - DNA, 25 bp, Rattus norvegicus
aatttgtcttcgatctttggctcca

SEQ ID NO: 69070 - DNA, 25 bp, Rattus norvegicus
aatttgtcttcgttctttggctcca

SEQ ID NO: 69071 - DNA, 25 bp, Rattus norvegicus
aatttgtgacccatctcagcacata

SEQ ID NO: 69072 - DNA, 25 bp, Rattus norvegicus
aatttgtgacccttctcagcacata

SEQ ID NO: 69073 - DNA, 25 bp, Rattus norvegicus
aatttgtgagagactgttgccctca

SEQ ID NO: 69074 - DNA, 25 bp, Rattus norvegicus
aatttgtgagagtctgttgccctca

SEQ ID NO: 69075 - DNA, 25 bp, Rattus norvegicus
aatttgtgcatccagaactgattac

SEQ ID NO: 69076 - DNA, 25 bp, Rattus norvegicus
aatttgtgcatcgagaactgattac

SEQ ID NO: 69077 - DNA, 25 bp, Rattus norvegicus
aatttgtgccttacttttccagact

SEQ ID NO: 69078 - DNA, 25 bp, Rattus norvegicus
aatttgtgcctttcttttccagact

SEQ ID NO: 69079 - DNA, 25 bp, Rattus norvegicus
aatttgtgctttcgactgtagttta

SEQ ID NO: 69080 - DNA, 25 bp, Rattus norvegicus
aatttgtgctttggactgtagttta

SEQ ID NO: 69081 - DNA, 25 bp, Rattus norvegicus
aatttgtggcagcatcttgcctcag

SEQ ID NO: 69082 - DNA, 25 bp, Rattus norvegicus
aatttgtggcaggatcttgcctcag

SEQ ID NO: 69083 - DNA, 25 bp, Rattus norvegicus
aatttgtggttcatactgagacagt

SEQ ID NO: 69084 - DNA, 25 bp, Rattus norvegicus
aatttgtggttcctgggtgcctaga

SEQ ID NO: 69085 - DNA, 25 bp, Rattus norvegicus
aatttgtggttcgtgggtgcctaga

SEQ ID NO: 69086 - DNA, 25 bp, Rattus norvegicus
aatttgtggttcttactgagacagt

SEQ ID NO: 69087 - DNA, 25 bp, Rattus norvegicus
aatttgtgtatgactgtccatttat

SEQ ID NO: 69088 - DNA, 25 bp, Rattus norvegicus
aatttgtgtatgtctgtccatttat

SEQ ID NO: 69089 - DNA, 25 bp, Rattus norvegicus
aatttgtgtccaaggtgcggaacct

SEQ ID NO: 69090 - DNA, 25 bp, Rattus norvegicus
aatttgtgtccatggtgcggaacct

SEQ ID NO: 69091 - DNA, 25 bp, Rattus norvegicus
aatttgtgtcgtctaattctccaac

SEQ ID NO: 69092 - DNA, 25 bp, Rattus norvegicus
aatttgtgtcgtgtaattctccaac

SEQ ID NO: 69093 - DNA, 25 bp, Rattus norvegicus
aatttgtgttgaattcccgctgttt

SEQ ID NO: 69094 - DNA, 25 bp, Rattus norvegicus
aatttgtgttgatttcccgctgttt

SEQ ID NO: 69095 - DNA, 25 bp, Rattus norvegicus
aatttgttacacctgtttcgctttg

SEQ ID NO: 69096 - DNA, 25 bp, Rattus norvegicus
aatttgttacacgtgtttcgctttg

SEQ ID NO: 69097 - DNA, 25 bp, Rattus norvegicus
aatttgttcaagctgtcattccaac

SEQ ID NO: 69098 - DNA, 25 bp, Rattus norvegicus
aatttgttcaaggtgtcattccaac

SEQ ID NO: 69099 - DNA, 25 bp, Rattus norvegicus
aatttgttccaaagcagtagtgtgc

SEQ ID NO: 69100 - DNA, 25 bp, Rattus norvegicus
aatttgttccaatgcagtagtgtgc

SEQ ID NO: 69101 - DNA, 25 bp, Rattus norvegicus
aatttgttcctcactgtgtgtatat

SEQ ID NO: 69102 - DNA, 25 bp, Rattus norvegicus
aatttgttcctctctgtgtgtatat

SEQ ID NO: 69103 - DNA, 25 bp, Rattus norvegicus
aatttgtttcataccaagttcctga

SEQ ID NO: 69104 - DNA, 25 bp, Rattus norvegicus
aatttgtttcattccaagttcctga

SEQ ID NO: 69105 - DNA, 25 bp, Rattus norvegicus
aatttgtttctgagttctctgtatc

SEQ ID NO: 69106 - DNA, 25 bp, Rattus norvegicus
aatttgtttctgtgttctctgtatc

SEQ ID NO: 69107 - DNA, 25 bp, Rattus norvegicus
aatttgtttgaaactggcactctag

SEQ ID NO: 69108 - DNA, 25 bp, Rattus norvegicus
aatttgtttgaatctggcactctag

SEQ ID NO: 69109 - DNA, 25 bp, Rattus norvegicus
aatttgttttacatggcgtcctcca

SEQ ID NO: 69110 - DNA, 25 bp, Rattus norvegicus
aatttgttttacttggcgtcctcca

SEQ ID NO: 69111 - DNA, 25 bp, Rattus norvegicus
aattttaaatctcatcctcactcca

SEQ ID NO: 69112 - DNA, 25 bp, Rattus norvegicus
aattttaaatctgatcctcactcca

SEQ ID NO: 69113 - DNA, 25 bp, Rattus norvegicus
aattttaacgacaaccagcctcatg

SEQ ID NO: 69114 - DNA, 25 bp, Rattus norvegicus
aattttaacgactaccagcctcatg

SEQ ID NO: 69115 - DNA, 25 bp, Rattus norvegicus
aattttaactcacaccagcccacag

SEQ ID NO: 69116 - DNA, 25 bp, Rattus norvegicus
aattttaactcagaccagcccacag

SEQ ID NO: 69117 - DNA, 25 bp, Rattus norvegicus
aattttaactttaatggatcttgct

SEQ ID NO: 69118 - DNA, 25 bp, Rattus norvegicus
aattttaacttttatggatcttgct

SEQ ID NO: 69119 - DNA, 25 bp, Rattus norvegicus
aattttaagttaacctgcatgctgt

SEQ ID NO: 69120 - DNA, 25 bp, Rattus norvegicus
aattttaagttatcctgcatgctgt

SEQ ID NO: 69121 - DNA, 25 bp, Rattus norvegicus
aattttacactaatcccatcctctg

SEQ ID NO: 69122 - DNA, 25 bp, Rattus norvegicus
aattttacactattcccatcctctg

SEQ ID NO: 69123 - DNA, 25 bp, Rattus norvegicus
aattttacatgtccgcctgtgtgtg

SEQ ID NO: 69124 - DNA, 25 bp, Rattus norvegicus
aattttacatgtgcgcctgtgtgtg

SEQ ID NO: 69125 - DNA, 25 bp, Rattus norvegicus
aattttagccccagtctcagtacct

SEQ ID NO: 69126 - DNA, 25 bp, Rattus norvegicus
aattttagcccctgtctcagtacct

SEQ ID NO: 69127 - DNA, 25 bp, Rattus norvegicus
aattttagccctatgtgctcactaa

SEQ ID NO: 69128 - DNA, 25 bp, Rattus norvegicus
aattttagccctttgtgctcactaa

SEQ ID NO: 69129 - DNA, 25 bp, Rattus norvegicus
aattttagcctaaatcattggttta

SEQ ID NO: 69130 - DNA, 25 bp, Rattus norvegicus
aattttagcctatatcattggttta

SEQ ID NO: 69131 - DNA, 25 bp, Rattus norvegicus
aattttaggttcagctctgtacttc

SEQ ID NO: 69132 - DNA, 25 bp, Rattus norvegicus
aattttaggttctgctctgtacttc

SEQ ID NO: 69133 - DNA, 25 bp, Rattus norvegicus
aattttataggtcgttcatgtgcaa

SEQ ID NO: 69134 - DNA, 25 bp, Rattus norvegicus
aattttataggtggttcatgtgcaa

SEQ ID NO: 69135 - DNA, 25 bp, Rattus norvegicus
aattttatatgcctccacacctcag

SEQ ID NO: 69136 - DNA, 25 bp, Rattus norvegicus
aattttatatgcgtccacacctcag

SEQ ID NO: 69137 - DNA, 25 bp, Rattus norvegicus
aattttatccacatggctgcaaatg

SEQ ID NO: 69138 - DNA, 25 bp, Rattus norvegicus
aattttatccacttggctgcaaatg

SEQ ID NO: 69139 - DNA, 25 bp, Rattus norvegicus
aattttatccctcatgtaaactgga

SEQ ID NO: 69140 - DNA, 25 bp, Rattus norvegicus
aattttatccctgatgtaaactgga

SEQ ID NO: 69141 - DNA, 25 bp, Rattus norvegicus
aattttatcctgaacttggtgccca

SEQ ID NO: 69142 - DNA, 25 bp, Rattus norvegicus
aattttatcctgtacttggtgccca

SEQ ID NO: 69143 - DNA, 25 bp, Rattus norvegicus
aattttatcttgacctttacatcag

SEQ ID NO: 69144 - DNA, 25 bp, Rattus norvegicus
aattttatcttgtcctttacatcag

SEQ ID NO: 69145 - DNA, 25 bp, Rattus norvegicus
aattttatgctaactgctaggttta

SEQ ID NO: 69146 - DNA, 25 bp, Rattus norvegicus
aattttatgctatctgctaggttta

SEQ ID NO: 69147 - DNA, 25 bp, Rattus norvegicus
aattttatgtcacagggcaggtccc

SEQ ID NO: 69148 - DNA, 25 bp, Rattus norvegicus
aattttatgtcagagggcaggtccc

SEQ ID NO: 69149 - DNA, 25 bp, Rattus norvegicus
aattttatgtgtcacttgtttctta

SEQ ID NO: 69150 - DNA, 25 bp, Rattus norvegicus
aattttatgtgtgacttgtttctta

SEQ ID NO: 69151 - DNA, 25 bp, Rattus norvegicus
aattttattcagagccgggactcca

SEQ ID NO: 69152 - DNA, 25 bp, Rattus norvegicus
aattttattcagatccttgggctgg

SEQ ID NO: 69153 - DNA, 25 bp, Rattus norvegicus
aattttattcagtgccgggactcca

SEQ ID NO: 69154 - DNA, 25 bp, Rattus norvegicus
aattttattcagttccttgggctgg

SEQ ID NO: 69155 - DNA, 25 bp, Rattus norvegicus
aattttattcttcttgatgcctaag

SEQ ID NO: 69156 - DNA, 25 bp, Rattus norvegicus
aattttattcttgttgatgcctaag

SEQ ID NO: 69157 - DNA, 25 bp, Rattus norvegicus
aattttatttctcttgctggcaccc

SEQ ID NO: 69158 - DNA, 25 bp, Rattus norvegicus
aattttatttctgttgctggcaccc

SEQ ID NO: 69159 - DNA, 25 bp, Rattus norvegicus
aattttatttggctctgcagcaggt

SEQ ID NO: 69160 - DNA, 25 bp, Rattus norvegicus
aattttatttgggtctgcagcaggt

SEQ ID NO: 69161 - DNA, 25 bp, Rattus norvegicus
aattttcaaatacgtagccgctgta

SEQ ID NO: 69162 - DNA, 25 bp, Rattus norvegicus
aattttcaaataggtagccgctgta

SEQ ID NO: 69163 - DNA, 25 bp, Rattus norvegicus
aattttcagactagagtacggtggc

SEQ ID NO: 69164 - DNA, 25 bp, Rattus norvegicus
aattttcagacttgagtacggtggc

SEQ ID NO: 69165 - DNA, 25 bp, Rattus norvegicus
aattttcagagaccaatggttttca

SEQ ID NO: 69166 - DNA, 25 bp, Rattus norvegicus
aattttcagagagcaatggttttca

SEQ ID NO: 69167 - DNA, 25 bp, Rattus norvegicus
aattttcaggacctggaacagccgg

SEQ ID NO: 69168 - DNA, 25 bp, Rattus norvegicus
aattttcaggacgtggaacagccgg

SEQ ID NO: 69169 - DNA, 25 bp, Rattus norvegicus
aattttcagtttctggttggccaga

SEQ ID NO: 69170 - DNA, 25 bp, Rattus norvegicus
aattttcagtttgtggttggccaga

SEQ ID NO: 69171 - DNA, 25 bp, Rattus norvegicus
aattttcataccaggatttccttat

SEQ ID NO: 69172 - DNA, 25 bp, Rattus norvegicus
aattttcatacctggatttccttat

SEQ ID NO: 69173 - DNA, 25 bp, Rattus norvegicus
aattttcatcctcctgggaattctc

SEQ ID NO: 69174 - DNA, 25 bp, Rattus norvegicus
aattttcatcctgctgggaattctc

SEQ ID NO: 69175 - DNA, 25 bp, Rattus norvegicus
aattttcatgtaactccagcctgga

SEQ ID NO: 69176 - DNA, 25 bp, Rattus norvegicus
aattttcatgtatctccagcctgga

SEQ ID NO: 69177 - DNA, 25 bp, Rattus norvegicus
aattttccaagtagataggctcatg

SEQ ID NO: 69178 - DNA, 25 bp, Rattus norvegicus
aattttccaagttgataggctcatg

SEQ ID NO: 69179 - DNA, 25 bp, Rattus norvegicus
aattttccaccaactgaggatctta

SEQ ID NO: 69180 - DNA, 25 bp, Rattus norvegicus
aattttccaccatctgaggatctta

SEQ ID NO: 69181 - DNA, 25 bp, Rattus norvegicus
aattttccagatctctccagcaatg

SEQ ID NO: 69182 - DNA, 25 bp, Rattus norvegicus
aattttccagatgtctccagcaatg

SEQ ID NO: 69183 - DNA, 25 bp, Rattus norvegicus
aattttccatagactctcacaggct

SEQ ID NO: 69184 - DNA, 25 bp, Rattus norvegicus
aattttccatagtctctcacaggct

SEQ ID NO: 69185 - DNA, 25 bp, Rattus norvegicus
aattttccatttagacctcatctcc

SEQ ID NO: 69186 - DNA, 25 bp, Rattus norvegicus
aattttccatttcttctgcattttg

SEQ ID NO: 69187 - DNA, 25 bp, Rattus norvegicus
aattttccatttgttctgcattttg

SEQ ID NO: 69188 - DNA, 25 bp, Rattus norvegicus
aattttccattttgacctcatctcc

SEQ ID NO: 69189 - DNA, 25 bp, Rattus norvegicus
aattttcctaccaagcactagtgct

SEQ ID NO: 69190 - DNA, 25 bp, Rattus norvegicus
aattttcctacctagcactagtgct

SEQ ID NO: 69191 - DNA, 25 bp, Rattus norvegicus
aattttcctgaacctttgcctgagc

SEQ ID NO: 69192 - DNA, 25 bp, Rattus norvegicus
aattttcctgaagctttgcctgagc

SEQ ID NO: 69193 - DNA, 25 bp, Rattus norvegicus
aattttctacatctgtgcctaccgg

SEQ ID NO: 69194 - DNA, 25 bp, Rattus norvegicus
aattttctacatgtgtgcctaccgg

SEQ ID NO: 69195 - DNA, 25 bp, Rattus norvegicus
aattttctagttaggaggtcacaga

SEQ ID NO: 69196 - DNA, 25 bp, Rattus norvegicus
aattttctagtttggaggtcacaga

SEQ ID NO: 69197 - DNA, 25 bp, Rattus norvegicus
aattttctccccatcaaatgagcat

SEQ ID NO: 69198 - DNA, 25 bp, Rattus norvegicus
aattttctccccttcaaatgagcat

SEQ ID NO: 69199 - DNA, 25 bp, Rattus norvegicus
aattttctcttcatgttgttcccgg

SEQ ID NO: 69200 - DNA, 25 bp, Rattus norvegicus
aattttctcttcttgttgttcccgg

SEQ ID NO: 69201 - DNA, 25 bp, Rattus norvegicus
aattttctgactaagacgctcatca

SEQ ID NO: 69202 - DNA, 25 bp, Rattus norvegicus
aattttctgacttagacgctcatca

SEQ ID NO: 69203 - DNA, 25 bp, Rattus norvegicus
aattttctgtacaccaattccaggg

SEQ ID NO: 69204 - DNA, 25 bp, Rattus norvegicus
aattttctgtactccaattccaggg

SEQ ID NO: 69205 - DNA, 25 bp, Rattus norvegicus
aattttctgtatccacttctgttta

SEQ ID NO: 69206 - DNA, 25 bp, Rattus norvegicus
aattttctgtatgcacttctgttta

SEQ ID NO: 69207 - DNA, 25 bp, Rattus norvegicus
aattttctgtgcatatttctgttac

SEQ ID NO: 69208 - DNA, 25 bp, Rattus norvegicus
aattttctgtgcttatttctgttac

SEQ ID NO: 69209 - DNA, 25 bp, Rattus norvegicus
aattttcttattctgtgtgggatat

SEQ ID NO: 69210 - DNA, 25 bp, Rattus norvegicus
aattttcttattgtgtgtgggatat

SEQ ID NO: 69211 - DNA, 25 bp, Rattus norvegicus
aattttctttgtcactgtagctcct

SEQ ID NO: 69212 - DNA, 25 bp, Rattus norvegicus
aattttctttgtgactgtagctcct

SEQ ID NO: 69213 - DNA, 25 bp, Rattus norvegicus
aattttgaaatccaagagcacttaa

SEQ ID NO: 69214 - DNA, 25 bp, Rattus norvegicus
aattttgaaatcgaagagcacttaa

SEQ ID NO: 69215 - DNA, 25 bp, Rattus norvegicus
aattttgaatgtcacccaatatgaa

SEQ ID NO: 69216 - DNA, 25 bp, Rattus norvegicus
aattttgaatgtgacccaatatgaa

SEQ ID NO: 69217 - DNA, 25 bp, Rattus norvegicus
aattttgacaaacagcttcagcagt

SEQ ID NO: 69218 - DNA, 25 bp, Rattus norvegicus
aattttgacaaagagcttcagcagt

SEQ ID NO: 69219 - DNA, 25 bp, Rattus norvegicus
aattttgaccccattcctgtatgtg

SEQ ID NO: 69220 - DNA, 25 bp, Rattus norvegicus
aattttgacccctttcctgtatgtg

SEQ ID NO: 69221 - DNA, 25 bp, Rattus norvegicus
aattttgaggtcacagggcttccct

SEQ ID NO: 69222 - DNA, 25 bp, Rattus norvegicus
aattttgaggtctcagggcttccct

SEQ ID NO: 69223 - DNA, 25 bp, Rattus norvegicus
aattttgagtacagcctaactgtca

SEQ ID NO: 69224 - DNA, 25 bp, Rattus norvegicus
aattttgagtactgcctaactgtca

SEQ ID NO: 69225 - DNA, 25 bp, Rattus norvegicus
aattttgatcatcccttcattcctc

SEQ ID NO: 69226 - DNA, 25 bp, Rattus norvegicus
aattttgatcatgccttcattcctc

SEQ ID NO: 69227 - DNA, 25 bp, Rattus norvegicus
aattttgatctcaggagcggcctca

SEQ ID NO: 69228 - DNA, 25 bp, Rattus norvegicus
aattttgatctctggagcggcctca

SEQ ID NO: 69229 - DNA, 25 bp, Rattus norvegicus
aattttgatgccagtctgggccata

SEQ ID NO: 69230 - DNA, 25 bp, Rattus norvegicus
aattttgatgcctgtctgggccata

SEQ ID NO: 69231 - DNA, 25 bp, Rattus norvegicus
aattttgattttctagcctttgagc

SEQ ID NO: 69232 - DNA, 25 bp, Rattus norvegicus
aattttgattttgtagcctttgagc

SEQ ID NO: 69233 - DNA, 25 bp, Rattus norvegicus
aattttgcacttagttagtctctta

SEQ ID NO: 69234 - DNA, 25 bp, Rattus norvegicus
aattttgcactttgttagtctctta

SEQ ID NO: 69235 - DNA, 25 bp, Rattus norvegicus
aattttgcatacagggctgctgggc

SEQ ID NO: 69236 - DNA, 25 bp, Rattus norvegicus
aattttgcatactgggctgctgggc

SEQ ID NO: 69237 - DNA, 25 bp, Rattus norvegicus
aattttgccattacttgtggcctct

SEQ ID NO: 69238 - DNA, 25 bp, Rattus norvegicus
aattttgccatttcttgtggcctct

SEQ ID NO: 69239 - DNA, 25 bp, Rattus norvegicus
aattttgccggtacggagctgctga

SEQ ID NO: 69240 - DNA, 25 bp, Rattus norvegicus
aattttgccggttcggagctgctga

SEQ ID NO: 69241 - DNA, 25 bp, Rattus norvegicus
aattttgccttaaacattgtgcctt

SEQ ID NO: 69242 - DNA, 25 bp, Rattus norvegicus
aattttgccttatacattgtgcctt

SEQ ID NO: 69243 - DNA, 25 bp, Rattus norvegicus
aattttgctaacactcagctctgcc

SEQ ID NO: 69244 - DNA, 25 bp, Rattus norvegicus
aattttgctaactctcagctctgcc

SEQ ID NO: 69245 - DNA, 25 bp, Rattus norvegicus
aattttgctactattacaggttata

SEQ ID NO: 69246 - DNA, 25 bp, Rattus norvegicus
aattttgctacttttacaggttata

SEQ ID NO: 69247 - DNA, 25 bp, Rattus norvegicus
aattttgcttcaacatttgctctct

SEQ ID NO: 69248 - DNA, 25 bp, Rattus norvegicus
aattttgcttcatcatttgctctct

SEQ ID NO: 69249 - DNA, 25 bp, Rattus norvegicus
aattttgctttaaccaaagtctcat

SEQ ID NO: 69250 - DNA, 25 bp, Rattus norvegicus
aattttgctttatccaaagtctcat

SEQ ID NO: 69251 - DNA, 25 bp, Rattus norvegicus
aattttggacctatgtacttctgca

SEQ ID NO: 69252 - DNA, 25 bp, Rattus norvegicus
aattttggacctttgtacttctgca

SEQ ID NO: 69253 - DNA, 25 bp, Rattus norvegicus
aattttggacttactatgccctgtt

SEQ ID NO: 69254 - DNA, 25 bp, Rattus norvegicus
aattttggactttctatgccctgtt

SEQ ID NO: 69255 - DNA, 25 bp, Rattus norvegicus
aattttggagacctaggccgcccag

SEQ ID NO: 69256 - DNA, 25 bp, Rattus norvegicus
aattttggagacgtaggccgcccag

SEQ ID NO: 69257 - DNA, 25 bp, Rattus norvegicus
aattttggatcacctgtacagctgc

SEQ ID NO: 69258 - DNA, 25 bp, Rattus norvegicus
aattttggatcagctgtacagctgc

SEQ ID NO: 69259 - DNA, 25 bp, Rattus norvegicus
aattttggctgacacacttacgggt

SEQ ID NO: 69260 - DNA, 25 bp, Rattus norvegicus
aattttggctgagacacttacgggt

SEQ ID NO: 69261 - DNA, 25 bp, Rattus norvegicus
aattttgggccaaggtctcactttg

SEQ ID NO: 69262 - DNA, 25 bp, Rattus norvegicus
aattttgggccatggtctcactttg

SEQ ID NO: 69263 - DNA, 25 bp, Rattus norvegicus
aattttgggcccagaattcactggg

SEQ ID NO: 69264 - DNA, 25 bp, Rattus norvegicus
aattttgggccctgaattcactggg

SEQ ID NO: 69265 - DNA, 25 bp, Rattus norvegicus
aattttgggctaccgatttgccctc

SEQ ID NO: 69266 - DNA, 25 bp, Rattus norvegicus
aattttgggctagcgatttgccctc

SEQ ID NO: 69267 - DNA, 25 bp, Rattus norvegicus
aattttgggtctctgtcattggctc

SEQ ID NO: 69268 - DNA, 25 bp, Rattus norvegicus
aattttgggtctgtgtcattggctc

SEQ ID NO: 69269 - DNA, 25 bp, Rattus norvegicus
aattttggtggtactcttgagtttg

SEQ ID NO: 69270 - DNA, 25 bp, Rattus norvegicus
aattttggtggttctcttgagtttg

SEQ ID NO: 69271 - DNA, 25 bp, Rattus norvegicus
aattttgtatctatggtcttcctgt

SEQ ID NO: 69272 - DNA, 25 bp, Rattus norvegicus
aattttgtatctttggtcttcctgt

SEQ ID NO: 69273 - DNA, 25 bp, Rattus norvegicus
aattttgtcacaaaacccgtatatt

SEQ ID NO: 69274 - DNA, 25 bp, Rattus norvegicus
aattttgtcacataacccgtatatt

SEQ ID NO: 69275 - DNA, 25 bp, Rattus norvegicus
aattttgtctccacagttccattat

SEQ ID NO: 69276 - DNA, 25 bp, Rattus norvegicus
aattttgtctcctcagttccattat

SEQ ID NO: 69277 - DNA, 25 bp, Rattus norvegicus
aattttgtctgcagggtgctccctg

SEQ ID NO: 69278 - DNA, 25 bp, Rattus norvegicus
aattttgtctgctgggtgctccctg

SEQ ID NO: 69279 - DNA, 25 bp, Rattus norvegicus
aattttgtcttgcatattcttgaaa

SEQ ID NO: 69280 - DNA, 25 bp, Rattus norvegicus
aattttgtcttggatattcttgaaa

SEQ ID NO: 69281 - DNA, 25 bp, Rattus norvegicus
aattttgtggaaatgcatgcgcata

SEQ ID NO: 69282 - DNA, 25 bp, Rattus norvegicus
aattttgtggaattgcatgcgcata

SEQ ID NO: 69283 - DNA, 25 bp, Rattus norvegicus
aattttgtggctcagctcagggtct

SEQ ID NO: 69284 - DNA, 25 bp, Rattus norvegicus
aattttgtggctgagctcagggtct

SEQ ID NO: 69285 - DNA, 25 bp, Rattus norvegicus
aattttgtgtggagcccttgtcttt

SEQ ID NO: 69286 - DNA, 25 bp, Rattus norvegicus
aattttgtgtggtgcccttgtcttt

SEQ ID NO: 69287 - DNA, 25 bp, Rattus norvegicus
aattttgtttgaataagcacttagc

SEQ ID NO: 69288 - DNA, 25 bp, Rattus norvegicus
aattttgtttgattaagcacttagc

SEQ ID NO: 69289 - DNA, 25 bp, Rattus norvegicus
aattttgtttgtcctgcagctgtag

SEQ ID NO: 69290 - DNA, 25 bp, Rattus norvegicus
aattttgtttgtgctgcagctgtag

SEQ ID NO: 69291 - DNA, 25 bp, Rattus norvegicus
aattttgttttgagggctcttatgc

SEQ ID NO: 69292 - DNA, 25 bp, Rattus norvegicus
aattttgttttgtgggctcttatgc

SEQ ID NO: 69293 - DNA, 25 bp, Rattus norvegicus
aattttgtttttcttgcctctgtgt

SEQ ID NO: 69294 - DNA, 25 bp, Rattus norvegicus
aattttgtttttgttgcctctgtgt

SEQ ID NO: 69295 - DNA, 25 bp, Rattus norvegicus
aatttttaatccagcagtctcctca

SEQ ID NO: 69296 - DNA, 25 bp, Rattus norvegicus
aatttttaatcctgcagtctcctca

SEQ ID NO: 69297 - DNA, 25 bp, Rattus norvegicus
aatttttacagactctagtgcacca

SEQ ID NO: 69298 - DNA, 25 bp, Rattus norvegicus
aatttttacagagtctagtgcacca

SEQ ID NO: 69299 - DNA, 25 bp, Rattus norvegicus
aatttttactcaccaggattcagcc

SEQ ID NO: 69300 - DNA, 25 bp, Rattus norvegicus
aatttttactcagcaggattcagcc

SEQ ID NO: 69301 - DNA, 25 bp, Rattus norvegicus
aatttttactcccttccatcttcat

SEQ ID NO: 69302 - DNA, 25 bp, Rattus norvegicus
aatttttactccgttccatcttcat

SEQ ID NO: 69303 - DNA, 25 bp, Rattus norvegicus
aatttttagttcattgtccctgatg

SEQ ID NO: 69304 - DNA, 25 bp, Rattus norvegicus
aatttttagttctttgtccctgatg

SEQ ID NO: 69305 - DNA, 25 bp, Rattus norvegicus
aatttttatcaacgccccaggatct

SEQ ID NO: 69306 - DNA, 25 bp, Rattus norvegicus
aatttttatcaaggccccaggatct

SEQ ID NO: 69307 - DNA, 25 bp, Rattus norvegicus
aatttttatgtcatagccatcttca

SEQ ID NO: 69308 - DNA, 25 bp, Rattus norvegicus
aatttttatgtcattgctcgtgggc

SEQ ID NO: 69309 - DNA, 25 bp, Rattus norvegicus
aatttttatgtcttagccatcttca

SEQ ID NO: 69310 - DNA, 25 bp, Rattus norvegicus
aatttttatgtctttgctcgtgggc

SEQ ID NO: 69311 - DNA, 25 bp, Rattus norvegicus
aatttttatgtgctgtcttcgtctc

SEQ ID NO: 69312 - DNA, 25 bp, Rattus norvegicus
aatttttatgtggtgtcttcgtctc

SEQ ID NO: 69313 - DNA, 25 bp, Rattus norvegicus
aatttttattacatggtgaccagca

SEQ ID NO: 69314 - DNA, 25 bp, Rattus norvegicus
aatttttattacttggtgaccagca

SEQ ID NO: 69315 - DNA, 25 bp, Rattus norvegicus
aatttttattcactactttcattat

SEQ ID NO: 69316 - DNA, 25 bp, Rattus norvegicus
aatttttattcagtactttcattat

SEQ ID NO: 69317 - DNA, 25 bp, Rattus norvegicus
aatttttatttcctctagccttgct

SEQ ID NO: 69318 - DNA, 25 bp, Rattus norvegicus
aatttttatttcgtctagccttgct

SEQ ID NO: 69319 - DNA, 25 bp, Rattus norvegicus
aatttttcaagcacgtgggcagaac

SEQ ID NO: 69320 - DNA, 25 bp, Rattus norvegicus
aatttttcaagctcgtgggcagaac

SEQ ID NO: 69321 - DNA, 25 bp, Rattus norvegicus
aatttttcacctctcttggttctga

SEQ ID NO: 69322 - DNA, 25 bp, Rattus norvegicus
aatttttcacctgtcttggttctga

SEQ ID NO: 69323 - DNA, 25 bp, Rattus norvegicus
aatttttcaggaaccagccagtctc

SEQ ID NO: 69324 - DNA, 25 bp, Rattus norvegicus
aatttttcaggatccagccagtctc

SEQ ID NO: 69325 - DNA, 25 bp, Rattus norvegicus
aatttttccaaacatttgctttgct

SEQ ID NO: 69326 - DNA, 25 bp, Rattus norvegicus
aatttttccaaagatttgctttgct

SEQ ID NO: 69327 - DNA, 25 bp, Rattus norvegicus
aatttttccatcatagcctcgcttg

SEQ ID NO: 69328 - DNA, 25 bp, Rattus norvegicus
aatttttccatcttagcctcgcttg

SEQ ID NO: 69329 - DNA, 25 bp, Rattus norvegicus
aatttttctcagactttccgcattg

SEQ ID NO: 69330 - DNA, 25 bp, Rattus norvegicus
aatttttctcagtctttccgcattg

SEQ ID NO: 69331 - DNA, 25 bp, Rattus norvegicus
aatttttctctgacaagcttgaact

SEQ ID NO: 69332 - DNA, 25 bp, Rattus norvegicus
aatttttctctgtcaagcttgaact

SEQ ID NO: 69333 - DNA, 25 bp, Rattus norvegicus
aatttttctggtctccttcacgtct

SEQ ID NO: 69334 - DNA, 25 bp, Rattus norvegicus
aatttttctggtgtccttcacgtct

SEQ ID NO: 69335 - DNA, 25 bp, Rattus norvegicus
aatttttcttagagcttgccctttg

SEQ ID NO: 69336 - DNA, 25 bp, Rattus norvegicus
aatttttcttagagtccatcttagc

SEQ ID NO: 69337 - DNA, 25 bp, Rattus norvegicus
aatttttcttagtgcttgccctttg

SEQ ID NO: 69338 - DNA, 25 bp, Rattus norvegicus
aatttttcttagtgtccatcttagc

SEQ ID NO: 69339 - DNA, 25 bp, Rattus norvegicus
aatttttcttggcttcattctggca

SEQ ID NO: 69340 - DNA, 25 bp, Rattus norvegicus
aatttttcttgggttcattctggca

SEQ ID NO: 69341 - DNA, 25 bp, Rattus norvegicus
aatttttgaggtatgggctgggcac

SEQ ID NO: 69342 - DNA, 25 bp, Rattus norvegicus
aatttttgaggtttgggctgggcac

SEQ ID NO: 69343 - DNA, 25 bp, Rattus norvegicus
aatttttgcttgagttggtggcgcc

SEQ ID NO: 69344 - DNA, 25 bp, Rattus norvegicus
aatttttgcttgtgttggtggcgcc

SEQ ID NO: 69345 - DNA, 25 bp, Rattus norvegicus
aatttttggctcactgcctttatga

SEQ ID NO: 69346 - DNA, 25 bp, Rattus norvegicus
aatttttggctctctgcctttatga

SEQ ID NO: 69347 - DNA, 25 bp, Rattus norvegicus
aatttttgtattacatgaactctaa

SEQ ID NO: 69348 - DNA, 25 bp, Rattus norvegicus
aatttttgtatttcatgaactctaa

SEQ ID NO: 69349 - DNA, 25 bp, Rattus norvegicus
aatttttgtctaatatggccattca

SEQ ID NO: 69350 - DNA, 25 bp, Rattus norvegicus
aatttttgtctattatggccattca

SEQ ID NO: 69351 - DNA, 25 bp, Rattus norvegicus
aatttttgtcttacagtctctgtaa

SEQ ID NO: 69352 - DNA, 25 bp, Rattus norvegicus
aatttttgtctttcagtctctgtaa

SEQ ID NO: 69353 - DNA, 25 bp, Rattus norvegicus
aatttttgtgctctttttcctgtgt

SEQ ID NO: 69354 - DNA, 25 bp, Rattus norvegicus
aatttttgtgctgtttttcctgtgt

SEQ ID NO: 69355 - DNA, 25 bp, Rattus norvegicus
aatttttgtggtaccgtggtatgca

SEQ ID NO: 69356 - DNA, 25 bp, Rattus norvegicus
aatttttgtggttccgtggtatgca

SEQ ID NO: 69357 - DNA, 25 bp, Rattus norvegicus
aattttttaggaaccacttgtgcat

SEQ ID NO: 69358 - DNA, 25 bp, Rattus norvegicus
aattttttaggatccacttgtgcat

SEQ ID NO: 69359 - DNA, 25 bp, Rattus norvegicus
aattttttcactcactctcttctca

SEQ ID NO: 69360 - DNA, 25 bp, Rattus norvegicus
aattttttcactgactctcttctca

SEQ ID NO: 69361 - DNA, 25 bp, Rattus norvegicus
aattttttgcttctgatatccttga

SEQ ID NO: 69362 - DNA, 25 bp, Rattus norvegicus
aattttttgcttgtgatatccttga

SEQ ID NO: 69363 - DNA, 25 bp, Rattus norvegicus
acaaaaacatccagagcagcggcgc

SEQ ID NO: 69364 - DNA, 25 bp, Rattus norvegicus
acaaaaacatcctgagcagcggcgc

SEQ ID NO: 69365 - DNA, 25 bp, Rattus norvegicus
acaaaaaccttgatggctgcctgaa

SEQ ID NO: 69366 - DNA, 25 bp, Rattus norvegicus
acaaaaaccttgttggctgcctgaa

SEQ ID NO: 69367 - DNA, 25 bp, Rattus norvegicus
acaaaaacgtcgcagagaagcagag

SEQ ID NO: 69368 - DNA, 25 bp, Rattus norvegicus
acaaaaacgtcggagagaagcagag

SEQ ID NO: 69369 - DNA, 25 bp, Rattus norvegicus
acaaaaagctgtcgcgcccattgtg

SEQ ID NO: 69370 - DNA, 25 bp, Rattus norvegicus
acaaaaagctgtggcgcccattgtg

SEQ ID NO: 69371 - DNA, 25 bp, Rattus norvegicus
acaaaaagtaggagctctctctggg

SEQ ID NO: 69372 - DNA, 25 bp, Rattus norvegicus
acaaaaagtaggtgctctctctggg

SEQ ID NO: 69373 - DNA, 25 bp, Rattus norvegicus
acaaaaatgggcacttcaccgcgga

SEQ ID NO: 69374 - DNA, 25 bp, Rattus norvegicus
acaaaaatgggctcttcaccgcgga

SEQ ID NO: 69375 - DNA, 25 bp, Rattus norvegicus
acaaaaatgtcactttcctggacct

SEQ ID NO: 69376 - DNA, 25 bp, Rattus norvegicus
acaaaaatgtcagtttcctggacct

SEQ ID NO: 69377 - DNA, 25 bp, Rattus norvegicus
acaaaacaaggcattctctacccct

SEQ ID NO: 69378 - DNA, 25 bp, Rattus norvegicus
acaaaacaaggctttctctacccct

SEQ ID NO: 69379 - DNA, 25 bp, Rattus norvegicus
acaaaacacgccaacgtgccaaact

SEQ ID NO: 69380 - DNA, 25 bp, Rattus norvegicus
acaaaacacgcctacgtgccaaact

SEQ ID NO: 69381 - DNA, 25 bp, Rattus norvegicus
acaaaacactgtaggagggcgatat

SEQ ID NO: 69382 - DNA, 25 bp, Rattus norvegicus
acaaaacactgttggagggcgatat

SEQ ID NO: 69383 - DNA, 25 bp, Rattus norvegicus
acaaaacagcagagaatgaacggtg

SEQ ID NO: 69384 - DNA, 25 bp, Rattus norvegicus
acaaaacagcagtgaatgaacggtg

SEQ ID NO: 69385 - DNA, 25 bp, Rattus norvegicus
acaaaacagctcaaatctacctcac

SEQ ID NO: 69386 - DNA, 25 bp, Rattus norvegicus
acaaaacagctctaatctacctcac

SEQ ID NO: 69387 - DNA, 25 bp, Rattus norvegicus
acaaaacaggaaatgccccagacgt

SEQ ID NO: 69388 - DNA, 25 bp, Rattus norvegicus
acaaaacaggaattgccccagacgt

SEQ ID NO: 69389 - DNA, 25 bp, Rattus norvegicus
acaaaacatactacaaacatttcag

SEQ ID NO: 69390 - DNA, 25 bp, Rattus norvegicus
acaaaacatacttcaaacatttcag

SEQ ID NO: 69391 - DNA, 25 bp, Rattus norvegicus
acaaaacatgttctcagtctccaaa

SEQ ID NO: 69392 - DNA, 25 bp, Rattus norvegicus
acaaaacatgttgtcagtctccaaa

SEQ ID NO: 69393 - DNA, 25 bp, Rattus norvegicus
acaaaaccagacagatgatccctgg

SEQ ID NO: 69394 - DNA, 25 bp, Rattus norvegicus
acaaaaccagactgatgatccctgg

SEQ ID NO: 69395 - DNA, 25 bp, Rattus norvegicus
acaaaaccaggccagtaccggagca

SEQ ID NO: 69396 - DNA, 25 bp, Rattus norvegicus
acaaaaccaggcgagtaccggagca

SEQ ID NO: 69397 - DNA, 25 bp, Rattus norvegicus
acaaaaccctgcatctcttagagtg

SEQ ID NO: 69398 - DNA, 25 bp, Rattus norvegicus
acaaaaccctgcttctcttagagtg

SEQ ID NO: 69399 - DNA, 25 bp, Rattus norvegicus
acaaaaccgctcacaactcaacgtt

SEQ ID NO: 69400 - DNA, 25 bp, Rattus norvegicus
acaaaaccgctctcaactcaacgtt

SEQ ID NO: 69401 - DNA, 25 bp, Rattus norvegicus
acaaaacctattccagggcctggcc

SEQ ID NO: 69402 - DNA, 25 bp, Rattus norvegicus
acaaaacctattgcagggcctggcc

SEQ ID NO: 69403 - DNA, 25 bp, Rattus norvegicus
acaaaacctggaagctccgggatct

SEQ ID NO: 69404 - DNA, 25 bp, Rattus norvegicus
acaaaacctggatgctccgggatct

SEQ ID NO: 69405 - DNA, 25 bp, Rattus norvegicus
acaaaacgggctagcgagatcctgc

SEQ ID NO: 69406 - DNA, 25 bp, Rattus norvegicus
acaaaacgggcttgcgagatcctgc

SEQ ID NO: 69407 - DNA, 25 bp, Rattus norvegicus
acaaaactgttcctctattgtccct

SEQ ID NO: 69408 - DNA, 25 bp, Rattus norvegicus
acaaaactgttcgtctattgtccct

SEQ ID NO: 69409 - DNA, 25 bp, Rattus norvegicus
acaaaagatgacagcggccccagtg

SEQ ID NO: 69410 - DNA, 25 bp, Rattus norvegicus
acaaaagatgactgcggccccagtg

SEQ ID NO: 69411 - DNA, 25 bp, Rattus norvegicus
acaaaagcacaacacacagattacg

SEQ ID NO: 69412 - DNA, 25 bp, Rattus norvegicus
acaaaagcacaagacacagattacg

SEQ ID NO: 69413 - DNA, 25 bp, Rattus norvegicus
acaaaagcatgcattccctgtccat

SEQ ID NO: 69414 - DNA, 25 bp, Rattus norvegicus
acaaaagcatgctttccctgtccat

SEQ ID NO: 69415 - DNA, 25 bp, Rattus norvegicus
acaaaagcgcggaccgcagccgggt

SEQ ID NO: 69416 - DNA, 25 bp, Rattus norvegicus
acaaaagcgcggtccgcagccgggt

SEQ ID NO: 69417 - DNA, 25 bp, Rattus norvegicus
acaaaagctatcctattttcattta

SEQ ID NO: 69418 - DNA, 25 bp, Rattus norvegicus
acaaaagctatcgtattttcattta

SEQ ID NO: 69419 - DNA, 25 bp, Rattus norvegicus
acaaaagcttctcgtcttcttgaga

SEQ ID NO: 69420 - DNA, 25 bp, Rattus norvegicus
acaaaagcttctggtcttcttgaga

SEQ ID NO: 69421 - DNA, 25 bp, Rattus norvegicus
acaaaaggcgttactgatccttcaa

SEQ ID NO: 69422 - DNA, 25 bp, Rattus norvegicus
acaaaaggcgtttctgatccttcaa

SEQ ID NO: 69423 - DNA, 25 bp, Rattus norvegicus
acaaaaggtggcatccagtcacgtc

SEQ ID NO: 69424 - DNA, 25 bp, Rattus norvegicus
acaaaaggtggcttccagtcacgtc

SEQ ID NO: 69425 - DNA, 25 bp, Rattus norvegicus
acaaaagtagttcgtcacctcacac

SEQ ID NO: 69426 - DNA, 25 bp, Rattus norvegicus
acaaaagtagttggtcacctcacac

SEQ ID NO: 69427 - DNA, 25 bp, Rattus norvegicus
acaaaagtatccatctctcagtcca

SEQ ID NO: 69428 - DNA, 25 bp, Rattus norvegicus
acaaaagtatccttctctcagtcca

SEQ ID NO: 69429 - DNA, 25 bp, Rattus norvegicus
acaaaatacaacctcatgctccttg

SEQ ID NO: 69430 - DNA, 25 bp, Rattus norvegicus
acaaaatacaacgtcatgctccttg

SEQ ID NO: 69431 - DNA, 25 bp, Rattus norvegicus
acaaaatacatccactgcatcgtcc

SEQ ID NO: 69432 - DNA, 25 bp, Rattus norvegicus
acaaaatacatcgactgcatcgtcc

SEQ ID NO: 69433 - DNA, 25 bp, Rattus norvegicus
acaaaatcattcatcatcccgacag

SEQ ID NO: 69434 - DNA, 25 bp, Rattus norvegicus
acaaaatcattcttcatcccgacag

SEQ ID NO: 69435 - DNA, 25 bp, Rattus norvegicus
acaaaatcgatgctagcctgtctcc

SEQ ID NO: 69436 - DNA, 25 bp, Rattus norvegicus
acaaaatcgatggtagcctgtctcc

SEQ ID NO: 69437 - DNA, 25 bp, Rattus norvegicus
acaaaatctgctctgatgtacaaga

SEQ ID NO: 69438 - DNA, 25 bp, Rattus norvegicus
acaaaatctgctgtgatgtacaaga

SEQ ID NO: 69439 - DNA, 25 bp, Rattus norvegicus
acaaaatgtccaaactgctgctgcc

SEQ ID NO: 69440 - DNA, 25 bp, Rattus norvegicus
acaaaatgtccatactgctgctgcc

SEQ ID NO: 69441 - DNA, 25 bp, Rattus norvegicus
acaaaattgtttcgagtcactcagg

SEQ ID NO: 69442 - DNA, 25 bp, Rattus norvegicus
acaaaattgtttggagtcactcagg

SEQ ID NO: 69443 - DNA, 25 bp, Rattus norvegicus
acaaaatttcacactgtagcccagg

SEQ ID NO: 69444 - DNA, 25 bp, Rattus norvegicus
acaaaatttcactctgtagcccagg

SEQ ID NO: 69445 - DNA, 25 bp, Rattus norvegicus
acaaaatttcatatgttgcatttta

SEQ ID NO: 69446 - DNA, 25 bp, Rattus norvegicus
acaaaatttcatttgttgcatttta

SEQ ID NO: 69447 - DNA, 25 bp, Rattus norvegicus
acaaacaaccctacgatggacttgg

SEQ ID NO: 69448 - DNA, 25 bp, Rattus norvegicus
acaaacaacccttcgatggacttgg

SEQ ID NO: 69449 - DNA, 25 bp, Rattus norvegicus
acaaacaatatgaaagatctccttt

SEQ ID NO: 69450 - DNA, 25 bp, Rattus norvegicus
acaaacaatatgtaagatctccttt

SEQ ID NO: 69451 - DNA, 25 bp, Rattus norvegicus
acaaacaccaacacagggtcctgga

SEQ ID NO: 69452 - DNA, 25 bp, Rattus norvegicus
acaaacaccaactcagggtcctgga

SEQ ID NO: 69453 - DNA, 25 bp, Rattus norvegicus
acaaacacctgtaattccacttcta

SEQ ID NO: 69454 - DNA, 25 bp, Rattus norvegicus
acaaacacctgttattccacttcta

SEQ ID NO: 69455 - DNA, 25 bp, Rattus norvegicus
acaaacagcaacacgggctcaggtg

SEQ ID NO: 69456 - DNA, 25 bp, Rattus norvegicus
acaaacagcaactcgggctcaggtg

SEQ ID NO: 69457 - DNA, 25 bp, Rattus norvegicus
acaaacagcacaagcctggcaggtt

SEQ ID NO: 69458 - DNA, 25 bp, Rattus norvegicus
acaaacagcacatgcctggcaggtt

SEQ ID NO: 69459 - DNA, 25 bp, Rattus norvegicus
acaaacagcttcacttaccatgtct

SEQ ID NO: 69460 - DNA, 25 bp, Rattus norvegicus
acaaacagcttctcttaccatgtct

SEQ ID NO: 69461 - DNA, 25 bp, Rattus norvegicus
acaaacaggaagcagctggtctttt

SEQ ID NO: 69462 - DNA, 25 bp, Rattus norvegicus
acaaacaggaaggagctggtctttt

SEQ ID NO: 69463 - DNA, 25 bp, Rattus norvegicus
acaaacaggaggaggcaagcccctt

SEQ ID NO: 69464 - DNA, 25 bp, Rattus norvegicus
acaaacaggaggtggcaagcccctt

SEQ ID NO: 69465 - DNA, 25 bp, Rattus norvegicus
acaaacagggcccacttaggaatat

SEQ ID NO: 69466 - DNA, 25 bp, Rattus norvegicus
acaaacagggccgacttaggaatat

SEQ ID NO: 69467 - DNA, 25 bp, Rattus norvegicus
acaaacagtatgagtgtcctagtca

SEQ ID NO: 69468 - DNA, 25 bp, Rattus norvegicus
acaaacagtatgtgtgtcctagtca

SEQ ID NO: 69469 - DNA, 25 bp, Rattus norvegicus
acaaacagtcctactggtggctatt

SEQ ID NO: 69470 - DNA, 25 bp, Rattus norvegicus
acaaacagtccttctggtggctatt

SEQ ID NO: 69471 - DNA, 25 bp, Rattus norvegicus
acaaacagtctgctcactcctagtt

SEQ ID NO: 69472 - DNA, 25 bp, Rattus norvegicus
acaaacagtctggtcactcctagtt

SEQ ID NO: 69473 - DNA, 25 bp, Rattus norvegicus
acaaacataggactctgccctcagg

SEQ ID NO: 69474 - DNA, 25 bp, Rattus norvegicus
acaaacataggagtctgccctcagg

SEQ ID NO: 69475 - DNA, 25 bp, Rattus norvegicus
acaaacatcagtacactgctggtta

SEQ ID NO: 69476 - DNA, 25 bp, Rattus norvegicus
acaaacatcagttcactgctggtta

SEQ ID NO: 69477 - DNA, 25 bp, Rattus norvegicus
acaaacatgtaccacttttcccaga

SEQ ID NO: 69478 - DNA, 25 bp, Rattus norvegicus
acaaacatgtacgacttttcccaga

SEQ ID NO: 69479 - DNA, 25 bp, Rattus norvegicus
acaaaccacacgatgcaccttaact

SEQ ID NO: 69480 - DNA, 25 bp, Rattus norvegicus
acaaaccacacgttgcaccttaact

SEQ ID NO: 69481 - DNA, 25 bp, Rattus norvegicus
acaaaccagaacctcctgtagcagg

SEQ ID NO: 69482 - DNA, 25 bp, Rattus norvegicus
acaaaccagaacgtcctgtagcagg

SEQ ID NO: 69483 - DNA, 25 bp, Rattus norvegicus
acaaaccagccaaggtcccaggtag

SEQ ID NO: 69484 - DNA, 25 bp, Rattus norvegicus
acaaaccagccaagtgacggacgcc

SEQ ID NO: 69485 - DNA, 25 bp, Rattus norvegicus
acaaaccagccatggtcccaggtag

SEQ ID NO: 69486 - DNA, 25 bp, Rattus norvegicus
acaaaccagccatgtgacggacgcc

SEQ ID NO: 69487 - DNA, 25 bp, Rattus norvegicus
acaaaccaggaaccacagtgccgaa

SEQ ID NO: 69488 - DNA, 25 bp, Rattus norvegicus
acaaaccaggaagcacagtgccgaa

SEQ ID NO: 69489 - DNA, 25 bp, Rattus norvegicus
acaaaccagtttcagacagggctct

SEQ ID NO: 69490 - DNA, 25 bp, Rattus norvegicus
acaaaccagtttgagacagggctct

SEQ ID NO: 69491 - DNA, 25 bp, Rattus norvegicus
acaaaccctccacgagggagacaag

SEQ ID NO: 69492 - DNA, 25 bp, Rattus norvegicus
acaaaccctccaggagggagacaag

SEQ ID NO: 69493 - DNA, 25 bp, Rattus norvegicus
acaaaccgtgatagttccttctggg

SEQ ID NO: 69494 - DNA, 25 bp, Rattus norvegicus
acaaaccgtgattgttccttctggg

SEQ ID NO: 69495 - DNA, 25 bp, Rattus norvegicus
acaaaccgtgtgagactctgtcaac

SEQ ID NO: 69496 - DNA, 25 bp, Rattus norvegicus
acaaaccgtgtgtgactctgtcaac

SEQ ID NO: 69497 - DNA, 25 bp, Rattus norvegicus
acaaacctaatcatcatgagccaaa

SEQ ID NO: 69498 - DNA, 25 bp, Rattus norvegicus
acaaacctaatcttcatgagccaaa

SEQ ID NO: 69499 - DNA, 25 bp, Rattus norvegicus
acaaacctacctatgagggcgtgga

SEQ ID NO: 69500 - DNA, 25 bp, Rattus norvegicus
acaaacctacctttgagggcgtgga

SEQ ID NO: 69501 - DNA, 25 bp, Rattus norvegicus
acaaacctattgctgttggctctca

SEQ ID NO: 69502 - DNA, 25 bp, Rattus norvegicus
acaaacctattggtgttggctctca

SEQ ID NO: 69503 - DNA, 25 bp, Rattus norvegicus
acaaacctggatcgtcgctgtcctg

SEQ ID NO: 69504 - DNA, 25 bp, Rattus norvegicus
acaaacctggatggtcgctgtcctg

SEQ ID NO: 69505 - DNA, 25 bp, Rattus norvegicus
acaaacctgttaccagttggcattt

SEQ ID NO: 69506 - DNA, 25 bp, Rattus norvegicus
acaaacctgttagcagttggcattt

SEQ ID NO: 69507 - DNA, 25 bp, Rattus norvegicus
acaaacctgtttcaccctcgtgatt

SEQ ID NO: 69508 - DNA, 25 bp, Rattus norvegicus
acaaacctgtttgaccctcgtgatt

SEQ ID NO: 69509 - DNA, 25 bp, Rattus norvegicus
acaaacgaatctacttcttgctgcc

SEQ ID NO: 69510 - DNA, 25 bp, Rattus norvegicus
acaaacgaatcttcttcttgctgcc

SEQ ID NO: 69511 - DNA, 25 bp, Rattus norvegicus
acaaacgccaaaatgggaagctcat

SEQ ID NO: 69512 - DNA, 25 bp, Rattus norvegicus
acaaacgccaaattgggaagctcat

SEQ ID NO: 69513 - DNA, 25 bp, Rattus norvegicus
acaaacggcagtcagaggcccagct

SEQ ID NO: 69514 - DNA, 25 bp, Rattus norvegicus
acaaacggcagtgagaggcccagct

SEQ ID NO: 69515 - DNA, 25 bp, Rattus norvegicus
acaaacggctcactttgtcccagat

SEQ ID NO: 69516 - DNA, 25 bp, Rattus norvegicus
acaaacggctcagtttgtcccagat

SEQ ID NO: 69517 - DNA, 25 bp, Rattus norvegicus
acaaacgggctacgagatggactca

SEQ ID NO: 69518 - DNA, 25 bp, Rattus norvegicus
acaaacgggctaggagatggactca

SEQ ID NO: 69519 - DNA, 25 bp, Rattus norvegicus
acaaacgtgtttatcttcctcctca

SEQ ID NO: 69520 - DNA, 25 bp, Rattus norvegicus
acaaacgtgtttttcttcctcctca

SEQ ID NO: 69521 - DNA, 25 bp, Rattus norvegicus
acaaactaaaccagtgtaccagaca

SEQ ID NO: 69522 - DNA, 25 bp, Rattus norvegicus
acaaactaaacctgtgtaccagaca

SEQ ID NO: 69523 - DNA, 25 bp, Rattus norvegicus
acaaactaaagtatcgcacagagaa

SEQ ID NO: 69524 - DNA, 25 bp, Rattus norvegicus
acaaactaaagtttcgcacagagaa

SEQ ID NO: 69525 - DNA, 25 bp, Rattus norvegicus
acaaactcagtgactgtcccttcta

SEQ ID NO: 69526 - DNA, 25 bp, Rattus norvegicus
acaaactcagtgtctgtcccttcta

SEQ ID NO: 69527 - DNA, 25 bp, Rattus norvegicus
acaaactcatttaggtttctggctt

SEQ ID NO: 69528 - DNA, 25 bp, Rattus norvegicus
acaaactcattttggtttctggctt

SEQ ID NO: 69529 - DNA, 25 bp, Rattus norvegicus
acaaactctcaaactgtctgtctga

SEQ ID NO: 69530 - DNA, 25 bp, Rattus norvegicus
acaaactctcaatctgtctgtctga

SEQ ID NO: 69531 - DNA, 25 bp, Rattus norvegicus
acaaactgacttcatcgccagcatc

SEQ ID NO: 69532 - DNA, 25 bp, Rattus norvegicus
acaaactgacttgatcgccagcatc

SEQ ID NO: 69533 - DNA, 25 bp, Rattus norvegicus
acaaactgctggacccatacactgt

SEQ ID NO: 69534 - DNA, 25 bp, Rattus norvegicus
acaaactgctggtcccatacactgt

SEQ ID NO: 69535 - DNA, 25 bp, Rattus norvegicus
acaaactgctttcgcctggtgcatt

SEQ ID NO: 69536 - DNA, 25 bp, Rattus norvegicus
acaaactgctttggcctggtgcatt

SEQ ID NO: 69537 - DNA, 25 bp, Rattus norvegicus
acaaactggctacccaggccaaaga

SEQ ID NO: 69538 - DNA, 25 bp, Rattus norvegicus
acaaactggctagccaggccaaaga

SEQ ID NO: 69539 - DNA, 25 bp, Rattus norvegicus
acaaactggctcactagtctcctgg

SEQ ID NO: 69540 - DNA, 25 bp, Rattus norvegicus
acaaactggctctctagtctcctgg

SEQ ID NO: 69541 - DNA, 25 bp, Rattus norvegicus
acaaactggtcacctgcagcaccag

SEQ ID NO: 69542 - DNA, 25 bp, Rattus norvegicus
acaaactggtcagctgcagcaccag

SEQ ID NO: 69543 - DNA, 25 bp, Rattus norvegicus
acaaactgtcagatctcatccacat

SEQ ID NO: 69544 - DNA, 25 bp, Rattus norvegicus
acaaactgtcagttctcatccacat

SEQ ID NO: 69545 - DNA, 25 bp, Rattus norvegicus
acaaactgtgcgactgtaagggtta

SEQ ID NO: 69546 - DNA, 25 bp, Rattus norvegicus
acaaactgtgcgtctgtaagggtta

SEQ ID NO: 69547 - DNA, 25 bp, Rattus norvegicus
acaaactgttgtcggttctgccagg

SEQ ID NO: 69548 - DNA, 25 bp, Rattus norvegicus
acaaactgttgtgggttctgccagg

SEQ ID NO: 69549 - DNA, 25 bp, Rattus norvegicus
acaaacttagccatgcttttgcttc

SEQ ID NO: 69550 - DNA, 25 bp, Rattus norvegicus
acaaacttagccttgcttttgcttc

SEQ ID NO: 69551 - DNA, 25 bp, Rattus norvegicus
acaaacttaggtccgctgccatcaa

SEQ ID NO: 69552 - DNA, 25 bp, Rattus norvegicus
acaaacttaggtgcgctgccatcaa

SEQ ID NO: 69553 - DNA, 25 bp, Rattus norvegicus
acaaacttccacaacgtcaagaggg

SEQ ID NO: 69554 - DNA, 25 bp, Rattus norvegicus
acaaacttccactacgtcaagaggg

SEQ ID NO: 69555 - DNA, 25 bp, Rattus norvegicus
acaaacttcctgacctttctttcag

SEQ ID NO: 69556 - DNA, 25 bp, Rattus norvegicus
acaaacttcctgtcctttctttcag

SEQ ID NO: 69557 - DNA, 25 bp, Rattus norvegicus
acaaacttcttgagggccatcaggt

SEQ ID NO: 69558 - DNA, 25 bp, Rattus norvegicus
acaaacttcttgtgggccatcaggt

SEQ ID NO: 69559 - DNA, 25 bp, Rattus norvegicus
acaaacttgcgcactgtgcttaaag

SEQ ID NO: 69560 - DNA, 25 bp, Rattus norvegicus
acaaacttgcgctctgtgcttaaag

SEQ ID NO: 69561 - DNA, 25 bp, Rattus norvegicus
acaaacttgcttaagccttccacgg

SEQ ID NO: 69562 - DNA, 25 bp, Rattus norvegicus
acaaacttgctttagccttccacgg

SEQ ID NO: 69563 - DNA, 25 bp, Rattus norvegicus
acaaactttgtgaatgtgacctaaa

SEQ ID NO: 69564 - DNA, 25 bp, Rattus norvegicus
acaaactttgtgtatgtgacctaaa

SEQ ID NO: 69565 - DNA, 25 bp, Rattus norvegicus
acaaacttttacactgcagtcagca

SEQ ID NO: 69566 - DNA, 25 bp, Rattus norvegicus
acaaacttttactctgcagtcagca

SEQ ID NO: 69567 - DNA, 25 bp, Rattus norvegicus
acaaagaaaagcctgccagcccgga

SEQ ID NO: 69568 - DNA, 25 bp, Rattus norvegicus
acaaagaaaagcgtgccagcccgga

SEQ ID NO: 69569 - DNA, 25 bp, Rattus norvegicus
acaaagaaacgccagctgtgcccaa

SEQ ID NO: 69570 - DNA, 25 bp, Rattus norvegicus
acaaagaaacgcgagctgtgcccaa

SEQ ID NO: 69571 - DNA, 25 bp, Rattus norvegicus
acaaagaagtttctgttcctggctc

SEQ ID NO: 69572 - DNA, 25 bp, Rattus norvegicus
acaaagaagtttgtgttcctggctc

SEQ ID NO: 69573 - DNA, 25 bp, Rattus norvegicus
acaaagaatcgtcggtctgccgcta

SEQ ID NO: 69574 - DNA, 25 bp, Rattus norvegicus
acaaagaatcgtgggtctgccgcta

SEQ ID NO: 69575 - DNA, 25 bp, Rattus norvegicus
acaaagaccattccataccattagt

SEQ ID NO: 69576 - DNA, 25 bp, Rattus norvegicus
acaaagaccattgcataccattagt

SEQ ID NO: 69577 - DNA, 25 bp, Rattus norvegicus
acaaagaccggacggagatgctgca

SEQ ID NO: 69578 - DNA, 25 bp, Rattus norvegicus
acaaagaccggagggagatgctgca

SEQ ID NO: 69579 - DNA, 25 bp, Rattus norvegicus
acaaagacctctagggtgccatctc

SEQ ID NO: 69580 - DNA, 25 bp, Rattus norvegicus
acaaagacctcttgggtgccatctc

SEQ ID NO: 69581 - DNA, 25 bp, Rattus norvegicus
acaaagacctgtctgagcggcatga

SEQ ID NO: 69582 - DNA, 25 bp, Rattus norvegicus
acaaagacctgtgtgagcggcatga

SEQ ID NO: 69583 - DNA, 25 bp, Rattus norvegicus
acaaagactggcaattgatgctcta

SEQ ID NO: 69584 - DNA, 25 bp, Rattus norvegicus
acaaagactggctattgatgctcta

SEQ ID NO: 69585 - DNA, 25 bp, Rattus norvegicus
acaaagacttccatgtcggaccgca

SEQ ID NO: 69586 - DNA, 25 bp, Rattus norvegicus
acaaagacttccttgtcggaccgca

SEQ ID NO: 69587 - DNA, 25 bp, Rattus norvegicus
acaaagaggttcaggcgtctcagct

SEQ ID NO: 69588 - DNA, 25 bp, Rattus norvegicus
acaaagaggttctggcgtctcagct

SEQ ID NO: 69589 - DNA, 25 bp, Rattus norvegicus
acaaagataaccctgccatactggc

SEQ ID NO: 69590 - DNA, 25 bp, Rattus norvegicus
acaaagataaccgtgccatactggc

SEQ ID NO: 69591 - DNA, 25 bp, Rattus norvegicus
acaaagatgcacatttcctcatggg

SEQ ID NO: 69592 - DNA, 25 bp, Rattus norvegicus
acaaagatgcacttttcctcatggg

SEQ ID NO: 69593 - DNA, 25 bp, Rattus norvegicus
acaaagatgcagagatggtccaact

SEQ ID NO: 69594 - DNA, 25 bp, Rattus norvegicus
acaaagatgcagtgatggtccaact

SEQ ID NO: 69595 - DNA, 25 bp, Rattus norvegicus
acaaagatggttaggctgcctgccg

SEQ ID NO: 69596 - DNA, 25 bp, Rattus norvegicus
acaaagatggtttggctgcctgccg

SEQ ID NO: 69597 - DNA, 25 bp, Rattus norvegicus
acaaagatttggcagcagcgcagca

SEQ ID NO: 69598 - DNA, 25 bp, Rattus norvegicus
acaaagatttgggagcagcgcagca

SEQ ID NO: 69599 - DNA, 25 bp, Rattus norvegicus
acaaagcaactccttactatccata

SEQ ID NO: 69600 - DNA, 25 bp, Rattus norvegicus
acaaagcaactcgttactatccata

SEQ ID NO: 69601 - DNA, 25 bp, Rattus norvegicus
acaaagcaatacacaggcctggtct

SEQ ID NO: 69602 - DNA, 25 bp, Rattus norvegicus
acaaagcaatactcaggcctggtct

SEQ ID NO: 69603 - DNA, 25 bp, Rattus norvegicus
acaaagcaatatatatgggagcaac

SEQ ID NO: 69604 - DNA, 25 bp, Rattus norvegicus
acaaagcaatatttatgggagcaac

SEQ ID NO: 69605 - DNA, 25 bp, Rattus norvegicus
acaaagcacccaatggccattgttt

SEQ ID NO: 69606 - DNA, 25 bp, Rattus norvegicus
acaaagcacccattggccattgttt

SEQ ID NO: 69607 - DNA, 25 bp, Rattus norvegicus
acaaagcagactcggctctggtctt

SEQ ID NO: 69608 - DNA, 25 bp, Rattus norvegicus
acaaagcagactgggctctggtctt

SEQ ID NO: 69609 - DNA, 25 bp, Rattus norvegicus
acaaagcagcccacagacttctgga

SEQ ID NO: 69610 - DNA, 25 bp, Rattus norvegicus
acaaagcagccctcagacttctgga

SEQ ID NO: 69611 - DNA, 25 bp, Rattus norvegicus
acaaagcaggacaatgtctaataaa

SEQ ID NO: 69612 - DNA, 25 bp, Rattus norvegicus
acaaagcaggactatgtctaataaa

SEQ ID NO: 69613 - DNA, 25 bp, Rattus norvegicus
acaaagcaggtcatagggctggaga

SEQ ID NO: 69614 - DNA, 25 bp, Rattus norvegicus
acaaagcaggtcttagggctggaga

SEQ ID NO: 69615 - DNA, 25 bp, Rattus norvegicus
acaaagcatctcactcactatgttc

SEQ ID NO: 69616 - DNA, 25 bp, Rattus norvegicus
acaaagcatctctctcactatgttc

SEQ ID NO: 69617 - DNA, 25 bp, Rattus norvegicus
acaaagccagctcattctctgatcc

SEQ ID NO: 69618 - DNA, 25 bp, Rattus norvegicus
acaaagccagctgattctctgatcc

SEQ ID NO: 69619 - DNA, 25 bp, Rattus norvegicus
acaaagccagttccgtaagctgcct

SEQ ID NO: 69620 - DNA, 25 bp, Rattus norvegicus
acaaagccagttgcgtaagctgcct

SEQ ID NO: 69621 - DNA, 25 bp, Rattus norvegicus
acaaagccatctccacgggatcaaa

SEQ ID NO: 69622 - DNA, 25 bp, Rattus norvegicus
acaaagccatctgcacgggatcaaa

SEQ ID NO: 69623 - DNA, 25 bp, Rattus norvegicus
acaaagccatgcacctgggctggtg

SEQ ID NO: 69624 - DNA, 25 bp, Rattus norvegicus
acaaagccatgctcctgggctggtg

SEQ ID NO: 69625 - DNA, 25 bp, Rattus norvegicus
acaaagcccagtctgtgccagcttc

SEQ ID NO: 69626 - DNA, 25 bp, Rattus norvegicus
acaaagcccagtgtgtgccagcttc

SEQ ID NO: 69627 - DNA, 25 bp, Rattus norvegicus
acaaagccccagagaacaacctaat

SEQ ID NO: 69628 - DNA, 25 bp, Rattus norvegicus
acaaagccccagtgaacaacctaat

SEQ ID NO: 69629 - DNA, 25 bp, Rattus norvegicus
acaaagcccgagatggcgaagcgga

SEQ ID NO: 69630 - DNA, 25 bp, Rattus norvegicus
acaaagcccgagttggcgaagcgga

SEQ ID NO: 69631 - DNA, 25 bp, Rattus norvegicus
acaaagcctcgaagccagtggttcc

SEQ ID NO: 69632 - DNA, 25 bp, Rattus norvegicus
acaaagcctcgatgccagtggttcc

SEQ ID NO: 69633 - DNA, 25 bp, Rattus norvegicus
acaaagcctgtcaacctgggttcac

SEQ ID NO: 69634 - DNA, 25 bp, Rattus norvegicus
acaaagcctgtctacctgggttcac

SEQ ID NO: 69635 - DNA, 25 bp, Rattus norvegicus
acaaagccttgtcttcacttcctca

SEQ ID NO: 69636 - DNA, 25 bp, Rattus norvegicus
acaaagccttgtgttcacttcctca

SEQ ID NO: 69637 - DNA, 25 bp, Rattus norvegicus
acaaagcgaacccaggtgcaactgt

SEQ ID NO: 69638 - DNA, 25 bp, Rattus norvegicus
acaaagcgaaccgaggtgcaactgt

SEQ ID NO: 69639 - DNA, 25 bp, Rattus norvegicus
acaaagcgtgcaactaaccccaatt

SEQ ID NO: 69640 - DNA, 25 bp, Rattus norvegicus
acaaagcgtgcatctaaccccaatt

SEQ ID NO: 69641 - DNA, 25 bp, Rattus norvegicus
acaaagctaccaagctacacaaccg

SEQ ID NO: 69642 - DNA, 25 bp, Rattus norvegicus
acaaagctaccatgctacacaaccg

SEQ ID NO: 69643 - DNA, 25 bp, Rattus norvegicus
acaaagctatgaacctggcacttgg

SEQ ID NO: 69644 - DNA, 25 bp, Rattus norvegicus
acaaagctatgatcctggcacttgg

SEQ ID NO: 69645 - DNA, 25 bp, Rattus norvegicus
acaaagctcagtaggtctgccggag

SEQ ID NO: 69646 - DNA, 25 bp, Rattus norvegicus
acaaagctcagttggtctgccggag

SEQ ID NO: 69647 - DNA, 25 bp, Rattus norvegicus
acaaagcttccgctcagggttttct

SEQ ID NO: 69648 - DNA, 25 bp, Rattus norvegicus
acaaagcttccggtcagggttttct

SEQ ID NO: 69649 - DNA, 25 bp, Rattus norvegicus
acaaagcttgtgatattctggctta

SEQ ID NO: 69650 - DNA, 25 bp, Rattus norvegicus
acaaagcttgtgttattctggctta

SEQ ID NO: 69651 - DNA, 25 bp, Rattus norvegicus
acaaagctttacatacggacatcga

SEQ ID NO: 69652 - DNA, 25 bp, Rattus norvegicus
acaaagctttacttacggacatcga

SEQ ID NO: 69653 - DNA, 25 bp, Rattus norvegicus
acaaagctttcacatggtactcggc

SEQ ID NO: 69654 - DNA, 25 bp, Rattus norvegicus
acaaagctttcagatggtactcggc

SEQ ID NO: 69655 - DNA, 25 bp, Rattus norvegicus
acaaaggaaactcaaagccagcctg

SEQ ID NO: 69656 - DNA, 25 bp, Rattus norvegicus
acaaaggaaactgaaagccagcctg

SEQ ID NO: 69657 - DNA, 25 bp, Rattus norvegicus
acaaaggaactgaagacctggacag

SEQ ID NO: 69658 - DNA, 25 bp, Rattus norvegicus
acaaaggaactgtagacctggacag

SEQ ID NO: 69659 - DNA, 25 bp, Rattus norvegicus
acaaaggaagtcatctgctcgtcct

SEQ ID NO: 69660 - DNA, 25 bp, Rattus norvegicus
acaaaggaagtcttctgctcgtcct

SEQ ID NO: 69661 - DNA, 25 bp, Rattus norvegicus
acaaaggactctcaggctcgctgga

SEQ ID NO: 69662 - DNA, 25 bp, Rattus norvegicus
acaaaggactctgaggctcgctgga

SEQ ID NO: 69663 - DNA, 25 bp, Rattus norvegicus
acaaaggagtgtcgcaacagtgacc

SEQ ID NO: 69664 - DNA, 25 bp, Rattus norvegicus
acaaaggagtgtggcaacagtgacc

SEQ ID NO: 69665 - DNA, 25 bp, Rattus norvegicus
acaaaggatcttaccaccttgacct

SEQ ID NO: 69666 - DNA, 25 bp, Rattus norvegicus
acaaaggatctttccaccttgacct

SEQ ID NO: 69667 - DNA, 25 bp, Rattus norvegicus
acaaaggcaacaccttttcaagagg

SEQ ID NO: 69668 - DNA, 25 bp, Rattus norvegicus
acaaaggcaacagcttttcaagagg

SEQ ID NO: 69669 - DNA, 25 bp, Rattus norvegicus
acaaaggcaacgagcttctgagctc

SEQ ID NO: 69670 - DNA, 25 bp, Rattus norvegicus
acaaaggcaacgtgcttctgagctc

SEQ ID NO: 69671 - DNA, 25 bp, Rattus norvegicus
acaaaggcactgaggactgcgtcca

SEQ ID NO: 69672 - DNA, 25 bp, Rattus norvegicus
acaaaggcactgtggactgcgtcca

SEQ ID NO: 69673 - DNA, 25 bp, Rattus norvegicus
acaaaggcagttagtggaccacaca

SEQ ID NO: 69674 - DNA, 25 bp, Rattus norvegicus
acaaaggcagtttgtggaccacaca

SEQ ID NO: 69675 - DNA, 25 bp, Rattus norvegicus
acaaaggcatgaacccatcctgagg

SEQ ID NO: 69676 - DNA, 25 bp, Rattus norvegicus
acaaaggcatgatcccatcctgagg

SEQ ID NO: 69677 - DNA, 25 bp, Rattus norvegicus
acaaaggcgggcagcgcgtccagac

SEQ ID NO: 69678 - DNA, 25 bp, Rattus norvegicus
acaaaggcgggctgcgcgtccagac

SEQ ID NO: 69679 - DNA, 25 bp, Rattus norvegicus
acaaaggctgacatctcttgtggct

SEQ ID NO: 69680 - DNA, 25 bp, Rattus norvegicus
acaaaggctgacttctcttgtggct

SEQ ID NO: 69681 - DNA, 25 bp, Rattus norvegicus
acaaaggctgatcacctttggcctt

SEQ ID NO: 69682 - DNA, 25 bp, Rattus norvegicus
acaaaggctgatgacctttggcctt

SEQ ID NO: 69683 - DNA, 25 bp, Rattus norvegicus
acaaaggctggacccctgactttga

SEQ ID NO: 69684 - DNA, 25 bp, Rattus norvegicus
acaaaggctggagccctgactttga

SEQ ID NO: 69685 - DNA, 25 bp, Rattus norvegicus
acaaaggctgggacgctgtggaagc

SEQ ID NO: 69686 - DNA, 25 bp, Rattus norvegicus
acaaaggctgggagctgtgcaacac

SEQ ID NO: 69687 - DNA, 25 bp, Rattus norvegicus
acaaaggctgggtcgctgtggaagc

SEQ ID NO: 69688 - DNA, 25 bp, Rattus norvegicus
acaaaggctgggtgctgtgcaacac

SEQ ID NO: 69689 - DNA, 25 bp, Rattus norvegicus
acaaaggcttctctaaactggcttc

SEQ ID NO: 69690 - DNA, 25 bp, Rattus norvegicus
acaaaggcttctgtaaactggcttc

SEQ ID NO: 69691 - DNA, 25 bp, Rattus norvegicus
acaaaggctttcatctgcgtgttca

SEQ ID NO: 69692 - DNA, 25 bp, Rattus norvegicus
acaaaggctttcttctgcgtgttca

SEQ ID NO: 69693 - DNA, 25 bp, Rattus norvegicus
acaaagggaatcactggtccagaca

SEQ ID NO: 69694 - DNA, 25 bp, Rattus norvegicus
acaaagggaatctctggtccagaca

SEQ ID NO: 69695 - DNA, 25 bp, Rattus norvegicus
acaaagggcctgatggtcactgacc

SEQ ID NO: 69696 - DNA, 25 bp, Rattus norvegicus
acaaagggcctgttggtcactgacc

SEQ ID NO: 69697 - DNA, 25 bp, Rattus norvegicus
acaaagggtaaacccagtggagtct

SEQ ID NO: 69698 - DNA, 25 bp, Rattus norvegicus
acaaagggtaaagccagtggagtct

SEQ ID NO: 69699 - DNA, 25 bp, Rattus norvegicus
acaaaggtccctcgaggcctgaagc

SEQ ID NO: 69700 - DNA, 25 bp, Rattus norvegicus
acaaaggtccctggaggcctgaagc

SEQ ID NO: 69701 - DNA, 25 bp, Rattus norvegicus
acaaaggtctccacataagttcatg

SEQ ID NO: 69702 - DNA, 25 bp, Rattus norvegicus
acaaaggtctcctcataagttcatg

SEQ ID NO: 69703 - DNA, 25 bp, Rattus norvegicus
acaaaggtgccaacattggactcat

SEQ ID NO: 69704 - DNA, 25 bp, Rattus norvegicus
acaaaggtgccatcattggactcat

SEQ ID NO: 69705 - DNA, 25 bp, Rattus norvegicus
acaaaggtgggtcttctccaacttg

SEQ ID NO: 69706 - DNA, 25 bp, Rattus norvegicus
acaaaggtgggtgttctccaacttg

SEQ ID NO: 69707 - DNA, 25 bp, Rattus norvegicus
acaaaggttcaacggcatcctcggc

SEQ ID NO: 69708 - DNA, 25 bp, Rattus norvegicus
acaaaggttcaagggcatcctcggc

SEQ ID NO: 69709 - DNA, 25 bp, Rattus norvegicus
acaaagtaggtcaactctctgctcc

SEQ ID NO: 69710 - DNA, 25 bp, Rattus norvegicus
acaaagtaggtctactctctgctcc

SEQ ID NO: 69711 - DNA, 25 bp, Rattus norvegicus
acaaagtatatgacccgggtccacg

SEQ ID NO: 69712 - DNA, 25 bp, Rattus norvegicus
acaaagtatatgtcccgggtccacg

SEQ ID NO: 69713 - DNA, 25 bp, Rattus norvegicus
acaaagtcaagcatggtctctgccc

SEQ ID NO: 69714 - DNA, 25 bp, Rattus norvegicus
acaaagtcaagcttggtctctgccc

SEQ ID NO: 69715 - DNA, 25 bp, Rattus norvegicus
acaaagtcactgatgtttgcccgac

SEQ ID NO: 69716 - DNA, 25 bp, Rattus norvegicus
acaaagtcactgttgtttgcccgac

SEQ ID NO: 69717 - DNA, 25 bp, Rattus norvegicus
acaaagtcaggcctcttctcggatg

SEQ ID NO: 69718 - DNA, 25 bp, Rattus norvegicus
acaaagtcaggcgtcttctcggatg

SEQ ID NO: 69719 - DNA, 25 bp, Rattus norvegicus
acaaagtcctggctgtgttgcctag

SEQ ID NO: 69720 - DNA, 25 bp, Rattus norvegicus
acaaagtcctgggtgtgttgcctag

SEQ ID NO: 69721 - DNA, 25 bp, Rattus norvegicus
acaaagtctgtgacctgtaccccgt

SEQ ID NO: 69722 - DNA, 25 bp, Rattus norvegicus
acaaagtctgtgtcctgtaccccgt

SEQ ID NO: 69723 - DNA, 25 bp, Rattus norvegicus
acaaagtgcctcagagctgactcta

SEQ ID NO: 69724 - DNA, 25 bp, Rattus norvegicus
acaaagtgcctctgagctgactcta

SEQ ID NO: 69725 - DNA, 25 bp, Rattus norvegicus
acaaagtgcgcaacttcttggccag

SEQ ID NO: 69726 - DNA, 25 bp, Rattus norvegicus
acaaagtgcgcatcttcttggccag

SEQ ID NO: 69727 - DNA, 25 bp, Rattus norvegicus
acaaagtgctacacttgcacccaca

SEQ ID NO: 69728 - DNA, 25 bp, Rattus norvegicus
acaaagtgctactcttgcacccaca

SEQ ID NO: 69729 - DNA, 25 bp, Rattus norvegicus
acaaagtgggtgaggcctcagctca

SEQ ID NO: 69730 - DNA, 25 bp, Rattus norvegicus
acaaagtgggtgtggcctcagctca

SEQ ID NO: 69731 - DNA, 25 bp, Rattus norvegicus
acaaagtgtcgaccgcctcgggaaa

SEQ ID NO: 69732 - DNA, 25 bp, Rattus norvegicus
acaaagtgtcgagcgcctcgggaaa

SEQ ID NO: 69733 - DNA, 25 bp, Rattus norvegicus
acaaagttgcctagccccactcaag

SEQ ID NO: 69734 - DNA, 25 bp, Rattus norvegicus
acaaagttgccttgccccactcaag

SEQ ID NO: 69735 - DNA, 25 bp, Rattus norvegicus
acaaagttgttgctgtgcagtgcat

SEQ ID NO: 69736 - DNA, 25 bp, Rattus norvegicus
acaaagttgttggtgtgcagtgcat

SEQ ID NO: 69737 - DNA, 25 bp, Rattus norvegicus
acaaagtttggtacctgtagggcat

SEQ ID NO: 69738 - DNA, 25 bp, Rattus norvegicus
acaaagtttggttcctgtagggcat

SEQ ID NO: 69739 - DNA, 25 bp, Rattus norvegicus
acaaatacaacacaccccttagctt

SEQ ID NO: 69740 - DNA, 25 bp, Rattus norvegicus
acaaatacaacagaccccttagctt

SEQ ID NO: 69741 - DNA, 25 bp, Rattus norvegicus
acaaatacacctcctacatctaaag

SEQ ID NO: 69742 - DNA, 25 bp, Rattus norvegicus
acaaatacacctgctacatctaaag

SEQ ID NO: 69743 - DNA, 25 bp, Rattus norvegicus
acaaatacatccatgtccaccttgg

SEQ ID NO: 69744 - DNA, 25 bp, Rattus norvegicus
acaaatacatccttgtccaccttgg

SEQ ID NO: 69745 - DNA, 25 bp, Rattus norvegicus
acaaataccaccaggcttttcaggg

SEQ ID NO: 69746 - DNA, 25 bp, Rattus norvegicus
acaaataccacctggcttttcaggg

SEQ ID NO: 69747 - DNA, 25 bp, Rattus norvegicus
acaaatacccaacttcttgacaaag

SEQ ID NO: 69748 - DNA, 25 bp, Rattus norvegicus
acaaatacccaagttcttgacaaag

SEQ ID NO: 69749 - DNA, 25 bp, Rattus norvegicus
acaaatagcctgaccatggtgctgg

SEQ ID NO: 69750 - DNA, 25 bp, Rattus norvegicus
acaaatagcctgtccatggtgctgg

SEQ ID NO: 69751 - DNA, 25 bp, Rattus norvegicus
acaaatatcaccaactccagtgtct

SEQ ID NO: 69752 - DNA, 25 bp, Rattus norvegicus
acaaatatcacctactccagtgtct

SEQ ID NO: 69753 - DNA, 25 bp, Rattus norvegicus
acaaatatctagctgctctgcatga

SEQ ID NO: 69754 - DNA, 25 bp, Rattus norvegicus
acaaatatctaggtgctctgcatga

SEQ ID NO: 69755 - DNA, 25 bp, Rattus norvegicus
acaaatattgttactggctcctacc

SEQ ID NO: 69756 - DNA, 25 bp, Rattus norvegicus
acaaatattgtttctggctcctacc

SEQ ID NO: 69757 - DNA, 25 bp, Rattus norvegicus
acaaatcaatccagccctcaagggt

SEQ ID NO: 69758 - DNA, 25 bp, Rattus norvegicus
acaaatcaatcctgccctcaagggt

SEQ ID NO: 69759 - DNA, 25 bp, Rattus norvegicus
acaaatcacatcctgcagtgttcca

SEQ ID NO: 69760 - DNA, 25 bp, Rattus norvegicus
acaaatcacatcgtgcagtgttcca

SEQ ID NO: 69761 - DNA, 25 bp, Rattus norvegicus
acaaatcatggaactgtgaacactg

SEQ ID NO: 69762 - DNA, 25 bp, Rattus norvegicus
acaaatcatggatctgtgaacactg

SEQ ID NO: 69763 - DNA, 25 bp, Rattus norvegicus
acaaatccagcacttttgcctcatc

SEQ ID NO: 69764 - DNA, 25 bp, Rattus norvegicus
acaaatccagcagttttgcctcatc

SEQ ID NO: 69765 - DNA, 25 bp, Rattus norvegicus
acaaatccccgcacatggcaacttg

SEQ ID NO: 69766 - DNA, 25 bp, Rattus norvegicus
acaaatccccgctcatggcaacttg

SEQ ID NO: 69767 - DNA, 25 bp, Rattus norvegicus
acaaatcccggaccaggccaggttt

SEQ ID NO: 69768 - DNA, 25 bp, Rattus norvegicus
acaaatcccggagcaggccaggttt

SEQ ID NO: 69769 - DNA, 25 bp, Rattus norvegicus
acaaatcgaaagagcctcctgagga

SEQ ID NO: 69770 - DNA, 25 bp, Rattus norvegicus
acaaatcgaaagtgcctcctgagga

SEQ ID NO: 69771 - DNA, 25 bp, Rattus norvegicus
acaaatctagtgactctcttttctc

SEQ ID NO: 69772 - DNA, 25 bp, Rattus norvegicus
acaaatctagtgtctctcttttctc

SEQ ID NO: 69773 - DNA, 25 bp, Rattus norvegicus
acaaatctatccaagttccgcaagc

SEQ ID NO: 69774 - DNA, 25 bp, Rattus norvegicus
acaaatctatcctagttccgcaagc

SEQ ID NO: 69775 - DNA, 25 bp, Rattus norvegicus
acaaatctatttcagtgccatggct

SEQ ID NO: 69776 - DNA, 25 bp, Rattus norvegicus
acaaatctatttgagtgccatggct

SEQ ID NO: 69777 - DNA, 25 bp, Rattus norvegicus
acaaatctcacaactgttttctgtt

SEQ ID NO: 69778 - DNA, 25 bp, Rattus norvegicus
acaaatctcacatctgttttctgtt

SEQ ID NO: 69779 - DNA, 25 bp, Rattus norvegicus
acaaatcttctgatgcattgactat

SEQ ID NO: 69780 - DNA, 25 bp, Rattus norvegicus
acaaatcttctgttgcattgactat

SEQ ID NO: 69781 - DNA, 25 bp, Rattus norvegicus
acaaatcttgttcttctaggctgca

SEQ ID NO: 69782 - DNA, 25 bp, Rattus norvegicus
acaaatcttgttgttctaggctgca

SEQ ID NO: 69783 - DNA, 25 bp, Rattus norvegicus
acaaatgaacacagccttagcctct

SEQ ID NO: 69784 - DNA, 25 bp, Rattus norvegicus
acaaatgaacactgccttagcctct

SEQ ID NO: 69785 - DNA, 25 bp, Rattus norvegicus
acaaatgaaggcaggctgggacgtt

SEQ ID NO: 69786 - DNA, 25 bp, Rattus norvegicus
acaaatgaaggctggctgggacgtt

SEQ ID NO: 69787 - DNA, 25 bp, Rattus norvegicus
acaaatgaattgagcccactttttt

SEQ ID NO: 69788 - DNA, 25 bp, Rattus norvegicus
acaaatgaattgtgcccactttttt

SEQ ID NO: 69789 - DNA, 25 bp, Rattus norvegicus
acaaatgactgtcattctctcccgc

SEQ ID NO: 69790 - DNA, 25 bp, Rattus norvegicus
acaaatgactgtgattctctcccgc

SEQ ID NO: 69791 - DNA, 25 bp, Rattus norvegicus
acaaatgaggcgactctgtctcctt

SEQ ID NO: 69792 - DNA, 25 bp, Rattus norvegicus
acaaatgaggcgtctctgtctcctt

SEQ ID NO: 69793 - DNA, 25 bp, Rattus norvegicus
acaaatgcatgtacactgtgtacat

SEQ ID NO: 69794 - DNA, 25 bp, Rattus norvegicus
acaaatgcatgttcactgtgtacat

SEQ ID NO: 69795 - DNA, 25 bp, Rattus norvegicus
acaaatgcattcaaagcctggaagt

SEQ ID NO: 69796 - DNA, 25 bp, Rattus norvegicus
acaaatgcattctaagcctggaagt

SEQ ID NO: 69797 - DNA, 25 bp, Rattus norvegicus
acaaatgcggatacttgtcacagaa

SEQ ID NO: 69798 - DNA, 25 bp, Rattus norvegicus
acaaatgcggattcttgtcacagaa

SEQ ID NO: 69799 - DNA, 25 bp, Rattus norvegicus
acaaatgctgctaccctttagtaat

SEQ ID NO: 69800 - DNA, 25 bp, Rattus norvegicus
acaaatgctgcttccctttagtaat

SEQ ID NO: 69801 - DNA, 25 bp, Rattus norvegicus
acaaatgcttagaccttctgtttcc

SEQ ID NO: 69802 - DNA, 25 bp, Rattus norvegicus
acaaatgcttagtccttctgtttcc

SEQ ID NO: 69803 - DNA, 25 bp, Rattus norvegicus
acaaatgggcccagggtagccacag

SEQ ID NO: 69804 - DNA, 25 bp, Rattus norvegicus
acaaatgggccctgggtagccacag

SEQ ID NO: 69805 - DNA, 25 bp, Rattus norvegicus
acaaatggtttcctctgtcacctgt

SEQ ID NO: 69806 - DNA, 25 bp, Rattus norvegicus
acaaatggtttcgtctgtcacctgt

SEQ ID NO: 69807 - DNA, 25 bp, Rattus norvegicus
acaaatgtaaccctcagaactccct

SEQ ID NO: 69808 - DNA, 25 bp, Rattus norvegicus
acaaatgtaaccgtcagaactccct

SEQ ID NO: 69809 - DNA, 25 bp, Rattus norvegicus
acaaatgtgctgctgggcctaggac

SEQ ID NO: 69810 - DNA, 25 bp, Rattus norvegicus
acaaatgtgctggtgggcctaggac

SEQ ID NO: 69811 - DNA, 25 bp, Rattus norvegicus
acaaatgtggacactgaaccactga

SEQ ID NO: 69812 - DNA, 25 bp, Rattus norvegicus
acaaatgtggactctgaaccactga

SEQ ID NO: 69813 - DNA, 25 bp, Rattus norvegicus
acaaatgttcttatcccatgattac

SEQ ID NO: 69814 - DNA, 25 bp, Rattus norvegicus
acaaatgttcttttcccatgattac

SEQ ID NO: 69815 - DNA, 25 bp, Rattus norvegicus
acaaattcatccacagattccacag

SEQ ID NO: 69816 - DNA, 25 bp, Rattus norvegicus
acaaattcatcctcagattccacag

SEQ ID NO: 69817 - DNA, 25 bp, Rattus norvegicus
acaaattcattcacttagtccttaa

SEQ ID NO: 69818 - DNA, 25 bp, Rattus norvegicus
acaaattcattctcttagtccttaa

SEQ ID NO: 69819 - DNA, 25 bp, Rattus norvegicus
acaaattccaatcgcctgcacttgt

SEQ ID NO: 69820 - DNA, 25 bp, Rattus norvegicus
acaaattccaatggcctgcacttgt

SEQ ID NO: 69821 - DNA, 25 bp, Rattus norvegicus
acaaattcccttctgtgcagcaggc

SEQ ID NO: 69822 - DNA, 25 bp, Rattus norvegicus
acaaattcccttgtgtgcagcaggc

SEQ ID NO: 69823 - DNA, 25 bp, Rattus norvegicus
acaaattccgagatattatcatccg

SEQ ID NO: 69824 - DNA, 25 bp, Rattus norvegicus
acaaattccgagttattatcatccg

SEQ ID NO: 69825 - DNA, 25 bp, Rattus norvegicus
acaaattcttgtattgctgctccca

SEQ ID NO: 69826 - DNA, 25 bp, Rattus norvegicus
acaaattcttgttttgctgctccca

SEQ ID NO: 69827 - DNA, 25 bp, Rattus norvegicus
acaaattgaactatgcctcacacct

SEQ ID NO: 69828 - DNA, 25 bp, Rattus norvegicus
acaaattgaactttgcctcacacct

SEQ ID NO: 69829 - DNA, 25 bp, Rattus norvegicus
acaaattgccttaagagactctgct

SEQ ID NO: 69830 - DNA, 25 bp, Rattus norvegicus
acaaattgcctttagagactctgct

SEQ ID NO: 69831 - DNA, 25 bp, Rattus norvegicus
acaaatttcatacagctcagccggc

SEQ ID NO: 69832 - DNA, 25 bp, Rattus norvegicus
acaaatttcatagagctcagccggc

SEQ ID NO: 69833 - DNA, 25 bp, Rattus norvegicus
acaaatttcctaaacacgtcattga

SEQ ID NO: 69834 - DNA, 25 bp, Rattus norvegicus
acaaatttcctatacacgtcattga

SEQ ID NO: 69835 - DNA, 25 bp, Rattus norvegicus
acaaatttctgcagctcacttggga

SEQ ID NO: 69836 - DNA, 25 bp, Rattus norvegicus
acaaatttctgctgctcacttggga

SEQ ID NO: 69837 - DNA, 25 bp, Rattus norvegicus
acaaatttggatccgcaagcaaggg

SEQ ID NO: 69838 - DNA, 25 bp, Rattus norvegicus
acaaatttggatgcgcaagcaaggg

SEQ ID NO: 69839 - DNA, 25 bp, Rattus norvegicus
acaaattttcagatcagttgctggg

SEQ ID NO: 69840 - DNA, 25 bp, Rattus norvegicus
acaaattttcagttcagttgctggg

SEQ ID NO: 69841 - DNA, 25 bp, Rattus norvegicus
acaaattttcttattatggatcact

SEQ ID NO: 69842 - DNA, 25 bp, Rattus norvegicus
acaaattttctttttatggatcact

SEQ ID NO: 69843 - DNA, 25 bp, Rattus norvegicus
acaacaaaaccactccattcggcgg

SEQ ID NO: 69844 - DNA, 25 bp, Rattus norvegicus
acaacaaaaccactgactgctcgta

SEQ ID NO: 69845 - DNA, 25 bp, Rattus norvegicus
acaacaaaaccagtccattcggcgg

SEQ ID NO: 69846 - DNA, 25 bp, Rattus norvegicus
acaacaaaaccagtgactgctcgta

SEQ ID NO: 69847 - DNA, 25 bp, Rattus norvegicus
acaacaaacaatccattcctttttt

SEQ ID NO: 69848 - DNA, 25 bp, Rattus norvegicus
acaacaaacaatgcattcctttttt

SEQ ID NO: 69849 - DNA, 25 bp, Rattus norvegicus
acaacaaagatgacagctgccacta

SEQ ID NO: 69850 - DNA, 25 bp, Rattus norvegicus
acaacaaagatgactgagcccagaa

SEQ ID NO: 69851 - DNA, 25 bp, Rattus norvegicus
acaacaaagatgtcagctgccacta

SEQ ID NO: 69852 - DNA, 25 bp, Rattus norvegicus
acaacaaagatgtctgagcccagaa

SEQ ID NO: 69853 - DNA, 25 bp, Rattus norvegicus
acaacaacaaagacagccctgtacc

SEQ ID NO: 69854 - DNA, 25 bp, Rattus norvegicus
acaacaacaaagtcagccctgtacc

SEQ ID NO: 69855 - DNA, 25 bp, Rattus norvegicus
acaacaacaaatatcctaccctcat

SEQ ID NO: 69856 - DNA, 25 bp, Rattus norvegicus
acaacaacaaatttcctaccctcat

SEQ ID NO: 69857 - DNA, 25 bp, Rattus norvegicus
acaacaacagtgatctgcagaagca

SEQ ID NO: 69858 - DNA, 25 bp, Rattus norvegicus
acaacaacagtgttctgcagaagca

SEQ ID NO: 69859 - DNA, 25 bp, Rattus norvegicus
acaacaacctgcatatttcttctct

SEQ ID NO: 69860 - DNA, 25 bp, Rattus norvegicus
acaacaacctgcttatttcttctct

SEQ ID NO: 69861 - DNA, 25 bp, Rattus norvegicus
acaacaacgtgcctgtgcttgctgt

SEQ ID NO: 69862 - DNA, 25 bp, Rattus norvegicus
acaacaacgtgcgtgtgcttgctgt

SEQ ID NO: 69863 - DNA, 25 bp, Rattus norvegicus
acaacaagccttacagtgggacttt

SEQ ID NO: 69864 - DNA, 25 bp, Rattus norvegicus
acaacaagcctttcagtgggacttt

SEQ ID NO: 69865 - DNA, 25 bp, Rattus norvegicus
acaacaatcaccattaggccctgag

SEQ ID NO: 69866 - DNA, 25 bp, Rattus norvegicus
acaacaatcacctttaggccctgag

SEQ ID NO: 69867 - DNA, 25 bp, Rattus norvegicus
acaacaatgcatattctaacggctg

SEQ ID NO: 69868 - DNA, 25 bp, Rattus norvegicus
acaacaatgcattttctaacggctg

SEQ ID NO: 69869 - DNA, 25 bp, Rattus norvegicus
acaacacaatgaagggagcctcacc

SEQ ID NO: 69870 - DNA, 25 bp, Rattus norvegicus
acaacacaatgatgggagcctcacc

SEQ ID NO: 69871 - DNA, 25 bp, Rattus norvegicus
acaacacaattgacagccacttttt

SEQ ID NO: 69872 - DNA, 25 bp, Rattus norvegicus
acaacacaattgtcagccacttttt

SEQ ID NO: 69873 - DNA, 25 bp, Rattus norvegicus
acaacacacatgcaggctcttctta

SEQ ID NO: 69874 - DNA, 25 bp, Rattus norvegicus
acaacacacatggaggctcttctta

SEQ ID NO: 69875 - DNA, 25 bp, Rattus norvegicus
acaacacactgcatttttaacccat

SEQ ID NO: 69876 - DNA, 25 bp, Rattus norvegicus
acaacacactgcttttttaacccat

SEQ ID NO: 69877 - DNA, 25 bp, Rattus norvegicus
acaacacactggagcacatacacag

SEQ ID NO: 69878 - DNA, 25 bp, Rattus norvegicus
acaacacactggtgcacatacacag

SEQ ID NO: 69879 - DNA, 25 bp, Rattus norvegicus
acaacacatttcatccagacgcaat

SEQ ID NO: 69880 - DNA, 25 bp, Rattus norvegicus
acaacacatttcttccagacgcaat

SEQ ID NO: 69881 - DNA, 25 bp, Rattus norvegicus
acaacacatttgcatctaagctgga

SEQ ID NO: 69882 - DNA, 25 bp, Rattus norvegicus
acaacacatttggatctaagctgga

SEQ ID NO: 69883 - DNA, 25 bp, Rattus norvegicus
acaacaccaacgctgtgtgaggtat

SEQ ID NO: 69884 - DNA, 25 bp, Rattus norvegicus
acaacaccaacggtgtgtgaggtat

SEQ ID NO: 69885 - DNA, 25 bp, Rattus norvegicus
acaacacccattcattcgtcttaag

SEQ ID NO: 69886 - DNA, 25 bp, Rattus norvegicus
acaacacccattgattcgtcttaag

SEQ ID NO: 69887 - DNA, 25 bp, Rattus norvegicus
acaacacctgaacttgtcctctggc

SEQ ID NO: 69888 - DNA, 25 bp, Rattus norvegicus
acaacacctgaagttgtcctctggc

SEQ ID NO: 69889 - DNA, 25 bp, Rattus norvegicus
acaacacctgtgacggctagtcatc

SEQ ID NO: 69890 - DNA, 25 bp, Rattus norvegicus
acaacacctgtgtcggctagtcatc

SEQ ID NO: 69891 - DNA, 25 bp, Rattus norvegicus
acaacacgaggtcgccctggcagtt

SEQ ID NO: 69892 - DNA, 25 bp, Rattus norvegicus
acaacacgaggtggccctggcagtt

SEQ ID NO: 69893 - DNA, 25 bp, Rattus norvegicus
acaacacgatgtcccctggcaggag

SEQ ID NO: 69894 - DNA, 25 bp, Rattus norvegicus
acaacacgatgtgccctggcaggag

SEQ ID NO: 69895 - DNA, 25 bp, Rattus norvegicus
acaacacgcacactgctgacacata

SEQ ID NO: 69896 - DNA, 25 bp, Rattus norvegicus
acaacacgcacagtgctgacacata

SEQ ID NO: 69897 - DNA, 25 bp, Rattus norvegicus
acaacacgccggactgactctggcg

SEQ ID NO: 69898 - DNA, 25 bp, Rattus norvegicus
acaacacgccggtctgactctggcg

SEQ ID NO: 69899 - DNA, 25 bp, Rattus norvegicus
acaacacgggtgagttctctggttt

SEQ ID NO: 69900 - DNA, 25 bp, Rattus norvegicus
acaacacgggtgtgttctctggttt

SEQ ID NO: 69901 - DNA, 25 bp, Rattus norvegicus
acaacacggtgtacggctaacctcg

SEQ ID NO: 69902 - DNA, 25 bp, Rattus norvegicus
acaacacggtgttcggctaacctcg

SEQ ID NO: 69903 - DNA, 25 bp, Rattus norvegicus
acaacacgtcctagacatgctgttc

SEQ ID NO: 69904 - DNA, 25 bp, Rattus norvegicus
acaacacgtccttgacatgctgttc

SEQ ID NO: 69905 - DNA, 25 bp, Rattus norvegicus
acaacactacatatgctcacagatg

SEQ ID NO: 69906 - DNA, 25 bp, Rattus norvegicus
acaacactacatttgctcacagatg

SEQ ID NO: 69907 - DNA, 25 bp, Rattus norvegicus
acaacactcaggacaacttcatggc

SEQ ID NO: 69908 - DNA, 25 bp, Rattus norvegicus
acaacactcaggtcaacttcatggc

SEQ ID NO: 69909 - DNA, 25 bp, Rattus norvegicus
acaacactccatactctctgtgaat

SEQ ID NO: 69910 - DNA, 25 bp, Rattus norvegicus
acaacactccattctctctgtgaat

SEQ ID NO: 69911 - DNA, 25 bp, Rattus norvegicus
acaacactcgtgagctcttcgaggg

SEQ ID NO: 69912 - DNA, 25 bp, Rattus norvegicus
acaacactcgtgtgctcttcgaggg

SEQ ID NO: 69913 - DNA, 25 bp, Rattus norvegicus
acaacactgccccttggtggaggtg

SEQ ID NO: 69914 - DNA, 25 bp, Rattus norvegicus
acaacactgcccgttggtggaggtg

SEQ ID NO: 69915 - DNA, 25 bp, Rattus norvegicus
acaacactgtgcagttactgtggta

SEQ ID NO: 69916 - DNA, 25 bp, Rattus norvegicus
acaacactgtgctgttactgtggta

SEQ ID NO: 69917 - DNA, 25 bp, Rattus norvegicus
acaacacttagtcgccttctgggag

SEQ ID NO: 69918 - DNA, 25 bp, Rattus norvegicus
acaacacttagtggccttctgggag

SEQ ID NO: 69919 - DNA, 25 bp, Rattus norvegicus
acaacacttctcaggtcgaactgaa

SEQ ID NO: 69920 - DNA, 25 bp, Rattus norvegicus
acaacacttctctggtcgaactgaa

SEQ ID NO: 69921 - DNA, 25 bp, Rattus norvegicus
acaacagaattcaaatccaagcgtg

SEQ ID NO: 69922 - DNA, 25 bp, Rattus norvegicus
acaacagaattctaatccaagcgtg

SEQ ID NO: 69923 - DNA, 25 bp, Rattus norvegicus
acaacagagctgagtatggccttgg

SEQ ID NO: 69924 - DNA, 25 bp, Rattus norvegicus
acaacagagctgtgtatggccttgg

SEQ ID NO: 69925 - DNA, 25 bp, Rattus norvegicus
acaacagatagcatgtcacggcagc

SEQ ID NO: 69926 - DNA, 25 bp, Rattus norvegicus
acaacagatagcttgtcacggcagc

SEQ ID NO: 69927 - DNA, 25 bp, Rattus norvegicus
acaacagcaaagaagggcacagcct

SEQ ID NO: 69928 - DNA, 25 bp, Rattus norvegicus
acaacagcaaagtagggcacagcct

SEQ ID NO: 69929 - DNA, 25 bp, Rattus norvegicus
acaacagcaacgacttgaacaggcg

SEQ ID NO: 69930 - DNA, 25 bp, Rattus norvegicus
acaacagcaacgtcttgaacaggcg

SEQ ID NO: 69931 - DNA, 25 bp, Rattus norvegicus
acaacagcagctcctccgtctgtgt

SEQ ID NO: 69932 - DNA, 25 bp, Rattus norvegicus
acaacagcagctgctccgtctgtgt

SEQ ID NO: 69933 - DNA, 25 bp, Rattus norvegicus
acaacagcctttatggtctctcatg

SEQ ID NO: 69934 - DNA, 25 bp, Rattus norvegicus
acaacagcctttttggtctctcatg

SEQ ID NO: 69935 - DNA, 25 bp, Rattus norvegicus
acaacagcgtggagtatggagcgaa

SEQ ID NO: 69936 - DNA, 25 bp, Rattus norvegicus
acaacagcgtggtgtatggagcgaa

SEQ ID NO: 69937 - DNA, 25 bp, Rattus norvegicus
acaacaggacagatccagacccgga

SEQ ID NO: 69938 - DNA, 25 bp, Rattus norvegicus
acaacaggacagttccagacccgga

SEQ ID NO: 69939 - DNA, 25 bp, Rattus norvegicus
acaacaggtgcacagatcagggact

SEQ ID NO: 69940 - DNA, 25 bp, Rattus norvegicus
acaacaggtgcagagatcagggact

SEQ ID NO: 69941 - DNA, 25 bp, Rattus norvegicus
acaacagtctatccggaagtccttt

SEQ ID NO: 69942 - DNA, 25 bp, Rattus norvegicus
acaacagtctatgcggaagtccttt

SEQ ID NO: 69943 - DNA, 25 bp, Rattus norvegicus
acaacagtctgcaggcgctctgtcc

SEQ ID NO: 69944 - DNA, 25 bp, Rattus norvegicus
acaacagtctgctggcgctctgtcc

SEQ ID NO: 69945 - DNA, 25 bp, Rattus norvegicus
acaacagtggttccctagggttcta

SEQ ID NO: 69946 - DNA, 25 bp, Rattus norvegicus
acaacagtggttgcctagggttcta

SEQ ID NO: 69947 - DNA, 25 bp, Rattus norvegicus
acaacagtgtctctgtggagctcaa

SEQ ID NO: 69948 - DNA, 25 bp, Rattus norvegicus
acaacagtgtctgtgtggagctcaa

SEQ ID NO: 69949 - DNA, 25 bp, Rattus norvegicus
acaacagtgttaccgcagcctgctg

SEQ ID NO: 69950 - DNA, 25 bp, Rattus norvegicus
acaacagtgttagcgcagcctgctg

SEQ ID NO: 69951 - DNA, 25 bp, Rattus norvegicus
acaacagttggcaaaagcgcggact

SEQ ID NO: 69952 - DNA, 25 bp, Rattus norvegicus
acaacagttggctaaagcgcggact

SEQ ID NO: 69953 - DNA, 25 bp, Rattus norvegicus
acaacagttgtcaccattggtatac

SEQ ID NO: 69954 - DNA, 25 bp, Rattus norvegicus
acaacagttgtctccattggtatac

SEQ ID NO: 69955 - DNA, 25 bp, Rattus norvegicus
acaacatcacccaccaggacctggt

SEQ ID NO: 69956 - DNA, 25 bp, Rattus norvegicus
acaacatcaccctccaggacctggt

SEQ ID NO: 69957 - DNA, 25 bp, Rattus norvegicus
acaacatcgtgtacatgcctgtcat

SEQ ID NO: 69958 - DNA, 25 bp, Rattus norvegicus
acaacatcgtgttcatgcctgtcat

SEQ ID NO: 69959 - DNA, 25 bp, Rattus norvegicus
acaacatctaccatactggctggga

SEQ ID NO: 69960 - DNA, 25 bp, Rattus norvegicus
acaacatctaccttactggctggga

SEQ ID NO: 69961 - DNA, 25 bp, Rattus norvegicus
acaacatctctcaggtctggaaggg

SEQ ID NO: 69962 - DNA, 25 bp, Rattus norvegicus
acaacatctctctggtctggaaggg

SEQ ID NO: 69963 - DNA, 25 bp, Rattus norvegicus
acaacatgaacgactgctactccaa

SEQ ID NO: 69964 - DNA, 25 bp, Rattus norvegicus
acaacatgaacgtctgctactccaa

SEQ ID NO: 69965 - DNA, 25 bp, Rattus norvegicus
acaacatgcaagacgggcagtccac

SEQ ID NO: 69966 - DNA, 25 bp, Rattus norvegicus
acaacatgcaagtcgggcagtccac

SEQ ID NO: 69967 - DNA, 25 bp, Rattus norvegicus
acaacatgcctactcggaagaacgt

SEQ ID NO: 69968 - DNA, 25 bp, Rattus norvegicus
acaacatgcctagtcggaagaacgt

SEQ ID NO: 69969 - DNA, 25 bp, Rattus norvegicus
acaacatggtcccatacctcgggta

SEQ ID NO: 69970 - DNA, 25 bp, Rattus norvegicus
acaacatggtccgatacctcgggta

SEQ ID NO: 69971 - DNA, 25 bp, Rattus norvegicus
acaacatgtgagagctacagcggat

SEQ ID NO: 69972 - DNA, 25 bp, Rattus norvegicus
acaacatgtgagtgctacagcggat

SEQ ID NO: 69973 - DNA, 25 bp, Rattus norvegicus
acaacatgttctccatctgtctgtc

SEQ ID NO: 69974 - DNA, 25 bp, Rattus norvegicus
acaacatgttctgcatctgtctgtc

SEQ ID NO: 69975 - DNA, 25 bp, Rattus norvegicus
acaacattactactccgggcattaa

SEQ ID NO: 69976 - DNA, 25 bp, Rattus norvegicus
acaacattactagtccgggcattaa

SEQ ID NO: 69977 - DNA, 25 bp, Rattus norvegicus
acaacattatagatttctgttcaga

SEQ ID NO: 69978 - DNA, 25 bp, Rattus norvegicus
acaacattatagttttctgttcaga

SEQ ID NO: 69979 - DNA, 25 bp, Rattus norvegicus
acaacattggtcacagtttcagttt

SEQ ID NO: 69980 - DNA, 25 bp, Rattus norvegicus
acaacattggtctcagtttcagttt

SEQ ID NO: 69981 - DNA, 25 bp, Rattus norvegicus
acaacatttaagcaagcccgtctat

SEQ ID NO: 69982 - DNA, 25 bp, Rattus norvegicus
acaacatttaaggaagcccgtctat

SEQ ID NO: 69983 - DNA, 25 bp, Rattus norvegicus
acaacatttgtgaccctgtacagtt

SEQ ID NO: 69984 - DNA, 25 bp, Rattus norvegicus
acaacatttgtgtccctgtacagtt

SEQ ID NO: 69985 - DNA, 25 bp, Rattus norvegicus
acaaccaaagcccatgtgtgcatgc

SEQ ID NO: 69986 - DNA, 25 bp, Rattus norvegicus
acaaccaaagccgatgtgtgcatgc

SEQ ID NO: 69987 - DNA, 25 bp, Rattus norvegicus
acaaccaagaatcgtgaagccctcc

SEQ ID NO: 69988 - DNA, 25 bp, Rattus norvegicus
acaaccaagaatggtgaagccctcc

SEQ ID NO: 69989 - DNA, 25 bp, Rattus norvegicus
acaaccacaagaagtcgtcctgacc

SEQ ID NO: 69990 - DNA, 25 bp, Rattus norvegicus
acaaccacaagatgtcgtcctgacc

SEQ ID NO: 69991 - DNA, 25 bp, Rattus norvegicus
acaaccaccaccacagaggaggagg

SEQ ID NO: 69992 - DNA, 25 bp, Rattus norvegicus
acaaccaccacctcagaggaggagg

SEQ ID NO: 69993 - DNA, 25 bp, Rattus norvegicus
acaaccaccgggaactctagctctg

SEQ ID NO: 69994 - DNA, 25 bp, Rattus norvegicus
acaaccaccgggtactctagctctg

SEQ ID NO: 69995 - DNA, 25 bp, Rattus norvegicus
acaaccacctcaagcacttctgtag

SEQ ID NO: 69996 - DNA, 25 bp, Rattus norvegicus
acaaccacctcatgcacttctgtag

SEQ ID NO: 69997 - DNA, 25 bp, Rattus norvegicus
acaaccacctgacgactgagaacct

SEQ ID NO: 69998 - DNA, 25 bp, Rattus norvegicus
acaaccacctgaggactgagaacct

SEQ ID NO: 69999 - DNA, 25 bp, Rattus norvegicus
acaaccactacaagccggatttgca

SEQ ID NO: 70000 - DNA, 25 bp, Rattus norvegicus
acaaccactacatgccggatttgca

SEQ ID NO: 70001 - DNA, 25 bp, Rattus norvegicus
acaaccactgacacttgtggccgca

SEQ ID NO: 70002 - DNA, 25 bp, Rattus norvegicus
acaaccactgactcttgtggccgca

SEQ ID NO: 70003 - DNA, 25 bp, Rattus norvegicus
acaaccactggcctttgtgaactag

SEQ ID NO: 70004 - DNA, 25 bp, Rattus norvegicus
acaaccactggcgtttgtgaactag

SEQ ID NO: 70005 - DNA, 25 bp, Rattus norvegicus
acaaccagcgatccgtaaccttgaa

SEQ ID NO: 70006 - DNA, 25 bp, Rattus norvegicus
acaaccagcgatgcgtaaccttgaa

SEQ ID NO: 70007 - DNA, 25 bp, Rattus norvegicus
acaaccagtgtgactgctgctctgt

SEQ ID NO: 70008 - DNA, 25 bp, Rattus norvegicus
acaaccagtgtgtctgctgctctgt

SEQ ID NO: 70009 - DNA, 25 bp, Rattus norvegicus
acaaccatactcagatttacttatt

SEQ ID NO: 70010 - DNA, 25 bp, Rattus norvegicus
acaaccatactctgatttacttatt

SEQ ID NO: 70011 - DNA, 25 bp, Rattus norvegicus
acaaccatgacgcactgctcaagaa

SEQ ID NO: 70012 - DNA, 25 bp, Rattus norvegicus
acaaccatgacggactgctcaagaa

SEQ ID NO: 70013 - DNA, 25 bp, Rattus norvegicus
acaaccattagtaaccttcaccaga

SEQ ID NO: 70014 - DNA, 25 bp, Rattus norvegicus
acaaccattagttaccttcaccaga

SEQ ID NO: 70015 - DNA, 25 bp, Rattus norvegicus
acaaccattatacccgtgtccctgg

SEQ ID NO: 70016 - DNA, 25 bp, Rattus norvegicus
acaaccattatagccgtgtccctgg

SEQ ID NO: 70017 - DNA, 25 bp, Rattus norvegicus
acaacccaaagtctttgctcacaaa

SEQ ID NO: 70018 - DNA, 25 bp, Rattus norvegicus
acaacccaaagtgtttgctcacaaa

SEQ ID NO: 70019 - DNA, 25 bp, Rattus norvegicus
acaacccaaggaacaatgtcagatt

SEQ ID NO: 70020 - DNA, 25 bp, Rattus norvegicus
acaacccaaggatcaatgtcagatt

SEQ ID NO: 70021 - DNA, 25 bp, Rattus norvegicus
acaacccagcacaaagtcgacaatg

SEQ ID NO: 70022 - DNA, 25 bp, Rattus norvegicus
acaacccagcactaagtcgacaatg

SEQ ID NO: 70023 - DNA, 25 bp, Rattus norvegicus
acaacccagctgagtcctgttatgg

SEQ ID NO: 70024 - DNA, 25 bp, Rattus norvegicus
acaacccagctgtgtcctgttatgg

SEQ ID NO: 70025 - DNA, 25 bp, Rattus norvegicus
acaacccagggcatcgtgtgtgtta

SEQ ID NO: 70026 - DNA, 25 bp, Rattus norvegicus
acaacccagggcttcgtgtgtgtta

SEQ ID NO: 70027 - DNA, 25 bp, Rattus norvegicus
acaaccccagctatgttcggagttc

SEQ ID NO: 70028 - DNA, 25 bp, Rattus norvegicus
acaaccccagctttgttcggagttc

SEQ ID NO: 70029 - DNA, 25 bp, Rattus norvegicus
acaacccctgggactgtgacaagga

SEQ ID NO: 70030 - DNA, 25 bp, Rattus norvegicus
acaacccctgggtctgtgacaagga

SEQ ID NO: 70031 - DNA, 25 bp, Rattus norvegicus
acaaccccttctcagatgagctgag

SEQ ID NO: 70032 - DNA, 25 bp, Rattus norvegicus
acaaccccttctgagatgagctgag

SEQ ID NO: 70033 - DNA, 25 bp, Rattus norvegicus
acaacccgcagtacataattccagg

SEQ ID NO: 70034 - DNA, 25 bp, Rattus norvegicus
acaacccgcagttcataattccagg

SEQ ID NO: 70035 - DNA, 25 bp, Rattus norvegicus
acaaccctacggagccactttgagg

SEQ ID NO: 70036 - DNA, 25 bp, Rattus norvegicus
acaaccctacggtgccactttgagg

SEQ ID NO: 70037 - DNA, 25 bp, Rattus norvegicus
acaaccctcaccagaagagtcttta

SEQ ID NO: 70038 - DNA, 25 bp, Rattus norvegicus
acaaccctcacctgaagagtcttta

SEQ ID NO: 70039 - DNA, 25 bp, Rattus norvegicus
acaaccctcctgatatgttctttga

SEQ ID NO: 70040 - DNA, 25 bp, Rattus norvegicus
acaaccctcctgttatgttctttga

SEQ ID NO: 70041 - DNA, 25 bp, Rattus norvegicus
acaaccctgccaattggtctggaaa

SEQ ID NO: 70042 - DNA, 25 bp, Rattus norvegicus
acaaccctgccatttggtctggaaa

SEQ ID NO: 70043 - DNA, 25 bp, Rattus norvegicus
acaacccttctgagtgtttccttag

SEQ ID NO: 70044 - DNA, 25 bp, Rattus norvegicus
acaacccttctgtgtgtttccttag

SEQ ID NO: 70045 - DNA, 25 bp, Rattus norvegicus
acaaccgaggtgaagctggcagaac

SEQ ID NO: 70046 - DNA, 25 bp, Rattus norvegicus
acaaccgaggtgtagctggcagaac

SEQ ID NO: 70047 - DNA, 25 bp, Rattus norvegicus
acaaccgcacgacgctggtacagtt

SEQ ID NO: 70048 - DNA, 25 bp, Rattus norvegicus
acaaccgcacgaggctggtacagtt

SEQ ID NO: 70049 - DNA, 25 bp, Rattus norvegicus
acaaccgcatcaacgaggagacgct

SEQ ID NO: 70050 - DNA, 25 bp, Rattus norvegicus
acaaccgcatcatcgaggagacgct

SEQ ID NO: 70051 - DNA, 25 bp, Rattus norvegicus
acaaccgccattcctgaagcctggg

SEQ ID NO: 70052 - DNA, 25 bp, Rattus norvegicus
acaaccgccattgctgaagcctggg

SEQ ID NO: 70053 - DNA, 25 bp, Rattus norvegicus
acaaccgcttcacaagtcctgctaa

SEQ ID NO: 70054 - DNA, 25 bp, Rattus norvegicus
acaaccgcttcagaagtcctgctaa

SEQ ID NO: 70055 - DNA, 25 bp, Rattus norvegicus
acaaccggatgtaggtttctctcct

SEQ ID NO: 70056 - DNA, 25 bp, Rattus norvegicus
acaaccggatgtcttgattgattta

SEQ ID NO: 70057 - DNA, 25 bp, Rattus norvegicus
acaaccggatgtgttgattgattta

SEQ ID NO: 70058 - DNA, 25 bp, Rattus norvegicus
acaaccggatgttggtttctctcct

SEQ ID NO: 70059 - DNA, 25 bp, Rattus norvegicus
acaaccggctcccttttgtaagcat

SEQ ID NO: 70060 - DNA, 25 bp, Rattus norvegicus
acaaccggctccgttttgtaagcat

SEQ ID NO: 70061 - DNA, 25 bp, Rattus norvegicus
acaaccggtgtcaggcatcgaactt

SEQ ID NO: 70062 - DNA, 25 bp, Rattus norvegicus
acaaccggtgtcaggtggacgtcaa

SEQ ID NO: 70063 - DNA, 25 bp, Rattus norvegicus
acaaccggtgtctggcatcgaactt

SEQ ID NO: 70064 - DNA, 25 bp, Rattus norvegicus
acaaccggtgtctggtggacgtcaa

SEQ ID NO: 70065 - DNA, 25 bp, Rattus norvegicus
acaaccggtttcacagaagctgatt

SEQ ID NO: 70066 - DNA, 25 bp, Rattus norvegicus
acaaccggtttctcagaagctgatt

SEQ ID NO: 70067 - DNA, 25 bp, Rattus norvegicus
acaaccgtgaggatcttgaattcat

SEQ ID NO: 70068 - DNA, 25 bp, Rattus norvegicus
acaaccgtgaggttcttgaattcat

SEQ ID NO: 70069 - DNA, 25 bp, Rattus norvegicus
acaaccgtggttcctgttttgactc

SEQ ID NO: 70070 - DNA, 25 bp, Rattus norvegicus
acaaccgtggttgctgttttgactc

SEQ ID NO: 70071 - DNA, 25 bp, Rattus norvegicus
acaaccgtgtagagagcaatctgct

SEQ ID NO: 70072 - DNA, 25 bp, Rattus norvegicus
acaaccgtgtagtgagcaatctgct

SEQ ID NO: 70073 - DNA, 25 bp, Rattus norvegicus
acaaccgtgtgaatcttgctgagtt

SEQ ID NO: 70074 - DNA, 25 bp, Rattus norvegicus
acaaccgtgtgattcttgctgagtt

SEQ ID NO: 70075 - DNA, 25 bp, Rattus norvegicus
acaaccgttccaatttatttctgag

SEQ ID NO: 70076 - DNA, 25 bp, Rattus norvegicus
acaaccgttccattttatttctgag

SEQ ID NO: 70077 - DNA, 25 bp, Rattus norvegicus
acaaccgttggacttatctttactg

SEQ ID NO: 70078 - DNA, 25 bp, Rattus norvegicus
acaaccgttggagttatctttactg

SEQ ID NO: 70079 - DNA, 25 bp, Rattus norvegicus
acaacctacgcactgacaagacttt

SEQ ID NO: 70080 - DNA, 25 bp, Rattus norvegicus
acaacctacgcagtgacaagacttt

SEQ ID NO: 70081 - DNA, 25 bp, Rattus norvegicus
acaacctacttcctgtagttgcagc

SEQ ID NO: 70082 - DNA, 25 bp, Rattus norvegicus
acaacctacttcgtgtagttgcagc

SEQ ID NO: 70083 - DNA, 25 bp, Rattus norvegicus
acaacctatgagaaggcgtccttgc

SEQ ID NO: 70084 - DNA, 25 bp, Rattus norvegicus
acaacctatgagtaggcgtccttgc

SEQ ID NO: 70085 - DNA, 25 bp, Rattus norvegicus
acaacctattcgaggatctctactt

SEQ ID NO: 70086 - DNA, 25 bp, Rattus norvegicus
acaacctattcgtggatctctactt

SEQ ID NO: 70087 - DNA, 25 bp, Rattus norvegicus
acaacctcaaggactggcagctgca

SEQ ID NO: 70088 - DNA, 25 bp, Rattus norvegicus
acaacctcaaggtctggcagctgca

SEQ ID NO: 70089 - DNA, 25 bp, Rattus norvegicus
acaacctcacgaaaaccatggcttt

SEQ ID NO: 70090 - DNA, 25 bp, Rattus norvegicus
acaacctcacgataaccatggcttt

SEQ ID NO: 70091 - DNA, 25 bp, Rattus norvegicus
acaacctcaggcaacagatttgcgg

SEQ ID NO: 70092 - DNA, 25 bp, Rattus norvegicus
acaacctcaggctacagatttgcgg

SEQ ID NO: 70093 - DNA, 25 bp, Rattus norvegicus
acaacctccaccactggctgggtgt

SEQ ID NO: 70094 - DNA, 25 bp, Rattus norvegicus
acaacctccacctctggctgggtgt

SEQ ID NO: 70095 - DNA, 25 bp, Rattus norvegicus
acaacctccgtgactaggcaaggaa

SEQ ID NO: 70096 - DNA, 25 bp, Rattus norvegicus
acaacctccgtgtctaggcaaggaa

SEQ ID NO: 70097 - DNA, 25 bp, Rattus norvegicus
acaacctcctgtatctgagcataga

SEQ ID NO: 70098 - DNA, 25 bp, Rattus norvegicus
acaacctcctgtttctgagcataga

SEQ ID NO: 70099 - DNA, 25 bp, Rattus norvegicus
acaacctctctcctgaaagctagga

SEQ ID NO: 70100 - DNA, 25 bp, Rattus norvegicus
acaacctctctcgtgaaagctagga

SEQ ID NO: 70101 - DNA, 25 bp, Rattus norvegicus
acaacctctggtattgggactggtg

SEQ ID NO: 70102 - DNA, 25 bp, Rattus norvegicus
acaacctctggttttgggactggtg

SEQ ID NO: 70103 - DNA, 25 bp, Rattus norvegicus
acaacctgaaggactgtggcctctt

SEQ ID NO: 70104 - DNA, 25 bp, Rattus norvegicus
acaacctgaaggtctgtggcctctt

SEQ ID NO: 70105 - DNA, 25 bp, Rattus norvegicus
acaacctgacaaatcctctgacagt

SEQ ID NO: 70106 - DNA, 25 bp, Rattus norvegicus
acaacctgacaattcctctgacagt

SEQ ID NO: 70107 - DNA, 25 bp, Rattus norvegicus
acaacctgcatgagccaagatggga

SEQ ID NO: 70108 - DNA, 25 bp, Rattus norvegicus
acaacctgcatgtgccaagatggga

SEQ ID NO: 70109 - DNA, 25 bp, Rattus norvegicus
acaacctgctgaacctgtagcttga

SEQ ID NO: 70110 - DNA, 25 bp, Rattus norvegicus
acaacctgctgatcctgtagcttga

SEQ ID NO: 70111 - DNA, 25 bp, Rattus norvegicus
acaacctggtaacatgtctcatcct

SEQ ID NO: 70112 - DNA, 25 bp, Rattus norvegicus
acaacctggtaagatgtctcatcct

SEQ ID NO: 70113 - DNA, 25 bp, Rattus norvegicus
acaacctgtatgctgtgtccaatca

SEQ ID NO: 70114 - DNA, 25 bp, Rattus norvegicus
acaacctgtatggtgtgtccaatca

SEQ ID NO: 70115 - DNA, 25 bp, Rattus norvegicus
acaacctgtcacacaatgattgctt

SEQ ID NO: 70116 - DNA, 25 bp, Rattus norvegicus
acaacctgtcacagcacagccgttt

SEQ ID NO: 70117 - DNA, 25 bp, Rattus norvegicus
acaacctgtcactcaatgattgctt

SEQ ID NO: 70118 - DNA, 25 bp, Rattus norvegicus
acaacctgtcactgcacagccgttt

SEQ ID NO: 70119 - DNA, 25 bp, Rattus norvegicus
acaacctgttaaagatttcttgagt

SEQ ID NO: 70120 - DNA, 25 bp, Rattus norvegicus
acaacctgttaatgatttcttgagt

SEQ ID NO: 70121 - DNA, 25 bp, Rattus norvegicus
acaacctgtttcagcacctgtttgt

SEQ ID NO: 70122 - DNA, 25 bp, Rattus norvegicus
acaacctgtttctgcacctgtttgt

SEQ ID NO: 70123 - DNA, 25 bp, Rattus norvegicus
acaaccttcagtatgacattgaatg

SEQ ID NO: 70124 - DNA, 25 bp, Rattus norvegicus
acaaccttcagtatggtctgcatga

SEQ ID NO: 70125 - DNA, 25 bp, Rattus norvegicus
acaaccttcagtttgacattgaatg

SEQ ID NO: 70126 - DNA, 25 bp, Rattus norvegicus
acaaccttcagtttggtctgcatga

SEQ ID NO: 70127 - DNA, 25 bp, Rattus norvegicus
acaaccttctctactgctatttaat

SEQ ID NO: 70128 - DNA, 25 bp, Rattus norvegicus
acaaccttctcttctgctatttaat

SEQ ID NO: 70129 - DNA, 25 bp, Rattus norvegicus
acaaccttctgcagatctaagaccc

SEQ ID NO: 70130 - DNA, 25 bp, Rattus norvegicus
acaaccttctgctgatctaagaccc

SEQ ID NO: 70131 - DNA, 25 bp, Rattus norvegicus
acaaccttgtttcgtttgctccatc

SEQ ID NO: 70132 - DNA, 25 bp, Rattus norvegicus
acaaccttgtttggtttgctccatc

SEQ ID NO: 70133 - DNA, 25 bp, Rattus norvegicus
acaacgacgagtctcccatcgagtg

SEQ ID NO: 70134 - DNA, 25 bp, Rattus norvegicus
acaacgacgagtgtcccatcgagtg

SEQ ID NO: 70135 - DNA, 25 bp, Rattus norvegicus
acaacgatgccgagagcttttcttc

SEQ ID NO: 70136 - DNA, 25 bp, Rattus norvegicus
acaacgatgccgtgagcttttcttc

SEQ ID NO: 70137 - DNA, 25 bp, Rattus norvegicus
acaacgcggagtcttctggaagcat

SEQ ID NO: 70138 - DNA, 25 bp, Rattus norvegicus
acaacgcggagtgttctggaagcat

SEQ ID NO: 70139 - DNA, 25 bp, Rattus norvegicus
acaacgctccatcatcgacaataaa

SEQ ID NO: 70140 - DNA, 25 bp, Rattus norvegicus
acaacgctccatgatcgacaataaa

SEQ ID NO: 70141 - DNA, 25 bp, Rattus norvegicus
acaacgctgagacccggcattgcag

SEQ ID NO: 70142 - DNA, 25 bp, Rattus norvegicus
acaacgctgagagccggcattgcag

SEQ ID NO: 70143 - DNA, 25 bp, Rattus norvegicus
acaacggaaaaaaggctcagctgct

SEQ ID NO: 70144 - DNA, 25 bp, Rattus norvegicus
acaacggaaaaatggctcagctgct

SEQ ID NO: 70145 - DNA, 25 bp, Rattus norvegicus
acaacggacgccagcatgacgaatg

SEQ ID NO: 70146 - DNA, 25 bp, Rattus norvegicus
acaacggacgcctgcatgacgaatg

SEQ ID NO: 70147 - DNA, 25 bp, Rattus norvegicus
acaacggatgtgacaggcctcagcc

SEQ ID NO: 70148 - DNA, 25 bp, Rattus norvegicus
acaacggatgtgtcaggcctcagcc

SEQ ID NO: 70149 - DNA, 25 bp, Rattus norvegicus
acaacggcactacgagttgccccaa

SEQ ID NO: 70150 - DNA, 25 bp, Rattus norvegicus
acaacggcactaggagttgccccaa

SEQ ID NO: 70151 - DNA, 25 bp, Rattus norvegicus
acaacggcagcacatctcagttcta

SEQ ID NO: 70152 - DNA, 25 bp, Rattus norvegicus
acaacggcagcagatctcagttcta

SEQ ID NO: 70153 - DNA, 25 bp, Rattus norvegicus
acaacggccagcacacactgtaggg

SEQ ID NO: 70154 - DNA, 25 bp, Rattus norvegicus
acaacggccagctcacactgtaggg

SEQ ID NO: 70155 - DNA, 25 bp, Rattus norvegicus
acaacggctctgacctcagagggaa

SEQ ID NO: 70156 - DNA, 25 bp, Rattus norvegicus
acaacggctctgtcctcagagggaa

SEQ ID NO: 70157 - DNA, 25 bp, Rattus norvegicus
acaacggcttgactcaggtactggc

SEQ ID NO: 70158 - DNA, 25 bp, Rattus norvegicus
acaacggcttgagtcaggtactggc

SEQ ID NO: 70159 - DNA, 25 bp, Rattus norvegicus
acaacgggcttactttctgctacga

SEQ ID NO: 70160 - DNA, 25 bp, Rattus norvegicus
acaacgggcttagtttctgctacga

SEQ ID NO: 70161 - DNA, 25 bp, Rattus norvegicus
acaacggggaaacattccagctgat

SEQ ID NO: 70162 - DNA, 25 bp, Rattus norvegicus
acaacggggaaagattccagctgat

SEQ ID NO: 70163 - DNA, 25 bp, Rattus norvegicus
acaacggtgtctacatttacatgca

SEQ ID NO: 70164 - DNA, 25 bp, Rattus norvegicus
acaacggtgtctctctggtgtcctt

SEQ ID NO: 70165 - DNA, 25 bp, Rattus norvegicus
acaacggtgtctgtctggtgtcctt

SEQ ID NO: 70166 - DNA, 25 bp, Rattus norvegicus
acaacggtgtcttcatttacatgca

SEQ ID NO: 70167 - DNA, 25 bp, Rattus norvegicus
acaacgtctattacagagccatttg

SEQ ID NO: 70168 - DNA, 25 bp, Rattus norvegicus
acaacgtctatttcagagccatttg

SEQ ID NO: 70169 - DNA, 25 bp, Rattus norvegicus
acaacgtgtagaacttgagtctgtg

SEQ ID NO: 70170 - DNA, 25 bp, Rattus norvegicus
acaacgtgtagatcttgagtctgtg

SEQ ID NO: 70171 - DNA, 25 bp, Rattus norvegicus
acaacgtgtctgaccgaaagagcag

SEQ ID NO: 70172 - DNA, 25 bp, Rattus norvegicus
acaacgtgtctgtccgaaagagcag

SEQ ID NO: 70173 - DNA, 25 bp, Rattus norvegicus
acaacgtgtttgacacgggcttgcg

SEQ ID NO: 70174 - DNA, 25 bp, Rattus norvegicus
acaacgtgtttgtcacgggcttgcg

SEQ ID NO: 70175 - DNA, 25 bp, Rattus norvegicus
acaacgttggctctgtgtttgcaaa

SEQ ID NO: 70176 - DNA, 25 bp, Rattus norvegicus
acaacgttggctgtgtgtttgcaaa

SEQ ID NO: 70177 - DNA, 25 bp, Rattus norvegicus
acaacgtttttgacacccacaggag

SEQ ID NO: 70178 - DNA, 25 bp, Rattus norvegicus
acaacgtttttgtcacccacaggag

SEQ ID NO: 70179 - DNA, 25 bp, Rattus norvegicus
acaactaacacgagtccttggatga

SEQ ID NO: 70180 - DNA, 25 bp, Rattus norvegicus
acaactaacacgtgtccttggatga

SEQ ID NO: 70181 - DNA, 25 bp, Rattus norvegicus
acaactacactcatgatgttttcat

SEQ ID NO: 70182 - DNA, 25 bp, Rattus norvegicus
acaactacactcttgatgttttcat

SEQ ID NO: 70183 - DNA, 25 bp, Rattus norvegicus
acaactacccagagcctgtgagaga

SEQ ID NO: 70184 - DNA, 25 bp, Rattus norvegicus
acaactacccagtgcctgtgagaga

SEQ ID NO: 70185 - DNA, 25 bp, Rattus norvegicus
acaactaccgccatccatggtggaa

SEQ ID NO: 70186 - DNA, 25 bp, Rattus norvegicus
acaactaccgccttccatggtggaa

SEQ ID NO: 70187 - DNA, 25 bp, Rattus norvegicus
acaactactataactctgcctaggg

SEQ ID NO: 70188 - DNA, 25 bp, Rattus norvegicus
acaactactatatctctgcctaggg

SEQ ID NO: 70189 - DNA, 25 bp, Rattus norvegicus
acaactactggcatgatctgtttag

SEQ ID NO: 70190 - DNA, 25 bp, Rattus norvegicus
acaactactggcttgatctgtttag

SEQ ID NO: 70191 - DNA, 25 bp, Rattus norvegicus
acaactacttacatttggtgaggca

SEQ ID NO: 70192 - DNA, 25 bp, Rattus norvegicus
acaactacttacttttggtgaggca

SEQ ID NO: 70193 - DNA, 25 bp, Rattus norvegicus
acaactatccaaatgcagtcactgg

SEQ ID NO: 70194 - DNA, 25 bp, Rattus norvegicus
acaactatccaattgcagtcactgg

SEQ ID NO: 70195 - DNA, 25 bp, Rattus norvegicus
acaactatcgccagaaccatcaatg

SEQ ID NO: 70196 - DNA, 25 bp, Rattus norvegicus
acaactatcgcctgaaccatcaatg

SEQ ID NO: 70197 - DNA, 25 bp, Rattus norvegicus
acaactatgagcagaaccttggtca

SEQ ID NO: 70198 - DNA, 25 bp, Rattus norvegicus
acaactatgagctgaaccttggtca

SEQ ID NO: 70199 - DNA, 25 bp, Rattus norvegicus
acaactatggcgaactgggacagac

SEQ ID NO: 70200 - DNA, 25 bp, Rattus norvegicus
acaactatggcgtactgggacagac

SEQ ID NO: 70201 - DNA, 25 bp, Rattus norvegicus
acaactcaagccataaagtgcataa

SEQ ID NO: 70202 - DNA, 25 bp, Rattus norvegicus
acaactcaagccttaaagtgcataa

SEQ ID NO: 70203 - DNA, 25 bp, Rattus norvegicus
acaactcaaggcctccaaatatcag

SEQ ID NO: 70204 - DNA, 25 bp, Rattus norvegicus
acaactcaaggcgtccaaatatcag

SEQ ID NO: 70205 - DNA, 25 bp, Rattus norvegicus
acaactcaatgtatacggtcccaac

SEQ ID NO: 70206 - DNA, 25 bp, Rattus norvegicus
acaactcaatgtttacggtcccaac

SEQ ID NO: 70207 - DNA, 25 bp, Rattus norvegicus
acaactcaccttctatacactgtgt

SEQ ID NO: 70208 - DNA, 25 bp, Rattus norvegicus
acaactcaccttgtatacactgtgt

SEQ ID NO: 70209 - DNA, 25 bp, Rattus norvegicus
acaactcagattatcatgcccatac

SEQ ID NO: 70210 - DNA, 25 bp, Rattus norvegicus
acaactcagattttcatgcccatac

SEQ ID NO: 70211 - DNA, 25 bp, Rattus norvegicus
acaactcagtgcaaccacgggaaga

SEQ ID NO: 70212 - DNA, 25 bp, Rattus norvegicus
acaactcagtgctaccacgggaaga

SEQ ID NO: 70213 - DNA, 25 bp, Rattus norvegicus
acaactcatggtatcagtctatcct

SEQ ID NO: 70214 - DNA, 25 bp, Rattus norvegicus
acaactcatggtttcagtctatcct

SEQ ID NO: 70215 - DNA, 25 bp, Rattus norvegicus
acaactcattgaatccttacagact

SEQ ID NO: 70216 - DNA, 25 bp, Rattus norvegicus
acaactcattgattccttacagact

SEQ ID NO: 70217 - DNA, 25 bp, Rattus norvegicus
acaactccaattccctacaggtgaa

SEQ ID NO: 70218 - DNA, 25 bp, Rattus norvegicus
acaactccaattgcctacaggtgaa

SEQ ID NO: 70219 - DNA, 25 bp, Rattus norvegicus
acaactccacttccttaggttaggg

SEQ ID NO: 70220 - DNA, 25 bp, Rattus norvegicus
acaactccacttgcttaggttaggg

SEQ ID NO: 70221 - DNA, 25 bp, Rattus norvegicus
acaactccagcaccattgactgaag

SEQ ID NO: 70222 - DNA, 25 bp, Rattus norvegicus
acaactccagcagcattgactgaag

SEQ ID NO: 70223 - DNA, 25 bp, Rattus norvegicus
acaactcccaaactgtgtaggaatt

SEQ ID NO: 70224 - DNA, 25 bp, Rattus norvegicus
acaactcccaaagtgtgtaggaatt

SEQ ID NO: 70225 - DNA, 25 bp, Rattus norvegicus
acaactcccagccttatgggtttgg

SEQ ID NO: 70226 - DNA, 25 bp, Rattus norvegicus
acaactcccagcgttatgggtttgg

SEQ ID NO: 70227 - DNA, 25 bp, Rattus norvegicus
acaactcccctacttgaaatgtgta

SEQ ID NO: 70228 - DNA, 25 bp, Rattus norvegicus
acaactcccctagttgaaatgtgta

SEQ ID NO: 70229 - DNA, 25 bp, Rattus norvegicus
acaactccctgaacttccgtagaag

SEQ ID NO: 70230 - DNA, 25 bp, Rattus norvegicus
acaactccctgatcttccgtagaag

SEQ ID NO: 70231 - DNA, 25 bp, Rattus norvegicus
acaactcctgggaaggtgttcctgg

SEQ ID NO: 70232 - DNA, 25 bp, Rattus norvegicus
acaactcctgggtaggtgttcctgg

SEQ ID NO: 70233 - DNA, 25 bp, Rattus norvegicus
acaactcctgttcgcagcctatata

SEQ ID NO: 70234 - DNA, 25 bp, Rattus norvegicus
acaactcctgttggcagcctatata

SEQ ID NO: 70235 - DNA, 25 bp, Rattus norvegicus
acaactcgagttcatagcagccagc

SEQ ID NO: 70236 - DNA, 25 bp, Rattus norvegicus
acaactcgagttgatagcagccagc

SEQ ID NO: 70237 - DNA, 25 bp, Rattus norvegicus
acaactcgcactcagtccatataaa

SEQ ID NO: 70238 - DNA, 25 bp, Rattus norvegicus
acaactcgcactgagtccatataaa

SEQ ID NO: 70239 - DNA, 25 bp, Rattus norvegicus
acaactcgctggctgggacgcaacc

SEQ ID NO: 70240 - DNA, 25 bp, Rattus norvegicus
acaactcgctgggtgggacgcaacc

SEQ ID NO: 70241 - DNA, 25 bp, Rattus norvegicus
acaactcggagaacagcaagcgcct

SEQ ID NO: 70242 - DNA, 25 bp, Rattus norvegicus
acaactcggagatcagcaagcgcct

SEQ ID NO: 70243 - DNA, 25 bp, Rattus norvegicus
acaactcgtgagaatgggtttggcg

SEQ ID NO: 70244 - DNA, 25 bp, Rattus norvegicus
acaactcgtgagtatgggtttggcg

SEQ ID NO: 70245 - DNA, 25 bp, Rattus norvegicus
acaactctaaccagtgtctaagcca

SEQ ID NO: 70246 - DNA, 25 bp, Rattus norvegicus
acaactctaacctgtgtctaagcca

SEQ ID NO: 70247 - DNA, 25 bp, Rattus norvegicus
acaactctacctctggtctcagaga

SEQ ID NO: 70248 - DNA, 25 bp, Rattus norvegicus
acaactctacctgtggtctcagaga

SEQ ID NO: 70249 - DNA, 25 bp, Rattus norvegicus
acaactctcctgcacttctggagga

SEQ ID NO: 70250 - DNA, 25 bp, Rattus norvegicus
acaactctcctggacttctggagga

SEQ ID NO: 70251 - DNA, 25 bp, Rattus norvegicus
acaactctgcacaggatgtgaagaa

SEQ ID NO: 70252 - DNA, 25 bp, Rattus norvegicus
acaactctgcactggatgtgaagaa

SEQ ID NO: 70253 - DNA, 25 bp, Rattus norvegicus
acaactctgcctcgtgagatgtcac

SEQ ID NO: 70254 - DNA, 25 bp, Rattus norvegicus
acaactctgcctggtgagatgtcac

SEQ ID NO: 70255 - DNA, 25 bp, Rattus norvegicus
acaactctgtctacaccttgaatga

SEQ ID NO: 70256 - DNA, 25 bp, Rattus norvegicus
acaactctgtcttcaccttgaatga

SEQ ID NO: 70257 - DNA, 25 bp, Rattus norvegicus
acaactcttcctcaagattttggag

SEQ ID NO: 70258 - DNA, 25 bp, Rattus norvegicus
acaactcttcctgaagattttggag

SEQ ID NO: 70259 - DNA, 25 bp, Rattus norvegicus
acaactcttgctcttactatgctct

SEQ ID NO: 70260 - DNA, 25 bp, Rattus norvegicus
acaactcttgctgttactatgctct

SEQ ID NO: 70261 - DNA, 25 bp, Rattus norvegicus
acaactctttgtagctcatcagcaa

SEQ ID NO: 70262 - DNA, 25 bp, Rattus norvegicus
acaactctttgttgctcatcagcaa

SEQ ID NO: 70263 - DNA, 25 bp, Rattus norvegicus
acaactgaacttctcctgtacacag

SEQ ID NO: 70264 - DNA, 25 bp, Rattus norvegicus
acaactgaacttgtcctgtacacag

SEQ ID NO: 70265 - DNA, 25 bp, Rattus norvegicus
acaactgactttccctctgtagtga

SEQ ID NO: 70266 - DNA, 25 bp, Rattus norvegicus
acaactgactttgcctctgtagtga

SEQ ID NO: 70267 - DNA, 25 bp, Rattus norvegicus
acaactgaggtcctgctcctgggtg

SEQ ID NO: 70268 - DNA, 25 bp, Rattus norvegicus
acaactgaggtcgtgctcctgggtg

SEQ ID NO: 70269 - DNA, 25 bp, Rattus norvegicus
acaactgagtcaaggcatggcatta

SEQ ID NO: 70270 - DNA, 25 bp, Rattus norvegicus
acaactgagtcatggcatggcatta

SEQ ID NO: 70271 - DNA, 25 bp, Rattus norvegicus
acaactgataaacatcccaaggaag

SEQ ID NO: 70272 - DNA, 25 bp, Rattus norvegicus
acaactgataaagatcccaaggaag

SEQ ID NO: 70273 - DNA, 25 bp, Rattus norvegicus
acaactgatgagctgggatgagact

SEQ ID NO: 70274 - DNA, 25 bp, Rattus norvegicus
acaactgatgaggtgggatgagact

SEQ ID NO: 70275 - DNA, 25 bp, Rattus norvegicus
acaactgatgttatcattgataatg

SEQ ID NO: 70276 - DNA, 25 bp, Rattus norvegicus
acaactgatgttttcattgataatg

SEQ ID NO: 70277 - DNA, 25 bp, Rattus norvegicus
acaactgattttctccatgtcaaca

SEQ ID NO: 70278 - DNA, 25 bp, Rattus norvegicus
acaactgattttgtccatgtcaaca

SEQ ID NO: 70279 - DNA, 25 bp, Rattus norvegicus
acaactgcaatcaggtgcttacctt

SEQ ID NO: 70280 - DNA, 25 bp, Rattus norvegicus
acaactgcaatctggtgcttacctt

SEQ ID NO: 70281 - DNA, 25 bp, Rattus norvegicus
acaactgcaccactagtagggtctt

SEQ ID NO: 70282 - DNA, 25 bp, Rattus norvegicus
acaactgcaccagtagtagggtctt

SEQ ID NO: 70283 - DNA, 25 bp, Rattus norvegicus
acaactgcactgacatctggttctg

SEQ ID NO: 70284 - DNA, 25 bp, Rattus norvegicus
acaactgcactgtcatctggttctg

SEQ ID NO: 70285 - DNA, 25 bp, Rattus norvegicus
acaactgcggtactctgttcagaca

SEQ ID NO: 70286 - DNA, 25 bp, Rattus norvegicus
acaactgcggtagtctgttcagaca

SEQ ID NO: 70287 - DNA, 25 bp, Rattus norvegicus
acaactgctgatcaactgactgatt

SEQ ID NO: 70288 - DNA, 25 bp, Rattus norvegicus
acaactgctgatgaactgactgatt

SEQ ID NO: 70289 - DNA, 25 bp, Rattus norvegicus
acaactgctgttccatttataccac

SEQ ID NO: 70290 - DNA, 25 bp, Rattus norvegicus
acaactgctgttgcatttataccac

SEQ ID NO: 70291 - DNA, 25 bp, Rattus norvegicus
acaactgcttggagtactggaaaaa

SEQ ID NO: 70292 - DNA, 25 bp, Rattus norvegicus
acaactgcttggtgtactggaaaaa

SEQ ID NO: 70293 - DNA, 25 bp, Rattus norvegicus
acaactggaaaacgtctggtggctg

SEQ ID NO: 70294 - DNA, 25 bp, Rattus norvegicus
acaactggaaaaggtctggtggctg

SEQ ID NO: 70295 - DNA, 25 bp, Rattus norvegicus
acaactggactcacttgttgggcaa

SEQ ID NO: 70296 - DNA, 25 bp, Rattus norvegicus
acaactggactctcttgttgggcaa

SEQ ID NO: 70297 - DNA, 25 bp, Rattus norvegicus
acaactggaggcaggctaggcttgc

SEQ ID NO: 70298 - DNA, 25 bp, Rattus norvegicus
acaactggaggctggctaggcttgc

SEQ ID NO: 70299 - DNA, 25 bp, Rattus norvegicus
acaactggatgaagccgtgggcaac

SEQ ID NO: 70300 - DNA, 25 bp, Rattus norvegicus
acaactggatgatgccgtgggcaac

SEQ ID NO: 70301 - DNA, 25 bp, Rattus norvegicus
acaactggcttgcaaggcagctcct

SEQ ID NO: 70302 - DNA, 25 bp, Rattus norvegicus
acaactggcttggaaggcagctcct

SEQ ID NO: 70303 - DNA, 25 bp, Rattus norvegicus
acaactgggctaattttgccatggt

SEQ ID NO: 70304 - DNA, 25 bp, Rattus norvegicus
acaactgggctatttttgccatggt

SEQ ID NO: 70305 - DNA, 25 bp, Rattus norvegicus
acaactgggtcgcatcatgctcaaa

SEQ ID NO: 70306 - DNA, 25 bp, Rattus norvegicus
acaactgggtcggatcatgctcaaa

SEQ ID NO: 70307 - DNA, 25 bp, Rattus norvegicus
acaactggtcgactgttttcactga

SEQ ID NO: 70308 - DNA, 25 bp, Rattus norvegicus
acaactggtcgagtgttttcactga

SEQ ID NO: 70309 - DNA, 25 bp, Rattus norvegicus
acaactggtgacattctatttcctt

SEQ ID NO: 70310 - DNA, 25 bp, Rattus norvegicus
acaactggtgactttctatttcctt

SEQ ID NO: 70311 - DNA, 25 bp, Rattus norvegicus
acaactggttgacttggatctttcc

SEQ ID NO: 70312 - DNA, 25 bp, Rattus norvegicus
acaactggttgagttggatctttcc

SEQ ID NO: 70313 - DNA, 25 bp, Rattus norvegicus
acaactgtacatatgccaatgggtt

SEQ ID NO: 70314 - DNA, 25 bp, Rattus norvegicus
acaactgtacatttgccaatgggtt

SEQ ID NO: 70315 - DNA, 25 bp, Rattus norvegicus
acaactgtacggaggcattgagtgc

SEQ ID NO: 70316 - DNA, 25 bp, Rattus norvegicus
acaactgtacggtggcattgagtgc

SEQ ID NO: 70317 - DNA, 25 bp, Rattus norvegicus
acaactgtcggccaggctttgggaa

SEQ ID NO: 70318 - DNA, 25 bp, Rattus norvegicus
acaactgtcggcgaggctttgggaa

SEQ ID NO: 70319 - DNA, 25 bp, Rattus norvegicus
acaactgtgagaactgcgggaacta

SEQ ID NO: 70320 - DNA, 25 bp, Rattus norvegicus
acaactgtgagatctgcgggaacta

SEQ ID NO: 70321 - DNA, 25 bp, Rattus norvegicus
acaactgtgagtctgtggcctcctg

SEQ ID NO: 70322 - DNA, 25 bp, Rattus norvegicus
acaactgtgagtgtgtggcctcctg

SEQ ID NO: 70323 - DNA, 25 bp, Rattus norvegicus
acaactgtgcatactatttcttctc

SEQ ID NO: 70324 - DNA, 25 bp, Rattus norvegicus
acaactgtgcattctatttcttctc

SEQ ID NO: 70325 - DNA, 25 bp, Rattus norvegicus
acaactgtgccactgctgggttgca

SEQ ID NO: 70326 - DNA, 25 bp, Rattus norvegicus
acaactgtgccagtgctgggttgca

SEQ ID NO: 70327 - DNA, 25 bp, Rattus norvegicus
acaactgtgcccagtgatacatgca

SEQ ID NO: 70328 - DNA, 25 bp, Rattus norvegicus
acaactgtgccctgtgatacatgca

SEQ ID NO: 70329 - DNA, 25 bp, Rattus norvegicus
acaactgtgggtctatgcactgtcc

SEQ ID NO: 70330 - DNA, 25 bp, Rattus norvegicus
acaactgtgggtgtatgcactgtcc

SEQ ID NO: 70331 - DNA, 25 bp, Rattus norvegicus
acaactgtgtccacccagtgtgtgc

SEQ ID NO: 70332 - DNA, 25 bp, Rattus norvegicus
acaactgtgtcctcccagtgtgtgc

SEQ ID NO: 70333 - DNA, 25 bp, Rattus norvegicus
acaactgtgtgactctttctctgct

SEQ ID NO: 70334 - DNA, 25 bp, Rattus norvegicus
acaactgtgtgagtctttctctgct

SEQ ID NO: 70335 - DNA, 25 bp, Rattus norvegicus
acaactgtgtgcctgtaccactgtg

SEQ ID NO: 70336 - DNA, 25 bp, Rattus norvegicus
acaactgtgtgcgtgtaccactgtg

SEQ ID NO: 70337 - DNA, 25 bp, Rattus norvegicus
acaactgtgttaccgcccatatctg

SEQ ID NO: 70338 - DNA, 25 bp, Rattus norvegicus
acaactgtgttagcgcccatatctg

SEQ ID NO: 70339 - DNA, 25 bp, Rattus norvegicus
acaactgttaagctcccttactgga

SEQ ID NO: 70340 - DNA, 25 bp, Rattus norvegicus
acaactgttaaggtcccttactgga

SEQ ID NO: 70341 - DNA, 25 bp, Rattus norvegicus
acaactgttcctatcacaagcaagc

SEQ ID NO: 70342 - DNA, 25 bp, Rattus norvegicus
acaactgttcctttcacaagcaagc

SEQ ID NO: 70343 - DNA, 25 bp, Rattus norvegicus
acaactgttgggaacatgctctatg

SEQ ID NO: 70344 - DNA, 25 bp, Rattus norvegicus
acaactgttgggtacatgctctatg

SEQ ID NO: 70345 - DNA, 25 bp, Rattus norvegicus
acaactgtttgcctgggaagcctac

SEQ ID NO: 70346 - DNA, 25 bp, Rattus norvegicus
acaactgtttgcgtgggaagcctac

SEQ ID NO: 70347 - DNA, 25 bp, Rattus norvegicus
acaactgtttgtaatgacttctggg

SEQ ID NO: 70348 - DNA, 25 bp, Rattus norvegicus
acaactgtttgttatgacttctggg

SEQ ID NO: 70349 - DNA, 25 bp, Rattus norvegicus
acaacttcaaatcgaggctgacctc

SEQ ID NO: 70350 - DNA, 25 bp, Rattus norvegicus
acaacttcaaatggaggctgacctc

SEQ ID NO: 70351 - DNA, 25 bp, Rattus norvegicus
acaacttcactaactaattccaggt

SEQ ID NO: 70352 - DNA, 25 bp, Rattus norvegicus
acaacttcactatctaattccaggt

SEQ ID NO: 70353 - DNA, 25 bp, Rattus norvegicus
acaacttcagatcccgtcatttcta

SEQ ID NO: 70354 - DNA, 25 bp, Rattus norvegicus
acaacttcagatgccgtcatttcta

SEQ ID NO: 70355 - DNA, 25 bp, Rattus norvegicus
acaacttccctgatcagaagcggta

SEQ ID NO: 70356 - DNA, 25 bp, Rattus norvegicus
acaacttccctgttcagaagcggta

SEQ ID NO: 70357 - DNA, 25 bp, Rattus norvegicus
acaacttcctccaacagctttataa

SEQ ID NO: 70358 - DNA, 25 bp, Rattus norvegicus
acaacttcctcctacagctttataa

SEQ ID NO: 70359 - DNA, 25 bp, Rattus norvegicus
acaacttcctgtatatctggtactc

SEQ ID NO: 70360 - DNA, 25 bp, Rattus norvegicus
acaacttcctgtttatctggtactc

SEQ ID NO: 70361 - DNA, 25 bp, Rattus norvegicus
acaacttcgagtcatggtcctctga

SEQ ID NO: 70362 - DNA, 25 bp, Rattus norvegicus
acaacttcgagtgatggtcctctga

SEQ ID NO: 70363 - DNA, 25 bp, Rattus norvegicus
acaacttctgctcaatagccaggct

SEQ ID NO: 70364 - DNA, 25 bp, Rattus norvegicus
acaacttctgctgaatagccaggct

SEQ ID NO: 70365 - DNA, 25 bp, Rattus norvegicus
acaacttctgggactgtgagcagcc

SEQ ID NO: 70366 - DNA, 25 bp, Rattus norvegicus
acaacttctgggtctgtgagcagcc

SEQ ID NO: 70367 - DNA, 25 bp, Rattus norvegicus
acaacttctggtcctgcgaggagac

SEQ ID NO: 70368 - DNA, 25 bp, Rattus norvegicus
acaacttctggtgctgcgaggagac

SEQ ID NO: 70369 - DNA, 25 bp, Rattus norvegicus
acaacttctgtcacgcttgcctggg

SEQ ID NO: 70370 - DNA, 25 bp, Rattus norvegicus
acaacttctgtctcgcttgcctggg

SEQ ID NO: 70371 - DNA, 25 bp, Rattus norvegicus
acaacttctgttagtctcttttcaa

SEQ ID NO: 70372 - DNA, 25 bp, Rattus norvegicus
acaacttctgtttgtctcttttcaa

SEQ ID NO: 70373 - DNA, 25 bp, Rattus norvegicus
acaacttgacatctggactggctcc

SEQ ID NO: 70374 - DNA, 25 bp, Rattus norvegicus
acaacttgacatgtggactggctcc

SEQ ID NO: 70375 - DNA, 25 bp, Rattus norvegicus
acaacttgactcattgttccaacgc

SEQ ID NO: 70376 - DNA, 25 bp, Rattus norvegicus
acaacttgactctttgttccaacgc

SEQ ID NO: 70377 - DNA, 25 bp, Rattus norvegicus
acaacttggtttcccattgctttag

SEQ ID NO: 70378 - DNA, 25 bp, Rattus norvegicus
acaacttggtttgccattgctttag

SEQ ID NO: 70379 - DNA, 25 bp, Rattus norvegicus
acaacttgtaaaaaacctttagcat

SEQ ID NO: 70380 - DNA, 25 bp, Rattus norvegicus
acaacttgtaaataacctttagcat

SEQ ID NO: 70381 - DNA, 25 bp, Rattus norvegicus
acaacttgtattcttgtcccacagt

SEQ ID NO: 70382 - DNA, 25 bp, Rattus norvegicus
acaacttgtattgttgtcccacagt

SEQ ID NO: 70383 - DNA, 25 bp, Rattus norvegicus
acaacttgtcagagttggttctctc

SEQ ID NO: 70384 - DNA, 25 bp, Rattus norvegicus
acaacttgtcagtgttggttctctc

SEQ ID NO: 70385 - DNA, 25 bp, Rattus norvegicus
acaacttgtcctacattgagacctc

SEQ ID NO: 70386 - DNA, 25 bp, Rattus norvegicus
acaacttgtccttcattgagacctc

SEQ ID NO: 70387 - DNA, 25 bp, Rattus norvegicus
acaactttccctactgtatgttcaa

SEQ ID NO: 70388 - DNA, 25 bp, Rattus norvegicus
acaactttccctatggcagtctacg

SEQ ID NO: 70389 - DNA, 25 bp, Rattus norvegicus
acaactttcccttctgtatgttcaa

SEQ ID NO: 70390 - DNA, 25 bp, Rattus norvegicus
acaactttccctttggcagtctacg

SEQ ID NO: 70391 - DNA, 25 bp, Rattus norvegicus
acaactttcttccacttactgttct

SEQ ID NO: 70392 - DNA, 25 bp, Rattus norvegicus
acaactttcttcgacttactgttct

SEQ ID NO: 70393 - DNA, 25 bp, Rattus norvegicus
acaactttgccacggttggacacct

SEQ ID NO: 70394 - DNA, 25 bp, Rattus norvegicus
acaactttgccagggttggacacct

SEQ ID NO: 70395 - DNA, 25 bp, Rattus norvegicus
acaactttggcgctctctagtggag

SEQ ID NO: 70396 - DNA, 25 bp, Rattus norvegicus
acaactttggcggtctctagtggag

SEQ ID NO: 70397 - DNA, 25 bp, Rattus norvegicus
acaactttggctaaactgagcagga

SEQ ID NO: 70398 - DNA, 25 bp, Rattus norvegicus
acaactttggcttaactgagcagga

SEQ ID NO: 70399 - DNA, 25 bp, Rattus norvegicus
acaactttggtcatgtatctctgca

SEQ ID NO: 70400 - DNA, 25 bp, Rattus norvegicus
acaactttggtcttgtatctctgca

SEQ ID NO: 70401 - DNA, 25 bp, Rattus norvegicus
acaactttgtctcagatcccagcac

SEQ ID NO: 70402 - DNA, 25 bp, Rattus norvegicus
acaactttgtctgagatcccagcac

SEQ ID NO: 70403 - DNA, 25 bp, Rattus norvegicus
acaactttgtgtcctgtcaggtcag

SEQ ID NO: 70404 - DNA, 25 bp, Rattus norvegicus
acaactttgtgtcgtcagatcccta

SEQ ID NO: 70405 - DNA, 25 bp, Rattus norvegicus
acaactttgtgtctctgggaggatt

SEQ ID NO: 70406 - DNA, 25 bp, Rattus norvegicus
acaactttgtgtgctgtcaggtcag

SEQ ID NO: 70407 - DNA, 25 bp, Rattus norvegicus
acaactttgtgtggtcagatcccta

SEQ ID NO: 70408 - DNA, 25 bp, Rattus norvegicus
acaactttgtgtgtctgggaggatt

SEQ ID NO: 70409 - DNA, 25 bp, Rattus norvegicus
acaacttttctaccagctgtttcag

SEQ ID NO: 70410 - DNA, 25 bp, Rattus norvegicus
acaacttttctagcagctgtttcag

SEQ ID NO: 70411 - DNA, 25 bp, Rattus norvegicus
acaactttttcaatctctggtgtga

SEQ ID NO: 70412 - DNA, 25 bp, Rattus norvegicus
acaactttttcattctctggtgtga

SEQ ID NO: 70413 - DNA, 25 bp, Rattus norvegicus
acaactttttccagttctaggagca

SEQ ID NO: 70414 - DNA, 25 bp, Rattus norvegicus
acaactttttcctgttctaggagca

SEQ ID NO: 70415 - DNA, 25 bp, Rattus norvegicus
acaagaaaagcccttccgagtgcag

SEQ ID NO: 70416 - DNA, 25 bp, Rattus norvegicus
acaagaaaagccgttccgagtgcag

SEQ ID NO: 70417 - DNA, 25 bp, Rattus norvegicus
acaagaaaaggtactctgctgttta

SEQ ID NO: 70418 - DNA, 25 bp, Rattus norvegicus
acaagaaaaggttctctgctgttta

SEQ ID NO: 70419 - DNA, 25 bp, Rattus norvegicus
acaagaaacgagctatctttccagt

SEQ ID NO: 70420 - DNA, 25 bp, Rattus norvegicus
acaagaaacgaggtatctttccagt

SEQ ID NO: 70421 - DNA, 25 bp, Rattus norvegicus
acaagaaactctaatctccgggcgc

SEQ ID NO: 70422 - DNA, 25 bp, Rattus norvegicus
acaagaaactcttatctccgggcgc

SEQ ID NO: 70423 - DNA, 25 bp, Rattus norvegicus
acaagaaaggtaacgtttgagggcg

SEQ ID NO: 70424 - DNA, 25 bp, Rattus norvegicus
acaagaaaggtatcgtttgagggcg

SEQ ID NO: 70425 - DNA, 25 bp, Rattus norvegicus
acaagaacaatgaccgcccagctaa

SEQ ID NO: 70426 - DNA, 25 bp, Rattus norvegicus
acaagaacaatgtccgcccagctaa

SEQ ID NO: 70427 - DNA, 25 bp, Rattus norvegicus
acaagaacagccaatcaagagctat

SEQ ID NO: 70428 - DNA, 25 bp, Rattus norvegicus
acaagaacagcctatcaagagctat

SEQ ID NO: 70429 - DNA, 25 bp, Rattus norvegicus
acaagaactaggctcagcttgcccc

SEQ ID NO: 70430 - DNA, 25 bp, Rattus norvegicus
acaagaactagggtcagcttgcccc

SEQ ID NO: 70431 - DNA, 25 bp, Rattus norvegicus
acaagaactcaaccccacatgtttc

SEQ ID NO: 70432 - DNA, 25 bp, Rattus norvegicus
acaagaactcaagcccacatgtttc

SEQ ID NO: 70433 - DNA, 25 bp, Rattus norvegicus
acaagaacttcacttaatggcctgg

SEQ ID NO: 70434 - DNA, 25 bp, Rattus norvegicus
acaagaacttcagttaatggcctgg

SEQ ID NO: 70435 - DNA, 25 bp, Rattus norvegicus
acaagaagactgacaactccccatt

SEQ ID NO: 70436 - DNA, 25 bp, Rattus norvegicus
acaagaagactgtcaactccccatt

SEQ ID NO: 70437 - DNA, 25 bp, Rattus norvegicus
acaagaagctgcaactccagtctgg

SEQ ID NO: 70438 - DNA, 25 bp, Rattus norvegicus
acaagaagctgctactccagtctgg

SEQ ID NO: 70439 - DNA, 25 bp, Rattus norvegicus
acaagaaggtgtagttggcagttct

SEQ ID NO: 70440 - DNA, 25 bp, Rattus norvegicus
acaagaaggtgttgttggcagttct

SEQ ID NO: 70441 - DNA, 25 bp, Rattus norvegicus
acaagaatcagacccctttacccag

SEQ ID NO: 70442 - DNA, 25 bp, Rattus norvegicus
acaagaatcagagccctttacccag

SEQ ID NO: 70443 - DNA, 25 bp, Rattus norvegicus
acaagaatccgcatttgtatttcaa

SEQ ID NO: 70444 - DNA, 25 bp, Rattus norvegicus
acaagaatccgcttttgtatttcaa

SEQ ID NO: 70445 - DNA, 25 bp, Rattus norvegicus
acaagaatgagaatggtccctcagg

SEQ ID NO: 70446 - DNA, 25 bp, Rattus norvegicus
acaagaatgagattggtccctcagg

SEQ ID NO: 70447 - DNA, 25 bp, Rattus norvegicus
acaagaattaataccccaggcctgg

SEQ ID NO: 70448 - DNA, 25 bp, Rattus norvegicus
acaagaattaattccccaggcctgg

SEQ ID NO: 70449 - DNA, 25 bp, Rattus norvegicus
acaagaattcaacggttccagcatt

SEQ ID NO: 70450 - DNA, 25 bp, Rattus norvegicus
acaagaattcaagggttccagcatt

SEQ ID NO: 70451 - DNA, 25 bp, Rattus norvegicus
acaagaattcagatggaccggctca

SEQ ID NO: 70452 - DNA, 25 bp, Rattus norvegicus
acaagaattcagttggaccggctca

SEQ ID NO: 70453 - DNA, 25 bp, Rattus norvegicus
acaagaattgaaagctcgagcccgg

SEQ ID NO: 70454 - DNA, 25 bp, Rattus norvegicus
acaagaattgaatgctcgagcccgg

SEQ ID NO: 70455 - DNA, 25 bp, Rattus norvegicus
acaagaatttgcagtctctggcccc

SEQ ID NO: 70456 - DNA, 25 bp, Rattus norvegicus
acaagaatttgctgtctctggcccc

SEQ ID NO: 70457 - DNA, 25 bp, Rattus norvegicus
acaagacaagcaaccggcatggcgg

SEQ ID NO: 70458 - DNA, 25 bp, Rattus norvegicus
acaagacaagcaattaccaaccaag

SEQ ID NO: 70459 - DNA, 25 bp, Rattus norvegicus
acaagacaagcatccggcatggcgg

SEQ ID NO: 70460 - DNA, 25 bp, Rattus norvegicus
acaagacaagcatttaccaaccaag

SEQ ID NO: 70461 - DNA, 25 bp, Rattus norvegicus
acaagacaatgcaagtcccttcact

SEQ ID NO: 70462 - DNA, 25 bp, Rattus norvegicus
acaagacaatgctagtcccttcact

SEQ ID NO: 70463 - DNA, 25 bp, Rattus norvegicus
acaagacaccttatggttgacattt

SEQ ID NO: 70464 - DNA, 25 bp, Rattus norvegicus
acaagacaccttttggttgacattt

SEQ ID NO: 70465 - DNA, 25 bp, Rattus norvegicus
acaagacactgtccagcgcgtatat

SEQ ID NO: 70466 - DNA, 25 bp, Rattus norvegicus
acaagacactgtgcagcgcgtatat

SEQ ID NO: 70467 - DNA, 25 bp, Rattus norvegicus
acaagacacttcagcctggttttaa

SEQ ID NO: 70468 - DNA, 25 bp, Rattus norvegicus
acaagacacttctgcctggttttaa

SEQ ID NO: 70469 - DNA, 25 bp, Rattus norvegicus
acaagacagaagactggagggctta

SEQ ID NO: 70470 - DNA, 25 bp, Rattus norvegicus
acaagacagaagtctggagggctta

SEQ ID NO: 70471 - DNA, 25 bp, Rattus norvegicus
acaagacagaggctggtctggatac

SEQ ID NO: 70472 - DNA, 25 bp, Rattus norvegicus
acaagacagagggtggtctggatac

SEQ ID NO: 70473 - DNA, 25 bp, Rattus norvegicus
acaagacagcccctgagaagaatgt

SEQ ID NO: 70474 - DNA, 25 bp, Rattus norvegicus
acaagacagcccgtgagaagaatgt

SEQ ID NO: 70475 - DNA, 25 bp, Rattus norvegicus
acaagacaggccatagaactgagga

SEQ ID NO: 70476 - DNA, 25 bp, Rattus norvegicus
acaagacaggccttagaactgagga

SEQ ID NO: 70477 - DNA, 25 bp, Rattus norvegicus
acaagacatgtcatcatgaatagac

SEQ ID NO: 70478 - DNA, 25 bp, Rattus norvegicus
acaagacatgtcttcatgaatagac

SEQ ID NO: 70479 - DNA, 25 bp, Rattus norvegicus
acaagacattcaccaggtggttcga

SEQ ID NO: 70480 - DNA, 25 bp, Rattus norvegicus
acaagacattcagcaggtggttcga

SEQ ID NO: 70481 - DNA, 25 bp, Rattus norvegicus
acaagaccaaatacggccttccaga

SEQ ID NO: 70482 - DNA, 25 bp, Rattus norvegicus
acaagaccaaattcggccttccaga

SEQ ID NO: 70483 - DNA, 25 bp, Rattus norvegicus
acaagacccagcaggaagcagtcaa

SEQ ID NO: 70484 - DNA, 25 bp, Rattus norvegicus
acaagacccagctggaagcagtcaa

SEQ ID NO: 70485 - DNA, 25 bp, Rattus norvegicus
acaagacccagtcgcatactggtga

SEQ ID NO: 70486 - DNA, 25 bp, Rattus norvegicus
acaagacccagtggcatactggtga

SEQ ID NO: 70487 - DNA, 25 bp, Rattus norvegicus
acaagaccccttaggaacagcccag

SEQ ID NO: 70488 - DNA, 25 bp, Rattus norvegicus
acaagacccctttggaacagcccag

SEQ ID NO: 70489 - DNA, 25 bp, Rattus norvegicus
acaagaccctgcaggagcgacatgt

SEQ ID NO: 70490 - DNA, 25 bp, Rattus norvegicus
acaagaccctgctggagcgacatgt

SEQ ID NO: 70491 - DNA, 25 bp, Rattus norvegicus
acaagaccggccagcgtttgacacc

SEQ ID NO: 70492 - DNA, 25 bp, Rattus norvegicus
acaagaccggcctgcgtttgacacc

SEQ ID NO: 70493 - DNA, 25 bp, Rattus norvegicus
acaagacctctgacaataaggcaaa

SEQ ID NO: 70494 - DNA, 25 bp, Rattus norvegicus
acaagacctctgtcaataaggcaaa

SEQ ID NO: 70495 - DNA, 25 bp, Rattus norvegicus
acaagacgaggtcgaggctggcgct

SEQ ID NO: 70496 - DNA, 25 bp, Rattus norvegicus
acaagacgaggtggaggctggcgct

SEQ ID NO: 70497 - DNA, 25 bp, Rattus norvegicus
acaagactacaaagcttctctccaa

SEQ ID NO: 70498 - DNA, 25 bp, Rattus norvegicus
acaagactacaatgcttctctccaa

SEQ ID NO: 70499 - DNA, 25 bp, Rattus norvegicus
acaagactgtgtactcaaggagcat

SEQ ID NO: 70500 - DNA, 25 bp, Rattus norvegicus
acaagactgtgttctcaaggagcat

SEQ ID NO: 70501 - DNA, 25 bp, Rattus norvegicus
acaagactgttcagggtctgcgacc

SEQ ID NO: 70502 - DNA, 25 bp, Rattus norvegicus
acaagactgttctgggtctgcgacc

SEQ ID NO: 70503 - DNA, 25 bp, Rattus norvegicus
acaagactttctaagagtgcccaga

SEQ ID NO: 70504 - DNA, 25 bp, Rattus norvegicus
acaagactttctcagggacctttct

SEQ ID NO: 70505 - DNA, 25 bp, Rattus norvegicus
acaagactttctgagggacctttct

SEQ ID NO: 70506 - DNA, 25 bp, Rattus norvegicus
acaagactttcttagagtgcccaga

SEQ ID NO: 70507 - DNA, 25 bp, Rattus norvegicus
acaagagaacccacccacggagttg

SEQ ID NO: 70508 - DNA, 25 bp, Rattus norvegicus
acaagagaaccctcccacggagttg

SEQ ID NO: 70509 - DNA, 25 bp, Rattus norvegicus
acaagagacttcactatccggtccc

SEQ ID NO: 70510 - DNA, 25 bp, Rattus norvegicus
acaagagacttctctatccggtccc

SEQ ID NO: 70511 - DNA, 25 bp, Rattus norvegicus
acaagagagggcctcagggttccct

SEQ ID NO: 70512 - DNA, 25 bp, Rattus norvegicus
acaagagagggcgtcagggttccct

SEQ ID NO: 70513 - DNA, 25 bp, Rattus norvegicus
acaagagaggtcaacagagcagccg

SEQ ID NO: 70514 - DNA, 25 bp, Rattus norvegicus
acaagagaggtctacagagcagccg

SEQ ID NO: 70515 - DNA, 25 bp, Rattus norvegicus
acaagagatctcactgttcgcagtt

SEQ ID NO: 70516 - DNA, 25 bp, Rattus norvegicus
acaagagatctctctgttcgcagtt

SEQ ID NO: 70517 - DNA, 25 bp, Rattus norvegicus
acaagagcagatctgacggtaaaca

SEQ ID NO: 70518 - DNA, 25 bp, Rattus norvegicus
acaagagcagatgtgacggtaaaca

SEQ ID NO: 70519 - DNA, 25 bp, Rattus norvegicus
acaagagcatctaatctgggcgata

SEQ ID NO: 70520 - DNA, 25 bp, Rattus norvegicus
acaagagcatcttatctgggcgata

SEQ ID NO: 70521 - DNA, 25 bp, Rattus norvegicus
acaagagcattgatatccgtccctt

SEQ ID NO: 70522 - DNA, 25 bp, Rattus norvegicus
acaagagcattgatcccaatttttt

SEQ ID NO: 70523 - DNA, 25 bp, Rattus norvegicus
acaagagcattgttatccgtccctt

SEQ ID NO: 70524 - DNA, 25 bp, Rattus norvegicus
acaagagcattgttcccaatttttt

SEQ ID NO: 70525 - DNA, 25 bp, Rattus norvegicus
acaagagccatcctcaggaagagct

SEQ ID NO: 70526 - DNA, 25 bp, Rattus norvegicus
acaagagccatcgtcaggaagagct

SEQ ID NO: 70527 - DNA, 25 bp, Rattus norvegicus
acaagagcgccaaggccaggctgtg

SEQ ID NO: 70528 - DNA, 25 bp, Rattus norvegicus
acaagagcgccatggccaggctgtg

SEQ ID NO: 70529 - DNA, 25 bp, Rattus norvegicus
acaagagcgcccctgcatcaaggga

SEQ ID NO: 70530 - DNA, 25 bp, Rattus norvegicus
acaagagcgcccgtgcatcaaggga

SEQ ID NO: 70531 - DNA, 25 bp, Rattus norvegicus
acaagagcggtgatctgcacacttc

SEQ ID NO: 70532 - DNA, 25 bp, Rattus norvegicus
acaagagcggtgttctgcacacttc

SEQ ID NO: 70533 - DNA, 25 bp, Rattus norvegicus
acaagagctctgacactgagtttac

SEQ ID NO: 70534 - DNA, 25 bp, Rattus norvegicus
acaagagctctgtcactgagtttac

SEQ ID NO: 70535 - DNA, 25 bp, Rattus norvegicus
acaagaggaaatcgctgccttggac

SEQ ID NO: 70536 - DNA, 25 bp, Rattus norvegicus
acaagaggaaatggctgccttggac

SEQ ID NO: 70537 - DNA, 25 bp, Rattus norvegicus
acaagaggaggtcttctgatacaga

SEQ ID NO: 70538 - DNA, 25 bp, Rattus norvegicus
acaagaggaggtgttctgatacaga

SEQ ID NO: 70539 - DNA, 25 bp, Rattus norvegicus
acaagaggctctaccgaccggtgga

SEQ ID NO: 70540 - DNA, 25 bp, Rattus norvegicus
acaagaggctcttccgaccggtgga

SEQ ID NO: 70541 - DNA, 25 bp, Rattus norvegicus
acaagaggttgtagtaccctgtgat

SEQ ID NO: 70542 - DNA, 25 bp, Rattus norvegicus
acaagaggttgttgtaccctgtgat

SEQ ID NO: 70543 - DNA, 25 bp, Rattus norvegicus
acaagagtctgacggcttgtctccc

SEQ ID NO: 70544 - DNA, 25 bp, Rattus norvegicus
acaagagtctgagggcttgtctccc

SEQ ID NO: 70545 - DNA, 25 bp, Rattus norvegicus
acaagagtgactattctttgcctgt

SEQ ID NO: 70546 - DNA, 25 bp, Rattus norvegicus
acaagagtgacttttctttgcctgt

SEQ ID NO: 70547 - DNA, 25 bp, Rattus norvegicus
acaagagtgcctatgagtgctcagt

SEQ ID NO: 70548 - DNA, 25 bp, Rattus norvegicus
acaagagtgcctttgagtgctcagt

SEQ ID NO: 70549 - DNA, 25 bp, Rattus norvegicus
acaagagttaatcgcctaccctcca

SEQ ID NO: 70550 - DNA, 25 bp, Rattus norvegicus
acaagagttaatggcctaccctcca

SEQ ID NO: 70551 - DNA, 25 bp, Rattus norvegicus
acaagagttgtgaggcctccctgag

SEQ ID NO: 70552 - DNA, 25 bp, Rattus norvegicus
acaagagttgtgtggcctccctgag

SEQ ID NO: 70553 - DNA, 25 bp, Rattus norvegicus
acaagagtttaccaaagggcatgag

SEQ ID NO: 70554 - DNA, 25 bp, Rattus norvegicus
acaagagtttacgaaagggcatgag

SEQ ID NO: 70555 - DNA, 25 bp, Rattus norvegicus
acaagatattaaaccagccccagag

SEQ ID NO: 70556 - DNA, 25 bp, Rattus norvegicus
acaagatattaatccagccccagag

SEQ ID NO: 70557 - DNA, 25 bp, Rattus norvegicus
acaagatcaagacccgctttctgga

SEQ ID NO: 70558 - DNA, 25 bp, Rattus norvegicus
acaagatcaagagccgctttctgga

SEQ ID NO: 70559 - DNA, 25 bp, Rattus norvegicus
acaagatcagcaatgtgccggccat

SEQ ID NO: 70560 - DNA, 25 bp, Rattus norvegicus
acaagatcagcattgtgccggccat

SEQ ID NO: 70561 - DNA, 25 bp, Rattus norvegicus
acaagatcatcacggcggcatgcct

SEQ ID NO: 70562 - DNA, 25 bp, Rattus norvegicus
acaagatcatcagggcggcatgcct

SEQ ID NO: 70563 - DNA, 25 bp, Rattus norvegicus
acaagatccttactggtgaccttct

SEQ ID NO: 70564 - DNA, 25 bp, Rattus norvegicus
acaagatccttagtggtgaccttct

SEQ ID NO: 70565 - DNA, 25 bp, Rattus norvegicus
acaagatctcttcgcacttctcaca

SEQ ID NO: 70566 - DNA, 25 bp, Rattus norvegicus
acaagatctcttggcacttctcaca

SEQ ID NO: 70567 - DNA, 25 bp, Rattus norvegicus
acaagatctgccagtcggagctcaa

SEQ ID NO: 70568 - DNA, 25 bp, Rattus norvegicus
acaagatctgcctgtcggagctcaa

SEQ ID NO: 70569 - DNA, 25 bp, Rattus norvegicus
acaagatcttcgatcagggcatcat

SEQ ID NO: 70570 - DNA, 25 bp, Rattus norvegicus
acaagatcttcgttcagggcatcat

SEQ ID NO: 70571 - DNA, 25 bp, Rattus norvegicus
acaagatgccatctcatgaaggttt

SEQ ID NO: 70572 - DNA, 25 bp, Rattus norvegicus
acaagatgccatgtcatgaaggttt

SEQ ID NO: 70573 - DNA, 25 bp, Rattus norvegicus
acaagatggactcggttgcgacctg

SEQ ID NO: 70574 - DNA, 25 bp, Rattus norvegicus
acaagatggactgggttgcgacctg

SEQ ID NO: 70575 - DNA, 25 bp, Rattus norvegicus
acaagatggcagagtccataagttc

SEQ ID NO: 70576 - DNA, 25 bp, Rattus norvegicus
acaagatggcagtgtccataagttc

SEQ ID NO: 70577 - DNA, 25 bp, Rattus norvegicus
acaagatggcggccggcggcagcgg

SEQ ID NO: 70578 - DNA, 25 bp, Rattus norvegicus
acaagatggcgggcggcggcagcgg

SEQ ID NO: 70579 - DNA, 25 bp, Rattus norvegicus
acaagatggcttacctcaccttcat

SEQ ID NO: 70580 - DNA, 25 bp, Rattus norvegicus
acaagatggctttcctcaccttcat

SEQ ID NO: 70581 - DNA, 25 bp, Rattus norvegicus
acaagatgtctgctgcttcttcctt

SEQ ID NO: 70582 - DNA, 25 bp, Rattus norvegicus
acaagatgtctggtgcttcttcctt

SEQ ID NO: 70583 - DNA, 25 bp, Rattus norvegicus
acaagattacagagcccttcatgaa

SEQ ID NO: 70584 - DNA, 25 bp, Rattus norvegicus
acaagattacagtgcccttcatgaa

SEQ ID NO: 70585 - DNA, 25 bp, Rattus norvegicus
acaagattgccaaccgcgatgcgga

SEQ ID NO: 70586 - DNA, 25 bp, Rattus norvegicus
acaagattgccatccgcgatgcgga

SEQ ID NO: 70587 - DNA, 25 bp, Rattus norvegicus
acaagattggttcgcgtctcaacgt

SEQ ID NO: 70588 - DNA, 25 bp, Rattus norvegicus
acaagattggttggcgtctcaacgt

SEQ ID NO: 70589 - DNA, 25 bp, Rattus norvegicus
acaagatttccgcagatacccatca

SEQ ID NO: 70590 - DNA, 25 bp, Rattus norvegicus
acaagatttccggagatacccatca

SEQ ID NO: 70591 - DNA, 25 bp, Rattus norvegicus
acaagcaaacccagctatttcagca

SEQ ID NO: 70592 - DNA, 25 bp, Rattus norvegicus
acaagcaaaccctgctatttcagca

SEQ ID NO: 70593 - DNA, 25 bp, Rattus norvegicus
acaagcaaatgcctgtgtcaccttc

SEQ ID NO: 70594 - DNA, 25 bp, Rattus norvegicus
acaagcaaatgcgtgtgtcaccttc

SEQ ID NO: 70595 - DNA, 25 bp, Rattus norvegicus
acaagcaagcttacactcttcgaac

SEQ ID NO: 70596 - DNA, 25 bp, Rattus norvegicus
acaagcaagctttcactcttcgaac

SEQ ID NO: 70597 - DNA, 25 bp, Rattus norvegicus
acaagcaagtctatgcggccatgcc

SEQ ID NO: 70598 - DNA, 25 bp, Rattus norvegicus
acaagcaagtctttgcggccatgcc

SEQ ID NO: 70599 - DNA, 25 bp, Rattus norvegicus
acaagcaatgcaacgctgggccact

SEQ ID NO: 70600 - DNA, 25 bp, Rattus norvegicus
acaagcaatgcatcgctgggccact

SEQ ID NO: 70601 - DNA, 25 bp, Rattus norvegicus
acaagcacaaacatctggaagtata

SEQ ID NO: 70602 - DNA, 25 bp, Rattus norvegicus
acaagcacaaacttctggaagtata

SEQ ID NO: 70603 - DNA, 25 bp, Rattus norvegicus
acaagcacgagaagtcaaggaccca

SEQ ID NO: 70604 - DNA, 25 bp, Rattus norvegicus
acaagcacgagatgtcaaggaccca

SEQ ID NO: 70605 - DNA, 25 bp, Rattus norvegicus
acaagcacggctactccttttggtt

SEQ ID NO: 70606 - DNA, 25 bp, Rattus norvegicus
acaagcacggcttctccttttggtt

SEQ ID NO: 70607 - DNA, 25 bp, Rattus norvegicus
acaagcacgggcactgcaggcagaa

SEQ ID NO: 70608 - DNA, 25 bp, Rattus norvegicus
acaagcacgggctctgcaggcagaa

SEQ ID NO: 70609 - DNA, 25 bp, Rattus norvegicus
acaagcactcttctaaggagggtgt

SEQ ID NO: 70610 - DNA, 25 bp, Rattus norvegicus
acaagcactcttgtaaggagggtgt

SEQ ID NO: 70611 - DNA, 25 bp, Rattus norvegicus
acaagcagactcctgaacagcatcc

SEQ ID NO: 70612 - DNA, 25 bp, Rattus norvegicus
acaagcagactcgtgaacagcatcc

SEQ ID NO: 70613 - DNA, 25 bp, Rattus norvegicus
acaagcagaggacgaccgggccaaa

SEQ ID NO: 70614 - DNA, 25 bp, Rattus norvegicus
acaagcagaggaggaccgggccaaa

SEQ ID NO: 70615 - DNA, 25 bp, Rattus norvegicus
acaagcagccggacagtggtgtaca

SEQ ID NO: 70616 - DNA, 25 bp, Rattus norvegicus
acaagcagccggtcagtggtgtaca

SEQ ID NO: 70617 - DNA, 25 bp, Rattus norvegicus
acaagcaggctcaggtgcagtacat

SEQ ID NO: 70618 - DNA, 25 bp, Rattus norvegicus
acaagcaggctctggtgcagtacat

SEQ ID NO: 70619 - DNA, 25 bp, Rattus norvegicus
acaagcagggcgcttacacagagaa

SEQ ID NO: 70620 - DNA, 25 bp, Rattus norvegicus
acaagcagggcggttacacagagaa

SEQ ID NO: 70621 - DNA, 25 bp, Rattus norvegicus
acaagcaggtcaaccgagtctacag

SEQ ID NO: 70622 - DNA, 25 bp, Rattus norvegicus
acaagcaggtcatccgagtctacag

SEQ ID NO: 70623 - DNA, 25 bp, Rattus norvegicus
acaagcagtaatatgttggccgcaa

SEQ ID NO: 70624 - DNA, 25 bp, Rattus norvegicus
acaagcagtaatttgttggccgcaa

SEQ ID NO: 70625 - DNA, 25 bp, Rattus norvegicus
acaagcagtttgactctgatacata

SEQ ID NO: 70626 - DNA, 25 bp, Rattus norvegicus
acaagcagtttgtctctgatacata

SEQ ID NO: 70627 - DNA, 25 bp, Rattus norvegicus
acaagcataaacattgcccagcaag

SEQ ID NO: 70628 - DNA, 25 bp, Rattus norvegicus
acaagcataaactttgcccagcaag

SEQ ID NO: 70629 - DNA, 25 bp, Rattus norvegicus
acaagcatagttctttctccagcaa

SEQ ID NO: 70630 - DNA, 25 bp, Rattus norvegicus
acaagcatagttgtttctccagcaa

SEQ ID NO: 70631 - DNA, 25 bp, Rattus norvegicus
acaagcatatttatgggcagtacaa

SEQ ID NO: 70632 - DNA, 25 bp, Rattus norvegicus
acaagcatatttttgggcagtacaa

SEQ ID NO: 70633 - DNA, 25 bp, Rattus norvegicus
acaagcatcagtcttctactatata

SEQ ID NO: 70634 - DNA, 25 bp, Rattus norvegicus
acaagcatcagtgttctactatata

SEQ ID NO: 70635 - DNA, 25 bp, Rattus norvegicus
acaagcatcgcgactcggagaagcc

SEQ ID NO: 70636 - DNA, 25 bp, Rattus norvegicus
acaagcatcgcgtctcggagaagcc

SEQ ID NO: 70637 - DNA, 25 bp, Rattus norvegicus
acaagcatgctgaggacggcgctgt

SEQ ID NO: 70638 - DNA, 25 bp, Rattus norvegicus
acaagcatgctgtggacggcgctgt

SEQ ID NO: 70639 - DNA, 25 bp, Rattus norvegicus
acaagcattgcaccggaggctttcc

SEQ ID NO: 70640 - DNA, 25 bp, Rattus norvegicus
acaagcattgcagcggaggctttcc

SEQ ID NO: 70641 - DNA, 25 bp, Rattus norvegicus
acaagccaagtaagttctttgcatt

SEQ ID NO: 70642 - DNA, 25 bp, Rattus norvegicus
acaagccaagtatgttctttgcatt

SEQ ID NO: 70643 - DNA, 25 bp, Rattus norvegicus
acaagccaccatactttaacaattg

SEQ ID NO: 70644 - DNA, 25 bp, Rattus norvegicus
acaagccaccattctttaacaattg

SEQ ID NO: 70645 - DNA, 25 bp, Rattus norvegicus
acaagccacgggagcaagtcagtaa

SEQ ID NO: 70646 - DNA, 25 bp, Rattus norvegicus
acaagccacgggtgcaagtcagtaa

SEQ ID NO: 70647 - DNA, 25 bp, Rattus norvegicus
acaagccactagcactgagacacat

SEQ ID NO: 70648 - DNA, 25 bp, Rattus norvegicus
acaagccactaggactgagacacat

SEQ ID NO: 70649 - DNA, 25 bp, Rattus norvegicus
acaagccacttgattttctattaac

SEQ ID NO: 70650 - DNA, 25 bp, Rattus norvegicus
acaagccacttgtttttctattaac

SEQ ID NO: 70651 - DNA, 25 bp, Rattus norvegicus
acaagccagagaatcttccttattg

SEQ ID NO: 70652 - DNA, 25 bp, Rattus norvegicus
acaagccagagattcttccttattg

SEQ ID NO: 70653 - DNA, 25 bp, Rattus norvegicus
acaagccaggagcttttagactatt

SEQ ID NO: 70654 - DNA, 25 bp, Rattus norvegicus
acaagccaggaggttttagactatt

SEQ ID NO: 70655 - DNA, 25 bp, Rattus norvegicus
acaagccaggcaagtccaagcggaa

SEQ ID NO: 70656 - DNA, 25 bp, Rattus norvegicus
acaagccaggcatgtccaagcggaa

SEQ ID NO: 70657 - DNA, 25 bp, Rattus norvegicus
acaagccatgcaagatagttctagc

SEQ ID NO: 70658 - DNA, 25 bp, Rattus norvegicus
acaagccatgcatgatagttctagc

SEQ ID NO: 70659 - DNA, 25 bp, Rattus norvegicus
acaagcccaagtacggtggccgcaa

SEQ ID NO: 70660 - DNA, 25 bp, Rattus norvegicus
acaagcccaagttcggtggccgcaa

SEQ ID NO: 70661 - DNA, 25 bp, Rattus norvegicus
acaagcccacctatgatgagatctt

SEQ ID NO: 70662 - DNA, 25 bp, Rattus norvegicus
acaagcccacctttgatgagatctt

SEQ ID NO: 70663 - DNA, 25 bp, Rattus norvegicus
acaagcccagggactcaagtagcag

SEQ ID NO: 70664 - DNA, 25 bp, Rattus norvegicus
acaagcccagggtctcaagtagcag

SEQ ID NO: 70665 - DNA, 25 bp, Rattus norvegicus
acaagcccatagagtcttagattag

SEQ ID NO: 70666 - DNA, 25 bp, Rattus norvegicus
acaagcccatagtgtcttagattag

SEQ ID NO: 70667 - DNA, 25 bp, Rattus norvegicus
acaagccccgatcgacatgagtaaa

SEQ ID NO: 70668 - DNA, 25 bp, Rattus norvegicus
acaagccccgatggacatgagtaaa

SEQ ID NO: 70669 - DNA, 25 bp, Rattus norvegicus
acaagccccttgatgtgagcattga

SEQ ID NO: 70670 - DNA, 25 bp, Rattus norvegicus
acaagccccttgttgtgagcattga

SEQ ID NO: 70671 - DNA, 25 bp, Rattus norvegicus
acaagcccgctgcaggtagagccat

SEQ ID NO: 70672 - DNA, 25 bp, Rattus norvegicus
acaagcccgctggaggtagagccat

SEQ ID NO: 70673 - DNA, 25 bp, Rattus norvegicus
acaagccctaatatcagtcagacag

SEQ ID NO: 70674 - DNA, 25 bp, Rattus norvegicus
acaagccctaatttcagtcagacag

SEQ ID NO: 70675 - DNA, 25 bp, Rattus norvegicus
acaagccctacaattgactctagca

SEQ ID NO: 70676 - DNA, 25 bp, Rattus norvegicus
acaagccctacatttgactctagca

SEQ ID NO: 70677 - DNA, 25 bp, Rattus norvegicus
acaagccctaccattgcaagatgtg

SEQ ID NO: 70678 - DNA, 25 bp, Rattus norvegicus
acaagccctacctttgcaagatgtg

SEQ ID NO: 70679 - DNA, 25 bp, Rattus norvegicus
acaagcccttcaaccagggtttcta

SEQ ID NO: 70680 - DNA, 25 bp, Rattus norvegicus
acaagcccttcatccagggtttcta

SEQ ID NO: 70681 - DNA, 25 bp, Rattus norvegicus
acaagccgcttaacctgctgtgcaa

SEQ ID NO: 70682 - DNA, 25 bp, Rattus norvegicus
acaagccgcttatcctgctgtgcaa

SEQ ID NO: 70683 - DNA, 25 bp, Rattus norvegicus
acaagccgcttccatgtcgtgagtt

SEQ ID NO: 70684 - DNA, 25 bp, Rattus norvegicus
acaagccgcttcgatgtcgtgagtt

SEQ ID NO: 70685 - DNA, 25 bp, Rattus norvegicus
acaagcctatccaagcacgcatgca

SEQ ID NO: 70686 - DNA, 25 bp, Rattus norvegicus
acaagcctatcctagcacgcatgca

SEQ ID NO: 70687 - DNA, 25 bp, Rattus norvegicus
acaagcctccaacgcagagccagag

SEQ ID NO: 70688 - DNA, 25 bp, Rattus norvegicus
acaagcctccaaggcagagccagag

SEQ ID NO: 70689 - DNA, 25 bp, Rattus norvegicus
acaagcctccgaacgaccaagagat

SEQ ID NO: 70690 - DNA, 25 bp, Rattus norvegicus
acaagcctccgatcgaccaagagat

SEQ ID NO: 70691 - DNA, 25 bp, Rattus norvegicus
acaagcctccttccaatagcatatt

SEQ ID NO: 70692 - DNA, 25 bp, Rattus norvegicus
acaagcctccttgcaatagcatatt

SEQ ID NO: 70693 - DNA, 25 bp, Rattus norvegicus
acaagcctgaatagcacctgtgggt

SEQ ID NO: 70694 - DNA, 25 bp, Rattus norvegicus
acaagcctgaattgcacctgtgggt

SEQ ID NO: 70695 - DNA, 25 bp, Rattus norvegicus
acaagcctgcacaagctcagtagtg

SEQ ID NO: 70696 - DNA, 25 bp, Rattus norvegicus
acaagcctgcactagctcagtagtg

SEQ ID NO: 70697 - DNA, 25 bp, Rattus norvegicus
acaagcctgctaaactcatttgcat

SEQ ID NO: 70698 - DNA, 25 bp, Rattus norvegicus
acaagcctgctatactcatttgcat

SEQ ID NO: 70699 - DNA, 25 bp, Rattus norvegicus
acaagcctgcttatgcacaaggtaa

SEQ ID NO: 70700 - DNA, 25 bp, Rattus norvegicus
acaagcctgcttttgcacaaggtaa

SEQ ID NO: 70701 - DNA, 25 bp, Rattus norvegicus
acaagccttaaaaccagtgaggtca

SEQ ID NO: 70702 - DNA, 25 bp, Rattus norvegicus
acaagccttaaatccagtgaggtca

SEQ ID NO: 70703 - DNA, 25 bp, Rattus norvegicus
acaagccttggtatacattagaata

SEQ ID NO: 70704 - DNA, 25 bp, Rattus norvegicus
acaagccttggtttacattagaata

SEQ ID NO: 70705 - DNA, 25 bp, Rattus norvegicus
acaagcgacatgctcagcctggagt

SEQ ID NO: 70706 - DNA, 25 bp, Rattus norvegicus
acaagcgacatggtcagcctggagt

SEQ ID NO: 70707 - DNA, 25 bp, Rattus norvegicus
acaagcgactgtaagtgttcctgtg

SEQ ID NO: 70708 - DNA, 25 bp, Rattus norvegicus
acaagcgactgttagtgttcctgtg

SEQ ID NO: 70709 - DNA, 25 bp, Rattus norvegicus
acaagcgcactaaggacatggctgt

SEQ ID NO: 70710 - DNA, 25 bp, Rattus norvegicus
acaagcgcactatggacatggctgt

SEQ ID NO: 70711 - DNA, 25 bp, Rattus norvegicus
acaagcgcatcccaactcttgctag

SEQ ID NO: 70712 - DNA, 25 bp, Rattus norvegicus
acaagcgcatccgaactcttgctag

SEQ ID NO: 70713 - DNA, 25 bp, Rattus norvegicus
acaagcgccatgatcgcgcggcctg

SEQ ID NO: 70714 - DNA, 25 bp, Rattus norvegicus
acaagcgccatgttcgcgcggcctg

SEQ ID NO: 70715 - DNA, 25 bp, Rattus norvegicus
acaagcgccttcattggctgagaat

SEQ ID NO: 70716 - DNA, 25 bp, Rattus norvegicus
acaagcgccttctttggctgagaat

SEQ ID NO: 70717 - DNA, 25 bp, Rattus norvegicus
acaagcggtggaaacctgagcagga

SEQ ID NO: 70718 - DNA, 25 bp, Rattus norvegicus
acaagcggtggatacctgagcagga

SEQ ID NO: 70719 - DNA, 25 bp, Rattus norvegicus
acaagcgtaatgcaggctgtgcgaa

SEQ ID NO: 70720 - DNA, 25 bp, Rattus norvegicus
acaagcgtaatggaggctgtgcgaa

SEQ ID NO: 70721 - DNA, 25 bp, Rattus norvegicus
acaagcgtatctctgtactgtctag

SEQ ID NO: 70722 - DNA, 25 bp, Rattus norvegicus
acaagcgtatctgtgtactgtctag

SEQ ID NO: 70723 - DNA, 25 bp, Rattus norvegicus
acaagcgtcctgctaagatctgctc

SEQ ID NO: 70724 - DNA, 25 bp, Rattus norvegicus
acaagcgtcctggtaagatctgctc

SEQ ID NO: 70725 - DNA, 25 bp, Rattus norvegicus
acaagcgtgcttcgaaccccagaaa

SEQ ID NO: 70726 - DNA, 25 bp, Rattus norvegicus
acaagcgtgcttggaaccccagaaa

SEQ ID NO: 70727 - DNA, 25 bp, Rattus norvegicus
acaagctacaggcatcgcagtgaaa

SEQ ID NO: 70728 - DNA, 25 bp, Rattus norvegicus
acaagctacagggatcgcagtgaaa

SEQ ID NO: 70729 - DNA, 25 bp, Rattus norvegicus
acaagctatcggcaactctcaagag

SEQ ID NO: 70730 - DNA, 25 bp, Rattus norvegicus
acaagctatcgggaactctcaagag

SEQ ID NO: 70731 - DNA, 25 bp, Rattus norvegicus
acaagctcaggaagtccccagcctt

SEQ ID NO: 70732 - DNA, 25 bp, Rattus norvegicus
acaagctcaggatgtccccagcctt

SEQ ID NO: 70733 - DNA, 25 bp, Rattus norvegicus
acaagctcaggcaccatgaagatca

SEQ ID NO: 70734 - DNA, 25 bp, Rattus norvegicus
acaagctcaggctccatgaagatca

SEQ ID NO: 70735 - DNA, 25 bp, Rattus norvegicus
acaagctcgcctaatttttcttgga

SEQ ID NO: 70736 - DNA, 25 bp, Rattus norvegicus
acaagctcgccttatttttcttgga

SEQ ID NO: 70737 - DNA, 25 bp, Rattus norvegicus
acaagctctcttcattggggtaatc

SEQ ID NO: 70738 - DNA, 25 bp, Rattus norvegicus
acaagctctcttgattggggtaatc

SEQ ID NO: 70739 - DNA, 25 bp, Rattus norvegicus
acaagctctgtgcatttctggttct

SEQ ID NO: 70740 - DNA, 25 bp, Rattus norvegicus
acaagctctgtggatttctggttct

SEQ ID NO: 70741 - DNA, 25 bp, Rattus norvegicus
acaagctgaacaatgctgtcatgca

SEQ ID NO: 70742 - DNA, 25 bp, Rattus norvegicus
acaagctgaacattgctgtcatgca

SEQ ID NO: 70743 - DNA, 25 bp, Rattus norvegicus
acaagctgagatacaacgcctctgc

SEQ ID NO: 70744 - DNA, 25 bp, Rattus norvegicus
acaagctgagattcaacgcctctgc

SEQ ID NO: 70745 - DNA, 25 bp, Rattus norvegicus
acaagctgatgtactgcctgggaag

SEQ ID NO: 70746 - DNA, 25 bp, Rattus norvegicus
acaagctgatgttctgcctgggaag

SEQ ID NO: 70747 - DNA, 25 bp, Rattus norvegicus
acaagctgccataagggtgacacct

SEQ ID NO: 70748 - DNA, 25 bp, Rattus norvegicus
acaagctgccattagggtgacacct

SEQ ID NO: 70749 - DNA, 25 bp, Rattus norvegicus
acaagctgctgaagtggtctctcca

SEQ ID NO: 70750 - DNA, 25 bp, Rattus norvegicus
acaagctgctgatgtggtctctcca

SEQ ID NO: 70751 - DNA, 25 bp, Rattus norvegicus
acaagctggacaacgtggagttcat

SEQ ID NO: 70752 - DNA, 25 bp, Rattus norvegicus
acaagctggacatcgtggagttcat

SEQ ID NO: 70753 - DNA, 25 bp, Rattus norvegicus
acaagctggtgtcggactttgctgt

SEQ ID NO: 70754 - DNA, 25 bp, Rattus norvegicus
acaagctggtgtgggactttgctgt

SEQ ID NO: 70755 - DNA, 25 bp, Rattus norvegicus
acaagctggttcatgggacgtcggc

SEQ ID NO: 70756 - DNA, 25 bp, Rattus norvegicus
acaagctggttcttgggacgtcggc

SEQ ID NO: 70757 - DNA, 25 bp, Rattus norvegicus
acaagctgtcaaatgctcagtgcca

SEQ ID NO: 70758 - DNA, 25 bp, Rattus norvegicus
acaagctgtcaattgctcagtgcca

SEQ ID NO: 70759 - DNA, 25 bp, Rattus norvegicus
acaagctgtcctctggtttacacct

SEQ ID NO: 70760 - DNA, 25 bp, Rattus norvegicus
acaagctgtcctgtggtttacacct

SEQ ID NO: 70761 - DNA, 25 bp, Rattus norvegicus
acaagctgtctacaggcctgtgaca

SEQ ID NO: 70762 - DNA, 25 bp, Rattus norvegicus
acaagctgtctagaggcctgtgaca

SEQ ID NO: 70763 - DNA, 25 bp, Rattus norvegicus
acaagctgtcttagcactagctcta

SEQ ID NO: 70764 - DNA, 25 bp, Rattus norvegicus
acaagctgtctttgcactagctcta

SEQ ID NO: 70765 - DNA, 25 bp, Rattus norvegicus
acaagctgtgcgagctgcagagagc

SEQ ID NO: 70766 - DNA, 25 bp, Rattus norvegicus
acaagctgtgcgtgctgcagagagc

SEQ ID NO: 70767 - DNA, 25 bp, Rattus norvegicus
acaagctgtggtctagccagtccaa

SEQ ID NO: 70768 - DNA, 25 bp, Rattus norvegicus
acaagctgtggtgtagccagtccaa

SEQ ID NO: 70769 - DNA, 25 bp, Rattus norvegicus
acaagctgttgcaacctgtgtggtt

SEQ ID NO: 70770 - DNA, 25 bp, Rattus norvegicus
acaagctgttgctacctgtgtggtt

SEQ ID NO: 70771 - DNA, 25 bp, Rattus norvegicus
acaagcttcactctgtttacgagga

SEQ ID NO: 70772 - DNA, 25 bp, Rattus norvegicus
acaagcttcactgtgtttacgagga

SEQ ID NO: 70773 - DNA, 25 bp, Rattus norvegicus
acaagcttccctatgctcattatga

SEQ ID NO: 70774 - DNA, 25 bp, Rattus norvegicus
acaagcttccctttgctcattatga

SEQ ID NO: 70775 - DNA, 25 bp, Rattus norvegicus
acaagcttctgtagctgcttcttaa

SEQ ID NO: 70776 - DNA, 25 bp, Rattus norvegicus
acaagcttctgttgctgcttcttaa

SEQ ID NO: 70777 - DNA, 25 bp, Rattus norvegicus
acaagcttgcacactatgagggcta

SEQ ID NO: 70778 - DNA, 25 bp, Rattus norvegicus
acaagcttgcactctatgagggcta

SEQ ID NO: 70779 - DNA, 25 bp, Rattus norvegicus
acaagcttgcagcaggaaccaactt

SEQ ID NO: 70780 - DNA, 25 bp, Rattus norvegicus
acaagcttgcaggaggaaccaactt

SEQ ID NO: 70781 - DNA, 25 bp, Rattus norvegicus
acaagcttgggcaattcctgcttaa

SEQ ID NO: 70782 - DNA, 25 bp, Rattus norvegicus
acaagcttgggcaggcgattcaccc

SEQ ID NO: 70783 - DNA, 25 bp, Rattus norvegicus
acaagcttgggctattcctgcttaa

SEQ ID NO: 70784 - DNA, 25 bp, Rattus norvegicus
acaagcttgggctggcgattcaccc

SEQ ID NO: 70785 - DNA, 25 bp, Rattus norvegicus
acaagcttgtgaacgccatagtctg

SEQ ID NO: 70786 - DNA, 25 bp, Rattus norvegicus
acaagcttgtgatcgccatagtctg

SEQ ID NO: 70787 - DNA, 25 bp, Rattus norvegicus
acaagctttcctaggatttccacac

SEQ ID NO: 70788 - DNA, 25 bp, Rattus norvegicus
acaagctttccttggatttccacac

SEQ ID NO: 70789 - DNA, 25 bp, Rattus norvegicus
acaagctttgtgattgcatgcatgt

SEQ ID NO: 70790 - DNA, 25 bp, Rattus norvegicus
acaagctttgtgtttgcatgcatgt

SEQ ID NO: 70791 - DNA, 25 bp, Rattus norvegicus
acaagcttttccaatgatctccaaa

SEQ ID NO: 70792 - DNA, 25 bp, Rattus norvegicus
acaagcttttcctatgatctccaaa

SEQ ID NO: 70793 - DNA, 25 bp, Rattus norvegicus
acaaggaaccagagccagcacctaa

SEQ ID NO: 70794 - DNA, 25 bp, Rattus norvegicus
acaaggaaccagtgccagcacctaa

SEQ ID NO: 70795 - DNA, 25 bp, Rattus norvegicus
acaaggaaggtaccagctctgctga

SEQ ID NO: 70796 - DNA, 25 bp, Rattus norvegicus
acaaggaaggtagcagctctgctga

SEQ ID NO: 70797 - DNA, 25 bp, Rattus norvegicus
acaaggaattttctcgatttcacga

SEQ ID NO: 70798 - DNA, 25 bp, Rattus norvegicus
acaaggaattttgtcgatttcacga

SEQ ID NO: 70799 - DNA, 25 bp, Rattus norvegicus
acaaggacacacaagcagctgcgaa

SEQ ID NO: 70800 - DNA, 25 bp, Rattus norvegicus
acaaggacacacaaggacccatgca

SEQ ID NO: 70801 - DNA, 25 bp, Rattus norvegicus
acaaggacacactagcagctgcgaa

SEQ ID NO: 70802 - DNA, 25 bp, Rattus norvegicus
acaaggacacactaggacccatgca

SEQ ID NO: 70803 - DNA, 25 bp, Rattus norvegicus
acaaggacataaatctgctgacccc

SEQ ID NO: 70804 - DNA, 25 bp, Rattus norvegicus
acaaggacataattctgctgacccc

SEQ ID NO: 70805 - DNA, 25 bp, Rattus norvegicus
acaaggacatccagcgcaaagctgt

SEQ ID NO: 70806 - DNA, 25 bp, Rattus norvegicus
acaaggacatcctgcgcaaagctgt

SEQ ID NO: 70807 - DNA, 25 bp, Rattus norvegicus
acaaggacctggatttgcactcgca

SEQ ID NO: 70808 - DNA, 25 bp, Rattus norvegicus
acaaggacctggttttgcactcgca

SEQ ID NO: 70809 - DNA, 25 bp, Rattus norvegicus
acaaggacctttacagcgacggtgc

SEQ ID NO: 70810 - DNA, 25 bp, Rattus norvegicus
acaaggaccttttcagcgacggtgc

SEQ ID NO: 70811 - DNA, 25 bp, Rattus norvegicus
acaaggacggcgaggtgaccatcga

SEQ ID NO: 70812 - DNA, 25 bp, Rattus norvegicus
acaaggacggcgtggtgaccatcga

SEQ ID NO: 70813 - DNA, 25 bp, Rattus norvegicus
acaaggactaggaggccgtggacac

SEQ ID NO: 70814 - DNA, 25 bp, Rattus norvegicus
acaaggactaggcacacagacatac

SEQ ID NO: 70815 - DNA, 25 bp, Rattus norvegicus
acaaggactagggacacagacatac

SEQ ID NO: 70816 - DNA, 25 bp, Rattus norvegicus
acaaggactaggtggccgtggacac

SEQ ID NO: 70817 - DNA, 25 bp, Rattus norvegicus
acaaggactcgcagcaatgaacatt

SEQ ID NO: 70818 - DNA, 25 bp, Rattus norvegicus
acaaggactcgctgcaatgaacatt

SEQ ID NO: 70819 - DNA, 25 bp, Rattus norvegicus
acaaggactggtccagaaagccgct

SEQ ID NO: 70820 - DNA, 25 bp, Rattus norvegicus
acaaggactggtgcagaaagccgct

SEQ ID NO: 70821 - DNA, 25 bp, Rattus norvegicus
acaaggactttaactgcgaccatct

SEQ ID NO: 70822 - DNA, 25 bp, Rattus norvegicus
acaaggactttatctgcgaccatct

SEQ ID NO: 70823 - DNA, 25 bp, Rattus norvegicus
acaaggactttgaggctgccaggaa

SEQ ID NO: 70824 - DNA, 25 bp, Rattus norvegicus
acaaggactttgtggctgccaggaa

SEQ ID NO: 70825 - DNA, 25 bp, Rattus norvegicus
acaaggagactcagaaccccgattc

SEQ ID NO: 70826 - DNA, 25 bp, Rattus norvegicus
acaaggagactctgaaccccgattc

SEQ ID NO: 70827 - DNA, 25 bp, Rattus norvegicus
acaaggagacttcttagccactctt

SEQ ID NO: 70828 - DNA, 25 bp, Rattus norvegicus
acaaggagacttgttagccactctt

SEQ ID NO: 70829 - DNA, 25 bp, Rattus norvegicus
acaaggagctggacacacgggtcat

SEQ ID NO: 70830 - DNA, 25 bp, Rattus norvegicus
acaaggagctggaggcccaggctaa

SEQ ID NO: 70831 - DNA, 25 bp, Rattus norvegicus
acaaggagctggtcacacgggtcat

SEQ ID NO: 70832 - DNA, 25 bp, Rattus norvegicus
acaaggagctggtggcccaggctaa

SEQ ID NO: 70833 - DNA, 25 bp, Rattus norvegicus
acaaggataactccttcgccactga

SEQ ID NO: 70834 - DNA, 25 bp, Rattus norvegicus
acaaggataactgcttcgccactga

SEQ ID NO: 70835 - DNA, 25 bp, Rattus norvegicus
acaaggcaaggacccatgcacctgg

SEQ ID NO: 70836 - DNA, 25 bp, Rattus norvegicus
acaaggcaaggagccatgcacctgg

SEQ ID NO: 70837 - DNA, 25 bp, Rattus norvegicus
acaaggcacagcacaggaccacagc

SEQ ID NO: 70838 - DNA, 25 bp, Rattus norvegicus
acaaggcacagctcaggaccacagc

SEQ ID NO: 70839 - DNA, 25 bp, Rattus norvegicus
acaaggcaccgtcgatggtggcggc

SEQ ID NO: 70840 - DNA, 25 bp, Rattus norvegicus
acaaggcaccgtggatggtggcggc

SEQ ID NO: 70841 - DNA, 25 bp, Rattus norvegicus
acaaggcagaccaacttacattccc

SEQ ID NO: 70842 - DNA, 25 bp, Rattus norvegicus
acaaggcagacctacttacattccc

SEQ ID NO: 70843 - DNA, 25 bp, Rattus norvegicus
acaaggcagtgtactacatgataaa

SEQ ID NO: 70844 - DNA, 25 bp, Rattus norvegicus
acaaggcagtgttctacatgataaa

SEQ ID NO: 70845 - DNA, 25 bp, Rattus norvegicus
acaaggcatacacctggtcgtctga

SEQ ID NO: 70846 - DNA, 25 bp, Rattus norvegicus
acaaggcatacagctggtcgtctga

SEQ ID NO: 70847 - DNA, 25 bp, Rattus norvegicus
acaaggcatcaaagagtttctcagg

SEQ ID NO: 70848 - DNA, 25 bp, Rattus norvegicus
acaaggcatcaatgagtttctcagg

SEQ ID NO: 70849 - DNA, 25 bp, Rattus norvegicus
acaaggccagcacggagtcactcta

SEQ ID NO: 70850 - DNA, 25 bp, Rattus norvegicus
acaaggccagcagggagtcactcta

SEQ ID NO: 70851 - DNA, 25 bp, Rattus norvegicus
acaaggccaggcaccgcagtctttc

SEQ ID NO: 70852 - DNA, 25 bp, Rattus norvegicus
acaaggccaggctccgcagtctttc

SEQ ID NO: 70853 - DNA, 25 bp, Rattus norvegicus
acaaggccatgtagcggtcgttctc

SEQ ID NO: 70854 - DNA, 25 bp, Rattus norvegicus
acaaggccatgttgcggtcgttctc

SEQ ID NO: 70855 - DNA, 25 bp, Rattus norvegicus
acaaggccggtcacaaactcagaga

SEQ ID NO: 70856 - DNA, 25 bp, Rattus norvegicus
acaaggccggtctcaaactcagaga

SEQ ID NO: 70857 - DNA, 25 bp, Rattus norvegicus
acaaggccgtgaccgccatcgtgca

SEQ ID NO: 70858 - DNA, 25 bp, Rattus norvegicus
acaaggccgtgagcgccatcgtgca

SEQ ID NO: 70859 - DNA, 25 bp, Rattus norvegicus
acaaggcctacacaaagctactggt

SEQ ID NO: 70860 - DNA, 25 bp, Rattus norvegicus
acaaggcctacagaaagctactggt

SEQ ID NO: 70861 - DNA, 25 bp, Rattus norvegicus
acaaggcctgctacctctagaggaa

SEQ ID NO: 70862 - DNA, 25 bp, Rattus norvegicus
acaaggcctgcttcctctagaggaa

SEQ ID NO: 70863 - DNA, 25 bp, Rattus norvegicus
acaaggcctggcacagtttgatcag

SEQ ID NO: 70864 - DNA, 25 bp, Rattus norvegicus
acaaggcctggctcagtttgatcag

SEQ ID NO: 70865 - DNA, 25 bp, Rattus norvegicus
acaaggccttgtacagctttttccg

SEQ ID NO: 70866 - DNA, 25 bp, Rattus norvegicus
acaaggccttgtcagctgaggctga

SEQ ID NO: 70867 - DNA, 25 bp, Rattus norvegicus
acaaggccttgtgagctgaggctga

SEQ ID NO: 70868 - DNA, 25 bp, Rattus norvegicus
acaaggccttgttcagctttttccg

SEQ ID NO: 70869 - DNA, 25 bp, Rattus norvegicus
acaaggcgtcaactgattcctggaa

SEQ ID NO: 70870 - DNA, 25 bp, Rattus norvegicus
acaaggcgtcaagtgattcctggaa

SEQ ID NO: 70871 - DNA, 25 bp, Rattus norvegicus
acaaggctacagatcttggacccca

SEQ ID NO: 70872 - DNA, 25 bp, Rattus norvegicus
acaaggctacagttcttggacccca

SEQ ID NO: 70873 - DNA, 25 bp, Rattus norvegicus
acaaggctccatactctaggttaga

SEQ ID NO: 70874 - DNA, 25 bp, Rattus norvegicus
acaaggctccattctctaggttaga

SEQ ID NO: 70875 - DNA, 25 bp, Rattus norvegicus
acaaggctcctaaccacttttggat

SEQ ID NO: 70876 - DNA, 25 bp, Rattus norvegicus
acaaggctcctaagatgcgcagacg

SEQ ID NO: 70877 - DNA, 25 bp, Rattus norvegicus
acaaggctcctatccacttttggat

SEQ ID NO: 70878 - DNA, 25 bp, Rattus norvegicus
acaaggctcctatgatgcgcagacg

SEQ ID NO: 70879 - DNA, 25 bp, Rattus norvegicus
acaaggctgagaacccgatgtctac

SEQ ID NO: 70880 - DNA, 25 bp, Rattus norvegicus
acaaggctgagatcccgatgtctac

SEQ ID NO: 70881 - DNA, 25 bp, Rattus norvegicus
acaaggctggctctgctgttagtct

SEQ ID NO: 70882 - DNA, 25 bp, Rattus norvegicus
acaaggctggctgtgctgttagtct

SEQ ID NO: 70883 - DNA, 25 bp, Rattus norvegicus
acaaggctggttacttttatgaaca

SEQ ID NO: 70884 - DNA, 25 bp, Rattus norvegicus
acaaggctggtttcttttatgaaca

SEQ ID NO: 70885 - DNA, 25 bp, Rattus norvegicus
acaaggctgtcactattcttcctgg

SEQ ID NO: 70886 - DNA, 25 bp, Rattus norvegicus
acaaggctgtcagtattcttcctgg

SEQ ID NO: 70887 - DNA, 25 bp, Rattus norvegicus
acaaggctgtgcattctctagacaa

SEQ ID NO: 70888 - DNA, 25 bp, Rattus norvegicus
acaaggctgtgctttctctagacaa

SEQ ID NO: 70889 - DNA, 25 bp, Rattus norvegicus
acaaggcttcccagctattatggaa

SEQ ID NO: 70890 - DNA, 25 bp, Rattus norvegicus
acaaggcttccctgctattatggaa

SEQ ID NO: 70891 - DNA, 25 bp, Rattus norvegicus
acaaggcttctgagaatggccacta

SEQ ID NO: 70892 - DNA, 25 bp, Rattus norvegicus
acaaggcttctgtgaatggccacta

SEQ ID NO: 70893 - DNA, 25 bp, Rattus norvegicus
acaagggaacgcagtcatcctgaca

SEQ ID NO: 70894 - DNA, 25 bp, Rattus norvegicus
acaagggaacgctgtcatcctgaca

SEQ ID NO: 70895 - DNA, 25 bp, Rattus norvegicus
acaagggacactacgggccatgctt

SEQ ID NO: 70896 - DNA, 25 bp, Rattus norvegicus
acaagggacacttcgggccatgctt

SEQ ID NO: 70897 - DNA, 25 bp, Rattus norvegicus
acaagggactgtacactgctgtcat

SEQ ID NO: 70898 - DNA, 25 bp, Rattus norvegicus
acaagggactgttcactgctgtcat

SEQ ID NO: 70899 - DNA, 25 bp, Rattus norvegicus
acaagggagctgctttctgcacggc

SEQ ID NO: 70900 - DNA, 25 bp, Rattus norvegicus
acaagggagctggtttctgcacggc

SEQ ID NO: 70901 - DNA, 25 bp, Rattus norvegicus
acaagggaggtgctagctcttcccc

SEQ ID NO: 70902 - DNA, 25 bp, Rattus norvegicus
acaagggaggtggtagctcttcccc

SEQ ID NO: 70903 - DNA, 25 bp, Rattus norvegicus
acaagggattgcaccatcagggccg

SEQ ID NO: 70904 - DNA, 25 bp, Rattus norvegicus
acaagggattgctccatcagggccg

SEQ ID NO: 70905 - DNA, 25 bp, Rattus norvegicus
acaagggcaactactcggagagggt

SEQ ID NO: 70906 - DNA, 25 bp, Rattus norvegicus
acaagggcaacttctcggagagggt

SEQ ID NO: 70907 - DNA, 25 bp, Rattus norvegicus
acaagggcaatcacaaccgctgtat

SEQ ID NO: 70908 - DNA, 25 bp, Rattus norvegicus
acaagggcaatctcaaccgctgtat

SEQ ID NO: 70909 - DNA, 25 bp, Rattus norvegicus
acaagggcagagctctgtctgcttc

SEQ ID NO: 70910 - DNA, 25 bp, Rattus norvegicus
acaagggcagaggtctgtctgcttc

SEQ ID NO: 70911 - DNA, 25 bp, Rattus norvegicus
acaagggcaggtatctcaacactcc

SEQ ID NO: 70912 - DNA, 25 bp, Rattus norvegicus
acaagggcaggtttctcaacactcc

SEQ ID NO: 70913 - DNA, 25 bp, Rattus norvegicus
acaagggcccgacaaatgctttcac

SEQ ID NO: 70914 - DNA, 25 bp, Rattus norvegicus
acaagggcccgagaaatgctttcac

SEQ ID NO: 70915 - DNA, 25 bp, Rattus norvegicus
acaagggccctgcttggctcatgga

SEQ ID NO: 70916 - DNA, 25 bp, Rattus norvegicus
acaagggccctggttggctcatgga

SEQ ID NO: 70917 - DNA, 25 bp, Rattus norvegicus
acaagggctcccaccatacacacat

SEQ ID NO: 70918 - DNA, 25 bp, Rattus norvegicus
acaagggctccctccatacacacat

SEQ ID NO: 70919 - DNA, 25 bp, Rattus norvegicus
acaagggctgctactagactgttca

SEQ ID NO: 70920 - DNA, 25 bp, Rattus norvegicus
acaagggctgctccacaaggtgctc

SEQ ID NO: 70921 - DNA, 25 bp, Rattus norvegicus
acaagggctgctgcacaaggtgctc

SEQ ID NO: 70922 - DNA, 25 bp, Rattus norvegicus
acaagggctgcttctagactgttca

SEQ ID NO: 70923 - DNA, 25 bp, Rattus norvegicus
acaagggtaatactctgccttcgct

SEQ ID NO: 70924 - DNA, 25 bp, Rattus norvegicus
acaagggtaatagtctgccttcgct

SEQ ID NO: 70925 - DNA, 25 bp, Rattus norvegicus
acaagggtctgcatgtcgctgtcta

SEQ ID NO: 70926 - DNA, 25 bp, Rattus norvegicus
acaagggtctgcttgtcgctgtcta

SEQ ID NO: 70927 - DNA, 25 bp, Rattus norvegicus
acaagggtctttcccaggagtagct

SEQ ID NO: 70928 - DNA, 25 bp, Rattus norvegicus
acaagggtctttgccaggagtagct

SEQ ID NO: 70929 - DNA, 25 bp, Rattus norvegicus
acaagggtgattatggtttgtgcct

SEQ ID NO: 70930 - DNA, 25 bp, Rattus norvegicus
acaagggtgattttggtttgtgcct

SEQ ID NO: 70931 - DNA, 25 bp, Rattus norvegicus
acaagggtgcatcggagctctcctg

SEQ ID NO: 70932 - DNA, 25 bp, Rattus norvegicus
acaagggtgcatgggagctctcctg

SEQ ID NO: 70933 - DNA, 25 bp, Rattus norvegicus
acaagggttagtaggtatgcatact

SEQ ID NO: 70934 - DNA, 25 bp, Rattus norvegicus
acaagggttagttggtatgcatact

SEQ ID NO: 70935 - DNA, 25 bp, Rattus norvegicus
acaagggttcctcagagcaatctac

SEQ ID NO: 70936 - DNA, 25 bp, Rattus norvegicus
acaagggttcctgagagcaatctac

SEQ ID NO: 70937 - DNA, 25 bp, Rattus norvegicus
acaagggttcgactcccgctcctga

SEQ ID NO: 70938 - DNA, 25 bp, Rattus norvegicus
acaagggttcgagtcccgctcctga

SEQ ID NO: 70939 - DNA, 25 bp, Rattus norvegicus
acaagggtttctccagagtcaccta

SEQ ID NO: 70940 - DNA, 25 bp, Rattus norvegicus
acaagggtttctgcagagtcaccta

SEQ ID NO: 70941 - DNA, 25 bp, Rattus norvegicus
acaaggtaccttcattgtgcccaag

SEQ ID NO: 70942 - DNA, 25 bp, Rattus norvegicus
acaaggtaccttgattgtgcccaag

SEQ ID NO: 70943 - DNA, 25 bp, Rattus norvegicus
acaaggtagaacaccagtccacagt

SEQ ID NO: 70944 - DNA, 25 bp, Rattus norvegicus
acaaggtagaactccagtccacagt

SEQ ID NO: 70945 - DNA, 25 bp, Rattus norvegicus
acaaggtcagctaccatcaattggg

SEQ ID NO: 70946 - DNA, 25 bp, Rattus norvegicus
acaaggtcagcttccatcaattggg

SEQ ID NO: 70947 - DNA, 25 bp, Rattus norvegicus
acaaggtcagtacgtggcatcaagc

SEQ ID NO: 70948 - DNA, 25 bp, Rattus norvegicus
acaaggtcagtaggtggcatcaagc

SEQ ID NO: 70949 - DNA, 25 bp, Rattus norvegicus
acaaggtccgctcagcctgcagggt

SEQ ID NO: 70950 - DNA, 25 bp, Rattus norvegicus
acaaggtccgctgagcctgcagggt

SEQ ID NO: 70951 - DNA, 25 bp, Rattus norvegicus
acaaggtcgagacattcgtgcgcat

SEQ ID NO: 70952 - DNA, 25 bp, Rattus norvegicus
acaaggtcgagagattcgtgcgcat

SEQ ID NO: 70953 - DNA, 25 bp, Rattus norvegicus
acaaggtctatgactgttttgcagg

SEQ ID NO: 70954 - DNA, 25 bp, Rattus norvegicus
acaaggtctatgtctgttttgcagg

SEQ ID NO: 70955 - DNA, 25 bp, Rattus norvegicus
acaaggtctggtctggtgtatgccc

SEQ ID NO: 70956 - DNA, 25 bp, Rattus norvegicus
acaaggtctggtgtggtgtatgccc

SEQ ID NO: 70957 - DNA, 25 bp, Rattus norvegicus
acaaggtcttccagtgcaaccgcag

SEQ ID NO: 70958 - DNA, 25 bp, Rattus norvegicus
acaaggtcttcctgtgcaaccgcag

SEQ ID NO: 70959 - DNA, 25 bp, Rattus norvegicus
acaaggtcttgtctgtttggcttca

SEQ ID NO: 70960 - DNA, 25 bp, Rattus norvegicus
acaaggtcttgtgtgtttggcttca

SEQ ID NO: 70961 - DNA, 25 bp, Rattus norvegicus
acaaggtgcttgatcccagggttgc

SEQ ID NO: 70962 - DNA, 25 bp, Rattus norvegicus
acaaggtgcttgttcccagggttgc

SEQ ID NO: 70963 - DNA, 25 bp, Rattus norvegicus
acaaggtggtccagctctgagtgga

SEQ ID NO: 70964 - DNA, 25 bp, Rattus norvegicus
acaaggtggtcctgctctgagtgga

SEQ ID NO: 70965 - DNA, 25 bp, Rattus norvegicus
acaaggtggtcgagttgctcagcat

SEQ ID NO: 70966 - DNA, 25 bp, Rattus norvegicus
acaaggtggtcgtgttgctcagcat

SEQ ID NO: 70967 - DNA, 25 bp, Rattus norvegicus
acaaggtgtggtcatggctgcctca

SEQ ID NO: 70968 - DNA, 25 bp, Rattus norvegicus
acaaggtgtggtcgcatatcccctt

SEQ ID NO: 70969 - DNA, 25 bp, Rattus norvegicus
acaaggtgtggtgatggctgcctca

SEQ ID NO: 70970 - DNA, 25 bp, Rattus norvegicus
acaaggtgtggtggcatatcccctt

SEQ ID NO: 70971 - DNA, 25 bp, Rattus norvegicus
acaaggtgttctatgcttccgtccg

SEQ ID NO: 70972 - DNA, 25 bp, Rattus norvegicus
acaaggtgttctttgcttccgtccg

SEQ ID NO: 70973 - DNA, 25 bp, Rattus norvegicus
acaaggttccctaaacaggagcatt

SEQ ID NO: 70974 - DNA, 25 bp, Rattus norvegicus
acaaggttcccttaacaggagcatt

SEQ ID NO: 70975 - DNA, 25 bp, Rattus norvegicus
acaaggttgtgtcacaccccatgac

SEQ ID NO: 70976 - DNA, 25 bp, Rattus norvegicus
acaaggttgtgtgacaccccatgac

SEQ ID NO: 70977 - DNA, 25 bp, Rattus norvegicus
acaagtaaccaccagataactccaa

SEQ ID NO: 70978 - DNA, 25 bp, Rattus norvegicus
acaagtaaccacgagataactccaa

SEQ ID NO: 70979 - DNA, 25 bp, Rattus norvegicus
acaagtaagtacctcccagaaccag

SEQ ID NO: 70980 - DNA, 25 bp, Rattus norvegicus
acaagtaagtacgtcccagaaccag

SEQ ID NO: 70981 - DNA, 25 bp, Rattus norvegicus
acaagtacactcagaaccttccaac

SEQ ID NO: 70982 - DNA, 25 bp, Rattus norvegicus
acaagtacactctgaaccttccaac

SEQ ID NO: 70983 - DNA, 25 bp, Rattus norvegicus
acaagtacagtgatgacccatatct

SEQ ID NO: 70984 - DNA, 25 bp, Rattus norvegicus
acaagtacagtgttgacccatatct

SEQ ID NO: 70985 - DNA, 25 bp, Rattus norvegicus
acaagtacatggctaccagctacct

SEQ ID NO: 70986 - DNA, 25 bp, Rattus norvegicus
acaagtacatgggtaccagctacct

SEQ ID NO: 70987 - DNA, 25 bp, Rattus norvegicus
acaagtacattgagacaggctcagg

SEQ ID NO: 70988 - DNA, 25 bp, Rattus norvegicus
acaagtacattgtgacaggctcagg

SEQ ID NO: 70989 - DNA, 25 bp, Rattus norvegicus
acaagtacctgtatgctgtgcgctg

SEQ ID NO: 70990 - DNA, 25 bp, Rattus norvegicus
acaagtacctgtttgctgtgcgctg

SEQ ID NO: 70991 - DNA, 25 bp, Rattus norvegicus
acaagtactcgcaggccggcgggct

SEQ ID NO: 70992 - DNA, 25 bp, Rattus norvegicus
acaagtactcgctggccggcgggct

SEQ ID NO: 70993 - DNA, 25 bp, Rattus norvegicus
acaagtactgtgaagcctggcgaac

SEQ ID NO: 70994 - DNA, 25 bp, Rattus norvegicus
acaagtactgtgtagcctggcgaac

SEQ ID NO: 70995 - DNA, 25 bp, Rattus norvegicus
acaagtactgttacacctgttgccg

SEQ ID NO: 70996 - DNA, 25 bp, Rattus norvegicus
acaagtactgtttcacctgttgccg

SEQ ID NO: 70997 - DNA, 25 bp, Rattus norvegicus
acaagtagagccctggttagccaga

SEQ ID NO: 70998 - DNA, 25 bp, Rattus norvegicus
acaagtagagccgtggttagccaga

SEQ ID NO: 70999 - DNA, 25 bp, Rattus norvegicus
acaagtaggatgaggtgtctcatgc

SEQ ID NO: 71000 - DNA, 25 bp, Rattus norvegicus
acaagtaggatgtggtgtctcatgc

SEQ ID NO: 71001 - DNA, 25 bp, Rattus norvegicus
acaagtaggctactgtgtgcatcag

SEQ ID NO: 71002 - DNA, 25 bp, Rattus norvegicus
acaagtaggctagtgtgtgcatcag

SEQ ID NO: 71003 - DNA, 25 bp, Rattus norvegicus
acaagtagtcctctggctttcaacc

SEQ ID NO: 71004 - DNA, 25 bp, Rattus norvegicus
acaagtagtcctgtggctttcaacc

SEQ ID NO: 71005 - DNA, 25 bp, Rattus norvegicus
acaagtagttcaataaattctccga

SEQ ID NO: 71006 - DNA, 25 bp, Rattus norvegicus
acaagtagttcattaaattctccga

SEQ ID NO: 71007 - DNA, 25 bp, Rattus norvegicus
acaagtatgcttctgcgtggttcct

SEQ ID NO: 71008 - DNA, 25 bp, Rattus norvegicus
acaagtatgcttgtgcgtggttcct

SEQ ID NO: 71009 - DNA, 25 bp, Rattus norvegicus
acaagtatggaactgcgggctcagc

SEQ ID NO: 71010 - DNA, 25 bp, Rattus norvegicus
acaagtatggaagtgcgggctcagc

SEQ ID NO: 71011 - DNA, 25 bp, Rattus norvegicus
acaagtatgtgtcaccatgcctggc

SEQ ID NO: 71012 - DNA, 25 bp, Rattus norvegicus
acaagtatgtgtgaccatgcctggc

SEQ ID NO: 71013 - DNA, 25 bp, Rattus norvegicus
acaagtattggcatcgtggcctact

SEQ ID NO: 71014 - DNA, 25 bp, Rattus norvegicus
acaagtattggcttcgtggcctact

SEQ ID NO: 71015 - DNA, 25 bp, Rattus norvegicus
acaagtattttcagctccctgaatt

SEQ ID NO: 71016 - DNA, 25 bp, Rattus norvegicus
acaagtattttctgctccctgaatt

SEQ ID NO: 71017 - DNA, 25 bp, Rattus norvegicus
acaagtcaatcacctccaactggct

SEQ ID NO: 71018 - DNA, 25 bp, Rattus norvegicus
acaagtcaatcagctccaactggct

SEQ ID NO: 71019 - DNA, 25 bp, Rattus norvegicus
acaagtcaccgcagtgttttcataa

SEQ ID NO: 71020 - DNA, 25 bp, Rattus norvegicus
acaagtcaccgctgtgttttcataa

SEQ ID NO: 71021 - DNA, 25 bp, Rattus norvegicus
acaagtcactgtattgaaccttaca

SEQ ID NO: 71022 - DNA, 25 bp, Rattus norvegicus
acaagtcactgttttgaaccttaca

SEQ ID NO: 71023 - DNA, 25 bp, Rattus norvegicus
acaagtcagagcaggagggctctat

SEQ ID NO: 71024 - DNA, 25 bp, Rattus norvegicus
acaagtcagagctggagggctctat

SEQ ID NO: 71025 - DNA, 25 bp, Rattus norvegicus
acaagtcatatgactaacccaccat

SEQ ID NO: 71026 - DNA, 25 bp, Rattus norvegicus
acaagtcatatgtctaacccaccat

SEQ ID NO: 71027 - DNA, 25 bp, Rattus norvegicus
acaagtcatcaaatgctggctcaga

SEQ ID NO: 71028 - DNA, 25 bp, Rattus norvegicus
acaagtcatcaattgctggctcaga

SEQ ID NO: 71029 - DNA, 25 bp, Rattus norvegicus
acaagtcatgtgagcacctcaggcg

SEQ ID NO: 71030 - DNA, 25 bp, Rattus norvegicus
acaagtcatgtgtgcacctcaggcg

SEQ ID NO: 71031 - DNA, 25 bp, Rattus norvegicus
acaagtccagctcctcagcgaggct

SEQ ID NO: 71032 - DNA, 25 bp, Rattus norvegicus
acaagtccagctgctcagcgaggct

SEQ ID NO: 71033 - DNA, 25 bp, Rattus norvegicus
acaagtccctcaaagtggaaggaaa

SEQ ID NO: 71034 - DNA, 25 bp, Rattus norvegicus
acaagtccctcatagtggaaggaaa

SEQ ID NO: 71035 - DNA, 25 bp, Rattus norvegicus
acaagtcctcatattcaaaccaaat

SEQ ID NO: 71036 - DNA, 25 bp, Rattus norvegicus
acaagtcctcattttcaaaccaaat

SEQ ID NO: 71037 - DNA, 25 bp, Rattus norvegicus
acaagtcctgggaaaatctcagttt

SEQ ID NO: 71038 - DNA, 25 bp, Rattus norvegicus
acaagtcctgggtaaatctcagttt

SEQ ID NO: 71039 - DNA, 25 bp, Rattus norvegicus
acaagtcctttgaggaggtcaatga

SEQ ID NO: 71040 - DNA, 25 bp, Rattus norvegicus
acaagtcctttgtggaggtcaatga

SEQ ID NO: 71041 - DNA, 25 bp, Rattus norvegicus
acaagtctcaccagggctactgtag

SEQ ID NO: 71042 - DNA, 25 bp, Rattus norvegicus
acaagtctcacctgggctactgtag

SEQ ID NO: 71043 - DNA, 25 bp, Rattus norvegicus
acaagtctcccaatgctgtgacaga

SEQ ID NO: 71044 - DNA, 25 bp, Rattus norvegicus
acaagtctcccattgctgtgacaga

SEQ ID NO: 71045 - DNA, 25 bp, Rattus norvegicus
acaagtctgccacctcttggtagag

SEQ ID NO: 71046 - DNA, 25 bp, Rattus norvegicus
acaagtctgccagctcttggtagag

SEQ ID NO: 71047 - DNA, 25 bp, Rattus norvegicus
acaagtctgccgaagttgacctttg

SEQ ID NO: 71048 - DNA, 25 bp, Rattus norvegicus
acaagtctgccgtagttgacctttg

SEQ ID NO: 71049 - DNA, 25 bp, Rattus norvegicus
acaagtcttaagcagtgtccactaa

SEQ ID NO: 71050 - DNA, 25 bp, Rattus norvegicus
acaagtcttaaggagtgtccactaa

SEQ ID NO: 71051 - DNA, 25 bp, Rattus norvegicus
acaagtcttagcaacctgagtttga

SEQ ID NO: 71052 - DNA, 25 bp, Rattus norvegicus
acaagtcttagctacctgagtttga

SEQ ID NO: 71053 - DNA, 25 bp, Rattus norvegicus
acaagtcttcagatgaactcttcag

SEQ ID NO: 71054 - DNA, 25 bp, Rattus norvegicus
acaagtcttcagttgaactcttcag

SEQ ID NO: 71055 - DNA, 25 bp, Rattus norvegicus
acaagtctttggctcctgtgttggg

SEQ ID NO: 71056 - DNA, 25 bp, Rattus norvegicus
acaagtctttgggtcctgtgttggg

SEQ ID NO: 71057 - DNA, 25 bp, Rattus norvegicus
acaagtgaaagtacttacgctgtac

SEQ ID NO: 71058 - DNA, 25 bp, Rattus norvegicus
acaagtgaaagttcttacgctgtac

SEQ ID NO: 71059 - DNA, 25 bp, Rattus norvegicus
acaagtgacactagccaaatgtaat

SEQ ID NO: 71060 - DNA, 25 bp, Rattus norvegicus
acaagtgacacttgccaaatgtaat

SEQ ID NO: 71061 - DNA, 25 bp, Rattus norvegicus
acaagtgaccagaggctgatggcca

SEQ ID NO: 71062 - DNA, 25 bp, Rattus norvegicus
acaagtgaccagtggctgatggcca

SEQ ID NO: 71063 - DNA, 25 bp, Rattus norvegicus
acaagtgacggtcaggcccatccag

SEQ ID NO: 71064 - DNA, 25 bp, Rattus norvegicus
acaagtgacggtgaggcccatccag

SEQ ID NO: 71065 - DNA, 25 bp, Rattus norvegicus
acaagtgagcgtattctttagttct

SEQ ID NO: 71066 - DNA, 25 bp, Rattus norvegicus
acaagtgagcgttttctttagttct

SEQ ID NO: 71067 - DNA, 25 bp, Rattus norvegicus
acaagtgagggcactctgactttgc

SEQ ID NO: 71068 - DNA, 25 bp, Rattus norvegicus
acaagtgagggctctctgactttgc

SEQ ID NO: 71069 - DNA, 25 bp, Rattus norvegicus
acaagtgatcttcgtaggtccctat

SEQ ID NO: 71070 - DNA, 25 bp, Rattus norvegicus
acaagtgatcttggtaggtccctat

SEQ ID NO: 71071 - DNA, 25 bp, Rattus norvegicus
acaagtgatgaccacgtgattcagt

SEQ ID NO: 71072 - DNA, 25 bp, Rattus norvegicus
acaagtgatgacgacgtgattcagt

SEQ ID NO: 71073 - DNA, 25 bp, Rattus norvegicus
acaagtgattctctgccacatcgac

SEQ ID NO: 71074 - DNA, 25 bp, Rattus norvegicus
acaagtgattctgtgccacatcgac

SEQ ID NO: 71075 - DNA, 25 bp, Rattus norvegicus
acaagtgcacacactttgcctctga

SEQ ID NO: 71076 - DNA, 25 bp, Rattus norvegicus
acaagtgcacactctttgcctctga

SEQ ID NO: 71077 - DNA, 25 bp, Rattus norvegicus
acaagtgcacttagatctgtaaaca

SEQ ID NO: 71078 - DNA, 25 bp, Rattus norvegicus
acaagtgcactttgatctgtaaaca

SEQ ID NO: 71079 - DNA, 25 bp, Rattus norvegicus
acaagtgcagcacccctgaggtgta

SEQ ID NO: 71080 - DNA, 25 bp, Rattus norvegicus
acaagtgcagcagccctgaggtgta

SEQ ID NO: 71081 - DNA, 25 bp, Rattus norvegicus
acaagtgcagtgacggtttctgtct

SEQ ID NO: 71082 - DNA, 25 bp, Rattus norvegicus
acaagtgcagtgtcggtttctgtct

SEQ ID NO: 71083 - DNA, 25 bp, Rattus norvegicus
acaagtgccatgatctttcgggatt

SEQ ID NO: 71084 - DNA, 25 bp, Rattus norvegicus
acaagtgccatgttctttcgggatt

SEQ ID NO: 71085 - DNA, 25 bp, Rattus norvegicus
acaagtgcccagagatcggaagact

SEQ ID NO: 71086 - DNA, 25 bp, Rattus norvegicus
acaagtgcccagtgatcggaagact

SEQ ID NO: 71087 - DNA, 25 bp, Rattus norvegicus
acaagtgcccttacccactgaactg

SEQ ID NO: 71088 - DNA, 25 bp, Rattus norvegicus
acaagtgccctttcccactgaactg

SEQ ID NO: 71089 - DNA, 25 bp, Rattus norvegicus
acaagtgccgtcctgtggcgctgca

SEQ ID NO: 71090 - DNA, 25 bp, Rattus norvegicus
acaagtgccgtcgtgtggcgctgca

SEQ ID NO: 71091 - DNA, 25 bp, Rattus norvegicus
acaagtgcctgaatttccggaaaga

SEQ ID NO: 71092 - DNA, 25 bp, Rattus norvegicus
acaagtgcctgattttccggaaaga

SEQ ID NO: 71093 - DNA, 25 bp, Rattus norvegicus
acaagtgcgccaccgtcctggagaa

SEQ ID NO: 71094 - DNA, 25 bp, Rattus norvegicus
acaagtgcgccagcgtcctggagaa

SEQ ID NO: 71095 - DNA, 25 bp, Rattus norvegicus
acaagtgctacgagattcctctgaa

SEQ ID NO: 71096 - DNA, 25 bp, Rattus norvegicus
acaagtgctacgtgattcctctgaa

SEQ ID NO: 71097 - DNA, 25 bp, Rattus norvegicus
acaagtgctcgccttgcattttcaa

SEQ ID NO: 71098 - DNA, 25 bp, Rattus norvegicus
acaagtgctcgcgttgcattttcaa

SEQ ID NO: 71099 - DNA, 25 bp, Rattus norvegicus
acaagtgcttcaagggtatggccca

SEQ ID NO: 71100 - DNA, 25 bp, Rattus norvegicus
acaagtgcttcatgggtatggccca

SEQ ID NO: 71101 - DNA, 25 bp, Rattus norvegicus
acaagtggatgtctgtgcatgtgtt

SEQ ID NO: 71102 - DNA, 25 bp, Rattus norvegicus
acaagtggatgtgtgtgcatgtgtt

SEQ ID NO: 71103 - DNA, 25 bp, Rattus norvegicus
acaagtggcaagctgtgtgtgcaca

SEQ ID NO: 71104 - DNA, 25 bp, Rattus norvegicus
acaagtggcaaggtgtgtgtgcaca

SEQ ID NO: 71105 - DNA, 25 bp, Rattus norvegicus
acaagtggctaaacaccgtggtgaa

SEQ ID NO: 71106 - DNA, 25 bp, Rattus norvegicus
acaagtggctaatcaccgtggtgaa

SEQ ID NO: 71107 - DNA, 25 bp, Rattus norvegicus
acaagtggctcacaactgaggactc

SEQ ID NO: 71108 - DNA, 25 bp, Rattus norvegicus
acaagtggctcagaactgaggactc

SEQ ID NO: 71109 - DNA, 25 bp, Rattus norvegicus
acaagtggcttgattctcttagaaa

SEQ ID NO: 71110 - DNA, 25 bp, Rattus norvegicus
acaagtggcttgtttctcttagaaa

SEQ ID NO: 71111 - DNA, 25 bp, Rattus norvegicus
acaagtgtcatcagtgggttaaaac

SEQ ID NO: 71112 - DNA, 25 bp, Rattus norvegicus
acaagtgtcatctgtgggttaaaac

SEQ ID NO: 71113 - DNA, 25 bp, Rattus norvegicus
acaagtgtccatcaactgtgtcttt

SEQ ID NO: 71114 - DNA, 25 bp, Rattus norvegicus
acaagtgtccatgaactgtgtcttt

SEQ ID NO: 71115 - DNA, 25 bp, Rattus norvegicus
acaagtgtcccaagactggttggaa

SEQ ID NO: 71116 - DNA, 25 bp, Rattus norvegicus
acaagtgtcccatgactggttggaa

SEQ ID NO: 71117 - DNA, 25 bp, Rattus norvegicus
acaagtgtcgcactaccgccaggat

SEQ ID NO: 71118 - DNA, 25 bp, Rattus norvegicus
acaagtgtcgcagtaccgccaggat

SEQ ID NO: 71119 - DNA, 25 bp, Rattus norvegicus
acaagtgtctctacgtggcttaggt

SEQ ID NO: 71120 - DNA, 25 bp, Rattus norvegicus
acaagtgtctcttcgtggcttaggt

SEQ ID NO: 71121 - DNA, 25 bp, Rattus norvegicus
acaagtgtctgtagagtgctgtctt

SEQ ID NO: 71122 - DNA, 25 bp, Rattus norvegicus
acaagtgtctgttgagtgctgtctt

SEQ ID NO: 71123 - DNA, 25 bp, Rattus norvegicus
acaagtgtgagacagcctacccagg

SEQ ID NO: 71124 - DNA, 25 bp, Rattus norvegicus
acaagtgtgagagagcctacccagg

SEQ ID NO: 71125 - DNA, 25 bp, Rattus norvegicus
acaagtgtgatgaggtgtcccgagt

SEQ ID NO: 71126 - DNA, 25 bp, Rattus norvegicus
acaagtgtgatgtggtgtcccgagt

SEQ ID NO: 71127 - DNA, 25 bp, Rattus norvegicus
acaagtgtgcaccacagttcctggc

SEQ ID NO: 71128 - DNA, 25 bp, Rattus norvegicus
acaagtgtgcacgacagttcctggc

SEQ ID NO: 71129 - DNA, 25 bp, Rattus norvegicus
acaagtgtgtcgcagggtcagcctc

SEQ ID NO: 71130 - DNA, 25 bp, Rattus norvegicus
acaagtgtgtcggagggtcagcctc

SEQ ID NO: 71131 - DNA, 25 bp, Rattus norvegicus
acaagtgtttcccagtgattccaca

SEQ ID NO: 71132 - DNA, 25 bp, Rattus norvegicus
acaagtgtttccgagtgattccaca

SEQ ID NO: 71133 - DNA, 25 bp, Rattus norvegicus
acaagtgtttgcagtccaactcgtt

SEQ ID NO: 71134 - DNA, 25 bp, Rattus norvegicus
acaagtgtttgctgtccaactcgtt

SEQ ID NO: 71135 - DNA, 25 bp, Rattus norvegicus
acaagttactgcacgtcatgttcag

SEQ ID NO: 71136 - DNA, 25 bp, Rattus norvegicus
acaagttactgctcgtcatgttcag

SEQ ID NO: 71137 - DNA, 25 bp, Rattus norvegicus
acaagttcaatcagtggctgtctct

SEQ ID NO: 71138 - DNA, 25 bp, Rattus norvegicus
acaagttcaatcagttctgtgttcc

SEQ ID NO: 71139 - DNA, 25 bp, Rattus norvegicus
acaagttcaatctgtggctgtctct

SEQ ID NO: 71140 - DNA, 25 bp, Rattus norvegicus
acaagttcaatctgttctgtgttcc

SEQ ID NO: 71141 - DNA, 25 bp, Rattus norvegicus
acaagttcagtcatgacacatatct

SEQ ID NO: 71142 - DNA, 25 bp, Rattus norvegicus
acaagttcagtcttgacacatatct

SEQ ID NO: 71143 - DNA, 25 bp, Rattus norvegicus
acaagttcattgaggctggccagta

SEQ ID NO: 71144 - DNA, 25 bp, Rattus norvegicus
acaagttcattgtggctggccagta

SEQ ID NO: 71145 - DNA, 25 bp, Rattus norvegicus
acaagttccctacatgctgagctca

SEQ ID NO: 71146 - DNA, 25 bp, Rattus norvegicus
acaagttccctagatgctgagctca

SEQ ID NO: 71147 - DNA, 25 bp, Rattus norvegicus
acaagttcgaaacccagtggctata

SEQ ID NO: 71148 - DNA, 25 bp, Rattus norvegicus
acaagttcgaaagccagtggctata

SEQ ID NO: 71149 - DNA, 25 bp, Rattus norvegicus
acaagttcggttccttacctcaaat

SEQ ID NO: 71150 - DNA, 25 bp, Rattus norvegicus
acaagttcggttgcttacctcaaat

SEQ ID NO: 71151 - DNA, 25 bp, Rattus norvegicus
acaagttcgtctaccaagtcctcgt

SEQ ID NO: 71152 - DNA, 25 bp, Rattus norvegicus
acaagttcgtcttccaagtcctcgt

SEQ ID NO: 71153 - DNA, 25 bp, Rattus norvegicus
acaagttctgccaggtgtgtattta

SEQ ID NO: 71154 - DNA, 25 bp, Rattus norvegicus
acaagttctgcctggtgtgtattta

SEQ ID NO: 71155 - DNA, 25 bp, Rattus norvegicus
acaagttctggaaaagtttggaagt

SEQ ID NO: 71156 - DNA, 25 bp, Rattus norvegicus
acaagttctggataagtttggaagt

SEQ ID NO: 71157 - DNA, 25 bp, Rattus norvegicus
acaagttcttggagccttacaacga

SEQ ID NO: 71158 - DNA, 25 bp, Rattus norvegicus
acaagttcttggcacgagtttcatt

SEQ ID NO: 71159 - DNA, 25 bp, Rattus norvegicus
acaagttcttgggacgagtttcatt

SEQ ID NO: 71160 - DNA, 25 bp, Rattus norvegicus
acaagttcttggtgccttacaacga

SEQ ID NO: 71161 - DNA, 25 bp, Rattus norvegicus
acaagttcttgtctcctgggtctga

SEQ ID NO: 71162 - DNA, 25 bp, Rattus norvegicus
acaagttcttgtgtcctgggtctga

SEQ ID NO: 71163 - DNA, 25 bp, Rattus norvegicus
acaagttctttgctagtaggtcatg

SEQ ID NO: 71164 - DNA, 25 bp, Rattus norvegicus
acaagttctttggtagtaggtcatg

SEQ ID NO: 71165 - DNA, 25 bp, Rattus norvegicus
acaagttgccatctaccttgggata

SEQ ID NO: 71166 - DNA, 25 bp, Rattus norvegicus
acaagttgccatgtaccttgggata

SEQ ID NO: 71167 - DNA, 25 bp, Rattus norvegicus
acaagttgcctgatcgtcaaggtca

SEQ ID NO: 71168 - DNA, 25 bp, Rattus norvegicus
acaagttgcctgttcgtcaaggtca

SEQ ID NO: 71169 - DNA, 25 bp, Rattus norvegicus
acaagttgctaccacatccatcttc

SEQ ID NO: 71170 - DNA, 25 bp, Rattus norvegicus
acaagttgctacgacatccatcttc

SEQ ID NO: 71171 - DNA, 25 bp, Rattus norvegicus
acaagttgctgtctactgtcaggtg

SEQ ID NO: 71172 - DNA, 25 bp, Rattus norvegicus
acaagttgctgtgtactgtcaggtg

SEQ ID NO: 71173 - DNA, 25 bp, Rattus norvegicus
acaagttggcagatccaggctacaa

SEQ ID NO: 71174 - DNA, 25 bp, Rattus norvegicus
acaagttggcagttccaggctacaa

SEQ ID NO: 71175 - DNA, 25 bp, Rattus norvegicus
acaagttgtaccatactttgcctct

SEQ ID NO: 71176 - DNA, 25 bp, Rattus norvegicus
acaagttgtaccttactttgcctct

SEQ ID NO: 71177 - DNA, 25 bp, Rattus norvegicus
acaagttgtagtcttctatggtttt

SEQ ID NO: 71178 - DNA, 25 bp, Rattus norvegicus
acaagttgtagtgttctatggtttt

SEQ ID NO: 71179 - DNA, 25 bp, Rattus norvegicus
acaagttgtccaaagatcccgtcct

SEQ ID NO: 71180 - DNA, 25 bp, Rattus norvegicus
acaagttgtccatagatcccgtcct

SEQ ID NO: 71181 - DNA, 25 bp, Rattus norvegicus
acaagttgtcccaagcaaaaccgct

SEQ ID NO: 71182 - DNA, 25 bp, Rattus norvegicus
acaagttgtccctagcaaaaccgct

SEQ ID NO: 71183 - DNA, 25 bp, Rattus norvegicus
acaagttgtgtgattcggtgccttt

SEQ ID NO: 71184 - DNA, 25 bp, Rattus norvegicus
acaagttgtgtgtttcggtgccttt

SEQ ID NO: 71185 - DNA, 25 bp, Rattus norvegicus
acaagttgttttcctgtaggcttaa

SEQ ID NO: 71186 - DNA, 25 bp, Rattus norvegicus
acaagttgttttgctgtaggcttaa

SEQ ID NO: 71187 - DNA, 25 bp, Rattus norvegicus
acaagtttaagcctggtgtcaataa

SEQ ID NO: 71188 - DNA, 25 bp, Rattus norvegicus
acaagtttaagcgtggtgtcaataa

SEQ ID NO: 71189 - DNA, 25 bp, Rattus norvegicus
acaagtttacacaccatatggcatt

SEQ ID NO: 71190 - DNA, 25 bp, Rattus norvegicus
acaagtttacactccatatggcatt

SEQ ID NO: 71191 - DNA, 25 bp, Rattus norvegicus
acaagtttagtgacctatagagaaa

SEQ ID NO: 71192 - DNA, 25 bp, Rattus norvegicus
acaagtttagtgtcctatagagaaa

SEQ ID NO: 71193 - DNA, 25 bp, Rattus norvegicus
acaagtttctgtcgcatgcttctct

SEQ ID NO: 71194 - DNA, 25 bp, Rattus norvegicus
acaagtttctgtggcatgcttctct

SEQ ID NO: 71195 - DNA, 25 bp, Rattus norvegicus
acaagtttcttgagctcttttggct

SEQ ID NO: 71196 - DNA, 25 bp, Rattus norvegicus
acaagtttcttgtgctcttttggct

SEQ ID NO: 71197 - DNA, 25 bp, Rattus norvegicus
acaagtttgctcagaactcagtggg

SEQ ID NO: 71198 - DNA, 25 bp, Rattus norvegicus
acaagtttgctctgaactcagtggg

SEQ ID NO: 71199 - DNA, 25 bp, Rattus norvegicus
acaagtttgttcatcgcttacagtc

SEQ ID NO: 71200 - DNA, 25 bp, Rattus norvegicus
acaagtttgttcttcgcttacagtc

SEQ ID NO: 71201 - DNA, 25 bp, Rattus norvegicus
acaagttttatcatggcgcctcttt

SEQ ID NO: 71202 - DNA, 25 bp, Rattus norvegicus
acaagttttatcttggcgcctcttt

SEQ ID NO: 71203 - DNA, 25 bp, Rattus norvegicus
acaagttttctgaaggtgcaggcat

SEQ ID NO: 71204 - DNA, 25 bp, Rattus norvegicus
acaagttttctgtaggtgcaggcat

SEQ ID NO: 71205 - DNA, 25 bp, Rattus norvegicus
acaagttttgttcacaggtcttaag

SEQ ID NO: 71206 - DNA, 25 bp, Rattus norvegicus
acaagttttgttgacaggtcttaag

SEQ ID NO: 71207 - DNA, 25 bp, Rattus norvegicus
acaagttttttcatgctcacatctt

SEQ ID NO: 71208 - DNA, 25 bp, Rattus norvegicus
acaagttttttcttgctcacatctt

SEQ ID NO: 71209 - DNA, 25 bp, Rattus norvegicus
acaataaaatttcatcctcccttgg

SEQ ID NO: 71210 - DNA, 25 bp, Rattus norvegicus
acaataaaatttgatcctcccttgg

SEQ ID NO: 71211 - DNA, 25 bp, Rattus norvegicus
acaataaatgtcacttcccacgcag

SEQ ID NO: 71212 - DNA, 25 bp, Rattus norvegicus
acaataaatgtctcttcccacgcag

SEQ ID NO: 71213 - DNA, 25 bp, Rattus norvegicus
acaataacagttcatccacctcctt

SEQ ID NO: 71214 - DNA, 25 bp, Rattus norvegicus
acaataacagttgatccacctcctt

SEQ ID NO: 71215 - DNA, 25 bp, Rattus norvegicus
acaataacgggcatctgcttgccat

SEQ ID NO: 71216 - DNA, 25 bp, Rattus norvegicus
acaataacgggcttctgcttgccat

SEQ ID NO: 71217 - DNA, 25 bp, Rattus norvegicus
acaataactatgatcctccagggtg

SEQ ID NO: 71218 - DNA, 25 bp, Rattus norvegicus
acaataactatgttcctccagggtg

SEQ ID NO: 71219 - DNA, 25 bp, Rattus norvegicus
acaataatgcctcaactcccaagtc

SEQ ID NO: 71220 - DNA, 25 bp, Rattus norvegicus
acaataatgcctgaactcccaagtc

SEQ ID NO: 71221 - DNA, 25 bp, Rattus norvegicus
acaatacacctcattcctaggacag

SEQ ID NO: 71222 - DNA, 25 bp, Rattus norvegicus
acaatacacctctttcctaggacag

SEQ ID NO: 71223 - DNA, 25 bp, Rattus norvegicus
acaatacactttctcatgactttta

SEQ ID NO: 71224 - DNA, 25 bp, Rattus norvegicus
acaatacactttgtcatgactttta

SEQ ID NO: 71225 - DNA, 25 bp, Rattus norvegicus
acaatacagtgactcctggaggcaa

SEQ ID NO: 71226 - DNA, 25 bp, Rattus norvegicus
acaatacagtgagtcctggaggcaa

SEQ ID NO: 71227 - DNA, 25 bp, Rattus norvegicus
acaataccatctactttcctcagat

SEQ ID NO: 71228 - DNA, 25 bp, Rattus norvegicus
acaataccatcttctttcctcagat

SEQ ID NO: 71229 - DNA, 25 bp, Rattus norvegicus
acaataccatgcaagtttctctcca

SEQ ID NO: 71230 - DNA, 25 bp, Rattus norvegicus
acaataccatgctagtttctctcca

SEQ ID NO: 71231 - DNA, 25 bp, Rattus norvegicus
acaatagccattatcctcttatccg

SEQ ID NO: 71232 - DNA, 25 bp, Rattus norvegicus
acaatagccattttcctcttatccg

SEQ ID NO: 71233 - DNA, 25 bp, Rattus norvegicus
acaatagcctgtaactccatctaca

SEQ ID NO: 71234 - DNA, 25 bp, Rattus norvegicus
acaatagcctgttactccatctaca

SEQ ID NO: 71235 - DNA, 25 bp, Rattus norvegicus
acaatagcggaacctatgcctgctt

SEQ ID NO: 71236 - DNA, 25 bp, Rattus norvegicus
acaatagcggaagctatgcctgctt

SEQ ID NO: 71237 - DNA, 25 bp, Rattus norvegicus
acaatagcggttatctgaggccctt

SEQ ID NO: 71238 - DNA, 25 bp, Rattus norvegicus
acaatagcggttttctgaggccctt

SEQ ID NO: 71239 - DNA, 25 bp, Rattus norvegicus
acaatagctacaacgtcacttccat

SEQ ID NO: 71240 - DNA, 25 bp, Rattus norvegicus
acaatagctacatcgtcacttccat

SEQ ID NO: 71241 - DNA, 25 bp, Rattus norvegicus
acaataggactgattactgcccacc

SEQ ID NO: 71242 - DNA, 25 bp, Rattus norvegicus
acaataggactgtttactgcccacc

SEQ ID NO: 71243 - DNA, 25 bp, Rattus norvegicus
acaataggagcaagggccaagccgg

SEQ ID NO: 71244 - DNA, 25 bp, Rattus norvegicus
acaataggagcatgggccaagccgg

SEQ ID NO: 71245 - DNA, 25 bp, Rattus norvegicus
acaataggcttcctcagacgctggc

SEQ ID NO: 71246 - DNA, 25 bp, Rattus norvegicus
acaataggcttcgtcagacgctggc

SEQ ID NO: 71247 - DNA, 25 bp, Rattus norvegicus
acaataggctttctctcacagggta

SEQ ID NO: 71248 - DNA, 25 bp, Rattus norvegicus
acaataggctttgtctcacagggta

SEQ ID NO: 71249 - DNA, 25 bp, Rattus norvegicus
acaataggtctgatgctgtctgcat

SEQ ID NO: 71250 - DNA, 25 bp, Rattus norvegicus
acaataggtctgttgctgtctgcat

SEQ ID NO: 71251 - DNA, 25 bp, Rattus norvegicus
acaataggttgactgtgctccttca

SEQ ID NO: 71252 - DNA, 25 bp, Rattus norvegicus
acaataggttgagtgtgctccttca

SEQ ID NO: 71253 - DNA, 25 bp, Rattus norvegicus
acaatagtcccccttggtctgtgat

SEQ ID NO: 71254 - DNA, 25 bp, Rattus norvegicus
acaatagtccccgttggtctgtgat

SEQ ID NO: 71255 - DNA, 25 bp, Rattus norvegicus
acaatagtgtctcatgctgcatgga

SEQ ID NO: 71256 - DNA, 25 bp, Rattus norvegicus
acaatagtgtctgatgctgcatgga

SEQ ID NO: 71257 - DNA, 25 bp, Rattus norvegicus
acaatatatagccatgccgtgtgtg

SEQ ID NO: 71258 - DNA, 25 bp, Rattus norvegicus
acaatatatagcgatgccgtgtgtg

SEQ ID NO: 71259 - DNA, 25 bp, Rattus norvegicus
acaatatctctgcactactaggcga

SEQ ID NO: 71260 - DNA, 25 bp, Rattus norvegicus
acaatatctctggactactaggcga

SEQ ID NO: 71261 - DNA, 25 bp, Rattus norvegicus
acaatatcttgtaacttccttctcc

SEQ ID NO: 71262 - DNA, 25 bp, Rattus norvegicus
acaatatcttgttacttccttctcc

SEQ ID NO: 71263 - DNA, 25 bp, Rattus norvegicus
acaatatgggccctggtgactggtc

SEQ ID NO: 71264 - DNA, 25 bp, Rattus norvegicus
acaatatgggccgtggtgactggtc

SEQ ID NO: 71265 - DNA, 25 bp, Rattus norvegicus
acaatatggtttattcgcagcccca

SEQ ID NO: 71266 - DNA, 25 bp, Rattus norvegicus
acaatatggttttttcgcagcccca

SEQ ID NO: 71267 - DNA, 25 bp, Rattus norvegicus
acaatattctgcagagttacaacca

SEQ ID NO: 71268 - DNA, 25 bp, Rattus norvegicus
acaatattctgctgagttacaacca

SEQ ID NO: 71269 - DNA, 25 bp, Rattus norvegicus
acaatattcttgatccttccctcaa

SEQ ID NO: 71270 - DNA, 25 bp, Rattus norvegicus
acaatattcttgttccttccctcaa

SEQ ID NO: 71271 - DNA, 25 bp, Rattus norvegicus
acaatattgagcctgcccatcatgc

SEQ ID NO: 71272 - DNA, 25 bp, Rattus norvegicus
acaatattgagcgtgcccatcatgc

SEQ ID NO: 71273 - DNA, 25 bp, Rattus norvegicus
acaatattgattccgtttcccttcg

SEQ ID NO: 71274 - DNA, 25 bp, Rattus norvegicus
acaatattgattgcgtttcccttcg

SEQ ID NO: 71275 - DNA, 25 bp, Rattus norvegicus
acaatattgccccagataccacgac

SEQ ID NO: 71276 - DNA, 25 bp, Rattus norvegicus
acaatattgcccgagataccacgac

SEQ ID NO: 71277 - DNA, 25 bp, Rattus norvegicus
acaatattggcacgatgttcctccg

SEQ ID NO: 71278 - DNA, 25 bp, Rattus norvegicus
acaatattggcaggatgttcctccg

SEQ ID NO: 71279 - DNA, 25 bp, Rattus norvegicus
acaatattggccatgagtcagctat

SEQ ID NO: 71280 - DNA, 25 bp, Rattus norvegicus
acaatattggccttgagtcagctat

SEQ ID NO: 71281 - DNA, 25 bp, Rattus norvegicus
acaatattgtataatgcctcgaagt

SEQ ID NO: 71282 - DNA, 25 bp, Rattus norvegicus
acaatattgtattatgcctcgaagt

SEQ ID NO: 71283 - DNA, 25 bp, Rattus norvegicus
acaatatttgtacttaagtctccat

SEQ ID NO: 71284 - DNA, 25 bp, Rattus norvegicus
acaatatttgtagttaagtctccat

SEQ ID NO: 71285 - DNA, 25 bp, Rattus norvegicus
acaatattttctctctccgtcgtct

SEQ ID NO: 71286 - DNA, 25 bp, Rattus norvegicus
acaatattttctgtctccgtcgtct

SEQ ID NO: 71287 - DNA, 25 bp, Rattus norvegicus
acaatcaacttaccttgcatctctg

SEQ ID NO: 71288 - DNA, 25 bp, Rattus norvegicus
acaatcaacttagcttgcatctctg

SEQ ID NO: 71289 - DNA, 25 bp, Rattus norvegicus
acaatcaagctaattcgtcgcatat

SEQ ID NO: 71290 - DNA, 25 bp, Rattus norvegicus
acaatcaagctatttcgtcgcatat

SEQ ID NO: 71291 - DNA, 25 bp, Rattus norvegicus
acaatcaagggcctgtgcacacagt

SEQ ID NO: 71292 - DNA, 25 bp, Rattus norvegicus
acaatcaagggcgtgtgcacacagt

SEQ ID NO: 71293 - DNA, 25 bp, Rattus norvegicus
acaatcacccacaggctacctatca

SEQ ID NO: 71294 - DNA, 25 bp, Rattus norvegicus
acaatcacccactggctacctatca

SEQ ID NO: 71295 - DNA, 25 bp, Rattus norvegicus
acaatcacctctatgtggtcttcat

SEQ ID NO: 71296 - DNA, 25 bp, Rattus norvegicus
acaatcacctctttgtggtcttcat

SEQ ID NO: 71297 - DNA, 25 bp, Rattus norvegicus
acaatcagcagaaagccctacccag

SEQ ID NO: 71298 - DNA, 25 bp, Rattus norvegicus
acaatcagcagatagccctacccag

SEQ ID NO: 71299 - DNA, 25 bp, Rattus norvegicus
acaatcaggtgaagaccctctctct

SEQ ID NO: 71300 - DNA, 25 bp, Rattus norvegicus
acaatcaggtgatgaccctctctct

SEQ ID NO: 71301 - DNA, 25 bp, Rattus norvegicus
acaatcatagtcctagccacttggg

SEQ ID NO: 71302 - DNA, 25 bp, Rattus norvegicus
acaatcatagtcgtagccacttggg

SEQ ID NO: 71303 - DNA, 25 bp, Rattus norvegicus
acaatcatggtaattcaggcaggac

SEQ ID NO: 71304 - DNA, 25 bp, Rattus norvegicus
acaatcatggtatttcaggcaggac

SEQ ID NO: 71305 - DNA, 25 bp, Rattus norvegicus
acaatcattgatctgtgtctggaat

SEQ ID NO: 71306 - DNA, 25 bp, Rattus norvegicus
acaatcattgatgtgtgtctggaat

SEQ ID NO: 71307 - DNA, 25 bp, Rattus norvegicus
acaatccaagcacatactgtcctct

SEQ ID NO: 71308 - DNA, 25 bp, Rattus norvegicus
acaatccaagcagatactgtcctct

SEQ ID NO: 71309 - DNA, 25 bp, Rattus norvegicus
acaatccaaggactctgccatcaag

SEQ ID NO: 71310 - DNA, 25 bp, Rattus norvegicus
acaatccaaggagtctgccatcaag

SEQ ID NO: 71311 - DNA, 25 bp, Rattus norvegicus
acaatccaagtgattctgacagttt

SEQ ID NO: 71312 - DNA, 25 bp, Rattus norvegicus
acaatccaagtgtttctgacagttt

SEQ ID NO: 71313 - DNA, 25 bp, Rattus norvegicus
acaatccagggaaccaggctataaa

SEQ ID NO: 71314 - DNA, 25 bp, Rattus norvegicus
acaatccagggatccaggctataaa

SEQ ID NO: 71315 - DNA, 25 bp, Rattus norvegicus
acaatcccttgtctttcttcatggg

SEQ ID NO: 71316 - DNA, 25 bp, Rattus norvegicus
acaatcccttgtgtttcttcatggg

SEQ ID NO: 71317 - DNA, 25 bp, Rattus norvegicus
acaatccgcagtaacttctaaccta

SEQ ID NO: 71318 - DNA, 25 bp, Rattus norvegicus
acaatccgcagttacttctaaccta

SEQ ID NO: 71319 - DNA, 25 bp, Rattus norvegicus
acaatccgtgtcattcagtgtgact

SEQ ID NO: 71320 - DNA, 25 bp, Rattus norvegicus
acaatccgtgtctttcagtgtgact

SEQ ID NO: 71321 - DNA, 25 bp, Rattus norvegicus
acaatcctcctcagtctgggaaaaa

SEQ ID NO: 71322 - DNA, 25 bp, Rattus norvegicus
acaatcctcctctgtctgggaaaaa

SEQ ID NO: 71323 - DNA, 25 bp, Rattus norvegicus
acaatcctcgcgcactttagggatc

SEQ ID NO: 71324 - DNA, 25 bp, Rattus norvegicus
acaatcctcgcggactttagggatc

SEQ ID NO: 71325 - DNA, 25 bp, Rattus norvegicus
acaatcctgtaccactcattgtggg

SEQ ID NO: 71326 - DNA, 25 bp, Rattus norvegicus
acaatcctgtacgactcattgtggg

SEQ ID NO: 71327 - DNA, 25 bp, Rattus norvegicus
acaatcctgtcccatggtatttaac

SEQ ID NO: 71328 - DNA, 25 bp, Rattus norvegicus
acaatcctgtccgatggtatttaac

SEQ ID NO: 71329 - DNA, 25 bp, Rattus norvegicus
acaatcgacctgaaacaatcacaaa

SEQ ID NO: 71330 - DNA, 25 bp, Rattus norvegicus
acaatcgacctgtaacaatcacaaa

SEQ ID NO: 71331 - DNA, 25 bp, Rattus norvegicus
acaatcggtatcctgcacaagtgat

SEQ ID NO: 71332 - DNA, 25 bp, Rattus norvegicus
acaatcggtatcgtgcacaagtgat

SEQ ID NO: 71333 - DNA, 25 bp, Rattus norvegicus
acaatcggtggtagcaatggttcaa

SEQ ID NO: 71334 - DNA, 25 bp, Rattus norvegicus
acaatcggtggttgcaatggttcaa

SEQ ID NO: 71335 - DNA, 25 bp, Rattus norvegicus
acaatctaaaccattctcgtctagg

SEQ ID NO: 71336 - DNA, 25 bp, Rattus norvegicus
acaatctaaacctttctcgtctagg

SEQ ID NO: 71337 - DNA, 25 bp, Rattus norvegicus
acaatctcaaatcctccatagtgcc

SEQ ID NO: 71338 - DNA, 25 bp, Rattus norvegicus
acaatctcaaatgctccatagtgcc

SEQ ID NO: 71339 - DNA, 25 bp, Rattus norvegicus
acaatctccccgagatgggtgaact

SEQ ID NO: 71340 - DNA, 25 bp, Rattus norvegicus
acaatctccccgtgatgggtgaact

SEQ ID NO: 71341 - DNA, 25 bp, Rattus norvegicus
acaatctccttcctgtacataatca

SEQ ID NO: 71342 - DNA, 25 bp, Rattus norvegicus
acaatctccttcgtgtacataatca

SEQ ID NO: 71343 - DNA, 25 bp, Rattus norvegicus
acaatctctattccctatacattat

SEQ ID NO: 71344 - DNA, 25 bp, Rattus norvegicus
acaatctctattgcctatacattat

SEQ ID NO: 71345 - DNA, 25 bp, Rattus norvegicus
acaatctctgatcttgcatgggcac

SEQ ID NO: 71346 - DNA, 25 bp, Rattus norvegicus
acaatctctgatgttgcatgggcac

SEQ ID NO: 71347 - DNA, 25 bp, Rattus norvegicus
acaatctgcgatcatcccggagtat

SEQ ID NO: 71348 - DNA, 25 bp, Rattus norvegicus
acaatctgcgatgatcccggagtat

SEQ ID NO: 71349 - DNA, 25 bp, Rattus norvegicus
acaatctggcagcatacatcccgtt

SEQ ID NO: 71350 - DNA, 25 bp, Rattus norvegicus
acaatctggcaggatacatcccgtt

SEQ ID NO: 71351 - DNA, 25 bp, Rattus norvegicus
acaatctgtcttcccttggtgtgtt

SEQ ID NO: 71352 - DNA, 25 bp, Rattus norvegicus
acaatctgtcttgccttggtgtgtt

SEQ ID NO: 71353 - DNA, 25 bp, Rattus norvegicus
acaatcttagctcctttgcattatc

SEQ ID NO: 71354 - DNA, 25 bp, Rattus norvegicus
acaatcttagctgctttgcattatc

SEQ ID NO: 71355 - DNA, 25 bp, Rattus norvegicus
acaatcttcatgaagcaaagcgctc

SEQ ID NO: 71356 - DNA, 25 bp, Rattus norvegicus
acaatcttcatgtagcaaagcgctc

SEQ ID NO: 71357 - DNA, 25 bp, Rattus norvegicus
acaatcttgatcaacatttcttaat

SEQ ID NO: 71358 - DNA, 25 bp, Rattus norvegicus
acaatcttgatctacatttcttaat

SEQ ID NO: 71359 - DNA, 25 bp, Rattus norvegicus
acaatcttggagactttcctgtctc

SEQ ID NO: 71360 - DNA, 25 bp, Rattus norvegicus
acaatcttggagtctttcctgtctc

SEQ ID NO: 71361 - DNA, 25 bp, Rattus norvegicus
acaatcttggttaccctggtgggct

SEQ ID NO: 71362 - DNA, 25 bp, Rattus norvegicus
acaatcttggtttccctggtgggct

SEQ ID NO: 71363 - DNA, 25 bp, Rattus norvegicus
acaatctttggactacctttgcacc

SEQ ID NO: 71364 - DNA, 25 bp, Rattus norvegicus
acaatctttggagtacctttgcacc

SEQ ID NO: 71365 - DNA, 25 bp, Rattus norvegicus
acaatgaaaagcaccctggtggcca

SEQ ID NO: 71366 - DNA, 25 bp, Rattus norvegicus
acaatgaaaagctccctggtggcca

SEQ ID NO: 71367 - DNA, 25 bp, Rattus norvegicus
acaatgaaatgtcccgctgtgccga

SEQ ID NO: 71368 - DNA, 25 bp, Rattus norvegicus
acaatgaaatgtgccgctgtgccga

SEQ ID NO: 71369 - DNA, 25 bp, Rattus norvegicus
acaatgaatctgatagttcccctta

SEQ ID NO: 71370 - DNA, 25 bp, Rattus norvegicus
acaatgaatctgttagttcccctta

SEQ ID NO: 71371 - DNA, 25 bp, Rattus norvegicus
acaatgacagtgacttttctgccag

SEQ ID NO: 71372 - DNA, 25 bp, Rattus norvegicus
acaatgacagtgtcttttctgccag

SEQ ID NO: 71373 - DNA, 25 bp, Rattus norvegicus
acaatgacggttagcctcccaggac

SEQ ID NO: 71374 - DNA, 25 bp, Rattus norvegicus
acaatgacggtttgcctcccaggac

SEQ ID NO: 71375 - DNA, 25 bp, Rattus norvegicus
acaatgacgtctcgaggtggctctt

SEQ ID NO: 71376 - DNA, 25 bp, Rattus norvegicus
acaatgacgtctggaggtggctctt

SEQ ID NO: 71377 - DNA, 25 bp, Rattus norvegicus
acaatgactgtgctggtacccacgg

SEQ ID NO: 71378 - DNA, 25 bp, Rattus norvegicus
acaatgactgtggtggtacccacgg

SEQ ID NO: 71379 - DNA, 25 bp, Rattus norvegicus
acaatgagagagctgcgacccgcgc

SEQ ID NO: 71380 - DNA, 25 bp, Rattus norvegicus
acaatgagagaggtgcgacccgcgc

SEQ ID NO: 71381 - DNA, 25 bp, Rattus norvegicus
acaatgaggtggagcccatcatcct

SEQ ID NO: 71382 - DNA, 25 bp, Rattus norvegicus
acaatgaggtggtgcccatcatcct

SEQ ID NO: 71383 - DNA, 25 bp, Rattus norvegicus
acaatgatggcccagtcctgacaga

SEQ ID NO: 71384 - DNA, 25 bp, Rattus norvegicus
acaatgatggccgagtcctgacaga

SEQ ID NO: 71385 - DNA, 25 bp, Rattus norvegicus
acaatgatttgtccctacaatcact

SEQ ID NO: 71386 - DNA, 25 bp, Rattus norvegicus
acaatgatttgtgcctacaatcact

SEQ ID NO: 71387 - DNA, 25 bp, Rattus norvegicus
acaatgcagactacggcctttacac

SEQ ID NO: 71388 - DNA, 25 bp, Rattus norvegicus
acaatgcagacttcggcctttacac

SEQ ID NO: 71389 - DNA, 25 bp, Rattus norvegicus
acaatgcagcgccttgttgtgccat

SEQ ID NO: 71390 - DNA, 25 bp, Rattus norvegicus
acaatgcagcgcgttgttgtgccat

SEQ ID NO: 71391 - DNA, 25 bp, Rattus norvegicus
acaatgcatgcaagtcagggatgtg

SEQ ID NO: 71392 - DNA, 25 bp, Rattus norvegicus
acaatgcatgcatgtcagggatgtg

SEQ ID NO: 71393 - DNA, 25 bp, Rattus norvegicus
acaatgcatgcccaagtgcgttcat

SEQ ID NO: 71394 - DNA, 25 bp, Rattus norvegicus
acaatgcatgccgaagtgcgttcat

SEQ ID NO: 71395 - DNA, 25 bp, Rattus norvegicus
acaatgccacatcttgttccttttc

SEQ ID NO: 71396 - DNA, 25 bp, Rattus norvegicus
acaatgccacatgttgttccttttc

SEQ ID NO: 71397 - DNA, 25 bp, Rattus norvegicus
acaatgccgaaaaagccgctcactt

SEQ ID NO: 71398 - DNA, 25 bp, Rattus norvegicus
acaatgccgaaatagccgctcactt

SEQ ID NO: 71399 - DNA, 25 bp, Rattus norvegicus
acaatgcctgtgaactcaccatcag

SEQ ID NO: 71400 - DNA, 25 bp, Rattus norvegicus
acaatgcctgtgtactcaccatcag

SEQ ID NO: 71401 - DNA, 25 bp, Rattus norvegicus
acaatgccttccactgtaacaggat

SEQ ID NO: 71402 - DNA, 25 bp, Rattus norvegicus
acaatgccttcctctgtaacaggat

SEQ ID NO: 71403 - DNA, 25 bp, Rattus norvegicus
acaatgccttctacctgtagttctg

SEQ ID NO: 71404 - DNA, 25 bp, Rattus norvegicus
acaatgccttcttcctgtagttctg

SEQ ID NO: 71405 - DNA, 25 bp, Rattus norvegicus
acaatgccttttagtcagtggcccc

SEQ ID NO: 71406 - DNA, 25 bp, Rattus norvegicus
acaatgcctttttgtcagtggcccc

SEQ ID NO: 71407 - DNA, 25 bp, Rattus norvegicus
acaatgctatgccagtgtccttctc

SEQ ID NO: 71408 - DNA, 25 bp, Rattus norvegicus
acaatgctatgcgagtgtccttctc

SEQ ID NO: 71409 - DNA, 25 bp, Rattus norvegicus
acaatgctattcaagccacagtgta

SEQ ID NO: 71410 - DNA, 25 bp, Rattus norvegicus
acaatgctattctagccacagtgta

SEQ ID NO: 71411 - DNA, 25 bp, Rattus norvegicus
acaatgctcacacctgtcgctaact

SEQ ID NO: 71412 - DNA, 25 bp, Rattus norvegicus
acaatgctcacagctgtcgctaact

SEQ ID NO: 71413 - DNA, 25 bp, Rattus norvegicus
acaatgctcatgctttacagtgtgc

SEQ ID NO: 71414 - DNA, 25 bp, Rattus norvegicus
acaatgctcatggtttacagtgtgc

SEQ ID NO: 71415 - DNA, 25 bp, Rattus norvegicus
acaatgctctcaatgagctgaccaa

SEQ ID NO: 71416 - DNA, 25 bp, Rattus norvegicus
acaatgctctcattgagctgaccaa

SEQ ID NO: 71417 - DNA, 25 bp, Rattus norvegicus
acaatgcttccaacagtgctctgta

SEQ ID NO: 71418 - DNA, 25 bp, Rattus norvegicus
acaatgcttccatcagtgctctgta

SEQ ID NO: 71419 - DNA, 25 bp, Rattus norvegicus
acaatgcttctactgcttggtgcaa

SEQ ID NO: 71420 - DNA, 25 bp, Rattus norvegicus
acaatgcttctagtgcttggtgcaa

SEQ ID NO: 71421 - DNA, 25 bp, Rattus norvegicus
acaatgctttttcttcttggaatac

SEQ ID NO: 71422 - DNA, 25 bp, Rattus norvegicus
acaatgctttttgttcttggaatac

SEQ ID NO: 71423 - DNA, 25 bp, Rattus norvegicus
acaatggaccccaagaagttggaat

SEQ ID NO: 71424 - DNA, 25 bp, Rattus norvegicus
acaatggacccctagaagttggaat

SEQ ID NO: 71425 - DNA, 25 bp, Rattus norvegicus
acaatggcagtgacagggcagtcca

SEQ ID NO: 71426 - DNA, 25 bp, Rattus norvegicus
acaatggcagtgtcagggcagtcca

SEQ ID NO: 71427 - DNA, 25 bp, Rattus norvegicus
acaatggccagtaccgcattcggac

SEQ ID NO: 71428 - DNA, 25 bp, Rattus norvegicus
acaatggccagttccgcattcggac

SEQ ID NO: 71429 - DNA, 25 bp, Rattus norvegicus
acaatggccttcactgcttttttga

SEQ ID NO: 71430 - DNA, 25 bp, Rattus norvegicus
acaatggccttctctgcttttttga

SEQ ID NO: 71431 - DNA, 25 bp, Rattus norvegicus
acaatggcgggtatgagtggctcaa

SEQ ID NO: 71432 - DNA, 25 bp, Rattus norvegicus
acaatggcgggtttgagtggctcaa

SEQ ID NO: 71433 - DNA, 25 bp, Rattus norvegicus
acaatggcggtacatctgcagcagc

SEQ ID NO: 71434 - DNA, 25 bp, Rattus norvegicus
acaatggcggtagatctgcagcagc

SEQ ID NO: 71435 - DNA, 25 bp, Rattus norvegicus
acaatggctaggcaccggttggact

SEQ ID NO: 71436 - DNA, 25 bp, Rattus norvegicus
acaatggctagggaccggttggact

SEQ ID NO: 71437 - DNA, 25 bp, Rattus norvegicus
acaatggctgtcatgttgtgctccc

SEQ ID NO: 71438 - DNA, 25 bp, Rattus norvegicus
acaatggctgtcttgttgtgctccc

SEQ ID NO: 71439 - DNA, 25 bp, Rattus norvegicus
acaatggctgtgaggcactatggct

SEQ ID NO: 71440 - DNA, 25 bp, Rattus norvegicus
acaatggctgtgtggcactatggct

SEQ ID NO: 71441 - DNA, 25 bp, Rattus norvegicus
acaatggcttccatagataactaca

SEQ ID NO: 71442 - DNA, 25 bp, Rattus norvegicus
acaatggcttccttagataactaca

SEQ ID NO: 71443 - DNA, 25 bp, Rattus norvegicus
acaatggctttgaggctctctgtcc

SEQ ID NO: 71444 - DNA, 25 bp, Rattus norvegicus
acaatggctttgtggctctctgtcc

SEQ ID NO: 71445 - DNA, 25 bp, Rattus norvegicus
acaatgggacctagttgcttccttc

SEQ ID NO: 71446 - DNA, 25 bp, Rattus norvegicus
acaatgggaccttgttgcttccttc

SEQ ID NO: 71447 - DNA, 25 bp, Rattus norvegicus
acaatgggcagtacagacgtggtca

SEQ ID NO: 71448 - DNA, 25 bp, Rattus norvegicus
acaatgggcagttcagacgtggtca

SEQ ID NO: 71449 - DNA, 25 bp, Rattus norvegicus
acaatgggcgccaacttggaatcat

SEQ ID NO: 71450 - DNA, 25 bp, Rattus norvegicus
acaatgggcgcctacttggaatcat

SEQ ID NO: 71451 - DNA, 25 bp, Rattus norvegicus
acaatgggcgctcgattggatgctt

SEQ ID NO: 71452 - DNA, 25 bp, Rattus norvegicus
acaatgggcgctggattggatgctt

SEQ ID NO: 71453 - DNA, 25 bp, Rattus norvegicus
acaatggtcccacatacttcacgca

SEQ ID NO: 71454 - DNA, 25 bp, Rattus norvegicus
acaatggtcccagatacttcacgca

SEQ ID NO: 71455 - DNA, 25 bp, Rattus norvegicus
acaatggtcctcatatgctggaacc

SEQ ID NO: 71456 - DNA, 25 bp, Rattus norvegicus
acaatggtcctcttatgctggaacc

SEQ ID NO: 71457 - DNA, 25 bp, Rattus norvegicus
acaatggtctacactggtcgctgag

SEQ ID NO: 71458 - DNA, 25 bp, Rattus norvegicus
acaatggtctactctggtcgctgag

SEQ ID NO: 71459 - DNA, 25 bp, Rattus norvegicus
acaatggtgctccagaacgcacaga

SEQ ID NO: 71460 - DNA, 25 bp, Rattus norvegicus
acaatggtgctcgagaacgcacaga

SEQ ID NO: 71461 - DNA, 25 bp, Rattus norvegicus
acaatggtgcttcctgtacagcctc

SEQ ID NO: 71462 - DNA, 25 bp, Rattus norvegicus
acaatggtgcttgctgtacagcctc

SEQ ID NO: 71463 - DNA, 25 bp, Rattus norvegicus
acaatggtggttatcggctgcccca

SEQ ID NO: 71464 - DNA, 25 bp, Rattus norvegicus
acaatggtggttttcggctgcccca

SEQ ID NO: 71465 - DNA, 25 bp, Rattus norvegicus
acaatggtgtccctttggatggccg

SEQ ID NO: 71466 - DNA, 25 bp, Rattus norvegicus
acaatggtgtccgtttggatggccg

SEQ ID NO: 71467 - DNA, 25 bp, Rattus norvegicus
acaatgtaattactacttcatgcag

SEQ ID NO: 71468 - DNA, 25 bp, Rattus norvegicus
acaatgtaattagtacttcatgcag

SEQ ID NO: 71469 - DNA, 25 bp, Rattus norvegicus
acaatgtacctaactcatcttgagc

SEQ ID NO: 71470 - DNA, 25 bp, Rattus norvegicus
acaatgtacctatctcatcttgagc

SEQ ID NO: 71471 - DNA, 25 bp, Rattus norvegicus
acaatgtactgtagccttttatata

SEQ ID NO: 71472 - DNA, 25 bp, Rattus norvegicus
acaatgtactgttgccttttatata

SEQ ID NO: 71473 - DNA, 25 bp, Rattus norvegicus
acaatgtattttctgagtctccaag

SEQ ID NO: 71474 - DNA, 25 bp, Rattus norvegicus
acaatgtattttgtgagtctccaag

SEQ ID NO: 71475 - DNA, 25 bp, Rattus norvegicus
acaatgtccactcggctctttgctg

SEQ ID NO: 71476 - DNA, 25 bp, Rattus norvegicus
acaatgtccactgggctctttgctg

SEQ ID NO: 71477 - DNA, 25 bp, Rattus norvegicus
acaatgtccccaatgctgtctggat

SEQ ID NO: 71478 - DNA, 25 bp, Rattus norvegicus
acaatgtccccattgctgtctggat

SEQ ID NO: 71479 - DNA, 25 bp, Rattus norvegicus
acaatgtcccctctgtgaaggaaca

SEQ ID NO: 71480 - DNA, 25 bp, Rattus norvegicus
acaatgtcccctgtgtgaaggaaca

SEQ ID NO: 71481 - DNA, 25 bp, Rattus norvegicus
acaatgtcggtcaagggcacggatt

SEQ ID NO: 71482 - DNA, 25 bp, Rattus norvegicus
acaatgtcggtctagggcacggatt

SEQ ID NO: 71483 - DNA, 25 bp, Rattus norvegicus
acaatgtctacaagcccacgagcca

SEQ ID NO: 71484 - DNA, 25 bp, Rattus norvegicus
acaatgtctacatgcccacgagcca

SEQ ID NO: 71485 - DNA, 25 bp, Rattus norvegicus
acaatgtctcccatgtaccaagtag

SEQ ID NO: 71486 - DNA, 25 bp, Rattus norvegicus
acaatgtctcccttgtaccaagtag

SEQ ID NO: 71487 - DNA, 25 bp, Rattus norvegicus
acaatgtctgaacctacgacctcct

SEQ ID NO: 71488 - DNA, 25 bp, Rattus norvegicus
acaatgtctgaagctacgacctcct

SEQ ID NO: 71489 - DNA, 25 bp, Rattus norvegicus
acaatgtctgaccagccgatggaga

SEQ ID NO: 71490 - DNA, 25 bp, Rattus norvegicus
acaatgtctgacgagccgatggaga

SEQ ID NO: 71491 - DNA, 25 bp, Rattus norvegicus
acaatgtctgcaaacctccaaggtg

SEQ ID NO: 71492 - DNA, 25 bp, Rattus norvegicus
acaatgtctgcatacctccaaggtg

SEQ ID NO: 71493 - DNA, 25 bp, Rattus norvegicus
acaatgtctgtgaactggacctggt

SEQ ID NO: 71494 - DNA, 25 bp, Rattus norvegicus
acaatgtctgtgtactggacctggt

SEQ ID NO: 71495 - DNA, 25 bp, Rattus norvegicus
acaatgtgataacggctttgtccaa

SEQ ID NO: 71496 - DNA, 25 bp, Rattus norvegicus
acaatgtgataagggctttgtccaa

SEQ ID NO: 71497 - DNA, 25 bp, Rattus norvegicus
acaatgtgggtcctgtcatccttga

SEQ ID NO: 71498 - DNA, 25 bp, Rattus norvegicus
acaatgtgggtcgtgtcatccttga

SEQ ID NO: 71499 - DNA, 25 bp, Rattus norvegicus
acaatgttcaacatgcagacctcag

SEQ ID NO: 71500 - DNA, 25 bp, Rattus norvegicus
acaatgttcaacttgcagacctcag

SEQ ID NO: 71501 - DNA, 25 bp, Rattus norvegicus
acaatgttcctcagtgatttctgct

SEQ ID NO: 71502 - DNA, 25 bp, Rattus norvegicus
acaatgttcctctgtgatttctgct

SEQ ID NO: 71503 - DNA, 25 bp, Rattus norvegicus
acaatgttcttccatgtttccagca

SEQ ID NO: 71504 - DNA, 25 bp, Rattus norvegicus
acaatgttcttcgatgtttccagca

SEQ ID NO: 71505 - DNA, 25 bp, Rattus norvegicus
acaatgtttcagacagagcggtaat

SEQ ID NO: 71506 - DNA, 25 bp, Rattus norvegicus
acaatgtttcagtcagagcggtaat

SEQ ID NO: 71507 - DNA, 25 bp, Rattus norvegicus
acaatgttttagagagcctgctctg

SEQ ID NO: 71508 - DNA, 25 bp, Rattus norvegicus
acaatgttttagtgagcctgctctg

SEQ ID NO: 71509 - DNA, 25 bp, Rattus norvegicus
acaattacctaacccacacctggag

SEQ ID NO: 71510 - DNA, 25 bp, Rattus norvegicus
acaattacctaagccacacctggag

SEQ ID NO: 71511 - DNA, 25 bp, Rattus norvegicus
acaattacttttcttacctgctcag

SEQ ID NO: 71512 - DNA, 25 bp, Rattus norvegicus
acaattacttttgttacctgctcag

SEQ ID NO: 71513 - DNA, 25 bp, Rattus norvegicus
acaattagtcctactgtactgggca

SEQ ID NO: 71514 - DNA, 25 bp, Rattus norvegicus
acaattagtccttctgtactgggca

SEQ ID NO: 71515 - DNA, 25 bp, Rattus norvegicus
acaattatgaccatcctatccattc

SEQ ID NO: 71516 - DNA, 25 bp, Rattus norvegicus
acaattatgaccttcctatccattc

SEQ ID NO: 71517 - DNA, 25 bp, Rattus norvegicus
acaattatgagtagcgtccccggag

SEQ ID NO: 71518 - DNA, 25 bp, Rattus norvegicus
acaattatgagttgcgtccccggag

SEQ ID NO: 71519 - DNA, 25 bp, Rattus norvegicus
acaattattcaaataccactgggta

SEQ ID NO: 71520 - DNA, 25 bp, Rattus norvegicus
acaattattcaattaccactgggta

SEQ ID NO: 71521 - DNA, 25 bp, Rattus norvegicus
acaattattgacacggcagggacct

SEQ ID NO: 71522 - DNA, 25 bp, Rattus norvegicus
acaattattgactcggcagggacct

SEQ ID NO: 71523 - DNA, 25 bp, Rattus norvegicus
acaattcaaaatacccctgctcttt

SEQ ID NO: 71524 - DNA, 25 bp, Rattus norvegicus
acaattcaaaattcccctgctcttt

SEQ ID NO: 71525 - DNA, 25 bp, Rattus norvegicus
acaattcaacgtatcctttggagag

SEQ ID NO: 71526 - DNA, 25 bp, Rattus norvegicus
acaattcaacgtttcctttggagag

SEQ ID NO: 71527 - DNA, 25 bp, Rattus norvegicus
acaattcagtctcttcttggccatc

SEQ ID NO: 71528 - DNA, 25 bp, Rattus norvegicus
acaattcagtctgttcttggccatc

SEQ ID NO: 71529 - DNA, 25 bp, Rattus norvegicus
acaattcatccgacagttcatctgc

SEQ ID NO: 71530 - DNA, 25 bp, Rattus norvegicus
acaattcatccgtcagttcatctgc

SEQ ID NO: 71531 - DNA, 25 bp, Rattus norvegicus
acaattcatttgctgtcatgggccc

SEQ ID NO: 71532 - DNA, 25 bp, Rattus norvegicus
acaattcatttggtgtcatgggccc

SEQ ID NO: 71533 - DNA, 25 bp, Rattus norvegicus
acaattccacgacgcggcttcaaaa

SEQ ID NO: 71534 - DNA, 25 bp, Rattus norvegicus
acaattccacgaggcggcttcaaaa

SEQ ID NO: 71535 - DNA, 25 bp, Rattus norvegicus
acaattcctcagacggttgcaaact

SEQ ID NO: 71536 - DNA, 25 bp, Rattus norvegicus
acaattcctcagtcggttgcaaact

SEQ ID NO: 71537 - DNA, 25 bp, Rattus norvegicus
acaattccttctagcctttgacaat

SEQ ID NO: 71538 - DNA, 25 bp, Rattus norvegicus
acaattccttcttgcctttgacaat

SEQ ID NO: 71539 - DNA, 25 bp, Rattus norvegicus
acaattcgcttgatggcaatgactt

SEQ ID NO: 71540 - DNA, 25 bp, Rattus norvegicus
acaattcgcttgttggcaatgactt

SEQ ID NO: 71541 - DNA, 25 bp, Rattus norvegicus
acaattctaattacatgtggcaatc

SEQ ID NO: 71542 - DNA, 25 bp, Rattus norvegicus
acaattctaatttcatgtggcaatc

SEQ ID NO: 71543 - DNA, 25 bp, Rattus norvegicus
acaattctcatcagggacttcctaa

SEQ ID NO: 71544 - DNA, 25 bp, Rattus norvegicus
acaattctcatctgggacttcctaa

SEQ ID NO: 71545 - DNA, 25 bp, Rattus norvegicus
acaattctcattcgcaactcgacct

SEQ ID NO: 71546 - DNA, 25 bp, Rattus norvegicus
acaattctcattggcaactcgacct

SEQ ID NO: 71547 - DNA, 25 bp, Rattus norvegicus
acaattctgctgaaattctgtaaac

SEQ ID NO: 71548 - DNA, 25 bp, Rattus norvegicus
acaattctgctgtaattctgtaaac

SEQ ID NO: 71549 - DNA, 25 bp, Rattus norvegicus
acaattcttattatcctggtgcttc

SEQ ID NO: 71550 - DNA, 25 bp, Rattus norvegicus
acaattcttattttcctggtgcttc

SEQ ID NO: 71551 - DNA, 25 bp, Rattus norvegicus
acaattcttttgcatgaccctctaa

SEQ ID NO: 71552 - DNA, 25 bp, Rattus norvegicus
acaattcttttggatgaccctctaa

SEQ ID NO: 71553 - DNA, 25 bp, Rattus norvegicus
acaattgaatacctccaacccaatc

SEQ ID NO: 71554 - DNA, 25 bp, Rattus norvegicus
acaattgaatacgtccaacccaatc

SEQ ID NO: 71555 - DNA, 25 bp, Rattus norvegicus
acaattgatgccatcaaagcagtgg

SEQ ID NO: 71556 - DNA, 25 bp, Rattus norvegicus
acaattgatgccttcaaagcagtgg

SEQ ID NO: 71557 - DNA, 25 bp, Rattus norvegicus
acaattgcagataccttttcttccc

SEQ ID NO: 71558 - DNA, 25 bp, Rattus norvegicus
acaattgcagattccttttcttccc

SEQ ID NO: 71559 - DNA, 25 bp, Rattus norvegicus
acaattgcagccagctgagaggcct

SEQ ID NO: 71560 - DNA, 25 bp, Rattus norvegicus
acaattgcagcctgctgagaggcct

SEQ ID NO: 71561 - DNA, 25 bp, Rattus norvegicus
acaattgcatgtctcccagatgtca

SEQ ID NO: 71562 - DNA, 25 bp, Rattus norvegicus
acaattgcatgtgtcccagatgtca

SEQ ID NO: 71563 - DNA, 25 bp, Rattus norvegicus
acaattgcccagcagactgtctgcc

SEQ ID NO: 71564 - DNA, 25 bp, Rattus norvegicus
acaattgcccaggagactgtctgcc

SEQ ID NO: 71565 - DNA, 25 bp, Rattus norvegicus
acaattggtggtctctacagagaat

SEQ ID NO: 71566 - DNA, 25 bp, Rattus norvegicus
acaattggtggtgtctacagagaat

SEQ ID NO: 71567 - DNA, 25 bp, Rattus norvegicus
acaattgttggtctgcatggcctcg

SEQ ID NO: 71568 - DNA, 25 bp, Rattus norvegicus
acaattgttggtgtgcatggcctcg

SEQ ID NO: 71569 - DNA, 25 bp, Rattus norvegicus
acaattgtttttacgatttctcaag

SEQ ID NO: 71570 - DNA, 25 bp, Rattus norvegicus
acaattgttttttcgatttctcaag

SEQ ID NO: 71571 - DNA, 25 bp, Rattus norvegicus
acaatttaaattcacagggctcaca

SEQ ID NO: 71572 - DNA, 25 bp, Rattus norvegicus
acaatttaaattgacagggctcaca

SEQ ID NO: 71573 - DNA, 25 bp, Rattus norvegicus
acaatttccggccatttcttaagag

SEQ ID NO: 71574 - DNA, 25 bp, Rattus norvegicus
acaatttccggcgatttcttaagag

SEQ ID NO: 71575 - DNA, 25 bp, Rattus norvegicus
acaatttcttgcatcagtctctgac

SEQ ID NO: 71576 - DNA, 25 bp, Rattus norvegicus
acaatttcttgcttcagtctctgac

SEQ ID NO: 71577 - DNA, 25 bp, Rattus norvegicus
acaatttgaaaactgttctgccttt

SEQ ID NO: 71578 - DNA, 25 bp, Rattus norvegicus
acaatttgaaaagtgttctgccttt

SEQ ID NO: 71579 - DNA, 25 bp, Rattus norvegicus
acaatttgaacaatcctcccagctg

SEQ ID NO: 71580 - DNA, 25 bp, Rattus norvegicus
acaatttgaacattcctcccagctg

SEQ ID NO: 71581 - DNA, 25 bp, Rattus norvegicus
acaatttgatatctggcaccacgtg

SEQ ID NO: 71582 - DNA, 25 bp, Rattus norvegicus
acaatttgatatgtggcaccacgtg

SEQ ID NO: 71583 - DNA, 25 bp, Rattus norvegicus
acaatttgccctctttggtattttg

SEQ ID NO: 71584 - DNA, 25 bp, Rattus norvegicus
acaatttgccctgtttggtattttg

SEQ ID NO: 71585 - DNA, 25 bp, Rattus norvegicus
acaatttggcgacgacaccttcttc

SEQ ID NO: 71586 - DNA, 25 bp, Rattus norvegicus
acaatttggcgaggacaccttcttc

SEQ ID NO: 71587 - DNA, 25 bp, Rattus norvegicus
acaatttgtagacaccccggcaggc

SEQ ID NO: 71588 - DNA, 25 bp, Rattus norvegicus
acaatttgtagagaccccggcaggc

SEQ ID NO: 71589 - DNA, 25 bp, Rattus norvegicus
acaatttgtattctcatctttcttg

SEQ ID NO: 71590 - DNA, 25 bp, Rattus norvegicus
acaatttgtattgtcatctttcttg

SEQ ID NO: 71591 - DNA, 25 bp, Rattus norvegicus
acaatttgtgccacgcatgctgaga

SEQ ID NO: 71592 - DNA, 25 bp, Rattus norvegicus
acaatttgtgcctcgcatgctgaga

SEQ ID NO: 71593 - DNA, 25 bp, Rattus norvegicus
acaattttagctcttcttcctacta

SEQ ID NO: 71594 - DNA, 25 bp, Rattus norvegicus
acaattttagctgttcttcctacta

SEQ ID NO: 71595 - DNA, 25 bp, Rattus norvegicus
acaattttgcttacccatctcttgt

SEQ ID NO: 71596 - DNA, 25 bp, Rattus norvegicus
acaattttgctttcccatctcttgt

SEQ ID NO: 71597 - DNA, 25 bp, Rattus norvegicus
acaatttttctgaatgccacctttg

SEQ ID NO: 71598 - DNA, 25 bp, Rattus norvegicus
acaatttttctgtatgccacctttg

SEQ ID NO: 71599 - DNA, 25 bp, Rattus norvegicus
acacaaaagcgtaggtgagggccct

SEQ ID NO: 71600 - DNA, 25 bp, Rattus norvegicus
acacaaaagcgttggtgagggccct

SEQ ID NO: 71601 - DNA, 25 bp, Rattus norvegicus
acacaaacatttccctggatctttc

SEQ ID NO: 71602 - DNA, 25 bp, Rattus norvegicus
acacaaacatttgcctggatctttc

SEQ ID NO: 71603 - DNA, 25 bp, Rattus norvegicus
acacaaaccagcatttgcttctctt

SEQ ID NO: 71604 - DNA, 25 bp, Rattus norvegicus
acacaaaccagcttttgcttctctt

SEQ ID NO: 71605 - DNA, 25 bp, Rattus norvegicus
acacaaagccagaagtcttccttct

SEQ ID NO: 71606 - DNA, 25 bp, Rattus norvegicus
acacaaagccagtagtcttccttct

SEQ ID NO: 71607 - DNA, 25 bp, Rattus norvegicus
acacaaagccttaagccctttcaat

SEQ ID NO: 71608 - DNA, 25 bp, Rattus norvegicus
acacaaagcctttagccctttcaat

SEQ ID NO: 71609 - DNA, 25 bp, Rattus norvegicus
acacaaagcgtcagctcctgtttag

SEQ ID NO: 71610 - DNA, 25 bp, Rattus norvegicus
acacaaagcgtctgctcctgtttag

SEQ ID NO: 71611 - DNA, 25 bp, Rattus norvegicus
acacaaaggctgatcgagggaagga

SEQ ID NO: 71612 - DNA, 25 bp, Rattus norvegicus
acacaaaggctgttcgagggaagga

SEQ ID NO: 71613 - DNA, 25 bp, Rattus norvegicus
acacaaagggtcaggatggccggaa

SEQ ID NO: 71614 - DNA, 25 bp, Rattus norvegicus
acacaaagggtctggatggccggaa

SEQ ID NO: 71615 - DNA, 25 bp, Rattus norvegicus
acacaaatgcatcagtccggagaaa

SEQ ID NO: 71616 - DNA, 25 bp, Rattus norvegicus
acacaaatgcatgagtccggagaaa

SEQ ID NO: 71617 - DNA, 25 bp, Rattus norvegicus
acacaacaaatactgtttcctgttt

SEQ ID NO: 71618 - DNA, 25 bp, Rattus norvegicus
acacaacaaatagtgtttcctgttt

SEQ ID NO: 71619 - DNA, 25 bp, Rattus norvegicus
acacaacagaagatccggcggcaac

SEQ ID NO: 71620 - DNA, 25 bp, Rattus norvegicus
acacaacagaagttccggcggcaac

SEQ ID NO: 71621 - DNA, 25 bp, Rattus norvegicus
acacaacagcccctctgggctgaat

SEQ ID NO: 71622 - DNA, 25 bp, Rattus norvegicus
acacaacagcccgtctgggctgaat

SEQ ID NO: 71623 - DNA, 25 bp, Rattus norvegicus
acacaacaggcactgctggaaggct

SEQ ID NO: 71624 - DNA, 25 bp, Rattus norvegicus
acacaacaggcagtgctggaaggct

SEQ ID NO: 71625 - DNA, 25 bp, Rattus norvegicus
acacaaccactaatctagccaggag

SEQ ID NO: 71626 - DNA, 25 bp, Rattus norvegicus
acacaaccactattctagccaggag

SEQ ID NO: 71627 - DNA, 25 bp, Rattus norvegicus
acacaaccattcaattcttatccca

SEQ ID NO: 71628 - DNA, 25 bp, Rattus norvegicus
acacaaccattctattcttatccca

SEQ ID NO: 71629 - DNA, 25 bp, Rattus norvegicus
acacaaccccttacatcgagataaa

SEQ ID NO: 71630 - DNA, 25 bp, Rattus norvegicus
acacaacccctttcatcgagataaa

SEQ ID NO: 71631 - DNA, 25 bp, Rattus norvegicus
acacaacccttcattctccaaagat

SEQ ID NO: 71632 - DNA, 25 bp, Rattus norvegicus
acacaacccttctttctccaaagat

SEQ ID NO: 71633 - DNA, 25 bp, Rattus norvegicus
acacaactcagcctttttaactcga

SEQ ID NO: 71634 - DNA, 25 bp, Rattus norvegicus
acacaactcagcgtttttaactcga

SEQ ID NO: 71635 - DNA, 25 bp, Rattus norvegicus
acacaacttcttatgggacattcat

SEQ ID NO: 71636 - DNA, 25 bp, Rattus norvegicus
acacaacttcttttgggacattcat

SEQ ID NO: 71637 - DNA, 25 bp, Rattus norvegicus
acacaagaatgtatcacgccgggaa

SEQ ID NO: 71638 - DNA, 25 bp, Rattus norvegicus
acacaagaatgtttcacgccgggaa

SEQ ID NO: 71639 - DNA, 25 bp, Rattus norvegicus
acacaagagctgacgctggctgaca

SEQ ID NO: 71640 - DNA, 25 bp, Rattus norvegicus
acacaagagctgtcgctggctgaca

SEQ ID NO: 71641 - DNA, 25 bp, Rattus norvegicus
acacaagatcttcgtttagagaatt

SEQ ID NO: 71642 - DNA, 25 bp, Rattus norvegicus
acacaagatcttggtttagagaatt

SEQ ID NO: 71643 - DNA, 25 bp, Rattus norvegicus
acacaagcagctattgacgcacccg

SEQ ID NO: 71644 - DNA, 25 bp, Rattus norvegicus
acacaagcagcttttgacgcacccg

SEQ ID NO: 71645 - DNA, 25 bp, Rattus norvegicus
acacaagccattcagtacattttta

SEQ ID NO: 71646 - DNA, 25 bp, Rattus norvegicus
acacaagccattgagtacattttta

SEQ ID NO: 71647 - DNA, 25 bp, Rattus norvegicus
acacaagcccagacactgtgcttaa

SEQ ID NO: 71648 - DNA, 25 bp, Rattus norvegicus
acacaagcccagctgagagctctaa

SEQ ID NO: 71649 - DNA, 25 bp, Rattus norvegicus
acacaagcccaggtgagagctctaa

SEQ ID NO: 71650 - DNA, 25 bp, Rattus norvegicus
acacaagcccagtcactgtgcttaa

SEQ ID NO: 71651 - DNA, 25 bp, Rattus norvegicus
acacaagctcccacacatgagagat

SEQ ID NO: 71652 - DNA, 25 bp, Rattus norvegicus
acacaagctccctcacatgagagat

SEQ ID NO: 71653 - DNA, 25 bp, Rattus norvegicus
acacaagctgtccagagacctgcag

SEQ ID NO: 71654 - DNA, 25 bp, Rattus norvegicus
acacaagctgtcgagagacctgcag

SEQ ID NO: 71655 - DNA, 25 bp, Rattus norvegicus
acacaagctgttctgaaggcttcta

SEQ ID NO: 71656 - DNA, 25 bp, Rattus norvegicus
acacaagctgttgtgaaggcttcta

SEQ ID NO: 71657 - DNA, 25 bp, Rattus norvegicus
acacaaggccctaggcttattttat

SEQ ID NO: 71658 - DNA, 25 bp, Rattus norvegicus
acacaaggcccttggcttattttat

SEQ ID NO: 71659 - DNA, 25 bp, Rattus norvegicus
acacaagggcctcgtggacaagttt

SEQ ID NO: 71660 - DNA, 25 bp, Rattus norvegicus
acacaagggcctggtggacaagttt

SEQ ID NO: 71661 - DNA, 25 bp, Rattus norvegicus
acacaagggtccaccaaggtccatc

SEQ ID NO: 71662 - DNA, 25 bp, Rattus norvegicus
acacaagggtcctccaaggtccatc

SEQ ID NO: 71663 - DNA, 25 bp, Rattus norvegicus
acacaagtcctgatgacggtatcat

SEQ ID NO: 71664 - DNA, 25 bp, Rattus norvegicus
acacaagtcctgttgacggtatcat

SEQ ID NO: 71665 - DNA, 25 bp, Rattus norvegicus
acacaagtctatacctttcatctgc

SEQ ID NO: 71666 - DNA, 25 bp, Rattus norvegicus
acacaagtctattcctttcatctgc

SEQ ID NO: 71667 - DNA, 25 bp, Rattus norvegicus
acacaagtgaccctgacatgagacg

SEQ ID NO: 71668 - DNA, 25 bp, Rattus norvegicus
acacaagtgaccgtgacatgagacg

SEQ ID NO: 71669 - DNA, 25 bp, Rattus norvegicus
acacaagtgcttccagcgtttcatc

SEQ ID NO: 71670 - DNA, 25 bp, Rattus norvegicus
acacaagtgcttgcagcgtttcatc

SEQ ID NO: 71671 - DNA, 25 bp, Rattus norvegicus
acacaagtggcgatgctcaggtact

SEQ ID NO: 71672 - DNA, 25 bp, Rattus norvegicus
acacaagtggcgttgctcaggtact

SEQ ID NO: 71673 - DNA, 25 bp, Rattus norvegicus
acacaagtgtccctaactctagctc

SEQ ID NO: 71674 - DNA, 25 bp, Rattus norvegicus
acacaagtgtccgtaactctagctc

SEQ ID NO: 71675 - DNA, 25 bp, Rattus norvegicus
acacaagtgtctacctgccagaggt

SEQ ID NO: 71676 - DNA, 25 bp, Rattus norvegicus
acacaagtgtcttcctgccagaggt

SEQ ID NO: 71677 - DNA, 25 bp, Rattus norvegicus
acacaagttggactcatcagaaagg

SEQ ID NO: 71678 - DNA, 25 bp, Rattus norvegicus
acacaagttggagtcatcagaaagg

SEQ ID NO: 71679 - DNA, 25 bp, Rattus norvegicus
acacaatacgcacggcttgctggtt

SEQ ID NO: 71680 - DNA, 25 bp, Rattus norvegicus
acacaatacgcagggcttgctggtt

SEQ ID NO: 71681 - DNA, 25 bp, Rattus norvegicus
acacaatatgagctctgtccgatat

SEQ ID NO: 71682 - DNA, 25 bp, Rattus norvegicus
acacaatatgaggtctgtccgatat

SEQ ID NO: 71683 - DNA, 25 bp, Rattus norvegicus
acacaatggagcctgcctggtgcct

SEQ ID NO: 71684 - DNA, 25 bp, Rattus norvegicus
acacaatggagcgtgcctggtgcct

SEQ ID NO: 71685 - DNA, 25 bp, Rattus norvegicus
acacaatgtatgaggctggcacggt

SEQ ID NO: 71686 - DNA, 25 bp, Rattus norvegicus
acacaatgtatgtggctggcacggt

SEQ ID NO: 71687 - DNA, 25 bp, Rattus norvegicus
acacaatgtgctcccctgggtcgcg

SEQ ID NO: 71688 - DNA, 25 bp, Rattus norvegicus
acacaatgtgctgccctgggtcgcg

SEQ ID NO: 71689 - DNA, 25 bp, Rattus norvegicus
acacaattaccgaacaagatctgca

SEQ ID NO: 71690 - DNA, 25 bp, Rattus norvegicus
acacaattaccgtacaagatctgca

SEQ ID NO: 71691 - DNA, 25 bp, Rattus norvegicus
acacaattctgaatccgactcagcg

SEQ ID NO: 71692 - DNA, 25 bp, Rattus norvegicus
acacaattctgattccgactcagcg

SEQ ID NO: 71693 - DNA, 25 bp, Rattus norvegicus
acacaattgcacaagaaccagagaa

SEQ ID NO: 71694 - DNA, 25 bp, Rattus norvegicus
acacaattgcactagaaccagagaa

SEQ ID NO: 71695 - DNA, 25 bp, Rattus norvegicus
acacaattttgcactgtttttcaga

SEQ ID NO: 71696 - DNA, 25 bp, Rattus norvegicus
acacaattttgctctgtttttcaga

SEQ ID NO: 71697 - DNA, 25 bp, Rattus norvegicus
acacacaaagtccttcattctgaaa

SEQ ID NO: 71698 - DNA, 25 bp, Rattus norvegicus
acacacaaagtcgttcattctgaaa

SEQ ID NO: 71699 - DNA, 25 bp, Rattus norvegicus
acacacaacagaagcctggcttcta

SEQ ID NO: 71700 - DNA, 25 bp, Rattus norvegicus
acacacaacagatgcctggcttcta

SEQ ID NO: 71701 - DNA, 25 bp, Rattus norvegicus
acacacaagcaaaaccggtggtgga

SEQ ID NO: 71702 - DNA, 25 bp, Rattus norvegicus
acacacaagcaataccggtggtgga

SEQ ID NO: 71703 - DNA, 25 bp, Rattus norvegicus
acacacaatatcaatatgtatttgg

SEQ ID NO: 71704 - DNA, 25 bp, Rattus norvegicus
acacacaatatctatatgtatttgg

SEQ ID NO: 71705 - DNA, 25 bp, Rattus norvegicus
acacacaatcttatctacttcatta

SEQ ID NO: 71706 - DNA, 25 bp, Rattus norvegicus
acacacaatcttattgcttattata

SEQ ID NO: 71707 - DNA, 25 bp, Rattus norvegicus
acacacaatcttttctacttcatta

SEQ ID NO: 71708 - DNA, 25 bp, Rattus norvegicus
acacacaatctttttgcttattata

SEQ ID NO: 71709 - DNA, 25 bp, Rattus norvegicus
acacacaatgctcttctcaggtcac

SEQ ID NO: 71710 - DNA, 25 bp, Rattus norvegicus
acacacaatgctgttctcaggtcac

SEQ ID NO: 71711 - DNA, 25 bp, Rattus norvegicus
acacacaattgcatggactacctat

SEQ ID NO: 71712 - DNA, 25 bp, Rattus norvegicus
acacacaattgcttggactacctat

SEQ ID NO: 71713 - DNA, 25 bp, Rattus norvegicus
acacacacaaacctctttacaggaa

SEQ ID NO: 71714 - DNA, 25 bp, Rattus norvegicus
acacacacaaacgtctttacaggaa

SEQ ID NO: 71715 - DNA, 25 bp, Rattus norvegicus
acacacacagggacaaagcaagaaa

SEQ ID NO: 71716 - DNA, 25 bp, Rattus norvegicus
acacacacagggtcaaagcaagaaa

SEQ ID NO: 71717 - DNA, 25 bp, Rattus norvegicus
acacacacagttagcccagaacggt

SEQ ID NO: 71718 - DNA, 25 bp, Rattus norvegicus
acacacacagtttgcccagaacggt

SEQ ID NO: 71719 - DNA, 25 bp, Rattus norvegicus
acacacacatatacgcagccaaaac

SEQ ID NO: 71720 - DNA, 25 bp, Rattus norvegicus
acacacacatattcgcagccaaaac

SEQ ID NO: 71721 - DNA, 25 bp, Rattus norvegicus
acacacacatcgaccttgttgggag

SEQ ID NO: 71722 - DNA, 25 bp, Rattus norvegicus
acacacacatcgtccttgttgggag

SEQ ID NO: 71723 - DNA, 25 bp, Rattus norvegicus
acacacacccctctgaatattgttg

SEQ ID NO: 71724 - DNA, 25 bp, Rattus norvegicus
acacacacccctgtgaatattgttg

SEQ ID NO: 71725 - DNA, 25 bp, Rattus norvegicus
acacacaccgggacaagcctgagaa

SEQ ID NO: 71726 - DNA, 25 bp, Rattus norvegicus
acacacaccgggtcaagcctgagaa

SEQ ID NO: 71727 - DNA, 25 bp, Rattus norvegicus
acacacaccttgactgacaggcata

SEQ ID NO: 71728 - DNA, 25 bp, Rattus norvegicus
acacacaccttgtctgacaggcata

SEQ ID NO: 71729 - DNA, 25 bp, Rattus norvegicus
acacacacggctacgagataggctt

SEQ ID NO: 71730 - DNA, 25 bp, Rattus norvegicus
acacacacggcttcgagataggctt

SEQ ID NO: 71731 - DNA, 25 bp, Rattus norvegicus
acacacactcacagggaggccacag

SEQ ID NO: 71732 - DNA, 25 bp, Rattus norvegicus
acacacactcactgggaggccacag

SEQ ID NO: 71733 - DNA, 25 bp, Rattus norvegicus
acacacactcctagtgttcactaca

SEQ ID NO: 71734 - DNA, 25 bp, Rattus norvegicus
acacacactccttgtgttcactaca

SEQ ID NO: 71735 - DNA, 25 bp, Rattus norvegicus
acacacactgagagttttctagctt

SEQ ID NO: 71736 - DNA, 25 bp, Rattus norvegicus
acacacactgagtgttttctagctt

SEQ ID NO: 71737 - DNA, 25 bp, Rattus norvegicus
acacacactgtaaccaagtcttgct

SEQ ID NO: 71738 - DNA, 25 bp, Rattus norvegicus
acacacactgtatccaagtcttgct

SEQ ID NO: 71739 - DNA, 25 bp, Rattus norvegicus
acacacactgtcagtggccttatgg

SEQ ID NO: 71740 - DNA, 25 bp, Rattus norvegicus
acacacactgtctgtggccttatgg

SEQ ID NO: 71741 - DNA, 25 bp, Rattus norvegicus
acacacactttactctagccaagat

SEQ ID NO: 71742 - DNA, 25 bp, Rattus norvegicus
acacacactttagtctagccaagat

SEQ ID NO: 71743 - DNA, 25 bp, Rattus norvegicus
acacacagcatgcaccataggtact

SEQ ID NO: 71744 - DNA, 25 bp, Rattus norvegicus
acacacagcatggaccataggtact

SEQ ID NO: 71745 - DNA, 25 bp, Rattus norvegicus
acacacagcattacagagtccgttc

SEQ ID NO: 71746 - DNA, 25 bp, Rattus norvegicus
acacacagcatttcagagtccgttc

SEQ ID NO: 71747 - DNA, 25 bp, Rattus norvegicus
acacacagctgccaagaacttgaag

SEQ ID NO: 71748 - DNA, 25 bp, Rattus norvegicus
acacacagctgcgaagaacttgaag

SEQ ID NO: 71749 - DNA, 25 bp, Rattus norvegicus
acacacagcttcagggctgggctaa

SEQ ID NO: 71750 - DNA, 25 bp, Rattus norvegicus
acacacagcttctgggctgggctaa

SEQ ID NO: 71751 - DNA, 25 bp, Rattus norvegicus
acacacaggataagagccaatacgt

SEQ ID NO: 71752 - DNA, 25 bp, Rattus norvegicus
acacacaggatatgagccaatacgt

SEQ ID NO: 71753 - DNA, 25 bp, Rattus norvegicus
acacacaggcgtattgcaaagtagg

SEQ ID NO: 71754 - DNA, 25 bp, Rattus norvegicus
acacacaggcgttttgcaaagtagg

SEQ ID NO: 71755 - DNA, 25 bp, Rattus norvegicus
acacacagtggtacttgtcttgagg

SEQ ID NO: 71756 - DNA, 25 bp, Rattus norvegicus
acacacagtggttcttgtcttgagg

SEQ ID NO: 71757 - DNA, 25 bp, Rattus norvegicus
acacacagtgttcatggaagaccat

SEQ ID NO: 71758 - DNA, 25 bp, Rattus norvegicus
acacacagtgttgatggaagaccat

SEQ ID NO: 71759 - DNA, 25 bp, Rattus norvegicus
acacacagtttcactttctctcata

SEQ ID NO: 71760 - DNA, 25 bp, Rattus norvegicus
acacacagtttcagagtggcagcaa

SEQ ID NO: 71761 - DNA, 25 bp, Rattus norvegicus
acacacagtttctctttctctcata

SEQ ID NO: 71762 - DNA, 25 bp, Rattus norvegicus
acacacagtttctgagtggcagcaa

SEQ ID NO: 71763 - DNA, 25 bp, Rattus norvegicus
acacacatacacacaaactacatac

SEQ ID NO: 71764 - DNA, 25 bp, Rattus norvegicus
acacacatacactcaaactacatac

SEQ ID NO: 71765 - DNA, 25 bp, Rattus norvegicus
acacacatactaacctaaggtcctg

SEQ ID NO: 71766 - DNA, 25 bp, Rattus norvegicus
acacacatactatcctaaggtcctg

SEQ ID NO: 71767 - DNA, 25 bp, Rattus norvegicus
acacacatacttaagcctgtcctgg

SEQ ID NO: 71768 - DNA, 25 bp, Rattus norvegicus
acacacatactttagcctgtcctgg

SEQ ID NO: 71769 - DNA, 25 bp, Rattus norvegicus
acacacatatccaaacacacgcgcg

SEQ ID NO: 71770 - DNA, 25 bp, Rattus norvegicus
acacacatatcctaacacacgcgcg

SEQ ID NO: 71771 - DNA, 25 bp, Rattus norvegicus
acacacatgcacacggttttgaaca

SEQ ID NO: 71772 - DNA, 25 bp, Rattus norvegicus
acacacatgcacagcgagggaagaa

SEQ ID NO: 71773 - DNA, 25 bp, Rattus norvegicus
acacacatgcactcggttttgaaca

SEQ ID NO: 71774 - DNA, 25 bp, Rattus norvegicus
acacacatgcactgcgagggaagaa

SEQ ID NO: 71775 - DNA, 25 bp, Rattus norvegicus
acacacatggacaggacctagacct

SEQ ID NO: 71776 - DNA, 25 bp, Rattus norvegicus
acacacatggactggacctagacct

SEQ ID NO: 71777 - DNA, 25 bp, Rattus norvegicus
acacacatggccacattgttctttc

SEQ ID NO: 71778 - DNA, 25 bp, Rattus norvegicus
acacacatggcctcattgttctttc

SEQ ID NO: 71779 - DNA, 25 bp, Rattus norvegicus
acacacattaataggattcttggca

SEQ ID NO: 71780 - DNA, 25 bp, Rattus norvegicus
acacacattaattggattcttggca

SEQ ID NO: 71781 - DNA, 25 bp, Rattus norvegicus
acacacattttgaccagagttctag

SEQ ID NO: 71782 - DNA, 25 bp, Rattus norvegicus
acacacattttgtccagagttctag

SEQ ID NO: 71783 - DNA, 25 bp, Rattus norvegicus
acacaccaagctccaggtcagatag

SEQ ID NO: 71784 - DNA, 25 bp, Rattus norvegicus
acacaccaagctgcaggtcagatag

SEQ ID NO: 71785 - DNA, 25 bp, Rattus norvegicus
acacaccacctcagtgttcataaat

SEQ ID NO: 71786 - DNA, 25 bp, Rattus norvegicus
acacaccacctctgtgttcataaat

SEQ ID NO: 71787 - DNA, 25 bp, Rattus norvegicus
acacaccagaagattgtcatcgcca

SEQ ID NO: 71788 - DNA, 25 bp, Rattus norvegicus
acacaccagaagtttgtcatcgcca

SEQ ID NO: 71789 - DNA, 25 bp, Rattus norvegicus
acacaccagcccctaagaggaagag

SEQ ID NO: 71790 - DNA, 25 bp, Rattus norvegicus
acacaccagcccgtaagaggaagag

SEQ ID NO: 71791 - DNA, 25 bp, Rattus norvegicus
acacaccaggcaaccttttgttaca

SEQ ID NO: 71792 - DNA, 25 bp, Rattus norvegicus
acacaccaggcatccttttgttaca

SEQ ID NO: 71793 - DNA, 25 bp, Rattus norvegicus
acacaccaggttatctgtgtggagg

SEQ ID NO: 71794 - DNA, 25 bp, Rattus norvegicus
acacaccaggttttctgtgtggagg

SEQ ID NO: 71795 - DNA, 25 bp, Rattus norvegicus
acacaccagtgcctcagaagactgt

SEQ ID NO: 71796 - DNA, 25 bp, Rattus norvegicus
acacaccagtgcgtcagaagactgt

SEQ ID NO: 71797 - DNA, 25 bp, Rattus norvegicus
acacaccagtttcctgaagtcatgg

SEQ ID NO: 71798 - DNA, 25 bp, Rattus norvegicus
acacaccagtttgctgaagtcatgg

SEQ ID NO: 71799 - DNA, 25 bp, Rattus norvegicus
acacaccatatcaagtgcctgagtt

SEQ ID NO: 71800 - DNA, 25 bp, Rattus norvegicus
acacaccatatctagtgcctgagtt

SEQ ID NO: 71801 - DNA, 25 bp, Rattus norvegicus
acacaccatgctatgtcttacatga

SEQ ID NO: 71802 - DNA, 25 bp, Rattus norvegicus
acacaccatgctttgtcttacatga

SEQ ID NO: 71803 - DNA, 25 bp, Rattus norvegicus
acacacccaagtcccgtcgtgaagt

SEQ ID NO: 71804 - DNA, 25 bp, Rattus norvegicus
acacacccaagtgccgtcgtgaagt

SEQ ID NO: 71805 - DNA, 25 bp, Rattus norvegicus
acacacccataacgccaggtctttt

SEQ ID NO: 71806 - DNA, 25 bp, Rattus norvegicus
acacacccataaggccaggtctttt

SEQ ID NO: 71807 - DNA, 25 bp, Rattus norvegicus
acacacccatacatgcctagagtaa

SEQ ID NO: 71808 - DNA, 25 bp, Rattus norvegicus
acacacccatacttgcctagagtaa

SEQ ID NO: 71809 - DNA, 25 bp, Rattus norvegicus
acacaccctgacattgtaaacggaa

SEQ ID NO: 71810 - DNA, 25 bp, Rattus norvegicus
acacaccctgactttgtaaacggaa

SEQ ID NO: 71811 - DNA, 25 bp, Rattus norvegicus
acacaccctggaagactgaggccga

SEQ ID NO: 71812 - DNA, 25 bp, Rattus norvegicus
acacaccctggatgactgaggccga

SEQ ID NO: 71813 - DNA, 25 bp, Rattus norvegicus
acacaccctttcactgagctaagta

SEQ ID NO: 71814 - DNA, 25 bp, Rattus norvegicus
acacaccctttctctgagctaagta

SEQ ID NO: 71815 - DNA, 25 bp, Rattus norvegicus
acacaccgcgctataaacacaggga

SEQ ID NO: 71816 - DNA, 25 bp, Rattus norvegicus
acacaccgcgctttaaacacaggga

SEQ ID NO: 71817 - DNA, 25 bp, Rattus norvegicus
acacaccggcctactcatgggtggg

SEQ ID NO: 71818 - DNA, 25 bp, Rattus norvegicus
acacaccggccttctcatgggtggg

SEQ ID NO: 71819 - DNA, 25 bp, Rattus norvegicus
acacaccgttaaaaccagcactggg

SEQ ID NO: 71820 - DNA, 25 bp, Rattus norvegicus
acacaccgttaataccagcactggg

SEQ ID NO: 71821 - DNA, 25 bp, Rattus norvegicus
acacaccgttcccattgagtattag

SEQ ID NO: 71822 - DNA, 25 bp, Rattus norvegicus
acacaccgttccgattgagtattag

SEQ ID NO: 71823 - DNA, 25 bp, Rattus norvegicus
acacacctaggcagatctaaagcaa

SEQ ID NO: 71824 - DNA, 25 bp, Rattus norvegicus
acacacctaggctgatctaaagcaa

SEQ ID NO: 71825 - DNA, 25 bp, Rattus norvegicus
acacacctatggacacctgagtttt

SEQ ID NO: 71826 - DNA, 25 bp, Rattus norvegicus
acacacctatggtcacctgagtttt

SEQ ID NO: 71827 - DNA, 25 bp, Rattus norvegicus
acacacctcccactgctaagttggg

SEQ ID NO: 71828 - DNA, 25 bp, Rattus norvegicus
acacacctcccagtgctaagttggg

SEQ ID NO: 71829 - DNA, 25 bp, Rattus norvegicus
acacacctccgccttaaagaaatgt

SEQ ID NO: 71830 - DNA, 25 bp, Rattus norvegicus
acacacctccgcgttaaagaaatgt

SEQ ID NO: 71831 - DNA, 25 bp, Rattus norvegicus
acacacctctaacactccagttttg

SEQ ID NO: 71832 - DNA, 25 bp, Rattus norvegicus
acacacctctaagactccagttttg

SEQ ID NO: 71833 - DNA, 25 bp, Rattus norvegicus
acacacctctgaaatgccagttctg

SEQ ID NO: 71834 - DNA, 25 bp, Rattus norvegicus
acacacctctgatatgccagttctg

SEQ ID NO: 71835 - DNA, 25 bp, Rattus norvegicus
acacacctgaagagggatgaccctt

SEQ ID NO: 71836 - DNA, 25 bp, Rattus norvegicus
acacacctgaagtgggatgaccctt

SEQ ID NO: 71837 - DNA, 25 bp, Rattus norvegicus
acacacctgcacatgttctgcatgc

SEQ ID NO: 71838 - DNA, 25 bp, Rattus norvegicus
acacacctgcacttgttctgcatgc

SEQ ID NO: 71839 - DNA, 25 bp, Rattus norvegicus
acacacctgcagacgcagcagtcgg

SEQ ID NO: 71840 - DNA, 25 bp, Rattus norvegicus
acacacctgcagtcgcagcagtcgg

SEQ ID NO: 71841 - DNA, 25 bp, Rattus norvegicus
acacacctgtgtatcccaaggtatt

SEQ ID NO: 71842 - DNA, 25 bp, Rattus norvegicus
acacacctgtgtttcccaaggtatt

SEQ ID NO: 71843 - DNA, 25 bp, Rattus norvegicus
acacaccttaccaagtgctgggagg

SEQ ID NO: 71844 - DNA, 25 bp, Rattus norvegicus
acacaccttacctagtgctgggagg

SEQ ID NO: 71845 - DNA, 25 bp, Rattus norvegicus
acacacctttaaaccctctggctgg

SEQ ID NO: 71846 - DNA, 25 bp, Rattus norvegicus
acacacctttaatccctctggctgg

SEQ ID NO: 71847 - DNA, 25 bp, Rattus norvegicus
acacacgaagagacagagctgtaga

SEQ ID NO: 71848 - DNA, 25 bp, Rattus norvegicus
acacacgaagagtcagagctgtaga

SEQ ID NO: 71849 - DNA, 25 bp, Rattus norvegicus
acacacgacttgacagtcacactat

SEQ ID NO: 71850 - DNA, 25 bp, Rattus norvegicus
acacacgacttgtcagtcacactat

SEQ ID NO: 71851 - DNA, 25 bp, Rattus norvegicus
acacacgcacaaaaatggcttctgt

SEQ ID NO: 71852 - DNA, 25 bp, Rattus norvegicus
acacacgcacaataatggcttctgt

SEQ ID NO: 71853 - DNA, 25 bp, Rattus norvegicus
acacacgcacatatatccttgaata

SEQ ID NO: 71854 - DNA, 25 bp, Rattus norvegicus
acacacgcacatttatccttgaata

SEQ ID NO: 71855 - DNA, 25 bp, Rattus norvegicus
acacacgcgcagcagctcgtcgtgg

SEQ ID NO: 71856 - DNA, 25 bp, Rattus norvegicus
acacacgcgcaggagctcgtcgtgg

SEQ ID NO: 71857 - DNA, 25 bp, Rattus norvegicus
acacacgcgctcatggttttgaagg

SEQ ID NO: 71858 - DNA, 25 bp, Rattus norvegicus
acacacgcgctcttggttttgaagg

SEQ ID NO: 71859 - DNA, 25 bp, Rattus norvegicus
acacacgctgtactcacccaagatg

SEQ ID NO: 71860 - DNA, 25 bp, Rattus norvegicus
acacacgctgtagtcacccaagatg

SEQ ID NO: 71861 - DNA, 25 bp, Rattus norvegicus
acacacgggaaactggaaaagccat

SEQ ID NO: 71862 - DNA, 25 bp, Rattus norvegicus
acacacgggaaagtggaaaagccat

SEQ ID NO: 71863 - DNA, 25 bp, Rattus norvegicus
acacacgggcttatattagggacat

SEQ ID NO: 71864 - DNA, 25 bp, Rattus norvegicus
acacacgggcttttattagggacat

SEQ ID NO: 71865 - DNA, 25 bp, Rattus norvegicus
acacacggtactctgtgcttgcttg

SEQ ID NO: 71866 - DNA, 25 bp, Rattus norvegicus
acacacggtactgtgtgcttgcttg

SEQ ID NO: 71867 - DNA, 25 bp, Rattus norvegicus
acacacgtcaaacatctgctcagag

SEQ ID NO: 71868 - DNA, 25 bp, Rattus norvegicus
acacacgtcaaagatctgctcagag

SEQ ID NO: 71869 - DNA, 25 bp, Rattus norvegicus
acacacgtgaaaaacttccaagtga

SEQ ID NO: 71870 - DNA, 25 bp, Rattus norvegicus
acacacgtgaaatacttccaagtga

SEQ ID NO: 71871 - DNA, 25 bp, Rattus norvegicus
acacacgtgcagctacgcagatcag

SEQ ID NO: 71872 - DNA, 25 bp, Rattus norvegicus
acacacgtgcaggtacgcagatcag

SEQ ID NO: 71873 - DNA, 25 bp, Rattus norvegicus
acacacgtgccgatgtttacaacga

SEQ ID NO: 71874 - DNA, 25 bp, Rattus norvegicus
acacacgtgccgttgtttacaacga

SEQ ID NO: 71875 - DNA, 25 bp, Rattus norvegicus
acacacgtgctacgtatcccttggc

SEQ ID NO: 71876 - DNA, 25 bp, Rattus norvegicus
acacacgtgctaggtatcccttggc

SEQ ID NO: 71877 - DNA, 25 bp, Rattus norvegicus
acacacgttgtgaatcagtgaaaca

SEQ ID NO: 71878 - DNA, 25 bp, Rattus norvegicus
acacacgttgtgtatcagtgaaaca

SEQ ID NO: 71879 - DNA, 25 bp, Rattus norvegicus
acacactaactcacctagctaagta

SEQ ID NO: 71880 - DNA, 25 bp, Rattus norvegicus
acacactaactctcctagctaagta

SEQ ID NO: 71881 - DNA, 25 bp, Rattus norvegicus
acacactatggcctggaacactggg

SEQ ID NO: 71882 - DNA, 25 bp, Rattus norvegicus
acacactatggcgtggaacactggg

SEQ ID NO: 71883 - DNA, 25 bp, Rattus norvegicus
acacactattaccttgtcactgtac

SEQ ID NO: 71884 - DNA, 25 bp, Rattus norvegicus
acacactattacgttgtcactgtac

SEQ ID NO: 71885 - DNA, 25 bp, Rattus norvegicus
acacactattatatccaggccagca

SEQ ID NO: 71886 - DNA, 25 bp, Rattus norvegicus
acacactattatttccaggccagca

SEQ ID NO: 71887 - DNA, 25 bp, Rattus norvegicus
acacactcacacctattagatccgt

SEQ ID NO: 71888 - DNA, 25 bp, Rattus norvegicus
acacactcacacgtattagatccgt

SEQ ID NO: 71889 - DNA, 25 bp, Rattus norvegicus
acacactcattccaaaccaacgttt

SEQ ID NO: 71890 - DNA, 25 bp, Rattus norvegicus
acacactcattcgaaaccaacgttt

SEQ ID NO: 71891 - DNA, 25 bp, Rattus norvegicus
acacactccttaactctgagaacca

SEQ ID NO: 71892 - DNA, 25 bp, Rattus norvegicus
acacactccttatctctgagaacca

SEQ ID NO: 71893 - DNA, 25 bp, Rattus norvegicus
acacactccttcattggcttatatg

SEQ ID NO: 71894 - DNA, 25 bp, Rattus norvegicus
acacactccttctttggcttatatg

SEQ ID NO: 71895 - DNA, 25 bp, Rattus norvegicus
acacactctcacacgcatgaaataa

SEQ ID NO: 71896 - DNA, 25 bp, Rattus norvegicus
acacactctcactcgcatgaaataa

SEQ ID NO: 71897 - DNA, 25 bp, Rattus norvegicus
acacactctctgaaggctcaggcat

SEQ ID NO: 71898 - DNA, 25 bp, Rattus norvegicus
acacactctctgtaggctcaggcat

SEQ ID NO: 71899 - DNA, 25 bp, Rattus norvegicus
acacactctgctagttctgttgtta

SEQ ID NO: 71900 - DNA, 25 bp, Rattus norvegicus
acacactctgcttgttctgttgtta

SEQ ID NO: 71901 - DNA, 25 bp, Rattus norvegicus
acacactcttcacaatcatgcgggt

SEQ ID NO: 71902 - DNA, 25 bp, Rattus norvegicus
acacactcttcagaatcatgcgggt

SEQ ID NO: 71903 - DNA, 25 bp, Rattus norvegicus
acacactcttccagagtggctgagt

SEQ ID NO: 71904 - DNA, 25 bp, Rattus norvegicus
acacactcttcctgagtggctgagt

SEQ ID NO: 71905 - DNA, 25 bp, Rattus norvegicus
acacactgcatcaattttgctggca

SEQ ID NO: 71906 - DNA, 25 bp, Rattus norvegicus
acacactgcatctattttgctggca

SEQ ID NO: 71907 - DNA, 25 bp, Rattus norvegicus
acacactgcgtcctggtcagggtag

SEQ ID NO: 71908 - DNA, 25 bp, Rattus norvegicus
acacactgcgtcgtggtcagggtag

SEQ ID NO: 71909 - DNA, 25 bp, Rattus norvegicus
acacactgctatacccaagctgact

SEQ ID NO: 71910 - DNA, 25 bp, Rattus norvegicus
acacactgctattcccaagctgact

SEQ ID NO: 71911 - DNA, 25 bp, Rattus norvegicus
acacactgctgaaggcgacgttcta

SEQ ID NO: 71912 - DNA, 25 bp, Rattus norvegicus
acacactgctgatggcgacgttcta

SEQ ID NO: 71913 - DNA, 25 bp, Rattus norvegicus
acacactgctgcaatggatatgctg

SEQ ID NO: 71914 - DNA, 25 bp, Rattus norvegicus
acacactgctgctatggatatgctg

SEQ ID NO: 71915 - DNA, 25 bp, Rattus norvegicus
acacactgctgtatctcttggttaa

SEQ ID NO: 71916 - DNA, 25 bp, Rattus norvegicus
acacactgctgtttctcttggttaa

SEQ ID NO: 71917 - DNA, 25 bp, Rattus norvegicus
acacactggcaaacacttaactggg

SEQ ID NO: 71918 - DNA, 25 bp, Rattus norvegicus
acacactggcaatcacttaactggg

SEQ ID NO: 71919 - DNA, 25 bp, Rattus norvegicus
acacactgggcaacttccgctggac

SEQ ID NO: 71920 - DNA, 25 bp, Rattus norvegicus
acacactgggcatcttccgctggac

SEQ ID NO: 71921 - DNA, 25 bp, Rattus norvegicus
acacactgtggcaagcggttcagct

SEQ ID NO: 71922 - DNA, 25 bp, Rattus norvegicus
acacactgtggctagcggttcagct

SEQ ID NO: 71923 - DNA, 25 bp, Rattus norvegicus
acacactgtgtaactcctcgagaga

SEQ ID NO: 71924 - DNA, 25 bp, Rattus norvegicus
acacactgtgtatctcctcgagaga

SEQ ID NO: 71925 - DNA, 25 bp, Rattus norvegicus
acacactgttccatggtaggtcaca

SEQ ID NO: 71926 - DNA, 25 bp, Rattus norvegicus
acacactgttccttggtaggtcaca

SEQ ID NO: 71927 - DNA, 25 bp, Rattus norvegicus
acacactgttgactgaggtctcaca

SEQ ID NO: 71928 - DNA, 25 bp, Rattus norvegicus
acacactgttgagtgaggtctcaca

SEQ ID NO: 71929 - DNA, 25 bp, Rattus norvegicus
acacacttactcatattgccttcga

SEQ ID NO: 71930 - DNA, 25 bp, Rattus norvegicus
acacacttactcttattgccttcga

SEQ ID NO: 71931 - DNA, 25 bp, Rattus norvegicus
acacacttactgctgcatgcagcac

SEQ ID NO: 71932 - DNA, 25 bp, Rattus norvegicus
acacacttactggtgcatgcagcac

SEQ ID NO: 71933 - DNA, 25 bp, Rattus norvegicus
acacacttagtgcagggtcattgag

SEQ ID NO: 71934 - DNA, 25 bp, Rattus norvegicus
acacacttagtggagggtcattgag

SEQ ID NO: 71935 - DNA, 25 bp, Rattus norvegicus
acacacttctctatggtgaatctaa

SEQ ID NO: 71936 - DNA, 25 bp, Rattus norvegicus
acacacttctctttggtgaatctaa

SEQ ID NO: 71937 - DNA, 25 bp, Rattus norvegicus
acacacttgaggatctaagccatct

SEQ ID NO: 71938 - DNA, 25 bp, Rattus norvegicus
acacacttgaggttctaagccatct

SEQ ID NO: 71939 - DNA, 25 bp, Rattus norvegicus
acacacttgctcaggcttcagttaa

SEQ ID NO: 71940 - DNA, 25 bp, Rattus norvegicus
acacacttgctctggcttcagttaa

SEQ ID NO: 71941 - DNA, 25 bp, Rattus norvegicus
acacacttgcttaccaaaatgagat

SEQ ID NO: 71942 - DNA, 25 bp, Rattus norvegicus
acacacttgctttccaaaatgagat

SEQ ID NO: 71943 - DNA, 25 bp, Rattus norvegicus
acacacttggtgacctgagctctat

SEQ ID NO: 71944 - DNA, 25 bp, Rattus norvegicus
acacacttggtgtcctgagctctat

SEQ ID NO: 71945 - DNA, 25 bp, Rattus norvegicus
acacactttaccaccggagttgagt

SEQ ID NO: 71946 - DNA, 25 bp, Rattus norvegicus
acacactttacctccggagttgagt

SEQ ID NO: 71947 - DNA, 25 bp, Rattus norvegicus
acacactttattccacgtgaagctg

SEQ ID NO: 71948 - DNA, 25 bp, Rattus norvegicus
acacactttattgcacgtgaagctg

SEQ ID NO: 71949 - DNA, 25 bp, Rattus norvegicus
acacacttttacagctttcctttct

SEQ ID NO: 71950 - DNA, 25 bp, Rattus norvegicus
acacacttttactgctttcctttct

SEQ ID NO: 71951 - DNA, 25 bp, Rattus norvegicus
acacagaaactccaaggacccactg

SEQ ID NO: 71952 - DNA, 25 bp, Rattus norvegicus
acacagaaactcgaaggacccactg

SEQ ID NO: 71953 - DNA, 25 bp, Rattus norvegicus
acacagaaagtaaccggccccaaag

SEQ ID NO: 71954 - DNA, 25 bp, Rattus norvegicus
acacagaaagtatccggccccaaag

SEQ ID NO: 71955 - DNA, 25 bp, Rattus norvegicus
acacagaaccatctcaaacaacgaa

SEQ ID NO: 71956 - DNA, 25 bp, Rattus norvegicus
acacagaaccatgtcaaacaacgaa

SEQ ID NO: 71957 - DNA, 25 bp, Rattus norvegicus
acacagaacccaagccatcattcat

SEQ ID NO: 71958 - DNA, 25 bp, Rattus norvegicus
acacagaacccatgccatcattcat

SEQ ID NO: 71959 - DNA, 25 bp, Rattus norvegicus
acacagaactacagcctccaagaag

SEQ ID NO: 71960 - DNA, 25 bp, Rattus norvegicus
acacagaactactgcctccaagaag

SEQ ID NO: 71961 - DNA, 25 bp, Rattus norvegicus
acacagaattctacccattggcatt

SEQ ID NO: 71962 - DNA, 25 bp, Rattus norvegicus
acacagaattcttcccattggcatt

SEQ ID NO: 71963 - DNA, 25 bp, Rattus norvegicus
acacagacacatctttagggttaca

SEQ ID NO: 71964 - DNA, 25 bp, Rattus norvegicus
acacagacacatgtttagggttaca

SEQ ID NO: 71965 - DNA, 25 bp, Rattus norvegicus
acacagacatggctctttctacaac

SEQ ID NO: 71966 - DNA, 25 bp, Rattus norvegicus
acacagacatgggtctttctacaac

SEQ ID NO: 71967 - DNA, 25 bp, Rattus norvegicus
acacagaccaacatgctgggttcca

SEQ ID NO: 71968 - DNA, 25 bp, Rattus norvegicus
acacagaccaacttgctgggttcca

SEQ ID NO: 71969 - DNA, 25 bp, Rattus norvegicus
acacagacccttccttattttgtct

SEQ ID NO: 71970 - DNA, 25 bp, Rattus norvegicus
acacagacccttgcttattttgtct

SEQ ID NO: 71971 - DNA, 25 bp, Rattus norvegicus
acacagacgtacagaagcctccttc

SEQ ID NO: 71972 - DNA, 25 bp, Rattus norvegicus
acacagacgtactgaagcctccttc

SEQ ID NO: 71973 - DNA, 25 bp, Rattus norvegicus
acacagagagacacagggctttaca

SEQ ID NO: 71974 - DNA, 25 bp, Rattus norvegicus
acacagagagactcagggctttaca

SEQ ID NO: 71975 - DNA, 25 bp, Rattus norvegicus
acacagagcaagagccgtaggtggc

SEQ ID NO: 71976 - DNA, 25 bp, Rattus norvegicus
acacagagcaagtgccgtaggtggc

SEQ ID NO: 71977 - DNA, 25 bp, Rattus norvegicus
acacagaggcagcaggaaccatgat

SEQ ID NO: 71978 - DNA, 25 bp, Rattus norvegicus
acacagaggcaggaggaaccatgat

SEQ ID NO: 71979 - DNA, 25 bp, Rattus norvegicus
acacagagggtaaattggcatccat

SEQ ID NO: 71980 - DNA, 25 bp, Rattus norvegicus
acacagagggtatattggcatccat

SEQ ID NO: 71981 - DNA, 25 bp, Rattus norvegicus
acacagaggtctattgaggtacaat

SEQ ID NO: 71982 - DNA, 25 bp, Rattus norvegicus
acacagaggtcttttgaggtacaat

SEQ ID NO: 71983 - DNA, 25 bp, Rattus norvegicus
acacagagtcatagttttttctttt

SEQ ID NO: 71984 - DNA, 25 bp, Rattus norvegicus
acacagagtcattgttttttctttt

SEQ ID NO: 71985 - DNA, 25 bp, Rattus norvegicus
acacagagtcccaagagtttaacct

SEQ ID NO: 71986 - DNA, 25 bp, Rattus norvegicus
acacagagtccctagagtttaacct

SEQ ID NO: 71987 - DNA, 25 bp, Rattus norvegicus
acacagagtttaaagccaccttctt

SEQ ID NO: 71988 - DNA, 25 bp, Rattus norvegicus
acacagagtttatagccaccttctt

SEQ ID NO: 71989 - DNA, 25 bp, Rattus norvegicus
acacagatccgcctcgtgaaggcgt

SEQ ID NO: 71990 - DNA, 25 bp, Rattus norvegicus
acacagatccgcgtcgtgaaggcgt

SEQ ID NO: 71991 - DNA, 25 bp, Rattus norvegicus
acacagatcctaattttggtttata

SEQ ID NO: 71992 - DNA, 25 bp, Rattus norvegicus
acacagatcctatttttggtttata

SEQ ID NO: 71993 - DNA, 25 bp, Rattus norvegicus
acacagatcggtatttgagcttgga

SEQ ID NO: 71994 - DNA, 25 bp, Rattus norvegicus
acacagatcggtttttgagcttgga

SEQ ID NO: 71995 - DNA, 25 bp, Rattus norvegicus
acacagatgactcagaccctgcttc

SEQ ID NO: 71996 - DNA, 25 bp, Rattus norvegicus
acacagatgactgagaccctgcttc

SEQ ID NO: 71997 - DNA, 25 bp, Rattus norvegicus
acacagatgcagcaggcagcagcta

SEQ ID NO: 71998 - DNA, 25 bp, Rattus norvegicus
acacagatgcaggaggcagcagcta

SEQ ID NO: 71999 - DNA, 25 bp, Rattus norvegicus
acacagattgccacctgacttttag

SEQ ID NO: 72000 - DNA, 25 bp, Rattus norvegicus
acacagattgcctcctgacttttag

SEQ ID NO: 72001 - DNA, 25 bp, Rattus norvegicus
acacagatttggctttgattggttg

SEQ ID NO: 72002 - DNA, 25 bp, Rattus norvegicus
acacagatttgggtttgattggttg

SEQ ID NO: 72003 - DNA, 25 bp, Rattus norvegicus
acacagcagagtcttctagggctct

SEQ ID NO: 72004 - DNA, 25 bp, Rattus norvegicus
acacagcagagtgttctagggctct

SEQ ID NO: 72005 - DNA, 25 bp, Rattus norvegicus
acacagcaggctaaggagttgatct

SEQ ID NO: 72006 - DNA, 25 bp, Rattus norvegicus
acacagcaggcttaggagttgatct

SEQ ID NO: 72007 - DNA, 25 bp, Rattus norvegicus
acacagcagggcacgtggatctgag

SEQ ID NO: 72008 - DNA, 25 bp, Rattus norvegicus
acacagcagggctcgtggatctgag

SEQ ID NO: 72009 - DNA, 25 bp, Rattus norvegicus
acacagcaggttagaggatggagca

SEQ ID NO: 72010 - DNA, 25 bp, Rattus norvegicus
acacagcaggtttgaggatggagca

SEQ ID NO: 72011 - DNA, 25 bp, Rattus norvegicus
acacagcatccccatgttttcattt

SEQ ID NO: 72012 - DNA, 25 bp, Rattus norvegicus
acacagcatcccgatgttttcattt

SEQ ID NO: 72013 - DNA, 25 bp, Rattus norvegicus
acacagcatgaaaagccaggacagt

SEQ ID NO: 72014 - DNA, 25 bp, Rattus norvegicus
acacagcatgaatagccaggacagt

SEQ ID NO: 72015 - DNA, 25 bp, Rattus norvegicus
acacagcatgcaaggcaggtgccca

SEQ ID NO: 72016 - DNA, 25 bp, Rattus norvegicus
acacagcatgcatggcaggtgccca

SEQ ID NO: 72017 - DNA, 25 bp, Rattus norvegicus
acacagccatctaaacccttaagga

SEQ ID NO: 72018 - DNA, 25 bp, Rattus norvegicus
acacagccatcttaacccttaagga

SEQ ID NO: 72019 - DNA, 25 bp, Rattus norvegicus
acacagccctggagaggtttggcaa

SEQ ID NO: 72020 - DNA, 25 bp, Rattus norvegicus
acacagccctggtgaggtttggcaa

SEQ ID NO: 72021 - DNA, 25 bp, Rattus norvegicus
acacagccgcagcactagcaggttg

SEQ ID NO: 72022 - DNA, 25 bp, Rattus norvegicus
acacagccgcaggactagcaggttg

SEQ ID NO: 72023 - DNA, 25 bp, Rattus norvegicus
acacagccgttcatgattctgggaa

SEQ ID NO: 72024 - DNA, 25 bp, Rattus norvegicus
acacagccgttcttgattctgggaa

SEQ ID NO: 72025 - DNA, 25 bp, Rattus norvegicus
acacagcctcaaatggatcagtctc

SEQ ID NO: 72026 - DNA, 25 bp, Rattus norvegicus
acacagcctcaattggatcagtctc

SEQ ID NO: 72027 - DNA, 25 bp, Rattus norvegicus
acacagcctgccaaattttatacat

SEQ ID NO: 72028 - DNA, 25 bp, Rattus norvegicus
acacagcctgcctaattttatacat

SEQ ID NO: 72029 - DNA, 25 bp, Rattus norvegicus
acacagcctgggacctcaagatgaa

SEQ ID NO: 72030 - DNA, 25 bp, Rattus norvegicus
acacagcctgggatggccttgagtt

SEQ ID NO: 72031 - DNA, 25 bp, Rattus norvegicus
acacagcctgggtcctcaagatgaa

SEQ ID NO: 72032 - DNA, 25 bp, Rattus norvegicus
acacagcctgggttggccttgagtt

SEQ ID NO: 72033 - DNA, 25 bp, Rattus norvegicus
acacagccttggattaagagcactt

SEQ ID NO: 72034 - DNA, 25 bp, Rattus norvegicus
acacagccttggtttaagagcactt

SEQ ID NO: 72035 - DNA, 25 bp, Rattus norvegicus
acacagcctttcaggaaatctctct

SEQ ID NO: 72036 - DNA, 25 bp, Rattus norvegicus
acacagcctttctggaaatctctct

SEQ ID NO: 72037 - DNA, 25 bp, Rattus norvegicus
acacagcgagccctttgaaacgcag

SEQ ID NO: 72038 - DNA, 25 bp, Rattus norvegicus
acacagcgagccgtttgaaacgcag

SEQ ID NO: 72039 - DNA, 25 bp, Rattus norvegicus
acacagcgggacagaggccaggctc

SEQ ID NO: 72040 - DNA, 25 bp, Rattus norvegicus
acacagcgggactgaggccaggctc

SEQ ID NO: 72041 - DNA, 25 bp, Rattus norvegicus
acacagcgtggtccgcagcgaagct

SEQ ID NO: 72042 - DNA, 25 bp, Rattus norvegicus
acacagcgtggtgcgcagcgaagct

SEQ ID NO: 72043 - DNA, 25 bp, Rattus norvegicus
acacagctagtactggacacatagg

SEQ ID NO: 72044 - DNA, 25 bp, Rattus norvegicus
acacagctagtagtggacacatagg

SEQ ID NO: 72045 - DNA, 25 bp, Rattus norvegicus
acacagctagtgaagtcccaaccag

SEQ ID NO: 72046 - DNA, 25 bp, Rattus norvegicus
acacagctagtgtagtcccaaccag

SEQ ID NO: 72047 - DNA, 25 bp, Rattus norvegicus
acacagctatccaggtgccggaggg

SEQ ID NO: 72048 - DNA, 25 bp, Rattus norvegicus
acacagctatcctggtgccggaggg

SEQ ID NO: 72049 - DNA, 25 bp, Rattus norvegicus
acacagctcaaacgcagccatgtct

SEQ ID NO: 72050 - DNA, 25 bp, Rattus norvegicus
acacagctcaaaggcagccatgtct

SEQ ID NO: 72051 - DNA, 25 bp, Rattus norvegicus
acacagctcgggagcgggacattga

SEQ ID NO: 72052 - DNA, 25 bp, Rattus norvegicus
acacagctcgggtgcgggacattga

SEQ ID NO: 72053 - DNA, 25 bp, Rattus norvegicus
acacagctctgcagatttcgctgaa

SEQ ID NO: 72054 - DNA, 25 bp, Rattus norvegicus
acacagctctgctgatttcgctgaa

SEQ ID NO: 72055 - DNA, 25 bp, Rattus norvegicus
acacagctctggaggtctctacagt

SEQ ID NO: 72056 - DNA, 25 bp, Rattus norvegicus
acacagctctggtggtctctacagt

SEQ ID NO: 72057 - DNA, 25 bp, Rattus norvegicus
acacagctgaaacttacctatttaa

SEQ ID NO: 72058 - DNA, 25 bp, Rattus norvegicus
acacagctgaaagttacctatttaa

SEQ ID NO: 72059 - DNA, 25 bp, Rattus norvegicus
acacagctgcctctgcaaggagtct

SEQ ID NO: 72060 - DNA, 25 bp, Rattus norvegicus
acacagctgcctgtgcaaggagtct

SEQ ID NO: 72061 - DNA, 25 bp, Rattus norvegicus
acacagctgcttacccgtaaaaaca

SEQ ID NO: 72062 - DNA, 25 bp, Rattus norvegicus
acacagctgctttcccgtaaaaaca

SEQ ID NO: 72063 - DNA, 25 bp, Rattus norvegicus
acacagctgggtagcaagcctcctt

SEQ ID NO: 72064 - DNA, 25 bp, Rattus norvegicus
acacagctgggttgcaagcctcctt

SEQ ID NO: 72065 - DNA, 25 bp, Rattus norvegicus
acacagctgtcaaccaaagtcctgg

SEQ ID NO: 72066 - DNA, 25 bp, Rattus norvegicus
acacagctgtcatccaaagtcctgg

SEQ ID NO: 72067 - DNA, 25 bp, Rattus norvegicus
acacagcttctcacttgatctttta

SEQ ID NO: 72068 - DNA, 25 bp, Rattus norvegicus
acacagcttctctcttgatctttta

SEQ ID NO: 72069 - DNA, 25 bp, Rattus norvegicus
acacagcttcttaccagttttcatg

SEQ ID NO: 72070 - DNA, 25 bp, Rattus norvegicus
acacagcttctttccagttttcatg

SEQ ID NO: 72071 - DNA, 25 bp, Rattus norvegicus
acacagctttgtcctcttaaggcaa

SEQ ID NO: 72072 - DNA, 25 bp, Rattus norvegicus
acacagctttgtgctcttaaggcaa

SEQ ID NO: 72073 - DNA, 25 bp, Rattus norvegicus
acacaggaaggccatttgtcacata

SEQ ID NO: 72074 - DNA, 25 bp, Rattus norvegicus
acacaggaaggcgatttgtcacata

SEQ ID NO: 72075 - DNA, 25 bp, Rattus norvegicus
acacaggaattcaggccttccctgg

SEQ ID NO: 72076 - DNA, 25 bp, Rattus norvegicus
acacaggaattctggccttccctgg

SEQ ID NO: 72077 - DNA, 25 bp, Rattus norvegicus
acacaggactccctgtccgaaatct

SEQ ID NO: 72078 - DNA, 25 bp, Rattus norvegicus
acacaggactccgtgtccgaaatct

SEQ ID NO: 72079 - DNA, 25 bp, Rattus norvegicus
acacaggagactatcgggccaggct

SEQ ID NO: 72080 - DNA, 25 bp, Rattus norvegicus
acacaggagactttcgggccaggct

SEQ ID NO: 72081 - DNA, 25 bp, Rattus norvegicus
acacaggagccccagcacaatagca

SEQ ID NO: 72082 - DNA, 25 bp, Rattus norvegicus
acacaggagcccgagcacaatagca

SEQ ID NO: 72083 - DNA, 25 bp, Rattus norvegicus
acacaggagcctataatctcattaa

SEQ ID NO: 72084 - DNA, 25 bp, Rattus norvegicus
acacaggagcctttaatctcattaa

SEQ ID NO: 72085 - DNA, 25 bp, Rattus norvegicus
acacaggaggcgactttgtgcagcc

SEQ ID NO: 72086 - DNA, 25 bp, Rattus norvegicus
acacaggaggcgtctttgtgcagcc

SEQ ID NO: 72087 - DNA, 25 bp, Rattus norvegicus
acacaggatgtcctcaagtctcttc

SEQ ID NO: 72088 - DNA, 25 bp, Rattus norvegicus
acacaggatgtcgtcaagtctcttc

SEQ ID NO: 72089 - DNA, 25 bp, Rattus norvegicus
acacaggattaccttgacttgggaa

SEQ ID NO: 72090 - DNA, 25 bp, Rattus norvegicus
acacaggattacgttgacttgggaa

SEQ ID NO: 72091 - DNA, 25 bp, Rattus norvegicus
acacaggattggctttgattcttaa

SEQ ID NO: 72092 - DNA, 25 bp, Rattus norvegicus
acacaggattgggtttgattcttaa

SEQ ID NO: 72093 - DNA, 25 bp, Rattus norvegicus
acacaggcaggcatgacagagttgg

SEQ ID NO: 72094 - DNA, 25 bp, Rattus norvegicus
acacaggcaggcttgacagagttgg

SEQ ID NO: 72095 - DNA, 25 bp, Rattus norvegicus
acacaggcccggactggagggtcta

SEQ ID NO: 72096 - DNA, 25 bp, Rattus norvegicus
acacaggcccggtctggagggtcta

SEQ ID NO: 72097 - DNA, 25 bp, Rattus norvegicus
acacaggcccgtcaagaagagtctt

SEQ ID NO: 72098 - DNA, 25 bp, Rattus norvegicus
acacaggcccgtgaagaagagtctt

SEQ ID NO: 72099 - DNA, 25 bp, Rattus norvegicus
acacaggcctgtactacaagctcta

SEQ ID NO: 72100 - DNA, 25 bp, Rattus norvegicus
acacaggcctgttctacaagctcta

SEQ ID NO: 72101 - DNA, 25 bp, Rattus norvegicus
acacaggctagaatcatcgcggcag

SEQ ID NO: 72102 - DNA, 25 bp, Rattus norvegicus
acacaggctagattcatcgcggcag

SEQ ID NO: 72103 - DNA, 25 bp, Rattus norvegicus
acacaggctcagacatggcggtact

SEQ ID NO: 72104 - DNA, 25 bp, Rattus norvegicus
acacaggctcagcttcaggcactga

SEQ ID NO: 72105 - DNA, 25 bp, Rattus norvegicus
acacaggctcaggttcaggcactga

SEQ ID NO: 72106 - DNA, 25 bp, Rattus norvegicus
acacaggctcagtcatggcggtact

SEQ ID NO: 72107 - DNA, 25 bp, Rattus norvegicus
acacaggctccaagcagaatctcgt

SEQ ID NO: 72108 - DNA, 25 bp, Rattus norvegicus
acacaggctccatgcagaatctcgt

SEQ ID NO: 72109 - DNA, 25 bp, Rattus norvegicus
acacaggctgctatacatggtctta

SEQ ID NO: 72110 - DNA, 25 bp, Rattus norvegicus
acacaggctgctttacatggtctta

SEQ ID NO: 72111 - DNA, 25 bp, Rattus norvegicus
acacaggcttgtcattttagctcct

SEQ ID NO: 72112 - DNA, 25 bp, Rattus norvegicus
acacaggcttgtgattttagctcct

SEQ ID NO: 72113 - DNA, 25 bp, Rattus norvegicus
acacagggagcaccgagcacgcgtt

SEQ ID NO: 72114 - DNA, 25 bp, Rattus norvegicus
acacagggagcagcgagcacgcgtt

SEQ ID NO: 72115 - DNA, 25 bp, Rattus norvegicus
acacagggatccagggcttcaacat

SEQ ID NO: 72116 - DNA, 25 bp, Rattus norvegicus
acacagggatcctgggcttcaacat

SEQ ID NO: 72117 - DNA, 25 bp, Rattus norvegicus
acacagggattgactgcgtctgaga

SEQ ID NO: 72118 - DNA, 25 bp, Rattus norvegicus
acacagggattgtctgcgtctgaga

SEQ ID NO: 72119 - DNA, 25 bp, Rattus norvegicus
acacagggcaagctttgggctccaa

SEQ ID NO: 72120 - DNA, 25 bp, Rattus norvegicus
acacagggcaaggtttgggctccaa

SEQ ID NO: 72121 - DNA, 25 bp, Rattus norvegicus
acacagggcctgatgttgctggagt

SEQ ID NO: 72122 - DNA, 25 bp, Rattus norvegicus
acacagggcctgttgttgctggagt

SEQ ID NO: 72123 - DNA, 25 bp, Rattus norvegicus
acacagggcggaaagctctgtgcct

SEQ ID NO: 72124 - DNA, 25 bp, Rattus norvegicus
acacagggcggatagctctgtgcct

SEQ ID NO: 72125 - DNA, 25 bp, Rattus norvegicus
acacagggtggccagttctattcct

SEQ ID NO: 72126 - DNA, 25 bp, Rattus norvegicus
acacagggtggcgagttctattcct

SEQ ID NO: 72127 - DNA, 25 bp, Rattus norvegicus
acacaggtaaatacttacagacata

SEQ ID NO: 72128 - DNA, 25 bp, Rattus norvegicus
acacaggtaaattcttacagacata

SEQ ID NO: 72129 - DNA, 25 bp, Rattus norvegicus
acacaggtactgagggctctggtca

SEQ ID NO: 72130 - DNA, 25 bp, Rattus norvegicus
acacaggtactgtgggctctggtca

SEQ ID NO: 72131 - DNA, 25 bp, Rattus norvegicus
acacaggtcatcacttgtcaaggca

SEQ ID NO: 72132 - DNA, 25 bp, Rattus norvegicus
acacaggtcatctcttgtcaaggca

SEQ ID NO: 72133 - DNA, 25 bp, Rattus norvegicus
acacaggtgactatggcaggaggtt

SEQ ID NO: 72134 - DNA, 25 bp, Rattus norvegicus
acacaggtgactttggcaggaggtt

SEQ ID NO: 72135 - DNA, 25 bp, Rattus norvegicus
acacaggtgctgatgctggtggcca

SEQ ID NO: 72136 - DNA, 25 bp, Rattus norvegicus
acacaggtgctgttgctggtggcca

SEQ ID NO: 72137 - DNA, 25 bp, Rattus norvegicus
acacaggtggacactattgatgcat

SEQ ID NO: 72138 - DNA, 25 bp, Rattus norvegicus
acacaggtggactctattgatgcat

SEQ ID NO: 72139 - DNA, 25 bp, Rattus norvegicus
acacaggtgggaattacattgccga

SEQ ID NO: 72140 - DNA, 25 bp, Rattus norvegicus
acacaggtgggatttacattgccga

SEQ ID NO: 72141 - DNA, 25 bp, Rattus norvegicus
acacaggtgggcaattttctctatg

SEQ ID NO: 72142 - DNA, 25 bp, Rattus norvegicus
acacaggtgggctattttctctatg

SEQ ID NO: 72143 - DNA, 25 bp, Rattus norvegicus
acacaggtgtcacctgcactactta

SEQ ID NO: 72144 - DNA, 25 bp, Rattus norvegicus
acacaggtgtcagctgcactactta

SEQ ID NO: 72145 - DNA, 25 bp, Rattus norvegicus
acacaggtgtggcttcttccaaccg

SEQ ID NO: 72146 - DNA, 25 bp, Rattus norvegicus
acacaggtgtgggttcttccaaccg

SEQ ID NO: 72147 - DNA, 25 bp, Rattus norvegicus
acacaggttctcactttacaaatgg

SEQ ID NO: 72148 - DNA, 25 bp, Rattus norvegicus
acacaggttctctctttacaaatgg

SEQ ID NO: 72149 - DNA, 25 bp, Rattus norvegicus
acacagtaaaggaggagtccctgcc

SEQ ID NO: 72150 - DNA, 25 bp, Rattus norvegicus
acacagtaaaggtggagtccctgcc

SEQ ID NO: 72151 - DNA, 25 bp, Rattus norvegicus
acacagtaagcgcaggcacagcctg

SEQ ID NO: 72152 - DNA, 25 bp, Rattus norvegicus
acacagtaagcggaggcacagcctg

SEQ ID NO: 72153 - DNA, 25 bp, Rattus norvegicus
acacagtaaggcattaccgccagca

SEQ ID NO: 72154 - DNA, 25 bp, Rattus norvegicus
acacagtaaggctttaccgccagca

SEQ ID NO: 72155 - DNA, 25 bp, Rattus norvegicus
acacagtacagtagttcccggtctt

SEQ ID NO: 72156 - DNA, 25 bp, Rattus norvegicus
acacagtacagttgttcccggtctt

SEQ ID NO: 72157 - DNA, 25 bp, Rattus norvegicus
acacagtaggtgcacacactcagcc

SEQ ID NO: 72158 - DNA, 25 bp, Rattus norvegicus
acacagtaggtggacacactcagcc

SEQ ID NO: 72159 - DNA, 25 bp, Rattus norvegicus
acacagtagtaacagcaagccgaca

SEQ ID NO: 72160 - DNA, 25 bp, Rattus norvegicus
acacagtagtaagagcaagccgaca

SEQ ID NO: 72161 - DNA, 25 bp, Rattus norvegicus
acacagtagttcacaacccgcagtt

SEQ ID NO: 72162 - DNA, 25 bp, Rattus norvegicus
acacagtagttctcaacccgcagtt

SEQ ID NO: 72163 - DNA, 25 bp, Rattus norvegicus
acacagtcacaaagtaccggttaaa

SEQ ID NO: 72164 - DNA, 25 bp, Rattus norvegicus
acacagtcacaatgtaccggttaaa

SEQ ID NO: 72165 - DNA, 25 bp, Rattus norvegicus
acacagtcccagactctatgaggaa

SEQ ID NO: 72166 - DNA, 25 bp, Rattus norvegicus
acacagtcccagtctctatgaggaa

SEQ ID NO: 72167 - DNA, 25 bp, Rattus norvegicus
acacagtccttgagggtcagatacc

SEQ ID NO: 72168 - DNA, 25 bp, Rattus norvegicus
acacagtccttgtgggtcagatacc

SEQ ID NO: 72169 - DNA, 25 bp, Rattus norvegicus
acacagtcgcttaggttggtggtga

SEQ ID NO: 72170 - DNA, 25 bp, Rattus norvegicus
acacagtcgctttggttggtggtga

SEQ ID NO: 72171 - DNA, 25 bp, Rattus norvegicus
acacagtcggcacgtttgggcgcat

SEQ ID NO: 72172 - DNA, 25 bp, Rattus norvegicus
acacagtcggcaggtttgggcgcat

SEQ ID NO: 72173 - DNA, 25 bp, Rattus norvegicus
acacagtctctcatggagctgcaag

SEQ ID NO: 72174 - DNA, 25 bp, Rattus norvegicus
acacagtctctcttggagctgcaag

SEQ ID NO: 72175 - DNA, 25 bp, Rattus norvegicus
acacagtctgagaggcttgcaagat

SEQ ID NO: 72176 - DNA, 25 bp, Rattus norvegicus
acacagtctgagtggcttgcaagat

SEQ ID NO: 72177 - DNA, 25 bp, Rattus norvegicus
acacagtctggaccaggctggcttt

SEQ ID NO: 72178 - DNA, 25 bp, Rattus norvegicus
acacagtctggagcaggctggcttt

SEQ ID NO: 72179 - DNA, 25 bp, Rattus norvegicus
acacagtctgtcagggacttcagcc

SEQ ID NO: 72180 - DNA, 25 bp, Rattus norvegicus
acacagtctgtctgggacttcagcc

SEQ ID NO: 72181 - DNA, 25 bp, Rattus norvegicus
acacagtgacacactcatttttgtt

SEQ ID NO: 72182 - DNA, 25 bp, Rattus norvegicus
acacagtgacactctcatttttgtt

SEQ ID NO: 72183 - DNA, 25 bp, Rattus norvegicus
acacagtgacccacagagatgccaa

SEQ ID NO: 72184 - DNA, 25 bp, Rattus norvegicus
acacagtgaccctcagagatgccaa

SEQ ID NO: 72185 - DNA, 25 bp, Rattus norvegicus
acacagtgaggaaacctactcccct

SEQ ID NO: 72186 - DNA, 25 bp, Rattus norvegicus
acacagtgaggatacctactcccct

SEQ ID NO: 72187 - DNA, 25 bp, Rattus norvegicus
acacagtgcacgctacctactacgt

SEQ ID NO: 72188 - DNA, 25 bp, Rattus norvegicus
acacagtgcacggtacctactacgt

SEQ ID NO: 72189 - DNA, 25 bp, Rattus norvegicus
acacagtgcagcagcgatgggcaat

SEQ ID NO: 72190 - DNA, 25 bp, Rattus norvegicus
acacagtgcagctgcgatgggcaat

SEQ ID NO: 72191 - DNA, 25 bp, Rattus norvegicus
acacagtgcgccatctctgttctta

SEQ ID NO: 72192 - DNA, 25 bp, Rattus norvegicus
acacagtgcgccttctctgttctta

SEQ ID NO: 72193 - DNA, 25 bp, Rattus norvegicus
acacagtggattctttgcttgaggc

SEQ ID NO: 72194 - DNA, 25 bp, Rattus norvegicus
acacagtggattgtttgcttgaggc

SEQ ID NO: 72195 - DNA, 25 bp, Rattus norvegicus
acacagtggccaccaagaccgtgga

SEQ ID NO: 72196 - DNA, 25 bp, Rattus norvegicus
acacagtggccagcaagaccgtgga

SEQ ID NO: 72197 - DNA, 25 bp, Rattus norvegicus
acacagtggctactttagttgcgaa

SEQ ID NO: 72198 - DNA, 25 bp, Rattus norvegicus
acacagtggctagtttagttgcgaa

SEQ ID NO: 72199 - DNA, 25 bp, Rattus norvegicus
acacagtgggggctcaaagtcaaac

SEQ ID NO: 72200 - DNA, 25 bp, Rattus norvegicus
acacagtggggggtcaaagtcaaac

SEQ ID NO: 72201 - DNA, 25 bp, Rattus norvegicus
acacagtggtatccaggtcctcttc

SEQ ID NO: 72202 - DNA, 25 bp, Rattus norvegicus
acacagtggtatgcaggtcctcttc

SEQ ID NO: 72203 - DNA, 25 bp, Rattus norvegicus
acacagtgttctacctgtcctgaga

SEQ ID NO: 72204 - DNA, 25 bp, Rattus norvegicus
acacagtgttcttcctgtcctgaga

SEQ ID NO: 72205 - DNA, 25 bp, Rattus norvegicus
acacagttcagtctctggagcggca

SEQ ID NO: 72206 - DNA, 25 bp, Rattus norvegicus
acacagttcagtgtctggagcggca

SEQ ID NO: 72207 - DNA, 25 bp, Rattus norvegicus
acacagttccacacagggtcagagg

SEQ ID NO: 72208 - DNA, 25 bp, Rattus norvegicus
acacagttccactcagggtcagagg

SEQ ID NO: 72209 - DNA, 25 bp, Rattus norvegicus
acacagttggctaccgtggacacaa

SEQ ID NO: 72210 - DNA, 25 bp, Rattus norvegicus
acacagttggcttccgtggacacaa

SEQ ID NO: 72211 - DNA, 25 bp, Rattus norvegicus
acacagttgttcacaattttatctt

SEQ ID NO: 72212 - DNA, 25 bp, Rattus norvegicus
acacagttgttctcaattttatctt

SEQ ID NO: 72213 - DNA, 25 bp, Rattus norvegicus
acacataaaagcagccgtcggtctt

SEQ ID NO: 72214 - DNA, 25 bp, Rattus norvegicus
acacataaaagctgccgtcggtctt

SEQ ID NO: 72215 - DNA, 25 bp, Rattus norvegicus
acacataaatggctctctgccagcc

SEQ ID NO: 72216 - DNA, 25 bp, Rattus norvegicus
acacataaatgggtctctgccagcc

SEQ ID NO: 72217 - DNA, 25 bp, Rattus norvegicus
acacatacagttagactccaggctc

SEQ ID NO: 72218 - DNA, 25 bp, Rattus norvegicus
acacatacagtttgactccaggctc

SEQ ID NO: 72219 - DNA, 25 bp, Rattus norvegicus
acacatacataaacagccttgcata

SEQ ID NO: 72220 - DNA, 25 bp, Rattus norvegicus
acacatacataatcagccttgcata

SEQ ID NO: 72221 - DNA, 25 bp, Rattus norvegicus
acacatacatcaactgtggctctca

SEQ ID NO: 72222 - DNA, 25 bp, Rattus norvegicus
acacatacatcatctgtggctctca

SEQ ID NO: 72223 - DNA, 25 bp, Rattus norvegicus
acacatacatccatacgttcataat

SEQ ID NO: 72224 - DNA, 25 bp, Rattus norvegicus
acacatacatccttacgttcataat

SEQ ID NO: 72225 - DNA, 25 bp, Rattus norvegicus
acacatacatctctagagattcaga

SEQ ID NO: 72226 - DNA, 25 bp, Rattus norvegicus
acacatacatctgtagagattcaga

SEQ ID NO: 72227 - DNA, 25 bp, Rattus norvegicus
acacatacatgaaggctagctgaca

SEQ ID NO: 72228 - DNA, 25 bp, Rattus norvegicus
acacatacatgatggctagctgaca

SEQ ID NO: 72229 - DNA, 25 bp, Rattus norvegicus
acacataccctgcacttgcacaagg

SEQ ID NO: 72230 - DNA, 25 bp, Rattus norvegicus
acacataccctggacttgcacaagg

SEQ ID NO: 72231 - DNA, 25 bp, Rattus norvegicus
acacatacctacatccttttgtctc

SEQ ID NO: 72232 - DNA, 25 bp, Rattus norvegicus
acacatacctacttccttttgtctc

SEQ ID NO: 72233 - DNA, 25 bp, Rattus norvegicus
acacatacgtacaaggcgatggcca

SEQ ID NO: 72234 - DNA, 25 bp, Rattus norvegicus
acacatacgtactaggcgatggcca

SEQ ID NO: 72235 - DNA, 25 bp, Rattus norvegicus
acacatactagactccatccaggag

SEQ ID NO: 72236 - DNA, 25 bp, Rattus norvegicus
acacatactagagtccatccaggag

SEQ ID NO: 72237 - DNA, 25 bp, Rattus norvegicus
acacatactcggaggacttcccagc

SEQ ID NO: 72238 - DNA, 25 bp, Rattus norvegicus
acacatactcggtggacttcccagc

SEQ ID NO: 72239 - DNA, 25 bp, Rattus norvegicus
acacatagactaagggctacatgta

SEQ ID NO: 72240 - DNA, 25 bp, Rattus norvegicus
acacatagactatgggctacatgta

SEQ ID NO: 72241 - DNA, 25 bp, Rattus norvegicus
acacatagcacccagatagcttgaa

SEQ ID NO: 72242 - DNA, 25 bp, Rattus norvegicus
acacatagcaccgagatagcttgaa

SEQ ID NO: 72243 - DNA, 25 bp, Rattus norvegicus
acacataggcacaagggacattttc

SEQ ID NO: 72244 - DNA, 25 bp, Rattus norvegicus
acacataggcactagggacattttc

SEQ ID NO: 72245 - DNA, 25 bp, Rattus norvegicus
acacatattgtcattgcttctgata

SEQ ID NO: 72246 - DNA, 25 bp, Rattus norvegicus
acacatattgtctttgcttctgata

SEQ ID NO: 72247 - DNA, 25 bp, Rattus norvegicus
acacatcacaatattgctgtttcaa

SEQ ID NO: 72248 - DNA, 25 bp, Rattus norvegicus
acacatcacaattttgctgtttcaa

SEQ ID NO: 72249 - DNA, 25 bp, Rattus norvegicus
acacatcacgctctatagttcttat

SEQ ID NO: 72250 - DNA, 25 bp, Rattus norvegicus
acacatcacgctgtatagttcttat

SEQ ID NO: 72251 - DNA, 25 bp, Rattus norvegicus
acacatcagagtcaggtttcctaat

SEQ ID NO: 72252 - DNA, 25 bp, Rattus norvegicus
acacatcagagtgaggtttcctaat

SEQ ID NO: 72253 - DNA, 25 bp, Rattus norvegicus
acacatcagtcaagggtcacactac

SEQ ID NO: 72254 - DNA, 25 bp, Rattus norvegicus
acacatcagtcatgggtcacactac

SEQ ID NO: 72255 - DNA, 25 bp, Rattus norvegicus
acacatcatgggattctgaggctcc

SEQ ID NO: 72256 - DNA, 25 bp, Rattus norvegicus
acacatcatgggtttctgaggctcc

SEQ ID NO: 72257 - DNA, 25 bp, Rattus norvegicus
acacatccaaataccaagacctttc

SEQ ID NO: 72258 - DNA, 25 bp, Rattus norvegicus
acacatccaaattccaagacctttc

SEQ ID NO: 72259 - DNA, 25 bp, Rattus norvegicus
acacatccacaacattcatactctt

SEQ ID NO: 72260 - DNA, 25 bp, Rattus norvegicus
acacatccacaagattcatactctt

SEQ ID NO: 72261 - DNA, 25 bp, Rattus norvegicus
acacatccacatacagtccaggcag

SEQ ID NO: 72262 - DNA, 25 bp, Rattus norvegicus
acacatccacattcagtccaggcag

SEQ ID NO: 72263 - DNA, 25 bp, Rattus norvegicus
acacatccacctctcgtgagaagga

SEQ ID NO: 72264 - DNA, 25 bp, Rattus norvegicus
acacatccacctgtcgtgagaagga

SEQ ID NO: 72265 - DNA, 25 bp, Rattus norvegicus
acacatcccttcatgtgcctgagac

SEQ ID NO: 72266 - DNA, 25 bp, Rattus norvegicus
acacatcccttcttgtgcctgagac

SEQ ID NO: 72267 - DNA, 25 bp, Rattus norvegicus
acacatcctaacatctcaaacacaa

SEQ ID NO: 72268 - DNA, 25 bp, Rattus norvegicus
acacatcctaacttctcaaacacaa

SEQ ID NO: 72269 - DNA, 25 bp, Rattus norvegicus
acacatcctcagatccacagattgg

SEQ ID NO: 72270 - DNA, 25 bp, Rattus norvegicus
acacatcctcagttccacagattgg

SEQ ID NO: 72271 - DNA, 25 bp, Rattus norvegicus
acacatcctgccagtttttcttaca

SEQ ID NO: 72272 - DNA, 25 bp, Rattus norvegicus
acacatcctgcctgtttttcttaca

SEQ ID NO: 72273 - DNA, 25 bp, Rattus norvegicus
acacatccttgcacatcttgttcaa

SEQ ID NO: 72274 - DNA, 25 bp, Rattus norvegicus
acacatccttgctcatcttgttcaa

SEQ ID NO: 72275 - DNA, 25 bp, Rattus norvegicus
acacatcgggacatttcttgtttaa

SEQ ID NO: 72276 - DNA, 25 bp, Rattus norvegicus
acacatcgggacttttcttgtttaa

SEQ ID NO: 72277 - DNA, 25 bp, Rattus norvegicus
acacatctaaaaatcaagcgagcga

SEQ ID NO: 72278 - DNA, 25 bp, Rattus norvegicus
acacatctaaaattcaagcgagcga

SEQ ID NO: 72279 - DNA, 25 bp, Rattus norvegicus
acacatctaactctgctgctggctt

SEQ ID NO: 72280 - DNA, 25 bp, Rattus norvegicus
acacatctaactgtgctgctggctt

SEQ ID NO: 72281 - DNA, 25 bp, Rattus norvegicus
acacatctacctacaagtctgtttg

SEQ ID NO: 72282 - DNA, 25 bp, Rattus norvegicus
acacatctaccttcaagtctgtttg

SEQ ID NO: 72283 - DNA, 25 bp, Rattus norvegicus
acacatctagctcctggttttgtat

SEQ ID NO: 72284 - DNA, 25 bp, Rattus norvegicus
acacatctagctgctggttttgtat

SEQ ID NO: 72285 - DNA, 25 bp, Rattus norvegicus
acacatctccacattacagcagagt

SEQ ID NO: 72286 - DNA, 25 bp, Rattus norvegicus
acacatctccactttacagcagagt

SEQ ID NO: 72287 - DNA, 25 bp, Rattus norvegicus
acacatctcgctccaatcaaggctg

SEQ ID NO: 72288 - DNA, 25 bp, Rattus norvegicus
acacatctcgctgcaatcaaggctg

SEQ ID NO: 72289 - DNA, 25 bp, Rattus norvegicus
acacatctctggctttagaatactg

SEQ ID NO: 72290 - DNA, 25 bp, Rattus norvegicus
acacatctctgggtttagaatactg

SEQ ID NO: 72291 - DNA, 25 bp, Rattus norvegicus
acacatctgaggcagagtggagtct

SEQ ID NO: 72292 - DNA, 25 bp, Rattus norvegicus
acacatctgagggagagtggagtct

SEQ ID NO: 72293 - DNA, 25 bp, Rattus norvegicus
acacatctgagtactggttctggca

SEQ ID NO: 72294 - DNA, 25 bp, Rattus norvegicus
acacatctgagttctggttctggca

SEQ ID NO: 72295 - DNA, 25 bp, Rattus norvegicus
acacatctgatgacacgtggcatta

SEQ ID NO: 72296 - DNA, 25 bp, Rattus norvegicus
acacatctgatgtcacgtggcatta

SEQ ID NO: 72297 - DNA, 25 bp, Rattus norvegicus
acacatctgccaaagaaatcctgcc

SEQ ID NO: 72298 - DNA, 25 bp, Rattus norvegicus
acacatctgccatagaaatcctgcc

SEQ ID NO: 72299 - DNA, 25 bp, Rattus norvegicus
acacatcttcccagctttttagaat

SEQ ID NO: 72300 - DNA, 25 bp, Rattus norvegicus
acacatcttccctgctttttagaat

SEQ ID NO: 72301 - DNA, 25 bp, Rattus norvegicus
acacatcttgatacttctaccatcg

SEQ ID NO: 72302 - DNA, 25 bp, Rattus norvegicus
acacatcttgattcttctaccatcg

SEQ ID NO: 72303 - DNA, 25 bp, Rattus norvegicus
acacatgaagttccgtgccttggtt

SEQ ID NO: 72304 - DNA, 25 bp, Rattus norvegicus
acacatgaagttgcgtgccttggtt

SEQ ID NO: 72305 - DNA, 25 bp, Rattus norvegicus
acacatgaatttagagaaactccgt

SEQ ID NO: 72306 - DNA, 25 bp, Rattus norvegicus
acacatgaattttgagaaactccgt

SEQ ID NO: 72307 - DNA, 25 bp, Rattus norvegicus
acacatgaccccagtcggtgtgaaa

SEQ ID NO: 72308 - DNA, 25 bp, Rattus norvegicus
acacatgacccctgtcggtgtgaaa

SEQ ID NO: 72309 - DNA, 25 bp, Rattus norvegicus
acacatgcacaaagcagtcctgggt

SEQ ID NO: 72310 - DNA, 25 bp, Rattus norvegicus
acacatgcacaatgcagtcctgggt

SEQ ID NO: 72311 - DNA, 25 bp, Rattus norvegicus
acacatgcactgactgttggcttag

SEQ ID NO: 72312 - DNA, 25 bp, Rattus norvegicus
acacatgcactgtctgttggcttag

SEQ ID NO: 72313 - DNA, 25 bp, Rattus norvegicus
acacatgcatccacttcagtttagt

SEQ ID NO: 72314 - DNA, 25 bp, Rattus norvegicus
acacatgcatcctcttcagtttagt

SEQ ID NO: 72315 - DNA, 25 bp, Rattus norvegicus
acacatgccacacaggattaccttg

SEQ ID NO: 72316 - DNA, 25 bp, Rattus norvegicus
acacatgccacagaggattaccttg

SEQ ID NO: 72317 - DNA, 25 bp, Rattus norvegicus
acacatgccattacttagctttaat

SEQ ID NO: 72318 - DNA, 25 bp, Rattus norvegicus
acacatgccatttcttagctttaat

SEQ ID NO: 72319 - DNA, 25 bp, Rattus norvegicus
acacatgcctatcagggtcaagctg

SEQ ID NO: 72320 - DNA, 25 bp, Rattus norvegicus
acacatgcctatgagggtcaagctg

SEQ ID NO: 72321 - DNA, 25 bp, Rattus norvegicus
acacatgcctttattcctaacactt

SEQ ID NO: 72322 - DNA, 25 bp, Rattus norvegicus
acacatgccttttttcctaacactt

SEQ ID NO: 72323 - DNA, 25 bp, Rattus norvegicus
acacatgctaaccactgacctataa

SEQ ID NO: 72324 - DNA, 25 bp, Rattus norvegicus
acacatgctaacgactgacctataa

SEQ ID NO: 72325 - DNA, 25 bp, Rattus norvegicus
acacatgctcacacctattttatca

SEQ ID NO: 72326 - DNA, 25 bp, Rattus norvegicus
acacatgctcactcctattttatca

SEQ ID NO: 72327 - DNA, 25 bp, Rattus norvegicus
acacatgctggcagacggctgagta

SEQ ID NO: 72328 - DNA, 25 bp, Rattus norvegicus
acacatgctggctgacggctgagta

SEQ ID NO: 72329 - DNA, 25 bp, Rattus norvegicus
acacatgctggtcacgtctcgaatg

SEQ ID NO: 72330 - DNA, 25 bp, Rattus norvegicus
acacatgctggtgacgtctcgaatg

SEQ ID NO: 72331 - DNA, 25 bp, Rattus norvegicus
acacatgcttctaattgttgtctaa

SEQ ID NO: 72332 - DNA, 25 bp, Rattus norvegicus
acacatgcttcttattgttgtctaa

SEQ ID NO: 72333 - DNA, 25 bp, Rattus norvegicus
acacatggactaataatctagcaag

SEQ ID NO: 72334 - DNA, 25 bp, Rattus norvegicus
acacatggactattaatctagcaag

SEQ ID NO: 72335 - DNA, 25 bp, Rattus norvegicus
acacatggaggcattcatgcaccag

SEQ ID NO: 72336 - DNA, 25 bp, Rattus norvegicus
acacatggaggctttcatgcaccag

SEQ ID NO: 72337 - DNA, 25 bp, Rattus norvegicus
acacatggcctcaagcaacatacag

SEQ ID NO: 72338 - DNA, 25 bp, Rattus norvegicus
acacatggcctcattgaggagccag

SEQ ID NO: 72339 - DNA, 25 bp, Rattus norvegicus
acacatggcctctagcaacatacag

SEQ ID NO: 72340 - DNA, 25 bp, Rattus norvegicus
acacatggcctctttgaggagccag

SEQ ID NO: 72341 - DNA, 25 bp, Rattus norvegicus
acacatgggaccattgatccaagaa

SEQ ID NO: 72342 - DNA, 25 bp, Rattus norvegicus
acacatgggacctttgatccaagaa

SEQ ID NO: 72343 - DNA, 25 bp, Rattus norvegicus
acacatgggactcctcttcctgaag

SEQ ID NO: 72344 - DNA, 25 bp, Rattus norvegicus
acacatgggactgctcttcctgaag

SEQ ID NO: 72345 - DNA, 25 bp, Rattus norvegicus
acacatgggagcagctgggcacact

SEQ ID NO: 72346 - DNA, 25 bp, Rattus norvegicus
acacatgggagctgctgggcacact

SEQ ID NO: 72347 - DNA, 25 bp, Rattus norvegicus
acacatgggagtctttggcttcgga

SEQ ID NO: 72348 - DNA, 25 bp, Rattus norvegicus
acacatgggagtgtttggcttcgga

SEQ ID NO: 72349 - DNA, 25 bp, Rattus norvegicus
acacatgggcctcaggttggaacac

SEQ ID NO: 72350 - DNA, 25 bp, Rattus norvegicus
acacatgggcctgaggttggaacac

SEQ ID NO: 72351 - DNA, 25 bp, Rattus norvegicus
acacatggtagacttgcctttttag

SEQ ID NO: 72352 - DNA, 25 bp, Rattus norvegicus
acacatggtagagttgcctttttag

SEQ ID NO: 72353 - DNA, 25 bp, Rattus norvegicus
acacatggttgtcagtgccctctgg

SEQ ID NO: 72354 - DNA, 25 bp, Rattus norvegicus
acacatggttgtcggagctagccat

SEQ ID NO: 72355 - DNA, 25 bp, Rattus norvegicus
acacatggttgtgagtgccctctgg

SEQ ID NO: 72356 - DNA, 25 bp, Rattus norvegicus
acacatggttgtgggagctagccat

SEQ ID NO: 72357 - DNA, 25 bp, Rattus norvegicus
acacatgtacctaggccggcatgta

SEQ ID NO: 72358 - DNA, 25 bp, Rattus norvegicus
acacatgtaccttggccggcatgta

SEQ ID NO: 72359 - DNA, 25 bp, Rattus norvegicus
acacatgtagcaaacttacacacac

SEQ ID NO: 72360 - DNA, 25 bp, Rattus norvegicus
acacatgtagcatacttacacacac

SEQ ID NO: 72361 - DNA, 25 bp, Rattus norvegicus
acacatgtagccagggtcgactcgg

SEQ ID NO: 72362 - DNA, 25 bp, Rattus norvegicus
acacatgtagcctgggtcgactcgg

SEQ ID NO: 72363 - DNA, 25 bp, Rattus norvegicus
acacatgtaggaagaagttggtccc

SEQ ID NO: 72364 - DNA, 25 bp, Rattus norvegicus
acacatgtaggatgaagttggtccc

SEQ ID NO: 72365 - DNA, 25 bp, Rattus norvegicus
acacatgtcattctggaactcctac

SEQ ID NO: 72366 - DNA, 25 bp, Rattus norvegicus
acacatgtcattgtggaactcctac

SEQ ID NO: 72367 - DNA, 25 bp, Rattus norvegicus
acacatgtccacacagaaattcata

SEQ ID NO: 72368 - DNA, 25 bp, Rattus norvegicus
acacatgtccactcagaaattcata

SEQ ID NO: 72369 - DNA, 25 bp, Rattus norvegicus
acacatgtccgacttcttgtcttta

SEQ ID NO: 72370 - DNA, 25 bp, Rattus norvegicus
acacatgtccgagttcttgtcttta

SEQ ID NO: 72371 - DNA, 25 bp, Rattus norvegicus
acacatgtcctcactgggcgggttt

SEQ ID NO: 72372 - DNA, 25 bp, Rattus norvegicus
acacatgtcctctctgggcgggttt

SEQ ID NO: 72373 - DNA, 25 bp, Rattus norvegicus
acacatgtccttccagagtctcctg

SEQ ID NO: 72374 - DNA, 25 bp, Rattus norvegicus
acacatgtccttgcagagtctcctg

SEQ ID NO: 72375 - DNA, 25 bp, Rattus norvegicus
acacatgtcggcctctggatggaga

SEQ ID NO: 72376 - DNA, 25 bp, Rattus norvegicus
acacatgtcggcgtctggatggaga

SEQ ID NO: 72377 - DNA, 25 bp, Rattus norvegicus
acacatgtctttctcattgcggaac

SEQ ID NO: 72378 - DNA, 25 bp, Rattus norvegicus
acacatgtctttgtcattgcggaac

SEQ ID NO: 72379 - DNA, 25 bp, Rattus norvegicus
acacatgtgcgtacatccggtcgtt

SEQ ID NO: 72380 - DNA, 25 bp, Rattus norvegicus
acacatgtgcgtctgctcgaacaca

SEQ ID NO: 72381 - DNA, 25 bp, Rattus norvegicus
acacatgtgcgtgtgctcgaacaca

SEQ ID NO: 72382 - DNA, 25 bp, Rattus norvegicus
acacatgtgcgttcatccggtcgtt

SEQ ID NO: 72383 - DNA, 25 bp, Rattus norvegicus
acacatgtgtgtactatgcactcgc

SEQ ID NO: 72384 - DNA, 25 bp, Rattus norvegicus
acacatgtgtgttctatgcactcgc

SEQ ID NO: 72385 - DNA, 25 bp, Rattus norvegicus
acacatgttgttatagctgctggaa

SEQ ID NO: 72386 - DNA, 25 bp, Rattus norvegicus
acacatgttgttttagctgctggaa

SEQ ID NO: 72387 - DNA, 25 bp, Rattus norvegicus
acacattcaggtctccttatttctc

SEQ ID NO: 72388 - DNA, 25 bp, Rattus norvegicus
acacattcaggtgtccttatttctc

SEQ ID NO: 72389 - DNA, 25 bp, Rattus norvegicus
acacattccaaaatggtttgcccaa

SEQ ID NO: 72390 - DNA, 25 bp, Rattus norvegicus
acacattccaaattggtttgcccaa

SEQ ID NO: 72391 - DNA, 25 bp, Rattus norvegicus
acacattccactcttgctttttatt

SEQ ID NO: 72392 - DNA, 25 bp, Rattus norvegicus
acacattccactgttgctttttatt

SEQ ID NO: 72393 - DNA, 25 bp, Rattus norvegicus
acacattcctgcaccaagcatggga

SEQ ID NO: 72394 - DNA, 25 bp, Rattus norvegicus
acacattcctgctccaagcatggga

SEQ ID NO: 72395 - DNA, 25 bp, Rattus norvegicus
acacattctcacaccaaggctggac

SEQ ID NO: 72396 - DNA, 25 bp, Rattus norvegicus
acacattctcactccaaggctggac

SEQ ID NO: 72397 - DNA, 25 bp, Rattus norvegicus
acacattctgccacaggagggagaa

SEQ ID NO: 72398 - DNA, 25 bp, Rattus norvegicus
acacattctgcctcaggagggagaa

SEQ ID NO: 72399 - DNA, 25 bp, Rattus norvegicus
acacattgcagacttcatactaaag

SEQ ID NO: 72400 - DNA, 25 bp, Rattus norvegicus
acacattgcagagttcatactaaag

SEQ ID NO: 72401 - DNA, 25 bp, Rattus norvegicus
acacattgcggtatcaagccaggcc

SEQ ID NO: 72402 - DNA, 25 bp, Rattus norvegicus
acacattgcggtttcaagccaggcc

SEQ ID NO: 72403 - DNA, 25 bp, Rattus norvegicus
acacattgctcgacagtccttgttg

SEQ ID NO: 72404 - DNA, 25 bp, Rattus norvegicus
acacattgctcgtcagtccttgttg

SEQ ID NO: 72405 - DNA, 25 bp, Rattus norvegicus
acacattgctggctattgcctttga

SEQ ID NO: 72406 - DNA, 25 bp, Rattus norvegicus
acacattgctgggtattgcctttga

SEQ ID NO: 72407 - DNA, 25 bp, Rattus norvegicus
acacattggcataattttgggtcag

SEQ ID NO: 72408 - DNA, 25 bp, Rattus norvegicus
acacattggcattattttgggtcag

SEQ ID NO: 72409 - DNA, 25 bp, Rattus norvegicus
acacattggtatctcctacgcttca

SEQ ID NO: 72410 - DNA, 25 bp, Rattus norvegicus
acacattggtatgtcctacgcttca

SEQ ID NO: 72411 - DNA, 25 bp, Rattus norvegicus
acacattgtccaaagggaccctgga

SEQ ID NO: 72412 - DNA, 25 bp, Rattus norvegicus
acacattgtccatagggaccctgga

SEQ ID NO: 72413 - DNA, 25 bp, Rattus norvegicus
acacatttcacccagtgacacactg

SEQ ID NO: 72414 - DNA, 25 bp, Rattus norvegicus
acacatttcaccgagtgacacactg

SEQ ID NO: 72415 - DNA, 25 bp, Rattus norvegicus
acacatttgactccattccttcagg

SEQ ID NO: 72416 - DNA, 25 bp, Rattus norvegicus
acacatttgactgcattccttcagg

SEQ ID NO: 72417 - DNA, 25 bp, Rattus norvegicus
acacatttggagctgctgtctctga

SEQ ID NO: 72418 - DNA, 25 bp, Rattus norvegicus
acacatttggaggtgctgtctctga

SEQ ID NO: 72419 - DNA, 25 bp, Rattus norvegicus
acacatttgtatcccttaggtccta

SEQ ID NO: 72420 - DNA, 25 bp, Rattus norvegicus
acacatttgtatgccttaggtccta

SEQ ID NO: 72421 - DNA, 25 bp, Rattus norvegicus
acacatttttggagctttcctttgt

SEQ ID NO: 72422 - DNA, 25 bp, Rattus norvegicus
acacatttttggtgctttcctttgt

SEQ ID NO: 72423 - DNA, 25 bp, Rattus norvegicus
acaccaaaatctctcgctacactaa

SEQ ID NO: 72424 - DNA, 25 bp, Rattus norvegicus
acaccaaaatctgtcgctacactaa

SEQ ID NO: 72425 - DNA, 25 bp, Rattus norvegicus
acaccaaacctgacaatgccttgag

SEQ ID NO: 72426 - DNA, 25 bp, Rattus norvegicus
acaccaaacctgtcaatgccttgag

SEQ ID NO: 72427 - DNA, 25 bp, Rattus norvegicus
acaccaaactccaagctctacaagg

SEQ ID NO: 72428 - DNA, 25 bp, Rattus norvegicus
acaccaaactcctagctctacaagg

SEQ ID NO: 72429 - DNA, 25 bp, Rattus norvegicus
acaccaagacacctgagaaaagaac

SEQ ID NO: 72430 - DNA, 25 bp, Rattus norvegicus
acaccaagacacgtgagaaaagaac

SEQ ID NO: 72431 - DNA, 25 bp, Rattus norvegicus
acaccaagatgcctggcgaacagca

SEQ ID NO: 72432 - DNA, 25 bp, Rattus norvegicus
acaccaagatgcgtggcgaacagca

SEQ ID NO: 72433 - DNA, 25 bp, Rattus norvegicus
acaccaagatggcactgctttccgc

SEQ ID NO: 72434 - DNA, 25 bp, Rattus norvegicus
acaccaagatgggactgctttccgc

SEQ ID NO: 72435 - DNA, 25 bp, Rattus norvegicus
acaccaagcatcatggtttctgctt

SEQ ID NO: 72436 - DNA, 25 bp, Rattus norvegicus
acaccaagcatcttggtttctgctt

SEQ ID NO: 72437 - DNA, 25 bp, Rattus norvegicus
acaccaagtgtccacaaccttttga

SEQ ID NO: 72438 - DNA, 25 bp, Rattus norvegicus
acaccaagtgtcgacaaccttttga

SEQ ID NO: 72439 - DNA, 25 bp, Rattus norvegicus
acaccaataaccagtgtgcctgcag

SEQ ID NO: 72440 - DNA, 25 bp, Rattus norvegicus
acaccaataacctgtgtgcctgcag

SEQ ID NO: 72441 - DNA, 25 bp, Rattus norvegicus
acaccaatcccaataatttccctgt

SEQ ID NO: 72442 - DNA, 25 bp, Rattus norvegicus
acaccaatcccattaatttccctgt

SEQ ID NO: 72443 - DNA, 25 bp, Rattus norvegicus
acaccaattgatatttcttagattc

SEQ ID NO: 72444 - DNA, 25 bp, Rattus norvegicus
acaccaattgatttttcttagattc

SEQ ID NO: 72445 - DNA, 25 bp, Rattus norvegicus
acaccaattgctatgaggtcacggt

SEQ ID NO: 72446 - DNA, 25 bp, Rattus norvegicus
acaccaattgctttgaggtcacggt

SEQ ID NO: 72447 - DNA, 25 bp, Rattus norvegicus
acaccacaaaccagccagtgactgt

SEQ ID NO: 72448 - DNA, 25 bp, Rattus norvegicus
acaccacaaacctgccagtgactgt

SEQ ID NO: 72449 - DNA, 25 bp, Rattus norvegicus
acaccacaggtcctaaatcatccta

SEQ ID NO: 72450 - DNA, 25 bp, Rattus norvegicus
acaccacaggtcgtaaatcatccta

SEQ ID NO: 72451 - DNA, 25 bp, Rattus norvegicus
acaccacagtggagtgcacaccgat

SEQ ID NO: 72452 - DNA, 25 bp, Rattus norvegicus
acaccacagtggtgtgcacaccgat

SEQ ID NO: 72453 - DNA, 25 bp, Rattus norvegicus
acaccacattttcaccttgtagggg

SEQ ID NO: 72454 - DNA, 25 bp, Rattus norvegicus
acaccacattttgaccttgtagggg

SEQ ID NO: 72455 - DNA, 25 bp, Rattus norvegicus
acaccaccaaagagtttgccacgta

SEQ ID NO: 72456 - DNA, 25 bp, Rattus norvegicus
acaccaccaaagtgtttgccacgta

SEQ ID NO: 72457 - DNA, 25 bp, Rattus norvegicus
acaccaccacatcttttcatctagt

SEQ ID NO: 72458 - DNA, 25 bp, Rattus norvegicus
acaccaccacatgttttcatctagt

SEQ ID NO: 72459 - DNA, 25 bp, Rattus norvegicus
acaccacccaatatattactgattt

SEQ ID NO: 72460 - DNA, 25 bp, Rattus norvegicus
acaccacccaatttattactgattt

SEQ ID NO: 72461 - DNA, 25 bp, Rattus norvegicus
acaccaccgaatcatacagtaccat

SEQ ID NO: 72462 - DNA, 25 bp, Rattus norvegicus
acaccaccgaatgatacagtaccat

SEQ ID NO: 72463 - DNA, 25 bp, Rattus norvegicus
acaccacctagcactggctttaaat

SEQ ID NO: 72464 - DNA, 25 bp, Rattus norvegicus
acaccacctagctctggctttaaat

SEQ ID NO: 72465 - DNA, 25 bp, Rattus norvegicus
acaccacctgctctaaacactggta

SEQ ID NO: 72466 - DNA, 25 bp, Rattus norvegicus
acaccacctgctgtaaacactggta

SEQ ID NO: 72467 - DNA, 25 bp, Rattus norvegicus
acaccacctggactccaacatgaaa

SEQ ID NO: 72468 - DNA, 25 bp, Rattus norvegicus
acaccacctggagtccaacatgaaa

SEQ ID NO: 72469 - DNA, 25 bp, Rattus norvegicus
acaccacggcatcggttctgggctt

SEQ ID NO: 72470 - DNA, 25 bp, Rattus norvegicus
acaccacggcatgggttctgggctt

SEQ ID NO: 72471 - DNA, 25 bp, Rattus norvegicus
acaccacggcggaccagacaggatg

SEQ ID NO: 72472 - DNA, 25 bp, Rattus norvegicus
acaccacggcggtccagacaggatg

SEQ ID NO: 72473 - DNA, 25 bp, Rattus norvegicus
acaccacgggtaacaactgcgagcg

SEQ ID NO: 72474 - DNA, 25 bp, Rattus norvegicus
acaccacgggtatcaactgcgagcg

SEQ ID NO: 72475 - DNA, 25 bp, Rattus norvegicus
acaccacggttgcagaagatgtcta

SEQ ID NO: 72476 - DNA, 25 bp, Rattus norvegicus
acaccacggttggagaagatgtcta

SEQ ID NO: 72477 - DNA, 25 bp, Rattus norvegicus
acaccacgtacaagtgagtgaccac

SEQ ID NO: 72478 - DNA, 25 bp, Rattus norvegicus
acaccacgtacatgtgagtgaccac

SEQ ID NO: 72479 - DNA, 25 bp, Rattus norvegicus
acaccacgtttcatttcacgagtga

SEQ ID NO: 72480 - DNA, 25 bp, Rattus norvegicus
acaccacgtttcttttcacgagtga

SEQ ID NO: 72481 - DNA, 25 bp, Rattus norvegicus
acaccactatccattattctctgaa

SEQ ID NO: 72482 - DNA, 25 bp, Rattus norvegicus
acaccactatcctttattctctgaa

SEQ ID NO: 72483 - DNA, 25 bp, Rattus norvegicus
acaccactcgtgatttaggtatctt

SEQ ID NO: 72484 - DNA, 25 bp, Rattus norvegicus
acaccactcgtgttttaggtatctt

SEQ ID NO: 72485 - DNA, 25 bp, Rattus norvegicus
acaccactcttcacttgagcacttt

SEQ ID NO: 72486 - DNA, 25 bp, Rattus norvegicus
acaccactcttctcttgagcacttt

SEQ ID NO: 72487 - DNA, 25 bp, Rattus norvegicus
acaccactgggcacggcaggatgca

SEQ ID NO: 72488 - DNA, 25 bp, Rattus norvegicus
acaccactgggctcggcaggatgca

SEQ ID NO: 72489 - DNA, 25 bp, Rattus norvegicus
acaccactgtgaatattctccttct

SEQ ID NO: 72490 - DNA, 25 bp, Rattus norvegicus
acaccactgtgattattctccttct

SEQ ID NO: 72491 - DNA, 25 bp, Rattus norvegicus
acaccacttagtccctatcatgtaa

SEQ ID NO: 72492 - DNA, 25 bp, Rattus norvegicus
acaccacttagtgcctatcatgtaa

SEQ ID NO: 72493 - DNA, 25 bp, Rattus norvegicus
acaccacttgccatttgcctagttg

SEQ ID NO: 72494 - DNA, 25 bp, Rattus norvegicus
acaccacttgccttttgcctagttg

SEQ ID NO: 72495 - DNA, 25 bp, Rattus norvegicus
acaccactttccattgactgtcaaa

SEQ ID NO: 72496 - DNA, 25 bp, Rattus norvegicus
acaccactttcctttgactgtcaaa

SEQ ID NO: 72497 - DNA, 25 bp, Rattus norvegicus
acaccactttgtagacggcacggcg

SEQ ID NO: 72498 - DNA, 25 bp, Rattus norvegicus
acaccactttgttgacggcacggcg

SEQ ID NO: 72499 - DNA, 25 bp, Rattus norvegicus
acaccagaacagagggagcttcccc

SEQ ID NO: 72500 - DNA, 25 bp, Rattus norvegicus
acaccagaacagtgggagcttcccc

SEQ ID NO: 72501 - DNA, 25 bp, Rattus norvegicus
acaccagaagagactattgaaagat

SEQ ID NO: 72502 - DNA, 25 bp, Rattus norvegicus
acaccagaagagtctattgaaagat

SEQ ID NO: 72503 - DNA, 25 bp, Rattus norvegicus
acaccagacactattctacagtatt

SEQ ID NO: 72504 - DNA, 25 bp, Rattus norvegicus
acaccagacacttttctacagtatt

SEQ ID NO: 72505 - DNA, 25 bp, Rattus norvegicus
acaccagactctatacacttcttat

SEQ ID NO: 72506 - DNA, 25 bp, Rattus norvegicus
acaccagactctttacacttcttat

SEQ ID NO: 72507 - DNA, 25 bp, Rattus norvegicus
acaccagagagaacagggcaccctt

SEQ ID NO: 72508 - DNA, 25 bp, Rattus norvegicus
acaccagagagatcagggcaccctt

SEQ ID NO: 72509 - DNA, 25 bp, Rattus norvegicus
acaccagaggctaggcatgactgct

SEQ ID NO: 72510 - DNA, 25 bp, Rattus norvegicus
acaccagaggcttggcatgactgct

SEQ ID NO: 72511 - DNA, 25 bp, Rattus norvegicus
acaccagatcctcttcctgtcagta

SEQ ID NO: 72512 - DNA, 25 bp, Rattus norvegicus
acaccagatcctgttcctgtcagta

SEQ ID NO: 72513 - DNA, 25 bp, Rattus norvegicus
acaccagatggaattctttttggat

SEQ ID NO: 72514 - DNA, 25 bp, Rattus norvegicus
acaccagatggatttctttttggat

SEQ ID NO: 72515 - DNA, 25 bp, Rattus norvegicus
acaccagattctagaggactccttg

SEQ ID NO: 72516 - DNA, 25 bp, Rattus norvegicus
acaccagattcttgaggactccttg

SEQ ID NO: 72517 - DNA, 25 bp, Rattus norvegicus
acaccagattgaatcgagggagttc

SEQ ID NO: 72518 - DNA, 25 bp, Rattus norvegicus
acaccagattgattcgagggagttc

SEQ ID NO: 72519 - DNA, 25 bp, Rattus norvegicus
acaccagattggcactgaaacccga

SEQ ID NO: 72520 - DNA, 25 bp, Rattus norvegicus
acaccagattgggactgaaacccga

SEQ ID NO: 72521 - DNA, 25 bp, Rattus norvegicus
acaccagcactgcagtcagagcggc

SEQ ID NO: 72522 - DNA, 25 bp, Rattus norvegicus
acaccagcactggagtcagagcggc

SEQ ID NO: 72523 - DNA, 25 bp, Rattus norvegicus
acaccagcatggctattcgagctta

SEQ ID NO: 72524 - DNA, 25 bp, Rattus norvegicus
acaccagcatgggtattcgagctta

SEQ ID NO: 72525 - DNA, 25 bp, Rattus norvegicus
acaccagccagcctttgtgagggtc

SEQ ID NO: 72526 - DNA, 25 bp, Rattus norvegicus
acaccagccagcgtttgtgagggtc

SEQ ID NO: 72527 - DNA, 25 bp, Rattus norvegicus
acaccagcccgcattggactgtgag

SEQ ID NO: 72528 - DNA, 25 bp, Rattus norvegicus
acaccagcccgctttggactgtgag

SEQ ID NO: 72529 - DNA, 25 bp, Rattus norvegicus
acaccagccgccaagagtcatttga

SEQ ID NO: 72530 - DNA, 25 bp, Rattus norvegicus
acaccagccgcctagagtcatttga

SEQ ID NO: 72531 - DNA, 25 bp, Rattus norvegicus
acaccagccggacggataagcacca

SEQ ID NO: 72532 - DNA, 25 bp, Rattus norvegicus
acaccagccggagggataagcacca

SEQ ID NO: 72533 - DNA, 25 bp, Rattus norvegicus
acaccagccggtcagagggaatgat

SEQ ID NO: 72534 - DNA, 25 bp, Rattus norvegicus
acaccagccggtgagagggaatgat

SEQ ID NO: 72535 - DNA, 25 bp, Rattus norvegicus
acaccagccttgagctcactgatga

SEQ ID NO: 72536 - DNA, 25 bp, Rattus norvegicus
acaccagccttgtgctcactgatga

SEQ ID NO: 72537 - DNA, 25 bp, Rattus norvegicus
acaccagcgggccagttagtaaagc

SEQ ID NO: 72538 - DNA, 25 bp, Rattus norvegicus
acaccagcgggcgagttagtaaagc

SEQ ID NO: 72539 - DNA, 25 bp, Rattus norvegicus
acaccagctccaagtaatcgtgcca

SEQ ID NO: 72540 - DNA, 25 bp, Rattus norvegicus
acaccagctccatgtaatcgtgcca

SEQ ID NO: 72541 - DNA, 25 bp, Rattus norvegicus
acaccagctcttagctaggccggga

SEQ ID NO: 72542 - DNA, 25 bp, Rattus norvegicus
acaccagctctttgctaggccggga

SEQ ID NO: 72543 - DNA, 25 bp, Rattus norvegicus
acaccagctggcagtgtgtttcggt

SEQ ID NO: 72544 - DNA, 25 bp, Rattus norvegicus
acaccagctggctgtgtgtttcggt

SEQ ID NO: 72545 - DNA, 25 bp, Rattus norvegicus
acaccagctgggatgcatactgttg

SEQ ID NO: 72546 - DNA, 25 bp, Rattus norvegicus
acaccagctgggttgcatactgttg

SEQ ID NO: 72547 - DNA, 25 bp, Rattus norvegicus
acaccagcttccagtgtgtatgtgt

SEQ ID NO: 72548 - DNA, 25 bp, Rattus norvegicus
acaccagcttcctgtgtgtatgtgt

SEQ ID NO: 72549 - DNA, 25 bp, Rattus norvegicus
acaccaggaggtcccttgtcggtca

SEQ ID NO: 72550 - DNA, 25 bp, Rattus norvegicus
acaccaggaggtgccttgtcggtca

SEQ ID NO: 72551 - DNA, 25 bp, Rattus norvegicus
acaccaggctggaagaacgaagcga

SEQ ID NO: 72552 - DNA, 25 bp, Rattus norvegicus
acaccaggctggagggatgaagcca

SEQ ID NO: 72553 - DNA, 25 bp, Rattus norvegicus
acaccaggctggtagaacgaagcga

SEQ ID NO: 72554 - DNA, 25 bp, Rattus norvegicus
acaccaggctggtgggatgaagcca

SEQ ID NO: 72555 - DNA, 25 bp, Rattus norvegicus
acaccagggccacgatgttgagcat

SEQ ID NO: 72556 - DNA, 25 bp, Rattus norvegicus
acaccagggccaggatgttgagcat

SEQ ID NO: 72557 - DNA, 25 bp, Rattus norvegicus
acaccagggctccaaggccctgttt

SEQ ID NO: 72558 - DNA, 25 bp, Rattus norvegicus
acaccagggctcgaaggccctgttt

SEQ ID NO: 72559 - DNA, 25 bp, Rattus norvegicus
acaccagggtctagctccagttagg

SEQ ID NO: 72560 - DNA, 25 bp, Rattus norvegicus
acaccagggtcttgctccagttagg

SEQ ID NO: 72561 - DNA, 25 bp, Rattus norvegicus
acaccaggtgtcatcttcctagagg

SEQ ID NO: 72562 - DNA, 25 bp, Rattus norvegicus
acaccaggtgtcttcttcctagagg

SEQ ID NO: 72563 - DNA, 25 bp, Rattus norvegicus
acaccaggttggctagtctgtctga

SEQ ID NO: 72564 - DNA, 25 bp, Rattus norvegicus
acaccaggttgggtagtctgtctga

SEQ ID NO: 72565 - DNA, 25 bp, Rattus norvegicus
acaccagtattacatccatccttta

SEQ ID NO: 72566 - DNA, 25 bp, Rattus norvegicus
acaccagtattagatccatccttta

SEQ ID NO: 72567 - DNA, 25 bp, Rattus norvegicus
acaccagtcctcaccttggaaaagg

SEQ ID NO: 72568 - DNA, 25 bp, Rattus norvegicus
acaccagtcctccaagaaccagaaa

SEQ ID NO: 72569 - DNA, 25 bp, Rattus norvegicus
acaccagtcctcgaagaaccagaaa

SEQ ID NO: 72570 - DNA, 25 bp, Rattus norvegicus
acaccagtcctctccttggaaaagg

SEQ ID NO: 72571 - DNA, 25 bp, Rattus norvegicus
acaccagtgacaagtgtcccgtaat

SEQ ID NO: 72572 - DNA, 25 bp, Rattus norvegicus
acaccagtgacatgtgtcccgtaat

SEQ ID NO: 72573 - DNA, 25 bp, Rattus norvegicus
acaccagtgagcaggtggcctcggt

SEQ ID NO: 72574 - DNA, 25 bp, Rattus norvegicus
acaccagtgagctggtggcctcggt

SEQ ID NO: 72575 - DNA, 25 bp, Rattus norvegicus
acaccagtgcccagagtgcgggaag

SEQ ID NO: 72576 - DNA, 25 bp, Rattus norvegicus
acaccagtgccctgagtgcgggaag

SEQ ID NO: 72577 - DNA, 25 bp, Rattus norvegicus
acaccagtgcggacaggactgtgaa

SEQ ID NO: 72578 - DNA, 25 bp, Rattus norvegicus
acaccagtgcggtcaggactgtgaa

SEQ ID NO: 72579 - DNA, 25 bp, Rattus norvegicus
acaccagtggctaagagggtacagt

SEQ ID NO: 72580 - DNA, 25 bp, Rattus norvegicus
acaccagtggcttagagggtacagt

SEQ ID NO: 72581 - DNA, 25 bp, Rattus norvegicus
acaccagtgggtataaaagcaatca

SEQ ID NO: 72582 - DNA, 25 bp, Rattus norvegicus
acaccagtgggtttaaaagcaatca

SEQ ID NO: 72583 - DNA, 25 bp, Rattus norvegicus
acaccagtgtttagggactcaggca

SEQ ID NO: 72584 - DNA, 25 bp, Rattus norvegicus
acaccagtgttttgggactcaggca

SEQ ID NO: 72585 - DNA, 25 bp, Rattus norvegicus
acaccagttactaccttttcgtgat

SEQ ID NO: 72586 - DNA, 25 bp, Rattus norvegicus
acaccagttacttccttttcgtgat

SEQ ID NO: 72587 - DNA, 25 bp, Rattus norvegicus
acaccagttccccagtaaatgcaaa

SEQ ID NO: 72588 - DNA, 25 bp, Rattus norvegicus
acaccagttcccgagtaaatgcaaa

SEQ ID NO: 72589 - DNA, 25 bp, Rattus norvegicus
acaccagtttcaccgaggcggcgat

SEQ ID NO: 72590 - DNA, 25 bp, Rattus norvegicus
acaccagtttcagcgaggcggcgat

SEQ ID NO: 72591 - DNA, 25 bp, Rattus norvegicus
acaccagtttctaccacagagtcag

SEQ ID NO: 72592 - DNA, 25 bp, Rattus norvegicus
acaccagtttcttccacagagtcag

SEQ ID NO: 72593 - DNA, 25 bp, Rattus norvegicus
acaccatacattagctgacttccat

SEQ ID NO: 72594 - DNA, 25 bp, Rattus norvegicus
acaccatacatttgctgacttccat

SEQ ID NO: 72595 - DNA, 25 bp, Rattus norvegicus
acaccatactgtaactttacttaca

SEQ ID NO: 72596 - DNA, 25 bp, Rattus norvegicus
acaccatactgttactttacttaca

SEQ ID NO: 72597 - DNA, 25 bp, Rattus norvegicus
acaccatatgtgcacagctattttg

SEQ ID NO: 72598 - DNA, 25 bp, Rattus norvegicus
acaccatatgtggacagctattttg

SEQ ID NO: 72599 - DNA, 25 bp, Rattus norvegicus
acaccatcagttactgggcatctgt

SEQ ID NO: 72600 - DNA, 25 bp, Rattus norvegicus
acaccatcagtttctgggcatctgt

SEQ ID NO: 72601 - DNA, 25 bp, Rattus norvegicus
acaccatcctatccctaacatttat

SEQ ID NO: 72602 - DNA, 25 bp, Rattus norvegicus
acaccatcctatgcctaacatttat

SEQ ID NO: 72603 - DNA, 25 bp, Rattus norvegicus
acaccatcgggaaccagcctgggcg

SEQ ID NO: 72604 - DNA, 25 bp, Rattus norvegicus
acaccatcgggatccagcctgggcg

SEQ ID NO: 72605 - DNA, 25 bp, Rattus norvegicus
acaccatctaccaaagttacacacg

SEQ ID NO: 72606 - DNA, 25 bp, Rattus norvegicus
acaccatctaccagggttttgggca

SEQ ID NO: 72607 - DNA, 25 bp, Rattus norvegicus
acaccatctacctaagttacacacg

SEQ ID NO: 72608 - DNA, 25 bp, Rattus norvegicus
acaccatctacctgggttttgggca

SEQ ID NO: 72609 - DNA, 25 bp, Rattus norvegicus
acaccatctgtcatagagtcctaac

SEQ ID NO: 72610 - DNA, 25 bp, Rattus norvegicus
acaccatctgtcttagagtcctaac

SEQ ID NO: 72611 - DNA, 25 bp, Rattus norvegicus
acaccatgccaccacaaacaaagga

SEQ ID NO: 72612 - DNA, 25 bp, Rattus norvegicus
acaccatgccacgacaaacaaagga

SEQ ID NO: 72613 - DNA, 25 bp, Rattus norvegicus
acaccatgctctcaggtacaactct

SEQ ID NO: 72614 - DNA, 25 bp, Rattus norvegicus
acaccatgctctgaggtacaactct

SEQ ID NO: 72615 - DNA, 25 bp, Rattus norvegicus
acaccatgctgaccggcgtgacaga

SEQ ID NO: 72616 - DNA, 25 bp, Rattus norvegicus
acaccatgctgagcggcgtgacaga

SEQ ID NO: 72617 - DNA, 25 bp, Rattus norvegicus
acaccatggtgtcgagcctgctagc

SEQ ID NO: 72618 - DNA, 25 bp, Rattus norvegicus
acaccatggtgtggagcctgctagc

SEQ ID NO: 72619 - DNA, 25 bp, Rattus norvegicus
acaccatggttcacttcacagctga

SEQ ID NO: 72620 - DNA, 25 bp, Rattus norvegicus
acaccatggttctcttcacagctga

SEQ ID NO: 72621 - DNA, 25 bp, Rattus norvegicus
acaccatgtatacttccctgtggga

SEQ ID NO: 72622 - DNA, 25 bp, Rattus norvegicus
acaccatgtatagttccctgtggga

SEQ ID NO: 72623 - DNA, 25 bp, Rattus norvegicus
acaccatgtattattcctcactagc

SEQ ID NO: 72624 - DNA, 25 bp, Rattus norvegicus
acaccatgtatttttcctcactagc

SEQ ID NO: 72625 - DNA, 25 bp, Rattus norvegicus
acaccatgtggtagccatgttcctg

SEQ ID NO: 72626 - DNA, 25 bp, Rattus norvegicus
acaccatgtggttgccatgttcctg

SEQ ID NO: 72627 - DNA, 25 bp, Rattus norvegicus
acaccatgttccattagtcttagag

SEQ ID NO: 72628 - DNA, 25 bp, Rattus norvegicus
acaccatgttcctttagtcttagag

SEQ ID NO: 72629 - DNA, 25 bp, Rattus norvegicus
acaccattcatgaatccacccaaag

SEQ ID NO: 72630 - DNA, 25 bp, Rattus norvegicus
acaccattcatgtatccacccaaag

SEQ ID NO: 72631 - DNA, 25 bp, Rattus norvegicus
acaccattccctatttgcatgtgag

SEQ ID NO: 72632 - DNA, 25 bp, Rattus norvegicus
acaccattccctttttgcatgtgag

SEQ ID NO: 72633 - DNA, 25 bp, Rattus norvegicus
acaccattgcttcccacagtagaat

SEQ ID NO: 72634 - DNA, 25 bp, Rattus norvegicus
acaccattgcttgccacagtagaat

SEQ ID NO: 72635 - DNA, 25 bp, Rattus norvegicus
acaccattgggcaatctctcagagt

SEQ ID NO: 72636 - DNA, 25 bp, Rattus norvegicus
acaccattgggcatgtcgtcaaact

SEQ ID NO: 72637 - DNA, 25 bp, Rattus norvegicus
acaccattgggctatctctcagagt

SEQ ID NO: 72638 - DNA, 25 bp, Rattus norvegicus
acaccattgggcttgtcgtcaaact

SEQ ID NO: 72639 - DNA, 25 bp, Rattus norvegicus
acaccattgttcctgacacaacaca

SEQ ID NO: 72640 - DNA, 25 bp, Rattus norvegicus
acaccattgttcgtgacacaacaca

SEQ ID NO: 72641 - DNA, 25 bp, Rattus norvegicus
acaccatttcctcttcaatagttgc

SEQ ID NO: 72642 - DNA, 25 bp, Rattus norvegicus
acaccatttcctgttcaatagttgc

SEQ ID NO: 72643 - DNA, 25 bp, Rattus norvegicus
acaccattttctcttgtttctgttc

SEQ ID NO: 72644 - DNA, 25 bp, Rattus norvegicus
acaccattttctgttgtttctgttc

SEQ ID NO: 72645 - DNA, 25 bp, Rattus norvegicus
acacccaactgacttctgctaggta

SEQ ID NO: 72646 - DNA, 25 bp, Rattus norvegicus
acacccaactgagttctgctaggta

SEQ ID NO: 72647 - DNA, 25 bp, Rattus norvegicus
acacccaaggcaaccagagctgtgg

SEQ ID NO: 72648 - DNA, 25 bp, Rattus norvegicus
acacccaaggcatccagagctgtgg

SEQ ID NO: 72649 - DNA, 25 bp, Rattus norvegicus
acacccaaggccctgtcagaaaagt

SEQ ID NO: 72650 - DNA, 25 bp, Rattus norvegicus
acacccaaggccgtgtcagaaaagt

SEQ ID NO: 72651 - DNA, 25 bp, Rattus norvegicus
acacccacaactctagttccaaagg

SEQ ID NO: 72652 - DNA, 25 bp, Rattus norvegicus
acacccacaactgtagttccaaagg

SEQ ID NO: 72653 - DNA, 25 bp, Rattus norvegicus
acacccacaatacctccaggaagta

SEQ ID NO: 72654 - DNA, 25 bp, Rattus norvegicus
acacccacaatagctccaggaagta

SEQ ID NO: 72655 - DNA, 25 bp, Rattus norvegicus
acacccacacccatggatagtgtgt

SEQ ID NO: 72656 - DNA, 25 bp, Rattus norvegicus
acacccacacccttggatagtgtgt

SEQ ID NO: 72657 - DNA, 25 bp, Rattus norvegicus
acacccacagatactcgcaaatatt

SEQ ID NO: 72658 - DNA, 25 bp, Rattus norvegicus
acacccacagattctcgcaaatatt

SEQ ID NO: 72659 - DNA, 25 bp, Rattus norvegicus
acacccagctagaactgaccagttc

SEQ ID NO: 72660 - DNA, 25 bp, Rattus norvegicus
acacccagctagataaagtccttcc

SEQ ID NO: 72661 - DNA, 25 bp, Rattus norvegicus
acacccagctagtactgaccagttc

SEQ ID NO: 72662 - DNA, 25 bp, Rattus norvegicus
acacccagctagttaaagtccttcc

SEQ ID NO: 72663 - DNA, 25 bp, Rattus norvegicus
acacccaggaggatcttttcagact

SEQ ID NO: 72664 - DNA, 25 bp, Rattus norvegicus
acacccaggaggttcttttcagact

SEQ ID NO: 72665 - DNA, 25 bp, Rattus norvegicus
acacccaggtggacagattgcttct

SEQ ID NO: 72666 - DNA, 25 bp, Rattus norvegicus
acacccaggtggtcagattgcttct

SEQ ID NO: 72667 - DNA, 25 bp, Rattus norvegicus
acacccagtgcacttgtcatttgca

SEQ ID NO: 72668 - DNA, 25 bp, Rattus norvegicus
acacccagtgcagttgtcatttgca

SEQ ID NO: 72669 - DNA, 25 bp, Rattus norvegicus
acacccagtggaagagagcgagtct

SEQ ID NO: 72670 - DNA, 25 bp, Rattus norvegicus
acacccagtggatgagagcgagtct

SEQ ID NO: 72671 - DNA, 25 bp, Rattus norvegicus
acacccatccttcaatccattgaaa

SEQ ID NO: 72672 - DNA, 25 bp, Rattus norvegicus
acacccatccttgaatccattgaaa

SEQ ID NO: 72673 - DNA, 25 bp, Rattus norvegicus
acacccatgtgtccagacgtgagac

SEQ ID NO: 72674 - DNA, 25 bp, Rattus norvegicus
acacccatgtgtcctggcgagagga

SEQ ID NO: 72675 - DNA, 25 bp, Rattus norvegicus
acacccatgtgtgcagacgtgagac

SEQ ID NO: 72676 - DNA, 25 bp, Rattus norvegicus
acacccatgtgtgctggcgagagga

SEQ ID NO: 72677 - DNA, 25 bp, Rattus norvegicus
acacccattgtgatctggttctagg

SEQ ID NO: 72678 - DNA, 25 bp, Rattus norvegicus
acacccattgtgttctggttctagg

SEQ ID NO: 72679 - DNA, 25 bp, Rattus norvegicus
acaccccaaaacaggcgctaaggag

SEQ ID NO: 72680 - DNA, 25 bp, Rattus norvegicus
acaccccaaaactggcgctaaggag

SEQ ID NO: 72681 - DNA, 25 bp, Rattus norvegicus
acaccccactgcaactgagtttaag

SEQ ID NO: 72682 - DNA, 25 bp, Rattus norvegicus
acaccccactgctactgagtttaag

SEQ ID NO: 72683 - DNA, 25 bp, Rattus norvegicus
acaccccagctaacttttgagtttc

SEQ ID NO: 72684 - DNA, 25 bp, Rattus norvegicus
acaccccagctatcttttgagtttc

SEQ ID NO: 72685 - DNA, 25 bp, Rattus norvegicus
acaccccagctgaccgggagagaaa

SEQ ID NO: 72686 - DNA, 25 bp, Rattus norvegicus
acaccccagctgtccgggagagaaa

SEQ ID NO: 72687 - DNA, 25 bp, Rattus norvegicus
acaccccagggaacagaatcagcca

SEQ ID NO: 72688 - DNA, 25 bp, Rattus norvegicus
acaccccagggatcagaatcagcca

SEQ ID NO: 72689 - DNA, 25 bp, Rattus norvegicus
acaccccatggaaacactattcctg

SEQ ID NO: 72690 - DNA, 25 bp, Rattus norvegicus
acaccccatggatacactattcctg

SEQ ID NO: 72691 - DNA, 25 bp, Rattus norvegicus
acaccccgcagcacaggagatggag

SEQ ID NO: 72692 - DNA, 25 bp, Rattus norvegicus
acaccccgcagctcaggagatggag

SEQ ID NO: 72693 - DNA, 25 bp, Rattus norvegicus
acaccccggacgctgaggcacgagt

SEQ ID NO: 72694 - DNA, 25 bp, Rattus norvegicus
acaccccggacggtgaggcacgagt

SEQ ID NO: 72695 - DNA, 25 bp, Rattus norvegicus
acaccccgtctcagaagatgagctg

SEQ ID NO: 72696 - DNA, 25 bp, Rattus norvegicus
acaccccgtctctgaagatgagctg

SEQ ID NO: 72697 - DNA, 25 bp, Rattus norvegicus
acacccctatgtaatgctgagtcag

SEQ ID NO: 72698 - DNA, 25 bp, Rattus norvegicus
acacccctatgttatgctgagtcag

SEQ ID NO: 72699 - DNA, 25 bp, Rattus norvegicus
acacccctcaaaatgctttgtttca

SEQ ID NO: 72700 - DNA, 25 bp, Rattus norvegicus
acacccctcaaattgctttgtttca

SEQ ID NO: 72701 - DNA, 25 bp, Rattus norvegicus
acacccctccacaacagattgagtg

SEQ ID NO: 72702 - DNA, 25 bp, Rattus norvegicus
acacccctccactacagattgagtg

SEQ ID NO: 72703 - DNA, 25 bp, Rattus norvegicus
acacccctctgtatagccaatagag

SEQ ID NO: 72704 - DNA, 25 bp, Rattus norvegicus
acacccctctgtttagccaatagag

SEQ ID NO: 72705 - DNA, 25 bp, Rattus norvegicus
acacccctttccaagttctcatgaa

SEQ ID NO: 72706 - DNA, 25 bp, Rattus norvegicus
acacccctttcctagttctcatgaa

SEQ ID NO: 72707 - DNA, 25 bp, Rattus norvegicus
acacccctttggctttgcatgctat

SEQ ID NO: 72708 - DNA, 25 bp, Rattus norvegicus
acacccctttgggtttgcatgctat

SEQ ID NO: 72709 - DNA, 25 bp, Rattus norvegicus
acacccgaggagactatgcggctga

SEQ ID NO: 72710 - DNA, 25 bp, Rattus norvegicus
acacccgaggagtctatgcggctga

SEQ ID NO: 72711 - DNA, 25 bp, Rattus norvegicus
acacccgcatacatctcatgatagt

SEQ ID NO: 72712 - DNA, 25 bp, Rattus norvegicus
acacccgcatacttctcatgatagt

SEQ ID NO: 72713 - DNA, 25 bp, Rattus norvegicus
acacccgccattatgtccagtaagt

SEQ ID NO: 72714 - DNA, 25 bp, Rattus norvegicus
acacccgccattttgtccagtaagt

SEQ ID NO: 72715 - DNA, 25 bp, Rattus norvegicus
acacccgccggaagtacatatgcgc

SEQ ID NO: 72716 - DNA, 25 bp, Rattus norvegicus
acacccgccggatgtacatatgcgc

SEQ ID NO: 72717 - DNA, 25 bp, Rattus norvegicus
acacccgctactacaagggtggctt

SEQ ID NO: 72718 - DNA, 25 bp, Rattus norvegicus
acacccgctacttcaagggtggctt

SEQ ID NO: 72719 - DNA, 25 bp, Rattus norvegicus
acacccgcttcaaggacgacgagga

SEQ ID NO: 72720 - DNA, 25 bp, Rattus norvegicus
acacccgcttcatggacgacgagga

SEQ ID NO: 72721 - DNA, 25 bp, Rattus norvegicus
acacccggctttactagagcagagc

SEQ ID NO: 72722 - DNA, 25 bp, Rattus norvegicus
acacccggcttttctagagcagagc

SEQ ID NO: 72723 - DNA, 25 bp, Rattus norvegicus
acacccgggattccctatgtgctag

SEQ ID NO: 72724 - DNA, 25 bp, Rattus norvegicus
acacccgggattgcctatgtgctag

SEQ ID NO: 72725 - DNA, 25 bp, Rattus norvegicus
acacccgggcttcgttcgtatacat

SEQ ID NO: 72726 - DNA, 25 bp, Rattus norvegicus
acacccgggcttggttcgtatacat

SEQ ID NO: 72727 - DNA, 25 bp, Rattus norvegicus
acacccggtgcaattgaacaggcca

SEQ ID NO: 72728 - DNA, 25 bp, Rattus norvegicus
acacccggtgcatttgaacaggcca

SEQ ID NO: 72729 - DNA, 25 bp, Rattus norvegicus
acacccggttttagctgtgccacaa

SEQ ID NO: 72730 - DNA, 25 bp, Rattus norvegicus
acacccggtttttgctgtgccacaa

SEQ ID NO: 72731 - DNA, 25 bp, Rattus norvegicus
acacccgtactgacatggaggagat

SEQ ID NO: 72732 - DNA, 25 bp, Rattus norvegicus
acacccgtactgtcatggaggagat

SEQ ID NO: 72733 - DNA, 25 bp, Rattus norvegicus
acacccgtcatcagtgagttggcgc

SEQ ID NO: 72734 - DNA, 25 bp, Rattus norvegicus
acacccgtcatctgtgagttggcgc

SEQ ID NO: 72735 - DNA, 25 bp, Rattus norvegicus
acacccgtgaccatgcaggttggag

SEQ ID NO: 72736 - DNA, 25 bp, Rattus norvegicus
acacccgtgaccttgcaggttggag

SEQ ID NO: 72737 - DNA, 25 bp, Rattus norvegicus
acacccgtgttactacatgaccata

SEQ ID NO: 72738 - DNA, 25 bp, Rattus norvegicus
acacccgtgttagtacatgaccata

SEQ ID NO: 72739 - DNA, 25 bp, Rattus norvegicus
acaccctaaggcattattattctat

SEQ ID NO: 72740 - DNA, 25 bp, Rattus norvegicus
acaccctaaggctttattattctat

SEQ ID NO: 72741 - DNA, 25 bp, Rattus norvegicus
acaccctagcatattccttttagct

SEQ ID NO: 72742 - DNA, 25 bp, Rattus norvegicus
acaccctagcattttccttttagct

SEQ ID NO: 72743 - DNA, 25 bp, Rattus norvegicus
acaccctattccacaggctgtaatt

SEQ ID NO: 72744 - DNA, 25 bp, Rattus norvegicus
acaccctattcctcaggctgtaatt

SEQ ID NO: 72745 - DNA, 25 bp, Rattus norvegicus
acaccctcaactctgcggaagtgaa

SEQ ID NO: 72746 - DNA, 25 bp, Rattus norvegicus
acaccctcaactgtgcggaagtgaa

SEQ ID NO: 72747 - DNA, 25 bp, Rattus norvegicus
acaccctcagctcagcagggtctag

SEQ ID NO: 72748 - DNA, 25 bp, Rattus norvegicus
acaccctcagctgagcagggtctag

SEQ ID NO: 72749 - DNA, 25 bp, Rattus norvegicus
acaccctcagggaaagaggaagact

SEQ ID NO: 72750 - DNA, 25 bp, Rattus norvegicus
acaccctcagggtaagaggaagact

SEQ ID NO: 72751 - DNA, 25 bp, Rattus norvegicus
acaccctctcagagcaggtccgttg

SEQ ID NO: 72752 - DNA, 25 bp, Rattus norvegicus
acaccctctcagtgcaggtccgttg

SEQ ID NO: 72753 - DNA, 25 bp, Rattus norvegicus
acaccctctggtcgctactgagaaa

SEQ ID NO: 72754 - DNA, 25 bp, Rattus norvegicus
acaccctctggtcttactgccagta

SEQ ID NO: 72755 - DNA, 25 bp, Rattus norvegicus
acaccctctggtggctactgagaaa

SEQ ID NO: 72756 - DNA, 25 bp, Rattus norvegicus
acaccctctggtgttactgccagta

SEQ ID NO: 72757 - DNA, 25 bp, Rattus norvegicus
acaccctctgtacgacactgggaga

SEQ ID NO: 72758 - DNA, 25 bp, Rattus norvegicus
acaccctctgtaggacactgggaga

SEQ ID NO: 72759 - DNA, 25 bp, Rattus norvegicus
acaccctctgtcacaagaatgtttc

SEQ ID NO: 72760 - DNA, 25 bp, Rattus norvegicus
acaccctctgtctcaagaatgtttc

SEQ ID NO: 72761 - DNA, 25 bp, Rattus norvegicus
acaccctcttacatctgagcttggt

SEQ ID NO: 72762 - DNA, 25 bp, Rattus norvegicus
acaccctcttacttctgagcttggt

SEQ ID NO: 72763 - DNA, 25 bp, Rattus norvegicus
acaccctgacttctaggcttcatgc

SEQ ID NO: 72764 - DNA, 25 bp, Rattus norvegicus
acaccctgacttgtaggcttcatgc

SEQ ID NO: 72765 - DNA, 25 bp, Rattus norvegicus
acaccctgatagcacaatctctggg

SEQ ID NO: 72766 - DNA, 25 bp, Rattus norvegicus
acaccctgataggacaatctctggg

SEQ ID NO: 72767 - DNA, 25 bp, Rattus norvegicus
acaccctgcaggacatttaacatcc

SEQ ID NO: 72768 - DNA, 25 bp, Rattus norvegicus
acaccctgcaggtcatttaacatcc

SEQ ID NO: 72769 - DNA, 25 bp, Rattus norvegicus
acaccctgcagtaaatcctcagaag

SEQ ID NO: 72770 - DNA, 25 bp, Rattus norvegicus
acaccctgcagttaatcctcagaag

SEQ ID NO: 72771 - DNA, 25 bp, Rattus norvegicus
acaccctgcgggagactatcaagtt

SEQ ID NO: 72772 - DNA, 25 bp, Rattus norvegicus
acaccctgcgggtgactatcaagtt

SEQ ID NO: 72773 - DNA, 25 bp, Rattus norvegicus
acaccctgctcaaagctttgtaaga

SEQ ID NO: 72774 - DNA, 25 bp, Rattus norvegicus
acaccctgctcaaggccagattgtc

SEQ ID NO: 72775 - DNA, 25 bp, Rattus norvegicus
acaccctgctcatagctttgtaaga

SEQ ID NO: 72776 - DNA, 25 bp, Rattus norvegicus
acaccctgctcatggccagattgtc

SEQ ID NO: 72777 - DNA, 25 bp, Rattus norvegicus
acaccctggactcttacacttgagt

SEQ ID NO: 72778 - DNA, 25 bp, Rattus norvegicus
acaccctggactcttgctgatggta

SEQ ID NO: 72779 - DNA, 25 bp, Rattus norvegicus
acaccctggactgttacacttgagt

SEQ ID NO: 72780 - DNA, 25 bp, Rattus norvegicus
acaccctggactgttgctgatggta

SEQ ID NO: 72781 - DNA, 25 bp, Rattus norvegicus
acaccctggatgatggccatacgaa

SEQ ID NO: 72782 - DNA, 25 bp, Rattus norvegicus
acaccctggatgttggccatacgaa

SEQ ID NO: 72783 - DNA, 25 bp, Rattus norvegicus
acaccctggcgtaaacagatactgg

SEQ ID NO: 72784 - DNA, 25 bp, Rattus norvegicus
acaccctggcgttaacagatactgg

SEQ ID NO: 72785 - DNA, 25 bp, Rattus norvegicus
acaccctggctaagtgtagctctga

SEQ ID NO: 72786 - DNA, 25 bp, Rattus norvegicus
acaccctggctatgtgtagctctga

SEQ ID NO: 72787 - DNA, 25 bp, Rattus norvegicus
acaccctgtcaccagtcaaaaggaa

SEQ ID NO: 72788 - DNA, 25 bp, Rattus norvegicus
acaccctgtcacgagtcaaaaggaa

SEQ ID NO: 72789 - DNA, 25 bp, Rattus norvegicus
acacccttatacacagacactctga

SEQ ID NO: 72790 - DNA, 25 bp, Rattus norvegicus
acacccttatactcagacactctga

SEQ ID NO: 72791 - DNA, 25 bp, Rattus norvegicus
acacccttgcctcgtggtgagcagg

SEQ ID NO: 72792 - DNA, 25 bp, Rattus norvegicus
acacccttgcctggtggtgagcagg

SEQ ID NO: 72793 - DNA, 25 bp, Rattus norvegicus
acacccttgtttagagaacctcact

SEQ ID NO: 72794 - DNA, 25 bp, Rattus norvegicus
acacccttgttttgagaacctcact

SEQ ID NO: 72795 - DNA, 25 bp, Rattus norvegicus
acaccctttagaccctacatgttca

SEQ ID NO: 72796 - DNA, 25 bp, Rattus norvegicus
acaccctttagagcctacatgttca

SEQ ID NO: 72797 - DNA, 25 bp, Rattus norvegicus
acaccctttgctcctagatgggagg

SEQ ID NO: 72798 - DNA, 25 bp, Rattus norvegicus
acaccctttgctgctagatgggagg

SEQ ID NO: 72799 - DNA, 25 bp, Rattus norvegicus
acaccgaaacagcatccctggaaag

SEQ ID NO: 72800 - DNA, 25 bp, Rattus norvegicus
acaccgaaacaggatccctggaaag

SEQ ID NO: 72801 - DNA, 25 bp, Rattus norvegicus
acaccgaactgtatctgagctagga

SEQ ID NO: 72802 - DNA, 25 bp, Rattus norvegicus
acaccgaactgtttctgagctagga

SEQ ID NO: 72803 - DNA, 25 bp, Rattus norvegicus
acaccgacagtcactttagggcatg

SEQ ID NO: 72804 - DNA, 25 bp, Rattus norvegicus
acaccgacagtctctttagggcatg

SEQ ID NO: 72805 - DNA, 25 bp, Rattus norvegicus
acaccgaccggaatgatactgtcat

SEQ ID NO: 72806 - DNA, 25 bp, Rattus norvegicus
acaccgaccggattgatactgtcat

SEQ ID NO: 72807 - DNA, 25 bp, Rattus norvegicus
acaccgacctgcatttcatgagcga

SEQ ID NO: 72808 - DNA, 25 bp, Rattus norvegicus
acaccgacctgcttttcatgagcga

SEQ ID NO: 72809 - DNA, 25 bp, Rattus norvegicus
acaccgagaggtccttcgtcattga

SEQ ID NO: 72810 - DNA, 25 bp, Rattus norvegicus
acaccgagaggtgcttcgtcattga

SEQ ID NO: 72811 - DNA, 25 bp, Rattus norvegicus
acaccgagatatcctatggcctgaa

SEQ ID NO: 72812 - DNA, 25 bp, Rattus norvegicus
acaccgagatatgctatggcctgaa

SEQ ID NO: 72813 - DNA, 25 bp, Rattus norvegicus
acaccgagcttgaggccgagttgga

SEQ ID NO: 72814 - DNA, 25 bp, Rattus norvegicus
acaccgagcttgtggccgagttgga

SEQ ID NO: 72815 - DNA, 25 bp, Rattus norvegicus
acaccgagggtgatatttcttttag

SEQ ID NO: 72816 - DNA, 25 bp, Rattus norvegicus
acaccgagggtgttatttcttttag

SEQ ID NO: 72817 - DNA, 25 bp, Rattus norvegicus
acaccgagtaatacagagcagcctg

SEQ ID NO: 72818 - DNA, 25 bp, Rattus norvegicus
acaccgagtaattcagagcagcctg

SEQ ID NO: 72819 - DNA, 25 bp, Rattus norvegicus
acaccgagtgtgacttcaggctgaa

SEQ ID NO: 72820 - DNA, 25 bp, Rattus norvegicus
acaccgagtgtgtcttcaggctgaa

SEQ ID NO: 72821 - DNA, 25 bp, Rattus norvegicus
acaccgagttctcatgcagactggg

SEQ ID NO: 72822 - DNA, 25 bp, Rattus norvegicus
acaccgagttctgatgcagactggg

SEQ ID NO: 72823 - DNA, 25 bp, Rattus norvegicus
acaccgatcctgattgtagcgagtc

SEQ ID NO: 72824 - DNA, 25 bp, Rattus norvegicus
acaccgatcctgtttgtagcgagtc

SEQ ID NO: 72825 - DNA, 25 bp, Rattus norvegicus
acaccgatgggcagaagctacttct

SEQ ID NO: 72826 - DNA, 25 bp, Rattus norvegicus
acaccgatgggctgaagctacttct

SEQ ID NO: 72827 - DNA, 25 bp, Rattus norvegicus
acaccgatggtcagtcagtgtctaa

SEQ ID NO: 72828 - DNA, 25 bp, Rattus norvegicus
acaccgatggtctgtcagtgtctaa

SEQ ID NO: 72829 - DNA, 25 bp, Rattus norvegicus
acaccgattatcacaaggcagccat

SEQ ID NO: 72830 - DNA, 25 bp, Rattus norvegicus
acaccgattatctcaaggcagccat

SEQ ID NO: 72831 - DNA, 25 bp, Rattus norvegicus
acaccgattgtgatccagctctgaa

SEQ ID NO: 72832 - DNA, 25 bp, Rattus norvegicus
acaccgattgtgttccagctctgaa

SEQ ID NO: 72833 - DNA, 25 bp, Rattus norvegicus
acaccgattttcatcccagaataca

SEQ ID NO: 72834 - DNA, 25 bp, Rattus norvegicus
acaccgattttcttcccagaataca

SEQ ID NO: 72835 - DNA, 25 bp, Rattus norvegicus
acaccgcagggaagagccagggcat

SEQ ID NO: 72836 - DNA, 25 bp, Rattus norvegicus
acaccgcagggatgagccagggcat

SEQ ID NO: 72837 - DNA, 25 bp, Rattus norvegicus
acaccgccagaaaatcacttcagtt

SEQ ID NO: 72838 - DNA, 25 bp, Rattus norvegicus
acaccgccagaatatcacttcagtt

SEQ ID NO: 72839 - DNA, 25 bp, Rattus norvegicus
acaccgccagggacaggctggctag

SEQ ID NO: 72840 - DNA, 25 bp, Rattus norvegicus
acaccgccagggtcaggctggctag

SEQ ID NO: 72841 - DNA, 25 bp, Rattus norvegicus
acaccgccatcacctatttaaatat

SEQ ID NO: 72842 - DNA, 25 bp, Rattus norvegicus
acaccgccatcagctatttaaatat

SEQ ID NO: 72843 - DNA, 25 bp, Rattus norvegicus
acaccgcccgtgcagggctgggctg

SEQ ID NO: 72844 - DNA, 25 bp, Rattus norvegicus
acaccgcccgtggagggctgggctg

SEQ ID NO: 72845 - DNA, 25 bp, Rattus norvegicus
acaccgccctctatgtttataacaa

SEQ ID NO: 72846 - DNA, 25 bp, Rattus norvegicus
acaccgccctctttgtttataacaa

SEQ ID NO: 72847 - DNA, 25 bp, Rattus norvegicus
acaccgcgcgttaccggcagtcggt

SEQ ID NO: 72848 - DNA, 25 bp, Rattus norvegicus
acaccgcgcgtttccggcagtcggt

SEQ ID NO: 72849 - DNA, 25 bp, Rattus norvegicus
acaccgcttctcattgcaggttaat

SEQ ID NO: 72850 - DNA, 25 bp, Rattus norvegicus
acaccgcttctctttgcaggttaat

SEQ ID NO: 72851 - DNA, 25 bp, Rattus norvegicus
acaccgctttgtcctggaacacgaa

SEQ ID NO: 72852 - DNA, 25 bp, Rattus norvegicus
acaccgctttgtgctggaacacgaa

SEQ ID NO: 72853 - DNA, 25 bp, Rattus norvegicus
acaccggagtccaagtggctaaact

SEQ ID NO: 72854 - DNA, 25 bp, Rattus norvegicus
acaccggagtcctagtggctaaact

SEQ ID NO: 72855 - DNA, 25 bp, Rattus norvegicus
acaccggctcctattcagtttgaag

SEQ ID NO: 72856 - DNA, 25 bp, Rattus norvegicus
acaccggctccttttcagtttgaag

SEQ ID NO: 72857 - DNA, 25 bp, Rattus norvegicus
acaccggctggtcaacgagtgctta

SEQ ID NO: 72858 - DNA, 25 bp, Rattus norvegicus
acaccggctggtgaacgagtgctta

SEQ ID NO: 72859 - DNA, 25 bp, Rattus norvegicus
acaccgggacagacacgatggtcat

SEQ ID NO: 72860 - DNA, 25 bp, Rattus norvegicus
acaccgggacagtcacgatggtcat

SEQ ID NO: 72861 - DNA, 25 bp, Rattus norvegicus
acaccgggagtcaagtcagcgatga

SEQ ID NO: 72862 - DNA, 25 bp, Rattus norvegicus
acaccgggagtcacttgattgcagc

SEQ ID NO: 72863 - DNA, 25 bp, Rattus norvegicus
acaccgggagtctagtcagcgatga

SEQ ID NO: 72864 - DNA, 25 bp, Rattus norvegicus
acaccgggagtctcttgattgcagc

SEQ ID NO: 72865 - DNA, 25 bp, Rattus norvegicus
acaccgggatgacccagttgtgcct

SEQ ID NO: 72866 - DNA, 25 bp, Rattus norvegicus
acaccgggatgagccagttgtgcct

SEQ ID NO: 72867 - DNA, 25 bp, Rattus norvegicus
acaccggtagaaacaccatctgcca

SEQ ID NO: 72868 - DNA, 25 bp, Rattus norvegicus
acaccggtagaatcaccatctgcca

SEQ ID NO: 72869 - DNA, 25 bp, Rattus norvegicus
acaccggtgcctctggagtttgtac

SEQ ID NO: 72870 - DNA, 25 bp, Rattus norvegicus
acaccggtgcctgtggagtttgtac

SEQ ID NO: 72871 - DNA, 25 bp, Rattus norvegicus
acaccggtggttaaagatcctctat

SEQ ID NO: 72872 - DNA, 25 bp, Rattus norvegicus
acaccggtggtttaagatcctctat

SEQ ID NO: 72873 - DNA, 25 bp, Rattus norvegicus
acaccggtgtgtcctatggcatcaa

SEQ ID NO: 72874 - DNA, 25 bp, Rattus norvegicus
acaccggtgtgtgctatggcatcaa

SEQ ID NO: 72875 - DNA, 25 bp, Rattus norvegicus
acaccgtacacacacatgagctggg

SEQ ID NO: 72876 - DNA, 25 bp, Rattus norvegicus
acaccgtacacagacatgagctggg

SEQ ID NO: 72877 - DNA, 25 bp, Rattus norvegicus
acaccgtactgccaaggtatgccca

SEQ ID NO: 72878 - DNA, 25 bp, Rattus norvegicus
acaccgtactgcgaaggtatgccca

SEQ ID NO: 72879 - DNA, 25 bp, Rattus norvegicus
acaccgtcgggtagcccaagtagat

SEQ ID NO: 72880 - DNA, 25 bp, Rattus norvegicus
acaccgtcgggttgcccaagtagat

SEQ ID NO: 72881 - DNA, 25 bp, Rattus norvegicus
acaccgtgagctcggtattgggcac

SEQ ID NO: 72882 - DNA, 25 bp, Rattus norvegicus
acaccgtgagctgggtattgggcac

SEQ ID NO: 72883 - DNA, 25 bp, Rattus norvegicus
acaccgtgcagaacttcgtggttat

SEQ ID NO: 72884 - DNA, 25 bp, Rattus norvegicus
acaccgtgcagatcttcgtggttat

SEQ ID NO: 72885 - DNA, 25 bp, Rattus norvegicus
acaccgtgctgacagttgctgtgtt

SEQ ID NO: 72886 - DNA, 25 bp, Rattus norvegicus
acaccgtgctgagagttgctgtgtt

SEQ ID NO: 72887 - DNA, 25 bp, Rattus norvegicus
acaccgtgtaacagcgtttctgagt

SEQ ID NO: 72888 - DNA, 25 bp, Rattus norvegicus
acaccgtgtaactgcgtttctgagt

SEQ ID NO: 72889 - DNA, 25 bp, Rattus norvegicus
acaccgtgtaccaggttgattgtca

SEQ ID NO: 72890 - DNA, 25 bp, Rattus norvegicus
acaccgtgtacctggttgattgtca

SEQ ID NO: 72891 - DNA, 25 bp, Rattus norvegicus
acaccgtgtgggaccaacggcagcg

SEQ ID NO: 72892 - DNA, 25 bp, Rattus norvegicus
acaccgtgtgggtccaacggcagcg

SEQ ID NO: 72893 - DNA, 25 bp, Rattus norvegicus
acaccgttctcaccagttactggtc

SEQ ID NO: 72894 - DNA, 25 bp, Rattus norvegicus
acaccgttctcagcagttactggtc

SEQ ID NO: 72895 - DNA, 25 bp, Rattus norvegicus
acaccgttctggcagaagagcggac

SEQ ID NO: 72896 - DNA, 25 bp, Rattus norvegicus
acaccgttctgggagaagagcggac

SEQ ID NO: 72897 - DNA, 25 bp, Rattus norvegicus
acaccgttgctcagtgctgaactat

SEQ ID NO: 72898 - DNA, 25 bp, Rattus norvegicus
acaccgttgctctgtgctgaactat

SEQ ID NO: 72899 - DNA, 25 bp, Rattus norvegicus
acacctaacctgcatgtcatcgaaa

SEQ ID NO: 72900 - DNA, 25 bp, Rattus norvegicus
acacctaacctggatgtcatcgaaa

SEQ ID NO: 72901 - DNA, 25 bp, Rattus norvegicus
acacctaacttaatccattatggag

SEQ ID NO: 72902 - DNA, 25 bp, Rattus norvegicus
acacctaacttattccattatggag

SEQ ID NO: 72903 - DNA, 25 bp, Rattus norvegicus
acacctaagtgtaggacatgtcctt

SEQ ID NO: 72904 - DNA, 25 bp, Rattus norvegicus
acacctaagtgttggacatgtcctt

SEQ ID NO: 72905 - DNA, 25 bp, Rattus norvegicus
acacctaattttagcctggcctatg

SEQ ID NO: 72906 - DNA, 25 bp, Rattus norvegicus
acacctaatttttgcctggcctatg

SEQ ID NO: 72907 - DNA, 25 bp, Rattus norvegicus
acacctacaaccaagttttcacatt

SEQ ID NO: 72908 - DNA, 25 bp, Rattus norvegicus
acacctacaacctagttttcacatt

SEQ ID NO: 72909 - DNA, 25 bp, Rattus norvegicus
acacctacatatatgtcctgctctt

SEQ ID NO: 72910 - DNA, 25 bp, Rattus norvegicus
acacctacatatttgtcctgctctt

SEQ ID NO: 72911 - DNA, 25 bp, Rattus norvegicus
acacctacatttaacggctgtggta

SEQ ID NO: 72912 - DNA, 25 bp, Rattus norvegicus
acacctacattttacggctgtggta

SEQ ID NO: 72913 - DNA, 25 bp, Rattus norvegicus
acacctacccagatatctgttctta

SEQ ID NO: 72914 - DNA, 25 bp, Rattus norvegicus
acacctacccagttatctgttctta

SEQ ID NO: 72915 - DNA, 25 bp, Rattus norvegicus
acacctacggtgaacaatgtgaatt

SEQ ID NO: 72916 - DNA, 25 bp, Rattus norvegicus
acacctacggtgtacaatgtgaatt

SEQ ID NO: 72917 - DNA, 25 bp, Rattus norvegicus
acacctagaagtattagcctggaca

SEQ ID NO: 72918 - DNA, 25 bp, Rattus norvegicus
acacctagaagttttagcctggaca

SEQ ID NO: 72919 - DNA, 25 bp, Rattus norvegicus
acacctagtagtcagatgcccaaca

SEQ ID NO: 72920 - DNA, 25 bp, Rattus norvegicus
acacctagtagtgagatgcccaaca

SEQ ID NO: 72921 - DNA, 25 bp, Rattus norvegicus
acacctatccacaaacaactgagct

SEQ ID NO: 72922 - DNA, 25 bp, Rattus norvegicus
acacctatccactaacaactgagct

SEQ ID NO: 72923 - DNA, 25 bp, Rattus norvegicus
acacctatgggtcctggccagtgac

SEQ ID NO: 72924 - DNA, 25 bp, Rattus norvegicus
acacctatgggtgctggccagtgac

SEQ ID NO: 72925 - DNA, 25 bp, Rattus norvegicus
acacctatgtgtagttcttgcatgg

SEQ ID NO: 72926 - DNA, 25 bp, Rattus norvegicus
acacctatgtgttgttcttgcatgg

SEQ ID NO: 72927 - DNA, 25 bp, Rattus norvegicus
acacctattagaaccgtttccattg

SEQ ID NO: 72928 - DNA, 25 bp, Rattus norvegicus
acacctattagatccgtttccattg

SEQ ID NO: 72929 - DNA, 25 bp, Rattus norvegicus
acacctattatgataatcctgggat

SEQ ID NO: 72930 - DNA, 25 bp, Rattus norvegicus
acacctattatgttaatcctgggat

SEQ ID NO: 72931 - DNA, 25 bp, Rattus norvegicus
acacctcaagaactccttttctggg

SEQ ID NO: 72932 - DNA, 25 bp, Rattus norvegicus
acacctcaagaagtccttttctggg

SEQ ID NO: 72933 - DNA, 25 bp, Rattus norvegicus
acacctcacatcagctctgtgtcta

SEQ ID NO: 72934 - DNA, 25 bp, Rattus norvegicus
acacctcacatctgctctgtgtcta

SEQ ID NO: 72935 - DNA, 25 bp, Rattus norvegicus
acacctcagagtcaaagtccaatgg

SEQ ID NO: 72936 - DNA, 25 bp, Rattus norvegicus
acacctcagagtgaaagtccaatgg

SEQ ID NO: 72937 - DNA, 25 bp, Rattus norvegicus
acacctcaggagaaagaagctatag

SEQ ID NO: 72938 - DNA, 25 bp, Rattus norvegicus
acacctcaggagtaagaagctatag

SEQ ID NO: 72939 - DNA, 25 bp, Rattus norvegicus
acacctcatgccaggttgtttctat

SEQ ID NO: 72940 - DNA, 25 bp, Rattus norvegicus
acacctcatgcctggttgtttctat

SEQ ID NO: 72941 - DNA, 25 bp, Rattus norvegicus
acacctcatgctagcctcatgaaac

SEQ ID NO: 72942 - DNA, 25 bp, Rattus norvegicus
acacctcatgctcctgaagttcaac

SEQ ID NO: 72943 - DNA, 25 bp, Rattus norvegicus
acacctcatgctgctgaagttcaac

SEQ ID NO: 72944 - DNA, 25 bp, Rattus norvegicus
acacctcatgcttgcctcatgaaac

SEQ ID NO: 72945 - DNA, 25 bp, Rattus norvegicus
acacctcatggcagtggtatgtaca

SEQ ID NO: 72946 - DNA, 25 bp, Rattus norvegicus
acacctcatggctgtggtatgtaca

SEQ ID NO: 72947 - DNA, 25 bp, Rattus norvegicus
acacctcattacattatcttctaca

SEQ ID NO: 72948 - DNA, 25 bp, Rattus norvegicus
acacctcattactttatcttctaca

SEQ ID NO: 72949 - DNA, 25 bp, Rattus norvegicus
acacctccttctaccagacaatgga

SEQ ID NO: 72950 - DNA, 25 bp, Rattus norvegicus
acacctccttcttccagacaatgga

SEQ ID NO: 72951 - DNA, 25 bp, Rattus norvegicus
acacctcgagtcacaggagctggat

SEQ ID NO: 72952 - DNA, 25 bp, Rattus norvegicus
acacctcgagtctcaggagctggat

SEQ ID NO: 72953 - DNA, 25 bp, Rattus norvegicus
acacctcgagtgacatcaagtatga

SEQ ID NO: 72954 - DNA, 25 bp, Rattus norvegicus
acacctcgagtgtcatcaagtatga

SEQ ID NO: 72955 - DNA, 25 bp, Rattus norvegicus
acacctcgatcaccagtatgtgctg

SEQ ID NO: 72956 - DNA, 25 bp, Rattus norvegicus
acacctcgatcagcagtatgtgctg

SEQ ID NO: 72957 - DNA, 25 bp, Rattus norvegicus
acacctcgtagtattccaccattat

SEQ ID NO: 72958 - DNA, 25 bp, Rattus norvegicus
acacctcgtagttttccaccattat

SEQ ID NO: 72959 - DNA, 25 bp, Rattus norvegicus
acacctctaagtcctagcttgttaa

SEQ ID NO: 72960 - DNA, 25 bp, Rattus norvegicus
acacctctaagtgctagcttgttaa

SEQ ID NO: 72961 - DNA, 25 bp, Rattus norvegicus
acacctctacttcgaaatgggacag

SEQ ID NO: 72962 - DNA, 25 bp, Rattus norvegicus
acacctctacttggaaatgggacag

SEQ ID NO: 72963 - DNA, 25 bp, Rattus norvegicus
acacctctatcacatcgacttcggg

SEQ ID NO: 72964 - DNA, 25 bp, Rattus norvegicus
acacctctatcagatcgacttcggg

SEQ ID NO: 72965 - DNA, 25 bp, Rattus norvegicus
acacctctatgcaacagagtctcac

SEQ ID NO: 72966 - DNA, 25 bp, Rattus norvegicus
acacctctatgctacagagtctcac

SEQ ID NO: 72967 - DNA, 25 bp, Rattus norvegicus
acacctctattcctagtgtacttgc

SEQ ID NO: 72968 - DNA, 25 bp, Rattus norvegicus
acacctctattcgtagtgtacttgc

SEQ ID NO: 72969 - DNA, 25 bp, Rattus norvegicus
acacctctccctcatgttgaagatt

SEQ ID NO: 72970 - DNA, 25 bp, Rattus norvegicus
acacctctccctgatgttgaagatt

SEQ ID NO: 72971 - DNA, 25 bp, Rattus norvegicus
acacctctctctaggcaactaggga

SEQ ID NO: 72972 - DNA, 25 bp, Rattus norvegicus
acacctctctcttggcaactaggga

SEQ ID NO: 72973 - DNA, 25 bp, Rattus norvegicus
acacctctgagaatgcatcctcttc

SEQ ID NO: 72974 - DNA, 25 bp, Rattus norvegicus
acacctctgagattgcatcctcttc

SEQ ID NO: 72975 - DNA, 25 bp, Rattus norvegicus
acacctctgattccattctgtgcta

SEQ ID NO: 72976 - DNA, 25 bp, Rattus norvegicus
acacctctgattgcattctgtgcta

SEQ ID NO: 72977 - DNA, 25 bp, Rattus norvegicus
acacctctggcgctatcagggactg

SEQ ID NO: 72978 - DNA, 25 bp, Rattus norvegicus
acacctctggcggtatcagggactg

SEQ ID NO: 72979 - DNA, 25 bp, Rattus norvegicus
acacctctggtcattaaggacacct

SEQ ID NO: 72980 - DNA, 25 bp, Rattus norvegicus
acacctctggtctttaaggacacct

SEQ ID NO: 72981 - DNA, 25 bp, Rattus norvegicus
acacctctggttactgtgtctcaga

SEQ ID NO: 72982 - DNA, 25 bp, Rattus norvegicus
acacctctggtttctgtgtctcaga

SEQ ID NO: 72983 - DNA, 25 bp, Rattus norvegicus
acacctcttaatcggaccctcatat

SEQ ID NO: 72984 - DNA, 25 bp, Rattus norvegicus
acacctcttaatgggaccctcatat

SEQ ID NO: 72985 - DNA, 25 bp, Rattus norvegicus
acacctcttattcacctgccgaagc

SEQ ID NO: 72986 - DNA, 25 bp, Rattus norvegicus
acacctcttattgacctgccgaagc

SEQ ID NO: 72987 - DNA, 25 bp, Rattus norvegicus
acacctcttcagcattccagagggt

SEQ ID NO: 72988 - DNA, 25 bp, Rattus norvegicus
acacctcttcaggattccagagggt

SEQ ID NO: 72989 - DNA, 25 bp, Rattus norvegicus
acacctgaagggactgctctgactg

SEQ ID NO: 72990 - DNA, 25 bp, Rattus norvegicus
acacctgaagggtctgctctgactg

SEQ ID NO: 72991 - DNA, 25 bp, Rattus norvegicus
acacctgacagtagttcttgataag

SEQ ID NO: 72992 - DNA, 25 bp, Rattus norvegicus
acacctgacagttgttcttgataag

SEQ ID NO: 72993 - DNA, 25 bp, Rattus norvegicus
acacctgagggaacctgagggctga

SEQ ID NO: 72994 - DNA, 25 bp, Rattus norvegicus
acacctgagggatcctgagggctga

SEQ ID NO: 72995 - DNA, 25 bp, Rattus norvegicus
acacctgagggcagcagcactgttc

SEQ ID NO: 72996 - DNA, 25 bp, Rattus norvegicus
acacctgagggctgcagcactgttc

SEQ ID NO: 72997 - DNA, 25 bp, Rattus norvegicus
acacctgatgtgactgtgttcttgg

SEQ ID NO: 72998 - DNA, 25 bp, Rattus norvegicus
acacctgatgtgtctgtgttcttgg

SEQ ID NO: 72999 - DNA, 25 bp, Rattus norvegicus
acacctgatgttacctgaccatgtt

SEQ ID NO: 73000 - DNA, 25 bp, Rattus norvegicus
acacctgatgtttcctgaccatgtt

SEQ ID NO: 73001 - DNA, 25 bp, Rattus norvegicus
acacctgatttcaattctaggcgaa

SEQ ID NO: 73002 - DNA, 25 bp, Rattus norvegicus
acacctgatttctattctaggcgaa

SEQ ID NO: 73003 - DNA, 25 bp, Rattus norvegicus
acacctgcacttagcgctacatata

SEQ ID NO: 73004 - DNA, 25 bp, Rattus norvegicus
acacctgcactttgcgctacatata

SEQ ID NO: 73005 - DNA, 25 bp, Rattus norvegicus
acacctgcagagactcagtactgat

SEQ ID NO: 73006 - DNA, 25 bp, Rattus norvegicus
acacctgcagagtctcagtactgat

SEQ ID NO: 73007 - DNA, 25 bp, Rattus norvegicus
acacctgcaggacgccggacatgaa

SEQ ID NO: 73008 - DNA, 25 bp, Rattus norvegicus
acacctgcaggaggccggacatgaa

SEQ ID NO: 73009 - DNA, 25 bp, Rattus norvegicus
acacctgccaggcacatgtgtggct

SEQ ID NO: 73010 - DNA, 25 bp, Rattus norvegicus
acacctgccagggacatgtgtggct

SEQ ID NO: 73011 - DNA, 25 bp, Rattus norvegicus
acacctgcgcttagagatcagcagt

SEQ ID NO: 73012 - DNA, 25 bp, Rattus norvegicus
acacctgcgctttgagatcagcagt

SEQ ID NO: 73013 - DNA, 25 bp, Rattus norvegicus
acacctgcgtgtcagatgcaagctg

SEQ ID NO: 73014 - DNA, 25 bp, Rattus norvegicus
acacctgcgtgtgagatgcaagctg

SEQ ID NO: 73015 - DNA, 25 bp, Rattus norvegicus
acacctgctcagcttgctggtgctg

SEQ ID NO: 73016 - DNA, 25 bp, Rattus norvegicus
acacctgctcaggttgctggtgctg

SEQ ID NO: 73017 - DNA, 25 bp, Rattus norvegicus
acacctgctggcaatctagagggat

SEQ ID NO: 73018 - DNA, 25 bp, Rattus norvegicus
acacctgctggctatctagagggat

SEQ ID NO: 73019 - DNA, 25 bp, Rattus norvegicus
acacctgcttttacattaccgggag

SEQ ID NO: 73020 - DNA, 25 bp, Rattus norvegicus
acacctgctttttcattaccgggag

SEQ ID NO: 73021 - DNA, 25 bp, Rattus norvegicus
acacctggaggtagcatggacgtac

SEQ ID NO: 73022 - DNA, 25 bp, Rattus norvegicus
acacctggaggttgcatggacgtac

SEQ ID NO: 73023 - DNA, 25 bp, Rattus norvegicus
acacctggcacaatccttatgatga

SEQ ID NO: 73024 - DNA, 25 bp, Rattus norvegicus
acacctggcacattccttatgatga

SEQ ID NO: 73025 - DNA, 25 bp, Rattus norvegicus
acacctggccctccatgtgggtctg

SEQ ID NO: 73026 - DNA, 25 bp, Rattus norvegicus
acacctggccctgcatgtgggtctg

SEQ ID NO: 73027 - DNA, 25 bp, Rattus norvegicus
acacctgggattagctgtatgagcc

SEQ ID NO: 73028 - DNA, 25 bp, Rattus norvegicus
acacctgggatttgctgtatgagcc

SEQ ID NO: 73029 - DNA, 25 bp, Rattus norvegicus
acacctgggcgtacatttcaaatgg

SEQ ID NO: 73030 - DNA, 25 bp, Rattus norvegicus
acacctgggcgttcatttcaaatgg

SEQ ID NO: 73031 - DNA, 25 bp, Rattus norvegicus
acacctgggcttatagattccctgc

SEQ ID NO: 73032 - DNA, 25 bp, Rattus norvegicus
acacctgggcttttagattccctgc

SEQ ID NO: 73033 - DNA, 25 bp, Rattus norvegicus
acacctgggtgacggtcattttggt

SEQ ID NO: 73034 - DNA, 25 bp, Rattus norvegicus
acacctgggtgagggtcattttggt

SEQ ID NO: 73035 - DNA, 25 bp, Rattus norvegicus
acacctgggtttcctgaagtctttt

SEQ ID NO: 73036 - DNA, 25 bp, Rattus norvegicus
acacctgggtttgctgaagtctttt

SEQ ID NO: 73037 - DNA, 25 bp, Rattus norvegicus
acacctggtgctagaggatttctcg

SEQ ID NO: 73038 - DNA, 25 bp, Rattus norvegicus
acacctggtgcttgaggatttctcg

SEQ ID NO: 73039 - DNA, 25 bp, Rattus norvegicus
acacctggtgttacccactgtgtgt

SEQ ID NO: 73040 - DNA, 25 bp, Rattus norvegicus
acacctggtgtttcccactgtgtgt

SEQ ID NO: 73041 - DNA, 25 bp, Rattus norvegicus
acacctggttccatgtttggcagat

SEQ ID NO: 73042 - DNA, 25 bp, Rattus norvegicus
acacctggttccttgtttggcagat

SEQ ID NO: 73043 - DNA, 25 bp, Rattus norvegicus
acacctgtaatactagtgctcgggc

SEQ ID NO: 73044 - DNA, 25 bp, Rattus norvegicus
acacctgtaatagtagtgctcgggc

SEQ ID NO: 73045 - DNA, 25 bp, Rattus norvegicus
acacctgtagggatctctgaactta

SEQ ID NO: 73046 - DNA, 25 bp, Rattus norvegicus
acacctgtagggttctctgaactta

SEQ ID NO: 73047 - DNA, 25 bp, Rattus norvegicus
acacctgtaggtaaagcatgcttca

SEQ ID NO: 73048 - DNA, 25 bp, Rattus norvegicus
acacctgtaggttaagcatgcttca

SEQ ID NO: 73049 - DNA, 25 bp, Rattus norvegicus
acacctgtagtcacagtgttcagga

SEQ ID NO: 73050 - DNA, 25 bp, Rattus norvegicus
acacctgtagtcatcatgggagttt

SEQ ID NO: 73051 - DNA, 25 bp, Rattus norvegicus
acacctgtagtccttctgtggttgt

SEQ ID NO: 73052 - DNA, 25 bp, Rattus norvegicus
acacctgtagtcgttctgtggttgt

SEQ ID NO: 73053 - DNA, 25 bp, Rattus norvegicus
acacctgtagtctcagtgttcagga

SEQ ID NO: 73054 - DNA, 25 bp, Rattus norvegicus
acacctgtagtcttcatgggagttt

SEQ ID NO: 73055 - DNA, 25 bp, Rattus norvegicus
acacctgtatgtactcttttatctc

SEQ ID NO: 73056 - DNA, 25 bp, Rattus norvegicus
acacctgtatgttctcttttatctc

SEQ ID NO: 73057 - DNA, 25 bp, Rattus norvegicus
acacctgtcagtagcgccaatatga

SEQ ID NO: 73058 - DNA, 25 bp, Rattus norvegicus
acacctgtcagtcacattttgtgat

SEQ ID NO: 73059 - DNA, 25 bp, Rattus norvegicus
acacctgtcagtgacattttgtgat

SEQ ID NO: 73060 - DNA, 25 bp, Rattus norvegicus
acacctgtcagttgcgccaatatga

SEQ ID NO: 73061 - DNA, 25 bp, Rattus norvegicus
acacctgtccaacaactggttcata

SEQ ID NO: 73062 - DNA, 25 bp, Rattus norvegicus
acacctgtccaagaactggttcata

SEQ ID NO: 73063 - DNA, 25 bp, Rattus norvegicus
acacctgtcctgagtctcagggtgg

SEQ ID NO: 73064 - DNA, 25 bp, Rattus norvegicus
acacctgtcctgtgtctcagggtgg

SEQ ID NO: 73065 - DNA, 25 bp, Rattus norvegicus
acacctgtctgaaggttagagcaac

SEQ ID NO: 73066 - DNA, 25 bp, Rattus norvegicus
acacctgtctgatggttagagcaac

SEQ ID NO: 73067 - DNA, 25 bp, Rattus norvegicus
acacctgtcttgagctaacacctgt

SEQ ID NO: 73068 - DNA, 25 bp, Rattus norvegicus
acacctgtcttgtgctaacacctgt

SEQ ID NO: 73069 - DNA, 25 bp, Rattus norvegicus
acacctgtgagcagctctgctggtg

SEQ ID NO: 73070 - DNA, 25 bp, Rattus norvegicus
acacctgtgagctgctctgctggtg

SEQ ID NO: 73071 - DNA, 25 bp, Rattus norvegicus
acacctgtgcagactgcgggctgaa

SEQ ID NO: 73072 - DNA, 25 bp, Rattus norvegicus
acacctgtgcagtctgcgggctgaa

SEQ ID NO: 73073 - DNA, 25 bp, Rattus norvegicus
acacctgtgcctctgggttgacatt

SEQ ID NO: 73074 - DNA, 25 bp, Rattus norvegicus
acacctgtgcctgtgggttgacatt

SEQ ID NO: 73075 - DNA, 25 bp, Rattus norvegicus
acacctgtggctaatggctgcagag

SEQ ID NO: 73076 - DNA, 25 bp, Rattus norvegicus
acacctgtggcttatggctgcagag

SEQ ID NO: 73077 - DNA, 25 bp, Rattus norvegicus
acacctgtgttgaaggccacgaggc

SEQ ID NO: 73078 - DNA, 25 bp, Rattus norvegicus
acacctgtgttgtaggccacgaggc

SEQ ID NO: 73079 - DNA, 25 bp, Rattus norvegicus
acacctgtgtttacgatgagttctc

SEQ ID NO: 73080 - DNA, 25 bp, Rattus norvegicus
acacctgtgttttcgatgagttctc

SEQ ID NO: 73081 - DNA, 25 bp, Rattus norvegicus
acacctgttcccacaaggtcaagaa

SEQ ID NO: 73082 - DNA, 25 bp, Rattus norvegicus
acacctgttccctcaaggtcaagaa

SEQ ID NO: 73083 - DNA, 25 bp, Rattus norvegicus
acacctgtttcaatggatgtctcca

SEQ ID NO: 73084 - DNA, 25 bp, Rattus norvegicus
acacctgtttcattggatgtctcca

SEQ ID NO: 73085 - DNA, 25 bp, Rattus norvegicus
acaccttatcggcacactgctaatg

SEQ ID NO: 73086 - DNA, 25 bp, Rattus norvegicus
acaccttatcgggacactgctaatg

SEQ ID NO: 73087 - DNA, 25 bp, Rattus norvegicus
acaccttcaatgcatgtcaattgcc

SEQ ID NO: 73088 - DNA, 25 bp, Rattus norvegicus
acaccttcaatggatgtcaattgcc

SEQ ID NO: 73089 - DNA, 25 bp, Rattus norvegicus
acaccttcccttactgaagcagaga

SEQ ID NO: 73090 - DNA, 25 bp, Rattus norvegicus
acaccttccctttctgaagcagaga

SEQ ID NO: 73091 - DNA, 25 bp, Rattus norvegicus
acaccttcctcaacattttccggag

SEQ ID NO: 73092 - DNA, 25 bp, Rattus norvegicus
acaccttcctcatcattttccggag

SEQ ID NO: 73093 - DNA, 25 bp, Rattus norvegicus
acaccttcctctaactgagtctaag

SEQ ID NO: 73094 - DNA, 25 bp, Rattus norvegicus
acaccttcctcttactgagtctaag

SEQ ID NO: 73095 - DNA, 25 bp, Rattus norvegicus
acaccttcctggcacttctcataag

SEQ ID NO: 73096 - DNA, 25 bp, Rattus norvegicus
acaccttcctgggacttctcataag

SEQ ID NO: 73097 - DNA, 25 bp, Rattus norvegicus
acaccttcgcttacgttcagaaata

SEQ ID NO: 73098 - DNA, 25 bp, Rattus norvegicus
acaccttcgctttcgttcagaaata

SEQ ID NO: 73099 - DNA, 25 bp, Rattus norvegicus
acaccttctgaaccaacttgcaaat

SEQ ID NO: 73100 - DNA, 25 bp, Rattus norvegicus
acaccttctgaagcaacttgcaaat

SEQ ID NO: 73101 - DNA, 25 bp, Rattus norvegicus
acaccttctgtgcaaatgtcctttg

SEQ ID NO: 73102 - DNA, 25 bp, Rattus norvegicus
acaccttctgtggaaatgtcctttg

SEQ ID NO: 73103 - DNA, 25 bp, Rattus norvegicus
acaccttcttaccaaatgccatttt

SEQ ID NO: 73104 - DNA, 25 bp, Rattus norvegicus
acaccttcttacgaaatgccatttt

SEQ ID NO: 73105 - DNA, 25 bp, Rattus norvegicus
acaccttcttgtctgattagcttca

SEQ ID NO: 73106 - DNA, 25 bp, Rattus norvegicus
acaccttcttgtgtgattagcttca

SEQ ID NO: 73107 - DNA, 25 bp, Rattus norvegicus
acaccttgaatcagaccacttggaa

SEQ ID NO: 73108 - DNA, 25 bp, Rattus norvegicus
acaccttgaatctgaccacttggaa

SEQ ID NO: 73109 - DNA, 25 bp, Rattus norvegicus
acaccttgacacatttctagcattc

SEQ ID NO: 73110 - DNA, 25 bp, Rattus norvegicus
acaccttgacacttttctagcattc

SEQ ID NO: 73111 - DNA, 25 bp, Rattus norvegicus
acaccttgcagcacagacgtgtgtg

SEQ ID NO: 73112 - DNA, 25 bp, Rattus norvegicus
acaccttgcagctcagacgtgtgtg

SEQ ID NO: 73113 - DNA, 25 bp, Rattus norvegicus
acaccttgcatcagccttaactgga

SEQ ID NO: 73114 - DNA, 25 bp, Rattus norvegicus
acaccttgcatctgccttaactgga

SEQ ID NO: 73115 - DNA, 25 bp, Rattus norvegicus
acaccttggagactatgcacttagt

SEQ ID NO: 73116 - DNA, 25 bp, Rattus norvegicus
acaccttggagagtatgcacttagt

SEQ ID NO: 73117 - DNA, 25 bp, Rattus norvegicus
acaccttgtctgatacgcgggagaa

SEQ ID NO: 73118 - DNA, 25 bp, Rattus norvegicus
acaccttgtctgttacgcgggagaa

SEQ ID NO: 73119 - DNA, 25 bp, Rattus norvegicus
acaccttgtgaaccattctgtcttg

SEQ ID NO: 73120 - DNA, 25 bp, Rattus norvegicus
acaccttgtgaagcattctgtcttg

SEQ ID NO: 73121 - DNA, 25 bp, Rattus norvegicus
acaccttgtgtcagtgctcagtgga

SEQ ID NO: 73122 - DNA, 25 bp, Rattus norvegicus
acaccttgtgtctgtgctcagtgga

SEQ ID NO: 73123 - DNA, 25 bp, Rattus norvegicus
acaccttgtttcatgatgaccgcag

SEQ ID NO: 73124 - DNA, 25 bp, Rattus norvegicus
acaccttgtttcttgatgaccgcag

SEQ ID NO: 73125 - DNA, 25 bp, Rattus norvegicus
acacctttagagaacatatcccaga

SEQ ID NO: 73126 - DNA, 25 bp, Rattus norvegicus
acacctttagagtacatatcccaga

SEQ ID NO: 73127 - DNA, 25 bp, Rattus norvegicus
acacctttagccctgcttttgaaat

SEQ ID NO: 73128 - DNA, 25 bp, Rattus norvegicus
acacctttagccgtgcttttgaaat

SEQ ID NO: 73129 - DNA, 25 bp, Rattus norvegicus
acacctttcatcaagctgctgaaga

SEQ ID NO: 73130 - DNA, 25 bp, Rattus norvegicus
acacctttcatctagctgctgaaga

SEQ ID NO: 73131 - DNA, 25 bp, Rattus norvegicus
acacctttctagagccaaacttcgt

SEQ ID NO: 73132 - DNA, 25 bp, Rattus norvegicus
acacctttctagtgccaaacttcgt

SEQ ID NO: 73133 - DNA, 25 bp, Rattus norvegicus
acacctttcttcatcgtgcagatgt

SEQ ID NO: 73134 - DNA, 25 bp, Rattus norvegicus
acacctttcttcttcgtgcagatgt

SEQ ID NO: 73135 - DNA, 25 bp, Rattus norvegicus
acacctttcttgcatgaggaactga

SEQ ID NO: 73136 - DNA, 25 bp, Rattus norvegicus
acacctttcttggatgaggaactga

SEQ ID NO: 73137 - DNA, 25 bp, Rattus norvegicus
acacctttctttcagttcatcactg

SEQ ID NO: 73138 - DNA, 25 bp, Rattus norvegicus
acacctttctttgagttcatcactg

SEQ ID NO: 73139 - DNA, 25 bp, Rattus norvegicus
acacctttgtctctttctagattct

SEQ ID NO: 73140 - DNA, 25 bp, Rattus norvegicus
acacctttgtctgtttctagattct

SEQ ID NO: 73141 - DNA, 25 bp, Rattus norvegicus
acacgaacagttacaccacatatgc

SEQ ID NO: 73142 - DNA, 25 bp, Rattus norvegicus
acacgaacagtttcaccacatatgc

SEQ ID NO: 73143 - DNA, 25 bp, Rattus norvegicus
acacgaacccagaggctgttatggt

SEQ ID NO: 73144 - DNA, 25 bp, Rattus norvegicus
acacgaacccagtggctgttatggt

SEQ ID NO: 73145 - DNA, 25 bp, Rattus norvegicus
acacgaacccgactgaggtgctgga

SEQ ID NO: 73146 - DNA, 25 bp, Rattus norvegicus
acacgaacccgagtgaggtgctgga

SEQ ID NO: 73147 - DNA, 25 bp, Rattus norvegicus
acacgaacgcccagacatcaaagga

SEQ ID NO: 73148 - DNA, 25 bp, Rattus norvegicus
acacgaacgccctgacatcaaagga

SEQ ID NO: 73149 - DNA, 25 bp, Rattus norvegicus
acacgaacggttccactgagagcaa

SEQ ID NO: 73150 - DNA, 25 bp, Rattus norvegicus
acacgaacggttgcactgagagcaa

SEQ ID NO: 73151 - DNA, 25 bp, Rattus norvegicus
acacgaatcgcaaactgttgcttag

SEQ ID NO: 73152 - DNA, 25 bp, Rattus norvegicus
acacgaatcgcatactgttgcttag

SEQ ID NO: 73153 - DNA, 25 bp, Rattus norvegicus
acacgaatgtggaatgctggctaag

SEQ ID NO: 73154 - DNA, 25 bp, Rattus norvegicus
acacgaatgtggtatgctggctaag

SEQ ID NO: 73155 - DNA, 25 bp, Rattus norvegicus
acacgacagggccaggtagcacaga

SEQ ID NO: 73156 - DNA, 25 bp, Rattus norvegicus
acacgacagggcgaggtagcacaga

SEQ ID NO: 73157 - DNA, 25 bp, Rattus norvegicus
acacgactctgtacactgcaattaa

SEQ ID NO: 73158 - DNA, 25 bp, Rattus norvegicus
acacgactctgttcactgcaattaa

SEQ ID NO: 73159 - DNA, 25 bp, Rattus norvegicus
acacgactgcttacaattagaccgg

SEQ ID NO: 73160 - DNA, 25 bp, Rattus norvegicus
acacgactgctttcaattagaccgg

SEQ ID NO: 73161 - DNA, 25 bp, Rattus norvegicus
acacgactggatattggcctccgca

SEQ ID NO: 73162 - DNA, 25 bp, Rattus norvegicus
acacgactggattttggcctccgca

SEQ ID NO: 73163 - DNA, 25 bp, Rattus norvegicus
acacgagactggatcacatttaaaa

SEQ ID NO: 73164 - DNA, 25 bp, Rattus norvegicus
acacgagactggttcacatttaaaa

SEQ ID NO: 73165 - DNA, 25 bp, Rattus norvegicus
acacgaggtctcattatttagtata

SEQ ID NO: 73166 - DNA, 25 bp, Rattus norvegicus
acacgaggtctctttatttagtata

SEQ ID NO: 73167 - DNA, 25 bp, Rattus norvegicus
acacgagtacatctcttacattaga

SEQ ID NO: 73168 - DNA, 25 bp, Rattus norvegicus
acacgagtacatgtcttacattaga

SEQ ID NO: 73169 - DNA, 25 bp, Rattus norvegicus
acacgagtatatacagacagtcatg

SEQ ID NO: 73170 - DNA, 25 bp, Rattus norvegicus
acacgagtatattcagacagtcatg

SEQ ID NO: 73171 - DNA, 25 bp, Rattus norvegicus
acacgagtcgttagttcaatagtca

SEQ ID NO: 73172 - DNA, 25 bp, Rattus norvegicus
acacgagtcgtttgttcaatagtca

SEQ ID NO: 73173 - DNA, 25 bp, Rattus norvegicus
acacgatggcatcactcactgggaa

SEQ ID NO: 73174 - DNA, 25 bp, Rattus norvegicus
acacgatggcatgactcactgggaa

SEQ ID NO: 73175 - DNA, 25 bp, Rattus norvegicus
acacgatggtggacctccgcagcag

SEQ ID NO: 73176 - DNA, 25 bp, Rattus norvegicus
acacgatggtggtcctccgcagcag

SEQ ID NO: 73177 - DNA, 25 bp, Rattus norvegicus
acacgattatgtccgcgtcaacagg

SEQ ID NO: 73178 - DNA, 25 bp, Rattus norvegicus
acacgattatgtgcgcgtcaacagg

SEQ ID NO: 73179 - DNA, 25 bp, Rattus norvegicus
acacgcacagtgctgacacatatct

SEQ ID NO: 73180 - DNA, 25 bp, Rattus norvegicus
acacgcacagtggtgacacatatct

SEQ ID NO: 73181 - DNA, 25 bp, Rattus norvegicus
acacgcacgtacctgtgttgtgtgt

SEQ ID NO: 73182 - DNA, 25 bp, Rattus norvegicus
acacgcacgtacgtgtgttgtgtgt

SEQ ID NO: 73183 - DNA, 25 bp, Rattus norvegicus
acacgcacgtgtaccgtctgaaaag

SEQ ID NO: 73184 - DNA, 25 bp, Rattus norvegicus
acacgcacgtgttccgtctgaaaag

SEQ ID NO: 73185 - DNA, 25 bp, Rattus norvegicus
acacgcagcgtgaggctcaggtcac

SEQ ID NO: 73186 - DNA, 25 bp, Rattus norvegicus
acacgcagcgtgtggctcaggtcac

SEQ ID NO: 73187 - DNA, 25 bp, Rattus norvegicus
acacgcagctgcagagacctcagat

SEQ ID NO: 73188 - DNA, 25 bp, Rattus norvegicus
acacgcagctgctgagacctcagat

SEQ ID NO: 73189 - DNA, 25 bp, Rattus norvegicus
acacgcagcttcagtgctgtgtgtt

SEQ ID NO: 73190 - DNA, 25 bp, Rattus norvegicus
acacgcagcttctgtgctgtgtgtt

SEQ ID NO: 73191 - DNA, 25 bp, Rattus norvegicus
acacgcagggttctctcttcaaagg

SEQ ID NO: 73192 - DNA, 25 bp, Rattus norvegicus
acacgcagggttgtctcttcaaagg

SEQ ID NO: 73193 - DNA, 25 bp, Rattus norvegicus
acacgcatggtcatttcactgctgc

SEQ ID NO: 73194 - DNA, 25 bp, Rattus norvegicus
acacgcatggtcttttcactgctgc

SEQ ID NO: 73195 - DNA, 25 bp, Rattus norvegicus
acacgcatggtgatcgcaagagtct

SEQ ID NO: 73196 - DNA, 25 bp, Rattus norvegicus
acacgcatggtgttcgcaagagtct

SEQ ID NO: 73197 - DNA, 25 bp, Rattus norvegicus
acacgccatagactgaagccgggtt

SEQ ID NO: 73198 - DNA, 25 bp, Rattus norvegicus
acacgccatagagtgaagccgggtt

SEQ ID NO: 73199 - DNA, 25 bp, Rattus norvegicus
acacgcccaagtcctggatttatgg

SEQ ID NO: 73200 - DNA, 25 bp, Rattus norvegicus
acacgcccaagtgctggatttatgg

SEQ ID NO: 73201 - DNA, 25 bp, Rattus norvegicus
acacgcccaatgacgtttttcttag

SEQ ID NO: 73202 - DNA, 25 bp, Rattus norvegicus
acacgcccaatgtcgtttttcttag

SEQ ID NO: 73203 - DNA, 25 bp, Rattus norvegicus
acacgccgagagatcagctctataa

SEQ ID NO: 73204 - DNA, 25 bp, Rattus norvegicus
acacgccgagagttcagctctataa

SEQ ID NO: 73205 - DNA, 25 bp, Rattus norvegicus
acacgccggaggagatagagaagtc

SEQ ID NO: 73206 - DNA, 25 bp, Rattus norvegicus
acacgccggaggtgatagagaagtc

SEQ ID NO: 73207 - DNA, 25 bp, Rattus norvegicus
acacgcctcggcctactggctgtag

SEQ ID NO: 73208 - DNA, 25 bp, Rattus norvegicus
acacgcctcggcgtactggctgtag

SEQ ID NO: 73209 - DNA, 25 bp, Rattus norvegicus
acacgcgattgcccaatgccataaa

SEQ ID NO: 73210 - DNA, 25 bp, Rattus norvegicus
acacgcgattgcgcaatgccataaa

SEQ ID NO: 73211 - DNA, 25 bp, Rattus norvegicus
acacgcggaaacatgccagcattca

SEQ ID NO: 73212 - DNA, 25 bp, Rattus norvegicus
acacgcggaaacttgccagcattca

SEQ ID NO: 73213 - DNA, 25 bp, Rattus norvegicus
acacgcggacttaggtgctttccca

SEQ ID NO: 73214 - DNA, 25 bp, Rattus norvegicus
acacgcggactttggtgctttccca

SEQ ID NO: 73215 - DNA, 25 bp, Rattus norvegicus
acacgcgtctccagaaagttcagtt

SEQ ID NO: 73216 - DNA, 25 bp, Rattus norvegicus
acacgcgtctcctgaaagttcagtt

SEQ ID NO: 73217 - DNA, 25 bp, Rattus norvegicus
acacgctatgagctgtgacggccat

SEQ ID NO: 73218 - DNA, 25 bp, Rattus norvegicus
acacgctatgaggtgtgacggccat

SEQ ID NO: 73219 - DNA, 25 bp, Rattus norvegicus
acacgctatgcaagttgatattcta

SEQ ID NO: 73220 - DNA, 25 bp, Rattus norvegicus
acacgctatgcatgttgatattcta

SEQ ID NO: 73221 - DNA, 25 bp, Rattus norvegicus
acacgctatgtgcacaatcgggctg

SEQ ID NO: 73222 - DNA, 25 bp, Rattus norvegicus
acacgctatgtggacaatcgggctg

SEQ ID NO: 73223 - DNA, 25 bp, Rattus norvegicus
acacgctccttacttaaatttccag

SEQ ID NO: 73224 - DNA, 25 bp, Rattus norvegicus
acacgctccttagttaaatttccag

SEQ ID NO: 73225 - DNA, 25 bp, Rattus norvegicus
acacgctcctttccatgtgctgtaa

SEQ ID NO: 73226 - DNA, 25 bp, Rattus norvegicus
acacgctcctttgcatgtgctgtaa

SEQ ID NO: 73227 - DNA, 25 bp, Rattus norvegicus
acacgctcttacagtcgatggactt

SEQ ID NO: 73228 - DNA, 25 bp, Rattus norvegicus
acacgctcttactgtcgatggactt

SEQ ID NO: 73229 - DNA, 25 bp, Rattus norvegicus
acacgctcttggacctggtagcttt

SEQ ID NO: 73230 - DNA, 25 bp, Rattus norvegicus
acacgctcttggtcctggtagcttt

SEQ ID NO: 73231 - DNA, 25 bp, Rattus norvegicus
acacgctgaatcagtcttccaggag

SEQ ID NO: 73232 - DNA, 25 bp, Rattus norvegicus
acacgctgaatctgtcttccaggag

SEQ ID NO: 73233 - DNA, 25 bp, Rattus norvegicus
acacgctgccctagatacgacagat

SEQ ID NO: 73234 - DNA, 25 bp, Rattus norvegicus
acacgctgcccttgatacgacagat

SEQ ID NO: 73235 - DNA, 25 bp, Rattus norvegicus
acacgctggacaagcccttcgtgtg

SEQ ID NO: 73236 - DNA, 25 bp, Rattus norvegicus
acacgctggacatgcccttcgtgtg

SEQ ID NO: 73237 - DNA, 25 bp, Rattus norvegicus
acacgctggacgacctgcggagtca

SEQ ID NO: 73238 - DNA, 25 bp, Rattus norvegicus
acacgctggacgtcctgcggagtca

SEQ ID NO: 73239 - DNA, 25 bp, Rattus norvegicus
acacgctggcagagcttaaacggca

SEQ ID NO: 73240 - DNA, 25 bp, Rattus norvegicus
acacgctggcagtgcttaaacggca

SEQ ID NO: 73241 - DNA, 25 bp, Rattus norvegicus
acacgctgggctccgagttgtactc

SEQ ID NO: 73242 - DNA, 25 bp, Rattus norvegicus
acacgctgggctgcgagttgtactc

SEQ ID NO: 73243 - DNA, 25 bp, Rattus norvegicus
acacgctgtccgagttgctgcagct

SEQ ID NO: 73244 - DNA, 25 bp, Rattus norvegicus
acacgctgtccgtgttgctgcagct

SEQ ID NO: 73245 - DNA, 25 bp, Rattus norvegicus
acacgcttacacaatcagcacaagc

SEQ ID NO: 73246 - DNA, 25 bp, Rattus norvegicus
acacgcttacactatcagcacaagc

SEQ ID NO: 73247 - DNA, 25 bp, Rattus norvegicus
acacgcttagcaacacccagaagaa

SEQ ID NO: 73248 - DNA, 25 bp, Rattus norvegicus
acacgcttagcatcacccagaagaa

SEQ ID NO: 73249 - DNA, 25 bp, Rattus norvegicus
acacgcttcacgctcttaaaatgca

SEQ ID NO: 73250 - DNA, 25 bp, Rattus norvegicus
acacgcttcacggtcttaaaatgca

SEQ ID NO: 73251 - DNA, 25 bp, Rattus norvegicus
acacgctttgtccagtgtggttccg

SEQ ID NO: 73252 - DNA, 25 bp, Rattus norvegicus
acacgctttgtcgagtgtggttccg

SEQ ID NO: 73253 - DNA, 25 bp, Rattus norvegicus
acacggaactccagtaggctctgag

SEQ ID NO: 73254 - DNA, 25 bp, Rattus norvegicus
acacggaactcctgtaggctctgag

SEQ ID NO: 73255 - DNA, 25 bp, Rattus norvegicus
acacggaagcatcagcgtggtcttc

SEQ ID NO: 73256 - DNA, 25 bp, Rattus norvegicus
acacggaagcatgagcgtggtcttc

SEQ ID NO: 73257 - DNA, 25 bp, Rattus norvegicus
acacggaaggacagcagaagtctct

SEQ ID NO: 73258 - DNA, 25 bp, Rattus norvegicus
acacggaaggactgcagaagtctct

SEQ ID NO: 73259 - DNA, 25 bp, Rattus norvegicus
acacggaatattactcggcccagtt

SEQ ID NO: 73260 - DNA, 25 bp, Rattus norvegicus
acacggaatatttctcggcccagtt

SEQ ID NO: 73261 - DNA, 25 bp, Rattus norvegicus
acacggaatgtgctgtggcagctat

SEQ ID NO: 73262 - DNA, 25 bp, Rattus norvegicus
acacggaatgtggtgtggcagctat

SEQ ID NO: 73263 - DNA, 25 bp, Rattus norvegicus
acacggacacttctatgccattgcg

SEQ ID NO: 73264 - DNA, 25 bp, Rattus norvegicus
acacggacacttgtatgccattgcg

SEQ ID NO: 73265 - DNA, 25 bp, Rattus norvegicus
acacggacagtgactctccaaaggg

SEQ ID NO: 73266 - DNA, 25 bp, Rattus norvegicus
acacggacagtgtctctccaaaggg

SEQ ID NO: 73267 - DNA, 25 bp, Rattus norvegicus
acacggaggattagtcccagcaaaa

SEQ ID NO: 73268 - DNA, 25 bp, Rattus norvegicus
acacggaggatttgtcccagcaaaa

SEQ ID NO: 73269 - DNA, 25 bp, Rattus norvegicus
acacggatactcacatgaccatggt

SEQ ID NO: 73270 - DNA, 25 bp, Rattus norvegicus
acacggatactctcatgaccatggt

SEQ ID NO: 73271 - DNA, 25 bp, Rattus norvegicus
acacggatattcaggcaggctctca

SEQ ID NO: 73272 - DNA, 25 bp, Rattus norvegicus
acacggatattctggcaggctctca

SEQ ID NO: 73273 - DNA, 25 bp, Rattus norvegicus
acacggatccacattgatttgtgat

SEQ ID NO: 73274 - DNA, 25 bp, Rattus norvegicus
acacggatccactttgatttgtgat

SEQ ID NO: 73275 - DNA, 25 bp, Rattus norvegicus
acacggatgcttatgtggcttactt

SEQ ID NO: 73276 - DNA, 25 bp, Rattus norvegicus
acacggatgcttttgtggcttactt

SEQ ID NO: 73277 - DNA, 25 bp, Rattus norvegicus
acacggattggcctaaaagagactt

SEQ ID NO: 73278 - DNA, 25 bp, Rattus norvegicus
acacggattggcgtaaaagagactt

SEQ ID NO: 73279 - DNA, 25 bp, Rattus norvegicus
acacggcaaggcaggcagcggtact

SEQ ID NO: 73280 - DNA, 25 bp, Rattus norvegicus
acacggcaaggctggcagcggtact

SEQ ID NO: 73281 - DNA, 25 bp, Rattus norvegicus
acacggccctctccttggagaagga

SEQ ID NO: 73282 - DNA, 25 bp, Rattus norvegicus
acacggccctctgcttggagaagga

SEQ ID NO: 73283 - DNA, 25 bp, Rattus norvegicus
acacggccctgtaaagttgctttgt

SEQ ID NO: 73284 - DNA, 25 bp, Rattus norvegicus
acacggccctgttaagttgctttgt

SEQ ID NO: 73285 - DNA, 25 bp, Rattus norvegicus
acacggcccttcaggttgatccata

SEQ ID NO: 73286 - DNA, 25 bp, Rattus norvegicus
acacggcccttctggttgatccata

SEQ ID NO: 73287 - DNA, 25 bp, Rattus norvegicus
acacggccgagaactctgaagcttt

SEQ ID NO: 73288 - DNA, 25 bp, Rattus norvegicus
acacggccgagatctctgaagcttt

SEQ ID NO: 73289 - DNA, 25 bp, Rattus norvegicus
acacggcctctaatctaattcagta

SEQ ID NO: 73290 - DNA, 25 bp, Rattus norvegicus
acacggcctctattctaattcagta

SEQ ID NO: 73291 - DNA, 25 bp, Rattus norvegicus
acacggcgacagagacagcggcggc

SEQ ID NO: 73292 - DNA, 25 bp, Rattus norvegicus
acacggcgacagtgacagcggcggc

SEQ ID NO: 73293 - DNA, 25 bp, Rattus norvegicus
acacggctgagcactgtgtgtggta

SEQ ID NO: 73294 - DNA, 25 bp, Rattus norvegicus
acacggctgagctctgtgtgtggta

SEQ ID NO: 73295 - DNA, 25 bp, Rattus norvegicus
acacggcttcgtcatcaagtggagc

SEQ ID NO: 73296 - DNA, 25 bp, Rattus norvegicus
acacggcttcgtgatcaagtggagc

SEQ ID NO: 73297 - DNA, 25 bp, Rattus norvegicus
acacgggaatgtagggctccgactc

SEQ ID NO: 73298 - DNA, 25 bp, Rattus norvegicus
acacgggaatgttgggctccgactc

SEQ ID NO: 73299 - DNA, 25 bp, Rattus norvegicus
acacgggactttctggtttcctctg

SEQ ID NO: 73300 - DNA, 25 bp, Rattus norvegicus
acacgggactttgtggtttcctctg

SEQ ID NO: 73301 - DNA, 25 bp, Rattus norvegicus
acacgggcatctctgtcatcagagt

SEQ ID NO: 73302 - DNA, 25 bp, Rattus norvegicus
acacgggcatctgtgtcatcagagt

SEQ ID NO: 73303 - DNA, 25 bp, Rattus norvegicus
acacgggccgtcattgactgcaatg

SEQ ID NO: 73304 - DNA, 25 bp, Rattus norvegicus
acacgggccgtctttgactgcaatg

SEQ ID NO: 73305 - DNA, 25 bp, Rattus norvegicus
acacgggcggtaatatattttatat

SEQ ID NO: 73306 - DNA, 25 bp, Rattus norvegicus
acacgggcggtattatattttatat

SEQ ID NO: 73307 - DNA, 25 bp, Rattus norvegicus
acacgggctcttattccacggcttt

SEQ ID NO: 73308 - DNA, 25 bp, Rattus norvegicus
acacgggctctttttccacggcttt

SEQ ID NO: 73309 - DNA, 25 bp, Rattus norvegicus
acacgggctggcactgtatgagcgc

SEQ ID NO: 73310 - DNA, 25 bp, Rattus norvegicus
acacgggctggctctgtatgagcgc

SEQ ID NO: 73311 - DNA, 25 bp, Rattus norvegicus
acacgggcttctctttgactcaaac

SEQ ID NO: 73312 - DNA, 25 bp, Rattus norvegicus
acacgggcttctgtttgactcaaac

SEQ ID NO: 73313 - DNA, 25 bp, Rattus norvegicus
acacgggggcttatatgcacagaga

SEQ ID NO: 73314 - DNA, 25 bp, Rattus norvegicus
acacgggggcttttatgcacagaga

SEQ ID NO: 73315 - DNA, 25 bp, Rattus norvegicus
acacgggtgaaccaccctactcctg

SEQ ID NO: 73316 - DNA, 25 bp, Rattus norvegicus
acacgggtgaacgaccctactcctg

SEQ ID NO: 73317 - DNA, 25 bp, Rattus norvegicus
acacggtacctccagatcatctgta

SEQ ID NO: 73318 - DNA, 25 bp, Rattus norvegicus
acacggtacctcgagatcatctgta

SEQ ID NO: 73319 - DNA, 25 bp, Rattus norvegicus
acacggtccagcagtctggctctaa

SEQ ID NO: 73320 - DNA, 25 bp, Rattus norvegicus
acacggtccagctgtctggctctaa

SEQ ID NO: 73321 - DNA, 25 bp, Rattus norvegicus
acacggtcccaaaggatcgaactca

SEQ ID NO: 73322 - DNA, 25 bp, Rattus norvegicus
acacggtcccaatggatcgaactca

SEQ ID NO: 73323 - DNA, 25 bp, Rattus norvegicus
acacggtcctgaatttcttggtgac

SEQ ID NO: 73324 - DNA, 25 bp, Rattus norvegicus
acacggtcctgattttcttggtgac

SEQ ID NO: 73325 - DNA, 25 bp, Rattus norvegicus
acacggtcttgtattatttggccat

SEQ ID NO: 73326 - DNA, 25 bp, Rattus norvegicus
acacggtcttgttttatttggccat

SEQ ID NO: 73327 - DNA, 25 bp, Rattus norvegicus
acacggtgagctaccttcctgcgag

SEQ ID NO: 73328 - DNA, 25 bp, Rattus norvegicus
acacggtgagcttccttcctgcgag

SEQ ID NO: 73329 - DNA, 25 bp, Rattus norvegicus
acacggtgaggacctgtcggaataa

SEQ ID NO: 73330 - DNA, 25 bp, Rattus norvegicus
acacggtgaggagctgtcggaataa

SEQ ID NO: 73331 - DNA, 25 bp, Rattus norvegicus
acacggtggaagaacactggctcac

SEQ ID NO: 73332 - DNA, 25 bp, Rattus norvegicus
acacggtggaagagagcctacttta

SEQ ID NO: 73333 - DNA, 25 bp, Rattus norvegicus
acacggtggaagtacactggctcac

SEQ ID NO: 73334 - DNA, 25 bp, Rattus norvegicus
acacggtggaagtgagcctacttta

SEQ ID NO: 73335 - DNA, 25 bp, Rattus norvegicus
acacggtggaccattgtggccgcaa

SEQ ID NO: 73336 - DNA, 25 bp, Rattus norvegicus
acacggtggacctttgtggccgcaa

SEQ ID NO: 73337 - DNA, 25 bp, Rattus norvegicus
acacggtgggtcatcaaaggcaaag

SEQ ID NO: 73338 - DNA, 25 bp, Rattus norvegicus
acacggtgggtcttcaaaggcaaag

SEQ ID NO: 73339 - DNA, 25 bp, Rattus norvegicus
acacggtgtgaacccttacatgtca

SEQ ID NO: 73340 - DNA, 25 bp, Rattus norvegicus
acacggtgtgaagccttacatgtca

SEQ ID NO: 73341 - DNA, 25 bp, Rattus norvegicus
acacggttacttacgcgcagacaaa

SEQ ID NO: 73342 - DNA, 25 bp, Rattus norvegicus
acacggttactttcgcgcagacaaa

SEQ ID NO: 73343 - DNA, 25 bp, Rattus norvegicus
acacggttatcaaaggttctgccaa

SEQ ID NO: 73344 - DNA, 25 bp, Rattus norvegicus
acacggttatcataggttctgccaa

SEQ ID NO: 73345 - DNA, 25 bp, Rattus norvegicus
acacggttccatatcttttgatctg

SEQ ID NO: 73346 - DNA, 25 bp, Rattus norvegicus
acacggttccatttcttttgatctg

SEQ ID NO: 73347 - DNA, 25 bp, Rattus norvegicus
acacggttctgaaggagctcggagt

SEQ ID NO: 73348 - DNA, 25 bp, Rattus norvegicus
acacggttctgatggagctcggagt

SEQ ID NO: 73349 - DNA, 25 bp, Rattus norvegicus
acacggttgcataacgtttcagtag

SEQ ID NO: 73350 - DNA, 25 bp, Rattus norvegicus
acacggttgcattacgtttcagtag

SEQ ID NO: 73351 - DNA, 25 bp, Rattus norvegicus
acacggtttctccaagccacgatga

SEQ ID NO: 73352 - DNA, 25 bp, Rattus norvegicus
acacggtttctcgaagccacgatga

SEQ ID NO: 73353 - DNA, 25 bp, Rattus norvegicus
acacgtacacagagttcatcatctg

SEQ ID NO: 73354 - DNA, 25 bp, Rattus norvegicus
acacgtacacagtgttcatcatctg

SEQ ID NO: 73355 - DNA, 25 bp, Rattus norvegicus
acacgtacacctcccacaagatgta

SEQ ID NO: 73356 - DNA, 25 bp, Rattus norvegicus
acacgtacacctgccacaagatgta

SEQ ID NO: 73357 - DNA, 25 bp, Rattus norvegicus
acacgtaccaggcaatgctgaagct

SEQ ID NO: 73358 - DNA, 25 bp, Rattus norvegicus
acacgtaccagggaatgctgaagct

SEQ ID NO: 73359 - DNA, 25 bp, Rattus norvegicus
acacgtactctaagcgctacctgct

SEQ ID NO: 73360 - DNA, 25 bp, Rattus norvegicus
acacgtactctatgcgctacctgct

SEQ ID NO: 73361 - DNA, 25 bp, Rattus norvegicus
acacgtacttcccattttagcagaa

SEQ ID NO: 73362 - DNA, 25 bp, Rattus norvegicus
acacgtacttccgattttagcagaa

SEQ ID NO: 73363 - DNA, 25 bp, Rattus norvegicus
acacgtaggtgaaggatgaccttca

SEQ ID NO: 73364 - DNA, 25 bp, Rattus norvegicus
acacgtaggtgatggatgaccttca

SEQ ID NO: 73365 - DNA, 25 bp, Rattus norvegicus
acacgtatgtaacctggcagggtta

SEQ ID NO: 73366 - DNA, 25 bp, Rattus norvegicus
acacgtatgtaagctggcagggtta

SEQ ID NO: 73367 - DNA, 25 bp, Rattus norvegicus
acacgtatttctccagactcttctg

SEQ ID NO: 73368 - DNA, 25 bp, Rattus norvegicus
acacgtatttctgcagactcttctg

SEQ ID NO: 73369 - DNA, 25 bp, Rattus norvegicus
acacgtcacgtgctggtttggtgat

SEQ ID NO: 73370 - DNA, 25 bp, Rattus norvegicus
acacgtcacgtggtggtttggtgat

SEQ ID NO: 73371 - DNA, 25 bp, Rattus norvegicus
acacgtcagtttctccttagagcaa

SEQ ID NO: 73372 - DNA, 25 bp, Rattus norvegicus
acacgtcagtttgtccttagagcaa

SEQ ID NO: 73373 - DNA, 25 bp, Rattus norvegicus
acacgtcatcatcaggagtctacct

SEQ ID NO: 73374 - DNA, 25 bp, Rattus norvegicus
acacgtcatcatgaggagtctacct

SEQ ID NO: 73375 - DNA, 25 bp, Rattus norvegicus
acacgtcatcgtagcagaggtctct

SEQ ID NO: 73376 - DNA, 25 bp, Rattus norvegicus
acacgtcatcgttgcagaggtctct

SEQ ID NO: 73377 - DNA, 25 bp, Rattus norvegicus
acacgtccggtcagaagtttctccg

SEQ ID NO: 73378 - DNA, 25 bp, Rattus norvegicus
acacgtccggtctgaagtttctccg

SEQ ID NO: 73379 - DNA, 25 bp, Rattus norvegicus
acacgtcctatacatcagtctctta

SEQ ID NO: 73380 - DNA, 25 bp, Rattus norvegicus
acacgtcctatagatcagtctctta

SEQ ID NO: 73381 - DNA, 25 bp, Rattus norvegicus
acacgtcctatgacatgggcatggc

SEQ ID NO: 73382 - DNA, 25 bp, Rattus norvegicus
acacgtcctatgtcatgggcatggc

SEQ ID NO: 73383 - DNA, 25 bp, Rattus norvegicus
acacgtcgaagcaacttttctaaca

SEQ ID NO: 73384 - DNA, 25 bp, Rattus norvegicus
acacgtcgaagctacttttctaaca

SEQ ID NO: 73385 - DNA, 25 bp, Rattus norvegicus
acacgtctcaacatacatacatcac

SEQ ID NO: 73386 - DNA, 25 bp, Rattus norvegicus
acacgtctcaacttacatacatcac

SEQ ID NO: 73387 - DNA, 25 bp, Rattus norvegicus
acacgtctctaaatactccatcaca

SEQ ID NO: 73388 - DNA, 25 bp, Rattus norvegicus
acacgtctctaattactccatcaca

SEQ ID NO: 73389 - DNA, 25 bp, Rattus norvegicus
acacgtctcttcagcacagacaaga

SEQ ID NO: 73390 - DNA, 25 bp, Rattus norvegicus
acacgtctcttctgcacagacaaga

SEQ ID NO: 73391 - DNA, 25 bp, Rattus norvegicus
acacgtctgctcatcagtgtgtgaa

SEQ ID NO: 73392 - DNA, 25 bp, Rattus norvegicus
acacgtctgctcttcagtgtgtgaa

SEQ ID NO: 73393 - DNA, 25 bp, Rattus norvegicus
acacgtctggaaaatctggctggct

SEQ ID NO: 73394 - DNA, 25 bp, Rattus norvegicus
acacgtctggaatatctggctggct

SEQ ID NO: 73395 - DNA, 25 bp, Rattus norvegicus
acacgtctgtacatgtctattcaaa

SEQ ID NO: 73396 - DNA, 25 bp, Rattus norvegicus
acacgtctgtacttgtctattcaaa

SEQ ID NO: 73397 - DNA, 25 bp, Rattus norvegicus
acacgtctgtagctgttctcgggtg

SEQ ID NO: 73398 - DNA, 25 bp, Rattus norvegicus
acacgtctgtaggtgttctcgggtg

SEQ ID NO: 73399 - DNA, 25 bp, Rattus norvegicus
acacgtcttgcccttgcaaatgaag

SEQ ID NO: 73400 - DNA, 25 bp, Rattus norvegicus
acacgtcttgccgttgcaaatgaag

SEQ ID NO: 73401 - DNA, 25 bp, Rattus norvegicus
acacgtctttgtacttttggaatga

SEQ ID NO: 73402 - DNA, 25 bp, Rattus norvegicus
acacgtctttgtcatacagcaccca

SEQ ID NO: 73403 - DNA, 25 bp, Rattus norvegicus
acacgtctttgtgatacagcaccca

SEQ ID NO: 73404 - DNA, 25 bp, Rattus norvegicus
acacgtctttgttcttttggaatga

SEQ ID NO: 73405 - DNA, 25 bp, Rattus norvegicus
acacgtgagctgatctgttacgcac

SEQ ID NO: 73406 - DNA, 25 bp, Rattus norvegicus
acacgtgagctgttctgttacgcac

SEQ ID NO: 73407 - DNA, 25 bp, Rattus norvegicus
acacgtgatgctcttgtcatgtggc

SEQ ID NO: 73408 - DNA, 25 bp, Rattus norvegicus
acacgtgatgctgttgtcatgtggc

SEQ ID NO: 73409 - DNA, 25 bp, Rattus norvegicus
acacgtgcacacatagtttcttaag

SEQ ID NO: 73410 - DNA, 25 bp, Rattus norvegicus
acacgtgcacacttagtttcttaag

SEQ ID NO: 73411 - DNA, 25 bp, Rattus norvegicus
acacgtgccctcagagaacctggag

SEQ ID NO: 73412 - DNA, 25 bp, Rattus norvegicus
acacgtgccctctgagaacctggag

SEQ ID NO: 73413 - DNA, 25 bp, Rattus norvegicus
acacgtgcttgaatctactcctgtt

SEQ ID NO: 73414 - DNA, 25 bp, Rattus norvegicus
acacgtgcttgattctactcctgtt

SEQ ID NO: 73415 - DNA, 25 bp, Rattus norvegicus
acacgtgcttgtattcttacaggtc

SEQ ID NO: 73416 - DNA, 25 bp, Rattus norvegicus
acacgtgcttgtcactgctgggagt

SEQ ID NO: 73417 - DNA, 25 bp, Rattus norvegicus
acacgtgcttgtgactgctgggagt

SEQ ID NO: 73418 - DNA, 25 bp, Rattus norvegicus
acacgtgcttgttttcttacaggtc

SEQ ID NO: 73419 - DNA, 25 bp, Rattus norvegicus
acacgtggacggcagattcttttat

SEQ ID NO: 73420 - DNA, 25 bp, Rattus norvegicus
acacgtggacgggagattcttttat

SEQ ID NO: 73421 - DNA, 25 bp, Rattus norvegicus
acacgtggctggaagtgcctgcttg

SEQ ID NO: 73422 - DNA, 25 bp, Rattus norvegicus
acacgtggctggtagtgcctgcttg

SEQ ID NO: 73423 - DNA, 25 bp, Rattus norvegicus
acacgtggtgacagcgttctgcagt

SEQ ID NO: 73424 - DNA, 25 bp, Rattus norvegicus
acacgtggtgacatatggctggcga

SEQ ID NO: 73425 - DNA, 25 bp, Rattus norvegicus
acacgtggtgactgcgttctgcagt

SEQ ID NO: 73426 - DNA, 25 bp, Rattus norvegicus
acacgtggtgacttatggctggcga

SEQ ID NO: 73427 - DNA, 25 bp, Rattus norvegicus
acacgtggtgtgactcagtgatcca

SEQ ID NO: 73428 - DNA, 25 bp, Rattus norvegicus
acacgtggtgtgtctcagtgatcca

SEQ ID NO: 73429 - DNA, 25 bp, Rattus norvegicus
acacgtgtacaaagactggacatct

SEQ ID NO: 73430 - DNA, 25 bp, Rattus norvegicus
acacgtgtacaatgactggacatct

SEQ ID NO: 73431 - DNA, 25 bp, Rattus norvegicus
acacgtgtactaaacccaggatgga

SEQ ID NO: 73432 - DNA, 25 bp, Rattus norvegicus
acacgtgtactatacccaggatgga

SEQ ID NO: 73433 - DNA, 25 bp, Rattus norvegicus
acacgtgtcctacatactcacaata

SEQ ID NO: 73434 - DNA, 25 bp, Rattus norvegicus
acacgtgtcctagatactcacaata

SEQ ID NO: 73435 - DNA, 25 bp, Rattus norvegicus
acacgtgtgaggagcccgattgcaa

SEQ ID NO: 73436 - DNA, 25 bp, Rattus norvegicus
acacgtgtgaggtgcccgattgcaa

SEQ ID NO: 73437 - DNA, 25 bp, Rattus norvegicus
acacgtgtggccaatgagatccatt

SEQ ID NO: 73438 - DNA, 25 bp, Rattus norvegicus
acacgtgtggcctatgagatccatt

SEQ ID NO: 73439 - DNA, 25 bp, Rattus norvegicus
acacgtgtgtatcccattccttgta

SEQ ID NO: 73440 - DNA, 25 bp, Rattus norvegicus
acacgtgtgtatgccattccttgta

SEQ ID NO: 73441 - DNA, 25 bp, Rattus norvegicus
acacgtgttagaccagaagggatat

SEQ ID NO: 73442 - DNA, 25 bp, Rattus norvegicus
acacgtgttagagcagaagggatat

SEQ ID NO: 73443 - DNA, 25 bp, Rattus norvegicus
acacgtgtttgacggtttgtcacaa

SEQ ID NO: 73444 - DNA, 25 bp, Rattus norvegicus
acacgtgtttgagggtttgtcacaa

SEQ ID NO: 73445 - DNA, 25 bp, Rattus norvegicus
acacgttagccgatttcatgacaat

SEQ ID NO: 73446 - DNA, 25 bp, Rattus norvegicus
acacgttagccgttttcatgacaat

SEQ ID NO: 73447 - DNA, 25 bp, Rattus norvegicus
acacgttcatgaccaggctttgaag

SEQ ID NO: 73448 - DNA, 25 bp, Rattus norvegicus
acacgttcatgagcaggctttgaag

SEQ ID NO: 73449 - DNA, 25 bp, Rattus norvegicus
acacgttcccgtcagtgtagaccac

SEQ ID NO: 73450 - DNA, 25 bp, Rattus norvegicus
acacgttcccgtgagtgtagaccac

SEQ ID NO: 73451 - DNA, 25 bp, Rattus norvegicus
acacgttgagtcatgggttccagga

SEQ ID NO: 73452 - DNA, 25 bp, Rattus norvegicus
acacgttgagtcttgggttccagga

SEQ ID NO: 73453 - DNA, 25 bp, Rattus norvegicus
acacgttgcggaaggcctttgctcg

SEQ ID NO: 73454 - DNA, 25 bp, Rattus norvegicus
acacgttgcggatggcctttgctcg

SEQ ID NO: 73455 - DNA, 25 bp, Rattus norvegicus
acacgttgtcgaagcccagcacggc

SEQ ID NO: 73456 - DNA, 25 bp, Rattus norvegicus
acacgttgtcgatgcccagcacggc

SEQ ID NO: 73457 - DNA, 25 bp, Rattus norvegicus
acacgttgtttgaattgcttctcca

SEQ ID NO: 73458 - DNA, 25 bp, Rattus norvegicus
acacgttgtttgtattgcttctcca

SEQ ID NO: 73459 - DNA, 25 bp, Rattus norvegicus
acacgttgttttaatagaagcatgc

SEQ ID NO: 73460 - DNA, 25 bp, Rattus norvegicus
acacgttgtttttatagaagcatgc

SEQ ID NO: 73461 - DNA, 25 bp, Rattus norvegicus
acacgtttacaacagatggcccgct

SEQ ID NO: 73462 - DNA, 25 bp, Rattus norvegicus
acacgtttacaagagatggcccgct

SEQ ID NO: 73463 - DNA, 25 bp, Rattus norvegicus
acacgtttatctactactggtacct

SEQ ID NO: 73464 - DNA, 25 bp, Rattus norvegicus
acacgtttatcttctactggtacct

SEQ ID NO: 73465 - DNA, 25 bp, Rattus norvegicus
acacgtttctccctacgggtgcaag

SEQ ID NO: 73466 - DNA, 25 bp, Rattus norvegicus
acacgtttctccgtacgggtgcaag

SEQ ID NO: 73467 - DNA, 25 bp, Rattus norvegicus
acacgtttgcttaacacctttcgat

SEQ ID NO: 73468 - DNA, 25 bp, Rattus norvegicus
acacgtttgctttacacctttcgat

SEQ ID NO: 73469 - DNA, 25 bp, Rattus norvegicus
acacgtttggacatgtgcagagcaa

SEQ ID NO: 73470 - DNA, 25 bp, Rattus norvegicus
acacgtttggacttgtgcagagcaa

SEQ ID NO: 73471 - DNA, 25 bp, Rattus norvegicus
acacgttttataaccttggtccctg

SEQ ID NO: 73472 - DNA, 25 bp, Rattus norvegicus
acacgttttatatccttggtccctg

SEQ ID NO: 73473 - DNA, 25 bp, Rattus norvegicus
acacgttttccactacacggcaggg

SEQ ID NO: 73474 - DNA, 25 bp, Rattus norvegicus
acacgttttccagtacacggcaggg

SEQ ID NO: 73475 - DNA, 25 bp, Rattus norvegicus
acactaacacccatcattttcttgg

SEQ ID NO: 73476 - DNA, 25 bp, Rattus norvegicus
acactaacacccttcattttcttgg

SEQ ID NO: 73477 - DNA, 25 bp, Rattus norvegicus
acactaacagctatctttgtgaggg

SEQ ID NO: 73478 - DNA, 25 bp, Rattus norvegicus
acactaacagctttctttgtgaggg

SEQ ID NO: 73479 - DNA, 25 bp, Rattus norvegicus
acactaaggggccagtgtgcccaga

SEQ ID NO: 73480 - DNA, 25 bp, Rattus norvegicus
acactaaggggcgagtgtgcccaga

SEQ ID NO: 73481 - DNA, 25 bp, Rattus norvegicus
acactacacaggacccttgttgcta

SEQ ID NO: 73482 - DNA, 25 bp, Rattus norvegicus
acactacacaggtcccttgttgcta

SEQ ID NO: 73483 - DNA, 25 bp, Rattus norvegicus
acactacaccttcccggaaagagct

SEQ ID NO: 73484 - DNA, 25 bp, Rattus norvegicus
acactacaccttgccggaaagagct

SEQ ID NO: 73485 - DNA, 25 bp, Rattus norvegicus
acactacatattaaggttggccatc

SEQ ID NO: 73486 - DNA, 25 bp, Rattus norvegicus
acactacatatttaggttggccatc

SEQ ID NO: 73487 - DNA, 25 bp, Rattus norvegicus
acactaccagcaatagacagttttg

SEQ ID NO: 73488 - DNA, 25 bp, Rattus norvegicus
acactaccagcattagacagttttg

SEQ ID NO: 73489 - DNA, 25 bp, Rattus norvegicus
acactacctagaagcgttagctgcc

SEQ ID NO: 73490 - DNA, 25 bp, Rattus norvegicus
acactacctagatgcgttagctgcc

SEQ ID NO: 73491 - DNA, 25 bp, Rattus norvegicus
acactacctccccatggaaggacag

SEQ ID NO: 73492 - DNA, 25 bp, Rattus norvegicus
acactacctcccgatggaaggacag

SEQ ID NO: 73493 - DNA, 25 bp, Rattus norvegicus
acactacctctcaggtggtcagcaa

SEQ ID NO: 73494 - DNA, 25 bp, Rattus norvegicus
acactacctctctggtggtcagcaa

SEQ ID NO: 73495 - DNA, 25 bp, Rattus norvegicus
acactacctgtaaggactggccggt

SEQ ID NO: 73496 - DNA, 25 bp, Rattus norvegicus
acactacctgtatggactggccggt

SEQ ID NO: 73497 - DNA, 25 bp, Rattus norvegicus
acactacggcctccagtctgatgaa

SEQ ID NO: 73498 - DNA, 25 bp, Rattus norvegicus
acactacggcctgcagtctgatgaa

SEQ ID NO: 73499 - DNA, 25 bp, Rattus norvegicus
acactactcgtcaggctatggacaa

SEQ ID NO: 73500 - DNA, 25 bp, Rattus norvegicus
acactactcgtctggctatggacaa

SEQ ID NO: 73501 - DNA, 25 bp, Rattus norvegicus
acactacttgtaatggttgcgggat

SEQ ID NO: 73502 - DNA, 25 bp, Rattus norvegicus
acactacttgtattggttgcgggat

SEQ ID NO: 73503 - DNA, 25 bp, Rattus norvegicus
acactactttccaatttctgcagtc

SEQ ID NO: 73504 - DNA, 25 bp, Rattus norvegicus
acactactttcctatttctgcagtc

SEQ ID NO: 73505 - DNA, 25 bp, Rattus norvegicus
acactagaaccacggcagtgcccaa

SEQ ID NO: 73506 - DNA, 25 bp, Rattus norvegicus
acactagaaccagggcagtgcccaa

SEQ ID NO: 73507 - DNA, 25 bp, Rattus norvegicus
acactagaatatccccgcttggatt

SEQ ID NO: 73508 - DNA, 25 bp, Rattus norvegicus
acactagaatatgcccgcttggatt

SEQ ID NO: 73509 - DNA, 25 bp, Rattus norvegicus
acactagaggctcaactctgggctt

SEQ ID NO: 73510 - DNA, 25 bp, Rattus norvegicus
acactagaggctgaactctgggctt

SEQ ID NO: 73511 - DNA, 25 bp, Rattus norvegicus
acactagcccagcaccatggaaaga

SEQ ID NO: 73512 - DNA, 25 bp, Rattus norvegicus
acactagcccaggaccatggaaaga

SEQ ID NO: 73513 - DNA, 25 bp, Rattus norvegicus
acactagctggtaggtggcctctgt

SEQ ID NO: 73514 - DNA, 25 bp, Rattus norvegicus
acactagctggttggtggcctctgt

SEQ ID NO: 73515 - DNA, 25 bp, Rattus norvegicus
acactagctttcattcggcatgctt

SEQ ID NO: 73516 - DNA, 25 bp, Rattus norvegicus
acactagctttctttcggcatgctt

SEQ ID NO: 73517 - DNA, 25 bp, Rattus norvegicus
acactaggactgcaacccacatggg

SEQ ID NO: 73518 - DNA, 25 bp, Rattus norvegicus
acactaggactggaacccacatggg

SEQ ID NO: 73519 - DNA, 25 bp, Rattus norvegicus
acactaggtagtcagctctgcggct

SEQ ID NO: 73520 - DNA, 25 bp, Rattus norvegicus
acactaggtagtgagctctgcggct

SEQ ID NO: 73521 - DNA, 25 bp, Rattus norvegicus
acactagtaagcatttcccacttct

SEQ ID NO: 73522 - DNA, 25 bp, Rattus norvegicus
acactagtaagcttttcccacttct

SEQ ID NO: 73523 - DNA, 25 bp, Rattus norvegicus
acactagtcagtcactgggagccaa

SEQ ID NO: 73524 - DNA, 25 bp, Rattus norvegicus
acactagtcagtgactgggagccaa

SEQ ID NO: 73525 - DNA, 25 bp, Rattus norvegicus
acactagtgaatatatgtgccaagt

SEQ ID NO: 73526 - DNA, 25 bp, Rattus norvegicus
acactagtgaatttatgtgccaagt

SEQ ID NO: 73527 - DNA, 25 bp, Rattus norvegicus
acactagtgcccctgatattgagaa

SEQ ID NO: 73528 - DNA, 25 bp, Rattus norvegicus
acactagtgcccgtgatattgagaa

SEQ ID NO: 73529 - DNA, 25 bp, Rattus norvegicus
acactagttgtgactctatctcagc

SEQ ID NO: 73530 - DNA, 25 bp, Rattus norvegicus
acactagttgtgtctctatctcagc

SEQ ID NO: 73531 - DNA, 25 bp, Rattus norvegicus
acactatagcacaagatacacacac

SEQ ID NO: 73532 - DNA, 25 bp, Rattus norvegicus
acactatagcactagatacacacac

SEQ ID NO: 73533 - DNA, 25 bp, Rattus norvegicus
acactatcaatgctttggccacttg

SEQ ID NO: 73534 - DNA, 25 bp, Rattus norvegicus
acactatcaatggtttggccacttg

SEQ ID NO: 73535 - DNA, 25 bp, Rattus norvegicus
acactatcacttctacggcagtttt

SEQ ID NO: 73536 - DNA, 25 bp, Rattus norvegicus
acactatcacttgtacggcagtttt

SEQ ID NO: 73537 - DNA, 25 bp, Rattus norvegicus
acactatcatctcgtctgctgggac

SEQ ID NO: 73538 - DNA, 25 bp, Rattus norvegicus
acactatcatctggtctgctgggac

SEQ ID NO: 73539 - DNA, 25 bp, Rattus norvegicus
acactatcccagagcccttgagtgg

SEQ ID NO: 73540 - DNA, 25 bp, Rattus norvegicus
acactatcccagtgcccttgagtgg

SEQ ID NO: 73541 - DNA, 25 bp, Rattus norvegicus
acactatccggacccttgggcctat

SEQ ID NO: 73542 - DNA, 25 bp, Rattus norvegicus
acactatccggagccttgggcctat

SEQ ID NO: 73543 - DNA, 25 bp, Rattus norvegicus
acactatccttccattcatgtaact

SEQ ID NO: 73544 - DNA, 25 bp, Rattus norvegicus
acactatccttcgattcatgtaact

SEQ ID NO: 73545 - DNA, 25 bp, Rattus norvegicus
acactatctgttattgctgccactg

SEQ ID NO: 73546 - DNA, 25 bp, Rattus norvegicus
acactatctgtttttgctgccactg

SEQ ID NO: 73547 - DNA, 25 bp, Rattus norvegicus
acactatcttgaatgtactcttcag

SEQ ID NO: 73548 - DNA, 25 bp, Rattus norvegicus
acactatcttgattgtactcttcag

SEQ ID NO: 73549 - DNA, 25 bp, Rattus norvegicus
acactatgctgtcgccctgtattgg

SEQ ID NO: 73550 - DNA, 25 bp, Rattus norvegicus
acactatgctgtggccctgtattgg

SEQ ID NO: 73551 - DNA, 25 bp, Rattus norvegicus
acactattaaacctcctctgctgtg

SEQ ID NO: 73552 - DNA, 25 bp, Rattus norvegicus
acactattaaacgtcctctgctgtg

SEQ ID NO: 73553 - DNA, 25 bp, Rattus norvegicus
acactattgggcctcatcggttaga

SEQ ID NO: 73554 - DNA, 25 bp, Rattus norvegicus
acactattgggcgtcatcggttaga

SEQ ID NO: 73555 - DNA, 25 bp, Rattus norvegicus
acactatttcttcttggtgcctaat

SEQ ID NO: 73556 - DNA, 25 bp, Rattus norvegicus
acactatttcttgttggtgcctaat

SEQ ID NO: 73557 - DNA, 25 bp, Rattus norvegicus
acactatttgtgatattgttggaaa

SEQ ID NO: 73558 - DNA, 25 bp, Rattus norvegicus
acactatttgtgttattgttggaaa

SEQ ID NO: 73559 - DNA, 25 bp, Rattus norvegicus
acactcaaactgacgtctctgttac

SEQ ID NO: 73560 - DNA, 25 bp, Rattus norvegicus
acactcaaactgtcgtctctgttac

SEQ ID NO: 73561 - DNA, 25 bp, Rattus norvegicus
acactcaaagccctcatcaaatttt

SEQ ID NO: 73562 - DNA, 25 bp, Rattus norvegicus
acactcaaagccgtcatcaaatttt

SEQ ID NO: 73563 - DNA, 25 bp, Rattus norvegicus
acactcaacaccaaacattctatac

SEQ ID NO: 73564 - DNA, 25 bp, Rattus norvegicus
acactcaacacctaacattctatac

SEQ ID NO: 73565 - DNA, 25 bp, Rattus norvegicus
acactcaattgtacttttctgggtc

SEQ ID NO: 73566 - DNA, 25 bp, Rattus norvegicus
acactcaattgttcttttctgggtc

SEQ ID NO: 73567 - DNA, 25 bp, Rattus norvegicus
acactcacatgacctggttgctggg

SEQ ID NO: 73568 - DNA, 25 bp, Rattus norvegicus
acactcacatgagctggttgctggg

SEQ ID NO: 73569 - DNA, 25 bp, Rattus norvegicus
acactcacctgcatgatccagaatt

SEQ ID NO: 73570 - DNA, 25 bp, Rattus norvegicus
acactcacctgcctgaataacaatc

SEQ ID NO: 73571 - DNA, 25 bp, Rattus norvegicus
acactcacctgcgtgaataacaatc

SEQ ID NO: 73572 - DNA, 25 bp, Rattus norvegicus
acactcacctgcttgatccagaatt

SEQ ID NO: 73573 - DNA, 25 bp, Rattus norvegicus
acactcactggaaacctgtctagaa

SEQ ID NO: 73574 - DNA, 25 bp, Rattus norvegicus
acactcactggatacctgtctagaa

SEQ ID NO: 73575 - DNA, 25 bp, Rattus norvegicus
acactcagctcacctctgatgaagg

SEQ ID NO: 73576 - DNA, 25 bp, Rattus norvegicus
acactcagctcagctctgatgaagg

SEQ ID NO: 73577 - DNA, 25 bp, Rattus norvegicus
acactcaggacgatgcagaggccct

SEQ ID NO: 73578 - DNA, 25 bp, Rattus norvegicus
acactcaggacgttgcagaggccct

SEQ ID NO: 73579 - DNA, 25 bp, Rattus norvegicus
acactcaggagacaatgtgaccctg

SEQ ID NO: 73580 - DNA, 25 bp, Rattus norvegicus
acactcaggagagaatgtgaccctg

SEQ ID NO: 73581 - DNA, 25 bp, Rattus norvegicus
acactcaggaggatggaaagttcca

SEQ ID NO: 73582 - DNA, 25 bp, Rattus norvegicus
acactcaggaggttggaaagttcca

SEQ ID NO: 73583 - DNA, 25 bp, Rattus norvegicus
acactcagggccatatttcaactag

SEQ ID NO: 73584 - DNA, 25 bp, Rattus norvegicus
acactcagggccttatttcaactag

SEQ ID NO: 73585 - DNA, 25 bp, Rattus norvegicus
acactcagggtgctggctacagctc

SEQ ID NO: 73586 - DNA, 25 bp, Rattus norvegicus
acactcagggtggtggctacagctc

SEQ ID NO: 73587 - DNA, 25 bp, Rattus norvegicus
acactcagtcccaggaagttcagag

SEQ ID NO: 73588 - DNA, 25 bp, Rattus norvegicus
acactcagtccctggaagttcagag

SEQ ID NO: 73589 - DNA, 25 bp, Rattus norvegicus
acactcagtgtgacaccagctggaa

SEQ ID NO: 73590 - DNA, 25 bp, Rattus norvegicus
acactcagtgtgtcaccagctggaa

SEQ ID NO: 73591 - DNA, 25 bp, Rattus norvegicus
acactcagtttcattcagtgctgaa

SEQ ID NO: 73592 - DNA, 25 bp, Rattus norvegicus
acactcagtttctttcagtgctgaa

SEQ ID NO: 73593 - DNA, 25 bp, Rattus norvegicus
acactcataagaaacattaccactg

SEQ ID NO: 73594 - DNA, 25 bp, Rattus norvegicus
acactcataagatacattaccactg

SEQ ID NO: 73595 - DNA, 25 bp, Rattus norvegicus
acactcatagtcactcattctgaag

SEQ ID NO: 73596 - DNA, 25 bp, Rattus norvegicus
acactcatagtctctcattctgaag

SEQ ID NO: 73597 - DNA, 25 bp, Rattus norvegicus
acactcatatgtacgcgggcaccgg

SEQ ID NO: 73598 - DNA, 25 bp, Rattus norvegicus
acactcatatgttcgcgggcaccgg

SEQ ID NO: 73599 - DNA, 25 bp, Rattus norvegicus
acactcatcctcaggcaacagagag

SEQ ID NO: 73600 - DNA, 25 bp, Rattus norvegicus
acactcatcctctggcaacagagag

SEQ ID NO: 73601 - DNA, 25 bp, Rattus norvegicus
acactcatcgtgcttgttggcgcca

SEQ ID NO: 73602 - DNA, 25 bp, Rattus norvegicus
acactcatcgtggttgttggcgcca

SEQ ID NO: 73603 - DNA, 25 bp, Rattus norvegicus
acactcatctgtatacttggctaat

SEQ ID NO: 73604 - DNA, 25 bp, Rattus norvegicus
acactcatctgtttacttggctaat

SEQ ID NO: 73605 - DNA, 25 bp, Rattus norvegicus
acactcattcccacttttaggtgat

SEQ ID NO: 73606 - DNA, 25 bp, Rattus norvegicus
acactcattccctcttttaggtgat

SEQ ID NO: 73607 - DNA, 25 bp, Rattus norvegicus
acactcattcgtacttcagtctgga

SEQ ID NO: 73608 - DNA, 25 bp, Rattus norvegicus
acactcattcgttcttcagtctgga

SEQ ID NO: 73609 - DNA, 25 bp, Rattus norvegicus
acactcattctaaatttgctggcaa

SEQ ID NO: 73610 - DNA, 25 bp, Rattus norvegicus
acactcattctatatttgctggcaa

SEQ ID NO: 73611 - DNA, 25 bp, Rattus norvegicus
acactccaatgtctcttttgcagga

SEQ ID NO: 73612 - DNA, 25 bp, Rattus norvegicus
acactccaatgtgtcttttgcagga

SEQ ID NO: 73613 - DNA, 25 bp, Rattus norvegicus
acactccacgcacatgtgtgcaggc

SEQ ID NO: 73614 - DNA, 25 bp, Rattus norvegicus
acactccacgcagatgtgtgcaggc

SEQ ID NO: 73615 - DNA, 25 bp, Rattus norvegicus
acactccataaacatgttcccaggg

SEQ ID NO: 73616 - DNA, 25 bp, Rattus norvegicus
acactccataaagatgttcccaggg

SEQ ID NO: 73617 - DNA, 25 bp, Rattus norvegicus
acactcccagagctgatatcacagg

SEQ ID NO: 73618 - DNA, 25 bp, Rattus norvegicus
acactcccagaggtgatatcacagg

SEQ ID NO: 73619 - DNA, 25 bp, Rattus norvegicus
acactcccctttacgggatatgaga

SEQ ID NO: 73620 - DNA, 25 bp, Rattus norvegicus
acactccccttttcgggatatgaga

SEQ ID NO: 73621 - DNA, 25 bp, Rattus norvegicus
acactcccgactctcttagaggaag

SEQ ID NO: 73622 - DNA, 25 bp, Rattus norvegicus
acactcccgactgtcttagaggaag

SEQ ID NO: 73623 - DNA, 25 bp, Rattus norvegicus
acactcccggcccaataattattga

SEQ ID NO: 73624 - DNA, 25 bp, Rattus norvegicus
acactcccggccgaataattattga

SEQ ID NO: 73625 - DNA, 25 bp, Rattus norvegicus
acactccctgatcatttctgtgaaa

SEQ ID NO: 73626 - DNA, 25 bp, Rattus norvegicus
acactccctgatgatttctgtgaaa

SEQ ID NO: 73627 - DNA, 25 bp, Rattus norvegicus
acactccgaggacaggcagccagag

SEQ ID NO: 73628 - DNA, 25 bp, Rattus norvegicus
acactccgaggagaggcagccagag

SEQ ID NO: 73629 - DNA, 25 bp, Rattus norvegicus
acactccgggctctgcatgtttaaa

SEQ ID NO: 73630 - DNA, 25 bp, Rattus norvegicus
acactccgggctgtgcatgtttaaa

SEQ ID NO: 73631 - DNA, 25 bp, Rattus norvegicus
acactcctattaaacgctgtctgca

SEQ ID NO: 73632 - DNA, 25 bp, Rattus norvegicus
acactcctattatacgctgtctgca

SEQ ID NO: 73633 - DNA, 25 bp, Rattus norvegicus
acactcctcaagacagctgccaaag

SEQ ID NO: 73634 - DNA, 25 bp, Rattus norvegicus
acactcctcaagtcagctgccaaag

SEQ ID NO: 73635 - DNA, 25 bp, Rattus norvegicus
acactcctcttgcaccaagcaagaa

SEQ ID NO: 73636 - DNA, 25 bp, Rattus norvegicus
acactcctcttggaccaagcaagaa

SEQ ID NO: 73637 - DNA, 25 bp, Rattus norvegicus
acactcctgcaacgcggtcagacaa

SEQ ID NO: 73638 - DNA, 25 bp, Rattus norvegicus
acactcctgcaaggcggtcagacaa

SEQ ID NO: 73639 - DNA, 25 bp, Rattus norvegicus
acactcctgcatcctgacagtagta

SEQ ID NO: 73640 - DNA, 25 bp, Rattus norvegicus
acactcctgcatgctgacagtagta

SEQ ID NO: 73641 - DNA, 25 bp, Rattus norvegicus
acactcctggcacttgtatggtttc

SEQ ID NO: 73642 - DNA, 25 bp, Rattus norvegicus
acactcctggcagttgtatggtttc

SEQ ID NO: 73643 - DNA, 25 bp, Rattus norvegicus
acactcctgtcacgcgccaaagtgg

SEQ ID NO: 73644 - DNA, 25 bp, Rattus norvegicus
acactcctgtcaggcgccaaagtgg

SEQ ID NO: 73645 - DNA, 25 bp, Rattus norvegicus
acactcctgtgtcctttggtggaca

SEQ ID NO: 73646 - DNA, 25 bp, Rattus norvegicus
acactcctgtgtgctttggtggaca

SEQ ID NO: 73647 - DNA, 25 bp, Rattus norvegicus
acactcctgtttactcaaggtccaa

SEQ ID NO: 73648 - DNA, 25 bp, Rattus norvegicus
acactcctgttttctcaaggtccaa

SEQ ID NO: 73649 - DNA, 25 bp, Rattus norvegicus
acactccttaggcttagaatgggca

SEQ ID NO: 73650 - DNA, 25 bp, Rattus norvegicus
acactccttagggttagaatgggca

SEQ ID NO: 73651 - DNA, 25 bp, Rattus norvegicus
acactcgagtaacggctgaccccag

SEQ ID NO: 73652 - DNA, 25 bp, Rattus norvegicus
acactcgagtaagggctgaccccag

SEQ ID NO: 73653 - DNA, 25 bp, Rattus norvegicus
acactcgctgtacttcaagtatgca

SEQ ID NO: 73654 - DNA, 25 bp, Rattus norvegicus
acactcgctgtagttcaagtatgca

SEQ ID NO: 73655 - DNA, 25 bp, Rattus norvegicus
acactcgcttcccttttcagagata

SEQ ID NO: 73656 - DNA, 25 bp, Rattus norvegicus
acactcgcttccgttttcagagata

SEQ ID NO: 73657 - DNA, 25 bp, Rattus norvegicus
acactcggcatcagacctggcatga

SEQ ID NO: 73658 - DNA, 25 bp, Rattus norvegicus
acactcggcatctgacctggcatga

SEQ ID NO: 73659 - DNA, 25 bp, Rattus norvegicus
acactcggccaacaatcactgtcaa

SEQ ID NO: 73660 - DNA, 25 bp, Rattus norvegicus
acactcggccaagaatcactgtcaa

SEQ ID NO: 73661 - DNA, 25 bp, Rattus norvegicus
acactcggctcaacgtgttcgaaaa

SEQ ID NO: 73662 - DNA, 25 bp, Rattus norvegicus
acactcggctcatcgtgttcgaaaa

SEQ ID NO: 73663 - DNA, 25 bp, Rattus norvegicus
acactcggtacaatcgggagcgcat

SEQ ID NO: 73664 - DNA, 25 bp, Rattus norvegicus
acactcggtacattcgggagcgcat

SEQ ID NO: 73665 - DNA, 25 bp, Rattus norvegicus
acactcggtgagctgtcctatattg

SEQ ID NO: 73666 - DNA, 25 bp, Rattus norvegicus
acactcggtgaggtgtcctatattg

SEQ ID NO: 73667 - DNA, 25 bp, Rattus norvegicus
acactcgtgagcacgtgctggcagt

SEQ ID NO: 73668 - DNA, 25 bp, Rattus norvegicus
acactcgtgagctcgtgctggcagt

SEQ ID NO: 73669 - DNA, 25 bp, Rattus norvegicus
acactcgtgcgaaggttgggtactg

SEQ ID NO: 73670 - DNA, 25 bp, Rattus norvegicus
acactcgtgcgatggttgggtactg

SEQ ID NO: 73671 - DNA, 25 bp, Rattus norvegicus
acactcgtttagctggtctgccatt

SEQ ID NO: 73672 - DNA, 25 bp, Rattus norvegicus
acactcgtttaggtggtctgccatt

SEQ ID NO: 73673 - DNA, 25 bp, Rattus norvegicus
acactctaacctcctttcatctgag

SEQ ID NO: 73674 - DNA, 25 bp, Rattus norvegicus
acactctaacctgctttcatctgag

SEQ ID NO: 73675 - DNA, 25 bp, Rattus norvegicus
acactctaactgaagaccttgtctg

SEQ ID NO: 73676 - DNA, 25 bp, Rattus norvegicus
acactctaactgtagaccttgtctg

SEQ ID NO: 73677 - DNA, 25 bp, Rattus norvegicus
acactctaagctagtttactatttg

SEQ ID NO: 73678 - DNA, 25 bp, Rattus norvegicus
acactctaagcttgtttactatttg

SEQ ID NO: 73679 - DNA, 25 bp, Rattus norvegicus
acactctaattaatggctgtcctta

SEQ ID NO: 73680 - DNA, 25 bp, Rattus norvegicus
acactctaattattggctgtcctta

SEQ ID NO: 73681 - DNA, 25 bp, Rattus norvegicus
acactctagagaagcttggacccag

SEQ ID NO: 73682 - DNA, 25 bp, Rattus norvegicus
acactctagagatgcttggacccag

SEQ ID NO: 73683 - DNA, 25 bp, Rattus norvegicus
acactctagcttcggatcagctcca

SEQ ID NO: 73684 - DNA, 25 bp, Rattus norvegicus
acactctagcttgggatcagctcca

SEQ ID NO: 73685 - DNA, 25 bp, Rattus norvegicus
acactctattagattccattcccag

SEQ ID NO: 73686 - DNA, 25 bp, Rattus norvegicus
acactctattagtttccattcccag

SEQ ID NO: 73687 - DNA, 25 bp, Rattus norvegicus
acactctcaaacaggtgcttttccc

SEQ ID NO: 73688 - DNA, 25 bp, Rattus norvegicus
acactctcaaactggtgcttttccc

SEQ ID NO: 73689 - DNA, 25 bp, Rattus norvegicus
acactctcaagaacgttagccttac

SEQ ID NO: 73690 - DNA, 25 bp, Rattus norvegicus
acactctcaagatcgttagccttac

SEQ ID NO: 73691 - DNA, 25 bp, Rattus norvegicus
acactctcacagaagacggtcgcga

SEQ ID NO: 73692 - DNA, 25 bp, Rattus norvegicus
acactctcacagtagacggtcgcga

SEQ ID NO: 73693 - DNA, 25 bp, Rattus norvegicus
acactctcagcaagaccggatcagg

SEQ ID NO: 73694 - DNA, 25 bp, Rattus norvegicus
acactctcagcatgaccggatcagg

SEQ ID NO: 73695 - DNA, 25 bp, Rattus norvegicus
acactctcattcaaggcacttactg

SEQ ID NO: 73696 - DNA, 25 bp, Rattus norvegicus
acactctcattctaggcacttactg

SEQ ID NO: 73697 - DNA, 25 bp, Rattus norvegicus
acactctccggtaagtagagccatt

SEQ ID NO: 73698 - DNA, 25 bp, Rattus norvegicus
acactctccggttagtagagccatt

SEQ ID NO: 73699 - DNA, 25 bp, Rattus norvegicus
acactctcgactcttctagtcttat

SEQ ID NO: 73700 - DNA, 25 bp, Rattus norvegicus
acactctcgactgttctagtcttat

SEQ ID NO: 73701 - DNA, 25 bp, Rattus norvegicus
acactctctcatctaatctgtggac

SEQ ID NO: 73702 - DNA, 25 bp, Rattus norvegicus
acactctctcatgtaatctgtggac

SEQ ID NO: 73703 - DNA, 25 bp, Rattus norvegicus
acactctctcgaagagcccgttgga

SEQ ID NO: 73704 - DNA, 25 bp, Rattus norvegicus
acactctctcgatgagcccgttgga

SEQ ID NO: 73705 - DNA, 25 bp, Rattus norvegicus
acactctctgttcatgatgctattc

SEQ ID NO: 73706 - DNA, 25 bp, Rattus norvegicus
acactctctgttgatgatgctattc

SEQ ID NO: 73707 - DNA, 25 bp, Rattus norvegicus
acactctcttccagttcagaggcag

SEQ ID NO: 73708 - DNA, 25 bp, Rattus norvegicus
acactctcttcctgttcagaggcag

SEQ ID NO: 73709 - DNA, 25 bp, Rattus norvegicus
acactctcttctagttgatctacgc

SEQ ID NO: 73710 - DNA, 25 bp, Rattus norvegicus
acactctcttctcggtagcaaagca

SEQ ID NO: 73711 - DNA, 25 bp, Rattus norvegicus
acactctcttctgggtagcaaagca

SEQ ID NO: 73712 - DNA, 25 bp, Rattus norvegicus
acactctcttcttgttgatctacgc

SEQ ID NO: 73713 - DNA, 25 bp, Rattus norvegicus
acactctgaagtagtgcttctccac

SEQ ID NO: 73714 - DNA, 25 bp, Rattus norvegicus
acactctgaagttgtgcttctccac

SEQ ID NO: 73715 - DNA, 25 bp, Rattus norvegicus
acactctgccttaattacagtctgc

SEQ ID NO: 73716 - DNA, 25 bp, Rattus norvegicus
acactctgcctttattacagtctgc

SEQ ID NO: 73717 - DNA, 25 bp, Rattus norvegicus
acactctgctcacactaatctgata

SEQ ID NO: 73718 - DNA, 25 bp, Rattus norvegicus
acactctgctcagactaatctgata

SEQ ID NO: 73719 - DNA, 25 bp, Rattus norvegicus
acactctggccactcgagaatatct

SEQ ID NO: 73720 - DNA, 25 bp, Rattus norvegicus
acactctggccagtcgagaatatct

SEQ ID NO: 73721 - DNA, 25 bp, Rattus norvegicus
acactctggcttagtggctgctgac

SEQ ID NO: 73722 - DNA, 25 bp, Rattus norvegicus
acactctggctttgtggctgctgac

SEQ ID NO: 73723 - DNA, 25 bp, Rattus norvegicus
acactctgtatccatttgcaattag

SEQ ID NO: 73724 - DNA, 25 bp, Rattus norvegicus
acactctgtatcgatttgcaattag

SEQ ID NO: 73725 - DNA, 25 bp, Rattus norvegicus
acactctgtcttactgccattattt

SEQ ID NO: 73726 - DNA, 25 bp, Rattus norvegicus
acactctgtctttctgccattattt

SEQ ID NO: 73727 - DNA, 25 bp, Rattus norvegicus
acactctgtgccctaattcctttgg

SEQ ID NO: 73728 - DNA, 25 bp, Rattus norvegicus
acactctgtgccgtaattcctttgg

SEQ ID NO: 73729 - DNA, 25 bp, Rattus norvegicus
acactcttaagtattggccatttga

SEQ ID NO: 73730 - DNA, 25 bp, Rattus norvegicus
acactcttaagttttggccatttga

SEQ ID NO: 73731 - DNA, 25 bp, Rattus norvegicus
acactcttctgcaccattggaagtc

SEQ ID NO: 73732 - DNA, 25 bp, Rattus norvegicus
acactcttctgctccattggaagtc

SEQ ID NO: 73733 - DNA, 25 bp, Rattus norvegicus
acactcttgcacctttccaaagtta

SEQ ID NO: 73734 - DNA, 25 bp, Rattus norvegicus
acactcttgcacgtttccaaagtta

SEQ ID NO: 73735 - DNA, 25 bp, Rattus norvegicus
acactcttgttcaccgggcgaggtg

SEQ ID NO: 73736 - DNA, 25 bp, Rattus norvegicus
acactcttgttctccgggcgaggtg

SEQ ID NO: 73737 - DNA, 25 bp, Rattus norvegicus
acactctttaagatcatgcagataa

SEQ ID NO: 73738 - DNA, 25 bp, Rattus norvegicus
acactctttaagttcatgcagataa

SEQ ID NO: 73739 - DNA, 25 bp, Rattus norvegicus
acactctttttcactgttggcaggt

SEQ ID NO: 73740 - DNA, 25 bp, Rattus norvegicus
acactctttttctctgttggcaggt

SEQ ID NO: 73741 - DNA, 25 bp, Rattus norvegicus
acactgaaacttaactgctctgcaa

SEQ ID NO: 73742 - DNA, 25 bp, Rattus norvegicus
acactgaaactttactgctctgcaa

SEQ ID NO: 73743 - DNA, 25 bp, Rattus norvegicus
acactgaaatgtaatcctcctggcc

SEQ ID NO: 73744 - DNA, 25 bp, Rattus norvegicus
acactgaaatgttatcctcctggcc

SEQ ID NO: 73745 - DNA, 25 bp, Rattus norvegicus
acactgaacatccacacctttaatc

SEQ ID NO: 73746 - DNA, 25 bp, Rattus norvegicus
acactgaacatcgacacctttaatc

SEQ ID NO: 73747 - DNA, 25 bp, Rattus norvegicus
acactgaactgcatgtttctctgct

SEQ ID NO: 73748 - DNA, 25 bp, Rattus norvegicus
acactgaactgcttgtttctctgct

SEQ ID NO: 73749 - DNA, 25 bp, Rattus norvegicus
acactgaaggaaatgcctgctagtc

SEQ ID NO: 73750 - DNA, 25 bp, Rattus norvegicus
acactgaaggaattgcctgctagtc

SEQ ID NO: 73751 - DNA, 25 bp, Rattus norvegicus
acactgaaggcaccgtgggtgccac

SEQ ID NO: 73752 - DNA, 25 bp, Rattus norvegicus
acactgaaggcagcgtgggtgccac

SEQ ID NO: 73753 - DNA, 25 bp, Rattus norvegicus
acactgaagggcagttcatgtctgt

SEQ ID NO: 73754 - DNA, 25 bp, Rattus norvegicus
acactgaagggctgttcatgtctgt

SEQ ID NO: 73755 - DNA, 25 bp, Rattus norvegicus
acactgaagtccaggcctgcgtgag

SEQ ID NO: 73756 - DNA, 25 bp, Rattus norvegicus
acactgaagtcctggcctgcgtgag

SEQ ID NO: 73757 - DNA, 25 bp, Rattus norvegicus
acactgaatcagaggctagaggccg

SEQ ID NO: 73758 - DNA, 25 bp, Rattus norvegicus
acactgaatcagtggctagaggccg

SEQ ID NO: 73759 - DNA, 25 bp, Rattus norvegicus
acactgaatgaaagctgaccgacca

SEQ ID NO: 73760 - DNA, 25 bp, Rattus norvegicus
acactgaatgaatgctgaccgacca

SEQ ID NO: 73761 - DNA, 25 bp, Rattus norvegicus
acactgacagctcgtaaggtcctta

SEQ ID NO: 73762 - DNA, 25 bp, Rattus norvegicus
acactgacagctggtaaggtcctta

SEQ ID NO: 73763 - DNA, 25 bp, Rattus norvegicus
acactgacagtgacccctgggtggg

SEQ ID NO: 73764 - DNA, 25 bp, Rattus norvegicus
acactgacagtgtcccctgggtggg

SEQ ID NO: 73765 - DNA, 25 bp, Rattus norvegicus
acactgacggtgatgctttaaactg

SEQ ID NO: 73766 - DNA, 25 bp, Rattus norvegicus
acactgacggtgttgctttaaactg

SEQ ID NO: 73767 - DNA, 25 bp, Rattus norvegicus
acactgactatacaagctccccaaa

SEQ ID NO: 73768 - DNA, 25 bp, Rattus norvegicus
acactgactatagaagctccccaaa

SEQ ID NO: 73769 - DNA, 25 bp, Rattus norvegicus
acactgactgtgactatctagaaaa

SEQ ID NO: 73770 - DNA, 25 bp, Rattus norvegicus
acactgactgtgtctatctagaaaa

SEQ ID NO: 73771 - DNA, 25 bp, Rattus norvegicus
acactgagctccagcgcttcatgag

SEQ ID NO: 73772 - DNA, 25 bp, Rattus norvegicus
acactgagctcctgcgcttcatgag

SEQ ID NO: 73773 - DNA, 25 bp, Rattus norvegicus
acactgagcttgagttcccagcaat

SEQ ID NO: 73774 - DNA, 25 bp, Rattus norvegicus
acactgagcttgtgttcccagcaat

SEQ ID NO: 73775 - DNA, 25 bp, Rattus norvegicus
acactgaggcacctgggctctggaa

SEQ ID NO: 73776 - DNA, 25 bp, Rattus norvegicus
acactgaggcacgtgggctctggaa

SEQ ID NO: 73777 - DNA, 25 bp, Rattus norvegicus
acactgaggctcacaatccaagtag

SEQ ID NO: 73778 - DNA, 25 bp, Rattus norvegicus
acactgaggctctcaatccaagtag

SEQ ID NO: 73779 - DNA, 25 bp, Rattus norvegicus
acactgagggccctgctaggtcaag

SEQ ID NO: 73780 - DNA, 25 bp, Rattus norvegicus
acactgagggccgtgctaggtcaag

SEQ ID NO: 73781 - DNA, 25 bp, Rattus norvegicus
acactgaggtgcagctgtgggctgt

SEQ ID NO: 73782 - DNA, 25 bp, Rattus norvegicus
acactgaggtgctgctgtgggctgt

SEQ ID NO: 73783 - DNA, 25 bp, Rattus norvegicus
acactgaggtgtatgtagaactgac

SEQ ID NO: 73784 - DNA, 25 bp, Rattus norvegicus
acactgaggtgtctgcaaaagggca

SEQ ID NO: 73785 - DNA, 25 bp, Rattus norvegicus
acactgaggtgtgtgcaaaagggca

SEQ ID NO: 73786 - DNA, 25 bp, Rattus norvegicus
acactgaggtgtttgtagaactgac

SEQ ID NO: 73787 - DNA, 25 bp, Rattus norvegicus
acactgagtcttacctagtctgaac

SEQ ID NO: 73788 - DNA, 25 bp, Rattus norvegicus
acactgagtctttcctagtctgaac

SEQ ID NO: 73789 - DNA, 25 bp, Rattus norvegicus
acactgagtgccctgcctagagtgc

SEQ ID NO: 73790 - DNA, 25 bp, Rattus norvegicus
acactgagtgccgtgcctagagtgc

SEQ ID NO: 73791 - DNA, 25 bp, Rattus norvegicus
acactgagtgtgatgcatacctgta

SEQ ID NO: 73792 - DNA, 25 bp, Rattus norvegicus
acactgagtgtgttgcatacctgta

SEQ ID NO: 73793 - DNA, 25 bp, Rattus norvegicus
acactgatcctgcagctggatggta

SEQ ID NO: 73794 - DNA, 25 bp, Rattus norvegicus
acactgatcctggagctggatggta

SEQ ID NO: 73795 - DNA, 25 bp, Rattus norvegicus
acactgattaaaaatgccctgcaca

SEQ ID NO: 73796 - DNA, 25 bp, Rattus norvegicus
acactgattaaatatgccctgcaca

SEQ ID NO: 73797 - DNA, 25 bp, Rattus norvegicus
acactgcaagctcccgtattttgag

SEQ ID NO: 73798 - DNA, 25 bp, Rattus norvegicus
acactgcaagctgccgtattttgag

SEQ ID NO: 73799 - DNA, 25 bp, Rattus norvegicus
acactgcacagtaaatggcttcctt

SEQ ID NO: 73800 - DNA, 25 bp, Rattus norvegicus
acactgcacagttaatggcttcctt

SEQ ID NO: 73801 - DNA, 25 bp, Rattus norvegicus
acactgcacattataagtgactgga

SEQ ID NO: 73802 - DNA, 25 bp, Rattus norvegicus
acactgcacattttaagtgactgga

SEQ ID NO: 73803 - DNA, 25 bp, Rattus norvegicus
acactgcagagtacccagcatgtgc

SEQ ID NO: 73804 - DNA, 25 bp, Rattus norvegicus
acactgcagagttcccagcatgtgc

SEQ ID NO: 73805 - DNA, 25 bp, Rattus norvegicus
acactgcaggcgaaggtagtacaca

SEQ ID NO: 73806 - DNA, 25 bp, Rattus norvegicus
acactgcaggcgtaggtagtacaca

SEQ ID NO: 73807 - DNA, 25 bp, Rattus norvegicus
acactgcaggtgctcgtactacaga

SEQ ID NO: 73808 - DNA, 25 bp, Rattus norvegicus
acactgcaggtggtcgtactacaga

SEQ ID NO: 73809 - DNA, 25 bp, Rattus norvegicus
acactgcagtttaatctttaggctt

SEQ ID NO: 73810 - DNA, 25 bp, Rattus norvegicus
acactgcagttttatctttaggctt

SEQ ID NO: 73811 - DNA, 25 bp, Rattus norvegicus
acactgcatcgaaccagtcgacagg

SEQ ID NO: 73812 - DNA, 25 bp, Rattus norvegicus
acactgcatcgatccagtcgacagg

SEQ ID NO: 73813 - DNA, 25 bp, Rattus norvegicus
acactgcatgcactagtagcctgga

SEQ ID NO: 73814 - DNA, 25 bp, Rattus norvegicus
acactgcatgcagtagtagcctgga

SEQ ID NO: 73815 - DNA, 25 bp, Rattus norvegicus
acactgcattttactcaccgaagga

SEQ ID NO: 73816 - DNA, 25 bp, Rattus norvegicus
acactgcattttccgtgcactggga

SEQ ID NO: 73817 - DNA, 25 bp, Rattus norvegicus
acactgcattttgcgtgcactggga

SEQ ID NO: 73818 - DNA, 25 bp, Rattus norvegicus
acactgcatttttctcaccgaagga

SEQ ID NO: 73819 - DNA, 25 bp, Rattus norvegicus
acactgccaagtcactgtcctttta

SEQ ID NO: 73820 - DNA, 25 bp, Rattus norvegicus
acactgccaagtgactgtcctttta

SEQ ID NO: 73821 - DNA, 25 bp, Rattus norvegicus
acactgccactgatccaggaaggga

SEQ ID NO: 73822 - DNA, 25 bp, Rattus norvegicus
acactgccactgttccaggaaggga

SEQ ID NO: 73823 - DNA, 25 bp, Rattus norvegicus
acactgccagtgctggaacttccat

SEQ ID NO: 73824 - DNA, 25 bp, Rattus norvegicus
acactgccagtggtggaacttccat

SEQ ID NO: 73825 - DNA, 25 bp, Rattus norvegicus
acactgcccaacatcatgaaagcca

SEQ ID NO: 73826 - DNA, 25 bp, Rattus norvegicus
acactgcccaacttcatgaaagcca

SEQ ID NO: 73827 - DNA, 25 bp, Rattus norvegicus
acactgcccagtacaagagacgaga

SEQ ID NO: 73828 - DNA, 25 bp, Rattus norvegicus
acactgcccagttcaagagacgaga

SEQ ID NO: 73829 - DNA, 25 bp, Rattus norvegicus
acactgcccctgacgcacatgtgag

SEQ ID NO: 73830 - DNA, 25 bp, Rattus norvegicus
acactgcccctgtcgcacatgtgag

SEQ ID NO: 73831 - DNA, 25 bp, Rattus norvegicus
acactgccgtgaacgttatatgacg

SEQ ID NO: 73832 - DNA, 25 bp, Rattus norvegicus
acactgccgtgatcgttatatgacg

SEQ ID NO: 73833 - DNA, 25 bp, Rattus norvegicus
acactgcctcccaagtattagttgt

SEQ ID NO: 73834 - DNA, 25 bp, Rattus norvegicus
acactgcctccctagtattagttgt

SEQ ID NO: 73835 - DNA, 25 bp, Rattus norvegicus
acactgcctccgagattcttggaaa

SEQ ID NO: 73836 - DNA, 25 bp, Rattus norvegicus
acactgcctccgtgattcttggaaa

SEQ ID NO: 73837 - DNA, 25 bp, Rattus norvegicus
acactgcctggtatgtgggtctgtg

SEQ ID NO: 73838 - DNA, 25 bp, Rattus norvegicus
acactgcctggtttgtgggtctgtg

SEQ ID NO: 73839 - DNA, 25 bp, Rattus norvegicus
acactgcgactaccttgcacaggac

SEQ ID NO: 73840 - DNA, 25 bp, Rattus norvegicus
acactgcgactagcttgcacaggac

SEQ ID NO: 73841 - DNA, 25 bp, Rattus norvegicus
acactgcgcagtcatggtcattctt

SEQ ID NO: 73842 - DNA, 25 bp, Rattus norvegicus
acactgcgcagtgatggtcattctt

SEQ ID NO: 73843 - DNA, 25 bp, Rattus norvegicus
acactgcgtcttagcactttgtgcg

SEQ ID NO: 73844 - DNA, 25 bp, Rattus norvegicus
acactgcgtctttgcactttgtgcg

SEQ ID NO: 73845 - DNA, 25 bp, Rattus norvegicus
acactgctacttcttaactgtaatg

SEQ ID NO: 73846 - DNA, 25 bp, Rattus norvegicus
acactgctacttgttaactgtaatg

SEQ ID NO: 73847 - DNA, 25 bp, Rattus norvegicus
acactgctagcgaggtgggctcaga

SEQ ID NO: 73848 - DNA, 25 bp, Rattus norvegicus
acactgctagcgtggtgggctcaga

SEQ ID NO: 73849 - DNA, 25 bp, Rattus norvegicus
acactgctccagatggctggaggcc

SEQ ID NO: 73850 - DNA, 25 bp, Rattus norvegicus
acactgctccagttggctggaggcc

SEQ ID NO: 73851 - DNA, 25 bp, Rattus norvegicus
acactgctgcacatgacctatgaaa

SEQ ID NO: 73852 - DNA, 25 bp, Rattus norvegicus
acactgctgcacttgacctatgaaa

SEQ ID NO: 73853 - DNA, 25 bp, Rattus norvegicus
acactgctgcgtaaatcctatcatt

SEQ ID NO: 73854 - DNA, 25 bp, Rattus norvegicus
acactgctgcgttaatcctatcatt

SEQ ID NO: 73855 - DNA, 25 bp, Rattus norvegicus
acactgctgggacgtgactcttttt

SEQ ID NO: 73856 - DNA, 25 bp, Rattus norvegicus
acactgctgggaggtgactcttttt

SEQ ID NO: 73857 - DNA, 25 bp, Rattus norvegicus
acactgctgtgtacactgctggaca

SEQ ID NO: 73858 - DNA, 25 bp, Rattus norvegicus
acactgctgtgtatagagtatggag

SEQ ID NO: 73859 - DNA, 25 bp, Rattus norvegicus
acactgctgtgttcactgctggaca

SEQ ID NO: 73860 - DNA, 25 bp, Rattus norvegicus
acactgctgtgtttagagtatggag

SEQ ID NO: 73861 - DNA, 25 bp, Rattus norvegicus
acactgcttcacatctttggtttta

SEQ ID NO: 73862 - DNA, 25 bp, Rattus norvegicus
acactgcttcacttctttggtttta

SEQ ID NO: 73863 - DNA, 25 bp, Rattus norvegicus
acactgcttgatccctgccttgaga

SEQ ID NO: 73864 - DNA, 25 bp, Rattus norvegicus
acactgcttgatgcctgccttgaga

SEQ ID NO: 73865 - DNA, 25 bp, Rattus norvegicus
acactgcttgtgcattggtcatctc

SEQ ID NO: 73866 - DNA, 25 bp, Rattus norvegicus
acactgcttgtggattggtcatctc

SEQ ID NO: 73867 - DNA, 25 bp, Rattus norvegicus
acactgcttttcatgtccaaaccag

SEQ ID NO: 73868 - DNA, 25 bp, Rattus norvegicus
acactgcttttcttgtccaaaccag

SEQ ID NO: 73869 - DNA, 25 bp, Rattus norvegicus
acactggaaactctcactcgttcaa

SEQ ID NO: 73870 - DNA, 25 bp, Rattus norvegicus
acactggaaactgtcactcgttcaa

SEQ ID NO: 73871 - DNA, 25 bp, Rattus norvegicus
acactggaaagccatggttcatctg

SEQ ID NO: 73872 - DNA, 25 bp, Rattus norvegicus
acactggaaagcgatggttcatctg

SEQ ID NO: 73873 - DNA, 25 bp, Rattus norvegicus
acactggaaatacggtgcttctgaa

SEQ ID NO: 73874 - DNA, 25 bp, Rattus norvegicus
acactggaaatagggtgcttctgaa

SEQ ID NO: 73875 - DNA, 25 bp, Rattus norvegicus
acactggaagagcttcagtctccaa

SEQ ID NO: 73876 - DNA, 25 bp, Rattus norvegicus
acactggaagaggttcagtctccaa

SEQ ID NO: 73877 - DNA, 25 bp, Rattus norvegicus
acactggaagccctgtaccctgttc

SEQ ID NO: 73878 - DNA, 25 bp, Rattus norvegicus
acactggaagccgtgtaccctgttc

SEQ ID NO: 73879 - DNA, 25 bp, Rattus norvegicus
acactggaagctacctcatatcacc

SEQ ID NO: 73880 - DNA, 25 bp, Rattus norvegicus
acactggaagcttcctcatatcacc

SEQ ID NO: 73881 - DNA, 25 bp, Rattus norvegicus
acactggacgggaatcccttcctgg

SEQ ID NO: 73882 - DNA, 25 bp, Rattus norvegicus
acactggacgggtatcccttcctgg

SEQ ID NO: 73883 - DNA, 25 bp, Rattus norvegicus
acactggagactcggttacaattca

SEQ ID NO: 73884 - DNA, 25 bp, Rattus norvegicus
acactggagactgggttacaattca

SEQ ID NO: 73885 - DNA, 25 bp, Rattus norvegicus
acactggaggacaggtctgcaggtc

SEQ ID NO: 73886 - DNA, 25 bp, Rattus norvegicus
acactggaggactggtctgcaggtc

SEQ ID NO: 73887 - DNA, 25 bp, Rattus norvegicus
acactggagttgcaagggcaccgcc

SEQ ID NO: 73888 - DNA, 25 bp, Rattus norvegicus
acactggagttggaagggcaccgcc

SEQ ID NO: 73889 - DNA, 25 bp, Rattus norvegicus
acactggatcataccctatggtcag

SEQ ID NO: 73890 - DNA, 25 bp, Rattus norvegicus
acactggatcattccctatggtcag

SEQ ID NO: 73891 - DNA, 25 bp, Rattus norvegicus
acactggatgttacagcttcctctt

SEQ ID NO: 73892 - DNA, 25 bp, Rattus norvegicus
acactggatgtttcagcttcctctt

SEQ ID NO: 73893 - DNA, 25 bp, Rattus norvegicus
acactggcacgtctggtcagctgta

SEQ ID NO: 73894 - DNA, 25 bp, Rattus norvegicus
acactggcacgtgtggtcagctgta

SEQ ID NO: 73895 - DNA, 25 bp, Rattus norvegicus
acactggcactcactgctggagaaa

SEQ ID NO: 73896 - DNA, 25 bp, Rattus norvegicus
acactggcactctctgctggagaaa

SEQ ID NO: 73897 - DNA, 25 bp, Rattus norvegicus
acactggcactgacaagtaactcct

SEQ ID NO: 73898 - DNA, 25 bp, Rattus norvegicus
acactggcactgtcaagtaactcct

SEQ ID NO: 73899 - DNA, 25 bp, Rattus norvegicus
acactggcagctacgtgaggatcgg

SEQ ID NO: 73900 - DNA, 25 bp, Rattus norvegicus
acactggcagcttcgtgaggatcgg

SEQ ID NO: 73901 - DNA, 25 bp, Rattus norvegicus
acactggcatgaattcagcctacct

SEQ ID NO: 73902 - DNA, 25 bp, Rattus norvegicus
acactggcatgatttcagcctacct

SEQ ID NO: 73903 - DNA, 25 bp, Rattus norvegicus
acactggccaccagatgtggtctca

SEQ ID NO: 73904 - DNA, 25 bp, Rattus norvegicus
acactggccacctgatgtggtctca

SEQ ID NO: 73905 - DNA, 25 bp, Rattus norvegicus
acactggccattcacgtactggaca

SEQ ID NO: 73906 - DNA, 25 bp, Rattus norvegicus
acactggccattgacgtactggaca

SEQ ID NO: 73907 - DNA, 25 bp, Rattus norvegicus
acactggccggcatggtatggcgac

SEQ ID NO: 73908 - DNA, 25 bp, Rattus norvegicus
acactggccggcttggtatggcgac

SEQ ID NO: 73909 - DNA, 25 bp, Rattus norvegicus
acactggcctctacacaggagatga

SEQ ID NO: 73910 - DNA, 25 bp, Rattus norvegicus
acactggcctcttcacaggagatga

SEQ ID NO: 73911 - DNA, 25 bp, Rattus norvegicus
acactggcctggactgcttgtctag

SEQ ID NO: 73912 - DNA, 25 bp, Rattus norvegicus
acactggcctggtctgcttgtctag

SEQ ID NO: 73913 - DNA, 25 bp, Rattus norvegicus
acactggctcttagtgtcacagtaa

SEQ ID NO: 73914 - DNA, 25 bp, Rattus norvegicus
acactggctctttgtgtcacagtaa

SEQ ID NO: 73915 - DNA, 25 bp, Rattus norvegicus
acactggctgcacagagtcctttca

SEQ ID NO: 73916 - DNA, 25 bp, Rattus norvegicus
acactggctgcagagagtcctttca

SEQ ID NO: 73917 - DNA, 25 bp, Rattus norvegicus
acactggctttcagggattctggag

SEQ ID NO: 73918 - DNA, 25 bp, Rattus norvegicus
acactggctttctgggattctggag

SEQ ID NO: 73919 - DNA, 25 bp, Rattus norvegicus
acactgggccacattcatcttagag

SEQ ID NO: 73920 - DNA, 25 bp, Rattus norvegicus
acactgggccactttcatcttagag

SEQ ID NO: 73921 - DNA, 25 bp, Rattus norvegicus
acactgggctgaccaactccgggag

SEQ ID NO: 73922 - DNA, 25 bp, Rattus norvegicus
acactgggctgagcaactccgggag

SEQ ID NO: 73923 - DNA, 25 bp, Rattus norvegicus
acactgggcttacaggattcctgct

SEQ ID NO: 73924 - DNA, 25 bp, Rattus norvegicus
acactgggcttagaggattcctgct

SEQ ID NO: 73925 - DNA, 25 bp, Rattus norvegicus
acactgggcttgactgtgaactgtc

SEQ ID NO: 73926 - DNA, 25 bp, Rattus norvegicus
acactgggcttgtctgtgaactgtc

SEQ ID NO: 73927 - DNA, 25 bp, Rattus norvegicus
acactgggtgcccagttacactgtt

SEQ ID NO: 73928 - DNA, 25 bp, Rattus norvegicus
acactgggtgccgagttacactgtt

SEQ ID NO: 73929 - DNA, 25 bp, Rattus norvegicus
acactggtaactaacgtgcctgtta

SEQ ID NO: 73930 - DNA, 25 bp, Rattus norvegicus
acactggtaacttacgtgcctgtta

SEQ ID NO: 73931 - DNA, 25 bp, Rattus norvegicus
acactggtaatgactttcctgttag

SEQ ID NO: 73932 - DNA, 25 bp, Rattus norvegicus
acactggtaatgtctttcctgttag

SEQ ID NO: 73933 - DNA, 25 bp, Rattus norvegicus
acactggtacttagggctctagcca

SEQ ID NO: 73934 - DNA, 25 bp, Rattus norvegicus
acactggtactttgggctctagcca

SEQ ID NO: 73935 - DNA, 25 bp, Rattus norvegicus
acactggtcaccactaccagcaggg

SEQ ID NO: 73936 - DNA, 25 bp, Rattus norvegicus
acactggtcacctctaccagcaggg

SEQ ID NO: 73937 - DNA, 25 bp, Rattus norvegicus
acactggtcgtgactctgcgaaagt

SEQ ID NO: 73938 - DNA, 25 bp, Rattus norvegicus
acactggtcgtgtctctgcgaaagt

SEQ ID NO: 73939 - DNA, 25 bp, Rattus norvegicus
acactggtctgtcaagtctgcttat

SEQ ID NO: 73940 - DNA, 25 bp, Rattus norvegicus
acactggtctgtgaagtctgcttat

SEQ ID NO: 73941 - DNA, 25 bp, Rattus norvegicus
acactggtcttgctgtgggaagttt

SEQ ID NO: 73942 - DNA, 25 bp, Rattus norvegicus
acactggtcttggtgtgggaagttt

SEQ ID NO: 73943 - DNA, 25 bp, Rattus norvegicus
acactggtgaccacttggagcaaaa

SEQ ID NO: 73944 - DNA, 25 bp, Rattus norvegicus
acactggtgacctcttggagcaaaa

SEQ ID NO: 73945 - DNA, 25 bp, Rattus norvegicus
acactggtgactagctcttcagcag

SEQ ID NO: 73946 - DNA, 25 bp, Rattus norvegicus
acactggtgactccatgagcctggc

SEQ ID NO: 73947 - DNA, 25 bp, Rattus norvegicus
acactggtgactgcatgagcctggc

SEQ ID NO: 73948 - DNA, 25 bp, Rattus norvegicus
acactggtgacttgctcttcagcag

SEQ ID NO: 73949 - DNA, 25 bp, Rattus norvegicus
acactggtgatcacccagcaggttc

SEQ ID NO: 73950 - DNA, 25 bp, Rattus norvegicus
acactggtgatctcccagcaggttc

SEQ ID NO: 73951 - DNA, 25 bp, Rattus norvegicus
acactggtgcacctccttagaagga

SEQ ID NO: 73952 - DNA, 25 bp, Rattus norvegicus
acactggtgcacgtccttagaagga

SEQ ID NO: 73953 - DNA, 25 bp, Rattus norvegicus
acactggtgttcatcaactgttgca

SEQ ID NO: 73954 - DNA, 25 bp, Rattus norvegicus
acactggtgttcttcaactgttgca

SEQ ID NO: 73955 - DNA, 25 bp, Rattus norvegicus
acactggttccccagtcgagtgaca

SEQ ID NO: 73956 - DNA, 25 bp, Rattus norvegicus
acactggttcccgagtcgagtgaca

SEQ ID NO: 73957 - DNA, 25 bp, Rattus norvegicus
acactggttccgcatcaaccatttg

SEQ ID NO: 73958 - DNA, 25 bp, Rattus norvegicus
acactggttccggatcaaccatttg

SEQ ID NO: 73959 - DNA, 25 bp, Rattus norvegicus
acactggttcttactgtatcctaac

SEQ ID NO: 73960 - DNA, 25 bp, Rattus norvegicus
acactggttctttctgtatcctaac

SEQ ID NO: 73961 - DNA, 25 bp, Rattus norvegicus
acactgtacaaaagaggtgggattt

SEQ ID NO: 73962 - DNA, 25 bp, Rattus norvegicus
acactgtacaaatgaggtgggattt

SEQ ID NO: 73963 - DNA, 25 bp, Rattus norvegicus
acactgtacagactggatcccagat

SEQ ID NO: 73964 - DNA, 25 bp, Rattus norvegicus
acactgtacagagtggatcccagat

SEQ ID NO: 73965 - DNA, 25 bp, Rattus norvegicus
acactgtacttcagccatatcttag

SEQ ID NO: 73966 - DNA, 25 bp, Rattus norvegicus
acactgtacttctgccatatcttag

SEQ ID NO: 73967 - DNA, 25 bp, Rattus norvegicus
acactgtagcacattgagtttgtca

SEQ ID NO: 73968 - DNA, 25 bp, Rattus norvegicus
acactgtagcactttgagtttgtca

SEQ ID NO: 73969 - DNA, 25 bp, Rattus norvegicus
acactgtaggatcagcagggctatc

SEQ ID NO: 73970 - DNA, 25 bp, Rattus norvegicus
acactgtaggatgagcagggctatc

SEQ ID NO: 73971 - DNA, 25 bp, Rattus norvegicus
acactgtcagtcagaccctgtggtt

SEQ ID NO: 73972 - DNA, 25 bp, Rattus norvegicus
acactgtcagtctgaccctgtggtt

SEQ ID NO: 73973 - DNA, 25 bp, Rattus norvegicus
acactgtcatgaatttggtgctgat

SEQ ID NO: 73974 - DNA, 25 bp, Rattus norvegicus
acactgtcatgattttggtgctgat

SEQ ID NO: 73975 - DNA, 25 bp, Rattus norvegicus
acactgtcattcaagacttcacgca

SEQ ID NO: 73976 - DNA, 25 bp, Rattus norvegicus
acactgtcattctagacttcacgca

SEQ ID NO: 73977 - DNA, 25 bp, Rattus norvegicus
acactgtcatttccatctcttgatt

SEQ ID NO: 73978 - DNA, 25 bp, Rattus norvegicus
acactgtcatttgcatctcttgatt

SEQ ID NO: 73979 - DNA, 25 bp, Rattus norvegicus
acactgtccagcagggtgctgatga

SEQ ID NO: 73980 - DNA, 25 bp, Rattus norvegicus
acactgtccagctgggtgctgatga

SEQ ID NO: 73981 - DNA, 25 bp, Rattus norvegicus
acactgtccccgagtctagagacgg

SEQ ID NO: 73982 - DNA, 25 bp, Rattus norvegicus
acactgtccccgtgtctagagacgg

SEQ ID NO: 73983 - DNA, 25 bp, Rattus norvegicus
acactgtctcccagaagccagctga

SEQ ID NO: 73984 - DNA, 25 bp, Rattus norvegicus
acactgtctccctgaagccagctga

SEQ ID NO: 73985 - DNA, 25 bp, Rattus norvegicus
acactgtctgggatggtgtgcccca

SEQ ID NO: 73986 - DNA, 25 bp, Rattus norvegicus
acactgtctgggttggtgtgcccca

SEQ ID NO: 73987 - DNA, 25 bp, Rattus norvegicus
acactgtcttaaacagggcggcttt

SEQ ID NO: 73988 - DNA, 25 bp, Rattus norvegicus
acactgtcttaatcagggcggcttt

SEQ ID NO: 73989 - DNA, 25 bp, Rattus norvegicus
acactgtcttgaatgacttcctgtg

SEQ ID NO: 73990 - DNA, 25 bp, Rattus norvegicus
acactgtcttgattgacttcctgtg

SEQ ID NO: 73991 - DNA, 25 bp, Rattus norvegicus
acactgtgagccaaaatcaaccttt

SEQ ID NO: 73992 - DNA, 25 bp, Rattus norvegicus
acactgtgagcctaaatcaaccttt

SEQ ID NO: 73993 - DNA, 25 bp, Rattus norvegicus
acactgtgatgaatctctctctctc

SEQ ID NO: 73994 - DNA, 25 bp, Rattus norvegicus
acactgtgatgattctctctctctc

SEQ ID NO: 73995 - DNA, 25 bp, Rattus norvegicus
acactgtgctctcggtatcccgaga

SEQ ID NO: 73996 - DNA, 25 bp, Rattus norvegicus
acactgtgctctgggtatcccgaga

SEQ ID NO: 73997 - DNA, 25 bp, Rattus norvegicus
acactgtggacaactcatcgaggcc

SEQ ID NO: 73998 - DNA, 25 bp, Rattus norvegicus
acactgtggacatctcatcgaggcc

SEQ ID NO: 73999 - DNA, 25 bp, Rattus norvegicus
acactgtggaccagcggcttctgaa

SEQ ID NO: 74000 - DNA, 25 bp, Rattus norvegicus
acactgtggacctgcggcttctgaa

SEQ ID NO: 74001 - DNA, 25 bp, Rattus norvegicus
acactgtggacgaaacacgccttca

SEQ ID NO: 74002 - DNA, 25 bp, Rattus norvegicus
acactgtggacgtaacacgccttca

SEQ ID NO: 74003 - DNA, 25 bp, Rattus norvegicus
acactgtggcatctgaaactggtta

SEQ ID NO: 74004 - DNA, 25 bp, Rattus norvegicus
acactgtggcatgtgaaactggtta

SEQ ID NO: 74005 - DNA, 25 bp, Rattus norvegicus
acactgtggcctatttgtcatggaa

SEQ ID NO: 74006 - DNA, 25 bp, Rattus norvegicus
acactgtggcctttttgtcatggaa

SEQ ID NO: 74007 - DNA, 25 bp, Rattus norvegicus
acactgtgtcttaataggaccctcc

SEQ ID NO: 74008 - DNA, 25 bp, Rattus norvegicus
acactgtgtcttcgtggagatgcac

SEQ ID NO: 74009 - DNA, 25 bp, Rattus norvegicus
acactgtgtcttggtggagatgcac

SEQ ID NO: 74010 - DNA, 25 bp, Rattus norvegicus
acactgtgtctttataggaccctcc

SEQ ID NO: 74011 - DNA, 25 bp, Rattus norvegicus
acactgtgtgtgagaacttgcaaag

SEQ ID NO: 74012 - DNA, 25 bp, Rattus norvegicus
acactgtgtgtgcatacgatgggat

SEQ ID NO: 74013 - DNA, 25 bp, Rattus norvegicus
acactgtgtgtggatacgatgggat

SEQ ID NO: 74014 - DNA, 25 bp, Rattus norvegicus
acactgtgtgtgtgaacttgcaaag

SEQ ID NO: 74015 - DNA, 25 bp, Rattus norvegicus
acactgtgttcccacaaaaccttat

SEQ ID NO: 74016 - DNA, 25 bp, Rattus norvegicus
acactgtgttccgacaaaaccttat

SEQ ID NO: 74017 - DNA, 25 bp, Rattus norvegicus
acactgttaattacacaccagagaa

SEQ ID NO: 74018 - DNA, 25 bp, Rattus norvegicus
acactgttaattacctaaagctcag

SEQ ID NO: 74019 - DNA, 25 bp, Rattus norvegicus
acactgttaatttcacaccagagaa

SEQ ID NO: 74020 - DNA, 25 bp, Rattus norvegicus
acactgttaatttcctaaagctcag

SEQ ID NO: 74021 - DNA, 25 bp, Rattus norvegicus
acactgttacagactgctgcaggtt

SEQ ID NO: 74022 - DNA, 25 bp, Rattus norvegicus
acactgttacagtctgctgcaggtt

SEQ ID NO: 74023 - DNA, 25 bp, Rattus norvegicus
acactgttaccgactctacacgaaa

SEQ ID NO: 74024 - DNA, 25 bp, Rattus norvegicus
acactgttaccgagtttatgctaac

SEQ ID NO: 74025 - DNA, 25 bp, Rattus norvegicus
acactgttaccgtctctacacgaaa

SEQ ID NO: 74026 - DNA, 25 bp, Rattus norvegicus
acactgttaccgtgtttatgctaac

SEQ ID NO: 74027 - DNA, 25 bp, Rattus norvegicus
acactgttactactctctcttaatt

SEQ ID NO: 74028 - DNA, 25 bp, Rattus norvegicus
acactgttactagtctctcttaatt

SEQ ID NO: 74029 - DNA, 25 bp, Rattus norvegicus
acactgttcccaaggctgcagttta

SEQ ID NO: 74030 - DNA, 25 bp, Rattus norvegicus
acactgttcccatggctgcagttta

SEQ ID NO: 74031 - DNA, 25 bp, Rattus norvegicus
acactgttctccactctggaaacaa

SEQ ID NO: 74032 - DNA, 25 bp, Rattus norvegicus
acactgttctcctctctggaaacaa

SEQ ID NO: 74033 - DNA, 25 bp, Rattus norvegicus
acactgttgctaacttcagatatat

SEQ ID NO: 74034 - DNA, 25 bp, Rattus norvegicus
acactgttgctatcttcagatatat

SEQ ID NO: 74035 - DNA, 25 bp, Rattus norvegicus
acactgttgggcaagggcaggcaca

SEQ ID NO: 74036 - DNA, 25 bp, Rattus norvegicus
acactgttgggctagggcaggcaca

SEQ ID NO: 74037 - DNA, 25 bp, Rattus norvegicus
acactgtttagtattcttagcatca

SEQ ID NO: 74038 - DNA, 25 bp, Rattus norvegicus
acactgtttagttttcttagcatca

SEQ ID NO: 74039 - DNA, 25 bp, Rattus norvegicus
acactgtttcatcctgtgcttctta

SEQ ID NO: 74040 - DNA, 25 bp, Rattus norvegicus
acactgtttcatgctgtgcttctta

SEQ ID NO: 74041 - DNA, 25 bp, Rattus norvegicus
acactgtttccaatgtggtctaatt

SEQ ID NO: 74042 - DNA, 25 bp, Rattus norvegicus
acactgtttccattgtggtctaatt

SEQ ID NO: 74043 - DNA, 25 bp, Rattus norvegicus
acactgtttcctccattgtacaagg

SEQ ID NO: 74044 - DNA, 25 bp, Rattus norvegicus
acactgtttcctgcattgtacaagg

SEQ ID NO: 74045 - DNA, 25 bp, Rattus norvegicus
acactgtttggcctctttcacggag

SEQ ID NO: 74046 - DNA, 25 bp, Rattus norvegicus
acactgtttggcgtctttcacggag

SEQ ID NO: 74047 - DNA, 25 bp, Rattus norvegicus
acactgtttgttaatggcccatgga

SEQ ID NO: 74048 - DNA, 25 bp, Rattus norvegicus
acactgtttgtttatggcccatgga

SEQ ID NO: 74049 - DNA, 25 bp, Rattus norvegicus
acactgtttttaatgggccaggtct

SEQ ID NO: 74050 - DNA, 25 bp, Rattus norvegicus
acactgtttttattgggccaggtct

SEQ ID NO: 74051 - DNA, 25 bp, Rattus norvegicus
acacttaactcccaaggccttgatg

SEQ ID NO: 74052 - DNA, 25 bp, Rattus norvegicus
acacttaactccgaaggccttgatg

SEQ ID NO: 74053 - DNA, 25 bp, Rattus norvegicus
acacttaagaccacgcgaagctctt

SEQ ID NO: 74054 - DNA, 25 bp, Rattus norvegicus
acacttaagacctcgcgaagctctt

SEQ ID NO: 74055 - DNA, 25 bp, Rattus norvegicus
acacttaagttaagcctgtcctaaa

SEQ ID NO: 74056 - DNA, 25 bp, Rattus norvegicus
acacttaagttatgcctgtcctaaa

SEQ ID NO: 74057 - DNA, 25 bp, Rattus norvegicus
acacttacagttccctttggcctta

SEQ ID NO: 74058 - DNA, 25 bp, Rattus norvegicus
acacttacagttgcctttggcctta

SEQ ID NO: 74059 - DNA, 25 bp, Rattus norvegicus
acacttacatgcaatggtccactac

SEQ ID NO: 74060 - DNA, 25 bp, Rattus norvegicus
acacttacatgctatggtccactac

SEQ ID NO: 74061 - DNA, 25 bp, Rattus norvegicus
acacttacctgaaccagaaccagat

SEQ ID NO: 74062 - DNA, 25 bp, Rattus norvegicus
acacttacctgatccagaaccagat

SEQ ID NO: 74063 - DNA, 25 bp, Rattus norvegicus
acacttacctgtctcagattcacat

SEQ ID NO: 74064 - DNA, 25 bp, Rattus norvegicus
acacttacctgtgtcagattcacat

SEQ ID NO: 74065 - DNA, 25 bp, Rattus norvegicus
acacttactgctatgtactggcgta

SEQ ID NO: 74066 - DNA, 25 bp, Rattus norvegicus
acacttactgctttgtactggcgta

SEQ ID NO: 74067 - DNA, 25 bp, Rattus norvegicus
acacttactgtgatcctatggaaac

SEQ ID NO: 74068 - DNA, 25 bp, Rattus norvegicus
acacttactgtgttcctatggaaac

SEQ ID NO: 74069 - DNA, 25 bp, Rattus norvegicus
acacttagactactaggtcagtact

SEQ ID NO: 74070 - DNA, 25 bp, Rattus norvegicus
acacttagactagtaggtcagtact

SEQ ID NO: 74071 - DNA, 25 bp, Rattus norvegicus
acacttagcactacttaggccttag

SEQ ID NO: 74072 - DNA, 25 bp, Rattus norvegicus
acacttagcacttcttaggccttag

SEQ ID NO: 74073 - DNA, 25 bp, Rattus norvegicus
acacttagcgtgactttcttttcag

SEQ ID NO: 74074 - DNA, 25 bp, Rattus norvegicus
acacttagcgtgtctttcttttcag

SEQ ID NO: 74075 - DNA, 25 bp, Rattus norvegicus
acacttagctatagacgccgttcct

SEQ ID NO: 74076 - DNA, 25 bp, Rattus norvegicus
acacttagctattgacgccgttcct

SEQ ID NO: 74077 - DNA, 25 bp, Rattus norvegicus
acacttagtgtgcattcatgtcccg

SEQ ID NO: 74078 - DNA, 25 bp, Rattus norvegicus
acacttagtgtggattcatgtcccg

SEQ ID NO: 74079 - DNA, 25 bp, Rattus norvegicus
acacttagttctagagttaccgaga

SEQ ID NO: 74080 - DNA, 25 bp, Rattus norvegicus
acacttagttcttgagttaccgaga

SEQ ID NO: 74081 - DNA, 25 bp, Rattus norvegicus
acacttattctacactggagccttt

SEQ ID NO: 74082 - DNA, 25 bp, Rattus norvegicus
acacttattctagactggagccttt

SEQ ID NO: 74083 - DNA, 25 bp, Rattus norvegicus
acacttatttacatcgagccgagcc

SEQ ID NO: 74084 - DNA, 25 bp, Rattus norvegicus
acacttatttacttcgagccgagcc

SEQ ID NO: 74085 - DNA, 25 bp, Rattus norvegicus
acacttatttttcttatcttcaggg

SEQ ID NO: 74086 - DNA, 25 bp, Rattus norvegicus
acacttatttttgttatcttcaggg

SEQ ID NO: 74087 - DNA, 25 bp, Rattus norvegicus
acacttcaaggacacattctttccc

SEQ ID NO: 74088 - DNA, 25 bp, Rattus norvegicus
acacttcaaggagacattctttccc

SEQ ID NO: 74089 - DNA, 25 bp, Rattus norvegicus
acacttcaagtacccaagccggctt

SEQ ID NO: 74090 - DNA, 25 bp, Rattus norvegicus
acacttcaagtagccaagccggctt

SEQ ID NO: 74091 - DNA, 25 bp, Rattus norvegicus
acacttcacgatcgcgcggtgatgt

SEQ ID NO: 74092 - DNA, 25 bp, Rattus norvegicus
acacttcacgatggcgcggtgatgt

SEQ ID NO: 74093 - DNA, 25 bp, Rattus norvegicus
acacttcagaagaccccgatggaat

SEQ ID NO: 74094 - DNA, 25 bp, Rattus norvegicus
acacttcagaagtccccgatggaat

SEQ ID NO: 74095 - DNA, 25 bp, Rattus norvegicus
acacttcagatcacagaccgcatgg

SEQ ID NO: 74096 - DNA, 25 bp, Rattus norvegicus
acacttcagatctcagaccgcatgg

SEQ ID NO: 74097 - DNA, 25 bp, Rattus norvegicus
acacttcagcgacatcagcgctttg

SEQ ID NO: 74098 - DNA, 25 bp, Rattus norvegicus
acacttcagcgagatcagcgctttg

SEQ ID NO: 74099 - DNA, 25 bp, Rattus norvegicus
acacttcagggcatgacttttgtac

SEQ ID NO: 74100 - DNA, 25 bp, Rattus norvegicus
acacttcagggcttgacttttgtac

SEQ ID NO: 74101 - DNA, 25 bp, Rattus norvegicus
acacttcaggttctccagcatgaat

SEQ ID NO: 74102 - DNA, 25 bp, Rattus norvegicus
acacttcaggttctggtccatcagt

SEQ ID NO: 74103 - DNA, 25 bp, Rattus norvegicus
acacttcaggttgtccagcatgaat

SEQ ID NO: 74104 - DNA, 25 bp, Rattus norvegicus
acacttcaggttgtggtccatcagt

SEQ ID NO: 74105 - DNA, 25 bp, Rattus norvegicus
acacttcagttgacatagagcactt

SEQ ID NO: 74106 - DNA, 25 bp, Rattus norvegicus
acacttcagttgtcatagagcactt

SEQ ID NO: 74107 - DNA, 25 bp, Rattus norvegicus
acacttcatcacacaaaacaccaaa

SEQ ID NO: 74108 - DNA, 25 bp, Rattus norvegicus
acacttcatcactcaaaacaccaaa

SEQ ID NO: 74109 - DNA, 25 bp, Rattus norvegicus
acacttcatctaccaatgcctgagt

SEQ ID NO: 74110 - DNA, 25 bp, Rattus norvegicus
acacttcatctagcaatgcctgagt

SEQ ID NO: 74111 - DNA, 25 bp, Rattus norvegicus
acacttcattgcctggatgtgacgc

SEQ ID NO: 74112 - DNA, 25 bp, Rattus norvegicus
acacttcattgcgtggatgtgacgc

SEQ ID NO: 74113 - DNA, 25 bp, Rattus norvegicus
acacttccaaatcctgttgcgatct

SEQ ID NO: 74114 - DNA, 25 bp, Rattus norvegicus
acacttccaaatgctgttgcgatct

SEQ ID NO: 74115 - DNA, 25 bp, Rattus norvegicus
acacttccacctcggacaggcagtt

SEQ ID NO: 74116 - DNA, 25 bp, Rattus norvegicus
acacttccacctgggacaggcagtt

SEQ ID NO: 74117 - DNA, 25 bp, Rattus norvegicus
acacttccaggcaccatgaggactt

SEQ ID NO: 74118 - DNA, 25 bp, Rattus norvegicus
acacttccaggctccatgaggactt

SEQ ID NO: 74119 - DNA, 25 bp, Rattus norvegicus
acacttcccgaaagcacgtgcaaat

SEQ ID NO: 74120 - DNA, 25 bp, Rattus norvegicus
acacttcccgaatgcacgtgcaaat

SEQ ID NO: 74121 - DNA, 25 bp, Rattus norvegicus
acacttcctctgctgggctagaaaa

SEQ ID NO: 74122 - DNA, 25 bp, Rattus norvegicus
acacttcctctggtgggctagaaaa

SEQ ID NO: 74123 - DNA, 25 bp, Rattus norvegicus
acacttccttaacgaccctggctgg

SEQ ID NO: 74124 - DNA, 25 bp, Rattus norvegicus
acacttccttaaggaccctggctgg

SEQ ID NO: 74125 - DNA, 25 bp, Rattus norvegicus
acacttctcaggcacatacccattt

SEQ ID NO: 74126 - DNA, 25 bp, Rattus norvegicus
acacttctcagggacatacccattt

SEQ ID NO: 74127 - DNA, 25 bp, Rattus norvegicus
acacttctcctgcagatcaagaggg

SEQ ID NO: 74128 - DNA, 25 bp, Rattus norvegicus
acacttctcctggagatcaagaggg

SEQ ID NO: 74129 - DNA, 25 bp, Rattus norvegicus
acacttctcggccagcagagcgagg

SEQ ID NO: 74130 - DNA, 25 bp, Rattus norvegicus
acacttctcggcgagcagagcgagg

SEQ ID NO: 74131 - DNA, 25 bp, Rattus norvegicus
acacttctctttacttatctgggac

SEQ ID NO: 74132 - DNA, 25 bp, Rattus norvegicus
acacttctcttttcttatctgggac

SEQ ID NO: 74133 - DNA, 25 bp, Rattus norvegicus
acacttctggagctcgagagggcct

SEQ ID NO: 74134 - DNA, 25 bp, Rattus norvegicus
acacttctggaggtcgagagggcct

SEQ ID NO: 74135 - DNA, 25 bp, Rattus norvegicus
acacttctgggacggaatctttcca

SEQ ID NO: 74136 - DNA, 25 bp, Rattus norvegicus
acacttctgggagggaatctttcca

SEQ ID NO: 74137 - DNA, 25 bp, Rattus norvegicus
acacttctgtttaccactgtcagga

SEQ ID NO: 74138 - DNA, 25 bp, Rattus norvegicus
acacttctgttttccactgtcagga

SEQ ID NO: 74139 - DNA, 25 bp, Rattus norvegicus
acacttcttaccactcagttcaggg

SEQ ID NO: 74140 - DNA, 25 bp, Rattus norvegicus
acacttcttacctctcagttcaggg

SEQ ID NO: 74141 - DNA, 25 bp, Rattus norvegicus
acacttgaatctaaaccatcggtac

SEQ ID NO: 74142 - DNA, 25 bp, Rattus norvegicus
acacttgaatcttaaccatcggtac

SEQ ID NO: 74143 - DNA, 25 bp, Rattus norvegicus
acacttgacactccgtcaaagtgag

SEQ ID NO: 74144 - DNA, 25 bp, Rattus norvegicus
acacttgacactgcgtcaaagtgag

SEQ ID NO: 74145 - DNA, 25 bp, Rattus norvegicus
acacttgaccaactattcgtgaact

SEQ ID NO: 74146 - DNA, 25 bp, Rattus norvegicus
acacttgaccaagtattcgtgaact

SEQ ID NO: 74147 - DNA, 25 bp, Rattus norvegicus
acacttgactgaagaatggaaccga

SEQ ID NO: 74148 - DNA, 25 bp, Rattus norvegicus
acacttgactgatgaatggaaccga

SEQ ID NO: 74149 - DNA, 25 bp, Rattus norvegicus
acacttgagaccagactgtggggac

SEQ ID NO: 74150 - DNA, 25 bp, Rattus norvegicus
acacttgagacctgactgtggggac

SEQ ID NO: 74151 - DNA, 25 bp, Rattus norvegicus
acacttgagcgtcacctcgaagcaa

SEQ ID NO: 74152 - DNA, 25 bp, Rattus norvegicus
acacttgagcgtgacctcgaagcaa

SEQ ID NO: 74153 - DNA, 25 bp, Rattus norvegicus
acacttgagtttataccctaggcat

SEQ ID NO: 74154 - DNA, 25 bp, Rattus norvegicus
acacttgagtttttaccctaggcat

SEQ ID NO: 74155 - DNA, 25 bp, Rattus norvegicus
acacttgatctaacagctgacctgg

SEQ ID NO: 74156 - DNA, 25 bp, Rattus norvegicus
acacttgatctatcagctgacctgg

SEQ ID NO: 74157 - DNA, 25 bp, Rattus norvegicus
acacttgatgagcagggccggccca

SEQ ID NO: 74158 - DNA, 25 bp, Rattus norvegicus
acacttgatgaggagggccggccca

SEQ ID NO: 74159 - DNA, 25 bp, Rattus norvegicus
acacttgatgctctaacctgatgga

SEQ ID NO: 74160 - DNA, 25 bp, Rattus norvegicus
acacttgatgctgtaacctgatgga

SEQ ID NO: 74161 - DNA, 25 bp, Rattus norvegicus
acacttgcaccaatgtgggtactgt

SEQ ID NO: 74162 - DNA, 25 bp, Rattus norvegicus
acacttgcaccattgtgggtactgt

SEQ ID NO: 74163 - DNA, 25 bp, Rattus norvegicus
acacttgcagctacaccaactgcgg

SEQ ID NO: 74164 - DNA, 25 bp, Rattus norvegicus
acacttgcagcttcaccaactgcgg

SEQ ID NO: 74165 - DNA, 25 bp, Rattus norvegicus
acacttgcattcacgcatacctgag

SEQ ID NO: 74166 - DNA, 25 bp, Rattus norvegicus
acacttgcattctcgcatacctgag

SEQ ID NO: 74167 - DNA, 25 bp, Rattus norvegicus
acacttgccaagctgggtataccga

SEQ ID NO: 74168 - DNA, 25 bp, Rattus norvegicus
acacttgccaaggtgggtataccga

SEQ ID NO: 74169 - DNA, 25 bp, Rattus norvegicus
acacttgccatcatgttgttgttga

SEQ ID NO: 74170 - DNA, 25 bp, Rattus norvegicus
acacttgccatcttgttgttgttga

SEQ ID NO: 74171 - DNA, 25 bp, Rattus norvegicus
acacttgccatgatgctgggatcag

SEQ ID NO: 74172 - DNA, 25 bp, Rattus norvegicus
acacttgccatgttgctgggatcag

SEQ ID NO: 74173 - DNA, 25 bp, Rattus norvegicus
acacttgcctctctcattcagagga

SEQ ID NO: 74174 - DNA, 25 bp, Rattus norvegicus
acacttgcctctgtcattcagagga

SEQ ID NO: 74175 - DNA, 25 bp, Rattus norvegicus
acacttgctcaccatgtacatgcat

SEQ ID NO: 74176 - DNA, 25 bp, Rattus norvegicus
acacttgctcacgatgtacatgcat

SEQ ID NO: 74177 - DNA, 25 bp, Rattus norvegicus
acacttgctctgctctctattcgac

SEQ ID NO: 74178 - DNA, 25 bp, Rattus norvegicus
acacttgctctggtctctattcgac

SEQ ID NO: 74179 - DNA, 25 bp, Rattus norvegicus
acacttgctgacagaccacaccaat

SEQ ID NO: 74180 - DNA, 25 bp, Rattus norvegicus
acacttgctgactgaccacaccaat

SEQ ID NO: 74181 - DNA, 25 bp, Rattus norvegicus
acacttggaatgaccgattcccttc

SEQ ID NO: 74182 - DNA, 25 bp, Rattus norvegicus
acacttggaatgtccgattcccttc

SEQ ID NO: 74183 - DNA, 25 bp, Rattus norvegicus
acacttggacctataaatgtctgga

SEQ ID NO: 74184 - DNA, 25 bp, Rattus norvegicus
acacttggacctttaaatgtctgga

SEQ ID NO: 74185 - DNA, 25 bp, Rattus norvegicus
acacttggatccattggtcctgcac

SEQ ID NO: 74186 - DNA, 25 bp, Rattus norvegicus
acacttggatcctttggtcctgcac

SEQ ID NO: 74187 - DNA, 25 bp, Rattus norvegicus
acacttggctacctggttggtgcct

SEQ ID NO: 74188 - DNA, 25 bp, Rattus norvegicus
acacttggctacgtggttggtgcct

SEQ ID NO: 74189 - DNA, 25 bp, Rattus norvegicus
acacttggctctcagtgtccagaag

SEQ ID NO: 74190 - DNA, 25 bp, Rattus norvegicus
acacttggctctgagtgtccagaag

SEQ ID NO: 74191 - DNA, 25 bp, Rattus norvegicus
acacttggctgcaggtactgatctc

SEQ ID NO: 74192 - DNA, 25 bp, Rattus norvegicus
acacttggctgctggtactgatctc

SEQ ID NO: 74193 - DNA, 25 bp, Rattus norvegicus
acacttggcttcattctgctgtatg

SEQ ID NO: 74194 - DNA, 25 bp, Rattus norvegicus
acacttggcttctttctgctgtatg

SEQ ID NO: 74195 - DNA, 25 bp, Rattus norvegicus
acacttgggaatctcagtcactgcc

SEQ ID NO: 74196 - DNA, 25 bp, Rattus norvegicus
acacttgggaatgtcagtcactgcc

SEQ ID NO: 74197 - DNA, 25 bp, Rattus norvegicus
acacttgggagcattaaggtctcag

SEQ ID NO: 74198 - DNA, 25 bp, Rattus norvegicus
acacttgggagctttaaggtctcag

SEQ ID NO: 74199 - DNA, 25 bp, Rattus norvegicus
acacttggtcaaatctcatatgcag

SEQ ID NO: 74200 - DNA, 25 bp, Rattus norvegicus
acacttggtcaattctcatatgcag

SEQ ID NO: 74201 - DNA, 25 bp, Rattus norvegicus
acacttggtgctcaggaagggtcaa

SEQ ID NO: 74202 - DNA, 25 bp, Rattus norvegicus
acacttggtgctgaggaagggtcaa

SEQ ID NO: 74203 - DNA, 25 bp, Rattus norvegicus
acacttgtatacaccccttgtgaag

SEQ ID NO: 74204 - DNA, 25 bp, Rattus norvegicus
acacttgtatactccccttgtgaag

SEQ ID NO: 74205 - DNA, 25 bp, Rattus norvegicus
acacttgtccatcagtcaggcttta

SEQ ID NO: 74206 - DNA, 25 bp, Rattus norvegicus
acacttgtccatgagtcaggcttta

SEQ ID NO: 74207 - DNA, 25 bp, Rattus norvegicus
acacttgtccccacacgtggacatg

SEQ ID NO: 74208 - DNA, 25 bp, Rattus norvegicus
acacttgtcccctcacgtggacatg

SEQ ID NO: 74209 - DNA, 25 bp, Rattus norvegicus
acacttgtgctgcttggtatggtcc

SEQ ID NO: 74210 - DNA, 25 bp, Rattus norvegicus
acacttgtgctggttggtatggtcc

SEQ ID NO: 74211 - DNA, 25 bp, Rattus norvegicus
acacttgtgtttagatacatctcca

SEQ ID NO: 74212 - DNA, 25 bp, Rattus norvegicus
acacttgtgttttgatacatctcca

SEQ ID NO: 74213 - DNA, 25 bp, Rattus norvegicus
acacttgttggcaatgatctggttc

SEQ ID NO: 74214 - DNA, 25 bp, Rattus norvegicus
acacttgttggctatgatctggttc

SEQ ID NO: 74215 - DNA, 25 bp, Rattus norvegicus
acacttgttgggattactgcccctg

SEQ ID NO: 74216 - DNA, 25 bp, Rattus norvegicus
acacttgttgggtttactgcccctg

SEQ ID NO: 74217 - DNA, 25 bp, Rattus norvegicus
acactttaaactagctttgatctga

SEQ ID NO: 74218 - DNA, 25 bp, Rattus norvegicus
acactttaaacttgctttgatctga

SEQ ID NO: 74219 - DNA, 25 bp, Rattus norvegicus
acactttaagatactggcacaggca

SEQ ID NO: 74220 - DNA, 25 bp, Rattus norvegicus
acactttaagattctggcacaggca

SEQ ID NO: 74221 - DNA, 25 bp, Rattus norvegicus
acactttacagaccctttaggcgag

SEQ ID NO: 74222 - DNA, 25 bp, Rattus norvegicus
acactttacagagcctttaggcgag

SEQ ID NO: 74223 - DNA, 25 bp, Rattus norvegicus
acactttaccatcaggatcttccaa

SEQ ID NO: 74224 - DNA, 25 bp, Rattus norvegicus
acactttaccatgaggatcttccaa

SEQ ID NO: 74225 - DNA, 25 bp, Rattus norvegicus
acactttacgtgaatacagttttag

SEQ ID NO: 74226 - DNA, 25 bp, Rattus norvegicus
acactttacgtgtatacagttttag

SEQ ID NO: 74227 - DNA, 25 bp, Rattus norvegicus
acactttcaagtaaccagctaccgt

SEQ ID NO: 74228 - DNA, 25 bp, Rattus norvegicus
acactttcaagttaccagctaccgt

SEQ ID NO: 74229 - DNA, 25 bp, Rattus norvegicus
acactttcaggccatttggtgcaat

SEQ ID NO: 74230 - DNA, 25 bp, Rattus norvegicus
acactttcaggcgatttggtgcaat

SEQ ID NO: 74231 - DNA, 25 bp, Rattus norvegicus
acactttcatctatagattcccaga

SEQ ID NO: 74232 - DNA, 25 bp, Rattus norvegicus
acactttcatctttagattcccaga

SEQ ID NO: 74233 - DNA, 25 bp, Rattus norvegicus
acactttcattgagagtctctcatc

SEQ ID NO: 74234 - DNA, 25 bp, Rattus norvegicus
acactttcattgtgagtctctcatc

SEQ ID NO: 74235 - DNA, 25 bp, Rattus norvegicus
acactttcccatacattacatactc

SEQ ID NO: 74236 - DNA, 25 bp, Rattus norvegicus
acactttcccattcattacatactc

SEQ ID NO: 74237 - DNA, 25 bp, Rattus norvegicus
acactttcctgcacacggtgtggat

SEQ ID NO: 74238 - DNA, 25 bp, Rattus norvegicus
acactttcctgctcacggtgtggat

SEQ ID NO: 74239 - DNA, 25 bp, Rattus norvegicus
acactttccttcagtggaacctgag

SEQ ID NO: 74240 - DNA, 25 bp, Rattus norvegicus
acactttccttctgtggaacctgag

SEQ ID NO: 74241 - DNA, 25 bp, Rattus norvegicus
acactttctgttactatggttctga

SEQ ID NO: 74242 - DNA, 25 bp, Rattus norvegicus
acactttctgtttctatggttctga

SEQ ID NO: 74243 - DNA, 25 bp, Rattus norvegicus
acactttgaaaaactttattgcctt

SEQ ID NO: 74244 - DNA, 25 bp, Rattus norvegicus
acactttgaaaatctttattgcctt

SEQ ID NO: 74245 - DNA, 25 bp, Rattus norvegicus
acactttgcaagctagggactgata

SEQ ID NO: 74246 - DNA, 25 bp, Rattus norvegicus
acactttgcaaggtagggactgata

SEQ ID NO: 74247 - DNA, 25 bp, Rattus norvegicus
acactttgcatactccgggttacat

SEQ ID NO: 74248 - DNA, 25 bp, Rattus norvegicus
acactttgcatagtccgggttacat

SEQ ID NO: 74249 - DNA, 25 bp, Rattus norvegicus
acactttgccccagcagccaagtgg

SEQ ID NO: 74250 - DNA, 25 bp, Rattus norvegicus
acactttgcccctgcagccaagtgg

SEQ ID NO: 74251 - DNA, 25 bp, Rattus norvegicus
acactttgctgccagaattcagtat

SEQ ID NO: 74252 - DNA, 25 bp, Rattus norvegicus
acactttgctgcgagaattcagtat

SEQ ID NO: 74253 - DNA, 25 bp, Rattus norvegicus
acactttgctggaaactgacctacc

SEQ ID NO: 74254 - DNA, 25 bp, Rattus norvegicus
acactttgctggtaactgacctacc

SEQ ID NO: 74255 - DNA, 25 bp, Rattus norvegicus
acactttggagacaactcacacctt

SEQ ID NO: 74256 - DNA, 25 bp, Rattus norvegicus
acactttggagagaactcacacctt

SEQ ID NO: 74257 - DNA, 25 bp, Rattus norvegicus
acactttggattatctactcttgag

SEQ ID NO: 74258 - DNA, 25 bp, Rattus norvegicus
acactttggattttctactcttgag

SEQ ID NO: 74259 - DNA, 25 bp, Rattus norvegicus
acactttggtagacagcctcaccga

SEQ ID NO: 74260 - DNA, 25 bp, Rattus norvegicus
acactttggtagtcagcctcaccga

SEQ ID NO: 74261 - DNA, 25 bp, Rattus norvegicus
acactttgtgaaacagacctgctcc

SEQ ID NO: 74262 - DNA, 25 bp, Rattus norvegicus
acactttgtgaatcagacctgctcc

SEQ ID NO: 74263 - DNA, 25 bp, Rattus norvegicus
acactttgtggccaggtgtctaagt

SEQ ID NO: 74264 - DNA, 25 bp, Rattus norvegicus
acactttgtggcgaggtgtctaagt

SEQ ID NO: 74265 - DNA, 25 bp, Rattus norvegicus
acactttgttggcatattggttcta

SEQ ID NO: 74266 - DNA, 25 bp, Rattus norvegicus
acactttgttgggatattggttcta

SEQ ID NO: 74267 - DNA, 25 bp, Rattus norvegicus
acacttttgaggcttggtcctcctg

SEQ ID NO: 74268 - DNA, 25 bp, Rattus norvegicus
acacttttgagggttggtcctcctg

SEQ ID NO: 74269 - DNA, 25 bp, Rattus norvegicus
acagaaaagctgatgccaggccctt

SEQ ID NO: 74270 - DNA, 25 bp, Rattus norvegicus
acagaaaagctgctcctgggcacca

SEQ ID NO: 74271 - DNA, 25 bp, Rattus norvegicus
acagaaaagctggtcctgggcacca

SEQ ID NO: 74272 - DNA, 25 bp, Rattus norvegicus
acagaaaagctgttgccaggccctt

SEQ ID NO: 74273 - DNA, 25 bp, Rattus norvegicus
acagaaacaagtccccaagccaaca

SEQ ID NO: 74274 - DNA, 25 bp, Rattus norvegicus
acagaaacaagtgcccaagccaaca

SEQ ID NO: 74275 - DNA, 25 bp, Rattus norvegicus
acagaaacagacacacaccggctgg

SEQ ID NO: 74276 - DNA, 25 bp, Rattus norvegicus
acagaaacagactcacaccggctgg

SEQ ID NO: 74277 - DNA, 25 bp, Rattus norvegicus
acagaaacctctaccagaagacagg

SEQ ID NO: 74278 - DNA, 25 bp, Rattus norvegicus
acagaaacctcttccagaagacagg

SEQ ID NO: 74279 - DNA, 25 bp, Rattus norvegicus
acagaaactagaacccattccctat

SEQ ID NO: 74280 - DNA, 25 bp, Rattus norvegicus
acagaaactagatcccattccctat

SEQ ID NO: 74281 - DNA, 25 bp, Rattus norvegicus
acagaaagacgtcttggcccagcaa

SEQ ID NO: 74282 - DNA, 25 bp, Rattus norvegicus
acagaaagacgtgttggcccagcaa

SEQ ID NO: 74283 - DNA, 25 bp, Rattus norvegicus
acagaaagcaagctgcctgcacaat

SEQ ID NO: 74284 - DNA, 25 bp, Rattus norvegicus
acagaaagcaaggtgcctgcacaat

SEQ ID NO: 74285 - DNA, 25 bp, Rattus norvegicus
acagaaagctgaagtccatcgcctt

SEQ ID NO: 74286 - DNA, 25 bp, Rattus norvegicus
acagaaagctgatgtccatcgcctt

SEQ ID NO: 74287 - DNA, 25 bp, Rattus norvegicus
acagaaagcttcaagctcctttccc

SEQ ID NO: 74288 - DNA, 25 bp, Rattus norvegicus
acagaaagcttctagctcctttccc

SEQ ID NO: 74289 - DNA, 25 bp, Rattus norvegicus
acagaaagtaggcagccctggccaa

SEQ ID NO: 74290 - DNA, 25 bp, Rattus norvegicus
acagaaagtagggagccctggccaa

SEQ ID NO: 74291 - DNA, 25 bp, Rattus norvegicus
acagaaagttatacggccccagtca

SEQ ID NO: 74292 - DNA, 25 bp, Rattus norvegicus
acagaaagttattcggccccagtca

SEQ ID NO: 74293 - DNA, 25 bp, Rattus norvegicus
acagaaatagtgaccctgcatgccc

SEQ ID NO: 74294 - DNA, 25 bp, Rattus norvegicus
acagaaatagtgtccctgcatgccc

SEQ ID NO: 74295 - DNA, 25 bp, Rattus norvegicus
acagaaatcctaagtggcttcccac

SEQ ID NO: 74296 - DNA, 25 bp, Rattus norvegicus
acagaaatcctatgtggcttcccac

SEQ ID NO: 74297 - DNA, 25 bp, Rattus norvegicus
acagaaatctcaaccgtgcaaccag

SEQ ID NO: 74298 - DNA, 25 bp, Rattus norvegicus
acagaaatctcatccgtgcaaccag

SEQ ID NO: 74299 - DNA, 25 bp, Rattus norvegicus
acagaaatctgcatgcatctgcctt

SEQ ID NO: 74300 - DNA, 25 bp, Rattus norvegicus
acagaaatctgcttgcatctgcctt

SEQ ID NO: 74301 - DNA, 25 bp, Rattus norvegicus
acagaaatgatcagcgcaaccgacc

SEQ ID NO: 74302 - DNA, 25 bp, Rattus norvegicus
acagaaatgatctgcgcaaccgacc

SEQ ID NO: 74303 - DNA, 25 bp, Rattus norvegicus
acagaaatgctccaagatctcccag

SEQ ID NO: 74304 - DNA, 25 bp, Rattus norvegicus
acagaaatgctcgaagatctcccag

SEQ ID NO: 74305 - DNA, 25 bp, Rattus norvegicus
acagaaatgcttctcactgcctgaa

SEQ ID NO: 74306 - DNA, 25 bp, Rattus norvegicus
acagaaatgcttgtcactgcctgaa

SEQ ID NO: 74307 - DNA, 25 bp, Rattus norvegicus
acagaaatgtgtatcaagccatgac

SEQ ID NO: 74308 - DNA, 25 bp, Rattus norvegicus
acagaaatgtgtttcaagccatgac

SEQ ID NO: 74309 - DNA, 25 bp, Rattus norvegicus
acagaacaaaccacacagtcttgaa

SEQ ID NO: 74310 - DNA, 25 bp, Rattus norvegicus
acagaacaaacctcacagtcttgaa

SEQ ID NO: 74311 - DNA, 25 bp, Rattus norvegicus
acagaacaatcccttgtttaccgct

SEQ ID NO: 74312 - DNA, 25 bp, Rattus norvegicus
acagaacaatccgttgtttaccgct

SEQ ID NO: 74313 - DNA, 25 bp, Rattus norvegicus
acagaacacagacaggcagggcagc

SEQ ID NO: 74314 - DNA, 25 bp, Rattus norvegicus
acagaacacagagaggcagggcagc

SEQ ID NO: 74315 - DNA, 25 bp, Rattus norvegicus
acagaacaccacacaaagggccaca

SEQ ID NO: 74316 - DNA, 25 bp, Rattus norvegicus
acagaacaccactcaaagggccaca

SEQ ID NO: 74317 - DNA, 25 bp, Rattus norvegicus
acagaacactgcatggccaggccta

SEQ ID NO: 74318 - DNA, 25 bp, Rattus norvegicus
acagaacactgcttggccaggccta

SEQ ID NO: 74319 - DNA, 25 bp, Rattus norvegicus
acagaacagggtaatctatgtggct

SEQ ID NO: 74320 - DNA, 25 bp, Rattus norvegicus
acagaacagggttatctatgtggct

SEQ ID NO: 74321 - DNA, 25 bp, Rattus norvegicus
acagaaccaccaccattcaaaagca

SEQ ID NO: 74322 - DNA, 25 bp, Rattus norvegicus
acagaaccaccagcattcaaaagca

SEQ ID NO: 74323 - DNA, 25 bp, Rattus norvegicus
acagaaccctgtcatctcccaatgg

SEQ ID NO: 74324 - DNA, 25 bp, Rattus norvegicus
acagaaccctgtgatctcccaatgg

SEQ ID NO: 74325 - DNA, 25 bp, Rattus norvegicus
acagaaccggcgcttcaaggagaaa

SEQ ID NO: 74326 - DNA, 25 bp, Rattus norvegicus
acagaaccggcggttcaaggagaaa

SEQ ID NO: 74327 - DNA, 25 bp, Rattus norvegicus
acagaaccgtgtcctcagcgcgatg

SEQ ID NO: 74328 - DNA, 25 bp, Rattus norvegicus
acagaaccgtgtgctcagcgcgatg

SEQ ID NO: 74329 - DNA, 25 bp, Rattus norvegicus
acagaaccttctcgcatgggaacag

SEQ ID NO: 74330 - DNA, 25 bp, Rattus norvegicus
acagaaccttctggcatgggaacag

SEQ ID NO: 74331 - DNA, 25 bp, Rattus norvegicus
acagaacgcccacccatgttaggag

SEQ ID NO: 74332 - DNA, 25 bp, Rattus norvegicus
acagaacgcccagccatgttaggag

SEQ ID NO: 74333 - DNA, 25 bp, Rattus norvegicus
acagaacgctcacgacagaagctca

SEQ ID NO: 74334 - DNA, 25 bp, Rattus norvegicus
acagaacgctcaggacagaagctca

SEQ ID NO: 74335 - DNA, 25 bp, Rattus norvegicus
acagaacgtggaagggtggatttat

SEQ ID NO: 74336 - DNA, 25 bp, Rattus norvegicus
acagaacgtggatgggtggatttat

SEQ ID NO: 74337 - DNA, 25 bp, Rattus norvegicus
acagaactacttagagctcacccat

SEQ ID NO: 74338 - DNA, 25 bp, Rattus norvegicus
acagaactactttgagctcacccat

SEQ ID NO: 74339 - DNA, 25 bp, Rattus norvegicus
acagaactcagcatttgacctctgc

SEQ ID NO: 74340 - DNA, 25 bp, Rattus norvegicus
acagaactcagcttttgacctctgc

SEQ ID NO: 74341 - DNA, 25 bp, Rattus norvegicus
acagaactctcaatggtggctccct

SEQ ID NO: 74342 - DNA, 25 bp, Rattus norvegicus
acagaactctcattggtggctccct

SEQ ID NO: 74343 - DNA, 25 bp, Rattus norvegicus
acagaactgcaaagacacatgtggt

SEQ ID NO: 74344 - DNA, 25 bp, Rattus norvegicus
acagaactgcaatgacacatgtggt

SEQ ID NO: 74345 - DNA, 25 bp, Rattus norvegicus
acagaactgcggcttctggaacaga

SEQ ID NO: 74346 - DNA, 25 bp, Rattus norvegicus
acagaactgcgggttctggaacaga

SEQ ID NO: 74347 - DNA, 25 bp, Rattus norvegicus
acagaactgctgacttttcaaagtg

SEQ ID NO: 74348 - DNA, 25 bp, Rattus norvegicus
acagaactgctgtcttttcaaagtg

SEQ ID NO: 74349 - DNA, 25 bp, Rattus norvegicus
acagaactgcttcagggatgtgagc

SEQ ID NO: 74350 - DNA, 25 bp, Rattus norvegicus
acagaactgcttgagggatgtgagc

SEQ ID NO: 74351 - DNA, 25 bp, Rattus norvegicus
acagaactgtggatgctgctgctgg

SEQ ID NO: 74352 - DNA, 25 bp, Rattus norvegicus
acagaactgtggctgttgctcacac

SEQ ID NO: 74353 - DNA, 25 bp, Rattus norvegicus
acagaactgtgggtgttgctcacac

SEQ ID NO: 74354 - DNA, 25 bp, Rattus norvegicus
acagaactgtggttgctgctgctgg

SEQ ID NO: 74355 - DNA, 25 bp, Rattus norvegicus
acagaacttcaaccctgggaggaaa

SEQ ID NO: 74356 - DNA, 25 bp, Rattus norvegicus
acagaacttcaagcctgggaggaaa

SEQ ID NO: 74357 - DNA, 25 bp, Rattus norvegicus
acagaacttgaaacaggccctgagt

SEQ ID NO: 74358 - DNA, 25 bp, Rattus norvegicus
acagaacttgaatcaggccctgagt

SEQ ID NO: 74359 - DNA, 25 bp, Rattus norvegicus
acagaacttgtgacgtagcggtagc

SEQ ID NO: 74360 - DNA, 25 bp, Rattus norvegicus
acagaacttgtgtcgtagcggtagc

SEQ ID NO: 74361 - DNA, 25 bp, Rattus norvegicus
acagaagaagccacacccatgaact

SEQ ID NO: 74362 - DNA, 25 bp, Rattus norvegicus
acagaagaagcctcacccatgaact

SEQ ID NO: 74363 - DNA, 25 bp, Rattus norvegicus
acagaagactatctggagtactcca

SEQ ID NO: 74364 - DNA, 25 bp, Rattus norvegicus
acagaagactatgtggagtactcca

SEQ ID NO: 74365 - DNA, 25 bp, Rattus norvegicus
acagaagactcacgtttggttctca

SEQ ID NO: 74366 - DNA, 25 bp, Rattus norvegicus
acagaagactcaggtttggttctca

SEQ ID NO: 74367 - DNA, 25 bp, Rattus norvegicus
acagaagaggaacctctcccttgtc

SEQ ID NO: 74368 - DNA, 25 bp, Rattus norvegicus
acagaagaggaagctctcccttgtc

SEQ ID NO: 74369 - DNA, 25 bp, Rattus norvegicus
acagaagatcggcaacagagcatgg

SEQ ID NO: 74370 - DNA, 25 bp, Rattus norvegicus
acagaagatcgggaacagagcatgg

SEQ ID NO: 74371 - DNA, 25 bp, Rattus norvegicus
acagaagcacccatccatcgaggat

SEQ ID NO: 74372 - DNA, 25 bp, Rattus norvegicus
acagaagcacccttccatcgaggat

SEQ ID NO: 74373 - DNA, 25 bp, Rattus norvegicus
acagaagcctataactccagagact

SEQ ID NO: 74374 - DNA, 25 bp, Rattus norvegicus
acagaagcctattactccagagact

SEQ ID NO: 74375 - DNA, 25 bp, Rattus norvegicus
acagaagcctttccaggcctcctaa

SEQ ID NO: 74376 - DNA, 25 bp, Rattus norvegicus
acagaagcctttgcaggcctcctaa

SEQ ID NO: 74377 - DNA, 25 bp, Rattus norvegicus
acagaagctgaaagccaatggccat

SEQ ID NO: 74378 - DNA, 25 bp, Rattus norvegicus
acagaagctgaatgccaatggccat

SEQ ID NO: 74379 - DNA, 25 bp, Rattus norvegicus
acagaagctgctagtttctccatgg

SEQ ID NO: 74380 - DNA, 25 bp, Rattus norvegicus
acagaagctgcttgtttctccatgg

SEQ ID NO: 74381 - DNA, 25 bp, Rattus norvegicus
acagaagctggtactgtgaccctca

SEQ ID NO: 74382 - DNA, 25 bp, Rattus norvegicus
acagaagctggttctgtgaccctca

SEQ ID NO: 74383 - DNA, 25 bp, Rattus norvegicus
acagaagcttgtaactcaccagtcc

SEQ ID NO: 74384 - DNA, 25 bp, Rattus norvegicus
acagaagcttgttactcaccagtcc

SEQ ID NO: 74385 - DNA, 25 bp, Rattus norvegicus
acagaaggcgttctgtggcagaaaa

SEQ ID NO: 74386 - DNA, 25 bp, Rattus norvegicus
acagaaggcgttgtgtggcagaaaa

SEQ ID NO: 74387 - DNA, 25 bp, Rattus norvegicus
acagaaggctatcttggaggctacc

SEQ ID NO: 74388 - DNA, 25 bp, Rattus norvegicus
acagaaggctatgttggaggctacc

SEQ ID NO: 74389 - DNA, 25 bp, Rattus norvegicus
acagaagggactagggctcttgcca

SEQ ID NO: 74390 - DNA, 25 bp, Rattus norvegicus
acagaagggacttgggctcttgcca

SEQ ID NO: 74391 - DNA, 25 bp, Rattus norvegicus
acagaagggcacattgcgtgtccat

SEQ ID NO: 74392 - DNA, 25 bp, Rattus norvegicus
acagaagggcactttgcgtgtccat

SEQ ID NO: 74393 - DNA, 25 bp, Rattus norvegicus
acagaaggtgcacgcaggtttctcc

SEQ ID NO: 74394 - DNA, 25 bp, Rattus norvegicus
acagaaggtgcaggcaggtttctcc

SEQ ID NO: 74395 - DNA, 25 bp, Rattus norvegicus
acagaaggtggcagctagagcttaa

SEQ ID NO: 74396 - DNA, 25 bp, Rattus norvegicus
acagaaggtggctgctagagcttaa

SEQ ID NO: 74397 - DNA, 25 bp, Rattus norvegicus
acagaaggtgtcacagactgagcca

SEQ ID NO: 74398 - DNA, 25 bp, Rattus norvegicus
acagaaggtgtctcagactgagcca

SEQ ID NO: 74399 - DNA, 25 bp, Rattus norvegicus
acagaaggtgttcgcttcggctctg

SEQ ID NO: 74400 - DNA, 25 bp, Rattus norvegicus
acagaaggtgttggcttcggctctg

SEQ ID NO: 74401 - DNA, 25 bp, Rattus norvegicus
acagaagtaaacacaccagattcct

SEQ ID NO: 74402 - DNA, 25 bp, Rattus norvegicus
acagaagtaaactcaccagattcct

SEQ ID NO: 74403 - DNA, 25 bp, Rattus norvegicus
acagaagtcaggacccggtggtgtc

SEQ ID NO: 74404 - DNA, 25 bp, Rattus norvegicus
acagaagtcaggtcccggtggtgtc

SEQ ID NO: 74405 - DNA, 25 bp, Rattus norvegicus
acagaagtcatgaagcttgcagatt

SEQ ID NO: 74406 - DNA, 25 bp, Rattus norvegicus
acagaagtcatgtagcttgcagatt

SEQ ID NO: 74407 - DNA, 25 bp, Rattus norvegicus
acagaagtcgcgatccagaggcaaa

SEQ ID NO: 74408 - DNA, 25 bp, Rattus norvegicus
acagaagtcgcgttccagaggcaaa

SEQ ID NO: 74409 - DNA, 25 bp, Rattus norvegicus
acagaagtctctccttttatttttg

SEQ ID NO: 74410 - DNA, 25 bp, Rattus norvegicus
acagaagtctctgcttttatttttg

SEQ ID NO: 74411 - DNA, 25 bp, Rattus norvegicus
acagaagtgaatcgctcatccccac

SEQ ID NO: 74412 - DNA, 25 bp, Rattus norvegicus
acagaagtgaatggctcatccccac

SEQ ID NO: 74413 - DNA, 25 bp, Rattus norvegicus
acagaagtgaccaggcctgccgttt

SEQ ID NO: 74414 - DNA, 25 bp, Rattus norvegicus
acagaagtgacctggcctgccgttt

SEQ ID NO: 74415 - DNA, 25 bp, Rattus norvegicus
acagaagtgctaattgtttcctaaa

SEQ ID NO: 74416 - DNA, 25 bp, Rattus norvegicus
acagaagtgctatttgtttcctaaa

SEQ ID NO: 74417 - DNA, 25 bp, Rattus norvegicus
acagaagtggagatctagtcttaga

SEQ ID NO: 74418 - DNA, 25 bp, Rattus norvegicus
acagaagtggagttctagtcttaga

SEQ ID NO: 74419 - DNA, 25 bp, Rattus norvegicus
acagaagtggtgatgcgccctgtag

SEQ ID NO: 74420 - DNA, 25 bp, Rattus norvegicus
acagaagtggtgttgcgccctgtag

SEQ ID NO: 74421 - DNA, 25 bp, Rattus norvegicus
acagaagttcagagtgaagggccga

SEQ ID NO: 74422 - DNA, 25 bp, Rattus norvegicus
acagaagttcagtgtgaagggccga

SEQ ID NO: 74423 - DNA, 25 bp, Rattus norvegicus
acagaagttttactcattcatttca

SEQ ID NO: 74424 - DNA, 25 bp, Rattus norvegicus
acagaagttttagtcattcatttca

SEQ ID NO: 74425 - DNA, 25 bp, Rattus norvegicus
acagaagttttccagcctttccctg

SEQ ID NO: 74426 - DNA, 25 bp, Rattus norvegicus
acagaagttttcgagcctttccctg

SEQ ID NO: 74427 - DNA, 25 bp, Rattus norvegicus
acagaataaccacggctcgacgatt

SEQ ID NO: 74428 - DNA, 25 bp, Rattus norvegicus
acagaataaccagggctcgacgatt

SEQ ID NO: 74429 - DNA, 25 bp, Rattus norvegicus
acagaataccccatgtgctcattct

SEQ ID NO: 74430 - DNA, 25 bp, Rattus norvegicus
acagaataccccttgtgctcattct

SEQ ID NO: 74431 - DNA, 25 bp, Rattus norvegicus
acagaatactgcatggtcctaagga

SEQ ID NO: 74432 - DNA, 25 bp, Rattus norvegicus
acagaatactgcttggtcctaagga

SEQ ID NO: 74433 - DNA, 25 bp, Rattus norvegicus
acagaatagccacgcccaggagttc

SEQ ID NO: 74434 - DNA, 25 bp, Rattus norvegicus
acagaatagccaggcccaggagttc

SEQ ID NO: 74435 - DNA, 25 bp, Rattus norvegicus
acagaatatgctcaatgtcatcttt

SEQ ID NO: 74436 - DNA, 25 bp, Rattus norvegicus
acagaatatgctgaatgtcatcttt

SEQ ID NO: 74437 - DNA, 25 bp, Rattus norvegicus
acagaatcaggaactacgagcgaga

SEQ ID NO: 74438 - DNA, 25 bp, Rattus norvegicus
acagaatcaggatctacgagcgaga

SEQ ID NO: 74439 - DNA, 25 bp, Rattus norvegicus
acagaatctatcaacccaacacaga

SEQ ID NO: 74440 - DNA, 25 bp, Rattus norvegicus
acagaatctatctacccaacacaga

SEQ ID NO: 74441 - DNA, 25 bp, Rattus norvegicus
acagaatctcttaacacggcccttg

SEQ ID NO: 74442 - DNA, 25 bp, Rattus norvegicus
acagaatctctttacacggcccttg

SEQ ID NO: 74443 - DNA, 25 bp, Rattus norvegicus
acagaatctgccagctgttcttgga

SEQ ID NO: 74444 - DNA, 25 bp, Rattus norvegicus
acagaatctgcctgctgttcttgga

SEQ ID NO: 74445 - DNA, 25 bp, Rattus norvegicus
acagaatgaagcctcagcgagctga

SEQ ID NO: 74446 - DNA, 25 bp, Rattus norvegicus
acagaatgaagcgtcagcgagctga

SEQ ID NO: 74447 - DNA, 25 bp, Rattus norvegicus
acagaatgaattatggtctccgatt

SEQ ID NO: 74448 - DNA, 25 bp, Rattus norvegicus
acagaatgaattttggtctccgatt

SEQ ID NO: 74449 - DNA, 25 bp, Rattus norvegicus
acagaatgacgtcccaggttgccca

SEQ ID NO: 74450 - DNA, 25 bp, Rattus norvegicus
acagaatgacgtgccaggttgccca

SEQ ID NO: 74451 - DNA, 25 bp, Rattus norvegicus
acagaatgctctccgtattttgtca

SEQ ID NO: 74452 - DNA, 25 bp, Rattus norvegicus
acagaatgctctgcgtattttgtca

SEQ ID NO: 74453 - DNA, 25 bp, Rattus norvegicus
acagaatgcttgactaaccttcaga

SEQ ID NO: 74454 - DNA, 25 bp, Rattus norvegicus
acagaatgcttgtctaaccttcaga

SEQ ID NO: 74455 - DNA, 25 bp, Rattus norvegicus
acagaatggagtcgtatcctttaga

SEQ ID NO: 74456 - DNA, 25 bp, Rattus norvegicus
acagaatggagtggtatcctttaga

SEQ ID NO: 74457 - DNA, 25 bp, Rattus norvegicus
acagaatgggtcagtgcagtcgaga

SEQ ID NO: 74458 - DNA, 25 bp, Rattus norvegicus
acagaatgggtctgtgcagtcgaga

SEQ ID NO: 74459 - DNA, 25 bp, Rattus norvegicus
acagaatgtctcaggctgctcacag

SEQ ID NO: 74460 - DNA, 25 bp, Rattus norvegicus
acagaatgtctctggctgctcacag

SEQ ID NO: 74461 - DNA, 25 bp, Rattus norvegicus
acagaatgtgctcccttgggtcgct

SEQ ID NO: 74462 - DNA, 25 bp, Rattus norvegicus
acagaatgtgctgccttgggtcgct

SEQ ID NO: 74463 - DNA, 25 bp, Rattus norvegicus
acagaattcactcttcagtacagaa

SEQ ID NO: 74464 - DNA, 25 bp, Rattus norvegicus
acagaattcactgttcagtacagaa

SEQ ID NO: 74465 - DNA, 25 bp, Rattus norvegicus
acagaattctgcacctttgggagat

SEQ ID NO: 74466 - DNA, 25 bp, Rattus norvegicus
acagaattctgctcctttgggagat

SEQ ID NO: 74467 - DNA, 25 bp, Rattus norvegicus
acagaatttcttatagcccaagcta

SEQ ID NO: 74468 - DNA, 25 bp, Rattus norvegicus
acagaatttcttttagcccaagcta

SEQ ID NO: 74469 - DNA, 25 bp, Rattus norvegicus
acagaattttctatggttgccgaca

SEQ ID NO: 74470 - DNA, 25 bp, Rattus norvegicus
acagaattttctttggttgccgaca

SEQ ID NO: 74471 - DNA, 25 bp, Rattus norvegicus
acagacaaactccacccagtaaatg

SEQ ID NO: 74472 - DNA, 25 bp, Rattus norvegicus
acagacaaactcgacccagtaaatg

SEQ ID NO: 74473 - DNA, 25 bp, Rattus norvegicus
acagacaagtgcatagccccagtgc

SEQ ID NO: 74474 - DNA, 25 bp, Rattus norvegicus
acagacaagtgcttagccccagtgc

SEQ ID NO: 74475 - DNA, 25 bp, Rattus norvegicus
acagacaatctgctgcagctccctg

SEQ ID NO: 74476 - DNA, 25 bp, Rattus norvegicus
acagacaatctggtgcagctccctg

SEQ ID NO: 74477 - DNA, 25 bp, Rattus norvegicus
acagacacaagtaagttggagcctt

SEQ ID NO: 74478 - DNA, 25 bp, Rattus norvegicus
acagacacaagttagttggagcctt

SEQ ID NO: 74479 - DNA, 25 bp, Rattus norvegicus
acagacacaattagccctgttttgt

SEQ ID NO: 74480 - DNA, 25 bp, Rattus norvegicus
acagacacaatttgccctgttttgt

SEQ ID NO: 74481 - DNA, 25 bp, Rattus norvegicus
acagacaccaggcacacgtggtgtg

SEQ ID NO: 74482 - DNA, 25 bp, Rattus norvegicus
acagacaccagggacacgtggtgtg

SEQ ID NO: 74483 - DNA, 25 bp, Rattus norvegicus
acagacacgtctatccatggctaag

SEQ ID NO: 74484 - DNA, 25 bp, Rattus norvegicus
acagacacgtctttccatggctaag

SEQ ID NO: 74485 - DNA, 25 bp, Rattus norvegicus
acagacactagtacgggtttcattt

SEQ ID NO: 74486 - DNA, 25 bp, Rattus norvegicus
acagacactagttcgggtttcattt

SEQ ID NO: 74487 - DNA, 25 bp, Rattus norvegicus
acagacactgacctcatgaagtaga

SEQ ID NO: 74488 - DNA, 25 bp, Rattus norvegicus
acagacactgacgtcatgaagtaga

SEQ ID NO: 74489 - DNA, 25 bp, Rattus norvegicus
acagacactgttcactttgcgacct

SEQ ID NO: 74490 - DNA, 25 bp, Rattus norvegicus
acagacactgttgactttgcgacct

SEQ ID NO: 74491 - DNA, 25 bp, Rattus norvegicus
acagacagaactctcagaattcata

SEQ ID NO: 74492 - DNA, 25 bp, Rattus norvegicus
acagacagaactgtcagaattcata

SEQ ID NO: 74493 - DNA, 25 bp, Rattus norvegicus
acagacagagaaaggcggcagcaca

SEQ ID NO: 74494 - DNA, 25 bp, Rattus norvegicus
acagacagagaatggcggcagcaca

SEQ ID NO: 74495 - DNA, 25 bp, Rattus norvegicus
acagacagagacctccaatgccagt

SEQ ID NO: 74496 - DNA, 25 bp, Rattus norvegicus
acagacagagacgtccaatgccagt

SEQ ID NO: 74497 - DNA, 25 bp, Rattus norvegicus
acagacagcctgagtgtgggccctg

SEQ ID NO: 74498 - DNA, 25 bp, Rattus norvegicus
acagacagcctgtgtgtgggccctg

SEQ ID NO: 74499 - DNA, 25 bp, Rattus norvegicus
acagacaggctgagcactgagtgct

SEQ ID NO: 74500 - DNA, 25 bp, Rattus norvegicus
acagacaggctgtgcactgagtgct

SEQ ID NO: 74501 - DNA, 25 bp, Rattus norvegicus
acagacagggccacacagagcctca

SEQ ID NO: 74502 - DNA, 25 bp, Rattus norvegicus
acagacagggcctcacagagcctca

SEQ ID NO: 74503 - DNA, 25 bp, Rattus norvegicus
acagacagtcagatccttgtggaaa

SEQ ID NO: 74504 - DNA, 25 bp, Rattus norvegicus
acagacagtcagttccttgtggaaa

SEQ ID NO: 74505 - DNA, 25 bp, Rattus norvegicus
acagacagttggactgaaccacccg

SEQ ID NO: 74506 - DNA, 25 bp, Rattus norvegicus
acagacagttggtctgaaccacccg

SEQ ID NO: 74507 - DNA, 25 bp, Rattus norvegicus
acagacatacagatccttagcattt

SEQ ID NO: 74508 - DNA, 25 bp, Rattus norvegicus
acagacatacagttccttagcattt

SEQ ID NO: 74509 - DNA, 25 bp, Rattus norvegicus
acagacataggtactgaaccagcct

SEQ ID NO: 74510 - DNA, 25 bp, Rattus norvegicus
acagacataggttctgaaccagcct

SEQ ID NO: 74511 - DNA, 25 bp, Rattus norvegicus
acagacatataccacacactttttt

SEQ ID NO: 74512 - DNA, 25 bp, Rattus norvegicus
acagacatatacgacacactttttt

SEQ ID NO: 74513 - DNA, 25 bp, Rattus norvegicus
acagacatatcaaagttttagcaac

SEQ ID NO: 74514 - DNA, 25 bp, Rattus norvegicus
acagacatatcatagttttagcaac

SEQ ID NO: 74515 - DNA, 25 bp, Rattus norvegicus
acagacatctggcttctgtgagttt

SEQ ID NO: 74516 - DNA, 25 bp, Rattus norvegicus
acagacatctgggttctgtgagttt

SEQ ID NO: 74517 - DNA, 25 bp, Rattus norvegicus
acagacatgccgaggagctcccgag

SEQ ID NO: 74518 - DNA, 25 bp, Rattus norvegicus
acagacatgccgtggagctcccgag

SEQ ID NO: 74519 - DNA, 25 bp, Rattus norvegicus
acagacatgtaccactgcagcttgt

SEQ ID NO: 74520 - DNA, 25 bp, Rattus norvegicus
acagacatgtacgactgcagcttgt

SEQ ID NO: 74521 - DNA, 25 bp, Rattus norvegicus
acagacattattaccactctggtgg

SEQ ID NO: 74522 - DNA, 25 bp, Rattus norvegicus
acagacattatttccactctggtgg

SEQ ID NO: 74523 - DNA, 25 bp, Rattus norvegicus
acagacattccactgaccggatgta

SEQ ID NO: 74524 - DNA, 25 bp, Rattus norvegicus
acagacattccagtgaccggatgta

SEQ ID NO: 74525 - DNA, 25 bp, Rattus norvegicus
acagacattcccattgaggtgccac

SEQ ID NO: 74526 - DNA, 25 bp, Rattus norvegicus
acagacattccctttgaggtgccac

SEQ ID NO: 74527 - DNA, 25 bp, Rattus norvegicus
acagacattcttcgagagtgaccct

SEQ ID NO: 74528 - DNA, 25 bp, Rattus norvegicus
acagacattcttggagagtgaccct

SEQ ID NO: 74529 - DNA, 25 bp, Rattus norvegicus
acagacattgtccttacacacacac

SEQ ID NO: 74530 - DNA, 25 bp, Rattus norvegicus
acagacattgtcgttacacacacac

SEQ ID NO: 74531 - DNA, 25 bp, Rattus norvegicus
acagaccaaagacgcggcggcccca

SEQ ID NO: 74532 - DNA, 25 bp, Rattus norvegicus
acagaccaaagaggcggcggcccca

SEQ ID NO: 74533 - DNA, 25 bp, Rattus norvegicus
acagaccaaataagttcgaaccagt

SEQ ID NO: 74534 - DNA, 25 bp, Rattus norvegicus
acagaccaaatatgttcgaaccagt

SEQ ID NO: 74535 - DNA, 25 bp, Rattus norvegicus
acagaccacaaccagaagcttccgt

SEQ ID NO: 74536 - DNA, 25 bp, Rattus norvegicus
acagaccacaacgagaagcttccgt

SEQ ID NO: 74537 - DNA, 25 bp, Rattus norvegicus
acagaccacagaccagagcttgcag

SEQ ID NO: 74538 - DNA, 25 bp, Rattus norvegicus
acagaccacagagcagagcttgcag

SEQ ID NO: 74539 - DNA, 25 bp, Rattus norvegicus
acagaccacagtattcccagaaagg

SEQ ID NO: 74540 - DNA, 25 bp, Rattus norvegicus
acagaccacagttttcccagaaagg

SEQ ID NO: 74541 - DNA, 25 bp, Rattus norvegicus
acagaccacctaagtttcacagcta

SEQ ID NO: 74542 - DNA, 25 bp, Rattus norvegicus
acagaccacctatgtttcacagcta

SEQ ID NO: 74543 - DNA, 25 bp, Rattus norvegicus
acagaccacttcacgagttcagaga

SEQ ID NO: 74544 - DNA, 25 bp, Rattus norvegicus
acagaccacttctcgagttcagaga

SEQ ID NO: 74545 - DNA, 25 bp, Rattus norvegicus
acagaccagattatcctgcactagg

SEQ ID NO: 74546 - DNA, 25 bp, Rattus norvegicus
acagaccagattttcctgcactagg

SEQ ID NO: 74547 - DNA, 25 bp, Rattus norvegicus
acagaccatctgagctcacggtttg

SEQ ID NO: 74548 - DNA, 25 bp, Rattus norvegicus
acagaccatctgtgctcacggtttg

SEQ ID NO: 74549 - DNA, 25 bp, Rattus norvegicus
acagacccagatagagttcgccagc

SEQ ID NO: 74550 - DNA, 25 bp, Rattus norvegicus
acagacccagattgagttcgccagc

SEQ ID NO: 74551 - DNA, 25 bp, Rattus norvegicus
acagacccaggcacattcccgtagt

SEQ ID NO: 74552 - DNA, 25 bp, Rattus norvegicus
acagacccaggctcattcccgtagt

SEQ ID NO: 74553 - DNA, 25 bp, Rattus norvegicus
acagacccagtcagtatcttcttga

SEQ ID NO: 74554 - DNA, 25 bp, Rattus norvegicus
acagacccagtctgtatcttcttga

SEQ ID NO: 74555 - DNA, 25 bp, Rattus norvegicus
acagaccccatgacctggaacaaaa

SEQ ID NO: 74556 - DNA, 25 bp, Rattus norvegicus
acagaccccatgtcctggaacaaaa

SEQ ID NO: 74557 - DNA, 25 bp, Rattus norvegicus
acagaccgagagattgaatgcaagt

SEQ ID NO: 74558 - DNA, 25 bp, Rattus norvegicus
acagaccgagagtttgaatgcaagt

SEQ ID NO: 74559 - DNA, 25 bp, Rattus norvegicus
acagaccgtctgcagatcctggaat

SEQ ID NO: 74560 - DNA, 25 bp, Rattus norvegicus
acagaccgtctggagatcctggaat

SEQ ID NO: 74561 - DNA, 25 bp, Rattus norvegicus
acagacctcaggctctcaaaaagaa

SEQ ID NO: 74562 - DNA, 25 bp, Rattus norvegicus
acagacctcagggtctcaaaaagaa

SEQ ID NO: 74563 - DNA, 25 bp, Rattus norvegicus
acagacctcctgaagtgcaggctga

SEQ ID NO: 74564 - DNA, 25 bp, Rattus norvegicus
acagacctcctgtagtgcaggctga

SEQ ID NO: 74565 - DNA, 25 bp, Rattus norvegicus
acagacctgactacactatttgtaa

SEQ ID NO: 74566 - DNA, 25 bp, Rattus norvegicus
acagacctgacttcactatttgtaa

SEQ ID NO: 74567 - DNA, 25 bp, Rattus norvegicus
acagacctgagacactagtgcgttt

SEQ ID NO: 74568 - DNA, 25 bp, Rattus norvegicus
acagacctgagagactagtgcgttt

SEQ ID NO: 74569 - DNA, 25 bp, Rattus norvegicus
acagacctgattagtgtcccagtgg

SEQ ID NO: 74570 - DNA, 25 bp, Rattus norvegicus
acagacctgatttgtgtcccagtgg

SEQ ID NO: 74571 - DNA, 25 bp, Rattus norvegicus
acagacctggccacggatcatgtga

SEQ ID NO: 74572 - DNA, 25 bp, Rattus norvegicus
acagacctggcctcggatcatgtga

SEQ ID NO: 74573 - DNA, 25 bp, Rattus norvegicus
acagacctgggcagttctcaactat

SEQ ID NO: 74574 - DNA, 25 bp, Rattus norvegicus
acagacctgggctgttctcaactat

SEQ ID NO: 74575 - DNA, 25 bp, Rattus norvegicus
acagacctggtaccgaagacacttc

SEQ ID NO: 74576 - DNA, 25 bp, Rattus norvegicus
acagacctggtagcgaagacacttc

SEQ ID NO: 74577 - DNA, 25 bp, Rattus norvegicus
acagacctgtggaagtccagtctca

SEQ ID NO: 74578 - DNA, 25 bp, Rattus norvegicus
acagacctgtggcactggttcgagt

SEQ ID NO: 74579 - DNA, 25 bp, Rattus norvegicus
acagacctgtgggactggttcgagt

SEQ ID NO: 74580 - DNA, 25 bp, Rattus norvegicus
acagacctgtggtagtccagtctca

SEQ ID NO: 74581 - DNA, 25 bp, Rattus norvegicus
acagaccttggaactgcagctgcag

SEQ ID NO: 74582 - DNA, 25 bp, Rattus norvegicus
acagaccttggatctgcagctgcag

SEQ ID NO: 74583 - DNA, 25 bp, Rattus norvegicus
acagacctttctagaacacctttgc

SEQ ID NO: 74584 - DNA, 25 bp, Rattus norvegicus
acagacctttcttgaacacctttgc

SEQ ID NO: 74585 - DNA, 25 bp, Rattus norvegicus
acagacctttgaagactatttggag

SEQ ID NO: 74586 - DNA, 25 bp, Rattus norvegicus
acagacctttgatgactatttggag

SEQ ID NO: 74587 - DNA, 25 bp, Rattus norvegicus
acagacctttgcacgtgcactttgg

SEQ ID NO: 74588 - DNA, 25 bp, Rattus norvegicus
acagacctttgctcgtgcactttgg

SEQ ID NO: 74589 - DNA, 25 bp, Rattus norvegicus
acagacgaaggacccctgccggtgt

SEQ ID NO: 74590 - DNA, 25 bp, Rattus norvegicus
acagacgaaggagccctgccggtgt

SEQ ID NO: 74591 - DNA, 25 bp, Rattus norvegicus
acagacgacactctttggtccctac

SEQ ID NO: 74592 - DNA, 25 bp, Rattus norvegicus
acagacgacactgtttggtccctac

SEQ ID NO: 74593 - DNA, 25 bp, Rattus norvegicus
acagacgatgtcagcctgcaggtgt

SEQ ID NO: 74594 - DNA, 25 bp, Rattus norvegicus
acagacgatgtctgcctgcaggtgt

SEQ ID NO: 74595 - DNA, 25 bp, Rattus norvegicus
acagacgcaccaacgaagttaaccg

SEQ ID NO: 74596 - DNA, 25 bp, Rattus norvegicus
acagacgcaccatcgaagttaaccg

SEQ ID NO: 74597 - DNA, 25 bp, Rattus norvegicus
acagacgccattcttattcaatcca

SEQ ID NO: 74598 - DNA, 25 bp, Rattus norvegicus
acagacgccattgttattcaatcca

SEQ ID NO: 74599 - DNA, 25 bp, Rattus norvegicus
acagacgccgctcgaacagtcgtgg

SEQ ID NO: 74600 - DNA, 25 bp, Rattus norvegicus
acagacgccgctggaacagtcgtgg

SEQ ID NO: 74601 - DNA, 25 bp, Rattus norvegicus
acagacgcctggaaccttctgcggg

SEQ ID NO: 74602 - DNA, 25 bp, Rattus norvegicus
acagacgcctggtaccttctgcggg

SEQ ID NO: 74603 - DNA, 25 bp, Rattus norvegicus
acagacgcggatctcaccattgtgc

SEQ ID NO: 74604 - DNA, 25 bp, Rattus norvegicus
acagacgcggatgtcaccattgtgc

SEQ ID NO: 74605 - DNA, 25 bp, Rattus norvegicus
acagacgctaacactgtcaaagcca

SEQ ID NO: 74606 - DNA, 25 bp, Rattus norvegicus
acagacgctaactctgtcaaagcca

SEQ ID NO: 74607 - DNA, 25 bp, Rattus norvegicus
acagacgctgctcttaggctacagg

SEQ ID NO: 74608 - DNA, 25 bp, Rattus norvegicus
acagacgctgctgttaggctacagg

SEQ ID NO: 74609 - DNA, 25 bp, Rattus norvegicus
acagacggtctgctcatggttcaga

SEQ ID NO: 74610 - DNA, 25 bp, Rattus norvegicus
acagacggtctggtcatggttcaga

SEQ ID NO: 74611 - DNA, 25 bp, Rattus norvegicus
acagacgtcctaatgcacagagcaa

SEQ ID NO: 74612 - DNA, 25 bp, Rattus norvegicus
acagacgtcctattgcacagagcaa

SEQ ID NO: 74613 - DNA, 25 bp, Rattus norvegicus
acagacgtgtccaacatgggccggg

SEQ ID NO: 74614 - DNA, 25 bp, Rattus norvegicus
acagacgtgtcctacatgggccggg

SEQ ID NO: 74615 - DNA, 25 bp, Rattus norvegicus
acagacgtgtggctgcttccgttga

SEQ ID NO: 74616 - DNA, 25 bp, Rattus norvegicus
acagacgtgtgggtgcttccgttga

SEQ ID NO: 74617 - DNA, 25 bp, Rattus norvegicus
acagacgttccgagttgtgcttcga

SEQ ID NO: 74618 - DNA, 25 bp, Rattus norvegicus
acagacgttccgtgttgtgcttcga

SEQ ID NO: 74619 - DNA, 25 bp, Rattus norvegicus
acagacgttgagctcatcacgggtc

SEQ ID NO: 74620 - DNA, 25 bp, Rattus norvegicus
acagacgttgaggtcatcacgggtc

SEQ ID NO: 74621 - DNA, 25 bp, Rattus norvegicus
acagacgttttgcacagcctggaca

SEQ ID NO: 74622 - DNA, 25 bp, Rattus norvegicus
acagacgttttggacagcctggaca

SEQ ID NO: 74623 - DNA, 25 bp, Rattus norvegicus
acagactaaagtcaaagcctacaag

SEQ ID NO: 74624 - DNA, 25 bp, Rattus norvegicus
acagactaaagtgaaagcctacaag

SEQ ID NO: 74625 - DNA, 25 bp, Rattus norvegicus
acagactaacagatacaagttcgtc

SEQ ID NO: 74626 - DNA, 25 bp, Rattus norvegicus
acagactaacagttacaagttcgtc

SEQ ID NO: 74627 - DNA, 25 bp, Rattus norvegicus
acagactagcaacggcatgcacaca

SEQ ID NO: 74628 - DNA, 25 bp, Rattus norvegicus
acagactagcaagggcatgcacaca

SEQ ID NO: 74629 - DNA, 25 bp, Rattus norvegicus
acagactcaaagatactaagcatgg

SEQ ID NO: 74630 - DNA, 25 bp, Rattus norvegicus
acagactcaaagttactaagcatgg

SEQ ID NO: 74631 - DNA, 25 bp, Rattus norvegicus
acagactcgtttcttttctcaggct

SEQ ID NO: 74632 - DNA, 25 bp, Rattus norvegicus
acagactcgtttgttttctcaggct

SEQ ID NO: 74633 - DNA, 25 bp, Rattus norvegicus
acagactctctcagccgtggatggc

SEQ ID NO: 74634 - DNA, 25 bp, Rattus norvegicus
acagactctctctgccgtggatggc

SEQ ID NO: 74635 - DNA, 25 bp, Rattus norvegicus
acagactctggtcatccatgtcaag

SEQ ID NO: 74636 - DNA, 25 bp, Rattus norvegicus
acagactctggtgatccatgtcaag

SEQ ID NO: 74637 - DNA, 25 bp, Rattus norvegicus
acagactctgtgcagcctgagatac

SEQ ID NO: 74638 - DNA, 25 bp, Rattus norvegicus
acagactctgtggagcctgagatac

SEQ ID NO: 74639 - DNA, 25 bp, Rattus norvegicus
acagactcttcgctgtcagaatcta

SEQ ID NO: 74640 - DNA, 25 bp, Rattus norvegicus
acagactcttcggtgtcagaatcta

SEQ ID NO: 74641 - DNA, 25 bp, Rattus norvegicus
acagactcttgcactacggcatgga

SEQ ID NO: 74642 - DNA, 25 bp, Rattus norvegicus
acagactcttgctctacggcatgga

SEQ ID NO: 74643 - DNA, 25 bp, Rattus norvegicus
acagactcttggctaccagctgcgg

SEQ ID NO: 74644 - DNA, 25 bp, Rattus norvegicus
acagactcttggctatttttaagaa

SEQ ID NO: 74645 - DNA, 25 bp, Rattus norvegicus
acagactcttgggtaccagctgcgg

SEQ ID NO: 74646 - DNA, 25 bp, Rattus norvegicus
acagactcttgggtatttttaagaa

SEQ ID NO: 74647 - DNA, 25 bp, Rattus norvegicus
acagactcttgtaacgatgttcccc

SEQ ID NO: 74648 - DNA, 25 bp, Rattus norvegicus
acagactcttgttacgatgttcccc

SEQ ID NO: 74649 - DNA, 25 bp, Rattus norvegicus
acagactgacctcccgttggaagaa

SEQ ID NO: 74650 - DNA, 25 bp, Rattus norvegicus
acagactgacctgccgttggaagaa

SEQ ID NO: 74651 - DNA, 25 bp, Rattus norvegicus
acagactgcacacaggaggtgaatg

SEQ ID NO: 74652 - DNA, 25 bp, Rattus norvegicus
acagactgcacagaggaggtgaatg

SEQ ID NO: 74653 - DNA, 25 bp, Rattus norvegicus
acagactgcccactgaatgggtcaa

SEQ ID NO: 74654 - DNA, 25 bp, Rattus norvegicus
acagactgcccagtgaatgggtcaa

SEQ ID NO: 74655 - DNA, 25 bp, Rattus norvegicus
acagactgcctgaaggtacagtgca

SEQ ID NO: 74656 - DNA, 25 bp, Rattus norvegicus
acagactgcctgtaggtacagtgca

SEQ ID NO: 74657 - DNA, 25 bp, Rattus norvegicus
acagactggatactcctcttgcctt

SEQ ID NO: 74658 - DNA, 25 bp, Rattus norvegicus
acagactggatagtcctcttgcctt

SEQ ID NO: 74659 - DNA, 25 bp, Rattus norvegicus
acagactgggtaattcctaatccaa

SEQ ID NO: 74660 - DNA, 25 bp, Rattus norvegicus
acagactgggtatttcctaatccaa

SEQ ID NO: 74661 - DNA, 25 bp, Rattus norvegicus
acagactgtcccaggtggcagtggc

SEQ ID NO: 74662 - DNA, 25 bp, Rattus norvegicus
acagactgtccctggtggcagtggc

SEQ ID NO: 74663 - DNA, 25 bp, Rattus norvegicus
acagactgtgtgcttatgcgggatc

SEQ ID NO: 74664 - DNA, 25 bp, Rattus norvegicus
acagactgtgtggttatgcgggatc

SEQ ID NO: 74665 - DNA, 25 bp, Rattus norvegicus
acagactgttctcaaggtcggaagt

SEQ ID NO: 74666 - DNA, 25 bp, Rattus norvegicus
acagactgttctgaaggtcggaagt

SEQ ID NO: 74667 - DNA, 25 bp, Rattus norvegicus
acagacttaccgatatcgatttggg

SEQ ID NO: 74668 - DNA, 25 bp, Rattus norvegicus
acagacttaccgttatcgatttggg

SEQ ID NO: 74669 - DNA, 25 bp, Rattus norvegicus
acagacttcatcacacccagattgg

SEQ ID NO: 74670 - DNA, 25 bp, Rattus norvegicus
acagacttcatctcacccagattgg

SEQ ID NO: 74671 - DNA, 25 bp, Rattus norvegicus
acagacttccaacaccattgcaaag

SEQ ID NO: 74672 - DNA, 25 bp, Rattus norvegicus
acagacttccaagaccattgcaaag

SEQ ID NO: 74673 - DNA, 25 bp, Rattus norvegicus
acagacttccacagagcgatatgaa

SEQ ID NO: 74674 - DNA, 25 bp, Rattus norvegicus
acagacttccactgagcgatatgaa

SEQ ID NO: 74675 - DNA, 25 bp, Rattus norvegicus
acagacttccccaaagagactgtct

SEQ ID NO: 74676 - DNA, 25 bp, Rattus norvegicus
acagacttcccctaagagactgtct

SEQ ID NO: 74677 - DNA, 25 bp, Rattus norvegicus
acagacttccctagtcagtatgtga

SEQ ID NO: 74678 - DNA, 25 bp, Rattus norvegicus
acagacttcccttgtcagtatgtga

SEQ ID NO: 74679 - DNA, 25 bp, Rattus norvegicus
acagacttcctgacctcactgtggg

SEQ ID NO: 74680 - DNA, 25 bp, Rattus norvegicus
acagacttcctgctcctcgtttgta

SEQ ID NO: 74681 - DNA, 25 bp, Rattus norvegicus
acagacttcctggtcctcgtttgta

SEQ ID NO: 74682 - DNA, 25 bp, Rattus norvegicus
acagacttcctgtcctcactgtggg

SEQ ID NO: 74683 - DNA, 25 bp, Rattus norvegicus
acagacttctcccaacaggtcagag

SEQ ID NO: 74684 - DNA, 25 bp, Rattus norvegicus
acagacttctccgaacaggtcagag

SEQ ID NO: 74685 - DNA, 25 bp, Rattus norvegicus
acagacttgttgaaggccactgcag

SEQ ID NO: 74686 - DNA, 25 bp, Rattus norvegicus
acagacttgttgtaggccactgcag

SEQ ID NO: 74687 - DNA, 25 bp, Rattus norvegicus
acagactttctccactgaccttttt

SEQ ID NO: 74688 - DNA, 25 bp, Rattus norvegicus
acagactttctcgactgaccttttt

SEQ ID NO: 74689 - DNA, 25 bp, Rattus norvegicus
acagactttggactgcagcgtaaac

SEQ ID NO: 74690 - DNA, 25 bp, Rattus norvegicus
acagactttggagtgcagcgtaaac

SEQ ID NO: 74691 - DNA, 25 bp, Rattus norvegicus
acagactttgtcctggccattttta

SEQ ID NO: 74692 - DNA, 25 bp, Rattus norvegicus
acagactttgtcgtggccattttta

SEQ ID NO: 74693 - DNA, 25 bp, Rattus norvegicus
acagacttttaaacagttcaccagg

SEQ ID NO: 74694 - DNA, 25 bp, Rattus norvegicus
acagacttttaatcagttcaccagg

SEQ ID NO: 74695 - DNA, 25 bp, Rattus norvegicus
acagagaacgcgaggccagcctggt

SEQ ID NO: 74696 - DNA, 25 bp, Rattus norvegicus
acagagaacgcgtggccagcctggt

SEQ ID NO: 74697 - DNA, 25 bp, Rattus norvegicus
acagagaacgtgatctttagtttaa

SEQ ID NO: 74698 - DNA, 25 bp, Rattus norvegicus
acagagaacgtgttctttagtttaa

SEQ ID NO: 74699 - DNA, 25 bp, Rattus norvegicus
acagagaagaccagagccggcttgt

SEQ ID NO: 74700 - DNA, 25 bp, Rattus norvegicus
acagagaagacctgagccggcttgt

SEQ ID NO: 74701 - DNA, 25 bp, Rattus norvegicus
acagagaagatgactcccagggacc

SEQ ID NO: 74702 - DNA, 25 bp, Rattus norvegicus
acagagaagatgtctcccagggacc

SEQ ID NO: 74703 - DNA, 25 bp, Rattus norvegicus
acagagaagccacagcccgagcggt

SEQ ID NO: 74704 - DNA, 25 bp, Rattus norvegicus
acagagaagccagagcccgagcggt

SEQ ID NO: 74705 - DNA, 25 bp, Rattus norvegicus
acagagaagggtcttggtctcctcc

SEQ ID NO: 74706 - DNA, 25 bp, Rattus norvegicus
acagagaagggtgttggtctcctcc

SEQ ID NO: 74707 - DNA, 25 bp, Rattus norvegicus
acagagaagttcatggccaagcaaa

SEQ ID NO: 74708 - DNA, 25 bp, Rattus norvegicus
acagagaagttcttggccaagcaaa

SEQ ID NO: 74709 - DNA, 25 bp, Rattus norvegicus
acagagacaaggaccctgcagggaa

SEQ ID NO: 74710 - DNA, 25 bp, Rattus norvegicus
acagagacaaggctcttctgcaagg

SEQ ID NO: 74711 - DNA, 25 bp, Rattus norvegicus
acagagacaagggtcttctgcaagg

SEQ ID NO: 74712 - DNA, 25 bp, Rattus norvegicus
acagagacaaggtccctgcagggaa

SEQ ID NO: 74713 - DNA, 25 bp, Rattus norvegicus
acagagacagaacagcccggtggca

SEQ ID NO: 74714 - DNA, 25 bp, Rattus norvegicus
acagagacagaagagcccggtggca

SEQ ID NO: 74715 - DNA, 25 bp, Rattus norvegicus
acagagacatggagcgtatcccggt

SEQ ID NO: 74716 - DNA, 25 bp, Rattus norvegicus
acagagacatggtgcgtatcccggt

SEQ ID NO: 74717 - DNA, 25 bp, Rattus norvegicus
acagagaccacactccacaaggact

SEQ ID NO: 74718 - DNA, 25 bp, Rattus norvegicus
acagagaccacagtccacaaggact

SEQ ID NO: 74719 - DNA, 25 bp, Rattus norvegicus
acagagaccctgaaatccttagcca

SEQ ID NO: 74720 - DNA, 25 bp, Rattus norvegicus
acagagaccctgtaatccttagcca

SEQ ID NO: 74721 - DNA, 25 bp, Rattus norvegicus
acagagacctccctgttcaaggcct

SEQ ID NO: 74722 - DNA, 25 bp, Rattus norvegicus
acagagacctccgtgttcaaggcct

SEQ ID NO: 74723 - DNA, 25 bp, Rattus norvegicus
acagagacctttaaccacccaacag

SEQ ID NO: 74724 - DNA, 25 bp, Rattus norvegicus
acagagaccttttaccacccaacag

SEQ ID NO: 74725 - DNA, 25 bp, Rattus norvegicus
acagagactctgcagatttagctag

SEQ ID NO: 74726 - DNA, 25 bp, Rattus norvegicus
acagagactctggagatttagctag

SEQ ID NO: 74727 - DNA, 25 bp, Rattus norvegicus
acagagactcttcgccctaggacac

SEQ ID NO: 74728 - DNA, 25 bp, Rattus norvegicus
acagagactcttggccctaggacac

SEQ ID NO: 74729 - DNA, 25 bp, Rattus norvegicus
acagagactgctacaaacttgtaaa

SEQ ID NO: 74730 - DNA, 25 bp, Rattus norvegicus
acagagactgcttcaaacttgtaaa

SEQ ID NO: 74731 - DNA, 25 bp, Rattus norvegicus
acagagactgtcagcttacctcttg

SEQ ID NO: 74732 - DNA, 25 bp, Rattus norvegicus
acagagactgtctgcttacctcttg

SEQ ID NO: 74733 - DNA, 25 bp, Rattus norvegicus
acagagagaaggcacgcttcccctt

SEQ ID NO: 74734 - DNA, 25 bp, Rattus norvegicus
acagagagaagggacgcttcccctt

SEQ ID NO: 74735 - DNA, 25 bp, Rattus norvegicus
acagagagaatgacacggcctccct

SEQ ID NO: 74736 - DNA, 25 bp, Rattus norvegicus
acagagagaatgtcacggcctccct

SEQ ID NO: 74737 - DNA, 25 bp, Rattus norvegicus
acagagagatcaacaagcaagccac

SEQ ID NO: 74738 - DNA, 25 bp, Rattus norvegicus
acagagagatcatcaagcaagccac

SEQ ID NO: 74739 - DNA, 25 bp, Rattus norvegicus
acagagagcaacacccgcagccggg

SEQ ID NO: 74740 - DNA, 25 bp, Rattus norvegicus
acagagagcaactcccgcagccggg

SEQ ID NO: 74741 - DNA, 25 bp, Rattus norvegicus
acagagagcacacttgaccatgtct

SEQ ID NO: 74742 - DNA, 25 bp, Rattus norvegicus
acagagagcacagttgaccatgtct

SEQ ID NO: 74743 - DNA, 25 bp, Rattus norvegicus
acagagagccgcatcccggagggaa

SEQ ID NO: 74744 - DNA, 25 bp, Rattus norvegicus
acagagagccgcttcccggagggaa

SEQ ID NO: 74745 - DNA, 25 bp, Rattus norvegicus
acagagagctgtcattttagagtac

SEQ ID NO: 74746 - DNA, 25 bp, Rattus norvegicus
acagagagctgtgattttagagtac

SEQ ID NO: 74747 - DNA, 25 bp, Rattus norvegicus
acagagaggcacctgggagtctcac

SEQ ID NO: 74748 - DNA, 25 bp, Rattus norvegicus
acagagaggcacgtgggagtctcac

SEQ ID NO: 74749 - DNA, 25 bp, Rattus norvegicus
acagagagggtcagatcatgtttct

SEQ ID NO: 74750 - DNA, 25 bp, Rattus norvegicus
acagagagggtctgatcatgtttct

SEQ ID NO: 74751 - DNA, 25 bp, Rattus norvegicus
acagagagtacacccttctgcaaag

SEQ ID NO: 74752 - DNA, 25 bp, Rattus norvegicus
acagagagtacagccttctgcaaag

SEQ ID NO: 74753 - DNA, 25 bp, Rattus norvegicus
acagagataagcctttcctggatga

SEQ ID NO: 74754 - DNA, 25 bp, Rattus norvegicus
acagagataagcgtttcctggatga

SEQ ID NO: 74755 - DNA, 25 bp, Rattus norvegicus
acagagatacacctgccccagaggt

SEQ ID NO: 74756 - DNA, 25 bp, Rattus norvegicus
acagagatacacgtgccccagaggt

SEQ ID NO: 74757 - DNA, 25 bp, Rattus norvegicus
acagagatagagatcccctgcctct

SEQ ID NO: 74758 - DNA, 25 bp, Rattus norvegicus
acagagatagagttcccctgcctct

SEQ ID NO: 74759 - DNA, 25 bp, Rattus norvegicus
acagagatctgccttactgctggat

SEQ ID NO: 74760 - DNA, 25 bp, Rattus norvegicus
acagagatctgcgttactgctggat

SEQ ID NO: 74761 - DNA, 25 bp, Rattus norvegicus
acagagatgcagatcagccagcagt

SEQ ID NO: 74762 - DNA, 25 bp, Rattus norvegicus
acagagatgcagttcagccagcagt

SEQ ID NO: 74763 - DNA, 25 bp, Rattus norvegicus
acagagatgcttagtgtccagaagt

SEQ ID NO: 74764 - DNA, 25 bp, Rattus norvegicus
acagagatgctttgtgtccagaagt

SEQ ID NO: 74765 - DNA, 25 bp, Rattus norvegicus
acagagatgtccaggatatctcttg

SEQ ID NO: 74766 - DNA, 25 bp, Rattus norvegicus
acagagatgtcctggatatctcttg

SEQ ID NO: 74767 - DNA, 25 bp, Rattus norvegicus
acagagatttccagctggacggtga

SEQ ID NO: 74768 - DNA, 25 bp, Rattus norvegicus
acagagatttcctgctggacggtga

SEQ ID NO: 74769 - DNA, 25 bp, Rattus norvegicus
acagagcaaaagagcagtgctcctg

SEQ ID NO: 74770 - DNA, 25 bp, Rattus norvegicus
acagagcaaaagtgcagtgctcctg

SEQ ID NO: 74771 - DNA, 25 bp, Rattus norvegicus
acagagcacactattaggaacgtta

SEQ ID NO: 74772 - DNA, 25 bp, Rattus norvegicus
acagagcacacttttaggaacgtta

SEQ ID NO: 74773 - DNA, 25 bp, Rattus norvegicus
acagagcagagcagaccaggccgac

SEQ ID NO: 74774 - DNA, 25 bp, Rattus norvegicus
acagagcagagcctttagtcccaag

SEQ ID NO: 74775 - DNA, 25 bp, Rattus norvegicus
acagagcagagcgtttagtcccaag

SEQ ID NO: 74776 - DNA, 25 bp, Rattus norvegicus
acagagcagagctgaccaggccgac

SEQ ID NO: 74777 - DNA, 25 bp, Rattus norvegicus
acagagcagctgagtctccataatc

SEQ ID NO: 74778 - DNA, 25 bp, Rattus norvegicus
acagagcagctgtgtctccataatc

SEQ ID NO: 74779 - DNA, 25 bp, Rattus norvegicus
acagagcagtggatagactcctgga

SEQ ID NO: 74780 - DNA, 25 bp, Rattus norvegicus
acagagcagtggttagactcctgga

SEQ ID NO: 74781 - DNA, 25 bp, Rattus norvegicus
acagagcatcagcagttgaggatca

SEQ ID NO: 74782 - DNA, 25 bp, Rattus norvegicus
acagagcatcaggagttgaggatca

SEQ ID NO: 74783 - DNA, 25 bp, Rattus norvegicus
acagagcatgagaacaagccgtatt

SEQ ID NO: 74784 - DNA, 25 bp, Rattus norvegicus
acagagcatgagtacaagccgtatt

SEQ ID NO: 74785 - DNA, 25 bp, Rattus norvegicus
acagagcatgtcaggcccttgaaga

SEQ ID NO: 74786 - DNA, 25 bp, Rattus norvegicus
acagagcatgtctggcccttgaaga

SEQ ID NO: 74787 - DNA, 25 bp, Rattus norvegicus
acagagcattcgacccacatggaaa

SEQ ID NO: 74788 - DNA, 25 bp, Rattus norvegicus
acagagcattcgtcccacatggaaa

SEQ ID NO: 74789 - DNA, 25 bp, Rattus norvegicus
acagagcattgacctgcttggccgc

SEQ ID NO: 74790 - DNA, 25 bp, Rattus norvegicus
acagagcattgagctgcttggccgc

SEQ ID NO: 74791 - DNA, 25 bp, Rattus norvegicus
acagagccaagtcccagaagatgcg

SEQ ID NO: 74792 - DNA, 25 bp, Rattus norvegicus
acagagccaagtgccagaagatgcg

SEQ ID NO: 74793 - DNA, 25 bp, Rattus norvegicus
acagagccacaaagcttctgacagt

SEQ ID NO: 74794 - DNA, 25 bp, Rattus norvegicus
acagagccacaatgcttctgacagt

SEQ ID NO: 74795 - DNA, 25 bp, Rattus norvegicus
acagagcccagtaggtttttctcat

SEQ ID NO: 74796 - DNA, 25 bp, Rattus norvegicus
acagagcccagttggtttttctcat

SEQ ID NO: 74797 - DNA, 25 bp, Rattus norvegicus
acagagccctaaagttccctccata

SEQ ID NO: 74798 - DNA, 25 bp, Rattus norvegicus
acagagccctaatgttccctccata

SEQ ID NO: 74799 - DNA, 25 bp, Rattus norvegicus
acagagccctgcaagggacaggatg

SEQ ID NO: 74800 - DNA, 25 bp, Rattus norvegicus
acagagccctgccttagagatgctg

SEQ ID NO: 74801 - DNA, 25 bp, Rattus norvegicus
acagagccctgcgttagagatgctg

SEQ ID NO: 74802 - DNA, 25 bp, Rattus norvegicus
acagagccctgctagggacaggatg

SEQ ID NO: 74803 - DNA, 25 bp, Rattus norvegicus
acagagccctgtcttgccatgcttg

SEQ ID NO: 74804 - DNA, 25 bp, Rattus norvegicus
acagagccctgtgttgccatgcttg

SEQ ID NO: 74805 - DNA, 25 bp, Rattus norvegicus
acagagccgagcacgaccggatggc

SEQ ID NO: 74806 - DNA, 25 bp, Rattus norvegicus
acagagccgagctcgaccggatggc

SEQ ID NO: 74807 - DNA, 25 bp, Rattus norvegicus
acagagcctcacagatccagttttg

SEQ ID NO: 74808 - DNA, 25 bp, Rattus norvegicus
acagagcctcactgatccagttttg

SEQ ID NO: 74809 - DNA, 25 bp, Rattus norvegicus
acagagcctcatctggtctgtccag

SEQ ID NO: 74810 - DNA, 25 bp, Rattus norvegicus
acagagcctcatgtggtctgtccag

SEQ ID NO: 74811 - DNA, 25 bp, Rattus norvegicus
acagagcctgccaacttaaagtgtc

SEQ ID NO: 74812 - DNA, 25 bp, Rattus norvegicus
acagagcctgcctacttaaagtgtc

SEQ ID NO: 74813 - DNA, 25 bp, Rattus norvegicus
acagagcctgtgctcccgtgatctt

SEQ ID NO: 74814 - DNA, 25 bp, Rattus norvegicus
acagagcctgtggtcccgtgatctt

SEQ ID NO: 74815 - DNA, 25 bp, Rattus norvegicus
acagagccttctagagccccagaga

SEQ ID NO: 74816 - DNA, 25 bp, Rattus norvegicus
acagagccttcttgagccccagaga

SEQ ID NO: 74817 - DNA, 25 bp, Rattus norvegicus
acagagcctttaccttgcctggaag

SEQ ID NO: 74818 - DNA, 25 bp, Rattus norvegicus
acagagcctttagcttgcctggaag

SEQ ID NO: 74819 - DNA, 25 bp, Rattus norvegicus
acagagcgtgttaagccttgaccct

SEQ ID NO: 74820 - DNA, 25 bp, Rattus norvegicus
acagagcgtgtttagccttgaccct

SEQ ID NO: 74821 - DNA, 25 bp, Rattus norvegicus
acagagctacagattcctggatcat

SEQ ID NO: 74822 - DNA, 25 bp, Rattus norvegicus
acagagctacagtttcctggatcat

SEQ ID NO: 74823 - DNA, 25 bp, Rattus norvegicus
acagagctatgtcatcggcccgata

SEQ ID NO: 74824 - DNA, 25 bp, Rattus norvegicus
acagagctatgtgatcggcccgata

SEQ ID NO: 74825 - DNA, 25 bp, Rattus norvegicus
acagagctcacaacagacccaaagg

SEQ ID NO: 74826 - DNA, 25 bp, Rattus norvegicus
acagagctcacatcagacccaaagg

SEQ ID NO: 74827 - DNA, 25 bp, Rattus norvegicus
acagagctccagagtcacccagagg

SEQ ID NO: 74828 - DNA, 25 bp, Rattus norvegicus
acagagctccagtgtcacccagagg

SEQ ID NO: 74829 - DNA, 25 bp, Rattus norvegicus
acagagctcctcatgggttgcgaca

SEQ ID NO: 74830 - DNA, 25 bp, Rattus norvegicus
acagagctcctcttgggttgcgaca

SEQ ID NO: 74831 - DNA, 25 bp, Rattus norvegicus
acagagctcgccatgttcctgggtg

SEQ ID NO: 74832 - DNA, 25 bp, Rattus norvegicus
acagagctcgccttgttcctgggtg

SEQ ID NO: 74833 - DNA, 25 bp, Rattus norvegicus
acagagctctccaggtgggtggata

SEQ ID NO: 74834 - DNA, 25 bp, Rattus norvegicus
acagagctctcctggtgggtggata

SEQ ID NO: 74835 - DNA, 25 bp, Rattus norvegicus
acagagctctgcattctcaccgatt

SEQ ID NO: 74836 - DNA, 25 bp, Rattus norvegicus
acagagctctgctttctcaccgatt

SEQ ID NO: 74837 - DNA, 25 bp, Rattus norvegicus
acagagctctggcagcgggtcctat

SEQ ID NO: 74838 - DNA, 25 bp, Rattus norvegicus
acagagctctgggagcgggtcctat

SEQ ID NO: 74839 - DNA, 25 bp, Rattus norvegicus
acagagctgagcatgggacaccaga

SEQ ID NO: 74840 - DNA, 25 bp, Rattus norvegicus
acagagctgagccatgtgaagccat

SEQ ID NO: 74841 - DNA, 25 bp, Rattus norvegicus
acagagctgagcgatgtgaagccat

SEQ ID NO: 74842 - DNA, 25 bp, Rattus norvegicus
acagagctgagcttgggacaccaga

SEQ ID NO: 74843 - DNA, 25 bp, Rattus norvegicus
acagagctgcagaccattaatatca

SEQ ID NO: 74844 - DNA, 25 bp, Rattus norvegicus
acagagctgcagtccattaatatca

SEQ ID NO: 74845 - DNA, 25 bp, Rattus norvegicus
acagagctgcttacaaacacccggg

SEQ ID NO: 74846 - DNA, 25 bp, Rattus norvegicus
acagagctgctttcaaacacccggg

SEQ ID NO: 74847 - DNA, 25 bp, Rattus norvegicus
acagagctggaccacctagaccaaa

SEQ ID NO: 74848 - DNA, 25 bp, Rattus norvegicus
acagagctggacgacctagaccaaa

SEQ ID NO: 74849 - DNA, 25 bp, Rattus norvegicus
acagagctggagctggcttgccctc

SEQ ID NO: 74850 - DNA, 25 bp, Rattus norvegicus
acagagctggaggtggcttgccctc

SEQ ID NO: 74851 - DNA, 25 bp, Rattus norvegicus
acagagctgttcatcgccgcagagg

SEQ ID NO: 74852 - DNA, 25 bp, Rattus norvegicus
acagagctgttcttcgccgcagagg

SEQ ID NO: 74853 - DNA, 25 bp, Rattus norvegicus
acagagctgttgcaccctgggtgtt

SEQ ID NO: 74854 - DNA, 25 bp, Rattus norvegicus
acagagctgttgctactggactcaa

SEQ ID NO: 74855 - DNA, 25 bp, Rattus norvegicus
acagagctgttggaccctgggtgtt

SEQ ID NO: 74856 - DNA, 25 bp, Rattus norvegicus
acagagctgttggtactggactcaa

SEQ ID NO: 74857 - DNA, 25 bp, Rattus norvegicus
acagagctgtttctggccatgggac

SEQ ID NO: 74858 - DNA, 25 bp, Rattus norvegicus
acagagctgtttgtggccatgggac

SEQ ID NO: 74859 - DNA, 25 bp, Rattus norvegicus
acagagcttctgagacagcgcccgg

SEQ ID NO: 74860 - DNA, 25 bp, Rattus norvegicus
acagagcttctgtgacagcgcccgg

SEQ ID NO: 74861 - DNA, 25 bp, Rattus norvegicus
acagagctttcaccatggcgttctc

SEQ ID NO: 74862 - DNA, 25 bp, Rattus norvegicus
acagagctttcagcatggcgttctc

SEQ ID NO: 74863 - DNA, 25 bp, Rattus norvegicus
acagagctttccatgagagcacaaa

SEQ ID NO: 74864 - DNA, 25 bp, Rattus norvegicus
acagagctttccttgagagcacaaa

SEQ ID NO: 74865 - DNA, 25 bp, Rattus norvegicus
acagagctttgaagaacagggtagg

SEQ ID NO: 74866 - DNA, 25 bp, Rattus norvegicus
acagagctttgatgaacagggtagg

SEQ ID NO: 74867 - DNA, 25 bp, Rattus norvegicus
acagaggaatcccaggccagcgaga

SEQ ID NO: 74868 - DNA, 25 bp, Rattus norvegicus
acagaggaatccgaggccagcgaga

SEQ ID NO: 74869 - DNA, 25 bp, Rattus norvegicus
acagaggacaatagcaccccggaca

SEQ ID NO: 74870 - DNA, 25 bp, Rattus norvegicus
acagaggacaattgcaccccggaca

SEQ ID NO: 74871 - DNA, 25 bp, Rattus norvegicus
acagaggacctacacactgcagtga

SEQ ID NO: 74872 - DNA, 25 bp, Rattus norvegicus
acagaggacctagacactgcagtga

SEQ ID NO: 74873 - DNA, 25 bp, Rattus norvegicus
acagaggactcaacatctttgcagt

SEQ ID NO: 74874 - DNA, 25 bp, Rattus norvegicus
acagaggactcatcatctttgcagt

SEQ ID NO: 74875 - DNA, 25 bp, Rattus norvegicus
acagaggagccgacgtctaacgaca

SEQ ID NO: 74876 - DNA, 25 bp, Rattus norvegicus
acagaggagccgtcgtctaacgaca

SEQ ID NO: 74877 - DNA, 25 bp, Rattus norvegicus
acagaggagtccaccactgccttac

SEQ ID NO: 74878 - DNA, 25 bp, Rattus norvegicus
acagaggagtcctccactgccttac

SEQ ID NO: 74879 - DNA, 25 bp, Rattus norvegicus
acagaggatattcatgcggtgccaa

SEQ ID NO: 74880 - DNA, 25 bp, Rattus norvegicus
acagaggatattgatgcggtgccaa

SEQ ID NO: 74881 - DNA, 25 bp, Rattus norvegicus
acagaggccagactcgacccgcagg

SEQ ID NO: 74882 - DNA, 25 bp, Rattus norvegicus
acagaggccagagtcgacccgcagg

SEQ ID NO: 74883 - DNA, 25 bp, Rattus norvegicus
acagaggcccagaatgtgtttctac

SEQ ID NO: 74884 - DNA, 25 bp, Rattus norvegicus
acagaggcccagtatgtgtttctac

SEQ ID NO: 74885 - DNA, 25 bp, Rattus norvegicus
acagaggccctcagtgacaggtaag

SEQ ID NO: 74886 - DNA, 25 bp, Rattus norvegicus
acagaggccctctgtgacaggtaag

SEQ ID NO: 74887 - DNA, 25 bp, Rattus norvegicus
acagaggccgaaagtgatgatgcat

SEQ ID NO: 74888 - DNA, 25 bp, Rattus norvegicus
acagaggccgaatgtgatgatgcat

SEQ ID NO: 74889 - DNA, 25 bp, Rattus norvegicus
acagaggccggcagacagatgagca

SEQ ID NO: 74890 - DNA, 25 bp, Rattus norvegicus
acagaggccggctgacagatgagca

SEQ ID NO: 74891 - DNA, 25 bp, Rattus norvegicus
acagaggcctctaacgtcaacctgc

SEQ ID NO: 74892 - DNA, 25 bp, Rattus norvegicus
acagaggcctcttacgtcaacctgc

SEQ ID NO: 74893 - DNA, 25 bp, Rattus norvegicus
acagaggctcatccgtgtggcagca

SEQ ID NO: 74894 - DNA, 25 bp, Rattus norvegicus
acagaggctcatgcgtgtggcagca

SEQ ID NO: 74895 - DNA, 25 bp, Rattus norvegicus
acagaggctccccacattctgatgg

SEQ ID NO: 74896 - DNA, 25 bp, Rattus norvegicus
acagaggctcccgacattctgatgg

SEQ ID NO: 74897 - DNA, 25 bp, Rattus norvegicus
acagaggctctgattcgacgagcat

SEQ ID NO: 74898 - DNA, 25 bp, Rattus norvegicus
acagaggctctgtttcgacgagcat

SEQ ID NO: 74899 - DNA, 25 bp, Rattus norvegicus
acagaggctgtcaggctcaccaagg

SEQ ID NO: 74900 - DNA, 25 bp, Rattus norvegicus
acagaggctgtctggctcaccaagg

SEQ ID NO: 74901 - DNA, 25 bp, Rattus norvegicus
acagaggctgtgatcagtgcgctcg

SEQ ID NO: 74902 - DNA, 25 bp, Rattus norvegicus
acagaggctgtgttcagtgcgctcg

SEQ ID NO: 74903 - DNA, 25 bp, Rattus norvegicus
acagaggcttgaaacgctacaggct

SEQ ID NO: 74904 - DNA, 25 bp, Rattus norvegicus
acagaggcttgatacgctacaggct

SEQ ID NO: 74905 - DNA, 25 bp, Rattus norvegicus
acagagggaattcttaggtagccaa

SEQ ID NO: 74906 - DNA, 25 bp, Rattus norvegicus
acagagggaattgttaggtagccaa

SEQ ID NO: 74907 - DNA, 25 bp, Rattus norvegicus
acagagggacagactgcaagccgtc

SEQ ID NO: 74908 - DNA, 25 bp, Rattus norvegicus
acagagggacagtctgcaagccgtc

SEQ ID NO: 74909 - DNA, 25 bp, Rattus norvegicus
acagagggacctattcaagccaaaa

SEQ ID NO: 74910 - DNA, 25 bp, Rattus norvegicus
acagagggaccttttcaagccaaaa

SEQ ID NO: 74911 - DNA, 25 bp, Rattus norvegicus
acagagggccaactccatgaagttt

SEQ ID NO: 74912 - DNA, 25 bp, Rattus norvegicus
acagagggccaagtccatgaagttt

SEQ ID NO: 74913 - DNA, 25 bp, Rattus norvegicus
acagagggccctaggtgtgtacact

SEQ ID NO: 74914 - DNA, 25 bp, Rattus norvegicus
acagagggcccttggtgtgtacact

SEQ ID NO: 74915 - DNA, 25 bp, Rattus norvegicus
acagagggcctgcaggttcacttcg

SEQ ID NO: 74916 - DNA, 25 bp, Rattus norvegicus
acagagggcctggaggttcacttcg

SEQ ID NO: 74917 - DNA, 25 bp, Rattus norvegicus
acagagggctacacgggcgctgaca

SEQ ID NO: 74918 - DNA, 25 bp, Rattus norvegicus
acagagggctactcgggcgctgaca

SEQ ID NO: 74919 - DNA, 25 bp, Rattus norvegicus
acagagggcttcaccgagggcgttc

SEQ ID NO: 74920 - DNA, 25 bp, Rattus norvegicus
acagagggcttctccgagggcgttc

SEQ ID NO: 74921 - DNA, 25 bp, Rattus norvegicus
acagagggtgccagtgttctcccca

SEQ ID NO: 74922 - DNA, 25 bp, Rattus norvegicus
acagagggtgcctgtgttctcccca

SEQ ID NO: 74923 - DNA, 25 bp, Rattus norvegicus
acagagggttagctggcccagctag

SEQ ID NO: 74924 - DNA, 25 bp, Rattus norvegicus
acagagggttaggtggcccagctag

SEQ ID NO: 74925 - DNA, 25 bp, Rattus norvegicus
acagaggtacagcatttgggacact

SEQ ID NO: 74926 - DNA, 25 bp, Rattus norvegicus
acagaggtacagctcaaaccccggg

SEQ ID NO: 74927 - DNA, 25 bp, Rattus norvegicus
acagaggtacaggatttgggacact

SEQ ID NO: 74928 - DNA, 25 bp, Rattus norvegicus
acagaggtacaggtcaaaccccggg

SEQ ID NO: 74929 - DNA, 25 bp, Rattus norvegicus
acagaggtatctcccctgccaggtg

SEQ ID NO: 74930 - DNA, 25 bp, Rattus norvegicus
acagaggtatctgccctgccaggtg

SEQ ID NO: 74931 - DNA, 25 bp, Rattus norvegicus
acagaggtcatcattcacccggtga

SEQ ID NO: 74932 - DNA, 25 bp, Rattus norvegicus
acagaggtcatctttcacccggtga

SEQ ID NO: 74933 - DNA, 25 bp, Rattus norvegicus
acagaggtccctcagtcagtgacgt

SEQ ID NO: 74934 - DNA, 25 bp, Rattus norvegicus
acagaggtccctgagtcagtgacgt

SEQ ID NO: 74935 - DNA, 25 bp, Rattus norvegicus
acagaggtcttacagcatgtgcaga

SEQ ID NO: 74936 - DNA, 25 bp, Rattus norvegicus
acagaggtcttacgagccaggctcc

SEQ ID NO: 74937 - DNA, 25 bp, Rattus norvegicus
acagaggtcttagagcatgtgcaga

SEQ ID NO: 74938 - DNA, 25 bp, Rattus norvegicus
acagaggtcttaggagccaggctcc

SEQ ID NO: 74939 - DNA, 25 bp, Rattus norvegicus
acagaggtggtgatgcggattctcc

SEQ ID NO: 74940 - DNA, 25 bp, Rattus norvegicus
acagaggtggtgttgcggattctcc

SEQ ID NO: 74941 - DNA, 25 bp, Rattus norvegicus
acagaggtggttatggccctggcaa

SEQ ID NO: 74942 - DNA, 25 bp, Rattus norvegicus
acagaggtggttttggccctggcaa

SEQ ID NO: 74943 - DNA, 25 bp, Rattus norvegicus
acagaggttctgagatgttcgaata

SEQ ID NO: 74944 - DNA, 25 bp, Rattus norvegicus
acagaggttctgcttgggataatga

SEQ ID NO: 74945 - DNA, 25 bp, Rattus norvegicus
acagaggttctggttgggataatga

SEQ ID NO: 74946 - DNA, 25 bp, Rattus norvegicus
acagaggttctgtgatgttcgaata

SEQ ID NO: 74947 - DNA, 25 bp, Rattus norvegicus
acagaggttggcaatcctgggctgt

SEQ ID NO: 74948 - DNA, 25 bp, Rattus norvegicus
acagaggttggctatcctgggctgt

SEQ ID NO: 74949 - DNA, 25 bp, Rattus norvegicus
acagaggttgttaagcaggtagtat

SEQ ID NO: 74950 - DNA, 25 bp, Rattus norvegicus
acagaggttgttagcagatgaggac

SEQ ID NO: 74951 - DNA, 25 bp, Rattus norvegicus
acagaggttgtttagcaggtagtat

SEQ ID NO: 74952 - DNA, 25 bp, Rattus norvegicus
acagaggttgtttgcagatgaggac

SEQ ID NO: 74953 - DNA, 25 bp, Rattus norvegicus
acagagtactgtatttggagaaaga

SEQ ID NO: 74954 - DNA, 25 bp, Rattus norvegicus
acagagtactgtttttggagaaaga

SEQ ID NO: 74955 - DNA, 25 bp, Rattus norvegicus
acagagtatgcacactggctatcat

SEQ ID NO: 74956 - DNA, 25 bp, Rattus norvegicus
acagagtatgcagactggctatcat

SEQ ID NO: 74957 - DNA, 25 bp, Rattus norvegicus
acagagtcaggtccttcagctcaag

SEQ ID NO: 74958 - DNA, 25 bp, Rattus norvegicus
acagagtcaggtgcttcagctcaag

SEQ ID NO: 74959 - DNA, 25 bp, Rattus norvegicus
acagagtccgttcctgaaggtcaca

SEQ ID NO: 74960 - DNA, 25 bp, Rattus norvegicus
acagagtccgttgctgaaggtcaca

SEQ ID NO: 74961 - DNA, 25 bp, Rattus norvegicus
acagagtcctgacaagcctgtgcct

SEQ ID NO: 74962 - DNA, 25 bp, Rattus norvegicus
acagagtcctgagaagcctgtgcct

SEQ ID NO: 74963 - DNA, 25 bp, Rattus norvegicus
acagagtcctgtcctcaattccctg

SEQ ID NO: 74964 - DNA, 25 bp, Rattus norvegicus
acagagtcctgtgctcaattccctg

SEQ ID NO: 74965 - DNA, 25 bp, Rattus norvegicus
acagagtcggccacattctgccgga

SEQ ID NO: 74966 - DNA, 25 bp, Rattus norvegicus
acagagtcggcctcattctgccgga

SEQ ID NO: 74967 - DNA, 25 bp, Rattus norvegicus
acagagtctctgaatcaccttttaa

SEQ ID NO: 74968 - DNA, 25 bp, Rattus norvegicus
acagagtctctgtatcaccttttaa

SEQ ID NO: 74969 - DNA, 25 bp, Rattus norvegicus
acagagtctgcgctcctcatttatg

SEQ ID NO: 74970 - DNA, 25 bp, Rattus norvegicus
acagagtctgcggtcctcatttatg

SEQ ID NO: 74971 - DNA, 25 bp, Rattus norvegicus
acagagtctgtgagatccagctttt

SEQ ID NO: 74972 - DNA, 25 bp, Rattus norvegicus
acagagtctgtgtgatccagctttt

SEQ ID NO: 74973 - DNA, 25 bp, Rattus norvegicus
acagagtgaccgactcctagggtgc

SEQ ID NO: 74974 - DNA, 25 bp, Rattus norvegicus
acagagtgaccgtctcctagggtgc

SEQ ID NO: 74975 - DNA, 25 bp, Rattus norvegicus
acagagtgactgaccttcatttcta

SEQ ID NO: 74976 - DNA, 25 bp, Rattus norvegicus
acagagtgactgtccttcatttcta

SEQ ID NO: 74977 - DNA, 25 bp, Rattus norvegicus
acagagtgcggactctagcctcggc

SEQ ID NO: 74978 - DNA, 25 bp, Rattus norvegicus
acagagtgcggagtctagcctcggc

SEQ ID NO: 74979 - DNA, 25 bp, Rattus norvegicus
acagagtggattctagtctcccggc

SEQ ID NO: 74980 - DNA, 25 bp, Rattus norvegicus
acagagtggattgtagtctcccggc

SEQ ID NO: 74981 - DNA, 25 bp, Rattus norvegicus
acagagtggccactatcattcccca

SEQ ID NO: 74982 - DNA, 25 bp, Rattus norvegicus
acagagtggccagtatcattcccca

SEQ ID NO: 74983 - DNA, 25 bp, Rattus norvegicus
acagagtgtaccactgtcacggtct

SEQ ID NO: 74984 - DNA, 25 bp, Rattus norvegicus
acagagtgtacctctgtcacggtct

SEQ ID NO: 74985 - DNA, 25 bp, Rattus norvegicus
acagagtgtgtgaacctcgaccgat

SEQ ID NO: 74986 - DNA, 25 bp, Rattus norvegicus
acagagtgtgtgtacctcgaccgat

SEQ ID NO: 74987 - DNA, 25 bp, Rattus norvegicus
acagagttcactacattgtcccatt

SEQ ID NO: 74988 - DNA, 25 bp, Rattus norvegicus
acagagttcacttcattgtcccatt

SEQ ID NO: 74989 - DNA, 25 bp, Rattus norvegicus
acagagttcctcagcgtaggacaca
